United States Patent 7,250,496 (BIOINFORMATICALLY DETECTABLE GROUP OF NOVEL REGULATORY GENES AND USES THEREOF) - sequence listing, part 29

SEQ ID NO: 1239893 - RNA, 19 nt, Human
acuccccagugccuaaggu

SEQ ID NO: 1239894 - RNA, 25 nt, Human
acuugccacccaggaaugaaaauaa

SEQ ID NO: 1239895 - RNA, 26 nt, Human
agaaauacugaagaggucaaaucagc

SEQ ID NO: 1239896 - RNA, 19 nt, Human
agcaaaugaacggcaugaa

SEQ ID NO: 1239897 - RNA, 23 nt, Human
agcuguguggccucaggcaaauu

SEQ ID NO: 1239898 - RNA, 19 nt, Human
aggaaaaaaauaccaggaa

SEQ ID NO: 1239899 - RNA, 23 nt, Human
aggaacucaccaccaggucuacc

SEQ ID NO: 1239900 - RNA, 18 nt, Human
aggaaugaaaauaacacc

SEQ ID NO: 1239901 - RNA, 18 nt, Human
aggaauggguggguggaa

SEQ ID NO: 1239902 - RNA, 20 nt, Human
aggaugaaagaauggaagga

SEQ ID NO: 1239903 - RNA, 21 nt, Human
aggauggggagucagccaggu

SEQ ID NO: 1239904 - RNA, 23 nt, Human
auuacugucccuuaccuucugga

SEQ ID NO: 1239905 - RNA, 19 nt, Human
caaaaauuauaucagugag

SEQ ID NO: 1239906 - RNA, 22 nt, Human
caacccaacuccccauuccuug

SEQ ID NO: 1239907 - RNA, 24 nt, Human
caacccaacuccccauuccuugcc

SEQ ID NO: 1239908 - RNA, 21 nt, Human
cacaagaaaagaaugacucau

SEQ ID NO: 1239909 - RNA, 22 nt, Human
cacaaugugccaggccuguggu

SEQ ID NO: 1239910 - RNA, 23 nt, Human
cacccaggaaugaaaauaacacc

SEQ ID NO: 1239911 - RNA, 22 nt, Human
cagaagcucacauccacugggc

SEQ ID NO: 1239912 - RNA, 19 nt, Human
cagagacaggaggcugaag

SEQ ID NO: 1239913 - RNA, 19 nt, Human
cagccuacuggggaagugg

SEQ ID NO: 1239914 - RNA, 26 nt, Human
ccaagacaauuauuccagcgugaccc

SEQ ID NO: 1239915 - RNA, 22 nt, Human
ccagggaagccaaaagacugga

SEQ ID NO: 1239916 - RNA, 27 nt, Human
cccaccacaagcuggugagguaagggc

SEQ ID NO: 1239917 - RNA, 21 nt, Human
cccaggaaugaaaauaacacc

SEQ ID NO: 1239918 - RNA, 20 nt, Human
ccucuaggaucagauuauuc

SEQ ID NO: 1239919 - RNA, 22 nt, Human
ccuucuggaaacauuucacugu

SEQ ID NO: 1239920 - RNA, 19 nt, Human
cuagccaacccaacucccc

SEQ ID NO: 1239921 - RNA, 19 nt, Human
gaaaauaacaccuuccucu

SEQ ID NO: 1239922 - RNA, 18 nt, Human
gacaaggcagaaaagcaa

SEQ ID NO: 1239923 - RNA, 21 nt, Human
gacaaggcagaaaagcaacug

SEQ ID NO: 1239924 - RNA, 22 nt, Human
gcacauacguucaggccuaaaa

SEQ ID NO: 1239925 - RNA, 19 nt, Human
gcccugaaggauggggagu

SEQ ID NO: 1239926 - RNA, 21 nt, Human
ggaaaggugugcugggcagaa

SEQ ID NO: 1239927 - RNA, 23 nt, Human
ggcagcaggaacugagggaagga

SEQ ID NO: 1239928 - RNA, 21 nt, Human
ggcucaauuccugccuucaga

SEQ ID NO: 1239929 - RNA, 22 nt, Human
ggcuuuguaagugaaacuguga

SEQ ID NO: 1239930 - RNA, 24 nt, Human
ggcuuuguaagugaaacugugaga

SEQ ID NO: 1239931 - RNA, 20 nt, Human
gggaagugguugaggguggg

SEQ ID NO: 1239932 - RNA, 18 nt, Human
gggggcuuuguaagugaa

SEQ ID NO: 1239933 - RNA, 19 nt, Human
gugguugaggguggggugg

SEQ ID NO: 1239934 - RNA, 21 nt, Human
uaacaaugccucuaggaucag

SEQ ID NO: 1239935 - RNA, 20 nt, Human
uaagaacacuaugcacauac

SEQ ID NO: 1239936 - RNA, 19 nt, Human
uaagacaaggcagaaaagc

SEQ ID NO: 1239937 - RNA, 23 nt, Human
uaagacaaggcagaaaagcaacu

SEQ ID NO: 1239938 - RNA, 19 nt, Human
uaagugaaacugugagaag

SEQ ID NO: 1239939 - RNA, 18 nt, Human
uacaagcuguguggccuc

SEQ ID NO: 1239940 - RNA, 20 nt, Human
uacaagcuguguggccucag

SEQ ID NO: 1239941 - RNA, 23 nt, Human
uaccuuccaaguccacugcuccu

SEQ ID NO: 1239942 - RNA, 24 nt, Human
uacugaagaggucaaaucagcugu

SEQ ID NO: 1239943 - RNA, 19 nt, Human
uagcuaguaguaacagcaa

SEQ ID NO: 1239944 - RNA, 19 nt, Human
uagcucccuuuucucaccc

SEQ ID NO: 1239945 - RNA, 20 nt, Human
uaggaucagauuauucaggu

SEQ ID NO: 1239946 - RNA, 19 nt, Human
uaguagaauuacuugggcu

SEQ ID NO: 1239947 - RNA, 27 nt, Human
uaguugacuccccagugccuaagguuu

SEQ ID NO: 1239948 - RNA, 18 nt, Human
uauagggcuaaagggugu

SEQ ID NO: 1239949 - RNA, 21 nt, Human
uauggcagugggggagaucug

SEQ ID NO: 1239950 - RNA, 19 nt, Human
uauuccagcgugacccagg

SEQ ID NO: 1239951 - RNA, 20 nt, Human
ucaaugguaacacaagaaaa

SEQ ID NO: 1239952 - RNA, 19 nt, Human
ucacaggguacccaccaca

SEQ ID NO: 1239953 - RNA, 23 nt, Human
ucagggaaagcuuccggggaacc

SEQ ID NO: 1239954 - RNA, 27 nt, Human
ucagugagaauauuauggcaguggggg

SEQ ID NO: 1239955 - RNA, 22 nt, Human
ucaugcagcugaacaauaggcc

SEQ ID NO: 1239956 - RNA, 20 nt, Human
uccggaugcaagauauaggg

SEQ ID NO: 1239957 - RNA, 19 nt, Human
ugaaaauaacaccuuccuc

SEQ ID NO: 1239958 - RNA, 24 nt, Human
ugaaaauaacaccuuccucuagga

SEQ ID NO: 1239959 - RNA, 20 nt, Human
ugagggugggguggggcugg

SEQ ID NO: 1239960 - RNA, 19 nt, Human
ugagguaaacgcuaugaca

SEQ ID NO: 1239961 - RNA, 25 nt, Human
ugcaaaacagggaaggaaaaaaaua

SEQ ID NO: 1239962 - RNA, 26 nt, Human
ugcaaaacagggaaggaaaaaaauac

SEQ ID NO: 1239963 - RNA, 19 nt, Human
ugccuaagguuuguaacac

SEQ ID NO: 1239964 - RNA, 23 nt, Human
ugccuuuagcuuucaagcugccu

SEQ ID NO: 1239965 - RNA, 28 nt, Human
ugcuacagauuucaaugguaacacaaga

SEQ ID NO: 1239966 - RNA, 26 nt, Human
ugcugcaaaacagggaaggaaaaaaa

SEQ ID NO: 1239967 - RNA, 18 nt, Human
uggaaacauuucacugug

SEQ ID NO: 1239968 - RNA, 21 nt, Human
uggaacaauauuuaguuggca

SEQ ID NO: 1239969 - RNA, 20 nt, Human
uggaagaggccacuaaagca

SEQ ID NO: 1239970 - RNA, 18 nt, Human
uggcccgagguggcucag

SEQ ID NO: 1239971 - RNA, 20 nt, Human
ugggguggggcuggaacaau

SEQ ID NO: 1239972 - RNA, 24 nt, Human
ugggguggggcuggaacaauauuu

SEQ ID NO: 1239973 - RNA, 19 nt, Human
uggguggguggaagaggcc

SEQ ID NO: 1239974 - RNA, 22 nt, Human
ugguaucacaggguacccacca

SEQ ID NO: 1239975 - RNA, 21 nt, Human
uggugagguaagggccucagc

SEQ ID NO: 1239976 - RNA, 24 nt, Human
ugguugagggugggguggggcugg

SEQ ID NO: 1239977 - RNA, 18 nt, Human
ugugagaggcacaguggu

SEQ ID NO: 1239978 - RNA, 24 nt, Human
ugugccaggccugugguggguucu

SEQ ID NO: 1239979 - RNA, 19 nt, Human
uguggccucaggcaaauua

SEQ ID NO: 1239980 - RNA, 20 nt, Human
uguuaguguguuuuaugugu

SEQ ID NO: 1239981 - RNA, 20 nt, Human
uuaacaaagauagccaaggc

SEQ ID NO: 1239982 - RNA, 24 nt, Human
uuaauauuaacaaagauagccaag

SEQ ID NO: 1239983 - RNA, 18 nt, Human
uuacccacuaaaaacuac

SEQ ID NO: 1239984 - RNA, 20 nt, Human
uuacuugggcuuucuuacua

SEQ ID NO: 1239985 - RNA, 20 nt, Human
uuuucucacccugaaaucgc

SEQ ID NO: 1239986 - RNA, 20 nt, Human
aaaaagaaacaagacuugaa

SEQ ID NO: 1239987 - RNA, 24 nt, Human
aaaaagucgccucaauaccagaaa

SEQ ID NO: 1239988 - RNA, 23 nt, Human
aaaacaaaccaauacaaccacaa

SEQ ID NO: 1239989 - RNA, 24 nt, Human
aaaagaaacaagacuugaaaugug

SEQ ID NO: 1239990 - RNA, 24 nt, Human
aaaagaaacuacaaaaaguaucau

SEQ ID NO: 1239991 - RNA, 26 nt, Human
aaaaggaagcaguucaucuuucaaaa

SEQ ID NO: 1239992 - RNA, 20 nt, Human
aaacaaaccaauacaaccac

SEQ ID NO: 1239993 - RNA, 23 nt, Human
aaacagaugacggcaauauugau

SEQ ID NO: 1239994 - RNA, 21 nt, Human
aaacaucuugacccaaaucaa

SEQ ID NO: 1239995 - RNA, 19 nt, Human
aaaccaauacaaccacaaa

SEQ ID NO: 1239996 - RNA, 24 nt, Human
aaauaguaaugaaagauuuugaac

SEQ ID NO: 1239997 - RNA, 24 nt, Human
aacaaaccaauacaaccacaaaua

SEQ ID NO: 1239998 - RNA, 19 nt, Human
aacaagacuugaaaugugg

SEQ ID NO: 1239999 - RNA, 22 nt, Human
aacugcgcgcgccccgagccuc

SEQ ID NO: 1240000 - RNA, 19 nt, Human
aagagguaccaccaucacc

SEQ ID NO: 1240001 - RNA, 29 nt, Human
aagcaaaagaagagaugaagagggacccc

SEQ ID NO: 1240002 - RNA, 22 nt, Human
aagcgaaggcagcggcccagag

SEQ ID NO: 1240003 - RNA, 23 nt, Human
aauaaaaugagaaacagcuuuga

SEQ ID NO: 1240004 - RNA, 19 nt, Human
acaaccacaaauacuaccu

SEQ ID NO: 1240005 - RNA, 23 nt, Human
accacaaauacuacccacacaca

SEQ ID NO: 1240006 - RNA, 24 nt, Human
accacaaauacuacccacacacaa

SEQ ID NO: 1240007 - RNA, 26 nt, Human
acucuauaauucaaacuauuuagcug

SEQ ID NO: 1240008 - RNA, 20 nt, Human
acuguucacugaguacuccg

SEQ ID NO: 1240009 - RNA, 19 nt, Human
agaaauaaaaugagaaaca

SEQ ID NO: 1240010 - RNA, 19 nt, Human
agcgcccagccgccggcag

SEQ ID NO: 1240011 - RNA, 22 nt, Human
aguaauuaagcaaaagaagaga

SEQ ID NO: 1240012 - RNA, 21 nt, Human
auaaaguauacuaaacaguaa

SEQ ID NO: 1240013 - RNA, 20 nt, Human
auacaaccacaaauacuacc

SEQ ID NO: 1240014 - RNA, 24 nt, Human
auacagcucaaacugcucuuaacu

SEQ ID NO: 1240015 - RNA, 24 nt, Human
auacuacccacacacaacccugaa

SEQ ID NO: 1240016 - RNA, 18 nt, Human
auccaacaacuaaaagca

SEQ ID NO: 1240017 - RNA, 22 nt, Human
caaaagaagagaugaagacuua

SEQ ID NO: 1240018 - RNA, 21 nt, Human
caaauaccagcauuuaaauuu

SEQ ID NO: 1240019 - RNA, 23 nt, Human
caaauacuacccacacacaaccc

SEQ ID NO: 1240020 - RNA, 19 nt, Human
caacaacuaaaagcacaca

SEQ ID NO: 1240021 - RNA, 20 nt, Human
caagaaauaaaaugagaaaa

SEQ ID NO: 1240022 - RNA, 21 nt, Human
caagcugcacagguguaacuu

SEQ ID NO: 1240023 - RNA, 26 nt, Human
caauaccagaaaauaguaaugaaaga

SEQ ID NO: 1240024 - RNA, 22 nt, Human
cacaacccugaaacauaaguug

SEQ ID NO: 1240025 - RNA, 19 nt, Human
cacacaacagcagauaaau

SEQ ID NO: 1240026 - RNA, 20 nt, Human
cacacauaaacaucagaaac

SEQ ID NO: 1240027 - RNA, 21 nt, Human
cacagguguaacuugaggcac

SEQ ID NO: 1240028 - RNA, 19 nt, Human
cagcucaaacugcucuuaa

SEQ ID NO: 1240029 - RNA, 21 nt, Human
cagugggcugugggcuacgag

SEQ ID NO: 1240030 - RNA, 21 nt, Human
ccaauacaaccacaaauacua

SEQ ID NO: 1240031 - RNA, 18 nt, Human
ccacauaccacucaaagc

SEQ ID NO: 1240032 - RNA, 22 nt, Human
ccauuuaggagaccucaguuau

SEQ ID NO: 1240033 - RNA, 22 nt, Human
cccagaggccgggcgucccccu

SEQ ID NO: 1240034 - RNA, 21 nt, Human
ccccgagccucggcagcgccc

SEQ ID NO: 1240035 - RNA, 23 nt, Human
cccgagccucggcagcgcccagc

SEQ ID NO: 1240036 - RNA, 19 nt, Human
ccgcggcugguggggccug

SEQ ID NO: 1240037 - RNA, 25 nt, Human
ccggagccgcggcugguggggccug

SEQ ID NO: 1240038 - RNA, 18 nt, Human
cgaaggcagcggcccaga

SEQ ID NO: 1240039 - RNA, 23 nt, Human
cgccccgagccucggcagcgccc

SEQ ID NO: 1240040 - RNA, 23 nt, Human
cgggcgucccccuuucgcgccuc

SEQ ID NO: 1240041 - RNA, 19 nt, Human
cuaucaaaacucagaccca

SEQ ID NO: 1240042 - RNA, 24 nt, Human
cuccaaaaacaaaaaacaaaccaa

SEQ ID NO: 1240043 - RNA, 23 nt, Human
gaaacuuuucuuggcacaacuag

SEQ ID NO: 1240044 - RNA, 18 nt, Human
gagaaagcgaaggcagcc

SEQ ID NO: 1240045 - RNA, 23 nt, Human
gagccgcggcugguggggccugg

SEQ ID NO: 1240046 - RNA, 19 nt, Human
gagccucggcagcgcccag

SEQ ID NO: 1240047 - RNA, 18 nt, Human
gccccgagccucggcagc

SEQ ID NO: 1240048 - RNA, 19 nt, Human
gccccgagccucggcagcg

SEQ ID NO: 1240049 - RNA, 20 nt, Human
ggcagacgccaacugcgcgc

SEQ ID NO: 1240050 - RNA, 21 nt, Human
gugggggcggcacagucuugg

SEQ ID NO: 1240051 - RNA, 25 nt, Human
uaaaagaaacuacaaaaaguaucau

SEQ ID NO: 1240052 - RNA, 21 nt, Human
uaaaagcacacaacagcagau

SEQ ID NO: 1240053 - RNA, 22 nt, Human
uaaaagcacacaacagcagaua

SEQ ID NO: 1240054 - RNA, 20 nt, Human
uaaacagaugacggcaauau

SEQ ID NO: 1240055 - RNA, 23 nt, Human
uaagaaaauagcacauccaccag

SEQ ID NO: 1240056 - RNA, 25 nt, Human
uaagagguaccaccaucaccagaac

SEQ ID NO: 1240057 - RNA, 26 nt, Human
uaagcaaaagaagagaugaagacuua

SEQ ID NO: 1240058 - RNA, 18 nt, Human
uacagcucaaacugcucu

SEQ ID NO: 1240059 - RNA, 22 nt, Human
uauccaacaacuaaaagcacac

SEQ ID NO: 1240060 - RNA, 22 nt, Human
ucaaaacucagacccaagcugc

SEQ ID NO: 1240061 - RNA, 27 nt, Human
ucacuccacaaaauuuuaaguaaacag

SEQ ID NO: 1240062 - RNA, 21 nt, Human
ucaguaauuaagcaaaagaag

SEQ ID NO: 1240063 - RNA, 20 nt, Human
uccaaaaacaaaaaacaaac

SEQ ID NO: 1240064 - RNA, 26 nt, Human
uccacaaaauuuuaaguaaacagaca

SEQ ID NO: 1240065 - RNA, 19 nt, Human
ugaaaagacacuccaaaaa

SEQ ID NO: 1240066 - RNA, 23 nt, Human
ugaaaagacacuccaaaaagaaa

SEQ ID NO: 1240067 - RNA, 24 nt, Human
ugaggcacuaacaaucuuccuacc

SEQ ID NO: 1240068 - RNA, 23 nt, Human
ugauuaaaaagaugcucaggcug

SEQ ID NO: 1240069 - RNA, 21 nt, Human
ugggaguguuaaacagaugac

SEQ ID NO: 1240070 - RNA, 20 nt, Human
ugggaugauaguuugaaaag

SEQ ID NO: 1240071 - RNA, 18 nt, Human
ugguggggccugggaagu

SEQ ID NO: 1240072 - RNA, 20 nt, Human
uguccauuuauaaagcucaa

SEQ ID NO: 1240073 - RNA, 19 nt, Human
uguuuuaagaaagggccag

SEQ ID NO: 1240074 - RNA, 18 nt, Human
uguuuugcucuacauuaa

SEQ ID NO: 1240075 - RNA, 21 nt, Human
uuaaggcaucuuuuacuccca

SEQ ID NO: 1240076 - RNA, 21 nt, Human
uuagcugaagucaguuaacga

SEQ ID NO: 1240077 - RNA, 20 nt, Human
uuauauucuccuauuccaca

SEQ ID NO: 1240078 - RNA, 24 nt, Human
uugaauacuugaaaagacacucca

SEQ ID NO: 1240079 - RNA, 23 nt, Human
aaacagugcgcuaaccgggucug

SEQ ID NO: 1240080 - RNA, 20 nt, Human
acagguuguuccauucaggu

SEQ ID NO: 1240081 - RNA, 24 nt, Human
caacagguuguuccauucagguuu

SEQ ID NO: 1240082 - RNA, 18 nt, Human
cacaagcgcucuuugcuc

SEQ ID NO: 1240083 - RNA, 28 nt, Human
cucuuugcucucucaacagguuguucca

SEQ ID NO: 1240084 - RNA, 21 nt, Human
gcucuuugcucucucaacagg

SEQ ID NO: 1240085 - RNA, 21 nt, Human
ucccgugugccacaaacacaa

SEQ ID NO: 1240086 - RNA, 24 nt, Human
ugccacaaacacaagcgcucuuug

SEQ ID NO: 1240087 - RNA, 23 nt, Human
uugcucucucaacagguuguucc

SEQ ID NO: 1240088 - RNA, 19 nt, Human
aauuucccuccagaauccc

SEQ ID NO: 1240089 - RNA, 23 nt, Human
agggcgggaccaaagcgggagga

SEQ ID NO: 1240090 - RNA, 23 nt, Human
caaauccggggcgggggagccgg

SEQ ID NO: 1240091 - RNA, 21 nt, Human
cacugccaagcaagucaagag

SEQ ID NO: 1240092 - RNA, 20 nt, Human
cagaaguguggagagaauaa

SEQ ID NO: 1240093 - RNA, 18 nt, Human
caucaucuucacugccaa

SEQ ID NO: 1240094 - RNA, 27 nt, Human
caucuucacugccaagcaagucaagag

SEQ ID NO: 1240095 - RNA, 21 nt, Human
cccggccugcuccucuucuuc

SEQ ID NO: 1240096 - RNA, 28 nt, Human
ccuccagaaucccgcgcugggagcggag

SEQ ID NO: 1240097 - RNA, 23 nt, Human
cgggaccaaagcgggaggacugg

SEQ ID NO: 1240098 - RNA, 25 nt, Human
cuggcgcgguuuccaagucucccuc

SEQ ID NO: 1240099 - RNA, 23 nt, Human
cuucuucccagagcucaaacugg

SEQ ID NO: 1240100 - RNA, 20 nt, Human
gagcucaaacugggcagcag

SEQ ID NO: 1240101 - RNA, 22 nt, Human
gggccgagccucagggcgggac

SEQ ID NO: 1240102 - RNA, 19 nt, Human
gucccggccugcuccucuu

SEQ ID NO: 1240103 - RNA, 18 nt, Human
uacccguugggccuggcg

SEQ ID NO: 1240104 - RNA, 21 nt, Human
uagguacccguugggccuggc

SEQ ID NO: 1240105 - RNA, 24 nt, Human
uccauggccuguugucucuggagc

SEQ ID NO: 1240106 - RNA, 21 nt, Human
ucccagagcucaaacugggca

SEQ ID NO: 1240107 - RNA, 21 nt, Human
ucccgcgcugggagcggaagc

SEQ ID NO: 1240108 - RNA, 21 nt, Human
ucucaggaagaccuagauuuc

SEQ ID NO: 1240109 - RNA, 25 nt, Human
ucuucuucccagagcucaaacuggg

SEQ ID NO: 1240110 - RNA, 18 nt, Human
ugaauauuaucuuuaaau

SEQ ID NO: 1240111 - RNA, 27 nt, Human
ugcuuuucccgaauucuuccccuucca

SEQ ID NO: 1240112 - RNA, 18 nt, Human
ugggagcggaagcccgcg

SEQ ID NO: 1240113 - RNA, 18 nt, Human
uguugucucuggagcgcu

SEQ ID NO: 1240114 - RNA, 18 nt, Human
uucuucccagagcucaaa

SEQ ID NO: 1240115 - RNA, 19 nt, Human
aaauaaaaugaaagucuau

SEQ ID NO: 1240116 - RNA, 23 nt, Human
cauuauguaaaaagcucgcaucu

SEQ ID NO: 1240117 - RNA, 21 nt, Human
gggaauccaugaguugguagg

SEQ ID NO: 1240118 - RNA, 23 nt, Human
ucuugggaauccaugaguuggua

SEQ ID NO: 1240119 - RNA, 25 nt, Human
uugcuggguuguucuuucauuaugu

SEQ ID NO: 1240120 - RNA, 23 nt, Human
aacacacacccugccccagcaca

SEQ ID NO: 1240121 - RNA, 22 nt, Human
aacacugcucugcuuccuuggu

SEQ ID NO: 1240122 - RNA, 18 nt, Human
aagaggccuugaggcaaa

SEQ ID NO: 1240123 - RNA, 21 nt, Human
aagcccagacugacaaagcaa

SEQ ID NO: 1240124 - RNA, 18 nt, Human
aaggccggaggucgcucc

SEQ ID NO: 1240125 - RNA, 23 nt, Human
aauccucuccagacccaggccug

SEQ ID NO: 1240126 - RNA, 19 nt, Human
acaaaauccucuccagacc

SEQ ID NO: 1240127 - RNA, 22 nt, Human
acaaaauccucuccagacccag

SEQ ID NO: 1240128 - RNA, 23 nt, Human
acaaaauccucuccagacccagg

SEQ ID NO: 1240129 - RNA, 22 nt, Human
acacaaaauccucuccagaccc

SEQ ID NO: 1240130 - RNA, 22 nt, Human
acauacagcucacauuuugcuu

SEQ ID NO: 1240131 - RNA, 21 nt, Human
acgccucaaacaccccauuua

SEQ ID NO: 1240132 - RNA, 21 nt, Human
agaacacacacccugccccag

SEQ ID NO: 1240133 - RNA, 20 nt, Human
agcacuuguugccccaggac

SEQ ID NO: 1240134 - RNA, 21 nt, Human
agcacuuguugccccaggacc

SEQ ID NO: 1240135 - RNA, 22 nt, Human
agcaucuauuuguccuggcaac

SEQ ID NO: 1240136 - RNA, 18 nt, Human
aggaggaaguuuuauaau

SEQ ID NO: 1240137 - RNA, 24 nt, Human
aggcacacucgcugucgacccaaa

SEQ ID NO: 1240138 - RNA, 22 nt, Human
caaaauccucuccagacccagg

SEQ ID NO: 1240139 - RNA, 23 nt, Human
cacaaaauccucuccagacccuu

SEQ ID NO: 1240140 - RNA, 19 nt, Human
cacauccccacagacaccc

SEQ ID NO: 1240141 - RNA, 20 nt, Human
cacauccccacagacacccu

SEQ ID NO: 1240142 - RNA, 24 nt, Human
cacauccccacagacacccuccca

SEQ ID NO: 1240143 - RNA, 22 nt, Human
caccaacagccacccauacgcc

SEQ ID NO: 1240144 - RNA, 21 nt, Human
cacccucccacagaacacaca

SEQ ID NO: 1240145 - RNA, 19 nt, Human
cacccugccccagcacagg

SEQ ID NO: 1240146 - RNA, 27 nt, Human
cagaacacacacccugccccagcacag

SEQ ID NO: 1240147 - RNA, 19 nt, Human
cagacacccucccacagaa

SEQ ID NO: 1240148 - RNA, 18 nt, Human
cagacccaggccugcccc

SEQ ID NO: 1240149 - RNA, 19 nt, Human
cagccacccauacgccuca

SEQ ID NO: 1240150 - RNA, 26 nt, Human
cagccacccauacgccucaaacaccc

SEQ ID NO: 1240151 - RNA, 24 nt, Human
caggaggaaguuuuauaauccauc

SEQ ID NO: 1240152 - RNA, 25 nt, Human
ccaacagccacccauacgccucaaa

SEQ ID NO: 1240153 - RNA, 24 nt, Human
ccacccauacgccucaaacacccc

SEQ ID NO: 1240154 - RNA, 21 nt, Human
ccacccugauagucacauccc

SEQ ID NO: 1240155 - RNA, 20 nt, Human
ccagcacaggcccacccuga

SEQ ID NO: 1240156 - RNA, 18 nt, Human
cccacagaacacacaccc

SEQ ID NO: 1240157 - RNA, 23 nt, Human
cccacagaacacacacccugccc

SEQ ID NO: 1240158 - RNA, 22 nt, Human
cccacccugauagucacauccc

SEQ ID NO: 1240159 - RNA, 21 nt, Human
cccagacugacaaagcaaaaa

SEQ ID NO: 1240160 - RNA, 20 nt, Human
cccauacgccucaaacaccc

SEQ ID NO: 1240161 - RNA, 21 nt, Human
cccauacgccucaaacacccc

SEQ ID NO: 1240162 - RNA, 20 nt, Human
cccauccccagcacaggccc

SEQ ID NO: 1240163 - RNA, 23 nt, Human
ccucccacagaacacacacccug

SEQ ID NO: 1240164 - RNA, 19 nt, Human
ccugccccauccccagcac

SEQ ID NO: 1240165 - RNA, 25 nt, Human
ccuggcaacacagcacuuguugccc

SEQ ID NO: 1240166 - RNA, 21 nt, Human
cgacccaaacacaaagacuaa

SEQ ID NO: 1240167 - RNA, 21 nt, Human
cuacagagucacuguaaucag

SEQ ID NO: 1240168 - RNA, 22 nt, Human
cuccccacaccaacagccaccc

SEQ ID NO: 1240169 - RNA, 19 nt, Human
cugaagaggccuugaggca

SEQ ID NO: 1240170 - RNA, 23 nt, Human
cugccccagcacaggcacacucg

SEQ ID NO: 1240171 - RNA, 20 nt, Human
gaacacacacccugcccccc

SEQ ID NO: 1240172 - RNA, 24 nt, Human
gacaucugcaguaaugucauugaa

SEQ ID NO: 1240173 - RNA, 23 nt, Human
gacccaaacacaaagacuaaugg

SEQ ID NO: 1240174 - RNA, 18 nt, Human
gcccaagcaagaugaugc

SEQ ID NO: 1240175 - RNA, 18 nt, Human
gccccaggacccagcuuc

SEQ ID NO: 1240176 - RNA, 25 nt, Human
gccccaggacccagcuucuucagcg

SEQ ID NO: 1240177 - RNA, 24 nt, Human
gccccauccccagcacaggcccac

SEQ ID NO: 1240178 - RNA, 24 nt, Human
guaaaaguuucacaguuuuccagg

SEQ ID NO: 1240179 - RNA, 22 nt, Human
gucacauccccacagacacccu

SEQ ID NO: 1240180 - RNA, 21 nt, Human
gucuuauuuaagguagccuuu

SEQ ID NO: 1240181 - RNA, 23 nt, Human
uaaaaagugcccuuuuguaagga

SEQ ID NO: 1240182 - RNA, 22 nt, Human
uaaacugaaaaauuaugaagga

SEQ ID NO: 1240183 - RNA, 21 nt, Human
uaacaaggucaaaagcaagac

SEQ ID NO: 1240184 - RNA, 18 nt, Human
uagacaucugcaguaaug

SEQ ID NO: 1240185 - RNA, 19 nt, Human
uaguuuuaaagcaaaauca

SEQ ID NO: 1240186 - RNA, 22 nt, Human
ucaacaucgaauccuuuuagcu

SEQ ID NO: 1240187 - RNA, 19 nt, Human
ucacuguagacaucugcag

SEQ ID NO: 1240188 - RNA, 20 nt, Human
ucacuguagacaucugcagu

SEQ ID NO: 1240189 - RNA, 20 nt, Human
ucaguguaugcauuuuucug

SEQ ID NO: 1240190 - RNA, 21 nt, Human
uccccacaccaacagccaccc

SEQ ID NO: 1240191 - RNA, 19 nt, Human
ucgacccaaacacaaagac

SEQ ID NO: 1240192 - RNA, 18 nt, Human
ugaaaacuguuugugaaa

SEQ ID NO: 1240193 - RNA, 20 nt, Human
ugcucugcuuccuuggugua

SEQ ID NO: 1240194 - RNA, 21 nt, Human
uggaaagauuacgucguggua

SEQ ID NO: 1240195 - RNA, 24 nt, Human
uggcaacacagcacuuguugcccc

SEQ ID NO: 1240196 - RNA, 21 nt, Human
uuaguaauaaaggcauguuuu

SEQ ID NO: 1240197 - RNA, 27 nt, Human
uucacacaaaauccucuccagacccaa

SEQ ID NO: 1240198 - RNA, 22 nt, Human
uugccuuuguuggguccuggaa

SEQ ID NO: 1240199 - RNA, 22 nt, Human
uuuagcuguaauaauuuaugaa

SEQ ID NO: 1240200 - RNA, 20 nt, Human
uuuucugucggcugcuaacu

SEQ ID NO: 1240201 - RNA, 26 nt, Human
uuuugcuuuaaagaguaaacugaaaa

SEQ ID NO: 1240202 - RNA, 22 nt, Human
aaaaauagcaauaaaagccuac

SEQ ID NO: 1240203 - RNA, 20 nt, Human
aaaagcacagcugagucccg

SEQ ID NO: 1240204 - RNA, 23 nt, Human
aaaaggauaggcacagccuuugg

SEQ ID NO: 1240205 - RNA, 20 nt, Human
aaacugcugggauuacaggc

SEQ ID NO: 1240206 - RNA, 24 nt, Human
aaacugcugggauuacaggcguga

SEQ ID NO: 1240207 - RNA, 19 nt, Human
aaauagcaauaaaagccua

SEQ ID NO: 1240208 - RNA, 21 nt, Human
aaauggaaacugacauaaaaa

SEQ ID NO: 1240209 - RNA, 18 nt, Human
aagcuccuucuugcccaa

SEQ ID NO: 1240210 - RNA, 29 nt, Human
aaguuuccaggaagcuuaguguucgggga

SEQ ID NO: 1240211 - RNA, 23 nt, Human
aauagaaaaugaggaaaguccau

SEQ ID NO: 1240212 - RNA, 27 nt, Human
acacagugguggccaagggcugucucc

SEQ ID NO: 1240213 - RNA, 23 nt, Human
acaggcgcccgccauuacgcccg

SEQ ID NO: 1240214 - RNA, 18 nt, Human
acgggguuucacuauguu

SEQ ID NO: 1240215 - RNA, 23 nt, Human
acgggguuucacuauguuggcca

SEQ ID NO: 1240216 - RNA, 24 nt, Human
acgggguuucacuauguuggccag

SEQ ID NO: 1240217 - RNA, 18 nt, Human
acuauguuggccaggcug

SEQ ID NO: 1240218 - RNA, 25 nt, Human
acucugucgcccgggcuggagucca

SEQ ID NO: 1240219 - RNA, 22 nt, Human
acugccaaaggacacucagagg

SEQ ID NO: 1240220 - RNA, 20 nt, Human
agacacaaaagcacagcuga

SEQ ID NO: 1240221 - RNA, 26 nt, Human
agacaguaaauggaaacugacauaaa

SEQ ID NO: 1240222 - RNA, 20 nt, Human
aggcgcccgccauuacgccc

SEQ ID NO: 1240223 - RNA, 22 nt, Human
aggcggcucugcagcccaaagc

SEQ ID NO: 1240224 - RNA, 18 nt, Human
aguagcugggaauacagg

SEQ ID NO: 1240225 - RNA, 21 nt, Human
aguccauucugacaacuggcu

SEQ ID NO: 1240226 - RNA, 24 nt, Human
caaacugcugggauuacaggcgug

SEQ ID NO: 1240227 - RNA, 18 nt, Human
caaagagacacaaaagca

SEQ ID NO: 1240228 - RNA, 24 nt, Human
caaagagacacaaaagcacagcug

SEQ ID NO: 1240229 - RNA, 20 nt, Human
caaccuccgccucccggauu

SEQ ID NO: 1240230 - RNA, 22 nt, Human
caagccauucuccugccucagc

SEQ ID NO: 1240231 - RNA, 24 nt, Human
caaguuuaggucuagggaaguuuc

SEQ ID NO: 1240232 - RNA, 23 nt, Human
cacacgggaaaucgagguaccac

SEQ ID NO: 1240233 - RNA, 23 nt, Human
cacagugguggccaagggcuguc

SEQ ID NO: 1240234 - RNA, 23 nt, Human
cacaugcaaccaaaauagagaau

SEQ ID NO: 1240235 - RNA, 20 nt, Human
caccggagcgcgcaacaauc

SEQ ID NO: 1240236 - RNA, 23 nt, Human
caccgugccgggcccucucucuu

SEQ ID NO: 1240237 - RNA, 20 nt, Human
caccucugccuccugcucag

SEQ ID NO: 1240238 - RNA, 21 nt, Human
caccucugccuccugcucagc

SEQ ID NO: 1240239 - RNA, 21 nt, Human
cacuauguuggccaggcuggu

SEQ ID NO: 1240240 - RNA, 22 nt, Human
cacuauguuggccaggcugguc

SEQ ID NO: 1240241 - RNA, 22 nt, Human
cacucugucgcccgggcuggag

SEQ ID NO: 1240242 - RNA, 21 nt, Human
cacugcaaccuccgccucccg

SEQ ID NO: 1240243 - RNA, 18 nt, Human
cagaagagauggaaccaa

SEQ ID NO: 1240244 - RNA, 19 nt, Human
cagaagagauggaaccaaa

SEQ ID NO: 1240245 - RNA, 21 nt, Human
cagcccuugaaacucugccgg

SEQ ID NO: 1240246 - RNA, 21 nt, Human
caggcgcccgccauuacgccc

SEQ ID NO: 1240247 - RNA, 22 nt, Human
ccaaacugcugggauuacaggc

SEQ ID NO: 1240248 - RNA, 22 nt, Human
ccaaacugcugggauuacaggc

SEQ ID NO: 1240249 - RNA, 24 nt, Human
ccaaacugcugggauuacaggcgu

SEQ ID NO: 1240250 - RNA, 23 nt, Human
ccagccccaaguaaagcgacaaa

SEQ ID NO: 1240251 - RNA, 19 nt, Human
cccccuucggccucccaaa

SEQ ID NO: 1240252 - RNA, 23 nt, Human
cccgaguagcugggaauacaggc

SEQ ID NO: 1240253 - RNA, 22 nt, Human
ccgagccuggggcaccuucgcu

SEQ ID NO: 1240254 - RNA, 24 nt, Human
ccgcggccccuccccugcgcgucc

SEQ ID NO: 1240255 - RNA, 19 nt, Human
ccucuucuucuuuucuuuu

SEQ ID NO: 1240256 - RNA, 23 nt, Human
ccugccucagccucccgaguagc

SEQ ID NO: 1240257 - RNA, 23 nt, Human
ccuguugagucaaaggcaaaggc

SEQ ID NO: 1240258 - RNA, 18 nt, Human
cgccagagcuggaaaggg

SEQ ID NO: 1240259 - RNA, 19 nt, Human
cgcccgggcuggaguccag

SEQ ID NO: 1240260 - RNA, 19 nt, Human
cgccucccggauucaagcc

SEQ ID NO: 1240261 - RNA, 18 nt, Human
cgcucccaccgccccagc

SEQ ID NO: 1240262 - RNA, 24 nt, Human
cgggguuucacuauguuggccagg

SEQ ID NO: 1240263 - RNA, 21 nt, Human
cuauuuaaaaggauaggcaca

SEQ ID NO: 1240264 - RNA, 24 nt, Human
cucacucugucgcccgggcuggag

SEQ ID NO: 1240265 - RNA, 24 nt, Human
cucagaagccacaacauuuucccc

SEQ ID NO: 1240266 - RNA, 19 nt, Human
cucauaauagaaaaugagg

SEQ ID NO: 1240267 - RNA, 21 nt, Human
cucccaaacugcugggauuac

SEQ ID NO: 1240268 - RNA, 22 nt, Human
cuccugaccucgugauucgccc

SEQ ID NO: 1240269 - RNA, 18 nt, Human
cuccuguugagucaaagg

SEQ ID NO: 1240270 - RNA, 19 nt, Human
cugaaugucuuuccucagg

SEQ ID NO: 1240271 - RNA, 30 nt, Human
cugacauaaaaauagcaauaaaagccuacu

SEQ ID NO: 1240272 - RNA, 23 nt, Human
cugccucagccucccgaguagcu

SEQ ID NO: 1240273 - RNA, 19 nt, Human
cugucgcccgggcuggagu

SEQ ID NO: 1240274 - RNA, 18 nt, Human
gaaaagguuuccaccuuc

SEQ ID NO: 1240275 - RNA, 24 nt, Human
gaaaguccauucugacaacuggcu

SEQ ID NO: 1240276 - RNA, 21 nt, Human
gaagccacaacauuuucccca

SEQ ID NO: 1240277 - RNA, 21 nt, Human
gaauguaacaggcaagcauaa

SEQ ID NO: 1240278 - RNA, 18 nt, Human
gaccucgugauucgcccc

SEQ ID NO: 1240279 - RNA, 22 nt, Human
gagaauaauagaauaugggccg

SEQ ID NO: 1240280 - RNA, 19 nt, Human
gagcgcgcaacaaucacuu

SEQ ID NO: 1240281 - RNA, 18 nt, Human
gauuacaggcgugagcca

SEQ ID NO: 1240282 - RNA, 20 nt, Human
gauuacaggcgugagccacc

SEQ ID NO: 1240283 - RNA, 21 nt, Human
gauuacaggcgugagccaccg

SEQ ID NO: 1240284 - RNA, 22 nt, Human
gcaaccuccgccucccggauuc

SEQ ID NO: 1240285 - RNA, 20 nt, Human
gcacacgggaaaucgaggua

SEQ ID NO: 1240286 - RNA, 20 nt, Human
gcccgggcuggaguccagcg

SEQ ID NO: 1240287 - RNA, 20 nt, Human
gccgguccggccgcggcccc

SEQ ID NO: 1240288 - RNA, 23 nt, Human
gcuggucuggaacuccugaccuc

SEQ ID NO: 1240289 - RNA, 19 nt, Human
gcuuccucuucuucuuuuc

SEQ ID NO: 1240290 - RNA, 21 nt, Human
gcuuccucuucuucuuuucuu

SEQ ID NO: 1240291 - RNA, 18 nt, Human
ggaacugaaugucuuucc

SEQ ID NO: 1240292 - RNA, 18 nt, Human
ggcugcuuccucuucuuc

SEQ ID NO: 1240293 - RNA, 24 nt, Human
ggcuggucuggaacuccugaccuc

SEQ ID NO: 1240294 - RNA, 23 nt, Human
gggguuucacuauguuggccagg

SEQ ID NO: 1240295 - RNA, 19 nt, Human
gucccgaagcuggcacacg

SEQ ID NO: 1240296 - RNA, 18 nt, Human
gugagacaguaaauggaa

SEQ ID NO: 1240297 - RNA, 21 nt, Human
uaaaaauagcaauaaaagccu

SEQ ID NO: 1240298 - RNA, 22 nt, Human
uacaggcgugagccaccgugcc

SEQ ID NO: 1240299 - RNA, 22 nt, Human
uagacacgggguuucacuaugu

SEQ ID NO: 1240300 - RNA, 24 nt, Human
uaguagacacgggguuucacuaug

SEQ ID NO: 1240301 - RNA, 18 nt, Human
uaugcagaagagauggaa

SEQ ID NO: 1240302 - RNA, 18 nt, Human
uaugcagaagagauggaa

SEQ ID NO: 1240303 - RNA, 18 nt, Human
uaugcagaagagauggaa

SEQ ID NO: 1240304 - RNA, 19 nt, Human
uaugcagaagagauggaac

SEQ ID NO: 1240305 - RNA, 20 nt, Human
uaugcagaagagauggaacc

SEQ ID NO: 1240306 - RNA, 22 nt, Human
uauguuggccaggcuggucugg

SEQ ID NO: 1240307 - RNA, 23 nt, Human
uauguuggccaggcuggucugga

SEQ ID NO: 1240308 - RNA, 24 nt, Human
uauguuggccaggcuggucuggaa

SEQ ID NO: 1240309 - RNA, 19 nt, Human
ucaaagagacacaaaagca

SEQ ID NO: 1240310 - RNA, 19 nt, Human
ucaaagagacacaaaagca

SEQ ID NO: 1240311 - RNA, 25 nt, Human
ucaagccauucuccugccucagccu

SEQ ID NO: 1240312 - RNA, 24 nt, Human
ucaauacauaauggaauggguaug

SEQ ID NO: 1240313 - RNA, 22 nt, Human
ucacuauguuggccaggcuggu

SEQ ID NO: 1240314 - RNA, 18 nt, Human
ucacugcaaccuccgccu

SEQ ID NO: 1240315 - RNA, 19 nt, Human
ucacugcaaccuccgccuc

SEQ ID NO: 1240316 - RNA, 23 nt, Human
ucacugcaaccuccgccucccgg

SEQ ID NO: 1240317 - RNA, 24 nt, Human
ucacugcaaccuccgccucccgga

SEQ ID NO: 1240318 - RNA, 27 nt, Human
ucacugcaaccuccgccucccggauuc

SEQ ID NO: 1240319 - RNA, 22 nt, Human
ucagaggccagggaauguaaca

SEQ ID NO: 1240320 - RNA, 20 nt, Human
ucagccucccgaguagcugg

SEQ ID NO: 1240321 - RNA, 23 nt, Human
uccagccccaaguaaagcgacaa

SEQ ID NO: 1240322 - RNA, 24 nt, Human
ucccaaacugcugggauuacaggc

SEQ ID NO: 1240323 - RNA, 24 nt, Human
ucccgaguagcugggaauacaggc

SEQ ID NO: 1240324 - RNA, 21 nt, Human
ucccggauucaagccauucuc

SEQ ID NO: 1240325 - RNA, 24 nt, Human
ucccggauucaagccauucuccug

SEQ ID NO: 1240326 - RNA, 18 nt, Human
ucucacucugucgcccgg

SEQ ID NO: 1240327 - RNA, 23 nt, Human
ucucacucugucgcccgggcugg

SEQ ID NO: 1240328 - RNA, 24 nt, Human
ucucacucugucgcccgggcugga

SEQ ID NO: 1240329 - RNA, 24 nt, Human
ucuccugccucagccucccgagua

SEQ ID NO: 1240330 - RNA, 24 nt, Human
ucuuuaguagacacgggguuucac

SEQ ID NO: 1240331 - RNA, 18 nt, Human
ucuuuuuuuuuuuuuuuu

SEQ ID NO: 1240332 - RNA, 22 nt, Human
ugaaugucuuuccucaggccuc

SEQ ID NO: 1240333 - RNA, 21 nt, Human
ugacauaaaaauagcaauaaa

SEQ ID NO: 1240334 - RNA, 24 nt, Human
ugauucgcccccuucggccuccca

SEQ ID NO: 1240335 - RNA, 18 nt, Human
ugccaggcggcucugcag

SEQ ID NO: 1240336 - RNA, 21 nt, Human
ugccaggcggcucugcagccc

SEQ ID NO: 1240337 - RNA, 24 nt, Human
ugccucagccucccgaguagcugg

SEQ ID NO: 1240338 - RNA, 24 nt, Human
ugcugggauuacaggcgugagcca

SEQ ID NO: 1240339 - RNA, 26 nt, Human
uggaaaggggagguccagccccaagu

SEQ ID NO: 1240340 - RNA, 24 nt, Human
uggaguccagcgacgcgaucucgg

SEQ ID NO: 1240341 - RNA, 24 nt, Human
uggccaggcuggucuggaacuccu

SEQ ID NO: 1240342 - RNA, 19 nt, Human
ugggaauacaggcgcccgc

SEQ ID NO: 1240343 - RNA, 21 nt, Human
ugggaauacaggcgcccgcca

SEQ ID NO: 1240344 - RNA, 22 nt, Human
ugggaauacaggcgcccgccau

SEQ ID NO: 1240345 - RNA, 22 nt, Human
ugggacggagucucacucuguc

SEQ ID NO: 1240346 - RNA, 18 nt, Human
ugggauuacaggcgugag

SEQ ID NO: 1240347 - RNA, 21 nt, Human
ugggauuacaggcgugagcca

SEQ ID NO: 1240348 - RNA, 22 nt, Human
ugggauuacaggcgugagccac

SEQ ID NO: 1240349 - RNA, 23 nt, Human
ugggauuacaggcgugagccacc

SEQ ID NO: 1240350 - RNA, 23 nt, Human
ugggauuacaggcgugagccacc

SEQ ID NO: 1240351 - RNA, 24 nt, Human
ugggauuacaggcgugagccaccg

SEQ ID NO: 1240352 - RNA, 21 nt, Human
ugucgcccgggcuggagucca

SEQ ID NO: 1240353 - RNA, 21 nt, Human
uuaguagacacgggguuucac

SEQ ID NO: 1240354 - RNA, 24 nt, Human
uuaguagacacgggguuucacuau

SEQ ID NO: 1240355 - RNA, 21 nt, Human
uucaagccauucuccugccuc

SEQ ID NO: 1240356 - RNA, 25 nt, Human
uuccccgagccuggggcaccuucgc

SEQ ID NO: 1240357 - RNA, 22 nt, Human
uucgcucccaccgccccagcug

SEQ ID NO: 1240358 - RNA, 21 nt, Human
uuggaacugaaugucuuuccu

SEQ ID NO: 1240359 - RNA, 24 nt, Human
uuucacuauguuggccaggcuggu

SEQ ID NO: 1240360 - RNA, 21 nt, Human
uuuugaccacaugcaaccaaa

SEQ ID NO: 1240361 - RNA, 26 nt, Human
uuuuuuuuuuuugggacggagucuca

SEQ ID NO: 1240362 - RNA, 22 nt, Human
uuuuuuuuuuuuuugggacgga

SEQ ID NO: 1240363 - RNA, 24 nt, Human
uuuuuuuuuuuuuuuuuuuuuggg

SEQ ID NO: 1240364 - RNA, 24 nt, Human
aaacaccaccuucucucaagagcc

SEQ ID NO: 1240365 - RNA, 20 nt, Human
aagcaccaggcauacuugac

SEQ ID NO: 1240366 - RNA, 21 nt, Human
accugugguuuucagggcggg

SEQ ID NO: 1240367 - RNA, 24 nt, Human
acuucguguuucaggcaucugccg

SEQ ID NO: 1240368 - RNA, 23 nt, Human
agccaaacaccaccuucucucag

SEQ ID NO: 1240369 - RNA, 18 nt, Human
aggaccacaggcagagcu

SEQ ID NO: 1240370 - RNA, 28 nt, Human
aggaguaugccugucuccaacaagaggg

SEQ ID NO: 1240371 - RNA, 25 nt, Human
aggccuguggugccgugggagauga

SEQ ID NO: 1240372 - RNA, 21 nt, Human
caaacaccaccuucucucaaa

SEQ ID NO: 1240373 - RNA, 23 nt, Human
cacagggcauggcucugggacag

SEQ ID NO: 1240374 - RNA, 22 nt, Human
cacagucuucugcaaaauaucc

SEQ ID NO: 1240375 - RNA, 18 nt, Human
caccuucucucaagagcc

SEQ ID NO: 1240376 - RNA, 19 nt, Human
caggaguaugccugucucc

SEQ ID NO: 1240377 - RNA, 18 nt, Human
caggccuguggugccgug

SEQ ID NO: 1240378 - RNA, 19 nt, Human
cagggcauggcucugggac

SEQ ID NO: 1240379 - RNA, 21 nt, Human
cagggcggggcccaggaccac

SEQ ID NO: 1240380 - RNA, 23 nt, Human
ccacugccaagcucuaagacagu

SEQ ID NO: 1240381 - RNA, 21 nt, Human
ccagaagugguuguuuuccuc

SEQ ID NO: 1240382 - RNA, 22 nt, Human
cccagccaaacaccaccuucuc

SEQ ID NO: 1240383 - RNA, 22 nt, Human
cccaugugaccaggccuguggu

SEQ ID NO: 1240384 - RNA, 20 nt, Human
ccuccuguggucucugaagg

SEQ ID NO: 1240385 - RNA, 25 nt, Human
cgaaugacacaaagccugacccugc

SEQ ID NO: 1240386 - RNA, 19 nt, Human
cggggcccaggaccacagg

SEQ ID NO: 1240387 - RNA, 23 nt, Human
gaaugacacaaagccugacccug

SEQ ID NO: 1240388 - RNA, 19 nt, Human
gcaaaauaucccacagaag

SEQ ID NO: 1240389 - RNA, 18 nt, Human
gccuguggugccguggga

SEQ ID NO: 1240390 - RNA, 20 nt, Human
gcucugggacagagccaugu

SEQ ID NO: 1240391 - RNA, 20 nt, Human
gggcccaggaccacaggcag

SEQ ID NO: 1240392 - RNA, 21 nt, Human
gugcuggcaggggugaggggu

SEQ ID NO: 1240393 - RNA, 24 nt, Human
uacucucggagagugugacggagc

SEQ ID NO: 1240394 - RNA, 19 nt, Human
ucuccaacaagagggcugu

SEQ ID NO: 1240395 - RNA, 19 nt, Human
ucucggccuaucuagaggg

SEQ ID NO: 1240396 - RNA, 18 nt, Human
ugacacaaagccugaccc

SEQ ID NO: 1240397 - RNA, 20 nt, Human
uggcaccacugccaagcucu

SEQ ID NO: 1240398 - RNA, 18 nt, Human
ugguggcccagccaaaca

SEQ ID NO: 1240399 - RNA, 18 nt, Human
uguccuugucccagaagu

SEQ ID NO: 1240400 - RNA, 24 nt, Human
ugugacggagccucccgagggcuu

SEQ ID NO: 1240401 - RNA, 21 nt, Human
ugugcuggcaggggugagggg

SEQ ID NO: 1240402 - RNA, 24 nt, Human
uugguggcccagccaaacaccacc

SEQ ID NO: 1240403 - RNA, 23 nt, Human
uuugguggcccagccaaacacca

SEQ ID NO: 1240404 - RNA, 22 nt, Human
aaaaauuguuaugcuaaacaau

SEQ ID NO: 1240405 - RNA, 24 nt, Human
aaacaaacaaacaaaaaaagcuuu

SEQ ID NO: 1240406 - RNA, 21 nt, Human
aagagcaccacauuguacugg

SEQ ID NO: 1240407 - RNA, 24 nt, Human
aagagcaccacauuguacugguuu

SEQ ID NO: 1240408 - RNA, 24 nt, Human
aagcugaggcaggagaauugcuug

SEQ ID NO: 1240409 - RNA, 24 nt, Human
aauugcuugaaccugggaggcgga

SEQ ID NO: 1240410 - RNA, 19 nt, Human
acaaagauauucugccuuc

SEQ ID NO: 1240411 - RNA, 18 nt, Human
acacacacacacacacac

SEQ ID NO: 1240412 - RNA, 19 nt, Human
acaggcagcaaccauacaa

SEQ ID NO: 1240413 - RNA, 19 nt, Human
acagugaggguuucaugga

SEQ ID NO: 1240414 - RNA, 22 nt, Human
acaguuaaaugaugucucuguc

SEQ ID NO: 1240415 - RNA, 24 nt, Human
accacacuccagccuggcugacag

SEQ ID NO: 1240416 - RNA, 21 nt, Human
acccuccccuccccucuccau

SEQ ID NO: 1240417 - RNA, 22 nt, Human
accuugugaucacagauugcca

SEQ ID NO: 1240418 - RNA, 22 nt, Human
acgacaaaagaugcaaucugaa

SEQ ID NO: 1240419 - RNA, 19 nt, Human
acuagcauguauacauuac

SEQ ID NO: 1240420 - RNA, 21 nt, Human
acugcacgugugccucugccu

SEQ ID NO: 1240421 - RNA, 23 nt, Human
agaaggcagacgugauuuuccaa

SEQ ID NO: 1240422 - RNA, 22 nt, Human
agaauugcuugaaccugggagg

SEQ ID NO: 1240423 - RNA, 21 nt, Human
agacacaccccaggaccugga

SEQ ID NO: 1240424 - RNA, 18 nt, Human
agagcuggaaacagaagc

SEQ ID NO: 1240425 - RNA, 24 nt, Human
agcaugacgacaaaagaugcaauc

SEQ ID NO: 1240426 - RNA, 21 nt, Human
agccgagauugugccaccaca

SEQ ID NO: 1240427 - RNA, 19 nt, Human
agccuggcugacagagaga

SEQ ID NO: 1240428 - RNA, 23 nt, Human
aggcagacgugauuuuccaaaau

SEQ ID NO: 1240429 - RNA, 22 nt, Human
aggcaggagaauugcuugaacc

SEQ ID NO: 1240430 - RNA, 24 nt, Human
aggcaggagaauugcuugaaccug

SEQ ID NO: 1240431 - RNA, 21 nt, Human
aggcggagguugcagugagcc

SEQ ID NO: 1240432 - RNA, 24 nt, Human
aggcggagguugcagugagccgag

SEQ ID NO: 1240433 - RNA, 21 nt, Human
aggguuucauggaggccgugc

SEQ ID NO: 1240434 - RNA, 24 nt, Human
auacacacacacacacacacauuc

SEQ ID NO: 1240435 - RNA, 18 nt, Human
auccugaacaguguucca

SEQ ID NO: 1240436 - RNA, 21 nt, Human
augcaaucugaagcuggugga

SEQ ID NO: 1240437 - RNA, 24 nt, Human
auugugccaccacacuccagccug

SEQ ID NO: 1240438 - RNA, 21 nt, Human
caagacagaugaugggaaagc

SEQ ID NO: 1240439 - RNA, 18 nt, Human
caagagcaccacauugua

SEQ ID NO: 1240440 - RNA, 25 nt, Human
caagucucuaagcugaccaaugagc

SEQ ID NO: 1240441 - RNA, 18 nt, Human
caaguuccgugagccuag

SEQ ID NO: 1240442 - RNA, 18 nt, Human
cacacacacacacacaca

SEQ ID NO: 1240443 - RNA, 24 nt, Human
cacacacacacacacauucacuuc

SEQ ID NO: 1240444 - RNA, 24 nt, Human
caccacacuccagccuggcugaca

SEQ ID NO: 1240445 - RNA, 20 nt, Human
cacccuccccuccccucucc

SEQ ID NO: 1240446 - RNA, 19 nt, Human
caccuggcuucucugggag

SEQ ID NO: 1240447 - RNA, 24 nt, Human
caccuguaguuccagcuacucagg

SEQ ID NO: 1240448 - RNA, 21 nt, Human
cacgcagcccuguaucucuac

SEQ ID NO: 1240449 - RNA, 23 nt, Human
cacugcaugaaccuuuaagaaau

SEQ ID NO: 1240450 - RNA, 21 nt, Human
cacuucucaaaaacugaucca

SEQ ID NO: 1240451 - RNA, 22 nt, Human
cagagcuggaaacagaagccaa

SEQ ID NO: 1240452 - RNA, 24 nt, Human
cagcagggauucgauuccaccaua

SEQ ID NO: 1240453 - RNA, 18 nt, Human
caggaagccugcccugau

SEQ ID NO: 1240454 - RNA, 18 nt, Human
cauggaggccgugcacag

SEQ ID NO: 1240455 - RNA, 21 nt, Human
ccaaaacuuagaccucaguaa

SEQ ID NO: 1240456 - RNA, 19 nt, Human
ccacaggagaaaugaacaa

SEQ ID NO: 1240457 - RNA, 25 nt, Human
ccaccuguaguuccagcuacucagg

SEQ ID NO: 1240458 - RNA, 19 nt, Human
ccauauccugucagucugc

SEQ ID NO: 1240459 - RNA, 18 nt, Human
ccuccugcuccaggaagc

SEQ ID NO: 1240460 - RNA, 18 nt, Human
ccugaacaguguuccagg

SEQ ID NO: 1240461 - RNA, 19 nt, Human
ccugggaggcggagguugc

SEQ ID NO: 1240462 - RNA, 21 nt, Human
ccuguaguuccagcuacucag

SEQ ID NO: 1240463 - RNA, 20 nt, Human
cuaagcugaccaaugagcau

SEQ ID NO: 1240464 - RNA, 21 nt, Human
cugcaaguuccgugagccuag

SEQ ID NO: 1240465 - RNA, 19 nt, Human
cugcacacagggacaggug

SEQ ID NO: 1240466 - RNA, 24 nt, Human
cugcacgugugccucugccacacu

SEQ ID NO: 1240467 - RNA, 19 nt, Human
cuuccuacgucuucugcau

SEQ ID NO: 1240468 - RNA, 23 nt, Human
cuuuguucuacauccccaagaag

SEQ ID NO: 1240469 - RNA, 18 nt, Human
gaagauacuaaauuccac

SEQ ID NO: 1240470 - RNA, 22 nt, Human
gacaggggggcuaaagauucau

SEQ ID NO: 1240471 - RNA, 18 nt, Human
gacauggcgggggugugg

SEQ ID NO: 1240472 - RNA, 19 nt, Human
gaccaaugagcaugacagg

SEQ ID NO: 1240473 - RNA, 18 nt, Human
gacuuuguucuacauccc

SEQ ID NO: 1240474 - RNA, 23 nt, Human
gagauugugccaccacacuccag

SEQ ID NO: 1240475 - RNA, 19 nt, Human
gagcacagucacaauucau

SEQ ID NO: 1240476 - RNA, 21 nt, Human
gagccacaggacgggagcugg

SEQ ID NO: 1240477 - RNA, 21 nt, Human
gagcugccauccauuugcugc

SEQ ID NO: 1240478 - RNA, 21 nt, Human
gagguugcagugagccgagau

SEQ ID NO: 1240479 - RNA, 23 nt, Human
gagguugcagugagccgagauug

SEQ ID NO: 1240480 - RNA, 21 nt, Human
gaugaugggaaagcaugagga

SEQ ID NO: 1240481 - RNA, 22 nt, Human
gcagcccgaggucuuggaaucc

SEQ ID NO: 1240482 - RNA, 21 nt, Human
gccugcacccuccccuccccu

SEQ ID NO: 1240483 - RNA, 20 nt, Human
gcuggaaacagaagccaaca

SEQ ID NO: 1240484 - RNA, 18 nt, Human
ggagaccauuuucuuuau

SEQ ID NO: 1240485 - RNA, 22 nt, Human
ggagguugcagugagccgagau

SEQ ID NO: 1240486 - RNA, 24 nt, Human
ggagguugcagugagccgagauug

SEQ ID NO: 1240487 - RNA, 25 nt, Human
guaguuuuuuaaucuccacaggaga

SEQ ID NO: 1240488 - RNA, 21 nt, Human
gugccucugccacacuuucug

SEQ ID NO: 1240489 - RNA, 19 nt, Human
guugacuuccugaaagugu

SEQ ID NO: 1240490 - RNA, 20 nt, Human
guugacuuccugaaaguguc

SEQ ID NO: 1240491 - RNA, 24 nt, Human
guugcagugagccgagauugugcc

SEQ ID NO: 1240492 - RNA, 24 nt, Human
guuugauaacagccuuucuuucac

SEQ ID NO: 1240493 - RNA, 20 nt, Human
uaaccuguagaaaugugauu

SEQ ID NO: 1240494 - RNA, 21 nt, Human
uaagcacuaaccgcuuccucc

SEQ ID NO: 1240495 - RNA, 21 nt, Human
uaagguugaacccaagagauc

SEQ ID NO: 1240496 - RNA, 22 nt, Human
uagcauaacucaaugaaucacu

SEQ ID NO: 1240497 - RNA, 19 nt, Human
uagcuugaaaaugcugccu

SEQ ID NO: 1240498 - RNA, 26 nt, Human
uaggaugaugauagccaggggcaaau

SEQ ID NO: 1240499 - RNA, 19 nt, Human
uaggaugccaaccaucccu

SEQ ID NO: 1240500 - RNA, 24 nt, Human
uagguaugguggcaccaccuguag

SEQ ID NO: 1240501 - RNA, 25 nt, Human
uaucucuacuaaaaagaggaaaaau

SEQ ID NO: 1240502 - RNA, 21 nt, Human
ucaaaccaaaauguagauggu

SEQ ID NO: 1240503 - RNA, 22 nt, Human
ucaaugcuccuaacuuguauca

SEQ ID NO: 1240504 - RNA, 22 nt, Human
ucaaugucuuguuccacugcag

SEQ ID NO: 1240505 - RNA, 19 nt, Human
ucacaggcagcaaccauac

SEQ ID NO: 1240506 - RNA, 19 nt, Human
ucaguuuaacccuuugagc

SEQ ID NO: 1240507 - RNA, 21 nt, Human
ucauaauuaaucucagaucaa

SEQ ID NO: 1240508 - RNA, 20 nt, Human
uccacaggagaaaugaacaa

SEQ ID NO: 1240509 - RNA, 22 nt, Human
uccagguagccaaagcuggucu

SEQ ID NO: 1240510 - RNA, 24 nt, Human
ucccaaaaugacuccgauuuggug

SEQ ID NO: 1240511 - RNA, 22 nt, Human
uccccuggccuucaccuggcuu

SEQ ID NO: 1240512 - RNA, 18 nt, Human
uccuccuccaccuucccu

SEQ ID NO: 1240513 - RNA, 24 nt, Human
ucuaaacaaacaaacaaaaaaagc

SEQ ID NO: 1240514 - RNA, 20 nt, Human
ucugcaagucucuaagcuga

SEQ ID NO: 1240515 - RNA, 21 nt, Human
ucugccucuucucaaaccaaa

SEQ ID NO: 1240516 - RNA, 23 nt, Human
ugaaaacgcuauucaaguucuua

SEQ ID NO: 1240517 - RNA, 24 nt, Human
ugaaccugggaggcggagguugca

SEQ ID NO: 1240518 - RNA, 24 nt, Human
ugaaucugugggagaccauuuucu

SEQ ID NO: 1240519 - RNA, 22 nt, Human
ugacuuccugaaaguguccuuc

SEQ ID NO: 1240520 - RNA, 19 nt, Human
ugagccgagauugugccac

SEQ ID NO: 1240521 - RNA, 24 nt, Human
ugaggcaggagaauugcuugaacc

SEQ ID NO: 1240522 - RNA, 24 nt, Human
ugaggcaggagaauugcuugaacc

SEQ ID NO: 1240523 - RNA, 19 nt, Human
ugcaacucagccucagccu

SEQ ID NO: 1240524 - RNA, 18 nt, Human
ugcacaggacugccccca

SEQ ID NO: 1240525 - RNA, 23 nt, Human
ugcacaggacugcccccaucugc

SEQ ID NO: 1240526 - RNA, 26 nt, Human
ugcacaggcauacacacacacacaca

SEQ ID NO: 1240527 - RNA, 22 nt, Human
ugcacccuccccuccccucucc

SEQ ID NO: 1240528 - RNA, 25 nt, Human
ugcagaaugaagcugaugugcacaa

SEQ ID NO: 1240529 - RNA, 20 nt, Human
ugccaaggauaaaaauccag

SEQ ID NO: 1240530 - RNA, 20 nt, Human
ugccucugccacacuuucug

SEQ ID NO: 1240531 - RNA, 21 nt, Human
ugcuugaaccugggaggcgga

SEQ ID NO: 1240532 - RNA, 22 nt, Human
uggaaagauacauaaccaaaag

SEQ ID NO: 1240533 - RNA, 21 nt, Human
uggaauccugaacaguguucc

SEQ ID NO: 1240534 - RNA, 25 nt, Human
uggaggcagcagcaugacgacaaaa

SEQ ID NO: 1240535 - RNA, 22 nt, Human
uggagggcgagcugcccaaaug

SEQ ID NO: 1240536 - RNA, 20 nt, Human
uggaugacccaaaacuuaga

SEQ ID NO: 1240537 - RNA, 23 nt, Human
uggcacaaaauugugcacagaua

SEQ ID NO: 1240538 - RNA, 21 nt, Human
uggcaccaccuguaguuccag

SEQ ID NO: 1240539 - RNA, 18 nt, Human
uggcuugucuuccuacgu

SEQ ID NO: 1240540 - RNA, 29 nt, Human
ugggaggcggagguugcagugacaacggu

SEQ ID NO: 1240541 - RNA, 24 nt, Human
ugggaggcggagguugcagugagc

SEQ ID NO: 1240542 - RNA, 21 nt, Human
ugggauguggaggcagcagca

SEQ ID NO: 1240543 - RNA, 25 nt, Human
ugggggucuucaauaauuuccuagu

SEQ ID NO: 1240544 - RNA, 21 nt, Human
uggugacaagguaaagaguag

SEQ ID NO: 1240545 - RNA, 22 nt, Human
ugguggcaccaccuguaguucc

SEQ ID NO: 1240546 - RNA, 23 nt, Human
ugguggcaccaccuguaguucca

SEQ ID NO: 1240547 - RNA, 27 nt, Human
uguauauuaucacuaauuggauacuuu

SEQ ID NO: 1240548 - RNA, 23 nt, Human
ugucagucugcacaggcauacac

SEQ ID NO: 1240549 - RNA, 19 nt, Human
uguccuguguucacagugg

SEQ ID NO: 1240550 - RNA, 22 nt, Human
ugucuuccuacgucuucugcau

SEQ ID NO: 1240551 - RNA, 20 nt, Human
uguuccacugcagcccgagg

SEQ ID NO: 1240552 - RNA, 19 nt, Human
uuaaaaauacuuuccaaaa

SEQ ID NO: 1240553 - RNA, 20 nt, Human
uuacuuggaguauuucaugu

SEQ ID NO: 1240554 - RNA, 21 nt, Human
uuacuuggaguauuucaugua

SEQ ID NO: 1240555 - RNA, 18 nt, Human
uuagcuagguaugguggc

SEQ ID NO: 1240556 - RNA, 18 nt, Human
uuaggaugccaaccaucc

SEQ ID NO: 1240557 - RNA, 19 nt, Human
uuaugguaaagaaugugag

SEQ ID NO: 1240558 - RNA, 22 nt, Human
uucacaggcagcaaccauacaa

SEQ ID NO: 1240559 - RNA, 20 nt, Human
uucaccuggcuucucuggga

SEQ ID NO: 1240560 - RNA, 21 nt, Human
uucauggaggccgugcacagg

SEQ ID NO: 1240561 - RNA, 18 nt, Human
uuccaacugugaaucugu

SEQ ID NO: 1240562 - RNA, 24 nt, Human
uuccagcuacucaggaagcugagg

SEQ ID NO: 1240563 - RNA, 23 nt, Human
uuccccuggccuucaccuggcuu

SEQ ID NO: 1240564 - RNA, 21 nt, Human
uuccugaaaguguccucucca

SEQ ID NO: 1240565 - RNA, 24 nt, Human
uugaaccugggaggcggagguugc

SEQ ID NO: 1240566 - RNA, 19 nt, Human
uugcagugagccgagauug

SEQ ID NO: 1240567 - RNA, 22 nt, Human
uugcagugagccgagauugugc

SEQ ID NO: 1240568 - RNA, 24 nt, Human
uugcuugaaccugggaggcggagg

SEQ ID NO: 1240569 - RNA, 22 nt, Human
uugugcacagauaaaaguugug

SEQ ID NO: 1240570 - RNA, 22 nt, Human
uuucauguccuguguucacagu

SEQ ID NO: 1240571 - RNA, 23 nt, Human
uuuccaaaaaaaaaaaaaaugua

SEQ ID NO: 1240572 - RNA, 21 nt, Human
uuuguaauugguagagacauu

SEQ ID NO: 1240573 - RNA, 19 nt, Human
agagaugggguuucaccgu

SEQ ID NO: 1240574 - RNA, 21 nt, Human
aggcgccccucugagagucuc

SEQ ID NO: 1240575 - RNA, 24 nt, Human
auccugaccucgugauccgcccgc

SEQ ID NO: 1240576 - RNA, 18 nt, Human
augggguuucaccguguu

SEQ ID NO: 1240577 - RNA, 19 nt, Human
augggguuucaccguguua

SEQ ID NO: 1240578 - RNA, 20 nt, Human
augggguuucaccguguuag

SEQ ID NO: 1240579 - RNA, 18 nt, Human
caccguguuagccaggau

SEQ ID NO: 1240580 - RNA, 24 nt, Human
caccguguuagccaggauggucuc

SEQ ID NO: 1240581 - RNA, 25 nt, Human
cagcggcgaggcgcgcggccggagc

SEQ ID NO: 1240582 - RNA, 21 nt, Human
caguggcgcgcgaggaacagg

SEQ ID NO: 1240583 - RNA, 18 nt, Human
cccccagcccucgccgcc

SEQ ID NO: 1240584 - RNA, 23 nt, Human
cccgggcuacugcugccgcuccc

SEQ ID NO: 1240585 - RNA, 24 nt, Human
cgcgcggccggagcaggucugcug

SEQ ID NO: 1240586 - RNA, 18 nt, Human
cgcggcgcccggagcccc

SEQ ID NO: 1240587 - RNA, 22 nt, Human
gaccucgugauccgcccgccuc

SEQ ID NO: 1240588 - RNA, 22 nt, Human
gaccucgugauccgcccgccuc

SEQ ID NO: 1240589 - RNA, 24 nt, Human
gaccucgugauccgcccgccucgg

SEQ ID NO: 1240590 - RNA, 24 nt, Human
gagaugggguuucaccguguuagc

SEQ ID NO: 1240591 - RNA, 18 nt, Human
gcgcggccggagcagguc

SEQ ID NO: 1240592 - RNA, 18 nt, Human
gcggccggagcaggucug

SEQ ID NO: 1240593 - RNA, 22 nt, Human
gggguuucaccguguuagccag

SEQ ID NO: 1240594 - RNA, 20 nt, Human
ggucucgauauccugaccuc

SEQ ID NO: 1240595 - RNA, 26 nt, Human
gguggugggcgccgaugggagggaag

SEQ ID NO: 1240596 - RNA, 24 nt, Human
gugauccgcccgccucggccuucc

SEQ ID NO: 1240597 - RNA, 21 nt, Human
uaguagagaugggguuucacc

SEQ ID NO: 1240598 - RNA, 24 nt, Human
uaguagagaugggguuucaccgug

SEQ ID NO: 1240599 - RNA, 26 nt, Human
uaguagagaugggguuucaccguguu

SEQ ID NO: 1240600 - RNA, 24 nt, Human
ucaccguguuagccaggauggucu

SEQ ID NO: 1240601 - RNA, 28 nt, Human
ucgccgcccgggcuacugcugccgcucc

SEQ ID NO: 1240602 - RNA, 18 nt, Human
ucggccuuccaaagugcu

SEQ ID NO: 1240603 - RNA, 27 nt, Human
uggcgcgcgaggaacagguuggggugg

SEQ ID NO: 1240604 - RNA, 24 nt, Human
ugggguuucaccguguuagccagg

SEQ ID NO: 1240605 - RNA, 21 nt, Human
uguauuuuuaguagagauggg

SEQ ID NO: 1240606 - RNA, 18 nt, Human
uuaguagagaugggguuu

SEQ ID NO: 1240607 - RNA, 22 nt, Human
uuaguagagaugggguuucacc

SEQ ID NO: 1240608 - RNA, 24 nt, Human
uuaguagagaugggguuucaccgu

SEQ ID NO: 1240609 - RNA, 23 nt, Human
uuguauuuuuaguagagaugggg

SEQ ID NO: 1240610 - RNA, 19 nt, Human
uuucaccguguuagccagg

SEQ ID NO: 1240611 - RNA, 24 nt, Human
uuuuuaguagagaugggguuucac

SEQ ID NO: 1240612 - RNA, 21 nt, Human
uuuuuguauuuuuaguagaga

SEQ ID NO: 1240613 - RNA, 21 nt, Human
uuuuuuguauuuuuaguagag

SEQ ID NO: 1240614 - RNA, 24 nt, Human
uuuuuuguauuuuuaguagagaug

SEQ ID NO: 1240615 - RNA, 24 nt, Human
uuuuuuuuguauuuuuaguagaga

SEQ ID NO: 1240616 - RNA, 18 nt, Human
uuuuuuuuuuuuuuuuug

SEQ ID NO: 1240617 - RNA, 24 nt, Human
uuuuuuuuuuuuuuuuuguauuuu

SEQ ID NO: 1240618 - RNA, 21 nt, Human
aaaccaaaaaugucugcacac

SEQ ID NO: 1240619 - RNA, 22 nt, Human
aaggaaaaaaaaaguuuaaaaa

SEQ ID NO: 1240620 - RNA, 25 nt, Human
aaggaaaaaaaaaguuuaaaaaaaa

SEQ ID NO: 1240621 - RNA, 24 nt, Human
acagcagcaccaugagaaaaaagc

SEQ ID NO: 1240622 - RNA, 18 nt, Human
accaucuucuucccucca

SEQ ID NO: 1240623 - RNA, 21 nt, Human
accaucuucuucccuccaucc

SEQ ID NO: 1240624 - RNA, 21 nt, Human
agaaauuucagaggauuuaga

SEQ ID NO: 1240625 - RNA, 24 nt, Human
agaaauuucagaggauuuagacaa

SEQ ID NO: 1240626 - RNA, 23 nt, Human
aggaaaaaaaaaguuuaaaaaaa

SEQ ID NO: 1240627 - RNA, 24 nt, Human
aggaaaaaaaaaguuuaaaaaaaa

SEQ ID NO: 1240628 - RNA, 22 nt, Human
aggaagaggcuucucggccgcg

SEQ ID NO: 1240629 - RNA, 19 nt, Human
cagcaccaugagaaaaaag

SEQ ID NO: 1240630 - RNA, 26 nt, Human
cagcagcaccaugagaaaaaagcucu

SEQ ID NO: 1240631 - RNA, 22 nt, Human
ccauccaccaaaaaacuaaagu

SEQ ID NO: 1240632 - RNA, 18 nt, Human
cccuccauccaccaaaaa

SEQ ID NO: 1240633 - RNA, 22 nt, Human
cccucuugccgucgccgcgggu

SEQ ID NO: 1240634 - RNA, 18 nt, Human
ccgcggagccacuugggg

SEQ ID NO: 1240635 - RNA, 22 nt, Human
ccugaauucagaaggaaaaaaa

SEQ ID NO: 1240636 - RNA, 21 nt, Human
cggagccacuuggggccucag

SEQ ID NO: 1240637 - RNA, 23 nt, Human
cugcacacauggucccccaaaau

SEQ ID NO: 1240638 - RNA, 21 nt, Human
cuucucggccgcggagccacu

SEQ ID NO: 1240639 - RNA, 22 nt, Human
cuuggggccucaguucucgccc

SEQ ID NO: 1240640 - RNA, 18 nt, Human
gaaaaaagcucuccuucg

SEQ ID NO: 1240641 - RNA, 18 nt, Human
gccccaggaagaggcuuc

SEQ ID NO: 1240642 - RNA, 18 nt, Human
gccucaguucucgcccuc

SEQ ID NO: 1240643 - RNA, 21 nt, Human
gccucaguucucgcccucuug

SEQ ID NO: 1240644 - RNA, 23 nt, Human
gccucaguucucgcccucuugcc

SEQ ID NO: 1240645 - RNA, 19 nt, Human
ggcaucgcgguuccaacgg

SEQ ID NO: 1240646 - RNA, 22 nt, Human
uaacacagcagcaccaugagaa

SEQ ID NO: 1240647 - RNA, 22 nt, Human
uagacaaagcagguagauuaaa

SEQ ID NO: 1240648 - RNA, 23 nt, Human
ucacuaggcuaacacagcagcac

SEQ ID NO: 1240649 - RNA, 22 nt, Human
ugaauucagaaggaaaaaaaaa

SEQ ID NO: 1240650 - RNA, 20 nt, Human
ugagaaaaaagcucuccuuc

SEQ ID NO: 1240651 - RNA, 22 nt, Human
uggacaaaacacuuuacugcca

SEQ ID NO: 1240652 - RNA, 24 nt, Human
ugucugcacacauggucccccaaa

SEQ ID NO: 1240653 - RNA, 23 nt, Human
uuaaaaaaaaaccaaaaaugucu

SEQ ID NO: 1240654 - RNA, 22 nt, Human
uucagaaggaaaaaaaaaguuu

SEQ ID NO: 1240655 - RNA, 26 nt, Human
uucagaaggaaaaaaaaaguuuaaaa

SEQ ID NO: 1240656 - RNA, 24 nt, Human
uucucggccgcggagccacuuggg

SEQ ID NO: 1240657 - RNA, 19 nt, Human
aaaagccuugcagcauacc

SEQ ID NO: 1240658 - RNA, 21 nt, Human
aauaucacagaggaaaauuuc

SEQ ID NO: 1240659 - RNA, 19 nt, Human
acuuaucugaguuuacaca

SEQ ID NO: 1240660 - RNA, 23 nt, Human
acuuuggcccauucccccccacc

SEQ ID NO: 1240661 - RNA, 24 nt, Human
agggcugggauuucaggcuuaggu

SEQ ID NO: 1240662 - RNA, 21 nt, Human
auuucaggcuuaggucuucug

SEQ ID NO: 1240663 - RNA, 20 nt, Human
cuuccuuuccuggaagucau

SEQ ID NO: 1240664 - RNA, 20 nt, Human
cuugcagucuaaaauaucac

SEQ ID NO: 1240665 - RNA, 20 nt, Human
gacuuuggcccauucccccc

SEQ ID NO: 1240666 - RNA, 18 nt, Human
gcccauucccccccaccc

SEQ ID NO: 1240667 - RNA, 19 nt, Human
gcccauucccccccacccc

SEQ ID NO: 1240668 - RNA, 21 nt, Human
gcccuggaaccugcccucauu

SEQ ID NO: 1240669 - RNA, 25 nt, Human
gcccuggaaccugcccucauuucuu

SEQ ID NO: 1240670 - RNA, 18 nt, Human
ggagaagaggggaugacu

SEQ ID NO: 1240671 - RNA, 27 nt, Human
gggcacagguuugagcaguuccugagg

SEQ ID NO: 1240672 - RNA, 27 nt, Human
guuaggggcagggcugggauuucaggc

SEQ ID NO: 1240673 - RNA, 19 nt, Human
uaggucuucugguucccca

SEQ ID NO: 1240674 - RNA, 20 nt, Human
ucccagagaaaggugacuua

SEQ ID NO: 1240675 - RNA, 21 nt, Human
ugagcaguuccugaggagaag

SEQ ID NO: 1240676 - RNA, 24 nt, Human
ugcagucuaaaauaucacagagga

SEQ ID NO: 1240677 - RNA, 21 nt, Human
uggcccauucccccccacccc

SEQ ID NO: 1240678 - RNA, 23 nt, Human
uuauauaccaugcuuccuuuccu

SEQ ID NO: 1240679 - RNA, 21 nt, Human
uuggcccauucccccccaccc

SEQ ID NO: 1240680 - RNA, 20 nt, Human
uuucaggcccuggaaccuga

SEQ ID NO: 1240681 - RNA, 19 nt, Human
uuucaggcuuaggucuucu

SEQ ID NO: 1240682 - RNA, 26 nt, Human
uuuggcccauucccccccaccccuuu

SEQ ID NO: 1240683 - RNA, 23 nt, Human
aaaggagagaggguuaaggaaau

SEQ ID NO: 1240684 - RNA, 19 nt, Human
aaagugcugggauuacagg

SEQ ID NO: 1240685 - RNA, 24 nt, Human
aaagugcugggauuacaggcuuga

SEQ ID NO: 1240686 - RNA, 19 nt, Human
aacccaucuccugacucug

SEQ ID NO: 1240687 - RNA, 19 nt, Human
aaccuccaccuugcaaguu

SEQ ID NO: 1240688 - RNA, 20 nt, Human
aagaaggaagaaagcaugga

SEQ ID NO: 1240689 - RNA, 19 nt, Human
aagugcugggauuacaggc

SEQ ID NO: 1240690 - RNA, 19 nt, Human
aagugcugggauuacaggc

SEQ ID NO: 1240691 - RNA, 26 nt, Human
aagugcugggauuacaggcuugagcc

SEQ ID NO: 1240692 - RNA, 22 nt, Human
acagcccaggcagugacugaau

SEQ ID NO: 1240693 - RNA, 24 nt, Human
acuguguuggccaggcuggucuug

SEQ ID NO: 1240694 - RNA, 18 nt, Human
agaaagcauggaucugcu

SEQ ID NO: 1240695 - RNA, 19 nt, Human
agacaggguccugcuuccu

SEQ ID NO: 1240696 - RNA, 20 nt, Human
agaugaggggucaugggguu

SEQ ID NO: 1240697 - RNA, 22 nt, Human
agaugaggggucaugggguugg

SEQ ID NO: 1240698 - RNA, 18 nt, Human
agccuaggaaugccuggu

SEQ ID NO: 1240699 - RNA, 20 nt, Human
aggagguuuaaguaagaaaa

SEQ ID NO: 1240700 - RNA, 20 nt, Human
aggauacuggguuaaacaaa

SEQ ID NO: 1240701 - RNA, 18 nt, Human
aggcccagaaccacacag

SEQ ID NO: 1240702 - RNA, 19 nt, Human
aguagagaugggguuucac

SEQ ID NO: 1240703 - RNA, 23 nt, Human
aguagcugggacuacaggcaugu

SEQ ID NO: 1240704 - RNA, 18 nt, Human
agucaugauaauucaggc

SEQ ID NO: 1240705 - RNA, 21 nt, Human
agugcaguggcgugauuucag

SEQ ID NO: 1240706 - RNA, 23 nt, Human
agugcaguggcgugauuucagcu

SEQ ID NO: 1240707 - RNA, 24 nt, Human
agugcaguggcgugauuucagcuc

SEQ ID NO: 1240708 - RNA, 18 nt, Human
auaaaaugugugacuacc

SEQ ID NO: 1240709 - RNA, 24 nt, Human
auccaccugccacagccucccaaa

SEQ ID NO: 1240710 - RNA, 24 nt, Human
aucuaguugggcagcaaaaucugg

SEQ ID NO: 1240711 - RNA, 21 nt, Human
aucuggcuauuucuagaaaug

SEQ ID NO: 1240712 - RNA, 22 nt, Human
augccucagccucccgaguagc

SEQ ID NO: 1240713 - RNA, 21 nt, Human
augccuccuccugggucugac

SEQ ID NO: 1240714 - RNA, 23 nt, Human
augggguuucacuguguuggcca

SEQ ID NO: 1240715 - RNA, 24 nt, Human
augggguuucacuguguuggccag

SEQ ID NO: 1240716 - RNA, 24 nt, Human
caaagugcugggauuacaggcuug

SEQ ID NO: 1240717 - RNA, 20 nt, Human
caacugagcaguuguccccu

SEQ ID NO: 1240718 - RNA, 26 nt, Human
caacugagcaguuguccccuacaagc

SEQ ID NO: 1240719 - RNA, 23 nt, Human
caagucaguuucauuauggccaa

SEQ ID NO: 1240720 - RNA, 20 nt, Human
cacacagcccaggcagugac

SEQ ID NO: 1240721 - RNA, 24 nt, Human
cacacagcccaggcagugacugaa

SEQ ID NO: 1240722 - RNA, 24 nt, Human
caccacaccuggcuaauuuuugua

SEQ ID NO: 1240723 - RNA, 23 nt, Human
caccugccacagccucccaaagu

SEQ ID NO: 1240724 - RNA, 19 nt, Human
cacuguguuggccaggcug

SEQ ID NO: 1240725 - RNA, 21 nt, Human
cacuguguuggccaggcuggu

SEQ ID NO: 1240726 - RNA, 24 nt, Human
cacuguguuggccaggcuggucuu

SEQ ID NO: 1240727 - RNA, 21 nt, Human
cagaaaagaugaggggucaug

SEQ ID NO: 1240728 - RNA, 19 nt, Human
cagccuggagagcuggcaa

SEQ ID NO: 1240729 - RNA, 18 nt, Human
caggugauccaccugcca

SEQ ID NO: 1240730 - RNA, 21 nt, Human
cagugguuggggauggggagg

SEQ ID NO: 1240731 - RNA, 24 nt, Human
caugccucagccucccgaguagcu

SEQ ID NO: 1240732 - RNA, 23 nt, Human
cauggagcagggagacggaaucc

SEQ ID NO: 1240733 - RNA, 19 nt, Human
cauuauggccaauuuucua

SEQ ID NO: 1240734 - RNA, 19 nt, Human
ccaaagugcugggauuaca

SEQ ID NO: 1240735 - RNA, 20 nt, Human
ccaaagugcugggauuacag

SEQ ID NO: 1240736 - RNA, 22 nt, Human
ccaaagugcugggauuacaggc

SEQ ID NO: 1240737 - RNA, 23 nt, Human
ccaaagugcugggauuacaggcu

SEQ ID NO: 1240738 - RNA, 20 nt, Human
ccacagccucccaaagugcu

SEQ ID NO: 1240739 - RNA, 20 nt, Human
ccaccacaccuggcuaauuu

SEQ ID NO: 1240740 - RNA, 21 nt, Human
ccagucuggcuagaaucaccu

SEQ ID NO: 1240741 - RNA, 23 nt, Human
ccagucuggcuagaaucaccuga

SEQ ID NO: 1240742 - RNA, 24 nt, Human
cccaaagugcugggauuacaggcu

SEQ ID NO: 1240743 - RNA, 23 nt, Human
cccgaguagcugggacuacaggc

SEQ ID NO: 1240744 - RNA, 24 nt, Human
cccgaguagcugggacuacaggca

SEQ ID NO: 1240745 - RNA, 21 nt, Human
ccuacaagccacuaaagcccc

SEQ ID NO: 1240746 - RNA, 21 nt, Human
ccugaccucaggugauccacc

SEQ ID NO: 1240747 - RNA, 23 nt, Human
ccugaccucaggugauccaccug

SEQ ID NO: 1240748 - RNA, 27 nt, Human
ccugaccucaggugauccaccugccac

SEQ ID NO: 1240749 - RNA, 20 nt, Human
ccugggcaucuaggacaggg

SEQ ID NO: 1240750 - RNA, 23 nt, Human
cggccgacucucuaccagaaacu

SEQ ID NO: 1240751 - RNA, 21 nt, Human
cuaaaaccaggaggacagauc

SEQ ID NO: 1240752 - RNA, 21 nt, Human
cuagacccccauauccaagga

SEQ ID NO: 1240753 - RNA, 19 nt, Human
cucacuguaaccuccaccu

SEQ ID NO: 1240754 - RNA, 23 nt, Human
cucacuguaaccuccaccuugca

SEQ ID NO: 1240755 - RNA, 24 nt, Human
cucagccucccgaguagcugggac

SEQ ID NO: 1240756 - RNA, 24 nt, Human
cuccugacucuguggaaugccugc

SEQ ID NO: 1240757 - RNA, 19 nt, Human
cuccugggucugaccaucu

SEQ ID NO: 1240758 - RNA, 20 nt, Human
cuccugggucugaccaucug

SEQ ID NO: 1240759 - RNA, 24 nt, Human
cugccacagccucccaaagugcug

SEQ ID NO: 1240760 - RNA, 23 nt, Human
cuguaaccuccaccuugcaaguu

SEQ ID NO: 1240761 - RNA, 22 nt, Human
cuuuggcuaagccuaggaaugc

SEQ ID NO: 1240762 - RNA, 19 nt, Human
gaacagaugcaagauugcc

SEQ ID NO: 1240763 - RNA, 20 nt, Human
gaacauaaauaggaacaagu

SEQ ID NO: 1240764 - RNA, 22 nt, Human
gaccucaggugauccaccugcc

SEQ ID NO: 1240765 - RNA, 23 nt, Human
gacucuguggaaugccugcagag

SEQ ID NO: 1240766 - RNA, 24 nt, Human
gagaugggguuucacuguguuggc

SEQ ID NO: 1240767 - RNA, 22 nt, Human
gaggggucaugggguuggggag

SEQ ID NO: 1240768 - RNA, 20 nt, Human
gaguagcugggacuacaggc

SEQ ID NO: 1240769 - RNA, 25 nt, Human
gaguagcugggacuacaggcaugug

SEQ ID NO: 1240770 - RNA, 22 nt, Human
gauggaguggagugcaguggcg

SEQ ID NO: 1240771 - RNA, 21 nt, Human
gauggggagaggagagcuuug

SEQ ID NO: 1240772 - RNA, 18 nt, Human
gauuacaggcuugagcca

SEQ ID NO: 1240773 - RNA, 22 nt, Human
gauuacaggcuugagccagugc

SEQ ID NO: 1240774 - RNA, 23 nt, Human
gauuacaggcuugagccagugca

SEQ ID NO: 1240775 - RNA, 21 nt, Human
gauucucaugccucagccucc

SEQ ID NO: 1240776 - RNA, 20 nt, Human
gccucagccucccgaguagc

SEQ ID NO: 1240777 - RNA, 24 nt, Human
gcgauucucaugccucagccuccc

SEQ ID NO: 1240778 - RNA, 18 nt, Human
gcucauggacauauuuua

SEQ ID NO: 1240779 - RNA, 19 nt, Human
gcucucccacuuucuacuu

SEQ ID NO: 1240780 - RNA, 21 nt, Human
gcugggauuacaggcuugagc

SEQ ID NO: 1240781 - RNA, 23 nt, Human
gcuggucuugaacuccugaccuc

SEQ ID NO: 1240782 - RNA, 24 nt, Human
ggaaggcccagaaccacacagccc

SEQ ID NO: 1240783 - RNA, 19 nt, Human
ggacuacaggcaugugcca

SEQ ID NO: 1240784 - RNA, 19 nt, Human
ggcaaugccuccuccuggg

SEQ ID NO: 1240785 - RNA, 24 nt, Human
ggcuggucuugaacuccugaccuc

SEQ ID NO: 1240786 - RNA, 18 nt, Human
gggaaaugaccgaaggga

SEQ ID NO: 1240787 - RNA, 23 nt, Human
gggcaggaacauguuccaaaggc

SEQ ID NO: 1240788 - RNA, 24 nt, Human
gggcugccugccugugagggaccu

SEQ ID NO: 1240789 - RNA, 22 nt, Human
gggguuucacuguguuggccag

SEQ ID NO: 1240790 - RNA, 23 nt, Human
gggguuucacuguguuggccagg

SEQ ID NO: 1240791 - RNA, 19 nt, Human
ggucuugaacuccugaccu

SEQ ID NO: 1240792 - RNA, 18 nt, Human
guauuauaaaauggaauc

SEQ ID NO: 1240793 - RNA, 24 nt, Human
gugauccaccugccacagccuccc

SEQ ID NO: 1240794 - RNA, 18 nt, Human
guggagggcugccugccu

SEQ ID NO: 1240795 - RNA, 21 nt, Human
guggagggcugccugccugug

SEQ ID NO: 1240796 - RNA, 21 nt, Human
guuuaaguaagaaaauaugug

SEQ ID NO: 1240797 - RNA, 20 nt, Human
uaaaauggaaucaggaacau

SEQ ID NO: 1240798 - RNA, 20 nt, Human
uaaagcccccaaucuuuacc

SEQ ID NO: 1240799 - RNA, 27 nt, Human
uaaagcccccaaucuuuaccugugaac

SEQ ID NO: 1240800 - RNA, 22 nt, Human
uaaaucauggccaugcauuggg

SEQ ID NO: 1240801 - RNA, 24 nt, Human
uaauuuuuguauuauuaguagaga

SEQ ID NO: 1240802 - RNA, 22 nt, Human
uacagaauuuauguuagacagg

SEQ ID NO: 1240803 - RNA, 22 nt, Human
uacaggcaugugccaccacacc

SEQ ID NO: 1240804 - RNA, 19 nt, Human
uaccugugaacccaucucc

SEQ ID NO: 1240805 - RNA, 20 nt, Human
uacugaggggaaaugaccga

SEQ ID NO: 1240806 - RNA, 23 nt, Human
uagcagugguuggggauggggag

SEQ ID NO: 1240807 - RNA, 24 nt, Human
uaggacagggucuuuuaaccuguc

SEQ ID NO: 1240808 - RNA, 20 nt, Human
uaguagagaugggguuucac

SEQ ID NO: 1240809 - RNA, 24 nt, Human
uaguagagaugggguuucacugug

SEQ ID NO: 1240810 - RNA, 23 nt, Human
uauaaaauggaaucaggaacaua

SEQ ID NO: 1240811 - RNA, 18 nt, Human
ucacuguaaccuccaccu

SEQ ID NO: 1240812 - RNA, 18 nt, Human
ucacuguaaccuccaccu

SEQ ID NO: 1240813 - RNA, 20 nt, Human
ucacuguaaccuccaccuug

SEQ ID NO: 1240814 - RNA, 24 nt, Human
ucacuguaaccuccaccuugcaag

SEQ ID NO: 1240815 - RNA, 22 nt, Human
ucacuguguuggccaggcuggu

SEQ ID NO: 1240816 - RNA, 23 nt, Human
ucagccucccgaguagcugggac

SEQ ID NO: 1240817 - RNA, 21 nt, Human
ucaggaggugugucuucuggg

SEQ ID NO: 1240818 - RNA, 21 nt, Human
ucaggcagcucagcuccacag

SEQ ID NO: 1240819 - RNA, 24 nt, Human
ucccaaagugcugggauuacaggc

SEQ ID NO: 1240820 - RNA, 24 nt, Human
ucccgaguagcugggacuacaggc

SEQ ID NO: 1240821 - RNA, 20 nt, Human
ucgugcccaugcuccugccu

SEQ ID NO: 1240822 - RNA, 22 nt, Human
ucuaccagaaacuuuucuucca

SEQ ID NO: 1240823 - RNA, 21 nt, Human
ucuaugauggaguagggaggc

SEQ ID NO: 1240824 - RNA, 21 nt, Human
ucucaggaggugugucuucug

SEQ ID NO: 1240825 - RNA, 19 nt, Human
ucucccacuuucuacuuga

SEQ ID NO: 1240826 - RNA, 19 nt, Human
ucugcccaaccaacgaagu

SEQ ID NO: 1240827 - RNA, 23 nt, Human
ucuugaacuccugaccucaggug

SEQ ID NO: 1240828 - RNA, 23 nt, Human
ugacaccaaugaugauacugagg

SEQ ID NO: 1240829 - RNA, 19 nt, Human
ugaccucaggugauccacc

SEQ ID NO: 1240830 - RNA, 20 nt, Human
ugaccucaggugauccaccu

SEQ ID NO: 1240831 - RNA, 24 nt, Human
ugacucuaaugaagggagagguau

SEQ ID NO: 1240832 - RNA, 21 nt, Human
ugacugaauucuuccuaguca

SEQ ID NO: 1240833 - RNA, 20 nt, Human
ugagauggaguggagugcag

SEQ ID NO: 1240834 - RNA, 31 nt, Human
ugagcaaacagccuggagagcuggcaaugcu

SEQ ID NO: 1240835 - RNA, 26 nt, Human
ugcaacugagcaguuguccccuacaa

SEQ ID NO: 1240836 - RNA, 24 nt, Human
ugccacagccucccaaagugcugg

SEQ ID NO: 1240837 - RNA, 24 nt, Human
ugccucagccucccgaguagcugg

SEQ ID NO: 1240838 - RNA, 22 nt, Human
uggaaugccugcagaggcaugg

SEQ ID NO: 1240839 - RNA, 24 nt, Human
uggagagcuggcaaugccuccucc

SEQ ID NO: 1240840 - RNA, 23 nt, Human
uggagugcaguggcgugauuuca

SEQ ID NO: 1240841 - RNA, 24 nt, Human
uggagugcaguggcgugauuucag

SEQ ID NO: 1240842 - RNA, 24 nt, Human
uggccaggcuggucuugaacuccu

SEQ ID NO: 1240843 - RNA, 22 nt, Human
uggcggagaugaugacucuaau

SEQ ID NO: 1240844 - RNA, 24 nt, Human
uggcgugauuucagcucacuguaa

SEQ ID NO: 1240845 - RNA, 18 nt, Human
ugggacuacaggcaugug

SEQ ID NO: 1240846 - RNA, 21 nt, Human
ugggacuacaggcaugugcca

SEQ ID NO: 1240847 - RNA, 22 nt, Human
ugggacuacaggcaugugccac

SEQ ID NO: 1240848 - RNA, 24 nt, Human
ugggacuacaggcaugugccacca

SEQ ID NO: 1240849 - RNA, 18 nt, Human
ugggauuacaggcuugag

SEQ ID NO: 1240850 - RNA, 19 nt, Human
ugggauuacaggcuugagc

SEQ ID NO: 1240851 - RNA, 21 nt, Human
ugggauuacaggcuugagcca

SEQ ID NO: 1240852 - RNA, 31 nt, Human
ugggauuacaggcuugagccagugcacccgg

SEQ ID NO: 1240853 - RNA, 20 nt, Human
uggggauggggagaggagag

SEQ ID NO: 1240854 - RNA, 24 nt, Human
uggggauggggagaggagagcuuu

SEQ ID NO: 1240855 - RNA, 24 nt, Human
ugggguuucacuguguuggccagg

SEQ ID NO: 1240856 - RNA, 20 nt, Human
uggucccuggagccacuccc

SEQ ID NO: 1240857 - RNA, 18 nt, Human
ugguuggggauggggaga

SEQ ID NO: 1240858 - RNA, 19 nt, Human
ugguuggggauggggagag

SEQ ID NO: 1240859 - RNA, 23 nt, Human
uguaaaucauggccaugcauugg

SEQ ID NO: 1240860 - RNA, 24 nt, Human
uguauuauaaaauggaaucaggaa

SEQ ID NO: 1240861 - RNA, 20 nt, Human
ugugugacuaccugauuccu

SEQ ID NO: 1240862 - RNA, 24 nt, Human
uguguuggccaggcuggucuugaa

SEQ ID NO: 1240863 - RNA, 23 nt, Human
uuaaugauccuuccaaguucaga

SEQ ID NO: 1240864 - RNA, 18 nt, Human
uuaguagagaugggguuu

SEQ ID NO: 1240865 - RNA, 21 nt, Human
uuaguagagaugggguuucac

SEQ ID NO: 1240866 - RNA, 21 nt, Human
uuaguagagaugggguuucac

SEQ ID NO: 1240867 - RNA, 24 nt, Human
uuaguagagaugggguuucacugu

SEQ ID NO: 1240868 - RNA, 24 nt, Human
uuauuaguagagaugggguuucac

SEQ ID NO: 1240869 - RNA, 22 nt, Human
uuccaauaugaaggaagcaugg

SEQ ID NO: 1240870 - RNA, 24 nt, Human
uuucacuguguuggccaggcuggu

SEQ ID NO: 1240871 - RNA, 20 nt, Human
uuuuuguauuauuaguagag

SEQ ID NO: 1240872 - RNA, 23 nt, Human
uuuuuguauuauuaguagagaug

SEQ ID NO: 1240873 - RNA, 24 nt, Human
aaaaaagaaaaccaaaguggucca

SEQ ID NO: 1240874 - RNA, 24 nt, Human
aaaaaguacugauuuuaaaaacua

SEQ ID NO: 1240875 - RNA, 23 nt, Human
aaaaccaaagugguccacaaaac

SEQ ID NO: 1240876 - RNA, 18 nt, Human
aaacaaacaguucugaga

SEQ ID NO: 1240877 - RNA, 20 nt, Human
aaagaaaaccaaaguggucc

SEQ ID NO: 1240878 - RNA, 24 nt, Human
aacaguucugagaccauucuucca

SEQ ID NO: 1240879 - RNA, 21 nt, Human
aacuuuuuuaacaggucucaa

SEQ ID NO: 1240880 - RNA, 24 nt, Human
aagaaaaccaaagugguccacaaa

SEQ ID NO: 1240881 - RNA, 21 nt, Human
accacaugcaaaaaagaaaac

SEQ ID NO: 1240882 - RNA, 20 nt, Human
acccaguguguaagccagaa

SEQ ID NO: 1240883 - RNA, 23 nt, Human
acguucacgcucagcuuucaguu

SEQ ID NO: 1240884 - RNA, 24 nt, Human
auaccaguuucaaauucgccaaca

SEQ ID NO: 1240885 - RNA, 19 nt, Human
caacaccagcagcaaccau

SEQ ID NO: 1240886 - RNA, 22 nt, Human
caaccaucaggacagcacagcc

SEQ ID NO: 1240887 - RNA, 18 nt, Human
caaggagauaucaauggu

SEQ ID NO: 1240888 - RNA, 22 nt, Human
caccagcagcaaccaucaggac

SEQ ID NO: 1240889 - RNA, 21 nt, Human
cagcaaccaucaggacagcac

SEQ ID NO: 1240890 - RNA, 19 nt, Human
cagcacagccugagauguc

SEQ ID NO: 1240891 - RNA, 23 nt, Human
cagccuccuucucaaauuuuuca

SEQ ID NO: 1240892 - RNA, 26 nt, Human
caugcaaaaaagaaaaccaaaguggu

SEQ ID NO: 1240893 - RNA, 23 nt, Human
ccacugauuaagaguuggguggc

SEQ ID NO: 1240894 - RNA, 22 nt, Human
ccagaagggcaugcucucaggu

SEQ ID NO: 1240895 - RNA, 24 nt, Human
ccaguagugguggacuugcccgaa

SEQ ID NO: 1240896 - RNA, 18 nt, Human
ccaguuucaaauucgcca

SEQ ID NO: 1240897 - RNA, 21 nt, Human
ccaguuucaaauucgccaaca

SEQ ID NO: 1240898 - RNA, 23 nt, Human
ccaguuucaaauucgccaacacc

SEQ ID NO: 1240899 - RNA, 23 nt, Human
cguucacgcucagcuuucaguuu

SEQ ID NO: 1240900 - RNA, 19 nt, Human
cucaggucugcccauucuu

SEQ ID NO: 1240901 - RNA, 26 nt, Human
cugagaugucccuguaaucauguuuu

SEQ ID NO: 1240902 - RNA, 22 nt, Human
gaaaaaaaagccauuuucccau

SEQ ID NO: 1240903 - RNA, 19 nt, Human
gaguccuuucccaucucag

SEQ ID NO: 1240904 - RNA, 22 nt, Human
gcaaccaucaggacagcacagc

SEQ ID NO: 1240905 - RNA, 23 nt, Human
gccaccacauuuguaggucagau

SEQ ID NO: 1240906 - RNA, 24 nt, Human
ggaguccuuucccaucucagcagc

SEQ ID NO: 1240907 - RNA, 25 nt, Human
ggguggcagguauuagggauaauau

SEQ ID NO: 1240908 - RNA, 25 nt, Human
gucaaguuguuuccauuaaaaagua

SEQ ID NO: 1240909 - RNA, 21 nt, Human
guucuuuugucgaugccacca

SEQ ID NO: 1240910 - RNA, 20 nt, Human
guuucaaauucgccaacacc

SEQ ID NO: 1240911 - RNA, 23 nt, Human
uaaaacuaccacaugcaaaaaag

SEQ ID NO: 1240912 - RNA, 24 nt, Human
uaacaggucucaaaauucugugac

SEQ ID NO: 1240913 - RNA, 23 nt, Human
uaagccagaagggcaugcucuca

SEQ ID NO: 1240914 - RNA, 24 nt, Human
uaauaacuuaaaacuaccacaugc

SEQ ID NO: 1240915 - RNA, 23 nt, Human
uaccacaugcaaaaaagaaaacc

SEQ ID NO: 1240916 - RNA, 21 nt, Human
uaccacguucacgcucagcuu

SEQ ID NO: 1240917 - RNA, 20 nt, Human
ucaauggugauaccacguuc

SEQ ID NO: 1240918 - RNA, 21 nt, Human
ucacaacaccuguguucuggu

SEQ ID NO: 1240919 - RNA, 23 nt, Human
ucaggacagcacagccugagaug

SEQ ID NO: 1240920 - RNA, 23 nt, Human
uccacaaaacauucuccuuuccu

SEQ ID NO: 1240921 - RNA, 27 nt, Human
ucccaucucagcagccuccuucucaaa

SEQ ID NO: 1240922 - RNA, 19 nt, Human
ucgaugccaccacauuugu

SEQ ID NO: 1240923 - RNA, 18 nt, Human
ucuuuugucgaugccacc

SEQ ID NO: 1240924 - RNA, 18 nt, Human
ugagaccauucuuccacc

SEQ ID NO: 1240925 - RNA, 24 nt, Human
ugcaaaaaagaaaaccaaaguggu

SEQ ID NO: 1240926 - RNA, 23 nt, Human
ugcauuguuaucauuaaccaguc

SEQ ID NO: 1240927 - RNA, 24 nt, Human
ugcauuguuaucauuaaccagucu

SEQ ID NO: 1240928 - RNA, 19 nt, Human
ugcccgaauuuacgugucc

SEQ ID NO: 1240929 - RNA, 22 nt, Human
uggcagguauuagggauaauau

SEQ ID NO: 1240930 - RNA, 24 nt, Human
uggcuuuuagggguaguuuucaca

SEQ ID NO: 1240931 - RNA, 22 nt, Human
ugguccacaaaacauucuccuu

SEQ ID NO: 1240932 - RNA, 23 nt, Human
ugguggacuugcccgaauuuacg

SEQ ID NO: 1240933 - RNA, 21 nt, Human
ugugggaaaaaaaagccauuu

SEQ ID NO: 1240934 - RNA, 21 nt, Human
uguucugguggcaaacccauu

SEQ ID NO: 1240935 - RNA, 24 nt, Human
uuaaacuuuuuuaacaggucucaa

SEQ ID NO: 1240936 - RNA, 24 nt, Human
uuaaauggccaauugaaacaaaca

SEQ ID NO: 1240937 - RNA, 26 nt, Human
uucacuacuaaacuuaaaagguuuuc

SEQ ID NO: 1240938 - RNA, 18 nt, Human
uuccaccacugauuaaga

SEQ ID NO: 1240939 - RNA, 22 nt, Human
uucccauuuuggcuuuuagggg

SEQ ID NO: 1240940 - RNA, 23 nt, Human
uucuccuuuccuucugaagguuu

SEQ ID NO: 1240941 - RNA, 21 nt, Human
uugaugaagucucugaguccu

SEQ ID NO: 1240942 - RNA, 20 nt, Human
uuucaaauucgccaacacca

SEQ ID NO: 1240943 - RNA, 26 nt, Human
uuucccauuuuggcuuuuaggggaag

SEQ ID NO: 1240944 - RNA, 20 nt, Human
aaagcugcucaaaagauucu

SEQ ID NO: 1240945 - RNA, 22 nt, Human
acacccagcacaugcaggaaac

SEQ ID NO: 1240946 - RNA, 23 nt, Human
acccuguguccugaacacagucc

SEQ ID NO: 1240947 - RNA, 19 nt, Human
acgcaggaaggugccucuc

SEQ ID NO: 1240948 - RNA, 22 nt, Human
acuccccugccuuccucucccu

SEQ ID NO: 1240949 - RNA, 19 nt, Human
agcccagugccaaggcacg

SEQ ID NO: 1240950 - RNA, 20 nt, Human
agcugcagagcagguugaac

SEQ ID NO: 1240951 - RNA, 19 nt, Human
aggugccucucuagcccag

SEQ ID NO: 1240952 - RNA, 19 nt, Human
caaaagcugcucaaaagau

SEQ ID NO: 1240953 - RNA, 22 nt, Human
caaacucuuaucuuggcaaaca

SEQ ID NO: 1240954 - RNA, 24 nt, Human
caaacucuuaucuuggcaaacacu

SEQ ID NO: 1240955 - RNA, 26 nt, Human
caaaugauacuugcuuuuccuucuug

SEQ ID NO: 1240956 - RNA, 28 nt, Human
cacaggauucacgcaggaagggacauac

SEQ ID NO: 1240957 - RNA, 22 nt, Human
cacaugcaggaaaccaaauuca

SEQ ID NO: 1240958 - RNA, 18 nt, Human
caccagcagcgcaugggc

SEQ ID NO: 1240959 - RNA, 20 nt, Human
cagcaccacaggccuggggu

SEQ ID NO: 1240960 - RNA, 22 nt, Human
cagcaccgggggucagagaaaa

SEQ ID NO: 1240961 - RNA, 18 nt, Human
cagcaggacaugaacaga

SEQ ID NO: 1240962 - RNA, 19 nt, Human
caggagaugccugguccac

SEQ ID NO: 1240963 - RNA, 24 nt, Human
caguggaggcuggacgugaccccg

SEQ ID NO: 1240964 - RNA, 19 nt, Human
caugcagggccugugcgug

SEQ ID NO: 1240965 - RNA, 21 nt, Human
caugcagggccugugcguggc

SEQ ID NO: 1240966 - RNA, 20 nt, Human
ccaccucuggguccaggccu

SEQ ID NO: 1240967 - RNA, 20 nt, Human
ccaggaagggcaggagagug

SEQ ID NO: 1240968 - RNA, 22 nt, Human
ccaguggaggcuggacgugacc

SEQ ID NO: 1240969 - RNA, 23 nt, Human
cccacacccagcacaugcaggaa

SEQ ID NO: 1240970 - RNA, 18 nt, Human
cccacagaaaaacagaac

SEQ ID NO: 1240971 - RNA, 21 nt, Human
cccccaggccacugagacccc

SEQ ID NO: 1240972 - RNA, 25 nt, Human
ccccgcccacacccagcacaugcag

SEQ ID NO: 1240973 - RNA, 23 nt, Human
ccccggcuggaacccaaaggggc

SEQ ID NO: 1240974 - RNA, 18 nt, Human
cccggcuggaacccaaag

SEQ ID NO: 1240975 - RNA, 20 nt, Human
cccugccuuccucucccucc

SEQ ID NO: 1240976 - RNA, 22 nt, Human
cccuguguccugaacacagucc

SEQ ID NO: 1240977 - RNA, 29 nt, Human
ccgcccacacccagcacaugcaggaaacc

SEQ ID NO: 1240978 - RNA, 20 nt, Human
ccuccagagacggagacaag

SEQ ID NO: 1240979 - RNA, 24 nt, Human
ccucuguagcacugaguaacgcuc

SEQ ID NO: 1240980 - RNA, 19 nt, Human
ccucuuggaaacagggagg

SEQ ID NO: 1240981 - RNA, 23 nt, Human
ccugccucuaggauucuuucucu

SEQ ID NO: 1240982 - RNA, 24 nt, Human
ccugccucuaggauucuuucucuc

SEQ ID NO: 1240983 - RNA, 18 nt, Human
ccuuccucucccuccuuc

SEQ ID NO: 1240984 - RNA, 19 nt, Human
ccuuccucucccuccuucc

SEQ ID NO: 1240985 - RNA, 23 nt, Human
ccuuuuccucuuucucuuguccc

SEQ ID NO: 1240986 - RNA, 21 nt, Human
cgcccacacccagcacaugca

SEQ ID NO: 1240987 - RNA, 20 nt, Human
cuacugaguaacuacuacgu

SEQ ID NO: 1240988 - RNA, 19 nt, Human
cuccccugccuuccucucc

SEQ ID NO: 1240989 - RNA, 20 nt, Human
cucuuggaaacagggaggcu

SEQ ID NO: 1240990 - RNA, 21 nt, Human
cugcagcaccacaggccuggg

SEQ ID NO: 1240991 - RNA, 24 nt, Human
cuggcacaggaccagcaccggggg

SEQ ID NO: 1240992 - RNA, 18 nt, Human
cugugcguggccccgccc

SEQ ID NO: 1240993 - RNA, 19 nt, Human
cuucuucccaggucacagg

SEQ ID NO: 1240994 - RNA, 20 nt, Human
cuuugcucugggcacccaga

SEQ ID NO: 1240995 - RNA, 19 nt, Human
gagcagguugaacgggcca

SEQ ID NO: 1240996 - RNA, 20 nt, Human
gagcagguugaacgggccac

SEQ ID NO: 1240997 - RNA, 18 nt, Human
gaggccccaaaccaccag

SEQ ID NO: 1240998 - RNA, 19 nt, Human
gaggcuauuuauagcagcu

SEQ ID NO: 1240999 - RNA, 20 nt, Human
gagggacuggaaacguggug

SEQ ID NO: 1241000 - RNA, 18 nt, Human
gcagcgcaugggcaccag

SEQ ID NO: 1241001 - RNA, 19 nt, Human
gccccaaaccaccagcagc

SEQ ID NO: 1241002 - RNA, 19 nt, Human
gccccaaaccaccagcagc

SEQ ID NO: 1241003 - RNA, 24 nt, Human
gccucuaggauucuuucucuccca

SEQ ID NO: 1241004 - RNA, 23 nt, Human
gcuucuucccaggucacaggugg

SEQ ID NO: 1241005 - RNA, 24 nt, Human
ggaaacagggaggcuauuuauagc

SEQ ID NO: 1241006 - RNA, 21 nt, Human
ggaagggcaggagaguggagc

SEQ ID NO: 1241007 - RNA, 24 nt, Human
ggaccagcaccgggggucagagaa

SEQ ID NO: 1241008 - RNA, 22 nt, Human
ggaguccucccaugcagggccu

SEQ ID NO: 1241009 - RNA, 22 nt, Human
ggucuguggggcuugaucuggu

SEQ ID NO: 1241010 - RNA, 24 nt, Human
guacuccaaaugauacuugcuuuu

SEQ ID NO: 1241011 - RNA, 21 nt, Human
guggccccgcccacacccagc

SEQ ID NO: 1241012 - RNA, 19 nt, Human
uaaaguacaguggcuccuu

SEQ ID NO: 1241013 - RNA, 21 nt, Human
uaaaguacaguggcuccuuuu

SEQ ID NO: 1241014 - RNA, 20 nt, Human
uacuacgugcuggcacagga

SEQ ID NO: 1241015 - RNA, 21 nt, Human
uagaacguuguacugguccuc

SEQ ID NO: 1241016 - RNA, 18 nt, Human
ucaagacagaacauagug

SEQ ID NO: 1241017 - RNA, 27 nt, Human
ucagcaaaccucuacugaguaacuacc

SEQ ID NO: 1241018 - RNA, 19 nt, Human
ucccaggucacagguggcc

SEQ ID NO: 1241019 - RNA, 23 nt, Human
ucccccaggccacugagacccca

SEQ ID NO: 1241020 - RNA, 18 nt, Human
uccccugccuuccucucc

SEQ ID NO: 1241021 - RNA, 23 nt, Human
ucgcuucuucccaggucacaggu

SEQ ID NO: 1241022 - RNA, 26 nt, Human
ucucuuguccccuucucaagacagaa

SEQ ID NO: 1241023 - RNA, 26 nt, Human
ucuuaucuuggcaaacacugugguuc

SEQ ID NO: 1241024 - RNA, 21 nt, Human
ucuuggcaaacacugugguuc

SEQ ID NO: 1241025 - RNA, 23 nt, Human
ugcaaaauaaaguacaguggcuc

SEQ ID NO: 1241026 - RNA, 19 nt, Human
ugcagcaccacaggccugg

SEQ ID NO: 1241027 - RNA, 25 nt, Human
ugcagcaccacaggccuggggugag

SEQ ID NO: 1241028 - RNA, 18 nt, Human
ugccugguccaccucugg

SEQ ID NO: 1241029 - RNA, 23 nt, Human
ugccugguccaccucugggucca

SEQ ID NO: 1241030 - RNA, 18 nt, Human
ugcgcacaggauucacgc

SEQ ID NO: 1241031 - RNA, 23 nt, Human
uggaggcuggacgugaccccggc

SEQ ID NO: 1241032 - RNA, 23 nt, Human
uggcacaggaccagcaccggggg

SEQ ID NO: 1241033 - RNA, 20 nt, Human
uggcccagcuuugcucuggg

SEQ ID NO: 1241034 - RNA, 19 nt, Human
uggggacgugugcaucucc

SEQ ID NO: 1241035 - RNA, 19 nt, Human
uguguccugaacacagucc

SEQ ID NO: 1241036 - RNA, 24 nt, Human
uucccccaggccacugagaccccc

SEQ ID NO: 1241037 - RNA, 21 nt, Human
uuugcucugggcacccagaca

SEQ ID NO: 1241038 - RNA, 24 nt, Human
uuugcucugggcacccagacaccc

SEQ ID NO: 1241039 - RNA, 23 nt, Human
aaaaaagcacaaaaauagaaaau

SEQ ID NO: 1241040 - RNA, 19 nt, Human
aaaaguaguuuuagacaaa

SEQ ID NO: 1241041 - RNA, 24 nt, Human
aaaauaaauugucuuuuucuuuuu

SEQ ID NO: 1241042 - RNA, 23 nt, Human
aaacaacacggccuuccucagcc

SEQ ID NO: 1241043 - RNA, 22 nt, Human
aaagagaaagaaacugcaaaag

SEQ ID NO: 1241044 - RNA, 22 nt, Human
aaagagaucuaggaaauaaguc

SEQ ID NO: 1241045 - RNA, 19 nt, Human
aaagauaggaaggagggaa

SEQ ID NO: 1241046 - RNA, 18 nt, Human
aaagggaccucacaggua

SEQ ID NO: 1241047 - RNA, 24 nt, Human
aaagugcugggauuauaggucuga

SEQ ID NO: 1241048 - RNA, 19 nt, Human
aaaugccuguuugggauuc

SEQ ID NO: 1241049 - RNA, 19 nt, Human
aaaugccuguuugggauuc

SEQ ID NO: 1241050 - RNA, 24 nt, Human
aacaacacggccuuccucagccuc

SEQ ID NO: 1241051 - RNA, 18 nt, Human
aacacaccugacacagga

SEQ ID NO: 1241052 - RNA, 21 nt, Human
aacugcaaaagguggcaaaug

SEQ ID NO: 1241053 - RNA, 18 nt, Human
aagaaagagaucuaggaa

SEQ ID NO: 1241054 - RNA, 24 nt, Human
aagaagggccuaccagcgaaggga

SEQ ID NO: 1241055 - RNA, 22 nt, Human
aagcuuccagcaucuacaacuc

SEQ ID NO: 1241056 - RNA, 18 nt, Human
aagugcugggauuauagg

SEQ ID NO: 1241057 - RNA, 26 nt, Human
aagugcugggauuauaggucugagcc

SEQ ID NO: 1241058 - RNA, 24 nt, Human
aaguggacuuacaauaaauaaaac

SEQ ID NO: 1241059 - RNA, 24 nt, Human
aauuugcuguauuuuuaguagaga

SEQ ID NO: 1241060 - RNA, 19 nt, Human
acaccugacacaggagccc

SEQ ID NO: 1241061 - RNA, 21 nt, Human
acaccugacacaggagcccca

SEQ ID NO: 1241062 - RNA, 21 nt, Human
acagaacauucuccaggauag

SEQ ID NO: 1241063 - RNA, 19 nt, Human
acagugcuggggggacaua

SEQ ID NO: 1241064 - RNA, 18 nt, Human
accaguggcuggauauuc

SEQ ID NO: 1241065 - RNA, 18 nt, Human
accauguuggccaggccg

SEQ ID NO: 1241066 - RNA, 19 nt, Human
acuacagcccaacuacauu

SEQ ID NO: 1241067 - RNA, 18 nt, Human
acuccuggguuguuuugg

SEQ ID NO: 1241068 - RNA, 20 nt, Human
acuuauggaaagagaaagaa

SEQ ID NO: 1241069 - RNA, 26 nt, Human
acuuguggccuugcauagccaguggc

SEQ ID NO: 1241070 - RNA, 18 nt, Human
agaacgugcauucuucuc

SEQ ID NO: 1241071 - RNA, 20 nt, Human
agacaaaaaggaaggcuuga

SEQ ID NO: 1241072 - RNA, 19 nt, Human
agacaaacaacacggccuu

SEQ ID NO: 1241073 - RNA, 19 nt, Human
agagggggugucuggagcc

SEQ ID NO: 1241074 - RNA, 19 nt, Human
agauaggaaggagggaagg

SEQ ID NO: 1241075 - RNA, 20 nt, Human
agauaggaaggagggaaggu

SEQ ID NO: 1241076 - RNA, 23 nt, Human
agcugcuaagcagaggaaaacuu

SEQ ID NO: 1241077 - RNA, 23 nt, Human
aggaggauuguuuauuuuaggua

SEQ ID NO: 1241078 - RNA, 19 nt, Human
aggcagaaaaguaacagac

SEQ ID NO: 1241079 - RNA, 22 nt, Human
aggcagaaaaguaacagaccag

SEQ ID NO: 1241080 - RNA, 23 nt, Human
aggcagaaaaguaacagaccaga

SEQ ID NO: 1241081 - RNA, 24 nt, Human
aggucugagccaccaucacaccca

SEQ ID NO: 1241082 - RNA, 24 nt, Human
aggugauccacccaccuuggacuc

SEQ ID NO: 1241083 - RNA, 24 nt, Human
agugcugggauuauaggucugagc

SEQ ID NO: 1241084 - RNA, 19 nt, Human
aucaugcuuaagaaggcug

SEQ ID NO: 1241085 - RNA, 21 nt, Human
auggaaagagaaagaaacugc

SEQ ID NO: 1241086 - RNA, 18 nt, Human
augggguuucaccauguu

SEQ ID NO: 1241087 - RNA, 22 nt, Human
augggguuucaccauguuggcc

SEQ ID NO: 1241088 - RNA, 20 nt, Human
auucauaccugacuaggauc

SEQ ID NO: 1241089 - RNA, 18 nt, Human
caaagugcugggauuaua

SEQ ID NO: 1241090 - RNA, 21 nt, Human
caacagacacacccucuaggc

SEQ ID NO: 1241091 - RNA, 21 nt, Human
caauguaaacacaccugacac

SEQ ID NO: 1241092 - RNA, 20 nt, Human
caccaguggcuggauauucc

SEQ ID NO: 1241093 - RNA, 18 nt, Human
caccauguuggccaggcc

SEQ ID NO: 1241094 - RNA, 21 nt, Human
caccauguuggccaggccggu

SEQ ID NO: 1241095 - RNA, 24 nt, Human
caccauguuggccaggccggucuc

SEQ ID NO: 1241096 - RNA, 27 nt, Human
caccauguuggccaggccggucucaaa

SEQ ID NO: 1241097 - RNA, 22 nt, Human
cacccaccuuggacucccaaag

SEQ ID NO: 1241098 - RNA, 23 nt, Human
cacccaccuuggacucccaaagu

SEQ ID NO: 1241099 - RNA, 18 nt, Human
cacuacaacuacagccca

SEQ ID NO: 1241100 - RNA, 24 nt, Human
cagcggaaggggcagcaaugucug

SEQ ID NO: 1241101 - RNA, 21 nt, Human
cagugccgggcccauggugcc

SEQ ID NO: 1241102 - RNA, 24 nt, Human
caugcuuaagaaggcuggggaaag

SEQ ID NO: 1241103 - RNA, 24 nt, Human
cauguuggccaggccggucucaaa

SEQ ID NO: 1241104 - RNA, 18 nt, Human
ccaaagugcugggauuau

SEQ ID NO: 1241105 - RNA, 20 nt, Human
ccaaagugcugggauuauag

SEQ ID NO: 1241106 - RNA, 22 nt, Human
ccaaagugcugggauuauaggu

SEQ ID NO: 1241107 - RNA, 20 nt, Human
ccaccacgcccagcuaauuu

SEQ ID NO: 1241108 - RNA, 18 nt, Human
ccaccaucacacccagcc

SEQ ID NO: 1241109 - RNA, 20 nt, Human
ccagcaucuacaacucuagu

SEQ ID NO: 1241110 - RNA, 22 nt, Human
ccaguuguucaaaauaaaccuc

SEQ ID NO: 1241111 - RNA, 19 nt, Human
cccaccuuggacucccaaa

SEQ ID NO: 1241112 - RNA, 27 nt, Human
ccucacacaaacaaaauaugcuggaau

SEQ ID NO: 1241113 - RNA, 24 nt, Human
ccugaccucaggugauccacccac

SEQ ID NO: 1241114 - RNA, 18 nt, Human
ccuucauccuugcucugg

SEQ ID NO: 1241115 - RNA, 21 nt, Human
ccuugccuguuacuuuucuug

SEQ ID NO: 1241116 - RNA, 20 nt, Human
ccuugccuugccuguuacuu

SEQ ID NO: 1241117 - RNA, 19 nt, Human
cgccugaggagcagcuucc

SEQ ID NO: 1241118 - RNA, 24 nt, Human
cgugaugggcuggugacaugcauc

SEQ ID NO: 1241119 - RNA, 22 nt, Human
cugagccaccaucacacccagc

SEQ ID NO: 1241120 - RNA, 18 nt, Human
cuguaggcaagggaaaga

SEQ ID NO: 1241121 - RNA, 23 nt, Human
cuguauuuuuaguagagaugggg

SEQ ID NO: 1241122 - RNA, 19 nt, Human
cuguggugacugaagaagg

SEQ ID NO: 1241123 - RNA, 21 nt, Human
gacacauuauuuucuauguuc

SEQ ID NO: 1241124 - RNA, 19 nt, Human
gacaggucacauaaucuag

SEQ ID NO: 1241125 - RNA, 23 nt, Human
gaccucaggugauccacccaccu

SEQ ID NO: 1241126 - RNA, 18 nt, Human
gagaugggguuucaccau

SEQ ID NO: 1241127 - RNA, 24 nt, Human
gagaugggguuucaccauguuggc

SEQ ID NO: 1241128 - RNA, 21 nt, Human
gagcauagcacaacuuguggc

SEQ ID NO: 1241129 - RNA, 24 nt, Human
gagcccauuccuuuggccuuggcu

SEQ ID NO: 1241130 - RNA, 19 nt, Human
gaggugccacagcucaaaa

SEQ ID NO: 1241131 - RNA, 19 nt, Human
gagguuccaguccuucuac

SEQ ID NO: 1241132 - RNA, 21 nt, Human
gauuauaggucugagccacca

SEQ ID NO: 1241133 - RNA, 22 nt, Human
gcagaacgugcauucuucucau

SEQ ID NO: 1241134 - RNA, 18 nt, Human
gcagcggaaggggcagca

SEQ ID NO: 1241135 - RNA, 23 nt, Human
gccggucucaaacuccugaccuc

SEQ ID NO: 1241136 - RNA, 23 nt, Human
gcuuccagcaucuacaacucuag

SEQ ID NO: 1241137 - RNA, 22 nt, Human
ggcaagggaaagauaggaagga

SEQ ID NO: 1241138 - RNA, 21 nt, Human
ggcacaaguggcaauggcugu

SEQ ID NO: 1241139 - RNA, 24 nt, Human
ggccggucucaaacuccugaccuc

SEQ ID NO: 1241140 - RNA, 19 nt, Human
gggcacaaguggcaauggc

SEQ ID NO: 1241141 - RNA, 22 nt, Human
gggguuucaccauguuggccag

SEQ ID NO: 1241142 - RNA, 18 nt, Human
ggguuucaccauguuggc

SEQ ID NO: 1241143 - RNA, 23 nt, Human
guagagaugggguuucaccaugu

SEQ ID NO: 1241144 - RNA, 24 nt, Human
gugauccacccaccuuggacuccc

SEQ ID NO: 1241145 - RNA, 21 nt, Human
guuucccuccuagacuuucuu

SEQ ID NO: 1241146 - RNA, 24 nt, Human
uaaacacaccugacacaggagccc

SEQ ID NO: 1241147 - RNA, 19 nt, Human
uaaauaaaacaaaagcagc

SEQ ID NO: 1241148 - RNA, 20 nt, Human
uaagucaaaaaagcacaaaa

SEQ ID NO: 1241149 - RNA, 23 nt, Human
uaaguggacuuacaauaaauaaa

SEQ ID NO: 1241150 - RNA, 22 nt, Human
uaauagcuggggacuccaacac

SEQ ID NO: 1241151 - RNA, 23 nt, Human
uaauugcauauuuauuuuuaaau

SEQ ID NO: 1241152 - RNA, 24 nt, Human
uaauuugcuguauuuuuaguagag

SEQ ID NO: 1241153 - RNA, 22 nt, Human
uacaauaaauaaaacaaaagca

SEQ ID NO: 1241154 - RNA, 20 nt, Human
uaccagcgaagggacuccau

SEQ ID NO: 1241155 - RNA, 24 nt, Human
uacuuuucuuggagugaauaauug

SEQ ID NO: 1241156 - RNA, 22 nt, Human
uagacaaacaacacggccuucc

SEQ ID NO: 1241157 - RNA, 26 nt, Human
uagacaaacaacacggccuuccucag

SEQ ID NO: 1241158 - RNA, 22 nt, Human
uagagaugggguuucaccaugu

SEQ ID NO: 1241159 - RNA, 23 nt, Human
uagcuggggacuccaacacccac

SEQ ID NO: 1241160 - RNA, 18 nt, Human
uaggaaggagggaaggug

SEQ ID NO: 1241161 - RNA, 25 nt, Human
uaggccacaaaacaaaucucaaaag

SEQ ID NO: 1241162 - RNA, 24 nt, Human
uaguagagaugggguuucaccaug

SEQ ID NO: 1241163 - RNA, 26 nt, Human
uaguagagaugggguuucaccauguu

SEQ ID NO: 1241164 - RNA, 18 nt, Human
ucaaagaggugccacagc

SEQ ID NO: 1241165 - RNA, 23 nt, Human
ucacacaaacaaaauaugcugga

SEQ ID NO: 1241166 - RNA, 19 nt, Human
ucagcaagaagguaggaca

SEQ ID NO: 1241167 - RNA, 19 nt, Human
ucaguagguguagucccag

SEQ ID NO: 1241168 - RNA, 22 nt, Human
ucaguggauucgcauccaaaaa

SEQ ID NO: 1241169 - RNA, 24 nt, Human
ucauuugcuuucaaaugauucaga

SEQ ID NO: 1241170 - RNA, 25 nt, Human
uccaaaaagcugagcauuaaacaaa

SEQ ID NO: 1241171 - RNA, 23 nt, Human
ucccaaagugcugggauuauagg

SEQ ID NO: 1241172 - RNA, 21 nt, Human
uccucagccucuaccugaguc

SEQ ID NO: 1241173 - RNA, 22 nt, Human
uccuggguuguuuugggaggag

SEQ ID NO: 1241174 - RNA, 19 nt, Human
uccuuuggccuuggcuucu

SEQ ID NO: 1241175 - RNA, 18 nt, Human
ucuaggaaauaagucacc

SEQ ID NO: 1241176 - RNA, 28 nt, Human
ucuguaaccgguggccaaaccggggucc

SEQ ID NO: 1241177 - RNA, 22 nt, Human
ugaaauuccauagucuugugcc

SEQ ID NO: 1241178 - RNA, 24 nt, Human
ugaagaauuccaaucuucaaaaaa

SEQ ID NO: 1241179 - RNA, 20 nt, Human
ugacacaggagccccaguua

SEQ ID NO: 1241180 - RNA, 20 nt, Human
ugacacuuuaggcuacuguu

SEQ ID NO: 1241181 - RNA, 21 nt, Human
ugaccucaggugauccaccca

SEQ ID NO: 1241182 - RNA, 24 nt, Human
ugaccucaggugauccacccaccu

SEQ ID NO: 1241183 - RNA, 24 nt, Human
ugauccacccaccuuggacuccca

SEQ ID NO: 1241184 - RNA, 20 nt, Human
ugccacagcucaaaaguaga

SEQ ID NO: 1241185 - RNA, 18 nt, Human
ugccggcauuaagaauca

SEQ ID NO: 1241186 - RNA, 23 nt, Human
uggaagagggggugucuggagcc

SEQ ID NO: 1241187 - RNA, 20 nt, Human
uggaucugaagauucaaaga

SEQ ID NO: 1241188 - RNA, 24 nt, Human
uggccaggccggucucaaacuccu

SEQ ID NO: 1241189 - RNA, 19 nt, Human
uggcuaaauacggacauuu

SEQ ID NO: 1241190 - RNA, 18 nt, Human
ugggauuauaggucugag

SEQ ID NO: 1241191 - RNA, 21 nt, Human
ugggauuauaggucugagcca

SEQ ID NO: 1241192 - RNA, 22 nt, Human
ugggauuauaggucugagccac

SEQ ID NO: 1241193 - RNA, 24 nt, Human
ugggauuauaggucugagccacca

SEQ ID NO: 1241194 - RNA, 25 nt, Human
ugggauuauaggucugagccaccau

SEQ ID NO: 1241195 - RNA, 24 nt, Human
ugggguuucaccauguuggccagg

SEQ ID NO: 1241196 - RNA, 22 nt, Human
ugucuggagcccauuccuuugg

SEQ ID NO: 1241197 - RNA, 21 nt, Human
ugucuuuuucuuuuuuuuccu

SEQ ID NO: 1241198 - RNA, 23 nt, Human
ugugaagaagugagauucgauga

SEQ ID NO: 1241199 - RNA, 24 nt, Human
uguggugacugaagaagggccuac

SEQ ID NO: 1241200 - RNA, 25 nt, Human
uguucaaaauaaaccucuaaaugau

SEQ ID NO: 1241201 - RNA, 22 nt, Human
uguuuucauuugcuuucaaaug

SEQ ID NO: 1241202 - RNA, 25 nt, Human
uuaagaaggcuggggaaagaguaac

SEQ ID NO: 1241203 - RNA, 18 nt, Human
uuacaaugagaacuuuug

SEQ ID NO: 1241204 - RNA, 20 nt, Human
uuacaaugagaacuuuuguu

SEQ ID NO: 1241205 - RNA, 18 nt, Human
uuaguagagaugggguuu

SEQ ID NO: 1241206 - RNA, 22 nt, Human
uuaguagagaugggguuucacc

SEQ ID NO: 1241207 - RNA, 24 nt, Human
uuaguagagaugggguuucaccau

SEQ ID NO: 1241208 - RNA, 21 nt, Human
uuauaggucugagccaccauc

SEQ ID NO: 1241209 - RNA, 23 nt, Human
uucaugaauggcaggcauccugu

SEQ ID NO: 1241210 - RNA, 31 nt, Human
uuccuuuggccuuggcuucucaaacagccuu

SEQ ID NO: 1241211 - RNA, 23 nt, Human
uugccuguuacuuuucuuggagu

SEQ ID NO: 1241212 - RNA, 19 nt, Human
uuggacucccaaagugcug

SEQ ID NO: 1241213 - RNA, 24 nt, Human
uuucaccauguuggccaggccggu

SEQ ID NO: 1241214 - RNA, 24 nt, Human
uuugcuguauuuuuaguagagaug

SEQ ID NO: 1241215 - RNA, 24 nt, Human
uuuuuaguagagaugggguuucac

SEQ ID NO: 1241216 - RNA, 18 nt, Human
uuuuuguaaguggacuua

SEQ ID NO: 1241217 - RNA, 19 nt, Human
aauguguccccuacaaugu

SEQ ID NO: 1241218 - RNA, 21 nt, Human
acuaccgucuacugaagggcu

SEQ ID NO: 1241219 - RNA, 20 nt, Human
aggaaaaacagguuuuagaa

SEQ ID NO: 1241220 - RNA, 21 nt, Human
aggcaaaagugaaaauacauc

SEQ ID NO: 1241221 - RNA, 22 nt, Human
aggcaaaagugaaaauacaucc

SEQ ID NO: 1241222 - RNA, 21 nt, Human
agguuuuagaaauuacauacu

SEQ ID NO: 1241223 - RNA, 20 nt, Human
auacuugguaaagaagaacc

SEQ ID NO: 1241224 - RNA, 22 nt, Human
caccacucagcagccaaggacu

SEQ ID NO: 1241225 - RNA, 22 nt, Human
caccagaaggccugcgggcucc

SEQ ID NO: 1241226 - RNA, 26 nt, Human
caggacuaaaaaaucaggacuucuuc

SEQ ID NO: 1241227 - RNA, 23 nt, Human
cauacuugguaaagaagaaccag

SEQ ID NO: 1241228 - RNA, 21 nt, Human
ccagcggcugacauuucccag

SEQ ID NO: 1241229 - RNA, 18 nt, Human
ccccggaccccagacuca

SEQ ID NO: 1241230 - RNA, 18 nt, Human
ccgccacagcuguccagg

SEQ ID NO: 1241231 - RNA, 22 nt, Human
ccgcccgcuuccgccuccccgc

SEQ ID NO: 1241232 - RNA, 20 nt, Human
ccgccugcucucggccccgg

SEQ ID NO: 1241233 - RNA, 18 nt, Human
ccgcuuccgccuccccgc

SEQ ID NO: 1241234 - RNA, 19 nt, Human
ccggguccccucucuuucc

SEQ ID NO: 1241235 - RNA, 27 nt, Human
ccuuguaaauuaggcaaaagugaaaau

SEQ ID NO: 1241236 - RNA, 23 nt, Human
cgcagcggcggccacucgggguc

SEQ ID NO: 1241237 - RNA, 21 nt, Human
cgcucagagacgacagcgcug

SEQ ID NO: 1241238 - RNA, 21 nt, Human
cuacugucaccacucagcagc

SEQ ID NO: 1241239 - RNA, 18 nt, Human
cucggccccggaccccag

SEQ ID NO: 1241240 - RNA, 19 nt, Human
cucggggucugccgggucc

SEQ ID NO: 1241241 - RNA, 20 nt, Human
cuucuucaaguuucucacua

SEQ ID NO: 1241242 - RNA, 20 nt, Human
gaaaggaaaauccgucuaca

SEQ ID NO: 1241243 - RNA, 24 nt, Human
gaagaaccaggacuaaaaaaucag

SEQ ID NO: 1241244 - RNA, 20 nt, Human
gcagcggcggccacucgggg

SEQ ID NO: 1241245 - RNA, 18 nt, Human
gccccggaccccagacuc

SEQ ID NO: 1241246 - RNA, 21 nt, Human
gcucucggccccggaccccag

SEQ ID NO: 1241247 - RNA, 21 nt, Human
ggcaaaagugaaaauacaucc

SEQ ID NO: 1241248 - RNA, 21 nt, Human
ggguccccucucuuuccgccu

SEQ ID NO: 1241249 - RNA, 18 nt, Human
gucuggacgggaccggga

SEQ ID NO: 1241250 - RNA, 23 nt, Human
uaaagaagaaccaggacuaaaaa

SEQ ID NO: 1241251 - RNA, 23 nt, Human
ucggggucugccggguccccucu

SEQ ID NO: 1241252 - RNA, 22 nt, Human
ucuacuaggaaagaauagaggu

SEQ ID NO: 1241253 - RNA, 19 nt, Human
ucugccggguccccucucu

SEQ ID NO: 1241254 - RNA, 24 nt, Human
ucugccggguccccucucuuuccg

SEQ ID NO: 1241255 - RNA, 20 nt, Human
ucuggacgggaccgggaaac

SEQ ID NO: 1241256 - RNA, 25 nt, Human
ugcucucggccccggaccccagacu

SEQ ID NO: 1241257 - RNA, 24 nt, Human
uggaccaauaaauauuaaaaauua

SEQ ID NO: 1241258 - RNA, 18 nt, Human
ugggccccgcagcggcgg

SEQ ID NO: 1241259 - RNA, 19 nt, Human
uguccagguucugggaucc

SEQ ID NO: 1241260 - RNA, 20 nt, Human
uguggaccaauaaauauuaa

SEQ ID NO: 1241261 - RNA, 21 nt, Human
uuacauacuugguaaagaaga

SEQ ID NO: 1241262 - RNA, 20 nt, Human
uuaggcucaccguccgaucu

SEQ ID NO: 1241263 - RNA, 23 nt, Human
uuaguagagaaugaggauaacuu

SEQ ID NO: 1241264 - RNA, 22 nt, Human
uugggccccgcagcggcggcca

SEQ ID NO: 1241265 - RNA, 24 nt, Human
uuuuaaacaauguguccccuacaa

SEQ ID NO: 1241266 - RNA, 24 nt, Human
aagucaagaguggcaauaggucua

SEQ ID NO: 1241267 - RNA, 20 nt, Human
aagucaaugaagucccugag

SEQ ID NO: 1241268 - RNA, 23 nt, Human
acuccacugucuuggcauuggcu

SEQ ID NO: 1241269 - RNA, 20 nt, Human
acugucuuggcauuggcugg

SEQ ID NO: 1241270 - RNA, 22 nt, Human
caaaaacugcacaguccccagg

SEQ ID NO: 1241271 - RNA, 27 nt, Human
caauaggucuauuuucucccucagcuc

SEQ ID NO: 1241272 - RNA, 21 nt, Human
caugagaagcauguaggccuc

SEQ ID NO: 1241273 - RNA, 19 nt, Human
ccacuccacugucuuggca

SEQ ID NO: 1241274 - RNA, 20 nt, Human
ccacugagcaagauuuucug

SEQ ID NO: 1241275 - RNA, 19 nt, Human
ccauggcaccugguaucac

SEQ ID NO: 1241276 - RNA, 23 nt, Human
cugaagacugguuggcucccucu

SEQ ID NO: 1241277 - RNA, 18 nt, Human
gaagagcuacuaaauuuu

SEQ ID NO: 1241278 - RNA, 19 nt, Human
ggcauuggcuggauguagc

SEQ ID NO: 1241279 - RNA, 22 nt, Human
guaggccuccuuuaggacaucc

SEQ ID NO: 1241280 - RNA, 18 nt, Human
guucucuucuuuucuuag

SEQ ID NO: 1241281 - RNA, 25 nt, Human
uaaguauaauucuagcugugggguu

SEQ ID NO: 1241282 - RNA, 18 nt, Human
uagaagaaagaauuucag

SEQ ID NO: 1241283 - RNA, 23 nt, Human
uagcugugggguuuucacagacg

SEQ ID NO: 1241284 - RNA, 18 nt, Human
uaggacauccacagucuc

SEQ ID NO: 1241285 - RNA, 18 nt, Human
uaguuaaaacuuccccua

SEQ ID NO: 1241286 - RNA, 20 nt, Human
ucaaaaacugcacagucccc

SEQ ID NO: 1241287 - RNA, 30 nt, Human
ucaagaguggcaauaggucuauuuucuccu

SEQ ID NO: 1241288 - RNA, 23 nt, Human
ucagccaucuugcucugccuucc

SEQ ID NO: 1241289 - RNA, 20 nt, Human
uccacugucuuggcauuggc

SEQ ID NO: 1241290 - RNA, 19 nt, Human
uccccaggggaaaauucuc

SEQ ID NO: 1241291 - RNA, 20 nt, Human
uccccuacagaagauauaau

SEQ ID NO: 1241292 - RNA, 23 nt, Human
ucugaaagugcuuucuugugugg

SEQ ID NO: 1241293 - RNA, 18 nt, Human
ucuugaacuuagaagaaa

SEQ ID NO: 1241294 - RNA, 21 nt, Human
ugagcaagauuuucuggauga

SEQ ID NO: 1241295 - RNA, 20 nt, Human
ugcuggaggguucuauucag

SEQ ID NO: 1241296 - RNA, 24 nt, Human
uggcucccucugggaaggagugac

SEQ ID NO: 1241297 - RNA, 27 nt, Human
uggcuggauguagccguugaauuuuca

SEQ ID NO: 1241298 - RNA, 23 nt, Human
ugugggguuuucacagacgccuu

SEQ ID NO: 1241299 - RNA, 21 nt, Human
uguucuugaacuuagaagaaa

SEQ ID NO: 1241300 - RNA, 21 nt, Human
uuuccagucccacuccacugu

SEQ ID NO: 1241301 - RNA, 18 nt, Human
uuucucccucagcucuug

SEQ ID NO: 1241302 - RNA, 19 nt, Human
accucugaguugucuuuga

SEQ ID NO: 1241303 - RNA, 22 nt, Human
ccucugaguugucuuugagaug

SEQ ID NO: 1241304 - RNA, 24 nt, Human
aaaaaaaaaaaaaaagacagaaaa

SEQ ID NO: 1241305 - RNA, 19 nt, Human
aaacagacacagaaaaauc

SEQ ID NO: 1241306 - RNA, 22 nt, Human
aacaccugacccugcuaacacc

SEQ ID NO: 1241307 - RNA, 23 nt, Human
aacaccuugaucuaacccugcua

SEQ ID NO: 1241308 - RNA, 21 nt, Human
aaccauauuuggaaacagggu

SEQ ID NO: 1241309 - RNA, 26 nt, Human
aacccugcuaacaccugacccugcua

SEQ ID NO: 1241310 - RNA, 23 nt, Human
aagaagaggagauuaagacagaa

SEQ ID NO: 1241311 - RNA, 27 nt, Human
aagacaaaaaccaugagaaaagccaga

SEQ ID NO: 1241312 - RNA, 20 nt, Human
aagacagaaacaugcaaaga

SEQ ID NO: 1241313 - RNA, 21 nt, Human
aagacagaaacaugcaaagau

SEQ ID NO: 1241314 - RNA, 25 nt, Human
aagaguuaauuaagguaaaggaggu

SEQ ID NO: 1241315 - RNA, 23 nt, Human
aaucugauaaaagacaaaaacca

SEQ ID NO: 1241316 - RNA, 25 nt, Human
acaaaaaaaaaaaaaaagacagaaa

SEQ ID NO: 1241317 - RNA, 27 nt, Human
acagaaaauuauaguuaacacuggaga

SEQ ID NO: 1241318 - RNA, 20 nt, Human
accauauuuggaaacagggu

SEQ ID NO: 1241319 - RNA, 20 nt, Human
accuucagcuucccaggcuc

SEQ ID NO: 1241320 - RNA, 21 nt, Human
agacagaaaauuauaguuaac

SEQ ID NO: 1241321 - RNA, 23 nt, Human
aggaagauuaucagacacaaaau

SEQ ID NO: 1241322 - RNA, 19 nt, Human
auaaaagacaaaaaccaug

SEQ ID NO: 1241323 - RNA, 20 nt, Human
aucugauaaaagacaaaaac

SEQ ID NO: 1241324 - RNA, 19 nt, Human
augagaaaagccagaagug

SEQ ID NO: 1241325 - RNA, 22 nt, Human
caaguucuaaagccccccaccc

SEQ ID NO: 1241326 - RNA, 24 nt, Human
cacagacacugugugggauauccu

SEQ ID NO: 1241327 - RNA, 25 nt, Human
caccuugaucuuggacuuccagccc

SEQ ID NO: 1241328 - RNA, 21 nt, Human
cagaggaagaggccauccaga

SEQ ID NO: 1241329 - RNA, 23 nt, Human
cagcccccagaauuguaagaaaa

SEQ ID NO: 1241330 - RNA, 25 nt, Human
cauuuuuguccugaugccuugagag

SEQ ID NO: 1241331 - RNA, 24 nt, Human
ccccaaccuucagcuucccaggcu

SEQ ID NO: 1241332 - RNA, 24 nt, Human
cccccaaccuucagcuucccaggc

SEQ ID NO: 1241333 - RNA, 20 nt, Human
cccccagaauuguaagaaaa

SEQ ID NO: 1241334 - RNA, 25 nt, Human
cccuucaccacuguuguucgaguuc

SEQ ID NO: 1241335 - RNA, 20 nt, Human
ccucugaguguugggggagg

SEQ ID NO: 1241336 - RNA, 21 nt, Human
ccuucagcuucccaggcucau

SEQ ID NO: 1241337 - RNA, 23 nt, Human
cggcccccaaccuucagcuuccc

SEQ ID NO: 1241338 - RNA, 18 nt, Human
cuaaagccccccacccca

SEQ ID NO: 1241339 - RNA, 22 nt, Human
cuaaagccccccaccccaauaa

SEQ ID NO: 1241340 - RNA, 24 nt, Human
cuaacaccugacccugcuaacacc

SEQ ID NO: 1241341 - RNA, 22 nt, Human
cucaugcugagaauuucccuuc

SEQ ID NO: 1241342 - RNA, 23 nt, Human
cuugaucuaacccugcuaacacc

SEQ ID NO: 1241343 - RNA, 24 nt, Human
gaagaggccauccagaagcccagg

SEQ ID NO: 1241344 - RNA, 20 nt, Human
gaagcauugaggaaaggaag

SEQ ID NO: 1241345 - RNA, 24 nt, Human
gaguguugggggaggccccuucuc

SEQ ID NO: 1241346 - RNA, 20 nt, Human
gauggagaaguaagaaggga

SEQ ID NO: 1241347 - RNA, 18 nt, Human
gccccccaccccaauaac

SEQ ID NO: 1241348 - RNA, 21 nt, Human
gccccccaccccaauaacuca

SEQ ID NO: 1241349 - RNA, 23 nt, Human
uaaacagacacagaaaaaucagg

SEQ ID NO: 1241350 - RNA, 24 nt, Human
uaaacagacacagaaaaaucagga

SEQ ID NO: 1241351 - RNA, 23 nt, Human
uaaagccccccaccccaauaacu

SEQ ID NO: 1241352 - RNA, 22 nt, Human
uaaaguuucauuaaugcuucuc

SEQ ID NO: 1241353 - RNA, 22 nt, Human
uaacccugcuaacaccugaccc

SEQ ID NO: 1241354 - RNA, 22 nt, Human
uaacuucagaagcaauuuccug

SEQ ID NO: 1241355 - RNA, 18 nt, Human
uacaaaaaaaaaaaaaaa

SEQ ID NO: 1241356 - RNA, 23 nt, Human
uacaaaaaaaaaaaaaaagacag

SEQ ID NO: 1241357 - RNA, 18 nt, Human
uacaguaacuucagaagc

SEQ ID NO: 1241358 - RNA, 22 nt, Human
uagcagugauuauugcagcuaa

SEQ ID NO: 1241359 - RNA, 18 nt, Human
uaggauacaaaaaaaaaa

SEQ ID NO: 1241360 - RNA, 21 nt, Human
uaggauacaaaaaaaaaaaaa

SEQ ID NO: 1241361 - RNA, 20 nt, Human
uaguuaacacuggagauuuu

SEQ ID NO: 1241362 - RNA, 18 nt, Human
uauccuaaggaugcaggg

SEQ ID NO: 1241363 - RNA, 21 nt, Human
ucaugaggacuuaggauacaa

SEQ ID NO: 1241364 - RNA, 22 nt, Human
uccagaagcccaggagagggcc

SEQ ID NO: 1241365 - RNA, 18 nt, Human
ucuaaagccccccacccc

SEQ ID NO: 1241366 - RNA, 18 nt, Human
ucuaacccugcuaacacc

SEQ ID NO: 1241367 - RNA, 19 nt, Human
ucugaaguccacugugccc

SEQ ID NO: 1241368 - RNA, 21 nt, Human
ugagaaaagccagaagugaga

SEQ ID NO: 1241369 - RNA, 22 nt, Human
ugagaggaugagauauucuaaa

SEQ ID NO: 1241370 - RNA, 18 nt, Human
ugcaaagauggaagacga

SEQ ID NO: 1241371 - RNA, 21 nt, Human
ugccacagacacuguguggga

SEQ ID NO: 1241372 - RNA, 18 nt, Human
uggacuuccagcccccag

SEQ ID NO: 1241373 - RNA, 21 nt, Human
uggagaaguaagaagggacaa

SEQ ID NO: 1241374 - RNA, 22 nt, Human
uguggacaccagaggaagaggc

SEQ ID NO: 1241375 - RNA, 19 nt, Human
uguucaggucaccuaguug

SEQ ID NO: 1241376 - RNA, 26 nt, Human
uguuuuauuuugcuauagcagcccua

SEQ ID NO: 1241377 - RNA, 25 nt, Human
uuaacacuggagauuuuuguuuagu

SEQ ID NO: 1241378 - RNA, 21 nt, Human
uuuuuuauuuauucauuuuug

SEQ ID NO: 1241379 - RNA, 24 nt, Human
aacgcccccgugaagacacagcca

SEQ ID NO: 1241380 - RNA, 18 nt, Human
aagcagguuugcaggggg

SEQ ID NO: 1241381 - RNA, 23 nt, Human
acccaugcuggacccuggucucc

SEQ ID NO: 1241382 - RNA, 23 nt, Human
acggugacuuccucugugccucu

SEQ ID NO: 1241383 - RNA, 18 nt, Human
acuccaggaacgcccccg

SEQ ID NO: 1241384 - RNA, 24 nt, Human
acuccaggaacgcccccgugaagg

SEQ ID NO: 1241385 - RNA, 23 nt, Human
caggauggcuccagggcugggga

SEQ ID NO: 1241386 - RNA, 25 nt, Human
caggauggcuccagggcuggggaca

SEQ ID NO: 1241387 - RNA, 24 nt, Human
cagggcuggggacaaagacagggu

SEQ ID NO: 1241388 - RNA, 28 nt, Human
cauggccucagggacggugacuuccucu

SEQ ID NO: 1241389 - RNA, 18 nt, Human
ccaggaacgcccccguga

SEQ ID NO: 1241390 - RNA, 19 nt, Human
cccgugaagacacagccau

SEQ ID NO: 1241391 - RNA, 23 nt, Human
ccugggccgcccccgccgucugc

SEQ ID NO: 1241392 - RNA, 18 nt, Human
cugugcugaaacccaugc

SEQ ID NO: 1241393 - RNA, 19 nt, Human
gaacgcccccgugaagaca

SEQ ID NO: 1241394 - RNA, 19 nt, Human
gcccccgccgucugcugug

SEQ ID NO: 1241395 - RNA, 18 nt, Human
ggacaaagacagggucag

SEQ ID NO: 1241396 - RNA, 21 nt, Human
gggccgcccccgccgucugcu

SEQ ID NO: 1241397 - RNA, 22 nt, Human
gucugcugugcugaaacccaug

SEQ ID NO: 1241398 - RNA, 26 nt, Human
gugaagacacagccauacauggccuc

SEQ ID NO: 1241399 - RNA, 25 nt, Human
uccaggaacgcccccgugaagacac

SEQ ID NO: 1241400 - RNA, 24 nt, Human
ucccagccgggacaggccgggguc

SEQ ID NO: 1241401 - RNA, 18 nt, Human
ucccgguucacccacucc

SEQ ID NO: 1241402 - RNA, 18 nt, Human
ugacuuccucugugccuc

SEQ ID NO: 1241403 - RNA, 23 nt, Human
uggacggccaagccugaggucag

SEQ ID NO: 1241404 - RNA, 22 nt, Human
uggucucccgaacuccgacgcu

SEQ ID NO: 1241405 - RNA, 18 nt, Human
uuccagaucccgggcgcc

SEQ ID NO: 1241406 - RNA, 19 nt, Human
aagcagaggugaccugucc

SEQ ID NO: 1241407 - RNA, 25 nt, Human
accuguccguaggaacucucagaac

SEQ ID NO: 1241408 - RNA, 21 nt, Human
agaaauguacacuuuaugccc

SEQ ID NO: 1241409 - RNA, 21 nt, Human
agaggugaccuguccguagga

SEQ ID NO: 1241410 - RNA, 18 nt, Human
aggaauucucagaacauc

SEQ ID NO: 1241411 - RNA, 19 nt, Human
cagcaggcgagccccucgg

SEQ ID NO: 1241412 - RNA, 19 nt, Human
caucauacuggcacacacc

SEQ ID NO: 1241413 - RNA, 21 nt, Human
caucccagggcccagugacag

SEQ ID NO: 1241414 - RNA, 18 nt, Human
cccaccucugcugcugug

SEQ ID NO: 1241415 - RNA, 21 nt, Human
ccccucgguggcaucacagcc

SEQ ID NO: 1241416 - RNA, 24 nt, Human
ccugccuguaggaauucucagaac

SEQ ID NO: 1241417 - RNA, 23 nt, Human
cugguaggggacucagugugugc

SEQ ID NO: 1241418 - RNA, 21 nt, Human
cugugauauguccccccaccu

SEQ ID NO: 1241419 - RNA, 24 nt, Human
gcccauaaagccugcauuucuacc

SEQ ID NO: 1241420 - RNA, 19 nt, Human
ggggacucagugugugcag

SEQ ID NO: 1241421 - RNA, 19 nt, Human
gguggcaucacagccgggg

SEQ ID NO: 1241422 - RNA, 23 nt, Human
ucuucuauggaaagcagagguug

SEQ ID NO: 1241423 - RNA, 20 nt, Human
ugaaaggggcugguagggga

SEQ ID NO: 1241424 - RNA, 20 nt, Human
uggaaagcagaggugaccug

SEQ ID NO: 1241425 - RNA, 24 nt, Human
uggaagggacgauugugaccaggu

SEQ ID NO: 1241426 - RNA, 21 nt, Human
uguggagucuugcgcauccca

SEQ ID NO: 1241427 - RNA, 18 nt, Human
uuuauuuagaaauguaca

SEQ ID NO: 1241428 - RNA, 19 nt, Human
ugacaaaggcccucgucaa

SEQ ID NO: 1241429 - RNA, 22 nt, Human
ugugcagcuuccgugaugcagu

SEQ ID NO: 1241430 - RNA, 22 nt, Human
aagaagaguaauaaucuacagg

SEQ ID NO: 1241431 - RNA, 20 nt, Human
aauugcuuccuuucuuaacc

SEQ ID NO: 1241432 - RNA, 21 nt, Human
caaaugguucaguguaauuaa

SEQ ID NO: 1241433 - RNA, 22 nt, Human
cagcgaacaacucccaaagcuu

SEQ ID NO: 1241434 - RNA, 19 nt, Human
ccaaaauuuucuccagaag

SEQ ID NO: 1241435 - RNA, 26 nt, Human
ccagccgccucccucuggcguucucu

SEQ ID NO: 1241436 - RNA, 22 nt, Human
ccgccgggccagccgccucccu

SEQ ID NO: 1241437 - RNA, 19 nt, Human
cugagagccugccgccggg

SEQ ID NO: 1241438 - RNA, 21 nt, Human
gaacaacucccaaagcuugca

SEQ ID NO: 1241439 - RNA, 26 nt, Human
gaagauccaaaauuuucuccagaaga

SEQ ID NO: 1241440 - RNA, 26 nt, Human
gaagauggugaaggguaagggugugg

SEQ ID NO: 1241441 - RNA, 19 nt, Human
gagcagggcagggacagcg

SEQ ID NO: 1241442 - RNA, 18 nt, Human
gcaucaugagacacuuuu

SEQ ID NO: 1241443 - RNA, 19 nt, Human
uagcagagcagggcaggga

SEQ ID NO: 1241444 - RNA, 19 nt, Human
uauucugccaaucccuuuc

SEQ ID NO: 1241445 - RNA, 18 nt, Human
ucaguguaauuaauugcu

SEQ ID NO: 1241446 - RNA, 24 nt, Human
ucccuagcagagcagggcagggac

SEQ ID NO: 1241447 - RNA, 19 nt, Human
ucccucuggcguucucucc

SEQ ID NO: 1241448 - RNA, 18 nt, Human
ugaccacuuugggauuuu

SEQ ID NO: 1241449 - RNA, 22 nt, Human
uuaauugcuuccuuucuuaacc

SEQ ID NO: 1241450 - RNA, 23 nt, Human
uuuugauggcaucaugagacacu

SEQ ID NO: 1241451 - RNA, 20 nt, Human
aaccucucccuccuuccacu

SEQ ID NO: 1241452 - RNA, 21 nt, Human
aaccucucccuccuuccacug

SEQ ID NO: 1241453 - RNA, 23 nt, Human
aacuuguuccucuuuuucacuuu

SEQ ID NO: 1241454 - RNA, 20 nt, Human
aagugagaauaugugguauu

SEQ ID NO: 1241455 - RNA, 19 nt, Human
acaacaccucaagauuggu

SEQ ID NO: 1241456 - RNA, 19 nt, Human
accacauuuucuuuaucca

SEQ ID NO: 1241457 - RNA, 21 nt, Human
agaggagagaguguauaaacu

SEQ ID NO: 1241458 - RNA, 21 nt, Human
aguguaauucuuuguagccua

SEQ ID NO: 1241459 - RNA, 19 nt, Human
aguuugauuccuugucuuu

SEQ ID NO: 1241460 - RNA, 20 nt, Human
aguuugauuccuugucuuug

SEQ ID NO: 1241461 - RNA, 22 nt, Human
cacuuccuuuuuugguuaaaug

SEQ ID NO: 1241462 - RNA, 23 nt, Human
cacuuccuuuuuugguuaaaugg

SEQ ID NO: 1241463 - RNA, 19 nt, Human
ccuuccacuguccucccuc

SEQ ID NO: 1241464 - RNA, 19 nt, Human
cucccuccuuccacugucc

SEQ ID NO: 1241465 - RNA, 21 nt, Human
cuggaagauggcucucuucgu

SEQ ID NO: 1241466 - RNA, 19 nt, Human
cuguucccauguuaguuuu

SEQ ID NO: 1241467 - RNA, 20 nt, Human
cuucgugugugaugcucuuc

SEQ ID NO: 1241468 - RNA, 21 nt, Human
gaacuuguuccucuuuuucac

SEQ ID NO: 1241469 - RNA, 22 nt, Human
gcucccacuuuuaagugagaau

SEQ ID NO: 1241470 - RNA, 18 nt, Human
gugagaauaugugguauu

SEQ ID NO: 1241471 - RNA, 19 nt, Human
guuauguuuuaaaccugca

SEQ ID NO: 1241472 - RNA, 19 nt, Human
uaagugagaauauguggua

SEQ ID NO: 1241473 - RNA, 23 nt, Human
uaagugagaauaugugguauuug

SEQ ID NO: 1241474 - RNA, 22 nt, Human
ucccagagaauggcacaacacc

SEQ ID NO: 1241475 - RNA, 22 nt, Human
ucccuccuuccacuguccuccc

SEQ ID NO: 1241476 - RNA, 23 nt, Human
ucccugaaccucucccuccuucc

SEQ ID NO: 1241477 - RNA, 23 nt, Human
ucuccauguguucuuauuauuua

SEQ ID NO: 1241478 - RNA, 19 nt, Human
ucuuuuguucuuuugguua

SEQ ID NO: 1241479 - RNA, 26 nt, Human
ucuuuuguucuuuugguuauguuuua

SEQ ID NO: 1241480 - RNA, 21 nt, Human
uggugggcaggguucaggucg

SEQ ID NO: 1241481 - RNA, 21 nt, Human
ugugaugcucuucacauuaca

SEQ ID NO: 1241482 - RNA, 21 nt, Human
uucagggguacauguucaggu

SEQ ID NO: 1241483 - RNA, 22 nt, Human
uuccacuguccucccucaagua

SEQ ID NO: 1241484 - RNA, 25 nt, Human
uucccagagaauggcacaacaccuc

SEQ ID NO: 1241485 - RNA, 21 nt, Human
uuccucuccuucucuccaugu

SEQ ID NO: 1241486 - RNA, 25 nt, Human
uuccuugucuuugcuguugaaaaau

SEQ ID NO: 1241487 - RNA, 18 nt, Human
uugaaaaauuacagugaa

SEQ ID NO: 1241488 - RNA, 21 nt, Human
uuggugugucaagcucucucu

SEQ ID NO: 1241489 - RNA, 24 nt, Human
uugguuaaauggugggcaggguuc

SEQ ID NO: 1241490 - RNA, 25 nt, Human
uuucuguucccauguuaguuuuguu

SEQ ID NO: 1241491 - RNA, 20 nt, Human
uuugguuaaauggugggcag

SEQ ID NO: 1241492 - RNA, 24 nt, Human
uuuuaagugagaauaugugguauu

SEQ ID NO: 1241493 - RNA, 20 nt, Human
uuuuacggcugcauaauauu

SEQ ID NO: 1241494 - RNA, 19 nt, Human
uuuuccuuuucagaucugg

SEQ ID NO: 1241495 - RNA, 19 nt, Human
uuuuuuuuuucccugaacc

SEQ ID NO: 1241496 - RNA, 24 nt, Human
aagcaaauaucauuuauugugauc

SEQ ID NO: 1241497 - RNA, 20 nt, Human
acucuacuuacuggagagaa

SEQ ID NO: 1241498 - RNA, 20 nt, Human
agacucaagaaucagaacag

SEQ ID NO: 1241499 - RNA, 18 nt, Human
aggauacaaugcuugaaa

SEQ ID NO: 1241500 - RNA, 18 nt, Human
aggguuucuuccaaccug

SEQ ID NO: 1241501 - RNA, 21 nt, Human
aggguuucuuccaaccugaaa

SEQ ID NO: 1241502 - RNA, 20 nt, Human
aguaguauccuuaugaguac

SEQ ID NO: 1241503 - RNA, 21 nt, Human
cagcaaguuuucuuaugauuc

SEQ ID NO: 1241504 - RNA, 21 nt, Human
caucucuacuuuguccugucu

SEQ ID NO: 1241505 - RNA, 23 nt, Human
ccugaaauucuuuaagcugugag

SEQ ID NO: 1241506 - RNA, 18 nt, Human
cugacccaaaaaaugccu

SEQ ID NO: 1241507 - RNA, 23 nt, Human
gacacaaaagaccugagagaacg

SEQ ID NO: 1241508 - RNA, 21 nt, Human
gagggaugguaacauuccuuu

SEQ ID NO: 1241509 - RNA, 18 nt, Human
gaugacacaaaagaccug

SEQ ID NO: 1241510 - RNA, 21 nt, Human
ggaccagaggugagcagagaa

SEQ ID NO: 1241511 - RNA, 18 nt, Human
ggagagaaagaaauggua

SEQ ID NO: 1241512 - RNA, 22 nt, Human
ggauuaggaggaggaagggcug

SEQ ID NO: 1241513 - RNA, 24 nt, Human
guagaggagacucaagaaucagaa

SEQ ID NO: 1241514 - RNA, 20 nt, Human
guuacugcagaaauguagaa

SEQ ID NO: 1241515 - RNA, 23 nt, Human
uaaaaaggacuucuaccaagaac

SEQ ID NO: 1241516 - RNA, 24 nt, Human
uaaaucacuuaauauuuucaguuc

SEQ ID NO: 1241517 - RNA, 21 nt, Human
uaccaagaacaugaaaguaac

SEQ ID NO: 1241518 - RNA, 25 nt, Human
uaugauaacuaccuuguuacugcag

SEQ ID NO: 1241519 - RNA, 24 nt, Human
uauuccaugugguugcugucaacu

SEQ ID NO: 1241520 - RNA, 18 nt, Human
uauucuucuuacagcuuu

SEQ ID NO: 1241521 - RNA, 18 nt, Human
ucauaaguaguauccuua

SEQ ID NO: 1241522 - RNA, 27 nt, Human
ucaucucuacuuuguccugucucccua

SEQ ID NO: 1241523 - RNA, 20 nt, Human
ucucuuauauacaaguguga

SEQ ID NO: 1241524 - RNA, 19 nt, Human
ucuguagcagcaaguuuuc

SEQ ID NO: 1241525 - RNA, 22 nt, Human
ugaaaaggaaccuuaaaagcau

SEQ ID NO: 1241526 - RNA, 22 nt, Human
ugaaauuaggacugacccaaaa

SEQ ID NO: 1241527 - RNA, 20 nt, Human
ugaaauucuuuaagcuguga

SEQ ID NO: 1241528 - RNA, 21 nt, Human
ugaauagugaagauaggguac

SEQ ID NO: 1241529 - RNA, 19 nt, Human
ugacacaaaagaccugaga

SEQ ID NO: 1241530 - RNA, 18 nt, Human
ugacuauaaauaaaaagg

SEQ ID NO: 1241531 - RNA, 24 nt, Human
ugagagaacguaggaauguauaga

SEQ ID NO: 1241532 - RNA, 23 nt, Human
ugagucauuauuccaugugguug

SEQ ID NO: 1241533 - RNA, 19 nt, Human
ugcuuagcuguggaccaga

SEQ ID NO: 1241534 - RNA, 21 nt, Human
uguccugucucccuacacccu

SEQ ID NO: 1241535 - RNA, 23 nt, Human
uguuucguuuucuuaugugcuua

SEQ ID NO: 1241536 - RNA, 20 nt, Human
uuaggaggaggaagggcuga

SEQ ID NO: 1241537 - RNA, 21 nt, Human
uuccugaacuaauauaggaac

SEQ ID NO: 1241538 - RNA, 18 nt, Human
uuuuguuuguuucguuuu

SEQ ID NO: 1241539 - RNA, 18 nt, Human
aaaaccaaugaaaauuug

SEQ ID NO: 1241540 - RNA, 22 nt, Human
aaaaccaaugaaaauuugccau

SEQ ID NO: 1241541 - RNA, 25 nt, Human
aaaaccaaugaaaauuugccauggc

SEQ ID NO: 1241542 - RNA, 18 nt, Human
aacaggauagcuugcuuu

SEQ ID NO: 1241543 - RNA, 23 nt, Human
accaaauauuaauauucacaugu

SEQ ID NO: 1241544 - RNA, 21 nt, Human
acuguuugacuucauauccca

SEQ ID NO: 1241545 - RNA, 22 nt, Human
auaaaaccaaugaaaauuugcc

SEQ ID NO: 1241546 - RNA, 20 nt, Human
caccaaauauuaauauucac

SEQ ID NO: 1241547 - RNA, 23 nt, Human
ccaaugaaaauuugccauggccu

SEQ ID NO: 1241548 - RNA, 21 nt, Human
ccaucacugcuucuuagcugu

SEQ ID NO: 1241549 - RNA, 23 nt, Human
ucauaucccaucacugcuucuua

SEQ ID NO: 1241550 - RNA, 25 nt, Human
ucuauaaucaugaauaagauaaaac

SEQ ID NO: 1241551 - RNA, 20 nt, Human
ucuguggugcuagcacuaca

SEQ ID NO: 1241552 - RNA, 19 nt, Human
aaggaaugaacagcagacc

SEQ ID NO: 1241553 - RNA, 18 nt, Human
acauuuuguggaaagcau

SEQ ID NO: 1241554 - RNA, 19 nt, Human
agcacaaccuuccuucacu

SEQ ID NO: 1241555 - RNA, 25 nt, Human
agcacaaccuuccuucacucugacc

SEQ ID NO: 1241556 - RNA, 22 nt, Human
caaccuuccuucacucugaccu

SEQ ID NO: 1241557 - RNA, 23 nt, Human
cacacacugcucuguaaagucaa

SEQ ID NO: 1241558 - RNA, 24 nt, Human
cacaugcugauugcuaugcaugca

SEQ ID NO: 1241559 - RNA, 19 nt, Human
cagcagacccccccaaaau

SEQ ID NO: 1241560 - RNA, 21 nt, Human
cagcagacccccccaaaauuc

SEQ ID NO: 1241561 - RNA, 25 nt, Human
cagcagacccccccaaaauucaaau

SEQ ID NO: 1241562 - RNA, 26 nt, Human
cauuucuacauuuaaaauuuuaggga

SEQ ID NO: 1241563 - RNA, 22 nt, Human
cauuuuucucuuucgguuccca

SEQ ID NO: 1241564 - RNA, 19 nt, Human
ccccccaaaauucaaaucg

SEQ ID NO: 1241565 - RNA, 21 nt, Human
ccccggugacuuugaguccac

SEQ ID NO: 1241566 - RNA, 23 nt, Human
ccuaaaggaaugaacagcagacc

SEQ ID NO: 1241567 - RNA, 22 nt, Human
cuaaaggaaugaacagcagacc

SEQ ID NO: 1241568 - RNA, 23 nt, Human
gaaauuucuaauauauagcacau

SEQ ID NO: 1241569 - RNA, 18 nt, Human
uaaaacagauggaagucc

SEQ ID NO: 1241570 - RNA, 20 nt, Human
uaaaacagauggaaguccau

SEQ ID NO: 1241571 - RNA, 21 nt, Human
uaggaaagaacucaaacuuag

SEQ ID NO: 1241572 - RNA, 21 nt, Human
uaggauucaucauccuuuagu

SEQ ID NO: 1241573 - RNA, 19 nt, Human
uagggaggagagacucaug

SEQ ID NO: 1241574 - RNA, 26 nt, Human
ucuacauuuaaaauuuuagggaggag

SEQ ID NO: 1241575 - RNA, 20 nt, Human
ugacuuugaguccacaucuc

SEQ ID NO: 1241576 - RNA, 21 nt, Human
ugaguccacaucucucuuugu

SEQ ID NO: 1241577 - RNA, 22 nt, Human
ugaguccacaucucucuuugug

SEQ ID NO: 1241578 - RNA, 18 nt, Human
uggcuuuauagacucuaa

SEQ ID NO: 1241579 - RNA, 21 nt, Human
uggcuuuauagacucuaacca

SEQ ID NO: 1241580 - RNA, 26 nt, Human
uuaaaauuuuagggaggagagacuca

SEQ ID NO: 1241581 - RNA, 21 nt, Human
aaauaaaaccacaaagcagcc

SEQ ID NO: 1241582 - RNA, 22 nt, Human
aacaaccagagcucucuaacaa

SEQ ID NO: 1241583 - RNA, 23 nt, Human
aacacagugauuuaagucaucuc

SEQ ID NO: 1241584 - RNA, 18 nt, Human
aacccggguuucuugagc

SEQ ID NO: 1241585 - RNA, 21 nt, Human
aagaaccaaaauaaaaccaca

SEQ ID NO: 1241586 - RNA, 24 nt, Human
aagagguagagaggggcagaaggg

SEQ ID NO: 1241587 - RNA, 21 nt, Human
aaugaauggcggagaauggaa

SEQ ID NO: 1241588 - RNA, 20 nt, Human
aauggcggagaauggaaaga

SEQ ID NO: 1241589 - RNA, 23 nt, Human
acaaagcagccaaucauggcccc

SEQ ID NO: 1241590 - RNA, 21 nt, Human
acaaccagagcucucuaacaa

SEQ ID NO: 1241591 - RNA, 19 nt, Human
acaggaacccggguuucuu

SEQ ID NO: 1241592 - RNA, 20 nt, Human
acauaagcagaaacagcgca

SEQ ID NO: 1241593 - RNA, 22 nt, Human
agaaccaaaauaaaaccacaaa

SEQ ID NO: 1241594 - RNA, 19 nt, Human
agacuggguuggcuccagc

SEQ ID NO: 1241595 - RNA, 22 nt, Human
agagcucucuaacaaccugcuc

SEQ ID NO: 1241596 - RNA, 22 nt, Human
agccaaugacaggcucccacag

SEQ ID NO: 1241597 - RNA, 26 nt, Human
agccucuggcccuguugcacuggccc

SEQ ID NO: 1241598 - RNA, 21 nt, Human
agcucagcugagaacuaacug

SEQ ID NO: 1241599 - RNA, 22 nt, Human
aggcaacauuagaauuacaacc

SEQ ID NO: 1241600 - RNA, 19 nt, Human
aggcagcguggacggaggc

SEQ ID NO: 1241601 - RNA, 19 nt, Human
auaaaaucuccucccaaac

SEQ ID NO: 1241602 - RNA, 21 nt, Human
auaaaaucuccucccaaacag

SEQ ID NO: 1241603 - RNA, 22 nt, Human
aucaaacuucuccacggaaaau

SEQ ID NO: 1241604 - RNA, 23 nt, Human
auggccccuuucccucacucccu

SEQ ID NO: 1241605 - RNA, 20 nt, Human
augggggcgggggggggggc

SEQ ID NO: 1241606 - RNA, 22 nt, Human
auugcacugggccacuccaggg

SEQ ID NO: 1241607 - RNA, 21 nt, Human
caaagcagccaaucauggccc

SEQ ID NO: 1241608 - RNA, 23 nt, Human
caaugcuaaagauuugguucaga

SEQ ID NO: 1241609 - RNA, 18 nt, Human
caauggccaccuucaccu

SEQ ID NO: 1241610 - RNA, 23 nt, Human
cacacacagguagcacccaccuc

SEQ ID NO: 1241611 - RNA, 18 nt, Human
caccucgaugagaccgcc

SEQ ID NO: 1241612 - RNA, 23 nt, Human
cacgaaacuuugcugaacuucca

SEQ ID NO: 1241613 - RNA, 21 nt, Human
cagaugaagaacugcucccca

SEQ ID NO: 1241614 - RNA, 21 nt, Human
cagauguccauccauucagau

SEQ ID NO: 1241615 - RNA, 18 nt, Human
cauaagcaguagaggggc

SEQ ID NO: 1241616 - RNA, 25 nt, Human
cauagccaaugacaggcucccacag

SEQ ID NO: 1241617 - RNA, 20 nt, Human
caucuacacacacacaggua

SEQ ID NO: 1241618 - RNA, 21 nt, Human
cauuuaaaaaaccuuaguaaa

SEQ ID NO: 1241619 - RNA, 25 nt, Human
ccaagaggaugacaguaucauuuaa

SEQ ID NO: 1241620 - RNA, 25 nt, Human
ccacaauaaccugauguuguccgga

SEQ ID NO: 1241621 - RNA, 18 nt, Human
ccaccucuggauugcacu

SEQ ID NO: 1241622 - RNA, 22 nt, Human
ccagugagcagacagugccgag

SEQ ID NO: 1241623 - RNA, 20 nt, Human
ccagugguuuucuaguuccc

SEQ ID NO: 1241624 - RNA, 19 nt, Human
cccacagcaacuaccaagc

SEQ ID NO: 1241625 - RNA, 23 nt, Human
ccccacuuuuaacaaagccucaa

SEQ ID NO: 1241626 - RNA, 18 nt, Human
cccuugaaggaagcccag

SEQ ID NO: 1241627 - RNA, 18 nt, Human
ccuaggaggcggcucugc

SEQ ID NO: 1241628 - RNA, 21 nt, Human
ccucaaacuuuucuacauaaa

SEQ ID NO: 1241629 - RNA, 18 nt, Human
ccucccaaacaggaaccc

SEQ ID NO: 1241630 - RNA, 18 nt, Human
ccuccccaccuucagcac

SEQ ID NO: 1241631 - RNA, 24 nt, Human
ccucuaaccuggcugauaaacccc

SEQ ID NO: 1241632 - RNA, 22 nt, Human
ccuuacaccugaagccccacaa

SEQ ID NO: 1241633 - RNA, 23 nt, Human
cggcaaaaaagcaaugauggacc

SEQ ID NO: 1241634 - RNA, 22 nt, Human
cuauuuucaucaaugcuaaaga

SEQ ID NO: 1241635 - RNA, 22 nt, Human
cuccccaccuucagcacacuca

SEQ ID NO: 1241636 - RNA, 22 nt, Human
cugaacuuccaggaccuuacac

SEQ ID NO: 1241637 - RNA, 23 nt, Human
cugcuccccaaaauggcucagga

SEQ ID NO: 1241638 - RNA, 22 nt, Human
gaaacuuugcugaacuuccagg

SEQ ID NO: 1241639 - RNA, 25 nt, Human
gaaguugaaaacauagaaccauuua

SEQ ID NO: 1241640 - RNA, 21 nt, Human
gacaagguggccccagcccug

SEQ ID NO: 1241641 - RNA, 21 nt, Human
gaggggcagaagggagcugag

SEQ ID NO: 1241642 - RNA, 23 nt, Human
gaggggcagaagggagcugagga

SEQ ID NO: 1241643 - RNA, 18 nt, Human
gaucuuccuucuccccac

SEQ ID NO: 1241644 - RNA, 18 nt, Human
gccccagcccugagaaac

SEQ ID NO: 1241645 - RNA, 23 nt, Human
gccuugcucuggccugccccaac

SEQ ID NO: 1241646 - RNA, 22 nt, Human
gcggcaaaaaagcaaugaugga

SEQ ID NO: 1241647 - RNA, 20 nt, Human
gcuguccucauuacucccua

SEQ ID NO: 1241648 - RNA, 19 nt, Human
ggaguccggcuccagugag

SEQ ID NO: 1241649 - RNA, 20 nt, Human
ggaucucuuccaccucugga

SEQ ID NO: 1241650 - RNA, 19 nt, Human
ggcgggggggggggcgcgg

SEQ ID NO: 1241651 - RNA, 20 nt, Human
ggcgggggggggggcgcggc

SEQ ID NO: 1241652 - RNA, 20 nt, Human
gggccacuccaggguugggu

SEQ ID NO: 1241653 - RNA, 23 nt, Human
gggcgggggggggggcgcggcaa

SEQ ID NO: 1241654 - RNA, 23 nt, Human
gguagagaggggcagaagggagc

SEQ ID NO: 1241655 - RNA, 21 nt, Human
guccauccauucagaugaaga

SEQ ID NO: 1241656 - RNA, 24 nt, Human
guguguguacaaaacaaugaucua

SEQ ID NO: 1241657 - RNA, 24 nt, Human
uaaaaucuccucccaaacaggaac

SEQ ID NO: 1241658 - RNA, 20 nt, Human
uaagcagaaacagcgcaugu

SEQ ID NO: 1241659 - RNA, 22 nt, Human
uagaauuacaaccugggagucc

SEQ ID NO: 1241660 - RNA, 18 nt, Human
uagcagccucuggcccug

SEQ ID NO: 1241661 - RNA, 24 nt, Human
uauucuuauuucaauuuacacuau

SEQ ID NO: 1241662 - RNA, 24 nt, Human
ucaauggcccuugaaggaagccca

SEQ ID NO: 1241663 - RNA, 19 nt, Human
ucagaagagggucaacaca

SEQ ID NO: 1241664 - RNA, 24 nt, Human
ucauggccccuuucccucacuccc

SEQ ID NO: 1241665 - RNA, 18 nt, Human
uccaugaguggaagaggu

SEQ ID NO: 1241666 - RNA, 19 nt, Human
ucccacagcaacuaccaag

SEQ ID NO: 1241667 - RNA, 19 nt, Human
uccccaaaauggcucagaa

SEQ ID NO: 1241668 - RNA, 21 nt, Human
uccccaaaauggcucagaagc

SEQ ID NO: 1241669 - RNA, 23 nt, Human
uccccaccuucagcacacucauc

SEQ ID NO: 1241670 - RNA, 22 nt, Human
uccccccgaacccuuucuuaac

SEQ ID NO: 1241671 - RNA, 28 nt, Human
uccucuaaccuggcugauaaaccccaag

SEQ ID NO: 1241672 - RNA, 22 nt, Human
ucuacacacacacagguagcac

SEQ ID NO: 1241673 - RNA, 25 nt, Human
ucuaguuuccagugguuuucuaguu

SEQ ID NO: 1241674 - RNA, 23 nt, Human
ucuggcccuguugcacuggcccu

SEQ ID NO: 1241675 - RNA, 18 nt, Human
ucuugagcugccaguccc

SEQ ID NO: 1241676 - RNA, 24 nt, Human
ugaaggaagcccagauguccaucc

SEQ ID NO: 1241677 - RNA, 27 nt, Human
ugacaguaucauuuaaaaaaccuuagu

SEQ ID NO: 1241678 - RNA, 19 nt, Human
ugaggaagacccaacaacc

SEQ ID NO: 1241679 - RNA, 22 nt, Human
ugaggauguuucuguaucaaug

SEQ ID NO: 1241680 - RNA, 23 nt, Human
ugaucuauucuuauuucaauuua

SEQ ID NO: 1241681 - RNA, 25 nt, Human
ugauuaccuaccaaagccuacuuua

SEQ ID NO: 1241682 - RNA, 21 nt, Human
ugcccugaccauagugugggg

SEQ ID NO: 1241683 - RNA, 23 nt, Human
ugcucaaaugagacucagcaaga

SEQ ID NO: 1241684 - RNA, 22 nt, Human
uggaaagaaccaaaauaaaacc

SEQ ID NO: 1241685 - RNA, 23 nt, Human
uggaaagaaccaaaauaaaacca

SEQ ID NO: 1241686 - RNA, 19 nt, Human
uggaagagguagagagggg

SEQ ID NO: 1241687 - RNA, 24 nt, Human
uggccccuuucccucacucccucc

SEQ ID NO: 1241688 - RNA, 22 nt, Human
uggcccuguugcacuggcccua

SEQ ID NO: 1241689 - RNA, 23 nt, Human
uggcggagaauggaaagaaccaa

SEQ ID NO: 1241690 - RNA, 19 nt, Human
uggcucagaagcuguuuuc

SEQ ID NO: 1241691 - RNA, 21 nt, Human
ugggaaagcagcucuagagaa

SEQ ID NO: 1241692 - RNA, 20 nt, Human
ugggaagggaucaacagggu

SEQ ID NO: 1241693 - RNA, 22 nt, Human
uggggacuccuaacacagggcu

SEQ ID NO: 1241694 - RNA, 22 nt, Human
uguuuucccaggcaggucugga

SEQ ID NO: 1241695 - RNA, 24 nt, Human
uuacaccugaagccccacaauaac

SEQ ID NO: 1241696 - RNA, 26 nt, Human
uucacugaggaucuuccuucucccca

SEQ ID NO: 1241697 - RNA, 21 nt, Human
uucuaguuuccagugguuuuc

SEQ ID NO: 1241698 - RNA, 18 nt, Human
uugcucuggccugcccca

SEQ ID NO: 1241699 - RNA, 21 nt, Human
uugcucuggccugccccaacc

SEQ ID NO: 1241700 - RNA, 19 nt, Human
uuggcuccagcaagauaag

SEQ ID NO: 1241701 - RNA, 27 nt, Human
uuguguguguguacaaaacaaugauua

SEQ ID NO: 1241702 - RNA, 26 nt, Human
uuucuacauaaaaucuccucccaaac

SEQ ID NO: 1241703 - RNA, 23 nt, Human
ugaguuuaggcaaaguaggacaa

SEQ ID NO: 1241704 - RNA, 18 nt, Human
uuuauagagacucucauc

SEQ ID NO: 1241705 - RNA, 24 nt, Human
aagagcuauagguuaaaaccaaca

SEQ ID NO: 1241706 - RNA, 18 nt, Human
acaguccugagccucacg

SEQ ID NO: 1241707 - RNA, 18 nt, Human
auagguuaaaaccaacau

SEQ ID NO: 1241708 - RNA, 18 nt, Human
auauauuugguggaugaa

SEQ ID NO: 1241709 - RNA, 21 nt, Human
auguacaguccugagccucac

SEQ ID NO: 1241710 - RNA, 23 nt, Human
ccagcuggcuuuuggcuuccucu

SEQ ID NO: 1241711 - RNA, 19 nt, Human
ccucacgccgccaacgccu

SEQ ID NO: 1241712 - RNA, 21 nt, Human
cuauagguuaaaaccaacauu

SEQ ID NO: 1241713 - RNA, 22 nt, Human
cugauccagaugauuucucccc

SEQ ID NO: 1241714 - RNA, 24 nt, Human
ugaagagcuauagguuaaaaccaa

SEQ ID NO: 1241715 - RNA, 20 nt, Human
ugauccagaugauuucuccc

SEQ ID NO: 1241716 - RNA, 22 nt, Human
ugaugaguaaguuuauugaaga

SEQ ID NO: 1241717 - RNA, 22 nt, Human
uggcuuccucugauguacaguc

SEQ ID NO: 1241718 - RNA, 26 nt, Human
uugcaaacaagauuaaaacuguauuc

SEQ ID NO: 1241719 - RNA, 22 nt, Human
aauuacaggcacaaguuaccau

SEQ ID NO: 1241720 - RNA, 19 nt, Human
acuuuuuuuuucuuuugcu

SEQ ID NO: 1241721 - RNA, 19 nt, Human
aucacagcucacugcagca

SEQ ID NO: 1241722 - RNA, 21 nt, Human
aucacagcucacugcagcauu

SEQ ID NO: 1241723 - RNA, 20 nt, Human
auuucuuuuucuuuuucuua

SEQ ID NO: 1241724 - RNA, 24 nt, Human
cagagcagcuggaauuacaggcac

SEQ ID NO: 1241725 - RNA, 23 nt, Human
ccacuuuuuuuuucuuuugcuua

SEQ ID NO: 1241726 - RNA, 21 nt, Human
cccgggcuuaagacaauccuc

SEQ ID NO: 1241727 - RNA, 21 nt, Human
cuuaagacaauccucccaccu

SEQ ID NO: 1241728 - RNA, 23 nt, Human
cuugaacuugaccuuaguuggau

SEQ ID NO: 1241729 - RNA, 27 nt, Human
gagcagcuggaauuacaggcacaaguu

SEQ ID NO: 1241730 - RNA, 18 nt, Human
gcuggcagugacagccug

SEQ ID NO: 1241731 - RNA, 21 nt, Human
gcugguuuuuaauauucagua

SEQ ID NO: 1241732 - RNA, 22 nt, Human
uacaggcacaaguuaccaugcc

SEQ ID NO: 1241733 - RNA, 24 nt, Human
ucaaaggaagcauuagucaggucc

SEQ ID NO: 1241734 - RNA, 24 nt, Human
ucacugcagcauugaagucccggg

SEQ ID NO: 1241735 - RNA, 18 nt, Human
uggaaugcaagggugaaa

SEQ ID NO: 1241736 - RNA, 20 nt, Human
uggaauuacaggcacaaguu

SEQ ID NO: 1241737 - RNA, 22 nt, Human
uggaauuacaggcacaaguuac

SEQ ID NO: 1241738 - RNA, 24 nt, Human
uggaauuacaggcacaaguuacca

SEQ ID NO: 1241739 - RNA, 25 nt, Human
uucaguaucugguccguauuuaaag

SEQ ID NO: 1241740 - RNA, 27 nt, Human
uucuaaauacuaucucauauuucccaa

SEQ ID NO: 1241741 - RNA, 24 nt, Human
uucuucuuuucagaaugugcuggu

SEQ ID NO: 1241742 - RNA, 20 nt, Human
uuucuuuuucuuagagaugg

SEQ ID NO: 1241743 - RNA, 19 nt, Human
agaagcuuucccacgcccc

SEQ ID NO: 1241744 - RNA, 25 nt, Human
agacaagaaagagggugcaggccgg

SEQ ID NO: 1241745 - RNA, 23 nt, Human
agagacaagaaagagggugcagg

SEQ ID NO: 1241746 - RNA, 18 nt, Human
aggaaagagaauauccau

SEQ ID NO: 1241747 - RNA, 24 nt, Human
aggccagaggagccaggggagccc

SEQ ID NO: 1241748 - RNA, 22 nt, Human
aggcugaacacaacaaagagga

SEQ ID NO: 1241749 - RNA, 25 nt, Human
aggcugaacacaacaaagaggacga

SEQ ID NO: 1241750 - RNA, 18 nt, Human
agguucuccaguucuuuc

SEQ ID NO: 1241751 - RNA, 19 nt, Human
caggcugaacacaacaaag

SEQ ID NO: 1241752 - RNA, 23 nt, Human
caggcugaacacaacaaagagga

SEQ ID NO: 1241753 - RNA, 24 nt, Human
ccccacagcugcagacccagugcu

SEQ ID NO: 1241754 - RNA, 21 nt, Human
cccccacguggccggugguuc

SEQ ID NO: 1241755 - RNA, 19 nt, Human
ccgcccagcucauggagcc

SEQ ID NO: 1241756 - RNA, 20 nt, Human
ccugagagacaagaaagagg

SEQ ID NO: 1241757 - RNA, 20 nt, Human
ccugggcggacuuggcgugg

SEQ ID NO: 1241758 - RNA, 20 nt, Human
ccuguccccacagcugcaga

SEQ ID NO: 1241759 - RNA, 24 nt, Human
ccugugugcuucucuuucacuggu

SEQ ID NO: 1241760 - RNA, 21 nt, Human
cgacaggaaaguguagaucuc

SEQ ID NO: 1241761 - RNA, 20 nt, Human
cgauccugagccauuccccc

SEQ ID NO: 1241762 - RNA, 21 nt, Human
cugcacugcuguccucaggca

SEQ ID NO: 1241763 - RNA, 21 nt, Human
cugguuuguacacuggcccug

SEQ ID NO: 1241764 - RNA, 22 nt, Human
cugguuuguacacuggcccugg

SEQ ID NO: 1241765 - RNA, 20 nt, Human
cuucuauucucgcuguccuc

SEQ ID NO: 1241766 - RNA, 20 nt, Human
cuuggcguggaaggugaugg

SEQ ID NO: 1241767 - RNA, 18 nt, Human
gaaauggaugaucugggg

SEQ ID NO: 1241768 - RNA, 22 nt, Human
gaagcuuucccacgccccccac

SEQ ID NO: 1241769 - RNA, 26 nt, Human
gaagcuuucccacgccccccacgugg

SEQ ID NO: 1241770 - RNA, 22 nt, Human
gaauggggcuggggcacagcuc

SEQ ID NO: 1241771 - RNA, 27 nt, Human
ggugaugggagcugcccucccuagaga

SEQ ID NO: 1241772 - RNA, 24 nt, Human
guaauaaccuuuuucugguuuccu

SEQ ID NO: 1241773 - RNA, 22 nt, Human
uaaucaggaucaccaggcugaa

SEQ ID NO: 1241774 - RNA, 19 nt, Human
uagagagcuucuucaggca

SEQ ID NO: 1241775 - RNA, 22 nt, Human
uccugagccauucccccacuuc

SEQ ID NO: 1241776 - RNA, 21 nt, Human
ucucagucuccuguccccaca

SEQ ID NO: 1241777 - RNA, 19 nt, Human
ucuguaaucuuucaaagug

SEQ ID NO: 1241778 - RNA, 26 nt, Human
ucuguaccaauaacacuguccagagg

SEQ ID NO: 1241779 - RNA, 20 nt, Human
ugagagacaagaaagagggu

SEQ ID NO: 1241780 - RNA, 18 nt, Human
ugaucuggggaauggggc

SEQ ID NO: 1241781 - RNA, 21 nt, Human
ugcguaauaaccuuuuucugg

SEQ ID NO: 1241782 - RNA, 18 nt, Human
uggaugaucuggggaaug

SEQ ID NO: 1241783 - RNA, 19 nt, Human
uggcccugggcggacuugg

SEQ ID NO: 1241784 - RNA, 18 nt, Human
uggggaauggggcugggg

SEQ ID NO: 1241785 - RNA, 19 nt, Human
uggggcuggggcacagcuc

SEQ ID NO: 1241786 - RNA, 19 nt, Human
ugugcuucucuuucacugg

SEQ ID NO: 1241787 - RNA, 25 nt, Human
uuuccgauccugagccauuccccca

SEQ ID NO: 1241788 - RNA, 19 nt, Human
caagagagaacugauugug

SEQ ID NO: 1241789 - RNA, 18 nt, Human
cacucugugccuaaagcu

SEQ ID NO: 1241790 - RNA, 22 nt, Human
ugcuggcagcuuguccuuccca

SEQ ID NO: 1241791 - RNA, 25 nt, Human
uguugagcugaggcucguagcagug

SEQ ID NO: 1241792 - RNA, 19 nt, Human
uuaaauugcuuagcgcuag

SEQ ID NO: 1241793 - RNA, 22 nt, Human
uugcuggcagcuuguccuuccc

SEQ ID NO: 1241794 - RNA, 22 nt, Human
uuuguuaaauugcuuagcgcua

SEQ ID NO: 1241795 - RNA, 24 nt, Human
aaacaaaaaagguauguuuucuag

SEQ ID NO: 1241796 - RNA, 19 nt, Human
aaacaaacaaaaaagguau

SEQ ID NO: 1241797 - RNA, 19 nt, Human
aaacaacuggcaagcaaac

SEQ ID NO: 1241798 - RNA, 21 nt, Human
aaaccucauugaaucaauaag

SEQ ID NO: 1241799 - RNA, 19 nt, Human
aaagaaaccaaugaucuca

SEQ ID NO: 1241800 - RNA, 21 nt, Human
aaagaaaccaaugaucucagg

SEQ ID NO: 1241801 - RNA, 19 nt, Human
aaccagcugcuuccucuuc

SEQ ID NO: 1241802 - RNA, 22 nt, Human
aacuuaucaaaagcauucaucu

SEQ ID NO: 1241803 - RNA, 23 nt, Human
aagaaacaaaaauaacuuuuccc

SEQ ID NO: 1241804 - RNA, 18 nt, Human
aagaaaccaaugaucuca

SEQ ID NO: 1241805 - RNA, 18 nt, Human
aagaaauccuguccaacg

SEQ ID NO: 1241806 - RNA, 26 nt, Human
aagccaggagccaaggcuguaaagga

SEQ ID NO: 1241807 - RNA, 22 nt, Human
aaggguguucuguuccaaaauc

SEQ ID NO: 1241808 - RNA, 21 nt, Human
aagguagaaguuggaaauuuu

SEQ ID NO: 1241809 - RNA, 18 nt, Human
acaacacaagcaacauaa

SEQ ID NO: 1241810 - RNA, 24 nt, Human
acaacacaagcaacauaaauacaa

SEQ ID NO: 1241811 - RNA, 22 nt, Human
acacaacacuaagaaacaaaaa

SEQ ID NO: 1241812 - RNA, 21 nt, Human
acacuaagaaacaaaaauaac

SEQ ID NO: 1241813 - RNA, 22 nt, Human
acugacuaaauaagaaggcaaa

SEQ ID NO: 1241814 - RNA, 22 nt, Human
agaagcacucccaauaagaacc

SEQ ID NO: 1241815 - RNA, 22 nt, Human
agacagaagauacuagacaacc

SEQ ID NO: 1241816 - RNA, 25 nt, Human
agauacuagacaaccacugguuaaa

SEQ ID NO: 1241817 - RNA, 22 nt, Human
agauaugugcacaaacaacaua

SEQ ID NO: 1241818 - RNA, 21 nt, Human
agccacucucuccucccuggu

SEQ ID NO: 1241819 - RNA, 18 nt, Human
aggcaccuccuccugccc

SEQ ID NO: 1241820 - RNA, 20 nt, Human
auaaaaggacccauaccacc

SEQ ID NO: 1241821 - RNA, 20 nt, Human
auccccacaacacaacacua

SEQ ID NO: 1241822 - RNA, 19 nt, Human
caaaugaucauccauagaa

SEQ ID NO: 1241823 - RNA, 20 nt, Human
caacacaacacuaagaaaca

SEQ ID NO: 1241824 - RNA, 25 nt, Human
cacaacacaacacuaagaaacaaaa

SEQ ID NO: 1241825 - RNA, 22 nt, Human
caccuucaguacaagucaaagg

SEQ ID NO: 1241826 - RNA, 21 nt, Human
cagaagauacuagacaaccac

SEQ ID NO: 1241827 - RNA, 19 nt, Human
cagcugcuuccucuucaga

SEQ ID NO: 1241828 - RNA, 18 nt, Human
cagggcccgagccucccu

SEQ ID NO: 1241829 - RNA, 21 nt, Human
cauaaucccgagguagccagg

SEQ ID NO: 1241830 - RNA, 21 nt, Human
cauccccacaacacaacacua

SEQ ID NO: 1241831 - RNA, 18 nt, Human
ccaaugaaagauguaaaa

SEQ ID NO: 1241832 - RNA, 21 nt, Human
ccacaucaaauagcaaacacu

SEQ ID NO: 1241833 - RNA, 24 nt, Human
ccaccauguagauaugugcacaaa

SEQ ID NO: 1241834 - RNA, 18 nt, Human
ccagcaguggagugcugu

SEQ ID NO: 1241835 - RNA, 20 nt, Human
ccaucaugccacaccuggau

SEQ ID NO: 1241836 - RNA, 20 nt, Human
ccauuauuuggaagaugaaa

SEQ ID NO: 1241837 - RNA, 28 nt, Human
cccagugacaagcucauauuuccaauaa

SEQ ID NO: 1241838 - RNA, 21 nt, Human
ccccuuuguaguauuguacaa

SEQ ID NO: 1241839 - RNA, 19 nt, Human
ccuccugccccaucaugcc

SEQ ID NO: 1241840 - RNA, 19 nt, Human
ccucuaggcaccuccuccu

SEQ ID NO: 1241841 - RNA, 19 nt, Human
ccuguuaaacaaagaacag

SEQ ID NO: 1241842 - RNA, 21 nt, Human
ccuuccauuccuacaauaguc

SEQ ID NO: 1241843 - RNA, 22 nt, Human
cuccucccugguaccccuuugu

SEQ ID NO: 1241844 - RNA, 22 nt, Human
cugcaagacucuggauuuuccu

SEQ ID NO: 1241845 - RNA, 22 nt, Human
cugcuguauagaauccaauccc

SEQ ID NO: 1241846 - RNA, 18 nt, Human
cuuaacugggaacucuga

SEQ ID NO: 1241847 - RNA, 18 nt, Human
cuucaagaaauccugucc

SEQ ID NO: 1241848 - RNA, 21 nt, Human
cuuguaaaaaccaauuguugg

SEQ ID NO: 1241849 - RNA, 21 nt, Human
gagaaaagguucuguauggug

SEQ ID NO: 1241850 - RNA, 20 nt, Human
gcuggcagugucagggcccg

SEQ ID NO: 1241851 - RNA, 22 nt, Human
gcuguaaaggagcugacaugga

SEQ ID NO: 1241852 - RNA, 21 nt, Human
ggccuuuggaguaaacaaaau

SEQ ID NO: 1241853 - RNA, 22 nt, Human
gggaaaagcauauugaauaaua

SEQ ID NO: 1241854 - RNA, 21 nt, Human
gggaacucugaccaugagccc

SEQ ID NO: 1241855 - RNA, 22 nt, Human
gguaaaagaauuuccaaaacua

SEQ ID NO: 1241856 - RNA, 24 nt, Human
gguggccaaugaaagauguaaaac

SEQ ID NO: 1241857 - RNA, 23 nt, Human
gucaucugcccaaggguagauuc

SEQ ID NO: 1241858 - RNA, 18 nt, Human
gugggagauaguaguagg

SEQ ID NO: 1241859 - RNA, 24 nt, Human
uaaaaaaaggcccuccaggugaug

SEQ ID NO: 1241860 - RNA, 18 nt, Human
uaaaacaacuggcaagca

SEQ ID NO: 1241861 - RNA, 20 nt, Human
uaaaggagcugacauggaaa

SEQ ID NO: 1241862 - RNA, 18 nt, Human
uaaaggguguucuguucc

SEQ ID NO: 1241863 - RNA, 22 nt, Human
uaaauaugaccaaacugacuaa

SEQ ID NO: 1241864 - RNA, 24 nt, Human
uaagaaaaaacauaaucuuuuaca

SEQ ID NO: 1241865 - RNA, 19 nt, Human
uaagaaccagaugaaagaa

SEQ ID NO: 1241866 - RNA, 21 nt, Human
uaagcagaagucuuuagagaa

SEQ ID NO: 1241867 - RNA, 22 nt, Human
uacaaagacaagaagcuuagau

SEQ ID NO: 1241868 - RNA, 19 nt, Human
uacaacacaagcaacauaa

SEQ ID NO: 1241869 - RNA, 21 nt, Human
uacaacacaagcaacauaaau

SEQ ID NO: 1241870 - RNA, 26 nt, Human
uacaacacaagcaacauaaauacaau

SEQ ID NO: 1241871 - RNA, 18 nt, Human
uaccacccacuggcuuua

SEQ ID NO: 1241872 - RNA, 21 nt, Human
uagaauuuucauuuccaccuc

SEQ ID NO: 1241873 - RNA, 18 nt, Human
uaguaguaggggaacugu

SEQ ID NO: 1241874 - RNA, 22 nt, Human
uauaaagaaaccaaugaucuca

SEQ ID NO: 1241875 - RNA, 19 nt, Human
uauaaggaauaaaaggacc

SEQ ID NO: 1241876 - RNA, 18 nt, Human
uauacauucauugucuuc

SEQ ID NO: 1241877 - RNA, 20 nt, Human
uaugugcacaaacaacauag

SEQ ID NO: 1241878 - RNA, 24 nt, Human
uauuuggaagaugaaauaaugaau

SEQ ID NO: 1241879 - RNA, 19 nt, Human
ucaaagcauaguucccaaa

SEQ ID NO: 1241880 - RNA, 19 nt, Human
ucaaagggucaacaugaua

SEQ ID NO: 1241881 - RNA, 18 nt, Human
ucccauccccacaacaca

SEQ ID NO: 1241882 - RNA, 19 nt, Human
uccccacaacacaacacua

SEQ ID NO: 1241883 - RNA, 25 nt, Human
ucccgagguagccagggaugcucuu

SEQ ID NO: 1241884 - RNA, 27 nt, Human
ucuacaacacaagcaacauaaauacaa

SEQ ID NO: 1241885 - RNA, 24 nt, Human
ucucaaagcauaguucccaaaaca

SEQ ID NO: 1241886 - RNA, 19 nt, Human
ucugaccaugagcccagca

SEQ ID NO: 1241887 - RNA, 21 nt, Human
ugaagugaaacccaacuuauc

SEQ ID NO: 1241888 - RNA, 24 nt, Human
ugaaugggguugcaaggaugaauu

SEQ ID NO: 1241889 - RNA, 25 nt, Human
ugacaagcucauauuuccaauaaaa

SEQ ID NO: 1241890 - RNA, 23 nt, Human
ugauuuacuuaacugggaacucu

SEQ ID NO: 1241891 - RNA, 21 nt, Human
ugcacaaacaacauauuuacu

SEQ ID NO: 1241892 - RNA, 24 nt, Human
uggaaaucuaaaggguguucuguu

SEQ ID NO: 1241893 - RNA, 20 nt, Human
uggcaagcaaacaacuauuc

SEQ ID NO: 1241894 - RNA, 24 nt, Human
uguaaaacaacuggcaagcaaaca

SEQ ID NO: 1241895 - RNA, 24 nt, Human
uguaaaggagcugacauggaaaca

SEQ ID NO: 1241896 - RNA, 20 nt, Human
uguacuaaaguuugagaacc

SEQ ID NO: 1241897 - RNA, 18 nt, Human
uguagauguuauggcaca

SEQ ID NO: 1241898 - RNA, 21 nt, Human
uguauagaauccaaucccaag

SEQ ID NO: 1241899 - RNA, 19 nt, Human
ugucagggcccgagccucc

SEQ ID NO: 1241900 - RNA, 19 nt, Human
uguucuaaagacagaagau

SEQ ID NO: 1241901 - RNA, 21 nt, Human
uguuuuggaaaucuaaagggu

SEQ ID NO: 1241902 - RNA, 21 nt, Human
uuaaaacgacauggauggaag

SEQ ID NO: 1241903 - RNA, 19 nt, Human
uuaaagguagaaguuggaa

SEQ ID NO: 1241904 - RNA, 18 nt, Human
uucaaggcagugguucuc

SEQ ID NO: 1241905 - RNA, 21 nt, Human
uucacuuuuauauuuuuccca

SEQ ID NO: 1241906 - RNA, 22 nt, Human
uucaucuuuguucagcuuugcc

SEQ ID NO: 1241907 - RNA, 20 nt, Human
uuccaauaaaaagugcucuu

SEQ ID NO: 1241908 - RNA, 19 nt, Human
uuccuuccauuccuacaau

SEQ ID NO: 1241909 - RNA, 21 nt, Human
uuguuggugguugaaaagggu

SEQ ID NO: 1241910 - RNA, 23 nt, Human
uuuagaauuuucauuuccaccuc

SEQ ID NO: 1241911 - RNA, 20 nt, Human
uuugcaaauuuccgugaagc

SEQ ID NO: 1241912 - RNA, 20 nt, Human
ucucucguggguaaagucac

SEQ ID NO: 1241913 - RNA, 22 nt, Human
uuuaaaaaucucucucgugggu

SEQ ID NO: 1241914 - RNA, 23 nt, Human
aaaacagcauaagagcuaugauc

SEQ ID NO: 1241915 - RNA, 20 nt, Human
acacgaccugcauguacaca

SEQ ID NO: 1241916 - RNA, 24 nt, Human
accagccacacgaccugcauguac

SEQ ID NO: 1241917 - RNA, 24 nt, Human
augcauuccaugucaauaccauca

SEQ ID NO: 1241918 - RNA, 22 nt, Human
caacccaucucuucgcuggccu

SEQ ID NO: 1241919 - RNA, 21 nt, Human
cauuccaugucaauaccauca

SEQ ID NO: 1241920 - RNA, 22 nt, Human
ccacaaguagaccagccacacg

SEQ ID NO: 1241921 - RNA, 22 nt, Human
ccacauccuuuugcucugacuc

SEQ ID NO: 1241922 - RNA, 22 nt, Human
ccugugccacagaugcauucca

SEQ ID NO: 1241923 - RNA, 22 nt, Human
cgcuggccugugccacagaugc

SEQ ID NO: 1241924 - RNA, 20 nt, Human
cuuuugcucugacucgaaga

SEQ ID NO: 1241925 - RNA, 20 nt, Human
gaagaggaagccaacccauc

SEQ ID NO: 1241926 - RNA, 18 nt, Human
ugagcaggaaaacagcau

SEQ ID NO: 1241927 - RNA, 23 nt, Human
uucugaggcugggaucgcccuuc

SEQ ID NO: 1241928 - RNA, 25 nt, Human
aggcacaggggguccccgggcgggg

SEQ ID NO: 1241929 - RNA, 25 nt, Human
aggggcucccccgcagcccgggagg

SEQ ID NO: 1241930 - RNA, 21 nt, Human
cacccggggccgaaggcagcu

SEQ ID NO: 1241931 - RNA, 22 nt, Human
cccgcagcccgggaggggaggc

SEQ ID NO: 1241932 - RNA, 24 nt, Human
cccgcagcccgggaggggaggcac

SEQ ID NO: 1241933 - RNA, 19 nt, Human
ccgggaggggaggcacagg

SEQ ID NO: 1241934 - RNA, 18 nt, Human
cgcagcccgggaggggag

SEQ ID NO: 1241935 - RNA, 20 nt, Human
gaaacggaggagugggagug

SEQ ID NO: 1241936 - RNA, 20 nt, Human
gaggcacaggggguccccgg

SEQ ID NO: 1241937 - RNA, 23 nt, Human
gcccgggaggggaggcacagggg

SEQ ID NO: 1241938 - RNA, 24 nt, Human
ggggaggcacaggggguccccggg

SEQ ID NO: 1241939 - RNA, 19 nt, Human
uccccgggcgggggagacc

SEQ ID NO: 1241940 - RNA, 24 nt, Human
aaaaacuaagaagaaaaugccacu

SEQ ID NO: 1241941 - RNA, 21 nt, Human
aaacagaaacgccaucuccaa

SEQ ID NO: 1241942 - RNA, 18 nt, Human
aaacgccaucuccaaaag

SEQ ID NO: 1241943 - RNA, 20 nt, Human
aacuugucucuuuaauacca

SEQ ID NO: 1241944 - RNA, 20 nt, Human
aagaaaugaaaaacuaagaa

SEQ ID NO: 1241945 - RNA, 23 nt, Human
accaggagauugaggcugcagug

SEQ ID NO: 1241946 - RNA, 18 nt, Human
acgcuacugcauuccagc

SEQ ID NO: 1241947 - RNA, 18 nt, Human
acugcauuccagccucaa

SEQ ID NO: 1241948 - RNA, 18 nt, Human
acugcauuccagccucaa

SEQ ID NO: 1241949 - RNA, 26 nt, Human
acugcauuccagccucaaaacagugg

SEQ ID NO: 1241950 - RNA, 20 nt, Human
acugcauuccagccucaaag

SEQ ID NO: 1241951 - RNA, 22 nt, Human
acugcauuccagccucaaagag

SEQ ID NO: 1241952 - RNA, 21 nt, Human
acugugauaaacuugucucuu

SEQ ID NO: 1241953 - RNA, 22 nt, Human
agaaaugaaaaacuaagaagaa

SEQ ID NO: 1241954 - RNA, 21 nt, Human
agaccaggagauugaggcugc

SEQ ID NO: 1241955 - RNA, 24 nt, Human
agagaucacgcuacugcauuccag

SEQ ID NO: 1241956 - RNA, 21 nt, Human
aggggaaaaaaaaauacugug

SEQ ID NO: 1241957 - RNA, 18 nt, Human
agguaaaccugaucagcu

SEQ ID NO: 1241958 - RNA, 23 nt, Human
aucacgcuacugcauuccagccu

SEQ ID NO: 1241959 - RNA, 18 nt, Human
caacaucguugguacagc

SEQ ID NO: 1241960 - RNA, 18 nt, Human
cacgccuguagucucagc

SEQ ID NO: 1241961 - RNA, 23 nt, Human
cacucuaacccaucagauagccc

SEQ ID NO: 1241962 - RNA, 21 nt, Human
cagcacuugcagccagggcgg

SEQ ID NO: 1241963 - RNA, 26 nt, Human
ccuggaggcuccuacaguggccuccg

SEQ ID NO: 1241964 - RNA, 20 nt, Human
ccuguagucucagcuaccug

SEQ ID NO: 1241965 - RNA, 22 nt, Human
cgccuguagucucagcuaccug

SEQ ID NO: 1241966 - RNA, 23 nt, Human
cgccuguagucucagcuaccuga

SEQ ID NO: 1241967 - RNA, 25 nt, Human
cuaacccaucagauagcccuucuca

SEQ ID NO: 1241968 - RNA, 18 nt, Human
cuacugcauuccagccuc

SEQ ID NO: 1241969 - RNA, 19 nt, Human
cucaaagagaacucccugg

SEQ ID NO: 1241970 - RNA, 22 nt, Human
gaaaaauuauuuauuucugcuc

SEQ ID NO: 1241971 - RNA, 20 nt, Human
gaccaggagauugaggcugc

SEQ ID NO: 1241972 - RNA, 18 nt, Human
gagcaaauccaguaucca

SEQ ID NO: 1241973 - RNA, 24 nt, Human
gauggugcacgccuguagucucag

SEQ ID NO: 1241974 - RNA, 22 nt, Human
gcugcucuucauucuuuuccac

SEQ ID NO: 1241975 - RNA, 18 nt, Human
gcuucaauacacuuccug

SEQ ID NO: 1241976 - RNA, 25 nt, Human
ggggguuguaaaaaauaaucacuuu

SEQ ID NO: 1241977 - RNA, 22 nt, Human
ggugugauggugcacgccugua

SEQ ID NO: 1241978 - RNA, 19 nt, Human
uaaaaaauaaucacuuuau

SEQ ID NO: 1241979 - RNA, 23 nt, Human
uaguccaagcuucaauacacuuc

SEQ ID NO: 1241980 - RNA, 22 nt, Human
uccagaguucucagcuuaugga

SEQ ID NO: 1241981 - RNA, 22 nt, Human
ucugaaauaaucuaccgucaca

SEQ ID NO: 1241982 - RNA, 24 nt, Human
ugauggugcacgccuguagucuca

SEQ ID NO: 1241983 - RNA, 23 nt, Human
uggacagccuuuaaacuucauug

SEQ ID NO: 1241984 - RNA, 22 nt, Human
ugggucagcaggggaaaaaaaa

SEQ ID NO: 1241985 - RNA, 18 nt, Human
uggugcacgccuguaguc

SEQ ID NO: 1241986 - RNA, 21 nt, Human
uggugcacgccuguagucuca

SEQ ID NO: 1241987 - RNA, 25 nt, Human
uguccagaguucucagcuuauggaa

SEQ ID NO: 1241988 - RNA, 18 nt, Human
uuaaaggcaaagcaccau

SEQ ID NO: 1241989 - RNA, 24 nt, Human
uuaauaccaagaaggaauucuagu

SEQ ID NO: 1241990 - RNA, 23 nt, Human
uuauuucugcuccuuucauacau

SEQ ID NO: 1241991 - RNA, 21 nt, Human
uucauauuagaggauuggaca

SEQ ID NO: 1241992 - RNA, 24 nt, Human
uuucugcuccuuucauacaucuua

SEQ ID NO: 1241993 - RNA, 23 nt, Human
uuucuuuuacugcugcucuucau

SEQ ID NO: 1241994 - RNA, 24 nt, Human
uuuuuuuuuuuuuuuuuuaauuag

SEQ ID NO: 1241995 - RNA, 23 nt, Human
aaaaaaaaaaaaagucucuaggg

SEQ ID NO: 1241996 - RNA, 19 nt, Human
aaacagacuguaaaccucu

SEQ ID NO: 1241997 - RNA, 18 nt, Human
aaagaacuugaucaaaau

SEQ ID NO: 1241998 - RNA, 22 nt, Human
aagaaaagcaaacaaaaaacaa

SEQ ID NO: 1241999 - RNA, 18 nt, Human
aagaagcauggcuaggag

SEQ ID NO: 1242000 - RNA, 23 nt, Human
aagaguucgagaccauccuggcc

SEQ ID NO: 1242001 - RNA, 22 nt, Human
aagcaaacaaaaaacaaacuca

SEQ ID NO: 1242002 - RNA, 21 nt, Human
aauaucucucagcacaauuuc

SEQ ID NO: 1242003 - RNA, 19 nt, Human
aaugauaaucuauuaugug

SEQ ID NO: 1242004 - RNA, 22 nt, Human
acaaccaucaccacaaucaauu

SEQ ID NO: 1242005 - RNA, 22 nt, Human
acaauuagaucaaacauacauu

SEQ ID NO: 1242006 - RNA, 24 nt, Human
acagagcaagaauccaucucaaaa

SEQ ID NO: 1242007 - RNA, 21 nt, Human
acagaguuuuaaaaugcaaac

SEQ ID NO: 1242008 - RNA, 18 nt, Human
acauggugaaaccccauc

SEQ ID NO: 1242009 - RNA, 19 nt, Human
acauggugaaaccccaucu

SEQ ID NO: 1242010 - RNA, 20 nt, Human
acauggugaaaccccaucuc

SEQ ID NO: 1242011 - RNA, 22 nt, Human
acauggugaaaccccaucucua

SEQ ID NO: 1242012 - RNA, 24 nt, Human
acccaggagguggagguuguagug

SEQ ID NO: 1242013 - RNA, 25 nt, Human
accccauaugccuguagaauuucau

SEQ ID NO: 1242014 - RNA, 24 nt, Human
accccaucucuacuaaaaauacaa

SEQ ID NO: 1242015 - RNA, 23 nt, Human
acugcacuccagccuggugacag

SEQ ID NO: 1242016 - RNA, 25 nt, Human
acugcacuccagccuggugacagag

SEQ ID NO: 1242017 - RNA, 24 nt, Human
acuggaaaccccaaauuacuguag

SEQ ID NO: 1242018 - RNA, 20 nt, Human
acuuuuauuccauucaucua

SEQ ID NO: 1242019 - RNA, 21 nt, Human
agaaaagcaaacaaaaaacaa

SEQ ID NO: 1242020 - RNA, 20 nt, Human
agaaggugaaggggaagcag

SEQ ID NO: 1242021 - RNA, 18 nt, Human
agacugggguuggggacc

SEQ ID NO: 1242022 - RNA, 21 nt, Human
agagacaggagccacaaggga

SEQ ID NO: 1242023 - RNA, 24 nt, Human
agagaugccuccacugcacuccag

SEQ ID NO: 1242024 - RNA, 18 nt, Human
agaggaggaagcugggga

SEQ ID NO: 1242025 - RNA, 18 nt, Human
agagggaggggaugaaca

SEQ ID NO: 1242026 - RNA, 18 nt, Human
agcauggccauucggcaa

SEQ ID NO: 1242027 - RNA, 24 nt, Human
agccuggugacagagcaagaaucc

SEQ ID NO: 1242028 - RNA, 18 nt, Human
agcuggagcccaggaccc

SEQ ID NO: 1242029 - RNA, 19 nt, Human
aggaagaggaggaagcugg

SEQ ID NO: 1242030 - RNA, 27 nt, Human
aggaagcuggggaucgaaaagagggag

SEQ ID NO: 1242031 - RNA, 20 nt, Human
aggcaggcggaucacaaggu

SEQ ID NO: 1242032 - RNA, 24 nt, Human
aggcaggcggaucacaaggucaag

SEQ ID NO: 1242033 - RNA, 25 nt, Human
aggcauuagauuaucauaaggagga

SEQ ID NO: 1242034 - RNA, 24 nt, Human
aggcggaucacaaggucaagaguu

SEQ ID NO: 1242035 - RNA, 18 nt, Human
aggcugggugugguggcu

SEQ ID NO: 1242036 - RNA, 23 nt, Human
aggucucuaggcuggguguggug

SEQ ID NO: 1242037 - RNA, 24 nt, Human
agguggagguuguagugggcagag

SEQ ID NO: 1242038 - RNA, 24 nt, Human
agucacuccccauugccucccaga

SEQ ID NO: 1242039 - RNA, 18 nt, Human
agugggcagagaugccuc

SEQ ID NO: 1242040 - RNA, 18 nt, Human
aucccaugccagacacuc

SEQ ID NO: 1242041 - RNA, 19 nt, Human
aucucaaaaaaaaaaaaag

SEQ ID NO: 1242042 - RNA, 24 nt, Human
augccuccacugcacuccagccug

SEQ ID NO: 1242043 - RNA, 19 nt, Human
auggaagacaauuuuucca

SEQ ID NO: 1242044 - RNA, 24 nt, Human
auuagagucuuugaucaauuuuaa

SEQ ID NO: 1242045 - RNA, 24 nt, Human
auucaagaaaagcaaacaaaaaac

SEQ ID NO: 1242046 - RNA, 24 nt, Human
auucacaguuauacaaccaucacc

SEQ ID NO: 1242047 - RNA, 21 nt, Human
auuuucuuucuuucuguuucu

SEQ ID NO: 1242048 - RNA, 24 nt, Human
caaaaaugugagcuaagauuuuga

SEQ ID NO: 1242049 - RNA, 24 nt, Human
caaaaguccacaguccaaagucuc

SEQ ID NO: 1242050 - RNA, 25 nt, Human
caacucuaguuagagaagcagagau

SEQ ID NO: 1242051 - RNA, 24 nt, Human
caagaaaagcaaacaaaaaacaaa

SEQ ID NO: 1242052 - RNA, 23 nt, Human
cacaaggcaacaggaaggagucu

SEQ ID NO: 1242053 - RNA, 22 nt, Human
cacaauauaugguuuuugugag

SEQ ID NO: 1242054 - RNA, 20 nt, Human
caccucagaucaucaggcau

SEQ ID NO: 1242055 - RNA, 20 nt, Human
caccucagaucaucaggcau

SEQ ID NO: 1242056 - RNA, 20 nt, Human
caccuccugcugugcggcug

SEQ ID NO: 1242057 - RNA, 20 nt, Human
caccuguaauccagcuacuu

SEQ ID NO: 1242058 - RNA, 22 nt, Human
caccuguaauccagcuacuugg

SEQ ID NO: 1242059 - RNA, 23 nt, Human
caccuguaauccagcuacuuggg

SEQ ID NO: 1242060 - RNA, 26 nt, Human
caccuguaauccagcuacuugggagg

SEQ ID NO: 1242061 - RNA, 22 nt, Human
cacuccagccuggugacagagc

SEQ ID NO: 1242062 - RNA, 22 nt, Human
cacuccccauugccucccagaa

SEQ ID NO: 1242063 - RNA, 18 nt, Human
cacugaaucuccuaggag

SEQ ID NO: 1242064 - RNA, 20 nt, Human
cacugauuuuuguauaucgu

SEQ ID NO: 1242065 - RNA, 18 nt, Human
cacugcacuccagccugg

SEQ ID NO: 1242066 - RNA, 18 nt, Human
cacugcacuccagccugg

SEQ ID NO: 1242067 - RNA, 22 nt, Human
cacugcacuccagccuggugac

SEQ ID NO: 1242068 - RNA, 23 nt, Human
cacugcacuccagccuggugaca

SEQ ID NO: 1242069 - RNA, 23 nt, Human
cacugcacuccagccuggugaca

SEQ ID NO: 1242070 - RNA, 19 nt, Human
cagaaauaauaagaggauc

SEQ ID NO: 1242071 - RNA, 27 nt, Human
cagaacaagguccagaacgaccuuguu

SEQ ID NO: 1242072 - RNA, 22 nt, Human
cagaaucuuccuggccaggccu

SEQ ID NO: 1242073 - RNA, 24 nt, Human
cagcacuuugggagaccgaggcag

SEQ ID NO: 1242074 - RNA, 25 nt, Human
cagcacuuugggagaccgaggcagg

SEQ ID NO: 1242075 - RNA, 19 nt, Human
cagcaggaggcgccccccu

SEQ ID NO: 1242076 - RNA, 20 nt, Human
cagcauuauaaaugagaaua

SEQ ID NO: 1242077 - RNA, 24 nt, Human
cagcuacuugggaggcugaggcag

SEQ ID NO: 1242078 - RNA, 21 nt, Human
cagcucaggacaguuccgcag

SEQ ID NO: 1242079 - RNA, 19 nt, Human
cagcuccugugcuccuacu

SEQ ID NO: 1242080 - RNA, 24 nt, Human
caggacaauuccucaaacccagga

SEQ ID NO: 1242081 - RNA, 21 nt, Human
caggacaguuccgcagaguga

SEQ ID NO: 1242082 - RNA, 29 nt, Human
caggagguggagguuguagugacaacggu

SEQ ID NO: 1242083 - RNA, 23 nt, Human
caguacuacauucauuuucagac

SEQ ID NO: 1242084 - RNA, 20 nt, Human
cagucucuuaguugugaaaa

SEQ ID NO: 1242085 - RNA, 25 nt, Human
cauucccaggaaaugaauuauuaaa

SEQ ID NO: 1242086 - RNA, 23 nt, Human
cauucggcaaauuucgacugcuc

SEQ ID NO: 1242087 - RNA, 21 nt, Human
cauuuuuguuccagaacaagg

SEQ ID NO: 1242088 - RNA, 27 nt, Human
cauuuuuuagaauaaaagaaucagaaa

SEQ ID NO: 1242089 - RNA, 19 nt, Human
ccacucaccuccugcugug

SEQ ID NO: 1242090 - RNA, 19 nt, Human
ccacugcacuccagccugg

SEQ ID NO: 1242091 - RNA, 19 nt, Human
ccacugcacuccagccugg

SEQ ID NO: 1242092 - RNA, 20 nt, Human
ccacugcacuccagccuggu

SEQ ID NO: 1242093 - RNA, 23 nt, Human
ccacugcacuccagccuggugac

SEQ ID NO: 1242094 - RNA, 24 nt, Human
ccauacaauuaaaccauuuaaagu

SEQ ID NO: 1242095 - RNA, 18 nt, Human
cccaggagguggagguug

SEQ ID NO: 1242096 - RNA, 22 nt, Human
ccccagaccuugccacugcagu

SEQ ID NO: 1242097 - RNA, 19 nt, Human
ccccccggcgaagagcugg

SEQ ID NO: 1242098 - RNA, 22 nt, Human
ccuaagaauaauaucucucagc

SEQ ID NO: 1242099 - RNA, 22 nt, Human
ccucccagaaucuuccuggcca

SEQ ID NO: 1242100 - RNA, 18 nt, Human
ccucccagcuucuguuaa

SEQ ID NO: 1242101 - RNA, 23 nt, Human
ccugaaccuuugcuccugcccaa

SEQ ID NO: 1242102 - RNA, 22 nt, Human
ccuggccuacauggugaaaccc

SEQ ID NO: 1242103 - RNA, 24 nt, Human
ccuggccuacauggugaaacccca

SEQ ID NO: 1242104 - RNA, 18 nt, Human
ccuguaaucccagcacuu

SEQ ID NO: 1242105 - RNA, 22 nt, Human
ccuguaaucccagcacuuuggg

SEQ ID NO: 1242106 - RNA, 24 nt, Human
cgagaccauccuggccuacauggu

SEQ ID NO: 1242107 - RNA, 21 nt, Human
cggcugggcuccuaauaggcc

SEQ ID NO: 1242108 - RNA, 21 nt, Human
cuaagaauaauaucucucagc

SEQ ID NO: 1242109 - RNA, 21 nt, Human
cuaaugccacugcugaucuca

SEQ ID NO: 1242110 - RNA, 19 nt, Human
cucaaaaaaaaaaaaaguc

SEQ ID NO: 1242111 - RNA, 21 nt, Human
cucaaaaguccacaguccaaa

SEQ ID NO: 1242112 - RNA, 25 nt, Human
cuccacugcacuccagccuggugac

SEQ ID NO: 1242113 - RNA, 24 nt, Human
cucuaggcugggugugguggcuua

SEQ ID NO: 1242114 - RNA, 24 nt, Human
cucuuugguucuuaguauauucac

SEQ ID NO: 1242115 - RNA, 18 nt, Human
cugaaccuuugcuccugc

SEQ ID NO: 1242116 - RNA, 22 nt, Human
cugccuucauggaagacaauuu

SEQ ID NO: 1242117 - RNA, 22 nt, Human
cugguuguaacuggaaacccca

SEQ ID NO: 1242118 - RNA, 21 nt, Human
cuguggcuaggaaucaaaggc

SEQ ID NO: 1242119 - RNA, 19 nt, Human
cuuccuggccaggccuggc

SEQ ID NO: 1242120 - RNA, 21 nt, Human
cuugaagcuucuuucaagccc

SEQ ID NO: 1242121 - RNA, 25 nt, Human
gaaaagcaaacaaaaaacaaacuca

SEQ ID NO: 1242122 - RNA, 21 nt, Human
gaauaucaauaaaacccuuaa

SEQ ID NO: 1242123 - RNA, 21 nt, Human
gaauauucuuccuccauuaaa

SEQ ID NO: 1242124 - RNA, 21 nt, Human
gagagacaggagccacaaggg

SEQ ID NO: 1242125 - RNA, 21 nt, Human
gagcuagaaguccaacuucau

SEQ ID NO: 1242126 - RNA, 23 nt, Human
gaggcaggcggaucacaagguca

SEQ ID NO: 1242127 - RNA, 18 nt, Human
gagguggagguuguagug

SEQ ID NO: 1242128 - RNA, 21 nt, Human
gagguggagguuguagugggc

SEQ ID NO: 1242129 - RNA, 24 nt, Human
gaucacaaggucaagaguucgaga

SEQ ID NO: 1242130 - RNA, 20 nt, Human
gauucuguugcugauuuucc

SEQ ID NO: 1242131 - RNA, 23 nt, Human
gcacuccagccuggugacagagc

SEQ ID NO: 1242132 - RNA, 24 nt, Human
gcaucauuuguugaaaagaauauu

SEQ ID NO: 1242133 - RNA, 19 nt, Human
gcccaacauauuauuucug

SEQ ID NO: 1242134 - RNA, 22 nt, Human
gccuaacaacaggucacaaaga

SEQ ID NO: 1242135 - RNA, 24 nt, Human
gccuacauggugaaaccccaucuc

SEQ ID NO: 1242136 - RNA, 18 nt, Human
gcuggagcccaggacccg

SEQ ID NO: 1242137 - RNA, 21 nt, Human
gcuggagcccaggacccgcgu

SEQ ID NO: 1242138 - RNA, 22 nt, Human
ggagagacaggagccacaaggg

SEQ ID NO: 1242139 - RNA, 23 nt, Human
ggagaucugagagauacgugcuu

SEQ ID NO: 1242140 - RNA, 22 nt, Human
ggagguuguagugggcagagau

SEQ ID NO: 1242141 - RNA, 23 nt, Human
ggagguuguagugggcagagaug

SEQ ID NO: 1242142 - RNA, 20 nt, Human
ggagguuguagugggcaggc

SEQ ID NO: 1242143 - RNA, 22 nt, Human
ggccucucaauccccagaccuu

SEQ ID NO: 1242144 - RNA, 21 nt, Human
ggcgaagagcuggagcccagg

SEQ ID NO: 1242145 - RNA, 22 nt, Human
gggcaguggucgaugaccuuuu

SEQ ID NO: 1242146 - RNA, 24 nt, Human
gggugucguggcaugcaccuguaa

SEQ ID NO: 1242147 - RNA, 19 nt, Human
gguccuggacgugcugggu

SEQ ID NO: 1242148 - RNA, 22 nt, Human
ggucucuaggcuggguguggug

SEQ ID NO: 1242149 - RNA, 24 nt, Human
gguggagguuguagugggcagaga

SEQ ID NO: 1242150 - RNA, 24 nt, Human
gguggcuuaucccuguaaucccag

SEQ ID NO: 1242151 - RNA, 19 nt, Human
guauuguccuuugaagcac

SEQ ID NO: 1242152 - RNA, 21 nt, Human
gugugguggcuuaucccugua

SEQ ID NO: 1242153 - RNA, 22 nt, Human
uaaagcaguaaugccaagggac

SEQ ID NO: 1242154 - RNA, 25 nt, Human
uaaaguacacaacucuuugguucuu

SEQ ID NO: 1242155 - RNA, 18 nt, Human
uaagaaaucauugccuaa

SEQ ID NO: 1242156 - RNA, 20 nt, Human
uaagaauaauaucucucagc

SEQ ID NO: 1242157 - RNA, 23 nt, Human
uaaucuuucaaauacuauacaga

SEQ ID NO: 1242158 - RNA, 22 nt, Human
uaaugccacugcugaucucaca

SEQ ID NO: 1242159 - RNA, 24 nt, Human
uacaacucuaguuagagaagcaga

SEQ ID NO: 1242160 - RNA, 19 nt, Human
uacaauuagaucaaacaua

SEQ ID NO: 1242161 - RNA, 20 nt, Human
uacaauuagaucaaacauac

SEQ ID NO: 1242162 - RNA, 21 nt, Human
uacauagcaaaggcuaacauu

SEQ ID NO: 1242163 - RNA, 23 nt, Human
uacauggugaaaccccaucucua

SEQ ID NO: 1242164 - RNA, 20 nt, Human
uagaaaauaauuaagaccau

SEQ ID NO: 1242165 - RNA, 23 nt, Human
uagaguugguucaucaauuucug

SEQ ID NO: 1242166 - RNA, 23 nt, Human
uagaucccucgcaugcauaguuc

SEQ ID NO: 1242167 - RNA, 21 nt, Human
uagcaaaggcuaacauugaua

SEQ ID NO: 1242168 - RNA, 20 nt, Human
uagcugggugucguggcaug

SEQ ID NO: 1242169 - RNA, 18 nt, Human
uaggccacagacuggggu

SEQ ID NO: 1242170 - RNA, 24 nt, Human
uaguaaacagacuguaaaccuccc

SEQ ID NO: 1242171 - RNA, 24 nt, Human
uauaugaauaucaauaaaacccuu

SEQ ID NO: 1242172 - RNA, 24 nt, Human
uaucccuguaaucccagcacuuug

SEQ ID NO: 1242173 - RNA, 21 nt, Human
ucaaaaugauaguacaauuag

SEQ ID NO: 1242174 - RNA, 20 nt, Human
ucacaaggcaacaggaagga

SEQ ID NO: 1242175 - RNA, 24 nt, Human
ucacaaggucaagaguucgagacc

SEQ ID NO: 1242176 - RNA, 19 nt, Human
ucagcggcgcccgucccuc

SEQ ID NO: 1242177 - RNA, 24 nt, Human
ucaggaaacuuacaaucgcgcaga

SEQ ID NO: 1242178 - RNA, 23 nt, Human
ucaguccaugaacgugauauauc

SEQ ID NO: 1242179 - RNA, 24 nt, Human
ucauaaucuuaaaacauaaccacc

SEQ ID NO: 1242180 - RNA, 18 nt, Human
ucaucaauuucugcaaaa

SEQ ID NO: 1242181 - RNA, 21 nt, Human
ucauuuucagacaauaauauu

SEQ ID NO: 1242182 - RNA, 21 nt, Human
uccacaguccaaagucucauc

SEQ ID NO: 1242183 - RNA, 27 nt, Human
uccacaguccaaagucucaucugagac

SEQ ID NO: 1242184 - RNA, 23 nt, Human
uccacugcacuccagccugguga

SEQ ID NO: 1242185 - RNA, 22 nt, Human
uccaucucaaaaaaaaaaaaag

SEQ ID NO: 1242186 - RNA, 20 nt, Human
ucccauacaaauuuuagagu

SEQ ID NO: 1242187 - RNA, 18 nt, Human
ucccucgcaugcauaguu

SEQ ID NO: 1242188 - RNA, 19 nt, Human
ucccuguaaucccagcacu

SEQ ID NO: 1242189 - RNA, 22 nt, Human
ucccuguaaucccagcacuuug

SEQ ID NO: 1242190 - RNA, 23 nt, Human
ucccuguaaucccagcacuuugg

SEQ ID NO: 1242191 - RNA, 25 nt, Human
uccgcaucuuugucugugaaacuca

SEQ ID NO: 1242192 - RNA, 21 nt, Human
uccuuuugaaauuuccugaac

SEQ ID NO: 1242193 - RNA, 20 nt, Human
ucgcaugcauaguucccaau

SEQ ID NO: 1242194 - RNA, 28 nt, Human
ucuaauggcuaucuuguuucucgacaga

SEQ ID NO: 1242195 - RNA, 21 nt, Human
ucuaguuuuagcugugacauu

SEQ ID NO: 1242196 - RNA, 21 nt, Human
ucucuacuaaaaauacaaaaa

SEQ ID NO: 1242197 - RNA, 18 nt, Human
ucuugaugauuguagcuu

SEQ ID NO: 1242198 - RNA, 23 nt, Human
ucuuucuguuucucuucacuuuc

SEQ ID NO: 1242199 - RNA, 20 nt, Human
ugaaaaagguaaaucuaaua

SEQ ID NO: 1242200 - RNA, 23 nt, Human
ugaaaaagguaaaucuaauauca

SEQ ID NO: 1242201 - RNA, 21 nt, Human
ugaaaagaauauucuuccucc

SEQ ID NO: 1242202 - RNA, 19 nt, Human
ugaaaccccaucucuacua

SEQ ID NO: 1242203 - RNA, 19 nt, Human
ugaaacuguuucaccucag

SEQ ID NO: 1242204 - RNA, 21 nt, Human
ugaaccuuugcuccugcccaa

SEQ ID NO: 1242205 - RNA, 20 nt, Human
ugaaucuguagaucaauuug

SEQ ID NO: 1242206 - RNA, 23 nt, Human
ugagaaaaacuggcaccaugaug

SEQ ID NO: 1242207 - RNA, 21 nt, Human
ugagcuaagauuuugauaggg

SEQ ID NO: 1242208 - RNA, 24 nt, Human
ugaggcaggacaauuccucaaacc

SEQ ID NO: 1242209 - RNA, 25 nt, Human
ugaggcaggacaauuccucaaaccc

SEQ ID NO: 1242210 - RNA, 21 nt, Human
ugaggcagugauuuggugaac

SEQ ID NO: 1242211 - RNA, 22 nt, Human
ugauaguacaauuagaucaaac

SEQ ID NO: 1242212 - RNA, 19 nt, Human
ugauuugcaaauauuuucu

SEQ ID NO: 1242213 - RNA, 22 nt, Human
ugccagacacucuauauuugcu

SEQ ID NO: 1242214 - RNA, 18 nt, Human
ugccucagagaacagcug

SEQ ID NO: 1242215 - RNA, 20 nt, Human
ugccuccacugcacuccagc

SEQ ID NO: 1242216 - RNA, 22 nt, Human
ugcucuagaggauuacuccagc

SEQ ID NO: 1242217 - RNA, 21 nt, Human
uggaaagaaucaccagggaag

SEQ ID NO: 1242218 - RNA, 21 nt, Human
uggacagggugguggguggaa

SEQ ID NO: 1242219 - RNA, 24 nt, Human
uggacagucucuuaguugugaaaa

SEQ ID NO: 1242220 - RNA, 23 nt, Human
uggagagacaggagccacaaggg

SEQ ID NO: 1242221 - RNA, 18 nt, Human
uggccaggccuggcuagg

SEQ ID NO: 1242222 - RNA, 21 nt, Human
uggcuuaucccuguaauccca

SEQ ID NO: 1242223 - RNA, 22 nt, Human
uggcuuaucccuguaaucccag

SEQ ID NO: 1242224 - RNA, 24 nt, Human
uggcuuaucccuguaaucccagca

SEQ ID NO: 1242225 - RNA, 24 nt, Human
ugggagaccgaggcaggcggauca

SEQ ID NO: 1242226 - RNA, 18 nt, Human
ugggaggcugaggcagga

SEQ ID NO: 1242227 - RNA, 18 nt, Human
ugggaggcugaggcaggc

SEQ ID NO: 1242228 - RNA, 23 nt, Human
ugggcagagaugccuccacugca

SEQ ID NO: 1242229 - RNA, 21 nt, Human
ugggguuggggaccccugcuc

SEQ ID NO: 1242230 - RNA, 22 nt, Human
ugguaucucaaugcaacaguuu

SEQ ID NO: 1242231 - RNA, 19 nt, Human
ugguauguccugcaauucc

SEQ ID NO: 1242232 - RNA, 23 nt, Human
uggugacagagcaagaauccauc

SEQ ID NO: 1242233 - RNA, 24 nt, Human
ugguggcuuaucccuguaauccca

SEQ ID NO: 1242234 - RNA, 26 nt, Human
ugguuucauuugcuaaguaaaauuug

SEQ ID NO: 1242235 - RNA, 18 nt, Human
uguaaaauuuauuccugu

SEQ ID NO: 1242236 - RNA, 18 nt, Human
uguaacuggaaaccccaa

SEQ ID NO: 1242237 - RNA, 18 nt, Human
uguaauccagcuacuugg

SEQ ID NO: 1242238 - RNA, 22 nt, Human
ugugaaacucaggaguuagauu

SEQ ID NO: 1242239 - RNA, 20 nt, Human
uguguguuuggugucauauc

SEQ ID NO: 1242240 - RNA, 21 nt, Human
uguuuuauuauuuuggaugcu

SEQ ID NO: 1242241 - RNA, 22 nt, Human
uguuuuauuauuuuggaugcua

SEQ ID NO: 1242242 - RNA, 24 nt, Human
uuaaaacauaaccaccuugaagcu

SEQ ID NO: 1242243 - RNA, 27 nt, Human
uuaaagcaguaaugccaagggacuuac

SEQ ID NO: 1242244 - RNA, 18 nt, Human
uuaaucuaaaaaaaguac

SEQ ID NO: 1242245 - RNA, 22 nt, Human
uuacauagcaaaggcuaacauu

SEQ ID NO: 1242246 - RNA, 19 nt, Human
uuacuccagcuccugugcu

SEQ ID NO: 1242247 - RNA, 19 nt, Human
uuagaauaaaagaaucaga

SEQ ID NO: 1242248 - RNA, 26 nt, Human
uuagcagucacuccccauugccuccc

SEQ ID NO: 1242249 - RNA, 22 nt, Human
uuagcugggugucguggcaugc

SEQ ID NO: 1242250 - RNA, 24 nt, Human
uuaggucuguuaacauuucuuucc

SEQ ID NO: 1242251 - RNA, 21 nt, Human
uuaguuggucuuacaacuacu

SEQ ID NO: 1242252 - RNA, 20 nt, Human
uucaagaaaagcaaacaaaa

SEQ ID NO: 1242253 - RNA, 24 nt, Human
uucaagacuguauuuccauaaacc

SEQ ID NO: 1242254 - RNA, 25 nt, Human
uucacugaaucuccuaggagcucca

SEQ ID NO: 1242255 - RNA, 19 nt, Human
uucauauauugucuucuuc

SEQ ID NO: 1242256 - RNA, 24 nt, Human
uuccucaaacccaggagguggagg

SEQ ID NO: 1242257 - RNA, 22 nt, Human
uucuucugcuagaauuuuuauu

SEQ ID NO: 1242258 - RNA, 20 nt, Human
uugcauggcuggcccuggag

SEQ ID NO: 1242259 - RNA, 24 nt, Human
uugccuaacaacaggucacaaaga

SEQ ID NO: 1242260 - RNA, 19 nt, Human
uugcuccugcccaacauau

SEQ ID NO: 1242261 - RNA, 20 nt, Human
uugucuuuuuacuguugagu

SEQ ID NO: 1242262 - RNA, 20 nt, Human
uuugaaauuuccugaaccuu

SEQ ID NO: 1242263 - RNA, 23 nt, Human
uuugcccaaguaguaaacagacu

SEQ ID NO: 1242264 - RNA, 28 nt, Human
uuuuaugccaguuucauaaugucuugau

SEQ ID NO: 1242265 - RNA, 23 nt, Human
uuuuuauucuuuguguaacccua

SEQ ID NO: 1242266 - RNA, 19 nt, Human
aacccagggaaaccggcag

SEQ ID NO: 1242267 - RNA, 23 nt, Human
agccuagggccccagggcuuggg

SEQ ID NO: 1242268 - RNA, 20 nt, Human
cagucccuccccucgccuca

SEQ ID NO: 1242269 - RNA, 20 nt, Human
ccacgcccuacggaugcccc

SEQ ID NO: 1242270 - RNA, 19 nt, Human
ccagggaaaccggcagugc

SEQ ID NO: 1242271 - RNA, 19 nt, Human
cccagucccuccccucgcc

SEQ ID NO: 1242272 - RNA, 20 nt, Human
ccccacuuucccccucuucu

SEQ ID NO: 1242273 - RNA, 26 nt, Human
ccccacuuucccccucuucuucccag

SEQ ID NO: 1242274 - RNA, 21 nt, Human
cccccucuucuucccaguccc

SEQ ID NO: 1242275 - RNA, 18 nt, Human
ccgcucuccuccacgccc

SEQ ID NO: 1242276 - RNA, 20 nt, Human
ccucgggugaugggaacgga

SEQ ID NO: 1242277 - RNA, 21 nt, Human
cgccucacucggauccccagc

SEQ ID NO: 1242278 - RNA, 23 nt, Human
cuacggaugccccacuuuccccc

SEQ ID NO: 1242279 - RNA, 20 nt, Human
cuucuucccagucccucccc

SEQ ID NO: 1242280 - RNA, 21 nt, Human
gccuagggccccagggcuugg

SEQ ID NO: 1242281 - RNA, 19 nt, Human
gcgggagggauuacagccc

SEQ ID NO: 1242282 - RNA, 18 nt, Human
ggaaaccggcagugcagg

SEQ ID NO: 1242283 - RNA, 29 nt, Human
ggagaagccuagggccccagggcuugggg

SEQ ID NO: 1242284 - RNA, 21 nt, Human
uccacgcccuacggaugcccc

SEQ ID NO: 1242285 - RNA, 22 nt, Human
ucccccucuucuucccaguccc

SEQ ID NO: 1242286 - RNA, 24 nt, Human
ugccccacuuucccccucuucuuc

SEQ ID NO: 1242287 - RNA, 18 nt, Human
uggaggcuggcaagguag

SEQ ID NO: 1242288 - RNA, 23 nt, Human
uggcaagguaggggugcguggcc

SEQ ID NO: 1242289 - RNA, 21 nt, Human
uucggagaagccuagggcccc

SEQ ID NO: 1242290 - RNA, 18 nt, Human
uuucggagaagccuaggg

SEQ ID NO: 1242291 - RNA, 19 nt, Human
agaggggcgcggugcggga

SEQ ID NO: 1242292 - RNA, 22 nt, Human
aggaggagccgggccauucgaa

SEQ ID NO: 1242293 - RNA, 19 nt, Human
agucccuuccacggugagu

SEQ ID NO: 1242294 - RNA, 25 nt, Human
cacggugagugaacaguuuugguca

SEQ ID NO: 1242295 - RNA, 21 nt, Human
cccacgcggagagggcagccg

SEQ ID NO: 1242296 - RNA, 18 nt, Human
gcggagagggcagccgga

SEQ ID NO: 1242297 - RNA, 21 nt, Human
ggcgcggugcgggaggcgggg

SEQ ID NO: 1242298 - RNA, 23 nt, Human
ggcgcggugcgggaggcgggggu

SEQ ID NO: 1242299 - RNA, 25 nt, Human
ggugacaggaggagccgggccauuc

SEQ ID NO: 1242300 - RNA, 21 nt, Human
gugcgggaggcggggguaggg

SEQ ID NO: 1242301 - RNA, 20 nt, Human
ucagcaccugcgcggccaaa

SEQ ID NO: 1242302 - RNA, 20 nt, Human
ugacaggaggagccgggcca

SEQ ID NO: 1242303 - RNA, 23 nt, Human
ugagugaacaguuuuggucagaa

SEQ ID NO: 1242304 - RNA, 20 nt, Human
uggcuacugaaugcugcccu

SEQ ID NO: 1242305 - RNA, 18 nt, Human
uggugacaggaggagccg

SEQ ID NO: 1242306 - RNA, 20 nt, Human
aaaaagaggcaaacugaaaa

SEQ ID NO: 1242307 - RNA, 18 nt, Human
acggacagcccccuuccu

SEQ ID NO: 1242308 - RNA, 19 nt, Human
aggcugggauccaguugcu

SEQ ID NO: 1242309 - RNA, 24 nt, Human
caguguugggggaggagaagaagg

SEQ ID NO: 1242310 - RNA, 23 nt, Human
cauucccccugcaguguuggggg

SEQ ID NO: 1242311 - RNA, 22 nt, Human
cccccuuccuccagccaguccc

SEQ ID NO: 1242312 - RNA, 19 nt, Human
ccccuccccuuccugguuc

SEQ ID NO: 1242313 - RNA, 20 nt, Human
ccccuuccuccagccagucc

SEQ ID NO: 1242314 - RNA, 22 nt, Human
cccuuccugguucagguccugc

SEQ ID NO: 1242315 - RNA, 22 nt, Human
cgccccuccccuuccugguuca

SEQ ID NO: 1242316 - RNA, 18 nt, Human
cuccugggacucagcgcu

SEQ ID NO: 1242317 - RNA, 21 nt, Human
gaggagaagaaggcagugggg

SEQ ID NO: 1242318 - RNA, 22 nt, Human
gaggagaagaaggcagugggga

SEQ ID NO: 1242319 - RNA, 20 nt, Human
gggacucagcgcugcgccuc

SEQ ID NO: 1242320 - RNA, 20 nt, Human
guguugggggaggagaagaa

SEQ ID NO: 1242321 - RNA, 21 nt, Human
guugcugugcccagcuccacu

SEQ ID NO: 1242322 - RNA, 21 nt, Human
uaaaaagaggcaaacugaaaa

SEQ ID NO: 1242323 - RNA, 18 nt, Human
uaggacgcaguuccguaa

SEQ ID NO: 1242324 - RNA, 22 nt, Human
ucagguccugcuccugggacuc

SEQ ID NO: 1242325 - RNA, 22 nt, Human
ucuagcccaagaacagcgggcu

SEQ ID NO: 1242326 - RNA, 22 nt, Human
uggggcucuagcccaagaacag

SEQ ID NO: 1242327 - RNA, 21 nt, Human
ugggggaggagaagaaggcag

SEQ ID NO: 1242328 - RNA, 21 nt, Human
ugggggucauucccccagcac

SEQ ID NO: 1242329 - RNA, 20 nt, Human
ugguccagcgaggcccgugu

SEQ ID NO: 1242330 - RNA, 24 nt, Human
ugugcggggaggaggaggcaggac

SEQ ID NO: 1242331 - RNA, 22 nt, Human
aaucugcaauuggcauuuccca

SEQ ID NO: 1242332 - RNA, 22 nt, Human
agaacaucugggccgugucccc

SEQ ID NO: 1242333 - RNA, 22 nt, Human
cacagucuugacggugccaucc

SEQ ID NO: 1242334 - RNA, 18 nt, Human
caucaggaaauaaggucu

SEQ ID NO: 1242335 - RNA, 27 nt, Human
caucuuugaucuuaacccucccggagg

SEQ ID NO: 1242336 - RNA, 19 nt, Human
cauuuccagcuucaucuuu

SEQ ID NO: 1242337 - RNA, 19 nt, Human
ccacagcuguccccaaguc

SEQ ID NO: 1242338 - RNA, 19 nt, Human
ccccacagcuguccccaag

SEQ ID NO: 1242339 - RNA, 21 nt, Human
ccgccagucacuucugcuggg

SEQ ID NO: 1242340 - RNA, 23 nt, Human
ccucccggaggcauacuugguuu

SEQ ID NO: 1242341 - RNA, 18 nt, Human
cguugcugagcacaaugg

SEQ ID NO: 1242342 - RNA, 24 nt, Human
cugggaccagaacaucugggccgu

SEQ ID NO: 1242343 - RNA, 21 nt, Human
gaaauaaggucucuuccuguc

SEQ ID NO: 1242344 - RNA, 18 nt, Human
gagaaugucuuuuccuuu

SEQ ID NO: 1242345 - RNA, 24 nt, Human
ggggagagaaugucuuuuccuuug

SEQ ID NO: 1242346 - RNA, 21 nt, Human
uccacccuuacgauuguccca

SEQ ID NO: 1242347 - RNA, 19 nt, Human
ucccaucaggaaauaaggu

SEQ ID NO: 1242348 - RNA, 18 nt, Human
uccccacagcugucccca

SEQ ID NO: 1242349 - RNA, 27 nt, Human
ucguccaggacgacauuuccuacggua

SEQ ID NO: 1242350 - RNA, 21 nt, Human
ucuagaugacuuggguagucc

SEQ ID NO: 1242351 - RNA, 22 nt, Human
ucugcaauuggcauuucccaug

SEQ ID NO: 1242352 - RNA, 19 nt, Human
ucugcugggaccagaacau

SEQ ID NO: 1242353 - RNA, 22 nt, Human
ucugcugggaccagaacaucug

SEQ ID NO: 1242354 - RNA, 19 nt, Human
ucuuugaucuuaacccucu

SEQ ID NO: 1242355 - RNA, 23 nt, Human
ucuuuuccuuugcaauuucuaga

SEQ ID NO: 1242356 - RNA, 19 nt, Human
uggguaguccuaaaguuuu

SEQ ID NO: 1242357 - RNA, 22 nt, Human
ugucuuuuccuuugcaauuucu

SEQ ID NO: 1242358 - RNA, 19 nt, Human
ugugcugcucuaaccaagu

SEQ ID NO: 1242359 - RNA, 25 nt, Human
uuuccugacagccgcugcaauacac

SEQ ID NO: 1242360 - RNA, 19 nt, Human
aaaaaaaagaaaaagaaaa

SEQ ID NO: 1242361 - RNA, 22 nt, Human
aaaagaaaaagaaaaaaaaaag

SEQ ID NO: 1242362 - RNA, 20 nt, Human
aaacaaaaaaaggacuauua

SEQ ID NO: 1242363 - RNA, 19 nt, Human
aaacaaacaaaaaaaggac

SEQ ID NO: 1242364 - RNA, 19 nt, Human
aaacaaccaagagaauauc

SEQ ID NO: 1242365 - RNA, 24 nt, Human
aacaaugaaaaacaaccaagagaa

SEQ ID NO: 1242366 - RNA, 21 nt, Human
acacacaacaaugaaaaacaa

SEQ ID NO: 1242367 - RNA, 19 nt, Human
acuggcccaugcacccagc

SEQ ID NO: 1242368 - RNA, 19 nt, Human
agaaaaagaaaaaaaaaag

SEQ ID NO: 1242369 - RNA, 23 nt, Human
agaauagaaacaaacaaacaaaa

SEQ ID NO: 1242370 - RNA, 20 nt, Human
agaauaucauccuacugaaa

SEQ ID NO: 1242371 - RNA, 23 nt, Human
caaacaaacaaaaaaaggacuau

SEQ ID NO: 1242372 - RNA, 21 nt, Human
caaacaucuuugucuaacuaa

SEQ ID NO: 1242373 - RNA, 28 nt, Human
caacaaugaaaaacaaccaagagaauau

SEQ ID NO: 1242374 - RNA, 25 nt, Human
caacccuaaacaaaguuucugcuag

SEQ ID NO: 1242375 - RNA, 23 nt, Human
caaugaaaaacaaccaagagaau

SEQ ID NO: 1242376 - RNA, 24 nt, Human
cacacaacaaugaaaaacaaccaa

SEQ ID NO: 1242377 - RNA, 25 nt, Human
cacacaacaaugaaaaacaaccaag

SEQ ID NO: 1242378 - RNA, 22 nt, Human
cagcaccugcgacucccgccgu

SEQ ID NO: 1242379 - RNA, 26 nt, Human
cauauuacagucuuuuagcaacccua

SEQ ID NO: 1242380 - RNA, 25 nt, Human
caugcacccagcaccugcgacuccc

SEQ ID NO: 1242381 - RNA, 20 nt, Human
ccccgcgcccacaccugccc

SEQ ID NO: 1242382 - RNA, 24 nt, Human
cccgcgcccacaccugcccguccc

SEQ ID NO: 1242383 - RNA, 18 nt, Human
cccgggcgaagcgcgagg

SEQ ID NO: 1242384 - RNA, 22 nt, Human
ccuagaauagaaacaaacaaac

SEQ ID NO: 1242385 - RNA, 19 nt, Human
ccuuaacuggagaggcggg

SEQ ID NO: 1242386 - RNA, 22 nt, Human
cgcaggcagggucuuggggcag

SEQ ID NO: 1242387 - RNA, 18 nt, Human
cuacauacauacaguagc

SEQ ID NO: 1242388 - RNA, 18 nt, Human
cucaaaaaaaaaaaaaag

SEQ ID NO: 1242389 - RNA, 25 nt, Human
cucaaaaaaaaaaaaaagaaaaaga

SEQ ID NO: 1242390 - RNA, 19 nt, Human
cucaaaaaaaaaaaaaagg

SEQ ID NO: 1242391 - RNA, 22 nt, Human
cugcccgucccuuccgucgucc

SEQ ID NO: 1242392 - RNA, 24 nt, Human
gaaaaacaaccaagagaauaucau

SEQ ID NO: 1242393 - RNA, 23 nt, Human
gcccaugcacccagcaccugcga

SEQ ID NO: 1242394 - RNA, 20 nt, Human
gcccgucccuuccgucgucc

SEQ ID NO: 1242395 - RNA, 19 nt, Human
ggaaauacuagaaauauau

SEQ ID NO: 1242396 - RNA, 21 nt, Human
ggcagcgccuggcucccgcgc

SEQ ID NO: 1242397 - RNA, 18 nt, Human
gggcagcgccuggcuccc

SEQ ID NO: 1242398 - RNA, 26 nt, Human
uaacaaauucaugcuuuuccucaaaa

SEQ ID NO: 1242399 - RNA, 19 nt, Human
uacagguuaaaacacugaa

SEQ ID NO: 1242400 - RNA, 20 nt, Human
uagaauagaaacaaacaaac

SEQ ID NO: 1242401 - RNA, 21 nt, Human
uagcuacauacauacaguagc

SEQ ID NO: 1242402 - RNA, 25 nt, Human
ucaaaaaaaaaaaaaagaaaaagaa

SEQ ID NO: 1242403 - RNA, 26 nt, Human
ucaaccccauuaaaacagcauuaaaa

SEQ ID NO: 1242404 - RNA, 27 nt, Human
ucaaccccauuaaaacagcauuaaaaa

SEQ ID NO: 1242405 - RNA, 21 nt, Human
ucaugagcaguuaucccuaga

SEQ ID NO: 1242406 - RNA, 25 nt, Human
uccccgggcgaagcgcgagguuccg

SEQ ID NO: 1242407 - RNA, 19 nt, Human
ucccuagaauagaaacaaa

SEQ ID NO: 1242408 - RNA, 18 nt, Human
uccgcgcggcgagggauc

SEQ ID NO: 1242409 - RNA, 19 nt, Human
uccucaaaaaaaaaaaaaa

SEQ ID NO: 1242410 - RNA, 20 nt, Human
uccucaaaaaaaaaaaaaag

SEQ ID NO: 1242411 - RNA, 22 nt, Human
uccucaaaaaaaaaaaaaagaa

SEQ ID NO: 1242412 - RNA, 21 nt, Human
ucuuggggcagcgccuggcuc

SEQ ID NO: 1242413 - RNA, 19 nt, Human
ugaaaaacaaccaagagaa

SEQ ID NO: 1242414 - RNA, 19 nt, Human
uggcucccgcgcugcuccu

SEQ ID NO: 1242415 - RNA, 18 nt, Human
uguggagaccacaggcua

SEQ ID NO: 1242416 - RNA, 28 nt, Human
uucaaccccauuaaaacagcauuaaaaa

SEQ ID NO: 1242417 - RNA, 24 nt, Human
uugaggugaggucacaggugggaa

SEQ ID NO: 1242418 - RNA, 21 nt, Human
aggaagugucucccugacaga

SEQ ID NO: 1242419 - RNA, 21 nt, Human
aggccugaggcugagaugcug

SEQ ID NO: 1242420 - RNA, 19 nt, Human
gagaugcugugcugcuacc

SEQ ID NO: 1242421 - RNA, 18 nt, Human
gcugugcugcuacccucg

SEQ ID NO: 1242422 - RNA, 25 nt, Human
uuuccucauccuggucggcuccugg

SEQ ID NO: 1242423 - RNA, 22 nt, Human
aaguaggagaugagaagcagag

SEQ ID NO: 1242424 - RNA, 18 nt, Human
aauccugggugaggauga

SEQ ID NO: 1242425 - RNA, 25 nt, Human
aaucuucagggaaacagaaaaaaga

SEQ ID NO: 1242426 - RNA, 21 nt, Human
acccagaaccaggaguccucc

SEQ ID NO: 1242427 - RNA, 21 nt, Human
agaaccaggaguccuccgccc

SEQ ID NO: 1242428 - RNA, 22 nt, Human
cagacgcccagcagcgccucuc

SEQ ID NO: 1242429 - RNA, 22 nt, Human
cagcacccagaaccaggagucc

SEQ ID NO: 1242430 - RNA, 22 nt, Human
ccagcacccagaaccaggaguc

SEQ ID NO: 1242431 - RNA, 22 nt, Human
cccagcagcgccucucagcaca

SEQ ID NO: 1242432 - RNA, 18 nt, Human
gaaucacuuuuaggaaca

SEQ ID NO: 1242433 - RNA, 22 nt, Human
ggaguccuccgcccagacgccc

SEQ ID NO: 1242434 - RNA, 21 nt, Human
gggaaacagaaaaaagagaga

SEQ ID NO: 1242435 - RNA, 21 nt, Human
ugagaagcagagugagaauca

SEQ ID NO: 1242436 - RNA, 25 nt, Human
ugggagcagguacaggagaauccug

SEQ ID NO: 1242437 - RNA, 24 nt, Human
uguaaguaggagaugagaagcaga

SEQ ID NO: 1242438 - RNA, 25 nt, Human
aggccagcagacccaaguucaggca

SEQ ID NO: 1242439 - RNA, 25 nt, Human
aggccagcagacccaaguucaggca

SEQ ID NO: 1242440 - RNA, 22 nt, Human
aggccugugaugaggcaaguaa

SEQ ID NO: 1242441 - RNA, 20 nt, Human
caagcugauuuauugucagu

SEQ ID NO: 1242442 - RNA, 26 nt, Human
ccagcagacccaaguucaggcaagcu

SEQ ID NO: 1242443 - RNA, 20 nt, Human
cugccgggcuaccuccugac

SEQ ID NO: 1242444 - RNA, 21 nt, Human
uggccuuaugggcugcuuugu

SEQ ID NO: 1242445 - RNA, 22 nt, Human
uggccuuaugggcugcuuuguu

SEQ ID NO: 1242446 - RNA, 20 nt, Human
aaaaauacuguaauuauaau

SEQ ID NO: 1242447 - RNA, 20 nt, Human
aaaagaauucagggccaccc

SEQ ID NO: 1242448 - RNA, 19 nt, Human
aaaguucagaagcuugaaa

SEQ ID NO: 1242449 - RNA, 21 nt, Human
aaccacacagccaucaucaac

SEQ ID NO: 1242450 - RNA, 22 nt, Human
aaccacacagccaucaucaaca

SEQ ID NO: 1242451 - RNA, 24 nt, Human
aagcagucaggacuuagguccuca

SEQ ID NO: 1242452 - RNA, 19 nt, Human
acccacagccuaguaacac

SEQ ID NO: 1242453 - RNA, 18 nt, Human
acuaugccuucuuugaaa

SEQ ID NO: 1242454 - RNA, 22 nt, Human
acucccuugccucuaguuuacu

SEQ ID NO: 1242455 - RNA, 18 nt, Human
acuccucuucccauuucc

SEQ ID NO: 1242456 - RNA, 19 nt, Human
agcauuuuagcaaagcuau

SEQ ID NO: 1242457 - RNA, 18 nt, Human
agcccuuagccaccaugc

SEQ ID NO: 1242458 - RNA, 20 nt, Human
auaagcaaaaguucagaagc

SEQ ID NO: 1242459 - RNA, 19 nt, Human
aucucaucaaccaagagaa

SEQ ID NO: 1242460 - RNA, 26 nt, Human
auuugggugaggaaacuaugacgcua

SEQ ID NO: 1242461 - RNA, 23 nt, Human
caagagucagccucuccauauuc

SEQ ID NO: 1242462 - RNA, 21 nt, Human
cacacagccaucaucaacagc

SEQ ID NO: 1242463 - RNA, 27 nt, Human
caccacaagcaagagucagccucucca

SEQ ID NO: 1242464 - RNA, 24 nt, Human
cacugcugagcccccaaaacccac

SEQ ID NO: 1242465 - RNA, 20 nt, Human
cagauuuauguuucuuguca

SEQ ID NO: 1242466 - RNA, 21 nt, Human
cagcaaaugcuuggacuccaa

SEQ ID NO: 1242467 - RNA, 21 nt, Human
cagcacccggaaccacacagc

SEQ ID NO: 1242468 - RNA, 23 nt, Human
cauaagcaaaaguucagaagcuu

SEQ ID NO: 1242469 - RNA, 21 nt, Human
caucuuugaucuaaguguggg

SEQ ID NO: 1242470 - RNA, 24 nt, Human
ccaaaacccacagccuaguaacac

SEQ ID NO: 1242471 - RNA, 19 nt, Human
ccacagccuaguaacacca

SEQ ID NO: 1242472 - RNA, 18 nt, Human
ccacagcuguauucuuca

SEQ ID NO: 1242473 - RNA, 18 nt, Human
ccaccccaccacaagcaa

SEQ ID NO: 1242474 - RNA, 25 nt, Human
ccauauuccuccuuuuagcucugug

SEQ ID NO: 1242475 - RNA, 21 nt, Human
cccccaaaacccacagccuag

SEQ ID NO: 1242476 - RNA, 20 nt, Human
cccuuacugcaucuuugauc

SEQ ID NO: 1242477 - RNA, 18 nt, Human
ccuacaacuuuguagggg

SEQ ID NO: 1242478 - RNA, 24 nt, Human
cgugaaaaguccaacugaucaaua

SEQ ID NO: 1242479 - RNA, 24 nt, Human
cuaaagcaaaacauccuguucacu

SEQ ID NO: 1242480 - RNA, 22 nt, Human
cucaaaagaauucagggccacc

SEQ ID NO: 1242481 - RNA, 19 nt, Human
cuccaagcugugccuugcc

SEQ ID NO: 1242482 - RNA, 22 nt, Human
cugagcccccaaaacccacagc

SEQ ID NO: 1242483 - RNA, 19 nt, Human
cugcugagcccccaaaacc

SEQ ID NO: 1242484 - RNA, 19 nt, Human
cugcugagcccccaaaacc

SEQ ID NO: 1242485 - RNA, 19 nt, Human
cuuccacagcaccagcacc

SEQ ID NO: 1242486 - RNA, 23 nt, Human
gaucucaucaaccaagagaaugu

SEQ ID NO: 1242487 - RNA, 27 nt, Human
gcacucuuguaaaaaaagccagaauuc

SEQ ID NO: 1242488 - RNA, 22 nt, Human
gcccccaaaacccacagccuag

SEQ ID NO: 1242489 - RNA, 19 nt, Human
gccucuaguuuacuccucu

SEQ ID NO: 1242490 - RNA, 24 nt, Human
gggaauaacgagcaacgcaucagc

SEQ ID NO: 1242491 - RNA, 19 nt, Human
uaaagcaaaacauccuguu

SEQ ID NO: 1242492 - RNA, 21 nt, Human
uaccacgggcucaccuuggga

SEQ ID NO: 1242493 - RNA, 23 nt, Human
uacugcaucuuugaucuaagugu

SEQ ID NO: 1242494 - RNA, 22 nt, Human
uaguaauuugggugaggaaacu

SEQ ID NO: 1242495 - RNA, 21 nt, Human
uauucuucaggaucacuuugc

SEQ ID NO: 1242496 - RNA, 21 nt, Human
ucaauaaugugauagaacgag

SEQ ID NO: 1242497 - RNA, 23 nt, Human
ucacugggugaaagaccugcuuu

SEQ ID NO: 1242498 - RNA, 20 nt, Human
ucagugcaauuuuuaaaaaa

SEQ ID NO: 1242499 - RNA, 23 nt, Human
uccacagcaccagcacccggaac

SEQ ID NO: 1242500 - RNA, 22 nt, Human
uccacagcuguauucuucagga

SEQ ID NO: 1242501 - RNA, 21 nt, Human
ucccuuacugcaucuuugauc

SEQ ID NO: 1242502 - RNA, 23 nt, Human
ucgcaugaucucaucaaccaaga

SEQ ID NO: 1242503 - RNA, 23 nt, Human
ucugcugcuaccacgggcucacc

SEQ ID NO: 1242504 - RNA, 23 nt, Human
ugaaagaccugcuuuaucugugu

SEQ ID NO: 1242505 - RNA, 23 nt, Human
ugaaagagcaucuaaggaaaagg

SEQ ID NO: 1242506 - RNA, 18 nt, Human
ugacgcuagaggcuuugg

SEQ ID NO: 1242507 - RNA, 23 nt, Human
ugagcccccaaaacccacagccu

SEQ ID NO: 1242508 - RNA, 23 nt, Human
ugaggaaacuaugacgcuagagg

SEQ ID NO: 1242509 - RNA, 20 nt, Human
ugccauugccacuuccacag

SEQ ID NO: 1242510 - RNA, 19 nt, Human
ugcugagcccccaaaaccc

SEQ ID NO: 1242511 - RNA, 21 nt, Human
ugcugagcccccaaaacccac

SEQ ID NO: 1242512 - RNA, 22 nt, Human
ugggaugaauauuuugcauaag

SEQ ID NO: 1242513 - RNA, 22 nt, Human
uguaaaaaaagccagaauucac

SEQ ID NO: 1242514 - RNA, 26 nt, Human
uguaaaaaaagccagaauucacuucu

SEQ ID NO: 1242515 - RNA, 24 nt, Human
uguuacacuucucaauaaagguga

SEQ ID NO: 1242516 - RNA, 28 nt, Human
uuccacagcuguauucuucaggaucacu

SEQ ID NO: 1242517 - RNA, 21 nt, Human
uugaaagagcaucuaaggaaa

SEQ ID NO: 1242518 - RNA, 19 nt, Human
uuuauguuucuugucaaug

SEQ ID NO: 1242519 - RNA, 20 nt, Human
aacugguuaaaggcuuggcc

SEQ ID NO: 1242520 - RNA, 21 nt, Human
acagcaauacccagggagacc

SEQ ID NO: 1242521 - RNA, 18 nt, Human
agacaggugaucaagucu

SEQ ID NO: 1242522 - RNA, 24 nt, Human
agucccauuucccggcuuccaggg

SEQ ID NO: 1242523 - RNA, 21 nt, Human
cagcaauacccagggagacca

SEQ ID NO: 1242524 - RNA, 22 nt, Human
cagcaauacccagggagaccaa

SEQ ID NO: 1242525 - RNA, 20 nt, Human
cauaaaucugcagauaccuu

SEQ ID NO: 1242526 - RNA, 22 nt, Human
ccgcugagcacaauccaggcau

SEQ ID NO: 1242527 - RNA, 19 nt, Human
guaacugggcguuuggcua

SEQ ID NO: 1242528 - RNA, 22 nt, Human
gucccauuucccggcuuccagg

SEQ ID NO: 1242529 - RNA, 21 nt, Human
gucucugaaugucaacagucc

SEQ ID NO: 1242530 - RNA, 23 nt, Human
uaaaggcuuuguuacauuuuuuu

SEQ ID NO: 1242531 - RNA, 19 nt, Human
uaaccucuuugggcaccuc

SEQ ID NO: 1242532 - RNA, 19 nt, Human
uaacugggcguuuggcuac

SEQ ID NO: 1242533 - RNA, 18 nt, Human
uacauuuguaguguuuuu

SEQ ID NO: 1242534 - RNA, 23 nt, Human
uacccagggagaccaaguuucug

SEQ ID NO: 1242535 - RNA, 18 nt, Human
uauuuugcuccagacagg

SEQ ID NO: 1242536 - RNA, 25 nt, Human
ucaacagucccauuucccggcuucc

SEQ ID NO: 1242537 - RNA, 18 nt, Human
ucacuauaaccucuuugg

SEQ ID NO: 1242538 - RNA, 18 nt, Human
uccauauguucuugguau

SEQ ID NO: 1242539 - RNA, 19 nt, Human
uccuccagagagaauucua

SEQ ID NO: 1242540 - RNA, 24 nt, Human
ucuauuggaauuugaaaauuuacc

SEQ ID NO: 1242541 - RNA, 24 nt, Human
ucucuuagguuuauuaagguuuga

SEQ ID NO: 1242542 - RNA, 24 nt, Human
ucugaaugucaacagucccauuuc

SEQ ID NO: 1242543 - RNA, 21 nt, Human
ucuuuuagccauaaaucugca

SEQ ID NO: 1242544 - RNA, 20 nt, Human
ugaaauauuuuguuuugggu

SEQ ID NO: 1242545 - RNA, 21 nt, Human
ugaaugucaacagucccauuu

SEQ ID NO: 1242546 - RNA, 23 nt, Human
ugggaaugcguaacugggcguuu

SEQ ID NO: 1242547 - RNA, 23 nt, Human
uguaggguuucucuccaguguga

SEQ ID NO: 1242548 - RNA, 19 nt, Human
uguccaauaugaauucucu

SEQ ID NO: 1242549 - RNA, 20 nt, Human
uguuucuuuccaguauaucu

SEQ ID NO: 1242550 - RNA, 26 nt, Human
uucuauagcuaugucucugaauguca

SEQ ID NO: 1242551 - RNA, 18 nt, Human
uuggcuaccaucucauuu

SEQ ID NO: 1242552 - RNA, 18 nt, Human
uugguauuacuuuuugga

SEQ ID NO: 1242553 - RNA, 19 nt, Human
uuuguaggguuucucucca

SEQ ID NO: 1242554 - RNA, 24 nt, Human
aaaugacaucagaggccugugcuc

SEQ ID NO: 1242555 - RNA, 22 nt, Human
acccgccccaccuccgccggcu

SEQ ID NO: 1242556 - RNA, 19 nt, Human
accucggcggcacccgccc

SEQ ID NO: 1242557 - RNA, 19 nt, Human
aggcggacucgggguggcc

SEQ ID NO: 1242558 - RNA, 20 nt, Human
agggggaggcaggucaggaa

SEQ ID NO: 1242559 - RNA, 22 nt, Human
aggucaggaaaugacaucagag

SEQ ID NO: 1242560 - RNA, 18 nt, Human
cacucagugugaacaaga

SEQ ID NO: 1242561 - RNA, 18 nt, Human
cccgugcacccuggagcc

SEQ ID NO: 1242562 - RNA, 23 nt, Human
cccgugcacccuggagcccagcu

SEQ ID NO: 1242563 - RNA, 19 nt, Human
ccggaggcgcacaggggcu

SEQ ID NO: 1242564 - RNA, 19 nt, Human
cggacucgggguggccggg

SEQ ID NO: 1242565 - RNA, 21 nt, Human
cgggguggccggguagcgggu

SEQ ID NO: 1242566 - RNA, 25 nt, Human
gauccugccuuuaccugggugugac

SEQ ID NO: 1242567 - RNA, 20 nt, Human
ggacucgggguggccgggua

SEQ ID NO: 1242568 - RNA, 23 nt, Human
ggccggaggcgcacaggggcugc

SEQ ID NO: 1242569 - RNA, 23 nt, Human
ggcggggagggggaggcagguca

SEQ ID NO: 1242570 - RNA, 22 nt, Human
gggcggggagggggaggcaggu

SEQ ID NO: 1242571 - RNA, 23 nt, Human
ggguagcgggugguggcaggagg

SEQ ID NO: 1242572 - RNA, 18 nt, Human
uaccugggugugacccgg

SEQ ID NO: 1242573 - RNA, 19 nt, Human
uaccugggugugacccggg

SEQ ID NO: 1242574 - RNA, 20 nt, Human
ucaggaaaugacaucagagg

SEQ ID NO: 1242575 - RNA, 22 nt, Human
uggccggguagcgggugguggc

SEQ ID NO: 1242576 - RNA, 18 nt, Human
ugugaacaagacgaaggc

SEQ ID NO: 1242577 - RNA, 23 nt, Human
uuggagggacuggacacucagug

SEQ ID NO: 1242578 - RNA, 18 nt, Human
cauggagagcuguccccc

SEQ ID NO: 1242579 - RNA, 23 nt, Human
ccagagccaccucuugcuggaga

SEQ ID NO: 1242580 - RNA, 21 nt, Human
gagagcugucccccauggaga

SEQ ID NO: 1242581 - RNA, 22 nt, Human
aaacauauaccagaauauauca

SEQ ID NO: 1242582 - RNA, 19 nt, Human
aaaggauaggauuacaggc

SEQ ID NO: 1242583 - RNA, 23 nt, Human
aaaggauaggauuacaggcguga

SEQ ID NO: 1242584 - RNA, 21 nt, Human
aaaugaaagacuaaaacaacc

SEQ ID NO: 1242585 - RNA, 20 nt, Human
aagagacaaaugaaagacua

SEQ ID NO: 1242586 - RNA, 26 nt, Human
aagagacaaaugaaagacuaaaacaa

SEQ ID NO: 1242587 - RNA, 24 nt, Human
aagcaauccuccugcucaaccucc

SEQ ID NO: 1242588 - RNA, 23 nt, Human
aaugauaaacauauaccagaaua

SEQ ID NO: 1242589 - RNA, 24 nt, Human
accgugucgcccaggcuggucucg

SEQ ID NO: 1242590 - RNA, 25 nt, Human
accgugucgcccaggcuggucucga

SEQ ID NO: 1242591 - RNA, 19 nt, Human
acggggccgggccuccccc

SEQ ID NO: 1242592 - RNA, 19 nt, Human
acgggguuucaccgugucg

SEQ ID NO: 1242593 - RNA, 24 nt, Human
acgggguuucaccgugucgcccag

SEQ ID NO: 1242594 - RNA, 19 nt, Human
acuacaggcgcgugccgcc

SEQ ID NO: 1242595 - RNA, 23 nt, Human
acuacaggugcccaccacaccag

SEQ ID NO: 1242596 - RNA, 26 nt, Human
agacagggucuggcuauaucguccag

SEQ ID NO: 1242597 - RNA, 22 nt, Human
agagacagagucucgcucuguc

SEQ ID NO: 1242598 - RNA, 22 nt, Human
aggcaauccgcccaccucggcc

SEQ ID NO: 1242599 - RNA, 24 nt, Human
aggcaauccgcccaccucggccuc

SEQ ID NO: 1242600 - RNA, 19 nt, Human
agggacgggguuucaccgu

SEQ ID NO: 1242601 - RNA, 19 nt, Human
aguagcugggacuacaggc

SEQ ID NO: 1242602 - RNA, 23 nt, Human
aguagcugggacuacaggcgcgu

SEQ ID NO: 1242603 - RNA, 20 nt, Human
aguagggacgggguuucacc

SEQ ID NO: 1242604 - RNA, 20 nt, Human
agugcagcggcgcgaucucg

SEQ ID NO: 1242605 - RNA, 24 nt, Human
agugcagcggcgcgaucucggcuc

SEQ ID NO: 1242606 - RNA, 22 nt, Human
aucccacuccgcccagggccaa

SEQ ID NO: 1242607 - RNA, 24 nt, Human
auggaugacaaauucuugguuuuu

SEQ ID NO: 1242608 - RNA, 24 nt, Human
auuuuaguagggacgggguuucac

SEQ ID NO: 1242609 - RNA, 24 nt, Human
auuuuuuguauuuuaguagggacg

SEQ ID NO: 1242610 - RNA, 25 nt, Human
caaacuccugggcucaagcaauccu

SEQ ID NO: 1242611 - RNA, 19 nt, Human
caaaugaaagacuaaaaca

SEQ ID NO: 1242612 - RNA, 22 nt, Human
caagccauucuccugccucagc

SEQ ID NO: 1242613 - RNA, 21 nt, Human
cacccaaucccacuccgcccg

SEQ ID NO: 1242614 - RNA, 21 nt, Human
caccgugucgcccaggcuggu

SEQ ID NO: 1242615 - RNA, 24 nt, Human
caccgugucgcccaggcuggucuc

SEQ ID NO: 1242616 - RNA, 27 nt, Human
caccgugucgcccaggcuggucucgaa

SEQ ID NO: 1242617 - RNA, 23 nt, Human
caccucggccuccuaaaggauag

SEQ ID NO: 1242618 - RNA, 21 nt, Human
cacggcauagccggguccagc

SEQ ID NO: 1242619 - RNA, 20 nt, Human
cacucgcggccacugcgaac

SEQ ID NO: 1242620 - RNA, 20 nt, Human
cagccuccugaguagcuggg

SEQ ID NO: 1242621 - RNA, 24 nt, Human
cagggucuggcuauaucguccagg

SEQ ID NO: 1242622 - RNA, 21 nt, Human
caugacauacauacaaaugua

SEQ ID NO: 1242623 - RNA, 23 nt, Human
ccagggaccaggccgguccggcc

SEQ ID NO: 1242624 - RNA, 22 nt, Human
ccagggccaagaagcccgagga

SEQ ID NO: 1242625 - RNA, 23 nt, Human
cccacauagccugaagguaaggu

SEQ ID NO: 1242626 - RNA, 23 nt, Human
cccacuccgcccagggccaagaa

SEQ ID NO: 1242627 - RNA, 19 nt, Human
ccccagcacguccccagcu

SEQ ID NO: 1242628 - RNA, 19 nt, Human
ccccaggacucgccgcgga

SEQ ID NO: 1242629 - RNA, 19 nt, Human
ccccccagcacguccccag

SEQ ID NO: 1242630 - RNA, 20 nt, Human
ccgccacgcccggcuaauuu

SEQ ID NO: 1242631 - RNA, 19 nt, Human
ccgcccagggccaagaagc

SEQ ID NO: 1242632 - RNA, 22 nt, Human
ccgcccagggccaagaagcccg

SEQ ID NO: 1242633 - RNA, 24 nt, Human
ccuaaaggauaggauuacaggcgu

SEQ ID NO: 1242634 - RNA, 22 nt, Human
ccuccugcucaaccucccgagu

SEQ ID NO: 1242635 - RNA, 23 nt, Human
ccugaguagcugggacuacaggc

SEQ ID NO: 1242636 - RNA, 23 nt, Human
ccugaguagcugggacuacaggc

SEQ ID NO: 1242637 - RNA, 23 nt, Human
ccugcucaaccucccgaguagcu

SEQ ID NO: 1242638 - RNA, 18 nt, Human
ccugggcucaagcaaucc

SEQ ID NO: 1242639 - RNA, 23 nt, Human
ccugggcucaagcaauccuccug

SEQ ID NO: 1242640 - RNA, 24 nt, Human
cgaauuuuagagcauuuuggauuu

SEQ ID NO: 1242641 - RNA, 19 nt, Human
cgaggaggccgcagaaccg

SEQ ID NO: 1242642 - RNA, 18 nt, Human
cgccagggaccaggccgg

SEQ ID NO: 1242643 - RNA, 24 nt, Human
cgcccaggcuggucucgaacuccu

SEQ ID NO: 1242644 - RNA, 24 nt, Human
cgcucugucgcccaggcuggagug

SEQ ID NO: 1242645 - RNA, 20 nt, Human
cggacccgacaggacgccag

SEQ ID NO: 1242646 - RNA, 21 nt, Human
cggccagagcggcucagguac

SEQ ID NO: 1242647 - RNA, 18 nt, Human
cgggacagcggggccucg

SEQ ID NO: 1242648 - RNA, 24 nt, Human
cgggguuucaccgugucgcccagg

SEQ ID NO: 1242649 - RNA, 23 nt, Human
cuaaaggauaggauuacaggcgu

SEQ ID NO: 1242650 - RNA, 23 nt, Human
cucaagcaauccuccugcucaac

SEQ ID NO: 1242651 - RNA, 24 nt, Human
cucagccuccugaguagcugggac

SEQ ID NO: 1242652 - RNA, 21 nt, Human
cucaggcaauccgcccaccuc

SEQ ID NO: 1242653 - RNA, 24 nt, Human
cuccugcccauacaaaaccacuca

SEQ ID NO: 1242654 - RNA, 23 nt, Human
cuccugggcucaagcaauccucc

SEQ ID NO: 1242655 - RNA, 25 nt, Human
cuccugggcucaagcaauccuccug

SEQ ID NO: 1242656 - RNA, 24 nt, Human
cucgcucugucgcccaggcuggag

SEQ ID NO: 1242657 - RNA, 23 nt, Human
cucugucgcccaggcuggagugc

SEQ ID NO: 1242658 - RNA, 23 nt, Human
cugccucagccuccugaguagcu

SEQ ID NO: 1242659 - RNA, 24 nt, Human
cuugcggagaccccaggacucgcc

SEQ ID NO: 1242660 - RNA, 24 nt, Human
gaacucaggcaauccgcccaccuc

SEQ ID NO: 1242661 - RNA, 23 nt, Human
gaacuccugaacucaggcaaucc

SEQ ID NO: 1242662 - RNA, 22 nt, Human
gacaaaugaaagacuaaaacaa

SEQ ID NO: 1242663 - RNA, 18 nt, Human
gacgggguuucaccgugu

SEQ ID NO: 1242664 - RNA, 22 nt, Human
gacgggguuucaccgugucgcc

SEQ ID NO: 1242665 - RNA, 26 nt, Human
gaguagcugggacuacaggcgcgugc

SEQ ID NO: 1242666 - RNA, 18 nt, Human
gauuacaggcgugagcca

SEQ ID NO: 1242667 - RNA, 22 nt, Human
gauuacaggcgugagccaccgc

SEQ ID NO: 1242668 - RNA, 22 nt, Human
gauuacaggcgugagccaccgc

SEQ ID NO: 1242669 - RNA, 19 nt, Human
gcaccgcgggcucugcugu

SEQ ID NO: 1242670 - RNA, 20 nt, Human
gcauagccggguccagcgcg

SEQ ID NO: 1242671 - RNA, 19 nt, Human
gcccaggcuggagugcagc

SEQ ID NO: 1242672 - RNA, 23 nt, Human
gcccggcuaauuuuuuguauuuu

SEQ ID NO: 1242673 - RNA, 20 nt, Human
gccucagccuccugaguagc

SEQ ID NO: 1242674 - RNA, 18 nt, Human
gccuugcucggccagagc

SEQ ID NO: 1242675 - RNA, 30 nt, Human
gcgcccggccccuucucuuuuuuaaaaccc

SEQ ID NO: 1242676 - RNA, 22 nt, Human
gcgccuugcucggccagagcgg

SEQ ID NO: 1242677 - RNA, 22 nt, Human
gcggggccucgggcagcgacgg

SEQ ID NO: 1242678 - RNA, 20 nt, Human
gcucauugcaaccuccccca

SEQ ID NO: 1242679 - RNA, 21 nt, Human
gcucauugcaaccucccccac

SEQ ID NO: 1242680 - RNA, 19 nt, Human
gcuggagugcagcggcgcg

SEQ ID NO: 1242681 - RNA, 22 nt, Human
ggauuacaggcgugagccaccg

SEQ ID NO: 1242682 - RNA, 26 nt, Human
ggccucgggcagcgacggggccgggc

SEQ ID NO: 1242683 - RNA, 19 nt, Human
gggcucaagcaauccuccu

SEQ ID NO: 1242684 - RNA, 19 nt, Human
guagaacaaaggccaacuu

SEQ ID NO: 1242685 - RNA, 24 nt, Human
gucucgcucugucgcccaggcugg

SEQ ID NO: 1242686 - RNA, 18 nt, Human
uaaaacaaccagaaaaca

SEQ ID NO: 1242687 - RNA, 23 nt, Human
uaaaacaaccagaaaacauugga

SEQ ID NO: 1242688 - RNA, 24 nt, Human
uaaaagguuuccugauuacaaagg

SEQ ID NO: 1242689 - RNA, 21 nt, Human
uaauuuuuuguauuuuaguag

SEQ ID NO: 1242690 - RNA, 24 nt, Human
uaauuuuuuguauuuuaguaggga

SEQ ID NO: 1242691 - RNA, 23 nt, Human
uacaggcgugagccaccgcgccc

SEQ ID NO: 1242692 - RNA, 23 nt, Human
uacaggugcccaccacaccaggc

SEQ ID NO: 1242693 - RNA, 18 nt, Human
uacuacuccagguccggc

SEQ ID NO: 1242694 - RNA, 23 nt, Human
uacuacuccagguccggccgcac

SEQ ID NO: 1242695 - RNA, 23 nt, Human
uagaacaaaggccaacuuaaagc

SEQ ID NO: 1242696 - RNA, 18 nt, Human
uaggauuacaggcgugag

SEQ ID NO: 1242697 - RNA, 19 nt, Human
uaggauuacaggcgugagc

SEQ ID NO: 1242698 - RNA, 21 nt, Human
uaggauuacaggcgugagcca

SEQ ID NO: 1242699 - RNA, 22 nt, Human
uaggauuacaggcgugagccac

SEQ ID NO: 1242700 - RNA, 23 nt, Human
uaggauuacaggcgugagccacc

SEQ ID NO: 1242701 - RNA, 24 nt, Human
uaggauuacaggcgugagccaccg

SEQ ID NO: 1242702 - RNA, 21 nt, Human
uaguagggacgggguuucacc

SEQ ID NO: 1242703 - RNA, 24 nt, Human
uaguagggacgggguuucaccgug

SEQ ID NO: 1242704 - RNA, 25 nt, Human
uaguagggacgggguuucaccgugu

SEQ ID NO: 1242705 - RNA, 18 nt, Human
uauaucguccaggcugga

SEQ ID NO: 1242706 - RNA, 21 nt, Human
uauaucguccaggcuggacuc

SEQ ID NO: 1242707 - RNA, 22 nt, Human
uauaucguccaggcuggacuca

SEQ ID NO: 1242708 - RNA, 18 nt, Human
uaucugaaaugcuuggga

SEQ ID NO: 1242709 - RNA, 25 nt, Human
ucaagccauucuccugccucagccu

SEQ ID NO: 1242710 - RNA, 19 nt, Human
ucacccagugucacaugag

SEQ ID NO: 1242711 - RNA, 23 nt, Human
ucagccuccugaguagcugggac

SEQ ID NO: 1242712 - RNA, 22 nt, Human
ucauugcaaccucccccacccg

SEQ ID NO: 1242713 - RNA, 24 nt, Human
ucauugcaaccucccccacccgag

SEQ ID NO: 1242714 - RNA, 21 nt, Human
uccaggcuggacucaaacucc

SEQ ID NO: 1242715 - RNA, 18 nt, Human
uccccccagcacgucccc

SEQ ID NO: 1242716 - RNA, 23 nt, Human
ucccgaguagcuggcacuacagg

SEQ ID NO: 1242717 - RNA, 24 nt, Human
ucccgaguagcuggcacuacaggu

SEQ ID NO: 1242718 - RNA, 23 nt, Human
uccuaaaggauaggauuacaggc

SEQ ID NO: 1242719 - RNA, 24 nt, Human
uccugaguagcugggacuacaggc

SEQ ID NO: 1242720 - RNA, 18 nt, Human
uccugggcucaagcaauc

SEQ ID NO: 1242721 - RNA, 24 nt, Human
uccugggcucaagcaauccuccug

SEQ ID NO: 1242722 - RNA, 18 nt, Human
ucgcccaggcuggagugc

SEQ ID NO: 1242723 - RNA, 24 nt, Human
ucgcucugucgcccaggcuggagu

SEQ ID NO: 1242724 - RNA, 23 nt, Human
ucguccaggcuggacucaaacuc

SEQ ID NO: 1242725 - RNA, 24 nt, Human
ucuccugccucagccuccugagua

SEQ ID NO: 1242726 - RNA, 23 nt, Human
ucucgaacuccugaacucaggca

SEQ ID NO: 1242727 - RNA, 19 nt, Human
ucucgcucugucgcccagg

SEQ ID NO: 1242728 - RNA, 23 nt, Human
ucucgcucugucgcccaggcugg

SEQ ID NO: 1242729 - RNA, 24 nt, Human
ucucgcucugucgcccaggcugga

SEQ ID NO: 1242730 - RNA, 26 nt, Human
ucucgcucugucgcccaggcuggagu

SEQ ID NO: 1242731 - RNA, 24 nt, Human
ucuggcuauaucguccaggcugga

SEQ ID NO: 1242732 - RNA, 24 nt, Human
ucugucgcccaggcuggagugcag

SEQ ID NO: 1242733 - RNA, 20 nt, Human
ugaaagacuaaaacaaccag

SEQ ID NO: 1242734 - RNA, 24 nt, Human
ugagcgcggggcuucccggggcug

SEQ ID NO: 1242735 - RNA, 21 nt, Human
ugaggccuugcggagacccca

SEQ ID NO: 1242736 - RNA, 22 nt, Human
ugaguguuuuuauuacagguug

SEQ ID NO: 1242737 - RNA, 18 nt, Human
ugcaaccucccccacccg

SEQ ID NO: 1242738 - RNA, 20 nt, Human
ugcccaccacaccaggcuuu

SEQ ID NO: 1242739 - RNA, 24 nt, Human
ugccucagccuccugaguagcugg

SEQ ID NO: 1242740 - RNA, 19 nt, Human
ugcgaacagccgggacacc

SEQ ID NO: 1242741 - RNA, 22 nt, Human
ugcguuguuuaccuccugccca

SEQ ID NO: 1242742 - RNA, 23 nt, Human
ugcucaaccucccgaguagcugg

SEQ ID NO: 1242743 - RNA, 22 nt, Human
uggaaugauaaaucauuaagua

SEQ ID NO: 1242744 - RNA, 23 nt, Human
uggagugcagcggcgcgaucucg

SEQ ID NO: 1242745 - RNA, 24 nt, Human
uggagugcagcggcgcgaucucgg

SEQ ID NO: 1242746 - RNA, 22 nt, Human
uggaucuaauguauuuauuaca

SEQ ID NO: 1242747 - RNA, 18 nt, Human
uggaugacaaauucuugg

SEQ ID NO: 1242748 - RNA, 21 nt, Human
uggcacuacaggugcccacca

SEQ ID NO: 1242749 - RNA, 20 nt, Human
ugggacuacaggcgcgugcc

SEQ ID NO: 1242750 - RNA, 21 nt, Human
ugggacuacaggcgcgugccg

SEQ ID NO: 1242751 - RNA, 22 nt, Human
ugggacuacaggcgcgugccgc

SEQ ID NO: 1242752 - RNA, 24 nt, Human
ugggacuacaggcgcgugccgcca

SEQ ID NO: 1242753 - RNA, 22 nt, Human
ugucgcccaggcuggucucgaa

SEQ ID NO: 1242754 - RNA, 20 nt, Human
ugucugggacucuccuccag

SEQ ID NO: 1242755 - RNA, 23 nt, Human
uguuuuguuuuuuuucagagaca

SEQ ID NO: 1242756 - RNA, 18 nt, Human
uuaguagggacgggguuu

SEQ ID NO: 1242757 - RNA, 22 nt, Human
uuaguagggacgggguuucacc

SEQ ID NO: 1242758 - RNA, 24 nt, Human
uuaguagggacgggguuucaccgu

SEQ ID NO: 1242759 - RNA, 21 nt, Human
uucaagccauucuccugccuc

SEQ ID NO: 1242760 - RNA, 21 nt, Human
uucagauauuuuugauuugga

SEQ ID NO: 1242761 - RNA, 23 nt, Human
uucccggggcuggagcuggguac

SEQ ID NO: 1242762 - RNA, 25 nt, Human
uuguuuuuuuacagacagggucugg

SEQ ID NO: 1242763 - RNA, 18 nt, Human
uuucacauacaccuuacc

SEQ ID NO: 1242764 - RNA, 20 nt, Human
uuuuuguauuuuaguaggga

SEQ ID NO: 1242765 - RNA, 23 nt, Human
uuuuuguuuuuuuacagacaggg

SEQ ID NO: 1242766 - RNA, 21 nt, Human
cacuacaaacagcaaaacaaa

SEQ ID NO: 1242767 - RNA, 19 nt, Human
cacucccaacucucgucac

SEQ ID NO: 1242768 - RNA, 21 nt, Human
cacugcuggagauccgcagcc

SEQ ID NO: 1242769 - RNA, 19 nt, Human
ccagccacacucccaacuc

SEQ ID NO: 1242770 - RNA, 21 nt, Human
cccacgcgaguccucuggcca

SEQ ID NO: 1242771 - RNA, 19 nt, Human
ccgcagccccagccacacu

SEQ ID NO: 1242772 - RNA, 24 nt, Human
ccgcagccccagccacacucccaa

SEQ ID NO: 1242773 - RNA, 20 nt, Human
ccgguauccagccgcuagaa

SEQ ID NO: 1242774 - RNA, 28 nt, Human
ccucuggccaggccagucgucgcuuccc

SEQ ID NO: 1242775 - RNA, 21 nt, Human
uacaaacagcaaaacaaauau

SEQ ID NO: 1242776 - RNA, 21 nt, Human
uccacuacaaacagcaaaaca

SEQ ID NO: 1242777 - RNA, 25 nt, Human
ucugaaauuuccacuacaaacagca

SEQ ID NO: 1242778 - RNA, 24 nt, Human
ugaaauuuccacuacaaacagcaa

SEQ ID NO: 1242779 - RNA, 24 nt, Human
uuuccacuacaaacagcaaaacaa

SEQ ID NO: 1242780 - RNA, 25 nt, Human
agaggaaaagcugaugacaaaggug

SEQ ID NO: 1242781 - RNA, 23 nt, Human
agaguuaagggaaagggaggggg

SEQ ID NO: 1242782 - RNA, 22 nt, Human
aggcuggucuccaaucugaagc

SEQ ID NO: 1242783 - RNA, 21 nt, Human
augaagauccaguggcaaaga

SEQ ID NO: 1242784 - RNA, 22 nt, Human
augaagauccaguggcaaagag

SEQ ID NO: 1242785 - RNA, 20 nt, Human
caugucuccaugaagaucca

SEQ ID NO: 1242786 - RNA, 25 nt, Human
cugaugacaaaggugguuuggggau

SEQ ID NO: 1242787 - RNA, 24 nt, Human
cuugcccaugucuccaugaagauc

SEQ ID NO: 1242788 - RNA, 19 nt, Human
gaagauccaguggcaaaga

SEQ ID NO: 1242789 - RNA, 20 nt, Human
gaagauccaguggcaaagag

SEQ ID NO: 1242790 - RNA, 19 nt, Human
uggcaaagaggaaaagcug

SEQ ID NO: 1242791 - RNA, 20 nt, Human
uggggauguaaaaguagagu

SEQ ID NO: 1242792 - RNA, 26 nt, Human
aaaaagaauugucucuuaaaaaugaa

SEQ ID NO: 1242793 - RNA, 19 nt, Human
aaacaaaccaauaaaaugc

SEQ ID NO: 1242794 - RNA, 24 nt, Human
aaacaagguaaaaaauuacaucug

SEQ ID NO: 1242795 - RNA, 21 nt, Human
aaacacacagcucauguccuc

SEQ ID NO: 1242796 - RNA, 23 nt, Human
aaaguaacauacaaacaugccaa

SEQ ID NO: 1242797 - RNA, 26 nt, Human
aaaguaacauacaaacaugccaaaac

SEQ ID NO: 1242798 - RNA, 21 nt, Human
aaccaugcucccuucagcagc

SEQ ID NO: 1242799 - RNA, 23 nt, Human
aaggaccccaccccccucccccu

SEQ ID NO: 1242800 - RNA, 19 nt, Human
acaggaacaaauuuaaaga

SEQ ID NO: 1242801 - RNA, 18 nt, Human
accccaccccccuccccc

SEQ ID NO: 1242802 - RNA, 27 nt, Human
accccaccccccucccccugcuccuag

SEQ ID NO: 1242803 - RNA, 24 nt, Human
aggaccccaccccccucccccugc

SEQ ID NO: 1242804 - RNA, 19 nt, Human
aggaugaaaagaauccucu

SEQ ID NO: 1242805 - RNA, 26 nt, Human
auaaaauagauaguauauauuagaca

SEQ ID NO: 1242806 - RNA, 18 nt, Human
auaacaacuauaacucuc

SEQ ID NO: 1242807 - RNA, 22 nt, Human
aucacacagcuuuauagaaaca

SEQ ID NO: 1242808 - RNA, 19 nt, Human
aucacuguauucagcucca

SEQ ID NO: 1242809 - RNA, 18 nt, Human
augaaaagaauccucucu

SEQ ID NO: 1242810 - RNA, 23 nt, Human
augcagagugugcaugaagcuau

SEQ ID NO: 1242811 - RNA, 19 nt, Human
augcucccuucagcagcau

SEQ ID NO: 1242812 - RNA, 23 nt, Human
augguccagguucuucuagauga

SEQ ID NO: 1242813 - RNA, 23 nt, Human
cacacagcgucuccacuacccag

SEQ ID NO: 1242814 - RNA, 19 nt, Human
cagcuccaucaagaauggu

SEQ ID NO: 1242815 - RNA, 21 nt, Human
caugcucccuucagcagcaug

SEQ ID NO: 1242816 - RNA, 23 nt, Human
ccaaaacaagguaaaaaauuaca

SEQ ID NO: 1242817 - RNA, 21 nt, Human
ccaccccccucccccugcucc

SEQ ID NO: 1242818 - RNA, 23 nt, Human
cccacacagcgucuccacuaccc

SEQ ID NO: 1242819 - RNA, 18 nt, Human
ccccaccccccucccccu

SEQ ID NO: 1242820 - RNA, 18 nt, Human
ccccccucccccugcucc

SEQ ID NO: 1242821 - RNA, 19 nt, Human
ccccuggguccgguguucu

SEQ ID NO: 1242822 - RNA, 23 nt, Human
cccuucagcagcauguguaauaa

SEQ ID NO: 1242823 - RNA, 20 nt, Human
ccgaugaccucaggccucca

SEQ ID NO: 1242824 - RNA, 19 nt, Human
ccucaggcucaggggcgag

SEQ ID NO: 1242825 - RNA, 22 nt, Human
ccuucagcagcauguguaauaa

SEQ ID NO: 1242826 - RNA, 18 nt, Human
cuccucaggcucaggggc

SEQ ID NO: 1242827 - RNA, 24 nt, Human
gaaaacacacagcucauguccucc

SEQ ID NO: 1242828 - RNA, 24 nt, Human
gacuccuagaaggaccccaccccc

SEQ ID NO: 1242829 - RNA, 21 nt, Human
gagugcucgcuucaggagcac

SEQ ID NO: 1242830 - RNA, 18 nt, Human
gcacacacauccucuuua

SEQ ID NO: 1242831 - RNA, 20 nt, Human
ggaaaggguggaacuggaaa

SEQ ID NO: 1242832 - RNA, 23 nt, Human
ggaaaggguggaacuggaaacac

SEQ ID NO: 1242833 - RNA, 20 nt, Human
ggaccuccagguuccgcccc

SEQ ID NO: 1242834 - RNA, 20 nt, Human
ggcaaccaaguccguaagaa

SEQ ID NO: 1242835 - RNA, 18 nt, Human
guaagaaauaggaccucc

SEQ ID NO: 1242836 - RNA, 23 nt, Human
uaacauacaaacaugccaaaaca

SEQ ID NO: 1242837 - RNA, 18 nt, Human
uaauacaggaacaaauuu

SEQ ID NO: 1242838 - RNA, 18 nt, Human
uacaucuguauucucaca

SEQ ID NO: 1242839 - RNA, 26 nt, Human
uaccaguauuuccaaaauauuuaaaa

SEQ ID NO: 1242840 - RNA, 23 nt, Human
uagauaaaaaccaugcucccuuc

SEQ ID NO: 1242841 - RNA, 22 nt, Human
uagaugaucugcacaaaugguu

SEQ ID NO: 1242842 - RNA, 24 nt, Human
uauaaaaagggugguggugccgca

SEQ ID NO: 1242843 - RNA, 22 nt, Human
uauauaacaacuauaacucuca

SEQ ID NO: 1242844 - RNA, 18 nt, Human
uauauguauguguauaua

SEQ ID NO: 1242845 - RNA, 19 nt, Human
uauauguauguguauauaa

SEQ ID NO: 1242846 - RNA, 22 nt, Human
ucaaagguacaacaauuuccaa

SEQ ID NO: 1242847 - RNA, 24 nt, Human
ucaggagcacauauaauaauacag

SEQ ID NO: 1242848 - RNA, 20 nt, Human
ucccccugcuccuagguagg

SEQ ID NO: 1242849 - RNA, 26 nt, Human
uccccuggguccgguguucuucucuc

SEQ ID NO: 1242850 - RNA, 20 nt, Human
uccuagaaggaccccacccc

SEQ ID NO: 1242851 - RNA, 18 nt, Human
uccuucuuccuggugucu

SEQ ID NO: 1242852 - RNA, 25 nt, Human
ucucaggccgaugaccucaggccuc

SEQ ID NO: 1242853 - RNA, 18 nt, Human
ugagccccugcauugugc

SEQ ID NO: 1242854 - RNA, 22 nt, Human
ugaucugcacaaaugguuccuc

SEQ ID NO: 1242855 - RNA, 18 nt, Human
ugccaaaacaagguaaaa

SEQ ID NO: 1242856 - RNA, 19 nt, Human
ugccaaucugagccccugc

SEQ ID NO: 1242857 - RNA, 23 nt, Human
uggaauaaaguuccugcugaaaa

SEQ ID NO: 1242858 - RNA, 21 nt, Human
uucacaaaagaauucugugcc

SEQ ID NO: 1242859 - RNA, 23 nt, Human
uucauuuuuauuauguuucccca

SEQ ID NO: 1242860 - RNA, 21 nt, Human
agggacugacggacaggcucu

SEQ ID NO: 1242861 - RNA, 26 nt, Human
guggcagugagggcccagccucucuu

SEQ ID NO: 1242862 - RNA, 22 nt, Human
ucaccuguauugcaauggaagc

SEQ ID NO: 1242863 - RNA, 18 nt, Human
ucagcuuuggccacagga

SEQ ID NO: 1242864 - RNA, 21 nt, Human
uccugagucagacucccuaag

SEQ ID NO: 1242865 - RNA, 18 nt, Human
ugaguggaaaaucaccug

SEQ ID NO: 1242866 - RNA, 19 nt, Human
ugaugagcacucucuaggu

SEQ ID NO: 1242867 - RNA, 24 nt, Human
uggaaaaucaccuguauugcaaug

SEQ ID NO: 1242868 - RNA, 21 nt, Human
uuuguggugguuccaaacuga

SEQ ID NO: 1242869 - RNA, 22 nt, Human
aaagaggggccaccgagcagug

SEQ ID NO: 1242870 - RNA, 21 nt, Human
aacuguuauuuccagaacuuc

SEQ ID NO: 1242871 - RNA, 20 nt, Human
accugcuccugucgucuccu

SEQ ID NO: 1242872 - RNA, 19 nt, Human
agaaaaugccugaggcaaa

SEQ ID NO: 1242873 - RNA, 20 nt, Human
agcagacaauggucagggaa

SEQ ID NO: 1242874 - RNA, 21 nt, Human
agcagugugauaggcagcccc

SEQ ID NO: 1242875 - RNA, 19 nt, Human
aggcaaagugggggugaaa

SEQ ID NO: 1242876 - RNA, 22 nt, Human
aggcaaagugggggugaaagag

SEQ ID NO: 1242877 - RNA, 18 nt, Human
caaaguucagacuucaga

SEQ ID NO: 1242878 - RNA, 20 nt, Human
caccauaaguaaggucacag

SEQ ID NO: 1242879 - RNA, 23 nt, Human
caccauaaguaaggucacagcug

SEQ ID NO: 1242880 - RNA, 25 nt, Human
caucucuauccagguccucugggga

SEQ ID NO: 1242881 - RNA, 19 nt, Human
ccagcucauuauccccacc

SEQ ID NO: 1242882 - RNA, 22 nt, Human
ccugaggcaaagugggggugaa

SEQ ID NO: 1242883 - RNA, 24 nt, Human
cgcuccugaccacuggauuggcau

SEQ ID NO: 1242884 - RNA, 21 nt, Human
cuagagucucaucaucgggag

SEQ ID NO: 1242885 - RNA, 22 nt, Human
gcacacagcagacaauggucag

SEQ ID NO: 1242886 - RNA, 24 nt, Human
gcagugugauaggcagccccuucc

SEQ ID NO: 1242887 - RNA, 19 nt, Human
gccccacaccagugcacaa

SEQ ID NO: 1242888 - RNA, 18 nt, Human
gggagcacacagcagaca

SEQ ID NO: 1242889 - RNA, 19 nt, Human
uaaguaaggucacagcuga

SEQ ID NO: 1242890 - RNA, 20 nt, Human
uacacguggaacuugggcuc

SEQ ID NO: 1242891 - RNA, 21 nt, Human
ucaaaguucagacuucagauu

SEQ ID NO: 1242892 - RNA, 19 nt, Human
uccagaacuucagcuauuu

SEQ ID NO: 1242893 - RNA, 24 nt, Human
uccgccagcucauuauccccaccu

SEQ ID NO: 1242894 - RNA, 23 nt, Human
uccgugguccucuccugggcccc

SEQ ID NO: 1242895 - RNA, 23 nt, Human
ugaaagaggggccaccgagcagu

SEQ ID NO: 1242896 - RNA, 18 nt, Human
ugcaagaagagauuucac

SEQ ID NO: 1242897 - RNA, 20 nt, Human
ugccugaggcaaaguggggg

SEQ ID NO: 1242898 - RNA, 21 nt, Human
uggaugcugucaaggagagcg

SEQ ID NO: 1242899 - RNA, 24 nt, Human
uuccgccagcucauuauccccacc

SEQ ID NO: 1242900 - RNA, 24 nt, Human
uuggcaaagguaauuaccuuuccu

SEQ ID NO: 1242901 - RNA, 19 nt, Human
uuuccuggaugcugucaag

SEQ ID NO: 1242902 - RNA, 19 nt, Human
uuuuuuuuuuuuuuuuuaa

SEQ ID NO: 1242903 - RNA, 22 nt, Human
aaaacaagaaaacacaaggaca

SEQ ID NO: 1242904 - RNA, 24 nt, Human
aaaacacaaggacaaacccuacug

SEQ ID NO: 1242905 - RNA, 21 nt, Human
aaacaaaacaagaaaacacaa

SEQ ID NO: 1242906 - RNA, 22 nt, Human
aaacauggaacaugggagaaaa

SEQ ID NO: 1242907 - RNA, 21 nt, Human
aaaccaguaagacugggaaau

SEQ ID NO: 1242908 - RNA, 20 nt, Human
aaagcauggggaguggcauc

SEQ ID NO: 1242909 - RNA, 24 nt, Human
aaagugcugggauuacaggcguga

SEQ ID NO: 1242910 - RNA, 24 nt, Human
aaagugcugggauuacagguguga

SEQ ID NO: 1242911 - RNA, 20 nt, Human
aagaaugggacuagcguccu

SEQ ID NO: 1242912 - RNA, 20 nt, Human
aagacggacaagugcuuuuc

SEQ ID NO: 1242913 - RNA, 18 nt, Human
aagagacagagaaggcca

SEQ ID NO: 1242914 - RNA, 19 nt, Human
aagcccacaagaaugggac

SEQ ID NO: 1242915 - RNA, 19 nt, Human
aaguagcugggacuacagg

SEQ ID NO: 1242916 - RNA, 20 nt, Human
aaguagcugggacuacaggc

SEQ ID NO: 1242917 - RNA, 25 nt, Human
aaguagcugggacuacaggcgcccg

SEQ ID NO: 1242918 - RNA, 18 nt, Human
aagugcugggauuacagg

SEQ ID NO: 1242919 - RNA, 19 nt, Human
aagugcugggauuacaggc

SEQ ID NO: 1242920 - RNA, 19 nt, Human
aagugcugggauuacaggc

SEQ ID NO: 1242921 - RNA, 26 nt, Human
aagugcugggauuacaggcgugagcc

SEQ ID NO: 1242922 - RNA, 19 nt, Human
aagugcugggauuacaggu

SEQ ID NO: 1242923 - RNA, 26 nt, Human
aagugcugggauuacaggugugagcc

SEQ ID NO: 1242924 - RNA, 22 nt, Human
aauuuuugacauaaggcaauuu

SEQ ID NO: 1242925 - RNA, 18 nt, Human
acaaaacaagaaaacaca

SEQ ID NO: 1242926 - RNA, 19 nt, Human
acaaaacaagaaaacacaa

SEQ ID NO: 1242927 - RNA, 19 nt, Human
acacagcgagaagccaucu

SEQ ID NO: 1242928 - RNA, 20 nt, Human
acagcgagaagccaucuucu

SEQ ID NO: 1242929 - RNA, 21 nt, Human
acagcgagaagccaucuucug

SEQ ID NO: 1242930 - RNA, 18 nt, Human
acaggguuucaccauguu

SEQ ID NO: 1242931 - RNA, 19 nt, Human
acaggguuucaccauguua

SEQ ID NO: 1242932 - RNA, 20 nt, Human
acaggguuucaccauguuag

SEQ ID NO: 1242933 - RNA, 24 nt, Human
acaggguuucaccauguuagccag

SEQ ID NO: 1242934 - RNA, 25 nt, Human
acccgccucagccucccaaagugcu

SEQ ID NO: 1242935 - RNA, 21 nt, Human
accugggcagcccaugggagc

SEQ ID NO: 1242936 - RNA, 18 nt, Human
acgggguuucaccauguu

SEQ ID NO: 1242937 - RNA, 19 nt, Human
acgggguuucaccauguua

SEQ ID NO: 1242938 - RNA, 20 nt, Human
acgggguuucaccauguuag

SEQ ID NO: 1242939 - RNA, 24 nt, Human
acgggguuucaccauguuagccag

SEQ ID NO: 1242940 - RNA, 20 nt, Human
acugcaagcuccgccucccg

SEQ ID NO: 1242941 - RNA, 20 nt, Human
acugcaagcucugccucccg

SEQ ID NO: 1242942 - RNA, 20 nt, Human
agaaacagugaaggugucag

SEQ ID NO: 1242943 - RNA, 21 nt, Human
agacagcaaaucaacuccaga

SEQ ID NO: 1242944 - RNA, 22 nt, Human
agacgagggaguuaacaaggga

SEQ ID NO: 1242945 - RNA, 24 nt, Human
agcacauuaggguguauucggggg

SEQ ID NO: 1242946 - RNA, 18 nt, Human
agccaccaugcccagcac

SEQ ID NO: 1242947 - RNA, 21 nt, Human
aggaagaaaagggccucccau

SEQ ID NO: 1242948 - RNA, 23 nt, Human
aggaagaaaagggccucccauaa

SEQ ID NO: 1242949 - RNA, 26 nt, Human
aggaggaggugaaggaagagggaccc

SEQ ID NO: 1242950 - RNA, 23 nt, Human
aggaggugaaggaagauacugga

SEQ ID NO: 1242951 - RNA, 22 nt, Human
aggagguggggacuuugggagu

SEQ ID NO: 1242952 - RNA, 20 nt, Human
aggcaggcagccacccaugu

SEQ ID NO: 1242953 - RNA, 19 nt, Human
aggcaggcaggcagccacc

SEQ ID NO: 1242954 - RNA, 18 nt, Human
aggcaggcaggcaggcag

SEQ ID NO: 1242955 - RNA, 19 nt, Human
aggggucagaggcaucagg

SEQ ID NO: 1242956 - RNA, 20 nt, Human
agguggggacuuugggagug

SEQ ID NO: 1242957 - RNA, 25 nt, Human
agguuggagugcaguggcgugaucu

SEQ ID NO: 1242958 - RNA, 21 nt, Human
aguacaguggugcgaucucag

SEQ ID NO: 1242959 - RNA, 24 nt, Human
aguacaguggugcgaucucagcuc

SEQ ID NO: 1242960 - RNA, 18 nt, Human
aguagcugggacuacagg

SEQ ID NO: 1242961 - RNA, 19 nt, Human
aguagcugggacuacaggc

SEQ ID NO: 1242962 - RNA, 23 nt, Human
aguagcugggacuacaggcgccc

SEQ ID NO: 1242963 - RNA, 19 nt, Human
agugcaguggcgugaucuc

SEQ ID NO: 1242964 - RNA, 21 nt, Human
agugcaguggcgugaucucag

SEQ ID NO: 1242965 - RNA, 23 nt, Human
agugcaguggcgugaucucagcu

SEQ ID NO: 1242966 - RNA, 24 nt, Human
agugcaguggcgugaucucagcuc

SEQ ID NO: 1242967 - RNA, 18 nt, Human
agugcugggauuacaggc

SEQ ID NO: 1242968 - RNA, 24 nt, Human
aguggcgugaucucagcucacugc

SEQ ID NO: 1242969 - RNA, 22 nt, Human
aguggucuguggacugcauggc

SEQ ID NO: 1242970 - RNA, 24 nt, Human
aguggugcgaucucagcucacugc

SEQ ID NO: 1242971 - RNA, 24 nt, Human
auaaagcccacaagaaugggacuu

SEQ ID NO: 1242972 - RNA, 24 nt, Human
augauccaccuaccucagccuccc

SEQ ID NO: 1242973 - RNA, 20 nt, Human
augguguggucggagcugcu

SEQ ID NO: 1242974 - RNA, 21 nt, Human
auucuccugccucagccuccc

SEQ ID NO: 1242975 - RNA, 27 nt, Human
caaaacaagaaaacacaaggacaaacc

SEQ ID NO: 1242976 - RNA, 22 nt, Human
caaagcaccaugcaguggucug

SEQ ID NO: 1242977 - RNA, 20 nt, Human
caaagcuuuuacaacaaauc

SEQ ID NO: 1242978 - RNA, 24 nt, Human
caaagugcugggauuacaggcgug

SEQ ID NO: 1242979 - RNA, 24 nt, Human
caaagugcugggauuacaggugug

SEQ ID NO: 1242980 - RNA, 20 nt, Human
cacacagugucaggggucag

SEQ ID NO: 1242981 - RNA, 18 nt, Human
caccaugcccagcacaaa

SEQ ID NO: 1242982 - RNA, 18 nt, Human
caccauguuagccaggau

SEQ ID NO: 1242983 - RNA, 18 nt, Human
caccauguuagccaggau

SEQ ID NO: 1242984 - RNA, 22 nt, Human
caccauguuagccaggaugguc

SEQ ID NO: 1242985 - RNA, 22 nt, Human
caccauguuagccaggaugguc

SEQ ID NO: 1242986 - RNA, 24 nt, Human
caccauguuagccaggauggucuc

SEQ ID NO: 1242987 - RNA, 24 nt, Human
caccauguuagccaggauggucuc

SEQ ID NO: 1242988 - RNA, 24 nt, Human
cacccagguuggagugcaguggcg

SEQ ID NO: 1242989 - RNA, 18 nt, Human
caccccuuccaccacaug

SEQ ID NO: 1242990 - RNA, 23 nt, Human
cacccgccucagccucccaaagu

SEQ ID NO: 1242991 - RNA, 23 nt, Human
caccuaccucagccucccaaagu

SEQ ID NO: 1242992 - RNA, 23 nt, Human
cacugcaagcucugccucccggg

SEQ ID NO: 1242993 - RNA, 18 nt, Human
cagcucacugcaagcucc

SEQ ID NO: 1242994 - RNA, 22 nt, Human
caggcagccacccauguuuccg

SEQ ID NO: 1242995 - RNA, 21 nt, Human
caggcgcccgccaccgcgccc

SEQ ID NO: 1242996 - RNA, 24 nt, Human
caggguuucaccauguuagccagg

SEQ ID NO: 1242997 - RNA, 18 nt, Human
caguuaacaugacaaaaa

SEQ ID NO: 1242998 - RNA, 24 nt, Human
caugauccaccuaccucagccucc

SEQ ID NO: 1242999 - RNA, 22 nt, Human
caugccauucuccugccucagc

SEQ ID NO: 1243000 - RNA, 22 nt, Human
caugccauucuccugccucagc

SEQ ID NO: 1243001 - RNA, 21 nt, Human
ccaaagugcugggauuacagg

SEQ ID NO: 1243002 - RNA, 21 nt, Human
ccaaagugcugggauuacagg

SEQ ID NO: 1243003 - RNA, 22 nt, Human
ccaaagugcugggauuacaggc

SEQ ID NO: 1243004 - RNA, 22 nt, Human
ccaaagugcugggauuacaggc

SEQ ID NO: 1243005 - RNA, 24 nt, Human
ccaaagugcugggauuacaggcgu

SEQ ID NO: 1243006 - RNA, 24 nt, Human
ccaaagugcugggauuacaggugu

SEQ ID NO: 1243007 - RNA, 26 nt, Human
ccacccgccucagccucccaaagugc

SEQ ID NO: 1243008 - RNA, 26 nt, Human
ccaccuaccucagccucccaaagugc

SEQ ID NO: 1243009 - RNA, 22 nt, Human
ccagaagucucuguucaucuga

SEQ ID NO: 1243010 - RNA, 18 nt, Human
ccagaaugcagaagacgg

SEQ ID NO: 1243011 - RNA, 23 nt, Human
cccaaguagcugggacuacaggc

SEQ ID NO: 1243012 - RNA, 24 nt, Human
cccaaguagcugggacuacaggcg

SEQ ID NO: 1243013 - RNA, 22 nt, Human
cccaccgugccggacucucaga

SEQ ID NO: 1243014 - RNA, 20 nt, Human
ccccaccgugccggacucuc

SEQ ID NO: 1243015 - RNA, 19 nt, Human
ccccucaccccuuccacca

SEQ ID NO: 1243016 - RNA, 20 nt, Human
ccccucaccccuuccaccaa

SEQ ID NO: 1243017 - RNA, 23 nt, Human
cccgaguagcugggacuacaggc

SEQ ID NO: 1243018 - RNA, 24 nt, Human
cccgaguagcugggacuacaggcg

SEQ ID NO: 1243019 - RNA, 26 nt, Human
cccucaccccuuccaccaaucgguug

SEQ ID NO: 1243020 - RNA, 24 nt, Human
ccgccucagccucccaaagugcug

SEQ ID NO: 1243021 - RNA, 24 nt, Human
ccggugaugacaaagcaccaugca

SEQ ID NO: 1243022 - RNA, 21 nt, Human
ccuacugugaagcaguggaga

SEQ ID NO: 1243023 - RNA, 23 nt, Human
ccucccauaaguaaggccagagu

SEQ ID NO: 1243024 - RNA, 22 nt, Human
ccugaccucaugauccaccuac

SEQ ID NO: 1243025 - RNA, 20 nt, Human
ccugaccucgugauccaccc

SEQ ID NO: 1243026 - RNA, 23 nt, Human
ccugccucagccucccgaguagc

SEQ ID NO: 1243027 - RNA, 24 nt, Human
cgagaacaagcagggagaacaaau

SEQ ID NO: 1243028 - RNA, 19 nt, Human
cgccucccggguucaugcc

SEQ ID NO: 1243029 - RNA, 22 nt, Human
cgcucugucacccaggcuggag

SEQ ID NO: 1243030 - RNA, 24 nt, Human
cgugauccacccgccucagccucc

SEQ ID NO: 1243031 - RNA, 24 nt, Human
cucacugcaagcucugccucccgg

SEQ ID NO: 1243032 - RNA, 24 nt, Human
cucagccucccaaguagcugggac

SEQ ID NO: 1243033 - RNA, 24 nt, Human
cucagccucccgaguagcugggac

SEQ ID NO: 1243034 - RNA, 21 nt, Human
cucccggguucaugccauucu

SEQ ID NO: 1243035 - RNA, 21 nt, Human
cucccggguucaugccauucu

SEQ ID NO: 1243036 - RNA, 21 nt, Human
cuccuaagaggaggaggugaa

SEQ ID NO: 1243037 - RNA, 18 nt, Human
cuccugaccucaugaucc

SEQ ID NO: 1243038 - RNA, 24 nt, Human
cuccugaccucgugauccacccgc

SEQ ID NO: 1243039 - RNA, 24 nt, Human
cucgcucugucacccaggcuggag

SEQ ID NO: 1243040 - RNA, 23 nt, Human
cucugucacccaggcuggaguac

SEQ ID NO: 1243041 - RNA, 20 nt, Human
cucugucacccagguuggag

SEQ ID NO: 1243042 - RNA, 23 nt, Human
cugccucagccucccaaguagcu

SEQ ID NO: 1243043 - RNA, 23 nt, Human
cugccucagccucccgaguagcu

SEQ ID NO: 1243044 - RNA, 18 nt, Human
cugucacccagguuggag

SEQ ID NO: 1243045 - RNA, 23 nt, Human
cuguggacugcauggcucugucc

SEQ ID NO: 1243046 - RNA, 21 nt, Human
cugugggucaggaagccgcau

SEQ ID NO: 1243047 - RNA, 22 nt, Human
cuuccaccacaugaggacacag

SEQ ID NO: 1243048 - RNA, 24 nt, Human
cuuucuuuuuuuguuugagacgga

SEQ ID NO: 1243049 - RNA, 21 nt, Human
gaaaggagaggagggagagga

SEQ ID NO: 1243050 - RNA, 20 nt, Human
gaacaugggagaaaacaagu

SEQ ID NO: 1243051 - RNA, 18 nt, Human
gaagaaaagggccuccca

SEQ ID NO: 1243052 - RNA, 20 nt, Human
gaagaagggacaaaccaccu

SEQ ID NO: 1243053 - RNA, 20 nt, Human
gacacagcgagaagccaucu

SEQ ID NO: 1243054 - RNA, 22 nt, Human
gaccucaugauccaccuaccuc

SEQ ID NO: 1243055 - RNA, 22 nt, Human
gaccucgugauccacccgccuc

SEQ ID NO: 1243056 - RNA, 24 nt, Human
gaccucgugauccacccgccucag

SEQ ID NO: 1243057 - RNA, 24 nt, Human
gacuacaggcgcccgccaccaugc

SEQ ID NO: 1243058 - RNA, 27 nt, Human
gagaacaagcagggagaaccgguaccc

SEQ ID NO: 1243059 - RNA, 24 nt, Human
gagacgggguuucaccauguuagc

SEQ ID NO: 1243060 - RNA, 18 nt, Human
gagcaggcggagaggggc

SEQ ID NO: 1243061 - RNA, 21 nt, Human
gaggaaaagaaagcaugggga

SEQ ID NO: 1243062 - RNA, 25 nt, Human
gaggcaggcaggcaggcaggcagcc

SEQ ID NO: 1243063 - RNA, 22 nt, Human
gagguggcagugugaggauggu

SEQ ID NO: 1243064 - RNA, 19 nt, Human
gagguggggacuuugggag

SEQ ID NO: 1243065 - RNA, 19 nt, Human
gagugauuagguggugaga

SEQ ID NO: 1243066 - RNA, 19 nt, Human
gauacuggaagaggaaagg

SEQ ID NO: 1243067 - RNA, 18 nt, Human
gauuacaggcgugagcca

SEQ ID NO: 1243068 - RNA, 21 nt, Human
gauuacaggcgugagccacca

SEQ ID NO: 1243069 - RNA, 22 nt, Human
gauuacaggcgugagccaccau

SEQ ID NO: 1243070 - RNA, 18 nt, Human
gauuacaggugugagcca

SEQ ID NO: 1243071 - RNA, 21 nt, Human
gauuacaggugugagccacug

SEQ ID NO: 1243072 - RNA, 24 nt, Human
gauuacaggugugagccacugugc

SEQ ID NO: 1243073 - RNA, 19 nt, Human
gcaaaucaacuccagaagu

SEQ ID NO: 1243074 - RNA, 20 nt, Human
gcagaagacggacaagugcu

SEQ ID NO: 1243075 - RNA, 24 nt, Human
gcccagcuaauuuuuuuguauuuu

SEQ ID NO: 1243076 - RNA, 23 nt, Human
gccucagccucccaaagugcugg

SEQ ID NO: 1243077 - RNA, 20 nt, Human
gccucagccucccaaguagc

SEQ ID NO: 1243078 - RNA, 25 nt, Human
gccucccggguucaugccauucucc

SEQ ID NO: 1243079 - RNA, 25 nt, Human
gccucccggguucaugccauucucc

SEQ ID NO: 1243080 - RNA, 19 nt, Human
gccugggcaccugggcagc

SEQ ID NO: 1243081 - RNA, 19 nt, Human
gcucugucacccagguugg

SEQ ID NO: 1243082 - RNA, 22 nt, Human
ggaaaggagaggagggagagga

SEQ ID NO: 1243083 - RNA, 21 nt, Human
ggaagaggaaaggagaggagg

SEQ ID NO: 1243084 - RNA, 18 nt, Human
ggagaggggaaaggagga

SEQ ID NO: 1243085 - RNA, 21 nt, Human
ggaggaaaagaaagcaugggg

SEQ ID NO: 1243086 - RNA, 24 nt, Human
ggagguggcagugugaggauggug

SEQ ID NO: 1243087 - RNA, 24 nt, Human
ggauggucucgaucuccugaccuc

SEQ ID NO: 1243088 - RNA, 24 nt, Human
ggauuacaggcgugagccaccaug

SEQ ID NO: 1243089 - RNA, 18 nt, Human
gggaagagacagagaagg

SEQ ID NO: 1243090 - RNA, 21 nt, Human
gggagugauuagguggugaga

SEQ ID NO: 1243091 - RNA, 23 nt, Human
ggggacuuugggagugauuaggu

SEQ ID NO: 1243092 - RNA, 23 nt, Human
gggguuucaccauguuagccagg

SEQ ID NO: 1243093 - RNA, 22 nt, Human
ggguuucaccauguuagccagg

SEQ ID NO: 1243094 - RNA, 20 nt, Human
ggucucgaucuccugaccuc

SEQ ID NO: 1243095 - RNA, 22 nt, Human
gguuggagugcaguggcgugau

SEQ ID NO: 1243096 - RNA, 24 nt, Human
gguuucaccauguuagccaggaug

SEQ ID NO: 1243097 - RNA, 24 nt, Human
gguuucaccauguuagccaggaug

SEQ ID NO: 1243098 - RNA, 23 nt, Human
guagagacgggguuucaccaugu

SEQ ID NO: 1243099 - RNA, 27 nt, Human
guauguggcaguguuuccucuuaguag

SEQ ID NO: 1243100 - RNA, 24 nt, Human
gugauccacccgccucagccuccc

SEQ ID NO: 1243101 - RNA, 24 nt, Human
guuucgcucugucacccagguugg

SEQ ID NO: 1243102 - RNA, 23 nt, Human
uaacaugacaaaaaaaauguuua

SEQ ID NO: 1243103 - RNA, 22 nt, Human
uaagaaccccacacaaauguca

SEQ ID NO: 1243104 - RNA, 24 nt, Human
uaauuuuuugcauuuuuaguagag

SEQ ID NO: 1243105 - RNA, 25 nt, Human
uaauuuuuugcauuuuuaguagaga

SEQ ID NO: 1243106 - RNA, 20 nt, Human
uacaacaaaucucuuuugca

SEQ ID NO: 1243107 - RNA, 21 nt, Human
uacaacaaaucucuuuugcau

SEQ ID NO: 1243108 - RNA, 24 nt, Human
uacaggcgugagccaccaugccca

SEQ ID NO: 1243109 - RNA, 23 nt, Human
uacaggugugagccacugugccc

SEQ ID NO: 1243110 - RNA, 24 nt, Human
uacaggugugagccacugugccca

SEQ ID NO: 1243111 - RNA, 24 nt, Human
uaccucagccucccaaagugcugg

SEQ ID NO: 1243112 - RNA, 22 nt, Human
uagagacaggguuucaccaugu

SEQ ID NO: 1243113 - RNA, 22 nt, Human
uagagacgggguuucaccaugu

SEQ ID NO: 1243114 - RNA, 18 nt, Human
uaggagguggggacuuug

SEQ ID NO: 1243115 - RNA, 24 nt, Human
uaguagagacaggguuucaccaug

SEQ ID NO: 1243116 - RNA, 26 nt, Human
uaguagagacaggguuucaccauguu

SEQ ID NO: 1243117 - RNA, 24 nt, Human
uaguagagacgggguuucaccaug

SEQ ID NO: 1243118 - RNA, 26 nt, Human
uaguagagacgggguuucaccauguu

SEQ ID NO: 1243119 - RNA, 19 nt, Human
uauuaguuaagaguccuca

SEQ ID NO: 1243120 - RNA, 24 nt, Human
ucaccauguuagccaggauggucu

SEQ ID NO: 1243121 - RNA, 24 nt, Human
ucaccauguuagccaggauggucu

SEQ ID NO: 1243122 - RNA, 22 nt, Human
ucacccagguuggagugcagug

SEQ ID NO: 1243123 - RNA, 25 nt, Human
ucaccccuuccaccacaugaggacc

SEQ ID NO: 1243124 - RNA, 18 nt, Human
ucacugcaagcuccgccu

SEQ ID NO: 1243125 - RNA, 19 nt, Human
ucacugcaagcuccgccuc

SEQ ID NO: 1243126 - RNA, 24 nt, Human
ucacugcaagcuccgccucccggg

SEQ ID NO: 1243127 - RNA, 18 nt, Human
ucacugcaagcucugccu

SEQ ID NO: 1243128 - RNA, 18 nt, Human
ucacugcaagcucugccu

SEQ ID NO: 1243129 - RNA, 24 nt, Human
ucacugcaagcucugccucccggg

SEQ ID NO: 1243130 - RNA, 18 nt, Human
ucagccucccaaagugcu

SEQ ID NO: 1243131 - RNA, 20 nt, Human
ucagccucccaaguagcugg

SEQ ID NO: 1243132 - RNA, 23 nt, Human
ucagccucccgaguagcugggac

SEQ ID NO: 1243133 - RNA, 18 nt, Human
ucagggcagauauccaaa

SEQ ID NO: 1243134 - RNA, 18 nt, Human
ucaugccauucuccugcc

SEQ ID NO: 1243135 - RNA, 21 nt, Human
uccacccgccucagccuccca

SEQ ID NO: 1243136 - RNA, 22 nt, Human
uccagaaaugaaacaagcacau

SEQ ID NO: 1243137 - RNA, 23 nt, Human
ucccaaagugcugggauuacagg

SEQ ID NO: 1243138 - RNA, 24 nt, Human
ucccaaagugcugggauuacaggc

SEQ ID NO: 1243139 - RNA, 24 nt, Human
ucccaaguagcugggacuacaggc

SEQ ID NO: 1243140 - RNA, 24 nt, Human
ucccgaguagcugggacuacaggc

SEQ ID NO: 1243141 - RNA, 21 nt, Human
ucccggguucaugccauucuc

SEQ ID NO: 1243142 - RNA, 21 nt, Human
ucccggguucaugccauucuc

SEQ ID NO: 1243143 - RNA, 24 nt, Human
ucccggguucaugccauucuccug

SEQ ID NO: 1243144 - RNA, 24 nt, Human
ucccggguucaugccauucuccug

SEQ ID NO: 1243145 - RNA, 24 nt, Human
ucgcucugucacccaggcuggagu

SEQ ID NO: 1243146 - RNA, 22 nt, Human
ucgcucugucacccagguugga

SEQ ID NO: 1243147 - RNA, 24 nt, Human
ucgcucugucacccagguuggagu

SEQ ID NO: 1243148 - RNA, 19 nt, Human
ucuaucagagaggaugagu

SEQ ID NO: 1243149 - RNA, 26 nt, Human
ucuccugccucagccucccaaguagc

SEQ ID NO: 1243150 - RNA, 24 nt, Human
ucuccugccucagccucccgagua

SEQ ID NO: 1243151 - RNA, 19 nt, Human
ucucgcucugucacccagg

SEQ ID NO: 1243152 - RNA, 23 nt, Human
ucucgcucugucacccaggcugg

SEQ ID NO: 1243153 - RNA, 24 nt, Human
ucucgcucugucacccaggcugga

SEQ ID NO: 1243154 - RNA, 25 nt, Human
ucucgcucugucacccaggcuggag

SEQ ID NO: 1243155 - RNA, 26 nt, Human
ucucgcucugucacccaggcuggagu

SEQ ID NO: 1243156 - RNA, 18 nt, Human
ucugucacccaggcugga

SEQ ID NO: 1243157 - RNA, 24 nt, Human
ucugucacccaggcuggaguacag

SEQ ID NO: 1243158 - RNA, 24 nt, Human
ucugucacccagguuggagugcag

SEQ ID NO: 1243159 - RNA, 18 nt, Human
ugaacuauggaaaaacau

SEQ ID NO: 1243160 - RNA, 20 nt, Human
ugacaguagcccuguggacu

SEQ ID NO: 1243161 - RNA, 23 nt, Human
ugaccucaugauccaccuaccuc

SEQ ID NO: 1243162 - RNA, 22 nt, Human
ugagacggagucucgcucuguc

SEQ ID NO: 1243163 - RNA, 24 nt, Human
ugauccaccuaccucagccuccca

SEQ ID NO: 1243164 - RNA, 22 nt, Human
ugcaguggcgugaucucagcuc

SEQ ID NO: 1243165 - RNA, 22 nt, Human
ugcauuauuuucccaaacaaaa

SEQ ID NO: 1243166 - RNA, 23 nt, Human
ugcauuauuuucccaaacaaaac

SEQ ID NO: 1243167 - RNA, 24 nt, Human
ugccucagccucccaaguagcugg

SEQ ID NO: 1243168 - RNA, 24 nt, Human
ugccucagccucccgaguagcugg

SEQ ID NO: 1243169 - RNA, 19 nt, Human
ugccucccggguucaugcc

SEQ ID NO: 1243170 - RNA, 24 nt, Human
ugcugggauuacaggcgugagcca

SEQ ID NO: 1243171 - RNA, 24 nt, Human
ugcugggauuacaggugugagcca

SEQ ID NO: 1243172 - RNA, 23 nt, Human
uggaagaggaaaggagaggaggg

SEQ ID NO: 1243173 - RNA, 19 nt, Human
uggaguacaguggugcgau

SEQ ID NO: 1243174 - RNA, 19 nt, Human
uggagugcaguggcgugau

SEQ ID NO: 1243175 - RNA, 24 nt, Human
uggagugcaguggcgugaucucag

SEQ ID NO: 1243176 - RNA, 24 nt, Human
uggcgugaucucagcucacugcaa

SEQ ID NO: 1243177 - RNA, 21 nt, Human
ugggacuacaggcgcccgcca

SEQ ID NO: 1243178 - RNA, 21 nt, Human
ugggacuacaggcgcccgcca

SEQ ID NO: 1243179 - RNA, 22 nt, Human
ugggacuacaggcgcccgccac

SEQ ID NO: 1243180 - RNA, 22 nt, Human
ugggacuacaggcgcccgccac

SEQ ID NO: 1243181 - RNA, 23 nt, Human
ugggacuacaggcgcccgccacc

SEQ ID NO: 1243182 - RNA, 24 nt, Human
ugggacuacaggcgcccgccacca

SEQ ID NO: 1243183 - RNA, 25 nt, Human
ugggacuacaggcgcccgccaccau

SEQ ID NO: 1243184 - RNA, 24 nt, Human
ugggacuacaggcgcccgccaccg

SEQ ID NO: 1243185 - RNA, 23 nt, Human
ugggagaaaacaaguauguggca

SEQ ID NO: 1243186 - RNA, 18 nt, Human
ugggauuacaggcgugag

SEQ ID NO: 1243187 - RNA, 22 nt, Human
ugggauuacaggcgugagccac

SEQ ID NO: 1243188 - RNA, 23 nt, Human
ugggauuacaggcgugagccacc

SEQ ID NO: 1243189 - RNA, 24 nt, Human
ugggauuacaggcgugagccacca

SEQ ID NO: 1243190 - RNA, 25 nt, Human
ugggauuacaggcgugagccaccau

SEQ ID NO: 1243191 - RNA, 18 nt, Human
ugggauuacaggugugag

SEQ ID NO: 1243192 - RNA, 21 nt, Human
ugggauuacaggugugagcca

SEQ ID NO: 1243193 - RNA, 22 nt, Human
ugggauuacaggugugagccac

SEQ ID NO: 1243194 - RNA, 22 nt, Human
ugggauuacaggugugagccac

SEQ ID NO: 1243195 - RNA, 22 nt, Human
ugggauuacaggugugagccac

SEQ ID NO: 1243196 - RNA, 24 nt, Human
ugggauuacaggugugagccacug

SEQ ID NO: 1243197 - RNA, 19 nt, Human
ugggcagcccaugggagca

SEQ ID NO: 1243198 - RNA, 24 nt, Human
uggugcgaucucagcucacugcaa

SEQ ID NO: 1243199 - RNA, 23 nt, Human
ugguguuaggagguggggacuuu

SEQ ID NO: 1243200 - RNA, 21 nt, Human
uguauuuuuaguagagacggg

SEQ ID NO: 1243201 - RNA, 23 nt, Human
uguggcaguguuucagagacagg

SEQ ID NO: 1243202 - RNA, 24 nt, Human
uuaacaagggaagagacagagaag

SEQ ID NO: 1243203 - RNA, 23 nt, Human
uuaagaguccucaaaaauucuuu

SEQ ID NO: 1243204 - RNA, 24 nt, Human
uuaguagagacaggguuucaccau

SEQ ID NO: 1243205 - RNA, 18 nt, Human
uuaguagagacgggguuu

SEQ ID NO: 1243206 - RNA, 22 nt, Human
uuaguagagacgggguuucacc

SEQ ID NO: 1243207 - RNA, 24 nt, Human
uuaguagagacgggguuucaccau

SEQ ID NO: 1243208 - RNA, 21 nt, Human
uucagagagaccccucacccc

SEQ ID NO: 1243209 - RNA, 19 nt, Human
uucaugccauucuccugcc

SEQ ID NO: 1243210 - RNA, 19 nt, Human
uucaugccauucuccugcc

SEQ ID NO: 1243211 - RNA, 21 nt, Human
uucccaaacaaaacaagaaaa

SEQ ID NO: 1243212 - RNA, 24 nt, Human
uuccuuuagaacucccugaucaua

SEQ ID NO: 1243213 - RNA, 24 nt, Human
uucucacauuuuuaagaaccccac

SEQ ID NO: 1243214 - RNA, 24 nt, Human
uuggagugcaguggcgugaucuca

SEQ ID NO: 1243215 - RNA, 23 nt, Human
uuguauuuuuaguagagacgggg

SEQ ID NO: 1243216 - RNA, 19 nt, Human
uuucaccauguuagccagg

SEQ ID NO: 1243217 - RNA, 19 nt, Human
uuucaccauguuagccagg

SEQ ID NO: 1243218 - RNA, 20 nt, Human
uuucaccauguuagccagga

SEQ ID NO: 1243219 - RNA, 20 nt, Human
uuucaccauguuagccagga

SEQ ID NO: 1243220 - RNA, 19 nt, Human
uuucgcucugucacccagg

SEQ ID NO: 1243221 - RNA, 23 nt, Human
uuucgcucugucacccagguugg

SEQ ID NO: 1243222 - RNA, 24 nt, Human
uuucgcucugucacccagguugga

SEQ ID NO: 1243223 - RNA, 21 nt, Human
uuuuguauuuuuaguagagac

SEQ ID NO: 1243224 - RNA, 24 nt, Human
uuuuuaguagagacaggguuucac

SEQ ID NO: 1243225 - RNA, 24 nt, Human
uuuuuaguagagacgggguuucac

SEQ ID NO: 1243226 - RNA, 21 nt, Human
uuuuugcauuuuuaguagaga

SEQ ID NO: 1243227 - RNA, 21 nt, Human
uuuuuguauuuuuaguagaga

SEQ ID NO: 1243228 - RNA, 24 nt, Human
uuuuuugcauuuuuaguagagaca

SEQ ID NO: 1243229 - RNA, 21 nt, Human
uuuuuuguauuuuuaguagag

SEQ ID NO: 1243230 - RNA, 19 nt, Human
aagauacucucuguuuucu

SEQ ID NO: 1243231 - RNA, 21 nt, Human
aauuuuuauacaaagaaaagg

SEQ ID NO: 1243232 - RNA, 18 nt, Human
accugggcuugcugcugc

SEQ ID NO: 1243233 - RNA, 21 nt, Human
agaaaagggagaggaagagaa

SEQ ID NO: 1243234 - RNA, 19 nt, Human
agagagcuuugccaccagu

SEQ ID NO: 1243235 - RNA, 18 nt, Human
augggcucaauauaucau

SEQ ID NO: 1243236 - RNA, 22 nt, Human
cagcaggaaggagcuaguuacc

SEQ ID NO: 1243237 - RNA, 20 nt, Human
cauguaaacaauugauauga

SEQ ID NO: 1243238 - RNA, 23 nt, Human
ccaagaacaugcacaucuucacc

SEQ ID NO: 1243239 - RNA, 20 nt, Human
cugggcuugcugcugcccca

SEQ ID NO: 1243240 - RNA, 19 nt, Human
cuuucccucucucucucca

SEQ ID NO: 1243241 - RNA, 19 nt, Human
ucuccaggugaaguuugug

SEQ ID NO: 1243242 - RNA, 21 nt, Human
ugauaugagaguuuuucuuga

SEQ ID NO: 1243243 - RNA, 23 nt, Human
ugauuacagcaggaaggagcuag

SEQ ID NO: 1243244 - RNA, 23 nt, Human
uguuauuaauacuuucuccaaga

SEQ ID NO: 1243245 - RNA, 20 nt, Human
uugcugcugccccacguagu

SEQ ID NO: 1243246 - RNA, 19 nt, Human
aacagagugaaaccucauc

SEQ ID NO: 1243247 - RNA, 20 nt, Human
aacagagugaaaccucaucu

SEQ ID NO: 1243248 - RNA, 21 nt, Human
aacagagugaaaccucaucuc

SEQ ID NO: 1243249 - RNA, 19 nt, Human
aagacacacacacacacac

SEQ ID NO: 1243250 - RNA, 24 nt, Human
aagcuuguuuuccugcaacuggau

SEQ ID NO: 1243251 - RNA, 24 nt, Human
aaucacuugaacccaggaggcaga

SEQ ID NO: 1243252 - RNA, 24 nt, Human
aauugcuugagccuggcaggugga

SEQ ID NO: 1243253 - RNA, 18 nt, Human
acagagugaaaccucauc

SEQ ID NO: 1243254 - RNA, 18 nt, Human
acagagugagacccuguc

SEQ ID NO: 1243255 - RNA, 20 nt, Human
acagagugagacccugucuc

SEQ ID NO: 1243256 - RNA, 24 nt, Human
acagagugagacccugucucaaga

SEQ ID NO: 1243257 - RNA, 18 nt, Human
acagggugagaccccauc

SEQ ID NO: 1243258 - RNA, 19 nt, Human
acagggugagaccccaucu

SEQ ID NO: 1243259 - RNA, 20 nt, Human
acagggugagaccccaucuc

SEQ ID NO: 1243260 - RNA, 25 nt, Human
accacaaauggaagaaaggccauga

SEQ ID NO: 1243261 - RNA, 19 nt, Human
accacuguacuccagccug

SEQ ID NO: 1243262 - RNA, 24 nt, Human
accacuguacuccagccuggguga

SEQ ID NO: 1243263 - RNA, 20 nt, Human
accaguccuagcuacucagg

SEQ ID NO: 1243264 - RNA, 22 nt, Human
acccugucucaagacacacaca

SEQ ID NO: 1243265 - RNA, 18 nt, Human
acuacacuccagccuugg

SEQ ID NO: 1243266 - RNA, 18 nt, Human
acuacacuccagccuugg

SEQ ID NO: 1243267 - RNA, 19 nt, Human
acuacacuccagccuugga

SEQ ID NO: 1243268 - RNA, 25 nt, Human
acuacacuccagccuuggacaacag

SEQ ID NO: 1243269 - RNA, 19 nt, Human
acuacacuccagccuuggg

SEQ ID NO: 1243270 - RNA, 24 nt, Human
acuacuguagucaagccuggguga

SEQ ID NO: 1243271 - RNA, 19 nt, Human
acuccagccugggugacag

SEQ ID NO: 1243272 - RNA, 24 nt, Human
acuccagccugggugacagaguga

SEQ ID NO: 1243273 - RNA, 21 nt, Human
acuggauugugagggccagag

SEQ ID NO: 1243274 - RNA, 24 nt, Human
acuguacuccagccugggugacag

SEQ ID NO: 1243275 - RNA, 26 nt, Human
acuguacuccagccugggugacagag

SEQ ID NO: 1243276 - RNA, 20 nt, Human
acuguacuccagccuguggg

SEQ ID NO: 1243277 - RNA, 22 nt, Human
acuguagucaagccugggugac

SEQ ID NO: 1243278 - RNA, 24 nt, Human
acuguagucaagccugggugacag

SEQ ID NO: 1243279 - RNA, 23 nt, Human
agaaguugggcaaaaggcugauu

SEQ ID NO: 1243280 - RNA, 25 nt, Human
agacagaaguugggcaaaagggacc

SEQ ID NO: 1243281 - RNA, 20 nt, Human
agacguugcagugagccaag

SEQ ID NO: 1243282 - RNA, 24 nt, Human
agcaccuguagucucagccacgug

SEQ ID NO: 1243283 - RNA, 23 nt, Human
agcagggcaugguggcaggcgcc

SEQ ID NO: 1243284 - RNA, 24 nt, Human
agccuggaugacagagcaagacuc

SEQ ID NO: 1243285 - RNA, 22 nt, Human
agccugggugacagagugagac

SEQ ID NO: 1243286 - RNA, 22 nt, Human
agccugggugacagggugagac

SEQ ID NO: 1243287 - RNA, 23 nt, Human
agccuguggucccagcuacuggg

SEQ ID NO: 1243288 - RNA, 24 nt, Human
agccuguggucccagcuacuggga

SEQ ID NO: 1243289 - RNA, 18 nt, Human
aggaggcucagguaggag

SEQ ID NO: 1243290 - RNA, 23 nt, Human
aggaguucaagaccagccugagc

SEQ ID NO: 1243291 - RNA, 19 nt, Human
aggcacuaggccuggaaau

SEQ ID NO: 1243292 - RNA, 24 nt, Human
aggcagacguugcagugagccaag

SEQ ID NO: 1243293 - RNA, 18 nt, Human
aggcaggagaaucacuug

SEQ ID NO: 1243294 - RNA, 23 nt, Human
aggcaggagaaucacuugaaccc

SEQ ID NO: 1243295 - RNA, 24 nt, Human
aggcaggagaaucacuugaaccca

SEQ ID NO: 1243296 - RNA, 22 nt, Human
aggcaggagaauugcuugagcc

SEQ ID NO: 1243297 - RNA, 24 nt, Human
aggcaggagaauugcuugagccug

SEQ ID NO: 1243298 - RNA, 25 nt, Human
aggcaggagcuucgacugaggaugc

SEQ ID NO: 1243299 - RNA, 19 nt, Human
aggcaggaggagcugggcc

SEQ ID NO: 1243300 - RNA, 21 nt, Human
aggcaggaggagcugggccug

SEQ ID NO: 1243301 - RNA, 19 nt, Human
aggcucagguaggaggauc

SEQ ID NO: 1243302 - RNA, 24 nt, Human
aggcugaggcaggagaaucacuug

SEQ ID NO: 1243303 - RNA, 21 nt, Human
aggcugaggcaggagaauugc

SEQ ID NO: 1243304 - RNA, 24 nt, Human
aggcugaggcaggagaauugcuug

SEQ ID NO: 1243305 - RNA, 19 nt, Human
agguggaggcugcagugag

SEQ ID NO: 1243306 - RNA, 20 nt, Human
agguggaggcugcagugagc

SEQ ID NO: 1243307 - RNA, 20 nt, Human
agguugagaugggaggaucg

SEQ ID NO: 1243308 - RNA, 19 nt, Human
aguaauuuugaggucacuu

SEQ ID NO: 1243309 - RNA, 20 nt, Human
auaauuggaccacugaacuc

SEQ ID NO: 1243310 - RNA, 21 nt, Human
auaccuauaaucccagcccac

SEQ ID NO: 1243311 - RNA, 22 nt, Human
aucaaguuguaaaucuucaccu

SEQ ID NO: 1243312 - RNA, 24 nt, Human
aucucaccacuguacuccagccug

SEQ ID NO: 1243313 - RNA, 22 nt, Human
aucucuacaaaaaauuagaaaa

SEQ ID NO: 1243314 - RNA, 19 nt, Human
aucugggucuggagggucc

SEQ ID NO: 1243315 - RNA, 19 nt, Human
augccacuguacuccagcc

SEQ ID NO: 1243316 - RNA, 18 nt, Human
caacuggauggucccacg

SEQ ID NO: 1243317 - RNA, 22 nt, Human
caagaccacgccacugccagcc

SEQ ID NO: 1243318 - RNA, 18 nt, Human
caagggaaucuucagcuc

SEQ ID NO: 1243319 - RNA, 21 nt, Human
caccccuaagcucgcaggaca

SEQ ID NO: 1243320 - RNA, 19 nt, Human
caccuguagucucagccac

SEQ ID NO: 1243321 - RNA, 24 nt, Human
caccuguagucucagccacguggg

SEQ ID NO: 1243322 - RNA, 21 nt, Human
cacuaggccuggaaauggccc

SEQ ID NO: 1243323 - RNA, 24 nt, Human
cacugccagccuggaugacagagc

SEQ ID NO: 1243324 - RNA, 19 nt, Human
cacuguacuccagccuggg

SEQ ID NO: 1243325 - RNA, 19 nt, Human
cacuguacuccagccuggg

SEQ ID NO: 1243326 - RNA, 19 nt, Human
cacuguacuccagccuggg

SEQ ID NO: 1243327 - RNA, 21 nt, Human
cacuguacuccagccugggug

SEQ ID NO: 1243328 - RNA, 22 nt, Human
cacuguacuccagccuggguga

SEQ ID NO: 1243329 - RNA, 24 nt, Human
cacuguacuccagccugggugaca

SEQ ID NO: 1243330 - RNA, 25 nt, Human
cacuguacuccagccugggugacag

SEQ ID NO: 1243331 - RNA, 20 nt, Human
cacuguacuccagccugugg

SEQ ID NO: 1243332 - RNA, 21 nt, Human
cacuguacuccagccuguggu

SEQ ID NO: 1243333 - RNA, 19 nt, Human
cagcccacugggagacuag

SEQ ID NO: 1243334 - RNA, 24 nt, Human
cagcuacucaggaggcugaggcag

SEQ ID NO: 1243335 - RNA, 24 nt, Human
cagcuacucgggaggcugaggcag

SEQ ID NO: 1243336 - RNA, 18 nt, Human
cagcugaguuucgucucc

SEQ ID NO: 1243337 - RNA, 24 nt, Human
caggaggcugaggcaggagaauca

SEQ ID NO: 1243338 - RNA, 20 nt, Human
cagggcaugguggcaggcgg

SEQ ID NO: 1243339 - RNA, 21 nt, Human
cagggugagaccccaucuccu

SEQ ID NO: 1243340 - RNA, 22 nt, Human
caugguggcaggcgccuguagu

SEQ ID NO: 1243341 - RNA, 20 nt, Human
ccaagaccacgccacugcca

SEQ ID NO: 1243342 - RNA, 19 nt, Human
ccacugaacuccauccuga

SEQ ID NO: 1243343 - RNA, 18 nt, Human
ccacuguacuccagccug

SEQ ID NO: 1243344 - RNA, 20 nt, Human
ccacuguacuccagccuggg

SEQ ID NO: 1243345 - RNA, 20 nt, Human
ccacuguacuccagccuggg

SEQ ID NO: 1243346 - RNA, 21 nt, Human
ccacuguacuccagccugggu

SEQ ID NO: 1243347 - RNA, 21 nt, Human
ccacuguacuccagccugggu

SEQ ID NO: 1243348 - RNA, 24 nt, Human
ccacuguacuccagccugggugac

SEQ ID NO: 1243349 - RNA, 19 nt, Human
ccacuguacuccagccugu

SEQ ID NO: 1243350 - RNA, 21 nt, Human
ccacuguacuccagccugugg

SEQ ID NO: 1243351 - RNA, 21 nt, Human
ccacuguacuccagccugugg

SEQ ID NO: 1243352 - RNA, 22 nt, Human
ccacuguacuccagccuguggu

SEQ ID NO: 1243353 - RNA, 18 nt, Human
ccacugugaggcagaggc

SEQ ID NO: 1243354 - RNA, 19 nt, Human
ccagcacugggaaacuagg

SEQ ID NO: 1243355 - RNA, 21 nt, Human
ccaguccuagcuacucaggag

SEQ ID NO: 1243356 - RNA, 25 nt, Human
cccgcagagccucggaagccacuga

SEQ ID NO: 1243357 - RNA, 24 nt, Human
ccgugaggccaggaguucaagacc

SEQ ID NO: 1243358 - RNA, 20 nt, Human
ccucauuuuccguuccccag

SEQ ID NO: 1243359 - RNA, 19 nt, Human
ccucggaagccacugaccc

SEQ ID NO: 1243360 - RNA, 22 nt, Human
ccuggaugacagagcaagacuc

SEQ ID NO: 1243361 - RNA, 24 nt, Human
ccuggcaugaggcgugcccagagg

SEQ ID NO: 1243362 - RNA, 20 nt, Human
ccugggugacagagugagac

SEQ ID NO: 1243363 - RNA, 20 nt, Human
ccugggugacagggugagac

SEQ ID NO: 1243364 - RNA, 19 nt, Human
ccuguagucccagcuacuc

SEQ ID NO: 1243365 - RNA, 21 nt, Human
ccuguagucccagcuacucag

SEQ ID NO: 1243366 - RNA, 22 nt, Human
ccuguagucccagcuacucagg

SEQ ID NO: 1243367 - RNA, 18 nt, Human
ccuguggucccagcuacu

SEQ ID NO: 1243368 - RNA, 24 nt, Human
ccuguggucccagcuacugggaag

SEQ ID NO: 1243369 - RNA, 18 nt, Human
cgaaaggauccaucccau

SEQ ID NO: 1243370 - RNA, 19 nt, Human
cgcaagaaccacaaaugga

SEQ ID NO: 1243371 - RNA, 24 nt, Human
cgccuguagucccagcuacucagg

SEQ ID NO: 1243372 - RNA, 22 nt, Human
cuacuacacuccagccuuggac

SEQ ID NO: 1243373 - RNA, 24 nt, Human
cuacuguagucaagccugggugac

SEQ ID NO: 1243374 - RNA, 21 nt, Human
cucccgcagagccucggaagc

SEQ ID NO: 1243375 - RNA, 18 nt, Human
cucguuggucuuugucuc

SEQ ID NO: 1243376 - RNA, 18 nt, Human
cugaguuucgucuccucc

SEQ ID NO: 1243377 - RNA, 24 nt, Human
cugcuugagccugggaguuugagg

SEQ ID NO: 1243378 - RNA, 23 nt, Human
cuggaagguugaggcugcaguca

SEQ ID NO: 1243379 - RNA, 18 nt, Human
cuggcagguggaggcugc

SEQ ID NO: 1243380 - RNA, 21 nt, Human
cuggcaugaggcgugcccaga

SEQ ID NO: 1243381 - RNA, 21 nt, Human
cuggccuucagaccugagccu

SEQ ID NO: 1243382 - RNA, 18 nt, Human
cuguaaucccagcuacuc

SEQ ID NO: 1243383 - RNA, 21 nt, Human
cuguaaucccagcuacucggg

SEQ ID NO: 1243384 - RNA, 19 nt, Human
gaaacggauucucccgcag

SEQ ID NO: 1243385 - RNA, 22 nt, Human
gaagcuucucucacucuccaga

SEQ ID NO: 1243386 - RNA, 19 nt, Human
gaauccacguauacgaaaa

SEQ ID NO: 1243387 - RNA, 18 nt, Human
gacagaagcaggaaacuc

SEQ ID NO: 1243388 - RNA, 24 nt, Human
gacagagugagacccugucucaag

SEQ ID NO: 1243389 - RNA, 18 nt, Human
gacccugucucaagacac

SEQ ID NO: 1243390 - RNA, 18 nt, Human
gacugcuugagccuggga

SEQ ID NO: 1243391 - RNA, 23 nt, Human
gagaaucacuugaacccaggagg

SEQ ID NO: 1243392 - RNA, 23 nt, Human
gaggaucacuugagcccaggaag

SEQ ID NO: 1243393 - RNA, 21 nt, Human
gaggcucagguaggaggaucc

SEQ ID NO: 1243394 - RNA, 21 nt, Human
gagugacagggcaagguccug

SEQ ID NO: 1243395 - RNA, 21 nt, Human
gaguuucgucuccuccacugg

SEQ ID NO: 1243396 - RNA, 24 nt, Human
gaucccgugaggccaggaguucaa

SEQ ID NO: 1243397 - RNA, 24 nt, Human
gauccuuagcccaggaguucaagg

SEQ ID NO: 1243398 - RNA, 23 nt, Human
gcagagccucggaagccacugac

SEQ ID NO: 1243399 - RNA, 22 nt, Human
gcaggagaaucacuugaaccca

SEQ ID NO: 1243400 - RNA, 23 nt, Human
gcagggcaugguggcaggcgccu

SEQ ID NO: 1243401 - RNA, 22 nt, Human
gccaagaccacgccacugccag

SEQ ID NO: 1243402 - RNA, 21 nt, Human
gccaccuccacggccaggaaa

SEQ ID NO: 1243403 - RNA, 22 nt, Human
gccacuguacuccagccugugg

SEQ ID NO: 1243404 - RNA, 24 nt, Human
gcccaggaguucaaggcugcagug

SEQ ID NO: 1243405 - RNA, 20 nt, Human
gcccugugguuggagaccgc

SEQ ID NO: 1243406 - RNA, 24 nt, Human
gccgaaaggcaggagcuucgacug

SEQ ID NO: 1243407 - RNA, 23 nt, Human
ggaggcaggaggagcugggcccc

SEQ ID NO: 1243408 - RNA, 22 nt, Human
ggaggcugaaauaggaggauca

SEQ ID NO: 1243409 - RNA, 20 nt, Human
ggaggcugcagugagcagag

SEQ ID NO: 1243410 - RNA, 24 nt, Human
ggaggcugcagugagcagagguua

SEQ ID NO: 1243411 - RNA, 23 nt, Human
ggagugcaggccaccuccacggc

SEQ ID NO: 1243412 - RNA, 23 nt, Human
ggaucccgugaggccaggaguuc

SEQ ID NO: 1243413 - RNA, 19 nt, Human
ggcagguggaggcugcagu

SEQ ID NO: 1243414 - RNA, 23 nt, Human
ggcgugcccagagggacagaggc

SEQ ID NO: 1243415 - RNA, 21 nt, Human
ggcucauaccuauaaucccag

SEQ ID NO: 1243416 - RNA, 25 nt, Human
gggcaaaaggcugauuugaggaagu

SEQ ID NO: 1243417 - RNA, 24 nt, Human
gggcauaguggcaagcaccuguag

SEQ ID NO: 1243418 - RNA, 24 nt, Human
gggcaugguggcaggcgccuguag

SEQ ID NO: 1243419 - RNA, 21 nt, Human
ggugauggagagggugggagg

SEQ ID NO: 1243420 - RNA, 24 nt, Human
gguggcucauaccuauaaucccag

SEQ ID NO: 1243421 - RNA, 24 nt, Human
guacuccagccugggugacagagu

SEQ ID NO: 1243422 - RNA, 23 nt, Human
guacuccagccuguggucccagc

SEQ ID NO: 1243423 - RNA, 24 nt, Human
guacuccagccuguggucccagcu

SEQ ID NO: 1243424 - RNA, 18 nt, Human
gugaggcagaggcuggcc

SEQ ID NO: 1243425 - RNA, 23 nt, Human
guggcaggcgccuguagucccag

SEQ ID NO: 1243426 - RNA, 24 nt, Human
guuaugccacuguacuccagccug

SEQ ID NO: 1243427 - RNA, 26 nt, Human
uaaggcaggaggaucccgugaggcca

SEQ ID NO: 1243428 - RNA, 26 nt, Human
uacaaaacagcagggcaugguggcag

SEQ ID NO: 1243429 - RNA, 22 nt, Human
uacaaugagccauaauuggacc

SEQ ID NO: 1243430 - RNA, 23 nt, Human
uaccuauaaucccagcccacugg

SEQ ID NO: 1243431 - RNA, 24 nt, Human
uaccuauaaucccagcccacuggg

SEQ ID NO: 1243432 - RNA, 25 nt, Human
uacuacacuccagccuuggacaaca

SEQ ID NO: 1243433 - RNA, 22 nt, Human
uacuccagccugggugacagag

SEQ ID NO: 1243434 - RNA, 24 nt, Human
uacuccagccugggugacagagug

SEQ ID NO: 1243435 - RNA, 22 nt, Human
uacuccagccuguggucccagc

SEQ ID NO: 1243436 - RNA, 19 nt, Human
uacucuggaggcugaaaua

SEQ ID NO: 1243437 - RNA, 19 nt, Human
uacuguaaucccagcuacu

SEQ ID NO: 1243438 - RNA, 23 nt, Human
uacuguaaucccagcuacucggg

SEQ ID NO: 1243439 - RNA, 18 nt, Human
uagaaaaugaacugggug

SEQ ID NO: 1243440 - RNA, 20 nt, Human
uagcacuacuacacuccagc

SEQ ID NO: 1243441 - RNA, 18 nt, Human
uaggguuuauccaucuug

SEQ ID NO: 1243442 - RNA, 23 nt, Human
uaguggcaagcaccuguagucuc

SEQ ID NO: 1243443 - RNA, 24 nt, Human
uaguggcaagcaccuguagucuca

SEQ ID NO: 1243444 - RNA, 20 nt, Human
uaguugggcauaguggcaag

SEQ ID NO: 1243445 - RNA, 21 nt, Human
ucaagccugggugacagggug

SEQ ID NO: 1243446 - RNA, 21 nt, Human
ucauuuuccguuccccagcau

SEQ ID NO: 1243447 - RNA, 27 nt, Human
uccacguauacgaaaauuccaaauauu

SEQ ID NO: 1243448 - RNA, 20 nt, Human
uccacugugaggcagaggcu

SEQ ID NO: 1243449 - RNA, 23 nt, Human
uccagccugggugacagagugag

SEQ ID NO: 1243450 - RNA, 24 nt, Human
uccagccugggugacagagugaga

SEQ ID NO: 1243451 - RNA, 19 nt, Human
ucccgugaggccaggaguu

SEQ ID NO: 1243452 - RNA, 21 nt, Human
uccuuagcccaggaguucaag

SEQ ID NO: 1243453 - RNA, 24 nt, Human
uccuuagcccaggaguucaaggcu

SEQ ID NO: 1243454 - RNA, 23 nt, Human
ucgggaggcugaggcaggagaau

SEQ ID NO: 1243455 - RNA, 20 nt, Human
ucuccagaagagcuucccau

SEQ ID NO: 1243456 - RNA, 21 nt, Human
ucuguggcccugugguuggag

SEQ ID NO: 1243457 - RNA, 21 nt, Human
ucuuagaagguggggaauaau

SEQ ID NO: 1243458 - RNA, 18 nt, Human
ugaaaccacaggacagua

SEQ ID NO: 1243459 - RNA, 23 nt, Human
ugaacucccucauuuuccguucc

SEQ ID NO: 1243460 - RNA, 24 nt, Human
ugaagacguaccucaugaagcuga

SEQ ID NO: 1243461 - RNA, 21 nt, Human
ugacagaagcaggaaacucca

SEQ ID NO: 1243462 - RNA, 22 nt, Human
ugacagagugagacccugucuc

SEQ ID NO: 1243463 - RNA, 21 nt, Human
ugacagggcaagguccuguuu

SEQ ID NO: 1243464 - RNA, 22 nt, Human
ugacagggugagaccccaucuc

SEQ ID NO: 1243465 - RNA, 24 nt, Human
ugacagggugagaccccaucuccu

SEQ ID NO: 1243466 - RNA, 18 nt, Human
ugacaugguaggacugcu

SEQ ID NO: 1243467 - RNA, 21 nt, Human
ugagaugggaggaucgcuuca

SEQ ID NO: 1243468 - RNA, 24 nt, Human
ugagccuggcagguggaggcugca

SEQ ID NO: 1243469 - RNA, 22 nt, Human
ugagccugggaguuugaggcua

SEQ ID NO: 1243470 - RNA, 25 nt, Human
ugaggaugccacagugagacaccau

SEQ ID NO: 1243471 - RNA, 20 nt, Human
ugaggcaggagaaucacuug

SEQ ID NO: 1243472 - RNA, 24 nt, Human
ugaggcaggagaaucacuugaacc

SEQ ID NO: 1243473 - RNA, 25 nt, Human
ugaggcaggagaaucacuugaaccc

SEQ ID NO: 1243474 - RNA, 24 nt, Human
ugaggcaggagaauugcuugagcc

SEQ ID NO: 1243475 - RNA, 25 nt, Human
ugaggcaggagaauugcuugagccu

SEQ ID NO: 1243476 - RNA, 21 nt, Human
ugagguccccaugccuggacu

SEQ ID NO: 1243477 - RNA, 18 nt, Human
ugaguugggccuaaaugg

SEQ ID NO: 1243478 - RNA, 18 nt, Human
ugauagcacuacuguagu

SEQ ID NO: 1243479 - RNA, 19 nt, Human
ugauggagagggugggagg

SEQ ID NO: 1243480 - RNA, 24 nt, Human
ugauggagagggugggagguguag

SEQ ID NO: 1243481 - RNA, 20 nt, Human
ugcccagagggacagaggca

SEQ ID NO: 1243482 - RNA, 24 nt, Human
ugcccagagggacagaggcagcug

SEQ ID NO: 1243483 - RNA, 23 nt, Human
uggaagaaaggccaugaaaccac

SEQ ID NO: 1243484 - RNA, 21 nt, Human
uggaagcuucucucacucucc

SEQ ID NO: 1243485 - RNA, 19 nt, Human
uggaagguugaggcugcag

SEQ ID NO: 1243486 - RNA, 22 nt, Human
uggaagguugaggcugcaguca

SEQ ID NO: 1243487 - RNA, 21 nt, Human
uggauggucccacguuucacu

SEQ ID NO: 1243488 - RNA, 22 nt, Human
uggcaagcaccuguagucucag

SEQ ID NO: 1243489 - RNA, 22 nt, Human
uggcagcuuucuccaacuuugg

SEQ ID NO: 1243490 - RNA, 24 nt, Human
uggcagguggaggcugcagugagc

SEQ ID NO: 1243491 - RNA, 20 nt, Human
ugggaggcaggaggagcugg

SEQ ID NO: 1243492 - RNA, 21 nt, Human
ugggaggcaggaggagcuggg

SEQ ID NO: 1243493 - RNA, 18 nt, Human
ugggagguugagauggga

SEQ ID NO: 1243494 - RNA, 23 nt, Human
ugggagguugagaugggaggauc

SEQ ID NO: 1243495 - RNA, 21 nt, Human
ugggcaaaaggcugauuugag

SEQ ID NO: 1243496 - RNA, 26 nt, Human
ugggcaaaaggcugauuugaggaagu

SEQ ID NO: 1243497 - RNA, 18 nt, Human
ugggccuggagaggcugc

SEQ ID NO: 1243498 - RNA, 21 nt, Human
ugggugacagagugagacccu

SEQ ID NO: 1243499 - RNA, 22 nt, Human
uggucuuugucucuuagaaggu

SEQ ID NO: 1243500 - RNA, 24 nt, Human
ugguggcaggcgccuguaguccca

SEQ ID NO: 1243501 - RNA, 22 nt, Human
uguauagucccagcuacucugg

SEQ ID NO: 1243502 - RNA, 21 nt, Human
uguugagguccccaugccugg

SEQ ID NO: 1243503 - RNA, 18 nt, Human
uuaguugggcauaguggc

SEQ ID NO: 1243504 - RNA, 23 nt, Human
uuaugccacuguacuccagccug

SEQ ID NO: 1243505 - RNA, 24 nt, Human
uuccccagcauuggcggguucugg

SEQ ID NO: 1243506 - RNA, 20 nt, Human
uugcagugagccaagaccac

SEQ ID NO: 1243507 - RNA, 24 nt, Human
uugcuugagccuggcagguggagg

SEQ ID NO: 1243508 - RNA, 19 nt, Human
uuucccagucagucucucu

SEQ ID NO: 1243509 - RNA, 24 nt, Human
uuuguauagucccagcuacucugg

SEQ ID NO: 1243510 - RNA, 21 nt, Human
uuuuccugcaacuggaugguc

SEQ ID NO: 1243511 - RNA, 20 nt, Human
accuggcccaguccagggag

SEQ ID NO: 1243512 - RNA, 19 nt, Human
agagcgauucccacagccc

SEQ ID NO: 1243513 - RNA, 18 nt, Human
agcgccccggcgccccuc

SEQ ID NO: 1243514 - RNA, 21 nt, Human
caaggccccgcagccacacuc

SEQ ID NO: 1243515 - RNA, 22 nt, Human
cacagccccacggugcuggcca

SEQ ID NO: 1243516 - RNA, 19 nt, Human
caccugggugccugccagg

SEQ ID NO: 1243517 - RNA, 21 nt, Human
caccuuuggcaggaguuggug

SEQ ID NO: 1243518 - RNA, 19 nt, Human
cacgugcccacgagggccg

SEQ ID NO: 1243519 - RNA, 22 nt, Human
cacucuccgccccacaguggcu

SEQ ID NO: 1243520 - RNA, 25 nt, Human
cagaggccugggcagccuggguccc

SEQ ID NO: 1243521 - RNA, 19 nt, Human
cagccugggucccuacagc

SEQ ID NO: 1243522 - RNA, 20 nt, Human
cagccuguguggaccccgcc

SEQ ID NO: 1243523 - RNA, 25 nt, Human
caggcacacgcuccccuggcugggc

SEQ ID NO: 1243524 - RNA, 25 nt, Human
caguggcuccuggggcugauggcug

SEQ ID NO: 1243525 - RNA, 19 nt, Human
cccacaguggcuccugggg

SEQ ID NO: 1243526 - RNA, 21 nt, Human
cccagcgccccggcgccccuc

SEQ ID NO: 1243527 - RNA, 23 nt, Human
ccccagaggccugggcagccugg

SEQ ID NO: 1243528 - RNA, 25 nt, Human
ccccaggcucuuccgauuggcucag

SEQ ID NO: 1243529 - RNA, 22 nt, Human
ccccgccggccugcggcgcccg

SEQ ID NO: 1243530 - RNA, 19 nt, Human
ccccuguggcuggcgugug

SEQ ID NO: 1243531 - RNA, 25 nt, Human
cccgcagccacacucacucuccgcc

SEQ ID NO: 1243532 - RNA, 22 nt, Human
cccgcugguucugugacccauc

SEQ ID NO: 1243533 - RNA, 19 nt, Human
cccggcgccccucccucca

SEQ ID NO: 1243534 - RNA, 19 nt, Human
cccugacccccuggcugga

SEQ ID NO: 1243535 - RNA, 21 nt, Human
ccucacaggugggcucucagg

SEQ ID NO: 1243536 - RNA, 21 nt, Human
ccugaaccagggagucugacc

SEQ ID NO: 1243537 - RNA, 22 nt, Human
ccugacccccuggcuggaggga

SEQ ID NO: 1243538 - RNA, 24 nt, Human
ccuggcccaguccagggaggccug

SEQ ID NO: 1243539 - RNA, 21 nt, Human
ccugggugccugccagggcca

SEQ ID NO: 1243540 - RNA, 20 nt, Human
ccuguggcuggcguguggag

SEQ ID NO: 1243541 - RNA, 20 nt, Human
cgagggccucacaggugggc

SEQ ID NO: 1243542 - RNA, 23 nt, Human
cgccccggcgccccucccuccag

SEQ ID NO: 1243543 - RNA, 24 nt, Human
cgccccggcgccccucccuccagc

SEQ ID NO: 1243544 - RNA, 21 nt, Human
cgccccucccuccagcugcca

SEQ ID NO: 1243545 - RNA, 22 nt, Human
cgccccucccuccagcugccca

SEQ ID NO: 1243546 - RNA, 24 nt, Human
cggcugcccagcgccccggcgccc

SEQ ID NO: 1243547 - RNA, 19 nt, Human
cucauggccacguggcccc

SEQ ID NO: 1243548 - RNA, 22 nt, Human
cucucaggagaggccccaccuu

SEQ ID NO: 1243549 - RNA, 19 nt, Human
cugaaccagggagucugac

SEQ ID NO: 1243550 - RNA, 24 nt, Human
cugccagggccaucaggugcccug

SEQ ID NO: 1243551 - RNA, 21 nt, Human
cuggcaggaagcaccuggccc

SEQ ID NO: 1243552 - RNA, 23 nt, Human
cuggccagggcuccccuguggcu

SEQ ID NO: 1243553 - RNA, 20 nt, Human
cuguggcuggcguguggaga

SEQ ID NO: 1243554 - RNA, 23 nt, Human
cuuugcuggcaggaagcaccugg

SEQ ID NO: 1243555 - RNA, 20 nt, Human
gaagccuagcuggucauucu

SEQ ID NO: 1243556 - RNA, 21 nt, Human
gacccuguucuuccccagagg

SEQ ID NO: 1243557 - RNA, 22 nt, Human
gaugggaagugggcuccgaggg

SEQ ID NO: 1243558 - RNA, 26 nt, Human
gccacguggccccaacuggaggcccc

SEQ ID NO: 1243559 - RNA, 18 nt, Human
gccccggcgccccucccu

SEQ ID NO: 1243560 - RNA, 18 nt, Human
gcccucuccugcgguggc

SEQ ID NO: 1243561 - RNA, 21 nt, Human
gcccugacccccuggcuggag

SEQ ID NO: 1243562 - RNA, 23 nt, Human
gcgauucccacagccccacggug

SEQ ID NO: 1243563 - RNA, 21 nt, Human
gcgcccggagcugcugacugu

SEQ ID NO: 1243564 - RNA, 24 nt, Human
ggcugauggcugggugaucccagg

SEQ ID NO: 1243565 - RNA, 21 nt, Human
ggcuggagggaggaugggaag

SEQ ID NO: 1243566 - RNA, 22 nt, Human
ggugccugccagggccaucagg

SEQ ID NO: 1243567 - RNA, 20 nt, Human
gguggguggggggacccugu

SEQ ID NO: 1243568 - RNA, 22 nt, Human
gugggcccuucuccacgugccc

SEQ ID NO: 1243569 - RNA, 21 nt, Human
uagcaggcuccaaggaggccc

SEQ ID NO: 1243570 - RNA, 22 nt, Human
ucagagcccggcugcccagcgc

SEQ ID NO: 1243571 - RNA, 22 nt, Human
uccagggaggccuggccuccag

SEQ ID NO: 1243572 - RNA, 21 nt, Human
uccccaggcucuuccgauugg

SEQ ID NO: 1243573 - RNA, 21 nt, Human
ucccuacagcacuggcagccc

SEQ ID NO: 1243574 - RNA, 23 nt, Human
ucccuccagcugcccagccuggg

SEQ ID NO: 1243575 - RNA, 28 nt, Human
uccgugcagccaaggccccgcagccaca

SEQ ID NO: 1243576 - RNA, 23 nt, Human
ugaaccagggagucugacccacu

SEQ ID NO: 1243577 - RNA, 21 nt, Human
ugcagccaaggccccgcagcc

SEQ ID NO: 1243578 - RNA, 21 nt, Human
ugcccugacccccuggcugga

SEQ ID NO: 1243579 - RNA, 20 nt, Human
uggcaggaguuggugggugg

SEQ ID NO: 1243580 - RNA, 21 nt, Human
uggcaggaguugguggguggg

SEQ ID NO: 1243581 - RNA, 21 nt, Human
uggccagccucacaggugccc

SEQ ID NO: 1243582 - RNA, 21 nt, Human
uggcuccuggggcugauggcu

SEQ ID NO: 1243583 - RNA, 21 nt, Human
ugggaagugggcuccgagggc

SEQ ID NO: 1243584 - RNA, 24 nt, Human
ugggcagccugggucccuacagca

SEQ ID NO: 1243585 - RNA, 23 nt, Human
uggggggacccuguucuucccca

SEQ ID NO: 1243586 - RNA, 20 nt, Human
ugggguccgugcagccaagg

SEQ ID NO: 1243587 - RNA, 25 nt, Human
ugggucccuacagcacuggcagccc

SEQ ID NO: 1243588 - RNA, 21 nt, Human
uguggaccccgccggccugcg

SEQ ID NO: 1243589 - RNA, 24 nt, Human
uugguggguggggggacccuguuc

SEQ ID NO: 1243590 - RNA, 24 nt, Human
aaaaaaaaaaacacaggaaaacaa

SEQ ID NO: 1243591 - RNA, 23 nt, Human
aaaaaaaaaacacaggaaaacaa

SEQ ID NO: 1243592 - RNA, 23 nt, Human
aaaaaaaaguaagccaaaaauac

SEQ ID NO: 1243593 - RNA, 25 nt, Human
aaaaaaauacugcagucuaagccac

SEQ ID NO: 1243594 - RNA, 18 nt, Human
aaaaaacacaggaaaaca

SEQ ID NO: 1243595 - RNA, 29 nt, Human
aaaaaagaaaugcaaacaaucaacaagaa

SEQ ID NO: 1243596 - RNA, 20 nt, Human
aaaaaagagacccaaauaaa

SEQ ID NO: 1243597 - RNA, 23 nt, Human
aaaaaggagacauuacaacuguu

SEQ ID NO: 1243598 - RNA, 24 nt, Human
aaaaaggagacauuacaacuguua

SEQ ID NO: 1243599 - RNA, 25 nt, Human
aaaaaggauuucccagauaagcaaa

SEQ ID NO: 1243600 - RNA, 24 nt, Human
aaaaauacaaaaauuagcugcaca

SEQ ID NO: 1243601 - RNA, 21 nt, Human
aaaagaaagagguuuaaugga

SEQ ID NO: 1243602 - RNA, 20 nt, Human
aaaagacaaagagaaaaugc

SEQ ID NO: 1243603 - RNA, 23 nt, Human
aaaaugacagguauaaguccuca

SEQ ID NO: 1243604 - RNA, 20 nt, Human
aaacaaacaccaauucuucu

SEQ ID NO: 1243605 - RNA, 21 nt, Human
aaacaaacaccaauucuucuc

SEQ ID NO: 1243606 - RNA, 21 nt, Human
aaacagaaaaccugaacugac

SEQ ID NO: 1243607 - RNA, 23 nt, Human
aaacagaaaaccugaacugaccc

SEQ ID NO: 1243608 - RNA, 21 nt, Human
aaacagaaaucaaaaauaauc

SEQ ID NO: 1243609 - RNA, 25 nt, Human
aaacagaaaucaaaaauaaucagga

SEQ ID NO: 1243610 - RNA, 23 nt, Human
aaacagcaagagaaaggcaucaa

SEQ ID NO: 1243611 - RNA, 24 nt, Human
aaagaaacucaggcagauacaaga

SEQ ID NO: 1243612 - RNA, 24 nt, Human
aaagaagccaccuggaggcccagg

SEQ ID NO: 1243613 - RNA, 21 nt, Human
aaagacauaccugacugagac

SEQ ID NO: 1243614 - RNA, 18 nt, Human
aacaaaaaaagagaccca

SEQ ID NO: 1243615 - RNA, 18 nt, Human
aacaaaaagucucccaaa

SEQ ID NO: 1243616 - RNA, 24 nt, Human
aacaaacaccaauucuucucaaac

SEQ ID NO: 1243617 - RNA, 19 nt, Human
aacaaguuaguuacuuccu

SEQ ID NO: 1243618 - RNA, 24 nt, Human
aacaaguuccucauuuccaucuga

SEQ ID NO: 1243619 - RNA, 24 nt, Human
aacauaaaacaaugaacaaaauga

SEQ ID NO: 1243620 - RNA, 21 nt, Human
aaccaaagaagccaccuggag

SEQ ID NO: 1243621 - RNA, 21 nt, Human
aaccaaaugcaacagagacaa

SEQ ID NO: 1243622 - RNA, 21 nt, Human
aaccauaugcuaacaaauugg

SEQ ID NO: 1243623 - RNA, 20 nt, Human
aaccuaaugaugcaccucaa

SEQ ID NO: 1243624 - RNA, 21 nt, Human
aaccucaauuuuugacuucug

SEQ ID NO: 1243625 - RNA, 18 nt, Human
aaccucugccuguuuccc

SEQ ID NO: 1243626 - RNA, 20 nt, Human
aacguggugaaacccugucu

SEQ ID NO: 1243627 - RNA, 21 nt, Human
aacguggugaaacccugucuc

SEQ ID NO: 1243628 - RNA, 26 nt, Human
aacuacuucccacugccucccuccca

SEQ ID NO: 1243629 - RNA, 19 nt, Human
aagaaagaaaaaagaauga

SEQ ID NO: 1243630 - RNA, 21 nt, Human
aagaaagaaaaaagaaugaag

SEQ ID NO: 1243631 - RNA, 18 nt, Human
aagaagaagaaauuugga

SEQ ID NO: 1243632 - RNA, 21 nt, Human
aagaagccaccuggaggccca

SEQ ID NO: 1243633 - RNA, 21 nt, Human
aagaggugggcucccauggcc

SEQ ID NO: 1243634 - RNA, 22 nt, Human
aagcaagaacaaaucaaacaca

SEQ ID NO: 1243635 - RNA, 22 nt, Human
aagcaagucaugucucacaugg

SEQ ID NO: 1243636 - RNA, 19 nt, Human
aaggagccuggcacagugg

SEQ ID NO: 1243637 - RNA, 24 nt, Human
aagugugguggcucacgccuguaa

SEQ ID NO: 1243638 - RNA, 23 nt, Human
aaucuaggcagcaguucccaaac

SEQ ID NO: 1243639 - RNA, 22 nt, Human
aaugcaacagagacaaaaaaga

SEQ ID NO: 1243640 - RNA, 18 nt, Human
aauugcuugaaccuggga

SEQ ID NO: 1243641 - RNA, 24 nt, Human
aauugcuugaaccugggaggcaga

SEQ ID NO: 1243642 - RNA, 22 nt, Human
acaaaaaagaaaugcaaacaau

SEQ ID NO: 1243643 - RNA, 22 nt, Human
acaaaguauaacaauuccaaau

SEQ ID NO: 1243644 - RNA, 22 nt, Human
acaacaacaaaaaaagagaccc

SEQ ID NO: 1243645 - RNA, 25 nt, Human
acaacaacaaaaaaagagacccaaa

SEQ ID NO: 1243646 - RNA, 25 nt, Human
acaauuccaaauaugcaugcaacca

SEQ ID NO: 1243647 - RNA, 18 nt, Human
acacacacuacccaggag

SEQ ID NO: 1243648 - RNA, 21 nt, Human
acacacacuacccaggagccc

SEQ ID NO: 1243649 - RNA, 19 nt, Human
acacacuacccaggagccc

SEQ ID NO: 1243650 - RNA, 21 nt, Human
acagaacaaggcugcacaaaa

SEQ ID NO: 1243651 - RNA, 25 nt, Human
acagagugagacuccauugcuaaaa

SEQ ID NO: 1243652 - RNA, 23 nt, Human
acaggacccaugcaagcccaaaa

SEQ ID NO: 1243653 - RNA, 18 nt, Human
accacagccuccaauaac

SEQ ID NO: 1243654 - RNA, 22 nt, Human
accauaucaaaaggauauacaa

SEQ ID NO: 1243655 - RNA, 19 nt, Human
accccacauuucccuucug

SEQ ID NO: 1243656 - RNA, 24 nt, Human
acccugucucuacuaaaaauacaa

SEQ ID NO: 1243657 - RNA, 25 nt, Human
acuacuucccacugccucccuccca

SEQ ID NO: 1243658 - RNA, 24 nt, Human
acuccagccugggugacagaguga

SEQ ID NO: 1243659 - RNA, 23 nt, Human
acugcacuccagccuggugacag

SEQ ID NO: 1243660 - RNA, 25 nt, Human
acugcacuccagccuggugacagag

SEQ ID NO: 1243661 - RNA, 24 nt, Human
acuguacuccagccugggugacag

SEQ ID NO: 1243662 - RNA, 26 nt, Human
acuguacuccagccugggugacagag

SEQ ID NO: 1243663 - RNA, 23 nt, Human
agaaaaccaucaaacugcaacca

SEQ ID NO: 1243664 - RNA, 20 nt, Human
agaaaaccugaacugaccca

SEQ ID NO: 1243665 - RNA, 20 nt, Human
agaaagauuucaaauaaaca

SEQ ID NO: 1243666 - RNA, 19 nt, Human
agaaccugcauacgucacc

SEQ ID NO: 1243667 - RNA, 23 nt, Human
agacaaaaaagaaaugcaaacaa

SEQ ID NO: 1243668 - RNA, 23 nt, Human
agacaaaaagaaagaaaagggac

SEQ ID NO: 1243669 - RNA, 19 nt, Human
agagguucuccaugagugc

SEQ ID NO: 1243670 - RNA, 22 nt, Human
agagguuguagugagcugagau

SEQ ID NO: 1243671 - RNA, 24 nt, Human
agagguuguagugagcugagauug

SEQ ID NO: 1243672 - RNA, 21 nt, Human
agauacaagagaacacagaua

SEQ ID NO: 1243673 - RNA, 27 nt, Human
agauagagacaggcuuaauggauaaaa

SEQ ID NO: 1243674 - RNA, 19 nt, Human
agcaagaacaaaucaaaca

SEQ ID NO: 1243675 - RNA, 24 nt, Human
agcacuuugagaggcugaggccgg

SEQ ID NO: 1243676 - RNA, 20 nt, Human
agcaguucccaaaccucaau

SEQ ID NO: 1243677 - RNA, 24 nt, Human
agcauaacaaagaacaaaacacaa

SEQ ID NO: 1243678 - RNA, 25 nt, Human
agccacugaaugacucacaggcacc

SEQ ID NO: 1243679 - RNA, 19 nt, Human
agccuaaaauauuaccauu

SEQ ID NO: 1243680 - RNA, 24 nt, Human
agccugggugacagagugagacuc

SEQ ID NO: 1243681 - RNA, 23 nt, Human
agcugcacaugguugcacaugcc

SEQ ID NO: 1243682 - RNA, 19 nt, Human
aggaagaaacagaaaaccu

SEQ ID NO: 1243683 - RNA, 21 nt, Human
aggacccaugcaagcccaaaa

SEQ ID NO: 1243684 - RNA, 19 nt, Human
aggcaaagagagagcuuga

SEQ ID NO: 1243685 - RNA, 23 nt, Human
aggcaccacucaugccaauuaca

SEQ ID NO: 1243686 - RNA, 24 nt, Human
aggcagagguuguagugagcugag

SEQ ID NO: 1243687 - RNA, 22 nt, Human
aggcaggagaauugcuugaacc

SEQ ID NO: 1243688 - RNA, 24 nt, Human
aggcaggagaauugcuugaaccug

SEQ ID NO: 1243689 - RNA, 18 nt, Human
aggcaggaggaccauuug

SEQ ID NO: 1243690 - RNA, 19 nt, Human
aggccacagcuccacuccu

SEQ ID NO: 1243691 - RNA, 24 nt, Human
aggccgguagaucacgaggucagg

SEQ ID NO: 1243692 - RNA, 21 nt, Human
aggcugaggcaggagaauugc

SEQ ID NO: 1243693 - RNA, 24 nt, Human
aggcugaggcaggagaauugcuug

SEQ ID NO: 1243694 - RNA, 24 nt, Human
aggcugaggcaggaggaccauuug

SEQ ID NO: 1243695 - RNA, 26 nt, Human
aguaacaaaaagucucccaaaagaga

SEQ ID NO: 1243696 - RNA, 18 nt, Human
aguaccccaaagucuuaa

SEQ ID NO: 1243697 - RNA, 24 nt, Human
aguggcucacaucugcaauuccag

SEQ ID NO: 1243698 - RNA, 18 nt, Human
auaaaagcaacaaagaaa

SEQ ID NO: 1243699 - RNA, 21 nt, Human
auaaauacaacucaaaaaggu

SEQ ID NO: 1243700 - RNA, 21 nt, Human
aucagauacccuaaaucucaa

SEQ ID NO: 1243701 - RNA, 24 nt, Human
aucaugccacuguacuccagccug

SEQ ID NO: 1243702 - RNA, 23 nt, Human
augagaucugaguggggacacag

SEQ ID NO: 1243703 - RNA, 22 nt, Human
augccacuguacuccagccugg

SEQ ID NO: 1243704 - RNA, 21 nt, Human
auucuggggucuggaggaugg

SEQ ID NO: 1243705 - RNA, 24 nt, Human
auugcaccacugcacuccagccug

SEQ ID NO: 1243706 - RNA, 18 nt, Human
caaaaaaagagacccaaa

SEQ ID NO: 1243707 - RNA, 22 nt, Human
caaaaaaagagacccaaauaaa

SEQ ID NO: 1243708 - RNA, 30 nt, Human
caaaaagcaagaacaaaucaaacacacaaa

SEQ ID NO: 1243709 - RNA, 18 nt, Human
caaaaagucucccaaaag

SEQ ID NO: 1243710 - RNA, 26 nt, Human
caaaaauacuauacccagcaaagcua

SEQ ID NO: 1243711 - RNA, 22 nt, Human
caaaaccaaucaugccuuccca

SEQ ID NO: 1243712 - RNA, 25 nt, Human
caaaaccuaugggauacagcaaaag

SEQ ID NO: 1243713 - RNA, 21 nt, Human
caaaacgaagaauuucugaac

SEQ ID NO: 1243714 - RNA, 22 nt, Human
caaaacgaagaauuucugaacc

SEQ ID NO: 1243715 - RNA, 20 nt, Human
caaaagaacaauaucuacca

SEQ ID NO: 1243716 - RNA, 21 nt, Human
caaaaugacagguauaagucc

SEQ ID NO: 1243717 - RNA, 24 nt, Human
caaacacacaauuaguggaaagaa

SEQ ID NO: 1243718 - RNA, 23 nt, Human
caaaccauaucauucugccccug

SEQ ID NO: 1243719 - RNA, 20 nt, Human
caaagaagccaccuggaggc

SEQ ID NO: 1243720 - RNA, 21 nt, Human
caaagagaaaaugcuaaaaac

SEQ ID NO: 1243721 - RNA, 22 nt, Human
caaaucacuuauaagagaaucu

SEQ ID NO: 1243722 - RNA, 19 nt, Human
caacaaaaaaagagacccc

SEQ ID NO: 1243723 - RNA, 27 nt, Human
caacaacgucuacaagaaacucacuuc

SEQ ID NO: 1243724 - RNA, 25 nt, Human
caacacaagugcauccagagacuua

SEQ ID NO: 1243725 - RNA, 23 nt, Human
caacagagguuaucuaggccaaa

SEQ ID NO: 1243726 - RNA, 23 nt, Human
caacaguaccccaaagucuuaac

SEQ ID NO: 1243727 - RNA, 21 nt, Human
caaccuaaugaugcaccucaa

SEQ ID NO: 1243728 - RNA, 24 nt, Human
caacguggugaaacccugucucua

SEQ ID NO: 1243729 - RNA, 22 nt, Human
cacaacacaugggaauucaaga

SEQ ID NO: 1243730 - RNA, 26 nt, Human
cacaacacaugggaauucaagaugag

SEQ ID NO: 1243731 - RNA, 19 nt, Human
cacaaugauaguugagaac

SEQ ID NO: 1243732 - RNA, 20 nt, Human
cacacacacuacccaggagc

SEQ ID NO: 1243733 - RNA, 31 nt, Human
cacaccaggucuaccaccacuaccacugauu

SEQ ID NO: 1243734 - RNA, 20 nt, Human
cacagcuccacuccuguggc

SEQ ID NO: 1243735 - RNA, 18 nt, Human
cacaugguugcacaugcc

SEQ ID NO: 1243736 - RNA, 23 nt, Human
caccaaaaaaguagaaagauuuc

SEQ ID NO: 1243737 - RNA, 31 nt, Human
caccaaaaaaguagaaagauuucaaauaaag

SEQ ID NO: 1243738 - RNA, 21 nt, Human
caccacagccuccaauaacaa

SEQ ID NO: 1243739 - RNA, 19 nt, Human
caccaccagaaccugcaua

SEQ ID NO: 1243740 - RNA, 25 nt, Human
caccacugcacuccagccuggugac

SEQ ID NO: 1243741 - RNA, 21 nt, Human
caccaggucuaccaccacuac

SEQ ID NO: 1243742 - RNA, 19 nt, Human
cacccagaaucaaagccaa

SEQ ID NO: 1243743 - RNA, 24 nt, Human
cacgccuguaaucccagcacuuug

SEQ ID NO: 1243744 - RNA, 22 nt, Human
cacuccagccuggugacagagc

SEQ ID NO: 1243745 - RNA, 18 nt, Human
cacugcacuccagccugg

SEQ ID NO: 1243746 - RNA, 20 nt, Human
cacugcacuccagccuggug

SEQ ID NO: 1243747 - RNA, 22 nt, Human
cacugcacuccagccuggugac

SEQ ID NO: 1243748 - RNA, 23 nt, Human
cacugcacuccagccuggugaca

SEQ ID NO: 1243749 - RNA, 23 nt, Human
cacugcacuccagccuggugaca

SEQ ID NO: 1243750 - RNA, 18 nt, Human
cacugccagcaaccaaag

SEQ ID NO: 1243751 - RNA, 24 nt, Human
cacugccucccucccacaacacau

SEQ ID NO: 1243752 - RNA, 19 nt, Human
cacuguacuccagccuggg

SEQ ID NO: 1243753 - RNA, 19 nt, Human
cacuguacuccagccuggg

SEQ ID NO: 1243754 - RNA, 21 nt, Human
cacuguacuccagccugggug

SEQ ID NO: 1243755 - RNA, 22 nt, Human
cacuguacuccagccuggguga

SEQ ID NO: 1243756 - RNA, 23 nt, Human
cacuguacuccagccugggugac

SEQ ID NO: 1243757 - RNA, 24 nt, Human
cacuguacuccagccugggugaca

SEQ ID NO: 1243758 - RNA, 24 nt, Human
cacuguacuccagccugggugaca

SEQ ID NO: 1243759 - RNA, 28 nt, Human
cagaaaauugcccaaacaaaggggcuac

SEQ ID NO: 1243760 - RNA, 24 nt, Human
cagaaggcugaggcaggaggacca

SEQ ID NO: 1243761 - RNA, 21 nt, Human
cagagcuagugcucacacuua

SEQ ID NO: 1243762 - RNA, 18 nt, Human
cagagguuguagugagcu

SEQ ID NO: 1243763 - RNA, 22 nt, Human
cagauaaaacagacuuuaaguc

SEQ ID NO: 1243764 - RNA, 25 nt, Human
cagcaaaagcaguacuaggaggaaa

SEQ ID NO: 1243765 - RNA, 22 nt, Human
cagcacuuugagaggcugaggc

SEQ ID NO: 1243766 - RNA, 25 nt, Human
cagcacuuugagaggcugaggccgg

SEQ ID NO: 1243767 - RNA, 25 nt, Human
cagcagcagaauauacagucaucuc

SEQ ID NO: 1243768 - RNA, 23 nt, Human
cagcagcagcagaauauacaguc

SEQ ID NO: 1243769 - RNA, 26 nt, Human
cagcaugggaaagaccugcccccaug

SEQ ID NO: 1243770 - RNA, 24 nt, Human
cagcuacucaggaggcugaggcag

SEQ ID NO: 1243771 - RNA, 21 nt, Human
caggacccaugcaagcccaaa

SEQ ID NO: 1243772 - RNA, 21 nt, Human
caggcagauacaagagaacac

SEQ ID NO: 1243773 - RNA, 21 nt, Human
caggggcaaaaagccaccagu

SEQ ID NO: 1243774 - RNA, 25 nt, Human
caggucccucccacaacauguggga

SEQ ID NO: 1243775 - RNA, 21 nt, Human
caguaacaaaaagucucccaa

SEQ ID NO: 1243776 - RNA, 22 nt, Human
caguaacaaaaagucucccaaa

SEQ ID NO: 1243777 - RNA, 20 nt, Human
cauaaaagcaacaaagaaac

SEQ ID NO: 1243778 - RNA, 21 nt, Human
cauaaaagcaacaaagaaaca

SEQ ID NO: 1243779 - RNA, 20 nt, Human
caucagugcccacaaacacu

SEQ ID NO: 1243780 - RNA, 22 nt, Human
caucaucacuaaagaaaaccau

SEQ ID NO: 1243781 - RNA, 21 nt, Human
caucugagacaaacucauccu

SEQ ID NO: 1243782 - RNA, 25 nt, Human
cauucugccccuggcccuucccaaa

SEQ ID NO: 1243783 - RNA, 18 nt, Human
cauuguggaagucaagga

SEQ ID NO: 1243784 - RNA, 21 nt, Human
cauuugaucccaggaguucaa

SEQ ID NO: 1243785 - RNA, 24 nt, Human
cauuuuagccuacccccccuuacc

SEQ ID NO: 1243786 - RNA, 21 nt, Human
ccaaaccauaucaaaaggaua

SEQ ID NO: 1243787 - RNA, 21 nt, Human
ccaaaccauaucauucugccc

SEQ ID NO: 1243788 - RNA, 22 nt, Human
ccaacacaagugcauccagaga

SEQ ID NO: 1243789 - RNA, 23 nt, Human
ccacaggcucaacccuaugugga

SEQ ID NO: 1243790 - RNA, 18 nt, Human
ccaccaccagaaccugca

SEQ ID NO: 1243791 - RNA, 21 nt, Human
ccaccagaaccugcauacguc

SEQ ID NO: 1243792 - RNA, 18 nt, Human
ccacccagaaucaaagcc

SEQ ID NO: 1243793 - RNA, 22 nt, Human
ccacugaaugacucacaggcac

SEQ ID NO: 1243794 - RNA, 19 nt, Human
ccacugcacuccagccugg

SEQ ID NO: 1243795 - RNA, 19 nt, Human
ccacugcacuccagccugg

SEQ ID NO: 1243796 - RNA, 20 nt, Human
ccacugcacuccagccuggu

SEQ ID NO: 1243797 - RNA, 23 nt, Human
ccacugcacuccagccuggugac

SEQ ID NO: 1243798 - RNA, 24 nt, Human
ccacugcacuccagccuggugaca

SEQ ID NO: 1243799 - RNA, 20 nt, Human
ccacuguacuccagccuggg

SEQ ID NO: 1243800 - RNA, 20 nt, Human
ccacuguacuccagccuggg

SEQ ID NO: 1243801 - RNA, 20 nt, Human
ccacuguacuccagccuggg

SEQ ID NO: 1243802 - RNA, 21 nt, Human
ccacuguacuccagccugggu

SEQ ID NO: 1243803 - RNA, 21 nt, Human
ccacuguacuccagccugggu

SEQ ID NO: 1243804 - RNA, 23 nt, Human
ccacuguacuccagccuggguga

SEQ ID NO: 1243805 - RNA, 24 nt, Human
ccacuguacuccagccugggugac

SEQ ID NO: 1243806 - RNA, 22 nt, Human
ccauaaauaaugagagaaaaaa

SEQ ID NO: 1243807 - RNA, 19 nt, Human
ccauaugcuaacaaauugg

SEQ ID NO: 1243808 - RNA, 19 nt, Human
ccaugcaagcccaaaaucc

SEQ ID NO: 1243809 - RNA, 18 nt, Human
cccaaaagagaaaagccc

SEQ ID NO: 1243810 - RNA, 20 nt, Human
cccaaaaugaauagcagguu

SEQ ID NO: 1243811 - RNA, 20 nt, Human
cccaccaccagaaccugcau

SEQ ID NO: 1243812 - RNA, 23 nt, Human
cccaccaccagaaccugcauacg

SEQ ID NO: 1243813 - RNA, 22 nt, Human
cccaugcaagcccaaaauccag

SEQ ID NO: 1243814 - RNA, 21 nt, Human
cccuucccaccaccagaaccu

SEQ ID NO: 1243815 - RNA, 22 nt, Human
ccuacauugggaagcaaaagaa

SEQ ID NO: 1243816 - RNA, 21 nt, Human
ccuaguagagguucuccauga

SEQ ID NO: 1243817 - RNA, 21 nt, Human
ccuauagucccagcuacucag

SEQ ID NO: 1243818 - RNA, 22 nt, Human
ccuauagucccagcuacucagg

SEQ ID NO: 1243819 - RNA, 21 nt, Human
ccuccuggcuccuuucacacg

SEQ ID NO: 1243820 - RNA, 23 nt, Human
ccuccuggcuccuuucacacguu

SEQ ID NO: 1243821 - RNA, 20 nt, Human
ccucuucucacagcuccacu

SEQ ID NO: 1243822 - RNA, 18 nt, Human
ccugaaaaaauuucagaa

SEQ ID NO: 1243823 - RNA, 22 nt, Human
ccuggaggcccagggauuggcc

SEQ ID NO: 1243824 - RNA, 22 nt, Human
ccuggccaacguggugaaaccc

SEQ ID NO: 1243825 - RNA, 22 nt, Human
ccuggccaacguggugaaaccc

SEQ ID NO: 1243826 - RNA, 24 nt, Human
ccuggccaacguggugaaacccug

SEQ ID NO: 1243827 - RNA, 21 nt, Human
ccugggaggcagagguuguag

SEQ ID NO: 1243828 - RNA, 22 nt, Human
ccugggugacagagugagacuc

SEQ ID NO: 1243829 - RNA, 18 nt, Human
ccuugggagaaaaaaggc

SEQ ID NO: 1243830 - RNA, 18 nt, Human
cgaccccacauuucccuu

SEQ ID NO: 1243831 - RNA, 24 nt, Human
cgagagcauccuggccaacguggu

SEQ ID NO: 1243832 - RNA, 18 nt, Human
cgccuguaaucccagcac

SEQ ID NO: 1243833 - RNA, 23 nt, Human
cgccuguaaucccagcacuuuga

SEQ ID NO: 1243834 - RNA, 27 nt, Human
cgguagaucacgaggucaggaguucga

SEQ ID NO: 1243835 - RNA, 21 nt, Human
cuagagaucagccugccacac

SEQ ID NO: 1243836 - RNA, 25 nt, Human
cuagagaucagccugccacacacac

SEQ ID NO: 1243837 - RNA, 18 nt, Human
cuaggaagaaacagaaaa

SEQ ID NO: 1243838 - RNA, 25 nt, Human
cuagugaggcuaacaacaacaaaaa

SEQ ID NO: 1243839 - RNA, 21 nt, Human
cucaaaaguccacaguccaaa

SEQ ID NO: 1243840 - RNA, 22 nt, Human
cucacgccuguaaucccagcac

SEQ ID NO: 1243841 - RNA, 24 nt, Human
cucacgccuguaaucccagcacuu

SEQ ID NO: 1243842 - RNA, 19 nt, Human
cuccaucaggcuaacaggg

SEQ ID NO: 1243843 - RNA, 20 nt, Human
cucccaaaagagaaaagccc

SEQ ID NO: 1243844 - RNA, 24 nt, Human
cugaagccacagcccacguuguac

SEQ ID NO: 1243845 - RNA, 24 nt, Human
cuggccaacguggugaaacccugu

SEQ ID NO: 1243846 - RNA, 23 nt, Human
cuggugccugaauguaccaucug

SEQ ID NO: 1243847 - RNA, 18 nt, Human
cuguuccaaccucugccu

SEQ ID NO: 1243848 - RNA, 23 nt, Human
cuucugagcccuccaaacuguuc

SEQ ID NO: 1243849 - RNA, 23 nt, Human
cuuuauuguccauauaaccauca

SEQ ID NO: 1243850 - RNA, 22 nt, Human
cuuuuaaaaccaucagaucuca

SEQ ID NO: 1243851 - RNA, 23 nt, Human
gaaaaaauauaaauaacauagca

SEQ ID NO: 1243852 - RNA, 23 nt, Human
gaaaaaggagacauuacaacugu

SEQ ID NO: 1243853 - RNA, 19 nt, Human
gaaaaccaucaaacugcaa

SEQ ID NO: 1243854 - RNA, 18 nt, Human
gaaagcaagaagaagcaa

SEQ ID NO: 1243855 - RNA, 18 nt, Human
gaaagggauaaauuccca

SEQ ID NO: 1243856 - RNA, 27 nt, Human
gaaaucucuuccaaauuuucccacauu

SEQ ID NO: 1243857 - RNA, 19 nt, Human
gaacaaccauaugcuaaca

SEQ ID NO: 1243858 - RNA, 21 nt, Human
gaacuaggaagaaacagaaaa

SEQ ID NO: 1243859 - RNA, 25 nt, Human
gacagagugagacuccauugcuaaa

SEQ ID NO: 1243860 - RNA, 19 nt, Human
gacagguauaaguccucac

SEQ ID NO: 1243861 - RNA, 18 nt, Human
gacuagugaggcuaacaa

SEQ ID NO: 1243862 - RNA, 18 nt, Human
gagaaaaaaggaacaaag

SEQ ID NO: 1243863 - RNA, 23 nt, Human
gagaauugcuugaaccugggagg

SEQ ID NO: 1243864 - RNA, 21 nt, Human
gagcagggaaacuccuccuuu

SEQ ID NO: 1243865 - RNA, 21 nt, Human
gagcauguaaaaucaaaaaca

SEQ ID NO: 1243866 - RNA, 18 nt, Human
gagcccuccaaacuguuc

SEQ ID NO: 1243867 - RNA, 22 nt, Human
gaucacgaggucaggaguucga

SEQ ID NO: 1243868 - RNA, 24 nt, Human
gaucacgaggucaggaguucgaga

SEQ ID NO: 1243869 - RNA, 20 nt, Human
gcaaagcuauccuucacaaa

SEQ ID NO: 1243870 - RNA, 21 nt, Human
gcaacagagacaaaaaagaaa

SEQ ID NO: 1243871 - RNA, 23 nt, Human
gcacuccagccuggugacagagc

SEQ ID NO: 1243872 - RNA, 21 nt, Human
gcagacuauaccacuguaccc

SEQ ID NO: 1243873 - RNA, 19 nt, Human
gcaggggcaaaaagccacc

SEQ ID NO: 1243874 - RNA, 24 nt, Human
gccaacguggugaaacccugucuc

SEQ ID NO: 1243875 - RNA, 25 nt, Human
gccacacacacuacccaggagccca

SEQ ID NO: 1243876 - RNA, 19 nt, Human
gccacuguacuccagccug

SEQ ID NO: 1243877 - RNA, 24 nt, Human
gccacuguacuccagccuggguga

SEQ ID NO: 1243878 - RNA, 23 nt, Human
gccucccuucccaccaccagaac

SEQ ID NO: 1243879 - RNA, 19 nt, Human
gccuggcacaguggcucac

SEQ ID NO: 1243880 - RNA, 19 nt, Human
ggaguucuggauggagaug

SEQ ID NO: 1243881 - RNA, 21 nt, Human
ggcucacgccuguaaucccag

SEQ ID NO: 1243882 - RNA, 23 nt, Human
gguagaucacgaggucaggaguu

SEQ ID NO: 1243883 - RNA, 24 nt, Human
gguggcucacgccuguaaucccag

SEQ ID NO: 1243884 - RNA, 24 nt, Human
gguugcacaugccuauagucccag

SEQ ID NO: 1243885 - RNA, 23 nt, Human
gguuuaaacccccuccuggcucc

SEQ ID NO: 1243886 - RNA, 19 nt, Human
gguuuaauggacuuacacc

SEQ ID NO: 1243887 - RNA, 23 nt, Human
guacuccagccugggugacagag

SEQ ID NO: 1243888 - RNA, 24 nt, Human
guacuccagccugggugacagagu

SEQ ID NO: 1243889 - RNA, 21 nt, Human
gugaaacccugucucuacuaa

SEQ ID NO: 1243890 - RNA, 18 nt, Human
gugaagggauggaaaaau

SEQ ID NO: 1243891 - RNA, 21 nt, Human
gugaggcuaacaacaacaaaa

SEQ ID NO: 1243892 - RNA, 23 nt, Human
guggcucacgccuguaaucccag

SEQ ID NO: 1243893 - RNA, 21 nt, Human
guuguagugagcugagauugc

SEQ ID NO: 1243894 - RNA, 19 nt, Human
uaaaaaaugacccaacaac

SEQ ID NO: 1243895 - RNA, 21 nt, Human
uaaaaaggacaaagaagguca

SEQ ID NO: 1243896 - RNA, 19 nt, Human
uaaaacauaacaggaguca

SEQ ID NO: 1243897 - RNA, 23 nt, Human
uaaaauauuaccauuugccucuu

SEQ ID NO: 1243898 - RNA, 25 nt, Human
uaaacagaaaauggaaacagggacc

SEQ ID NO: 1243899 - RNA, 21 nt, Human
uaaacauaaaacaaugaacaa

SEQ ID NO: 1243900 - RNA, 23 nt, Human
uaaauacaaucagaaaugaaaaa

SEQ ID NO: 1243901 - RNA, 24 nt, Human
uaaaucucucaaguucaaaauucc

SEQ ID NO: 1243902 - RNA, 25 nt, Human
uaacaaaaagucucccaaaagagaa

SEQ ID NO: 1243903 - RNA, 21 nt, Human
uaacaacaacaaaaaaagaga

SEQ ID NO: 1243904 - RNA, 23 nt, Human
uaaguucagcauuaacucaaaag

SEQ ID NO: 1243905 - RNA, 24 nt, Human
uaauaaagugaucaauucagcaac

SEQ ID NO: 1243906 - RNA, 24 nt, Human
uaauuuacuguauuaguccauuuu

SEQ ID NO: 1243907 - RNA, 22 nt, Human
uacaaaagaaagagguuuaaug

SEQ ID NO: 1243908 - RNA, 24 nt, Human
uacaggacccaugcaagcccaaag

SEQ ID NO: 1243909 - RNA, 19 nt, Human
uacaucagauaaaacagac

SEQ ID NO: 1243910 - RNA, 19 nt, Human
uacccacccagaaucaaag

SEQ ID NO: 1243911 - RNA, 25 nt, Human
uacccuaaaucucucaaguucaaaa

SEQ ID NO: 1243912 - RNA, 19 nt, Human
uacuacugagaggccugag

SEQ ID NO: 1243913 - RNA, 22 nt, Human
uacuccagccugggugacagag

SEQ ID NO: 1243914 - RNA, 24 nt, Human
uacuccagccugggugacagagug

SEQ ID NO: 1243915 - RNA, 22 nt, Human
uagaucacgaggucaggaguuc

SEQ ID NO: 1243916 - RNA, 19 nt, Human
uagcagaaccaaaugcaac

SEQ ID NO: 1243917 - RNA, 24 nt, Human
uagcagguuugaaucaguaacaaa

SEQ ID NO: 1243918 - RNA, 23 nt, Human
uagccaaugaacacuguagauac

SEQ ID NO: 1243919 - RNA, 21 nt, Human
uaggaagaaacagaaaaccug

SEQ ID NO: 1243920 - RNA, 28 nt, Human
uaguacaaguaaaaaaaaaaaaaaaaaa

SEQ ID NO: 1243921 - RNA, 22 nt, Human
uaguccauuuucacacagcuga

SEQ ID NO: 1243922 - RNA, 21 nt, Human
uauaaagaaaaacaaacacca

SEQ ID NO: 1243923 - RNA, 20 nt, Human
uauaaccaucagcauuuugg

SEQ ID NO: 1243924 - RNA, 21 nt, Human
uaucagauacccuaaaucucu

SEQ ID NO: 1243925 - RNA, 25 nt, Human
uaucagauacccuaaaucucucaag

SEQ ID NO: 1243926 - RNA, 22 nt, Human
uauccuucacaaaugaaggagc

SEQ ID NO: 1243927 - RNA, 20 nt, Human
ucaaacugcaaccauaaaua

SEQ ID NO: 1243928 - RNA, 19 nt, Human
ucaaagauagagcuucugc

SEQ ID NO: 1243929 - RNA, 20 nt, Human
ucaaagauagagcuucugca

SEQ ID NO: 1243930 - RNA, 21 nt, Human
ucaccuaucaauaauaacuuc

SEQ ID NO: 1243931 - RNA, 18 nt, Human
ucacgaggucaggaguuc

SEQ ID NO: 1243932 - RNA, 22 nt, Human
ucacgaggucaggaguucgaga

SEQ ID NO: 1243933 - RNA, 24 nt, Human
ucacgaggucaggaguucgagagc

SEQ ID NO: 1243934 - RNA, 18 nt, Human
ucagacaaaaagaaagaa

SEQ ID NO: 1243935 - RNA, 21 nt, Human
ucagacaaaaagaaagaaaaa

SEQ ID NO: 1243936 - RNA, 21 nt, Human
ucaggcagauacaagagaaca

SEQ ID NO: 1243937 - RNA, 23 nt, Human
ucaguaacaaaaagucucccaaa

SEQ ID NO: 1243938 - RNA, 19 nt, Human
ucagugcccacaaacacug

SEQ ID NO: 1243939 - RNA, 23 nt, Human
ucauauccucacauuucaaaacc

SEQ ID NO: 1243940 - RNA, 23 nt, Human
ucaugccacuguacuccagccug

SEQ ID NO: 1243941 - RNA, 18 nt, Human
uccacaguccaaagucuc

SEQ ID NO: 1243942 - RNA, 20 nt, Human
uccacauagcugaggaagcu

SEQ ID NO: 1243943 - RNA, 23 nt, Human
uccagccugggugacagagugag

SEQ ID NO: 1243944 - RNA, 24 nt, Human
uccagccugggugacagagugaga

SEQ ID NO: 1243945 - RNA, 26 nt, Human
uccauucugacuguucuacugaggga

SEQ ID NO: 1243946 - RNA, 22 nt, Human
ucccacauuuuccugucuccuu

SEQ ID NO: 1243947 - RNA, 18 nt, Human
ucccaccaggucccuccc

SEQ ID NO: 1243948 - RNA, 19 nt, Human
ucccagacauacacagccu

SEQ ID NO: 1243949 - RNA, 21 nt, Human
ucccagacauacacagccuac

SEQ ID NO: 1243950 - RNA, 18 nt, Human
ucccaggaguucaaggcu

SEQ ID NO: 1243951 - RNA, 18 nt, Human
ucccauauaaaagccaau

SEQ ID NO: 1243952 - RNA, 19 nt, Human
uccuguggcuuuguauggu

SEQ ID NO: 1243953 - RNA, 20 nt, Human
ucgagagcauccuggccaac

SEQ ID NO: 1243954 - RNA, 23 nt, Human
ucuaagccacugaaugacucaca

SEQ ID NO: 1243955 - RNA, 19 nt, Human
ucuaccaccacuaccacug

SEQ ID NO: 1243956 - RNA, 18 nt, Human
ucucaaacuauucccaaa

SEQ ID NO: 1243957 - RNA, 19 nt, Human
ucucaaguucaaauacccu

SEQ ID NO: 1243958 - RNA, 23 nt, Human
ucucauauccucacauuucaaaa

SEQ ID NO: 1243959 - RNA, 23 nt, Human
ucucuacuaaaaauacaaaaauu

SEQ ID NO: 1243960 - RNA, 24 nt, Human
ucugccccuggcccuucccaaauc

SEQ ID NO: 1243961 - RNA, 18 nt, Human
ucuggccaaguguggugg

SEQ ID NO: 1243962 - RNA, 24 nt, Human
ucuggccaagugugguggcucacg

SEQ ID NO: 1243963 - RNA, 21 nt, Human
ucugggaguucuggauggaga

SEQ ID NO: 1243964 - RNA, 21 nt, Human
ugaaaaaggagacauuacaac

SEQ ID NO: 1243965 - RNA, 23 nt, Human
ugaaaauaaaaucuaugaaaugc

SEQ ID NO: 1243966 - RNA, 22 nt, Human
ugaaccugggaggcagagguug

SEQ ID NO: 1243967 - RNA, 23 nt, Human
ugaauagcagguuugaaucagua

SEQ ID NO: 1243968 - RNA, 20 nt, Human
ugaccaaaaacugaaauucu

SEQ ID NO: 1243969 - RNA, 20 nt, Human
ugacccaaaaugaauagcag

SEQ ID NO: 1243970 - RNA, 18 nt, Human
ugacuccaugucucacau

SEQ ID NO: 1243971 - RNA, 23 nt, Human
ugacuccaugucucacaugcagg

SEQ ID NO: 1243972 - RNA, 19 nt, Human
ugacugcucuaaacagggu

SEQ ID NO: 1243973 - RNA, 24 nt, Human
ugagaggcugaggccgguagauca

SEQ ID NO: 1243974 - RNA, 24 nt, Human
ugagauugcaccacugcacuccag

SEQ ID NO: 1243975 - RNA, 22 nt, Human
ugagcugagauugcaccacugc

SEQ ID NO: 1243976 - RNA, 18 nt, Human
ugaggaaacgccucccuu

SEQ ID NO: 1243977 - RNA, 21 nt, Human
ugaggaagccuaagaaucacg

SEQ ID NO: 1243978 - RNA, 24 nt, Human
ugaggcaggagaauugcuugaacc

SEQ ID NO: 1243979 - RNA, 25 nt, Human
ugaggcaggagaauugcuugaaccu

SEQ ID NO: 1243980 - RNA, 20 nt, Human
ugaggcaggaggaccauuug

SEQ ID NO: 1243981 - RNA, 24 nt, Human
ugaggccgguagaucacgagguca

SEQ ID NO: 1243982 - RNA, 22 nt, Human
ugaggcuaacaacaacaaaaaa

SEQ ID NO: 1243983 - RNA, 20 nt, Human
ugaucaauucagcaacaaag

SEQ ID NO: 1243984 - RNA, 22 nt, Human
ugauuuauccauugucuacaua

SEQ ID NO: 1243985 - RNA, 19 nt, Human
ugcaaacaaucaacaagau

SEQ ID NO: 1243986 - RNA, 24 nt, Human
ugcaagaaauaugaaaaaggaaac

SEQ ID NO: 1243987 - RNA, 21 nt, Human
ugcaccacugcacuccagccu

SEQ ID NO: 1243988 - RNA, 19 nt, Human
ugcccugccccugcagcaa

SEQ ID NO: 1243989 - RNA, 18 nt, Human
ugccuauagucccagcua

SEQ ID NO: 1243990 - RNA, 24 nt, Human
ugccuauagucccagcuacucagg

SEQ ID NO: 1243991 - RNA, 24 nt, Human
ugcuaacaaguuccucauuuccau

SEQ ID NO: 1243992 - RNA, 22 nt, Human
uggaaaacuagagaucagccug

SEQ ID NO: 1243993 - RNA, 18 nt, Human
uggaaagcaagaagaagc

SEQ ID NO: 1243994 - RNA, 19 nt, Human
uggcagcaggcaaagagag

SEQ ID NO: 1243995 - RNA, 24 nt, Human
uggccaacguggugaaacccuguc

SEQ ID NO: 1243996 - RNA, 24 nt, Human
uggcucacgccuguaaucccagca

SEQ ID NO: 1243997 - RNA, 18 nt, Human
ugggaaagaccugccccc

SEQ ID NO: 1243998 - RNA, 24 nt, Human
ugggaggcagagguuguagugagc

SEQ ID NO: 1243999 - RNA, 23 nt, Human
ugggaguucuggauggagaugag

SEQ ID NO: 1244000 - RNA, 18 nt, Human
uggggacacaaccaaacc

SEQ ID NO: 1244001 - RNA, 18 nt, Human
uggggguauaggcacugg

SEQ ID NO: 1244002 - RNA, 24 nt, Human
ugguggcucacgccuguaauccca

SEQ ID NO: 1244003 - RNA, 24 nt, Human
ugguuuaaacccccuccuggcucc

SEQ ID NO: 1244004 - RNA, 24 nt, Human
ugucuccuucugagcccuccaaac

SEQ ID NO: 1244005 - RNA, 18 nt, Human
ugugcacccacaggcuca

SEQ ID NO: 1244006 - RNA, 23 nt, Human
uguuaccaaagaaauaaaaagga

SEQ ID NO: 1244007 - RNA, 21 nt, Human
uuaccaaagaaauaaaaagga

SEQ ID NO: 1244008 - RNA, 18 nt, Human
uuacuggaauaaaaccag

SEQ ID NO: 1244009 - RNA, 19 nt, Human
uuauagcaauaaaugccua

SEQ ID NO: 1244010 - RNA, 18 nt, Human
uucaaaaccaucagaccu

SEQ ID NO: 1244011 - RNA, 20 nt, Human
uucaacuacuucccacugcc

SEQ ID NO: 1244012 - RNA, 19 nt, Human
uucacaauuaaaagaauag

SEQ ID NO: 1244013 - RNA, 22 nt, Human
uuccaggcacacagugcaagcu

SEQ ID NO: 1244014 - RNA, 19 nt, Human
uucccagauaagcaaaaga

SEQ ID NO: 1244015 - RNA, 24 nt, Human
uucccauauaaaagccaauccaua

SEQ ID NO: 1244016 - RNA, 22 nt, Human
uuccucauuuccaucugagaca

SEQ ID NO: 1244017 - RNA, 24 nt, Human
uuccugaaugcuuccaaaugcagg

SEQ ID NO: 1244018 - RNA, 24 nt, Human
uucgagagcauccuggccaacgug

SEQ ID NO: 1244019 - RNA, 23 nt, Human
uucuccagcaacagauccaauga

SEQ ID NO: 1244020 - RNA, 22 nt, Human
uucuucucaaacuauucccaaa

SEQ ID NO: 1244021 - RNA, 24 nt, Human
uugaaccugggaggcagagguugu

SEQ ID NO: 1244022 - RNA, 25 nt, Human
uugagaggcugaggccgguagauca

SEQ ID NO: 1244023 - RNA, 20 nt, Human
uugauaaacgacuagugagg

SEQ ID NO: 1244024 - RNA, 23 nt, Human
uugcaccacugcacuccagccug

SEQ ID NO: 1244025 - RNA, 24 nt, Human
uugcuugaaccugggaggcagagg

SEQ ID NO: 1244026 - RNA, 19 nt, Human
uuguagugagcugagauug

SEQ ID NO: 1244027 - RNA, 22 nt, Human
uuuaugcugauuucuacccaau

SEQ ID NO: 1244028 - RNA, 21 nt, Human
uuucagaauauuucauccagc

SEQ ID NO: 1244029 - RNA, 20 nt, Human
uuuccugucuccuucugagc

SEQ ID NO: 1244030 - RNA, 20 nt, Human
uuuuuugaaaaguuaaacaa

SEQ ID NO: 1244031 - RNA, 21 nt, Human
aaagcucaagaagaccauggg

SEQ ID NO: 1244032 - RNA, 21 nt, Human
aacaugucucgccucccgcca

SEQ ID NO: 1244033 - RNA, 20 nt, Human
aagcaggagacaguggccuu

SEQ ID NO: 1244034 - RNA, 19 nt, Human
aagcuacaaaugaacaaca

SEQ ID NO: 1244035 - RNA, 23 nt, Human
aaggaaccaaagaggguggaagg

SEQ ID NO: 1244036 - RNA, 20 nt, Human
aaggaggucaacaaaaaaca

SEQ ID NO: 1244037 - RNA, 23 nt, Human
aaggcagcauuacugccaacaug

SEQ ID NO: 1244038 - RNA, 20 nt, Human
acaaaguauccguauccaga

SEQ ID NO: 1244039 - RNA, 21 nt, Human
acccaaacaucucagcggagu

SEQ ID NO: 1244040 - RNA, 21 nt, Human
acucagcacaccaaggaccug

SEQ ID NO: 1244041 - RNA, 21 nt, Human
agacaguggccuuccuccaug

SEQ ID NO: 1244042 - RNA, 18 nt, Human
agcaagaaaaccucagcc

SEQ ID NO: 1244043 - RNA, 18 nt, Human
agcaagaaaaccucagcc

SEQ ID NO: 1244044 - RNA, 21 nt, Human
agcccuagaucccuuaaaccu

SEQ ID NO: 1244045 - RNA, 19 nt, Human
agcgguguuggcuuucuuc

SEQ ID NO: 1244046 - RNA, 22 nt, Human
agcugaaaagggagccagguac

SEQ ID NO: 1244047 - RNA, 26 nt, Human
aggaggucaacaaaaaacaugugagc

SEQ ID NO: 1244048 - RNA, 23 nt, Human
aggcaguguaaaaugcagucuag

SEQ ID NO: 1244049 - RNA, 18 nt, Human
aucacuaaccuuuccuga

SEQ ID NO: 1244050 - RNA, 25 nt, Human
auccacaggagcaagaaaaccucag

SEQ ID NO: 1244051 - RNA, 21 nt, Human
auccaguucaccuguaguguu

SEQ ID NO: 1244052 - RNA, 25 nt, Human
auccaguucaccuguaguguuuuuu

SEQ ID NO: 1244053 - RNA, 22 nt, Human
augcugcccuugagccuuugug

SEQ ID NO: 1244054 - RNA, 21 nt, Human
auuucguugugacaaagacca

SEQ ID NO: 1244055 - RNA, 22 nt, Human
auuuuugguuggagaguuuugg

SEQ ID NO: 1244056 - RNA, 23 nt, Human
caaagcaauuguuuaaaguacag

SEQ ID NO: 1244057 - RNA, 19 nt, Human
caaggaccugcaccggccu

SEQ ID NO: 1244058 - RNA, 22 nt, Human
cagcacaccaaggaccugcacc

SEQ ID NO: 1244059 - RNA, 24 nt, Human
cagcacaccaaggaccugcaccgg

SEQ ID NO: 1244060 - RNA, 21 nt, Human
caggagcaagaaaaccucagc

SEQ ID NO: 1244061 - RNA, 28 nt, Human
cagucuagaaggcaaaauucccagccac

SEQ ID NO: 1244062 - RNA, 20 nt, Human
caguggccuuccuccauguc

SEQ ID NO: 1244063 - RNA, 19 nt, Human
caugucacaaaaguugagg

SEQ ID NO: 1244064 - RNA, 21 nt, Human
ccaaagcucaagaagaccaug

SEQ ID NO: 1244065 - RNA, 19 nt, Human
ccacaggagcaagaaaacc

SEQ ID NO: 1244066 - RNA, 22 nt, Human
ccagaggcaguguaaaaugcag

SEQ ID NO: 1244067 - RNA, 19 nt, Human
ccagaucaccuacaaagua

SEQ ID NO: 1244068 - RNA, 21 nt, Human
ccagggaauuagagccucaca

SEQ ID NO: 1244069 - RNA, 20 nt, Human
cccaaacaucucagcggagu

SEQ ID NO: 1244070 - RNA, 19 nt, Human
cccugcuuucaagggcaga

SEQ ID NO: 1244071 - RNA, 22 nt, Human
cccugcuuucaagggcagaggu

SEQ ID NO: 1244072 - RNA, 23 nt, Human
ccggaaagcucggaaaacggcca

SEQ ID NO: 1244073 - RNA, 22 nt, Human
ccugucucuucccguccaagga

SEQ ID NO: 1244074 - RNA, 20 nt, Human
cgccggagggccaacaagau

SEQ ID NO: 1244075 - RNA, 23 nt, Human
cggccacagggggucgucagcag

SEQ ID NO: 1244076 - RNA, 20 nt, Human
cggccucugaguucccucag

SEQ ID NO: 1244077 - RNA, 18 nt, Human
cggcuggggcaaaguggc

SEQ ID NO: 1244078 - RNA, 19 nt, Human
cuccugccugucucuuccc

SEQ ID NO: 1244079 - RNA, 20 nt, Human
cugauccuaagaguagcuga

SEQ ID NO: 1244080 - RNA, 18 nt, Human
cugcaagaggcuuuccuc

SEQ ID NO: 1244081 - RNA, 21 nt, Human
gaacaacaucucagcaaagca

SEQ ID NO: 1244082 - RNA, 19 nt, Human
gacacauucugcagaagga

SEQ ID NO: 1244083 - RNA, 22 nt, Human
gacccagggaauuagagccuca

SEQ ID NO: 1244084 - RNA, 20 nt, Human
gacucagaacuuaucuagag

SEQ ID NO: 1244085 - RNA, 19 nt, Human
gagcugaaaagggagccag

SEQ ID NO: 1244086 - RNA, 22 nt, Human
gagcugucccugccuuucugaa

SEQ ID NO: 1244087 - RNA, 19 nt, Human
gaggggaccgcagggcugg

SEQ ID NO: 1244088 - RNA, 20 nt, Human
gcacaccaaggaccugcacc

SEQ ID NO: 1244089 - RNA, 24 nt, Human
gcagaaggagcaggaccacaagga

SEQ ID NO: 1244090 - RNA, 22 nt, Human
gcaggaccacaaggaaccaaag

SEQ ID NO: 1244091 - RNA, 21 nt, Human
gcccuagaucccuuaaaccuu

SEQ ID NO: 1244092 - RNA, 19 nt, Human
ggaacaacaguggguccag

SEQ ID NO: 1244093 - RNA, 18 nt, Human
ggagcaggaccacaagga

SEQ ID NO: 1244094 - RNA, 18 nt, Human
ggcaaaguggcuggggca

SEQ ID NO: 1244095 - RNA, 20 nt, Human
gggcagaggucccugcggcu

SEQ ID NO: 1244096 - RNA, 24 nt, Human
gguguuggcuuucuucaucugugu

SEQ ID NO: 1244097 - RNA, 19 nt, Human
gguucaucauuccgacucc

SEQ ID NO: 1244098 - RNA, 22 nt, Human
guagaauucauguauuuauuuu

SEQ ID NO: 1244099 - RNA, 22 nt, Human
guggcuggggcaaagcuacaaa

SEQ ID NO: 1244100 - RNA, 22 nt, Human
guuccaaagcucaagaagacca

SEQ ID NO: 1244101 - RNA, 19 nt, Human
uaagaucaacucucugcuc

SEQ ID NO: 1244102 - RNA, 23 nt, Human
uacuaugccuggacgugcacgua

SEQ ID NO: 1244103 - RNA, 18 nt, Human
uagcucagaguugaacaa

SEQ ID NO: 1244104 - RNA, 18 nt, Human
uaggagagcagggugaua

SEQ ID NO: 1244105 - RNA, 23 nt, Human
uauacaacauagguuuuugugug

SEQ ID NO: 1244106 - RNA, 23 nt, Human
uauccagaaucaauaagaucaac

SEQ ID NO: 1244107 - RNA, 21 nt, Human
uauccagaucaccuacaaagu

SEQ ID NO: 1244108 - RNA, 24 nt, Human
uauucugaagauggagguugucca

SEQ ID NO: 1244109 - RNA, 27 nt, Human
ucaaaauagagucucuuaugucuuccc

SEQ ID NO: 1244110 - RNA, 23 nt, Human
ucacagagauuucugcugucaga

SEQ ID NO: 1244111 - RNA, 19 nt, Human
ucacaggccggccugggau

SEQ ID NO: 1244112 - RNA, 21 nt, Human
ucacaggccggccugggaugc

SEQ ID NO: 1244113 - RNA, 21 nt, Human
ucacaggccggccugggaugc

SEQ ID NO: 1244114 - RNA, 23 nt, Human
ucacuaaccuuuccugagccccc

SEQ ID NO: 1244115 - RNA, 20 nt, Human
ucaggucuuucucaucccac

SEQ ID NO: 1244116 - RNA, 24 nt, Human
ucaugaauaauuaaugaagcacaa

SEQ ID NO: 1244117 - RNA, 21 nt, Human
uccagaaucaauaagaucaac

SEQ ID NO: 1244118 - RNA, 22 nt, Human
uccugagcccccauggggacuc

SEQ ID NO: 1244119 - RNA, 23 nt, Human
uccugagcccccauggggacuca

SEQ ID NO: 1244120 - RNA, 24 nt, Human
ucgcauggggagaaacuuuggaca

SEQ ID NO: 1244121 - RNA, 18 nt, Human
ucggaacucagcgggauu

SEQ ID NO: 1244122 - RNA, 19 nt, Human
ucggaacucagcgggauuu

SEQ ID NO: 1244123 - RNA, 22 nt, Human
ucuccauucucugaccugggaa

SEQ ID NO: 1244124 - RNA, 21 nt, Human
ucucucuuucuuuucccuaca

SEQ ID NO: 1244125 - RNA, 23 nt, Human
ucucuuaugucuucccuuucgac

SEQ ID NO: 1244126 - RNA, 18 nt, Human
ucugaagauggagguugu

SEQ ID NO: 1244127 - RNA, 24 nt, Human
ucuuuccaggucaucacuaaccuu

SEQ ID NO: 1244128 - RNA, 22 nt, Human
ugaagauggagguuguccaaga

SEQ ID NO: 1244129 - RNA, 20 nt, Human
ugacagucugaucucucuuu

SEQ ID NO: 1244130 - RNA, 22 nt, Human
ugacugaggggaccgcagggcu

SEQ ID NO: 1244131 - RNA, 26 nt, Human
ugacuucgaaauaauuuuguugauuu

SEQ ID NO: 1244132 - RNA, 19 nt, Human
ugauccuaagaguagcuga

SEQ ID NO: 1244133 - RNA, 20 nt, Human
ugccuggacgugcacguagg

SEQ ID NO: 1244134 - RNA, 19 nt, Human
ugccuugguggcaucuugg

SEQ ID NO: 1244135 - RNA, 18 nt, Human
uggcaucuuggaacauug

SEQ ID NO: 1244136 - RNA, 19 nt, Human
uggcuggggcaaagcuaca

SEQ ID NO: 1244137 - RNA, 20 nt, Human
uggcuggggcaaagcuacaa

SEQ ID NO: 1244138 - RNA, 21 nt, Human
ugggauuauguggaaacucuu

SEQ ID NO: 1244139 - RNA, 25 nt, Human
uggggacucagaacuuaucuagagu

SEQ ID NO: 1244140 - RNA, 22 nt, Human
ugggucaaagcggcuggggcaa

SEQ ID NO: 1244141 - RNA, 21 nt, Human
uggguccaggggaccggcacu

SEQ ID NO: 1244142 - RNA, 21 nt, Human
ugguagcaagagugauuucug

SEQ ID NO: 1244143 - RNA, 26 nt, Human
ugucacaaaaguugagggacacggga

SEQ ID NO: 1244144 - RNA, 20 nt, Human
uguccagaggcaguguaaaa

SEQ ID NO: 1244145 - RNA, 24 nt, Human
ugugcugguucaucauuccgacuc

SEQ ID NO: 1244146 - RNA, 20 nt, Human
uuacugccaacaugucucgc

SEQ ID NO: 1244147 - RNA, 25 nt, Human
uucagcaaaaaggaauauacuagga

SEQ ID NO: 1244148 - RNA, 18 nt, Human
uucccuacauccaaggac

SEQ ID NO: 1244149 - RNA, 21 nt, Human
uucgugaaaaaugucagaguu

SEQ ID NO: 1244150 - RNA, 25 nt, Human
uucucaucccacgaggccauauuuc

SEQ ID NO: 1244151 - RNA, 19 nt, Human
uugagagacugggagucgg

SEQ ID NO: 1244152 - RNA, 24 nt, Human
uugagggacacgggaguuccacag

SEQ ID NO: 1244153 - RNA, 20 nt, Human
uugaugccagcgaagcauac

SEQ ID NO: 1244154 - RNA, 19 nt, Human
uugauuauccagaucaccu

SEQ ID NO: 1244155 - RNA, 20 nt, Human
uuggcuuucuucaucugugu

SEQ ID NO: 1244156 - RNA, 24 nt, Human
uuggcuuucuucaucuguguuucc

SEQ ID NO: 1244157 - RNA, 21 nt, Human
uugggauuauguggaaacucu

SEQ ID NO: 1244158 - RNA, 20 nt, Human
uugggucaaagcggcugggg

SEQ ID NO: 1244159 - RNA, 23 nt, Human
uuucucaucccacgaggccauau

SEQ ID NO: 1244160 - RNA, 22 nt, Human
uuucugcugucagaagccacag

SEQ ID NO: 1244161 - RNA, 24 nt, Human
uuucuuuucccuacauccaaggac

SEQ ID NO: 1244162 - RNA, 24 nt, Human
aaaguguugggauuacaggcauga

SEQ ID NO: 1244163 - RNA, 21 nt, Human
aaguguugggauuacaggcau

SEQ ID NO: 1244164 - RNA, 26 nt, Human
aaguguugggauuacaggcaugagcc

SEQ ID NO: 1244165 - RNA, 24 nt, Human
accauguuggccaggcuggucucg

SEQ ID NO: 1244166 - RNA, 22 nt, Human
acccgccucggccucucaaagu

SEQ ID NO: 1244167 - RNA, 18 nt, Human
acgggguuucaccauguu

SEQ ID NO: 1244168 - RNA, 23 nt, Human
acgggguuucaccauguuggcca

SEQ ID NO: 1244169 - RNA, 24 nt, Human
acgggguuucaccauguuggccag

SEQ ID NO: 1244170 - RNA, 21 nt, Human
agaggacagaaucaaaaucug

SEQ ID NO: 1244171 - RNA, 18 nt, Human
agcuugugggcgaugggc

SEQ ID NO: 1244172 - RNA, 18 nt, Human
aggugacccacccgccuc

SEQ ID NO: 1244173 - RNA, 23 nt, Human
caaaguguugggauuacaggcau

SEQ ID NO: 1244174 - RNA, 24 nt, Human
caaaguguugggauuacaggcaug

SEQ ID NO: 1244175 - RNA, 28 nt, Human
caagcgauucuccugccucaaccuccca

SEQ ID NO: 1244176 - RNA, 20 nt, Human
caauggugcaaucuuggcuc

SEQ ID NO: 1244177 - RNA, 21 nt, Human
caccauguuggccaggcuggu

SEQ ID NO: 1244178 - RNA, 24 nt, Human
caccauguuggccaggcuggucuc

SEQ ID NO: 1244179 - RNA, 27 nt, Human
caccauguuggccaggcuggucucgaa

SEQ ID NO: 1244180 - RNA, 23 nt, Human
cacccgccucggccucucaaagu

SEQ ID NO: 1244181 - RNA, 20 nt, Human
caccgggcacccaggcuggu

SEQ ID NO: 1244182 - RNA, 21 nt, Human
caccugcugggcuaaaaucau

SEQ ID NO: 1244183 - RNA, 21 nt, Human
cacugcaaccuucgccuccca

SEQ ID NO: 1244184 - RNA, 25 nt, Human
cagccucauugaugcccucagugau

SEQ ID NO: 1244185 - RNA, 23 nt, Human
caggaugcaccaccaugcacggc

SEQ ID NO: 1244186 - RNA, 23 nt, Human
caugaacacugaaagggugggca

SEQ ID NO: 1244187 - RNA, 24 nt, Human
cauguuggccaggcuggucucgaa

SEQ ID NO: 1244188 - RNA, 24 nt, Human
ccagaagucuuccuccaaggcugg

SEQ ID NO: 1244189 - RNA, 18 nt, Human
ccagaggacagaaucaaa

SEQ ID NO: 1244190 - RNA, 21 nt, Human
cccagaagucuuccuccaagg

SEQ ID NO: 1244191 - RNA, 20 nt, Human
cccagguucaagcgauucuc

SEQ ID NO: 1244192 - RNA, 23 nt, Human
cccagguucaagcgauucuccug

SEQ ID NO: 1244193 - RNA, 24 nt, Human
ccucccagguucaagcgauucucc

SEQ ID NO: 1244194 - RNA, 22 nt, Human
ccugaccucaggugacccaccc

SEQ ID NO: 1244195 - RNA, 23 nt, Human
ccugaccucaggugacccacccg

SEQ ID NO: 1244196 - RNA, 23 nt, Human
ccugccucaaccucccaaguagc

SEQ ID NO: 1244197 - RNA, 19 nt, Human
cucaaccucccaaguagcu

SEQ ID NO: 1244198 - RNA, 24 nt, Human
cucacugcaaccuucgccucccag

SEQ ID NO: 1244199 - RNA, 20 nt, Human
cucuuguugcccaggcugga

SEQ ID NO: 1244200 - RNA, 23 nt, Human
cugcaaccuucgccucccagguu

SEQ ID NO: 1244201 - RNA, 24 nt, Human
cugcaaccuucgccucccagguuc

SEQ ID NO: 1244202 - RNA, 22 nt, Human
cuggagccaagacuaugugucu

SEQ ID NO: 1244203 - RNA, 18 nt, Human
cuuuaacaagcugcccuc

SEQ ID NO: 1244204 - RNA, 24 nt, Human
gagacgggguuucaccauguuggc

SEQ ID NO: 1244205 - RNA, 20 nt, Human
gauuacaggaugcaccacca

SEQ ID NO: 1244206 - RNA, 23 nt, Human
gauuacaggaugcaccaccaugc

SEQ ID NO: 1244207 - RNA, 18 nt, Human
gauuacaggcaugagcca

SEQ ID NO: 1244208 - RNA, 22 nt, Human
gauuacaggcaugagccacugc

SEQ ID NO: 1244209 - RNA, 23 nt, Human
gauuacaggcaugagccacugca

SEQ ID NO: 1244210 - RNA, 23 nt, Human
gcaccgggcacccaggcugguuu

SEQ ID NO: 1244211 - RNA, 23 nt, Human
gccaagacuaugugucucugcuc

SEQ ID NO: 1244212 - RNA, 20 nt, Human
gcucuuguugcccaggcugg

SEQ ID NO: 1244213 - RNA, 21 nt, Human
gcucuuguugcccaggcugga

SEQ ID NO: 1244214 - RNA, 23 nt, Human
gcuggucucgaacuccugaccuc

SEQ ID NO: 1244215 - RNA, 22 nt, Human
ggauuacaggcaugagccacug

SEQ ID NO: 1244216 - RNA, 24 nt, Human
ggcuggucucgaacuccugaccuc

SEQ ID NO: 1244217 - RNA, 23 nt, Human
gggguuucaccauguuggccagg

SEQ ID NO: 1244218 - RNA, 22 nt, Human
ggguuucaccauguuggccagg

SEQ ID NO: 1244219 - RNA, 19 nt, Human
ggucucgaacuccugaccu

SEQ ID NO: 1244220 - RNA, 23 nt, Human
guagagacgggguuucaccaugu

SEQ ID NO: 1244221 - RNA, 23 nt, Human
gucuuuaacaagcugcccucuag

SEQ ID NO: 1244222 - RNA, 22 nt, Human
gugacccacccgccucggccuc

SEQ ID NO: 1244223 - RNA, 22 nt, Human
uacaggcaugagccacugcacc

SEQ ID NO: 1244224 - RNA, 22 nt, Human
uagagacgggguuucaccaugu

SEQ ID NO: 1244225 - RNA, 19 nt, Human
uaggucuuuaacaagcugc

SEQ ID NO: 1244226 - RNA, 24 nt, Human
uaguagagacgggguuucaccaug

SEQ ID NO: 1244227 - RNA, 26 nt, Human
uaguagagacgggguuucaccauguu

SEQ ID NO: 1244228 - RNA, 19 nt, Human
uauuuuauuuuuuaguaga

SEQ ID NO: 1244229 - RNA, 22 nt, Human
uauuuuauuuuuuaguagagac

SEQ ID NO: 1244230 - RNA, 23 nt, Human
ucaaaguguugggauuacaggca

SEQ ID NO: 1244231 - RNA, 24 nt, Human
ucaaaguguugggauuacaggcau

SEQ ID NO: 1244232 - RNA, 19 nt, Human
ucacugcaaccuucgccuc

SEQ ID NO: 1244233 - RNA, 24 nt, Human
ucacugcaaccuucgccucccagg

SEQ ID NO: 1244234 - RNA, 25 nt, Human
ucacugcaaccuucgccucccaggu

SEQ ID NO: 1244235 - RNA, 21 nt, Human
ucccagguucaagcgauucuc

SEQ ID NO: 1244236 - RNA, 24 nt, Human
ucccagguucaagcgauucuccug

SEQ ID NO: 1244237 - RNA, 24 nt, Human
ucucaaaguguugggauuacaggc

SEQ ID NO: 1244238 - RNA, 19 nt, Human
ucuccucuagcccaggcug

SEQ ID NO: 1244239 - RNA, 26 nt, Human
ucuccugccucaaccucccaaguagc

SEQ ID NO: 1244240 - RNA, 23 nt, Human
ucucgaacuccugaccucaggug

SEQ ID NO: 1244241 - RNA, 24 nt, Human
ugaccucaggugacccacccgccu

SEQ ID NO: 1244242 - RNA, 25 nt, Human
ugaccucaggugacccacccgccuc

SEQ ID NO: 1244243 - RNA, 23 nt, Human
ugcaaccuucgccucccagguuc

SEQ ID NO: 1244244 - RNA, 18 nt, Human
ugcccagaagucuuccuc

SEQ ID NO: 1244245 - RNA, 19 nt, Human
ugcccaggcuggaguucaa

SEQ ID NO: 1244246 - RNA, 21 nt, Human
ugcccaggcuggaguucaaug

SEQ ID NO: 1244247 - RNA, 24 nt, Human
ugcccaggcuggaguucaauggug

SEQ ID NO: 1244248 - RNA, 23 nt, Human
ugccucaaccucccaaguagcua

SEQ ID NO: 1244249 - RNA, 25 nt, Human
ugccucaaccucccaaguagcuaug

SEQ ID NO: 1244250 - RNA, 24 nt, Human
ugcucuuguugcccaggcuggagu

SEQ ID NO: 1244251 - RNA, 20 nt, Human
ugcugggcuaaaaucaugac

SEQ ID NO: 1244252 - RNA, 24 nt, Human
uggaguucaauggugcaaucuugg

SEQ ID NO: 1244253 - RNA, 21 nt, Human
uggcauugauacagcugaagu

SEQ ID NO: 1244254 - RNA, 24 nt, Human
uggccaggcuggucucgaacuccu

SEQ ID NO: 1244255 - RNA, 20 nt, Human
uggccaucucgaauucuccu

SEQ ID NO: 1244256 - RNA, 18 nt, Human
ugggauuacaggcaugag

SEQ ID NO: 1244257 - RNA, 19 nt, Human
ugggauuacaggcaugagc

SEQ ID NO: 1244258 - RNA, 21 nt, Human
ugggauuacaggcaugagcca

SEQ ID NO: 1244259 - RNA, 22 nt, Human
ugggauuacaggcaugagccac

SEQ ID NO: 1244260 - RNA, 22 nt, Human
ugggauuacaggcaugagccac

SEQ ID NO: 1244261 - RNA, 24 nt, Human
ugggauuacaggcaugagccacug

SEQ ID NO: 1244262 - RNA, 24 nt, Human
ugggauuacaggcaugagccacug

SEQ ID NO: 1244263 - RNA, 26 nt, Human
ugggauuacaggcaugagccacugca

SEQ ID NO: 1244264 - RNA, 27 nt, Human
ugggcauaacugaaacgaaacuggagc

SEQ ID NO: 1244265 - RNA, 18 nt, Human
uuaguagagacgggguuu

SEQ ID NO: 1244266 - RNA, 22 nt, Human
uuaguagagacgggguuucacc

SEQ ID NO: 1244267 - RNA, 24 nt, Human
uuaguagagacgggguuucaccau

SEQ ID NO: 1244268 - RNA, 21 nt, Human
uucaagcgauucuccugccuc

SEQ ID NO: 1244269 - RNA, 24 nt, Human
uucaagcgauucuccugccucaac

SEQ ID NO: 1244270 - RNA, 23 nt, Human
uugcucuuguugcccaggcugga

SEQ ID NO: 1244271 - RNA, 21 nt, Human
uuggggauauagaugugcuuc

SEQ ID NO: 1244272 - RNA, 24 nt, Human
uuucaccauguuggccaggcuggu

SEQ ID NO: 1244273 - RNA, 24 nt, Human
uuugcucuuguugcccaggcugga

SEQ ID NO: 1244274 - RNA, 23 nt, Human
uuuguaggucuuuaacaagcugc

SEQ ID NO: 1244275 - RNA, 24 nt, Human
uuuugcucuuguugcccaggcugg

SEQ ID NO: 1244276 - RNA, 24 nt, Human
uuuuuaguagagacgggguuucac

SEQ ID NO: 1244277 - RNA, 23 nt, Human
uuuuuuaguagagacgggguuuc

SEQ ID NO: 1244278 - RNA, 22 nt, Human
aagccaaccagcccagaaccag

SEQ ID NO: 1244279 - RNA, 26 nt, Human
agcaguagguguauucccucccgcag

SEQ ID NO: 1244280 - RNA, 23 nt, Human
cagagugggggcaguccucugcc

SEQ ID NO: 1244281 - RNA, 22 nt, Human
ccaaccggccucgauaagccaa

SEQ ID NO: 1244282 - RNA, 21 nt, Human
cgaguagaucccgcgcuccca

SEQ ID NO: 1244283 - RNA, 18 nt, Human
cgcgcucccaaauccggc

SEQ ID NO: 1244284 - RNA, 26 nt, Human
cgcugggcuggguguuccucggggac

SEQ ID NO: 1244285 - RNA, 21 nt, Human
gcaguauggugaaccccacac

SEQ ID NO: 1244286 - RNA, 18 nt, Human
ggacggcgcccacugccc

SEQ ID NO: 1244287 - RNA, 24 nt, Human
ggagugucccgagcugccucccau

SEQ ID NO: 1244288 - RNA, 18 nt, Human
gggcuggguguuccucgg

SEQ ID NO: 1244289 - RNA, 21 nt, Human
uaagccaaccagcccagaacc

SEQ ID NO: 1244290 - RNA, 22 nt, Human
uaagccaaccagcccagaacca

SEQ ID NO: 1244291 - RNA, 20 nt, Human
uagcucccucagcugcgugg

SEQ ID NO: 1244292 - RNA, 25 nt, Human
ucaaagcaguagguguauucccucc

SEQ ID NO: 1244293 - RNA, 20 nt, Human
ucccgcgcucccaaauccgg

SEQ ID NO: 1244294 - RNA, 22 nt, Human
ugcccgcuuggucccuggagug

SEQ ID NO: 1244295 - RNA, 20 nt, Human
ugcggacagagugggggcag

SEQ ID NO: 1244296 - RNA, 18 nt, Human
ugggggcaguccucugcc

SEQ ID NO: 1244297 - RNA, 18 nt, Human
uucaucuuuacacaaggu

SEQ ID NO: 1244298 - RNA, 20 nt, Human
uuugccaaacuuuguuuuua

SEQ ID NO: 1244299 - RNA, 23 nt, Human
aaugcccauuccuguccagcaac

SEQ ID NO: 1244300 - RNA, 23 nt, Human
acaagaacaaagccacacagcga

SEQ ID NO: 1244301 - RNA, 23 nt, Human
agcaacaauaaaaacauccugaa

SEQ ID NO: 1244302 - RNA, 20 nt, Human
agcaagaagggaggucuuuu

SEQ ID NO: 1244303 - RNA, 22 nt, Human
agccacacagcgaagacaagcc

SEQ ID NO: 1244304 - RNA, 22 nt, Human
caagaacaaagccacacagcga

SEQ ID NO: 1244305 - RNA, 24 nt, Human
cagcaacaauaaaaacauccugaa

SEQ ID NO: 1244306 - RNA, 19 nt, Human
cauuucaaauauauuucua

SEQ ID NO: 1244307 - RNA, 21 nt, Human
ccacauaauaucucuuuguuc

SEQ ID NO: 1244308 - RNA, 25 nt, Human
ccagcaacaauaaaaacauccugaa

SEQ ID NO: 1244309 - RNA, 25 nt, Human
uauccagagugucucuuaauucgau

SEQ ID NO: 1244310 - RNA, 20 nt, Human
ucccuacaagaacaaagcca

SEQ ID NO: 1244311 - RNA, 21 nt, Human
ucuuuguucuagcauaucugg

SEQ ID NO: 1244312 - RNA, 24 nt, Human
ucuuuguucuagcauaucuggguu

SEQ ID NO: 1244313 - RNA, 21 nt, Human
ugauuuguauaucaccaguga

SEQ ID NO: 1244314 - RNA, 21 nt, Human
ugcugucuuggucaaccacau

SEQ ID NO: 1244315 - RNA, 23 nt, Human
uguuuugcugucuuggucaacca

SEQ ID NO: 1244316 - RNA, 27 nt, Human
uucacuaggggagcuaacuguaaauuc

SEQ ID NO: 1244317 - RNA, 18 nt, Human
aaacaagaagacgcaccc

SEQ ID NO: 1244318 - RNA, 22 nt, Human
aagacgcacccuuugagggcac

SEQ ID NO: 1244319 - RNA, 20 nt, Human
acagaggccucacccuggcu

SEQ ID NO: 1244320 - RNA, 22 nt, Human
accaagcaccagacccuugcag

SEQ ID NO: 1244321 - RNA, 21 nt, Human
acccuugcagacauucccagg

SEQ ID NO: 1244322 - RNA, 23 nt, Human
acccuugcagacauucccaggau

SEQ ID NO: 1244323 - RNA, 22 nt, Human
acucuagaaccugcaccucguc

SEQ ID NO: 1244324 - RNA, 18 nt, Human
acuggucuguaccaagca

SEQ ID NO: 1244325 - RNA, 24 nt, Human
agcccauucuggggccuuuucugc

SEQ ID NO: 1244326 - RNA, 21 nt, Human
agcugugccagcccccgcccu

SEQ ID NO: 1244327 - RNA, 23 nt, Human
agcuugcagccccaucacucccu

SEQ ID NO: 1244328 - RNA, 19 nt, Human
aggcucaggaguggggccc

SEQ ID NO: 1244329 - RNA, 18 nt, Human
aggugcuucaggcuccag

SEQ ID NO: 1244330 - RNA, 19 nt, Human
aggugguagugguagcugg

SEQ ID NO: 1244331 - RNA, 21 nt, Human
aggugguagugguagcuggug

SEQ ID NO: 1244332 - RNA, 21 nt, Human
agucccagcaagucuucagaa

SEQ ID NO: 1244333 - RNA, 19 nt, Human
aucacucccugccucugcc

SEQ ID NO: 1244334 - RNA, 20 nt, Human
caaaacaagaagacgcaccc

SEQ ID NO: 1244335 - RNA, 19 nt, Human
caagcaccagacccuugca

SEQ ID NO: 1244336 - RNA, 21 nt, Human
caccauggcggcucaauuuca

SEQ ID NO: 1244337 - RNA, 18 nt, Human
cacccggcacagagcugg

SEQ ID NO: 1244338 - RNA, 23 nt, Human
caccuugcuggccugggcaggag

SEQ ID NO: 1244339 - RNA, 21 nt, Human
cagagcuccugccugccuucc

SEQ ID NO: 1244340 - RNA, 19 nt, Human
caucacucccugccucugc

SEQ ID NO: 1244341 - RNA, 23 nt, Human
ccagaaauccccacccucauuuc

SEQ ID NO: 1244342 - RNA, 21 nt, Human
ccaggcccacagccacugugc

SEQ ID NO: 1244343 - RNA, 23 nt, Human
ccaguccagagcugugccagccc

SEQ ID NO: 1244344 - RNA, 21 nt, Human
ccaguucaagccagcccauuc

SEQ ID NO: 1244345 - RNA, 22 nt, Human
cccacagggcacucuggggucc

SEQ ID NO: 1244346 - RNA, 21 nt, Human
ccccaugugggcaggacuggu

SEQ ID NO: 1244347 - RNA, 20 nt, Human
cccccacaggcugggcuccu

SEQ ID NO: 1244348 - RNA, 23 nt, Human
ccccgcccugagcuugcagcccc

SEQ ID NO: 1244349 - RNA, 21 nt, Human
cccugcccuccaggcccacag

SEQ ID NO: 1244350 - RNA, 22 nt, Human
ccucacccuggcugcagcccuu

SEQ ID NO: 1244351 - RNA, 19 nt, Human
cguaugugucccuuuuccu

SEQ ID NO: 1244352 - RNA, 21 nt, Human
cuccacucuagaaccugcacc

SEQ ID NO: 1244353 - RNA, 23 nt, Human
cuccugccugccuuccucuggcu

SEQ ID NO: 1244354 - RNA, 18 nt, Human
cucuagaaccugcaccuc

SEQ ID NO: 1244355 - RNA, 21 nt, Human
cugaaugucuucugugaacgg

SEQ ID NO: 1244356 - RNA, 21 nt, Human
cugcccaguccagagcugugc

SEQ ID NO: 1244357 - RNA, 20 nt, Human
cugcccaucaggcagcccug

SEQ ID NO: 1244358 - RNA, 22 nt, Human
cugggcaggaggugcuucaggc

SEQ ID NO: 1244359 - RNA, 20 nt, Human
cuucugucucuuggaacugu

SEQ ID NO: 1244360 - RNA, 27 nt, Human
cuugagaucccagaugugaacugcccc

SEQ ID NO: 1244361 - RNA, 23 nt, Human
cuugguggagaccccaauucccc

SEQ ID NO: 1244362 - RNA, 21 nt, Human
gagagugggccccaugugggc

SEQ ID NO: 1244363 - RNA, 20 nt, Human
gcaccuugcuggccugggca

SEQ ID NO: 1244364 - RNA, 18 nt, Human
gcccugagcuugcagccc

SEQ ID NO: 1244365 - RNA, 21 nt, Human
gccgggagacagagcuccugc

SEQ ID NO: 1244366 - RNA, 18 nt, Human
gcgaggauugcuugguug

SEQ ID NO: 1244367 - RNA, 24 nt, Human
ggcauccucucgaaggagggggug

SEQ ID NO: 1244368 - RNA, 20 nt, Human
gggcaggacuggucccacaa

SEQ ID NO: 1244369 - RNA, 21 nt, Human
gucucccagagcuggcccucc

SEQ ID NO: 1244370 - RNA, 21 nt, Human
gugcaguugaaauggugguug

SEQ ID NO: 1244371 - RNA, 20 nt, Human
uaacagcuuucuguggccag

SEQ ID NO: 1244372 - RNA, 31 nt, Human
uaccaagcaccagacccuugcagacauuccu

SEQ ID NO: 1244373 - RNA, 21 nt, Human
uagcaguaauagugcccacag

SEQ ID NO: 1244374 - RNA, 22 nt, Human
uagcucacagcagagaugacac

SEQ ID NO: 1244375 - RNA, 21 nt, Human
uccacagaggccucacccugg

SEQ ID NO: 1244376 - RNA, 25 nt, Human
ucccagagcuggcccucccccugcc

SEQ ID NO: 1244377 - RNA, 19 nt, Human
ucgaaggagggggugcagu

SEQ ID NO: 1244378 - RNA, 20 nt, Human
ucugcagaggucucuaggug

SEQ ID NO: 1244379 - RNA, 18 nt, Human
ucuguaccaagcaccaga

SEQ ID NO: 1244380 - RNA, 21 nt, Human
ucugucucuuggaacuguagg

SEQ ID NO: 1244381 - RNA, 18 nt, Human
ucuucugugaacgggggc

SEQ ID NO: 1244382 - RNA, 21 nt, Human
ugacacauuuggguugggcuu

SEQ ID NO: 1244383 - RNA, 21 nt, Human
ugcaccuugcuggccugggca

SEQ ID NO: 1244384 - RNA, 18 nt, Human
ugcagcaaacaugccaag

SEQ ID NO: 1244385 - RNA, 24 nt, Human
ugcagccccaucacucccugccuc

SEQ ID NO: 1244386 - RNA, 18 nt, Human
ugcaguugaaaugguggu

SEQ ID NO: 1244387 - RNA, 20 nt, Human
ugccaagugcacccacagau

SEQ ID NO: 1244388 - RNA, 21 nt, Human
ugccagcccccgcccugagcu

SEQ ID NO: 1244389 - RNA, 20 nt, Human
ugcccuccaggcccacagcc

SEQ ID NO: 1244390 - RNA, 18 nt, Human
ugccucugccgcaguccc

SEQ ID NO: 1244391 - RNA, 22 nt, Human
ugccugccuuccucuggcucag

SEQ ID NO: 1244392 - RNA, 19 nt, Human
uggcccucccccugcccag

SEQ ID NO: 1244393 - RNA, 23 nt, Human
ugggcaggaggugcuucaggcuc

SEQ ID NO: 1244394 - RNA, 25 nt, Human
ugggguguguggucaagucugcaga

SEQ ID NO: 1244395 - RNA, 24 nt, Human
uggugcgacugcccagaauggcac

SEQ ID NO: 1244396 - RNA, 20 nt, Human
uguccuuaugccccagaaau

SEQ ID NO: 1244397 - RNA, 20 nt, Human
ugugaacgggggcaggacug

SEQ ID NO: 1244398 - RNA, 20 nt, Human
uucccaggauggcugcccau

SEQ ID NO: 1244399 - RNA, 19 nt, Human
uugcagccccaucacuccc

SEQ ID NO: 1244400 - RNA, 21 nt, Human
aagggccccgccggcccuggg

SEQ ID NO: 1244401 - RNA, 21 nt, Human
aggugaaaagggccccgccgg

SEQ ID NO: 1244402 - RNA, 22 nt, Human
cagccccccagugcgagugccc

SEQ ID NO: 1244403 - RNA, 24 nt, Human
ccagcagcaccagcuccgcuuucc

SEQ ID NO: 1244404 - RNA, 25 nt, Human
ccagcagcaccagcuccgcuuuccc

SEQ ID NO: 1244405 - RNA, 19 nt, Human
ccaggauguggguccgagu

SEQ ID NO: 1244406 - RNA, 20 nt, Human
cccagugcgagugcccacgg

SEQ ID NO: 1244407 - RNA, 22 nt, Human
ccccgccaccuccgucagccca

SEQ ID NO: 1244408 - RNA, 20 nt, Human
cccgcaggaugauggcccgc

SEQ ID NO: 1244409 - RNA, 19 nt, Human
ccgccacagcuggcagagg

SEQ ID NO: 1244410 - RNA, 23 nt, Human
ccgccggcccugggcggcugcac

SEQ ID NO: 1244411 - RNA, 25 nt, Human
ccuggcccagcugcugguccccugg

SEQ ID NO: 1244412 - RNA, 21 nt, Human
cgcgguccuucuccuccagga

SEQ ID NO: 1244413 - RNA, 21 nt, Human
cuccaggaacugguagagccc

SEQ ID NO: 1244414 - RNA, 20 nt, Human
cugcgcgguccuucuccucc

SEQ ID NO: 1244415 - RNA, 25 nt, Human
cuggcccagcugcugucacagcccc

SEQ ID NO: 1244416 - RNA, 19 nt, Human
gagcccgugguccagcagc

SEQ ID NO: 1244417 - RNA, 18 nt, Human
gaggagaggcauugcagu

SEQ ID NO: 1244418 - RNA, 19 nt, Human
gcagagggcugcgcggucc

SEQ ID NO: 1244419 - RNA, 20 nt, Human
gcccaaggugaaaagggccc

SEQ ID NO: 1244420 - RNA, 20 nt, Human
gcccacggggcucggggugu

SEQ ID NO: 1244421 - RNA, 18 nt, Human
gcccugggcggcugcacc

SEQ ID NO: 1244422 - RNA, 19 nt, Human
gcuaucuggggagaggaga

SEQ ID NO: 1244423 - RNA, 19 nt, Human
gcugcgcgguccuucuccu

SEQ ID NO: 1244424 - RNA, 21 nt, Human
gucauuacacggccuccuggc

SEQ ID NO: 1244425 - RNA, 23 nt, Human
uacaccucuagccccgccaccuc

SEQ ID NO: 1244426 - RNA, 21 nt, Human
uaucuggggagaggagaggca

SEQ ID NO: 1244427 - RNA, 23 nt, Human
uccgcaccagaacguugccagga

SEQ ID NO: 1244428 - RNA, 18 nt, Human
ucuagccccgccaccucc

SEQ ID NO: 1244429 - RNA, 19 nt, Human
ucuggggagaggagaggca

SEQ ID NO: 1244430 - RNA, 21 nt, Human
uuucccguccgggccuuuccg

SEQ ID NO: 1244431 - RNA, 18 nt, Human
aaaaaacaagauagaggc

SEQ ID NO: 1244432 - RNA, 22 nt, Human
aaaaacaaaaaacaagauagag

SEQ ID NO: 1244433 - RNA, 20 nt, Human
aaacaagauagaggcagcaa

SEQ ID NO: 1244434 - RNA, 23 nt, Human
accccccccagaagaaaaaacaa

SEQ ID NO: 1244435 - RNA, 25 nt, Human
agaggcagcaaacacaaauucugag

SEQ ID NO: 1244436 - RNA, 23 nt, Human
aggcacuguucuagacccccccc

SEQ ID NO: 1244437 - RNA, 22 nt, Human
aggcagcaaacacaaauucuga

SEQ ID NO: 1244438 - RNA, 22 nt, Human
agggagaaaggagaggggaggg

SEQ ID NO: 1244439 - RNA, 23 nt, Human
augcgccccagaggcuggagcag

SEQ ID NO: 1244440 - RNA, 22 nt, Human
auucugagggagaggaaagggg

SEQ ID NO: 1244441 - RNA, 19 nt, Human
caaaaaacaagauagaggc

SEQ ID NO: 1244442 - RNA, 18 nt, Human
cagaagaaaaaacaaaaa

SEQ ID NO: 1244443 - RNA, 21 nt, Human
cagcgaggugcaaacgcgacg

SEQ ID NO: 1244444 - RNA, 23 nt, Human
ccagaggcuggagcagcgaggug

SEQ ID NO: 1244445 - RNA, 19 nt, Human
cccagaagaaaaaacaaaa

SEQ ID NO: 1244446 - RNA, 19 nt, Human
ccccagaggcuggagcagc

SEQ ID NO: 1244447 - RNA, 24 nt, Human
ccccagaggcuggagcagcgaggu

SEQ ID NO: 1244448 - RNA, 22 nt, Human
cccccagaagaaaaaacaaaaa

SEQ ID NO: 1244449 - RNA, 21 nt, Human
ccccccagaagaaaaaacaaa

SEQ ID NO: 1244450 - RNA, 20 nt, Human
ccggggcugggaggcgggag

SEQ ID NO: 1244451 - RNA, 21 nt, Human
cggggcugggaggcgggagaa

SEQ ID NO: 1244452 - RNA, 20 nt, Human
cuaugugccaggcacuguuc

SEQ ID NO: 1244453 - RNA, 22 nt, Human
gagaagccugaggugauggggg

SEQ ID NO: 1244454 - RNA, 23 nt, Human
gagaagccugaggugaugggggc

SEQ ID NO: 1244455 - RNA, 18 nt, Human
gagggcgcggagggaaag

SEQ ID NO: 1244456 - RNA, 21 nt, Human
gccccagaggcuggagcagcg

SEQ ID NO: 1244457 - RNA, 20 nt, Human
gcgccccagaggcuggagca

SEQ ID NO: 1244458 - RNA, 21 nt, Human
gcgccggggcugggaggcggg

SEQ ID NO: 1244459 - RNA, 19 nt, Human
ggagaaaggagaggggagg

SEQ ID NO: 1244460 - RNA, 23 nt, Human
ggagaggggagggcgcggaggga

SEQ ID NO: 1244461 - RNA, 22 nt, Human
ggcaggaagguucugagaggga

SEQ ID NO: 1244462 - RNA, 20 nt, Human
ggcaguugaguaagacggcu

SEQ ID NO: 1244463 - RNA, 21 nt, Human
uacuaugugccaggcacuguu

SEQ ID NO: 1244464 - RNA, 23 nt, Human
ucuagaccccccccagaagaaaa

SEQ ID NO: 1244465 - RNA, 20 nt, Human
ucugagggagaggaaagggg

SEQ ID NO: 1244466 - RNA, 19 nt, Human
ugagggagaggaaaggggc

SEQ ID NO: 1244467 - RNA, 19 nt, Human
uggaaugcgccccagaggc

SEQ ID NO: 1244468 - RNA, 27 nt, Human
ugggcggggcgcgcgugcgccggggcu

SEQ ID NO: 1244469 - RNA, 19 nt, Human
accccauggugaagcucga

SEQ ID NO: 1244470 - RNA, 19 nt, Human
acgcagauccaggccaguu

SEQ ID NO: 1244471 - RNA, 26 nt, Human
aggcaggagcgcggcaggggccagag

SEQ ID NO: 1244472 - RNA, 25 nt, Human
aggggccagagaggccauccgaacu

SEQ ID NO: 1244473 - RNA, 18 nt, Human
aguuuuuauuuuuucucc

SEQ ID NO: 1244474 - RNA, 21 nt, Human
caccacaccccauggugaagc

SEQ ID NO: 1244475 - RNA, 19 nt, Human
cagcccccauucuuccugc

SEQ ID NO: 1244476 - RNA, 21 nt, Human
ccaccggccagcccgggcacc

SEQ ID NO: 1244477 - RNA, 21 nt, Human
cccugccagcuggggccucuc

SEQ ID NO: 1244478 - RNA, 19 nt, Human
ccgcagcugcuccuugguu

SEQ ID NO: 1244479 - RNA, 21 nt, Human
ccuggugacagaugaccgucc

SEQ ID NO: 1244480 - RNA, 21 nt, Human
cgagguagaggucagccccca

SEQ ID NO: 1244481 - RNA, 23 nt, Human
cgagguagaggucagcccccauu

SEQ ID NO: 1244482 - RNA, 20 nt, Human
cggcgcgucgcagccgcccu

SEQ ID NO: 1244483 - RNA, 24 nt, Human
cgggcaccucggggaaccgcagcu

SEQ ID NO: 1244484 - RNA, 25 nt, Human
cguccuccucuuccagcccucccca

SEQ ID NO: 1244485 - RNA, 19 nt, Human
cuaaagcccaccacacccc

SEQ ID NO: 1244486 - RNA, 20 nt, Human
cuaaagcccaccacacccca

SEQ ID NO: 1244487 - RNA, 18 nt, Human
cucaagagaucaaaauuc

SEQ ID NO: 1244488 - RNA, 19 nt, Human
cucaagagaucaaaauucu

SEQ ID NO: 1244489 - RNA, 21 nt, Human
cugcagcagaaagcgguccag

SEQ ID NO: 1244490 - RNA, 19 nt, Human
cugggucccugccagcugg

SEQ ID NO: 1244491 - RNA, 19 nt, Human
gaaccgcagcugcuccuug

SEQ ID NO: 1244492 - RNA, 23 nt, Human
gaccguccuccucuuccagcccu

SEQ ID NO: 1244493 - RNA, 19 nt, Human
gagaagggccagggugaca

SEQ ID NO: 1244494 - RNA, 19 nt, Human
gaguuuuuauuuuuucucc

SEQ ID NO: 1244495 - RNA, 18 nt, Human
gcaggagcgcggcagggg

SEQ ID NO: 1244496 - RNA, 19 nt, Human
gccagcuacgucgggacgc

SEQ ID NO: 1244497 - RNA, 24 nt, Human
ggagaagcugcucaagagaucaaa

SEQ ID NO: 1244498 - RNA, 20 nt, Human
ggagaugggccgaggaccgu

SEQ ID NO: 1244499 - RNA, 24 nt, Human
ggcacauacaaaggcuggucaggc

SEQ ID NO: 1244500 - RNA, 22 nt, Human
ggccgaggaccgugguaccugc

SEQ ID NO: 1244501 - RNA, 20 nt, Human
ggcugaggagaggaagacac

SEQ ID NO: 1244502 - RNA, 18 nt, Human
ggggaaccgcagcugcuc

SEQ ID NO: 1244503 - RNA, 18 nt, Human
gggucuccagcaccaaca

SEQ ID NO: 1244504 - RNA, 18 nt, Human
guccaguuccuccuggau

SEQ ID NO: 1244505 - RNA, 21 nt, Human
guggugcggggcugcucuggc

SEQ ID NO: 1244506 - RNA, 24 nt, Human
uaaagcccaccacaccccauggug

SEQ ID NO: 1244507 - RNA, 20 nt, Human
ucuccagcaccaacaucucc

SEQ ID NO: 1244508 - RNA, 22 nt, Human
ucucggcgcgucgcagccgccc

SEQ ID NO: 1244509 - RNA, 18 nt, Human
ucucggcugaggagagga

SEQ ID NO: 1244510 - RNA, 24 nt, Human
ucucuugagcaccgagguagaggu

SEQ ID NO: 1244511 - RNA, 22 nt, Human
ucuuccugccugcgcagcaccc

SEQ ID NO: 1244512 - RNA, 18 nt, Human
ugacagcugcuucugcag

SEQ ID NO: 1244513 - RNA, 23 nt, Human
ugacagcugcuucugcagcagaa

SEQ ID NO: 1244514 - RNA, 18 nt, Human
ugaccguccuccucuucc

SEQ ID NO: 1244515 - RNA, 23 nt, Human
ugcggggcugcucuggcgucugu

SEQ ID NO: 1244516 - RNA, 21 nt, Human
ugcuggggcaggaggcaggag

SEQ ID NO: 1244517 - RNA, 23 nt, Human
uggugaagcucgaggguggugcg

SEQ ID NO: 1244518 - RNA, 25 nt, Human
gcccugggcugugcugugggcccca

SEQ ID NO: 1244519 - RNA, 18 nt, Human
ugaaagaauagccucuau

SEQ ID NO: 1244520 - RNA, 23 nt, Human
ugggcugugcugugggcccgggg

SEQ ID NO: 1244521 - RNA, 24 nt, Human
aaauggccccgguaaucucuaagc

SEQ ID NO: 1244522 - RNA, 21 nt, Human
agccucaguaauggagcagcc

SEQ ID NO: 1244523 - RNA, 24 nt, Human
aggugugguggaaguagucacaga

SEQ ID NO: 1244524 - RNA, 22 nt, Human
aguaauggagcagccuguaaaa

SEQ ID NO: 1244525 - RNA, 20 nt, Human
augaaggugugguggaaguu

SEQ ID NO: 1244526 - RNA, 25 nt, Human
ccgguaaucucuaagcuuguucccc

SEQ ID NO: 1244527 - RNA, 22 nt, Human
ccugcugguccuggcccaggac

SEQ ID NO: 1244528 - RNA, 20 nt, Human
cgggaggggaugggguggca

SEQ ID NO: 1244529 - RNA, 18 nt, Human
cucggccagcgggagggg

SEQ ID NO: 1244530 - RNA, 24 nt, Human
gcccucggccagcgggaggggaug

SEQ ID NO: 1244531 - RNA, 23 nt, Human
gggugguguugaaauggccccgg

SEQ ID NO: 1244532 - RNA, 22 nt, Human
ggugguguugaaauggccccgg

SEQ ID NO: 1244533 - RNA, 21 nt, Human
uaaacacucaauaaguaaugc

SEQ ID NO: 1244534 - RNA, 19 nt, Human
uaaguaaugccauugucac

SEQ ID NO: 1244535 - RNA, 22 nt, Human
uaaguaaugccauugucaccgu

SEQ ID NO: 1244536 - RNA, 24 nt, Human
uaaguaaugccauugucaccguca

SEQ ID NO: 1244537 - RNA, 22 nt, Human
uccacaagucccuguccaugcc

SEQ ID NO: 1244538 - RNA, 24 nt, Human
ucggccagcgggaggggauggggu

SEQ ID NO: 1244539 - RNA, 23 nt, Human
ucgucacagccucaguaauggag

SEQ ID NO: 1244540 - RNA, 18 nt, Human
ugaaauggccccgguaau

SEQ ID NO: 1244541 - RNA, 20 nt, Human
uggaaguagucacagagggc

SEQ ID NO: 1244542 - RNA, 18 nt, Human
uguaaaauagaggcaaua

SEQ ID NO: 1244543 - RNA, 20 nt, Human
uguaguggcggaugaaggug

SEQ ID NO: 1244544 - RNA, 19 nt, Human
ugugguggaaguagucaca

SEQ ID NO: 1244545 - RNA, 20 nt, Human
aaacgaugcccuagaacaga

SEQ ID NO: 1244546 - RNA, 23 nt, Human
aacauacuugcaacaccugcaga

SEQ ID NO: 1244547 - RNA, 21 nt, Human
aacuccuccuucuccacccua

SEQ ID NO: 1244548 - RNA, 18 nt, Human
aagacagaagcaccaaac

SEQ ID NO: 1244549 - RNA, 19 nt, Human
aaggcuucccaccaaaugg

SEQ ID NO: 1244550 - RNA, 19 nt, Human
aaugucuaccauucacagc

SEQ ID NO: 1244551 - RNA, 28 nt, Human
aauuuugacuuuuuauauauauguauau

SEQ ID NO: 1244552 - RNA, 25 nt, Human
acacacacaaacacacacauacuac

SEQ ID NO: 1244553 - RNA, 21 nt, Human
acacacacacauacacacaca

SEQ ID NO: 1244554 - RNA, 30 nt, Human
acacacacauacacacacaaacacacacaa

SEQ ID NO: 1244555 - RNA, 33 nt, Human
acacacacauacacacacaaacacacacauagu

SEQ ID NO: 1244556 - RNA, 21 nt, Human
acacacacauauauacgugug

SEQ ID NO: 1244557 - RNA, 19 nt, Human
acauacuacacacacaaaa

SEQ ID NO: 1244558 - RNA, 30 nt, Human
acgugugcuaugggcacacacacacauaca

SEQ ID NO: 1244559 - RNA, 19 nt, Human
acuccuccuucuccacccu

SEQ ID NO: 1244560 - RNA, 24 nt, Human
agaacagaaauauucuuuaaagga

SEQ ID NO: 1244561 - RNA, 23 nt, Human
agauaggaagaauaauugcuuug

SEQ ID NO: 1244562 - RNA, 23 nt, Human
agcccaguagaagcgucgcuggu

SEQ ID NO: 1244563 - RNA, 24 nt, Human
agccuucaaguagcuucuccagcc

SEQ ID NO: 1244564 - RNA, 19 nt, Human
auauguauauauauauaua

SEQ ID NO: 1244565 - RNA, 20 nt, Human
auauguauauauauauauau

SEQ ID NO: 1244566 - RNA, 19 nt, Human
aucuacacuugguguaagg

SEQ ID NO: 1244567 - RNA, 19 nt, Human
auguauauauauauauaua

SEQ ID NO: 1244568 - RNA, 20 nt, Human
auguauauauauauauauaa

SEQ ID NO: 1244569 - RNA, 19 nt, Human
caaaauuucccauucaacc

SEQ ID NO: 1244570 - RNA, 18 nt, Human
caaaguggggagaagguc

SEQ ID NO: 1244571 - RNA, 19 nt, Human
caaaugcuaaaauggcaca

SEQ ID NO: 1244572 - RNA, 19 nt, Human
caacaccugcagaaauuca

SEQ ID NO: 1244573 - RNA, 21 nt, Human
cacaauaucacaugugauaaa

SEQ ID NO: 1244574 - RNA, 22 nt, Human
cacacaaaauuucccauucaac

SEQ ID NO: 1244575 - RNA, 26 nt, Human
cacacaaacacacacauacuacacac

SEQ ID NO: 1244576 - RNA, 23 nt, Human
cacacacaaacacacacauacua

SEQ ID NO: 1244577 - RNA, 30 nt, Human
cacacacaaacacacacauacuacacacag

SEQ ID NO: 1244578 - RNA, 21 nt, Human
cacacacauacuacacacaca

SEQ ID NO: 1244579 - RNA, 25 nt, Human
cacacacauauauacgugugcuaug

SEQ ID NO: 1244580 - RNA, 21 nt, Human
cacacauacacacacaaacac

SEQ ID NO: 1244581 - RNA, 23 nt, Human
cacacauacuacacacacaaaau

SEQ ID NO: 1244582 - RNA, 19 nt, Human
cacagccuuaaaaugaugg

SEQ ID NO: 1244583 - RNA, 24 nt, Human
caccaaucccauaaaugaucuaca

SEQ ID NO: 1244584 - RNA, 23 nt, Human
cacccaaaccagggcucgugggc

SEQ ID NO: 1244585 - RNA, 23 nt, Human
cagccuucaaguagcuucuccag

SEQ ID NO: 1244586 - RNA, 19 nt, Human
caugagaaaacgugacagu

SEQ ID NO: 1244587 - RNA, 26 nt, Human
ccaaacuuaagguccccuucucaacu

SEQ ID NO: 1244588 - RNA, 24 nt, Human
ccaaccacaauggugaaagacaga

SEQ ID NO: 1244589 - RNA, 20 nt, Human
ccagagaguuuugcaugaga

SEQ ID NO: 1244590 - RNA, 21 nt, Human
ccagagcccccgcccccaugc

SEQ ID NO: 1244591 - RNA, 22 nt, Human
ccagagcccccgcccccaugcu

SEQ ID NO: 1244592 - RNA, 23 nt, Human
ccagaugcaccaggugagcugaa

SEQ ID NO: 1244593 - RNA, 24 nt, Human
cccaccaaauggaaacagaagagg

SEQ ID NO: 1244594 - RNA, 23 nt, Human
ccccaugcucugcugaaccaagc

SEQ ID NO: 1244595 - RNA, 20 nt, Human
ccgcuggcucugaaucccca

SEQ ID NO: 1244596 - RNA, 20 nt, Human
ccuagaacagaaauauucuu

SEQ ID NO: 1244597 - RNA, 22 nt, Human
ccucuaaggccugcaguccgcu

SEQ ID NO: 1244598 - RNA, 21 nt, Human
ccuugagcuccuagaaggcuc

SEQ ID NO: 1244599 - RNA, 22 nt, Human
cucacccaaauggcauggccuc

SEQ ID NO: 1244600 - RNA, 21 nt, Human
cugaguuuuauuauuacugac

SEQ ID NO: 1244601 - RNA, 25 nt, Human
gaaaauaaacaguggaaucaaaucc

SEQ ID NO: 1244602 - RNA, 22 nt, Human
gaagguuuuuuguuuguuugug

SEQ ID NO: 1244603 - RNA, 25 nt, Human
gcacacacacacauacacacacaaa

SEQ ID NO: 1244604 - RNA, 25 nt, Human
gcagcagggacacacacauauauac

SEQ ID NO: 1244605 - RNA, 22 nt, Human
gcagcaguacacaguguuugca

SEQ ID NO: 1244606 - RNA, 24 nt, Human
gccgcuggcucugaauccccaggu

SEQ ID NO: 1244607 - RNA, 19 nt, Human
gcgguggcuuuuuguuuug

SEQ ID NO: 1244608 - RNA, 21 nt, Human
ggagaaggucaggagaggagg

SEQ ID NO: 1244609 - RNA, 22 nt, Human
ggagaaggucaggagaggaggg

SEQ ID NO: 1244610 - RNA, 26 nt, Human
gguaaaaaacuuuuuuuuuuucuuuu

SEQ ID NO: 1244611 - RNA, 19 nt, Human
ggucaggagaggaggggga

SEQ ID NO: 1244612 - RNA, 18 nt, Human
gguggugguggcgguggu

SEQ ID NO: 1244613 - RNA, 18 nt, Human
gguuuaugcuuuugcuuu

SEQ ID NO: 1244614 - RNA, 22 nt, Human
guauauauauauauauauucua

SEQ ID NO: 1244615 - RNA, 21 nt, Human
guggugguguugguguggcgg

SEQ ID NO: 1244616 - RNA, 24 nt, Human
uaaaugucuaccauucacagccuu

SEQ ID NO: 1244617 - RNA, 22 nt, Human
uaagggcauaaggcaguugaag

SEQ ID NO: 1244618 - RNA, 21 nt, Human
uaagguccccuucucaacuug

SEQ ID NO: 1244619 - RNA, 23 nt, Human
uaagguccccuucucaacuuggu

SEQ ID NO: 1244620 - RNA, 21 nt, Human
uacaaugagaaaauaaacagu

SEQ ID NO: 1244621 - RNA, 22 nt, Human
uacacaauaucacaugugauaa

SEQ ID NO: 1244622 - RNA, 22 nt, Human
uacacacacaaacacacacaua

SEQ ID NO: 1244623 - RNA, 25 nt, Human
uacacacacaaacacacacauacua

SEQ ID NO: 1244624 - RNA, 25 nt, Human
uauauauauauauucuaguuuuccu

SEQ ID NO: 1244625 - RNA, 20 nt, Human
uauauauauguauauauaua

SEQ ID NO: 1244626 - RNA, 23 nt, Human
uauauauauguauauauauauau

SEQ ID NO: 1244627 - RNA, 18 nt, Human
uauauauguauauauaua

SEQ ID NO: 1244628 - RNA, 18 nt, Human
uauauguauauauauaua

SEQ ID NO: 1244629 - RNA, 26 nt, Human
uaugggcacacacacacauacacaca

SEQ ID NO: 1244630 - RNA, 18 nt, Human
uauguauauauauauaua

SEQ ID NO: 1244631 - RNA, 19 nt, Human
uauguauauauauauauau

SEQ ID NO: 1244632 - RNA, 25 nt, Human
uauguauauauauauauauauucua

SEQ ID NO: 1244633 - RNA, 22 nt, Human
uauuuguugguugguuuuuguu

SEQ ID NO: 1244634 - RNA, 19 nt, Human
ucacuuccccaccacucca

SEQ ID NO: 1244635 - RNA, 19 nt, Human
uccaggagaaggcaggaga

SEQ ID NO: 1244636 - RNA, 21 nt, Human
uccaggagaaggcaggagaaa

SEQ ID NO: 1244637 - RNA, 22 nt, Human
uccccaccacuccagagccccc

SEQ ID NO: 1244638 - RNA, 24 nt, Human
uccuagaaggcucugcaaaguggg

SEQ ID NO: 1244639 - RNA, 19 nt, Human
ucgcugguguuccuuccgc

SEQ ID NO: 1244640 - RNA, 23 nt, Human
ucuuuguauacauacagcgacug

SEQ ID NO: 1244641 - RNA, 22 nt, Human
ugaacauacuugcaacaccugc

SEQ ID NO: 1244642 - RNA, 22 nt, Human
ugacaguacuuaaugaaacuca

SEQ ID NO: 1244643 - RNA, 24 nt, Human
ugacaguacuuaaugaaacucagc

SEQ ID NO: 1244644 - RNA, 18 nt, Human
ugagaaaauaaacagugg

SEQ ID NO: 1244645 - RNA, 19 nt, Human
ugauggaacuaaucguugu

SEQ ID NO: 1244646 - RNA, 24 nt, Human
ugcagcagggacacacacauauau

SEQ ID NO: 1244647 - RNA, 27 nt, Human
ugcagcagggacacacacauauauacg

SEQ ID NO: 1244648 - RNA, 21 nt, Human
ugcuuuugcuuuugguaaauu

SEQ ID NO: 1244649 - RNA, 24 nt, Human
uggaaucaaauccucacccaaaug

SEQ ID NO: 1244650 - RNA, 22 nt, Human
uggccucuaaggccugcagucc

SEQ ID NO: 1244651 - RNA, 22 nt, Human
uggcuuuuuguuuuguucuggu

SEQ ID NO: 1244652 - RNA, 21 nt, Human
ugggcaggcagcaucacuucc

SEQ ID NO: 1244653 - RNA, 22 nt, Human
ugggcaggcagcaucacuuccc

SEQ ID NO: 1244654 - RNA, 24 nt, Human
ugggggaggcccgcgugcagcagu

SEQ ID NO: 1244655 - RNA, 19 nt, Human
ugguggugguggcgguggu

SEQ ID NO: 1244656 - RNA, 24 nt, Human
ugguggugguggcggugguucugu

SEQ ID NO: 1244657 - RNA, 25 nt, Human
ugguguggcgguguuggugguggug

SEQ ID NO: 1244658 - RNA, 23 nt, Human
ugguucuguguauugggggaagg

SEQ ID NO: 1244659 - RNA, 24 nt, Human
uguaaaaaacaaaagaaagguuuu

SEQ ID NO: 1244660 - RNA, 19 nt, Human
uguauacauacagcgacug

SEQ ID NO: 1244661 - RNA, 18 nt, Human
uguauauauauauauaua

SEQ ID NO: 1244662 - RNA, 18 nt, Human
ugucuaccauucacagcc

SEQ ID NO: 1244663 - RNA, 20 nt, Human
ugugagucuugccacccaaa

SEQ ID NO: 1244664 - RNA, 27 nt, Human
ugugauaaaugucuaccauucacagcc

SEQ ID NO: 1244665 - RNA, 30 nt, Human
ugugcuaugggcacacacacacauacacag

SEQ ID NO: 1244666 - RNA, 23 nt, Human
uguguuuguuuuguuuuguuuug

SEQ ID NO: 1244667 - RNA, 21 nt, Human
uguugccagucacugauuaag

SEQ ID NO: 1244668 - RNA, 20 nt, Human
uguugguggugguggcggug

SEQ ID NO: 1244669 - RNA, 19 nt, Human
uguuuuguuuuguucuuuc

SEQ ID NO: 1244670 - RNA, 19 nt, Human
uucaaguagcuucuccagc

SEQ ID NO: 1244671 - RNA, 18 nt, Human
uucaucuccaggagaagg

SEQ ID NO: 1244672 - RNA, 23 nt, Human
uuccagaucaauuuaaggcuucc

SEQ ID NO: 1244673 - RNA, 19 nt, Human
uuccuuuuuuuuugugccc

SEQ ID NO: 1244674 - RNA, 22 nt, Human
uucuuuuuuuuuuguaguggug

SEQ ID NO: 1244675 - RNA, 22 nt, Human
uugaagggguugugacuuauua

SEQ ID NO: 1244676 - RNA, 21 nt, Human
uugcgguggcuuuuuguuuug

SEQ ID NO: 1244677 - RNA, 26 nt, Human
uugcuaggcaaaugcuaaaauggcac

SEQ ID NO: 1244678 - RNA, 18 nt, Human
uuggaguggagauaacuc

SEQ ID NO: 1244679 - RNA, 18 nt, Human
uugguggugguggcggug

SEQ ID NO: 1244680 - RNA, 23 nt, Human
uuguguuuguuuuguuuuguuuu

SEQ ID NO: 1244681 - RNA, 18 nt, Human
uuguugccagucacugau

SEQ ID NO: 1244682 - RNA, 19 nt, Human
uuuguuuuguuuuguuuug

SEQ ID NO: 1244683 - RNA, 21 nt, Human
uuuuauauauauguauauauu

SEQ ID NO: 1244684 - RNA, 19 nt, Human
uuuugugcccaaguagaga

SEQ ID NO: 1244685 - RNA, 22 nt, Human
aaacagagauuggaaacacgca

SEQ ID NO: 1244686 - RNA, 19 nt, Human
aaaguguaagguuuucuuu

SEQ ID NO: 1244687 - RNA, 20 nt, Human
aacauaaaaucugaauaaaa

SEQ ID NO: 1244688 - RNA, 18 nt, Human
aagagacacauacugaaa

SEQ ID NO: 1244689 - RNA, 18 nt, Human
aagaucucaugccacuac

SEQ ID NO: 1244690 - RNA, 21 nt, Human
acagagucagaucaccggcca

SEQ ID NO: 1244691 - RNA, 19 nt, Human
accagucuaaugcauaaaa

SEQ ID NO: 1244692 - RNA, 19 nt, Human
acugcagccugcuagggug

SEQ ID NO: 1244693 - RNA, 23 nt, Human
acugcagccugcuagggugggcu

SEQ ID NO: 1244694 - RNA, 22 nt, Human
acuguauucaugccaucaucuc

SEQ ID NO: 1244695 - RNA, 22 nt, Human
agaacagagucagaucaccgga

SEQ ID NO: 1244696 - RNA, 20 nt, Human
agaacgcccacagcuccaga

SEQ ID NO: 1244697 - RNA, 20 nt, Human
agaguuugucugaaacuucc

SEQ ID NO: 1244698 - RNA, 25 nt, Human
aggaagcaagcaucaaacccugacu

SEQ ID NO: 1244699 - RNA, 21 nt, Human
agguggagaaucccagauccg

SEQ ID NO: 1244700 - RNA, 20 nt, Human
agucagaucaccggccaagg

SEQ ID NO: 1244701 - RNA, 21 nt, Human
auccaacagggacagaagacc

SEQ ID NO: 1244702 - RNA, 20 nt, Human
auguauuuagugcaccugaa

SEQ ID NO: 1244703 - RNA, 19 nt, Human
caacagggacagaagaccu

SEQ ID NO: 1244704 - RNA, 22 nt, Human
caacagggacagaagaccuuua

SEQ ID NO: 1244705 - RNA, 19 nt, Human
caacuuaugaaauaaaccc

SEQ ID NO: 1244706 - RNA, 20 nt, Human
caagagacacauacugaaac

SEQ ID NO: 1244707 - RNA, 30 nt, Human
cacagcuccagacccggcauggaccaucuu

SEQ ID NO: 1244708 - RNA, 30 nt, Human
cacauauccauucagaacauaccagaacag

SEQ ID NO: 1244709 - RNA, 19 nt, Human
cacucugaugaugcucuuc

SEQ ID NO: 1244710 - RNA, 21 nt, Human
cacuuccuucccugacagcac

SEQ ID NO: 1244711 - RNA, 25 nt, Human
cagauccgaaaacagagauuggaaa

SEQ ID NO: 1244712 - RNA, 21 nt, Human
ccacagaaaccacacgaauac

SEQ ID NO: 1244713 - RNA, 22 nt, Human
ccagggccagucccuacaccca

SEQ ID NO: 1244714 - RNA, 21 nt, Human
cccaagagacacauacugaaa

SEQ ID NO: 1244715 - RNA, 18 nt, Human
cccccaacccuaccacca

SEQ ID NO: 1244716 - RNA, 22 nt, Human
cgaaaacagagauuggaaacac

SEQ ID NO: 1244717 - RNA, 26 nt, Human
cgaaaacagagauuggaaacacgcaa

SEQ ID NO: 1244718 - RNA, 22 nt, Human
cucaaacucacuguuaggaaau

SEQ ID NO: 1244719 - RNA, 26 nt, Human
cucauaacgauguauucgucccuggg

SEQ ID NO: 1244720 - RNA, 23 nt, Human
cucugaugaugcucuuccaucuc

SEQ ID NO: 1244721 - RNA, 23 nt, Human
cuuagugccuuggacucuauuuc

SEQ ID NO: 1244722 - RNA, 23 nt, Human
cuucaagaucugaugcuccauuc

SEQ ID NO: 1244723 - RNA, 21 nt, Human
gaaaacagagauuggaaacac

SEQ ID NO: 1244724 - RNA, 22 nt, Human
gaagcucuugccauguggcucu

SEQ ID NO: 1244725 - RNA, 21 nt, Human
gaugcucuuccaucucuccac

SEQ ID NO: 1244726 - RNA, 20 nt, Human
gcucuuccaucucuccacuc

SEQ ID NO: 1244727 - RNA, 20 nt, Human
ggaaacacgcaaagggaccc

SEQ ID NO: 1244728 - RNA, 19 nt, Human
gggcuauccaacaucagaa

SEQ ID NO: 1244729 - RNA, 20 nt, Human
gucccuacacccacagaaac

SEQ ID NO: 1244730 - RNA, 21 nt, Human
uaaaaaacaggacauuaguac

SEQ ID NO: 1244731 - RNA, 18 nt, Human
uaaaagacagugguaucc

SEQ ID NO: 1244732 - RNA, 21 nt, Human
uaaacccacuaagccagcagg

SEQ ID NO: 1244733 - RNA, 20 nt, Human
uacacccacagaaaccacac

SEQ ID NO: 1244734 - RNA, 19 nt, Human
uacagucuucccaggaaaa

SEQ ID NO: 1244735 - RNA, 20 nt, Human
uacguaugucuguacagucu

SEQ ID NO: 1244736 - RNA, 26 nt, Human
uagcuaaguuaaucuuugagccacau

SEQ ID NO: 1244737 - RNA, 23 nt, Human
uaggaagcaagcaucaaacccug

SEQ ID NO: 1244738 - RNA, 19 nt, Human
uaugaaauaaacccacuaa

SEQ ID NO: 1244739 - RNA, 25 nt, Human
uccaaggcgacagagaaucaaccac

SEQ ID NO: 1244740 - RNA, 23 nt, Human
uccaucucuccacucggucccaa

SEQ ID NO: 1244741 - RNA, 26 nt, Human
ucccaggaaaaggauccauagauuuc

SEQ ID NO: 1244742 - RNA, 21 nt, Human
ucccgcaugugcggcggcacc

SEQ ID NO: 1244743 - RNA, 27 nt, Human
ucccuacacccacagaaaccacacgaa

SEQ ID NO: 1244744 - RNA, 21 nt, Human
ucccuaugucuagauguguuc

SEQ ID NO: 1244745 - RNA, 26 nt, Human
ucccuggguaaagagucagauuucug

SEQ ID NO: 1244746 - RNA, 18 nt, Human
ucugaaacuuccaaaaua

SEQ ID NO: 1244747 - RNA, 21 nt, Human
ucugaugaugcucuuccaucu

SEQ ID NO: 1244748 - RNA, 19 nt, Human
ucuuccaucucuccacucg

SEQ ID NO: 1244749 - RNA, 22 nt, Human
ugaccaagaaggugcagauucc

SEQ ID NO: 1244750 - RNA, 23 nt, Human
ugcaccugaacucauaacgaugu

SEQ ID NO: 1244751 - RNA, 20 nt, Human
ugcagugaccaagaaggugc

SEQ ID NO: 1244752 - RNA, 20 nt, Human
ugccgggcuaugaagugcag

SEQ ID NO: 1244753 - RNA, 23 nt, Human
ugcucagaguuuucagcaucuaa

SEQ ID NO: 1244754 - RNA, 25 nt, Human
ugcucuuccaucucuccacucgguc

SEQ ID NO: 1244755 - RNA, 22 nt, Human
uggaaaagcaaugagcgaccuu

SEQ ID NO: 1244756 - RNA, 19 nt, Human
uucccugacagcacuuuaa

SEQ ID NO: 1244757 - RNA, 25 nt, Human
uuccuucuugggucgcuuucauuug

SEQ ID NO: 1244758 - RNA, 20 nt, Human
aaccuccaccuccugggcuc

SEQ ID NO: 1244759 - RNA, 24 nt, Human
aaggugcugagaucacagguguga

SEQ ID NO: 1244760 - RNA, 21 nt, Human
acaggugcccaccaccacacc

SEQ ID NO: 1244761 - RNA, 22 nt, Human
accauagggagaugucuucuca

SEQ ID NO: 1244762 - RNA, 18 nt, Human
accauguuggccaggcug

SEQ ID NO: 1244763 - RNA, 23 nt, Human
accuaucagguacuggaggugaa

SEQ ID NO: 1244764 - RNA, 21 nt, Human
acucuguugcccaggcuggag

SEQ ID NO: 1244765 - RNA, 25 nt, Human
acucuguugcccaggcuggagugca

SEQ ID NO: 1244766 - RNA, 18 nt, Human
agaacucaagggacagga

SEQ ID NO: 1244767 - RNA, 19 nt, Human
agaucacaggugugagcca

SEQ ID NO: 1244768 - RNA, 20 nt, Human
agcuaugacagagaggggca

SEQ ID NO: 1244769 - RNA, 18 nt, Human
aggaaggagaugaguugg

SEQ ID NO: 1244770 - RNA, 21 nt, Human
aggaaggcagguuugggcugg

SEQ ID NO: 1244771 - RNA, 25 nt, Human
aggcuggagugcaguggcaugaucu

SEQ ID NO: 1244772 - RNA, 24 nt, Human
aggugauccaccugccucggccuc

SEQ ID NO: 1244773 - RNA, 26 nt, Human
aggugcugagaucacaggugugagcc

SEQ ID NO: 1244774 - RNA, 22 nt, Human
aguagagaugggguuucaccau

SEQ ID NO: 1244775 - RNA, 24 nt, Human
agugauucuccugccucagccucc

SEQ ID NO: 1244776 - RNA, 18 nt, Human
agugcaguggcaugaucu

SEQ ID NO: 1244777 - RNA, 19 nt, Human
agugcaguggcaugaucuc

SEQ ID NO: 1244778 - RNA, 21 nt, Human
agugcaguggcaugaucuccg

SEQ ID NO: 1244779 - RNA, 22 nt, Human
augacagagaggggcaggguac

SEQ ID NO: 1244780 - RNA, 18 nt, Human
augggguuucaccauguu

SEQ ID NO: 1244781 - RNA, 22 nt, Human
augggguuucaccauguuggcc

SEQ ID NO: 1244782 - RNA, 23 nt, Human
augggguuucaccauguuggcca

SEQ ID NO: 1244783 - RNA, 24 nt, Human
augggguuucaccauguuggccag

SEQ ID NO: 1244784 - RNA, 18 nt, Human
auucuccugccucagccu

SEQ ID NO: 1244785 - RNA, 24 nt, Human
auuuuuguauuuuuaguagagaug

SEQ ID NO: 1244786 - RNA, 26 nt, Human
caaacuccugaccuaaggugauccaa

SEQ ID NO: 1244787 - RNA, 20 nt, Human
caaccuccaccuccugggcu

SEQ ID NO: 1244788 - RNA, 23 nt, Human
caaccuccaccuccugggcucaa

SEQ ID NO: 1244789 - RNA, 24 nt, Human
caaccuccaccuccugggcucaag

SEQ ID NO: 1244790 - RNA, 22 nt, Human
caagauauucuccugccucagc

SEQ ID NO: 1244791 - RNA, 24 nt, Human
caaggugcugagaucacaggugug

SEQ ID NO: 1244792 - RNA, 20 nt, Human
caagugauucuccugccuca

SEQ ID NO: 1244793 - RNA, 22 nt, Human
caagugauucuccugccucagc

SEQ ID NO: 1244794 - RNA, 23 nt, Human
caaugugugccaggacagauagu

SEQ ID NO: 1244795 - RNA, 19 nt, Human
cacagaacucaagggacag

SEQ ID NO: 1244796 - RNA, 19 nt, Human
cacaggugugagccaccac

SEQ ID NO: 1244797 - RNA, 24 nt, Human
caccacaccuggcuaauuuuugua

SEQ ID NO: 1244798 - RNA, 21 nt, Human
caccauguuggccaggcuggu

SEQ ID NO: 1244799 - RNA, 24 nt, Human
caccauguuggccaggcuggucuc

SEQ ID NO: 1244800 - RNA, 27 nt, Human
caccauguuggccaggcuggucucaaa

SEQ ID NO: 1244801 - RNA, 21 nt, Human
cacugcaaccuccaccuccug

SEQ ID NO: 1244802 - RNA, 23 nt, Human
cacugcaaccuccaccuccuggg

SEQ ID NO: 1244803 - RNA, 20 nt, Human
cacuggacauuucgcacccu

SEQ ID NO: 1244804 - RNA, 24 nt, Human
caggugcccaccaccacaccuggc

SEQ ID NO: 1244805 - RNA, 24 nt, Human
cauguuggccaggcuggucucaaa

SEQ ID NO: 1244806 - RNA, 20 nt, Human
cauuguaacacagacaaagc

SEQ ID NO: 1244807 - RNA, 24 nt, Human
ccaccuccugggcucaagugauuc

SEQ ID NO: 1244808 - RNA, 19 nt, Human
cccaggcuggagugcagug

SEQ ID NO: 1244809 - RNA, 22 nt, Human
ccuccaccuccugggcucaagu

SEQ ID NO: 1244810 - RNA, 24 nt, Human
ccucccagguucaagauauucucc

SEQ ID NO: 1244811 - RNA, 24 nt, Human
ccuccugggcucaagugauucucc

SEQ ID NO: 1244812 - RNA, 21 nt, Human
ccugaccuaaggugauccacc

SEQ ID NO: 1244813 - RNA, 23 nt, Human
ccugaccuaaggugauccaccug

SEQ ID NO: 1244814 - RNA, 23 nt, Human
ccugggcucaagugauucuccuc

SEQ ID NO: 1244815 - RNA, 23 nt, Human
ccugggcucaagugauucuccug

SEQ ID NO: 1244816 - RNA, 23 nt, Human
cuaaggugauccaccugccucgg

SEQ ID NO: 1244817 - RNA, 23 nt, Human
cuaauuuuuguauuuuuaguaga

SEQ ID NO: 1244818 - RNA, 23 nt, Human
cucaagugauucuccugccucag

SEQ ID NO: 1244819 - RNA, 24 nt, Human
cucaagugauucuccugccucagc

SEQ ID NO: 1244820 - RNA, 24 nt, Human
cucacugcaaccuccaccuccugg

SEQ ID NO: 1244821 - RNA, 27 nt, Human
cucacugcaaccuccaccuccugggcu

SEQ ID NO: 1244822 - RNA, 20 nt, Human
cuccugggcucaagugauuc

SEQ ID NO: 1244823 - RNA, 21 nt, Human
cuccugggcucaagugauucu

SEQ ID NO: 1244824 - RNA, 21 nt, Human
cucgcaaggugcugagaucac

SEQ ID NO: 1244825 - RNA, 18 nt, Human
cugcaaccuccaccuccu

SEQ ID NO: 1244826 - RNA, 24 nt, Human
cugcaaccuccaccuccugggcuc

SEQ ID NO: 1244827 - RNA, 21 nt, Human
cugccucagccucccgaguaa

SEQ ID NO: 1244828 - RNA, 21 nt, Human
cuggaucuugauauguguuuc

SEQ ID NO: 1244829 - RNA, 24 nt, Human
cuggggagcccaccucccagguuc

SEQ ID NO: 1244830 - RNA, 19 nt, Human
cuuguggagugggggcugu

SEQ ID NO: 1244831 - RNA, 21 nt, Human
cuuguggagugggggcugugu

SEQ ID NO: 1244832 - RNA, 20 nt, Human
cuuuuguauuuuuaguagag

SEQ ID NO: 1244833 - RNA, 19 nt, Human
gacacagaacucaagggac

SEQ ID NO: 1244834 - RNA, 18 nt, Human
gacagauaguucuggggc

SEQ ID NO: 1244835 - RNA, 24 nt, Human
gaccuaaggugauccaccugccuc

SEQ ID NO: 1244836 - RNA, 25 nt, Human
gagaccugggcuugggaggcauccc

SEQ ID NO: 1244837 - RNA, 20 nt, Human
gagaugaguuggaggcuggg

SEQ ID NO: 1244838 - RNA, 18 nt, Human
gagaugggguuucaccau

SEQ ID NO: 1244839 - RNA, 24 nt, Human
gagaugggguuucaccauguuggc

SEQ ID NO: 1244840 - RNA, 20 nt, Human
gaggcugggacagggguccc

SEQ ID NO: 1244841 - RNA, 19 nt, Human
gaguuggaggcugggacag

SEQ ID NO: 1244842 - RNA, 18 nt, Human
gaucacaggugugagcca

SEQ ID NO: 1244843 - RNA, 24 nt, Human
gcaaggugcugagaucacaggugu

SEQ ID NO: 1244844 - RNA, 24 nt, Human
gcccaggcuggagugcaguggcau

SEQ ID NO: 1244845 - RNA, 21 nt, Human
gccugguuuggggaauguucg

SEQ ID NO: 1244846 - RNA, 25 nt, Human
gcuggagugcaguggcaugaucucc

SEQ ID NO: 1244847 - RNA, 22 nt, Human
gcuugggaggcaucccaggugg

SEQ ID NO: 1244848 - RNA, 22 nt, Human
ggacaggaaggagaugaguugg

SEQ ID NO: 1244849 - RNA, 25 nt, Human
ggacaggggucccugccagggaugc

SEQ ID NO: 1244850 - RNA, 20 nt, Human
ggagacagacaagauggggg

SEQ ID NO: 1244851 - RNA, 23 nt, Human
ggagucuuacucuguugcccagg

SEQ ID NO: 1244852 - RNA, 24 nt, Human
gggaggcaucccagguggacagug

SEQ ID NO: 1244853 - RNA, 19 nt, Human
gggcuaggaaggcagguuu

SEQ ID NO: 1244854 - RNA, 22 nt, Human
gggcucaagugauucuccugcc

SEQ ID NO: 1244855 - RNA, 22 nt, Human
gggguuucaccauguuggccag

SEQ ID NO: 1244856 - RNA, 20 nt, Human
gggguuuugcuuuaaagccu

SEQ ID NO: 1244857 - RNA, 22 nt, Human
ggguuucaccauguuggccagg

SEQ ID NO: 1244858 - RNA, 23 nt, Human
guagagaugggguuucaccaugu

SEQ ID NO: 1244859 - RNA, 19 nt, Human
gugauccaccugccucggc

SEQ ID NO: 1244860 - RNA, 22 nt, Human
gugauccaccugccucggccuc

SEQ ID NO: 1244861 - RNA, 24 nt, Human
gugauucuccugccucagccuccc

SEQ ID NO: 1244862 - RNA, 21 nt, Human
gugcugagaucacagguguga

SEQ ID NO: 1244863 - RNA, 21 nt, Human
gugugagccaccacgcugggc

SEQ ID NO: 1244864 - RNA, 22 nt, Human
uaacuuuuguauuuuuaguaga

SEQ ID NO: 1244865 - RNA, 24 nt, Human
uaauuuuuguauuuuuaguagaga

SEQ ID NO: 1244866 - RNA, 22 nt, Human
uacaggugcccaccaccacacc

SEQ ID NO: 1244867 - RNA, 22 nt, Human
uagagaugggguuucaccaugu

SEQ ID NO: 1244868 - RNA, 25 nt, Human
uaggaaggcagguuugggcuggaga

SEQ ID NO: 1244869 - RNA, 24 nt, Human
uaguagagaugggguuucaccaug

SEQ ID NO: 1244870 - RNA, 26 nt, Human
uaguagagaugggguuucaccauguu

SEQ ID NO: 1244871 - RNA, 19 nt, Human
uauguguuucucaguugga

SEQ ID NO: 1244872 - RNA, 19 nt, Human
uauucuccugccucagccu

SEQ ID NO: 1244873 - RNA, 23 nt, Human
ucacugcaaccuccaccuccugg

SEQ ID NO: 1244874 - RNA, 24 nt, Human
ucacugcaaccuccaccuccuggg

SEQ ID NO: 1244875 - RNA, 25 nt, Human
ucacugcaaccuccaccuccugggc

SEQ ID NO: 1244876 - RNA, 27 nt, Human
ucacugcaaccuccaccuccugggcuc

SEQ ID NO: 1244877 - RNA, 22 nt, Human
uccaaagaagcaagucuuacua

SEQ ID NO: 1244878 - RNA, 19 nt, Human
uccaaaggaccgacggacc

SEQ ID NO: 1244879 - RNA, 20 nt, Human
uccaaaggaccgacggaccu

SEQ ID NO: 1244880 - RNA, 24 nt, Human
ucccagguggacagugguugaggu

SEQ ID NO: 1244881 - RNA, 21 nt, Human
ucccagguucaagauauucuc

SEQ ID NO: 1244882 - RNA, 24 nt, Human
ucccagguucaagauauucuccug

SEQ ID NO: 1244883 - RNA, 23 nt, Human
ucccgaguaagugggauuacagg

SEQ ID NO: 1244884 - RNA, 24 nt, Human
ucccgaguaagugggauuacaggu

SEQ ID NO: 1244885 - RNA, 21 nt, Human
uccugggcucaagugauucuc

SEQ ID NO: 1244886 - RNA, 22 nt, Human
uccugggcucaagugauucucc

SEQ ID NO: 1244887 - RNA, 22 nt, Human
uccugggcucaagugauucucc

SEQ ID NO: 1244888 - RNA, 24 nt, Human
uccugggcucaagugauucuccug

SEQ ID NO: 1244889 - RNA, 24 nt, Human
ucgcaaggugcugagaucacaggu

SEQ ID NO: 1244890 - RNA, 22 nt, Human
ucuagacuccauccuccauucc

SEQ ID NO: 1244891 - RNA, 19 nt, Human
ucuccugccucagccuccc

SEQ ID NO: 1244892 - RNA, 25 nt, Human
ucuccugccucagccucccaaguaa

SEQ ID NO: 1244893 - RNA, 18 nt, Human
ucuguugcccaggcugga

SEQ ID NO: 1244894 - RNA, 24 nt, Human
ucuguugcccaggcuggagugcag

SEQ ID NO: 1244895 - RNA, 23 nt, Human
ucuuacucuguugcccaggcugg

SEQ ID NO: 1244896 - RNA, 24 nt, Human
ucuuacucuguugcccaggcugga

SEQ ID NO: 1244897 - RNA, 19 nt, Human
ugacacagaacucaaggga

SEQ ID NO: 1244898 - RNA, 18 nt, Human
ugacagagaggggcaggg

SEQ ID NO: 1244899 - RNA, 22 nt, Human
ugaccgugauugccugggauga

SEQ ID NO: 1244900 - RNA, 24 nt, Human
ugaccuaaggugauccaccugccu

SEQ ID NO: 1244901 - RNA, 22 nt, Human
ugagaucacaggugugagccac

SEQ ID NO: 1244902 - RNA, 24 nt, Human
ugagaucacaggugugagccacca

SEQ ID NO: 1244903 - RNA, 23 nt, Human
ugaucuccgcucacugcaaccuc

SEQ ID NO: 1244904 - RNA, 19 nt, Human
ugccaggacagauaguucu

SEQ ID NO: 1244905 - RNA, 21 nt, Human
ugccaggacagauaguucugg

SEQ ID NO: 1244906 - RNA, 18 nt, Human
ugcccaggcuggagugca

SEQ ID NO: 1244907 - RNA, 22 nt, Human
ugcccaggcuggagugcagugg

SEQ ID NO: 1244908 - RNA, 24 nt, Human
ugcccaggcuggagugcaguggca

SEQ ID NO: 1244909 - RNA, 21 nt, Human
ugcccugggcuuuaauuauuu

SEQ ID NO: 1244910 - RNA, 24 nt, Human
ugccucagccucccaaguaacugg

SEQ ID NO: 1244911 - RNA, 24 nt, Human
ugccucagccucccgaguaagugg

SEQ ID NO: 1244912 - RNA, 22 nt, Human
ugccugggaugagaguggagac

SEQ ID NO: 1244913 - RNA, 21 nt, Human
ugccugguuuggggaauguuc

SEQ ID NO: 1244914 - RNA, 24 nt, Human
ugcugagaucacaggugugagcca

SEQ ID NO: 1244915 - RNA, 22 nt, Human
uggaaaggacaggaaguugaug

SEQ ID NO: 1244916 - RNA, 24 nt, Human
uggagucuuacucuguugcccagg

SEQ ID NO: 1244917 - RNA, 19 nt, Human
uggagugcaguggcaugau

SEQ ID NO: 1244918 - RNA, 22 nt, Human
uggagugcaguggcaugaucuc

SEQ ID NO: 1244919 - RNA, 23 nt, Human
uggagugcaguggcaugaucucc

SEQ ID NO: 1244920 - RNA, 24 nt, Human
uggagugcaguggcaugaucuccg

SEQ ID NO: 1244921 - RNA, 24 nt, Human
uggccaggcuggucucaaacuccu

SEQ ID NO: 1244922 - RNA, 24 nt, Human
ugggaaugcaggugcgugccacca

SEQ ID NO: 1244923 - RNA, 20 nt, Human
ugggaugagaguggagacag

SEQ ID NO: 1244924 - RNA, 21 nt, Human
ugggauuacaggugcccacca

SEQ ID NO: 1244925 - RNA, 24 nt, Human
ugggauuacaggugcccaccacca

SEQ ID NO: 1244926 - RNA, 18 nt, Human
ugggcucaagugauucuc

SEQ ID NO: 1244927 - RNA, 24 nt, Human
ugggcucaagugauucuccugccu

SEQ ID NO: 1244928 - RNA, 20 nt, Human
ugggcuggagaccugggcuu

SEQ ID NO: 1244929 - RNA, 24 nt, Human
ugggguuucaccauguuggccagg

SEQ ID NO: 1244930 - RNA, 21 nt, Human
uguauuuuuaguagagauggg

SEQ ID NO: 1244931 - RNA, 18 nt, Human
ugucuggaaaggacagga

SEQ ID NO: 1244932 - RNA, 24 nt, Human
ugucuggaaaggacaggaaguuga

SEQ ID NO: 1244933 - RNA, 22 nt, Human
ugugacacagaacucaagggac

SEQ ID NO: 1244934 - RNA, 24 nt, Human
uuacucuguugcccaggcuggagu

SEQ ID NO: 1244935 - RNA, 18 nt, Human
uuaguagagaugggguuu

SEQ ID NO: 1244936 - RNA, 22 nt, Human
uuaguagagaugggguuucacc

SEQ ID NO: 1244937 - RNA, 24 nt, Human
uuaguagagaugggguuucaccau

SEQ ID NO: 1244938 - RNA, 21 nt, Human
uucaagauauucuccugccuc

SEQ ID NO: 1244939 - RNA, 19 nt, Human
uuccaaagaagcaagucuu

SEQ ID NO: 1244940 - RNA, 19 nt, Human
uugauauguguuucucagu

SEQ ID NO: 1244941 - RNA, 24 nt, Human
uugcccaggcuggagugcaguggc

SEQ ID NO: 1244942 - RNA, 20 nt, Human
uuggaggcugggacaggggu

SEQ ID NO: 1244943 - RNA, 21 nt, Human
uugggaggcaucccaggugga

SEQ ID NO: 1244944 - RNA, 22 nt, Human
uuuaaagauggagucuuacucu

SEQ ID NO: 1244945 - RNA, 24 nt, Human
uuuaaagccuggggagcccaccuc

SEQ ID NO: 1244946 - RNA, 24 nt, Human
uuucaccauguuggccaggcuggu

SEQ ID NO: 1244947 - RNA, 22 nt, Human
uuugcuuuaaagccuggggagc

SEQ ID NO: 1244948 - RNA, 24 nt, Human
uuuuuaguagagaugggguuucac

SEQ ID NO: 1244949 - RNA, 20 nt, Human
uuuuuguauuuuuaguagag

SEQ ID NO: 1244950 - RNA, 19 nt, Human
aaacaaagucuaacccaag

SEQ ID NO: 1244951 - RNA, 18 nt, Human
aaacagaaaaaaugguac

SEQ ID NO: 1244952 - RNA, 26 nt, Human
aaacagaaaaaaugguacacacuuua

SEQ ID NO: 1244953 - RNA, 26 nt, Human
aaacagguaaauuaacaggaaaacca

SEQ ID NO: 1244954 - RNA, 20 nt, Human
aacaaaaucuucaacuauga

SEQ ID NO: 1244955 - RNA, 21 nt, Human
aacuuacuuauaaaaacagaa

SEQ ID NO: 1244956 - RNA, 23 nt, Human
aagaacaaguaauauacauguac

SEQ ID NO: 1244957 - RNA, 19 nt, Human
aauagcuauacuacacuaa

SEQ ID NO: 1244958 - RNA, 21 nt, Human
acacauuauaaagucaaacag

SEQ ID NO: 1244959 - RNA, 19 nt, Human
acaguguaaaagaaaaaaa

SEQ ID NO: 1244960 - RNA, 22 nt, Human
acuaaaacacauuauaaaguca

SEQ ID NO: 1244961 - RNA, 21 nt, Human
acuacacuaagaugcuaaaca

SEQ ID NO: 1244962 - RNA, 18 nt, Human
agaaaaagucagcaaaua

SEQ ID NO: 1244963 - RNA, 23 nt, Human
agaaagaagaaauauugccaaga

SEQ ID NO: 1244964 - RNA, 19 nt, Human
aggaaaaccaaacugaucu

SEQ ID NO: 1244965 - RNA, 21 nt, Human
aggucuuucuacgggugccug

SEQ ID NO: 1244966 - RNA, 18 nt, Human
aguugguaccagugggcc

SEQ ID NO: 1244967 - RNA, 27 nt, Human
auaaagucuuguuuccaaaaaucuauu

SEQ ID NO: 1244968 - RNA, 19 nt, Human
auauuugguaaaccuaaaa

SEQ ID NO: 1244969 - RNA, 26 nt, Human
augcaauaagaaauuggaaaaaggga

SEQ ID NO: 1244970 - RNA, 25 nt, Human
auggaucacuuaaaagugagauuau

SEQ ID NO: 1244971 - RNA, 19 nt, Human
caaaaacaaagucuaaccc

SEQ ID NO: 1244972 - RNA, 19 nt, Human
caaaaacaaagucuaaccc

SEQ ID NO: 1244973 - RNA, 19 nt, Human
caaccgcacagaaucagaa

SEQ ID NO: 1244974 - RNA, 20 nt, Human
caacuaugaacugacaaaau

SEQ ID NO: 1244975 - RNA, 20 nt, Human
caaguaauauacauguacaa

SEQ ID NO: 1244976 - RNA, 25 nt, Human
cacuucaaccgcacagaaucagaag

SEQ ID NO: 1244977 - RNA, 24 nt, Human
cacuuuaacaaaagcaaaacuuaa

SEQ ID NO: 1244978 - RNA, 21 nt, Human
cauauuugguaaaccuaaaau

SEQ ID NO: 1244979 - RNA, 20 nt, Human
cauuuuagauaagcugguca

SEQ ID NO: 1244980 - RNA, 18 nt, Human
cccaaguugcuuuaaaaa

SEQ ID NO: 1244981 - RNA, 18 nt, Human
ccuacacuucaaccgcac

SEQ ID NO: 1244982 - RNA, 22 nt, Human
ccuuucuguugcuuacauugcc

SEQ ID NO: 1244983 - RNA, 22 nt, Human
cgaaucaaaaucuagucaugaa

SEQ ID NO: 1244984 - RNA, 19 nt, Human
cuccaaacagaaaaaaugg

SEQ ID NO: 1244985 - RNA, 24 nt, Human
cucccuacacuucaaccgcacaga

SEQ ID NO: 1244986 - RNA, 19 nt, Human
cuuaacacggacauuuaaa

SEQ ID NO: 1244987 - RNA, 23 nt, Human
uaaagcuaguuacaaaauccguu

SEQ ID NO: 1244988 - RNA, 18 nt, Human
uaacagagaguaacagaa

SEQ ID NO: 1244989 - RNA, 20 nt, Human
uaagaaagaagaaauauugc

SEQ ID NO: 1244990 - RNA, 18 nt, Human
uaagaaauuggaaaaagg

SEQ ID NO: 1244991 - RNA, 22 nt, Human
uacaugccaauauggaaaaaaa

SEQ ID NO: 1244992 - RNA, 19 nt, Human
uacauguacaagaaauuac

SEQ ID NO: 1244993 - RNA, 23 nt, Human
uacauguacaagaaauuacaaga

SEQ ID NO: 1244994 - RNA, 22 nt, Human
uaggucaaaaacaaagucuaac

SEQ ID NO: 1244995 - RNA, 23 nt, Human
uagugggaaguuuucaucuuugc

SEQ ID NO: 1244996 - RNA, 24 nt, Human
ucaaaaacaaagucuaacccaagu

SEQ ID NO: 1244997 - RNA, 24 nt, Human
uccaaacagaaaaaaugguacaca

SEQ ID NO: 1244998 - RNA, 21 nt, Human
uccacauggaaagaccacagc

SEQ ID NO: 1244999 - RNA, 21 nt, Human
ucccuacugaucugaaacuac

SEQ ID NO: 1245000 - RNA, 23 nt, Human
ucccuacugaucugaaacuacag

SEQ ID NO: 1245001 - RNA, 23 nt, Human
uccuuggucaguauagauuuccg

SEQ ID NO: 1245002 - RNA, 22 nt, Human
ucuccacauggaaagaccacag

SEQ ID NO: 1245003 - RNA, 23 nt, Human
ucuuucuucuuuucgucaagguc

SEQ ID NO: 1245004 - RNA, 20 nt, Human
ugcaaaacuaaaacacauua

SEQ ID NO: 1245005 - RNA, 19 nt, Human
ugccucagggcuguucugc

SEQ ID NO: 1245006 - RNA, 23 nt, Human
ugcgauguaauugcagguucuuu

SEQ ID NO: 1245007 - RNA, 25 nt, Human
uggaaaaagggagcaaaggagagug

SEQ ID NO: 1245008 - RNA, 23 nt, Human
ugucucauccuuucuguugcuua

SEQ ID NO: 1245009 - RNA, 19 nt, Human
uucaucuuugccuaugagg

SEQ ID NO: 1245010 - RNA, 20 nt, Human
uucaucuuugccuaugaggg

SEQ ID NO: 1245011 - RNA, 20 nt, Human
uuuaaaauggaucacuuaaa

SEQ ID NO: 1245012 - RNA, 24 nt, Human
uuuccaaaaaucuauuaagaacaa

SEQ ID NO: 1245013 - RNA, 19 nt, Human
uuugucucauccuuucugu

SEQ ID NO: 1245014 - RNA, 22 nt, Human
aaugcucucccucccucuaccc

SEQ ID NO: 1245015 - RNA, 21 nt, Human
accacauuugcuuuauccagu

SEQ ID NO: 1245016 - RNA, 18 nt, Human
acccacugccaggcccca

SEQ ID NO: 1245017 - RNA, 21 nt, Human
auacaaaccacgugauauaac

SEQ ID NO: 1245018 - RNA, 19 nt, Human
aucaacccaucaccugggu

SEQ ID NO: 1245019 - RNA, 21 nt, Human
auggcugcauaguauuccaug

SEQ ID NO: 1245020 - RNA, 21 nt, Human
caacccaucaccuggguguua

SEQ ID NO: 1245021 - RNA, 21 nt, Human
cagaggacuguugcuuuuuau

SEQ ID NO: 1245022 - RNA, 18 nt, Human
cauaugcaggaugugcag

SEQ ID NO: 1245023 - RNA, 21 nt, Human
cauuuggguugauaaccaucc

SEQ ID NO: 1245024 - RNA, 21 nt, Human
ccaguguguguuguuccccuc

SEQ ID NO: 1245025 - RNA, 19 nt, Human
ccaugucccugcagaggac

SEQ ID NO: 1245026 - RNA, 18 nt, Human
cccacuuauaagugagaa

SEQ ID NO: 1245027 - RNA, 18 nt, Human
cucuacccuacccacugc

SEQ ID NO: 1245028 - RNA, 18 nt, Human
cugaggauaaugguuucc

SEQ ID NO: 1245029 - RNA, 27 nt, Human
cugcaccuaucaaucaacccaucaccu

SEQ ID NO: 1245030 - RNA, 26 nt, Human
cuuuacucuggaccugcaaacccucc

SEQ ID NO: 1245031 - RNA, 18 nt, Human
gccaggccccagugugug

SEQ ID NO: 1245032 - RNA, 19 nt, Human
ggcugcauaguauuccaug

SEQ ID NO: 1245033 - RNA, 24 nt, Human
gguugauaaccauccauuuuucuu

SEQ ID NO: 1245034 - RNA, 19 nt, Human
guaaaugugugccaugaug

SEQ ID NO: 1245035 - RNA, 20 nt, Human
uaagaaaaagauccaaaaac

SEQ ID NO: 1245036 - RNA, 24 nt, Human
uaagcccagcaugcauuagcuauu

SEQ ID NO: 1245037 - RNA, 24 nt, Human
uaagugagaacaugcaguauuugg

SEQ ID NO: 1245038 - RNA, 20 nt, Human
uagcuauuuuugcuaaugcu

SEQ ID NO: 1245039 - RNA, 20 nt, Human
uagguaaaugugugccauga

SEQ ID NO: 1245040 - RNA, 24 nt, Human
uaguuugcugaggauaaugguuuc

SEQ ID NO: 1245041 - RNA, 21 nt, Human
uccaaaaacuucuugccaugu

SEQ ID NO: 1245042 - RNA, 19 nt, Human
ucccuauguucauguguuc

SEQ ID NO: 1245043 - RNA, 20 nt, Human
ucccucuacccuacccacug

SEQ ID NO: 1245044 - RNA, 22 nt, Human
ucccugcagaggacuguugcuu

SEQ ID NO: 1245045 - RNA, 18 nt, Human
uccugcguuaguuugcug

SEQ ID NO: 1245046 - RNA, 19 nt, Human
ucucccucccucuacccua

SEQ ID NO: 1245047 - RNA, 20 nt, Human
ugaggauaaugguuuccagc

SEQ ID NO: 1245048 - RNA, 21 nt, Human
ugaggauaaugguuuccagcu

SEQ ID NO: 1245049 - RNA, 24 nt, Human
ugaggauaaugguuuccagcucca

SEQ ID NO: 1245050 - RNA, 20 nt, Human
uguauauguaccacauuugc

SEQ ID NO: 1245051 - RNA, 24 nt, Human
ugucccugcagaggacuguugcuu

SEQ ID NO: 1245052 - RNA, 21 nt, Human
uuauaagugagaacaugcagu

SEQ ID NO: 1245053 - RNA, 24 nt, Human
uuauaagugagaacaugcaguauu

SEQ ID NO: 1245054 - RNA, 23 nt, Human
uucagugacuuuacucuggaccu

SEQ ID NO: 1245055 - RNA, 25 nt, Human
uuccaugguguauauguaccacauu

SEQ ID NO: 1245056 - RNA, 21 nt, Human
uuccuuccucgcuuccacucu

SEQ ID NO: 1245057 - RNA, 22 nt, Human
uuuccagcuccauccauguccc

SEQ ID NO: 1245058 - RNA, 20 nt, Human
uuuuauggcugcauaguauu

SEQ ID NO: 1245059 - RNA, 22 nt, Human
aaacaaaaagcaaacaaacgca

SEQ ID NO: 1245060 - RNA, 23 nt, Human
acuccagcaauacaacauacauc

SEQ ID NO: 1245061 - RNA, 19 nt, Human
augaagacagauauaggga

SEQ ID NO: 1245062 - RNA, 23 nt, Human
augaagacagauauagggauuac

SEQ ID NO: 1245063 - RNA, 26 nt, Human
caaaaagcaaacaaacgcauuuuuua

SEQ ID NO: 1245064 - RNA, 21 nt, Human
caaaguuaauugaauguggua

SEQ ID NO: 1245065 - RNA, 21 nt, Human
cagccuccaagacggucccaa

SEQ ID NO: 1245066 - RNA, 24 nt, Human
caucaaauaaggcagucagacuuc

SEQ ID NO: 1245067 - RNA, 24 nt, Human
uauaaacaaaaagcaaacaaacgc

SEQ ID NO: 1245068 - RNA, 25 nt, Human
uauaaacaaaaagcaaacaaacgca

SEQ ID NO: 1245069 - RNA, 19 nt, Human
uaugaagacagauauaggg

SEQ ID NO: 1245070 - RNA, 22 nt, Human
uauguuuacaugagaaaguauc

SEQ ID NO: 1245071 - RNA, 18 nt, Human
ucaaaagauacauuugag

SEQ ID NO: 1245072 - RNA, 21 nt, Human
ucaaaagauacauuugaguag

SEQ ID NO: 1245073 - RNA, 22 nt, Human
ucauauauaaauaaaagcuaua

SEQ ID NO: 1245074 - RNA, 23 nt, Human
ugaagacagauauagggauuaca

SEQ ID NO: 1245075 - RNA, 22 nt, Human
uggcauuaaaauguauuuugca

SEQ ID NO: 1245076 - RNA, 18 nt, Human
uuuacaugagaaaguauc

SEQ ID NO: 1245077 - RNA, 23 nt, Human
uuucauggcauuaaaauguauuu

SEQ ID NO: 1245078 - RNA, 19 nt, Human
acacagaaacauccuucuc

SEQ ID NO: 1245079 - RNA, 19 nt, Human
acagaaacauccuucucau

SEQ ID NO: 1245080 - RNA, 21 nt, Human
agaacaauauaaucaagaaca

SEQ ID NO: 1245081 - RNA, 21 nt, Human
cacugugucgguucacucuuc

SEQ ID NO: 1245082 - RNA, 19 nt, Human
uaagaaaacuguucauggc

SEQ ID NO: 1245083 - RNA, 25 nt, Human
uagaaagauaagauacauaaccaca

SEQ ID NO: 1245084 - RNA, 26 nt, Human
ucaagaacacagaaacauccuucuca

SEQ ID NO: 1245085 - RNA, 20 nt, Human
ucucuauaaccacacuccuu

SEQ ID NO: 1245086 - RNA, 19 nt, Human
ugguuuuuauacuuuuaaa

SEQ ID NO: 1245087 - RNA, 18 nt, Human
uucaucaucuucuagacc

SEQ ID NO: 1245088 - RNA, 18 nt, Human
aaacuaacacguccacug

SEQ ID NO: 1245089 - RNA, 20 nt, Human
aaaggaaaauaaagaacaau

SEQ ID NO: 1245090 - RNA, 24 nt, Human
aagaaaaugaggagaaccgguacc

SEQ ID NO: 1245091 - RNA, 19 nt, Human
aagaagccagagcaauuac

SEQ ID NO: 1245092 - RNA, 24 nt, Human
aagaagccagagcaauuacugaaa

SEQ ID NO: 1245093 - RNA, 23 nt, Human
cuuuuguguaugucagagagagg

SEQ ID NO: 1245094 - RNA, 24 nt, Human
gaaagaagaauuucaugaagaaaa

SEQ ID NO: 1245095 - RNA, 24 nt, Human
uaacuuaugaaaacuucuucgcuc

SEQ ID NO: 1245096 - RNA, 23 nt, Human
uacagcuuuuguguaugucagag

SEQ ID NO: 1245097 - RNA, 23 nt, Human
uaugaaaacuucuucgcucauuu

SEQ ID NO: 1245098 - RNA, 21 nt, Human
ucagagagaggaauccaugcu

SEQ ID NO: 1245099 - RNA, 19 nt, Human
ucuugauguuaacuugugg

SEQ ID NO: 1245100 - RNA, 25 nt, Human
ugaaagaagaauuucaugaagaaaa

SEQ ID NO: 1245101 - RNA, 21 nt, Human
ugagugccaucuagaaguuuu

SEQ ID NO: 1245102 - RNA, 22 nt, Human
ugaugagugccaucuagaaguu

SEQ ID NO: 1245103 - RNA, 19 nt, Human
uggcggacauuuuuuguua

SEQ ID NO: 1245104 - RNA, 19 nt, Human
uguagaaggaaagaagcca

SEQ ID NO: 1245105 - RNA, 23 nt, Human
uguaguuguagaaggaaagaagc

SEQ ID NO: 1245106 - RNA, 20 nt, Human
uuucuugauguuaacuugug

SEQ ID NO: 1245107 - RNA, 19 nt, Human
aaaaaaaucauccaaucca

SEQ ID NO: 1245108 - RNA, 20 nt, Human
aaaaacacaaaaaaauaucc

SEQ ID NO: 1245109 - RNA, 21 nt, Human
aaaaacacaaaaaaauaucca

SEQ ID NO: 1245110 - RNA, 20 nt, Human
aaaaauugagagaauucuga

SEQ ID NO: 1245111 - RNA, 19 nt, Human
aaaaccacaaccacaagcg

SEQ ID NO: 1245112 - RNA, 18 nt, Human
aaacacaaaaaaauaucc

SEQ ID NO: 1245113 - RNA, 22 nt, Human
aaacugaggaccaggcaaagaa

SEQ ID NO: 1245114 - RNA, 18 nt, Human
aaagcaaucaauccacaa

SEQ ID NO: 1245115 - RNA, 21 nt, Human
aaaggcuaggucuugggggcu

SEQ ID NO: 1245116 - RNA, 21 nt, Human
aaauaaguccucaagucaaac

SEQ ID NO: 1245117 - RNA, 20 nt, Human
aacaucagaacaagcagcag

SEQ ID NO: 1245118 - RNA, 19 nt, Human
aacauggcgaaaccccauc

SEQ ID NO: 1245119 - RNA, 20 nt, Human
aacauggcgaaaccccaucu

SEQ ID NO: 1245120 - RNA, 20 nt, Human
aacauggcgaaaccccaucu

SEQ ID NO: 1245121 - RNA, 21 nt, Human
aacauggcgaaaccccaucuc

SEQ ID NO: 1245122 - RNA, 21 nt, Human
aaccacaagcgugcaugccug

SEQ ID NO: 1245123 - RNA, 19 nt, Human
aacuggcauauacacagga

SEQ ID NO: 1245124 - RNA, 20 nt, Human
aacuuggaagcagcagauca

SEQ ID NO: 1245125 - RNA, 23 nt, Human
aagcagccuuuccaggggcuggu

SEQ ID NO: 1245126 - RNA, 26 nt, Human
aagccucugagcucuucaaagaauuc

SEQ ID NO: 1245127 - RNA, 19 nt, Human
aaggcaaugccacauagag

SEQ ID NO: 1245128 - RNA, 23 nt, Human
aaguggcagaucagguccagaac

SEQ ID NO: 1245129 - RNA, 23 nt, Human
aauccacaagauuuuuuuuuccu

SEQ ID NO: 1245130 - RNA, 24 nt, Human
acaggaucaaucuuucucaaauau

SEQ ID NO: 1245131 - RNA, 24 nt, Human
acauaccacugcuuuucacaaaau

SEQ ID NO: 1245132 - RNA, 23 nt, Human
acaucacaggccccuuuuggagu

SEQ ID NO: 1245133 - RNA, 24 nt, Human
accccaucucuacuaaaaacacaa

SEQ ID NO: 1245134 - RNA, 25 nt, Human
accccgaggagccgcccgccggagg

SEQ ID NO: 1245135 - RNA, 24 nt, Human
accugaggucaggaguucaagacc

SEQ ID NO: 1245136 - RNA, 18 nt, Human
acugcacuccagccuggg

SEQ ID NO: 1245137 - RNA, 24 nt, Human
acugcacuccagccugggugacag

SEQ ID NO: 1245138 - RNA, 23 nt, Human
agaaaaacuggcauauacacagg

SEQ ID NO: 1245139 - RNA, 18 nt, Human
agacaacacguacacaua

SEQ ID NO: 1245140 - RNA, 25 nt, Human
agaucacuuggaagccucugagcuc

SEQ ID NO: 1245141 - RNA, 18 nt, Human
agcagcagaucaggaaga

SEQ ID NO: 1245142 - RNA, 21 nt, Human
agcccgaggcggguggaucac

SEQ ID NO: 1245143 - RNA, 21 nt, Human
agccucugggcaccgcagccc

SEQ ID NO: 1245144 - RNA, 22 nt, Human
agccucugggcaccgcagcccc

SEQ ID NO: 1245145 - RNA, 24 nt, Human
agccugggugacagugcaagacuc

SEQ ID NO: 1245146 - RNA, 19 nt, Human
agcuagaaaaacuggcaua

SEQ ID NO: 1245147 - RNA, 24 nt, Human
agcuuggccaacauggcgaaaccc

SEQ ID NO: 1245148 - RNA, 25 nt, Human
aggaggcagagagcagcaggguugg

SEQ ID NO: 1245149 - RNA, 24 nt, Human
aggaguaguggugcacaccuguag

SEQ ID NO: 1245150 - RNA, 18 nt, Human
aggcaugagaaucacuug

SEQ ID NO: 1245151 - RNA, 22 nt, Human
aggcggguggaucaccugaggu

SEQ ID NO: 1245152 - RNA, 26 nt, Human
aggcggguggaucaccugaggucagg

SEQ ID NO: 1245153 - RNA, 24 nt, Human
aggcugaggcaugagaaucacuug

SEQ ID NO: 1245154 - RNA, 23 nt, Human
agguggcggggguugcagugagc

SEQ ID NO: 1245155 - RNA, 19 nt, Human
aguggcugaucacacuuca

SEQ ID NO: 1245156 - RNA, 24 nt, Human
aguggugcacaccuguagucccag

SEQ ID NO: 1245157 - RNA, 23 nt, Human
aucaccugaggucaggaguucaa

SEQ ID NO: 1245158 - RNA, 19 nt, Human
aucagguccagaacccagg

SEQ ID NO: 1245159 - RNA, 24 nt, Human
aucgcgccacugcacuccagccug

SEQ ID NO: 1245160 - RNA, 23 nt, Human
caaagaaagcaacuugccaaaaa

SEQ ID NO: 1245161 - RNA, 21 nt, Human
caaagcaaucaauccacaaga

SEQ ID NO: 1245162 - RNA, 21 nt, Human
caaagcagccuuuccaggggc

SEQ ID NO: 1245163 - RNA, 22 nt, Human
caacaccccaguggcugacauc

SEQ ID NO: 1245164 - RNA, 24 nt, Human
caagaucgcgccacugcacuccag

SEQ ID NO: 1245165 - RNA, 18 nt, Human
caagggcuaugagggggc

SEQ ID NO: 1245166 - RNA, 21 nt, Human
caauaccauaaaacaucagaa

SEQ ID NO: 1245167 - RNA, 22 nt, Human
cacaaaaaaauauccaggagua

SEQ ID NO: 1245168 - RNA, 22 nt, Human
cacacagaaagugaauggucag

SEQ ID NO: 1245169 - RNA, 24 nt, Human
cacaccuguagucccagcuacuug

SEQ ID NO: 1245170 - RNA, 18 nt, Human
cacauaccacugcuuuuc

SEQ ID NO: 1245171 - RNA, 25 nt, Human
cacauaccacugcuuuucacaaaau

SEQ ID NO: 1245172 - RNA, 21 nt, Human
caccccaguggcugacaucac

SEQ ID NO: 1245173 - RNA, 23 nt, Human
caccugaggucaggaguucaaga

SEQ ID NO: 1245174 - RNA, 22 nt, Human
caccuggggcuccccauuggcc

SEQ ID NO: 1245175 - RNA, 23 nt, Human
caccuguagucccagcuacuugg

SEQ ID NO: 1245176 - RNA, 24 nt, Human
caccuguagucccagcuacuuggg

SEQ ID NO: 1245177 - RNA, 24 nt, Human
cacgucuguaaucccagcacuuug

SEQ ID NO: 1245178 - RNA, 20 nt, Human
cacuccagccugggugacag

SEQ ID NO: 1245179 - RNA, 21 nt, Human
cacuccagccugggugacagu

SEQ ID NO: 1245180 - RNA, 22 nt, Human
cacuccagccugggugacagug

SEQ ID NO: 1245181 - RNA, 19 nt, Human
cacugcacuccagccuggg

SEQ ID NO: 1245182 - RNA, 19 nt, Human
cacugcacuccagccuggg

SEQ ID NO: 1245183 - RNA, 22 nt, Human
cacugcacuccagccuggguga

SEQ ID NO: 1245184 - RNA, 23 nt, Human
cacugcacuccagccugggugac

SEQ ID NO: 1245185 - RNA, 24 nt, Human
cacugcacuccagccugggugaca

SEQ ID NO: 1245186 - RNA, 24 nt, Human
cacugcacuccagccugggugaca

SEQ ID NO: 1245187 - RNA, 24 nt, Human
cagaacccagguccacagcaaugu

SEQ ID NO: 1245188 - RNA, 24 nt, Human
cagcacuuugggagcccgaggcgg

SEQ ID NO: 1245189 - RNA, 19 nt, Human
cagccucugggcaccgcag

SEQ ID NO: 1245190 - RNA, 24 nt, Human
cagcuuggccaacauggcgaaacc

SEQ ID NO: 1245191 - RNA, 26 nt, Human
cauauacacaggaaaacagaaucagu

SEQ ID NO: 1245192 - RNA, 23 nt, Human
caucaucugaggccaaguuuugg

SEQ ID NO: 1245193 - RNA, 21 nt, Human
cauuggccaucuugggcuccu

SEQ ID NO: 1245194 - RNA, 23 nt, Human
ccaaaaucgcagacaaaggcuag

SEQ ID NO: 1245195 - RNA, 20 nt, Human
ccacugcacuccagccuggg

SEQ ID NO: 1245196 - RNA, 20 nt, Human
ccacugcacuccagccuggg

SEQ ID NO: 1245197 - RNA, 20 nt, Human
ccacugcacuccagccuggg

SEQ ID NO: 1245198 - RNA, 21 nt, Human
ccacugcacuccagccugggu

SEQ ID NO: 1245199 - RNA, 21 nt, Human
ccacugcacuccagccugggu

SEQ ID NO: 1245200 - RNA, 23 nt, Human
ccacugcacuccagccuggguga

SEQ ID NO: 1245201 - RNA, 23 nt, Human
ccacugcacuccagccuggguga

SEQ ID NO: 1245202 - RNA, 24 nt, Human
ccacugcacuccagccugggugac

SEQ ID NO: 1245203 - RNA, 20 nt, Human
ccagaacccagguccacagc

SEQ ID NO: 1245204 - RNA, 23 nt, Human
ccagaugcuucucuccucaccug

SEQ ID NO: 1245205 - RNA, 20 nt, Human
cccagcacgccucccgcgcc

SEQ ID NO: 1245206 - RNA, 18 nt, Human
cccccagaugcuucucuc

SEQ ID NO: 1245207 - RNA, 21 nt, Human
cccccgcccggccggccccgc

SEQ ID NO: 1245208 - RNA, 21 nt, Human
ccccgcgcccagcacgccucc

SEQ ID NO: 1245209 - RNA, 25 nt, Human
ccccgcucggucgcccaaccccgag

SEQ ID NO: 1245210 - RNA, 21 nt, Human
ccccuaaugccgcagccucug

SEQ ID NO: 1245211 - RNA, 18 nt, Human
cccgcgccgccgccgccg

SEQ ID NO: 1245212 - RNA, 21 nt, Human
cccgcgccgccgccgccgccg

SEQ ID NO: 1245213 - RNA, 18 nt, Human
cccgcgccgcgcugcgcc

SEQ ID NO: 1245214 - RNA, 20 nt, Human
cccuaaugccgcagccucug

SEQ ID NO: 1245215 - RNA, 20 nt, Human
ccgcccgccggacucgcuuu

SEQ ID NO: 1245216 - RNA, 27 nt, Human
ccgcccgcgccgccgccgccgccgccg

SEQ ID NO: 1245217 - RNA, 20 nt, Human
ccgcccggccggccccgcuc

SEQ ID NO: 1245218 - RNA, 23 nt, Human
ccgccgccgccgccgccaccccg

SEQ ID NO: 1245219 - RNA, 24 nt, Human
ccgccgccgccgccgccaccccgg

SEQ ID NO: 1245220 - RNA, 18 nt, Human
ccgccgccgccgccgccg

SEQ ID NO: 1245221 - RNA, 18 nt, Human
ccgccgccgccgccgccg

SEQ ID NO: 1245222 - RNA, 23 nt, Human
ccgccuucacgggcccgcccccc

SEQ ID NO: 1245223 - RNA, 23 nt, Human
ccgcgcccagcacgccucccgcg

SEQ ID NO: 1245224 - RNA, 23 nt, Human
ccgcgccgcgcugcgccgccuuc

SEQ ID NO: 1245225 - RNA, 19 nt, Human
ccucugggcaccgcagccc

SEQ ID NO: 1245226 - RNA, 23 nt, Human
ccucugggcaccgcagccccgcg

SEQ ID NO: 1245227 - RNA, 20 nt, Human
ccugaagccuuccugacugc

SEQ ID NO: 1245228 - RNA, 22 nt, Human
ccugaagccuuccugacugcuc

SEQ ID NO: 1245229 - RNA, 22 nt, Human
ccugggugacagugcaagacuc

SEQ ID NO: 1245230 - RNA, 21 nt, Human
ccuguagucccagcuacuugg

SEQ ID NO: 1245231 - RNA, 28 nt, Human
ccuugaccaaagcagccuuuccaggggc

SEQ ID NO: 1245232 - RNA, 24 nt, Human
cgaggcggguggaucaccugaggu

SEQ ID NO: 1245233 - RNA, 26 nt, Human
cgaggcggguggaucaccugagguca

SEQ ID NO: 1245234 - RNA, 24 nt, Human
cgccgccgccgccgccgccgccgg

SEQ ID NO: 1245235 - RNA, 24 nt, Human
cggguggaucaccugaggucagga

SEQ ID NO: 1245236 - RNA, 23 nt, Human
cgucuguaaucccagcacuuugg

SEQ ID NO: 1245237 - RNA, 23 nt, Human
cucaaauauuccuaucaacaguu

SEQ ID NO: 1245238 - RNA, 27 nt, Human
cucaauuaaaaaaaaaaaaaucaucca

SEQ ID NO: 1245239 - RNA, 24 nt, Human
cucacgucuguaaucccagcacuu

SEQ ID NO: 1245240 - RNA, 21 nt, Human
cucagccuugaccaaagcagc

SEQ ID NO: 1245241 - RNA, 23 nt, Human
cugagccucaguuuccccaucug

SEQ ID NO: 1245242 - RNA, 18 nt, Human
cuggagcagccagcucag

SEQ ID NO: 1245243 - RNA, 24 nt, Human
cuggcauauacacaggaaaacaga

SEQ ID NO: 1245244 - RNA, 22 nt, Human
cugggcaccgcagccccgcgcc

SEQ ID NO: 1245245 - RNA, 25 nt, Human
cugguuguggugccucacgucugua

SEQ ID NO: 1245246 - RNA, 21 nt, Human
cuguaaucccagcacuuuggg

SEQ ID NO: 1245247 - RNA, 24 nt, Human
cuuggccaacauggcgaaacccca

SEQ ID NO: 1245248 - RNA, 18 nt, Human
gaaaccccaucucuacua

SEQ ID NO: 1245249 - RNA, 19 nt, Human
gaacccagguccacagcaa

SEQ ID NO: 1245250 - RNA, 27 nt, Human
gaagccaaaaucgcagacagugggcac

SEQ ID NO: 1245251 - RNA, 19 nt, Human
gaauaggaguccaacaaau

SEQ ID NO: 1245252 - RNA, 23 nt, Human
gagcagcaggguuggcugugugg

SEQ ID NO: 1245253 - RNA, 24 nt, Human
gagcagcaggguuggcuguguggg

SEQ ID NO: 1245254 - RNA, 18 nt, Human
gagccccuaaugccgcag

SEQ ID NO: 1245255 - RNA, 21 nt, Human
gagccccuaaugccgcagccu

SEQ ID NO: 1245256 - RNA, 19 nt, Human
gaggcggguggaucaccug

SEQ ID NO: 1245257 - RNA, 23 nt, Human
gaggcggguggaucaccugaggu

SEQ ID NO: 1245258 - RNA, 21 nt, Human
gaucaccugaggucaggaguu

SEQ ID NO: 1245259 - RNA, 23 nt, Human
gaucaccugaggucaggaguuca

SEQ ID NO: 1245260 - RNA, 24 nt, Human
gaucaccugaggucaggaguucaa

SEQ ID NO: 1245261 - RNA, 19 nt, Human
gaucacuuggaagccucug

SEQ ID NO: 1245262 - RNA, 21 nt, Human
gcaaagaaagcaacuugccaa

SEQ ID NO: 1245263 - RNA, 22 nt, Human
gcacuuugggagcccgaggcgg

SEQ ID NO: 1245264 - RNA, 21 nt, Human
gcagaucacuuggaagccuuu

SEQ ID NO: 1245265 - RNA, 24 nt, Human
gccaacauggcgaaaccccaucuc

SEQ ID NO: 1245266 - RNA, 20 nt, Human
gccaagaucgcgccacugca

SEQ ID NO: 1245267 - RNA, 19 nt, Human
gccacugcacuccagccug

SEQ ID NO: 1245268 - RNA, 24 nt, Human
gccacugcacuccagccuggguga

SEQ ID NO: 1245269 - RNA, 20 nt, Human
gccccccgcccggccggccc

SEQ ID NO: 1245270 - RNA, 22 nt, Human
gccgcccgcgccgccgccgccg

SEQ ID NO: 1245271 - RNA, 21 nt, Human
gccucacgucuguaaucccag

SEQ ID NO: 1245272 - RNA, 19 nt, Human
gcgccgcgcugcgccgccu

SEQ ID NO: 1245273 - RNA, 20 nt, Human
ggaucaccugaggucaggaa

SEQ ID NO: 1245274 - RNA, 26 nt, Human
ggcaaagaaagcaacuugccaaaaaa

SEQ ID NO: 1245275 - RNA, 23 nt, Human
ggcaaagcaaucaauccacaaga

SEQ ID NO: 1245276 - RNA, 24 nt, Human
ggcagaucagguccagaacccagg

SEQ ID NO: 1245277 - RNA, 23 nt, Human
ggcggggguugcagugagccaag

SEQ ID NO: 1245278 - RNA, 18 nt, Human
ggcuggggauccuuuaga

SEQ ID NO: 1245279 - RNA, 19 nt, Human
gggguugcagugagccaag

SEQ ID NO: 1245280 - RNA, 22 nt, Human
gggguugcagugagccaagauc

SEQ ID NO: 1245281 - RNA, 23 nt, Human
gggguugcagugagccaagaucg

SEQ ID NO: 1245282 - RNA, 24 nt, Human
ggugccucacgucuguaaucccag

SEQ ID NO: 1245283 - RNA, 21 nt, Human
gguggaucaccugaggucagg

SEQ ID NO: 1245284 - RNA, 21 nt, Human
gguugcagugagccaagaucg

SEQ ID NO: 1245285 - RNA, 23 nt, Human
guggaucaccugaggucaggagu

SEQ ID NO: 1245286 - RNA, 21 nt, Human
guguccacaguucuaagcagc

SEQ ID NO: 1245287 - RNA, 23 nt, Human
uaaaaccacaaccacaagcgugc

SEQ ID NO: 1245288 - RNA, 24 nt, Human
uaagugacuuagccaaggucacac

SEQ ID NO: 1245289 - RNA, 23 nt, Human
uacacauaccacugcuuuucaca

SEQ ID NO: 1245290 - RNA, 21 nt, Human
uaccauaaaacaucagaacaa

SEQ ID NO: 1245291 - RNA, 25 nt, Human
uaccauaaaacaucagaacaagcag

SEQ ID NO: 1245292 - RNA, 19 nt, Human
uaggucuugggggcugggg

SEQ ID NO: 1245293 - RNA, 24 nt, Human
uagguggcggggguugcagugagc

SEQ ID NO: 1245294 - RNA, 24 nt, Human
uaguggugcacaccuguaguccca

SEQ ID NO: 1245295 - RNA, 19 nt, Human
ucaccugaggucaggaguu

SEQ ID NO: 1245296 - RNA, 23 nt, Human
ucaccugaggucaggaguucaag

SEQ ID NO: 1245297 - RNA, 19 nt, Human
ucacuugaaccuagguggc

SEQ ID NO: 1245298 - RNA, 18 nt, Human
ucagaacaagcagcagcu

SEQ ID NO: 1245299 - RNA, 22 nt, Human
uccacagcaaugucaucauuca

SEQ ID NO: 1245300 - RNA, 20 nt, Human
uccagaacccagguccacag

SEQ ID NO: 1245301 - RNA, 24 nt, Human
uccagccugggugacagugcaaga

SEQ ID NO: 1245302 - RNA, 23 nt, Human
ucgcgccacugcacuccagccug

SEQ ID NO: 1245303 - RNA, 24 nt, Human
ucucagagcugugguucauucugg

SEQ ID NO: 1245304 - RNA, 23 nt, Human
ucucagccuugaccaaagcagcc

SEQ ID NO: 1245305 - RNA, 24 nt, Human
ucuguaauauaaaaccacaaccac

SEQ ID NO: 1245306 - RNA, 19 nt, Human
ucuugggcuccugaagccu

SEQ ID NO: 1245307 - RNA, 21 nt, Human
ucuugggggcuggggauccuu

SEQ ID NO: 1245308 - RNA, 23 nt, Human
ucuuucuucugucucugucuucu

SEQ ID NO: 1245309 - RNA, 23 nt, Human
ugaagccuuccugacugcucagu

SEQ ID NO: 1245310 - RNA, 19 nt, Human
ugaaguggcagaucagguc

SEQ ID NO: 1245311 - RNA, 19 nt, Human
ugaaguggcagaucagguc

SEQ ID NO: 1245312 - RNA, 22 nt, Human
ugagccaagaucgcgccacugc

SEQ ID NO: 1245313 - RNA, 20 nt, Human
ugaggcaugagaaucacuug

SEQ ID NO: 1245314 - RNA, 24 nt, Human
ugaggcaugagaaucacuugaacc

SEQ ID NO: 1245315 - RNA, 22 nt, Human
ugaguuuggaaagcaauuugca

SEQ ID NO: 1245316 - RNA, 20 nt, Human
ugaucucuuucuucugucuc

SEQ ID NO: 1245317 - RNA, 19 nt, Human
ugcaagacuccaucucaau

SEQ ID NO: 1245318 - RNA, 22 nt, Human
ugcccccagaugcuucucuccu

SEQ ID NO: 1245319 - RNA, 25 nt, Human
ugccgcagccucugggcaccgcagc

SEQ ID NO: 1245320 - RNA, 21 nt, Human
ugccucacgucuguaauccca

SEQ ID NO: 1245321 - RNA, 24 nt, Human
ugccucacgucuguaaucccagca

SEQ ID NO: 1245322 - RNA, 21 nt, Human
ugcuagguaggccagucuucu

SEQ ID NO: 1245323 - RNA, 20 nt, Human
ugcuucucuccucaccuggg

SEQ ID NO: 1245324 - RNA, 20 nt, Human
uggaaagcaauuugcaaaag

SEQ ID NO: 1245325 - RNA, 24 nt, Human
uggaucaccugaggucaggaguuc

SEQ ID NO: 1245326 - RNA, 26 nt, Human
uggaucaccugaggucaggaguucaa

SEQ ID NO: 1245327 - RNA, 22 nt, Human
uggccaacauggcgaaacccca

SEQ ID NO: 1245328 - RNA, 24 nt, Human
ugggaggcugaggcaugagaauca

SEQ ID NO: 1245329 - RNA, 21 nt, Human
ugggguugccagauguuucug

SEQ ID NO: 1245330 - RNA, 21 nt, Human
ugggucuaugaaacaauaggu

SEQ ID NO: 1245331 - RNA, 18 nt, Human
uggugcacaccuguaguc

SEQ ID NO: 1245332 - RNA, 22 nt, Human
uggugcacaccuguagucccag

SEQ ID NO: 1245333 - RNA, 24 nt, Human
uggugccucacgucuguaauccca

SEQ ID NO: 1245334 - RNA, 21 nt, Human
uguaaccaucagcuucugcaa

SEQ ID NO: 1245335 - RNA, 22 nt, Human
uguccaaggguguccuaggacc

SEQ ID NO: 1245336 - RNA, 22 nt, Human
uguccacaguucuaagcagcag

SEQ ID NO: 1245337 - RNA, 19 nt, Human
ugucucugucuucugcagc

SEQ ID NO: 1245338 - RNA, 18 nt, Human
ugugggguugccagaugu

SEQ ID NO: 1245339 - RNA, 25 nt, Human
uucacaaaauaugggggagaaaaac

SEQ ID NO: 1245340 - RNA, 18 nt, Human
uuccauacguguccacag

SEQ ID NO: 1245341 - RNA, 24 nt, Human
uugaaccuagguggcggggguugc

SEQ ID NO: 1245342 - RNA, 22 nt, Human
uugcagugagccaagaucgcgc

SEQ ID NO: 1245343 - RNA, 23 nt, Human
uuggccaacauggcgaaacccca

SEQ ID NO: 1245344 - RNA, 25 nt, Human
uugggaggcugaggcaugagaauca

SEQ ID NO: 1245345 - RNA, 19 nt, Human
uuguucaggagcagaucac

SEQ ID NO: 1245346 - RNA, 19 nt, Human
aaacaaugccuccacuccg

SEQ ID NO: 1245347 - RNA, 23 nt, Human
aaaugcauuuuauuuuuagacaa

SEQ ID NO: 1245348 - RNA, 18 nt, Human
acaugacauguuuuucuu

SEQ ID NO: 1245349 - RNA, 25 nt, Human
cacagcccguccacaaucucccaga

SEQ ID NO: 1245350 - RNA, 22 nt, Human
caccaccucccagcacagcccg

SEQ ID NO: 1245351 - RNA, 18 nt, Human
caccucccagcacagccc

SEQ ID NO: 1245352 - RNA, 19 nt, Human
cacuucagauguuggcacu

SEQ ID NO: 1245353 - RNA, 18 nt, Human
ccagcacagcccguccac

SEQ ID NO: 1245354 - RNA, 25 nt, Human
ccccaccaccucccagcacagcccg

SEQ ID NO: 1245355 - RNA, 19 nt, Human
cuaugaacauggucuuucc

SEQ ID NO: 1245356 - RNA, 25 nt, Human
cuugguaaucucuuccaguuaacua

SEQ ID NO: 1245357 - RNA, 26 nt, Human
cuuuuuauucucuugguaaucucuuc

SEQ ID NO: 1245358 - RNA, 18 nt, Human
gcuguagcuucuccagga

SEQ ID NO: 1245359 - RNA, 18 nt, Human
guaaagcuccacuucaga

SEQ ID NO: 1245360 - RNA, 20 nt, Human
guaaagcuccacuucagaug

SEQ ID NO: 1245361 - RNA, 24 nt, Human
gucccauuugucuuagguccuggu

SEQ ID NO: 1245362 - RNA, 21 nt, Human
uaaaaacaaugccuccacucc

SEQ ID NO: 1245363 - RNA, 22 nt, Human
uaaaaauaaaugaagagcucaa

SEQ ID NO: 1245364 - RNA, 20 nt, Human
uacaugacauguuuuucuua

SEQ ID NO: 1245365 - RNA, 23 nt, Human
uauucucuugguaaucucuucca

SEQ ID NO: 1245366 - RNA, 18 nt, Human
uccccaccaccucccagc

SEQ ID NO: 1245367 - RNA, 21 nt, Human
ucccuuuauugcaacacacaa

SEQ ID NO: 1245368 - RNA, 26 nt, Human
ucucccagaucuucuagaugucggag

SEQ ID NO: 1245369 - RNA, 22 nt, Human
ugacagguaauagauccaaacu

SEQ ID NO: 1245370 - RNA, 23 nt, Human
ugaccaggcuguagcuucuccag

SEQ ID NO: 1245371 - RNA, 21 nt, Human
ugcuaugaacauggucuuucc

SEQ ID NO: 1245372 - RNA, 19 nt, Human
uggaugacaauuagaagcg

SEQ ID NO: 1245373 - RNA, 18 nt, Human
uuccagcugaauucgucu

SEQ ID NO: 1245374 - RNA, 19 nt, Human
uuuagacaaccuacaugac

SEQ ID NO: 1245375 - RNA, 20 nt, Human
ccccgggcuucuccagcucc

SEQ ID NO: 1245376 - RNA, 23 nt, Human
ccccuuguggggccgaaggguug

SEQ ID NO: 1245377 - RNA, 25 nt, Human
ccuccaagaucuguuugcgaaugga

SEQ ID NO: 1245378 - RNA, 24 nt, Human
ggcacugccugggcccccuugugg

SEQ ID NO: 1245379 - RNA, 23 nt, Human
gggcccagcagcugccgggcggc

SEQ ID NO: 1245380 - RNA, 19 nt, Human
guggcuccucuucagcagg

SEQ ID NO: 1245381 - RNA, 19 nt, Human
uccuccaagaucuguuugc

SEQ ID NO: 1245382 - RNA, 22 nt, Human
uccuccaagaucuguuugcgaa

SEQ ID NO: 1245383 - RNA, 20 nt, Human
ucuccagcuccuccaagauc

SEQ ID NO: 1245384 - RNA, 23 nt, Human
ugccugggcccccuuguggggcc

SEQ ID NO: 1245385 - RNA, 18 nt, Human
agacaauuuuucuugacu

SEQ ID NO: 1245386 - RNA, 23 nt, Human
agaugcuccagaaacaggcugag

SEQ ID NO: 1245387 - RNA, 24 nt, Human
caccagcagugggcgaagaugcuc

SEQ ID NO: 1245388 - RNA, 22 nt, Human
cagacguccucauccucguccu

SEQ ID NO: 1245389 - RNA, 18 nt, Human
cagcggucccccaccucc

SEQ ID NO: 1245390 - RNA, 21 nt, Human
cagggccuucaccagcagugg

SEQ ID NO: 1245391 - RNA, 25 nt, Human
ccccaccuccuucacggggcuucca

SEQ ID NO: 1245392 - RNA, 19 nt, Human
ccucauccucguccucuuc

SEQ ID NO: 1245393 - RNA, 25 nt, Human
cugguguuagcagcuggaguucuuc

SEQ ID NO: 1245394 - RNA, 21 nt, Human
gaagaugcuccagaaacaggc

SEQ ID NO: 1245395 - RNA, 20 nt, Human
uccagcugcgguuuaucugc

SEQ ID NO: 1245396 - RNA, 24 nt, Human
uccagcugcgguuuaucugccguc

SEQ ID NO: 1245397 - RNA, 21 nt, Human
ugcagcggucccccaccuccu

SEQ ID NO: 1245398 - RNA, 22 nt, Human
ugcccuguaacuugacugagau

SEQ ID NO: 1245399 - RNA, 23 nt, Human
aaaggccuuccacauguuaacuc

SEQ ID NO: 1245400 - RNA, 20 nt, Human
acccagggagugggucagcu

SEQ ID NO: 1245401 - RNA, 23 nt, Human
acugcagucuccacacagaguga

SEQ ID NO: 1245402 - RNA, 21 nt, Human
agacccaguccccccacccag

SEQ ID NO: 1245403 - RNA, 23 nt, Human
agaggguggcguuguagggcucc

SEQ ID NO: 1245404 - RNA, 24 nt, Human
aggcaugaagaaaugcagccgggg

SEQ ID NO: 1245405 - RNA, 18 nt, Human
aggugggugugggcaguu

SEQ ID NO: 1245406 - RNA, 18 nt, Human
aggugguucaggucacca

SEQ ID NO: 1245407 - RNA, 23 nt, Human
aguaggauuagcccuuucaccuu

SEQ ID NO: 1245408 - RNA, 22 nt, Human
caaagccaggcaugaagaaaug

SEQ ID NO: 1245409 - RNA, 21 nt, Human
caaggcccgguacugcuggcu

SEQ ID NO: 1245410 - RNA, 22 nt, Human
caaggcccgguacugcuggcug

SEQ ID NO: 1245411 - RNA, 22 nt, Human
caccuuuccagaggacugcagu

SEQ ID NO: 1245412 - RNA, 24 nt, Human
cagaaaggcuucgggguaaauuag

SEQ ID NO: 1245413 - RNA, 18 nt, Human
cagacccaguccccccac

SEQ ID NO: 1245414 - RNA, 20 nt, Human
caguggggcaaagccaggca

SEQ ID NO: 1245415 - RNA, 24 nt, Human
caucucauccaugcccucgcccgu

SEQ ID NO: 1245416 - RNA, 22 nt, Human
cauuagcaaauauuugaaucuc

SEQ ID NO: 1245417 - RNA, 18 nt, Human
ccaggcaugaagaaaugc

SEQ ID NO: 1245418 - RNA, 25 nt, Human
ccaucccagacccaguccccccacc

SEQ ID NO: 1245419 - RNA, 23 nt, Human
ccucaugggcaugcgacccugga

SEQ ID NO: 1245420 - RNA, 23 nt, Human
cuccaccacggugucugacaccu

SEQ ID NO: 1245421 - RNA, 22 nt, Human
cuccuuggccguggcauccuga

SEQ ID NO: 1245422 - RNA, 24 nt, Human
cucucggccucggugaauuccauc

SEQ ID NO: 1245423 - RNA, 21 nt, Human
cugguaaacauuuuucagaug

SEQ ID NO: 1245424 - RNA, 19 nt, Human
gaacauaugucauauagcg

SEQ ID NO: 1245425 - RNA, 26 nt, Human
gaagcgcaggcacguggugaccccac

SEQ ID NO: 1245426 - RNA, 21 nt, Human
gcgacccuggaaaauggcagc

SEQ ID NO: 1245427 - RNA, 19 nt, Human
ggagaaggagaaaauugcu

SEQ ID NO: 1245428 - RNA, 23 nt, Human
ggggcaaagccaggcaugaagaa

SEQ ID NO: 1245429 - RNA, 20 nt, Human
gguucaggucaccauaggug

SEQ ID NO: 1245430 - RNA, 23 nt, Human
gucaguggggcaaagccaggcau

SEQ ID NO: 1245431 - RNA, 18 nt, Human
guucauccaccucccuca

SEQ ID NO: 1245432 - RNA, 23 nt, Human
uaaccaucccagacccagucccc

SEQ ID NO: 1245433 - RNA, 23 nt, Human
uaacuggagaaggagaaaauugc

SEQ ID NO: 1245434 - RNA, 18 nt, Human
uagcuggagucuucugua

SEQ ID NO: 1245435 - RNA, 20 nt, Human
uagggcuccaccacgguguc

SEQ ID NO: 1245436 - RNA, 19 nt, Human
ucagaugggguggggaaug

SEQ ID NO: 1245437 - RNA, 21 nt, Human
ucagcaaaguagcugcuguuc

SEQ ID NO: 1245438 - RNA, 21 nt, Human
ucauguugcucucggccucgg

SEQ ID NO: 1245439 - RNA, 18 nt, Human
uccacacagagugaaggu

SEQ ID NO: 1245440 - RNA, 22 nt, Human
ucccagacccaguccccccacc

SEQ ID NO: 1245441 - RNA, 23 nt, Human
ucccagacccaguccccccaccc

SEQ ID NO: 1245442 - RNA, 19 nt, Human
ucccucaugggcaugcgac

SEQ ID NO: 1245443 - RNA, 20 nt, Human
uccgcaggucagcauucagc

SEQ ID NO: 1245444 - RNA, 24 nt, Human
ucuccugcagaaaggcuucggggu

SEQ ID NO: 1245445 - RNA, 18 nt, Human
ucugagacacacgugaag

SEQ ID NO: 1245446 - RNA, 21 nt, Human
ucuguucauccaccucccuca

SEQ ID NO: 1245447 - RNA, 21 nt, Human
ucuucugguaaacauuuuuca

SEQ ID NO: 1245448 - RNA, 22 nt, Human
ugaacaucuguucauccaccuc

SEQ ID NO: 1245449 - RNA, 21 nt, Human
ugagcugguggacugagaggg

SEQ ID NO: 1245450 - RNA, 22 nt, Human
ugagcugguggacugagagggu

SEQ ID NO: 1245451 - RNA, 19 nt, Human
ugccccggcuggucagugg

SEQ ID NO: 1245452 - RNA, 22 nt, Human
ugcucucggccucggugaauuc

SEQ ID NO: 1245453 - RNA, 20 nt, Human
ugcugggugagcucagccac

SEQ ID NO: 1245454 - RNA, 22 nt, Human
ugcuguaaacugcucugagaca

SEQ ID NO: 1245455 - RNA, 18 nt, Human
uggccugggaagcgcagg

SEQ ID NO: 1245456 - RNA, 23 nt, Human
uggcguuguagggcuccaccacg

SEQ ID NO: 1245457 - RNA, 20 nt, Human
uggggcaaagccaggcauga

SEQ ID NO: 1245458 - RNA, 19 nt, Human
uguucauccaccucccuca

SEQ ID NO: 1245459 - RNA, 28 nt, Human
uguuggacagguuuaacuggagaaggag

SEQ ID NO: 1245460 - RNA, 23 nt, Human
uuaacuggagaaggagaaaauug

SEQ ID NO: 1245461 - RNA, 23 nt, Human
accccacuuccucccggccucca

SEQ ID NO: 1245462 - RNA, 24 nt, Human
accccacuuccucccggccuccaa

SEQ ID NO: 1245463 - RNA, 23 nt, Human
cacccucuccucggcggacacug

SEQ ID NO: 1245464 - RNA, 18 nt, Human
cagggcuccacacagggc

SEQ ID NO: 1245465 - RNA, 22 nt, Human
ccccacuuccucccggccucca

SEQ ID NO: 1245466 - RNA, 28 nt, Human
ccccgcuccuuucugaggccaggcugga

SEQ ID NO: 1245467 - RNA, 20 nt, Human
cccggccccaggcuuuggcc

SEQ ID NO: 1245468 - RNA, 24 nt, Human
cccuacguccauccucggagcugu

SEQ ID NO: 1245469 - RNA, 22 nt, Human
ccguccccagcagggugaggcc

SEQ ID NO: 1245470 - RNA, 23 nt, Human
ccucccggccuccaaggggguuc

SEQ ID NO: 1245471 - RNA, 27 nt, Human
cuccugggcaguccuccccgcugggcu

SEQ ID NO: 1245472 - RNA, 18 nt, Human
cugaggccaggcuggaga

SEQ ID NO: 1245473 - RNA, 23 nt, Human
cugcugcccggccccaggcuuug

SEQ ID NO: 1245474 - RNA, 21 nt, Human
cuggggcagcagcuggccccu

SEQ ID NO: 1245475 - RNA, 22 nt, Human
cuggggcagcagcuggccccua

SEQ ID NO: 1245476 - RNA, 18 nt, Human
gaccguccccagcagggu

SEQ ID NO: 1245477 - RNA, 22 nt, Human
gacucuggggcagcagcuggcc

SEQ ID NO: 1245478 - RNA, 19 nt, Human
gcaguccuccccgcugggc

SEQ ID NO: 1245479 - RNA, 18 nt, Human
gcccuggcgcuguggcug

SEQ ID NO: 1245480 - RNA, 18 nt, Human
gcugcccggccccaggcu

SEQ ID NO: 1245481 - RNA, 22 nt, Human
ggcaaguucaggccccucuggg

SEQ ID NO: 1245482 - RNA, 23 nt, Human
ggcccuggcgcuguggcuggacc

SEQ ID NO: 1245483 - RNA, 23 nt, Human
ggcugcagggggcaggacucugg

SEQ ID NO: 1245484 - RNA, 18 nt, Human
gggcagcagcuggccccu

SEQ ID NO: 1245485 - RNA, 22 nt, Human
uccccagcagggugaggcccac

SEQ ID NO: 1245486 - RNA, 24 nt, Human
ucuccgggacagggguccuggccc

SEQ ID NO: 1245487 - RNA, 24 nt, Human
ucuccucggcggacacugcugccc

SEQ ID NO: 1245488 - RNA, 23 nt, Human
ucuggggcagcagcuggccccua

SEQ ID NO: 1245489 - RNA, 18 nt, Human
ucugggggcccuggcgcu

SEQ ID NO: 1245490 - RNA, 23 nt, Human
ugaggccaggcuggagacagauc

SEQ ID NO: 1245491 - RNA, 23 nt, Human
uggcccagcguuugcaggguggg

SEQ ID NO: 1245492 - RNA, 19 nt, Human
uggccccuacguccauccu

SEQ ID NO: 1245493 - RNA, 20 nt, Human
uggcuggaccguccccagca

SEQ ID NO: 1245494 - RNA, 19 nt, Human
uggggcagcagcuggcccc

SEQ ID NO: 1245495 - RNA, 21 nt, Human
uggggcagcagcuggccccua

SEQ ID NO: 1245496 - RNA, 21 nt, Human
ugggggcccuggcgcuguggc

SEQ ID NO: 1245497 - RNA, 20 nt, Human
uucugagcuggcugcuucuc

SEQ ID NO: 1245498 - RNA, 22 nt, Human
uuuggccugcagggcucugggc

SEQ ID NO: 1245499 - RNA, 25 nt, Human
aaaaugagcaacugugauaacaaau

SEQ ID NO: 1245500 - RNA, 19 nt, Human
aaggagacagagcuaccag

SEQ ID NO: 1245501 - RNA, 23 nt, Human
aaguaugaaacaacuuugauaga

SEQ ID NO: 1245502 - RNA, 27 nt, Human
aauccacugccacuucugcugaaacaa

SEQ ID NO: 1245503 - RNA, 19 nt, Human
cucucucaauccuauuaaa

SEQ ID NO: 1245504 - RNA, 21 nt, Human
cugaaacaaaagucaacugau

SEQ ID NO: 1245505 - RNA, 19 nt, Human
cugccacuucugcugaaac

SEQ ID NO: 1245506 - RNA, 20 nt, Human
cuucugcugaaacaaaaguc

SEQ ID NO: 1245507 - RNA, 25 nt, Human
gauaacaaauaaaacuuggagagaa

SEQ ID NO: 1245508 - RNA, 18 nt, Human
gcuauuuccuuauucaag

SEQ ID NO: 1245509 - RNA, 24 nt, Human
uaagucugagggaaauuacccaaa

SEQ ID NO: 1245510 - RNA, 21 nt, Human
uagauagagacuaaaauggcu

SEQ ID NO: 1245511 - RNA, 20 nt, Human
ugagggaaauuacccaaaau

SEQ ID NO: 1245512 - RNA, 23 nt, Human
uggagagaaaaaaguuggcuauu

SEQ ID NO: 1245513 - RNA, 20 nt, Human
uucaaauagcucucucaauc

SEQ ID NO: 1245514 - RNA, 20 nt, Human
uucaaggagacagagcuacc

SEQ ID NO: 1245515 - RNA, 19 nt, Human
acccccuacaggggauagg

SEQ ID NO: 1245516 - RNA, 24 nt, Human
acuaggccuuugguaaccccccuc

SEQ ID NO: 1245517 - RNA, 19 nt, Human
ccaauuccccuucucuucu

SEQ ID NO: 1245518 - RNA, 25 nt, Human
ccaauuccccuucucuucuuccuca

SEQ ID NO: 1245519 - RNA, 22 nt, Human
cccaauuccccuucucuucuuc

SEQ ID NO: 1245520 - RNA, 18 nt, Human
ccgcugccagccagcagc

SEQ ID NO: 1245521 - RNA, 20 nt, Human
ccgcugccagccagcagcgu

SEQ ID NO: 1245522 - RNA, 20 nt, Human
ccucgccccucacccacccc

SEQ ID NO: 1245523 - RNA, 18 nt, Human
cuccccuccccucuuuuu

SEQ ID NO: 1245524 - RNA, 23 nt, Human
gccuuugguaaccccccucgcua

SEQ ID NO: 1245525 - RNA, 19 nt, Human
ggcugaggcaagggccuug

SEQ ID NO: 1245526 - RNA, 25 nt, Human
uccucagccucgccccucacccacc

SEQ ID NO: 1245527 - RNA, 27 nt, Human
uccucagccucgccccucacccacccc

SEQ ID NO: 1245528 - RNA, 22 nt, Human
ucuaaacguucgugcccaggag

SEQ ID NO: 1245529 - RNA, 19 nt, Human
ugcguagggcccagccccg

SEQ ID NO: 1245530 - RNA, 20 nt, Human
uggucacaauagaggaguug

SEQ ID NO: 1245531 - RNA, 22 nt, Human
uuauaauccccucaagcgcccc

SEQ ID NO: 1245532 - RNA, 27 nt, Human
uuguaaccauuggucauauguggcuga

SEQ ID NO: 1245533 - RNA, 25 nt, Human
aaaacuuuuagagcaacuacuacau

SEQ ID NO: 1245534 - RNA, 22 nt, Human
aaacccaggucuccccaacagc

SEQ ID NO: 1245535 - RNA, 24 nt, Human
aaagugcugggauuacaggcguga

SEQ ID NO: 1245536 - RNA, 24 nt, Human
aaguccagcccacgugcugaggaa

SEQ ID NO: 1245537 - RNA, 19 nt, Human
aagugcugggauuacaggc

SEQ ID NO: 1245538 - RNA, 19 nt, Human
aagugcugggauuacaggc

SEQ ID NO: 1245539 - RNA, 26 nt, Human
aagugcugggauuacaggcgugagcc

SEQ ID NO: 1245540 - RNA, 20 nt, Human
acccaguucggcaaguggag

SEQ ID NO: 1245541 - RNA, 18 nt, Human
accccagagcuugcuggc

SEQ ID NO: 1245542 - RNA, 31 nt, Human
accuuccccaggccaccccagagcuugcugg

SEQ ID NO: 1245543 - RNA, 18 nt, Human
acgggguuucaccguggu

SEQ ID NO: 1245544 - RNA, 20 nt, Human
acgggguuucaccguggucu

SEQ ID NO: 1245545 - RNA, 22 nt, Human
acgggguuucaccguggucucg

SEQ ID NO: 1245546 - RNA, 21 nt, Human
acugcaagcuccgccuuccgg

SEQ ID NO: 1245547 - RNA, 22 nt, Human
agcaaaacuuuuagagcaacua

SEQ ID NO: 1245548 - RNA, 22 nt, Human
agccaaccuuccccaggccacc

SEQ ID NO: 1245549 - RNA, 22 nt, Human
agcccgaugugcuccugaccuc

SEQ ID NO: 1245550 - RNA, 21 nt, Human
agccgggcccugugaaaaguc

SEQ ID NO: 1245551 - RNA, 18 nt, Human
aggaagucccaaagagag

SEQ ID NO: 1245552 - RNA, 19 nt, Human
aggaagucccaaagagagc

SEQ ID NO: 1245553 - RNA, 19 nt, Human
aggaagucccaaagagagc

SEQ ID NO: 1245554 - RNA, 20 nt, Human
aguagagacgggguuucacc

SEQ ID NO: 1245555 - RNA, 21 nt, Human
aguagagacgggguuucaccg

SEQ ID NO: 1245556 - RNA, 18 nt, Human
aguagcugggacuacagg

SEQ ID NO: 1245557 - RNA, 19 nt, Human
aguagcugggacuacaggc

SEQ ID NO: 1245558 - RNA, 18 nt, Human
agugcugggauuacaggc

SEQ ID NO: 1245559 - RNA, 24 nt, Human
caaagugcugggauuacaggcgug

SEQ ID NO: 1245560 - RNA, 18 nt, Human
caacuacuacaugucagg

SEQ ID NO: 1245561 - RNA, 25 nt, Human
caagacccccaucugaccucugacc

SEQ ID NO: 1245562 - RNA, 18 nt, Human
caagagguuggugcuguc

SEQ ID NO: 1245563 - RNA, 19 nt, Human
caccccagagcuugcuggc

SEQ ID NO: 1245564 - RNA, 22 nt, Human
cacgccauucuccugccucagc

SEQ ID NO: 1245565 - RNA, 21 nt, Human
cacgcuuguaaucccagcacu

SEQ ID NO: 1245566 - RNA, 22 nt, Human
cagacugagaaauguagaauga

SEQ ID NO: 1245567 - RNA, 21 nt, Human
cagccaaccuuccccaggcca

SEQ ID NO: 1245568 - RNA, 21 nt, Human
caggcgcccgccacugcgccc

SEQ ID NO: 1245569 - RNA, 22 nt, Human
ccaaagugcugggauuacaggc

SEQ ID NO: 1245570 - RNA, 22 nt, Human
ccaaagugcugggauuacaggc

SEQ ID NO: 1245571 - RNA, 24 nt, Human
ccaaagugcugggauuacaggcgu

SEQ ID NO: 1245572 - RNA, 19 nt, Human
cccaaagagagcaagauca

SEQ ID NO: 1245573 - RNA, 19 nt, Human
cccacacugaaaacagaau

SEQ ID NO: 1245574 - RNA, 22 nt, Human
cccacacugaaaacagaaucca

SEQ ID NO: 1245575 - RNA, 23 nt, Human
cccagcacugaugaaagaucccc

SEQ ID NO: 1245576 - RNA, 21 nt, Human
ccccacacugaaaacagaauc

SEQ ID NO: 1245577 - RNA, 23 nt, Human
ccccaggccaccccagagcuugc

SEQ ID NO: 1245578 - RNA, 23 nt, Human
cccgaguagcugggacuacaggc

SEQ ID NO: 1245579 - RNA, 24 nt, Human
cccgaguagcugggacuacaggcg

SEQ ID NO: 1245580 - RNA, 24 nt, Human
cccggccgggcgcgguggcucacg

SEQ ID NO: 1245581 - RNA, 22 nt, Human
ccggguucacgccauucuccug

SEQ ID NO: 1245582 - RNA, 19 nt, Human
ccucaaaaugacaccaaga

SEQ ID NO: 1245583 - RNA, 23 nt, Human
ccugccucagccucccgaguagc

SEQ ID NO: 1245584 - RNA, 18 nt, Human
ccuggcugucuacuacaa

SEQ ID NO: 1245585 - RNA, 22 nt, Human
ccuuggcagccaaccuucccca

SEQ ID NO: 1245586 - RNA, 19 nt, Human
cgccuuccggguucacgcc

SEQ ID NO: 1245587 - RNA, 21 nt, Human
cgcuuguaaucccagcacuga

SEQ ID NO: 1245588 - RNA, 18 nt, Human
cgucagaaguccagccca

SEQ ID NO: 1245589 - RNA, 19 nt, Human
cgugcugaggaagucccaa

SEQ ID NO: 1245590 - RNA, 22 nt, Human
cucacgcuuguaaucccagcac

SEQ ID NO: 1245591 - RNA, 23 nt, Human
cucacgcuuguaaucccagcacu

SEQ ID NO: 1245592 - RNA, 24 nt, Human
cucagccucccgaguagcugggac

SEQ ID NO: 1245593 - RNA, 21 nt, Human
cuccacgcugggcugcuccua

SEQ ID NO: 1245594 - RNA, 22 nt, Human
cuccuagcuaagaaaggcaccc

SEQ ID NO: 1245595 - RNA, 24 nt, Human
cuccugaccucgugauccgcccgc

SEQ ID NO: 1245596 - RNA, 22 nt, Human
cuccugccucagccucccgagu

SEQ ID NO: 1245597 - RNA, 23 nt, Human
cugccucagccucccgaguagcu

SEQ ID NO: 1245598 - RNA, 22 nt, Human
cuuccaagacccccaucugacc

SEQ ID NO: 1245599 - RNA, 22 nt, Human
gaccucgugauccgcccgccuc

SEQ ID NO: 1245600 - RNA, 22 nt, Human
gaccucgugauccgcccgccuc

SEQ ID NO: 1245601 - RNA, 24 nt, Human
gaccucgugauccgcccgccucgg

SEQ ID NO: 1245602 - RNA, 23 nt, Human
gaccucugacccuuggcagccaa

SEQ ID NO: 1245603 - RNA, 21 nt, Human
gacgggguuucaccguggucu

SEQ ID NO: 1245604 - RNA, 22 nt, Human
gacuacaggcgcccgccacugc

SEQ ID NO: 1245605 - RNA, 21 nt, Human
gagacggagucucguucuguc

SEQ ID NO: 1245606 - RNA, 20 nt, Human
gagacgggguuucaccgugg

SEQ ID NO: 1245607 - RNA, 21 nt, Human
gagacgggguuucaccguggu

SEQ ID NO: 1245608 - RNA, 21 nt, Human
gagagcaagaucacuucuguc

SEQ ID NO: 1245609 - RNA, 25 nt, Human
gaguagcugggacuacaggcgcccg

SEQ ID NO: 1245610 - RNA, 19 nt, Human
gaucacuucugucugggug

SEQ ID NO: 1245611 - RNA, 22 nt, Human
gaugaggaaacagacugagaaa

SEQ ID NO: 1245612 - RNA, 18 nt, Human
gauuacaggcgugagcca

SEQ ID NO: 1245613 - RNA, 22 nt, Human
gauuacaggcgugagccaccgc

SEQ ID NO: 1245614 - RNA, 22 nt, Human
gauuacaggcgugagccaccgc

SEQ ID NO: 1245615 - RNA, 23 nt, Human
gcccggcuaauuuuuuguauuuu

SEQ ID NO: 1245616 - RNA, 23 nt, Human
gccucggccucccaaagugcugg

SEQ ID NO: 1245617 - RNA, 25 nt, Human
gccuuccggguucacgccauucucc

SEQ ID NO: 1245618 - RNA, 19 nt, Human
gcucaacaaauccucaaaa

SEQ ID NO: 1245619 - RNA, 24 nt, Human
gcuugcuggcccuucccacuuaug

SEQ ID NO: 1245620 - RNA, 21 nt, Human
ggacaaacaugguggcaaugc

SEQ ID NO: 1245621 - RNA, 24 nt, Human
gggcgcgguggcucacgcuuguaa

SEQ ID NO: 1245622 - RNA, 23 nt, Human
gguggcucacgcuuguaauccca

SEQ ID NO: 1245623 - RNA, 24 nt, Human
gguggcucacgcuuguaaucccag

SEQ ID NO: 1245624 - RNA, 19 nt, Human
guagagacgggguuucacc

SEQ ID NO: 1245625 - RNA, 23 nt, Human
gucacagagcucauucagcagag

SEQ ID NO: 1245626 - RNA, 24 nt, Human
gugauccgcccgccucggccuccc

SEQ ID NO: 1245627 - RNA, 24 nt, Human
uaauuuuuuguauuuuuaguagag

SEQ ID NO: 1245628 - RNA, 23 nt, Human
uacagacacggucucuuguuuuc

SEQ ID NO: 1245629 - RNA, 22 nt, Human
uacaggcgugagccaccgcgcc

SEQ ID NO: 1245630 - RNA, 22 nt, Human
uacaggcgugagccaccgcgcc

SEQ ID NO: 1245631 - RNA, 23 nt, Human
uacaggcgugagccaccgcgccu

SEQ ID NO: 1245632 - RNA, 21 nt, Human
uaguagagacgggguuucacc

SEQ ID NO: 1245633 - RNA, 24 nt, Human
uaguagagacgggguuucaccgug

SEQ ID NO: 1245634 - RNA, 18 nt, Human
ucacugcaagcuccgccu

SEQ ID NO: 1245635 - RNA, 19 nt, Human
ucacugcaagcuccgccuu

SEQ ID NO: 1245636 - RNA, 24 nt, Human
ucacugcaagcuccgccuuccggg

SEQ ID NO: 1245637 - RNA, 18 nt, Human
ucagcagagccaagaggc

SEQ ID NO: 1245638 - RNA, 23 nt, Human
ucagccucccgaguagcugggac

SEQ ID NO: 1245639 - RNA, 21 nt, Human
uccaagacccccaucugaccu

SEQ ID NO: 1245640 - RNA, 25 nt, Human
uccaagacccccaucugaccucuga

SEQ ID NO: 1245641 - RNA, 24 nt, Human
ucccaaagugcugggauuacaggc

SEQ ID NO: 1245642 - RNA, 21 nt, Human
ucccacuuaugcacgccgccu

SEQ ID NO: 1245643 - RNA, 18 nt, Human
uccccaacagcagagccc

SEQ ID NO: 1245644 - RNA, 24 nt, Human
uccccaggccaccccagagcuugc

SEQ ID NO: 1245645 - RNA, 24 nt, Human
ucccccacacugaaaacagaaucc

SEQ ID NO: 1245646 - RNA, 24 nt, Human
ucccgaguagcugggacuacaggc

SEQ ID NO: 1245647 - RNA, 18 nt, Human
ucgcccaggcgggagugc

SEQ ID NO: 1245648 - RNA, 23 nt, Human
ucgcccaggcgggagugcugugg

SEQ ID NO: 1245649 - RNA, 18 nt, Human
ucggccucccaaagugcu

SEQ ID NO: 1245650 - RNA, 23 nt, Human
ucuacuacaagccgggcccugug

SEQ ID NO: 1245651 - RNA, 18 nt, Human
ucucguucugucgcccag

SEQ ID NO: 1245652 - RNA, 19 nt, Human
ucucguucugucgcccagg

SEQ ID NO: 1245653 - RNA, 22 nt, Human
ucucguucugucgcccaggcgg

SEQ ID NO: 1245654 - RNA, 24 nt, Human
ucucguucugucgcccaggcggga

SEQ ID NO: 1245655 - RNA, 23 nt, Human
ucuggcaaaagcaaagauguuga

SEQ ID NO: 1245656 - RNA, 19 nt, Human
ucugucgcccaggcgggag

SEQ ID NO: 1245657 - RNA, 19 nt, Human
ucugucgcccaggcgggag

SEQ ID NO: 1245658 - RNA, 24 nt, Human
ugaccuccacgcugggcugcuccu

SEQ ID NO: 1245659 - RNA, 22 nt, Human
ugaccucugacccuuggcagcc

SEQ ID NO: 1245660 - RNA, 21 nt, Human
ugaggaaacagacugagaaau

SEQ ID NO: 1245661 - RNA, 21 nt, Human
ugcacgccgccugggcaggag

SEQ ID NO: 1245662 - RNA, 24 nt, Human
ugccucagccucccgaguagcugg

SEQ ID NO: 1245663 - RNA, 24 nt, Human
ugcugggauuacaggcgugagcca

SEQ ID NO: 1245664 - RNA, 23 nt, Human
uggcaaaagcaaagauguugauc

SEQ ID NO: 1245665 - RNA, 24 nt, Human
uggcucacgcuuguaaucccagca

SEQ ID NO: 1245666 - RNA, 21 nt, Human
ugggacuacaggcgcccgcca

SEQ ID NO: 1245667 - RNA, 22 nt, Human
ugggacuacaggcgcccgccac

SEQ ID NO: 1245668 - RNA, 22 nt, Human
ugggacuacaggcgcccgccac

SEQ ID NO: 1245669 - RNA, 24 nt, Human
ugggacuacaggcgcccgccacug

SEQ ID NO: 1245670 - RNA, 18 nt, Human
ugggauuacaggcgugag

SEQ ID NO: 1245671 - RNA, 19 nt, Human
ugggauuacaggcgugagc

SEQ ID NO: 1245672 - RNA, 21 nt, Human
ugggauuacaggcgugagcca

SEQ ID NO: 1245673 - RNA, 22 nt, Human
ugggauuacaggcgugagccac

SEQ ID NO: 1245674 - RNA, 23 nt, Human
ugggauuacaggcgugagccacc

SEQ ID NO: 1245675 - RNA, 24 nt, Human
ugggauuacaggcgugagccaccg

SEQ ID NO: 1245676 - RNA, 20 nt, Human
ugugaaaaguccugugggga

SEQ ID NO: 1245677 - RNA, 18 nt, Human
uuaguagagacgggguuu

SEQ ID NO: 1245678 - RNA, 22 nt, Human
uuaguagagacgggguuucacc

SEQ ID NO: 1245679 - RNA, 24 nt, Human
uuaguagagacgggguuucaccgu

SEQ ID NO: 1245680 - RNA, 22 nt, Human
uuauaauccccucaagcgcccc

SEQ ID NO: 1245681 - RNA, 24 nt, Human
uuccggguucacgccauucuccug

SEQ ID NO: 1245682 - RNA, 23 nt, Human
uuguauuuuuaguagagacgggg

SEQ ID NO: 1245683 - RNA, 24 nt, Human
uuuuuaguagagacgggguuucac

SEQ ID NO: 1245684 - RNA, 21 nt, Human
uuuuuguauuuuuaguagaga

SEQ ID NO: 1245685 - RNA, 24 nt, Human
uuuuuuguauuuuuaguagagacg

SEQ ID NO: 1245686 - RNA, 22 nt, Human
aaaagucaaagcaagccggaaa

SEQ ID NO: 1245687 - RNA, 23 nt, Human
aaacaggagcagcaggaggccug

SEQ ID NO: 1245688 - RNA, 23 nt, Human
aaaggauaccaaguucugcacuu

SEQ ID NO: 1245689 - RNA, 19 nt, Human
aacccagaaggaacagaac

SEQ ID NO: 1245690 - RNA, 18 nt, Human
aaggaacagaacuccccc

SEQ ID NO: 1245691 - RNA, 20 nt, Human
acucugcaggacaggcaggc

SEQ ID NO: 1245692 - RNA, 19 nt, Human
agacggcagaacccagggg

SEQ ID NO: 1245693 - RNA, 20 nt, Human
agaggacugggacugcauuu

SEQ ID NO: 1245694 - RNA, 21 nt, Human
agaggucacacauguggccuu

SEQ ID NO: 1245695 - RNA, 22 nt, Human
agcccccaagcccaaacguccc

SEQ ID NO: 1245696 - RNA, 18 nt, Human
aggaagagaagucagaga

SEQ ID NO: 1245697 - RNA, 23 nt, Human
aggagcagcaggaggccugcagc

SEQ ID NO: 1245698 - RNA, 19 nt, Human
aggcaagacggcagaaccc

SEQ ID NO: 1245699 - RNA, 21 nt, Human
aggcaagacggcagaacccag

SEQ ID NO: 1245700 - RNA, 23 nt, Human
aggcaagacggcagaacccaggg

SEQ ID NO: 1245701 - RNA, 20 nt, Human
aggcaccucacagccuagca

SEQ ID NO: 1245702 - RNA, 19 nt, Human
aggcccugagcaagaagga

SEQ ID NO: 1245703 - RNA, 20 nt, Human
aggggaagcagagaaggggc

SEQ ID NO: 1245704 - RNA, 23 nt, Human
auaaccaacaaguuuucccacaa

SEQ ID NO: 1245705 - RNA, 21 nt, Human
aucucaucuauaaaaugcggu

SEQ ID NO: 1245706 - RNA, 23 nt, Human
augcugacugucgaugaauggcu

SEQ ID NO: 1245707 - RNA, 21 nt, Human
caauaaccaacaaguuuuccc

SEQ ID NO: 1245708 - RNA, 18 nt, Human
cacauguggccuuagaac

SEQ ID NO: 1245709 - RNA, 24 nt, Human
cacuggcaucuuccucauagaguu

SEQ ID NO: 1245710 - RNA, 24 nt, Human
cagaaggaacagaacucccccaaa

SEQ ID NO: 1245711 - RNA, 21 nt, Human
caggcucccccacuugguccc

SEQ ID NO: 1245712 - RNA, 24 nt, Human
cagguaucccucccuccuagcuuc

SEQ ID NO: 1245713 - RNA, 23 nt, Human
ccagcccuggggcuuuggggcug

SEQ ID NO: 1245714 - RNA, 20 nt, Human
cccaaacgucccaccuccuc

SEQ ID NO: 1245715 - RNA, 21 nt, Human
cccaaccugggccuccagggc

SEQ ID NO: 1245716 - RNA, 20 nt, Human
cccagaaggaacagaacucc

SEQ ID NO: 1245717 - RNA, 21 nt, Human
ccccaaaagucaaagcaagcc

SEQ ID NO: 1245718 - RNA, 22 nt, Human
ccccaagcccaaacgucccacc

SEQ ID NO: 1245719 - RNA, 21 nt, Human
cccccaagcccaaacguccca

SEQ ID NO: 1245720 - RNA, 22 nt, Human
cccccaagcccaaacgucccac

SEQ ID NO: 1245721 - RNA, 18 nt, Human
cccugagccccagggcug

SEQ ID NO: 1245722 - RNA, 22 nt, Human
ccugcgggaccuucacugagcc

SEQ ID NO: 1245723 - RNA, 18 nt, Human
ccuggggcuuuggggcug

SEQ ID NO: 1245724 - RNA, 19 nt, Human
ccugugcuggaggggaagc

SEQ ID NO: 1245725 - RNA, 26 nt, Human
cuaaaggccuucacaaauaucacugg

SEQ ID NO: 1245726 - RNA, 18 nt, Human
cuaacccagaaggaacag

SEQ ID NO: 1245727 - RNA, 20 nt, Human
cucauagaguuguucuggag

SEQ ID NO: 1245728 - RNA, 18 nt, Human
cucccaaccugggccucc

SEQ ID NO: 1245729 - RNA, 23 nt, Human
cucccccacuuggucccugugcu

SEQ ID NO: 1245730 - RNA, 19 nt, Human
cugacugucgaugaauggc

SEQ ID NO: 1245731 - RNA, 20 nt, Human
cugcaggcucccccacuugg

SEQ ID NO: 1245732 - RNA, 22 nt, Human
cugucccaaacgggccagcccu

SEQ ID NO: 1245733 - RNA, 23 nt, Human
cugugcuggaggggaagcagaga

SEQ ID NO: 1245734 - RNA, 20 nt, Human
cuugaggagccacugugccu

SEQ ID NO: 1245735 - RNA, 21 nt, Human
cuugccgagcccccaagccca

SEQ ID NO: 1245736 - RNA, 19 nt, Human
cuugcuuuggugccugcua

SEQ ID NO: 1245737 - RNA, 25 nt, Human
gaacagaacucccccaaaagucaaa

SEQ ID NO: 1245738 - RNA, 18 nt, Human
gagcaagaaggaggugac

SEQ ID NO: 1245739 - RNA, 19 nt, Human
gagcagcaggaggccugca

SEQ ID NO: 1245740 - RNA, 20 nt, Human
gaggaagagaagucagagag

SEQ ID NO: 1245741 - RNA, 21 nt, Human
gaggaagagaagucagagagg

SEQ ID NO: 1245742 - RNA, 19 nt, Human
gaggaccagcaucuuuuag

SEQ ID NO: 1245743 - RNA, 20 nt, Human
gagggaagagcucuggugug

SEQ ID NO: 1245744 - RNA, 22 nt, Human
gcccgggguggcugcccugagc

SEQ ID NO: 1245745 - RNA, 19 nt, Human
gcuggaggggaagcagaga

SEQ ID NO: 1245746 - RNA, 23 nt, Human
ggacaagagaacagggcacaaga

SEQ ID NO: 1245747 - RNA, 20 nt, Human
ggcucccccacuuggucccu

SEQ ID NO: 1245748 - RNA, 24 nt, Human
ggcuggcagccucaucccugcggg

SEQ ID NO: 1245749 - RNA, 19 nt, Human
gggaagcagagaaggggcu

SEQ ID NO: 1245750 - RNA, 21 nt, Human
gggcugguccuggggucuguc

SEQ ID NO: 1245751 - RNA, 19 nt, Human
gggguggcugcccugagcc

SEQ ID NO: 1245752 - RNA, 21 nt, Human
guggaggaagagaagucagag

SEQ ID NO: 1245753 - RNA, 22 nt, Human
guggaggaagagaagucagaga

SEQ ID NO: 1245754 - RNA, 21 nt, Human
gugugucuugcuugccuugcc

SEQ ID NO: 1245755 - RNA, 22 nt, Human
uaaaggccuucacaaauaucac

SEQ ID NO: 1245756 - RNA, 19 nt, Human
uaacccagaaggaacagaa

SEQ ID NO: 1245757 - RNA, 23 nt, Human
uacggcauuugggugucgugguu

SEQ ID NO: 1245758 - RNA, 24 nt, Human
uagaaccugcuaaguccaacguca

SEQ ID NO: 1245759 - RNA, 21 nt, Human
ucacacauguggccuuagaac

SEQ ID NO: 1245760 - RNA, 21 nt, Human
ucacugagccuucuuggucac

SEQ ID NO: 1245761 - RNA, 20 nt, Human
ucagguguaagcuccaugcc

SEQ ID NO: 1245762 - RNA, 22 nt, Human
ucagucggucagcggcccgggg

SEQ ID NO: 1245763 - RNA, 23 nt, Human
uccaugccauggggacucugcag

SEQ ID NO: 1245764 - RNA, 21 nt, Human
uccuggggucugucaguccuu

SEQ ID NO: 1245765 - RNA, 21 nt, Human
ucuccccuagccucagcuauc

SEQ ID NO: 1245766 - RNA, 21 nt, Human
ucugcaggcucccccacuugg

SEQ ID NO: 1245767 - RNA, 23 nt, Human
ucugucaguccuuccccaggcuu

SEQ ID NO: 1245768 - RNA, 21 nt, Human
ugaccggagucuuccagguau

SEQ ID NO: 1245769 - RNA, 20 nt, Human
ugacucccaaccugggccuc

SEQ ID NO: 1245770 - RNA, 18 nt, Human
ugagccccagggcugguc

SEQ ID NO: 1245771 - RNA, 27 nt, Human
ugagccccagggcugguccuggggucu

SEQ ID NO: 1245772 - RNA, 18 nt, Human
ugcccuaaggcaccucac

SEQ ID NO: 1245773 - RNA, 20 nt, Human
ugcccuaaggcaccucacag

SEQ ID NO: 1245774 - RNA, 24 nt, Human
ugcccugagccccagggcuggucc

SEQ ID NO: 1245775 - RNA, 18 nt, Human
ugccgagcccccaagccc

SEQ ID NO: 1245776 - RNA, 19 nt, Human
ugccgagcccccaagccca

SEQ ID NO: 1245777 - RNA, 20 nt, Human
ugccuggacagguucugcag

SEQ ID NO: 1245778 - RNA, 21 nt, Human
ugccuggacagguucugcagg

SEQ ID NO: 1245779 - RNA, 21 nt, Human
ugcuuuggugccugcuauagg

SEQ ID NO: 1245780 - RNA, 21 nt, Human
uggaagugggagucggggagg

SEQ ID NO: 1245781 - RNA, 24 nt, Human
uggcagccucaucccugcgggacc

SEQ ID NO: 1245782 - RNA, 26 nt, Human
uggcagggagucugagagugagguug

SEQ ID NO: 1245783 - RNA, 20 nt, Human
ugguggaggaagagaaguca

SEQ ID NO: 1245784 - RNA, 27 nt, Human
ugucuugcuugccuugccgagccccca

SEQ ID NO: 1245785 - RNA, 23 nt, Human
uucagcaucacauaggagaugaa

SEQ ID NO: 1245786 - RNA, 18 nt, Human
uuccagguccagaaggcu

SEQ ID NO: 1245787 - RNA, 22 nt, Human
uucccacaagaaaaaaauaucc

SEQ ID NO: 1245788 - RNA, 23 nt, Human
uucuggaagugggagucggggag

SEQ ID NO: 1245789 - RNA, 19 nt, Human
uugccgagcccccaagccc

SEQ ID NO: 1245790 - RNA, 22 nt, Human
uuggucuucagcaucacauagg

SEQ ID NO: 1245791 - RNA, 25 nt, Human
aaagaaccauuauacgaaggccuua

SEQ ID NO: 1245792 - RNA, 24 nt, Human
aaagacuguccaaagggauucucc

SEQ ID NO: 1245793 - RNA, 22 nt, Human
aagcagcgaucuaaguaagaca

SEQ ID NO: 1245794 - RNA, 21 nt, Human
aauaaagacuguccaaaggga

SEQ ID NO: 1245795 - RNA, 22 nt, Human
acacauuuccagaauaacucuc

SEQ ID NO: 1245796 - RNA, 25 nt, Human
agaaaaauaaagacuguccaaaggg

SEQ ID NO: 1245797 - RNA, 21 nt, Human
aggagaugcaucagcugguac

SEQ ID NO: 1245798 - RNA, 18 nt, Human
aggaggaagagaguuuuc

SEQ ID NO: 1245799 - RNA, 24 nt, Human
aggaggaagagaguuuucaccaaa

SEQ ID NO: 1245800 - RNA, 20 nt, Human
cacagaauggaaaauagaau

SEQ ID NO: 1245801 - RNA, 21 nt, Human
caccaaaaaaaaaaucauuua

SEQ ID NO: 1245802 - RNA, 24 nt, Human
cagaauggaaaauagaaucaaagg

SEQ ID NO: 1245803 - RNA, 18 nt, Human
cauuucguucccuuguca

SEQ ID NO: 1245804 - RNA, 26 nt, Human
cauuucguucccuugucagaguugua

SEQ ID NO: 1245805 - RNA, 19 nt, Human
ccggcgcaggccuggcugg

SEQ ID NO: 1245806 - RNA, 22 nt, Human
ccgguggaguuguuguucuucu

SEQ ID NO: 1245807 - RNA, 31 nt, Human
ccuguacacagcgaaaacagaacuuauguag

SEQ ID NO: 1245808 - RNA, 29 nt, Human
cuaacccuucaaacaguacuccacuaucc

SEQ ID NO: 1245809 - RNA, 22 nt, Human
cucacagaauggaaaauagaau

SEQ ID NO: 1245810 - RNA, 23 nt, Human
cugcaguagacgacauucuuccu

SEQ ID NO: 1245811 - RNA, 23 nt, Human
cugcuagcaguaucauuuucuuc

SEQ ID NO: 1245812 - RNA, 20 nt, Human
cuggcuggggcgcucgccgc

SEQ ID NO: 1245813 - RNA, 24 nt, Human
gaggaugccggcgcaggccuggcu

SEQ ID NO: 1245814 - RNA, 22 nt, Human
gcuuuaggugaaaaguugucca

SEQ ID NO: 1245815 - RNA, 21 nt, Human
guacuccacuauccgguggag

SEQ ID NO: 1245816 - RNA, 19 nt, Human
gugcauaucuuugagggug

SEQ ID NO: 1245817 - RNA, 19 nt, Human
uaaaaugccucaauuuaac

SEQ ID NO: 1245818 - RNA, 19 nt, Human
uaaacugugcagauuaaaa

SEQ ID NO: 1245819 - RNA, 25 nt, Human
uaaauuuuuauuuuggcagaagaua

SEQ ID NO: 1245820 - RNA, 21 nt, Human
uaagaagaaaaauaaagacug

SEQ ID NO: 1245821 - RNA, 21 nt, Human
uaggacacuuagaaucaggag

SEQ ID NO: 1245822 - RNA, 23 nt, Human
ucaaaaauacucauugacuaccu

SEQ ID NO: 1245823 - RNA, 22 nt, Human
ucaaagggcuguuuacauagug

SEQ ID NO: 1245824 - RNA, 19 nt, Human
ucaauaccguauggcuuua

SEQ ID NO: 1245825 - RNA, 24 nt, Human
uccagauaaacaaguauauaaagg

SEQ ID NO: 1245826 - RNA, 24 nt, Human
ucuccuagcuuauaacacauuucc

SEQ ID NO: 1245827 - RNA, 20 nt, Human
ugagggugggacauacauuu

SEQ ID NO: 1245828 - RNA, 18 nt, Human
ugccggcgcaggccuggc

SEQ ID NO: 1245829 - RNA, 18 nt, Human
uggcuuuaugaaauaacu

SEQ ID NO: 1245830 - RNA, 19 nt, Human
ugggacauacauuuugaac

SEQ ID NO: 1245831 - RNA, 19 nt, Human
uguacacagcgaaaacaga

SEQ ID NO: 1245832 - RNA, 20 nt, Human
uguacacagcgaaaacagaa

SEQ ID NO: 1245833 - RNA, 20 nt, Human
uucguucccuugucagaguu

SEQ ID NO: 1245834 - RNA, 24 nt, Human
uuuuacuggcaguccagauaaaca

SEQ ID NO: 1245835 - RNA, 24 nt, Human
ggcgggcgagcgggccaggggccg

SEQ ID NO: 1245836 - RNA, 20 nt, Human
aaccuauguccccauuccuc

SEQ ID NO: 1245837 - RNA, 19 nt, Human
aaggggguccagcugggcc

SEQ ID NO: 1245838 - RNA, 20 nt, Human
aaggggguccagcugggccc

SEQ ID NO: 1245839 - RNA, 26 nt, Human
aauucacagaaucauugcucuccucu

SEQ ID NO: 1245840 - RNA, 24 nt, Human
aggggguccagcugggccaucagg

SEQ ID NO: 1245841 - RNA, 20 nt, Human
auguuccaguuucagagacu

SEQ ID NO: 1245842 - RNA, 19 nt, Human
cacaaauuccccaaaaauu

SEQ ID NO: 1245843 - RNA, 23 nt, Human
cacaaauuccccaaaaauucaca

SEQ ID NO: 1245844 - RNA, 20 nt, Human
cacacugaagaaauguccac

SEQ ID NO: 1245845 - RNA, 24 nt, Human
cacagaaucauugcucuccucacc

SEQ ID NO: 1245846 - RNA, 20 nt, Human
cacagccuggcugcaccuuc

SEQ ID NO: 1245847 - RNA, 23 nt, Human
cagaaguccucaggaagaggucu

SEQ ID NO: 1245848 - RNA, 27 nt, Human
cagcagacucgccucccgagccuucac

SEQ ID NO: 1245849 - RNA, 21 nt, Human
ccacggguggagggaucgggc

SEQ ID NO: 1245850 - RNA, 20 nt, Human
cccauuccucccuccugcca

SEQ ID NO: 1245851 - RNA, 19 nt, Human
ccccgccccaccucccagg

SEQ ID NO: 1245852 - RNA, 21 nt, Human
ccccgccccaccucccaggaa

SEQ ID NO: 1245853 - RNA, 18 nt, Human
ccggcccacggguggagg

SEQ ID NO: 1245854 - RNA, 19 nt, Human
ccucaggaagaggucugcu

SEQ ID NO: 1245855 - RNA, 25 nt, Human
ccucaggaagaggucugcuggccuc

SEQ ID NO: 1245856 - RNA, 23 nt, Human
ccucccgagccuucaccugguuc

SEQ ID NO: 1245857 - RNA, 18 nt, Human
ccuccuuuaaacagaagu

SEQ ID NO: 1245858 - RNA, 21 nt, Human
ccuucaccugguucugaagcc

SEQ ID NO: 1245859 - RNA, 26 nt, Human
cgccccaccucccaggaaguagcuag

SEQ ID NO: 1245860 - RNA, 20 nt, Human
cgccucccgagccuucaccu

SEQ ID NO: 1245861 - RNA, 22 nt, Human
cgggcggugccgaagcgguccg

SEQ ID NO: 1245862 - RNA, 22 nt, Human
cguaguccccgccccaccuccc

SEQ ID NO: 1245863 - RNA, 22 nt, Human
cuagguuccaugucucugugcu

SEQ ID NO: 1245864 - RNA, 23 nt, Human
cucccaggccugacugucaccaa

SEQ ID NO: 1245865 - RNA, 23 nt, Human
cuccugcugggcuccagccagag

SEQ ID NO: 1245866 - RNA, 21 nt, Human
cucuccucaccgcucaaaaag

SEQ ID NO: 1245867 - RNA, 21 nt, Human
cugccacaaauuccccaaaaa

SEQ ID NO: 1245868 - RNA, 18 nt, Human
cugcuggccucugugugg

SEQ ID NO: 1245869 - RNA, 20 nt, Human
cugcugggcuccagccagag

SEQ ID NO: 1245870 - RNA, 21 nt, Human
cugcugggcuccagccagagu

SEQ ID NO: 1245871 - RNA, 24 nt, Human
cugggccagcuguugcucugggga

SEQ ID NO: 1245872 - RNA, 20 nt, Human
cugugcuccaguuugugggc

SEQ ID NO: 1245873 - RNA, 20 nt, Human
gaagaggucugcuggccucu

SEQ ID NO: 1245874 - RNA, 20 nt, Human
gcuguugcucuggggauaag

SEQ ID NO: 1245875 - RNA, 21 nt, Human
gguccagcugggccaucaggu

SEQ ID NO: 1245876 - RNA, 22 nt, Human
gugcugcucugucugggccagc

SEQ ID NO: 1245877 - RNA, 19 nt, Human
gugggcuccucccaggccu

SEQ ID NO: 1245878 - RNA, 24 nt, Human
ucaccaaucuccuccucguccucc

SEQ ID NO: 1245879 - RNA, 22 nt, Human
ucccaaccuauguccccauucc

SEQ ID NO: 1245880 - RNA, 19 nt, Human
uccccgccccaccucccag

SEQ ID NO: 1245881 - RNA, 18 nt, Human
uccggcauuggccggccg

SEQ ID NO: 1245882 - RNA, 24 nt, Human
uccguaguccccgccccaccuccc

SEQ ID NO: 1245883 - RNA, 21 nt, Human
uccuccucguccuccuuuaaa

SEQ ID NO: 1245884 - RNA, 23 nt, Human
uccugccacaaauuccccaaaaa

SEQ ID NO: 1245885 - RNA, 21 nt, Human
ugccacaaauuccccaaaaau

SEQ ID NO: 1245886 - RNA, 30 nt, Human
ugccacaaauuccccaaaaauucacagaag

SEQ ID NO: 1245887 - RNA, 19 nt, Human
ugcugggcuccagccagag

SEQ ID NO: 1245888 - RNA, 18 nt, Human
ugggcuccucccaggccu

SEQ ID NO: 1245889 - RNA, 19 nt, Human
uguucaggugcugcucugu

SEQ ID NO: 1245890 - RNA, 23 nt, Human
uucagagacuuugucuccaccuc

SEQ ID NO: 1245891 - RNA, 19 nt, Human
uuguucaggugcugcucug

SEQ ID NO: 1245892 - RNA, 22 nt, Human
uuuaaacagaaguccucaggaa

SEQ ID NO: 1245893 - RNA, 22 nt, Human
uuugccacagccuggcugcacc

SEQ ID NO: 1245894 - RNA, 19 nt, Human
cacuggguggcaggggcca

SEQ ID NO: 1245895 - RNA, 24 nt, Human
ccacuggguggcaggggccaguuu

SEQ ID NO: 1245896 - RNA, 19 nt, Human
ccgcacuccaguaugacca

SEQ ID NO: 1245897 - RNA, 21 nt, Human
ccgcacuccaguaugaccaag

SEQ ID NO: 1245898 - RNA, 23 nt, Human
ccgcacuccaguaugaccaagag

SEQ ID NO: 1245899 - RNA, 21 nt, Human
gcugcgugcccugccgcacuc

SEQ ID NO: 1245900 - RNA, 27 nt, Human
ugcccugccgcacuccaguaugaccaa

SEQ ID NO: 1245901 - RNA, 21 nt, Human
uggcaggggccaguuucagca

SEQ ID NO: 1245902 - RNA, 18 nt, Human
uggguggcaggggccagu

SEQ ID NO: 1245903 - RNA, 19 nt, Human
uggguggcaggggccaguu

SEQ ID NO: 1245904 - RNA, 19 nt, Human
cacuggguggcaggggcca

SEQ ID NO: 1245905 - RNA, 24 nt, Human
ccacuggguggcaggggccaguuu

SEQ ID NO: 1245906 - RNA, 19 nt, Human
ccgcacuccaguaugacca

SEQ ID NO: 1245907 - RNA, 21 nt, Human
ccgcacuccaguaugaccaag

SEQ ID NO: 1245908 - RNA, 23 nt, Human
ccgcacuccaguaugaccaagag

SEQ ID NO: 1245909 - RNA, 21 nt, Human
gcugcgugcccugccgcacuc

SEQ ID NO: 1245910 - RNA, 27 nt, Human
ugcccugccgcacuccaguaugaccaa

SEQ ID NO: 1245911 - RNA, 21 nt, Human
uggcaggggccaguuucagca

SEQ ID NO: 1245912 - RNA, 18 nt, Human
uggguggcaggggccagu

SEQ ID NO: 1245913 - RNA, 19 nt, Human
uggguggcaggggccaguu

SEQ ID NO: 1245914 - RNA, 22 nt, Human
agcagcgccgacgaggccgaca

SEQ ID NO: 1245915 - RNA, 24 nt, Human
aggugcccgcccagcaccgcgccc

SEQ ID NO: 1245916 - RNA, 25 nt, Human
aggugcccgcccagcaccgcgcccu

SEQ ID NO: 1245917 - RNA, 22 nt, Human
cccuccgccacugccugauacc

SEQ ID NO: 1245918 - RNA, 22 nt, Human
ccuccgccacugccugauaccu

SEQ ID NO: 1245919 - RNA, 24 nt, Human
cuagagcccuccgccacugccuga

SEQ ID NO: 1245920 - RNA, 21 nt, Human
gccacugccugauaccucagc

SEQ ID NO: 1245921 - RNA, 19 nt, Human
ugccugauaccucagcagc

SEQ ID NO: 1245922 - RNA, 21 nt, Human
ugccugauaccucagcagcgc

SEQ ID NO: 1245923 - RNA, 22 nt, Human
aaacaggaauccaucaucaggc

SEQ ID NO: 1245924 - RNA, 20 nt, Human
aacccgggggccgcgaggcu

SEQ ID NO: 1245925 - RNA, 19 nt, Human
aagagcccaguccagcuac

SEQ ID NO: 1245926 - RNA, 22 nt, Human
accaccaacccgggggccgcga

SEQ ID NO: 1245927 - RNA, 20 nt, Human
acuuccaggaaugcguggaa

SEQ ID NO: 1245928 - RNA, 23 nt, Human
agagcaaugagccgagacccagg

SEQ ID NO: 1245929 - RNA, 18 nt, Human
agagcccaguccagcuac

SEQ ID NO: 1245930 - RNA, 22 nt, Human
aggcugggaucaggcaccccgg

SEQ ID NO: 1245931 - RNA, 20 nt, Human
aguggcgcugagcgugccca

SEQ ID NO: 1245932 - RNA, 20 nt, Human
cagagagcaaugagccgaga

SEQ ID NO: 1245933 - RNA, 18 nt, Human
caggaaacaggaauccau

SEQ ID NO: 1245934 - RNA, 20 nt, Human
ccaguccagcuacgccugcc

SEQ ID NO: 1245935 - RNA, 20 nt, Human
cccaagagcccaguccagcu

SEQ ID NO: 1245936 - RNA, 21 nt, Human
cccagaaacuuccaggaaugc

SEQ ID NO: 1245937 - RNA, 21 nt, Human
cccccgaaagcgugaccaugu

SEQ ID NO: 1245938 - RNA, 18 nt, Human
ccucacuguggcaggagc

SEQ ID NO: 1245939 - RNA, 24 nt, Human
ccucuguaaaggugccuguugcuc

SEQ ID NO: 1245940 - RNA, 19 nt, Human
ccugcaacagagcucgagg

SEQ ID NO: 1245941 - RNA, 19 nt, Human
cgccuggcuggcccaagag

SEQ ID NO: 1245942 - RNA, 21 nt, Human
gcagggccgcccacgcgggaa

SEQ ID NO: 1245943 - RNA, 24 nt, Human
gccgcccacgcgggaaaaccaacg

SEQ ID NO: 1245944 - RNA, 19 nt, Human
ggagcaguggcgcugagcc

SEQ ID NO: 1245945 - RNA, 25 nt, Human
ggggcagggccgcccacgcgggaaa

SEQ ID NO: 1245946 - RNA, 23 nt, Human
gucggugcucuccuuuccaguuu

SEQ ID NO: 1245947 - RNA, 18 nt, Human
uagcgucauuccuuuguu

SEQ ID NO: 1245948 - RNA, 21 nt, Human
uccccacguugagcccugcaa

SEQ ID NO: 1245949 - RNA, 18 nt, Human
ucccuguccucuuggugc

SEQ ID NO: 1245950 - RNA, 20 nt, Human
ucuuugcccucuguaaaggu

SEQ ID NO: 1245951 - RNA, 23 nt, Human
ugacuguuucgcgagcucugugg

SEQ ID NO: 1245952 - RNA, 28 nt, Human
ugagccgagacccagguaguugucuguu

SEQ ID NO: 1245953 - RNA, 21 nt, Human
ugauucuggauuccacguuuc

SEQ ID NO: 1245954 - RNA, 19 nt, Human
uggcaggagcaguggcgcu

SEQ ID NO: 1245955 - RNA, 22 nt, Human
ugggaucaggcaccccggagcc

SEQ ID NO: 1245956 - RNA, 23 nt, Human
uggggccccagaaacuuccagga

SEQ ID NO: 1245957 - RNA, 19 nt, Human
ugggucucucucauuuucc

SEQ ID NO: 1245958 - RNA, 19 nt, Human
ugguauggccguggacaau

SEQ ID NO: 1245959 - RNA, 20 nt, Human
uguggcaggagcaguggcgc

SEQ ID NO: 1245960 - RNA, 20 nt, Human
uucacagaugacauaucccc

SEQ ID NO: 1245961 - RNA, 22 nt, Human
uucacagaugacauauccccac

SEQ ID NO: 1245962 - RNA, 24 nt, Human
uuccaggaaugcguggaagaccag

SEQ ID NO: 1245963 - RNA, 20 nt, Human
uuguuggcuccucccugucc

SEQ ID NO: 1245964 - RNA, 21 nt, Human
aaaaagaaauucaauagaaag

SEQ ID NO: 1245965 - RNA, 22 nt, Human
aaacaauacagaacagaccagg

SEQ ID NO: 1245966 - RNA, 22 nt, Human
aaacaggaagugagaaaauggg

SEQ ID NO: 1245967 - RNA, 18 nt, Human
aagaacuggcaaggacuc

SEQ ID NO: 1245968 - RNA, 19 nt, Human
aagaagauacuucaauacc

SEQ ID NO: 1245969 - RNA, 21 nt, Human
aagagcuccccauccccaaag

SEQ ID NO: 1245970 - RNA, 28 nt, Human
aagagcuccccauccccaaagaacuggg

SEQ ID NO: 1245971 - RNA, 19 nt, Human
aagaucaaugggacagaau

SEQ ID NO: 1245972 - RNA, 21 nt, Human
acaaacauggcucccugaagc

SEQ ID NO: 1245973 - RNA, 22 nt, Human
acacggcuuucaagugccagag

SEQ ID NO: 1245974 - RNA, 26 nt, Human
acagagcacuccaccagguauuaaag

SEQ ID NO: 1245975 - RNA, 19 nt, Human
acauauccaaugccugcug

SEQ ID NO: 1245976 - RNA, 19 nt, Human
accaccuagaaccauggag

SEQ ID NO: 1245977 - RNA, 20 nt, Human
accccagcccugaccccacc

SEQ ID NO: 1245978 - RNA, 21 nt, Human
acucgccugcccagggccccu

SEQ ID NO: 1245979 - RNA, 20 nt, Human
agagcuccccauccccaaag

SEQ ID NO: 1245980 - RNA, 21 nt, Human
agcccugaccccaccuccucc

SEQ ID NO: 1245981 - RNA, 23 nt, Human
aggaagcuuccucaagcccaacu

SEQ ID NO: 1245982 - RNA, 18 nt, Human
auccucuauucuuggaga

SEQ ID NO: 1245983 - RNA, 24 nt, Human
caagagcaacauggaggucugcac

SEQ ID NO: 1245984 - RNA, 21 nt, Human
cacacuccccagagacucgcc

SEQ ID NO: 1245985 - RNA, 21 nt, Human
caccacacuccccagagacuc

SEQ ID NO: 1245986 - RNA, 24 nt, Human
caccacacuccccagagacucgcc

SEQ ID NO: 1245987 - RNA, 25 nt, Human
caccaccuaucauauggaaaaagaa

SEQ ID NO: 1245988 - RNA, 22 nt, Human
caccuuccagucaccacuacac

SEQ ID NO: 1245989 - RNA, 19 nt, Human
cagagcccccaaucuaacc

SEQ ID NO: 1245990 - RNA, 21 nt, Human
cagagcccccaaucuaaccuc

SEQ ID NO: 1245991 - RNA, 21 nt, Human
cagcaucuuacacaaggauuc

SEQ ID NO: 1245992 - RNA, 24 nt, Human
caggucagaucgguugaaaaaaua

SEQ ID NO: 1245993 - RNA, 18 nt, Human
cauauggaaaaagaaauu

SEQ ID NO: 1245994 - RNA, 21 nt, Human
caucaugaacucagaagaccu

SEQ ID NO: 1245995 - RNA, 21 nt, Human
ccacaaugaggucaaagggcg

SEQ ID NO: 1245996 - RNA, 20 nt, Human
ccacauaugucuucuccagg

SEQ ID NO: 1245997 - RNA, 21 nt, Human
ccacauaugucuucuccaggc

SEQ ID NO: 1245998 - RNA, 22 nt, Human
ccacauaugucuucuccaggca

SEQ ID NO: 1245999 - RNA, 22 nt, Human
ccaccacgccacauaugucuuc

SEQ ID NO: 1246000 - RNA, 22 nt, Human
ccacggaccccagcccugaccc

SEQ ID NO: 1246001 - RNA, 20 nt, Human
ccauguaagugaguuucaga

SEQ ID NO: 1246002 - RNA, 23 nt, Human
cccaacccgucggcccacggacc

SEQ ID NO: 1246003 - RNA, 23 nt, Human
cccagcccugaccccaccuccuc

SEQ ID NO: 1246004 - RNA, 25 nt, Human
cccagcccugaccccaccuccuccc

SEQ ID NO: 1246005 - RNA, 23 nt, Human
ccccagagacucgccugcccagg

SEQ ID NO: 1246006 - RNA, 18 nt, Human
cccccaacccgucggccc

SEQ ID NO: 1246007 - RNA, 24 nt, Human
cccccaacccgucggcccacggac

SEQ ID NO: 1246008 - RNA, 21 nt, Human
ccuccauagcauguaaagcuc

SEQ ID NO: 1246009 - RNA, 23 nt, Human
cgcagaaauaaguaaacagagca

SEQ ID NO: 1246010 - RNA, 19 nt, Human
cgcccugugaugucagaac

SEQ ID NO: 1246011 - RNA, 23 nt, Human
cggcuaauguuugacuguagcac

SEQ ID NO: 1246012 - RNA, 24 nt, Human
cgguugggacaaguaccggggucc

SEQ ID NO: 1246013 - RNA, 27 nt, Human
cgucggcccacggaccccagcccugac

SEQ ID NO: 1246014 - RNA, 21 nt, Human
cuaaguaucuuaaccaagguc

SEQ ID NO: 1246015 - RNA, 18 nt, Human
cuagaaccauggagagca

SEQ ID NO: 1246016 - RNA, 25 nt, Human
gaagcuuccucaagcccaacuauac

SEQ ID NO: 1246017 - RNA, 23 nt, Human
gccagagccaggacucagaucua

SEQ ID NO: 1246018 - RNA, 22 nt, Human
gcccuuauuucuccauuuggca

SEQ ID NO: 1246019 - RNA, 23 nt, Human
gcccuucaguuaaagaccaccag

SEQ ID NO: 1246020 - RNA, 27 nt, Human
gccugcccagggccccucucuaacccc

SEQ ID NO: 1246021 - RNA, 25 nt, Human
gcuccagagcccccaaucuaaccuc

SEQ ID NO: 1246022 - RNA, 25 nt, Human
ggaagaacagagacggucauggaaa

SEQ ID NO: 1246023 - RNA, 19 nt, Human
ggaccccagcccugacccc

SEQ ID NO: 1246024 - RNA, 23 nt, Human
ggagcacacuuguaaguaaauau

SEQ ID NO: 1246025 - RNA, 19 nt, Human
gguugaaaaaauaaaacua

SEQ ID NO: 1246026 - RNA, 23 nt, Human
gugcagggcccugagaugggguc

SEQ ID NO: 1246027 - RNA, 21 nt, Human
uaaaacaauacagaacagacc

SEQ ID NO: 1246028 - RNA, 21 nt, Human
uaaaacuaacaaauuuuuaca

SEQ ID NO: 1246029 - RNA, 22 nt, Human
uaaagaccaccaggagcacacu

SEQ ID NO: 1246030 - RNA, 18 nt, Human
uaagagcuccccaucccc

SEQ ID NO: 1246031 - RNA, 21 nt, Human
uacaacccuguguuaauauua

SEQ ID NO: 1246032 - RNA, 18 nt, Human
uagaaaauccauaguaac

SEQ ID NO: 1246033 - RNA, 20 nt, Human
uagaaaauccauaguaacau

SEQ ID NO: 1246034 - RNA, 19 nt, Human
uagcacaugugagaggccc

SEQ ID NO: 1246035 - RNA, 19 nt, Human
uaggugcccuuauuucucc

SEQ ID NO: 1246036 - RNA, 23 nt, Human
ucaccagugacccagucagugcc

SEQ ID NO: 1246037 - RNA, 23 nt, Human
ucaccugccaccauaaugugaau

SEQ ID NO: 1246038 - RNA, 23 nt, Human
uccagagcccccaaucuaaccuc

SEQ ID NO: 1246039 - RNA, 19 nt, Human
uccagucaccacuacaccu

SEQ ID NO: 1246040 - RNA, 24 nt, Human
uccauuccaccacgccacauaugu

SEQ ID NO: 1246041 - RNA, 20 nt, Human
uccccagagacucgccugcc

SEQ ID NO: 1246042 - RNA, 19 nt, Human
ucccugaagccgcucaggc

SEQ ID NO: 1246043 - RNA, 21 nt, Human
ucccugaagccgcucaggcuc

SEQ ID NO: 1246044 - RNA, 21 nt, Human
ucccugacgcuggccaucccc

SEQ ID NO: 1246045 - RNA, 25 nt, Human
ucgcccgucaagacgggccagggcu

SEQ ID NO: 1246046 - RNA, 21 nt, Human
ucucaccacacuccccagaga

SEQ ID NO: 1246047 - RNA, 24 nt, Human
ucucaucacuuagaaacccuacag

SEQ ID NO: 1246048 - RNA, 20 nt, Human
ucuccauuuggcagagaggg

SEQ ID NO: 1246049 - RNA, 23 nt, Human
ucucuuuguauugucugucaccu

SEQ ID NO: 1246050 - RNA, 19 nt, Human
ucuuggagaucugaaugcc

SEQ ID NO: 1246051 - RNA, 20 nt, Human
ugaaguguauuaacuugugu

SEQ ID NO: 1246052 - RNA, 23 nt, Human
ugacacaaaucgauaauuaacug

SEQ ID NO: 1246053 - RNA, 22 nt, Human
ugaccccaccuccucccagcau

SEQ ID NO: 1246054 - RNA, 20 nt, Human
ugagaggcgaauaacauugc

SEQ ID NO: 1246055 - RNA, 19 nt, Human
ugagauggggucugacuca

SEQ ID NO: 1246056 - RNA, 20 nt, Human
ugaggaagcuuccucaagcc

SEQ ID NO: 1246057 - RNA, 22 nt, Human
ugaggacauaggugguggaguc

SEQ ID NO: 1246058 - RNA, 21 nt, Human
ugaggucaaagggcggucuca

SEQ ID NO: 1246059 - RNA, 23 nt, Human
ugaucccugacgcuggccauccc

SEQ ID NO: 1246060 - RNA, 24 nt, Human
ugccugcugcugaccacagggauu

SEQ ID NO: 1246061 - RNA, 19 nt, Human
ugcuaaacucaugaauacu

SEQ ID NO: 1246062 - RNA, 20 nt, Human
uggcuccuuuuagcacuccu

SEQ ID NO: 1246063 - RNA, 19 nt, Human
uguaaucacacaacuaccc

SEQ ID NO: 1246064 - RNA, 22 nt, Human
uguaauuaaaacaauacagaac

SEQ ID NO: 1246065 - RNA, 23 nt, Human
uguaauuaaaacaauacagaaca

SEQ ID NO: 1246066 - RNA, 22 nt, Human
uguagaaugaggaagcuuccuc

SEQ ID NO: 1246067 - RNA, 21 nt, Human
uguauugucugucaccugcca

SEQ ID NO: 1246068 - RNA, 22 nt, Human
ugucacagaucucaucacuuag

SEQ ID NO: 1246069 - RNA, 22 nt, Human
ugugcagggcccugagaugggg

SEQ ID NO: 1246070 - RNA, 22 nt, Human
uuccuccugggaagcucuuucu

SEQ ID NO: 1246071 - RNA, 26 nt, Human
uugacacacaaacaggaagugagaaa

SEQ ID NO: 1246072 - RNA, 19 nt, Human
uuucuccauuuggcagaga

SEQ ID NO: 1246073 - RNA, 18 nt, Human
uuugaaaauccaaggcua

SEQ ID NO: 1246074 - RNA, 24 nt, Human
aaaagaaccaacauggaugcaugg

SEQ ID NO: 1246075 - RNA, 21 nt, Human
aaaaugaaacaagcuuagccc

SEQ ID NO: 1246076 - RNA, 22 nt, Human
aaaaugaaacaagcuuagccca

SEQ ID NO: 1246077 - RNA, 21 nt, Human
aaacaggcacucacacuuuca

SEQ ID NO: 1246078 - RNA, 19 nt, Human
aaauacaaaaagcaagccc

SEQ ID NO: 1246079 - RNA, 18 nt, Human
aaaugaagcuaacaaaua

SEQ ID NO: 1246080 - RNA, 21 nt, Human
aaaugggaauaauaagaauau

SEQ ID NO: 1246081 - RNA, 19 nt, Human
aaccugcaaagguacccuc

SEQ ID NO: 1246082 - RNA, 20 nt, Human
aacugcccacauuuuugcca

SEQ ID NO: 1246083 - RNA, 18 nt, Human
aacuuccucuucuucucu

SEQ ID NO: 1246084 - RNA, 20 nt, Human
aagaacccuccuggggaaga

SEQ ID NO: 1246085 - RNA, 18 nt, Human
aagcacaggcuucucuug

SEQ ID NO: 1246086 - RNA, 20 nt, Human
aagccuuccuuacaaacacc

SEQ ID NO: 1246087 - RNA, 20 nt, Human
aaggccacaaaaaaucagaa

SEQ ID NO: 1246088 - RNA, 24 nt, Human
aaggccacaaaaaaucagaacgua

SEQ ID NO: 1246089 - RNA, 24 nt, Human
aagugaucuguccaccuuggccuc

SEQ ID NO: 1246090 - RNA, 24 nt, Human
aagugauucuccugccucacccuc

SEQ ID NO: 1246091 - RNA, 24 nt, Human
aauaauaaucauaaucaugaaaau

SEQ ID NO: 1246092 - RNA, 21 nt, Human
aauagaaggguucugccugga

SEQ ID NO: 1246093 - RNA, 19 nt, Human
aauaucuacuuaaucucaa

SEQ ID NO: 1246094 - RNA, 27 nt, Human
acaaaaagcaagcccauggaugucaac

SEQ ID NO: 1246095 - RNA, 21 nt, Human
acacuugcagguuaacagccu

SEQ ID NO: 1246096 - RNA, 18 nt, Human
acagccucaggggaagac

SEQ ID NO: 1246097 - RNA, 18 nt, Human
acagcucauugcagccuc

SEQ ID NO: 1246098 - RNA, 21 nt, Human
acaggguuucaccauguuggc

SEQ ID NO: 1246099 - RNA, 21 nt, Human
acaggguuucaccauguuggc

SEQ ID NO: 1246100 - RNA, 24 nt, Human
acaggguuucaccauguuggccag

SEQ ID NO: 1246101 - RNA, 18 nt, Human
accacuguccuggccugu

SEQ ID NO: 1246102 - RNA, 27 nt, Human
accacuguccuggccuguuuccugucg

SEQ ID NO: 1246103 - RNA, 23 nt, Human
accauguuggccagguuggucuc

SEQ ID NO: 1246104 - RNA, 22 nt, Human
acccacucuuuugcccuuccca

SEQ ID NO: 1246105 - RNA, 25 nt, Human
acccaggcuggaagugcaguggcau

SEQ ID NO: 1246106 - RNA, 18 nt, Human
acccuccagaguagcugg

SEQ ID NO: 1246107 - RNA, 24 nt, Human
accuggcuaauuuuuuuguauuuu

SEQ ID NO: 1246108 - RNA, 24 nt, Human
accuugguuucccauaaugcuggg

SEQ ID NO: 1246109 - RNA, 19 nt, Human
acgggguuuugauauguug

SEQ ID NO: 1246110 - RNA, 24 nt, Human
acgggguuuugauauguugcucag

SEQ ID NO: 1246111 - RNA, 28 nt, Human
acuaucuuauauucacacauguguuggu

SEQ ID NO: 1246112 - RNA, 25 nt, Human
acucuguugcccaggcuggaguuca

SEQ ID NO: 1246113 - RNA, 21 nt, Human
acugcaaccuuccucuccugg

SEQ ID NO: 1246114 - RNA, 22 nt, Human
acugcaaccuuccucuccuggg

SEQ ID NO: 1246115 - RNA, 26 nt, Human
acugugucacccaggcuggaagugca

SEQ ID NO: 1246116 - RNA, 20 nt, Human
agagaccuaccaccaggaua

SEQ ID NO: 1246117 - RNA, 23 nt, Human
agcacaaauacagcccagaaaca

SEQ ID NO: 1246118 - RNA, 23 nt, Human
agccccuucccaucuugucuuug

SEQ ID NO: 1246119 - RNA, 19 nt, Human
agcuggguaaugagagacc

SEQ ID NO: 1246120 - RNA, 19 nt, Human
aggaaugugguaguaaagg

SEQ ID NO: 1246121 - RNA, 20 nt, Human
aggauuuugccugagcacaa

SEQ ID NO: 1246122 - RNA, 20 nt, Human
aggcaaucugcccaccuugg

SEQ ID NO: 1246123 - RNA, 23 nt, Human
aggcaggaguaucacuucaaccc

SEQ ID NO: 1246124 - RNA, 18 nt, Human
aggcuaaacuuuuuucuu

SEQ ID NO: 1246125 - RNA, 22 nt, Human
aggcucaggugauccuccuacc

SEQ ID NO: 1246126 - RNA, 18 nt, Human
aggcugagauagcuccca

SEQ ID NO: 1246127 - RNA, 19 nt, Human
aggcugaggcaggaguauc

SEQ ID NO: 1246128 - RNA, 24 nt, Human
agggacuacaggcaugagccacca

SEQ ID NO: 1246129 - RNA, 19 nt, Human
aguaccuucuaacuacuga

SEQ ID NO: 1246130 - RNA, 23 nt, Human
aguagcuggaauuauagacgugu

SEQ ID NO: 1246131 - RNA, 18 nt, Human
aguagcugggauuacagg

SEQ ID NO: 1246132 - RNA, 22 nt, Human
aguaggcacaggguuucaccau

SEQ ID NO: 1246133 - RNA, 19 nt, Human
agucucagccaccgugaga

SEQ ID NO: 1246134 - RNA, 21 nt, Human
agugcaguggcaugaucacag

SEQ ID NO: 1246135 - RNA, 23 nt, Human
agugcaguggcaugaucacagcu

SEQ ID NO: 1246136 - RNA, 24 nt, Human
agugcaguggcaugaucacagcuc

SEQ ID NO: 1246137 - RNA, 24 nt, Human
aguggcaugaucucagcuuacugc

SEQ ID NO: 1246138 - RNA, 23 nt, Human
aucaaauaauuucucuacuuuac

SEQ ID NO: 1246139 - RNA, 23 nt, Human
aucauucaauaauaaucauaauc

SEQ ID NO: 1246140 - RNA, 22 nt, Human
aucccagccaaucugauugcaa

SEQ ID NO: 1246141 - RNA, 18 nt, Human
aucucacucuuuccuuag

SEQ ID NO: 1246142 - RNA, 22 nt, Human
aucuuccuauguuguccaggcu

SEQ ID NO: 1246143 - RNA, 23 nt, Human
aucuuccuauguuguccaggcug

SEQ ID NO: 1246144 - RNA, 19 nt, Human
augcaauacuuuuuuuugg

SEQ ID NO: 1246145 - RNA, 22 nt, Human
auguacccuacaaauauguaua

SEQ ID NO: 1246146 - RNA, 20 nt, Human
augucuccugccucauaagu

SEQ ID NO: 1246147 - RNA, 19 nt, Human
auguggggauaaaagaacc

SEQ ID NO: 1246148 - RNA, 20 nt, Human
auucagggcagggguccucu

SEQ ID NO: 1246149 - RNA, 20 nt, Human
auuuggagacagaaucucac

SEQ ID NO: 1246150 - RNA, 24 nt, Human
caaauugcugggaugacuggcaug

SEQ ID NO: 1246151 - RNA, 20 nt, Human
caaccuuccucuccuggguu

SEQ ID NO: 1246152 - RNA, 18 nt, Human
caacuccauagaaauuca

SEQ ID NO: 1246153 - RNA, 21 nt, Human
caacuccauagaaauucagcu

SEQ ID NO: 1246154 - RNA, 21 nt, Human
caagcauauaaagcccauuuc

SEQ ID NO: 1246155 - RNA, 22 nt, Human
caagggauccuccugccucagc

SEQ ID NO: 1246156 - RNA, 20 nt, Human
caagugauucuccugccuca

SEQ ID NO: 1246157 - RNA, 20 nt, Human
caauggcaguuaaugcuuau

SEQ ID NO: 1246158 - RNA, 23 nt, Human
cacaaagccauccaagcauauaa

SEQ ID NO: 1246159 - RNA, 19 nt, Human
cacacaaguguuccagaag

SEQ ID NO: 1246160 - RNA, 23 nt, Human
cacacaauacacccauguaauaa

SEQ ID NO: 1246161 - RNA, 20 nt, Human
cacaguuugcacuuugaaau

SEQ ID NO: 1246162 - RNA, 24 nt, Human
caccacaccuggcuaauuuuugua

SEQ ID NO: 1246163 - RNA, 21 nt, Human
caccauguuggccagguuggu

SEQ ID NO: 1246164 - RNA, 22 nt, Human
caccauguuggccagguugguc

SEQ ID NO: 1246165 - RNA, 24 nt, Human
caccauguuggccagguuggucuc

SEQ ID NO: 1246166 - RNA, 23 nt, Human
cacccacucuuuugcccuuccca

SEQ ID NO: 1246167 - RNA, 24 nt, Human
cacccuguaaaagccuuccuuaca

SEQ ID NO: 1246168 - RNA, 22 nt, Human
caccuucucaagugcaggauuc

SEQ ID NO: 1246169 - RNA, 19 nt, Human
cacuacacauuguaugcau

SEQ ID NO: 1246170 - RNA, 22 nt, Human
cacucuguugcccaggcuggag

SEQ ID NO: 1246171 - RNA, 21 nt, Human
cacuuaaaaaaugcacugaga

SEQ ID NO: 1246172 - RNA, 20 nt, Human
cacuuacccugauacagaaa

SEQ ID NO: 1246173 - RNA, 19 nt, Human
cacuuugaaauggacccag

SEQ ID NO: 1246174 - RNA, 22 nt, Human
cagaagauugccuacagaggca

SEQ ID NO: 1246175 - RNA, 21 nt, Human
cagaaguugguuaauggacac

SEQ ID NO: 1246176 - RNA, 24 nt, Human
cagaaucucacucuguugcccagg

SEQ ID NO: 1246177 - RNA, 19 nt, Human
cagcaucacacaauacacc

SEQ ID NO: 1246178 - RNA, 21 nt, Human
cagcaucacacaauacaccca

SEQ ID NO: 1246179 - RNA, 18 nt, Human
cagccaccacgcacagcc

SEQ ID NO: 1246180 - RNA, 19 nt, Human
cagccuccugaguagcugg

SEQ ID NO: 1246181 - RNA, 24 nt, Human
cagcuacucaggaggcugaggcag

SEQ ID NO: 1246182 - RNA, 23 nt, Human
cagcucauugcagccucuacauc

SEQ ID NO: 1246183 - RNA, 24 nt, Human
caggaggcugaggcaggaguauca

SEQ ID NO: 1246184 - RNA, 18 nt, Human
cagggccugguccaugga

SEQ ID NO: 1246185 - RNA, 24 nt, Human
cagggucucacugugucacccagg

SEQ ID NO: 1246186 - RNA, 24 nt, Human
caggguuucaccauguuggccagg

SEQ ID NO: 1246187 - RNA, 19 nt, Human
caguggcaugaucucagcu

SEQ ID NO: 1246188 - RNA, 21 nt, Human
cauaacaagcugcaaacaaga

SEQ ID NO: 1246189 - RNA, 22 nt, Human
cauaaugcugggauuacaggug

SEQ ID NO: 1246190 - RNA, 22 nt, Human
caugcaccacuguccuggccug

SEQ ID NO: 1246191 - RNA, 20 nt, Human
caugggcagggccuggucca

SEQ ID NO: 1246192 - RNA, 21 nt, Human
cauuuuaaacuaacacugagu

SEQ ID NO: 1246193 - RNA, 23 nt, Human
cauuuuagaccacugagcacuuu

SEQ ID NO: 1246194 - RNA, 23 nt, Human
ccaaauacaaaaagcaagcccau

SEQ ID NO: 1246195 - RNA, 18 nt, Human
ccacaaagccauccaagc

SEQ ID NO: 1246196 - RNA, 22 nt, Human
ccacaaggucaaaguugagugu

SEQ ID NO: 1246197 - RNA, 19 nt, Human
ccacuggacuaguucccuu

SEQ ID NO: 1246198 - RNA, 23 nt, Human
ccacuggacuaguucccuuuuau

SEQ ID NO: 1246199 - RNA, 19 nt, Human
ccagaguagcugggauuac

SEQ ID NO: 1246200 - RNA, 22 nt, Human
ccagaguagcugggauuacagg

SEQ ID NO: 1246201 - RNA, 24 nt, Human
ccagaguagcugggauuacaggug

SEQ ID NO: 1246202 - RNA, 23 nt, Human
ccagccaccacgcacagccacaa

SEQ ID NO: 1246203 - RNA, 20 nt, Human
ccaggguacagucaguggag

SEQ ID NO: 1246204 - RNA, 21 nt, Human
ccauaaugcugggauuacagg

SEQ ID NO: 1246205 - RNA, 24 nt, Human
cccaaguagcagggacuacaggca

SEQ ID NO: 1246206 - RNA, 19 nt, Human
cccacauuugcauuauguc

SEQ ID NO: 1246207 - RNA, 22 nt, Human
cccacauuugcauuaugucuaa

SEQ ID NO: 1246208 - RNA, 23 nt, Human
cccaggcuggaguucaguggcau

SEQ ID NO: 1246209 - RNA, 21 nt, Human
cccaucauuuguuugcuguug

SEQ ID NO: 1246210 - RNA, 18 nt, Human
cccaugcaagcugcaucc

SEQ ID NO: 1246211 - RNA, 19 nt, Human
cccaugcaagcugcaucca

SEQ ID NO: 1246212 - RNA, 20 nt, Human
cccaugcaagcugcauccac

SEQ ID NO: 1246213 - RNA, 21 nt, Human
cccaugguccaccuuuuuauu

SEQ ID NO: 1246214 - RNA, 19 nt, Human
ccccaugcaagcugcaucc

SEQ ID NO: 1246215 - RNA, 24 nt, Human
ccccccauucagccagcacugagc

SEQ ID NO: 1246216 - RNA, 23 nt, Human
cccugagugcccagcgugugccc

SEQ ID NO: 1246217 - RNA, 18 nt, Human
cccugauacagaaagaag

SEQ ID NO: 1246218 - RNA, 25 nt, Human
cccuucagaaagcagauccuugggc

SEQ ID NO: 1246219 - RNA, 20 nt, Human
cccuuuucauccacccacuc

SEQ ID NO: 1246220 - RNA, 23 nt, Human
ccuaccucagccucccaaguagc

SEQ ID NO: 1246221 - RNA, 26 nt, Human
ccuccaaauacaaaaagcaagcccau

SEQ ID NO: 1246222 - RNA, 22 nt, Human
ccuccgaaaucuaaaaugaaag

SEQ ID NO: 1246223 - RNA, 20 nt, Human
ccuccugcuuuuagucauuu

SEQ ID NO: 1246224 - RNA, 19 nt, Human
ccugaguagcuggaauuau

SEQ ID NO: 1246225 - RNA, 19 nt, Human
ccugauccaugaaucucug

SEQ ID NO: 1246226 - RNA, 24 nt, Human
ccugccucagccuccugaguagcu

SEQ ID NO: 1246227 - RNA, 23 nt, Human
ccuggguucaagugauucuccuc

SEQ ID NO: 1246228 - RNA, 23 nt, Human
ccuggguucaagugauucuccug

SEQ ID NO: 1246229 - RNA, 21 nt, Human
ccuggugcucuccugcccccc

SEQ ID NO: 1246230 - RNA, 18 nt, Human
ccuguaaaagccuuccuu

SEQ ID NO: 1246231 - RNA, 19 nt, Human
ccuguaaucccagcuacuc

SEQ ID NO: 1246232 - RNA, 21 nt, Human
ccuguaaucccagcuacucag

SEQ ID NO: 1246233 - RNA, 22 nt, Human
ccuguaaucccagcuacucagg

SEQ ID NO: 1246234 - RNA, 24 nt, Human
cgggguuuugauauguugcucagg

SEQ ID NO: 1246235 - RNA, 18 nt, Human
cucaagggauccuccugc

SEQ ID NO: 1246236 - RNA, 24 nt, Human
cucaagugaucuguccaccuuggc

SEQ ID NO: 1246237 - RNA, 24 nt, Human
cucacucuguugcccaggcuggag

SEQ ID NO: 1246238 - RNA, 24 nt, Human
cucaggugauccuccuaccucagc

SEQ ID NO: 1246239 - RNA, 23 nt, Human
cucccauggccaggguuccugca

SEQ ID NO: 1246240 - RNA, 20 nt, Human
cuccuggguucaagugauuc

SEQ ID NO: 1246241 - RNA, 21 nt, Human
cuccuggguucaagugauucu

SEQ ID NO: 1246242 - RNA, 20 nt, Human
cugcagucccuacucuaagc

SEQ ID NO: 1246243 - RNA, 19 nt, Human
cuggaagugcaguggcaug

SEQ ID NO: 1246244 - RNA, 24 nt, Human
cuggaguucaguggcaugaucuca

SEQ ID NO: 1246245 - RNA, 24 nt, Human
cuuacaaacaccuccaguagaucc

SEQ ID NO: 1246246 - RNA, 23 nt, Human
cuuagcucaaggccacaaaaaau

SEQ ID NO: 1246247 - RNA, 22 nt, Human
cuucccaaaagaaucagacacu

SEQ ID NO: 1246248 - RNA, 24 nt, Human
gaaaauauauguaaagaccuuuga

SEQ ID NO: 1246249 - RNA, 18 nt, Human
gaacguaaauuccagccc

SEQ ID NO: 1246250 - RNA, 22 nt, Human
gaagaggccaugcaggcucagg

SEQ ID NO: 1246251 - RNA, 23 nt, Human
gaagccccuucccaucuugucuu

SEQ ID NO: 1246252 - RNA, 18 nt, Human
gaaguagcaacuccauag

SEQ ID NO: 1246253 - RNA, 18 nt, Human
gaagugcaguggcaugau

SEQ ID NO: 1246254 - RNA, 23 nt, Human
gaaguggagaacaaagauaagug

SEQ ID NO: 1246255 - RNA, 24 nt, Human
gaccuaccaccaggauaguucaaa

SEQ ID NO: 1246256 - RNA, 19 nt, Human
gacgggguuuugauauguu

SEQ ID NO: 1246257 - RNA, 21 nt, Human
gacuacaggcaugagccacca

SEQ ID NO: 1246258 - RNA, 22 nt, Human
gacucaagugaucuguccaccu

SEQ ID NO: 1246259 - RNA, 19 nt, Human
gagagaccuaccaccagga

SEQ ID NO: 1246260 - RNA, 18 nt, Human
gagaggcaccuucucaag

SEQ ID NO: 1246261 - RNA, 22 nt, Human
gagagugaaaguuaccugaggu

SEQ ID NO: 1246262 - RNA, 19 nt, Human
gagauggugaagcucugag

SEQ ID NO: 1246263 - RNA, 24 nt, Human
gagcucaggcaaucugcccaccuu

SEQ ID NO: 1246264 - RNA, 26 nt, Human
gaguagcugggauuacaggugcacac

SEQ ID NO: 1246265 - RNA, 24 nt, Human
gagugugguggcacaugccuguaa

SEQ ID NO: 1246266 - RNA, 18 nt, Human
gauuacaggugccagcca

SEQ ID NO: 1246267 - RNA, 18 nt, Human
gcaagcugcauccacaau

SEQ ID NO: 1246268 - RNA, 23 nt, Human
gcagaugcuacugcaguuuguau

SEQ ID NO: 1246269 - RNA, 27 nt, Human
gcaggagaugggugcaagagggacccc

SEQ ID NO: 1246270 - RNA, 19 nt, Human
gcaggauucagggcagggg

SEQ ID NO: 1246271 - RNA, 20 nt, Human
gccucagccuccugaguagc

SEQ ID NO: 1246272 - RNA, 19 nt, Human
gcucuaauaaugcaguuga

SEQ ID NO: 1246273 - RNA, 20 nt, Human
ggacagguggacaaaugcuc

SEQ ID NO: 1246274 - RNA, 19 nt, Human
ggacuacaggcaugagcca

SEQ ID NO: 1246275 - RNA, 22 nt, Human
ggauccuccugccucagccucc

SEQ ID NO: 1246276 - RNA, 22 nt, Human
ggaucuuccuauguuguccagg

SEQ ID NO: 1246277 - RNA, 18 nt, Human
ggcagggguccucuugcc

SEQ ID NO: 1246278 - RNA, 21 nt, Human
ggcaugaucacagcucauugc

SEQ ID NO: 1246279 - RNA, 23 nt, Human
ggcucaggugauccuccuaccuc

SEQ ID NO: 1246280 - RNA, 20 nt, Human
ggcuggaagugcaguggcau

SEQ ID NO: 1246281 - RNA, 23 nt, Human
gggacuacaggcaugagccacca

SEQ ID NO: 1246282 - RNA, 24 nt, Human
gggauccuccugccucagccuccu

SEQ ID NO: 1246283 - RNA, 19 nt, Human
gggcagggccugguccaug

SEQ ID NO: 1246284 - RNA, 23 nt, Human
gggguuuugauauguugcucagg

SEQ ID NO: 1246285 - RNA, 22 nt, Human
ggguuucaccauguuggccagg

SEQ ID NO: 1246286 - RNA, 19 nt, Human
gguaagaacccuccugggg

SEQ ID NO: 1246287 - RNA, 24 nt, Human
gguggcacaugccuguaaucccag

SEQ ID NO: 1246288 - RNA, 24 nt, Human
gugauccuccuaccucagccuccc

SEQ ID NO: 1246289 - RNA, 19 nt, Human
gugauucuccugccucacc

SEQ ID NO: 1246290 - RNA, 22 nt, Human
gugccuccacacccagcuuaca

SEQ ID NO: 1246291 - RNA, 20 nt, Human
guggcaugaggagcuguggg

SEQ ID NO: 1246292 - RNA, 19 nt, Human
guguccuaauacauaugua

SEQ ID NO: 1246293 - RNA, 19 nt, Human
guuguuccuggugcucucc

SEQ ID NO: 1246294 - RNA, 22 nt, Human
uaaaagaaccaacauggaugca

SEQ ID NO: 1246295 - RNA, 26 nt, Human
uaaaagccuuccuuacaaacaccucc

SEQ ID NO: 1246296 - RNA, 18 nt, Human
uaaacaagguacagagaa

SEQ ID NO: 1246297 - RNA, 24 nt, Human
uaaaccugcaaagguacccuccga

SEQ ID NO: 1246298 - RNA, 25 nt, Human
uaaacuccugaacucaagggauccu

SEQ ID NO: 1246299 - RNA, 22 nt, Human
uaaaguagcuucaaaacccauu

SEQ ID NO: 1246300 - RNA, 23 nt, Human
uaaaguagcuucaaaacccauuu

SEQ ID NO: 1246301 - RNA, 25 nt, Human
uaaauacuuucacuuaaaaaaugca

SEQ ID NO: 1246302 - RNA, 22 nt, Human
uaacaauaacuuauauauuuca

SEQ ID NO: 1246303 - RNA, 22 nt, Human
uaacaguuagaaguggagaaaa

SEQ ID NO: 1246304 - RNA, 22 nt, Human
uaauuuuuguauuuuuuguaga

SEQ ID NO: 1246305 - RNA, 24 nt, Human
uaauuuuuguauuuuuuguagaga

SEQ ID NO: 1246306 - RNA, 21 nt, Human
uacaaaaagcaagcccaugga

SEQ ID NO: 1246307 - RNA, 22 nt, Human
uacaaacaccuccaguagaucc

SEQ ID NO: 1246308 - RNA, 24 nt, Human
uacagaaagaagguguaaaauuuc

SEQ ID NO: 1246309 - RNA, 23 nt, Human
uacagcccagaaacacuugcagg

SEQ ID NO: 1246310 - RNA, 22 nt, Human
uacaggcaugagccaccacacc

SEQ ID NO: 1246311 - RNA, 21 nt, Human
uaccccaaaucucagcaucac

SEQ ID NO: 1246312 - RNA, 23 nt, Human
uaccccaaaucucagcaucacac

SEQ ID NO: 1246313 - RNA, 23 nt, Human
uaccucagccucccaaguagcag

SEQ ID NO: 1246314 - RNA, 22 nt, Human
uaccuucuaacuacugaucuac

SEQ ID NO: 1246315 - RNA, 23 nt, Human
uacugcaaccuuccucuccuggg

SEQ ID NO: 1246316 - RNA, 24 nt, Human
uacuuuuuuuuggaaauaggguga

SEQ ID NO: 1246317 - RNA, 20 nt, Human
uagaauucucugauuucuug

SEQ ID NO: 1246318 - RNA, 24 nt, Human
uagacgugugccuccacacccagc

SEQ ID NO: 1246319 - RNA, 20 nt, Human
uagauccuccaaccacuuuc

SEQ ID NO: 1246320 - RNA, 22 nt, Human
uagauccuccaaccacuuucag

SEQ ID NO: 1246321 - RNA, 26 nt, Human
uagcucccauggccaggguuccuucc

SEQ ID NO: 1246322 - RNA, 22 nt, Human
uaggcacaggguuucaccaugu

SEQ ID NO: 1246323 - RNA, 24 nt, Human
uaguaggcacaggguuucaccaug

SEQ ID NO: 1246324 - RNA, 26 nt, Human
uauauaauauauaacuauauagugau

SEQ ID NO: 1246325 - RNA, 19 nt, Human
uaucaugucuccugccuca

SEQ ID NO: 1246326 - RNA, 24 nt, Human
uaucccucaucuacaaaaugggaa

SEQ ID NO: 1246327 - RNA, 24 nt, Human
uauguucccugcaccacuggugcc

SEQ ID NO: 1246328 - RNA, 24 nt, Human
uauguugcucaggcuugucucaaa

SEQ ID NO: 1246329 - RNA, 24 nt, Human
uauguuguccaggcuggucuuaaa

SEQ ID NO: 1246330 - RNA, 18 nt, Human
uauuaggaaugccuuguu

SEQ ID NO: 1246331 - RNA, 24 nt, Human
uauuuggagacagaaucucacucu

SEQ ID NO: 1246332 - RNA, 25 nt, Human
uauuuggagacagaaucucacucug

SEQ ID NO: 1246333 - RNA, 23 nt, Human
ucaaaauacauaugagcacaauc

SEQ ID NO: 1246334 - RNA, 22 nt, Human
ucaacccuccaccacuucaggu

SEQ ID NO: 1246335 - RNA, 19 nt, Human
ucaagugauucuccugccu

SEQ ID NO: 1246336 - RNA, 21 nt, Human
ucaccauguuggccagguugg

SEQ ID NO: 1246337 - RNA, 23 nt, Human
ucaccccuucagaaagcagaucc

SEQ ID NO: 1246338 - RNA, 24 nt, Human
ucacucuguugcccaggcuggagu

SEQ ID NO: 1246339 - RNA, 27 nt, Human
ucagaaagcagauccuugggcaccauu

SEQ ID NO: 1246340 - RNA, 22 nt, Human
ucagccuccugaguagcuggaa

SEQ ID NO: 1246341 - RNA, 23 nt, Human
ucagcucaccuuucauucagucu

SEQ ID NO: 1246342 - RNA, 19 nt, Human
ucauauccagcuucccaaa

SEQ ID NO: 1246343 - RNA, 19 nt, Human
uccacaaagccauccaagc

SEQ ID NO: 1246344 - RNA, 20 nt, Human
uccacaauucucaccccuuc

SEQ ID NO: 1246345 - RNA, 19 nt, Human
uccacuguacaaauaaaau

SEQ ID NO: 1246346 - RNA, 24 nt, Human
uccagaguagcugggauuacaggu

SEQ ID NO: 1246347 - RNA, 25 nt, Human
uccaguagauccuccaaccacuuuc

SEQ ID NO: 1246348 - RNA, 24 nt, Human
ucccaaauugcugggaugacuggc

SEQ ID NO: 1246349 - RNA, 24 nt, Human
ucccaaguagcagggacuacaggc

SEQ ID NO: 1246350 - RNA, 18 nt, Human
ucccagccaaucugauug

SEQ ID NO: 1246351 - RNA, 23 nt, Human
ucccauaaugcugggauuacagg

SEQ ID NO: 1246352 - RNA, 25 nt, Human
ucccugcaccacuggugccuaucuc

SEQ ID NO: 1246353 - RNA, 24 nt, Human
uccuauguuguccaggcuggucuu

SEQ ID NO: 1246354 - RNA, 27 nt, Human
uccuccuaccucagccucccaaguagc

SEQ ID NO: 1246355 - RNA, 26 nt, Human
uccuccugccucagccuccugaguag

SEQ ID NO: 1246356 - RNA, 19 nt, Human
uccuggguucaagugauuc

SEQ ID NO: 1246357 - RNA, 21 nt, Human
uccuggguucaagugauucuc

SEQ ID NO: 1246358 - RNA, 24 nt, Human
uccuggguucaagugauucuccug

SEQ ID NO: 1246359 - RNA, 19 nt, Human
uccuugaagaagcuucauu

SEQ ID NO: 1246360 - RNA, 23 nt, Human
ucucaaacuccugagcucaggca

SEQ ID NO: 1246361 - RNA, 24 nt, Human
ucucaccccuucagaaagcagauc

SEQ ID NO: 1246362 - RNA, 22 nt, Human
ucucacucuguugcccaggcug

SEQ ID NO: 1246363 - RNA, 23 nt, Human
ucucacucuguugcccaggcugg

SEQ ID NO: 1246364 - RNA, 24 nt, Human
ucucacucuguugcccaggcugga

SEQ ID NO: 1246365 - RNA, 26 nt, Human
ucucacucuguugcccaggcuggagu

SEQ ID NO: 1246366 - RNA, 27 nt, Human
ucucacucuguugcccaggcuggaguu

SEQ ID NO: 1246367 - RNA, 24 nt, Human
ucucacugugucacccaggcugga

SEQ ID NO: 1246368 - RNA, 22 nt, Human
ucuccaggcucaggugauccuc

SEQ ID NO: 1246369 - RNA, 25 nt, Human
ucuccaggcucaggugauccuccua

SEQ ID NO: 1246370 - RNA, 24 nt, Human
ucuccuggguucaagugauucucc

SEQ ID NO: 1246371 - RNA, 18 nt, Human
ucucugauuucuuggugc

SEQ ID NO: 1246372 - RNA, 19 nt, Human
ucucuugugcugccagcaa

SEQ ID NO: 1246373 - RNA, 19 nt, Human
ucugugaagaccuguaccc

SEQ ID NO: 1246374 - RNA, 19 nt, Human
ucuuccuauguuguccagg

SEQ ID NO: 1246375 - RNA, 23 nt, Human
ucuuccuauguuguccaggcugg

SEQ ID NO: 1246376 - RNA, 24 nt, Human
ucuuccuauguuguccaggcuggu

SEQ ID NO: 1246377 - RNA, 23 nt, Human
ucuucuucucugagauuucuaga

SEQ ID NO: 1246378 - RNA, 19 nt, Human
ugaaaagaaugacauugag

SEQ ID NO: 1246379 - RNA, 20 nt, Human
ugaaauggacccagggaaga

SEQ ID NO: 1246380 - RNA, 24 nt, Human
ugaacucaagggauccuccugccu

SEQ ID NO: 1246381 - RNA, 20 nt, Human
ugaagaccuguacccucagu

SEQ ID NO: 1246382 - RNA, 23 nt, Human
ugaagauuauagcaauauuuuug

SEQ ID NO: 1246383 - RNA, 19 nt, Human
ugacuucauauccagcuuc

SEQ ID NO: 1246384 - RNA, 22 nt, Human
ugagaagcuuugcauacccuug

SEQ ID NO: 1246385 - RNA, 23 nt, Human
ugagagugaaaguuaccugaggu

SEQ ID NO: 1246386 - RNA, 18 nt, Human
ugagauauccacagaacu

SEQ ID NO: 1246387 - RNA, 19 nt, Human
ugagaucaacccuccacca

SEQ ID NO: 1246388 - RNA, 22 nt, Human
ugagaucaacccuccaccacuu

SEQ ID NO: 1246389 - RNA, 24 nt, Human
ugagcacaaauacagcccagaaac

SEQ ID NO: 1246390 - RNA, 24 nt, Human
ugagccagcaggaaggaucucaca

SEQ ID NO: 1246391 - RNA, 19 nt, Human
ugaggcaggaguaucacuu

SEQ ID NO: 1246392 - RNA, 24 nt, Human
ugaggcaggaguaucacuucaacc

SEQ ID NO: 1246393 - RNA, 25 nt, Human
ugaggcaggaguaucacuucaaccc

SEQ ID NO: 1246394 - RNA, 24 nt, Human
ugaucuguccaccuuggccuccca

SEQ ID NO: 1246395 - RNA, 21 nt, Human
ugauuugaucacuacacauug

SEQ ID NO: 1246396 - RNA, 19 nt, Human
ugcaaaaagagauuggaaa

SEQ ID NO: 1246397 - RNA, 22 nt, Human
ugcaggagaugggugcaagaca

SEQ ID NO: 1246398 - RNA, 21 nt, Human
ugcauagacaaaaugaaacaa

SEQ ID NO: 1246399 - RNA, 18 nt, Human
ugcaugggcagggccugg

SEQ ID NO: 1246400 - RNA, 21 nt, Human
ugcauguaucaaaauauaaca

SEQ ID NO: 1246401 - RNA, 18 nt, Human
ugccagcaguucucuucc

SEQ ID NO: 1246402 - RNA, 19 nt, Human
ugccauucaauuucugcag

SEQ ID NO: 1246403 - RNA, 19 nt, Human
ugccauucaauuucugcag

SEQ ID NO: 1246404 - RNA, 21 nt, Human
ugcccaggcuggaguucagug

SEQ ID NO: 1246405 - RNA, 24 nt, Human
ugcccaggcuggaguucaguggca

SEQ ID NO: 1246406 - RNA, 24 nt, Human
ugccucagccuccugaguagcugg

SEQ ID NO: 1246407 - RNA, 19 nt, Human
ugccugagcacaaauacag

SEQ ID NO: 1246408 - RNA, 28 nt, Human
ugccugagcacaaauacagcccagaaac

SEQ ID NO: 1246409 - RNA, 20 nt, Human
ugccuggauuugcauguggg

SEQ ID NO: 1246410 - RNA, 24 nt, Human
ugccuguaaucccagcuacucagg

SEQ ID NO: 1246411 - RNA, 20 nt, Human
ugcugagggaaacagggugg

SEQ ID NO: 1246412 - RNA, 18 nt, Human
ugcugggaugacuggcau

SEQ ID NO: 1246413 - RNA, 18 nt, Human
ugcugggauuacaggugc

SEQ ID NO: 1246414 - RNA, 24 nt, Human
uggaauuauagacgugugccucca

SEQ ID NO: 1246415 - RNA, 24 nt, Human
uggacacaaaaauacaguuagaug

SEQ ID NO: 1246416 - RNA, 19 nt, Human
uggacucaagugaucuguc

SEQ ID NO: 1246417 - RNA, 22 nt, Human
uggacucaagugaucuguccac

SEQ ID NO: 1246418 - RNA, 22 nt, Human
uggagacagaaucucacucugu

SEQ ID NO: 1246419 - RNA, 19 nt, Human
uggaguucaguggcaugau

SEQ ID NO: 1246420 - RNA, 19 nt, Human
uggaguucaguggcaugau

SEQ ID NO: 1246421 - RNA, 21 nt, Human
uggcacaugccuguaauccca

SEQ ID NO: 1246422 - RNA, 22 nt, Human
uggcacaugccuguaaucccag

SEQ ID NO: 1246423 - RNA, 24 nt, Human
uggcaugaucucagcuuacugcaa

SEQ ID NO: 1246424 - RNA, 24 nt, Human
uggccagguuggucucaaacuccu

SEQ ID NO: 1246425 - RNA, 19 nt, Human
ugggacagggucucacugu

SEQ ID NO: 1246426 - RNA, 21 nt, Human
ugggagagcauuaggcugaga

SEQ ID NO: 1246427 - RNA, 18 nt, Human
ugggaucuuccuauguug

SEQ ID NO: 1246428 - RNA, 24 nt, Human
ugggaucuuccuauguuguccagg

SEQ ID NO: 1246429 - RNA, 21 nt, Human
ugggauuacaggugcacacca

SEQ ID NO: 1246430 - RNA, 19 nt, Human
ugggauuacaggugcacca

SEQ ID NO: 1246431 - RNA, 22 nt, Human
ugggauuacaggugccagccac

SEQ ID NO: 1246432 - RNA, 24 nt, Human
ugggauuacaggugccagccacca

SEQ ID NO: 1246433 - RNA, 21 nt, Human
uggggauaaaagaaccaacau

SEQ ID NO: 1246434 - RNA, 23 nt, Human
uggguucaagugauucuccugcc

SEQ ID NO: 1246435 - RNA, 24 nt, Human
uggguucaagugauucuccugccu

SEQ ID NO: 1246436 - RNA, 19 nt, Human
ugguaagaacccuccuggg

SEQ ID NO: 1246437 - RNA, 24 nt, Human
ugguggcacaugccuguaauccca

SEQ ID NO: 1246438 - RNA, 23 nt, Human
ugguguccuaauacauauguaug

SEQ ID NO: 1246439 - RNA, 25 nt, Human
uguaaaagccuuccuuacaaacacc

SEQ ID NO: 1246440 - RNA, 18 nt, Human
uguaauaaaccugcaaag

SEQ ID NO: 1246441 - RNA, 24 nt, Human
uguagagacgggguuuugauaugu

SEQ ID NO: 1246442 - RNA, 22 nt, Human
ugucacccaggcuggaagugca

SEQ ID NO: 1246443 - RNA, 24 nt, Human
uguccaggcuggucuuaaacuccu

SEQ ID NO: 1246444 - RNA, 23 nt, Human
ugucucaaacucuuggacucaac

SEQ ID NO: 1246445 - RNA, 24 nt, Human
uguguguuguuccuggugcucucc

SEQ ID NO: 1246446 - RNA, 24 nt, Human
uuacugcaaccuuccucuccuggg

SEQ ID NO: 1246447 - RNA, 18 nt, Human
uuagcccacccacaggug

SEQ ID NO: 1246448 - RNA, 22 nt, Human
uuaggcugagauagcucccaug

SEQ ID NO: 1246449 - RNA, 24 nt, Human
uuaguaggcacaggguuucaccau

SEQ ID NO: 1246450 - RNA, 22 nt, Human
uucaaaaugacuagaggaaaga

SEQ ID NO: 1246451 - RNA, 21 nt, Human
uucaagugauucuccugccuc

SEQ ID NO: 1246452 - RNA, 23 nt, Human
uucaagugauucuccugccucac

SEQ ID NO: 1246453 - RNA, 18 nt, Human
uucaaguuaguuuacccu

SEQ ID NO: 1246454 - RNA, 24 nt, Human
uucacccuguaaaagccuuccuua

SEQ ID NO: 1246455 - RNA, 27 nt, Human
uucauucauaccccaaaucucagcauc

SEQ ID NO: 1246456 - RNA, 24 nt, Human
uuccuugggucccuuuuccuuagc

SEQ ID NO: 1246457 - RNA, 23 nt, Human
uucgccaggucccugagugccca

SEQ ID NO: 1246458 - RNA, 19 nt, Human
uugcagccucuacaucucc

SEQ ID NO: 1246459 - RNA, 21 nt, Human
uugcugggaugacuggcaugc

SEQ ID NO: 1246460 - RNA, 22 nt, Human
uuguagagacgggguuuugaua

SEQ ID NO: 1246461 - RNA, 24 nt, Human
uuguagagacgggguuuugauaug

SEQ ID NO: 1246462 - RNA, 19 nt, Human
uuuaaaauuuuaauauguu

SEQ ID NO: 1246463 - RNA, 19 nt, Human
uuucaccauguuggccagg

SEQ ID NO: 1246464 - RNA, 20 nt, Human
uuucaccauguuggccaggu

SEQ ID NO: 1246465 - RNA, 20 nt, Human
uuuguagagacgggguuuug

SEQ ID NO: 1246466 - RNA, 24 nt, Human
uuuguagagacgggguuuugauau

SEQ ID NO: 1246467 - RNA, 18 nt, Human
uuuucacauugcuaaguu

SEQ ID NO: 1246468 - RNA, 19 nt, Human
uuuugauauguugcucagg

SEQ ID NO: 1246469 - RNA, 24 nt, Human
uuuuuaguaggcacaggguuucac

SEQ ID NO: 1246470 - RNA, 20 nt, Human
uuuuuguauuuuuuguagag

SEQ ID NO: 1246471 - RNA, 23 nt, Human
uuuuuguauuuuuuguagagacg

SEQ ID NO: 1246472 - RNA, 21 nt, Human
uuuuuuguagagacgggguuu

SEQ ID NO: 1246473 - RNA, 22 nt, Human
uuuuuuguauuuuuaguaggca

SEQ ID NO: 1246474 - RNA, 18 nt, Human
aaaaaaacaggaccacag

SEQ ID NO: 1246475 - RNA, 25 nt, Human
aaaaaaacaggaccacagcaaaaag

SEQ ID NO: 1246476 - RNA, 21 nt, Human
aaaaacacccaaccaucaggg

SEQ ID NO: 1246477 - RNA, 22 nt, Human
aaaaacacccaaccaucagggc

SEQ ID NO: 1246478 - RNA, 18 nt, Human
aaaaagaaaggaaaggca

SEQ ID NO: 1246479 - RNA, 18 nt, Human
aaaaagcaggcacaaaac

SEQ ID NO: 1246480 - RNA, 20 nt, Human
aaaaagcaggcacaaaaccu

SEQ ID NO: 1246481 - RNA, 23 nt, Human
aaaaagcaggcacaaaaccucaa

SEQ ID NO: 1246482 - RNA, 24 nt, Human
aaaaagcaggcacaaaaccucaaa

SEQ ID NO: 1246483 - RNA, 19 nt, Human
aaaaggcacaggcuugcaa

SEQ ID NO: 1246484 - RNA, 27 nt, Human
aaaauaaacaaucuccucacaaaacca

SEQ ID NO: 1246485 - RNA, 23 nt, Human
aaacaagcacccaacugaccccu

SEQ ID NO: 1246486 - RNA, 24 nt, Human
aaacaagcacccaacugaccccuc

SEQ ID NO: 1246487 - RNA, 18 nt, Human
aaacagaaaaacaggcac

SEQ ID NO: 1246488 - RNA, 21 nt, Human
aaacagaaaaacaggcaccca

SEQ ID NO: 1246489 - RNA, 20 nt, Human
aaacaggaccacagcaaaaa

SEQ ID NO: 1246490 - RNA, 23 nt, Human
aaacaggcacccaacugacccuu

SEQ ID NO: 1246491 - RNA, 24 nt, Human
aaacaggcacccaacugacccuuc

SEQ ID NO: 1246492 - RNA, 22 nt, Human
aaacauccccagaaagggugcc

SEQ ID NO: 1246493 - RNA, 19 nt, Human
aaaucagaaaaacaagcac

SEQ ID NO: 1246494 - RNA, 20 nt, Human
aacaucaggucucuuuacac

SEQ ID NO: 1246495 - RNA, 19 nt, Human
aaccccugaagccaucagu

SEQ ID NO: 1246496 - RNA, 20 nt, Human
aagaagaaacgugcucaaca

SEQ ID NO: 1246497 - RNA, 24 nt, Human
aagcaggcacaaaaccucaaagca

SEQ ID NO: 1246498 - RNA, 21 nt, Human
aagccaucaguaaauuaaaac

SEQ ID NO: 1246499 - RNA, 23 nt, Human
aaggaaaaacacccaaccaucag

SEQ ID NO: 1246500 - RNA, 24 nt, Human
aaggaccaaaaaucagaaaaacaa

SEQ ID NO: 1246501 - RNA, 25 nt, Human
aauucugugcagccuaccaucgacu

SEQ ID NO: 1246502 - RNA, 20 nt, Human
acaaaaccagcuggccucca

SEQ ID NO: 1246503 - RNA, 22 nt, Human
acaaaaccucaaagcacauaac

SEQ ID NO: 1246504 - RNA, 20 nt, Human
acagcaaaaagcaggcacaa

SEQ ID NO: 1246505 - RNA, 20 nt, Human
accagcuggccuccauguaa

SEQ ID NO: 1246506 - RNA, 18 nt, Human
acccgcuggaucagcuuc

SEQ ID NO: 1246507 - RNA, 19 nt, Human
acuccaucucucuccucug

SEQ ID NO: 1246508 - RNA, 20 nt, Human
acuuccugcagacccagcac

SEQ ID NO: 1246509 - RNA, 19 nt, Human
agaagaaagagagaugaga

SEQ ID NO: 1246510 - RNA, 18 nt, Human
agacagagcguacgagua

SEQ ID NO: 1246511 - RNA, 19 nt, Human
agagaugagagaugaaagg

SEQ ID NO: 1246512 - RNA, 22 nt, Human
agccaccugagcggcugcuacc

SEQ ID NO: 1246513 - RNA, 22 nt, Human
aggaaaggcauugucuggagcc

SEQ ID NO: 1246514 - RNA, 22 nt, Human
aggaccacagcaaaaagcaggc

SEQ ID NO: 1246515 - RNA, 18 nt, Human
aggacuaaaaacagaaaa

SEQ ID NO: 1246516 - RNA, 19 nt, Human
aggagaccaacuuguggcu

SEQ ID NO: 1246517 - RNA, 23 nt, Human
aggauggugcuucacagugccuc

SEQ ID NO: 1246518 - RNA, 21 nt, Human
aggcaaacaauucuaggccua

SEQ ID NO: 1246519 - RNA, 27 nt, Human
aggcaggcuggggacacgugugggaag

SEQ ID NO: 1246520 - RNA, 18 nt, Human
agggaaacugggacucaa

SEQ ID NO: 1246521 - RNA, 18 nt, Human
agggacagaugagagaug

SEQ ID NO: 1246522 - RNA, 23 nt, Human
agggucccgggcucuucccccgg

SEQ ID NO: 1246523 - RNA, 18 nt, Human
aucauuguucaaucaaac

SEQ ID NO: 1246524 - RNA, 21 nt, Human
augagagauggcaccucccaa

SEQ ID NO: 1246525 - RNA, 21 nt, Human
augccaggaaauccagugaca

SEQ ID NO: 1246526 - RNA, 18 nt, Human
auuacgugcugccuuugc

SEQ ID NO: 1246527 - RNA, 22 nt, Human
auucugugcagccuaccaucga

SEQ ID NO: 1246528 - RNA, 21 nt, Human
auuugugaaaaggugaccccc

SEQ ID NO: 1246529 - RNA, 18 nt, Human
caaacuuaccugagugga

SEQ ID NO: 1246530 - RNA, 23 nt, Human
caaagcacauaacgucaggggcc

SEQ ID NO: 1246531 - RNA, 22 nt, Human
caaagguaaagcugccagcaca

SEQ ID NO: 1246532 - RNA, 22 nt, Human
caaccagggaaccucaccccag

SEQ ID NO: 1246533 - RNA, 23 nt, Human
caacuuguggcucagcauggcuc

SEQ ID NO: 1246534 - RNA, 26 nt, Human
caaggacagcgacaggauuggagacc

SEQ ID NO: 1246535 - RNA, 20 nt, Human
cacaggcuugcaagcccacc

SEQ ID NO: 1246536 - RNA, 25 nt, Human
caccccacuuucacauacacacccu

SEQ ID NO: 1246537 - RNA, 22 nt, Human
caccucccaaggagaccaacuu

SEQ ID NO: 1246538 - RNA, 21 nt, Human
caccugagcggcugcuaccuc

SEQ ID NO: 1246539 - RNA, 18 nt, Human
cacgacacaccagcaaga

SEQ ID NO: 1246540 - RNA, 21 nt, Human
cacuccaucucucuccucuga

SEQ ID NO: 1246541 - RNA, 22 nt, Human
cagaagggagagaagaaagaga

SEQ ID NO: 1246542 - RNA, 23 nt, Human
cagcaaaaagcaggcacaaaacc

SEQ ID NO: 1246543 - RNA, 23 nt, Human
cagcagggacuuggacauccagc

SEQ ID NO: 1246544 - RNA, 25 nt, Human
cagcuuuauuagggaaaacaucagg

SEQ ID NO: 1246545 - RNA, 22 nt, Human
caggaccacagcaaaaagcagg

SEQ ID NO: 1246546 - RNA, 21 nt, Human
caggagcccuccguggccagc

SEQ ID NO: 1246547 - RNA, 20 nt, Human
cagggacuuggacauccagc

SEQ ID NO: 1246548 - RNA, 25 nt, Human
caggguggagccucagcucaaugcc

SEQ ID NO: 1246549 - RNA, 23 nt, Human
cauccaaacauccccagaaaggg

SEQ ID NO: 1246550 - RNA, 22 nt, Human
cauccagcacucacgacacacc

SEQ ID NO: 1246551 - RNA, 23 nt, Human
caucgacuggguacuuccugcag

SEQ ID NO: 1246552 - RNA, 23 nt, Human
caucugaacuuugaaccugaguc

SEQ ID NO: 1246553 - RNA, 21 nt, Human
caugcccccgcuggggugccc

SEQ ID NO: 1246554 - RNA, 18 nt, Human
ccaaaccuacucaaccag

SEQ ID NO: 1246555 - RNA, 18 nt, Human
ccaagcaagggaggugcu

SEQ ID NO: 1246556 - RNA, 22 nt, Human
ccacacaugcccccgcuggggu

SEQ ID NO: 1246557 - RNA, 23 nt, Human
ccagagucaggcacauuuggagg

SEQ ID NO: 1246558 - RNA, 25 nt, Human
ccagagucaggcacauuuggaggag

SEQ ID NO: 1246559 - RNA, 20 nt, Human
ccagccuccggccuggccca

SEQ ID NO: 1246560 - RNA, 22 nt, Human
ccagggaccucuugugaaccag

SEQ ID NO: 1246561 - RNA, 23 nt, Human
ccauguaauuuuguggcgcugaa

SEQ ID NO: 1246562 - RNA, 20 nt, Human
cccaggaagggucccgggcu

SEQ ID NO: 1246563 - RNA, 25 nt, Human
ccccagaaagggugccagggaccuc

SEQ ID NO: 1246564 - RNA, 23 nt, Human
cccccuguaaccaaaagggaaac

SEQ ID NO: 1246565 - RNA, 22 nt, Human
cccgaaugugcaagaugagguu

SEQ ID NO: 1246566 - RNA, 21 nt, Human
cccuccguggccagcagggac

SEQ ID NO: 1246567 - RNA, 18 nt, Human
cccuuuuucuuuucugcc

SEQ ID NO: 1246568 - RNA, 20 nt, Human
ccgaugccagcagagccacc

SEQ ID NO: 1246569 - RNA, 22 nt, Human
ccgcauccaaacauccccagaa

SEQ ID NO: 1246570 - RNA, 25 nt, Human
ccuacucaaccagggaaccucaccc

SEQ ID NO: 1246571 - RNA, 21 nt, Human
ccuacuguuaaccccugaagc

SEQ ID NO: 1246572 - RNA, 22 nt, Human
ccucaccccacuuucacauaca

SEQ ID NO: 1246573 - RNA, 22 nt, Human
ccuccguggccagcagggacuu

SEQ ID NO: 1246574 - RNA, 18 nt, Human
ccucuaagauacuguggg

SEQ ID NO: 1246575 - RNA, 26 nt, Human
ccuguaaccaaaagggaaacugggac

SEQ ID NO: 1246576 - RNA, 23 nt, Human
cgacaugauugucuccucuaaga

SEQ ID NO: 1246577 - RNA, 19 nt, Human
cgaugccagcagagccacc

SEQ ID NO: 1246578 - RNA, 23 nt, Human
cgauuaacuugcuaggaauggac

SEQ ID NO: 1246579 - RNA, 23 nt, Human
cgcagcacuaggucuauguccag

SEQ ID NO: 1246580 - RNA, 22 nt, Human
cuagaacuuacacauuacgugc

SEQ ID NO: 1246581 - RNA, 23 nt, Human
cuauaccaguauauuguuaugaa

SEQ ID NO: 1246582 - RNA, 25 nt, Human
cucaaagcacauaacgucaggggcc

SEQ ID NO: 1246583 - RNA, 19 nt, Human
cucaaccagggaaccucac

SEQ ID NO: 1246584 - RNA, 22 nt, Human
cucaccccacuuucacauacac

SEQ ID NO: 1246585 - RNA, 18 nt, Human
cugcuccuucugggcugu

SEQ ID NO: 1246586 - RNA, 21 nt, Human
cuggagccucugcuguccugu

SEQ ID NO: 1246587 - RNA, 24 nt, Human
cuggagccucugcuguccugucug

SEQ ID NO: 1246588 - RNA, 23 nt, Human
cuuucugucugccaugccaggaa

SEQ ID NO: 1246589 - RNA, 24 nt, Human
gaaaaaaacaggaccacagcaaaa

SEQ ID NO: 1246590 - RNA, 18 nt, Human
gaaaguuggcuucuguga

SEQ ID NO: 1246591 - RNA, 18 nt, Human
gaaugugcaagaugaggu

SEQ ID NO: 1246592 - RNA, 19 nt, Human
gacacugccugggugcugg

SEQ ID NO: 1246593 - RNA, 19 nt, Human
gacagccucugaaagccaa

SEQ ID NO: 1246594 - RNA, 20 nt, Human
gacuaaaaacagaaaaacag

SEQ ID NO: 1246595 - RNA, 21 nt, Human
gagcauacuuuugggaaaugc

SEQ ID NO: 1246596 - RNA, 24 nt, Human
gaggcauuuacuuggaaguacagg

SEQ ID NO: 1246597 - RNA, 18 nt, Human
gaucccugggggcuacua

SEQ ID NO: 1246598 - RNA, 19 nt, Human
gcagaauucucccaggaag

SEQ ID NO: 1246599 - RNA, 20 nt, Human
gccauugagcuucaucugaa

SEQ ID NO: 1246600 - RNA, 18 nt, Human
gcccuuuuucuuuucugc

SEQ ID NO: 1246601 - RNA, 18 nt, Human
gcgugcccaggcugagcc

SEQ ID NO: 1246602 - RNA, 19 nt, Human
gcucugaggcaagaauaaa

SEQ ID NO: 1246603 - RNA, 24 nt, Human
gcugccucucaaugucgggaccau

SEQ ID NO: 1246604 - RNA, 21 nt, Human
gcuucuuguggggggaacagc

SEQ ID NO: 1246605 - RNA, 20 nt, Human
ggaaaaacacccaaccauca

SEQ ID NO: 1246606 - RNA, 25 nt, Human
ggacagaugagagauggcaccuccc

SEQ ID NO: 1246607 - RNA, 19 nt, Human
ggacauccagcacucacga

SEQ ID NO: 1246608 - RNA, 18 nt, Human
ggaccaucuauuuacagg

SEQ ID NO: 1246609 - RNA, 19 nt, Human
ggacgaguucccugccccc

SEQ ID NO: 1246610 - RNA, 20 nt, Human
ggcaguuucuucuggccuca

SEQ ID NO: 1246611 - RNA, 23 nt, Human
ggcugcagaauucucccaggaag

SEQ ID NO: 1246612 - RNA, 18 nt, Human
gggaaacugggacucaaa

SEQ ID NO: 1246613 - RNA, 23 nt, Human
gggaaacugggacucaaagggaa

SEQ ID NO: 1246614 - RNA, 18 nt, Human
gggcagagaaguccuuuu

SEQ ID NO: 1246615 - RNA, 18 nt, Human
gggcuuucauggcugggg

SEQ ID NO: 1246616 - RNA, 25 nt, Human
ggguucccaggagcauacuuuuggg

SEQ ID NO: 1246617 - RNA, 18 nt, Human
gguccaucggccacuccu

SEQ ID NO: 1246618 - RNA, 21 nt, Human
ggugcagcuguguaucauugu

SEQ ID NO: 1246619 - RNA, 23 nt, Human
ggugcccuuucucuucccugccu

SEQ ID NO: 1246620 - RNA, 23 nt, Human
gucccgggcucuucaggaggcau

SEQ ID NO: 1246621 - RNA, 20 nt, Human
gucuggagccucugcugucc

SEQ ID NO: 1246622 - RNA, 27 nt, Human
gugaucaaggaccaaaaaucagaaaaa

SEQ ID NO: 1246623 - RNA, 18 nt, Human
gugcccuuucucuucccu

SEQ ID NO: 1246624 - RNA, 18 nt, Human
uaaaaacagaaaaacagg

SEQ ID NO: 1246625 - RNA, 23 nt, Human
uaaaaacagaaaaacaggcaccc

SEQ ID NO: 1246626 - RNA, 19 nt, Human
uaaaacaagaaucacaagu

SEQ ID NO: 1246627 - RNA, 19 nt, Human
uacacaaugccaccuccag

SEQ ID NO: 1246628 - RNA, 22 nt, Human
uaccagccgcauccaaacaucc

SEQ ID NO: 1246629 - RNA, 23 nt, Human
uaccagccgcauccaaacauccc

SEQ ID NO: 1246630 - RNA, 20 nt, Human
uacgugcugccuuugcacau

SEQ ID NO: 1246631 - RNA, 23 nt, Human
uacuguuaaccccugaagccauc

SEQ ID NO: 1246632 - RNA, 22 nt, Human
uaucaguaacagcuaaaugaaa

SEQ ID NO: 1246633 - RNA, 22 nt, Human
ucaagguagagaucagaauucu

SEQ ID NO: 1246634 - RNA, 24 nt, Human
ucaagguagagaucagaauucugu

SEQ ID NO: 1246635 - RNA, 20 nt, Human
ucacaaaaccagcuggccuc

SEQ ID NO: 1246636 - RNA, 26 nt, Human
ucaguaaauuaaaacaagaaucacaa

SEQ ID NO: 1246637 - RNA, 19 nt, Human
uccaggguggccaugagga

SEQ ID NO: 1246638 - RNA, 20 nt, Human
ucccuugagggcagagaagu

SEQ ID NO: 1246639 - RNA, 23 nt, Human
uccucacaaaaccagcuggccuc

SEQ ID NO: 1246640 - RNA, 24 nt, Human
ucucaccgacaugauugucuccuc

SEQ ID NO: 1246641 - RNA, 19 nt, Human
ucuccucuaagauacugug

SEQ ID NO: 1246642 - RNA, 19 nt, Human
ucuccuuaaaaaggcuggg

SEQ ID NO: 1246643 - RNA, 25 nt, Human
ucucucuccucuggggcgugcccag

SEQ ID NO: 1246644 - RNA, 24 nt, Human
ucucuuuacacguugaacaggaac

SEQ ID NO: 1246645 - RNA, 21 nt, Human
ucuggggcgugcccaggcuga

SEQ ID NO: 1246646 - RNA, 21 nt, Human
ucuucuggccucacccaccuu

SEQ ID NO: 1246647 - RNA, 20 nt, Human
ugaaaaaaacaggaccacag

SEQ ID NO: 1246648 - RNA, 27 nt, Human
ugaaaaaaacaggaccacagcaaaaag

SEQ ID NO: 1246649 - RNA, 18 nt, Human
ugaaaaagaaaggaaagg

SEQ ID NO: 1246650 - RNA, 18 nt, Human
ugaaccagcacacaaacu

SEQ ID NO: 1246651 - RNA, 19 nt, Human
ugaccccagaucugcuccu

SEQ ID NO: 1246652 - RNA, 26 nt, Human
ugagggcagagaaguccuccccgagg

SEQ ID NO: 1246653 - RNA, 22 nt, Human
ugagguuucccacaucugcacc

SEQ ID NO: 1246654 - RNA, 19 nt, Human
ugcccaggcugagccugag

SEQ ID NO: 1246655 - RNA, 20 nt, Human
ugcccaggcugagccugagc

SEQ ID NO: 1246656 - RNA, 24 nt, Human
ugccccagcuggaaugcccuuuuu

SEQ ID NO: 1246657 - RNA, 19 nt, Human
ugcccccgcuggggugccc

SEQ ID NO: 1246658 - RNA, 19 nt, Human
ugcccccgcuggggugccc

SEQ ID NO: 1246659 - RNA, 21 nt, Human
ugcccuuucucuucccugccu

SEQ ID NO: 1246660 - RNA, 23 nt, Human
ugcuaggaauggacaaggacagc

SEQ ID NO: 1246661 - RNA, 19 nt, Human
ugcuucccucuccuaagca

SEQ ID NO: 1246662 - RNA, 21 nt, Human
ugcuucuagcuccaggagucu

SEQ ID NO: 1246663 - RNA, 22 nt, Human
uggaggucuacauuugugaaaa

SEQ ID NO: 1246664 - RNA, 22 nt, Human
uggggcgugcccaggcugagcc

SEQ ID NO: 1246665 - RNA, 18 nt, Human
ugguucuaagcuccaacu

SEQ ID NO: 1246666 - RNA, 22 nt, Human
uguccugucugcaaaaugggaa

SEQ ID NO: 1246667 - RNA, 23 nt, Human
uguccugucugcaaaaugggaau

SEQ ID NO: 1246668 - RNA, 22 nt, Human
ugugaaaagggcuuucucacuu

SEQ ID NO: 1246669 - RNA, 22 nt, Human
ugugaaccagcacacaaacuuc

SEQ ID NO: 1246670 - RNA, 23 nt, Human
uuaaaaaggcugggacauuagua

SEQ ID NO: 1246671 - RNA, 18 nt, Human
uuaaccccugaagccauc

SEQ ID NO: 1246672 - RNA, 21 nt, Human
uucccacaucugcaccgcucc

SEQ ID NO: 1246673 - RNA, 23 nt, Human
uuccugcagacccagcacuuugg

SEQ ID NO: 1246674 - RNA, 22 nt, Human
uuuaaaaugggcaaccaucuuu

SEQ ID NO: 1246675 - RNA, 24 nt, Human
uuuaaaggacuaaaaacagaaaaa

SEQ ID NO: 1246676 - RNA, 22 nt, Human
uuucccacaucugcaccgcucc

SEQ ID NO: 1246677 - RNA, 20 nt, Human
uuuuuacccgcuggaucagc

SEQ ID NO: 1246678 - RNA, 24 nt, Human
aaagugcugggaucacaggcguga

SEQ ID NO: 1246679 - RNA, 21 nt, Human
aagcgaacacgggcuccucca

SEQ ID NO: 1246680 - RNA, 23 nt, Human
aaggacugggggaucccaacuca

SEQ ID NO: 1246681 - RNA, 19 nt, Human
aaguagcugggacuaaggc

SEQ ID NO: 1246682 - RNA, 25 nt, Human
aagugauuccccugccucagccucc

SEQ ID NO: 1246683 - RNA, 26 nt, Human
aagugcugggaucacaggcgugagcc

SEQ ID NO: 1246684 - RNA, 26 nt, Human
acagaacuccagcaaaaagggaacgc

SEQ ID NO: 1246685 - RNA, 18 nt, Human
acgggguuucaccacguu

SEQ ID NO: 1246686 - RNA, 20 nt, Human
acgggguuucaccacguugg

SEQ ID NO: 1246687 - RNA, 24 nt, Human
acgggguuucaccacguuggccag

SEQ ID NO: 1246688 - RNA, 20 nt, Human
acugcaagcuccgccucccg

SEQ ID NO: 1246689 - RNA, 23 nt, Human
acuugcucugucgccaggcugga

SEQ ID NO: 1246690 - RNA, 22 nt, Human
agccuucugucguccugagcaa

SEQ ID NO: 1246691 - RNA, 20 nt, Human
aggaaggaugaugggcauau

SEQ ID NO: 1246692 - RNA, 24 nt, Human
aggcuggagugcaguggcagaucu

SEQ ID NO: 1246693 - RNA, 24 nt, Human
agugauuccccugccucagccucc

SEQ ID NO: 1246694 - RNA, 22 nt, Human
agugcaguggcagaucucgguu

SEQ ID NO: 1246695 - RNA, 18 nt, Human
augaaguggaaaaaguga

SEQ ID NO: 1246696 - RNA, 24 nt, Human
auuuuaguagagacgggguuucac

SEQ ID NO: 1246697 - RNA, 24 nt, Human
auuuuuuguauuuuaguagagacg

SEQ ID NO: 1246698 - RNA, 23 nt, Human
caaaaguugauuugaauccugau

SEQ ID NO: 1246699 - RNA, 22 nt, Human
caaaguaucauuuaacaugcaa

SEQ ID NO: 1246700 - RNA, 24 nt, Human
caaagugcugggaucacaggcgug

SEQ ID NO: 1246701 - RNA, 19 nt, Human
caacaugaaaaucauuaac

SEQ ID NO: 1246702 - RNA, 22 nt, Human
caagugauuccccugccucagc

SEQ ID NO: 1246703 - RNA, 25 nt, Human
caauucagacuaaccauaaugccga

SEQ ID NO: 1246704 - RNA, 23 nt, Human
cacaggcgugagccaccgcgccc

SEQ ID NO: 1246705 - RNA, 18 nt, Human
caccacguuggccaggau

SEQ ID NO: 1246706 - RNA, 22 nt, Human
caccacguuggccaggaugguc

SEQ ID NO: 1246707 - RNA, 24 nt, Human
caccacguuggccaggauggucuc

SEQ ID NO: 1246708 - RNA, 22 nt, Human
caccauccaauuccuaaucaaa

SEQ ID NO: 1246709 - RNA, 19 nt, Human
cacgauguuuucugcgcug

SEQ ID NO: 1246710 - RNA, 22 nt, Human
ccaaagugcugggaucacaggc

SEQ ID NO: 1246711 - RNA, 24 nt, Human
ccaaagugcugggaucacaggcgu

SEQ ID NO: 1246712 - RNA, 24 nt, Human
ccaacucaccauccaauuccuaau

SEQ ID NO: 1246713 - RNA, 20 nt, Human
ccaccacgcccggcuaauuu

SEQ ID NO: 1246714 - RNA, 18 nt, Human
ccaccgcgcccggccugc

SEQ ID NO: 1246715 - RNA, 18 nt, Human
ccaccgcgcccggccugc

SEQ ID NO: 1246716 - RNA, 20 nt, Human
ccaccgcgcccggccugcuu

SEQ ID NO: 1246717 - RNA, 24 nt, Human
ccagcaaaaagcuaaggacugggg

SEQ ID NO: 1246718 - RNA, 19 nt, Human
cccaaguagcugggacuaa

SEQ ID NO: 1246719 - RNA, 21 nt, Human
cccggguucaagugauucccc

SEQ ID NO: 1246720 - RNA, 23 nt, Human
cccggguucaagugauuccccug

SEQ ID NO: 1246721 - RNA, 24 nt, Human
cccugccucagccucccaaguagc

SEQ ID NO: 1246722 - RNA, 24 nt, Human
ccgccucccggguucaagugauuc

SEQ ID NO: 1246723 - RNA, 19 nt, Human
ccgcgcccggccugcuuug

SEQ ID NO: 1246724 - RNA, 22 nt, Human
ccucccggguucaagugauucc

SEQ ID NO: 1246725 - RNA, 24 nt, Human
cgccucggccucccaaagugcugg

SEQ ID NO: 1246726 - RNA, 24 nt, Human
cucagccucccaaguagcugggac

SEQ ID NO: 1246727 - RNA, 22 nt, Human
cucagucugaaacugaaauaaa

SEQ ID NO: 1246728 - RNA, 20 nt, Human
cucccggguucaagugauuc

SEQ ID NO: 1246729 - RNA, 24 nt, Human
cuccugaccucgugaugcgcccgc

SEQ ID NO: 1246730 - RNA, 23 nt, Human
cugcaagccuucugucguccuga

SEQ ID NO: 1246731 - RNA, 23 nt, Human
cugccucagccucccaaguagcu

SEQ ID NO: 1246732 - RNA, 24 nt, Human
cuggagugcaguggcagaucucgg

SEQ ID NO: 1246733 - RNA, 20 nt, Human
cuugcucugucgccaggcug

SEQ ID NO: 1246734 - RNA, 22 nt, Human
cuugcucugucgccaggcugga

SEQ ID NO: 1246735 - RNA, 18 nt, Human
gaaaacauuuuuugagaa

SEQ ID NO: 1246736 - RNA, 19 nt, Human
gaauccugauagauuccac

SEQ ID NO: 1246737 - RNA, 24 nt, Human
gagacgggguuucaccacguuggc

SEQ ID NO: 1246738 - RNA, 24 nt, Human
gagugcaguggcagaucucgguuc

SEQ ID NO: 1246739 - RNA, 18 nt, Human
gaucacaggcgugagcca

SEQ ID NO: 1246740 - RNA, 21 nt, Human
gaucacaggcgugagccaccg

SEQ ID NO: 1246741 - RNA, 23 nt, Human
gcccggcuaauuuuuuguauuuu

SEQ ID NO: 1246742 - RNA, 24 nt, Human
gccugcuuugguauuuuuuaagag

SEQ ID NO: 1246743 - RNA, 19 nt, Human
gcucugucgccaggcugga

SEQ ID NO: 1246744 - RNA, 20 nt, Human
ggaugaauccauuauauuua

SEQ ID NO: 1246745 - RNA, 24 nt, Human
ggauggucucgaucuccugaccuc

SEQ ID NO: 1246746 - RNA, 22 nt, Human
ggcuccguccucgccugcuuca

SEQ ID NO: 1246747 - RNA, 24 nt, Human
gggcuucuuagcagaccucagucu

SEQ ID NO: 1246748 - RNA, 23 nt, Human
gggguuucaccacguuggccagg

SEQ ID NO: 1246749 - RNA, 22 nt, Human
ggguuucaccacguuggccagg

SEQ ID NO: 1246750 - RNA, 19 nt, Human
gguuguuuuuuuuuuuucu

SEQ ID NO: 1246751 - RNA, 24 nt, Human
gugaugcgcccgccucggccuccc

SEQ ID NO: 1246752 - RNA, 24 nt, Human
gugauuccccugccucagccuccc

SEQ ID NO: 1246753 - RNA, 23 nt, Human
gugcaguggcagaucucgguuca

SEQ ID NO: 1246754 - RNA, 26 nt, Human
uaaauaaaccaaaagaaauggccugu

SEQ ID NO: 1246755 - RNA, 22 nt, Human
uaaggcgugcgccaccacgccc

SEQ ID NO: 1246756 - RNA, 23 nt, Human
uaauuuuuuguauuuuaguagag

SEQ ID NO: 1246757 - RNA, 24 nt, Human
uaauuuuuuguauuuuaguagaga

SEQ ID NO: 1246758 - RNA, 20 nt, Human
uacagaacuccagcaaaagg

SEQ ID NO: 1246759 - RNA, 20 nt, Human
uacccugguccaaaggagcc

SEQ ID NO: 1246760 - RNA, 18 nt, Human
uagaaagagcuuggcucc

SEQ ID NO: 1246761 - RNA, 23 nt, Human
uagaaagagcuuggcuccuggug

SEQ ID NO: 1246762 - RNA, 22 nt, Human
uagagacgggguuucaccacgu

SEQ ID NO: 1246763 - RNA, 22 nt, Human
uagagcagcacgccggcaccuu

SEQ ID NO: 1246764 - RNA, 24 nt, Human
uaguagagacgggguuucaccacg

SEQ ID NO: 1246765 - RNA, 25 nt, Human
uaguagagacgggguuucaccacgu

SEQ ID NO: 1246766 - RNA, 24 nt, Human
ucaccacguuggccaggauggucu

SEQ ID NO: 1246767 - RNA, 18 nt, Human
ucacugcaagcuccgccu

SEQ ID NO: 1246768 - RNA, 19 nt, Human
ucacugcaagcuccgccuc

SEQ ID NO: 1246769 - RNA, 24 nt, Human
ucacugcaagcuccgccucccggg

SEQ ID NO: 1246770 - RNA, 18 nt, Human
ucagccucccaaguagcu

SEQ ID NO: 1246771 - RNA, 20 nt, Human
ucagccucccaaguagcugg

SEQ ID NO: 1246772 - RNA, 20 nt, Human
uccacuaacuuuuuugucuu

SEQ ID NO: 1246773 - RNA, 24 nt, Human
ucccaaagugcugggaucacaggc

SEQ ID NO: 1246774 - RNA, 23 nt, Human
ucccaaguagcugggacuaaggc

SEQ ID NO: 1246775 - RNA, 26 nt, Human
uccccugccucagccucccaaguagc

SEQ ID NO: 1246776 - RNA, 19 nt, Human
ucccggguucaagugauuc

SEQ ID NO: 1246777 - RNA, 24 nt, Human
ucccggguucaagugauuccccug

SEQ ID NO: 1246778 - RNA, 19 nt, Human
uccuuggaugaauccauua

SEQ ID NO: 1246779 - RNA, 18 nt, Human
ucggccucccaaagugcu

SEQ ID NO: 1246780 - RNA, 18 nt, Human
ucugucgccaggcuggag

SEQ ID NO: 1246781 - RNA, 21 nt, Human
ucugucgccaggcuggagugc

SEQ ID NO: 1246782 - RNA, 23 nt, Human
ucugucgccaggcuggagugcag

SEQ ID NO: 1246783 - RNA, 20 nt, Human
ugaaacugaaauaaaccugg

SEQ ID NO: 1246784 - RNA, 23 nt, Human
ugaaacugaaauaaaccuggacg

SEQ ID NO: 1246785 - RNA, 22 nt, Human
ugaagcgaacacgggcuccucc

SEQ ID NO: 1246786 - RNA, 21 nt, Human
ugacauuuugagauuuacaga

SEQ ID NO: 1246787 - RNA, 19 nt, Human
ugaugggcauauugcuugc

SEQ ID NO: 1246788 - RNA, 24 nt, Human
ugccucagccucccaaguagcugg

SEQ ID NO: 1246789 - RNA, 22 nt, Human
ugcgcugucuuuaaauuccagu

SEQ ID NO: 1246790 - RNA, 23 nt, Human
ugcucugucgccaggcuggagug

SEQ ID NO: 1246791 - RNA, 24 nt, Human
ugcugggaucacaggcgugagcca

SEQ ID NO: 1246792 - RNA, 21 nt, Human
uggagugcaguggcagaucuc

SEQ ID NO: 1246793 - RNA, 23 nt, Human
uggagugcaguggcagaucucgg

SEQ ID NO: 1246794 - RNA, 25 nt, Human
uggcaucgcuauuuuuauacccuuc

SEQ ID NO: 1246795 - RNA, 24 nt, Human
uggccaggauggucucgaucuccu

SEQ ID NO: 1246796 - RNA, 23 nt, Human
ugggacuaaggcgugcgccacca

SEQ ID NO: 1246797 - RNA, 19 nt, Human
ugggaucacaggcgugagc

SEQ ID NO: 1246798 - RNA, 21 nt, Human
ugggaucacaggcgugagcca

SEQ ID NO: 1246799 - RNA, 22 nt, Human
ugggaucacaggcgugagccac

SEQ ID NO: 1246800 - RNA, 23 nt, Human
ugggaucacaggcgugagccacc

SEQ ID NO: 1246801 - RNA, 24 nt, Human
ugggaucacaggcgugagccaccg

SEQ ID NO: 1246802 - RNA, 24 nt, Human
ugguaaauggaggcauuauaugga

SEQ ID NO: 1246803 - RNA, 22 nt, Human
ugguuguuuuuuuuuuuucuuu

SEQ ID NO: 1246804 - RNA, 18 nt, Human
uuaguagagacgggguuu

SEQ ID NO: 1246805 - RNA, 22 nt, Human
uuaguagagacgggguuucacc

SEQ ID NO: 1246806 - RNA, 24 nt, Human
uuaguagagacgggguuucaccac

SEQ ID NO: 1246807 - RNA, 25 nt, Human
uuaguagagacgggguuucaccacg

SEQ ID NO: 1246808 - RNA, 21 nt, Human
uucaagugauuccccugccuc

SEQ ID NO: 1246809 - RNA, 23 nt, Human
uucaagugauuccccugccucag

SEQ ID NO: 1246810 - RNA, 24 nt, Human
uucaagugauuccccugccucagc

SEQ ID NO: 1246811 - RNA, 19 nt, Human
uuccccugccucagccucc

SEQ ID NO: 1246812 - RNA, 22 nt, Human
uuccuuggaugaauccauuaua

SEQ ID NO: 1246813 - RNA, 24 nt, Human
uugucuuuuuuuuuggcugccuuc

SEQ ID NO: 1246814 - RNA, 19 nt, Human
uuucaccacguuggccagg

SEQ ID NO: 1246815 - RNA, 20 nt, Human
uuuuuguauuuuaguagaga

SEQ ID NO: 1246816 - RNA, 19 nt, Human
acugccagcaccaacugcc

SEQ ID NO: 1246817 - RNA, 22 nt, Human
aggaagcaucuccauaacacau

SEQ ID NO: 1246818 - RNA, 24 nt, Human
aggaagucugugcacaggcagauc

SEQ ID NO: 1246819 - RNA, 23 nt, Human
aggaggaaaccagcuuacugcca

SEQ ID NO: 1246820 - RNA, 22 nt, Human
agugaccauacccagccccaca

SEQ ID NO: 1246821 - RNA, 19 nt, Human
augaaacccuggaagcacu

SEQ ID NO: 1246822 - RNA, 22 nt, Human
caaaaggcucacugcccuaacg

SEQ ID NO: 1246823 - RNA, 19 nt, Human
caacugccucucacaggcu

SEQ ID NO: 1246824 - RNA, 21 nt, Human
caccaaacagucagcagugcu

SEQ ID NO: 1246825 - RNA, 18 nt, Human
caccaacugccucucaca

SEQ ID NO: 1246826 - RNA, 20 nt, Human
cagcagugcuucuggaugga

SEQ ID NO: 1246827 - RNA, 22 nt, Human
caggcccugcagaagcaucucc

SEQ ID NO: 1246828 - RNA, 20 nt, Human
caggguugacauucccucca

SEQ ID NO: 1246829 - RNA, 18 nt, Human
cauacccagccccacacc

SEQ ID NO: 1246830 - RNA, 23 nt, Human
ccaagaggagaaaccagcccaau

SEQ ID NO: 1246831 - RNA, 21 nt, Human
ccagcuggagaccuagguucc

SEQ ID NO: 1246832 - RNA, 18 nt, Human
cccacaccugaaauagga

SEQ ID NO: 1246833 - RNA, 24 nt, Human
cccuaacggcaaccaccaaccaug

SEQ ID NO: 1246834 - RNA, 29 nt, Human
ccucucacaggcuggggugaucaugggac

SEQ ID NO: 1246835 - RNA, 19 nt, Human
ccugcagucaggcuguugg

SEQ ID NO: 1246836 - RNA, 21 nt, Human
ccugcagucaggcuguugggc

SEQ ID NO: 1246837 - RNA, 20 nt, Human
cucacugcccuaacggcaac

SEQ ID NO: 1246838 - RNA, 21 nt, Human
cucagaauggacaaaaggcuc

SEQ ID NO: 1246839 - RNA, 19 nt, Human
cugguauuuuccuaggucc

SEQ ID NO: 1246840 - RNA, 19 nt, Human
gaucaugggacugggaagg

SEQ ID NO: 1246841 - RNA, 24 nt, Human
ggacugggaaggaggggucugggc

SEQ ID NO: 1246842 - RNA, 23 nt, Human
ggagaaaccagcccaaucucaga

SEQ ID NO: 1246843 - RNA, 18 nt, Human
ggcuggggugaucauggg

SEQ ID NO: 1246844 - RNA, 18 nt, Human
guccuugguuuucaccuu

SEQ ID NO: 1246845 - RNA, 28 nt, Human
uacccagccccacaccugaaauaggacu

SEQ ID NO: 1246846 - RNA, 20 nt, Human
uagcaucugugccuaggaug

SEQ ID NO: 1246847 - RNA, 21 nt, Human
ucauucugcagaaagcuccuu

SEQ ID NO: 1246848 - RNA, 28 nt, Human
uccagcaggagugaccauacccagcccu

SEQ ID NO: 1246849 - RNA, 21 nt, Human
ucccagccagaaacucaggac

SEQ ID NO: 1246850 - RNA, 23 nt, Human
ucuccauaacacauaugaaaccc

SEQ ID NO: 1246851 - RNA, 19 nt, Human
ucugcuggugcucuuacac

SEQ ID NO: 1246852 - RNA, 24 nt, Human
ugaccagggugugcaaaauggcuu

SEQ ID NO: 1246853 - RNA, 18 nt, Human
ugagggcacugagcucca

SEQ ID NO: 1246854 - RNA, 20 nt, Human
ugagguuggagagaggaagc

SEQ ID NO: 1246855 - RNA, 24 nt, Human
ugagguuggagagaggaagcaucu

SEQ ID NO: 1246856 - RNA, 23 nt, Human
ugccccaggucgcaggcccugca

SEQ ID NO: 1246857 - RNA, 20 nt, Human
uggaaaggcuguaucuggua

SEQ ID NO: 1246858 - RNA, 21 nt, Human
uuccugcagucaggcuguugg

SEQ ID NO: 1246859 - RNA, 23 nt, Human
uugcccgggagggugcgauaagg

SEQ ID NO: 1246860 - RNA, 22 nt, Human
uuggcuucuuucugaagccagg

SEQ ID NO: 1246861 - RNA, 24 nt, Human
uuguccugcucuggaugauggugg

SEQ ID NO: 1246862 - RNA, 22 nt, Human
uuuccuagguccuugguuuuca

SEQ ID NO: 1246863 - RNA, 24 nt, Human
uuuggcuucuuucugaagccaggg

SEQ ID NO: 1246864 - RNA, 22 nt, Human
aagcuucuggagaccuuggucu

SEQ ID NO: 1246865 - RNA, 18 nt, Human
aaucgcuugaaccuggga

SEQ ID NO: 1246866 - RNA, 24 nt, Human
aaucgcuugaaccugggaggcaga

SEQ ID NO: 1246867 - RNA, 19 nt, Human
accauugcacuccagccug

SEQ ID NO: 1246868 - RNA, 24 nt, Human
accauugcacuccagccuggguga

SEQ ID NO: 1246869 - RNA, 18 nt, Human
agagguugcagugagccg

SEQ ID NO: 1246870 - RNA, 23 nt, Human
agagguugcagugagccgagauc

SEQ ID NO: 1246871 - RNA, 24 nt, Human
agagguugcagugagccgagauca

SEQ ID NO: 1246872 - RNA, 19 nt, Human
agcuggaccuguaauccca

SEQ ID NO: 1246873 - RNA, 21 nt, Human
aggcagagguugcagugagcc

SEQ ID NO: 1246874 - RNA, 24 nt, Human
aggcagagguugcagugagccgag

SEQ ID NO: 1246875 - RNA, 22 nt, Human
aggcaggagaaucgcuugaacc

SEQ ID NO: 1246876 - RNA, 24 nt, Human
aggcaggagaaucgcuugaaccug

SEQ ID NO: 1246877 - RNA, 20 nt, Human
aggcugaggcaggagaaucg

SEQ ID NO: 1246878 - RNA, 24 nt, Human
aggcugaggcaggagaaucgcuug

SEQ ID NO: 1246879 - RNA, 23 nt, Human
aggucggggagcucccagcugga

SEQ ID NO: 1246880 - RNA, 24 nt, Human
aucauaccauugcacuccagccug

SEQ ID NO: 1246881 - RNA, 18 nt, Human
auugcacuccagccuggg

SEQ ID NO: 1246882 - RNA, 24 nt, Human
auugcacuccagccugggugacag

SEQ ID NO: 1246883 - RNA, 22 nt, Human
cacuccagccugggugacagag

SEQ ID NO: 1246884 - RNA, 23 nt, Human
cagcagucaguggaagcuucugg

SEQ ID NO: 1246885 - RNA, 24 nt, Human
cagcuacucgggaggcugaggcag

SEQ ID NO: 1246886 - RNA, 20 nt, Human
caguggaagcuucuggagac

SEQ ID NO: 1246887 - RNA, 19 nt, Human
cauugcacuccagccuggg

SEQ ID NO: 1246888 - RNA, 19 nt, Human
cauugcacuccagccuggg

SEQ ID NO: 1246889 - RNA, 21 nt, Human
cauugcacuccagccugggug

SEQ ID NO: 1246890 - RNA, 22 nt, Human
cauugcacuccagccuggguga

SEQ ID NO: 1246891 - RNA, 24 nt, Human
cauugcacuccagccugggugaca

SEQ ID NO: 1246892 - RNA, 25 nt, Human
cauugcacuccagccugggugacag

SEQ ID NO: 1246893 - RNA, 26 nt, Human
ccaacagcagucaguggaagcuucuu

SEQ ID NO: 1246894 - RNA, 20 nt, Human
ccagacccuguugccuggug

SEQ ID NO: 1246895 - RNA, 20 nt, Human
ccauugcacuccagccuggg

SEQ ID NO: 1246896 - RNA, 21 nt, Human
ccauugcacuccagccugggu

SEQ ID NO: 1246897 - RNA, 21 nt, Human
ccauugcacuccagccugggu

SEQ ID NO: 1246898 - RNA, 22 nt, Human
ccauugcacuccagccugggug

SEQ ID NO: 1246899 - RNA, 24 nt, Human
ccauugcacuccagccugggugac

SEQ ID NO: 1246900 - RNA, 22 nt, Human
cccacgauggugcaggucucug

SEQ ID NO: 1246901 - RNA, 25 nt, Human
ccugggaggcagagguugcagugag

SEQ ID NO: 1246902 - RNA, 20 nt, Human
ccuggugcagccaacagcag

SEQ ID NO: 1246903 - RNA, 21 nt, Human
ccuguaaucccagcuacucgg

SEQ ID NO: 1246904 - RNA, 24 nt, Human
cgagaucauaccauugcacuccag

SEQ ID NO: 1246905 - RNA, 26 nt, Human
cugaugaugaacuuggagucccucuu

SEQ ID NO: 1246906 - RNA, 21 nt, Human
cuguaaucccagcuacucggg

SEQ ID NO: 1246907 - RNA, 19 nt, Human
cuuggaagguggaugaggg

SEQ ID NO: 1246908 - RNA, 23 nt, Human
gaagguggaugagggcugcagca

SEQ ID NO: 1246909 - RNA, 23 nt, Human
gaccuguaaucccagcuacucgg

SEQ ID NO: 1246910 - RNA, 24 nt, Human
gaccuguaaucccagcuacucggg

SEQ ID NO: 1246911 - RNA, 23 nt, Human
gagaaucgcuugaaccugggagg

SEQ ID NO: 1246912 - RNA, 24 nt, Human
gcacuccagccugggugacagagc

SEQ ID NO: 1246913 - RNA, 23 nt, Human
ucauaccauugcacuccagccug

SEQ ID NO: 1246914 - RNA, 24 nt, Human
uccagccugggugacagagccaga

SEQ ID NO: 1246915 - RNA, 19 nt, Human
uccuggaggucggggagcu

SEQ ID NO: 1246916 - RNA, 18 nt, Human
ucgcuugaaccugggagg

SEQ ID NO: 1246917 - RNA, 24 nt, Human
ucgggaggcugaggcaggagaauc

SEQ ID NO: 1246918 - RNA, 21 nt, Human
ucugugguguugccguaccag

SEQ ID NO: 1246919 - RNA, 22 nt, Human
ucugugguguugccguaccagg

SEQ ID NO: 1246920 - RNA, 24 nt, Human
ugaaccugggaggcagagguugca

SEQ ID NO: 1246921 - RNA, 24 nt, Human
ugaggcaggagaaucgcuugaacc

SEQ ID NO: 1246922 - RNA, 24 nt, Human
ugaggcaggagaaucgcuugaacc

SEQ ID NO: 1246923 - RNA, 22 nt, Human
ugcacuccagccugggugacag

SEQ ID NO: 1246924 - RNA, 24 nt, Human
ugcacuccagccugggugacagag

SEQ ID NO: 1246925 - RNA, 19 nt, Human
ugccuggugcagccaacag

SEQ ID NO: 1246926 - RNA, 20 nt, Human
ugcuuggaagguggaugagg

SEQ ID NO: 1246927 - RNA, 19 nt, Human
uggaccuguaaucccagcu

SEQ ID NO: 1246928 - RNA, 21 nt, Human
uggaucuugcccuccuggagg

SEQ ID NO: 1246929 - RNA, 24 nt, Human
ugggaggcagagguugcagugagc

SEQ ID NO: 1246930 - RNA, 23 nt, Human
uggggcccacgauggugcagguc

SEQ ID NO: 1246931 - RNA, 26 nt, Human
ugguggggcccacgauggugcagguc

SEQ ID NO: 1246932 - RNA, 24 nt, Human
uugaaccugggaggcagagguugc

SEQ ID NO: 1246933 - RNA, 18 nt, Human
uugcagugagccgagauc

SEQ ID NO: 1246934 - RNA, 19 nt, Human
uugcagugagccgagauca

SEQ ID NO: 1246935 - RNA, 20 nt, Human
uugcagugagccgagaucau

SEQ ID NO: 1246936 - RNA, 24 nt, Human
aaaagaaccaacauggaugcaugg

SEQ ID NO: 1246937 - RNA, 21 nt, Human
aaaaugaaacaagcuuagccc

SEQ ID NO: 1246938 - RNA, 21 nt, Human
aaacaggcacucacacuuuca

SEQ ID NO: 1246939 - RNA, 23 nt, Human
aaaccugcaaagguacccuccga

SEQ ID NO: 1246940 - RNA, 19 nt, Human
aaauacaaaaagcaagccc

SEQ ID NO: 1246941 - RNA, 18 nt, Human
aaaugaagcuaacaaaua

SEQ ID NO: 1246942 - RNA, 21 nt, Human
aaaugggaauaauaagaauau

SEQ ID NO: 1246943 - RNA, 19 nt, Human
aaccugcaaagguacccuc

SEQ ID NO: 1246944 - RNA, 20 nt, Human
aacugcccacauuuuugcca

SEQ ID NO: 1246945 - RNA, 19 nt, Human
aacuuccucuucuucucug

SEQ ID NO: 1246946 - RNA, 20 nt, Human
aagaacccuccuggggaaga

SEQ ID NO: 1246947 - RNA, 20 nt, Human
aagccuuccuuacaaacacc

SEQ ID NO: 1246948 - RNA, 20 nt, Human
aaggccacaaaaaaucagaa

SEQ ID NO: 1246949 - RNA, 24 nt, Human
aaggccacaaaaaaucagaacgua

SEQ ID NO: 1246950 - RNA, 25 nt, Human
aaguaccuucuaacuacugaucuac

SEQ ID NO: 1246951 - RNA, 24 nt, Human
aagugaucugcccaccuuggccuc

SEQ ID NO: 1246952 - RNA, 24 nt, Human
aauaauaaucauaaucaugaaaau

SEQ ID NO: 1246953 - RNA, 21 nt, Human
aauagaaggguucugccugga

SEQ ID NO: 1246954 - RNA, 19 nt, Human
aauaucuacuuaaucucaa

SEQ ID NO: 1246955 - RNA, 19 nt, Human
aaugcugggauuacaggug

SEQ ID NO: 1246956 - RNA, 27 nt, Human
acaaaaagcaagcccauggaugucaac

SEQ ID NO: 1246957 - RNA, 21 nt, Human
acacuugcagguuaacagccu

SEQ ID NO: 1246958 - RNA, 18 nt, Human
acagccucaggggaagac

SEQ ID NO: 1246959 - RNA, 18 nt, Human
acagcucauugcagccuc

SEQ ID NO: 1246960 - RNA, 21 nt, Human
acaggguuucaccauguuggc

SEQ ID NO: 1246961 - RNA, 24 nt, Human
acaggguuucaccauguuggccag

SEQ ID NO: 1246962 - RNA, 25 nt, Human
acaggguuucaccauguuggccagg

SEQ ID NO: 1246963 - RNA, 18 nt, Human
accacuguccuggccugu

SEQ ID NO: 1246964 - RNA, 27 nt, Human
accacuguccuggccuguuuccugucg

SEQ ID NO: 1246965 - RNA, 23 nt, Human
accauguuggccagguuggucuc

SEQ ID NO: 1246966 - RNA, 22 nt, Human
acccacucuuuugcccuuccca

SEQ ID NO: 1246967 - RNA, 25 nt, Human
acccaggcuggaagugcaguggcau

SEQ ID NO: 1246968 - RNA, 18 nt, Human
acccuccagaguagcugg

SEQ ID NO: 1246969 - RNA, 24 nt, Human
accuggcuaauuuuuuuguauuuu

SEQ ID NO: 1246970 - RNA, 24 nt, Human
accuugguuucccauaaugcuggg

SEQ ID NO: 1246971 - RNA, 19 nt, Human
acgggguuuugauauguug

SEQ ID NO: 1246972 - RNA, 24 nt, Human
acgggguuuugauauguugcucag

SEQ ID NO: 1246973 - RNA, 28 nt, Human
acuaucuuauauucacacauguguuggu

SEQ ID NO: 1246974 - RNA, 25 nt, Human
acucuguugcccaggcuggaguuca

SEQ ID NO: 1246975 - RNA, 21 nt, Human
acugcaaccuuccucuccugg

SEQ ID NO: 1246976 - RNA, 22 nt, Human
acugcaaccuuccucuccuggg

SEQ ID NO: 1246977 - RNA, 26 nt, Human
acugugucacccaggcuggaagugca

SEQ ID NO: 1246978 - RNA, 20 nt, Human
agagaccuaccaccaggaua

SEQ ID NO: 1246979 - RNA, 20 nt, Human
agagauggugaagcucugag

SEQ ID NO: 1246980 - RNA, 23 nt, Human
agcacaaauacagcccagaaaca

SEQ ID NO: 1246981 - RNA, 23 nt, Human
agccccuucccaucuugucuuug

SEQ ID NO: 1246982 - RNA, 19 nt, Human
agcuggguaaugagagacc

SEQ ID NO: 1246983 - RNA, 19 nt, Human
aggaaugugguaguaaagg

SEQ ID NO: 1246984 - RNA, 23 nt, Human
aggaggcugaggcaggaguauca

SEQ ID NO: 1246985 - RNA, 20 nt, Human
aggauuuugccugagcacaa

SEQ ID NO: 1246986 - RNA, 20 nt, Human
aggcaaucugcccaccuugg

SEQ ID NO: 1246987 - RNA, 23 nt, Human
aggcaggaguaucacuucaaccc

SEQ ID NO: 1246988 - RNA, 18 nt, Human
aggcuaaacuuuuuucuu

SEQ ID NO: 1246989 - RNA, 22 nt, Human
aggcucaggugauccuccuacc

SEQ ID NO: 1246990 - RNA, 18 nt, Human
aggcugagauagcuccca

SEQ ID NO: 1246991 - RNA, 19 nt, Human
aggcugaggcaggaguauc

SEQ ID NO: 1246992 - RNA, 24 nt, Human
agggacuacaggcaugagccacca

SEQ ID NO: 1246993 - RNA, 19 nt, Human
aguaccuucuaacuacuga

SEQ ID NO: 1246994 - RNA, 23 nt, Human
aguagcuggaauuauagacgugu

SEQ ID NO: 1246995 - RNA, 18 nt, Human
aguagcugggauuacagg

SEQ ID NO: 1246996 - RNA, 19 nt, Human
agucucagccaccgugaga

SEQ ID NO: 1246997 - RNA, 21 nt, Human
agugcaguggcaugaucacag

SEQ ID NO: 1246998 - RNA, 23 nt, Human
agugcaguggcaugaucacagcu

SEQ ID NO: 1246999 - RNA, 24 nt, Human
agugcaguggcaugaucacagcuc

SEQ ID NO: 1247000 - RNA, 24 nt, Human
aguggcaugaucucagcuuacugc

SEQ ID NO: 1247001 - RNA, 23 nt, Human
aucauucaauaauaaucauaauc

SEQ ID NO: 1247002 - RNA, 22 nt, Human
aucccagccaaucugauugcaa

SEQ ID NO: 1247003 - RNA, 20 nt, Human
aucucacucuguugcccagg

SEQ ID NO: 1247004 - RNA, 22 nt, Human
aucuuccuauguuguccaggcu

SEQ ID NO: 1247005 - RNA, 23 nt, Human
aucuuccuauguuguccaggcug

SEQ ID NO: 1247006 - RNA, 19 nt, Human
augcaauacuuuuuuuugg

SEQ ID NO: 1247007 - RNA, 29 nt, Human
augcaggagaugggugcaagagggacccc

SEQ ID NO: 1247008 - RNA, 20 nt, Human
augucuccugccucauaagu

SEQ ID NO: 1247009 - RNA, 19 nt, Human
auguggggauaaaagaacc

SEQ ID NO: 1247010 - RNA, 19 nt, Human
caaaaagcaagcccaugga

SEQ ID NO: 1247011 - RNA, 24 nt, Human
caaauugcugggaugacuggcaug

SEQ ID NO: 1247012 - RNA, 18 nt, Human
caacuccauagaaauuca

SEQ ID NO: 1247013 - RNA, 21 nt, Human
caacuccauagaaauucagcu

SEQ ID NO: 1247014 - RNA, 21 nt, Human
caagcauauaaagcccauuuc

SEQ ID NO: 1247015 - RNA, 22 nt, Human
caagggauccuccugccucagc

SEQ ID NO: 1247016 - RNA, 20 nt, Human
caagugauucuccugccuca

SEQ ID NO: 1247017 - RNA, 26 nt, Human
caagugauucuccugccucacccucc

SEQ ID NO: 1247018 - RNA, 18 nt, Human
caaucugauugcaaaaug

SEQ ID NO: 1247019 - RNA, 20 nt, Human
caauggcaguuaaugcuuau

SEQ ID NO: 1247020 - RNA, 19 nt, Human
cacacaaguguuccagaag

SEQ ID NO: 1247021 - RNA, 24 nt, Human
cacacaauacacccauguaauaaa

SEQ ID NO: 1247022 - RNA, 20 nt, Human
cacaguuugcacuuugaaau

SEQ ID NO: 1247023 - RNA, 24 nt, Human
caccacaccuggcuaauuuuugua

SEQ ID NO: 1247024 - RNA, 21 nt, Human
caccauguuggccagguuggu

SEQ ID NO: 1247025 - RNA, 22 nt, Human
caccauguuggccagguugguc

SEQ ID NO: 1247026 - RNA, 24 nt, Human
caccauguuggccagguuggucuc

SEQ ID NO: 1247027 - RNA, 23 nt, Human
cacccacucuuuugcccuuccca

SEQ ID NO: 1247028 - RNA, 24 nt, Human
cacccuguaaaagccuuccuuaca

SEQ ID NO: 1247029 - RNA, 22 nt, Human
caccuucucaagugcaggauuc

SEQ ID NO: 1247030 - RNA, 19 nt, Human
cacuacacauuguaugcau

SEQ ID NO: 1247031 - RNA, 22 nt, Human
cacucuguugcccaggcuggag

SEQ ID NO: 1247032 - RNA, 21 nt, Human
cacuuaaaaaaugcacugaga

SEQ ID NO: 1247033 - RNA, 20 nt, Human
cacuuacccugauacagaaa

SEQ ID NO: 1247034 - RNA, 19 nt, Human
cacuuugaaauggacccag

SEQ ID NO: 1247035 - RNA, 23 nt, Human
cagaagauugccuacagaggcaa

SEQ ID NO: 1247036 - RNA, 21 nt, Human
cagaaguugguuaauggacac

SEQ ID NO: 1247037 - RNA, 24 nt, Human
cagaaucucacucuguugcccagg

SEQ ID NO: 1247038 - RNA, 21 nt, Human
cagcaucacacaauacaccca

SEQ ID NO: 1247039 - RNA, 18 nt, Human
cagccaccacgcacagcc

SEQ ID NO: 1247040 - RNA, 19 nt, Human
cagccuccugaguagcugg

SEQ ID NO: 1247041 - RNA, 24 nt, Human
cagcuacucaggaggcugaggcag

SEQ ID NO: 1247042 - RNA, 23 nt, Human
cagcucauugcagccucuacauc

SEQ ID NO: 1247043 - RNA, 18 nt, Human
cagggccugguccaugga

SEQ ID NO: 1247044 - RNA, 24 nt, Human
cagggucucacugugucacccagg

SEQ ID NO: 1247045 - RNA, 24 nt, Human
caggguuucaccauguuggccagg

SEQ ID NO: 1247046 - RNA, 19 nt, Human
caguggcaugaucucagcu

SEQ ID NO: 1247047 - RNA, 21 nt, Human
cauaacaagcugcaaacaaga

SEQ ID NO: 1247048 - RNA, 22 nt, Human
cauaaugcugggauuacaggug

SEQ ID NO: 1247049 - RNA, 22 nt, Human
caugcaccacuguccuggccug

SEQ ID NO: 1247050 - RNA, 20 nt, Human
caugggcagggccuggucca

SEQ ID NO: 1247051 - RNA, 23 nt, Human
cauguacccuacaaauauguaua

SEQ ID NO: 1247052 - RNA, 21 nt, Human
cauuuuaaacuaacacugagu

SEQ ID NO: 1247053 - RNA, 22 nt, Human
cauuuuagaccacugagcacuu

SEQ ID NO: 1247054 - RNA, 23 nt, Human
ccaaauacaaaaagcaagcccau

SEQ ID NO: 1247055 - RNA, 18 nt, Human
ccacaaagccauccaagc

SEQ ID NO: 1247056 - RNA, 22 nt, Human
ccacaaggucaaaguugagugu

SEQ ID NO: 1247057 - RNA, 21 nt, Human
ccagagaggcaccuucucaag

SEQ ID NO: 1247058 - RNA, 19 nt, Human
ccagaguagcugggauuac

SEQ ID NO: 1247059 - RNA, 22 nt, Human
ccagaguagcugggauuacagg

SEQ ID NO: 1247060 - RNA, 23 nt, Human
ccagaguagcugggauuacaggu

SEQ ID NO: 1247061 - RNA, 24 nt, Human
ccagaguagcugggauuacaggug

SEQ ID NO: 1247062 - RNA, 23 nt, Human
ccagccaccacgcacagccacaa

SEQ ID NO: 1247063 - RNA, 20 nt, Human
ccaggguacagucaguggag

SEQ ID NO: 1247064 - RNA, 21 nt, Human
ccauaaugcugggauuacagg

SEQ ID NO: 1247065 - RNA, 24 nt, Human
cccaaguagcagggacuacaggca

SEQ ID NO: 1247066 - RNA, 19 nt, Human
cccacauuugcauuauguc

SEQ ID NO: 1247067 - RNA, 22 nt, Human
cccacauuugcauuaugucuaa

SEQ ID NO: 1247068 - RNA, 21 nt, Human
cccaucauuuguuugcuguug

SEQ ID NO: 1247069 - RNA, 18 nt, Human
cccaugcaagcugcaucc

SEQ ID NO: 1247070 - RNA, 19 nt, Human
cccaugcaagcugcaucca

SEQ ID NO: 1247071 - RNA, 20 nt, Human
cccaugcaagcugcauccac

SEQ ID NO: 1247072 - RNA, 21 nt, Human
cccaugguccaccuuuuuauu

SEQ ID NO: 1247073 - RNA, 19 nt, Human
ccccaugcaagcugcaucc

SEQ ID NO: 1247074 - RNA, 24 nt, Human
ccccccauucagccagcacugagc

SEQ ID NO: 1247075 - RNA, 23 nt, Human
cccugagugcccagcgugugccc

SEQ ID NO: 1247076 - RNA, 18 nt, Human
cccugauacagaaagaag

SEQ ID NO: 1247077 - RNA, 23 nt, Human
ccuaccucagccucccaaguagc

SEQ ID NO: 1247078 - RNA, 26 nt, Human
ccuccaaauacaaaaagcaagcccau

SEQ ID NO: 1247079 - RNA, 22 nt, Human
ccuccgaaaucuaaaaugaaag

SEQ ID NO: 1247080 - RNA, 20 nt, Human
ccuccugcuuuuagucauuu

SEQ ID NO: 1247081 - RNA, 19 nt, Human
ccugaguagcuggaauuau

SEQ ID NO: 1247082 - RNA, 19 nt, Human
ccugauccaugaaucucug

SEQ ID NO: 1247083 - RNA, 23 nt, Human
ccugccucagccuccugaguagc

SEQ ID NO: 1247084 - RNA, 23 nt, Human
ccuggguucaagugauucuccuc

SEQ ID NO: 1247085 - RNA, 23 nt, Human
ccuggguucaagugauucuccug

SEQ ID NO: 1247086 - RNA, 21 nt, Human
ccuggugcucuccugcccccc

SEQ ID NO: 1247087 - RNA, 18 nt, Human
ccuguaaaagccuuccuu

SEQ ID NO: 1247088 - RNA, 21 nt, Human
ccuguaaucccagcuacucag

SEQ ID NO: 1247089 - RNA, 24 nt, Human
cgggguuuugauauguugcucagg

SEQ ID NO: 1247090 - RNA, 23 nt, Human
cuaacaguuagaaguggagaaaa

SEQ ID NO: 1247091 - RNA, 18 nt, Human
cucaagggauccuccugc

SEQ ID NO: 1247092 - RNA, 24 nt, Human
cucaagugaucugcccaccuuggc

SEQ ID NO: 1247093 - RNA, 24 nt, Human
cucacucuguugcccaggcuggag

SEQ ID NO: 1247094 - RNA, 21 nt, Human
cucagcaucacacaauacacc

SEQ ID NO: 1247095 - RNA, 21 nt, Human
cucaggugauccuccuaccuc

SEQ ID NO: 1247096 - RNA, 24 nt, Human
cucaggugauccuccuaccucagc

SEQ ID NO: 1247097 - RNA, 23 nt, Human
cucccauggccaggguuccugca

SEQ ID NO: 1247098 - RNA, 20 nt, Human
cuccuggguucaagugauuc

SEQ ID NO: 1247099 - RNA, 21 nt, Human
cuccuggguucaagugauucu

SEQ ID NO: 1247100 - RNA, 23 nt, Human
cugcaaccuuccucuccuggguu

SEQ ID NO: 1247101 - RNA, 23 nt, Human
cugccucagccuccugaguagcu

SEQ ID NO: 1247102 - RNA, 19 nt, Human
cuggaagugcaguggcaug

SEQ ID NO: 1247103 - RNA, 21 nt, Human
cuggacaaguucccuuuuaug

SEQ ID NO: 1247104 - RNA, 24 nt, Human
cuggaguucaguggcaugaucuca

SEQ ID NO: 1247105 - RNA, 24 nt, Human
cuuacaaacaccuccaguagaucc

SEQ ID NO: 1247106 - RNA, 23 nt, Human
cuuagcucaaggccacaaaaaau

SEQ ID NO: 1247107 - RNA, 21 nt, Human
cuucccaaaagaaucagacac

SEQ ID NO: 1247108 - RNA, 24 nt, Human
gaaaauauauguaaagaccuuuga

SEQ ID NO: 1247109 - RNA, 18 nt, Human
gaacguaaauuccagccc

SEQ ID NO: 1247110 - RNA, 22 nt, Human
gaagaggccaugcaggcucagg

SEQ ID NO: 1247111 - RNA, 23 nt, Human
gaagccccuucccaucuugucuu

SEQ ID NO: 1247112 - RNA, 18 nt, Human
gaaguagcaacuccauag

SEQ ID NO: 1247113 - RNA, 18 nt, Human
gaagugcaguggcaugau

SEQ ID NO: 1247114 - RNA, 23 nt, Human
gaaguggagaacaaagauaagug

SEQ ID NO: 1247115 - RNA, 24 nt, Human
gaccuaccaccaggauaguucaaa

SEQ ID NO: 1247116 - RNA, 19 nt, Human
gacgggguuuugauauguu

SEQ ID NO: 1247117 - RNA, 21 nt, Human
gacuacaggcaugagccacca

SEQ ID NO: 1247118 - RNA, 22 nt, Human
gacucaagugaucugcccaccu

SEQ ID NO: 1247119 - RNA, 19 nt, Human
gagagaccuaccaccagga

SEQ ID NO: 1247120 - RNA, 22 nt, Human
gagagugaaaguuaccugaggu

SEQ ID NO: 1247121 - RNA, 24 nt, Human
gagcucaggcaaucugcccaccuu

SEQ ID NO: 1247122 - RNA, 26 nt, Human
gaguagcugggauuacaggugcacac

SEQ ID NO: 1247123 - RNA, 24 nt, Human
gagugugguggcacaugccuguaa

SEQ ID NO: 1247124 - RNA, 18 nt, Human
gauuacaggugccagcca

SEQ ID NO: 1247125 - RNA, 18 nt, Human
gcaagcugcauccacaau

SEQ ID NO: 1247126 - RNA, 23 nt, Human
gcagaugcuacugcaguuuguau

SEQ ID NO: 1247127 - RNA, 19 nt, Human
gcaggauucagggcagggg

SEQ ID NO: 1247128 - RNA, 24 nt, Human
gcccaggcuggaguucaguggcau

SEQ ID NO: 1247129 - RNA, 19 nt, Human
gcucuaauaaugcaguuga

SEQ ID NO: 1247130 - RNA, 20 nt, Human
ggacagguggacaaaugcuc

SEQ ID NO: 1247131 - RNA, 19 nt, Human
ggacuacaggcaugagcca

SEQ ID NO: 1247132 - RNA, 22 nt, Human
ggauccuccugccucagccucc

SEQ ID NO: 1247133 - RNA, 22 nt, Human
ggaucuuccuauguuguccagg

SEQ ID NO: 1247134 - RNA, 18 nt, Human
ggcagggguccucuugcc

SEQ ID NO: 1247135 - RNA, 21 nt, Human
ggcaugaucacagcucauugc

SEQ ID NO: 1247136 - RNA, 20 nt, Human
ggcuggaagugcaguggcau

SEQ ID NO: 1247137 - RNA, 23 nt, Human
gggacuacaggcaugagccacca

SEQ ID NO: 1247138 - RNA, 24 nt, Human
gggauccuccugccucagccuccu

SEQ ID NO: 1247139 - RNA, 19 nt, Human
gggcagggccugguccaug

SEQ ID NO: 1247140 - RNA, 23 nt, Human
gggguuuugauauguugcucagg

SEQ ID NO: 1247141 - RNA, 22 nt, Human
ggguuucaccauguuggccagg

SEQ ID NO: 1247142 - RNA, 19 nt, Human
gguaagaacccuccugggg

SEQ ID NO: 1247143 - RNA, 24 nt, Human
gguggcacaugccuguaaucccag

SEQ ID NO: 1247144 - RNA, 24 nt, Human
gugauccuccuaccucagccuccc

SEQ ID NO: 1247145 - RNA, 19 nt, Human
gugauucuccugccucacc

SEQ ID NO: 1247146 - RNA, 22 nt, Human
gugccuccacacccagcuuaca

SEQ ID NO: 1247147 - RNA, 20 nt, Human
guggcaugaggagcuguggg

SEQ ID NO: 1247148 - RNA, 19 nt, Human
guguccuaauacauaugua

SEQ ID NO: 1247149 - RNA, 19 nt, Human
guuguuccuggugcucucc

SEQ ID NO: 1247150 - RNA, 22 nt, Human
uaaaagaaccaacauggaugca

SEQ ID NO: 1247151 - RNA, 26 nt, Human
uaaaagccuuccuuacaaacaccucc

SEQ ID NO: 1247152 - RNA, 18 nt, Human
uaaacaagguacagagaa

SEQ ID NO: 1247153 - RNA, 25 nt, Human
uaaacuccugaacucaagggauccu

SEQ ID NO: 1247154 - RNA, 19 nt, Human
uaaagggagagccgaucau

SEQ ID NO: 1247155 - RNA, 25 nt, Human
uaaauacuuucacuuaaaaaaugca

SEQ ID NO: 1247156 - RNA, 22 nt, Human
uaacaauaacuuauauauuuca

SEQ ID NO: 1247157 - RNA, 22 nt, Human
uaauuuuuguauuuuuuguaga

SEQ ID NO: 1247158 - RNA, 24 nt, Human
uaauuuuuguauuuuuuguagaga

SEQ ID NO: 1247159 - RNA, 22 nt, Human
uacaaacaccuccaguagaucc

SEQ ID NO: 1247160 - RNA, 24 nt, Human
uacagaaagaagguguaaaauuuc

SEQ ID NO: 1247161 - RNA, 23 nt, Human
uacagcccagaaacacuugcagg

SEQ ID NO: 1247162 - RNA, 22 nt, Human
uacaggcaugagccaccacacc

SEQ ID NO: 1247163 - RNA, 21 nt, Human
uaccccaaaucucagcaucac

SEQ ID NO: 1247164 - RNA, 23 nt, Human
uaccccaaaucucagcaucacac

SEQ ID NO: 1247165 - RNA, 23 nt, Human
uaccucagccucccaaguagcag

SEQ ID NO: 1247166 - RNA, 23 nt, Human
uacugcaaccuuccucuccuggg

SEQ ID NO: 1247167 - RNA, 24 nt, Human
uacuuuuuuuuggaaauaggguga

SEQ ID NO: 1247168 - RNA, 20 nt, Human
uagaauucucugauuucuug

SEQ ID NO: 1247169 - RNA, 24 nt, Human
uagacgugugccuccacacccagc

SEQ ID NO: 1247170 - RNA, 20 nt, Human
uagauccuccaaccacuuuc

SEQ ID NO: 1247171 - RNA, 22 nt, Human
uagauccuccaaccacuuucag

SEQ ID NO: 1247172 - RNA, 26 nt, Human
uagcucccauggccaggguuccuucc

SEQ ID NO: 1247173 - RNA, 18 nt, Human
uagcugcucucugccucc

SEQ ID NO: 1247174 - RNA, 22 nt, Human
uaggcacaggguuucaccaugu

SEQ ID NO: 1247175 - RNA, 24 nt, Human
uaguaggcacaggguuucaccaug

SEQ ID NO: 1247176 - RNA, 26 nt, Human
uauauaauauauaacuauauagugau

SEQ ID NO: 1247177 - RNA, 19 nt, Human
uaucaugucuccugccuca

SEQ ID NO: 1247178 - RNA, 24 nt, Human
uaucccucaucuacaaaaugggaa

SEQ ID NO: 1247179 - RNA, 24 nt, Human
uauguucccugcaccacuggugcc

SEQ ID NO: 1247180 - RNA, 24 nt, Human
uauguugcucaggcuugucucaaa

SEQ ID NO: 1247181 - RNA, 24 nt, Human
uauguuguccaggcuggucuuaaa

SEQ ID NO: 1247182 - RNA, 18 nt, Human
uauuaggaaugccuuguu

SEQ ID NO: 1247183 - RNA, 24 nt, Human
uauuuggagacagaaucucacucu

SEQ ID NO: 1247184 - RNA, 25 nt, Human
uauuuggagacagaaucucacucug

SEQ ID NO: 1247185 - RNA, 25 nt, Human
uauuuggagacagaaucucacucug

SEQ ID NO: 1247186 - RNA, 23 nt, Human
ucaaaauacauaugagcacaauc

SEQ ID NO: 1247187 - RNA, 22 nt, Human
ucaacccuccaccacuucaggu

SEQ ID NO: 1247188 - RNA, 19 nt, Human
ucaagugauucuccugccu

SEQ ID NO: 1247189 - RNA, 21 nt, Human
ucaccauguuggccagguugg

SEQ ID NO: 1247190 - RNA, 23 nt, Human
ucaccccuucagaaagcagauuc

SEQ ID NO: 1247191 - RNA, 24 nt, Human
ucacucuguugcccaggcuggagu

SEQ ID NO: 1247192 - RNA, 27 nt, Human
ucagaaagcagauucuugggcaccauu

SEQ ID NO: 1247193 - RNA, 22 nt, Human
ucagccuccugaguagcuggaa

SEQ ID NO: 1247194 - RNA, 23 nt, Human
ucagcucaccuuucauucagucu

SEQ ID NO: 1247195 - RNA, 19 nt, Human
ucauauccagcuucccaaa

SEQ ID NO: 1247196 - RNA, 19 nt, Human
uccacaaagccauccaagc

SEQ ID NO: 1247197 - RNA, 20 nt, Human
uccacaauucucaccccuuc

SEQ ID NO: 1247198 - RNA, 19 nt, Human
uccacuguacaaauaaaau

SEQ ID NO: 1247199 - RNA, 24 nt, Human
uccagaguagcugggauuacaggu

SEQ ID NO: 1247200 - RNA, 20 nt, Human
uccaggcucaggugauccuc

SEQ ID NO: 1247201 - RNA, 25 nt, Human
uccaguagauccuccaaccacuuuc

SEQ ID NO: 1247202 - RNA, 24 nt, Human
ucccaaauugcugggaugacuggc

SEQ ID NO: 1247203 - RNA, 24 nt, Human
ucccaaguagcagggacuacaggc

SEQ ID NO: 1247204 - RNA, 18 nt, Human
ucccagccaaucugauug

SEQ ID NO: 1247205 - RNA, 23 nt, Human
ucccauaaugcugggauuacagg

SEQ ID NO: 1247206 - RNA, 25 nt, Human
ucccugcaccacuggugccuaucuc

SEQ ID NO: 1247207 - RNA, 24 nt, Human
uccuauguuguccaggcuggucuu

SEQ ID NO: 1247208 - RNA, 27 nt, Human
uccuccuaccucagccucccaaguagc

SEQ ID NO: 1247209 - RNA, 26 nt, Human
uccuccugccucagccuccugaguag

SEQ ID NO: 1247210 - RNA, 19 nt, Human
uccuggguucaagugauuc

SEQ ID NO: 1247211 - RNA, 21 nt, Human
uccuggguucaagugauucuc

SEQ ID NO: 1247212 - RNA, 24 nt, Human
uccuggguucaagugauucuccug

SEQ ID NO: 1247213 - RNA, 23 nt, Human
ucucaaacuccugagcucaggca

SEQ ID NO: 1247214 - RNA, 23 nt, Human
ucucacucuguugcccaggcugg

SEQ ID NO: 1247215 - RNA, 24 nt, Human
ucucacucuguugcccaggcugga

SEQ ID NO: 1247216 - RNA, 26 nt, Human
ucucacucuguugcccaggcuggagu

SEQ ID NO: 1247217 - RNA, 27 nt, Human
ucucacucuguugcccaggcuggaguu

SEQ ID NO: 1247218 - RNA, 24 nt, Human
ucucacugugucacccaggcugga

SEQ ID NO: 1247219 - RNA, 22 nt, Human
ucuccaggcucaggugauccuc

SEQ ID NO: 1247220 - RNA, 25 nt, Human
ucuccaggcucaggugauccuccua

SEQ ID NO: 1247221 - RNA, 24 nt, Human
ucuccuggguucaagugauucucc

SEQ ID NO: 1247222 - RNA, 18 nt, Human
ucucugauuucuuggugc

SEQ ID NO: 1247223 - RNA, 19 nt, Human
ucucuugugcugccagcaa

SEQ ID NO: 1247224 - RNA, 21 nt, Human
ucugcagucccuacucuaagc

SEQ ID NO: 1247225 - RNA, 19 nt, Human
ucugugaagaccuguaccc

SEQ ID NO: 1247226 - RNA, 18 nt, Human
ucuguugcccaggcugga

SEQ ID NO: 1247227 - RNA, 19 nt, Human
ucuuccuauguuguccagg

SEQ ID NO: 1247228 - RNA, 23 nt, Human
ucuuccuauguuguccaggcugg

SEQ ID NO: 1247229 - RNA, 24 nt, Human
ucuuccuauguuguccaggcuggu

SEQ ID NO: 1247230 - RNA, 23 nt, Human
ucuucuucucugagauuucuaga

SEQ ID NO: 1247231 - RNA, 19 nt, Human
ugaaaagaaugacauugag

SEQ ID NO: 1247232 - RNA, 21 nt, Human
ugaaauggacccagggaagag

SEQ ID NO: 1247233 - RNA, 24 nt, Human
ugaacucaagggauccuccugccu

SEQ ID NO: 1247234 - RNA, 20 nt, Human
ugaagaccuguacccucagu

SEQ ID NO: 1247235 - RNA, 23 nt, Human
ugaagauuauagcaauauuuuug

SEQ ID NO: 1247236 - RNA, 21 nt, Human
ugacauugagauguauuuuca

SEQ ID NO: 1247237 - RNA, 19 nt, Human
ugacuucauauccagcuuc

SEQ ID NO: 1247238 - RNA, 22 nt, Human
ugagaagcuuugcauacccuug

SEQ ID NO: 1247239 - RNA, 18 nt, Human
ugagauauccacagaacu

SEQ ID NO: 1247240 - RNA, 19 nt, Human
ugagaucaacccuccacca

SEQ ID NO: 1247241 - RNA, 22 nt, Human
ugagaucaacccuccaccacuu

SEQ ID NO: 1247242 - RNA, 24 nt, Human
ugagcacaaauacagcccagaaac

SEQ ID NO: 1247243 - RNA, 24 nt, Human
ugagccagcaggaaggaucucaca

SEQ ID NO: 1247244 - RNA, 24 nt, Human
ugaggcaggaguaucacuucaacc

SEQ ID NO: 1247245 - RNA, 25 nt, Human
ugaggcaggaguaucacuucaaccc

SEQ ID NO: 1247246 - RNA, 24 nt, Human
ugaucugcccaccuuggccuccca

SEQ ID NO: 1247247 - RNA, 21 nt, Human
ugauuugaucacuacacauug

SEQ ID NO: 1247248 - RNA, 19 nt, Human
ugcaaaaagagauuggaaa

SEQ ID NO: 1247249 - RNA, 22 nt, Human
ugcaggagaugggugcaagaca

SEQ ID NO: 1247250 - RNA, 21 nt, Human
ugcauagacaaaaugaaacaa

SEQ ID NO: 1247251 - RNA, 18 nt, Human
ugcaugggcagggccugg

SEQ ID NO: 1247252 - RNA, 21 nt, Human
ugcauguaucaaaauauaaca

SEQ ID NO: 1247253 - RNA, 18 nt, Human
ugccagcaguucucuucc

SEQ ID NO: 1247254 - RNA, 19 nt, Human
ugccauucaauuucugcag

SEQ ID NO: 1247255 - RNA, 19 nt, Human
ugccauucaauuucugcag

SEQ ID NO: 1247256 - RNA, 21 nt, Human
ugcccaggcuggaguucagug

SEQ ID NO: 1247257 - RNA, 24 nt, Human
ugcccaggcuggaguucaguggca

SEQ ID NO: 1247258 - RNA, 24 nt, Human
ugccucagccuccugaguagcugg

SEQ ID NO: 1247259 - RNA, 24 nt, Human
ugccucauaaguaccacuggacaa

SEQ ID NO: 1247260 - RNA, 19 nt, Human
ugccugagcacaaauacag

SEQ ID NO: 1247261 - RNA, 28 nt, Human
ugccugagcacaaauacagcccagaaac

SEQ ID NO: 1247262 - RNA, 20 nt, Human
ugccuggauuugcauguggg

SEQ ID NO: 1247263 - RNA, 24 nt, Human
ugccuguaaucccagcuacucagg

SEQ ID NO: 1247264 - RNA, 20 nt, Human
ugcugagggaaacagggugg

SEQ ID NO: 1247265 - RNA, 18 nt, Human
ugcugggaugacuggcau

SEQ ID NO: 1247266 - RNA, 20 nt, Human
ugcugggauuacaggugcca

SEQ ID NO: 1247267 - RNA, 24 nt, Human
uggaauuauagacgugugccucca

SEQ ID NO: 1247268 - RNA, 24 nt, Human
uggacacaaaaauacaguuagaug

SEQ ID NO: 1247269 - RNA, 18 nt, Human
uggacucaagugaucugc

SEQ ID NO: 1247270 - RNA, 22 nt, Human
uggacucaagugaucugcccac

SEQ ID NO: 1247271 - RNA, 22 nt, Human
uggagacagaaucucacucugu

SEQ ID NO: 1247272 - RNA, 19 nt, Human
uggaguucaguggcaugau

SEQ ID NO: 1247273 - RNA, 19 nt, Human
uggaguucaguggcaugau

SEQ ID NO: 1247274 - RNA, 21 nt, Human
uggcacaugccuguaauccca

SEQ ID NO: 1247275 - RNA, 22 nt, Human
uggcacaugccuguaaucccag

SEQ ID NO: 1247276 - RNA, 24 nt, Human
uggcaugaucucagcuuacugcaa

SEQ ID NO: 1247277 - RNA, 24 nt, Human
uggccagguuggucucaaacuccu

SEQ ID NO: 1247278 - RNA, 19 nt, Human
ugggacagggucucacugu

SEQ ID NO: 1247279 - RNA, 21 nt, Human
ugggagagcauuaggcugaga

SEQ ID NO: 1247280 - RNA, 18 nt, Human
ugggaucuuccuauguug

SEQ ID NO: 1247281 - RNA, 24 nt, Human
ugggaucuuccuauguuguccagg

SEQ ID NO: 1247282 - RNA, 21 nt, Human
ugggauuacaggugcacacca

SEQ ID NO: 1247283 - RNA, 19 nt, Human
ugggauuacaggugcacca

SEQ ID NO: 1247284 - RNA, 22 nt, Human
ugggauuacaggugccagccac

SEQ ID NO: 1247285 - RNA, 24 nt, Human
ugggauuacaggugccagccacca

SEQ ID NO: 1247286 - RNA, 21 nt, Human
uggggauaaaagaaccaacau

SEQ ID NO: 1247287 - RNA, 23 nt, Human
uggguucaagugauucuccugcc

SEQ ID NO: 1247288 - RNA, 24 nt, Human
uggguucaagugauucuccugccu

SEQ ID NO: 1247289 - RNA, 19 nt, Human
ugguaagaacccuccuggg

SEQ ID NO: 1247290 - RNA, 24 nt, Human
ugguggcacaugccuguaauccca

SEQ ID NO: 1247291 - RNA, 23 nt, Human
ugguguccuaauacauauguaug

SEQ ID NO: 1247292 - RNA, 25 nt, Human
uguaaaagccuuccuuacaaacacc

SEQ ID NO: 1247293 - RNA, 18 nt, Human
uguaauaaaccugcaaag

SEQ ID NO: 1247294 - RNA, 24 nt, Human
uguagagacgggguuuugauaugu

SEQ ID NO: 1247295 - RNA, 22 nt, Human
ugucacccaggcuggaagugca

SEQ ID NO: 1247296 - RNA, 24 nt, Human
uguccaggcuggucuuaaacuccu

SEQ ID NO: 1247297 - RNA, 23 nt, Human
ugucucaaacucuuggacucaac

SEQ ID NO: 1247298 - RNA, 24 nt, Human
uguguguuguuccuggugcucucc

SEQ ID NO: 1247299 - RNA, 23 nt, Human
uuaaaguagcuucaaaacccauu

SEQ ID NO: 1247300 - RNA, 24 nt, Human
uuacugcaaccuuccucuccuggg

SEQ ID NO: 1247301 - RNA, 18 nt, Human
uuagcccacccacaggug

SEQ ID NO: 1247302 - RNA, 22 nt, Human
uuaggcugagauagcucccaug

SEQ ID NO: 1247303 - RNA, 24 nt, Human
uuaguaggcacaggguuucaccau

SEQ ID NO: 1247304 - RNA, 22 nt, Human
uucaaaaugacuagaggaaaga

SEQ ID NO: 1247305 - RNA, 21 nt, Human
uucaagugauucuccugccuc

SEQ ID NO: 1247306 - RNA, 23 nt, Human
uucaagugauucuccugccucac

SEQ ID NO: 1247307 - RNA, 18 nt, Human
uucaaguuaguuuacccu

SEQ ID NO: 1247308 - RNA, 24 nt, Human
uucacccuguaaaagccuuccuua

SEQ ID NO: 1247309 - RNA, 27 nt, Human
uucauucauaccccaaaucucagcauc

SEQ ID NO: 1247310 - RNA, 24 nt, Human
uuccuugggucccuuuuccuuagc

SEQ ID NO: 1247311 - RNA, 23 nt, Human
uucgccaggucccugagugccca

SEQ ID NO: 1247312 - RNA, 25 nt, Human
uugauauauauauuauacugacaua

SEQ ID NO: 1247313 - RNA, 19 nt, Human
uugcagccucuacaucucc

SEQ ID NO: 1247314 - RNA, 21 nt, Human
uugcugggaugacuggcaugc

SEQ ID NO: 1247315 - RNA, 22 nt, Human
uuguagagacgggguuuugaua

SEQ ID NO: 1247316 - RNA, 24 nt, Human
uuguagagacgggguuuugauaug

SEQ ID NO: 1247317 - RNA, 19 nt, Human
uuuaaaauuuuaauauguu

SEQ ID NO: 1247318 - RNA, 19 nt, Human
uuucaccauguuggccagg

SEQ ID NO: 1247319 - RNA, 20 nt, Human
uuucaccauguuggccaggu

SEQ ID NO: 1247320 - RNA, 20 nt, Human
uuuguagagacgggguuuug

SEQ ID NO: 1247321 - RNA, 24 nt, Human
uuuguagagacgggguuuugauau

SEQ ID NO: 1247322 - RNA, 18 nt, Human
uuuucacauugcuaaguu

SEQ ID NO: 1247323 - RNA, 19 nt, Human
uuuugauauguugcucagg

SEQ ID NO: 1247324 - RNA, 24 nt, Human
uuuuuaguaggcacaggguuucac

SEQ ID NO: 1247325 - RNA, 20 nt, Human
uuuuuguauuuuuuguagag

SEQ ID NO: 1247326 - RNA, 23 nt, Human
uuuuuguauuuuuuguagagacg

SEQ ID NO: 1247327 - RNA, 21 nt, Human
uuuuuuguagagacgggguuu

SEQ ID NO: 1247328 - RNA, 22 nt, Human
uuuuuuguauuuuuaguaggca

SEQ ID NO: 1247329 - RNA, 22 nt, Human
aaaaaaaguaaccccaaguaac

SEQ ID NO: 1247330 - RNA, 23 nt, Human
aagaacccuucauugcaagugua

SEQ ID NO: 1247331 - RNA, 20 nt, Human
aagacccagcaccauguugg

SEQ ID NO: 1247332 - RNA, 23 nt, Human
aaguaaccccaaguaacaaguuu

SEQ ID NO: 1247333 - RNA, 22 nt, Human
acaaaauaaaaaaaguaacccc

SEQ ID NO: 1247334 - RNA, 21 nt, Human
aguccaggccuuccgucaccc

SEQ ID NO: 1247335 - RNA, 21 nt, Human
auaaaaauguguaccaggaac

SEQ ID NO: 1247336 - RNA, 26 nt, Human
caaaauaaaaaaaguaaccccaagua

SEQ ID NO: 1247337 - RNA, 24 nt, Human
caaacccgacuccuggcucccuca

SEQ ID NO: 1247338 - RNA, 19 nt, Human
caacuuccauuggcaagac

SEQ ID NO: 1247339 - RNA, 18 nt, Human
cacacagucgggaguggc

SEQ ID NO: 1247340 - RNA, 19 nt, Human
cacacagucgggaguggcu

SEQ ID NO: 1247341 - RNA, 22 nt, Human
ccaaguaacaaguuuacuaaac

SEQ ID NO: 1247342 - RNA, 23 nt, Human
ccuuccgucaccccauuggccag

SEQ ID NO: 1247343 - RNA, 18 nt, Human
cuuucccaauagacagca

SEQ ID NO: 1247344 - RNA, 21 nt, Human
gaggguagagcagcaucuauu

SEQ ID NO: 1247345 - RNA, 18 nt, Human
uaacaaguuuacuaaaca

SEQ ID NO: 1247346 - RNA, 28 nt, Human
uaacaaguuuacuaaacaagacccagca

SEQ ID NO: 1247347 - RNA, 18 nt, Human
uaccaggaacuuucccaa

SEQ ID NO: 1247348 - RNA, 24 nt, Human
ucgggaguggcuccacuccaacuu

SEQ ID NO: 1247349 - RNA, 20 nt, Human
uggaaacauguaagaaagua

SEQ ID NO: 1247350 - RNA, 20 nt, Human
uggcuccacuccaacuucca

SEQ ID NO: 1247351 - RNA, 21 nt, Human
aaauguuaaaaguuauaaaau

SEQ ID NO: 1247352 - RNA, 19 nt, Human
aagcccccuuuaugcuucc

SEQ ID NO: 1247353 - RNA, 29 nt, Human
acaaaaauacaaauauauacauauaaaaa

SEQ ID NO: 1247354 - RNA, 20 nt, Human
acgcggggcggccgagggcc

SEQ ID NO: 1247355 - RNA, 21 nt, Human
aggcauugaaggucacauucc

SEQ ID NO: 1247356 - RNA, 20 nt, Human
caggcauugaaggucacauu

SEQ ID NO: 1247357 - RNA, 23 nt, Human
caguugaaagugacugagugcau

SEQ ID NO: 1247358 - RNA, 22 nt, Human
cgagggccuggguccgcucugu

SEQ ID NO: 1247359 - RNA, 22 nt, Human
cuuuaugcuucccuaacuccuc

SEQ ID NO: 1247360 - RNA, 19 nt, Human
gggcggccgagggccuggg

SEQ ID NO: 1247361 - RNA, 21 nt, Human
uauaaaaaugcaguuacauug

SEQ ID NO: 1247362 - RNA, 24 nt, Human
uauaauggucuuguguuguucucc

SEQ ID NO: 1247363 - RNA, 20 nt, Human
uauauugccaaaaaacucuu

SEQ ID NO: 1247364 - RNA, 24 nt, Human
ucacugaauauaauggucuugugu

SEQ ID NO: 1247365 - RNA, 18 nt, Human
ucuccuguccccuuauaa

SEQ ID NO: 1247366 - RNA, 23 nt, Human
ugaauauaauggucuuguguugu

SEQ ID NO: 1247367 - RNA, 20 nt, Human
ugggaagggacagcagguuc

SEQ ID NO: 1247368 - RNA, 28 nt, Human
uucaagcccccuuuaugcuucccuaacu

SEQ ID NO: 1247369 - RNA, 25 nt, Human
uuccugucuuuuuccaaagcauaca

SEQ ID NO: 1247370 - RNA, 24 nt, Human
uuuccugucuuuuuccaaagcaua

SEQ ID NO: 1247371 - RNA, 25 nt, Human
aggugcccgcccagcaccgcgcccu

SEQ ID NO: 1247372 - RNA, 22 nt, Human
cccucugccacugccugauacc

SEQ ID NO: 1247373 - RNA, 20 nt, Human
ccguuggcgcaguccuccuc

SEQ ID NO: 1247374 - RNA, 18 nt, Human
cguuggcgcaguccuccu

SEQ ID NO: 1247375 - RNA, 24 nt, Human
cuagagcccucugccacugccuga

SEQ ID NO: 1247376 - RNA, 21 nt, Human
cucugccacugccugauaccu

SEQ ID NO: 1247377 - RNA, 22 nt, Human
gugcccgcccagcaccgcgccc

SEQ ID NO: 1247378 - RNA, 22 nt, Human
ugccacugccugauaccucagc

SEQ ID NO: 1247379 - RNA, 25 nt, Human
aaaaaaaccaauguaauacccuaaa

SEQ ID NO: 1247380 - RNA, 26 nt, Human
aaaaaaccaauguaauacccuaaaua

SEQ ID NO: 1247381 - RNA, 18 nt, Human
aaacaaaugaggcuagcc

SEQ ID NO: 1247382 - RNA, 19 nt, Human
aaacaaaugaggcuagccc

SEQ ID NO: 1247383 - RNA, 20 nt, Human
aaagaaagagagaucagacc

SEQ ID NO: 1247384 - RNA, 23 nt, Human
aaagaaugcagauggaacucaga

SEQ ID NO: 1247385 - RNA, 19 nt, Human
aacauggugaaaccccauc

SEQ ID NO: 1247386 - RNA, 20 nt, Human
aacauggugaaaccccaucu

SEQ ID NO: 1247387 - RNA, 21 nt, Human
aacauggugaaaccccaucuc

SEQ ID NO: 1247388 - RNA, 21 nt, Human
aacauggugaaaccccaucuc

SEQ ID NO: 1247389 - RNA, 23 nt, Human
aacauggugaaaccccaucucua

SEQ ID NO: 1247390 - RNA, 22 nt, Human
aacuucuagcuuccaaaacucu

SEQ ID NO: 1247391 - RNA, 23 nt, Human
aacuuuccaggccacagcacagg

SEQ ID NO: 1247392 - RNA, 19 nt, Human
aagaagaaaauucagaucu

SEQ ID NO: 1247393 - RNA, 23 nt, Human
aagaagaaaauucagaucugccg

SEQ ID NO: 1247394 - RNA, 25 nt, Human
aagaagaauagagggaaccgguacc

SEQ ID NO: 1247395 - RNA, 18 nt, Human
aagccccuauucccccag

SEQ ID NO: 1247396 - RNA, 18 nt, Human
acagagcaagacucaguc

SEQ ID NO: 1247397 - RNA, 18 nt, Human
accaauguaauacccuaa

SEQ ID NO: 1247398 - RNA, 24 nt, Human
accccaucucuacuaaaaauacaa

SEQ ID NO: 1247399 - RNA, 18 nt, Human
acccccaucgcacugggg

SEQ ID NO: 1247400 - RNA, 24 nt, Human
agaaagcaggcucaauaaaggcuc

SEQ ID NO: 1247401 - RNA, 22 nt, Human
agaaagcaggucauuugcaauc

SEQ ID NO: 1247402 - RNA, 20 nt, Human
agaagaaaauucagaucugc

SEQ ID NO: 1247403 - RNA, 18 nt, Human
agacagaacugugagccu

SEQ ID NO: 1247404 - RNA, 19 nt, Human
agagccagccccucuuccc

SEQ ID NO: 1247405 - RNA, 21 nt, Human
agaggaggccaugugaugaug

SEQ ID NO: 1247406 - RNA, 21 nt, Human
agaggaggccaugugaugaug

SEQ ID NO: 1247407 - RNA, 24 nt, Human
agcacuuugggaggcugagguggg

SEQ ID NO: 1247408 - RNA, 24 nt, Human
agcaugggcaacagagcaagacuc

SEQ ID NO: 1247409 - RNA, 23 nt, Human
agcuggguguggugacacacgcc

SEQ ID NO: 1247410 - RNA, 21 nt, Human
aggaaaggaggcaccccccgc

SEQ ID NO: 1247411 - RNA, 26 nt, Human
aggaggccaugugaugaugggggcgg

SEQ ID NO: 1247412 - RNA, 22 nt, Human
aggcaggagaaucucuugaacc

SEQ ID NO: 1247413 - RNA, 24 nt, Human
aggcaggagaaucucuugaaccug

SEQ ID NO: 1247414 - RNA, 20 nt, Human
aggcagugguugcagucacc

SEQ ID NO: 1247415 - RNA, 23 nt, Human
aggcagugguugcagucacccga

SEQ ID NO: 1247416 - RNA, 24 nt, Human
aggcugaggcaggagaaucucuug

SEQ ID NO: 1247417 - RNA, 19 nt, Human
aggcugagguggguggauc

SEQ ID NO: 1247418 - RNA, 19 nt, Human
aggcuggacccgguggcuc

SEQ ID NO: 1247419 - RNA, 24 nt, Human
agguggguggaucacaagggcagg

SEQ ID NO: 1247420 - RNA, 19 nt, Human
auaaaggcugguagaauua

SEQ ID NO: 1247421 - RNA, 21 nt, Human
auagaguaacagagaccaaaa

SEQ ID NO: 1247422 - RNA, 24 nt, Human
caaagggcagugauccucaagaga

SEQ ID NO: 1247423 - RNA, 19 nt, Human
caagagaugagaaacaaau

SEQ ID NO: 1247424 - RNA, 22 nt, Human
caagauagaguaacagagacca

SEQ ID NO: 1247425 - RNA, 20 nt, Human
caauugaccucccuaacacc

SEQ ID NO: 1247426 - RNA, 23 nt, Human
caauugaccucccuaacaccuua

SEQ ID NO: 1247427 - RNA, 21 nt, Human
cacaauugaccucccuaacac

SEQ ID NO: 1247428 - RNA, 18 nt, Human
cacccccgcgaggcgggg

SEQ ID NO: 1247429 - RNA, 19 nt, Human
cacccgucuguauugggag

SEQ ID NO: 1247430 - RNA, 22 nt, Human
cacccucuuucacugucaaaga

SEQ ID NO: 1247431 - RNA, 19 nt, Human
caccugcaaucccagcacu

SEQ ID NO: 1247432 - RNA, 24 nt, Human
caccugcaaucccagcacuuuggg

SEQ ID NO: 1247433 - RNA, 21 nt, Human
caccuuagaaaacuuuccagg

SEQ ID NO: 1247434 - RNA, 21 nt, Human
cagagaggaggccaugugaug

SEQ ID NO: 1247435 - RNA, 24 nt, Human
cagcacuuugggaggcugaggugg

SEQ ID NO: 1247436 - RNA, 24 nt, Human
cagcuacucaggaggcugaggcag

SEQ ID NO: 1247437 - RNA, 21 nt, Human
ccaguggcucuuacgaccccc

SEQ ID NO: 1247438 - RNA, 22 nt, Human
ccaguggcucuuacgaccccca

SEQ ID NO: 1247439 - RNA, 24 nt, Human
ccauguauguagucauaucacccc

SEQ ID NO: 1247440 - RNA, 20 nt, Human
cccacaauugaccucccuaa

SEQ ID NO: 1247441 - RNA, 21 nt, Human
cccacgcugcaauuagaagga

SEQ ID NO: 1247442 - RNA, 23 nt, Human
ccccacuggcucuuaggaccccc

SEQ ID NO: 1247443 - RNA, 23 nt, Human
ccccuauucccccaguggcucuu

SEQ ID NO: 1247444 - RNA, 25 nt, Human
cccgagaucgagcaaagccgggguc

SEQ ID NO: 1247445 - RNA, 19 nt, Human
ccucgguguacagagggug

SEQ ID NO: 1247446 - RNA, 21 nt, Human
ccucuagucccagcuacucag

SEQ ID NO: 1247447 - RNA, 22 nt, Human
ccucuagucccagcuacucagg

SEQ ID NO: 1247448 - RNA, 21 nt, Human
ccugaguugagaagacagaac

SEQ ID NO: 1247449 - RNA, 22 nt, Human
ccuggcaaacauggugaaaccc

SEQ ID NO: 1247450 - RNA, 24 nt, Human
ccuggcaaacauggugaaacccca

SEQ ID NO: 1247451 - RNA, 20 nt, Human
cgaggcggggucucagagcc

SEQ ID NO: 1247452 - RNA, 24 nt, Human
cgcaccugcaaucccagcacuuug

SEQ ID NO: 1247453 - RNA, 24 nt, Human
cgccucuagucccagcuacucagg

SEQ ID NO: 1247454 - RNA, 24 nt, Human
cgcgugucauauccuccccuccca

SEQ ID NO: 1247455 - RNA, 24 nt, Human
cgcgugucauauccuccucuccca

SEQ ID NO: 1247456 - RNA, 20 nt, Human
cuaggagcugugggguuuug

SEQ ID NO: 1247457 - RNA, 27 nt, Human
cuaggagcugugggguuuuguagacug

SEQ ID NO: 1247458 - RNA, 24 nt, Human
cucgcaccugcaaucccagcacuu

SEQ ID NO: 1247459 - RNA, 19 nt, Human
gaaacaaaugaggcuagcc

SEQ ID NO: 1247460 - RNA, 19 nt, Human
gaaauaggguuguugcaga

SEQ ID NO: 1247461 - RNA, 23 nt, Human
gacccgguggcucgcaccugcaa

SEQ ID NO: 1247462 - RNA, 20 nt, Human
gagcaagccccuauuccccc

SEQ ID NO: 1247463 - RNA, 18 nt, Human
gaggccaugugaugaugg

SEQ ID NO: 1247464 - RNA, 24 nt, Human
gauaucgcgugucauauccucccc

SEQ ID NO: 1247465 - RNA, 27 nt, Human
gaugaugggggcggaaaagggagggcc

SEQ ID NO: 1247466 - RNA, 22 nt, Human
gaugaugggggcggaaacuggg

SEQ ID NO: 1247467 - RNA, 24 nt, Human
gcaaacauggugaaaccccaucuc

SEQ ID NO: 1247468 - RNA, 26 nt, Human
gcaucuacaagccaaggaaugucagg

SEQ ID NO: 1247469 - RNA, 18 nt, Human
ggauuuacuauucgacag

SEQ ID NO: 1247470 - RNA, 26 nt, Human
ggcaauagaaacugccaauaacagaa

SEQ ID NO: 1247471 - RNA, 20 nt, Human
ggcggggaggcaccccccgc

SEQ ID NO: 1247472 - RNA, 22 nt, Human
gggaaggccaauguggcuagaa

SEQ ID NO: 1247473 - RNA, 19 nt, Human
ggguggaucacaagggcag

SEQ ID NO: 1247474 - RNA, 22 nt, Human
gguauuagguguccaagaagaa

SEQ ID NO: 1247475 - RNA, 18 nt, Human
guauugggaguaauauca

SEQ ID NO: 1247476 - RNA, 19 nt, Human
gugaucagaguaugcaggu

SEQ ID NO: 1247477 - RNA, 19 nt, Human
guggguggaucacaagggc

SEQ ID NO: 1247478 - RNA, 22 nt, Human
gugucgguguccuuagaagaag

SEQ ID NO: 1247479 - RNA, 21 nt, Human
uaaaacaacaaaacuacugga

SEQ ID NO: 1247480 - RNA, 21 nt, Human
uaacaacacccucuuucacug

SEQ ID NO: 1247481 - RNA, 21 nt, Human
uagaaaggaaaggaggcaccc

SEQ ID NO: 1247482 - RNA, 24 nt, Human
uagaauacccuaugcacuaucuuu

SEQ ID NO: 1247483 - RNA, 26 nt, Human
uagaguaacagagaccaaaagggagc

SEQ ID NO: 1247484 - RNA, 22 nt, Human
uagcuggguguggugacacacg

SEQ ID NO: 1247485 - RNA, 20 nt, Human
uaucagugggggcgugucca

SEQ ID NO: 1247486 - RNA, 20 nt, Human
uauggcccucaagcaacaaa

SEQ ID NO: 1247487 - RNA, 22 nt, Human
ucaaucacuggaaucaagcauu

SEQ ID NO: 1247488 - RNA, 24 nt, Human
ucacaagggcaggagauaaagacc

SEQ ID NO: 1247489 - RNA, 23 nt, Human
ucacagggguguuucuacucccu

SEQ ID NO: 1247490 - RNA, 18 nt, Human
ucacccgagaucgagcaa

SEQ ID NO: 1247491 - RNA, 23 nt, Human
ucagagccagccccucuuccccc

SEQ ID NO: 1247492 - RNA, 22 nt, Human
ucagugggggcguguccacagg

SEQ ID NO: 1247493 - RNA, 20 nt, Human
uccaagaagaaaauucagau

SEQ ID NO: 1247494 - RNA, 22 nt, Human
uccacuuucugccauguaugua

SEQ ID NO: 1247495 - RNA, 20 nt, Human
uccaggccacagcacaggaa

SEQ ID NO: 1247496 - RNA, 26 nt, Human
uccaggccacagcacaggaagaaaaa

SEQ ID NO: 1247497 - RNA, 21 nt, Human
ucccccgcuggcucugaggau

SEQ ID NO: 1247498 - RNA, 21 nt, Human
ucccuccaggaucgugggaac

SEQ ID NO: 1247499 - RNA, 18 nt, Human
uccuaggagcuguggggu

SEQ ID NO: 1247500 - RNA, 22 nt, Human
uccucaagagaugagaaacaaa

SEQ ID NO: 1247501 - RNA, 18 nt, Human
ucgcagggggaggaggca

SEQ ID NO: 1247502 - RNA, 18 nt, Human
ucgcgugucauauccucc

SEQ ID NO: 1247503 - RNA, 19 nt, Human
ucgcgugucauauccuccu

SEQ ID NO: 1247504 - RNA, 26 nt, Human
ucuacaagccaaggaaugucagggcu

SEQ ID NO: 1247505 - RNA, 21 nt, Human
ucucuacuaaaaauacaaaaa

SEQ ID NO: 1247506 - RNA, 23 nt, Human
ucuggccaagauagaguaacaga

SEQ ID NO: 1247507 - RNA, 19 nt, Human
ugaaaccccaucucuacua

SEQ ID NO: 1247508 - RNA, 19 nt, Human
ugaaccugggaggcagugg

SEQ ID NO: 1247509 - RNA, 24 nt, Human
ugaaccugggaggcagugguugca

SEQ ID NO: 1247510 - RNA, 28 nt, Human
ugagaaacaaaugaggcuagccccacaa

SEQ ID NO: 1247511 - RNA, 19 nt, Human
ugagaagacagaacuguga

SEQ ID NO: 1247512 - RNA, 23 nt, Human
ugagagccagccccucuuccccc

SEQ ID NO: 1247513 - RNA, 20 nt, Human
ugagccugggaaggccaaug

SEQ ID NO: 1247514 - RNA, 20 nt, Human
ugaggcaggagaaucucuug

SEQ ID NO: 1247515 - RNA, 24 nt, Human
ugaggcaggagaaucucuugaacc

SEQ ID NO: 1247516 - RNA, 25 nt, Human
ugaggcaggagaaucucuugaaccu

SEQ ID NO: 1247517 - RNA, 18 nt, Human
ugagguggguggaucaca

SEQ ID NO: 1247518 - RNA, 19 nt, Human
ugagguggguggaucacaa

SEQ ID NO: 1247519 - RNA, 22 nt, Human
ugagguggguggaucacaaggg

SEQ ID NO: 1247520 - RNA, 23 nt, Human
ugagguggguggaucacaagggc

SEQ ID NO: 1247521 - RNA, 24 nt, Human
ugagguggguggaucacaagggca

SEQ ID NO: 1247522 - RNA, 19 nt, Human
ugaugggggcggaaacugg

SEQ ID NO: 1247523 - RNA, 21 nt, Human
ugcacuaucuuuaaaugggau

SEQ ID NO: 1247524 - RNA, 19 nt, Human
ugccaacaccucguuuuga

SEQ ID NO: 1247525 - RNA, 18 nt, Human
uggcaaacauggugaaac

SEQ ID NO: 1247526 - RNA, 26 nt, Human
uggccaagauagaguaacagagacca

SEQ ID NO: 1247527 - RNA, 22 nt, Human
uggcucgcaccugcaaucccag

SEQ ID NO: 1247528 - RNA, 24 nt, Human
uggcucgcaccugcaaucccagca

SEQ ID NO: 1247529 - RNA, 22 nt, Human
ugggaggcagugguugcaguca

SEQ ID NO: 1247530 - RNA, 20 nt, Human
ugggaggcugaggugggugg

SEQ ID NO: 1247531 - RNA, 23 nt, Human
ugggaggcugagguggguggauc

SEQ ID NO: 1247532 - RNA, 24 nt, Human
ugggaggcugagguggguggauca

SEQ ID NO: 1247533 - RNA, 21 nt, Human
ugggauuuacuauucgacagg

SEQ ID NO: 1247534 - RNA, 19 nt, Human
uguacagaggguguacacc

SEQ ID NO: 1247535 - RNA, 23 nt, Human
ugucacugugucuauguagaaag

SEQ ID NO: 1247536 - RNA, 27 nt, Human
uguccaagaagaaaauucagaucugcc

SEQ ID NO: 1247537 - RNA, 19 nt, Human
uguccaucuuucagaguuu

SEQ ID NO: 1247538 - RNA, 20 nt, Human
uguccgaaagcagcccggga

SEQ ID NO: 1247539 - RNA, 19 nt, Human
uuagcuggguguggugaca

SEQ ID NO: 1247540 - RNA, 24 nt, Human
uuagcuggguguggugacacacgc

SEQ ID NO: 1247541 - RNA, 21 nt, Human
uuccugggauaguccugguuu

SEQ ID NO: 1247542 - RNA, 24 nt, Human
uugaaccugggaggcagugguugc

SEQ ID NO: 1247543 - RNA, 25 nt, Human
uugggaggcugagguggguggauca

SEQ ID NO: 1247544 - RNA, 20 nt, Human
uuuugauguguaaaugcuua

SEQ ID NO: 1247545 - RNA, 25 nt, Human
aagacaccacacaaaaaggggcaaa

SEQ ID NO: 1247546 - RNA, 19 nt, Human
accccaaaaaaugaaggaa

SEQ ID NO: 1247547 - RNA, 22 nt, Human
accccaaaaaaugaaggaaaau

SEQ ID NO: 1247548 - RNA, 23 nt, Human
agggagaagaaauaaguguaaaa

SEQ ID NO: 1247549 - RNA, 22 nt, Human
caagaaaguuuaugaagacacc

SEQ ID NO: 1247550 - RNA, 22 nt, Human
caccacacaaaaaggggcaaaa

SEQ ID NO: 1247551 - RNA, 22 nt, Human
caccccaaaaaaugaaggaaaa

SEQ ID NO: 1247552 - RNA, 25 nt, Human
cagguauaaagaauagggagaagaa

SEQ ID NO: 1247553 - RNA, 18 nt, Human
cauguaucaaacaguaua

SEQ ID NO: 1247554 - RNA, 19 nt, Human
ccaccccaaaaaaugaagg

SEQ ID NO: 1247555 - RNA, 21 nt, Human
cccaaaaaaugaaggaaaaua

SEQ ID NO: 1247556 - RNA, 21 nt, Human
gguauaaagaauagggagaag

SEQ ID NO: 1247557 - RNA, 20 nt, Human
uacuguaacucaacaugaca

SEQ ID NO: 1247558 - RNA, 23 nt, Human
ucccaccccaaaaaaugaaggaa

SEQ ID NO: 1247559 - RNA, 22 nt, Human
ugaagacaccacacaaaaaggg

SEQ ID NO: 1247560 - RNA, 18 nt, Human
ugucacagguauaaagaa

SEQ ID NO: 1247561 - RNA, 23 nt, Human
uucaaaagcuaacaacuuauggg

SEQ ID NO: 1247562 - RNA, 24 nt, Human
uucaggcaagaaaguuuaugaaga

SEQ ID NO: 1247563 - RNA, 21 nt, Human
aaaaaaaaaaaaaaaauagag

SEQ ID NO: 1247564 - RNA, 21 nt, Human
aaaaaaaaaaaaaauagagau

SEQ ID NO: 1247565 - RNA, 24 nt, Human
aaagugcugggauuaaagguauga

SEQ ID NO: 1247566 - RNA, 24 nt, Human
aaagugcugggauuacaggcauga

SEQ ID NO: 1247567 - RNA, 23 nt, Human
aacaccaacagacacagaacaca

SEQ ID NO: 1247568 - RNA, 20 nt, Human
aacacggugaaaccccgucu

SEQ ID NO: 1247569 - RNA, 21 nt, Human
aacacggugaaaccccgucuc

SEQ ID NO: 1247570 - RNA, 21 nt, Human
aacacucucuacagcauagaa

SEQ ID NO: 1247571 - RNA, 24 nt, Human
aacagagugagacucugucucaaa

SEQ ID NO: 1247572 - RNA, 24 nt, Human
aagccaaaggcccugacccgugcu

SEQ ID NO: 1247573 - RNA, 20 nt, Human
aaggcagguggaucacaagg

SEQ ID NO: 1247574 - RNA, 25 nt, Human
aagugauccucccaccucagccucc

SEQ ID NO: 1247575 - RNA, 19 nt, Human
aagugcugggauuaaaggu

SEQ ID NO: 1247576 - RNA, 26 nt, Human
aagugcugggauuaaagguaugagcc

SEQ ID NO: 1247577 - RNA, 19 nt, Human
aagugcugggauuacaggc

SEQ ID NO: 1247578 - RNA, 21 nt, Human
aagugcugggauuacaggcau

SEQ ID NO: 1247579 - RNA, 26 nt, Human
aagugcugggauuacaggcaugaacc

SEQ ID NO: 1247580 - RNA, 24 nt, Human
aauugcuugaaccugggaggcgga

SEQ ID NO: 1247581 - RNA, 21 nt, Human
acagagugagacucugucuca

SEQ ID NO: 1247582 - RNA, 24 nt, Human
acagagugagacucugucucaaaa

SEQ ID NO: 1247583 - RNA, 18 nt, Human
acagcucacuguagccuc

SEQ ID NO: 1247584 - RNA, 21 nt, Human
acaggcaucaccacacccugc

SEQ ID NO: 1247585 - RNA, 24 nt, Human
acaguggcucaugccuggaauccc

SEQ ID NO: 1247586 - RNA, 22 nt, Human
accacccacugcugcugcaccc

SEQ ID NO: 1247587 - RNA, 22 nt, Human
accacugcacuccagccugggc

SEQ ID NO: 1247588 - RNA, 24 nt, Human
accccgucucuaauaaaaauacaa

SEQ ID NO: 1247589 - RNA, 24 nt, Human
acuaucuugcccaagcuggucuug

SEQ ID NO: 1247590 - RNA, 24 nt, Human
acuccagccugggcaacagaguga

SEQ ID NO: 1247591 - RNA, 25 nt, Human
acucugucauccaggcuggagugca

SEQ ID NO: 1247592 - RNA, 28 nt, Human
acucugucucaaaaaaaaaaaaaaaaaa

SEQ ID NO: 1247593 - RNA, 19 nt, Human
acugagucuaccauguccc

SEQ ID NO: 1247594 - RNA, 24 nt, Human
acugcacuccagccugggcaacag

SEQ ID NO: 1247595 - RNA, 24 nt, Human
acugcacuccagccugggcaacag

SEQ ID NO: 1247596 - RNA, 22 nt, Human
agacagaugagaccuucccaga

SEQ ID NO: 1247597 - RNA, 21 nt, Human
agacaggaaguaggagaccca

SEQ ID NO: 1247598 - RNA, 22 nt, Human
agacaggaaguaggagacccaa

SEQ ID NO: 1247599 - RNA, 24 nt, Human
agacaggaaguaggagacccaaga

SEQ ID NO: 1247600 - RNA, 23 nt, Human
agagaacagcccagagaacccaa

SEQ ID NO: 1247601 - RNA, 18 nt, Human
agcagccgcaucaccacc

SEQ ID NO: 1247602 - RNA, 23 nt, Human
agccucaaccucccagucucaag

SEQ ID NO: 1247603 - RNA, 24 nt, Human
agccuggccaacacggugaaaccc

SEQ ID NO: 1247604 - RNA, 24 nt, Human
agccugggcaacagagugagacuc

SEQ ID NO: 1247605 - RNA, 18 nt, Human
agcuggucuugaacuccu

SEQ ID NO: 1247606 - RNA, 24 nt, Human
agcuggucuugaacuccugggcuc

SEQ ID NO: 1247607 - RNA, 20 nt, Human
aggcaagaggcagaccuggg

SEQ ID NO: 1247608 - RNA, 21 nt, Human
aggcaagaggcagaccugggg

SEQ ID NO: 1247609 - RNA, 21 nt, Human
aggcagauaauugcuugaacc

SEQ ID NO: 1247610 - RNA, 23 nt, Human
aggcagauaauugcuugaaccug

SEQ ID NO: 1247611 - RNA, 18 nt, Human
aggcagguggaucacaag

SEQ ID NO: 1247612 - RNA, 24 nt, Human
aggcagguggaucacaaggucagg

SEQ ID NO: 1247613 - RNA, 22 nt, Human
aggcccagcaagggugugccug

SEQ ID NO: 1247614 - RNA, 22 nt, Human
aggccggguacaguggcucaug

SEQ ID NO: 1247615 - RNA, 24 nt, Human
aggcggagguugcagucaguugag

SEQ ID NO: 1247616 - RNA, 21 nt, Human
aggcguggcgggcgccuguaa

SEQ ID NO: 1247617 - RNA, 23 nt, Human
aggcugaggcagauaauugcuug

SEQ ID NO: 1247618 - RNA, 20 nt, Human
agguaugagccacugcaccc

SEQ ID NO: 1247619 - RNA, 23 nt, Human
agguggaucacaaggucaggagu

SEQ ID NO: 1247620 - RNA, 21 nt, Human
agugcaguagcgcgaucacag

SEQ ID NO: 1247621 - RNA, 23 nt, Human
agugcaguagcgcgaucacagcu

SEQ ID NO: 1247622 - RNA, 18 nt, Human
agugcugggauuacaggc

SEQ ID NO: 1247623 - RNA, 24 nt, Human
aguggcucaugccuggaaucccag

SEQ ID NO: 1247624 - RNA, 24 nt, Human
aucgcaccacugcacuccagccug

SEQ ID NO: 1247625 - RNA, 28 nt, Human
aucgcaccacugcacuccagccugggca

SEQ ID NO: 1247626 - RNA, 18 nt, Human
auguugccccaggcuggu

SEQ ID NO: 1247627 - RNA, 20 nt, Human
auguugccccaggcuggucu

SEQ ID NO: 1247628 - RNA, 24 nt, Human
auguugccccaggcuggucuugaa

SEQ ID NO: 1247629 - RNA, 23 nt, Human
auuauuuuaaguaagcaaacacu

SEQ ID NO: 1247630 - RNA, 24 nt, Human
auucaggaugacaaagccuucaac

SEQ ID NO: 1247631 - RNA, 24 nt, Human
caaagugcugggauuaaagguaug

SEQ ID NO: 1247632 - RNA, 24 nt, Human
caaagugcugggauuacaggcaug

SEQ ID NO: 1247633 - RNA, 27 nt, Human
caaaugauccuccuaccuuggcuuccc

SEQ ID NO: 1247634 - RNA, 28 nt, Human
caaaugauccuccuaccuuggcuuccca

SEQ ID NO: 1247635 - RNA, 22 nt, Human
caaauugaagcagcuacagcuu

SEQ ID NO: 1247636 - RNA, 23 nt, Human
caacaccaacagacacagaacac

SEQ ID NO: 1247637 - RNA, 24 nt, Human
caacacggugaaaccccgucucua

SEQ ID NO: 1247638 - RNA, 22 nt, Human
caacagacacagaacacaggaa

SEQ ID NO: 1247639 - RNA, 22 nt, Human
caacagacacagaacacaggaa

SEQ ID NO: 1247640 - RNA, 19 nt, Human
caagagcagccgcaucacc

SEQ ID NO: 1247641 - RNA, 19 nt, Human
caagaggcagaccuggggu

SEQ ID NO: 1247642 - RNA, 22 nt, Human
caaggcagguggaucacaaggu

SEQ ID NO: 1247643 - RNA, 26 nt, Human
caaggcagguggaucacaaggucagg

SEQ ID NO: 1247644 - RNA, 22 nt, Human
caaggucaggaguacaagacca

SEQ ID NO: 1247645 - RNA, 20 nt, Human
caagugauccucccaccuca

SEQ ID NO: 1247646 - RNA, 27 nt, Human
caagugauccucccaccucagccuccu

SEQ ID NO: 1247647 - RNA, 22 nt, Human
caagugaucuuccugccucggc

SEQ ID NO: 1247648 - RNA, 23 nt, Human
cacagccuguaagccaaaggccc

SEQ ID NO: 1247649 - RNA, 22 nt, Human
caccaacagacacagaacacag

SEQ ID NO: 1247650 - RNA, 25 nt, Human
caccacacccugcuacuucuguuaa

SEQ ID NO: 1247651 - RNA, 21 nt, Human
caccagcaggcaagaggcaga

SEQ ID NO: 1247652 - RNA, 18 nt, Human
caccaggccacucaagag

SEQ ID NO: 1247653 - RNA, 25 nt, Human
caccucagccuccugaguagcugca

SEQ ID NO: 1247654 - RNA, 23 nt, Human
cacggugaaaccccgucucuaau

SEQ ID NO: 1247655 - RNA, 22 nt, Human
cacuccagccugggcaacagag

SEQ ID NO: 1247656 - RNA, 24 nt, Human
cacuccagccugggcaacagagug

SEQ ID NO: 1247657 - RNA, 23 nt, Human
cacucugucauccaggcuggagu

SEQ ID NO: 1247658 - RNA, 24 nt, Human
cacucugucauccaggcuggagug

SEQ ID NO: 1247659 - RNA, 19 nt, Human
cacugcacuccagccuggg

SEQ ID NO: 1247660 - RNA, 21 nt, Human
cacugcacuccagccugggca

SEQ ID NO: 1247661 - RNA, 22 nt, Human
cacugcacuccagccugggcaa

SEQ ID NO: 1247662 - RNA, 23 nt, Human
cacugcacuccagccugggcaac

SEQ ID NO: 1247663 - RNA, 24 nt, Human
cacugcacuccagccugggcaaca

SEQ ID NO: 1247664 - RNA, 25 nt, Human
cacugcacuccagccugggcaacaa

SEQ ID NO: 1247665 - RNA, 20 nt, Human
cacugcugcugcaccccugc

SEQ ID NO: 1247666 - RNA, 22 nt, Human
cacuguagccucaaccucccag

SEQ ID NO: 1247667 - RNA, 21 nt, Human
cacuucccuugcugguccuug

SEQ ID NO: 1247668 - RNA, 21 nt, Human
cagagucucugagguagaaac

SEQ ID NO: 1247669 - RNA, 20 nt, Human
cagauaauugcuugaacccc

SEQ ID NO: 1247670 - RNA, 24 nt, Human
cagcaauuugggaggccaaggcag

SEQ ID NO: 1247671 - RNA, 24 nt, Human
cagcaauuugggaggccaaggcag

SEQ ID NO: 1247672 - RNA, 18 nt, Human
cagccuccugaguagcug

SEQ ID NO: 1247673 - RNA, 24 nt, Human
cagcuacucaggaggcugaggcag

SEQ ID NO: 1247674 - RNA, 20 nt, Human
cagguggaucacaaggucau

SEQ ID NO: 1247675 - RNA, 20 nt, Human
caguagcgcgaucacagcuc

SEQ ID NO: 1247676 - RNA, 23 nt, Human
cauaacaaccccacuuuacagau

SEQ ID NO: 1247677 - RNA, 25 nt, Human
cauagggcugcucagaaauaaacac

SEQ ID NO: 1247678 - RNA, 21 nt, Human
caucaccacacccugcuacuu

SEQ ID NO: 1247679 - RNA, 24 nt, Human
caugccuggaaucccagcaauuug

SEQ ID NO: 1247680 - RNA, 18 nt, Human
cauuuuccuagaaaaucc

SEQ ID NO: 1247681 - RNA, 21 nt, Human
ccaaagugcugggauuaaagg

SEQ ID NO: 1247682 - RNA, 21 nt, Human
ccaaagugcugggauuaaagg

SEQ ID NO: 1247683 - RNA, 24 nt, Human
ccaaagugcugggauuaaagguau

SEQ ID NO: 1247684 - RNA, 23 nt, Human
ccaaagugcugggauuacaggca

SEQ ID NO: 1247685 - RNA, 24 nt, Human
ccaaagugcugggauuacaggcau

SEQ ID NO: 1247686 - RNA, 18 nt, Human
ccaacagacacagaacac

SEQ ID NO: 1247687 - RNA, 24 nt, Human
ccaagcuggucuugaacuccuggg

SEQ ID NO: 1247688 - RNA, 28 nt, Human
ccaccaggccacucaagagcagccgcau

SEQ ID NO: 1247689 - RNA, 23 nt, Human
ccaccucagccuccugaguagcu

SEQ ID NO: 1247690 - RNA, 20 nt, Human
ccacugcacuccagccuggg

SEQ ID NO: 1247691 - RNA, 20 nt, Human
ccacugcacuccagccuggg

SEQ ID NO: 1247692 - RNA, 21 nt, Human
ccacugcacuccagccugggc

SEQ ID NO: 1247693 - RNA, 23 nt, Human
ccacugcacuccagccugggcaa

SEQ ID NO: 1247694 - RNA, 24 nt, Human
ccacugcacuccagccugggcaac

SEQ ID NO: 1247695 - RNA, 21 nt, Human
ccacugcugcugcaccccugc

SEQ ID NO: 1247696 - RNA, 23 nt, Human
cccaaagugcugggauuacaggc

SEQ ID NO: 1247697 - RNA, 24 nt, Human
cccaaagugcugggauuacaggca

SEQ ID NO: 1247698 - RNA, 23 nt, Human
cccaccucagccuccugaguagc

SEQ ID NO: 1247699 - RNA, 20 nt, Human
cccagagaacccaauuccuc

SEQ ID NO: 1247700 - RNA, 21 nt, Human
cccuccaccaugcacacacua

SEQ ID NO: 1247701 - RNA, 25 nt, Human
cccuccaccaugcacacacuauuuc

SEQ ID NO: 1247702 - RNA, 19 nt, Human
cccucccucucucucucuc

SEQ ID NO: 1247703 - RNA, 24 nt, Human
cccuggcugcaucucccaagccuc

SEQ ID NO: 1247704 - RNA, 19 nt, Human
cccuggggcaugggaggcc

SEQ ID NO: 1247705 - RNA, 21 nt, Human
ccucucucucucucugagaga

SEQ ID NO: 1247706 - RNA, 24 nt, Human
ccugaguagcugcaacuacaggca

SEQ ID NO: 1247707 - RNA, 23 nt, Human
ccuggccaacacggugaaacccc

SEQ ID NO: 1247708 - RNA, 24 nt, Human
ccuggccaacacggugaaaccccg

SEQ ID NO: 1247709 - RNA, 19 nt, Human
ccugggaggcggagguugc

SEQ ID NO: 1247710 - RNA, 22 nt, Human
ccugggcaacagagugagacuc

SEQ ID NO: 1247711 - RNA, 22 nt, Human
ccugggcucaaaugauccuccu

SEQ ID NO: 1247712 - RNA, 22 nt, Human
ccugggcucaagugaucuuccu

SEQ ID NO: 1247713 - RNA, 23 nt, Human
ccugggcucaagugaucuuccug

SEQ ID NO: 1247714 - RNA, 22 nt, Human
ccuggggcaugggaggcccagc

SEQ ID NO: 1247715 - RNA, 19 nt, Human
ccuguaaucccagcuacuc

SEQ ID NO: 1247716 - RNA, 21 nt, Human
ccuguaaucccagcuacucag

SEQ ID NO: 1247717 - RNA, 19 nt, Human
cgaggcagacagaugaagu

SEQ ID NO: 1247718 - RNA, 24 nt, Human
cgccuguaaucccagcuacucagg

SEQ ID NO: 1247719 - RNA, 25 nt, Human
cggguacaguggcucaugccuggaa

SEQ ID NO: 1247720 - RNA, 24 nt, Human
cgucgccauucaggaugacaaagc

SEQ ID NO: 1247721 - RNA, 24 nt, Human
cguggcgggcgccuguaaucccag

SEQ ID NO: 1247722 - RNA, 21 nt, Human
cuacaggcaucaccacacccu

SEQ ID NO: 1247723 - RNA, 24 nt, Human
cucaaaugauccuccuaccuuggc

SEQ ID NO: 1247724 - RNA, 22 nt, Human
cucaaauugaagcagcuacagc

SEQ ID NO: 1247725 - RNA, 21 nt, Human
cucaagagcagccgcaucacc

SEQ ID NO: 1247726 - RNA, 24 nt, Human
cucaagugauccucccaccucagc

SEQ ID NO: 1247727 - RNA, 25 nt, Human
cucaagugaucuuccugccucggcc

SEQ ID NO: 1247728 - RNA, 24 nt, Human
cucacucugucauccaggcuggag

SEQ ID NO: 1247729 - RNA, 20 nt, Human
cucacuucccauucgucgcc

SEQ ID NO: 1247730 - RNA, 25 nt, Human
cucaugccuggaaucccagcaauuu

SEQ ID NO: 1247731 - RNA, 20 nt, Human
cucccaagccuccagagaac

SEQ ID NO: 1247732 - RNA, 23 nt, Human
cuccugggcucaaaugauccucc

SEQ ID NO: 1247733 - RNA, 23 nt, Human
cuccugggcucaagugaucuucc

SEQ ID NO: 1247734 - RNA, 19 nt, Human
cucugucucaaaaaaaaaa

SEQ ID NO: 1247735 - RNA, 19 nt, Human
cugcacccgccaauuuuua

SEQ ID NO: 1247736 - RNA, 19 nt, Human
cugcuaagcacacucucca

SEQ ID NO: 1247737 - RNA, 21 nt, Human
cugcugcaccccugccgcaaa

SEQ ID NO: 1247738 - RNA, 18 nt, Human
cuggccaacacggugaaa

SEQ ID NO: 1247739 - RNA, 19 nt, Human
cuggucuugaacuccuggg

SEQ ID NO: 1247740 - RNA, 19 nt, Human
cuggucuugaacuccuggg

SEQ ID NO: 1247741 - RNA, 19 nt, Human
cuucaguagacagccucuc

SEQ ID NO: 1247742 - RNA, 20 nt, Human
gagacagggucucacucugu

SEQ ID NO: 1247743 - RNA, 23 nt, Human
gagaccuucccagagagccacaa

SEQ ID NO: 1247744 - RNA, 23 nt, Human
gagaucgcaccacugcacuccag

SEQ ID NO: 1247745 - RNA, 23 nt, Human
gagguugcagucaguugagaucg

SEQ ID NO: 1247746 - RNA, 24 nt, Human
gaucacaaggucaggaguacaaga

SEQ ID NO: 1247747 - RNA, 22 nt, Human
gauuaaagguaugagccacugc

SEQ ID NO: 1247748 - RNA, 23 nt, Human
gauuaaagguaugagccacugca

SEQ ID NO: 1247749 - RNA, 19 nt, Human
gcaaagccagcguaaugac

SEQ ID NO: 1247750 - RNA, 24 nt, Human
gcaacagagugagacucugucuca

SEQ ID NO: 1247751 - RNA, 20 nt, Human
gcaccacugcacuccagccu

SEQ ID NO: 1247752 - RNA, 24 nt, Human
gcacuccagccugggcaacagagu

SEQ ID NO: 1247753 - RNA, 19 nt, Human
gcaugggaggcccagcaag

SEQ ID NO: 1247754 - RNA, 24 nt, Human
gccaacacggugaaaccccgucuc

SEQ ID NO: 1247755 - RNA, 24 nt, Human
gccccaggcuggucuugaacuccu

SEQ ID NO: 1247756 - RNA, 30 nt, Human
gccuggaaucccagcaauuugggaggccaa

SEQ ID NO: 1247757 - RNA, 23 nt, Human
gccuguaaucccagcuacucagg

SEQ ID NO: 1247758 - RNA, 20 nt, Human
gcgggcgccuguaaucccag

SEQ ID NO: 1247759 - RNA, 24 nt, Human
gcuauguugccccaggcuggucuu

SEQ ID NO: 1247760 - RNA, 22 nt, Human
ggagguugcagucaguugagau

SEQ ID NO: 1247761 - RNA, 24 nt, Human
ggagguugcagucaguugagaucg

SEQ ID NO: 1247762 - RNA, 23 nt, Human
ggccggguacaguggcucaugcc

SEQ ID NO: 1247763 - RNA, 18 nt, Human
ggcuggucuugaacuccu

SEQ ID NO: 1247764 - RNA, 25 nt, Human
ggcuguuucauguguuuuauccugu

SEQ ID NO: 1247765 - RNA, 18 nt, Human
gggauccuguuuguggcu

SEQ ID NO: 1247766 - RNA, 28 nt, Human
gggcaugggaggcccagcaagggugugc

SEQ ID NO: 1247767 - RNA, 22 nt, Human
gggcucaaaugauccuccuacc

SEQ ID NO: 1247768 - RNA, 22 nt, Human
gggcucaagugaucuuccugcc

SEQ ID NO: 1247769 - RNA, 20 nt, Human
gguacaguggcucaugccug

SEQ ID NO: 1247770 - RNA, 22 nt, Human
guagagaacagcccagagaacc

SEQ ID NO: 1247771 - RNA, 20 nt, Human
gucaagguccuuccccucca

SEQ ID NO: 1247772 - RNA, 23 nt, Human
gucgccauucaggaugacaaagc

SEQ ID NO: 1247773 - RNA, 20 nt, Human
gucuugaacuccugggcuca

SEQ ID NO: 1247774 - RNA, 23 nt, Human
gugauccucccaccucagccucc

SEQ ID NO: 1247775 - RNA, 21 nt, Human
guuuguggcucccagagucuc

SEQ ID NO: 1247776 - RNA, 21 nt, Human
uaaaaauacaaaaauuagcca

SEQ ID NO: 1247777 - RNA, 25 nt, Human
uaacuuggcugagugcaccagcagg

SEQ ID NO: 1247778 - RNA, 19 nt, Human
uaaguaagcaaacacucuc

SEQ ID NO: 1247779 - RNA, 24 nt, Human
uaauucacggucccgacaucccuc

SEQ ID NO: 1247780 - RNA, 21 nt, Human
uacagcuuagcaaguacuagc

SEQ ID NO: 1247781 - RNA, 25 nt, Human
uacaguggcucaugccuggaauccc

SEQ ID NO: 1247782 - RNA, 18 nt, Human
uagcaaaaauauaaucac

SEQ ID NO: 1247783 - RNA, 21 nt, Human
uagccaggcguggcgggcgcc

SEQ ID NO: 1247784 - RNA, 19 nt, Human
uagccuauguucuucccca

SEQ ID NO: 1247785 - RNA, 24 nt, Human
uagcgcgaucacagcucacuguag

SEQ ID NO: 1247786 - RNA, 21 nt, Human
uagguuaaaagugguaaaaug

SEQ ID NO: 1247787 - RNA, 24 nt, Human
uaucuugcccaagcuggucuugaa

SEQ ID NO: 1247788 - RNA, 25 nt, Human
uauguugccccaggcuggucuugaa

SEQ ID NO: 1247789 - RNA, 21 nt, Human
ucaaaaaaaaaaaaaaaaaaa

SEQ ID NO: 1247790 - RNA, 22 nt, Human
ucaagguccuuccccuccacca

SEQ ID NO: 1247791 - RNA, 24 nt, Human
ucacaaggucaggaguacaagacc

SEQ ID NO: 1247792 - RNA, 24 nt, Human
ucacucugucauccaggcuggagu

SEQ ID NO: 1247793 - RNA, 19 nt, Human
ucacuguagccucaaccuc

SEQ ID NO: 1247794 - RNA, 23 nt, Human
ucacuguagccucaaccucccag

SEQ ID NO: 1247795 - RNA, 18 nt, Human
ucaggacuuucuuugggc

SEQ ID NO: 1247796 - RNA, 24 nt, Human
ucauccaggcuggagugcaguagc

SEQ ID NO: 1247797 - RNA, 23 nt, Human
uccagccugggcaacagagugag

SEQ ID NO: 1247798 - RNA, 24 nt, Human
uccagccugggcaacagagugaga

SEQ ID NO: 1247799 - RNA, 23 nt, Human
ucccaaagugcugggauuaaagg

SEQ ID NO: 1247800 - RNA, 19 nt, Human
ucccaagccuccagagaac

SEQ ID NO: 1247801 - RNA, 23 nt, Human
ucccaggccuagccuauguucuu

SEQ ID NO: 1247802 - RNA, 19 nt, Human
uccccuccaccaugcacac

SEQ ID NO: 1247803 - RNA, 26 nt, Human
uccucccaccucagccuccugaguag

SEQ ID NO: 1247804 - RNA, 24 nt, Human
uccugaguagcugcaacuacaggc

SEQ ID NO: 1247805 - RNA, 22 nt, Human
uccugggcucaaaugauccucc

SEQ ID NO: 1247806 - RNA, 20 nt, Human
uccugggcucaagugaucuu

SEQ ID NO: 1247807 - RNA, 21 nt, Human
uccugggcucaagugaucuuc

SEQ ID NO: 1247808 - RNA, 22 nt, Human
uccugggcucaagugaucuucc

SEQ ID NO: 1247809 - RNA, 24 nt, Human
uccugggcucaagugaucuuccug

SEQ ID NO: 1247810 - RNA, 23 nt, Human
ucgcaccacugcacuccagccug

SEQ ID NO: 1247811 - RNA, 20 nt, Human
ucgguuugagucccagcugg

SEQ ID NO: 1247812 - RNA, 22 nt, Human
ucucaagugauccucccaccuc

SEQ ID NO: 1247813 - RNA, 19 nt, Human
ucucacuaucuugcccaag

SEQ ID NO: 1247814 - RNA, 23 nt, Human
ucucacucugucauccaggcugg

SEQ ID NO: 1247815 - RNA, 24 nt, Human
ucucacucugucauccaggcugga

SEQ ID NO: 1247816 - RNA, 19 nt, Human
ucucccaagccuccagaga

SEQ ID NO: 1247817 - RNA, 20 nt, Human
ucucgcuauguugccccagg

SEQ ID NO: 1247818 - RNA, 24 nt, Human
ucucgcuauguugccccaggcugg

SEQ ID NO: 1247819 - RNA, 25 nt, Human
ucucgcuauguugccccaggcuggu

SEQ ID NO: 1247820 - RNA, 23 nt, Human
ucucuacagcauagaaauugcuu

SEQ ID NO: 1247821 - RNA, 18 nt, Human
ucucugagagaugggguc

SEQ ID NO: 1247822 - RNA, 21 nt, Human
ucugaguuaaggggucaggac

SEQ ID NO: 1247823 - RNA, 18 nt, Human
ucuguagguuaaaagugg

SEQ ID NO: 1247824 - RNA, 24 nt, Human
ucugucauccaggcuggagugcag

SEQ ID NO: 1247825 - RNA, 23 nt, Human
ucugucucaaaaaaaaaaaaaaa

SEQ ID NO: 1247826 - RNA, 22 nt, Human
ucuugaacuccugggcucaagu

SEQ ID NO: 1247827 - RNA, 23 nt, Human
ucuugaacuccugggcucaagug

SEQ ID NO: 1247828 - RNA, 19 nt, Human
ucuuugggcagcccaggcu

SEQ ID NO: 1247829 - RNA, 24 nt, Human
ugaaccugggaggcggagguugca

SEQ ID NO: 1247830 - RNA, 25 nt, Human
ugaacuccugggcucaaaugauccu

SEQ ID NO: 1247831 - RNA, 19 nt, Human
ugacuaccugggcagcuga

SEQ ID NO: 1247832 - RNA, 20 nt, Human
ugagacagggucucacucug

SEQ ID NO: 1247833 - RNA, 22 nt, Human
ugagacagggucucacucuguc

SEQ ID NO: 1247834 - RNA, 18 nt, Human
ugagaccuucccagagag

SEQ ID NO: 1247835 - RNA, 23 nt, Human
ugaggcagauaauugcuugaacc

SEQ ID NO: 1247836 - RNA, 23 nt, Human
ugaggcagauaauugcuugaacc

SEQ ID NO: 1247837 - RNA, 24 nt, Human
ugagugcaccagcaggcaagaggc

SEQ ID NO: 1247838 - RNA, 20 nt, Human
ugcaacuacaggcaucacca

SEQ ID NO: 1247839 - RNA, 24 nt, Human
ugcccaagcuggucuugaacuccu

SEQ ID NO: 1247840 - RNA, 24 nt, Human
ugccuggaaucccagcaauuuggg

SEQ ID NO: 1247841 - RNA, 20 nt, Human
ugcugggauuacaggcauga

SEQ ID NO: 1247842 - RNA, 21 nt, Human
ugcuugaaccugggaggcgga

SEQ ID NO: 1247843 - RNA, 23 nt, Human
uggagggguauaguccagccugg

SEQ ID NO: 1247844 - RNA, 19 nt, Human
uggagugcaguagcgcgau

SEQ ID NO: 1247845 - RNA, 19 nt, Human
uggaugccauucaccauga

SEQ ID NO: 1247846 - RNA, 21 nt, Human
uggcgggcgccuguaauccca

SEQ ID NO: 1247847 - RNA, 22 nt, Human
uggcucaugccuggaaucccag

SEQ ID NO: 1247848 - RNA, 24 nt, Human
uggcucaugccuggaaucccagca

SEQ ID NO: 1247849 - RNA, 20 nt, Human
uggcugagugcaccagcagg

SEQ ID NO: 1247850 - RNA, 21 nt, Human
uggcuguggcaggagguccac

SEQ ID NO: 1247851 - RNA, 22 nt, Human
uggcuguggcaggagguccaca

SEQ ID NO: 1247852 - RNA, 24 nt, Human
ugggaggccaaggcagguggauca

SEQ ID NO: 1247853 - RNA, 19 nt, Human
ugggaggcggagguugcag

SEQ ID NO: 1247854 - RNA, 20 nt, Human
ugggaggcggagguugcagu

SEQ ID NO: 1247855 - RNA, 22 nt, Human
ugggaggcggagguugcaguca

SEQ ID NO: 1247856 - RNA, 26 nt, Human
ugggaggcggagguugcagucaguug

SEQ ID NO: 1247857 - RNA, 22 nt, Human
ugggauuaaagguaugagccac

SEQ ID NO: 1247858 - RNA, 22 nt, Human
ugggauuaaagguaugagccac

SEQ ID NO: 1247859 - RNA, 24 nt, Human
ugggauuaaagguaugagccacug

SEQ ID NO: 1247860 - RNA, 19 nt, Human
ugggauuacaggcaugaac

SEQ ID NO: 1247861 - RNA, 19 nt, Human
ugggauuacaggcaugaac

SEQ ID NO: 1247862 - RNA, 20 nt, Human
ugggauuacaggcaugaacc

SEQ ID NO: 1247863 - RNA, 20 nt, Human
ugggauuacaggcaugaacc

SEQ ID NO: 1247864 - RNA, 20 nt, Human
ugggauuacaggcaugaacc

SEQ ID NO: 1247865 - RNA, 22 nt, Human
ugggauuacaggcaugaaccug

SEQ ID NO: 1247866 - RNA, 23 nt, Human
ugggauuacaggcaugaaccugg

SEQ ID NO: 1247867 - RNA, 21 nt, Human
ugggcaacagagugagacucu

SEQ ID NO: 1247868 - RNA, 24 nt, Human
ugggcucaagugaucuuccugccu

SEQ ID NO: 1247869 - RNA, 24 nt, Human
uggggucucacuaucuugcccaag

SEQ ID NO: 1247870 - RNA, 18 nt, Human
uguagccucaaccuccca

SEQ ID NO: 1247871 - RNA, 19 nt, Human
uguguguguguuugcuuuu

SEQ ID NO: 1247872 - RNA, 22 nt, Human
uguguuugcuuugagacagggu

SEQ ID NO: 1247873 - RNA, 22 nt, Human
uuagccaggcguggcgggcgcc

SEQ ID NO: 1247874 - RNA, 19 nt, Human
uucacggucccgacauccc

SEQ ID NO: 1247875 - RNA, 23 nt, Human
uucuugacuaccugggcagcuga

SEQ ID NO: 1247876 - RNA, 24 nt, Human
uugaaccugggaggcggagguugc

SEQ ID NO: 1247877 - RNA, 24 nt, Human
uugcuugaaccugggaggcggagg

SEQ ID NO: 1247878 - RNA, 19 nt, Human
uuucagagcucacuuccca

SEQ ID NO: 1247879 - RNA, 22 nt, Human
uuucaguuucagagcucacuuc

SEQ ID NO: 1247880 - RNA, 21 nt, Human
uuuguguguguguuugcuuug

SEQ ID NO: 1247881 - RNA, 24 nt, Human
aaacaaguaccaggaagaauuccu

SEQ ID NO: 1247882 - RNA, 22 nt, Human
aaauauacacacaccacaguac

SEQ ID NO: 1247883 - RNA, 21 nt, Human
aagcaccauccggucaaaacc

SEQ ID NO: 1247884 - RNA, 21 nt, Human
aagccucauugagaaaguaac

SEQ ID NO: 1247885 - RNA, 22 nt, Human
acacaccacaguacagguuagc

SEQ ID NO: 1247886 - RNA, 19 nt, Human
acuucaggagaaagagaaa

SEQ ID NO: 1247887 - RNA, 18 nt, Human
agacucccaaaauuagca

SEQ ID NO: 1247888 - RNA, 18 nt, Human
aggagaaagagaaagcua

SEQ ID NO: 1247889 - RNA, 22 nt, Human
aggcccaaaauccggcuugaaa

SEQ ID NO: 1247890 - RNA, 22 nt, Human
auucacuucaggagaaagagaa

SEQ ID NO: 1247891 - RNA, 24 nt, Human
caaaaaaacuaccacaggcuuacc

SEQ ID NO: 1247892 - RNA, 24 nt, Human
caaaaagggauaggcugagucuua

SEQ ID NO: 1247893 - RNA, 27 nt, Human
cacugucagcagaagucagagaaaacc

SEQ ID NO: 1247894 - RNA, 20 nt, Human
cagcagaagucagagaaaac

SEQ ID NO: 1247895 - RNA, 23 nt, Human
ccaggaagaauuccugagagaaa

SEQ ID NO: 1247896 - RNA, 26 nt, Human
cugaaggccuacccaacaguaaccgg

SEQ ID NO: 1247897 - RNA, 25 nt, Human
gaaaacuuaacacugcuuaggaacg

SEQ ID NO: 1247898 - RNA, 20 nt, Human
gaagcaccauccggucaaaa

SEQ ID NO: 1247899 - RNA, 23 nt, Human
gacaaaaguaugcugaaggccua

SEQ ID NO: 1247900 - RNA, 18 nt, Human
gcagaaaauuagaagcac

SEQ ID NO: 1247901 - RNA, 22 nt, Human
gcucugaaaagagccuuugggu

SEQ ID NO: 1247902 - RNA, 21 nt, Human
ggaacggggggcggggagaga

SEQ ID NO: 1247903 - RNA, 25 nt, Human
ggacaaaaguaugcugaaggccuac

SEQ ID NO: 1247904 - RNA, 19 nt, Human
uaagcaaagacucaaguau

SEQ ID NO: 1247905 - RNA, 24 nt, Human
uacaggcaaaacaaguaccaggaa

SEQ ID NO: 1247906 - RNA, 20 nt, Human
uaccaggaagaauuccugag

SEQ ID NO: 1247907 - RNA, 25 nt, Human
uagaagcaccauccggucaaaaccg

SEQ ID NO: 1247908 - RNA, 19 nt, Human
uagcagaaaauuagaagca

SEQ ID NO: 1247909 - RNA, 21 nt, Human
ucaaguauuuuauccugugcu

SEQ ID NO: 1247910 - RNA, 23 nt, Human
ucagagaaaacacuuucucuccc

SEQ ID NO: 1247911 - RNA, 20 nt, Human
ucagaguuuuagccacuguc

SEQ ID NO: 1247912 - RNA, 21 nt, Human
ucuacuacaggcaaaacaagu

SEQ ID NO: 1247913 - RNA, 24 nt, Human
ucucuggcgggcuuucuccagaag

SEQ ID NO: 1247914 - RNA, 19 nt, Human
ugaaaagagccuuugggua

SEQ ID NO: 1247915 - RNA, 22 nt, Human
ugaaaagagccuuuggguaugu

SEQ ID NO: 1247916 - RNA, 21 nt, Human
ugcuuaggaacggggggcggg

SEQ ID NO: 1247917 - RNA, 21 nt, Human
uggacaaaaguaugcugaagg

SEQ ID NO: 1247918 - RNA, 24 nt, Human
uggcgggcuuucuccagaagacuu

SEQ ID NO: 1247919 - RNA, 23 nt, Human
ugggagagcaauacacgaaggaa

SEQ ID NO: 1247920 - RNA, 21 nt, Human
uggguggcucugaaaagagcc

SEQ ID NO: 1247921 - RNA, 19 nt, Human
uguuaagacucccaaaauu

SEQ ID NO: 1247922 - RNA, 21 nt, Human
uucacuuuagccagcaugagc

SEQ ID NO: 1247923 - RNA, 18 nt, Human
uuggguauguaaucagug

SEQ ID NO: 1247924 - RNA, 21 nt, Human
gaaguggcucugaaaagagcc

SEQ ID NO: 1247925 - RNA, 22 nt, Human
ugaaguggcucugaaaagagcc

SEQ ID NO: 1247926 - RNA, 22 nt, Human
augucuacuuucuaucucaaaa

SEQ ID NO: 1247927 - RNA, 22 nt, Human
caaaaugacucgacuaucagau

SEQ ID NO: 1247928 - RNA, 23 nt, Human
cagauaaaacugaacacagcucu

SEQ ID NO: 1247929 - RNA, 18 nt, Human
caucuaccuuacuucugc

SEQ ID NO: 1247930 - RNA, 18 nt, Human
cccgcccaucuaccuuac

SEQ ID NO: 1247931 - RNA, 21 nt, Human
cguaaaaaauucaaucaguaa

SEQ ID NO: 1247932 - RNA, 21 nt, Human
cuaucagauaaaacugaacac

SEQ ID NO: 1247933 - RNA, 23 nt, Human
gaaaagaaccuuuuugguuugga

SEQ ID NO: 1247934 - RNA, 21 nt, Human
uauucugcccucuaacuuuca

SEQ ID NO: 1247935 - RNA, 24 nt, Human
ucaaaacaaugugguguaaaagcc

SEQ ID NO: 1247936 - RNA, 24 nt, Human
ucacccgcccaucuaccuuacuuc

SEQ ID NO: 1247937 - RNA, 23 nt, Human
ucacugcuuguuaucucgcuucu

SEQ ID NO: 1247938 - RNA, 26 nt, Human
ucagauaaaacugaacaacgggggcg

SEQ ID NO: 1247939 - RNA, 18 nt, Human
ucucuugccucacuuuuc

SEQ ID NO: 1247940 - RNA, 20 nt, Human
ucugaaaagaaccuuuuugg

SEQ ID NO: 1247941 - RNA, 18 nt, Human
ugcccucuaacuuucagc

SEQ ID NO: 1247942 - RNA, 18 nt, Human
uguuucagcuguauugca

SEQ ID NO: 1247943 - RNA, 24 nt, Human
uuauucugcccucuaacuuucagc

SEQ ID NO: 1247944 - RNA, 19 nt, Human
uucuuguucacccgcccau

SEQ ID NO: 1247945 - RNA, 23 nt, Human
aaaacaccaaggaguuuuccagg

SEQ ID NO: 1247946 - RNA, 18 nt, Human
aacacagugaaaccccau

SEQ ID NO: 1247947 - RNA, 19 nt, Human
aacacagugaaaccccauc

SEQ ID NO: 1247948 - RNA, 23 nt, Human
aacacagugaaaccccaucggua

SEQ ID NO: 1247949 - RNA, 18 nt, Human
aacccauuuuauguuagc

SEQ ID NO: 1247950 - RNA, 23 nt, Human
aaggcgggcggaucacgagguca

SEQ ID NO: 1247951 - RNA, 28 nt, Human
aauaaacaacagaaggauauaucauaac

SEQ ID NO: 1247952 - RNA, 28 nt, Human
aauaaacaacagaaggauauaucauaac

SEQ ID NO: 1247953 - RNA, 18 nt, Human
aauaagugaaugcccccc

SEQ ID NO: 1247954 - RNA, 24 nt, Human
aaugauagaaccaaacauuaaaaa

SEQ ID NO: 1247955 - RNA, 24 nt, Human
acgcggcaagacuccgucucgaaa

SEQ ID NO: 1247956 - RNA, 18 nt, Human
acuccagccugggagacg

SEQ ID NO: 1247957 - RNA, 18 nt, Human
acugcacuccagccuggg

SEQ ID NO: 1247958 - RNA, 18 nt, Human
acugcacuccagccuggg

SEQ ID NO: 1247959 - RNA, 18 nt, Human
agaacaggugacugucug

SEQ ID NO: 1247960 - RNA, 19 nt, Human
agaaccaaacauuaaaaag

SEQ ID NO: 1247961 - RNA, 20 nt, Human
agacaggaagggggauguag

SEQ ID NO: 1247962 - RNA, 19 nt, Human
agcuacucaggaggcuggg

SEQ ID NO: 1247963 - RNA, 19 nt, Human
aggaagacgguagcucugu

SEQ ID NO: 1247964 - RNA, 21 nt, Human
aggagaauggccuaaaccccg

SEQ ID NO: 1247965 - RNA, 21 nt, Human
aggccaaggcgggcggaucac

SEQ ID NO: 1247966 - RNA, 23 nt, Human
aggccaaggcgggcggaucacga

SEQ ID NO: 1247967 - RNA, 21 nt, Human
aggcggagcuugcagugagcc

SEQ ID NO: 1247968 - RNA, 24 nt, Human
aggcggagcuugcagugagccgag

SEQ ID NO: 1247969 - RNA, 18 nt, Human
aggcgggcggaucacgag

SEQ ID NO: 1247970 - RNA, 24 nt, Human
aggcgggcggaucacgaggucagg

SEQ ID NO: 1247971 - RNA, 19 nt, Human
aggcuggggcaggagaaug

SEQ ID NO: 1247972 - RNA, 20 nt, Human
aucacgaggucaggagaucc

SEQ ID NO: 1247973 - RNA, 24 nt, Human
aucgcgccacugcacuccagccug

SEQ ID NO: 1247974 - RNA, 22 nt, Human
augaaggagaaagauuucuuug

SEQ ID NO: 1247975 - RNA, 23 nt, Human
augaaugggcccuccaaagaaca

SEQ ID NO: 1247976 - RNA, 21 nt, Human
caaaacaaaguaaauggaucu

SEQ ID NO: 1247977 - RNA, 22 nt, Human
caaaacaaaguaaauggaucug

SEQ ID NO: 1247978 - RNA, 21 nt, Human
caacuuccagucuccucuccu

SEQ ID NO: 1247979 - RNA, 19 nt, Human
caaucccuagacaucaaca

SEQ ID NO: 1247980 - RNA, 26 nt, Human
caauccuagacaucaacagcaaaaca

SEQ ID NO: 1247981 - RNA, 20 nt, Human
cacaaaugaacauuacuagu

SEQ ID NO: 1247982 - RNA, 24 nt, Human
cacgccuguaaucccagcacuuug

SEQ ID NO: 1247983 - RNA, 18 nt, Human
cacugcacuccagccugg

SEQ ID NO: 1247984 - RNA, 19 nt, Human
cacugcacuccagccuggg

SEQ ID NO: 1247985 - RNA, 22 nt, Human
cacugcacuccagccugggaga

SEQ ID NO: 1247986 - RNA, 27 nt, Human
cacugcacuccagccugggagacgcgg

SEQ ID NO: 1247987 - RNA, 24 nt, Human
cagcacuuugggaggccaaggcgg

SEQ ID NO: 1247988 - RNA, 23 nt, Human
cagcaguucuugaaccuucuggu

SEQ ID NO: 1247989 - RNA, 24 nt, Human
cagcuacucaggaggcuggggcag

SEQ ID NO: 1247990 - RNA, 22 nt, Human
caugguggcgggcgccuguagu

SEQ ID NO: 1247991 - RNA, 19 nt, Human
ccacugcacuccagccugg

SEQ ID NO: 1247992 - RNA, 20 nt, Human
ccacugcacuccagccuggg

SEQ ID NO: 1247993 - RNA, 21 nt, Human
ccacugcacuccagccuggga

SEQ ID NO: 1247994 - RNA, 22 nt, Human
ccacugcacuccagccugggag

SEQ ID NO: 1247995 - RNA, 24 nt, Human
ccacugcacuccagccugggagac

SEQ ID NO: 1247996 - RNA, 21 nt, Human
ccagcaaugacagucauuaaa

SEQ ID NO: 1247997 - RNA, 24 nt, Human
ccuagcuaacacagugaaacccca

SEQ ID NO: 1247998 - RNA, 19 nt, Human
ccuguagucccagcuacuc

SEQ ID NO: 1247999 - RNA, 21 nt, Human
ccuguagucccagcuacucag

SEQ ID NO: 1248000 - RNA, 24 nt, Human
cgagaccauccuagcuaacacagu

SEQ ID NO: 1248001 - RNA, 23 nt, Human
cgccuguaaucccagcacuuugg

SEQ ID NO: 1248002 - RNA, 24 nt, Human
cgccuguaaucccagcacuuuggg

SEQ ID NO: 1248003 - RNA, 24 nt, Human
cgccuguagucccagcuacucagg

SEQ ID NO: 1248004 - RNA, 20 nt, Human
cgggcggaucacgaggucau

SEQ ID NO: 1248005 - RNA, 24 nt, Human
cgguagaaacaaauauuaaaaagu

SEQ ID NO: 1248006 - RNA, 23 nt, Human
cuagcuaacacagugaaacccca

SEQ ID NO: 1248007 - RNA, 22 nt, Human
cucacgccuguaaucccagcac

SEQ ID NO: 1248008 - RNA, 24 nt, Human
cucacgccuguaaucccagcacuu

SEQ ID NO: 1248009 - RNA, 25 nt, Human
cuccaaagaacaggugacugucugu

SEQ ID NO: 1248010 - RNA, 23 nt, Human
cugaaaacacaaaaaaauuagcc

SEQ ID NO: 1248011 - RNA, 21 nt, Human
cuucuggucucaugacccacu

SEQ ID NO: 1248012 - RNA, 19 nt, Human
cuugcagugagccgagauc

SEQ ID NO: 1248013 - RNA, 21 nt, Human
cuugcagugagccgagaucgc

SEQ ID NO: 1248014 - RNA, 23 nt, Human
gaaaaaaacaggaagacgguagc

SEQ ID NO: 1248015 - RNA, 21 nt, Human
gacagucauuaaaauaaaaua

SEQ ID NO: 1248016 - RNA, 21 nt, Human
gacgcggcaagacuccgucuc

SEQ ID NO: 1248017 - RNA, 23 nt, Human
gagaucgcgccacugcacuccag

SEQ ID NO: 1248018 - RNA, 23 nt, Human
gagcuugcagugagccgagaucg

SEQ ID NO: 1248019 - RNA, 18 nt, Human
gaggcuggggcaggagaa

SEQ ID NO: 1248020 - RNA, 21 nt, Human
gcagaugauaauuugaggaug

SEQ ID NO: 1248021 - RNA, 20 nt, Human
gccgagaucgcgccacugca

SEQ ID NO: 1248022 - RNA, 23 nt, Human
gccuguagucccagcuacucagg

SEQ ID NO: 1248023 - RNA, 20 nt, Human
ggaaaauuggaggaaaaaaa

SEQ ID NO: 1248024 - RNA, 24 nt, Human
ggagcuugcagugagccgagaucg

SEQ ID NO: 1248025 - RNA, 21 nt, Human
ggcggaucacgaggucaggag

SEQ ID NO: 1248026 - RNA, 23 nt, Human
ggcgugguggcucacgccuguaa

SEQ ID NO: 1248027 - RNA, 24 nt, Human
gggcaugguggcgggcgccuguag

SEQ ID NO: 1248028 - RNA, 24 nt, Human
gguggcgggcgccuguagucccag

SEQ ID NO: 1248029 - RNA, 24 nt, Human
gguggcucacgccuguaaucccag

SEQ ID NO: 1248030 - RNA, 21 nt, Human
guggccgggcgugguggcuca

SEQ ID NO: 1248031 - RNA, 20 nt, Human
uaaaaagagugacacuguuu

SEQ ID NO: 1248032 - RNA, 26 nt, Human
uaaaccccggaggcggagcuugcagg

SEQ ID NO: 1248033 - RNA, 22 nt, Human
uaacaguaauaaacccauuuua

SEQ ID NO: 1248034 - RNA, 20 nt, Human
uaagagaggcuauuaggaug

SEQ ID NO: 1248035 - RNA, 21 nt, Human
uaaggcagcaguucuugaacc

SEQ ID NO: 1248036 - RNA, 23 nt, Human
uaagugaaugccccccaagccca

SEQ ID NO: 1248037 - RNA, 22 nt, Human
uagcaugaaggagaaagauuuc

SEQ ID NO: 1248038 - RNA, 20 nt, Human
uaggggagaggaaauuauuu

SEQ ID NO: 1248039 - RNA, 18 nt, Human
ucacgaggucaggagauc

SEQ ID NO: 1248040 - RNA, 24 nt, Human
ucacgaggucaggagaucgagacc

SEQ ID NO: 1248041 - RNA, 23 nt, Human
ucgcgccacugcacuccagccug

SEQ ID NO: 1248042 - RNA, 25 nt, Human
ugaaaaauaagugaaugccccccaa

SEQ ID NO: 1248043 - RNA, 25 nt, Human
ugaaaaauagucauuugaacacaaa

SEQ ID NO: 1248044 - RNA, 19 nt, Human
ugaaaccccaucgguacug

SEQ ID NO: 1248045 - RNA, 22 nt, Human
ugagccgagaucgcgccacugc

SEQ ID NO: 1248046 - RNA, 22 nt, Human
ugcagaugauaauuugaggaug

SEQ ID NO: 1248047 - RNA, 22 nt, Human
uggcucacgccuguaaucccag

SEQ ID NO: 1248048 - RNA, 24 nt, Human
uggcucacgccuguaaucccagca

SEQ ID NO: 1248049 - RNA, 19 nt, Human
ugggaaagaugaaugggcc

SEQ ID NO: 1248050 - RNA, 24 nt, Human
ugggaggccaaggcgggcggauca

SEQ ID NO: 1248051 - RNA, 18 nt, Human
uggggcaggagaauggcc

SEQ ID NO: 1248052 - RNA, 24 nt, Human
uggggcaggagaauggccuaaacc

SEQ ID NO: 1248053 - RNA, 24 nt, Human
ugguggcgggcgccuguaguccca

SEQ ID NO: 1248054 - RNA, 24 nt, Human
ugguggcucacgccuguaauccca

SEQ ID NO: 1248055 - RNA, 20 nt, Human
uguagguuauaacuauugac

SEQ ID NO: 1248056 - RNA, 24 nt, Human
uguggccgggcgugguggcucacg

SEQ ID NO: 1248057 - RNA, 18 nt, Human
uuagccgggcaugguggc

SEQ ID NO: 1248058 - RNA, 18 nt, Human
uugcagugagccgagauc

SEQ ID NO: 1248059 - RNA, 22 nt, Human
uugcagugagccgagaucgcgc

SEQ ID NO: 1248060 - RNA, 21 nt, Human
uuugaaccuugaucuauagca

SEQ ID NO: 1248061 - RNA, 19 nt, Human
uuugugcauggagguauca

SEQ ID NO: 1248062 - RNA, 18 nt, Human
gcccugagaagggccuuu

SEQ ID NO: 1248063 - RNA, 18 nt, Human
ugagaagggccuuugagg

SEQ ID NO: 1248064 - RNA, 20 nt, Human
aaaagcaucuccauuuauac

SEQ ID NO: 1248065 - RNA, 30 nt, Human; identical to SEQ ID NO: 1146352

SEQ ID NO: 1248066 - RNA, 20 nt, Human
aaacaaaaaaggggugcacg

SEQ ID NO: 1248067 - RNA, 22 nt, Human
aaacaaaaaugaaaagcaucuc

SEQ ID NO: 1248068 - RNA, 21 nt, Human
aaacacacaaaaaagcaaacu

SEQ ID NO: 1248069 - RNA, 23 nt, Human
aacaaaaaugaaaagcaucucca

SEQ ID NO: 1248070 - RNA, 22 nt, Human
aacaagaaucacaggaacucac

SEQ ID NO: 1248071 - RNA, 24 nt, Human
aagcaaacuguaaugagcagugac

SEQ ID NO: 1248072 - RNA, 23 nt, Human
aagccaauauggaaauuaaaaua

SEQ ID NO: 1248073 - RNA, 19 nt, Human
aagcgaacaagaaucacag

SEQ ID NO: 1248074 - RNA, 21 nt, Human
aagcgaacaagaaucacagga

SEQ ID NO: 1248075 - RNA, 28 nt, Human
aauccucucccccaaaacaaaaagcaaa

SEQ ID NO: 1248076 - RNA, 21 nt, Human
acaaacccaguccaaacaaaa

SEQ ID NO: 1248077 - RNA, 23 nt, Human
acacaccuaccuacagacauaca

SEQ ID NO: 1248078 - RNA, 20 nt, Human
accccaaagaaaaacaaaaa

SEQ ID NO: 1248079 - RNA, 22 nt, Human
accccaaagaaaaacaaaaagg

SEQ ID NO: 1248080 - RNA, 19 nt, Human
acccuaagugcuaagaaag

SEQ ID NO: 1248081 - RNA, 22 nt, Human
acgaaacucccagcuuccuaaa

SEQ ID NO: 1248082 - RNA, 22 nt, Human
acuaugugccaagcacugugcu

SEQ ID NO: 1248083 - RNA, 19 nt, Human
acucacccucagcuucacg

SEQ ID NO: 1248084 - RNA, 24 nt, Human
agaauccugcauuacuuaaccccc

SEQ ID NO: 1248085 - RNA, 20 nt, Human
agcaaacacacaaaaaagca

SEQ ID NO: 1248086 - RNA, 23 nt, Human
aggaaacaaauaucacuaaagaa

SEQ ID NO: 1248087 - RNA, 22 nt, Human
agggagcgucugguguccagcu

SEQ ID NO: 1248088 - RNA, 22 nt, Human
agucccaagguagacccaaagg

SEQ ID NO: 1248089 - RNA, 21 nt, Human
auaaaacuuugaauccaucag

SEQ ID NO: 1248090 - RNA, 23 nt, Human
aucaagaauuuuuggccagaggu

SEQ ID NO: 1248091 - RNA, 21 nt, Human
auccucucccccaaaacaaaa

SEQ ID NO: 1248092 - RNA, 24 nt, Human
augaaaagcaucuccauuuauaca

SEQ ID NO: 1248093 - RNA, 21 nt, Human
augauucugccucagccacac

SEQ ID NO: 1248094 - RNA, 22 nt, Human
caaaaaccccaaagaaaaacaa

SEQ ID NO: 1248095 - RNA, 22 nt, Human
caaaaaggcacaucaaggaaac

SEQ ID NO: 1248096 - RNA, 20 nt, Human
caaacacacaaaaaagcaaa

SEQ ID NO: 1248097 - RNA, 18 nt, Human
caaacccaguccaaacaa

SEQ ID NO: 1248098 - RNA, 27 nt, Human
caaccagcagucccaagguagacccaa

SEQ ID NO: 1248099 - RNA, 21 nt, Human
caagacucuacagcuaauuug

SEQ ID NO: 1248100 - RNA, 23 nt, Human
caagcuagguaaaccaccuugga

SEQ ID NO: 1248101 - RNA, 21 nt, Human
caaggcuucacacccuccucu

SEQ ID NO: 1248102 - RNA, 23 nt, Human
caauauggaaauuaaaauacuuu

SEQ ID NO: 1248103 - RNA, 19 nt, Human
cacaaaaucugggcuacag

SEQ ID NO: 1248104 - RNA, 22 nt, Human
cacaaacccaguccaaacaaaa

SEQ ID NO: 1248105 - RNA, 18 nt, Human
cacacccuccucuguggg

SEQ ID NO: 1248106 - RNA, 21 nt, Human
cacagcaaacacacaaaaaag

SEQ ID NO: 1248107 - RNA, 23 nt, Human
cacagcaaacacacaaaaaagca

SEQ ID NO: 1248108 - RNA, 26 nt, Human
cacaugcauacacgcuauggccuggc

SEQ ID NO: 1248109 - RNA, 21 nt, Human
cacugaauccucacaaaaccc

SEQ ID NO: 1248110 - RNA, 19 nt, Human
cacugggcuccacucccaa

SEQ ID NO: 1248111 - RNA, 24 nt, Human
cagcagucccaagguagacccaaa

SEQ ID NO: 1248112 - RNA, 22 nt, Human
cagcauccggauuccaaaaacc

SEQ ID NO: 1248113 - RNA, 24 nt, Human
cagcauccggauuccaaaaacccc

SEQ ID NO: 1248114 - RNA, 18 nt, Human
cagccacaccucagcaag

SEQ ID NO: 1248115 - RNA, 21 nt, Human
cagccucuaggagcuguucug

SEQ ID NO: 1248116 - RNA, 21 nt, Human
cagcuggcagggugggguugg

SEQ ID NO: 1248117 - RNA, 22 nt, Human
cagcuucacgaaacucccagcu

SEQ ID NO: 1248118 - RNA, 19 nt, Human
cagggcaggagauaaggag

SEQ ID NO: 1248119 - RNA, 22 nt, Human
caguauguggcuagccaaaggu

SEQ ID NO: 1248120 - RNA, 24 nt, Human
ccaaaaaccccaaagaaaaacaaa

SEQ ID NO: 1248121 - RNA, 18 nt, Human
ccaaaacaaaaagcaaac

SEQ ID NO: 1248122 - RNA, 21 nt, Human
ccaaagaaaaacaaaaaggca

SEQ ID NO: 1248123 - RNA, 23 nt, Human
ccaaagaaaaacaaaaaggcaca

SEQ ID NO: 1248124 - RNA, 20 nt, Human
ccacaaaaucugggcuacag

SEQ ID NO: 1248125 - RNA, 25 nt, Human
ccacaccucagcaaguggugggaac

SEQ ID NO: 1248126 - RNA, 20 nt, Human
ccaccuuggagaaauggggu

SEQ ID NO: 1248127 - RNA, 21 nt, Human
ccagccguggggucagggugg

SEQ ID NO: 1248128 - RNA, 24 nt, Human
ccccaaagaaaaacaaaaaggcac

SEQ ID NO: 1248129 - RNA, 19 nt, Human
ccccauugcccccagcugg

SEQ ID NO: 1248130 - RNA, 21 nt, Human
ccccauugcccccagcuggca

SEQ ID NO: 1248131 - RNA, 20 nt, Human
cccccaaaacaaaaagcaaa

SEQ ID NO: 1248132 - RNA, 22 nt, Human
cccccaaaacaaaaagcaaacc

SEQ ID NO: 1248133 - RNA, 19 nt, Human
cccuaagugcuaagaaagc

SEQ ID NO: 1248134 - RNA, 24 nt, Human
cccuaagugcuaagaaagcuaggg

SEQ ID NO: 1248135 - RNA, 24 nt, Human
ccuacagacauacaguuucagucc

SEQ ID NO: 1248136 - RNA, 24 nt, Human
ccucacaaaacccuaagugcuaag

SEQ ID NO: 1248137 - RNA, 20 nt, Human
ccuuggagaaaugggguggc

SEQ ID NO: 1248138 - RNA, 23 nt, Human
ccuuguuuccuugggggcugaag

SEQ ID NO: 1248139 - RNA, 23 nt, Human
cggauuccaaaaaccccaaagaa

SEQ ID NO: 1248140 - RNA, 23 nt, Human
cggcgacaccuuguuugcagaau

SEQ ID NO: 1248141 - RNA, 19 nt, Human
cuaaaaggcacacaccuac

SEQ ID NO: 1248142 - RNA, 22 nt, Human
cuaaauccucucccccaaaaca

SEQ ID NO: 1248143 - RNA, 21 nt, Human
cuacaacaguggaaaacaaag

SEQ ID NO: 1248144 - RNA, 23 nt, Human
cuccagccguggggucagggugg

SEQ ID NO: 1248145 - RNA, 18 nt, Human
cugccagagaacccauuu

SEQ ID NO: 1248146 - RNA, 18 nt, Human
gagaggccaaaaucccug

SEQ ID NO: 1248147 - RNA, 25 nt, Human
gcacagcaaacacacaaaaaagcaa

SEQ ID NO: 1248148 - RNA, 23 nt, Human
gccacaccucagcaagugcgugg

SEQ ID NO: 1248149 - RNA, 23 nt, Human
gcccccagcuggcaggguggggu

SEQ ID NO: 1248150 - RNA, 24 nt, Human
gcggaacagaauccaaaggaauuu

SEQ ID NO: 1248151 - RNA, 21 nt, Human
gcugcacugggcuccacuccc

SEQ ID NO: 1248152 - RNA, 20 nt, Human
ggagcuguucugagaggcca

SEQ ID NO: 1248153 - RNA, 22 nt, Human
ggccgagaacugggcuacucua

SEQ ID NO: 1248154 - RNA, 20 nt, Human
ggcuaaauccucucccccaa

SEQ ID NO: 1248155 - RNA, 19 nt, Human
gggaauguguaaguucaau

SEQ ID NO: 1248156 - RNA, 23 nt, Human
ggguggcagggaacacaggcugg

SEQ ID NO: 1248157 - RNA, 21 nt, Human
gugccaagacagggcaggaga

SEQ ID NO: 1248158 - RNA, 23 nt, Human
uaaaaggcacacaccuaccuaca

SEQ ID NO: 1248159 - RNA, 18 nt, Human
uaaaguauuucuucucca

SEQ ID NO: 1248160 - RNA, 27 nt, Human
uaaauccucucccccaaaacaaaaagc

SEQ ID NO: 1248161 - RNA, 24 nt, Human
uaacccccgaagugaaucacacaa

SEQ ID NO: 1248162 - RNA, 18 nt, Human
uacagagaugcuuugcag

SEQ ID NO: 1248163 - RNA, 19 nt, Human
uacaguuucaguccaacac

SEQ ID NO: 1248164 - RNA, 19 nt, Human
uacauuuggacggcgacac

SEQ ID NO: 1248165 - RNA, 24 nt, Human
uacuaugugccaagcacugugcua

SEQ ID NO: 1248166 - RNA, 22 nt, Human
uagacccaaagguauggcagaa

SEQ ID NO: 1248167 - RNA, 22 nt, Human
uagguaaaccaccuuggagaaa

SEQ ID NO: 1248168 - RNA, 22 nt, Human
uauaaaaacuuggucucccacu

SEQ ID NO: 1248169 - RNA, 23 nt, Human
uauggaaauuaaaauacuuuuaa

SEQ ID NO: 1248170 - RNA, 19 nt, Human
uauugcccuucaacagcau

SEQ ID NO: 1248171 - RNA, 22 nt, Human
ucacaggaacucacccucagcu

SEQ ID NO: 1248172 - RNA, 23 nt, Human
ucacuaaagaaacugacuaauau

SEQ ID NO: 1248173 - RNA, 24 nt, Human
ucagcucuauuucucaaguuuuac

SEQ ID NO: 1248174 - RNA, 22 nt, Human
ucagggaaguaagaggcuaaau

SEQ ID NO: 1248175 - RNA, 22 nt, Human
ucauacugaugucaacccuguc

SEQ ID NO: 1248176 - RNA, 23 nt, Human
uccaaaaaccccaaagaaaaaca

SEQ ID NO: 1248177 - RNA, 25 nt, Human
uccaaaaaccccaaagaaaaacaaa

SEQ ID NO: 1248178 - RNA, 26 nt, Human
uccaaaaaccccaaagaaaaacaaaa

SEQ ID NO: 1248179 - RNA, 25 nt, Human
uccaaaggaauuugacgaagucacc

SEQ ID NO: 1248180 - RNA, 20 nt, Human
uccacaaaaucugggcuaca

SEQ ID NO: 1248181 - RNA, 24 nt, Human
uccacaaaaucugggcuacagaga

SEQ ID NO: 1248182 - RNA, 18 nt, Human
uccacaccugcaaucuau

SEQ ID NO: 1248183 - RNA, 19 nt, Human
uccacagggauggauggga

SEQ ID NO: 1248184 - RNA, 25 nt, Human
ucccccaaaacaaaaagcaaaccga

SEQ ID NO: 1248185 - RNA, 20 nt, Human
ucccugaggacaggaggggc

SEQ ID NO: 1248186 - RNA, 22 nt, Human
uccuuggaugcacccauucaca

SEQ ID NO: 1248187 - RNA, 23 nt, Human
ucucaaggcuucacacccuccuc

SEQ ID NO: 1248188 - RNA, 19 nt, Human
ucuccaaacgcacagcaaa

SEQ ID NO: 1248189 - RNA, 19 nt, Human
ucuccaagcagggcccuga

SEQ ID NO: 1248190 - RNA, 18 nt, Human
ucugaaagacgucagugg

SEQ ID NO: 1248191 - RNA, 22 nt, Human
ucugcuauugcccuucaacagc

SEQ ID NO: 1248192 - RNA, 25 nt, Human
ugaagcgaacaagaaucacaggaac

SEQ ID NO: 1248193 - RNA, 23 nt, Human
ugaaucacacaaaauggcuguaa

SEQ ID NO: 1248194 - RNA, 18 nt, Human
ugaauccucacaaaaccc

SEQ ID NO: 1248195 - RNA, 19 nt, Human
ugacacguuggcaaccagc

SEQ ID NO: 1248196 - RNA, 22 nt, Human
ugacuaauaucuccaaacgcac

SEQ ID NO: 1248197 - RNA, 19 nt, Human
ugaggacaggaggggccac

SEQ ID NO: 1248198 - RNA, 25 nt, Human
ugagggagugucuuaaggcuccaca

SEQ ID NO: 1248199 - RNA, 21 nt, Human
ugaugucaacccugucaguga

SEQ ID NO: 1248200 - RNA, 19 nt, Human
ugcacguucuuucccuuuc

SEQ ID NO: 1248201 - RNA, 20 nt, Human
ugcagccuuguuuccuuggg

SEQ ID NO: 1248202 - RNA, 19 nt, Human
ugcccccagcuggcagggu

SEQ ID NO: 1248203 - RNA, 19 nt, Human
ugccucagccacaccucag

SEQ ID NO: 1248204 - RNA, 21 nt, Human
ugcuaaaguauuucuucucca

SEQ ID NO: 1248205 - RNA, 20 nt, Human
ugcuauugcccuucaacagc

SEQ ID NO: 1248206 - RNA, 20 nt, Human
uggaaaacaaagcagugcuc

SEQ ID NO: 1248207 - RNA, 19 nt, Human
uggaaacaugcagaacuaa

SEQ ID NO: 1248208 - RNA, 27 nt, Human
uggcagggugggguugguuuucucccc

SEQ ID NO: 1248209 - RNA, 19 nt, Human
uggcauugagggagugucu

SEQ ID NO: 1248210 - RNA, 27 nt, Human
uggccagaggugaggguggucgacacg

SEQ ID NO: 1248211 - RNA, 24 nt, Human
ugggguaagguccaguauguggcu

SEQ ID NO: 1248212 - RNA, 24 nt, Human
ugggguugguuuucuccaggaggc

SEQ ID NO: 1248213 - RNA, 24 nt, Human
uguaaugagcagugacacaaaccc

SEQ ID NO: 1248214 - RNA, 22 nt, Human
uguccauccgucuacucacaug

SEQ ID NO: 1248215 - RNA, 23 nt, Human
uucaacagcauccggauuccaaa

SEQ ID NO: 1248216 - RNA, 20 nt, Human
uucacuuuuauuaaaucuug

SEQ ID NO: 1248217 - RNA, 23 nt, Human
uuccaaaaaccccaaagaaaaac

SEQ ID NO: 1248218 - RNA, 20 nt, Human
uuccuugaggaaaacccuug

SEQ ID NO: 1248219 - RNA, 22 nt, Human
uuccuugggggcugaagucugg

SEQ ID NO: 1248220 - RNA, 21 nt, Human
uuggagaaaugggguggccac

SEQ ID NO: 1248221 - RNA, 21 nt, Human
uuuggccagaggugagggugg

SEQ ID NO: 1248222 - RNA, 20 nt, Human
aaaaacaaaacaaaagccug

SEQ ID NO: 1248223 - RNA, 18 nt, Human
aaaaauagcagcaggaac

SEQ ID NO: 1248224 - RNA, 21 nt, Human
aaacaaaagccugaagcuagu

SEQ ID NO: 1248225 - RNA, 23 nt, Human
aaacaaaagccugaagcuagugc

SEQ ID NO: 1248226 - RNA, 26 nt, Human
aaacaugaaggagacacagucccugg

SEQ ID NO: 1248227 - RNA, 24 nt, Human
aaaccagaaauuggcaaaaaaaaa

SEQ ID NO: 1248228 - RNA, 22 nt, Human
aaaccugcuggcuggccuuuga

SEQ ID NO: 1248229 - RNA, 24 nt, Human
aaagugccgggauuacagguguga

SEQ ID NO: 1248230 - RNA, 18 nt, Human
aaagugugggauuacagg

SEQ ID NO: 1248231 - RNA, 18 nt, Human
aaaugcccaaauaggaug

SEQ ID NO: 1248232 - RNA, 22 nt, Human
aacaaaaagucuaauaaccaac

SEQ ID NO: 1248233 - RNA, 18 nt, Human
aacaaggcaggcaaaccc

SEQ ID NO: 1248234 - RNA, 19 nt, Human
aacagaagggccagucaga

SEQ ID NO: 1248235 - RNA, 19 nt, Human
aacagucugaagccuuagu

SEQ ID NO: 1248236 - RNA, 19 nt, Human
aacauggcgcuuugcagau

SEQ ID NO: 1248237 - RNA, 22 nt, Human
aacccacuguugcccuccacuc

SEQ ID NO: 1248238 - RNA, 19 nt, Human
aaccccucaccccacccac

SEQ ID NO: 1248239 - RNA, 22 nt, Human
aacuccuagccucaggggauuc

SEQ ID NO: 1248240 - RNA, 20 nt, Human
aacucuuucacagaguuacu

SEQ ID NO: 1248241 - RNA, 23 nt, Human
aacuggauaacuucugcagccuu

SEQ ID NO: 1248242 - RNA, 22 nt, Human
aagaacacagguucaaauauaa

SEQ ID NO: 1248243 - RNA, 18 nt, Human
aagaaggagcaaagcaaa

SEQ ID NO: 1248244 - RNA, 21 nt, Human
aagaaugaaagcacacaguga

SEQ ID NO: 1248245 - RNA, 19 nt, Human
aagacucuuuagaaacuug

SEQ ID NO: 1248246 - RNA, 18 nt, Human
aaggcaucacugaaaugg

SEQ ID NO: 1248247 - RNA, 21 nt, Human
aaggggccagagaaggggagg

SEQ ID NO: 1248248 - RNA, 24 nt, Human
aaguagaaaaggaaacuauucuaa

SEQ ID NO: 1248249 - RNA, 26 nt, Human
aagugccgggauuacaggugugagcc

SEQ ID NO: 1248250 - RNA, 21 nt, Human
aauccugcagcugaacacugg

SEQ ID NO: 1248251 - RNA, 19 nt, Human
aauguuccaagguugacca

SEQ ID NO: 1248252 - RNA, 24 nt, Human
aauugcuugaacccgggaggcaga

SEQ ID NO: 1248253 - RNA, 24 nt, Human
acaagccugcuuagaacacagaac

SEQ ID NO: 1248254 - RNA, 24 nt, Human
acacagccaacccugaagaagagg

SEQ ID NO: 1248255 - RNA, 24 nt, Human
acagagcgagacucugugucaaaa

SEQ ID NO: 1248256 - RNA, 18 nt, Human
acagguguaagccaccau

SEQ ID NO: 1248257 - RNA, 20 nt, Human
accccacccacugcagccaa

SEQ ID NO: 1248258 - RNA, 23 nt, Human
accucaaccucccaaagugccgg

SEQ ID NO: 1248259 - RNA, 18 nt, Human
acgagguuuugccauguu

SEQ ID NO: 1248260 - RNA, 20 nt, Human
acgagguuuugccauguugg

SEQ ID NO: 1248261 - RNA, 24 nt, Human
acgagguuuugccauguuggccag

SEQ ID NO: 1248262 - RNA, 24 nt, Human
acggagucucgcugugucacccag

SEQ ID NO: 1248263 - RNA, 18 nt, Human
acgggguuucgccauguu

SEQ ID NO: 1248264 - RNA, 20 nt, Human
acgggguuucgccauguuug

SEQ ID NO: 1248265 - RNA, 24 nt, Human
acgggguuucgccauguuugccag

SEQ ID NO: 1248266 - RNA, 18 nt, Human
acugagacccugagacag

SEQ ID NO: 1248267 - RNA, 18 nt, Human
acugcucuccagccuggg

SEQ ID NO: 1248268 - RNA, 24 nt, Human
acugcucuccagccugggcgacag

SEQ ID NO: 1248269 - RNA, 18 nt, Human
acuuggugcuagcuucuc

SEQ ID NO: 1248270 - RNA, 21 nt, Human
agaaaagcauaagggcucaga

SEQ ID NO: 1248271 - RNA, 19 nt, Human
agaaaccccucaccccacc

SEQ ID NO: 1248272 - RNA, 20 nt, Human
agaaaccccucaccccaccc

SEQ ID NO: 1248273 - RNA, 18 nt, Human
agacagaagacccucaaa

SEQ ID NO: 1248274 - RNA, 18 nt, Human
agacagcaugacuguaca

SEQ ID NO: 1248275 - RNA, 23 nt, Human
agacaggaagcugccgcaacagc

SEQ ID NO: 1248276 - RNA, 24 nt, Human
agacaggagaauugcuugaacccg

SEQ ID NO: 1248277 - RNA, 21 nt, Human
agacggaacaauguucuaaac

SEQ ID NO: 1248278 - RNA, 19 nt, Human
agacugccugguggacucu

SEQ ID NO: 1248279 - RNA, 19 nt, Human
agagcucagacugccuggu

SEQ ID NO: 1248280 - RNA, 23 nt, Human
agagggcuaaguggugugugaag

SEQ ID NO: 1248281 - RNA, 19 nt, Human
agcaaagcagcagcagaga

SEQ ID NO: 1248282 - RNA, 24 nt, Human
agcaggcgcuucuggguagcuugg

SEQ ID NO: 1248283 - RNA, 19 nt, Human
agccccugucauagcuucu

SEQ ID NO: 1248284 - RNA, 18 nt, Human
agccugcucaaccuguaa

SEQ ID NO: 1248285 - RNA, 18 nt, Human
agccugcuuagaacacag

SEQ ID NO: 1248286 - RNA, 24 nt, Human
agccugggcgacagagcgagacuc

SEQ ID NO: 1248287 - RNA, 21 nt, Human
agcugugggacuucauagaug

SEQ ID NO: 1248288 - RNA, 22 nt, Human
aggaaccacaaaucccugccuu

SEQ ID NO: 1248289 - RNA, 19 nt, Human
aggaagcagcacaaagguu

SEQ ID NO: 1248290 - RNA, 24 nt, Human
aggaagcagcacaaagguuaacac

SEQ ID NO: 1248291 - RNA, 21 nt, Human
aggagcaaagcaaaacccacc

SEQ ID NO: 1248292 - RNA, 24 nt, Human
aggagugcaguggcaugaucuugg

SEQ ID NO: 1248293 - RNA, 20 nt, Human
aggaguuugagaccagccug

SEQ ID NO: 1248294 - RNA, 24 nt, Human
aggcagaggaacaucuagaucaga

SEQ ID NO: 1248295 - RNA, 24 nt, Human
aggcagagguugccgugagccgag

SEQ ID NO: 1248296 - RNA, 25 nt, Human
aggcaggagugcaguggcaugaucu

SEQ ID NO: 1248297 - RNA, 21 nt, Human
aggcaggguggcucaugccug

SEQ ID NO: 1248298 - RNA, 24 nt, Human
aggcaggguggcucaugccuguaa

SEQ ID NO: 1248299 - RNA, 22 nt, Human
aggcaucacugaaaugguggca

SEQ ID NO: 1248300 - RNA, 24 nt, Human
aggcaugguggcgcgcgccuguaa

SEQ ID NO: 1248301 - RNA, 21 nt, Human
aggccaaggugguuggaucac

SEQ ID NO: 1248302 - RNA, 21 nt, Human
aggccugaagguggcaggaga

SEQ ID NO: 1248303 - RNA, 22 nt, Human
agguuuugccauguuggccagg

SEQ ID NO: 1248304 - RNA, 20 nt, Human
aguacaguggugcgaucucg

SEQ ID NO: 1248305 - RNA, 24 nt, Human
aguacaguggugcgaucucgguuc

SEQ ID NO: 1248306 - RNA, 21 nt, Human
agugagacuguuggcagagau

SEQ ID NO: 1248307 - RNA, 22 nt, Human
agugagacuguuggcagagaug

SEQ ID NO: 1248308 - RNA, 20 nt, Human
agugcaguggcaugaucuug

SEQ ID NO: 1248309 - RNA, 23 nt, Human
agugcaguggcaugaucuugguu

SEQ ID NO: 1248310 - RNA, 24 nt, Human
agugcaguggcaugaucuugguuc

SEQ ID NO: 1248311 - RNA, 24 nt, Human
aguggcaugaucuugguucacugc

SEQ ID NO: 1248312 - RNA, 24 nt, Human
agugggugaguggguaagcagagu

SEQ ID NO: 1248313 - RNA, 24 nt, Human
aucccaucucuacuaaaaauccaa

SEQ ID NO: 1248314 - RNA, 23 nt, Human
augaaggagacacagucccugga

SEQ ID NO: 1248315 - RNA, 18 nt, Human
augaucacacugaacaga

SEQ ID NO: 1248316 - RNA, 19 nt, Human
augccuguaaucccagcac

SEQ ID NO: 1248317 - RNA, 24 nt, Human
auggcgccacugcucuccagccug

SEQ ID NO: 1248318 - RNA, 24 nt, Human
auuuuuguauuuuuaguagagacg

SEQ ID NO: 1248319 - RNA, 19 nt, Human
caaaacaaaagccugaagc

SEQ ID NO: 1248320 - RNA, 19 nt, Human
caaaacccaccgaaggcuc

SEQ ID NO: 1248321 - RNA, 22 nt, Human
caaaagacaguaagaaggagca

SEQ ID NO: 1248322 - RNA, 20 nt, Human
caaagcagcagcagagagac

SEQ ID NO: 1248323 - RNA, 24 nt, Human
caaagugccgggauuacaggugug

SEQ ID NO: 1248324 - RNA, 23 nt, Human
caaagugugggauuacaggugua

SEQ ID NO: 1248325 - RNA, 22 nt, Human
caacuagacagaagacccucaa

SEQ ID NO: 1248326 - RNA, 21 nt, Human
caacucuuucacagaguuacu

SEQ ID NO: 1248327 - RNA, 20 nt, Human
caagauccaccuuuuggccc

SEQ ID NO: 1248328 - RNA, 21 nt, Human
cacacgcagcuaauuuuugua

SEQ ID NO: 1248329 - RNA, 23 nt, Human
caccaaaucaugugacugaacag

SEQ ID NO: 1248330 - RNA, 19 nt, Human
caccaugacgacaugcaau

SEQ ID NO: 1248331 - RNA, 22 nt, Human
caccaugacgacaugcaaucua

SEQ ID NO: 1248332 - RNA, 21 nt, Human
caccccacccacugcagccaa

SEQ ID NO: 1248333 - RNA, 22 nt, Human
cacgcaauucuccugccucagc

SEQ ID NO: 1248334 - RNA, 22 nt, Human
cacugcaaccucccucugccag

SEQ ID NO: 1248335 - RNA, 24 nt, Human
cacugcucuccagccugggcgaca

SEQ ID NO: 1248336 - RNA, 19 nt, Human
cacuuguucagagcaaagc

SEQ ID NO: 1248337 - RNA, 22 nt, Human
cagaagacccucaaaugacucc

SEQ ID NO: 1248338 - RNA, 25 nt, Human
cagacugcaggagcugcucaacuaa

SEQ ID NO: 1248339 - RNA, 22 nt, Human
cagcaaaaaugagauauaaaca

SEQ ID NO: 1248340 - RNA, 24 nt, Human
cagcacuuugggaggccaaggugg

SEQ ID NO: 1248341 - RNA, 18 nt, Human
cagcagccuccccucuca

SEQ ID NO: 1248342 - RNA, 19 nt, Human
cagcccugggcaccaccag

SEQ ID NO: 1248343 - RNA, 24 nt, Human
cagccuccccucucaagguccccc

SEQ ID NO: 1248344 - RNA, 23 nt, Human
caggaagaaugaaagcacacagu

SEQ ID NO: 1248345 - RNA, 25 nt, Human
caggacccauacagcccugggcacc

SEQ ID NO: 1248346 - RNA, 24 nt, Human
caggagugcaguggcaugaucuug

SEQ ID NO: 1248347 - RNA, 19 nt, Human
caggccccuguuaagccau

SEQ ID NO: 1248348 - RNA, 24 nt, Human
caguagcuggaacuacaggugugc

SEQ ID NO: 1248349 - RNA, 19 nt, Human
caguaugaaacaaaugccc

SEQ ID NO: 1248350 - RNA, 21 nt, Human
cagucuccugaguaccugggg

SEQ ID NO: 1248351 - RNA, 20 nt, Human
cauacagcccugggcaccac

SEQ ID NO: 1248352 - RNA, 21 nt, Human
cauacagcccugggcaccacc

SEQ ID NO: 1248353 - RNA, 23 nt, Human
cauccuucccuaacaauuauuuc

SEQ ID NO: 1248354 - RNA, 18 nt, Human
caucuagaucagaagauu

SEQ ID NO: 1248355 - RNA, 24 nt, Human
caucucuguucaacaaauccccau

SEQ ID NO: 1248356 - RNA, 20 nt, Human
caucuggguuuuguaggcug

SEQ ID NO: 1248357 - RNA, 20 nt, Human
caugccuguaaucccagcac

SEQ ID NO: 1248358 - RNA, 24 nt, Human
caugccuguaaucccagcacuuug

SEQ ID NO: 1248359 - RNA, 21 nt, Human
caugugauucuccugccucag

SEQ ID NO: 1248360 - RNA, 24 nt, Human
cauguuggccaggcuggucucgaa

SEQ ID NO: 1248361 - RNA, 21 nt, Human
ccaaagugccgggauuacagg

SEQ ID NO: 1248362 - RNA, 24 nt, Human
ccaaagugccgggauuacaggugu

SEQ ID NO: 1248363 - RNA, 19 nt, Human
ccaaagugugggauuacag

SEQ ID NO: 1248364 - RNA, 20 nt, Human
ccaaagugugggauuacagg

SEQ ID NO: 1248365 - RNA, 22 nt, Human
ccacacccagcuaauuuuugua

SEQ ID NO: 1248366 - RNA, 23 nt, Human
ccacauacaccaaaucaugugac

SEQ ID NO: 1248367 - RNA, 18 nt, Human
ccacugcucuccagccug

SEQ ID NO: 1248368 - RNA, 20 nt, Human
ccacugcucuccagccuggg

SEQ ID NO: 1248369 - RNA, 21 nt, Human
ccacugcucuccagccugggc

SEQ ID NO: 1248370 - RNA, 21 nt, Human
ccacugcucuccagccugggc

SEQ ID NO: 1248371 - RNA, 23 nt, Human
ccacugcucuccagccugggcga

SEQ ID NO: 1248372 - RNA, 24 nt, Human
ccacugcucuccagccugggcgac

SEQ ID NO: 1248373 - RNA, 23 nt, Human
ccagaaaccccucaccccaccca

SEQ ID NO: 1248374 - RNA, 25 nt, Human
ccaggaacccuuucuggugcucccc

SEQ ID NO: 1248375 - RNA, 18 nt, Human
ccaggcaggguggcucau

SEQ ID NO: 1248376 - RNA, 20 nt, Human
ccagggccuggcacaggaag

SEQ ID NO: 1248377 - RNA, 19 nt, Human
ccagguucaugugauucuc

SEQ ID NO: 1248378 - RNA, 19 nt, Human
ccauguuggccaggcuggu

SEQ ID NO: 1248379 - RNA, 22 nt, Human
ccauguuggccaggcuggucuc

SEQ ID NO: 1248380 - RNA, 23 nt, Human
ccauguuggccaggcuggucucg

SEQ ID NO: 1248381 - RNA, 22 nt, Human
ccauguuugccaggcugaccuc

SEQ ID NO: 1248382 - RNA, 24 nt, Human
cccaaagugugggauuacaggugu

SEQ ID NO: 1248383 - RNA, 23 nt, Human
cccaaaucucaacauaaaauuca

SEQ ID NO: 1248384 - RNA, 21 nt, Human
cccaucucuacuaaaaaucca

SEQ ID NO: 1248385 - RNA, 18 nt, Human
ccccacccacugcagcca

SEQ ID NO: 1248386 - RNA, 21 nt, Human
cccgaaugaguuuuggugguu

SEQ ID NO: 1248387 - RNA, 23 nt, Human
cccucaccccacccacugcagcc

SEQ ID NO: 1248388 - RNA, 21 nt, Human
cccugcuaccuccgccuccug

SEQ ID NO: 1248389 - RNA, 21 nt, Human
ccuacauccacaagauccacc

SEQ ID NO: 1248390 - RNA, 25 nt, Human
ccucaccccacccacugcagccaac

SEQ ID NO: 1248391 - RNA, 18 nt, Human
ccucccaaagugugggau

SEQ ID NO: 1248392 - RNA, 19 nt, Human
ccuccgccuccuggauuca

SEQ ID NO: 1248393 - RNA, 24 nt, Human
ccuccuggauucacgcaauucucc

SEQ ID NO: 1248394 - RNA, 24 nt, Human
ccucuugguuugcugggccaggga

SEQ ID NO: 1248395 - RNA, 24 nt, Human
ccugaccaaugugguaaaauccca

SEQ ID NO: 1248396 - RNA, 24 nt, Human
ccugaccucaggugaucugcccac

SEQ ID NO: 1248397 - RNA, 22 nt, Human
ccugcuaccuccgccuccugga

SEQ ID NO: 1248398 - RNA, 21 nt, Human
ccuggcacaggaaguguucca

SEQ ID NO: 1248399 - RNA, 22 nt, Human
ccuggcacaggaaguguuccau

SEQ ID NO: 1248400 - RNA, 22 nt, Human
ccugggcgacagagcgagacuc

SEQ ID NO: 1248401 - RNA, 22 nt, Human
ccuguaaucccagcacuuuggg

SEQ ID NO: 1248402 - RNA, 21 nt, Human
ccuguaaucccagcuacccag

SEQ ID NO: 1248403 - RNA, 24 nt, Human
ccuguaaucccagcuacccaggag

SEQ ID NO: 1248404 - RNA, 19 nt, Human
ccuuuuggcccagcugcuu

SEQ ID NO: 1248405 - RNA, 21 nt, Human
cgcagucuaguaagagaggcc

SEQ ID NO: 1248406 - RNA, 24 nt, Human
cgccuguaaucccagcuacccagg

SEQ ID NO: 1248407 - RNA, 21 nt, Human
cgggauuacaggugugagcca

SEQ ID NO: 1248408 - RNA, 22 nt, Human
cgggauuacaggugugagccac

SEQ ID NO: 1248409 - RNA, 24 nt, Human
cgggauuacaggugugagccaccg

SEQ ID NO: 1248410 - RNA, 23 nt, Human
cuaauuuuuguauuuuuaguaga

SEQ ID NO: 1248411 - RNA, 21 nt, Human
cuagaggaagaaaaaccagaa

SEQ ID NO: 1248412 - RNA, 23 nt, Human
cucaugccuguaaucccagcacu

SEQ ID NO: 1248413 - RNA, 24 nt, Human
cucaugccuguaaucccagcacuu

SEQ ID NO: 1248414 - RNA, 22 nt, Human
cuccagccugggcgacagagcg

SEQ ID NO: 1248415 - RNA, 21 nt, Human
cucccagcugugggacuucau

SEQ ID NO: 1248416 - RNA, 26 nt, Human
cuccuagccucaggggauucgcuugc

SEQ ID NO: 1248417 - RNA, 21 nt, Human
cuccuggauucacgcaauucu

SEQ ID NO: 1248418 - RNA, 23 nt, Human
cucuccagccugggcgacagagc

SEQ ID NO: 1248419 - RNA, 24 nt, Human
cucucccauaagugccagucccau

SEQ ID NO: 1248420 - RNA, 19 nt, Human
cucugugucaaaaaacaaa

SEQ ID NO: 1248421 - RNA, 21 nt, Human
cucuugcuuuuaccagcuaug

SEQ ID NO: 1248422 - RNA, 19 nt, Human
cugaaaugcuuaggaugag

SEQ ID NO: 1248423 - RNA, 24 nt, Human
cugaacacuggagcuccaggaacc

SEQ ID NO: 1248424 - RNA, 23 nt, Human
cugccucagcuuccucaguagcu

SEQ ID NO: 1248425 - RNA, 23 nt, Human
cugccucagucuccugaguaccu

SEQ ID NO: 1248426 - RNA, 25 nt, Human
cuggaacuacaggugugcaccccca

SEQ ID NO: 1248427 - RNA, 21 nt, Human
cuuggauuuggcuugacccag

SEQ ID NO: 1248428 - RNA, 21 nt, Human
cuuguucugucgcccaggcug

SEQ ID NO: 1248429 - RNA, 23 nt, Human
cuuugcagauagcuggugcuggg

SEQ ID NO: 1248430 - RNA, 26 nt, Human
gaaaagcgccugacacaaaaacacca

SEQ ID NO: 1248431 - RNA, 18 nt, Human
gaacaucuagaucagaag

SEQ ID NO: 1248432 - RNA, 23 nt, Human
gaagacccucaaaugacuccuua

SEQ ID NO: 1248433 - RNA, 18 nt, Human
gaagccccugucauagcu

SEQ ID NO: 1248434 - RNA, 21 nt, Human
gaaggagacacagucccugga

SEQ ID NO: 1248435 - RNA, 23 nt, Human
gaaggggaggagaaugcucccug

SEQ ID NO: 1248436 - RNA, 23 nt, Human
gaagguggcaggagaaagcugga

SEQ ID NO: 1248437 - RNA, 23 nt, Human
gaauguguuuugcaucuugaggc

SEQ ID NO: 1248438 - RNA, 24 nt, Human
gaccucaggugaucugcccaccuc

SEQ ID NO: 1248439 - RNA, 20 nt, Human
gacgggguuucgccauguuu

SEQ ID NO: 1248440 - RNA, 19 nt, Human
gacugagacccugagacag

SEQ ID NO: 1248441 - RNA, 23 nt, Human
gagaauugcuugaacccgggagg

SEQ ID NO: 1248442 - RNA, 21 nt, Human
gaggggauuugacuacuccag

SEQ ID NO: 1248443 - RNA, 23 nt, Human
gagguuuugccauguuggccagg

SEQ ID NO: 1248444 - RNA, 24 nt, Human
gaucaccugaguggaggaguuuga

SEQ ID NO: 1248445 - RNA, 18 nt, Human
gauuacagguguaagcca

SEQ ID NO: 1248446 - RNA, 21 nt, Human
gauuacagguguaagccacca

SEQ ID NO: 1248447 - RNA, 24 nt, Human
gauuacagguguaagccaccaugu

SEQ ID NO: 1248448 - RNA, 18 nt, Human
gauuacaggugugagcca

SEQ ID NO: 1248449 - RNA, 22 nt, Human
gauuacaggugugagccaccgc

SEQ ID NO: 1248450 - RNA, 22 nt, Human
gauuacaggugugagccaccgc

SEQ ID NO: 1248451 - RNA, 18 nt, Human
gcaaagcagcagcagaga

SEQ ID NO: 1248452 - RNA, 22 nt, Human
gcaaccucccucugccagguuc

SEQ ID NO: 1248453 - RNA, 20 nt, Human
gcacagugaucacugguggc

SEQ ID NO: 1248454 - RNA, 19 nt, Human
gcaguagucauaaaccaac

SEQ ID NO: 1248455 - RNA, 22 nt, Human
gccacugcucuccagccugggc

SEQ ID NO: 1248456 - RNA, 22 nt, Human
gccacugcucuccagccugggc

SEQ ID NO: 1248457 - RNA, 20 nt, Human
gccauguuggccaggcuggu

SEQ ID NO: 1248458 - RNA, 19 nt, Human
gcccaggcuggaguacagu

SEQ ID NO: 1248459 - RNA, 20 nt, Human
gcccaggcuggaguacagug

SEQ ID NO: 1248460 - RNA, 23 nt, Human
gccucagucuccugaguaccugg

SEQ ID NO: 1248461 - RNA, 22 nt, Human
gcuaggcaugguggcgcgcgcc

SEQ ID NO: 1248462 - RNA, 23 nt, Human
gcugaccucgaacuccuagccuc

SEQ ID NO: 1248463 - RNA, 18 nt, Human
gcugggccagggaaaggg

SEQ ID NO: 1248464 - RNA, 23 nt, Human
gcuggucucgaacuccugaccuc

SEQ ID NO: 1248465 - RNA, 18 nt, Human
ggaaccaagaacacaggu

SEQ ID NO: 1248466 - RNA, 23 nt, Human
ggagugcaguggcaugaucuugg

SEQ ID NO: 1248467 - RNA, 24 nt, Human
ggauuacagguguaagccaccaug

SEQ ID NO: 1248468 - RNA, 24 nt, Human
ggcaaacccacuguugcccuccac

SEQ ID NO: 1248469 - RNA, 26 nt, Human
ggcaggcaaacccacuguugcccucc

SEQ ID NO: 1248470 - RNA, 20 nt, Human
ggcccugagagcacauccug

SEQ ID NO: 1248471 - RNA, 21 nt, Human
ggcgcgcgccuguaaucccag

SEQ ID NO: 1248472 - RNA, 21 nt, Human
ggcucaugccuguaaucccag

SEQ ID NO: 1248473 - RNA, 24 nt, Human
ggcuggucucgaacuccugaccuc

SEQ ID NO: 1248474 - RNA, 23 nt, Human
ggcuuucauggcuggcaagaaaa

SEQ ID NO: 1248475 - RNA, 21 nt, Human
gggaagaacauucuaggcaga

SEQ ID NO: 1248476 - RNA, 20 nt, Human
gggaggccugaagguggcag

SEQ ID NO: 1248477 - RNA, 18 nt, Human
gggauuacaggugugagc

SEQ ID NO: 1248478 - RNA, 22 nt, Human
gggauuacaggugugagccacc

SEQ ID NO: 1248479 - RNA, 23 nt, Human
gggauuacaggugugagccaccg

SEQ ID NO: 1248480 - RNA, 20 nt, Human
gggcacaacugaaauggaag

SEQ ID NO: 1248481 - RNA, 24 nt, Human
ggggauucgcuugccucagccucc

SEQ ID NO: 1248482 - RNA, 23 nt, Human
gguaagcagagugccccaggacc

SEQ ID NO: 1248483 - RNA, 18 nt, Human
ggucaacagaaucaggaa

SEQ ID NO: 1248484 - RNA, 19 nt, Human
ggucucgaacuccugaccu

SEQ ID NO: 1248485 - RNA, 24 nt, Human
gguggcgcgcgccuguaaucccag

SEQ ID NO: 1248486 - RNA, 23 nt, Human
gguggcucaugccuguaauccca

SEQ ID NO: 1248487 - RNA, 24 nt, Human
gguuaggauucuggcucccagcug

SEQ ID NO: 1248488 - RNA, 23 nt, Human
guagagacgagguuuugccaugu

SEQ ID NO: 1248489 - RNA, 24 nt, Human
gugaucugcccaccucaaccuccc

SEQ ID NO: 1248490 - RNA, 23 nt, Human
guggcucaugccuguaaucccag

SEQ ID NO: 1248491 - RNA, 28 nt, Human
gugucaaaaaacaaaacaaaagccugaa

SEQ ID NO: 1248492 - RNA, 23 nt, Human
guuaggauucuggcucccagcug

SEQ ID NO: 1248493 - RNA, 19 nt, Human
guucacugcaaccucccuc

SEQ ID NO: 1248494 - RNA, 24 nt, Human
guuccaagguugaccauucuuugc

SEQ ID NO: 1248495 - RNA, 18 nt, Human
guuucagauuuuggagca

SEQ ID NO: 1248496 - RNA, 19 nt, Human
uaaaaauacagaaggggcc

SEQ ID NO: 1248497 - RNA, 24 nt, Human
uaaaauccacauacaccaaaucau

SEQ ID NO: 1248498 - RNA, 20 nt, Human
uaaaauucauuuauguuuca

SEQ ID NO: 1248499 - RNA, 19 nt, Human
uaaacaaaugaacacagcc

SEQ ID NO: 1248500 - RNA, 24 nt, Human
uaaaccaacaaaaagucuaauaac

SEQ ID NO: 1248501 - RNA, 21 nt, Human
uaaacuacagcagccuccccu

SEQ ID NO: 1248502 - RNA, 19 nt, Human
uaaagaagugagccaugca

SEQ ID NO: 1248503 - RNA, 22 nt, Human
uaaagacgggguuucgccaugu

SEQ ID NO: 1248504 - RNA, 18 nt, Human
uaaaucaaggauccugau

SEQ ID NO: 1248505 - RNA, 21 nt, Human
uaacucuagggaaggggaaag

SEQ ID NO: 1248506 - RNA, 23 nt, Human
uaagacaggagaauugcuugaac

SEQ ID NO: 1248507 - RNA, 24 nt, Human
uaagacaggagaauugcuugaacc

SEQ ID NO: 1248508 - RNA, 25 nt, Human
uaagacaggagaauugcuugaaccc

SEQ ID NO: 1248509 - RNA, 22 nt, Human
uaagagaggccgaugcuaaaaa

SEQ ID NO: 1248510 - RNA, 20 nt, Human
uaagcuggcuuugaagguuu

SEQ ID NO: 1248511 - RNA, 23 nt, Human
uaaggcagacagcaugacuguac

SEQ ID NO: 1248512 - RNA, 24 nt, Human
uaauuuuuguauuuuuaguaaaga

SEQ ID NO: 1248513 - RNA, 24 nt, Human
uaauuuuuguauuuuuaguagaga

SEQ ID NO: 1248514 - RNA, 22 nt, Human
uacaccaaaucaugugacugaa

SEQ ID NO: 1248515 - RNA, 19 nt, Human
uacagaaggggccagagaa

SEQ ID NO: 1248516 - RNA, 28 nt, Human
uacagcccugggcaccaccagagacaga

SEQ ID NO: 1248517 - RNA, 21 nt, Human
uacagcugagaaauccagggc

SEQ ID NO: 1248518 - RNA, 18 nt, Human
uacagguguaagccacca

SEQ ID NO: 1248519 - RNA, 23 nt, Human
uacaggugugagccaccgcgccc

SEQ ID NO: 1248520 - RNA, 24 nt, Human
uacaggugugcacccccacaccca

SEQ ID NO: 1248521 - RNA, 19 nt, Human
uaccuacugaguuugaaga

SEQ ID NO: 1248522 - RNA, 20 nt, Human
uacuaggcagaaaagcauaa

SEQ ID NO: 1248523 - RNA, 19 nt, Human
uagaacacagaacaucugc

SEQ ID NO: 1248524 - RNA, 22 nt, Human
uagagacgagguuuugccaugu

SEQ ID NO: 1248525 - RNA, 18 nt, Human
uagaugucucuucagcuc

SEQ ID NO: 1248526 - RNA, 21 nt, Human
uagcagaaguagaaaaggaaa

SEQ ID NO: 1248527 - RNA, 22 nt, Human
uagcagcaggaacuucucaaag

SEQ ID NO: 1248528 - RNA, 23 nt, Human
uagcagucagagaaggcuuccag

SEQ ID NO: 1248529 - RNA, 20 nt, Human
uaggaccaugaaaauggggu

SEQ ID NO: 1248530 - RNA, 24 nt, Human
uaguaaagacgggguuucgccaug

SEQ ID NO: 1248531 - RNA, 24 nt, Human
uaguagagacgagguuuugccaug

SEQ ID NO: 1248532 - RNA, 20 nt, Human
uagugucauguuggugcuca

SEQ ID NO: 1248533 - RNA, 21 nt, Human
uaguuuccucaucagaaaaag

SEQ ID NO: 1248534 - RNA, 19 nt, Human
ucaaagcuugcugccaccu

SEQ ID NO: 1248535 - RNA, 26 nt, Human
ucaaccuguaaaucuuuuuuuuuuuu

SEQ ID NO: 1248536 - RNA, 18 nt, Human
ucacugcaaccucccucu

SEQ ID NO: 1248537 - RNA, 19 nt, Human
ucacugcaaccucccucug

SEQ ID NO: 1248538 - RNA, 19 nt, Human
ucacugcaaccucccucug

SEQ ID NO: 1248539 - RNA, 24 nt, Human
ucacugcaaccucccucugccagg

SEQ ID NO: 1248540 - RNA, 18 nt, Human
ucagaagaagccaagugg

SEQ ID NO: 1248541 - RNA, 20 nt, Human
ucagacaggaagaaugaaag

SEQ ID NO: 1248542 - RNA, 19 nt, Human
ucagagaaggcugggaauc

SEQ ID NO: 1248543 - RNA, 19 nt, Human
ucagagcucagacugccug

SEQ ID NO: 1248544 - RNA, 23 nt, Human
uccaacaaggcaggcaaacccac

SEQ ID NO: 1248545 - RNA, 23 nt, Human
uccaaucugguuaacaagccugc

SEQ ID NO: 1248546 - RNA, 22 nt, Human
uccaccuuuuggcccagcugcu

SEQ ID NO: 1248547 - RNA, 19 nt, Human
uccagaaaccccucacccc

SEQ ID NO: 1248548 - RNA, 23 nt, Human
uccagccugggcgacagagcgag

SEQ ID NO: 1248549 - RNA, 24 nt, Human
uccagccugggcgacagagcgaga

SEQ ID NO: 1248550 - RNA, 23 nt, Human
ucccaaagugccgggauuacagg

SEQ ID NO: 1248551 - RNA, 22 nt, Human
ucccaaagugugggauuacagg

SEQ ID NO: 1248552 - RNA, 19 nt, Human
ucccaucucuacuaaaaau

SEQ ID NO: 1248553 - RNA, 21 nt, Human
ucccugccuucauagggcuug

SEQ ID NO: 1248554 - RNA, 24 nt, Human
ucccugcuaccuccgccuccugga

SEQ ID NO: 1248555 - RNA, 21 nt, Human
uccuggauucacgcaauucuc

SEQ ID NO: 1248556 - RNA, 24 nt, Human
uccuggauucacgcaauucuccug

SEQ ID NO: 1248557 - RNA, 24 nt, Human
ucgcccaggcuggaguacaguggu

SEQ ID NO: 1248558 - RNA, 23 nt, Human
ucuagaggaagaaaaaccagaaa

SEQ ID NO: 1248559 - RNA, 21 nt, Human
ucucacacauaaaaugaggau

SEQ ID NO: 1248560 - RNA, 18 nt, Human
ucuccugaguaccugggg

SEQ ID NO: 1248561 - RNA, 23 nt, Human
ucucgaacuccugaccucaggug

SEQ ID NO: 1248562 - RNA, 19 nt, Human
ucucgcugugucacccagg

SEQ ID NO: 1248563 - RNA, 24 nt, Human
ucucgcugugucacccaggcagga

SEQ ID NO: 1248564 - RNA, 21 nt, Human
ucucuacuaaaaauccaaaaa

SEQ ID NO: 1248565 - RNA, 22 nt, Human
ucucuacuaaaaauccaaaaaa

SEQ ID NO: 1248566 - RNA, 24 nt, Human
ucugccagguucaugugauucucc

SEQ ID NO: 1248567 - RNA, 21 nt, Human
ucugcccaccucaaccuccca

SEQ ID NO: 1248568 - RNA, 22 nt, Human
ucuuguucugucgcccaggcug

SEQ ID NO: 1248569 - RNA, 23 nt, Human
ucuuguucugucgcccaggcugg

SEQ ID NO: 1248570 - RNA, 24 nt, Human
ucuuguucugucgcccaggcugga

SEQ ID NO: 1248571 - RNA, 20 nt, Human
ugaaaaugaugcacaguggg

SEQ ID NO: 1248572 - RNA, 25 nt, Human
ugaaacaaaugcccaaauaggaugc

SEQ ID NO: 1248573 - RNA, 19 nt, Human
ugaaccagaggaaccacaa

SEQ ID NO: 1248574 - RNA, 24 nt, Human
ugaaggggguccagaaaccccuca

SEQ ID NO: 1248575 - RNA, 22 nt, Human
ugaagguggcaggagaaagcug

SEQ ID NO: 1248576 - RNA, 22 nt, Human
ugacacaaaaacaccaucugca

SEQ ID NO: 1248577 - RNA, 18 nt, Human
ugaccucaggugaucugc

SEQ ID NO: 1248578 - RNA, 20 nt, Human
ugaccucaggugaucugccc

SEQ ID NO: 1248579 - RNA, 21 nt, Human
ugaccucaggugaucugccca

SEQ ID NO: 1248580 - RNA, 24 nt, Human
ugaccucaggugaucugcccaccu

SEQ ID NO: 1248581 - RNA, 20 nt, Human
ugaccucgaacuccuagccu

SEQ ID NO: 1248582 - RNA, 23 nt, Human
ugagaaaggcaacuauagguuac

SEQ ID NO: 1248583 - RNA, 21 nt, Human
ugagaagaaaaugaggugacu

SEQ ID NO: 1248584 - RNA, 23 nt, Human
ugagaccagccugaccaaugugg

SEQ ID NO: 1248585 - RNA, 24 nt, Human
ugagaccagccugaccaauguggu

SEQ ID NO: 1248586 - RNA, 19 nt, Human
ugagacgaagucuuguucu

SEQ ID NO: 1248587 - RNA, 22 nt, Human
ugagacgaagucuuguucuguc

SEQ ID NO: 1248588 - RNA, 20 nt, Human
ugagacuguuggcagagaug

SEQ ID NO: 1248589 - RNA, 18 nt, Human
ugagaugagacccaaauc

SEQ ID NO: 1248590 - RNA, 18 nt, Human
ugagcauuacacaaaguu

SEQ ID NO: 1248591 - RNA, 22 nt, Human
ugagccgagauggcgccacugc

SEQ ID NO: 1248592 - RNA, 22 nt, Human
ugagggaaaggaugaugaacca

SEQ ID NO: 1248593 - RNA, 21 nt, Human
ugagggauauuaggaugcagc

SEQ ID NO: 1248594 - RNA, 21 nt, Human
ugaguaccugggguuacaggu

SEQ ID NO: 1248595 - RNA, 24 nt, Human
ugaucugcccaccucaaccuccca

SEQ ID NO: 1248596 - RNA, 20 nt, Human
ugaugggguucaggagggcc

SEQ ID NO: 1248597 - RNA, 20 nt, Human
ugauucuccugccucagucu

SEQ ID NO: 1248598 - RNA, 24 nt, Human
ugccagguucaugugauucuccug

SEQ ID NO: 1248599 - RNA, 24 nt, Human
ugccauguuggccaggcuggucuc

SEQ ID NO: 1248600 - RNA, 27 nt, Human
ugccauguuggccaggcuggucucgaa

SEQ ID NO: 1248601 - RNA, 21 nt, Human
ugcccaccucaaccucccaaa

SEQ ID NO: 1248602 - RNA, 20 nt, Human
ugccccaggacccauacagc

SEQ ID NO: 1248603 - RNA, 24 nt, Human
ugccgggauuacaggugugagcca

SEQ ID NO: 1248604 - RNA, 23 nt, Human
ugccucagccucccaaagugugg

SEQ ID NO: 1248605 - RNA, 21 nt, Human
ugccucagcuuccucaguagc

SEQ ID NO: 1248606 - RNA, 24 nt, Human
ugccucagcuuccucaguagcugg

SEQ ID NO: 1248607 - RNA, 24 nt, Human
ugccucagucuccugaguaccugg

SEQ ID NO: 1248608 - RNA, 21 nt, Human
ugccugguggacucuuaccuc

SEQ ID NO: 1248609 - RNA, 23 nt, Human
ugccuguaaucccagcacuuugg

SEQ ID NO: 1248610 - RNA, 23 nt, Human
ugccuguaaucccagcacuuugg

SEQ ID NO: 1248611 - RNA, 21 nt, Human
ugcuaaaaaauuaccgaacag

SEQ ID NO: 1248612 - RNA, 19 nt, Human
ugcugagaaaggcauugcc

SEQ ID NO: 1248613 - RNA, 24 nt, Human
uggaaauauaaacaugaaggagac

SEQ ID NO: 1248614 - RNA, 22 nt, Human
uggaacuacaggugugcacccc

SEQ ID NO: 1248615 - RNA, 24 nt, Human
uggaacuacaggugugcaccccca

SEQ ID NO: 1248616 - RNA, 18 nt, Human
uggaggaguuugagacca

SEQ ID NO: 1248617 - RNA, 24 nt, Human
uggaguacaguggugcgaucucgg

SEQ ID NO: 1248618 - RNA, 23 nt, Human
uggaucaccugaguggaggaguu

SEQ ID NO: 1248619 - RNA, 24 nt, Human
uggaucaccugaguggaggaguuu

SEQ ID NO: 1248620 - RNA, 20 nt, Human
uggauucacgcaauucuccu

SEQ ID NO: 1248621 - RNA, 19 nt, Human
uggcaaaaaaaaaaaaaaa

SEQ ID NO: 1248622 - RNA, 25 nt, Human
uggcacaggaaguguuccauaaaua

SEQ ID NO: 1248623 - RNA, 19 nt, Human
uggcaggagaaagcugggg

SEQ ID NO: 1248624 - RNA, 19 nt, Human
uggcaugaucuugguucac

SEQ ID NO: 1248625 - RNA, 21 nt, Human
uggcaugaucuugguucacug

SEQ ID NO: 1248626 - RNA, 24 nt, Human
uggccaggcuggucucgaacuccu

SEQ ID NO: 1248627 - RNA, 21 nt, Human
uggcccagcugcuuuuagggg

SEQ ID NO: 1248628 - RNA, 22 nt, Human
uggccuuugacacucugcccau

SEQ ID NO: 1248629 - RNA, 21 nt, Human
uggcgcgcgccuguaauccca

SEQ ID NO: 1248630 - RNA, 20 nt, Human
uggcuaaugcaagcaacuuu

SEQ ID NO: 1248631 - RNA, 22 nt, Human
uggcucaugccuguaaucccag

SEQ ID NO: 1248632 - RNA, 24 nt, Human
uggcucaugccuguaaucccagca

SEQ ID NO: 1248633 - RNA, 24 nt, Human
ugggaagaacauucuaggcagagg

SEQ ID NO: 1248634 - RNA, 19 nt, Human
ugggaggccaaggugguug

SEQ ID NO: 1248635 - RNA, 24 nt, Human
ugggaggccaaggugguuggauca

SEQ ID NO: 1248636 - RNA, 21 nt, Human
ugggagucagaucuuuggggu

SEQ ID NO: 1248637 - RNA, 18 nt, Human
ugggauuacagguguaag

SEQ ID NO: 1248638 - RNA, 22 nt, Human
ugggauuacagguguaagccac

SEQ ID NO: 1248639 - RNA, 24 nt, Human
ugggauuacagguguaagccacca

SEQ ID NO: 1248640 - RNA, 25 nt, Human
ugggauuacagguguaagccaccau

SEQ ID NO: 1248641 - RNA, 21 nt, Human
ugggguuacagguacaugcca

SEQ ID NO: 1248642 - RNA, 24 nt, Human
ugggguuacagguacaugccauca

SEQ ID NO: 1248643 - RNA, 23 nt, Human
ugguggacucuuaccuccuccgu

SEQ ID NO: 1248644 - RNA, 24 nt, Human
ugguggcgcgcgccuguaauccca

SEQ ID NO: 1248645 - RNA, 20 nt, Human
ugucaaaaaacaaaacaaaa

SEQ ID NO: 1248646 - RNA, 20 nt, Human
ugucaaaaaacaaaacaaaa

SEQ ID NO: 1248647 - RNA, 24 nt, Human
ugugauucuccugccucagucucc

SEQ ID NO: 1248648 - RNA, 24 nt, Human
ugugucacccaggcaggagugcag

SEQ ID NO: 1248649 - RNA, 21 nt, Human
uguuccaagguugaccauucu

SEQ ID NO: 1248650 - RNA, 23 nt, Human
uguuccaagguugaccauucuuu

SEQ ID NO: 1248651 - RNA, 22 nt, Human
uguucugucgcccaggcuggag

SEQ ID NO: 1248652 - RNA, 27 nt, Human
uuaccgaacaguaugaaacaaaugccc

SEQ ID NO: 1248653 - RNA, 21 nt, Human
uuaggugacaggaaaccugcu

SEQ ID NO: 1248654 - RNA, 24 nt, Human
uuaguaaagacgggguuucgccau

SEQ ID NO: 1248655 - RNA, 24 nt, Human
uuaguagagacgagguuuugccau

SEQ ID NO: 1248656 - RNA, 23 nt, Human
uucacugcaaccucccucugcca

SEQ ID NO: 1248657 - RNA, 19 nt, Human
uucagagaugaaaagaaac

SEQ ID NO: 1248658 - RNA, 19 nt, Human
uucauggcuggcaagaaaa

SEQ ID NO: 1248659 - RNA, 18 nt, Human
uucaugugauucuccugc

SEQ ID NO: 1248660 - RNA, 23 nt, Human
uucaugugauucuccugccucag

SEQ ID NO: 1248661 - RNA, 18 nt, Human
uucgcuugccucagccuc

SEQ ID NO: 1248662 - RNA, 24 nt, Human
uucuccugccucagcuuccucagu

SEQ ID NO: 1248663 - RNA, 24 nt, Human
uugccaggcugaccucgaacuccu

SEQ ID NO: 1248664 - RNA, 24 nt, Human
uugccauguuggccaggcuggucu

SEQ ID NO: 1248665 - RNA, 22 nt, Human
uugccgugagccgagauggcgc

SEQ ID NO: 1248666 - RNA, 18 nt, Human
uugcuugaacccgggagg

SEQ ID NO: 1248667 - RNA, 24 nt, Human
uugcuugaacccgggaggcagagg

SEQ ID NO: 1248668 - RNA, 19 nt, Human
uuggcaaaaaaaaaaaaaa

SEQ ID NO: 1248669 - RNA, 23 nt, Human
uuggcaaaaaaaaaaaaaaaguu

SEQ ID NO: 1248670 - RNA, 23 nt, Human
uuguauuuuuaguaaagacgggg

SEQ ID NO: 1248671 - RNA, 24 nt, Human
uuguucugucgcccaggcuggagu

SEQ ID NO: 1248672 - RNA, 20 nt, Human
uuuaaaauccacauacaccc

SEQ ID NO: 1248673 - RNA, 21 nt, Human
uuucgccauguuugccaggcu

SEQ ID NO: 1248674 - RNA, 18 nt, Human
uuugacaaggaggaagug

SEQ ID NO: 1248675 - RNA, 21 nt, Human
uuugagaugagacccaaaucu

SEQ ID NO: 1248676 - RNA, 19 nt, Human
uuugcaucuugaggcuuug

SEQ ID NO: 1248677 - RNA, 23 nt, Human
uuuugccauguuggccaggcugg

SEQ ID NO: 1248678 - RNA, 21 nt, Human
uuuuguauuuuuaguaaagac

SEQ ID NO: 1248679 - RNA, 22 nt, Human
uuuuuaguaaagacgggguuuc

SEQ ID NO: 1248680 - RNA, 23 nt, Human
uuuuuaguaaagacgggguuucg

SEQ ID NO: 1248681 - RNA, 24 nt, Human
uuuuuaguagagacgagguuuugc

SEQ ID NO: 1248682 - RNA, 20 nt, Human
uuuuuguauuuuuaguaaag

SEQ ID NO: 1248683 - RNA, 20 nt, Human
uuuuuguauuuuuaguagag

SEQ ID NO: 1248684 - RNA, 18 nt, Human
agcgaggcgcacacucaa

SEQ ID NO: 1248685 - RNA, 19 nt, Human
caaaggucccccucggccc

SEQ ID NO: 1248686 - RNA, 22 nt, Human
cccccaccgcgucuuccagaga

SEQ ID NO: 1248687 - RNA, 20 nt, Human
ccuucguccuggcccucccg

SEQ ID NO: 1248688 - RNA, 20 nt, Human
cgcacacucacgcgcacuca

SEQ ID NO: 1248689 - RNA, 23 nt, Human
cgcccccuccccuccccagcuug

SEQ ID NO: 1248690 - RNA, 24 nt, Human
cgcccggguuuccugugaccguuc

SEQ ID NO: 1248691 - RNA, 19 nt, Human
gcacucacuuucugggcuc

SEQ ID NO: 1248692 - RNA, 20 nt, Human
gccuacggacacgcgcgggg

SEQ ID NO: 1248693 - RNA, 19 nt, Human
gcgcgcacacucacgcgca

SEQ ID NO: 1248694 - RNA, 22 nt, Human
gcgcgcacacucacgcgcacuc

SEQ ID NO: 1248695 - RNA, 23 nt, Human
ggcacaguucgcugggagcgggc

SEQ ID NO: 1248696 - RNA, 21 nt, Human
gggccggagcgaggcgcacac

SEQ ID NO: 1248697 - RNA, 24 nt, Human
uccgugggggacaccuagccuuug

SEQ ID NO: 1248698 - RNA, 18 nt, Human
ucgccggggcaauuggug

SEQ ID NO: 1248699 - RNA, 23 nt, Human
ucuccgugggggacaccuagccu

SEQ ID NO: 1248700 - RNA, 23 nt, Human
ucugcgcccccuccccuccccag

SEQ ID NO: 1248701 - RNA, 22 nt, Human
ugcgcaccccccaccgcgucuu

SEQ ID NO: 1248702 - RNA, 20 nt, Human
ugggccgaguccagaccacu

SEQ ID NO: 1248703 - RNA, 22 nt, Human
uuccagagagcgcgccuacgga

SEQ ID NO: 1248704 - RNA, 23 nt, Human
uucugcgcccccuccccucccca

SEQ ID NO: 1248705 - RNA, 25 nt, Human
aaacucccuccaagccagaacacua

SEQ ID NO: 1248706 - RNA, 24 nt, Human
aagccagaacacggguccggggga

SEQ ID NO: 1248707 - RNA, 21 nt, Human
acggguccgggggacuccuca

SEQ ID NO: 1248708 - RNA, 20 nt, Human
cacggguccgggggacuccu

SEQ ID NO: 1248709 - RNA, 23 nt, Human
ccaaagucaaacucccuccaagc

SEQ ID NO: 1248710 - RNA, 18 nt, Human
ccacggcacaagcaccca

SEQ ID NO: 1248711 - RNA, 26 nt, Human
cccagguggugguucucgacgggcua

SEQ ID NO: 1248712 - RNA, 19 nt, Human
ccgugggccccgccugccc

SEQ ID NO: 1248713 - RNA, 25 nt, Human
ccucaccccuggcuguuccccccaa

SEQ ID NO: 1248714 - RNA, 21 nt, Human
ccugccccacggcacaagcac

SEQ ID NO: 1248715 - RNA, 24 nt, Human
cucccaagacugaauggggucuag

SEQ ID NO: 1248716 - RNA, 23 nt, Human
gaacacggguccgggggacuccc

SEQ ID NO: 1248717 - RNA, 24 nt, Human
gaacuggcucucucaccucccaag

SEQ ID NO: 1248718 - RNA, 21 nt, Human
uaccuuuggccaaagucaaac

SEQ ID NO: 1248719 - RNA, 24 nt, Human
ucaccccuggcuguuccccccaac

SEQ ID NO: 1248720 - RNA, 25 nt, Human
aaaccugcucacccuguccccuaaa

SEQ ID NO: 1248721 - RNA, 24 nt, Human
aacccacucuccuuguccccccaa

SEQ ID NO: 1248722 - RNA, 22 nt, Human
aaccugcucacccuguccccua

SEQ ID NO: 1248723 - RNA, 24 nt, Human
aacgugcugagauuacagguguga

SEQ ID NO: 1248724 - RNA, 18 nt, Human
accagggcugcaaugcuc

SEQ ID NO: 1248725 - RNA, 20 nt, Human
accaugaguugcugguccuu

SEQ ID NO: 1248726 - RNA, 20 nt, Human
acccacucuccuuguccccc

SEQ ID NO: 1248727 - RNA, 19 nt, Human
acccugcccgcugugcagc

SEQ ID NO: 1248728 - RNA, 20 nt, Human
acccuggacaccuucugcuu

SEQ ID NO: 1248729 - RNA, 20 nt, Human
acccuguccccuaaacccac

SEQ ID NO: 1248730 - RNA, 18 nt, Human
acgggauuucgccauguu

SEQ ID NO: 1248731 - RNA, 20 nt, Human
acgggauuucgccauguugg

SEQ ID NO: 1248732 - RNA, 24 nt, Human
acgggauuucgccauguuggccag

SEQ ID NO: 1248733 - RNA, 24 nt, Human
acucuccuuguccccccaaacccu

SEQ ID NO: 1248734 - RNA, 20 nt, Human
agacguucaggagguucugc

SEQ ID NO: 1248735 - RNA, 18 nt, Human
agagaguccuucaggagc

SEQ ID NO: 1248736 - RNA, 22 nt, Human
agauuacaggugugagucacug

SEQ ID NO: 1248737 - RNA, 22 nt, Human
agcacuccuuucgcugcuccuc

SEQ ID NO: 1248738 - RNA, 19 nt, Human
agcuugcugucgcgauagu

SEQ ID NO: 1248739 - RNA, 23 nt, Human
aggugugagucacugugcccagc

SEQ ID NO: 1248740 - RNA, 24 nt, Human
caacgugcugagauuacaggugug

SEQ ID NO: 1248741 - RNA, 19 nt, Human
cacaggauuuguggccuga

SEQ ID NO: 1248742 - RNA, 22 nt, Human
cacccuguccccuaaacccacu

SEQ ID NO: 1248743 - RNA, 25 nt, Human
cacccuguccccuaaacccacucuc

SEQ ID NO: 1248744 - RNA, 22 nt, Human
cacugugcccagccugaaaaac

SEQ ID NO: 1248745 - RNA, 24 nt, Human
cagccgcacccccaccgccuccgg

SEQ ID NO: 1248746 - RNA, 19 nt, Human
cagccugaaaaacccuaau

SEQ ID NO: 1248747 - RNA, 18 nt, Human
cagccuucucacccugcc

SEQ ID NO: 1248748 - RNA, 20 nt, Human
cagcugcuagcugcccgccg

SEQ ID NO: 1248749 - RNA, 18 nt, Human
caggagccgggugagcuu

SEQ ID NO: 1248750 - RNA, 21 nt, Human
caggagccgggugagcuugcu

SEQ ID NO: 1248751 - RNA, 20 nt, Human
caugccagccuucucacccu

SEQ ID NO: 1248752 - RNA, 24 nt, Human
cauguuggccaggcuggucucgaa

SEQ ID NO: 1248753 - RNA, 21 nt, Human
ccaacgugcugagauuacagg

SEQ ID NO: 1248754 - RNA, 21 nt, Human
ccaacgugcugagauuacagg

SEQ ID NO: 1248755 - RNA, 24 nt, Human
ccaacgugcugagauuacaggugu

SEQ ID NO: 1248756 - RNA, 20 nt, Human
ccaccgccuccgggucgcgu

SEQ ID NO: 1248757 - RNA, 24 nt, Human
ccaccgggcauggcucagccgcac

SEQ ID NO: 1248758 - RNA, 19 nt, Human
ccagggcugcaaugcucuc

SEQ ID NO: 1248759 - RNA, 19 nt, Human
ccauguuggccaggcuggu

SEQ ID NO: 1248760 - RNA, 22 nt, Human
ccauguuggccaggcuggucuc

SEQ ID NO: 1248761 - RNA, 23 nt, Human
ccauguuggccaggcuggucucg

SEQ ID NO: 1248762 - RNA, 23 nt, Human
cccacucuccuuguccccccaaa

SEQ ID NO: 1248763 - RNA, 25 nt, Human
ccccaccgccuccgggucgcguccg

SEQ ID NO: 1248764 - RNA, 27 nt, Human
cccccaccgccuccgggucgcguccgc

SEQ ID NO: 1248765 - RNA, 18 nt, Human
ccccgggccuggccccgc

SEQ ID NO: 1248766 - RNA, 20 nt, Human
cccgccgccucgcgcgcugc

SEQ ID NO: 1248767 - RNA, 21 nt, Human
cccuccgccuugccucucaaa

SEQ ID NO: 1248768 - RNA, 20 nt, Human
cccugccgcaccuccugcaa

SEQ ID NO: 1248769 - RNA, 19 nt, Human
ccgcacccccaccgccucc

SEQ ID NO: 1248770 - RNA, 21 nt, Human
ccgcacccccaccgccucccc

SEQ ID NO: 1248771 - RNA, 20 nt, Human
ccgccgccucgcgcgcugcc

SEQ ID NO: 1248772 - RNA, 23 nt, Human
ccgccgccucgcgcgcugccuga

SEQ ID NO: 1248773 - RNA, 23 nt, Human
ccggccccgggccuggccccgcc

SEQ ID NO: 1248774 - RNA, 19 nt, Human
ccucucaaaccugcucacc

SEQ ID NO: 1248775 - RNA, 19 nt, Human
ccugcccgcugugcagcug

SEQ ID NO: 1248776 - RNA, 23 nt, Human
ccuggccccuccgccuugccucu

SEQ ID NO: 1248777 - RNA, 18 nt, Human
ccuggccucaagugaucu

SEQ ID NO: 1248778 - RNA, 24 nt, Human
ccuggccucaagugaucugccuac

SEQ ID NO: 1248779 - RNA, 18 nt, Human
ccuuucgcugcuccuccc

SEQ ID NO: 1248780 - RNA, 21 nt, Human
ccuuucgcugcuccucccgcc

SEQ ID NO: 1248781 - RNA, 24 nt, Human
cgccauguuggccaggcuggucuc

SEQ ID NO: 1248782 - RNA, 27 nt, Human
cgccauguuggccaggcuggucucgaa

SEQ ID NO: 1248783 - RNA, 19 nt, Human
cgccgccucgcgcgcugcc

SEQ ID NO: 1248784 - RNA, 24 nt, Human
cgccuugccucucaaaccugcuca

SEQ ID NO: 1248785 - RNA, 19 nt, Human
cggccccgggccuggcccc

SEQ ID NO: 1248786 - RNA, 21 nt, Human
cggcuacccccacccuggccc

SEQ ID NO: 1248787 - RNA, 24 nt, Human
cgggauuucgccauguuggccagg

SEQ ID NO: 1248788 - RNA, 19 nt, Human
cgugcugagauuacaggug

SEQ ID NO: 1248789 - RNA, 24 nt, Human
cucaagugaucugccuaccucaac

SEQ ID NO: 1248790 - RNA, 18 nt, Human
cucccgggcugcggccac

SEQ ID NO: 1248791 - RNA, 23 nt, Human
cuccuggguccucugccgguucc

SEQ ID NO: 1248792 - RNA, 19 nt, Human
cucugccgguuccccuuca

SEQ ID NO: 1248793 - RNA, 20 nt, Human
cuggccccuccgccuugccu

SEQ ID NO: 1248794 - RNA, 21 nt, Human
cuggccccuccgccuugccuc

SEQ ID NO: 1248795 - RNA, 22 nt, Human
gaagcgccaccaugaguugcug

SEQ ID NO: 1248796 - RNA, 21 nt, Human
gaagcugucccaugccagccu

SEQ ID NO: 1248797 - RNA, 22 nt, Human
gagcaggugucgggagguguca

SEQ ID NO: 1248798 - RNA, 20 nt, Human
gaugcaguugcccagugcca

SEQ ID NO: 1248799 - RNA, 18 nt, Human
gauuacaggugugaguca

SEQ ID NO: 1248800 - RNA, 24 nt, Human
gauuacaggugugagucacugugc

SEQ ID NO: 1248801 - RNA, 24 nt, Human
gcccgccgccucgcgcgcugccug

SEQ ID NO: 1248802 - RNA, 21 nt, Human
gccggccccgggccuggcccc

SEQ ID NO: 1248803 - RNA, 20 nt, Human
gccugaaaaacccuaauuau

SEQ ID NO: 1248804 - RNA, 22 nt, Human
gccuugccucucaaaccugcuc

SEQ ID NO: 1248805 - RNA, 18 nt, Human
gcggccgugggcuccugg

SEQ ID NO: 1248806 - RNA, 22 nt, Human
gcucacccuguccccuaaaccc

SEQ ID NO: 1248807 - RNA, 19 nt, Human
gcucagggcguugaugcag

SEQ ID NO: 1248808 - RNA, 23 nt, Human
gcuggucucgaacuccuggccuc

SEQ ID NO: 1248809 - RNA, 20 nt, Human
ggagguucugcuucacccua

SEQ ID NO: 1248810 - RNA, 20 nt, Human
ggcccggccggcguagguca

SEQ ID NO: 1248811 - RNA, 24 nt, Human
ggccucaagugaucugccuaccuc

SEQ ID NO: 1248812 - RNA, 24 nt, Human
ggcuggucucgaacuccuggccuc

SEQ ID NO: 1248813 - RNA, 23 nt, Human
gggauuucgccauguuggccagg

SEQ ID NO: 1248814 - RNA, 22 nt, Human
gggccuggccccgcccagucug

SEQ ID NO: 1248815 - RNA, 23 nt, Human
gguggcuccaggaugucugguug

SEQ ID NO: 1248816 - RNA, 24 nt, Human
gugaucugccuaccucaacuuccc

SEQ ID NO: 1248817 - RNA, 21 nt, Human
gugcugagauuacagguguga

SEQ ID NO: 1248818 - RNA, 22 nt, Human
uaaagacgggauuucgccaugu

SEQ ID NO: 1248819 - RNA, 19 nt, Human
uaacauuaguuaccauuuu

SEQ ID NO: 1248820 - RNA, 25 nt, Human
uaauguucuuggcccggccggcgua

SEQ ID NO: 1248821 - RNA, 24 nt, Human
uaccucaacuucccaacgugcuga

SEQ ID NO: 1248822 - RNA, 20 nt, Human
uagcugcccgccgccucgcg

SEQ ID NO: 1248823 - RNA, 24 nt, Human
uaguaaagacgggauuucgccaug

SEQ ID NO: 1248824 - RNA, 23 nt, Human
ucacugugcccagccugaaaaac

SEQ ID NO: 1248825 - RNA, 19 nt, Human
ucacugugcggcuguuucc

SEQ ID NO: 1248826 - RNA, 23 nt, Human
ucccaacgugcugagauuacagg

SEQ ID NO: 1248827 - RNA, 21 nt, Human
ucccaagucucacggcuaccc

SEQ ID NO: 1248828 - RNA, 22 nt, Human
ucccagcaaccccaugagggcu

SEQ ID NO: 1248829 - RNA, 22 nt, Human
uccccccaaacccuggacaccu

SEQ ID NO: 1248830 - RNA, 19 nt, Human
uccgggacuccucgaaggc

SEQ ID NO: 1248831 - RNA, 20 nt, Human
uccuugguaugugccaggca

SEQ ID NO: 1248832 - RNA, 20 nt, Human
ucgcaggacugaugugagcg

SEQ ID NO: 1248833 - RNA, 22 nt, Human
ucgccauguuggccaggcuggu

SEQ ID NO: 1248834 - RNA, 24 nt, Human
ucgccauguuggccaggcuggucu

SEQ ID NO: 1248835 - RNA, 18 nt, Human
ucgcugcuccucccgcca

SEQ ID NO: 1248836 - RNA, 27 nt, Human
ucucacccugcccgcugugcagcugga

SEQ ID NO: 1248837 - RNA, 23 nt, Human
ucuccagcuccagcaggcgccuc

SEQ ID NO: 1248838 - RNA, 21 nt, Human
ucucgaacuccuggccucaag

SEQ ID NO: 1248839 - RNA, 18 nt, Human
ucugguuggcggccgugg

SEQ ID NO: 1248840 - RNA, 20 nt, Human
ugaacaggcggcccugccgc

SEQ ID NO: 1248841 - RNA, 21 nt, Human
ugagauuacaggugugaguca

SEQ ID NO: 1248842 - RNA, 22 nt, Human
ugagauuacaggugugagucac

SEQ ID NO: 1248843 - RNA, 22 nt, Human
ugagauuacaggugugagucac

SEQ ID NO: 1248844 - RNA, 22 nt, Human
ugagauuacaggugugagucac

SEQ ID NO: 1248845 - RNA, 24 nt, Human
ugagauuacaggugugagucacug

SEQ ID NO: 1248846 - RNA, 18 nt, Human
ugaguccuugguaugugc

SEQ ID NO: 1248847 - RNA, 19 nt, Human
ugaguugcugguccuugga

SEQ ID NO: 1248848 - RNA, 23 nt, Human
ugaucugccuaccucaacuuccc

SEQ ID NO: 1248849 - RNA, 23 nt, Human
ugccacgcugaugggccggaccc

SEQ ID NO: 1248850 - RNA, 24 nt, Human
ugccaggcauuuauguaaucuucc

SEQ ID NO: 1248851 - RNA, 19 nt, Human
ugcccgccgccucgcgcgc

SEQ ID NO: 1248852 - RNA, 24 nt, Human
ugcugagauuacaggugugaguca

SEQ ID NO: 1248853 - RNA, 24 nt, Human
uggccaggcuggucucgaacuccu

SEQ ID NO: 1248854 - RNA, 18 nt, Human
uggccucaagugaucugc

SEQ ID NO: 1248855 - RNA, 19 nt, Human
uggccucaagugaucugcc

SEQ ID NO: 1248856 - RNA, 20 nt, Human
uggccucaagugaucugccu

SEQ ID NO: 1248857 - RNA, 24 nt, Human
ugggcgaugaggguagcuccuucc

SEQ ID NO: 1248858 - RNA, 22 nt, Human
uguccccuaaacccacucuccu

SEQ ID NO: 1248859 - RNA, 19 nt, Human
ugugcagcuggaccucagc

SEQ ID NO: 1248860 - RNA, 18 nt, Human
uguuuccucccagagagu

SEQ ID NO: 1248861 - RNA, 22 nt, Human
uuacagguggggaaugugacgc

SEQ ID NO: 1248862 - RNA, 23 nt, Human
uuacagguggggaaugugacgca

SEQ ID NO: 1248863 - RNA, 24 nt, Human
uuaguaaagacgggauuucgccau

SEQ ID NO: 1248864 - RNA, 19 nt, Human
uuauaacauuaguuaccau

SEQ ID NO: 1248865 - RNA, 21 nt, Human
uucccaacgugcugagauuac

SEQ ID NO: 1248866 - RNA, 19 nt, Human
uuggcggccgugggcuccu

SEQ ID NO: 1248867 - RNA, 24 nt, Human
uuucgccauguuggccaggcuggu

SEQ ID NO: 1248868 - RNA, 21 nt, Human
aaaaaaacaccugugcaccau

SEQ ID NO: 1248869 - RNA, 22 nt, Human
aaaaaacugucaaaaauguaaa

SEQ ID NO: 1248870 - RNA, 22 nt, Human
aaaaaguuuuagugcuuacaga

SEQ ID NO: 1248871 - RNA, 27 nt, Human
aaacaccugugcaccauuaguauguga

SEQ ID NO: 1248872 - RNA, 20 nt, Human
aaagaagaaaacacguaaca

SEQ ID NO: 1248873 - RNA, 20 nt, Human
aaccaagcuaaagaagaaaa

SEQ ID NO: 1248874 - RNA, 22 nt, Human
aagaaacagcaagcucauauac

SEQ ID NO: 1248875 - RNA, 19 nt, Human
aagaagaaaacacguaaca

SEQ ID NO: 1248876 - RNA, 19 nt, Human
acaaagacccuccaaguua

SEQ ID NO: 1248877 - RNA, 18 nt, Human
acaagacaaaggacaaga

SEQ ID NO: 1248878 - RNA, 21 nt, Human
acaccuuauaaaagaugcaac

SEQ ID NO: 1248879 - RNA, 24 nt, Human
acacguaacauuuucuuucuuaca

SEQ ID NO: 1248880 - RNA, 18 nt, Human
acccuggaaggguuccaa

SEQ ID NO: 1248881 - RNA, 19 nt, Human
acugcauuuauuaaguacu

SEQ ID NO: 1248882 - RNA, 19 nt, Human
acugccucccucugcucac

SEQ ID NO: 1248883 - RNA, 19 nt, Human
acugcugaagauccucugg

SEQ ID NO: 1248884 - RNA, 23 nt, Human
agaagauuuauagaaaaaaacac

SEQ ID NO: 1248885 - RNA, 21 nt, Human
agagcacaaaauaauacacca

SEQ ID NO: 1248886 - RNA, 18 nt, Human
aggaacccaggagcuagg

SEQ ID NO: 1248887 - RNA, 19 nt, Human
aggaacccaggagcuaggc

SEQ ID NO: 1248888 - RNA, 24 nt, Human
aggcaaauuuguaauacaaucuaa

SEQ ID NO: 1248889 - RNA, 23 nt, Human
aggccccagauguccugagcagc

SEQ ID NO: 1248890 - RNA, 18 nt, Human
aguucaaccccaacugcc

SEQ ID NO: 1248891 - RNA, 24 nt, Human
auaaaguuuuacuguugaacaaag

SEQ ID NO: 1248892 - RNA, 20 nt, Human
augaugcuuuuguaagaagu

SEQ ID NO: 1248893 - RNA, 21 nt, Human
augcuuccugcagcucaccgu

SEQ ID NO: 1248894 - RNA, 24 nt, Human
caaacaagacaaaggacaagagau

SEQ ID NO: 1248895 - RNA, 23 nt, Human
caagagaaaauguuuacccugga

SEQ ID NO: 1248896 - RNA, 19 nt, Human
caagcuaaagaagaaaaca

SEQ ID NO: 1248897 - RNA, 20 nt, Human
caagcuaaagaagaaaacac

SEQ ID NO: 1248898 - RNA, 23 nt, Human
cacaaccaagcuaaagaagaaaa

SEQ ID NO: 1248899 - RNA, 18 nt, Human
cacaugcugcuggugugu

SEQ ID NO: 1248900 - RNA, 20 nt, Human
cagaaagaacacuuucuuca

SEQ ID NO: 1248901 - RNA, 21 nt, Human
cagacaaugaccuguaagagc

SEQ ID NO: 1248902 - RNA, 23 nt, Human
cagcagauucuucuauagaauuu

SEQ ID NO: 1248903 - RNA, 20 nt, Human
caggccaagacaauggucau

SEQ ID NO: 1248904 - RNA, 23 nt, Human
caucaaagaaacagcaagcucau

SEQ ID NO: 1248905 - RNA, 24 nt, Human
caucaaagaaacagcaagcucaua

SEQ ID NO: 1248906 - RNA, 20 nt, Human
cauggcauucuccaagcucu

SEQ ID NO: 1248907 - RNA, 24 nt, Human
ccaucaaagaaacagcaagcucau

SEQ ID NO: 1248908 - RNA, 19 nt, Human
cccacaaccaagcuaaaga

SEQ ID NO: 1248909 - RNA, 20 nt, Human
cccacaaccaagcuaaagaa

SEQ ID NO: 1248910 - RNA, 23 nt, Human
ccggcaauuacgauaccuucaag

SEQ ID NO: 1248911 - RNA, 23 nt, Human
ccucugcucacaugcugcuggug

SEQ ID NO: 1248912 - RNA, 20 nt, Human
cgcagaaagaacacuuucuu

SEQ ID NO: 1248913 - RNA, 18 nt, Human
cuaguuccgaaguucaac

SEQ ID NO: 1248914 - RNA, 19 nt, Human
cuccaagcucuacuacuug

SEQ ID NO: 1248915 - RNA, 19 nt, Human
cugaaaaagguaaccccau

SEQ ID NO: 1248916 - RNA, 19 nt, Human
cugaagauccucuggggug

SEQ ID NO: 1248917 - RNA, 25 nt, Human
cugaagauccucuggggugucuugu

SEQ ID NO: 1248918 - RNA, 27 nt, Human
cuuggagacaggaacccaggagcuagg

SEQ ID NO: 1248919 - RNA, 20 nt, Human
cuuguggggcaaaacauguc

SEQ ID NO: 1248920 - RNA, 18 nt, Human
gagacaggaacccaggag

SEQ ID NO: 1248921 - RNA, 19 nt, Human
gaucaaaauguuuaacagu

SEQ ID NO: 1248922 - RNA, 18 nt, Human
ggcaauuacgauaccuuc

SEQ ID NO: 1248923 - RNA, 23 nt, Human
gugacuugcacauauacaaccuu

SEQ ID NO: 1248924 - RNA, 23 nt, Human
uaaaaaaaacugucaaaaaugua

SEQ ID NO: 1248925 - RNA, 26 nt, Human
uaaaaaaaacugucaaaaauguaaac

SEQ ID NO: 1248926 - RNA, 21 nt, Human
uaaaaauagaacaaauacugu

SEQ ID NO: 1248927 - RNA, 22 nt, Human
uaaagaaguuggauagauggcu

SEQ ID NO: 1248928 - RNA, 22 nt, Human
uaaagugguucccaaauccuga

SEQ ID NO: 1248929 - RNA, 19 nt, Human
uaaauaccauaggacaaag

SEQ ID NO: 1248930 - RNA, 24 nt, Human
uaaugaugcuuuuguaagaaguuu

SEQ ID NO: 1248931 - RNA, 24 nt, Human
uaauuccacccaguucuguucucc

SEQ ID NO: 1248932 - RNA, 22 nt, Human
uacagagcaacucaauaaucug

SEQ ID NO: 1248933 - RNA, 19 nt, Human
uacuccuaggaccaauagc

SEQ ID NO: 1248934 - RNA, 25 nt, Human
uacuuuucaaacaagacaaaggaca

SEQ ID NO: 1248935 - RNA, 23 nt, Human
uagaaacaugcuuuuucuaaucc

SEQ ID NO: 1248936 - RNA, 18 nt, Human
uagaacagacaaugaccu

SEQ ID NO: 1248937 - RNA, 18 nt, Human
uaucauaggcccuacuuc

SEQ ID NO: 1248938 - RNA, 22 nt, Human
uauuucauggcauucuccaagc

SEQ ID NO: 1248939 - RNA, 19 nt, Human
ucaaaaauguaaacaaugc

SEQ ID NO: 1248940 - RNA, 21 nt, Human
ucacucuacagaaaccacagu

SEQ ID NO: 1248941 - RNA, 19 nt, Human
ucccaaaugauugucuacc

SEQ ID NO: 1248942 - RNA, 24 nt, Human
uccuugcuguagaagugcccacaa

SEQ ID NO: 1248943 - RNA, 26 nt, Human
ucuaauccauaaauaacacuaaucau

SEQ ID NO: 1248944 - RNA, 18 nt, Human
ucuacagaaaccacagug

SEQ ID NO: 1248945 - RNA, 20 nt, Human
ucugucaggagacccggccu

SEQ ID NO: 1248946 - RNA, 19 nt, Human
ucuugugaucugucaggag

SEQ ID NO: 1248947 - RNA, 19 nt, Human
ugacccaagucauuaauaa

SEQ ID NO: 1248948 - RNA, 19 nt, Human
ugacuugcacauauacaac

SEQ ID NO: 1248949 - RNA, 21 nt, Human
ugagagccacaauaucuauga

SEQ ID NO: 1248950 - RNA, 18 nt, Human
ugauaauaugccagggac

SEQ ID NO: 1248951 - RNA, 19 nt, Human
ugcaaagaugaauaugaua

SEQ ID NO: 1248952 - RNA, 22 nt, Human
uggaauaaaccaauaauucgua

SEQ ID NO: 1248953 - RNA, 24 nt, Human
uggcauucuccaagcucuacuacu

SEQ ID NO: 1248954 - RNA, 22 nt, Human
ugggaaguaggacugcugaaga

SEQ ID NO: 1248955 - RNA, 21 nt, Human
ugguucccaaauccugauccu

SEQ ID NO: 1248956 - RNA, 21 nt, Human
uguuagaacagacaaugaccu

SEQ ID NO: 1248957 - RNA, 25 nt, Human
uguuuuguucauuuauuugguauca

SEQ ID NO: 1248958 - RNA, 19 nt, Human
uuacaggacagucagaaga

SEQ ID NO: 1248959 - RNA, 21 nt, Human
uuccaagcuucaaagcucuau

SEQ ID NO: 1248960 - RNA, 23 nt, Human
uuccacccaguucuguucuccuu

SEQ ID NO: 1248961 - RNA, 25 nt, Human
uucuccaagcucuacuacuugaaca

SEQ ID NO: 1248962 - RNA, 23 nt, Human
cagugggccucuagccgccugga

SEQ ID NO: 1248963 - RNA, 18 nt, Human
ccugguguaacugggaag

SEQ ID NO: 1248964 - RNA, 22 nt, Human
cugguaguugggaagcaguggg

SEQ ID NO: 1248965 - RNA, 21 nt, Human
gccucuagccgccuggauuug

SEQ ID NO: 1248966 - RNA, 23 nt, Human
gggccucuagccgccuggauuug

SEQ ID NO: 1248967 - RNA, 22 nt, Human
aaaucacccuaaagaaaacugg

SEQ ID NO: 1248968 - RNA, 21 nt, Human
aaauggccaauagaccaaaac

SEQ ID NO: 1248969 - RNA, 24 nt, Human
aagcaaaaauugaauagcacaagg

SEQ ID NO: 1248970 - RNA, 18 nt, Human
aagcugaagggaauuauc

SEQ ID NO: 1248971 - RNA, 28 nt, Human
aaugcaaaagacaaaaagaguuuaggga

SEQ ID NO: 1248972 - RNA, 22 nt, Human
acagcaucaacauccagcgcug

SEQ ID NO: 1248973 - RNA, 23 nt, Human
accaaaacaauccucaauugcac

SEQ ID NO: 1248974 - RNA, 24 nt, Human
acccuaaagaaaacuggacaaagg

SEQ ID NO: 1248975 - RNA, 18 nt, Human
caaaacauaggaagcaaa

SEQ ID NO: 1248976 - RNA, 21 nt, Human
caaauggccaauagaccaaaa

SEQ ID NO: 1248977 - RNA, 23 nt, Human
caaauggccaauagaccaaaaca

SEQ ID NO: 1248978 - RNA, 24 nt, Human
caaggcaaaugggcuuagaaauca

SEQ ID NO: 1248979 - RNA, 22 nt, Human
cacaucacccccaguugacaag

SEQ ID NO: 1248980 - RNA, 24 nt, Human
cacccccaguugacaagcugaagg

SEQ ID NO: 1248981 - RNA, 20 nt, Human
cauaggaagcaaaaauugaa

SEQ ID NO: 1248982 - RNA, 21 nt, Human
caucaacauccagcgcuggag

SEQ ID NO: 1248983 - RNA, 22 nt, Human
ccacaucacccccaguugacaa

SEQ ID NO: 1248984 - RNA, 22 nt, Human
ccucguacuugagccuuaaggc

SEQ ID NO: 1248985 - RNA, 18 nt, Human
cucccugccacaucaccc

SEQ ID NO: 1248986 - RNA, 18 nt, Human
cuccucucucucuuucuc

SEQ ID NO: 1248987 - RNA, 19 nt, Human
cuccucucucucuuucucc

SEQ ID NO: 1248988 - RNA, 23 nt, Human
gacaaaaagaguuuagggaaaaa

SEQ ID NO: 1248989 - RNA, 18 nt, Human
gagaaaagccaaauggcc

SEQ ID NO: 1248990 - RNA, 19 nt, Human
gauuacugugcccagccca

SEQ ID NO: 1248991 - RNA, 24 nt, Human
gcaaaagacaaaaagaguuuaggg

SEQ ID NO: 1248992 - RNA, 23 nt, Human
gcuauuuuuuuuuuuauuuuuag

SEQ ID NO: 1248993 - RNA, 19 nt, Human
gucucucucucuccucucu

SEQ ID NO: 1248994 - RNA, 20 nt, Human
uaaaaggcccaacgcacaag

SEQ ID NO: 1248995 - RNA, 23 nt, Human
uaacugacagacuguuaauaucc

SEQ ID NO: 1248996 - RNA, 21 nt, Human
uagaccaaaacaauccucaau

SEQ ID NO: 1248997 - RNA, 19 nt, Human
uagcacaaggaaaaccugc

SEQ ID NO: 1248998 - RNA, 20 nt, Human
uagcacaaggaaaaccugcc

SEQ ID NO: 1248999 - RNA, 24 nt, Human
uaguagagaugggugcugggauua

SEQ ID NO: 1249000 - RNA, 28 nt, Human
uaguagagaugggugcugggauuacugu

SEQ ID NO: 1249001 - RNA, 23 nt, Human
uccucaauugcacaaaguaguca

SEQ ID NO: 1249002 - RNA, 24 nt, Human
uccucucucucuuucucccugcca

SEQ ID NO: 1249003 - RNA, 30 nt, Human
ucucucucucuccucucucucuuucucccc

SEQ ID NO: 1249004 - RNA, 19 nt, Human
ugagccuuaaggcaaguuu

SEQ ID NO: 1249005 - RNA, 22 nt, Human
ugcaaaagacaaaaagaguuua

SEQ ID NO: 1249006 - RNA, 27 nt, Human
ugcaaaagagaaaagccaaauggccaa

SEQ ID NO: 1249007 - RNA, 19 nt, Human
ugggggaaggaauuuggcu

SEQ ID NO: 1249008 - RNA, 18 nt, Human
uuaguagagaugggugcu

SEQ ID NO: 1249009 - RNA, 22 nt, Human
uuuuauuuuuaguagagauggg

SEQ ID NO: 1249010 - RNA, 20 nt, Human
uuuuuaguagagaugggugc

SEQ ID NO: 1249011 - RNA, 24 nt, Human
uuuuuuuuauuuuuaguagagaug

SEQ ID NO: 1249012 - RNA, 19 nt, Human
aaaauacuugcaacauacc

SEQ ID NO: 1249013 - RNA, 20 nt, Human
aaacaaaacaaaacaacaga

SEQ ID NO: 1249014 - RNA, 21 nt, Human
aaacacaagauuuuaagccug

SEQ ID NO: 1249015 - RNA, 22 nt, Human
aaccaucucauuucccagagca

SEQ ID NO: 1249016 - RNA, 24 nt, Human
aagcaggaggaugucuugagccca

SEQ ID NO: 1249017 - RNA, 19 nt, Human
aaguggaacaauccugaga

SEQ ID NO: 1249018 - RNA, 20 nt, Human
acagagcaagacccugucuc

SEQ ID NO: 1249019 - RNA, 25 nt, Human
acagagcaagacccugucucuaaaa

SEQ ID NO: 1249020 - RNA, 24 nt, Human
acccaguggcugaccucacaacgu

SEQ ID NO: 1249021 - RNA, 23 nt, Human
acccugucucuaaaaacaaaaca

SEQ ID NO: 1249022 - RNA, 22 nt, Human
acuccagucugggugacagagc

SEQ ID NO: 1249023 - RNA, 18 nt, Human
acuugcaacauaccgaaa

SEQ ID NO: 1249024 - RNA, 21 nt, Human
agauuugauuuuuagaaaguu

SEQ ID NO: 1249025 - RNA, 23 nt, Human
agccugggcaacauagcaagacc

SEQ ID NO: 1249026 - RNA, 24 nt, Human
agccugggcaacauagcaagaccu

SEQ ID NO: 1249027 - RNA, 18 nt, Human
agcuaggugugguggugu

SEQ ID NO: 1249028 - RNA, 23 nt, Human
agcuaggugugguggugugcacc

SEQ ID NO: 1249029 - RNA, 23 nt, Human
aggaguucaagaccagccugggc

SEQ ID NO: 1249030 - RNA, 23 nt, Human
aggcaggaggauugcaugagccc

SEQ ID NO: 1249031 - RNA, 24 nt, Human
aggcaggaggauugcaugagccca

SEQ ID NO: 1249032 - RNA, 24 nt, Human
aggcugaagcaggaggaugucuug

SEQ ID NO: 1249033 - RNA, 18 nt, Human
agggacgggaagccccgu

SEQ ID NO: 1249034 - RNA, 18 nt, Human
agggccuggaggguccgg

SEQ ID NO: 1249035 - RNA, 18 nt, Human
augcauagauaggugcua

SEQ ID NO: 1249036 - RNA, 21 nt, Human
augcauuuuuaaaugcauaga

SEQ ID NO: 1249037 - RNA, 23 nt, Human
caaggcccagccugcuagacauc

SEQ ID NO: 1249038 - RNA, 20 nt, Human
caccuauggucccaacucuc

SEQ ID NO: 1249039 - RNA, 26 nt, Human
caccucuaauccuagcgcuuugggag

SEQ ID NO: 1249040 - RNA, 24 nt, Human
cagagcaagacccugucucuaaaa

SEQ ID NO: 1249041 - RNA, 23 nt, Human
cauagcaagaccuccccaaaaaa

SEQ ID NO: 1249042 - RNA, 24 nt, Human
cauggccaaaccaucucauuuccc

SEQ ID NO: 1249043 - RNA, 19 nt, Human
cauuguacuccagucuggg

SEQ ID NO: 1249044 - RNA, 22 nt, Human
cauuguacuccagucuggguga

SEQ ID NO: 1249045 - RNA, 23 nt, Human
cauuguacuccagucugggugac

SEQ ID NO: 1249046 - RNA, 27 nt, Human
cccgacccgggcccggaagaccgcgug

SEQ ID NO: 1249047 - RNA, 18 nt, Human
cccuagccuggcccgagg

SEQ ID NO: 1249048 - RNA, 21 nt, Human
ccuauggucccaacucucugg

SEQ ID NO: 1249049 - RNA, 24 nt, Human
ccuggcccgaggcuggucgggggu

SEQ ID NO: 1249050 - RNA, 19 nt, Human
cggcucacaccucuaaucc

SEQ ID NO: 1249051 - RNA, 21 nt, Human
cuaaauguucagugcgccccc

SEQ ID NO: 1249052 - RNA, 19 nt, Human
cuagcgcuuugggaggcca

SEQ ID NO: 1249053 - RNA, 24 nt, Human
cucacaccucuaauccuagcgcuu

SEQ ID NO: 1249054 - RNA, 19 nt, Human
cugggugacagagcaagac

SEQ ID NO: 1249055 - RNA, 23 nt, Human
gaaucucuaaaguggaacaaucc

SEQ ID NO: 1249056 - RNA, 19 nt, Human
gacccugucucuaaaaaca

SEQ ID NO: 1249057 - RNA, 21 nt, Human
gacccugucucuaaaaacaaa

SEQ ID NO: 1249058 - RNA, 24 nt, Human
gagcaagacccugucucuaaaaac

SEQ ID NO: 1249059 - RNA, 18 nt, Human
gcaaguuaaaaaggcaga

SEQ ID NO: 1249060 - RNA, 19 nt, Human
gcaaguuaaaaaggcagag

SEQ ID NO: 1249061 - RNA, 19 nt, Human
gcagggugcagcggcucac

SEQ ID NO: 1249062 - RNA, 24 nt, Human
gcaugagcccaggaguucaagacc

SEQ ID NO: 1249063 - RNA, 23 nt, Human
gccacgggcggagguggcgggcc

SEQ ID NO: 1249064 - RNA, 22 nt, Human
gcccaggaguucaagaccagcc

SEQ ID NO: 1249065 - RNA, 20 nt, Human
gccugggaugcuucaaauuu

SEQ ID NO: 1249066 - RNA, 29 nt, Human
ggaaaaaauacuugcaacauaccgaaaag

SEQ ID NO: 1249067 - RNA, 23 nt, Human
ggaagccccgucuacggugaccc

SEQ ID NO: 1249068 - RNA, 24 nt, Human
ggccacgggcggagguggcgggcc

SEQ ID NO: 1249069 - RNA, 20 nt, Human
ggccccaggccccgcccggc

SEQ ID NO: 1249070 - RNA, 18 nt, Human
ggcccggaagaccgcgug

SEQ ID NO: 1249071 - RNA, 20 nt, Human
ggcucgggccuggggcucuc

SEQ ID NO: 1249072 - RNA, 19 nt, Human
gggccccaggccccgcccg

SEQ ID NO: 1249073 - RNA, 18 nt, Human
gggccuggaggguccggg

SEQ ID NO: 1249074 - RNA, 18 nt, Human
gggguggggcgcgagggc

SEQ ID NO: 1249075 - RNA, 18 nt, Human
ggguggggcgcgagggcc

SEQ ID NO: 1249076 - RNA, 20 nt, Human
gguccgggguccgaggccgc

SEQ ID NO: 1249077 - RNA, 20 nt, Human
ggugcagcggcucacaccuc

SEQ ID NO: 1249078 - RNA, 24 nt, Human
guacuccagucugggugacagagc

SEQ ID NO: 1249079 - RNA, 24 nt, Human
gucauuguacuccagucuggguga

SEQ ID NO: 1249080 - RNA, 18 nt, Human
guggcucgggccuggggc

SEQ ID NO: 1249081 - RNA, 24 nt, Human
uaaaaaggcagagaauuuaggcca

SEQ ID NO: 1249082 - RNA, 18 nt, Human
uaaaguggaacaauccug

SEQ ID NO: 1249083 - RNA, 20 nt, Human
uaccgaaaaucucucucuau

SEQ ID NO: 1249084 - RNA, 22 nt, Human
uacuccagucugggugacagag

SEQ ID NO: 1249085 - RNA, 22 nt, Human
uagcaguagcuucucaucccuc

SEQ ID NO: 1249086 - RNA, 24 nt, Human
uagcgcuuugggaggccaaggcag

SEQ ID NO: 1249087 - RNA, 25 nt, Human
uagcgcuuugggaggccaaggcagg

SEQ ID NO: 1249088 - RNA, 21 nt, Human
uagcuucucaucccuccucag

SEQ ID NO: 1249089 - RNA, 22 nt, Human
uauaaacugucuuucugaaaca

SEQ ID NO: 1249090 - RNA, 20 nt, Human
uaugaguguaugugugugua

SEQ ID NO: 1249091 - RNA, 26 nt, Human
uauguaugaguguauguguguguaua

SEQ ID NO: 1249092 - RNA, 23 nt, Human
uauuggaaagucucaggucaaac

SEQ ID NO: 1249093 - RNA, 19 nt, Human
ucagaguaggcuugcaaag

SEQ ID NO: 1249094 - RNA, 18 nt, Human
ucaugguauaaacugucu

SEQ ID NO: 1249095 - RNA, 24 nt, Human
ucauuguacuccagucugggugac

SEQ ID NO: 1249096 - RNA, 24 nt, Human
uccagucugggugacagagcaaga

SEQ ID NO: 1249097 - RNA, 19 nt, Human
ucccagagcagcagauagc

SEQ ID NO: 1249098 - RNA, 26 nt, Human
ucuaaaaacaaaacaaaacaacagau

SEQ ID NO: 1249099 - RNA, 21 nt, Human
ucuccggccacgggcggaggu

SEQ ID NO: 1249100 - RNA, 23 nt, Human
ucucuaaaaacaaaacaaaacaa

SEQ ID NO: 1249101 - RNA, 18 nt, Human
ucucuggaggcugaagcc

SEQ ID NO: 1249102 - RNA, 22 nt, Human
ugacagagcaagacccugucuc

SEQ ID NO: 1249103 - RNA, 22 nt, Human
ugacccaguggcugaccucaca

SEQ ID NO: 1249104 - RNA, 18 nt, Human
ugaccucacaacguggua

SEQ ID NO: 1249105 - RNA, 23 nt, Human
ugagcccaggaguucaagaccag

SEQ ID NO: 1249106 - RNA, 22 nt, Human
ugagcccaguaguuaaaggcug

SEQ ID NO: 1249107 - RNA, 22 nt, Human
ugcaaagcaaguuaaaaaggca

SEQ ID NO: 1249108 - RNA, 18 nt, Human
uggaaugccaucaugaua

SEQ ID NO: 1249109 - RNA, 19 nt, Human
uggccaaaccaucucauuu

SEQ ID NO: 1249110 - RNA, 26 nt, Human
uggcgggccccaggccccgcccggca

SEQ ID NO: 1249111 - RNA, 23 nt, Human
uggcugaccucacaacgugguau

SEQ ID NO: 1249112 - RNA, 21 nt, Human
uggggcgcgagggccuggagg

SEQ ID NO: 1249113 - RNA, 21 nt, Human
uguaugaguguaugugugugu

SEQ ID NO: 1249114 - RNA, 23 nt, Human
ugugcaagcuuugcauugacuac

SEQ ID NO: 1249115 - RNA, 20 nt, Human
uguguguguauaaauuaaca

SEQ ID NO: 1249116 - RNA, 23 nt, Human
uguguguguauaaauuaacaauu

SEQ ID NO: 1249117 - RNA, 24 nt, Human
uuaaugcauuuuuaaaugcauaga

SEQ ID NO: 1249118 - RNA, 19 nt, Human
uuagcuaggugugguggug

SEQ ID NO: 1249119 - RNA, 22 nt, Human
uuagcuaggugugguggugugc

SEQ ID NO: 1249120 - RNA, 23 nt, Human
uucaauuaccuguugcuuugaga

SEQ ID NO: 1249121 - RNA, 20 nt, Human
uucauuuagauucugauaag

SEQ ID NO: 1249122 - RNA, 26 nt, Human
aaaaagaaacauacagcuguauugga

SEQ ID NO: 1249123 - RNA, 20 nt, Human
aaaagaaaaagaaacauaca

SEQ ID NO: 1249124 - RNA, 23 nt, Human
aaagaaacauacagcuguauugg

SEQ ID NO: 1249125 - RNA, 23 nt, Human
aaccaaucagcaaaaauaugugc

SEQ ID NO: 1249126 - RNA, 24 nt, Human
aaggcggggguaguggggcggggu

SEQ ID NO: 1249127 - RNA, 19 nt, Human
agaaaaaaaccacccucau

SEQ ID NO: 1249128 - RNA, 22 nt, Human
agaaaaagaaacauacagcugu

SEQ ID NO: 1249129 - RNA, 23 nt, Human
agaaaagaaaaagaaacauacag

SEQ ID NO: 1249130 - RNA, 20 nt, Human
agaacggcuuggggacagga

SEQ ID NO: 1249131 - RNA, 23 nt, Human
caccaaauuagaaaagaaaaaga

SEQ ID NO: 1249132 - RNA, 21 nt, Human
cacuccguuacgcuccugacc

SEQ ID NO: 1249133 - RNA, 22 nt, Human
ccaaauuagaaaagaaaaagaa

SEQ ID NO: 1249134 - RNA, 21 nt, Human
cgcagccgcgcacggguuucc

SEQ ID NO: 1249135 - RNA, 24 nt, Human
cuuaaaacacuucuuuccaacaca

SEQ ID NO: 1249136 - RNA, 18 nt, Human
gcgcagccgcgcacgggu

SEQ ID NO: 1249137 - RNA, 20 nt, Human
ggagccguccguuugcccgc

SEQ ID NO: 1249138 - RNA, 18 nt, Human
gucuagaacggcuugggg

SEQ ID NO: 1249139 - RNA, 27 nt, Human
gugccaccaaauuagaaaagaaaaaga

SEQ ID NO: 1249140 - RNA, 18 nt, Human
uaaagaaaaaaaccaccc

SEQ ID NO: 1249141 - RNA, 18 nt, Human
uaaaggagccggcggcug

SEQ ID NO: 1249142 - RNA, 24 nt, Human
uagaaaagaaaaagaaacauacag

SEQ ID NO: 1249143 - RNA, 25 nt, Human
ugacaacacacguccuauacaaaga

SEQ ID NO: 1249144 - RNA, 22 nt, Human
ugugguuauaccagugccacca

SEQ ID NO: 1249145 - RNA, 23 nt, Human
aaaacaaagugaagacucagccc

SEQ ID NO: 1249146 - RNA, 24 nt, Human
aaaagucaggaccccagcacccac

SEQ ID NO: 1249147 - RNA, 20 nt, Human
aaaccgaaacagagaacaaa

SEQ ID NO: 1249148 - RNA, 18 nt, Human
aaagaacagcuuauucca

SEQ ID NO: 1249149 - RNA, 18 nt, Human
aaccccacucuaccccuc

SEQ ID NO: 1249150 - RNA, 18 nt, Human
aaucacugagaaagacaa

SEQ ID NO: 1249151 - RNA, 18 nt, Human
accccacucuaccccucg

SEQ ID NO: 1249152 - RNA, 20 nt, Human
accgaaacagagaacaauaa

SEQ ID NO: 1249153 - RNA, 26 nt, Human
acucagccccagccuucacugcuggc

SEQ ID NO: 1249154 - RNA, 19 nt, Human
agaaagacaaauagaacug

SEQ ID NO: 1249155 - RNA, 23 nt, Human
agcaaaucucuccugcuaaaacc

SEQ ID NO: 1249156 - RNA, 18 nt, Human
agccauggcucuagcccu

SEQ ID NO: 1249157 - RNA, 21 nt, Human
agguucucccuaaccccacuc

SEQ ID NO: 1249158 - RNA, 19 nt, Human
auaaaaugauauacucucc

SEQ ID NO: 1249159 - RNA, 23 nt, Human
augaaacagcaaaucucuccugc

SEQ ID NO: 1249160 - RNA, 21 nt, Human
caaccacacuggcacuguccc

SEQ ID NO: 1249161 - RNA, 21 nt, Human
caccagauacuccugcugcac

SEQ ID NO: 1249162 - RNA, 25 nt, Human
cacuagccugagauugcaaccacac

SEQ ID NO: 1249163 - RNA, 22 nt, Human
cacuggcacugucccagguacu

SEQ ID NO: 1249164 - RNA, 21 nt, Human
cacuuuggccacaaacuccgg

SEQ ID NO: 1249165 - RNA, 24 nt, Human
cagcaaaacaaagugaagacucag

SEQ ID NO: 1249166 - RNA, 28 nt, Human
cagcaaaucucuccugcuaaaaccgaaa

SEQ ID NO: 1249167 - RNA, 19 nt, Human
cagccccagccuucacugc

SEQ ID NO: 1249168 - RNA, 21 nt, Human
cagcugccaucucgggcacgg

SEQ ID NO: 1249169 - RNA, 25 nt, Human
ccccagcacccacugcuguggggcc

SEQ ID NO: 1249170 - RNA, 22 nt, Human
cccccacaagaauaccuagagc

SEQ ID NO: 1249171 - RNA, 18 nt, Human
cccugacacuagccugag

SEQ ID NO: 1249172 - RNA, 25 nt, Human
ccgaaacagagaacaauaaaacaac

SEQ ID NO: 1249173 - RNA, 24 nt, Human
cgaaacagagaacaauaaaacauu

SEQ ID NO: 1249174 - RNA, 19 nt, Human
cuccugcugcacacuagcu

SEQ ID NO: 1249175 - RNA, 21 nt, Human
cugacacuagccugagauugc

SEQ ID NO: 1249176 - RNA, 25 nt, Human
cuggcacuugcauuggugcugguga

SEQ ID NO: 1249177 - RNA, 21 nt, Human
cuuuugaucgccaccgucuuc

SEQ ID NO: 1249178 - RNA, 21 nt, Human
gaagacucagccccagccuuc

SEQ ID NO: 1249179 - RNA, 23 nt, Human
gagaaagacaaauagaacuggaa

SEQ ID NO: 1249180 - RNA, 26 nt, Human
gcaaaacaaagugaagacucagcccc

SEQ ID NO: 1249181 - RNA, 20 nt, Human
gccugagauugcaaccacac

SEQ ID NO: 1249182 - RNA, 18 nt, Human
gggggagggggggaauga

SEQ ID NO: 1249183 - RNA, 19 nt, Human
uaaaaccgaaacagagaac

SEQ ID NO: 1249184 - RNA, 19 nt, Human
uaaaaugauauacucuccc

SEQ ID NO: 1249185 - RNA, 21 nt, Human
uaaggcaaacaaaacuuugca

SEQ ID NO: 1249186 - RNA, 21 nt, Human
uaccuagagcgugggauugcu

SEQ ID NO: 1249187 - RNA, 23 nt, Human
uagaacuggaacacagauaccau

SEQ ID NO: 1249188 - RNA, 18 nt, Human
uagauguucaacuuaagu

SEQ ID NO: 1249189 - RNA, 23 nt, Human
uaggcaaauacaagcagagagcg

SEQ ID NO: 1249190 - RNA, 19 nt, Human
uauauuugggggagggggg

SEQ ID NO: 1249191 - RNA, 19 nt, Human
uauggaacaaaggauuuug

SEQ ID NO: 1249192 - RNA, 23 nt, Human
uccuuugagagcccccacaagaa

SEQ ID NO: 1249193 - RNA, 22 nt, Human
ucucccuaaccccacucuaccc

SEQ ID NO: 1249194 - RNA, 24 nt, Human
ugaaaaaaaugcuuagguauggcg

SEQ ID NO: 1249195 - RNA, 20 nt, Human
ugagaaagacaaauagaacu

SEQ ID NO: 1249196 - RNA, 24 nt, Human
ugagaaagacaaauagaacuggaa

SEQ ID NO: 1249197 - RNA, 22 nt, Human
ugcaaccacacuggcacugucc

SEQ ID NO: 1249198 - RNA, 26 nt, Human
ugcaccagauacuccugcugcacacu

SEQ ID NO: 1249199 - RNA, 19 nt, Human
uggcacugucccagguacu

SEQ ID NO: 1249200 - RNA, 22 nt, Human
ugggauugcugugggacaccua

SEQ ID NO: 1249201 - RNA, 21 nt, Human
ugggugucauucacuuuggcc

SEQ ID NO: 1249202 - RNA, 26 nt, Human
ugucuuguuuccuuugagagccccca

SEQ ID NO: 1249203 - RNA, 21 nt, Human
uucuggagaacuaggcaaaua

SEQ ID NO: 1249204 - RNA, 21 nt, Human
uuggugcuggugcugaugcuu

SEQ ID NO: 1249205 - RNA, 20 nt, Human
uuugggggagggggggaaug

SEQ ID NO: 1249206 - RNA, 19 nt, Human
caccaauggugguggaacc

SEQ ID NO: 1249207 - RNA, 19 nt, Human
auguacacacaaguuugua

SEQ ID NO: 1249208 - RNA, 21 nt, Human
gcugccuccgcuacgagccug

SEQ ID NO: 1249209 - RNA, 24 nt, Human
ggaggguaggauccguagaugagg

SEQ ID NO: 1249210 - RNA, 20 nt, Human
gggucagcaggcgaccggcc

SEQ ID NO: 1249211 - RNA, 18 nt, Human
uacauuuguuuccacaca

SEQ ID NO: 1249212 - RNA, 18 nt, Human
uccacacaugugccaaau

SEQ ID NO: 1249213 - RNA, 22 nt, Human
ugaaugcuugcaagagcgggga

SEQ ID NO: 1249214 - RNA, 24 nt, Human
ugcaagagcggggaggguaggauc

SEQ ID NO: 1249215 - RNA, 25 nt, Human
uuccacacaugugccaaauuuuacc

SEQ ID NO: 1249216 - RNA, 21 nt, Human
uuguauuuuuuagagcaaaac

SEQ ID NO: 1249217 - RNA, 23 nt, Human
uuuuuagagcaaaacaacaguua

SEQ ID NO: 1249218 - RNA, 20 nt, Human
caaaagacauuguacaccau

SEQ ID NO: 1249219 - RNA, 20 nt, Human
caaaguuugugcaaaagaca

SEQ ID NO: 1249220 - RNA, 23 nt, Human
uaaaaauaaaacugaauacucau

SEQ ID NO: 1249221 - RNA, 23 nt, Human
uaaaaucugaauacagauacugu

SEQ ID NO: 1249222 - RNA, 19 nt, Human
uaacagguuucuuuacucc

SEQ ID NO: 1249223 - RNA, 21 nt, Human
uacaugauguuuauaaugugg

SEQ ID NO: 1249224 - RNA, 21 nt, Human
ucaucaaaggacuuuggugcc

SEQ ID NO: 1249225 - RNA, 21 nt, Human
uuaaaacuauucugugcuaca

SEQ ID NO: 1249226 - RNA, 18 nt, Human
aggggcccggccaggagg

SEQ ID NO: 1249227 - RNA, 18 nt, Human
aucuccgucaaacgucuc

SEQ ID NO: 1249228 - RNA, 25 nt, Human
cuccagcgacgcgccgcgggguacc

SEQ ID NO: 1249229 - RNA, 21 nt, Human
ucugcacgaugaacuccggga

SEQ ID NO: 1249230 - RNA, 21 nt, Human
ugccaggcacacuuaagcccu

SEQ ID NO: 1249231 - RNA, 18 nt, Human
aaauacaccucucucaca

SEQ ID NO: 1249232 - RNA, 25 nt, Human
aagaagacgugacaacaccagaaac

SEQ ID NO: 1249233 - RNA, 20 nt, Human
aagacuggggaggggugugg

SEQ ID NO: 1249234 - RNA, 19 nt, Human
aagagguggggaggggagg

SEQ ID NO: 1249235 - RNA, 19 nt, Human
acaagaacaucucucuggc

SEQ ID NO: 1249236 - RNA, 24 nt, Human
accagaaacaagaacaucucucug

SEQ ID NO: 1249237 - RNA, 18 nt, Human
accagcaggcugacaggc

SEQ ID NO: 1249238 - RNA, 20 nt, Human
accagcaggcugacaggccc

SEQ ID NO: 1249239 - RNA, 19 nt, Human
accgccuacaaacgucaau

SEQ ID NO: 1249240 - RNA, 20 nt, Human
accgcggccagggccagggc

SEQ ID NO: 1249241 - RNA, 25 nt, Human
acgcaguuccuccucauccccggag

SEQ ID NO: 1249242 - RNA, 25 nt, Human
agaaaacaagaagacgugacaacac

SEQ ID NO: 1249243 - RNA, 20 nt, Human
agaccccaucacgcagcaag

SEQ ID NO: 1249244 - RNA, 21 nt, Human
agagaggccagcaaggucagg

SEQ ID NO: 1249245 - RNA, 18 nt, Human
agagguggggaggggagg

SEQ ID NO: 1249246 - RNA, 23 nt, Human
agauccccagauucccuacccuu

SEQ ID NO: 1249247 - RNA, 23 nt, Human
agcagaagccacggggggugggc

SEQ ID NO: 1249248 - RNA, 19 nt, Human
agcccugcuccuccccagu

SEQ ID NO: 1249249 - RNA, 22 nt, Human
agccugugcugaccaguacaca

SEQ ID NO: 1249250 - RNA, 22 nt, Human
aggaggguacgugguagguggg

SEQ ID NO: 1249251 - RNA, 21 nt, Human
aggcaggcggacagcuucauu

SEQ ID NO: 1249252 - RNA, 21 nt, Human
aggccagcaaggucagggguu

SEQ ID NO: 1249253 - RNA, 24 nt, Human
aggcccuucacgcugccucugccc

SEQ ID NO: 1249254 - RNA, 24 nt, Human
aggcugcccccagagaucuguugg

SEQ ID NO: 1249255 - RNA, 19 nt, Human
agggauccuggggcccauc

SEQ ID NO: 1249256 - RNA, 23 nt, Human
aggggagagaagagguggggagg

SEQ ID NO: 1249257 - RNA, 23 nt, Human
agguagagaagcagcaggcgggg

SEQ ID NO: 1249258 - RNA, 21 nt, Human
aguccgagcucagguaguuuc

SEQ ID NO: 1249259 - RNA, 20 nt, Human
auaaagugcauggagacccc

SEQ ID NO: 1249260 - RNA, 20 nt, Human
auccuggggcccaucucucc

SEQ ID NO: 1249261 - RNA, 18 nt, Human
caaagaacuuuccuccac

SEQ ID NO: 1249262 - RNA, 22 nt, Human
caaaucccccccuccccgaagc

SEQ ID NO: 1249263 - RNA, 21 nt, Human
caacaccagaaacaagaacau

SEQ ID NO: 1249264 - RNA, 20 nt, Human
caacaccagaaacaagaacc

SEQ ID NO: 1249265 - RNA, 25 nt, Human
caagaagacgugacaacaccagaaa

SEQ ID NO: 1249266 - RNA, 21 nt, Human
caccagaaacaagaacaucuc

SEQ ID NO: 1249267 - RNA, 18 nt, Human
caccccccacuguaucac

SEQ ID NO: 1249268 - RNA, 21 nt, Human
caccuccgccccccgccgcga

SEQ ID NO: 1249269 - RNA, 21 nt, Human
cacgaggcagccacuguccag

SEQ ID NO: 1249270 - RNA, 24 nt, Human
cacgaggcagccacuguccagccu

SEQ ID NO: 1249271 - RNA, 19 nt, Human
cacuccucuucuccuccag

SEQ ID NO: 1249272 - RNA, 19 nt, Human
cacucuugucccacagagg

SEQ ID NO: 1249273 - RNA, 22 nt, Human
cacugggcacccccaccccugu

SEQ ID NO: 1249274 - RNA, 22 nt, Human
cagagguggucaaggguggaca

SEQ ID NO: 1249275 - RNA, 18 nt, Human
cagcaaagaacuuuccuc

SEQ ID NO: 1249276 - RNA, 21 nt, Human
cagcaaagaacuuuccuccac

SEQ ID NO: 1249277 - RNA, 25 nt, Human
cagcagaauucccuccuucugguuu

SEQ ID NO: 1249278 - RNA, 19 nt, Human
cagcuccgacacacauuuc

SEQ ID NO: 1249279 - RNA, 24 nt, Human
cagggauccuggggcccaucucuc

SEQ ID NO: 1249280 - RNA, 24 nt, Human
cagggcugggccuucgugcccggg

SEQ ID NO: 1249281 - RNA, 19 nt, Human
cagggguucucaggagacu

SEQ ID NO: 1249282 - RNA, 21 nt, Human
cagugaaucacacacagaaac

SEQ ID NO: 1249283 - RNA, 21 nt, Human
ccaagccaggacucgaucacu

SEQ ID NO: 1249284 - RNA, 24 nt, Human
ccaccaaacugggagguuugugcc

SEQ ID NO: 1249285 - RNA, 19 nt, Human
ccagcaaggucagggguuc

SEQ ID NO: 1249286 - RNA, 21 nt, Human
cccaccaaacugggagguuug

SEQ ID NO: 1249287 - RNA, 18 nt, Human
ccccacuugcccaccaaa

SEQ ID NO: 1249288 - RNA, 18 nt, Human
ccccagagaucuguuggg

SEQ ID NO: 1249289 - RNA, 19 nt, Human
ccccagagaucuguugggg

SEQ ID NO: 1249290 - RNA, 26 nt, Human
ccccagagaucuguuggggggaccag

SEQ ID NO: 1249291 - RNA, 21 nt, Human
ccccagagguggucaaggggg

SEQ ID NO: 1249292 - RNA, 21 nt, Human
ccccaucacgcagcaagggcu

SEQ ID NO: 1249293 - RNA, 24 nt, Human
cccccagagguggucaagggugga

SEQ ID NO: 1249294 - RNA, 23 nt, Human
ccccccgccgcgauccagcuguc

SEQ ID NO: 1249295 - RNA, 19 nt, Human
cccgggccgccccaccucc

SEQ ID NO: 1249296 - RNA, 21 nt, Human
cccgggcugagaccgcggcca

SEQ ID NO: 1249297 - RNA, 25 nt, Human
cccgggcugagaccgcggccagggc

SEQ ID NO: 1249298 - RNA, 19 nt, Human
cccuacccuugggccccuc

SEQ ID NO: 1249299 - RNA, 21 nt, Human
cccucuucacuuuccccuccc

SEQ ID NO: 1249300 - RNA, 20 nt, Human
cccuugcauggggagggcuc

SEQ ID NO: 1249301 - RNA, 18 nt, Human
ccgcggccagggccaggg

SEQ ID NO: 1249302 - RNA, 19 nt, Human
ccgcggccagggccagggc

SEQ ID NO: 1249303 - RNA, 21 nt, Human
ccuagaaaacagacugcaaau

SEQ ID NO: 1249304 - RNA, 21 nt, Human
ccucacuccucuucuccucca

SEQ ID NO: 1249305 - RNA, 22 nt, Human
ccucacuccucuucuccuccag

SEQ ID NO: 1249306 - RNA, 23 nt, Human
ccuccacccuuccuggcuggccc

SEQ ID NO: 1249307 - RNA, 21 nt, Human
ccucuacuaggaaggcccuuc

SEQ ID NO: 1249308 - RNA, 21 nt, Human
ccugcagcuccgacacacauu

SEQ ID NO: 1249309 - RNA, 24 nt, Human
ccuugggccccucucccuuggugc

SEQ ID NO: 1249310 - RNA, 19 nt, Human
cgccccaccuccgcccccc

SEQ ID NO: 1249311 - RNA, 21 nt, Human
cgcggccagggccagggcugg

SEQ ID NO: 1249312 - RNA, 20 nt, Human
cggggucccgggcugagacc

SEQ ID NO: 1249313 - RNA, 18 nt, Human
cuagaagcuccaccgccu

SEQ ID NO: 1249314 - RNA, 22 nt, Human
cuaucugcaugucaagggcaaa

SEQ ID NO: 1249315 - RNA, 28 nt, Human
cucacagugcugcuagccgauuucaguu

SEQ ID NO: 1249316 - RNA, 19 nt, Human
cucagaccuucccucccaa

SEQ ID NO: 1249317 - RNA, 18 nt, Human
cuccagcucuguaucacu

SEQ ID NO: 1249318 - RNA, 24 nt, Human
cuccugucugccaucucagcuguc

SEQ ID NO: 1249319 - RNA, 19 nt, Human
cucuaggccaauauagcca

SEQ ID NO: 1249320 - RNA, 21 nt, Human
cugagaccgcggccagggcca

SEQ ID NO: 1249321 - RNA, 19 nt, Human
cugcaaauaaauaaagugc

SEQ ID NO: 1249322 - RNA, 22 nt, Human
cugcugcaguuuucaaucccag

SEQ ID NO: 1249323 - RNA, 24 nt, Human
cuggcuggcccaggaagaggcugg

SEQ ID NO: 1249324 - RNA, 20 nt, Human
cuguaucacucuugucccac

SEQ ID NO: 1249325 - RNA, 19 nt, Human
cugucccuggagcuggcca

SEQ ID NO: 1249326 - RNA, 22 nt, Human
cugugaucuucuguacugcucc

SEQ ID NO: 1249327 - RNA, 18 nt, Human
gacuugggacaaggaggc

SEQ ID NO: 1249328 - RNA, 21 nt, Human
gagaaaacaagaagacgugac

SEQ ID NO: 1249329 - RNA, 18 nt, Human
gagaagacuggggagggg

SEQ ID NO: 1249330 - RNA, 22 nt, Human
gagaagagguggggaggggagg

SEQ ID NO: 1249331 - RNA, 23 nt, Human
gagagaagagguggggaggggag

SEQ ID NO: 1249332 - RNA, 19 nt, Human
gagguuugugccacuucac

SEQ ID NO: 1249333 - RNA, 25 nt, Human
gcaaaucccccccuccccgaagccu

SEQ ID NO: 1249334 - RNA, 21 nt, Human
gcaggcggacagcuucauuca

SEQ ID NO: 1249335 - RNA, 24 nt, Human
gccagccugugcugaccaguacac

SEQ ID NO: 1249336 - RNA, 20 nt, Human
gccccacuugcccaccaaac

SEQ ID NO: 1249337 - RNA, 18 nt, Human
gcccccagagaucuguug

SEQ ID NO: 1249338 - RNA, 24 nt, Human
gcccuaggagcccuaugcuucccu

SEQ ID NO: 1249339 - RNA, 21 nt, Human
gcuccaccgccuagaaaacag

SEQ ID NO: 1249340 - RNA, 20 nt, Human
ggacauggacauccgugacc

SEQ ID NO: 1249341 - RNA, 21 nt, Human
ggaccagcaggcugacaggcc

SEQ ID NO: 1249342 - RNA, 20 nt, Human
ggagcuggccagacugcugc

SEQ ID NO: 1249343 - RNA, 22 nt, Human
gggcacccccaccccugugagg

SEQ ID NO: 1249344 - RNA, 20 nt, Human
ggggaaagcuuggcucccca

SEQ ID NO: 1249345 - RNA, 18 nt, Human
gggguggguucccugcag

SEQ ID NO: 1249346 - RNA, 20 nt, Human
ggugggguggggaggcuagg

SEQ ID NO: 1249347 - RNA, 19 nt, Human
guccagggucagaggugcc

SEQ ID NO: 1249348 - RNA, 21 nt, Human
gucuuggagaagacuggggag

SEQ ID NO: 1249349 - RNA, 22 nt, Human
gugaggcaacagguaguccgag

SEQ ID NO: 1249350 - RNA, 24 nt, Human
uacacagugaaucacacacagaaa

SEQ ID NO: 1249351 - RNA, 20 nt, Human
ucacugggcacccccacccc

SEQ ID NO: 1249352 - RNA, 22 nt, Human
uccagagucccaggaugagccc

SEQ ID NO: 1249353 - RNA, 21 nt, Human
ucccacagaggcugcccccag

SEQ ID NO: 1249354 - RNA, 24 nt, Human
ucccaggaugagccccuugcaugg

SEQ ID NO: 1249355 - RNA, 20 nt, Human
ucccagggaacucagaccuu

SEQ ID NO: 1249356 - RNA, 21 nt, Human
ucccagggaacucagaccuuc

SEQ ID NO: 1249357 - RNA, 19 nt, Human
ucccaucaugccaggucuu

SEQ ID NO: 1249358 - RNA, 26 nt, Human
ucccgggcugagaccgcggccagggc

SEQ ID NO: 1249359 - RNA, 23 nt, Human
ucccuacccuugggccccucucc

SEQ ID NO: 1249360 - RNA, 22 nt, Human
ucccugcagucgggggucucug

SEQ ID NO: 1249361 - RNA, 18 nt, Human
ucccuggagcuggccaga

SEQ ID NO: 1249362 - RNA, 22 nt, Human
ucccuggagcuggccagacugc

SEQ ID NO: 1249363 - RNA, 23 nt, Human
ucccuggagcuggccagacugcu

SEQ ID NO: 1249364 - RNA, 19 nt, Human
uccuggggcccaucucucc

SEQ ID NO: 1249365 - RNA, 22 nt, Human
uccugugaucuucuguacugcu

SEQ ID NO: 1249366 - RNA, 23 nt, Human
ucucacagugcugcuagccgauu

SEQ ID NO: 1249367 - RNA, 21 nt, Human
ucucucacagugcugcuagcc

SEQ ID NO: 1249368 - RNA, 19 nt, Human
ucuuggagaagacugggga

SEQ ID NO: 1249369 - RNA, 24 nt, Human
ucuuggagaagacuggggaggggg

SEQ ID NO: 1249370 - RNA, 22 nt, Human
ugaaaaggcagggacaggagca

SEQ ID NO: 1249371 - RNA, 25 nt, Human
ugaaaaggcagggacaggagcaaau

SEQ ID NO: 1249372 - RNA, 20 nt, Human
ugacaacaccagaaacaaga

SEQ ID NO: 1249373 - RNA, 21 nt, Human
ugagagaggccagcaagguca

SEQ ID NO: 1249374 - RNA, 21 nt, Human
ugagccuuuguccaugcugug

SEQ ID NO: 1249375 - RNA, 19 nt, Human
ugaggaggguacgugguag

SEQ ID NO: 1249376 - RNA, 22 nt, Human
ugcccgcgacccggccgggggc

SEQ ID NO: 1249377 - RNA, 19 nt, Human
ugcccuaggagcccuaugc

SEQ ID NO: 1249378 - RNA, 21 nt, Human
ugcuccaaagaaagcgagauc

SEQ ID NO: 1249379 - RNA, 27 nt, Human
ugcugaccaguacacagugaaucacac

SEQ ID NO: 1249380 - RNA, 21 nt, Human
uggcaaggccagagaaggggc

SEQ ID NO: 1249381 - RNA, 19 nt, Human
uggcccaggaagaggcugg

SEQ ID NO: 1249382 - RNA, 24 nt, Human
ugggagccugcaggcccaggggca

SEQ ID NO: 1249383 - RNA, 26 nt, Human
ugggcacccccaccccugugagccuu

SEQ ID NO: 1249384 - RNA, 23 nt, Human
ugggcggacauggacauccguga

SEQ ID NO: 1249385 - RNA, 22 nt, Human
uggggaggggagguagagaagc

SEQ ID NO: 1249386 - RNA, 21 nt, Human
uggggaggggugugggagccu

SEQ ID NO: 1249387 - RNA, 19 nt, Human
ugggguggggaggcuaggc

SEQ ID NO: 1249388 - RNA, 24 nt, Human
uggugaagcuccaggugggguggg

SEQ ID NO: 1249389 - RNA, 25 nt, Human
uggugaagcuccagguggggugggg

SEQ ID NO: 1249390 - RNA, 21 nt, Human
ugugcaucagacacaaggagg

SEQ ID NO: 1249391 - RNA, 23 nt, Human
ugugggagccugcaggcccaggg

SEQ ID NO: 1249392 - RNA, 20 nt, Human
uguuggggggaccagcaggc

SEQ ID NO: 1249393 - RNA, 23 nt, Human
uucacuuuccccucccuccuccc

SEQ ID NO: 1249394 - RNA, 25 nt, Human
uuggagaagacuggggaggggugug

SEQ ID NO: 1249395 - RNA, 21 nt, Human
uuggcuccccagggauccugg

SEQ ID NO: 1249396 - RNA, 18 nt, Human
uugucccacagaggcugc

SEQ ID NO: 1249397 - RNA, 26 nt, Human
uuucccccucuuuugccaaugugagg

SEQ ID NO: 1249398 - RNA, 20 nt, Human
ggcgcagcugguuacugagc

SEQ ID NO: 1249399 - RNA, 22 nt, Human
uagaaggugggaguaugcagca

SEQ ID NO: 1249400 - RNA, 20 nt, Human
aaacaaaacaaaacaauuca

SEQ ID NO: 1249401 - RNA, 19 nt, Human
aaagcccagcuuucacugc

SEQ ID NO: 1249402 - RNA, 26 nt, Human
acuuuaaaaaauuauuaaggcaaaag

SEQ ID NO: 1249403 - RNA, 23 nt, Human
agauaaucauaaaauucaaaagc

SEQ ID NO: 1249404 - RNA, 21 nt, Human
cagauaaucauaaaauucaaa

SEQ ID NO: 1249405 - RNA, 20 nt, Human
cagcacagaaaacuugucag

SEQ ID NO: 1249406 - RNA, 24 nt, Human
cuccucauggccaucgugaaugau

SEQ ID NO: 1249407 - RNA, 24 nt, Human
cuugacucaaacauuccaggaggc

SEQ ID NO: 1249408 - RNA, 22 nt, Human
gaaaacaaaacaaaacaauuca

SEQ ID NO: 1249409 - RNA, 27 nt, Human
uaaggcaaaagcccagcuuucacugcc

SEQ ID NO: 1249410 - RNA, 23 nt, Human
uggaaagcaauucccuugacuca

SEQ ID NO: 1249411 - RNA, 27 nt, Human
uggaaagcaauucccuugacucaaaca

SEQ ID NO: 1249412 - RNA, 18 nt, Human
uggguuuuaugagguuug

SEQ ID NO: 1249413 - RNA, 24 nt, Human
uuaaggcaaaagcccagcuuucac

SEQ ID NO: 1249414 - RNA, 24 nt, Human
uucaaaagccccacugcugcuucu

SEQ ID NO: 1249415 - RNA, 21 nt, Human
uucccuugacucaaacauucc

SEQ ID NO: 1249416 - RNA, 24 nt, Human
aaacaaaaccaaggagacagagaa

SEQ ID NO: 1249417 - RNA, 20 nt, Human
aaacaaucaggauuucaaca

SEQ ID NO: 1249418 - RNA, 26 nt, Human
aagauaaaaaaaccauuacauacaga

SEQ ID NO: 1249419 - RNA, 21 nt, Human
aagcaaagacuacacugcuua

SEQ ID NO: 1249420 - RNA, 18 nt, Human
aagcacauauauguacaa

SEQ ID NO: 1249421 - RNA, 21 nt, Human
aauuauuagugagauauuuca

SEQ ID NO: 1249422 - RNA, 22 nt, Human
acccaaguacccuagggagaca

SEQ ID NO: 1249423 - RNA, 18 nt, Human
agaaggggaauugagucu

SEQ ID NO: 1249424 - RNA, 26 nt, Human
aguaaaaagaaccugucaagaacccu

SEQ ID NO: 1249425 - RNA, 21 nt, Human
aguucuucuccuuccucuuuu

SEQ ID NO: 1249426 - RNA, 19 nt, Human
auacagaguauacagauaa

SEQ ID NO: 1249427 - RNA, 23 nt, Human
aucuuauauaguaaacaaaacca

SEQ ID NO: 1249428 - RNA, 24 nt, Human
caaaaccaaggagacagagaaagg

SEQ ID NO: 1249429 - RNA, 22 nt, Human
caaccaccaacccaaguacccu

SEQ ID NO: 1249430 - RNA, 21 nt, Human
caccuacagcgccucagcgcc

SEQ ID NO: 1249431 - RNA, 21 nt, Human
cacugucaguucuucuccuuc

SEQ ID NO: 1249432 - RNA, 19 nt, Human
cagagaaaggaagggcaac

SEQ ID NO: 1249433 - RNA, 18 nt, Human
cagagaacccccauagac

SEQ ID NO: 1249434 - RNA, 20 nt, Human
cagagaacccccauagacaa

SEQ ID NO: 1249435 - RNA, 21 nt, Human
cagcagaucucaauuuguauu

SEQ ID NO: 1249436 - RNA, 21 nt, Human
cagcuccugcagagaaccccc

SEQ ID NO: 1249437 - RNA, 18 nt, Human
caucuggaagcuccugcu

SEQ ID NO: 1249438 - RNA, 20 nt, Human
cccaaagauacugcccucuc

SEQ ID NO: 1249439 - RNA, 23 nt, Human
cccauucacaaugauucuaagca

SEQ ID NO: 1249440 - RNA, 22 nt, Human
cccccauagacaagacuggagu

SEQ ID NO: 1249441 - RNA, 19 nt, Human
ccucuuuuuuucaaugacc

SEQ ID NO: 1249442 - RNA, 23 nt, Human
ccugcagagaacccccauagacc

SEQ ID NO: 1249443 - RNA, 19 nt, Human
cgcccccuuccagcaguuu

SEQ ID NO: 1249444 - RNA, 22 nt, Human
cucagcgcccacgguucuccca

SEQ ID NO: 1249445 - RNA, 20 nt, Human
cucccaagcucaccggcaac

SEQ ID NO: 1249446 - RNA, 19 nt, Human
cucucugaaaucguugggg

SEQ ID NO: 1249447 - RNA, 23 nt, Human
cucucugaaaucguugggguggg

SEQ ID NO: 1249448 - RNA, 21 nt, Human
cugaaaucguuggggugggag

SEQ ID NO: 1249449 - RNA, 22 nt, Human
cugcagagaacccccauagaca

SEQ ID NO: 1249450 - RNA, 23 nt, Human
cuucaggccauggagcaauuuac

SEQ ID NO: 1249451 - RNA, 21 nt, Human
ggaagggcaaccaccaaccca

SEQ ID NO: 1249452 - RNA, 18 nt, Human
ggagcccugaagcuaaca

SEQ ID NO: 1249453 - RNA, 18 nt, Human
gggagggagccaccuaca

SEQ ID NO: 1249454 - RNA, 19 nt, Human
gucccuaccaaguguggaa

SEQ ID NO: 1249455 - RNA, 19 nt, Human
gugaaaagcaaagacuaca

SEQ ID NO: 1249456 - RNA, 23 nt, Human
gugcauaguaaaguggacauuau

SEQ ID NO: 1249457 - RNA, 25 nt, Human
uaaaaagaaccugucaagaacccca

SEQ ID NO: 1249458 - RNA, 26 nt, Human
uaaacaaaaccaaggagacagagaaa

SEQ ID NO: 1249459 - RNA, 19 nt, Human
uacacagucauucugaaug

SEQ ID NO: 1249460 - RNA, 23 nt, Human
uagaccacaugaagauaaaaucu

SEQ ID NO: 1249461 - RNA, 23 nt, Human
uagaugcaaacaucugacaacuu

SEQ ID NO: 1249462 - RNA, 21 nt, Human
uaguacuugagcuuuaucagu

SEQ ID NO: 1249463 - RNA, 21 nt, Human
ucaccuacuuuuuucauacca

SEQ ID NO: 1249464 - RNA, 30 nt, Human
ucacugucaguucuucuccuuccucuuuuu

SEQ ID NO: 1249465 - RNA, 19 nt, Human
ucagaagacuccuguucag

SEQ ID NO: 1249466 - RNA, 23 nt, Human
ucagcgcccacgguucucccaag

SEQ ID NO: 1249467 - RNA, 23 nt, Human
ucaguucuucuccuuccucuuuu

SEQ ID NO: 1249468 - RNA, 20 nt, Human
ucucucagucacggcacuuc

SEQ ID NO: 1249469 - RNA, 18 nt, Human
ucugaaaucguuggggug

SEQ ID NO: 1249470 - RNA, 22 nt, Human
ucugaaaucguuggggugggag

SEQ ID NO: 1249471 - RNA, 22 nt, Human
ucuucuccuuccucuuuuuuuc

SEQ ID NO: 1249472 - RNA, 18 nt, Human
ugaaaagaggcuuuacac

SEQ ID NO: 1249473 - RNA, 19 nt, Human
ugaauuucuggcuguccca

SEQ ID NO: 1249474 - RNA, 24 nt, Human
ugagucugauagaguuaaaagcac

SEQ ID NO: 1249475 - RNA, 21 nt, Human
uggaaaaucacaugacgagga

SEQ ID NO: 1249476 - RNA, 24 nt, Human
uggaacauaauuuacaaugcagaa

SEQ ID NO: 1249477 - RNA, 20 nt, Human
uggaguaucccugaugccca

SEQ ID NO: 1249478 - RNA, 22 nt, Human
ugggagggagccaccuacagcg

SEQ ID NO: 1249479 - RNA, 19 nt, Human
uggguugauguaugugggu

SEQ ID NO: 1249480 - RNA, 18 nt, Human
ugucuagaccacaugaag

SEQ ID NO: 1249481 - RNA, 19 nt, Human
ugugaaaagcaaagacuac

SEQ ID NO: 1249482 - RNA, 21 nt, Human
ugugaguaaaaagaaccuguc

SEQ ID NO: 1249483 - RNA, 19 nt, Human
uguggguagauuauguugu

SEQ ID NO: 1249484 - RNA, 22 nt, Human
uguuuuguuuugcauaguuuca

SEQ ID NO: 1249485 - RNA, 18 nt, Human
uuucagcacaaaugaaau

SEQ ID NO: 1249486 - RNA, 18 nt, Human
aagggugggggguggggg

SEQ ID NO: 1249487 - RNA, 24 nt, Human
aaggguggggggugggggggaaga

SEQ ID NO: 1249488 - RNA, 20 nt, Human
caccucggccccggaggccc

SEQ ID NO: 1249489 - RNA, 23 nt, Human
cggaggccccggcgcaaccccgc

SEQ ID NO: 1249490 - RNA, 23 nt, Human
cggcgcaaccccgcuuugggcgg

SEQ ID NO: 1249491 - RNA, 21 nt, Human
cucggccccggaggccccggc

SEQ ID NO: 1249492 - RNA, 18 nt, Human
gagcaggcccaccucggc

SEQ ID NO: 1249493 - RNA, 21 nt, Human
gcccaccucggccccggaggc

SEQ ID NO: 1249494 - RNA, 25 nt, Human
gccccggaggccccggcgcaacccc

SEQ ID NO: 1249495 - RNA, 20 nt, Human
ggccccggcgcaaccccgcu

SEQ ID NO: 1249496 - RNA, 25 nt, Human
gggggugggggggaagauuuaagug

SEQ ID NO: 1249497 - RNA, 18 nt, Human
gggugggggggaagauuu

SEQ ID NO: 1249498 - RNA, 19 nt, Human
gggugggggguggggggga

SEQ ID NO: 1249499 - RNA, 20 nt, Human
ucagcaaaaggguggggggu

SEQ ID NO: 1249500 - RNA, 20 nt, Human
uggggcaucuaccaaugauu

SEQ ID NO: 1249501 - RNA, 20 nt, Human
ugggggggaagauuuaagug

SEQ ID NO: 1249502 - RNA, 19 nt, Human
aaacuauaccaauaugccc

SEQ ID NO: 1249503 - RNA, 18 nt, Human
aaaguauaaaccaaggaa

SEQ ID NO: 1249504 - RNA, 25 nt, Human
aagaauaaaaggaaaucuccacaac

SEQ ID NO: 1249505 - RNA, 24 nt, Human
aaugcaauguuggugccuuaggaa

SEQ ID NO: 1249506 - RNA, 25 nt, Human
acagaagaaaacacacuuuagguca

SEQ ID NO: 1249507 - RNA, 18 nt, Human
acauuugagacccgcaac

SEQ ID NO: 1249508 - RNA, 23 nt, Human
accaagauauucuaccucccuac

SEQ ID NO: 1249509 - RNA, 20 nt, Human
accacuccugaaaaaaaccu

SEQ ID NO: 1249510 - RNA, 21 nt, Human
accuucuacaagaauugaaaa

SEQ ID NO: 1249511 - RNA, 22 nt, Human
acgcagggucuagcugccuaac

SEQ ID NO: 1249512 - RNA, 21 nt, Human
agaaaaaguauaaaccaagga

SEQ ID NO: 1249513 - RNA, 19 nt, Human
agaagcaaaaagcuaguag

SEQ ID NO: 1249514 - RNA, 20 nt, Human
agacaucaccacuccugaaa

SEQ ID NO: 1249515 - RNA, 18 nt, Human
agacuuccuacccugaug

SEQ ID NO: 1249516 - RNA, 19 nt, Human
agaguaucaaagacuaaaa

SEQ ID NO: 1249517 - RNA, 21 nt, Human
agccaaaccaacauugcaagc

SEQ ID NO: 1249518 - RNA, 19 nt, Human
agugaggcagcucauguac

SEQ ID NO: 1249519 - RNA, 23 nt, Human
auaggaaauauggacuaucuuca

SEQ ID NO: 1249520 - RNA, 20 nt, Human
auauucuucaucucccagaa

SEQ ID NO: 1249521 - RNA, 20 nt, Human
aucccaaacuccacagcuga

SEQ ID NO: 1249522 - RNA, 23 nt, Human
auccccuccccaccaagauauuc

SEQ ID NO: 1249523 - RNA, 19 nt, Human
caaaccaacauugcaagca

SEQ ID NO: 1249524 - RNA, 21 nt, Human
caaagacuaaaaauacuacaa

SEQ ID NO: 1249525 - RNA, 19 nt, Human
cacauuugagacccgcaac

SEQ ID NO: 1249526 - RNA, 21 nt, Human
caccaagauauucuaccuccc

SEQ ID NO: 1249527 - RNA, 21 nt, Human
cacccuccuguuguugacuuc

SEQ ID NO: 1249528 - RNA, 24 nt, Human
cagaguaucaaagacuaaaaauac

SEQ ID NO: 1249529 - RNA, 21 nt, Human
caucccaagauuucccccaga

SEQ ID NO: 1249530 - RNA, 18 nt, Human
cauuugagacccgcaacu

SEQ ID NO: 1249531 - RNA, 21 nt, Human
ccagaagcugauaacaucccc

SEQ ID NO: 1249532 - RNA, 25 nt, Human
ccccaccaagauauucuaccucccu

SEQ ID NO: 1249533 - RNA, 18 nt, Human
ccuaggaaaaagcauccc

SEQ ID NO: 1249534 - RNA, 22 nt, Human
ccucaguggacuccccagccaa

SEQ ID NO: 1249535 - RNA, 21 nt, Human
ccucccuacugcucaccgcuu

SEQ ID NO: 1249536 - RNA, 19 nt, Human
ccuccuguuguugacuucu

SEQ ID NO: 1249537 - RNA, 21 nt, Human
ccuccuguuguugacuucugg

SEQ ID NO: 1249538 - RNA, 21 nt, Human
ccuuaggaacuagcacuuaca

SEQ ID NO: 1249539 - RNA, 22 nt, Human
cuccaagcucagaucccaaacu

SEQ ID NO: 1249540 - RNA, 19 nt, Human
cuccugaaaaaaaccuucu

SEQ ID NO: 1249541 - RNA, 23 nt, Human
cucuccccacaaguauuucuaaa

SEQ ID NO: 1249542 - RNA, 24 nt, Human
cucuccccacaaguauuucuaaaa

SEQ ID NO: 1249543 - RNA, 22 nt, Human
cugaaaggaugaucaaacccug

SEQ ID NO: 1249544 - RNA, 21 nt, Human
cugaagaucucacaacagaga

SEQ ID NO: 1249545 - RNA, 20 nt, Human
cugauaacauccccucccca

SEQ ID NO: 1249546 - RNA, 19 nt, Human
cuuugugccaucaacaugg

SEQ ID NO: 1249547 - RNA, 23 nt, Human
gagcaucagacaucaccacuccu

SEQ ID NO: 1249548 - RNA, 19 nt, Human
gccaaaacauaucacaacc

SEQ ID NO: 1249549 - RNA, 26 nt, Human
ggagcccuuucaagugcuuuccacuu

SEQ ID NO: 1249550 - RNA, 21 nt, Human
ggugugugugugugugugugu

SEQ ID NO: 1249551 - RNA, 20 nt, Human
gugugugugugugugugugu

SEQ ID NO: 1249552 - RNA, 22 nt, Human
uaaaagagaagcaaaaagcuag

SEQ ID NO: 1249553 - RNA, 20 nt, Human
uacuuuacacagaagaaaac

SEQ ID NO: 1249554 - RNA, 24 nt, Human
uauauacauuccagacuguacaug

SEQ ID NO: 1249555 - RNA, 21 nt, Human
uaucucaaagcugaaaggaug

SEQ ID NO: 1249556 - RNA, 25 nt, Human
uauuucugucuccuaugcgccaaaa

SEQ ID NO: 1249557 - RNA, 21 nt, Human
ucaaguggaaaauaugagcgg

SEQ ID NO: 1249558 - RNA, 21 nt, Human
ucacuauuucugucuccuaug

SEQ ID NO: 1249559 - RNA, 21 nt, Human
ucccaagauuucccccagaug

SEQ ID NO: 1249560 - RNA, 25 nt, Human
ucccccagaugguuuuaacaucagu

SEQ ID NO: 1249561 - RNA, 19 nt, Human
ucuaccucccuacugcuca

SEQ ID NO: 1249562 - RNA, 21 nt, Human
ugaaaggaugaucaaacccug

SEQ ID NO: 1249563 - RNA, 20 nt, Human
ugaaauaggaaauauggacu

SEQ ID NO: 1249564 - RNA, 24 nt, Human
ugauaacauccccuccccaccaag

SEQ ID NO: 1249565 - RNA, 21 nt, Human
ugccagaaacaaaugggcucc

SEQ ID NO: 1249566 - RNA, 24 nt, Human
ugcccaaaccauccuuuuuucucu

SEQ ID NO: 1249567 - RNA, 25 nt, Human
ugcccaaaccauccuuuuuucucuc

SEQ ID NO: 1249568 - RNA, 23 nt, Human
uggaaccucaacaauauucuuca

SEQ ID NO: 1249569 - RNA, 19 nt, Human
ugucaagaauaaaaggaaa

SEQ ID NO: 1249570 - RNA, 23 nt, Human
ugucaagaauaaaaggaaaucuc

SEQ ID NO: 1249571 - RNA, 18 nt, Human
ugugugugugugugugug

SEQ ID NO: 1249572 - RNA, 18 nt, Human
ugugugugugugugugug

SEQ ID NO: 1249573 - RNA, 21 nt, Human
ugugugugugugugugugugu

SEQ ID NO: 1249574 - RNA, 24 nt, Human
uguguguguguguguguguguaau

SEQ ID NO: 1249575 - RNA, 22 nt, Human
uuaaaaauaguuuaugacaguu

SEQ ID NO: 1249576 - RNA, 24 nt, Human
uuagcacagguccagcaucuuugg

SEQ ID NO: 1249577 - RNA, 21 nt, Human
uuaguuuacucaaacuauacc

SEQ ID NO: 1249578 - RNA, 28 nt, Human
uucaaccuucucucuuugaagaccccaa

SEQ ID NO: 1249579 - RNA, 21 nt, Human
uucgcaauaaugaaugcucaa

SEQ ID NO: 1249580 - RNA, 20 nt, Human
uucuuggaugccuaaggauu

SEQ ID NO: 1249581 - RNA, 19 nt, Human
uuggugccuuaggaacuag

SEQ ID NO: 1249582 - RNA, 20 nt, Human
uuuaagacuuccuacccuga

SEQ ID NO: 1249583 - RNA, 31 nt, Human
uuuaaguaggugugugugugugugugugugg

SEQ ID NO: 1249584 - RNA, 19 nt, Human
cgcgccgggcgcucgguuc

SEQ ID NO: 1249585 - RNA, 19 nt, Human
cuccgcucccgcgcucucc

SEQ ID NO: 1249586 - RNA, 25 nt, Human
cucggcccgcggccccggaucgggc

SEQ ID NO: 1249587 - RNA, 21 nt, Human
gccccggaucgggcuacugcu

SEQ ID NO: 1249588 - RNA, 22 nt, Human
gcuccgcucccgcgcucuccgc

SEQ ID NO: 1249589 - RNA, 20 nt, Human
ucccgcgcucuccgcgccgg

SEQ ID NO: 1249590 - RNA, 23 nt, Human
ucuccgcgccgggcgcucgguuc

SEQ ID NO: 1249591 - RNA, 22 nt, Human
aaagcacaaagcuggccugcaa

SEQ ID NO: 1249592 - RNA, 18 nt, Human
aaagcuggccugcaaggg

SEQ ID NO: 1249593 - RNA, 23 nt, Human
aaagcuggccugcaaggggacuu

SEQ ID NO: 1249594 - RNA, 27 nt, Human
aaaucagauucauacaguuaaaacuga

SEQ ID NO: 1249595 - RNA, 20 nt, Human
aagcaaccguaagucagaau

SEQ ID NO: 1249596 - RNA, 18 nt, Human
aauuccuuccagaguauu

SEQ ID NO: 1249597 - RNA, 22 nt, Human
acugacuuuaacauguucuuuc

SEQ ID NO: 1249598 - RNA, 22 nt, Human
agacugacuuuaacauguucuu

SEQ ID NO: 1249599 - RNA, 21 nt, Human
aguaaaacucaaaagcaaccg

SEQ ID NO: 1249600 - RNA, 21 nt, Human
aguguccacaauuuaagcaac

SEQ ID NO: 1249601 - RNA, 18 nt, Human
auaaaauuccuuccagag

SEQ ID NO: 1249602 - RNA, 21 nt, Human
auguugaaugaggaagcaaag

SEQ ID NO: 1249603 - RNA, 24 nt, Human
auuagaaagaucaaaauuuacaua

SEQ ID NO: 1249604 - RNA, 24 nt, Human
caaggaccugguauuuucaugcua

SEQ ID NO: 1249605 - RNA, 18 nt, Human
caugcuaaagaaagcauu

SEQ ID NO: 1249606 - RNA, 21 nt, Human
cauuaaaaaguuggucugcaa

SEQ ID NO: 1249607 - RNA, 20 nt, Human
cauuccagcguaaaguggag

SEQ ID NO: 1249608 - RNA, 19 nt, Human
gauuguuuccacuccuaac

SEQ ID NO: 1249609 - RNA, 21 nt, Human
gcaaagcacaaagcuggccug

SEQ ID NO: 1249610 - RNA, 23 nt, Human
gugugcaucuuaauauauccaaa

SEQ ID NO: 1249611 - RNA, 21 nt, Human
uaaauggagcuuccucgaacc

SEQ ID NO: 1249612 - RNA, 19 nt, Human
uaacauaugcaaaaaugaa

SEQ ID NO: 1249613 - RNA, 23 nt, Human
uaacauaugcaaaaaugaacaua

SEQ ID NO: 1249614 - RNA, 22 nt, Human
uaagcaacuuuccauaggaaau

SEQ ID NO: 1249615 - RNA, 19 nt, Human
uaccugaauggauguaauu

SEQ ID NO: 1249616 - RNA, 20 nt, Human
uacucaaacgugacuccuua

SEQ ID NO: 1249617 - RNA, 24 nt, Human
uccacuccuaacauaugcaaaaau

SEQ ID NO: 1249618 - RNA, 18 nt, Human
uccagcguaaaguggagu

SEQ ID NO: 1249619 - RNA, 21 nt, Human
uccaucagauaugcccaagga

SEQ ID NO: 1249620 - RNA, 21 nt, Human
ucugcaaagcacaaagcuggc

SEQ ID NO: 1249621 - RNA, 18 nt, Human
ucuuugcuuugcucuuua

SEQ ID NO: 1249622 - RNA, 21 nt, Human
ugaagccuagcuucaauguug

SEQ ID NO: 1249623 - RNA, 23 nt, Human
ugaagccuagcuucaauguuggu

SEQ ID NO: 1249624 - RNA, 21 nt, Human
ugaggaagcaaaguaucucau

SEQ ID NO: 1249625 - RNA, 22 nt, Human
ugaguaaaacucaaaagcaacc

SEQ ID NO: 1249626 - RNA, 21 nt, Human
ugaguagugagaucuuugcuu

SEQ ID NO: 1249627 - RNA, 20 nt, Human
ugcaaaaaugaacauauuua

SEQ ID NO: 1249628 - RNA, 22 nt, Human
ugcaaagcacaaagcuggccug

SEQ ID NO: 1249629 - RNA, 18 nt, Human
ugcuaaagaaagcauucc

SEQ ID NO: 1249630 - RNA, 23 nt, Human
ugcuuugcucuuuagauccuuca

SEQ ID NO: 1249631 - RNA, 23 nt, Human
uuguuuccacuccuaacauaugc

SEQ ID NO: 1249632 - RNA, 21 nt, Human
uuucaugcuaaagaaagcauu

SEQ ID NO: 1249633 - RNA, 20 nt, Human
uuugaguagugagaucuuug

SEQ ID NO: 1249634 - RNA, 19 nt, Human
cccagcccggccgcggccg

SEQ ID NO: 1249635 - RNA, 25 nt, Human
cccucugcugccucccgcugaagcc

SEQ ID NO: 1249636 - RNA, 18 nt, Human
cucccgcugaagccccag

SEQ ID NO: 1249637 - RNA, 24 nt, Human
cucugcugccucccgcugaagccc

SEQ ID NO: 1249638 - RNA, 22 nt, Human
uccccucugcugccucccgcug

SEQ ID NO: 1249639 - RNA, 24 nt, Human
uccccucugcugccucccgcugaa

SEQ ID NO: 1249640 - RNA, 22 nt, Human
ugccucccgcugaagccccagc

SEQ ID NO: 1249641 - RNA, 23 nt, Human
caggggccuccaagccuugcugu

SEQ ID NO: 1249642 - RNA, 23 nt, Human
uagggucccauuccgcagcugcu

SEQ ID NO: 1249643 - RNA, 26 nt, Human
ucccaaccacaaccacuauguagauu

SEQ ID NO: 1249644 - RNA, 22 nt, Human
ugcuuggaaccacgcacagaac

SEQ ID NO: 1249645 - RNA, 23 nt, Human
caccuuggaaaaaaaaaagcaga

SEQ ID NO: 1249646 - RNA, 21 nt, Human
cagcaacaaaaaggcugccau

SEQ ID NO: 1249647 - RNA, 21 nt, Human
cagguugacucuagucccacc

SEQ ID NO: 1249648 - RNA, 24 nt, Human
ccaaccaauccagaguccuuucac

SEQ ID NO: 1249649 - RNA, 24 nt, Human
ccaauccagaguccuuucaccagc

SEQ ID NO: 1249650 - RNA, 22 nt, Human
ccuuggaaaaaaaaaagcagac

SEQ ID NO: 1249651 - RNA, 21 nt, Human
ucccaccuccuuuccugaacu

SEQ ID NO: 1249652 - RNA, 18 nt, Human
ucccagcaacaaaaaggc

SEQ ID NO: 1249653 - RNA, 23 nt, Human
uuccagguugacucuagucccac

SEQ ID NO: 1249654 - RNA, 18 nt, Human
gauggcggaaagaaugaa

SEQ ID NO: 1249655 - RNA, 19 nt, Human
ucagucuucauuugucuug

SEQ ID NO: 1249656 - RNA, 21 nt, Human
ugagaaagaaucaagauggcg

SEQ ID NO: 1249657 - RNA, 22 nt, Human
ugagucuuggucagugagaaag

SEQ ID NO: 1249658 - RNA, 21 nt, Human
uucuugguuucagucuucauu

SEQ ID NO: 1249659 - RNA, 24 nt, Human
acccucacagccugugguggaggc

SEQ ID NO: 1249660 - RNA, 21 nt, Human
accuggagcccccgcagucuc

SEQ ID NO: 1249661 - RNA, 24 nt, Human
acgcugccaccuccguuuccuggg

SEQ ID NO: 1249662 - RNA, 20 nt, Human
acugaggacaccuuggggac

SEQ ID NO: 1249663 - RNA, 21 nt, Human
caccuggagcccccgcagucu

SEQ ID NO: 1249664 - RNA, 21 nt, Human
ccugugacccucacagccugu

SEQ ID NO: 1249665 - RNA, 23 nt, Human
cgcugccaccuccguuuccuggg

SEQ ID NO: 1249666 - RNA, 24 nt, Human
cgucuacccaccaccuggagcccc

SEQ ID NO: 1249667 - RNA, 21 nt, Human
cugaggacaccuuggggacag

SEQ ID NO: 1249668 - RNA, 20 nt, Human
cugccaccuccguuuccugg

SEQ ID NO: 1249669 - RNA, 21 nt, Human
cugccaccuccguuuccuggg

SEQ ID NO: 1249670 - RNA, 23 nt, Human
cuggagcccccgcagucucuccu

SEQ ID NO: 1249671 - RNA, 21 nt, Human
gacaccuuggggacagcagca

SEQ ID NO: 1249672 - RNA, 21 nt, Human
gacggcugccgguggaugaac

SEQ ID NO: 1249673 - RNA, 27 nt, Human
gcucucgggguggucccggcuuggccc

SEQ ID NO: 1249674 - RNA, 22 nt, Human
ggacagcagcauucccccggga

SEQ ID NO: 1249675 - RNA, 19 nt, Human
guggucccggcuuggcccu

SEQ ID NO: 1249676 - RNA, 23 nt, Human
ucccauggucaccaccugugacc

SEQ ID NO: 1249677 - RNA, 25 nt, Human
ucucgggguggucccggcuuggccc

SEQ ID NO: 1249678 - RNA, 22 nt, Human
uggucccggcuuggcccugccc

SEQ ID NO: 1249679 - RNA, 19 nt, Human
ugugguggaggcuccuguc

SEQ ID NO: 1249680 - RNA, 22 nt, Human
ugugguggaggcuccuguccag

SEQ ID NO: 1249681 - RNA, 19 nt, Human
uucccauggucaccaccug

SEQ ID NO: 1249682 - RNA, 18 nt, Human
agcauccucaccaugacc

SEQ ID NO: 1249683 - RNA, 21 nt, Human
cacaaacaccuucucaagcac

SEQ ID NO: 1249684 - RNA, 22 nt, Human
cauccuguuaccuggagacccu

SEQ ID NO: 1249685 - RNA, 20 nt, Human
cccccgaguccugggcucug

SEQ ID NO: 1249686 - RNA, 22 nt, Human
cccccgaguccugggcucugag

SEQ ID NO: 1249687 - RNA, 24 nt, Human
ccgcccacaaacaccuucucaagc

SEQ ID NO: 1249688 - RNA, 20 nt, Human
cgcaaacauguauuccagca

SEQ ID NO: 1249689 - RNA, 18 nt, Human
cugccgcccacaaacacc

SEQ ID NO: 1249690 - RNA, 22 nt, Human
cugccgcccacaaacaccuucu

SEQ ID NO: 1249691 - RNA, 25 nt, Human
gaagggcagccgucugccgcccaca

SEQ ID NO: 1249692 - RNA, 24 nt, Human
gacagauggaacuggaagggcagg

SEQ ID NO: 1249693 - RNA, 24 nt, Human
gcaaacauguauuccagcauccuc

SEQ ID NO: 1249694 - RNA, 22 nt, Human
gccgcccacaaacaccuucuca

SEQ ID NO: 1249695 - RNA, 18 nt, Human
gggcagccgucugccgcc

SEQ ID NO: 1249696 - RNA, 23 nt, Human
ugcuuugcaacguggugaccgug

SEQ ID NO: 1249697 - RNA, 21 nt, Human
uggccccccgaguccugggcu

SEQ ID NO: 1249698 - RNA, 18 nt, Human
uuacgcaaacauguauuc

SEQ ID NO: 1249699 - RNA, 23 nt, Human
aaaggaaaagaaaaucaagcgau

SEQ ID NO: 1249700 - RNA, 20 nt, Human
acacuucuuucugccuccag

SEQ ID NO: 1249701 - RNA, 24 nt, Human
acauagacacuucuuucugccucc

SEQ ID NO: 1249702 - RNA, 19 nt, Human
accuuuguuucaguugcgu

SEQ ID NO: 1249703 - RNA, 18 nt, Human
aguagccucaggugagag

SEQ ID NO: 1249704 - RNA, 21 nt, Human
augugguguaacaaguuuuac

SEQ ID NO: 1249705 - RNA, 24 nt, Human
caaaaugauuccauaauucacuaa

SEQ ID NO: 1249706 - RNA, 19 nt, Human
cagcucuucaccagguucu

SEQ ID NO: 1249707 - RNA, 21 nt, Human
ccagaauuuuaacuuauuaac

SEQ ID NO: 1249708 - RNA, 21 nt, Human
ccagcucuucaccagguucug

SEQ ID NO: 1249709 - RNA, 20 nt, Human
ccucuccacacuuacugccu

SEQ ID NO: 1249710 - RNA, 20 nt, Human
cuagaacauacacuaaagua

SEQ ID NO: 1249711 - RNA, 23 nt, Human
cuggauauuuccaccaaaaugau

SEQ ID NO: 1249712 - RNA, 22 nt, Human
cuggugggacagcuugggcuuu

SEQ ID NO: 1249713 - RNA, 21 nt, Human
cuuacugccuggugggacagc

SEQ ID NO: 1249714 - RNA, 23 nt, Human
gguaagaacuagacauuuauaaa

SEQ ID NO: 1249715 - RNA, 20 nt, Human
uaaaguuuucuuuuguuaac

SEQ ID NO: 1249716 - RNA, 18 nt, Human
uauaaaggaaaagaaaau

SEQ ID NO: 1249717 - RNA, 19 nt, Human
uauaaaggaaaagaaaauc

SEQ ID NO: 1249718 - RNA, 22 nt, Human
ucaguagccucaggugagagua

SEQ ID NO: 1249719 - RNA, 21 nt, Human
uccacacauuagaaccuggau

SEQ ID NO: 1249720 - RNA, 22 nt, Human
ucuccacacuuacugccuggug

SEQ ID NO: 1249721 - RNA, 31 nt, Human; identical to SEQ ID NO: 102689

SEQ ID NO: 1249722 - RNA, 22 nt, Human
uggaacaguugcugugccaccu

SEQ ID NO: 1249723 - RNA, 20 nt, Human
uuacugccuggugggacagc

SEQ ID NO: 1249724 - RNA, 19 nt, Human
uuggaacaguugcugugcc

SEQ ID NO: 1249725 - RNA, 27 nt, Human
aaagaagcaacgcccugagagcucaga

SEQ ID NO: 1249726 - RNA, 23 nt, Human
aacagccaccucugccguccccc

SEQ ID NO: 1249727 - RNA, 19 nt, Human
aacucggccggaugagugg

SEQ ID NO: 1249728 - RNA, 21 nt, Human
aagcaacgcccugagagcuca

SEQ ID NO: 1249729 - RNA, 22 nt, Human
aagcaucggggaguccugaggc

SEQ ID NO: 1249730 - RNA, 19 nt, Human
aaggggccccgaggaccug

SEQ ID NO: 1249731 - RNA, 22 nt, Human
acccagcacaggcuggcggccu

SEQ ID NO: 1249732 - RNA, 21 nt, Human
accgcacggugacccagcaca

SEQ ID NO: 1249733 - RNA, 19 nt, Human
accgguuuggaagcacccc

SEQ ID NO: 1249734 - RNA, 20 nt, Human
agaggaacgaggaggacucc

SEQ ID NO: 1249735 - RNA, 21 nt, Human
aggcaagaggccaggcggugg

SEQ ID NO: 1249736 - RNA, 23 nt, Human
aggcagccgugguuccugggaag

SEQ ID NO: 1249737 - RNA, 23 nt, Human
aggcgguggggagaggaacgagg

SEQ ID NO: 1249738 - RNA, 21 nt, Human
aucugaaaccaucuugugggg

SEQ ID NO: 1249739 - RNA, 23 nt, Human
auuaucccauuuccaacacagaa

SEQ ID NO: 1249740 - RNA, 24 nt, Human
caacacagaaaucaauuuccaaua

SEQ ID NO: 1249741 - RNA, 24 nt, Human
cacacacucgugccugcccgugug

SEQ ID NO: 1249742 - RNA, 19 nt, Human
cacccagagaccgaggcgg

SEQ ID NO: 1249743 - RNA, 19 nt, Human
cacccccccccggugaggc

SEQ ID NO: 1249744 - RNA, 23 nt, Human
cacccccggcucccccacagcuc

SEQ ID NO: 1249745 - RNA, 20 nt, Human
cacccuccagccauacacac

SEQ ID NO: 1249746 - RNA, 19 nt, Human
caccgcacggugacccagc

SEQ ID NO: 1249747 - RNA, 21 nt, Human
caccgguuuggaagcacccca

SEQ ID NO: 1249748 - RNA, 21 nt, Human
caccguccagcccagccgccu

SEQ ID NO: 1249749 - RNA, 21 nt, Human
caccguccagcccagccgccu

SEQ ID NO: 1249750 - RNA, 21 nt, Human
caccguccagcccagccgccu

SEQ ID NO: 1249751 - RNA, 21 nt, Human
caccguccagcccagccgccu

SEQ ID NO: 1249752 - RNA, 24 nt, Human
caccucguccagccucggcccacc

SEQ ID NO: 1249753 - RNA, 23 nt, Human
cacuuccaggguugacaggugug

SEQ ID NO: 1249754 - RNA, 22 nt, Human
cagagggcaccuucacuggcac

SEQ ID NO: 1249755 - RNA, 21 nt, Human
cagcccagccgccucggccca

SEQ ID NO: 1249756 - RNA, 21 nt, Human
cagcccagccgccucggccca

SEQ ID NO: 1249757 - RNA, 21 nt, Human
cagcccagccgccucggccca

SEQ ID NO: 1249758 - RNA, 21 nt, Human
cagcccagccgccucggccca

SEQ ID NO: 1249759 - RNA, 20 nt, Human
cagccgccucggcccaccuc

SEQ ID NO: 1249760 - RNA, 21 nt, Human
caggguggggcucagacaguc

SEQ ID NO: 1249761 - RNA, 23 nt, Human
caguagcagugacaugcggugaa

SEQ ID NO: 1249762 - RNA, 22 nt, Human
ccacagcuccugggcagagggc

SEQ ID NO: 1249763 - RNA, 19 nt, Human
ccacuggaacucacccaag

SEQ ID NO: 1249764 - RNA, 18 nt, Human
ccacugggcacccagugc

SEQ ID NO: 1249765 - RNA, 21 nt, Human
ccagagaccgaggcggcauca

SEQ ID NO: 1249766 - RNA, 22 nt, Human
ccagccucacccggcuguccuc

SEQ ID NO: 1249767 - RNA, 23 nt, Human
cccaaaagucagaggccauuccc

SEQ ID NO: 1249768 - RNA, 23 nt, Human
ccccaaaagucagaggccauucc

SEQ ID NO: 1249769 - RNA, 21 nt, Human
ccccacccccccccggugagg

SEQ ID NO: 1249770 - RNA, 20 nt, Human
ccccaggacaagugucccgu

SEQ ID NO: 1249771 - RNA, 19 nt, Human
ccccaggcugcuauggucc

SEQ ID NO: 1249772 - RNA, 20 nt, Human
ccccaggcugcuaugguccc

SEQ ID NO: 1249773 - RNA, 20 nt, Human
ccccaugcaggggaugcccc

SEQ ID NO: 1249774 - RNA, 19 nt, Human
cccccgaauucgaggcgga

SEQ ID NO: 1249775 - RNA, 21 nt, Human
ccccucuuucgggucuuccca

SEQ ID NO: 1249776 - RNA, 24 nt, Human
cccguaagaaaaaaaggcagccuu

SEQ ID NO: 1249777 - RNA, 26 nt, Human
cccuccagccauacacacgggcugcc

SEQ ID NO: 1249778 - RNA, 18 nt, Human
cccugcccugggcucccc

SEQ ID NO: 1249779 - RNA, 19 nt, Human
ccggcucccccacagcucc

SEQ ID NO: 1249780 - RNA, 22 nt, Human
ccggggccucugugaagaccug

SEQ ID NO: 1249781 - RNA, 24 nt, Human
ccggggccucugugaagaccugac

SEQ ID NO: 1249782 - RNA, 21 nt, Human
ccgugugcccccccacccccc

SEQ ID NO: 1249783 - RNA, 22 nt, Human
ccgugugcccccccaccccccc

SEQ ID NO: 1249784 - RNA, 18 nt, Human
ccuccccucuuucggguc

SEQ ID NO: 1249785 - RNA, 24 nt, Human
ccuccgggucacaccguccagccc

SEQ ID NO: 1249786 - RNA, 21 nt, Human
ccuggguguagcggcucccac

SEQ ID NO: 1249787 - RNA, 19 nt, Human
cgaggcggacggcgcaguc

SEQ ID NO: 1249788 - RNA, 18 nt, Human
cgccucggcccaccucag

SEQ ID NO: 1249789 - RNA, 18 nt, Human
cgccucggcccaccucag

SEQ ID NO: 1249790 - RNA, 19 nt, Human
cggcacccagagaccgagg

SEQ ID NO: 1249791 - RNA, 18 nt, Human
cggccuccgaucacaccu

SEQ ID NO: 1249792 - RNA, 21 nt, Human
cggcugcguuccccaaaaguc

SEQ ID NO: 1249793 - RNA, 21 nt, Human
cggggaguccugaggcaccgg

SEQ ID NO: 1249794 - RNA, 25 nt, Human
cuccgcacacgcuccagcgccuccc

SEQ ID NO: 1249795 - RNA, 25 nt, Human
cucgcaggguggggcucagacaguc

SEQ ID NO: 1249796 - RNA, 22 nt, Human
cucggcccaccguuuuagcagg

SEQ ID NO: 1249797 - RNA, 24 nt, Human
cucuggagacgaggcccucccgag

SEQ ID NO: 1249798 - RNA, 19 nt, Human
cugaaaccaucuugugggg

SEQ ID NO: 1249799 - RNA, 22 nt, Human
cugcccgugugcccccccaccc

SEQ ID NO: 1249800 - RNA, 23 nt, Human
cugcccgugugcccccccacccc

SEQ ID NO: 1249801 - RNA, 18 nt, Human
cugcccugggcuccccaa

SEQ ID NO: 1249802 - RNA, 24 nt, Human
cugcucuugucugagcucuguccg

SEQ ID NO: 1249803 - RNA, 21 nt, Human
cuggggggggggucaaagggc

SEQ ID NO: 1249804 - RNA, 19 nt, Human
gaccuggacgggaaggggc

SEQ ID NO: 1249805 - RNA, 21 nt, Human
gagcucagagcacccucgcag

SEQ ID NO: 1249806 - RNA, 21 nt, Human
gaggcaccgguuuggaagcac

SEQ ID NO: 1249807 - RNA, 25 nt, Human
gaggcccucccgagccuggacacua

SEQ ID NO: 1249808 - RNA, 22 nt, Human
gaggguggggccugggccugcu

SEQ ID NO: 1249809 - RNA, 21 nt, Human
gagugggggcugggggggggg

SEQ ID NO: 1249810 - RNA, 22 nt, Human
gcaaagaagcaacgcccugaga

SEQ ID NO: 1249811 - RNA, 19 nt, Human
gcaggggaugccccaggac

SEQ ID NO: 1249812 - RNA, 18 nt, Human
gcccccccaccccccccc

SEQ ID NO: 1249813 - RNA, 20 nt, Human
gcccugagagcucagagcac

SEQ ID NO: 1249814 - RNA, 18 nt, Human
gcccugggcuccccaacc

SEQ ID NO: 1249815 - RNA, 18 nt, Human
gcccugggguggacuucu

SEQ ID NO: 1249816 - RNA, 20 nt, Human
gcgcaguccugcgggaaugc

SEQ ID NO: 1249817 - RNA, 23 nt, Human
gcucuggagacgaggcccucccg

SEQ ID NO: 1249818 - RNA, 19 nt, Human
gcugccagccucacccggc

SEQ ID NO: 1249819 - RNA, 21 nt, Human
ggaacucacccaagacccggg

SEQ ID NO: 1249820 - RNA, 22 nt, Human
ggagccgucccacgcucggcuu

SEQ ID NO: 1249821 - RNA, 22 nt, Human
ggaggaccauggggccugcaga

SEQ ID NO: 1249822 - RNA, 23 nt, Human
ggcaaagaagcaacgcccugaga

SEQ ID NO: 1249823 - RNA, 19 nt, Human
ggcaguagcagugacaugc

SEQ ID NO: 1249824 - RNA, 18 nt, Human
ggccugggccugcugccc

SEQ ID NO: 1249825 - RNA, 24 nt, Human
ggcgguggggagaggaacgaggag

SEQ ID NO: 1249826 - RNA, 19 nt, Human
ggcucuggagacgaggccc

SEQ ID NO: 1249827 - RNA, 22 nt, Human
ggcuggcggccuccgaucacac

SEQ ID NO: 1249828 - RNA, 23 nt, Human
ggcuggggggggggucaaagggc

SEQ ID NO: 1249829 - RNA, 19 nt, Human
gggauaaaugggcaaagaa

SEQ ID NO: 1249830 - RNA, 22 nt, Human
gggucuucccagcgacccacac

SEQ ID NO: 1249831 - RNA, 22 nt, Human
gugguuccugggaagggcaagu

SEQ ID NO: 1249832 - RNA, 22 nt, Human
uaaaugggcaaagaagcaacgc

SEQ ID NO: 1249833 - RNA, 18 nt, Human
uaagaaaaaaaggcagcc

SEQ ID NO: 1249834 - RNA, 24 nt, Human
ucaaagggcguauugguccauggg

SEQ ID NO: 1249835 - RNA, 22 nt, Human
ucacccguaagaaaaaaaggca

SEQ ID NO: 1249836 - RNA, 19 nt, Human
ucaucugaaaccaucuugu

SEQ ID NO: 1249837 - RNA, 21 nt, Human
uccaaggcagaguccuugaga

SEQ ID NO: 1249838 - RNA, 23 nt, Human
uccagcccagccgccucggccca

SEQ ID NO: 1249839 - RNA, 23 nt, Human
uccagcccagccgccucggccca

SEQ ID NO: 1249840 - RNA, 23 nt, Human
uccagcccagccgccucggccca

SEQ ID NO: 1249841 - RNA, 23 nt, Human
uccagcccagccgccucggccca

SEQ ID NO: 1249842 - RNA, 20 nt, Human
uccaggguugacaggugugg

SEQ ID NO: 1249843 - RNA, 24 nt, Human
ucccagagucguguuucccccucc

SEQ ID NO: 1249844 - RNA, 19 nt, Human
ucccauaaucacuuccagg

SEQ ID NO: 1249845 - RNA, 19 nt, Human
ucccugcuggcgcugcugc

SEQ ID NO: 1249846 - RNA, 22 nt, Human
ucccugcuggcgcugcugcgag

SEQ ID NO: 1249847 - RNA, 25 nt, Human
uccgccacuggaacucacccaagac

SEQ ID NO: 1249848 - RNA, 21 nt, Human
ucuguccugcucaucgaggaa

SEQ ID NO: 1249849 - RNA, 21 nt, Human
ugacccagcacaggcuggcgg

SEQ ID NO: 1249850 - RNA, 18 nt, Human
ugaccuccgcacacgcuc

SEQ ID NO: 1249851 - RNA, 20 nt, Human
ugacuggcagcuuccucccc

SEQ ID NO: 1249852 - RNA, 18 nt, Human
ugagagcaggucugcaug

SEQ ID NO: 1249853 - RNA, 24 nt, Human
ugaggcccugggguggacuucugc

SEQ ID NO: 1249854 - RNA, 22 nt, Human
ugaugacaaugaugaagaugga

SEQ ID NO: 1249855 - RNA, 19 nt, Human
ugccagccucacccggcug

SEQ ID NO: 1249856 - RNA, 22 nt, Human
ugcccccccacccccccccggu

SEQ ID NO: 1249857 - RNA, 19 nt, Human
ugccccggcacccagagac

SEQ ID NO: 1249858 - RNA, 19 nt, Human
ugccgggagaaacagccac

SEQ ID NO: 1249859 - RNA, 22 nt, Human
ugcgggaaugcugaccguggca

SEQ ID NO: 1249860 - RNA, 24 nt, Human
ugcugccgggagaaacagccaccu

SEQ ID NO: 1249861 - RNA, 21 nt, Human
uggagccgucccacgcucggc

SEQ ID NO: 1249862 - RNA, 22 nt, Human
uggagcgagagcccagagaacc

SEQ ID NO: 1249863 - RNA, 19 nt, Human
uggcaccgcacggugaccc

SEQ ID NO: 1249864 - RNA, 21 nt, Human
uggcaguagcagugacaugcg

SEQ ID NO: 1249865 - RNA, 18 nt, Human
ugggaagggcaaguggag

SEQ ID NO: 1249866 - RNA, 20 nt, Human
ugggcuccccaaccagagag

SEQ ID NO: 1249867 - RNA, 21 nt, Human
uggggagaggaacgaggagga

SEQ ID NO: 1249868 - RNA, 22 nt, Human
ugggggcaggggucccagaguc

SEQ ID NO: 1249869 - RNA, 18 nt, Human
uggggggggggucaaagg

SEQ ID NO: 1249870 - RNA, 24 nt, Human
uguccugcucaucgaggaauucca

SEQ ID NO: 1249871 - RNA, 20 nt, Human
uguggaggcguccaucacug

SEQ ID NO: 1249872 - RNA, 18 nt, Human
aggaagcacggcgggugg

SEQ ID NO: 1249873 - RNA, 19 nt, Human
agggggaugggcccgggug

SEQ ID NO: 1249874 - RNA, 22 nt, Human
aggguguggaggggcaggaagc

SEQ ID NO: 1249875 - RNA, 24 nt, Human
gggggucgcgggggaccgcgggga

SEQ ID NO: 1249876 - RNA, 21 nt, Human
ggggucgcgggggaccgcggg

SEQ ID NO: 1249877 - RNA, 23 nt, Human
uguggaggggcaggaagcacggc

SEQ ID NO: 1249878 - RNA, 24 nt, Human
uguggaggggcaggaagcacggcg

SEQ ID NO: 1249879 - RNA, 19 nt, Human
aaaccaccucgaguccugc

SEQ ID NO: 1249880 - RNA, 22 nt, Human
aaacgacagccagagaaauccc

SEQ ID NO: 1249881 - RNA, 24 nt, Human
acccacgcagcacagcgcagcccc

SEQ ID NO: 1249882 - RNA, 23 nt, Human
acgacccgcacccacgcagcaca

SEQ ID NO: 1249883 - RNA, 21 nt, Human
acuccacggcccccccaggcu

SEQ ID NO: 1249884 - RNA, 27 nt, Human
aggugcugaggcugccuccccugagcc

SEQ ID NO: 1249885 - RNA, 25 nt, Human
aggugggggcugccaggcacugcca

SEQ ID NO: 1249886 - RNA, 19 nt, Human
augcagcgcaaacgacagc

SEQ ID NO: 1249887 - RNA, 18 nt, Human
caccgggggacgcaggag

SEQ ID NO: 1249888 - RNA, 19 nt, Human
cacgacccgcacccacgca

SEQ ID NO: 1249889 - RNA, 24 nt, Human
cacgcugaccacgacccgcaccca

SEQ ID NO: 1249890 - RNA, 21 nt, Human
cagcuccggcuccccaccuug

SEQ ID NO: 1249891 - RNA, 21 nt, Human
caggugcugaggcugccuccc

SEQ ID NO: 1249892 - RNA, 18 nt, Human
ccaucgaaucucucuugc

SEQ ID NO: 1249893 - RNA, 22 nt, Human
ccccaccuugccuucuuacccu

SEQ ID NO: 1249894 - RNA, 20 nt, Human
ccccaggcuucaggugcuga

SEQ ID NO: 1249895 - RNA, 21 nt, Human
ccccccgcugcugccccaauc

SEQ ID NO: 1249896 - RNA, 18 nt, Human
cccugguggcugcgcugc

SEQ ID NO: 1249897 - RNA, 21 nt, Human
ccuccccuuuucuucccaaac

SEQ ID NO: 1249898 - RNA, 19 nt, Human
ccucgcgguguugagccgc

SEQ ID NO: 1249899 - RNA, 28 nt, Human
ccuuccagagccgccaucgaaucucucu

SEQ ID NO: 1249900 - RNA, 23 nt, Human
cgcaaacgacagccagagaaauc

SEQ ID NO: 1249901 - RNA, 23 nt, Human
cgggaagggcggagagcccagcg

SEQ ID NO: 1249902 - RNA, 18 nt, Human
cguggccgggaagggcgg

SEQ ID NO: 1249903 - RNA, 19 nt, Human
cuccccuuuucuucccaaa

SEQ ID NO: 1249904 - RNA, 21 nt, Human
cucggaguggaguuuugagaa

SEQ ID NO: 1249905 - RNA, 23 nt, Human
cugagcgccuccccuuuucuucc

SEQ ID NO: 1249906 - RNA, 27 nt, Human
cuuccagagccgccaucgaaucucucu

SEQ ID NO: 1249907 - RNA, 22 nt, Human
cuuccagcuccggcuccccacc

SEQ ID NO: 1249908 - RNA, 23 nt, Human
cuuccccccgcugcugccccaau

SEQ ID NO: 1249909 - RNA, 20 nt, Human
cuugcagcgcucuggggguu

SEQ ID NO: 1249910 - RNA, 21 nt, Human
gaacgcacgcugaccacgacc

SEQ ID NO: 1249911 - RNA, 25 nt, Human
gaggaaauuagagcgggcgggcggg

SEQ ID NO: 1249912 - RNA, 23 nt, Human
gcagaggugggggcugccaggca

SEQ ID NO: 1249913 - RNA, 19 nt, Human
gcguugggccgaggugucg

SEQ ID NO: 1249914 - RNA, 19 nt, Human
ggccgggaagggcggagag

SEQ ID NO: 1249915 - RNA, 20 nt, Human
uaauaagcugagcgccuccc

SEQ ID NO: 1249916 - RNA, 18 nt, Human
uacacgcgagccgggagc

SEQ ID NO: 1249917 - RNA, 19 nt, Human
ucagucaacacagucuggg

SEQ ID NO: 1249918 - RNA, 18 nt, Human
uccacggcccccccaggc

SEQ ID NO: 1249919 - RNA, 23 nt, Human
uccccaccuugccuucuuacccu

SEQ ID NO: 1249920 - RNA, 21 nt, Human
uccccgggcgucacguggccg

SEQ ID NO: 1249921 - RNA, 19 nt, Human
uccgaagcacuggcagagg

SEQ ID NO: 1249922 - RNA, 19 nt, Human
ucgaaucucucuugcuaac

SEQ ID NO: 1249923 - RNA, 25 nt, Human
ucgcgguguugagccgccgccgcug

SEQ ID NO: 1249924 - RNA, 22 nt, Human
ucggaguggaguuuugagaaaa

SEQ ID NO: 1249925 - RNA, 23 nt, Human
ucggaguggaguuuugagaaaag

SEQ ID NO: 1249926 - RNA, 24 nt, Human
ucuuccagcuccggcuccccaccu

SEQ ID NO: 1249927 - RNA, 19 nt, Human
ugagaaaagcgaacgcacg

SEQ ID NO: 1249928 - RNA, 24 nt, Human
ugcgacugcccaucuagcuucugg

SEQ ID NO: 1249929 - RNA, 22 nt, Human
uggggaauuugcuuucauuuuu

SEQ ID NO: 1249930 - RNA, 21 nt, Human
uucaccgcgggcgaaccuggc

SEQ ID NO: 1249931 - RNA, 23 nt, Human
uuccagcuccggcuccccaccuu

SEQ ID NO: 1249932 - RNA, 19 nt, Human
uucuuccagcuccggcucc

SEQ ID NO: 1249933 - RNA, 19 nt, Human
uucuucccaaacaacccga

SEQ ID NO: 1249934 - RNA, 23 nt, Human
agaaccugcucacuacgcuccac

SEQ ID NO: 1249935 - RNA, 22 nt, Human
agacccggcgcugccgccagaa

SEQ ID NO: 1249936 - RNA, 18 nt, Human
agcugccgggcugagggc

SEQ ID NO: 1249937 - RNA, 21 nt, Human
agguagagggagacgacuucu

SEQ ID NO: 1249938 - RNA, 19 nt, Human
cagcagacccggcgcugcc

SEQ ID NO: 1249939 - RNA, 27 nt, Human
cagcucgucagggcccaaggccaaugg

SEQ ID NO: 1249940 - RNA, 22 nt, Human
cagggcaaaccccacaacugcc

SEQ ID NO: 1249941 - RNA, 19 nt, Human
ccccacaacugccugcgga

SEQ ID NO: 1249942 - RNA, 24 nt, Human
ccugugcccagggcaaaccggggc

SEQ ID NO: 1249943 - RNA, 18 nt, Human
cgcggccuggcgcugggu

SEQ ID NO: 1249944 - RNA, 21 nt, Human
cucacuacgcuccacacagcu

SEQ ID NO: 1249945 - RNA, 18 nt, Human
gaagaugggggcugccca

SEQ ID NO: 1249946 - RNA, 19 nt, Human
gaagaugggggcugcccag

SEQ ID NO: 1249947 - RNA, 18 nt, Human
gagugugagcccugugau

SEQ ID NO: 1249948 - RNA, 23 nt, Human
gcaugaguccgcgucgagcuggg

SEQ ID NO: 1249949 - RNA, 18 nt, Human
gcccagggcaaaccccac

SEQ ID NO: 1249950 - RNA, 25 nt, Human
ucagggcccaaccugagcacuccgc

SEQ ID NO: 1249951 - RNA, 20 nt, Human
uccacacagcucgucagggc

SEQ ID NO: 1249952 - RNA, 18 nt, Human
uccgagagcugccgggcu

SEQ ID NO: 1249953 - RNA, 20 nt, Human
uccugaagaugggggcugcc

SEQ ID NO: 1249954 - RNA, 18 nt, Human
ugccugcggaauguccuc

SEQ ID NO: 1249955 - RNA, 23 nt, Human
uuccagacaaaucuccacuccac

SEQ ID NO: 1249956 - RNA, 21 nt, Human
cauccuagcucucccaguaca

SEQ ID NO: 1249957 - RNA, 20 nt, Human
uguuuuccauccuagcucuc

SEQ ID NO: 1249958 - RNA, 20 nt, Human
uuuccauccuagcucuccca

SEQ ID NO: 1249959 - RNA, 21 nt, Human
ucaagagcugcuuucuccagu

SEQ ID NO: 1249960 - RNA, 21 nt, Human
ucuccaguucauuuuuggcua

SEQ ID NO: 1249961 - RNA, 18 nt, Human
accgcaggggaaggugcu

SEQ ID NO: 1249962 - RNA, 21 nt, Human
acugcagccaaacagugcgcu

SEQ ID NO: 1249963 - RNA, 21 nt, Human
agacaagaugaugugagcccg

SEQ ID NO: 1249964 - RNA, 22 nt, Human
agccaaacagugcgcugcagcc

SEQ ID NO: 1249965 - RNA, 21 nt, Human
agccagcgcugggggugcaca

SEQ ID NO: 1249966 - RNA, 23 nt, Human
agccaggggugggagugaguggg

SEQ ID NO: 1249967 - RNA, 19 nt, Human
agcgcugggggugcacaug

SEQ ID NO: 1249968 - RNA, 22 nt, Human
agcuggcuccaaggucagccuc

SEQ ID NO: 1249969 - RNA, 22 nt, Human
aggggugggagugagugggagc

SEQ ID NO: 1249970 - RNA, 22 nt, Human
caaaauuagugccaguugccug

SEQ ID NO: 1249971 - RNA, 18 nt, Human
caccggagacagcucuga

SEQ ID NO: 1249972 - RNA, 21 nt, Human
cagcugguucuauuggcuucc

SEQ ID NO: 1249973 - RNA, 19 nt, Human
caggccagagccagcgcug

SEQ ID NO: 1249974 - RNA, 22 nt, Human
cagucuucuccuuucuuuccca

SEQ ID NO: 1249975 - RNA, 21 nt, Human
caguugccugccgugcugagg

SEQ ID NO: 1249976 - RNA, 19 nt, Human
cauccucagcugcuguggg

SEQ ID NO: 1249977 - RNA, 20 nt, Human
ccaaggucagccuccccaag

SEQ ID NO: 1249978 - RNA, 18 nt, Human
ccccggcuggcagccagg

SEQ ID NO: 1249979 - RNA, 22 nt, Human
cccgggcucucaacugcagcca

SEQ ID NO: 1249980 - RNA, 22 nt, Human
cccuccagcacgcugggccugc

SEQ ID NO: 1249981 - RNA, 27 nt, Human
ccucccggcagacaagaugaugugagc

SEQ ID NO: 1249982 - RNA, 21 nt, Human
ccuccgaauguggggcuucug

SEQ ID NO: 1249983 - RNA, 18 nt, Human
cgcugggccugcccuggg

SEQ ID NO: 1249984 - RNA, 21 nt, Human
cgugcugaggccacuggccug

SEQ ID NO: 1249985 - RNA, 18 nt, Human
cuaccgccacuaccauca

SEQ ID NO: 1249986 - RNA, 19 nt, Human
cucauaaccgcuggggccu

SEQ ID NO: 1249987 - RNA, 19 nt, Human
cugauucccuccagcacgc

SEQ ID NO: 1249988 - RNA, 23 nt, Human
cugggccugcccuggggaucuac

SEQ ID NO: 1249989 - RNA, 18 nt, Human
cugugggauggaggggcu

SEQ ID NO: 1249990 - RNA, 21 nt, Human
gacaccggagacagcucugaa

SEQ ID NO: 1249991 - RNA, 19 nt, Human
gaggugccugcugaagggg

SEQ ID NO: 1249992 - RNA, 18 nt, Human
gcacuaaauccucccggc

SEQ ID NO: 1249993 - RNA, 21 nt, Human
gcagcuggcucagcggggucc

SEQ ID NO: 1249994 - RNA, 19 nt, Human
gccaaacagugcgcugcag

SEQ ID NO: 1249995 - RNA, 23 nt, Human
gccaaacagugcgcugcagccuc

SEQ ID NO: 1249996 - RNA, 24 nt, Human
gcuccaaggucagccuccccaagc

SEQ ID NO: 1249997 - RNA, 18 nt, Human
gcugcagccuccgaaugu

SEQ ID NO: 1249998 - RNA, 22 nt, Human
ggggaucuacagggggcagcug

SEQ ID NO: 1249999 - RNA, 21 nt, Human
gggggcagcuggcucagcggg

SEQ ID NO: 1250000 - RNA, 22 nt, Human
ggugggagugagugggagcugu

SEQ ID NO: 1250001 - RNA, 19 nt, Human
uacaggggugaugccggcc

SEQ ID NO: 1250002 - RNA, 19 nt, Human
uaccgccacuaccauccag

SEQ ID NO: 1250003 - RNA, 23 nt, Human
ucagccgaagagcuauugaccgc

SEQ ID NO: 1250004 - RNA, 19 nt, Human
uccaaggucagccucccca

SEQ ID NO: 1250005 - RNA, 20 nt, Human
uccccaagcggucuuggucu

SEQ ID NO: 1250006 - RNA, 23 nt, Human
uccccaagcggucuuggucuccg

SEQ ID NO: 1250007 - RNA, 24 nt, Human
ugacaccggagacagcucugaacc

SEQ ID NO: 1250008 - RNA, 21 nt, Human
ugacucccgcacagacauccu

SEQ ID NO: 1250009 - RNA, 18 nt, Human
ugaggccacuggccuggc

SEQ ID NO: 1250010 - RNA, 21 nt, Human
ugcugugggauggaggggcug

SEQ ID NO: 1250011 - RNA, 23 nt, Human
uggcagccaggggugggagugag

SEQ ID NO: 1250012 - RNA, 21 nt, Human
uggcccagguacggcaggugc

SEQ ID NO: 1250013 - RNA, 23 nt, Human
uggcucagcgggguccucagcag

SEQ ID NO: 1250014 - RNA, 24 nt, Human
uggcuuccuguccugcaggaccug

SEQ ID NO: 1250015 - RNA, 19 nt, Human
ugggagcuguggcugggcc

SEQ ID NO: 1250016 - RNA, 21 nt, Human
ugggauggaggggcugguucu

SEQ ID NO: 1250017 - RNA, 21 nt, Human
uggggggacuugggggucggg

SEQ ID NO: 1250018 - RNA, 18 nt, Human
ugguucugcacccaaccc

SEQ ID NO: 1250019 - RNA, 20 nt, Human
uuccuguccugcaggaccug

SEQ ID NO: 1250020 - RNA, 18 nt, Human
cccucuugcugguuggag

SEQ ID NO: 1250021 - RNA, 18 nt, Human
ccucuugcugguuggagg

SEQ ID NO: 1250022 - RNA, 19 nt, Human
ugguuggagguggcucuga

SEQ ID NO: 1250023 - RNA, 21 nt, Human
ccugcagcagggcggaagagc

SEQ ID NO: 1250024 - RNA, 24 nt, Human
cugcagcagggcggaagagccacu

SEQ ID NO: 1250025 - RNA, 22 nt, Human
gcugaaaaccuccaggucaucc

SEQ ID NO: 1250026 - RNA, 21 nt, Human
uccucguccagagccagcacc

SEQ ID NO: 1250027 - RNA, 19 nt, Human
ugaggcauaguugcugaaa

SEQ ID NO: 1250028 - RNA, 20 nt, Human
cccgguagaaaccaagggca

SEQ ID NO: 1250029 - RNA, 21 nt, Human
cggcccgguagaaaccaaggg

SEQ ID NO: 1250030 - RNA, 22 nt, Human
cugcuguuguguaauuuuuuuc

SEQ ID NO: 1250031 - RNA, 22 nt, Human
gaagucgccuggauuucccagg

SEQ ID NO: 1250032 - RNA, 19 nt, Human
gggcagggggagacgucug

SEQ ID NO: 1250033 - RNA, 22 nt, Human
uaaagaguugacggagacacag

SEQ ID NO: 1250034 - RNA, 22 nt, Human
ugccaaaguccagcaccaacgc

SEQ ID NO: 1250035 - RNA, 25 nt, Human
aaguguccccaaguuuccuuccaga

SEQ ID NO: 1250036 - RNA, 21 nt, Human
aaguuuccuuccaggaagaug

SEQ ID NO: 1250037 - RNA, 22 nt, Human
cagcaaguccggaagaaggucc

SEQ ID NO: 1250038 - RNA, 20 nt, Human
cagccgcggcugagcccggg

SEQ ID NO: 1250039 - RNA, 21 nt, Human
ccacuccggggucacgaagga

SEQ ID NO: 1250040 - RNA, 19 nt, Human
cccaaguuuccuuccagga

SEQ ID NO: 1250041 - RNA, 22 nt, Human
cggaagaagguccgggggcugg

SEQ ID NO: 1250042 - RNA, 18 nt, Human
cugggaaggggcggggcc

SEQ ID NO: 1250043 - RNA, 22 nt, Human
gagcccggggcguugaaugcgg

SEQ ID NO: 1250044 - RNA, 20 nt, Human
gcgcagccgcggcugagccc

SEQ ID NO: 1250045 - RNA, 22 nt, Human
gcuggaguccugggaccuagcu

SEQ ID NO: 1250046 - RNA, 23 nt, Human
ggaguccugggaccuagcucggg

SEQ ID NO: 1250047 - RNA, 18 nt, Human
uccgggcgcagccgcggc

SEQ ID NO: 1250048 - RNA, 19 nt, Human
uccgggcgcagccgcggcu

SEQ ID NO: 1250049 - RNA, 20 nt, Human
uccgggcgcagccgcggcug

SEQ ID NO: 1250050 - RNA, 19 nt, Human
uccgggggcuggaguccug

SEQ ID NO: 1250051 - RNA, 19 nt, Human
ugggaaggggcggggccuu

SEQ ID NO: 1250052 - RNA, 24 nt, Human
uuccagucugggaagggaggaaac

SEQ ID NO: 1250053 - RNA, 22 nt, Human
aaguuucucuuuaagucaugac

SEQ ID NO: 1250054 - RNA, 24 nt, Human
aggcagaguucacaaagaaagaaa

SEQ ID NO: 1250055 - RNA, 24 nt, Human
augacaacaauggcaugaccugcc

SEQ ID NO: 1250056 - RNA, 22 nt, Human
augcuguagaugccaucacuuu

SEQ ID NO: 1250057 - RNA, 19 nt, Human
cagaagcuucucccagguc

SEQ ID NO: 1250058 - RNA, 24 nt, Human
cauucagugguugcuccuacccau

SEQ ID NO: 1250059 - RNA, 24 nt, Human
ccagcagaagcuucucccaggucc

SEQ ID NO: 1250060 - RNA, 18 nt, Human
cccacagaagcuugcagg

SEQ ID NO: 1250061 - RNA, 22 nt, Human
cucgaugugcccacuggugcua

SEQ ID NO: 1250062 - RNA, 21 nt, Human
cugccagcagaagcuucuccc

SEQ ID NO: 1250063 - RNA, 23 nt, Human
cuucccgaauucucuaaauggga

SEQ ID NO: 1250064 - RNA, 18 nt, Human
cuugcagggaaccuuccc

SEQ ID NO: 1250065 - RNA, 23 nt, Human
cuuuccuuuuauagauguacugu

SEQ ID NO: 1250066 - RNA, 24 nt, Human
cuuugcaucacagaauuuuauuuu

SEQ ID NO: 1250067 - RNA, 21 nt, Human
gaagucaauuuggugccaccu

SEQ ID NO: 1250068 - RNA, 22 nt, Human
gagcuuaaggacauccuccucc

SEQ ID NO: 1250069 - RNA, 21 nt, Human
gccaccuaauuggauucccac

SEQ ID NO: 1250070 - RNA, 22 nt, Human
gcuuaaggacauccuccuccuu

SEQ ID NO: 1250071 - RNA, 24 nt, Human
gcuuaaggacauccuccuccuuca

SEQ ID NO: 1250072 - RNA, 24 nt, Human
ggaaccuucccgaauucucuaaau

SEQ ID NO: 1250073 - RNA, 19 nt, Human
guagaugccaucacuuucc

SEQ ID NO: 1250074 - RNA, 20 nt, Human
uaaggacauccuccuccuuc

SEQ ID NO: 1250075 - RNA, 21 nt, Human
uaaggcagaguucacaaagaa

SEQ ID NO: 1250076 - RNA, 19 nt, Human
ucacagaauuuuauuuuuu

SEQ ID NO: 1250077 - RNA, 18 nt, Human
ucccacagaagcuugcag

SEQ ID NO: 1250078 - RNA, 23 nt, Human
ucuccgauguguuugcucucgau

SEQ ID NO: 1250079 - RNA, 23 nt, Human
ucucuuuaagucaugacaggaau

SEQ ID NO: 1250080 - RNA, 31 nt, Human
ugacaacaauggcaugaccugccagcagaag

SEQ ID NO: 1250081 - RNA, 23 nt, Human
ugacaggaaucuuugaguuaagg

SEQ ID NO: 1250082 - RNA, 24 nt, Human
uguuugcucucgaugugcccacug

SEQ ID NO: 1250083 - RNA, 18 nt, Human
uucuggccaguauuccug

SEQ ID NO: 1250084 - RNA, 21 nt, Human
uugaguuaaggcagaguucac

SEQ ID NO: 1250085 - RNA, 23 nt, Human
uuuauuuucugucaaccuuauuu

SEQ ID NO: 1250086 - RNA, 18 nt, Human
aacuccaagccguuacug

SEQ ID NO: 1250087 - RNA, 21 nt, Human
aaacaucccauagacagagcg

SEQ ID NO: 1250088 - RNA, 21 nt, Human
aaacuuucccuccagagaaac

SEQ ID NO: 1250089 - RNA, 23 nt, Human
aacagugggugaaagcccgaagc

SEQ ID NO: 1250090 - RNA, 20 nt, Human
aacuguuuaaggagaauguu

SEQ ID NO: 1250091 - RNA, 20 nt, Human
aaggagaaauggagaaagca

SEQ ID NO: 1250092 - RNA, 19 nt, Human
aagugcagaaacucaucgc

SEQ ID NO: 1250093 - RNA, 22 nt, Human
acaagaaaggagauacaaugua

SEQ ID NO: 1250094 - RNA, 22 nt, Human
acacagauaccugcacugcccc

SEQ ID NO: 1250095 - RNA, 18 nt, Human
acaucacuguacccaggg

SEQ ID NO: 1250096 - RNA, 21 nt, Human
accagguaguuuggaaguucu

SEQ ID NO: 1250097 - RNA, 22 nt, Human
acccuauuuccaggaaacccac

SEQ ID NO: 1250098 - RNA, 20 nt, Human
acucuuaucuucccacugaa

SEQ ID NO: 1250099 - RNA, 18 nt, Human
acugcaaucuacuggcuu

SEQ ID NO: 1250100 - RNA, 19 nt, Human
acuugauagggguagugac

SEQ ID NO: 1250101 - RNA, 21 nt, Human
acuugucauucacuggaacga

SEQ ID NO: 1250102 - RNA, 21 nt, Human
agaaaggagauacaauguaag

SEQ ID NO: 1250103 - RNA, 22 nt, Human
agaaaggagauacaauguaagu

SEQ ID NO: 1250104 - RNA, 20 nt, Human
agagaaggaggcuuucaguc

SEQ ID NO: 1250105 - RNA, 21 nt, Human
agagccaggucucugggaagu

SEQ ID NO: 1250106 - RNA, 20 nt, Human
agaguaaaaggagaaaugga

SEQ ID NO: 1250107 - RNA, 18 nt, Human
agcacagagacaacugga

SEQ ID NO: 1250108 - RNA, 23 nt, Human
agcaggaggugguacaagaaagg

SEQ ID NO: 1250109 - RNA, 25 nt, Human
agcaggaggugguacaagagggacc

SEQ ID NO: 1250110 - RNA, 22 nt, Human
agccacuggggagcugguuucc

SEQ ID NO: 1250111 - RNA, 19 nt, Human
agcuacaacaccuccacug

SEQ ID NO: 1250112 - RNA, 23 nt, Human
aggaaacagaucccagagccagg

SEQ ID NO: 1250113 - RNA, 21 nt, Human
aggaagcugcggguugugcug

SEQ ID NO: 1250114 - RNA, 20 nt, Human
agggagaaaauguaagccaa

SEQ ID NO: 1250115 - RNA, 21 nt, Human
agggagcuaggccauuguuau

SEQ ID NO: 1250116 - RNA, 18 nt, Human
agguuccugcauuuguca

SEQ ID NO: 1250117 - RNA, 22 nt, Human
aguaaaaggagaaauggagaaa

SEQ ID NO: 1250118 - RNA, 18 nt, Human
agugaccauaccagaaug

SEQ ID NO: 1250119 - RNA, 24 nt, Human
aguuaguccaacagugggugaaag

SEQ ID NO: 1250120 - RNA, 24 nt, Human
aucuacauccuuucccaucuccag

SEQ ID NO: 1250121 - RNA, 20 nt, Human
augaagaugaauuucugagc

SEQ ID NO: 1250122 - RNA, 18 nt, Human
augacucaaaagccucug

SEQ ID NO: 1250123 - RNA, 18 nt, Human
augcauaugcugugaguu

SEQ ID NO: 1250124 - RNA, 23 nt, Human
auggccccuaacucuuaucuucc

SEQ ID NO: 1250125 - RNA, 21 nt, Human
caaacaaaccuucugaacgga

SEQ ID NO: 1250126 - RNA, 20 nt, Human
caacuucugggucuuguccu

SEQ ID NO: 1250127 - RNA, 22 nt, Human
caagguaaagggagcuaggcca

SEQ ID NO: 1250128 - RNA, 21 nt, Human
cacacugaaaguaccaaaggu

SEQ ID NO: 1250129 - RNA, 19 nt, Human
cacguuggcauagcagcca

SEQ ID NO: 1250130 - RNA, 19 nt, Human
cagaaacucaucgccuucc

SEQ ID NO: 1250131 - RNA, 19 nt, Human
cagaaacucaucgccuucc

SEQ ID NO: 1250132 - RNA, 21 nt, Human
cagggccuguguguagagguu

SEQ ID NO: 1250133 - RNA, 20 nt, Human
caggugcugagaaacauccu

SEQ ID NO: 1250134 - RNA, 20 nt, Human
caguccuuucuucuuagagu

SEQ ID NO: 1250135 - RNA, 21 nt, Human
caucucgcuccccaaaggcaa

SEQ ID NO: 1250136 - RNA, 21 nt, Human
cauggccccuaacucuuaucu

SEQ ID NO: 1250137 - RNA, 21 nt, Human
cauuuccccagccagggagaa

SEQ ID NO: 1250138 - RNA, 20 nt, Human
ccaacucccgacacccggau

SEQ ID NO: 1250139 - RNA, 22 nt, Human
ccacuggggagcugguuuccug

SEQ ID NO: 1250140 - RNA, 24 nt, Human
ccagccagggagaaaauguaagcc

SEQ ID NO: 1250141 - RNA, 23 nt, Human
ccauguguuuccauuuccaucuc

SEQ ID NO: 1250142 - RNA, 25 nt, Human
ccauuuccaucucgcuccccaaagg

SEQ ID NO: 1250143 - RNA, 21 nt, Human
ccccauaugcauuguguugcu

SEQ ID NO: 1250144 - RNA, 23 nt, Human
cccccauaugcauuguguugcuu

SEQ ID NO: 1250145 - RNA, 21 nt, Human
cccggagcgcacacagggauc

SEQ ID NO: 1250146 - RNA, 18 nt, Human
cccuccaucaccaaacuu

SEQ ID NO: 1250147 - RNA, 19 nt, Human
ccgacacccggauuguggc

SEQ ID NO: 1250148 - RNA, 19 nt, Human
ccgcccggagcgcacacag

SEQ ID NO: 1250149 - RNA, 22 nt, Human
ccuccagagaaacgucuguccc

SEQ ID NO: 1250150 - RNA, 22 nt, Human
ccuccagauaauggaacgcugg

SEQ ID NO: 1250151 - RNA, 23 nt, Human
ccucuggaugaccaccgccaccc

SEQ ID NO: 1250152 - RNA, 18 nt, Human
ccugccauccacuugaga

SEQ ID NO: 1250153 - RNA, 24 nt, Human
ccuggggcuggccacauuccgacg

SEQ ID NO: 1250154 - RNA, 23 nt, Human
ccuguugcuauuuggauccuguc

SEQ ID NO: 1250155 - RNA, 20 nt, Human
ccuugcucagguaccacuuc

SEQ ID NO: 1250156 - RNA, 18 nt, Human
cgaaaggauuccccacgg

SEQ ID NO: 1250157 - RNA, 19 nt, Human
cgcccggagcgcacacagg

SEQ ID NO: 1250158 - RNA, 20 nt, Human
cgcuccccaaaggcacugua

SEQ ID NO: 1250159 - RNA, 22 nt, Human
cgggucgauguaauaauccacc

SEQ ID NO: 1250160 - RNA, 22 nt, Human
cuaguggccuucgcuaucuccu

SEQ ID NO: 1250161 - RNA, 23 nt, Human
cucaaaagccucuggaugaccac

SEQ ID NO: 1250162 - RNA, 20 nt, Human
cucagguccaaacaaaccuu

SEQ ID NO: 1250163 - RNA, 20 nt, Human
cugcaguuggaggucuggcc

SEQ ID NO: 1250164 - RNA, 22 nt, Human
cugccacaguguaggugcccag

SEQ ID NO: 1250165 - RNA, 21 nt, Human
cugcccguuugcuucccacuc

SEQ ID NO: 1250166 - RNA, 22 nt, Human
cuggacacugaucauacucagc

SEQ ID NO: 1250167 - RNA, 22 nt, Human
cuuccaccuuaaacuucggcag

SEQ ID NO: 1250168 - RNA, 21 nt, Human
cuuccuccacaacaguagcca

SEQ ID NO: 1250169 - RNA, 24 nt, Human
cuuccuccacaacaguagccacaa

SEQ ID NO: 1250170 - RNA, 18 nt, Human
gaaaagguccgugccuuc

SEQ ID NO: 1250171 - RNA, 23 nt, Human
gaaggaggcuuucaguccuuucu

SEQ ID NO: 1250172 - RNA, 24 nt, Human
gaauucuugagacaccguagaccc

SEQ ID NO: 1250173 - RNA, 19 nt, Human
gacagagcgguugcucagc

SEQ ID NO: 1250174 - RNA, 18 nt, Human
gagaaaauguaagccaac

SEQ ID NO: 1250175 - RNA, 21 nt, Human
gcagcugcagcuccacuucug

SEQ ID NO: 1250176 - RNA, 22 nt, Human
gcauuuugguaguaacguggca

SEQ ID NO: 1250177 - RNA, 19 nt, Human
gcccggagcgcacacaggg

SEQ ID NO: 1250178 - RNA, 20 nt, Human
gcugguuuccugccauccac

SEQ ID NO: 1250179 - RNA, 20 nt, Human
gcugugugaaggagauuucc

SEQ ID NO: 1250180 - RNA, 20 nt, Human
ggaaaaagcugaaaaggucc

SEQ ID NO: 1250181 - RNA, 21 nt, Human
ggaagcuguucccguuccacc

SEQ ID NO: 1250182 - RNA, 19 nt, Human
ggaagugcagaaacucauc

SEQ ID NO: 1250183 - RNA, 20 nt, Human
ggaagugcagaaacucaucg

SEQ ID NO: 1250184 - RNA, 18 nt, Human
ggacaggucuacaaugcc

SEQ ID NO: 1250185 - RNA, 19 nt, Human
ggacaggucuacaaugccu

SEQ ID NO: 1250186 - RNA, 24 nt, Human
ggagaauguuucugauguccauuu

SEQ ID NO: 1250187 - RNA, 24 nt, Human
ggcauugggucaaugaggggcuga

SEQ ID NO: 1250188 - RNA, 21 nt, Human
ggcugaggaaagucccauggg

SEQ ID NO: 1250189 - RNA, 20 nt, Human
gggcauugggucaaugaggg

SEQ ID NO: 1250190 - RNA, 25 nt, Human
gggcauugggucaaugaggggcuga

SEQ ID NO: 1250191 - RNA, 20 nt, Human
ggguuccaccacuuccaccu

SEQ ID NO: 1250192 - RNA, 28 nt, Human
ggugauagggccaacauuccuagaagga

SEQ ID NO: 1250193 - RNA, 21 nt, Human
gguggaugccaaggaagcugc

SEQ ID NO: 1250194 - RNA, 24 nt, Human
gugcagaaacucaucgccuuccac

SEQ ID NO: 1250195 - RNA, 24 nt, Human
uaacuccuuggguuccaccacuuc

SEQ ID NO: 1250196 - RNA, 19 nt, Human
uacaagaaaggagauacaa

SEQ ID NO: 1250197 - RNA, 21 nt, Human
uacaagaaaggagauacaaug

SEQ ID NO: 1250198 - RNA, 20 nt, Human
uaccaauaggaaacagaucc

SEQ ID NO: 1250199 - RNA, 25 nt, Human
uaccaauaggaaacagaucccagag

SEQ ID NO: 1250200 - RNA, 19 nt, Human
uaccagaauggaaacaucc

SEQ ID NO: 1250201 - RNA, 21 nt, Human
uagacccugacucaccauugg

SEQ ID NO: 1250202 - RNA, 19 nt, Human
uaggaaacagaucccagag

SEQ ID NO: 1250203 - RNA, 19 nt, Human
uaggagaagcugaucucuu

SEQ ID NO: 1250204 - RNA, 20 nt, Human
uaggagaagcugaucucuug

SEQ ID NO: 1250205 - RNA, 23 nt, Human
uaggugcccagcauugccucugg

SEQ ID NO: 1250206 - RNA, 18 nt, Human
uauggcaagggcuauuac

SEQ ID NO: 1250207 - RNA, 24 nt, Human
ucaacaaagaacggcuugaaagca

SEQ ID NO: 1250208 - RNA, 24 nt, Human
ucagguguuucugccccuccauca

SEQ ID NO: 1250209 - RNA, 22 nt, Human
uccacaccugucccuuccucca

SEQ ID NO: 1250210 - RNA, 22 nt, Human
uccacacugaaaguaccaaagg

SEQ ID NO: 1250211 - RNA, 23 nt, Human
uccacacugaaaguaccaaaggu

SEQ ID NO: 1250212 - RNA, 20 nt, Human
uccaccagcacuuccugggg

SEQ ID NO: 1250213 - RNA, 21 nt, Human
uccacuagcuugacaaaugca

SEQ ID NO: 1250214 - RNA, 22 nt, Human
uccauuuccaucucgcucccca

SEQ ID NO: 1250215 - RNA, 18 nt, Human
ucccaugggccagacacu

SEQ ID NO: 1250216 - RNA, 21 nt, Human
uccuuggucuccagaguaacc

SEQ ID NO: 1250217 - RNA, 21 nt, Human
ucuacagccgcaggcucagac

SEQ ID NO: 1250218 - RNA, 18 nt, Human
ucucauccaccgcccgga

SEQ ID NO: 1250219 - RNA, 21 nt, Human
ucuccuuuugagucaggcugg

SEQ ID NO: 1250220 - RNA, 21 nt, Human
ucuccuuuugagucaggcugg

SEQ ID NO: 1250221 - RNA, 21 nt, Human
ucugaacggaggggaaauuua

SEQ ID NO: 1250222 - RNA, 21 nt, Human
ucuugagacaccguagacccu

SEQ ID NO: 1250223 - RNA, 23 nt, Human
ugaaagcccgaagccucuugacu

SEQ ID NO: 1250224 - RNA, 24 nt, Human
ugaaagcccgaagccucuugacug

SEQ ID NO: 1250225 - RNA, 21 nt, Human
ugaauuagaaccuuuuucuuc

SEQ ID NO: 1250226 - RNA, 22 nt, Human
ugacaaaugcaggaugcugcca

SEQ ID NO: 1250227 - RNA, 19 nt, Human
ugacacacagauaccugca

SEQ ID NO: 1250228 - RNA, 18 nt, Human
ugacugcaaucuacuggc

SEQ ID NO: 1250229 - RNA, 24 nt, Human
ugagacaccguagacccugacuca

SEQ ID NO: 1250230 - RNA, 24 nt, Human
ugagcuuggccaaagcauuuugug

SEQ ID NO: 1250231 - RNA, 20 nt, Human
ugaggaaggagucaucaugg

SEQ ID NO: 1250232 - RNA, 18 nt, Human
ugccaaggaagcugcggg

SEQ ID NO: 1250233 - RNA, 21 nt, Human
ugccauaaaucaccagaaaca

SEQ ID NO: 1250234 - RNA, 22 nt, Human
ugcccagcauugccucuggugc

SEQ ID NO: 1250235 - RNA, 22 nt, Human
ugcccgagaccugaucuccucc

SEQ ID NO: 1250236 - RNA, 20 nt, Human
ugcccugggguguagagagg

SEQ ID NO: 1250237 - RNA, 21 nt, Human
ugcccugggguguagagaggu

SEQ ID NO: 1250238 - RNA, 21 nt, Human
ugcccuuggggcauuggguca

SEQ ID NO: 1250239 - RNA, 24 nt, Human
ugccugcccguuugcuucccacuc

SEQ ID NO: 1250240 - RNA, 23 nt, Human
ugcugagaaacauccuguuuugu

SEQ ID NO: 1250241 - RNA, 19 nt, Human
uggaugaccaccgccaccc

SEQ ID NO: 1250242 - RNA, 22 nt, Human
uggaugguaaaaauugcuggaa

SEQ ID NO: 1250243 - RNA, 18 nt, Human
uggcauagaucaccaggg

SEQ ID NO: 1250244 - RNA, 22 nt, Human
uggccaaagcauuuugugacaa

SEQ ID NO: 1250245 - RNA, 23 nt, Human
uggccccuaacucuuaucuuccc

SEQ ID NO: 1250246 - RNA, 22 nt, Human
ugguaagcugggccaacaaugc

SEQ ID NO: 1250247 - RNA, 22 nt, Human
uucugaacggaggggaaauuua

SEQ ID NO: 1250248 - RNA, 19 nt, Human
uucuggcuccaguaaaugg

SEQ ID NO: 1250249 - RNA, 24 nt, Human
uugauggcuguacgcauauccaau

SEQ ID NO: 1250250 - RNA, 21 nt, Human
uugcuauuuggauccugucca

SEQ ID NO: 1250251 - RNA, 25 nt, Human
uugcucagcucucugucuuccucgg

SEQ ID NO: 1250252 - RNA, 18 nt, Human
uuggucguggagguggcc

SEQ ID NO: 1250253 - RNA, 22 nt, Human
uuggucguggagguggccgaau

SEQ ID NO: 1250254 - RNA, 23 nt, Human
uuuaaggagaauguuucugaugu

SEQ ID NO: 1250255 - RNA, 20 nt, Human
uuugaaacuuucccuccaga

SEQ ID NO: 1250256 - RNA, 22 nt, Human
uuaagauggcagggauuccuuu

SEQ ID NO: 1250257 - RNA, 25 nt, Human
cagaaccagaaaaacccagggaguu

SEQ ID NO: 1250258 - RNA, 23 nt, Human
gaauauacccaggguugugccac

SEQ ID NO: 1250259 - RNA, 23 nt, Human
uagaaagagaagggaauauaccc

SEQ ID NO: 1250260 - RNA, 23 nt, Human
uggcagugaauugcacugggccc

SEQ ID NO: 1250261 - RNA, 23 nt, Human
uguccuuugaguugaaaugauuu

SEQ ID NO: 1250262 - RNA, 19 nt, Human
uguucugaguuguggcagu

SEQ ID NO: 1250263 - RNA, 24 nt, Human
gccacuucccuugccaucucuggu

SEQ ID NO: 1250264 - RNA, 22 nt, Human
aacucacagagcagccacagcc

SEQ ID NO: 1250265 - RNA, 21 nt, Human
aagcucgcaggacagcagccc

SEQ ID NO: 1250266 - RNA, 23 nt, Human
accaggucacccacuacuggguc

SEQ ID NO: 1250267 - RNA, 19 nt, Human
agagcagccacagccugag

SEQ ID NO: 1250268 - RNA, 20 nt, Human
agagccccaggaaggcccag

SEQ ID NO: 1250269 - RNA, 23 nt, Human
agagccccaggaaggcccagagg

SEQ ID NO: 1250270 - RNA, 20 nt, Human
agcccccagggaccacccag

SEQ ID NO: 1250271 - RNA, 19 nt, Human
aggaaggcccagaggaggc

SEQ ID NO: 1250272 - RNA, 23 nt, Human
aggaaggcccagaggaggcagug

SEQ ID NO: 1250273 - RNA, 18 nt, Human
aggccacuggcugcccag

SEQ ID NO: 1250274 - RNA, 20 nt, Human
auggaggaggggcccagcag

SEQ ID NO: 1250275 - RNA, 22 nt, Human
caaggucagggcccuucccauc

SEQ ID NO: 1250276 - RNA, 19 nt, Human
cacagccugagcucccucu

SEQ ID NO: 1250277 - RNA, 27 nt, Human
cagagcagccacagccugaccccuugg

SEQ ID NO: 1250278 - RNA, 23 nt, Human
cagcagaggggccaagcucgcag

SEQ ID NO: 1250279 - RNA, 19 nt, Human
cagcagcccaaggucaggg

SEQ ID NO: 1250280 - RNA, 21 nt, Human
cagcccccagggaccacccag

SEQ ID NO: 1250281 - RNA, 23 nt, Human
cagccccucccucagagcagccc

SEQ ID NO: 1250282 - RNA, 19 nt, Human
cagggcccuucccaucagc

SEQ ID NO: 1250283 - RNA, 19 nt, Human
caggucagcuuccucagcc

SEQ ID NO: 1250284 - RNA, 18 nt, Human
cagguccuccgaaucccc

SEQ ID NO: 1250285 - RNA, 21 nt, Human
cagugggugguuugcaccagg

SEQ ID NO: 1250286 - RNA, 24 nt, Human
ccacggcgaugggccagguccucc

SEQ ID NO: 1250287 - RNA, 23 nt, Human
ccccaaggccuccagggcuacgg

SEQ ID NO: 1250288 - RNA, 20 nt, Human
ccccaggaaggcccagagga

SEQ ID NO: 1250289 - RNA, 18 nt, Human
ccccagggaccacccagc

SEQ ID NO: 1250290 - RNA, 20 nt, Human
ccccagggaccacccagccc

SEQ ID NO: 1250291 - RNA, 21 nt, Human
cccccagggaccacccagccc

SEQ ID NO: 1250292 - RNA, 24 nt, Human
ccccgugcucaccagaacaagaac

SEQ ID NO: 1250293 - RNA, 24 nt, Human
cccuccagggucacucugagaacc

SEQ ID NO: 1250294 - RNA, 18 nt, Human
cccuccucuccugagagc

SEQ ID NO: 1250295 - RNA, 23 nt, Human
ccuccagggcuacgggcaccguc

SEQ ID NO: 1250296 - RNA, 23 nt, Human
ccuccgaauccccaaggccucca

SEQ ID NO: 1250297 - RNA, 19 nt, Human
ccucuccugagagccgaag

SEQ ID NO: 1250298 - RNA, 22 nt, Human
ccugcugccccuuggccccagc

SEQ ID NO: 1250299 - RNA, 18 nt, Human
cgcaggacagcagcccaa

SEQ ID NO: 1250300 - RNA, 23 nt, Human
cggcgaugggccagguccuccuc

SEQ ID NO: 1250301 - RNA, 23 nt, Human
cguccugcugccccuuggcccca

SEQ ID NO: 1250302 - RNA, 21 nt, Human
cuccugagagccgaagagccc

SEQ ID NO: 1250303 - RNA, 23 nt, Human
cucgcuguggauccacauccugg

SEQ ID NO: 1250304 - RNA, 20 nt, Human
cugcugccccuuggccccag

SEQ ID NO: 1250305 - RNA, 21 nt, Human
cugcugccccuuggccccagc

SEQ ID NO: 1250306 - RNA, 28 nt, Human
cuuggccccagcucgagugcugcccagc

SEQ ID NO: 1250307 - RNA, 23 nt, Human
gaagagccccaggaaggcccaga

SEQ ID NO: 1250308 - RNA, 22 nt, Human
gaucacacuggcccuggaggac

SEQ ID NO: 1250309 - RNA, 22 nt, Human
gcacagcccccagggaccaccc

SEQ ID NO: 1250310 - RNA, 24 nt, Human
gcacagcccccagggaccacccag

SEQ ID NO: 1250311 - RNA, 23 nt, Human
gccgaagagccccaggaaggccc

SEQ ID NO: 1250312 - RNA, 19 nt, Human
gcugccccuuggccccagc

SEQ ID NO: 1250313 - RNA, 19 nt, Human
gcuuggugccguuccccgu

SEQ ID NO: 1250314 - RNA, 21 nt, Human
gucagcuuccucagccccucc

SEQ ID NO: 1250315 - RNA, 19 nt, Human
guuugcaccaggucaccca

SEQ ID NO: 1250316 - RNA, 23 nt, Human
uacuggguccccuuucucugucc

SEQ ID NO: 1250317 - RNA, 21 nt, Human
ucagcuuccucagccccuccc

SEQ ID NO: 1250318 - RNA, 24 nt, Human
ucagggcccuucccaucagcauug

SEQ ID NO: 1250319 - RNA, 18 nt, Human
ucccaaggcucgcccggg

SEQ ID NO: 1250320 - RNA, 22 nt, Human
uccccaaggccuccagggcuac

SEQ ID NO: 1250321 - RNA, 23 nt, Human
uccuccgaauccccaaggccucc

SEQ ID NO: 1250322 - RNA, 19 nt, Human
ucgcaggacagcagcccaa

SEQ ID NO: 1250323 - RNA, 22 nt, Human
ugagaagagggaugugcaucug

SEQ ID NO: 1250324 - RNA, 21 nt, Human
uguccugaugcagauguggga

SEQ ID NO: 1250325 - RNA, 27 nt, Human
uuccccgugcucaccagaacaagaaca

SEQ ID NO: 1250326 - RNA, 21 nt, Human
uuggugccguuccccgugcuc

SEQ ID NO: 1250327 - RNA, 21 nt, Human
aaaaccccuccacgauucccu

SEQ ID NO: 1250328 - RNA, 23 nt, Human
agaagacaccugagcucaaaacc

SEQ ID NO: 1250329 - RNA, 22 nt, Human
agaccuuuccagaggugagcug

SEQ ID NO: 1250330 - RNA, 18 nt, Human
agccucauccucgcccca

SEQ ID NO: 1250331 - RNA, 25 nt, Human
caaaaccccuccacgauuccccaga

SEQ ID NO: 1250332 - RNA, 23 nt, Human
cacagcuuggagaccuuuccaga

SEQ ID NO: 1250333 - RNA, 24 nt, Human
caccugagcucaaaaccccuccac

SEQ ID NO: 1250334 - RNA, 19 nt, Human
ccccagcaggccagggucu

SEQ ID NO: 1250335 - RNA, 21 nt, Human
ccccuggagacuuugggcgaa

SEQ ID NO: 1250336 - RNA, 24 nt, Human
ccucauccucgccccagcaggcca

SEQ ID NO: 1250337 - RNA, 22 nt, Human
ccugagcucaaaaccccuccac

SEQ ID NO: 1250338 - RNA, 21 nt, Human
cucaaaaccccuccacgauuc

SEQ ID NO: 1250339 - RNA, 24 nt, Human
cucaaaaccccuccacgauucccu

SEQ ID NO: 1250340 - RNA, 22 nt, Human
cugggccugaaccagggagggg

SEQ ID NO: 1250341 - RNA, 20 nt, Human
gagccucauccucgccccag

SEQ ID NO: 1250342 - RNA, 22 nt, Human
ggagaccuuuccagaggugagc

SEQ ID NO: 1250343 - RNA, 20 nt, Human
ggcugggccugaaccaggga

SEQ ID NO: 1250344 - RNA, 21 nt, Human
ggcugggccugaaccagggag

SEQ ID NO: 1250345 - RNA, 21 nt, Human
gggcugggccugaaccaggga

SEQ ID NO: 1250346 - RNA, 24 nt, Human
gggcugggccugaaccagggaggg

SEQ ID NO: 1250347 - RNA, 19 nt, Human
ggggcugggccugaaccag

SEQ ID NO: 1250348 - RNA, 23 nt, Human
uaggcgcggacaccccuggagac

SEQ ID NO: 1250349 - RNA, 19 nt, Human
uccccagaucacacagcuu

SEQ ID NO: 1250350 - RNA, 20 nt, Human
uggcagaagacaccugagcu

SEQ ID NO: 1250351 - RNA, 21 nt, Human
uuuccagaggugagcugagcu

SEQ ID NO: 1250352 - RNA, 19 nt, Human
aggguggcccuuguggggc

SEQ ID NO: 1250353 - RNA, 22 nt, Human
ccugcaggcagcugccugcugg

SEQ ID NO: 1250354 - RNA, 23 nt, Human
ccugcaggcagcugccugcugga

SEQ ID NO: 1250355 - RNA, 19 nt, Human
gaaggcugcugacucagca

SEQ ID NO: 1250356 - RNA, 21 nt, Human
gcagcugccugcuggaucuuc

SEQ ID NO: 1250357 - RNA, 24 nt, Human
gggcagguccugcaggcagcugcc

SEQ ID NO: 1250358 - RNA, 18 nt, Human
gguccugcaggcagcugc

SEQ ID NO: 1250359 - RNA, 23 nt, Human
gguggcccuuguggggcaggaug

SEQ ID NO: 1250360 - RNA, 24 nt, Human
gugggccucaggguggcccuugug

SEQ ID NO: 1250361 - RNA, 22 nt, Human
uagcccuggugcuucccgcagg

SEQ ID NO: 1250362 - RNA, 23 nt, Human
ugaauggagccggggaaggcugc

SEQ ID NO: 1250363 - RNA, 23 nt, Human
ugcuggaucuuccugugggccuc

SEQ ID NO: 1250364 - RNA, 21 nt, Human
aggcccggaaaccccuggcgg

SEQ ID NO: 1250365 - RNA, 20 nt, Human
caaacuccuccagagaccug

SEQ ID NO: 1250366 - RNA, 18 nt, Human
caccugaacgggcuguaa

SEQ ID NO: 1250367 - RNA, 20 nt, Human
caccugaacgggcuguaagg

SEQ ID NO: 1250368 - RNA, 19 nt, Human
cagcucugggcaaacuccu

SEQ ID NO: 1250369 - RNA, 22 nt, Human
caggagcacccauccuuccuca

SEQ ID NO: 1250370 - RNA, 18 nt, Human
cccaccgcccagcggggc

SEQ ID NO: 1250371 - RNA, 18 nt, Human
ccccuggcgccgccccgg

SEQ ID NO: 1250372 - RNA, 19 nt, Human
cccucugggugaaggugga

SEQ ID NO: 1250373 - RNA, 27 nt, Human
cgcccggcuccucugacccaccgccca

SEQ ID NO: 1250374 - RNA, 18 nt, Human
cggggccccuggcgccgc

SEQ ID NO: 1250375 - RNA, 19 nt, Human
cuccucugacccaccgccc

SEQ ID NO: 1250376 - RNA, 21 nt, Human
gcccggaaaccccuggcggcg

SEQ ID NO: 1250377 - RNA, 19 nt, Human
ggcccggaaaccccuggcg

SEQ ID NO: 1250378 - RNA, 20 nt, Human
gggccagauggcgggggcug

SEQ ID NO: 1250379 - RNA, 22 nt, Human
gggcgcccgccacggaggaggg

SEQ ID NO: 1250380 - RNA, 20 nt, Human
ggggcugguguuuauuuagu

SEQ ID NO: 1250381 - RNA, 19 nt, Human
guccuccuuccguuagggc

SEQ ID NO: 1250382 - RNA, 18 nt, Human
ugacccaccgcccagcgg

SEQ ID NO: 1250383 - RNA, 25 nt, Human
uguuuauuuaguaggggcccccaug

SEQ ID NO: 1250384 - RNA, 19 nt, Human
aaaaaaccaagcaaagagu

SEQ ID NO: 1250385 - RNA, 19 nt, Human
aaaaaccaagcaaagagug

SEQ ID NO: 1250386 - RNA, 26 nt, Human
aaaaacuaaacagguauuuuggacaa

SEQ ID NO: 1250387 - RNA, 28 nt, Human
aaacagguauuuuggacaacacauucuu

SEQ ID NO: 1250388 - RNA, 21 nt, Human
aauguccaauucauccuuugc

SEQ ID NO: 1250389 - RNA, 18 nt, Human
acuuugggaaaagaaaga

SEQ ID NO: 1250390 - RNA, 26 nt, Human
agaaagaccuuuuucuacauuugcuu

SEQ ID NO: 1250391 - RNA, 22 nt, Human
agauaguucuggggccucaggg

SEQ ID NO: 1250392 - RNA, 21 nt, Human
agccuccugguaaauccuccg

SEQ ID NO: 1250393 - RNA, 22 nt, Human
auacauacuuaaaaaaccaagc

SEQ ID NO: 1250394 - RNA, 24 nt, Human
auaguucuggggccucagggggcu

SEQ ID NO: 1250395 - RNA, 19 nt, Human
ccaauucauccuuugcacc

SEQ ID NO: 1250396 - RNA, 23 nt, Human
cccgccccuaaacugacuguucu

SEQ ID NO: 1250397 - RNA, 19 nt, Human
cgguagggaaaguucucac

SEQ ID NO: 1250398 - RNA, 27 nt, Human
cucacucugcauuauaaaaaggacaac

SEQ ID NO: 1250399 - RNA, 18 nt, Human
cucuucgacaauguccaa

SEQ ID NO: 1250400 - RNA, 23 nt, Human
cugcauuauaaaaaggacagcca

SEQ ID NO: 1250401 - RNA, 18 nt, Human
cuuaaagagacuuccucc

SEQ ID NO: 1250402 - RNA, 18 nt, Human
gaagaacuuggcuuccac

SEQ ID NO: 1250403 - RNA, 18 nt, Human
gagacuuccuccacugcc

SEQ ID NO: 1250404 - RNA, 21 nt, Human
ggggccucagggggcucaugu

SEQ ID NO: 1250405 - RNA, 19 nt, Human
uagccuccugguaaauccu

SEQ ID NO: 1250406 - RNA, 19 nt, Human
uaggaguuuuuuccuguuu

SEQ ID NO: 1250407 - RNA, 21 nt, Human
uagggaaaguucucacucugc

SEQ ID NO: 1250408 - RNA, 22 nt, Human
uccauacauacuuaaaaaacca

SEQ ID NO: 1250409 - RNA, 18 nt, Human
ucuugguguuaaugaugg

SEQ ID NO: 1250410 - RNA, 25 nt, Human
ugaauagccuccugguaaauccucc

SEQ ID NO: 1250411 - RNA, 23 nt, Human
uggaaccuagacaacauuuauca

SEQ ID NO: 1250412 - RNA, 24 nt, Human
uggaaccuagacaacauuuaucaa

SEQ ID NO: 1250413 - RNA, 24 nt, Human
uuccacuuugggaaaagaaagacc

SEQ ID NO: 1250414 - RNA, 20 nt, Human
uuccuccacugccagagauc

SEQ ID NO: 1250415 - RNA, 20 nt, Human
uucuuggcaauggaaccuag

SEQ ID NO: 1250416 - RNA, 20 nt, Human
uucuugguguuaaugauggu

SEQ ID NO: 1250417 - RNA, 21 nt, Human
uucuugguguuaaugaugguu

SEQ ID NO: 1250418 - RNA, 25 nt, Human
uugguguuaaugaugguuuugucuu

SEQ ID NO: 1250419 - RNA, 21 nt, Human
uuuuguucuugguguuaauga

SEQ ID NO: 1250420 - RNA, 25 nt, Human
aaauaaccaucucaagaauaugaaa

SEQ ID NO: 1250421 - RNA, 20 nt, Human
aaaugucuuucuggccagac

SEQ ID NO: 1250422 - RNA, 18 nt, Human
aacacugccauccccacu

SEQ ID NO: 1250423 - RNA, 20 nt, Human
aacuugcucuccagauccca

SEQ ID NO: 1250424 - RNA, 22 nt, Human
aagaagcguggacucuuguccu

SEQ ID NO: 1250425 - RNA, 21 nt, Human
aagcacuggcaagacucgugc

SEQ ID NO: 1250426 - RNA, 19 nt, Human
accauccuguguuucuggc

SEQ ID NO: 1250427 - RNA, 18 nt, Human
acccuugcaagcuggaag

SEQ ID NO: 1250428 - RNA, 21 nt, Human
accugcagguacuggucagcg

SEQ ID NO: 1250429 - RNA, 22 nt, Human
agagauuucccaaauacagcac

SEQ ID NO: 1250430 - RNA, 22 nt, Human
agauaaaugcucccagccagug

SEQ ID NO: 1250431 - RNA, 23 nt, Human
agauggccaaugacggucugacc

SEQ ID NO: 1250432 - RNA, 22 nt, Human
agccagugagagaagcaccagg

SEQ ID NO: 1250433 - RNA, 19 nt, Human
agccgguagccagcucucc

SEQ ID NO: 1250434 - RNA, 21 nt, Human
agcgcagcgugguccuggggu

SEQ ID NO: 1250435 - RNA, 21 nt, Human
agcuguggggagggaggcugg

SEQ ID NO: 1250436 - RNA, 19 nt, Human
aggaggucagggaccaucc

SEQ ID NO: 1250437 - RNA, 20 nt, Human
aggaggucagggaccauccu

SEQ ID NO: 1250438 - RNA, 21 nt, Human
aggcagauggucacugccagg

SEQ ID NO: 1250439 - RNA, 21 nt, Human
aggccugugguccacggugag

SEQ ID NO: 1250440 - RNA, 19 nt, Human
aguugcugagcagcagaga

SEQ ID NO: 1250441 - RNA, 18 nt, Human
aucuccuucgagcugccg

SEQ ID NO: 1250442 - RNA, 21 nt, Human
aucuccuucgagcugccguug

SEQ ID NO: 1250443 - RNA, 23 nt, Human
augaagcuguaagcaaacacugc

SEQ ID NO: 1250444 - RNA, 21 nt, Human
augacaauaaaagcaccuguc

SEQ ID NO: 1250445 - RNA, 21 nt, Human
auggucuucaagaccagaaag

SEQ ID NO: 1250446 - RNA, 22 nt, Human
auggugcuaucauggugacgag

SEQ ID NO: 1250447 - RNA, 20 nt, Human
caaauuuccgccagagcucu

SEQ ID NO: 1250448 - RNA, 19 nt, Human
caagaauaugaaauaggag

SEQ ID NO: 1250449 - RNA, 18 nt, Human
caagaccagaaagaaaag

SEQ ID NO: 1250450 - RNA, 24 nt, Human
caagaccagaaagaaaaguuaugc

SEQ ID NO: 1250451 - RNA, 25 nt, Human
cacaauucuguaggaggucagggac

SEQ ID NO: 1250452 - RNA, 18 nt, Human
cacagaccgugcagauac

SEQ ID NO: 1250453 - RNA, 25 nt, Human
caccgaggcuuucagccucgggaac

SEQ ID NO: 1250454 - RNA, 18 nt, Human
cacucagcuguggggagg

SEQ ID NO: 1250455 - RNA, 18 nt, Human
cacugcuaacaaucagaa

SEQ ID NO: 1250456 - RNA, 28 nt, Human
cagaccgugcagauaccugguuaaagag

SEQ ID NO: 1250457 - RNA, 19 nt, Human
cagacgaaaccugcuccuu

SEQ ID NO: 1250458 - RNA, 27 nt, Human
cagcaaagucgaggccugugguccacg

SEQ ID NO: 1250459 - RNA, 21 nt, Human
cagcaucuccucaaugcucau

SEQ ID NO: 1250460 - RNA, 19 nt, Human
cagccucuggguuuccaau

SEQ ID NO: 1250461 - RNA, 19 nt, Human
cagcuucugggaccggucc

SEQ ID NO: 1250462 - RNA, 20 nt, Human
cagggaaugaagaugaccac

SEQ ID NO: 1250463 - RNA, 22 nt, Human
cauauugucgcacguuccuggg

SEQ ID NO: 1250464 - RNA, 18 nt, Human
ccaaauaaccaucucaag

SEQ ID NO: 1250465 - RNA, 22 nt, Human
ccacagcagacuucuacgccac

SEQ ID NO: 1250466 - RNA, 19 nt, Human
ccagaaagaaaaguuaugc

SEQ ID NO: 1250467 - RNA, 19 nt, Human
ccagagcucugcaccugcu

SEQ ID NO: 1250468 - RNA, 28 nt, Human
cccacugcuaacaaucagaagguuuucc

SEQ ID NO: 1250469 - RNA, 24 nt, Human
ccccacuaggaaauacgccaaggg

SEQ ID NO: 1250470 - RNA, 22 nt, Human
ccccagagaccagacggugucc

SEQ ID NO: 1250471 - RNA, 18 nt, Human
cccucagcuucuguccca

SEQ ID NO: 1250472 - RNA, 18 nt, Human
cccucugggcuucagagg

SEQ ID NO: 1250473 - RNA, 26 nt, Human
ccggguaagguccagccguauccgcc

SEQ ID NO: 1250474 - RNA, 22 nt, Human
ccucgggaaccugcccuggcuu

SEQ ID NO: 1250475 - RNA, 22 nt, Human
ccucuauagcgcugggaugccu

SEQ ID NO: 1250476 - RNA, 23 nt, Human
ccugagaaacagauccaucuccu

SEQ ID NO: 1250477 - RNA, 22 nt, Human
ccugggacccugugccagcaaa

SEQ ID NO: 1250478 - RNA, 20 nt, Human
ccugggcuucccucugggcu

SEQ ID NO: 1250479 - RNA, 26 nt, Human
ccuguccccuggccucgggcucuggg

SEQ ID NO: 1250480 - RNA, 22 nt, Human
ccuguguuucuggcagagcuga

SEQ ID NO: 1250481 - RNA, 19 nt, Human
ccuucaggccacagcagac

SEQ ID NO: 1250482 - RNA, 21 nt, Human
cgagugcgcugaggacagcug

SEQ ID NO: 1250483 - RNA, 21 nt, Human
cgccaagggcagccgguagcc

SEQ ID NO: 1250484 - RNA, 22 nt, Human
cggaccucuccccaauauaaaa

SEQ ID NO: 1250485 - RNA, 27 nt, Human
cuccagaucccaacaccaguagucacu

SEQ ID NO: 1250486 - RNA, 18 nt, Human
cucgggcucuggggcaug

SEQ ID NO: 1250487 - RNA, 24 nt, Human
cugcagccucuggguuuccaauga

SEQ ID NO: 1250488 - RNA, 19 nt, Human
cugggcacauaggcuggcc

SEQ ID NO: 1250489 - RNA, 20 nt, Human
cuuccaaagggcuggccugc

SEQ ID NO: 1250490 - RNA, 19 nt, Human
cuucugggaccgguccacc

SEQ ID NO: 1250491 - RNA, 19 nt, Human
cuuuauccucauuucccag

SEQ ID NO: 1250492 - RNA, 23 nt, Human
cuuucuggaacuguauauucugg

SEQ ID NO: 1250493 - RNA, 19 nt, Human
gaaccugggcuucccucug

SEQ ID NO: 1250494 - RNA, 19 nt, Human
gacccugugccagcaaagu

SEQ ID NO: 1250495 - RNA, 21 nt, Human
gacuuguagugcacccucccc

SEQ ID NO: 1250496 - RNA, 18 nt, Human
gaucuuccucucccugcc

SEQ ID NO: 1250497 - RNA, 21 nt, Human
gcaaacacugccauccccacu

SEQ ID NO: 1250498 - RNA, 18 nt, Human
gcagguacuggucagcgc

SEQ ID NO: 1250499 - RNA, 18 nt, Human
gccagcaaagucgaggcc

SEQ ID NO: 1250500 - RNA, 23 nt, Human
gccagcucucccgaucuuccucu

SEQ ID NO: 1250501 - RNA, 19 nt, Human
gccggguaagguccagccg

SEQ ID NO: 1250502 - RNA, 20 nt, Human
gccucccuucaaacuucagc

SEQ ID NO: 1250503 - RNA, 19 nt, Human
gccucggguccuggucagc

SEQ ID NO: 1250504 - RNA, 21 nt, Human
gccugugguccacggugagga

SEQ ID NO: 1250505 - RNA, 19 nt, Human
gcgcagcgugguccugggg

SEQ ID NO: 1250506 - RNA, 20 nt, Human
gcgcugaggacagcuggcug

SEQ ID NO: 1250507 - RNA, 18 nt, Human
gcuggcgggggacccggg

SEQ ID NO: 1250508 - RNA, 20 nt, Human
ggagcccuguccccuggccu

SEQ ID NO: 1250509 - RNA, 18 nt, Human
ggccucgggcucuggggc

SEQ ID NO: 1250510 - RNA, 19 nt, Human
ggcucuggggcauggacug

SEQ ID NO: 1250511 - RNA, 18 nt, Human
gggagggaggcuggcggg

SEQ ID NO: 1250512 - RNA, 22 nt, Human
gggaguucuuagccaucuuuuu

SEQ ID NO: 1250513 - RNA, 21 nt, Human
gggaugcauauugucgcacgu

SEQ ID NO: 1250514 - RNA, 21 nt, Human
gggcuucagagggggcugugg

SEQ ID NO: 1250515 - RNA, 18 nt, Human
ggggagggaggcuggcgg

SEQ ID NO: 1250516 - RNA, 20 nt, Human
ggggagggaggcuggcgggg

SEQ ID NO: 1250517 - RNA, 18 nt, Human
ggugaccugcagguacug

SEQ ID NO: 1250518 - RNA, 24 nt, Human
guaagcaaacacugccauccccac

SEQ ID NO: 1250519 - RNA, 19 nt, Human
gucaccugaagcaucuauc

SEQ ID NO: 1250520 - RNA, 21 nt, Human
gucguuuggaagcuucuuggu

SEQ ID NO: 1250521 - RNA, 18 nt, Human
guuccugggguacagcuc

SEQ ID NO: 1250522 - RNA, 20 nt, Human
guugauuugcugaaagucuu

SEQ ID NO: 1250523 - RNA, 20 nt, Human
uaacccacugcuaacaauca

SEQ ID NO: 1250524 - RNA, 22 nt, Human
uaacuuuguccaggagagcaau

SEQ ID NO: 1250525 - RNA, 22 nt, Human
uaagcaaacacugccaucccca

SEQ ID NO: 1250526 - RNA, 21 nt, Human
uaaguaccgcacgaaaagucc

SEQ ID NO: 1250527 - RNA, 20 nt, Human
uacagcuccacaaugucacc

SEQ ID NO: 1250528 - RNA, 21 nt, Human
uacuggucagcgcugcuguuc

SEQ ID NO: 1250529 - RNA, 18 nt, Human
ucaaaggcugauggugcu

SEQ ID NO: 1250530 - RNA, 22 nt, Human
ucaccugaagcaucuaucuuga

SEQ ID NO: 1250531 - RNA, 23 nt, Human
ucacuauggcagcuguuuugcuc

SEQ ID NO: 1250532 - RNA, 24 nt, Human
ucagcaucuccucaaugcucaugc

SEQ ID NO: 1250533 - RNA, 19 nt, Human
ucagcuccuucuucgacug

SEQ ID NO: 1250534 - RNA, 19 nt, Human
uccaauauagcuucccuga

SEQ ID NO: 1250535 - RNA, 19 nt, Human
uccacaaugucaccugaag

SEQ ID NO: 1250536 - RNA, 23 nt, Human
uccagaucccaacaccaguaguc

SEQ ID NO: 1250537 - RNA, 21 nt, Human
ucccaaagugucagcuccuuc

SEQ ID NO: 1250538 - RNA, 23 nt, Human
ucccaaauacagcacaaggaccc

SEQ ID NO: 1250539 - RNA, 21 nt, Human
ucccaacaccaguagucacuu

SEQ ID NO: 1250540 - RNA, 19 nt, Human
uccccuggccucgggcucu

SEQ ID NO: 1250541 - RNA, 21 nt, Human
uccccuggccucgggcucugg

SEQ ID NO: 1250542 - RNA, 24 nt, Human
ucccgggucugacuuucggaccuc

SEQ ID NO: 1250543 - RNA, 20 nt, Human
ucccugagucaaaaugggcc

SEQ ID NO: 1250544 - RNA, 18 nt, Human
uccgccuccuucaugucc

SEQ ID NO: 1250545 - RNA, 24 nt, Human
ucgaaccugggcuucccucugggc

SEQ ID NO: 1250546 - RNA, 22 nt, Human
ucgugcgggaguucuuagccau

SEQ ID NO: 1250547 - RNA, 20 nt, Human
ucuccuccucuucuucacuc

SEQ ID NO: 1250548 - RNA, 22 nt, Human
ucuggaaugacaauaaaagcac

SEQ ID NO: 1250549 - RNA, 21 nt, Human
ucuuccuggcugugcuuccaa

SEQ ID NO: 1250550 - RNA, 19 nt, Human
ugaagcaucuaucuugaaa

SEQ ID NO: 1250551 - RNA, 18 nt, Human
ugacaauaaaagcaccug

SEQ ID NO: 1250552 - RNA, 19 nt, Human
ugaccacaaaguuacaggc

SEQ ID NO: 1250553 - RNA, 23 nt, Human
ugacgagggagaccaccacacug

SEQ ID NO: 1250554 - RNA, 19 nt, Human
ugacuuucggaccucuccc

SEQ ID NO: 1250555 - RNA, 20 nt, Human
ugacuuucggaccucucccc

SEQ ID NO: 1250556 - RNA, 19 nt, Human
ugagagaagcaccaggaug

SEQ ID NO: 1250557 - RNA, 22 nt, Human
ugagauaaaugcucccagccag

SEQ ID NO: 1250558 - RNA, 20 nt, Human
ugaggucaaaggcugauggu

SEQ ID NO: 1250559 - RNA, 22 nt, Human
ugauggagagcuucagcaucuc

SEQ ID NO: 1250560 - RNA, 19 nt, Human
ugcagcgaauguuugccau

SEQ ID NO: 1250561 - RNA, 21 nt, Human
ugccaugagaucuuucuggaa

SEQ ID NO: 1250562 - RNA, 19 nt, Human
ugcccgagugcgcugagga

SEQ ID NO: 1250563 - RNA, 26 nt, Human
ugcccucagcuucugucccauagucc

SEQ ID NO: 1250564 - RNA, 18 nt, Human
ugcuguuaacuuugucca

SEQ ID NO: 1250565 - RNA, 21 nt, Human
ugcuugcacacagaccgugca

SEQ ID NO: 1250566 - RNA, 24 nt, Human
ugcuuggcgucuccuccucuucuu

SEQ ID NO: 1250567 - RNA, 21 nt, Human
ugcuuucuuccugggucugga

SEQ ID NO: 1250568 - RNA, 19 nt, Human
uggcagcuguuuugcucuc

SEQ ID NO: 1250569 - RNA, 20 nt, Human
uggccucucaaggugacccu

SEQ ID NO: 1250570 - RNA, 19 nt, Human
ugggaggggcucuggagcg

SEQ ID NO: 1250571 - RNA, 21 nt, Human
ugggaggggcucuggagcgcc

SEQ ID NO: 1250572 - RNA, 18 nt, Human
uggggaccccagggagag

SEQ ID NO: 1250573 - RNA, 21 nt, Human
uggggaccccagggagaggug

SEQ ID NO: 1250574 - RNA, 22 nt, Human
uggggaccccagggagagguga

SEQ ID NO: 1250575 - RNA, 21 nt, Human
uggggagggaggcuggcggga

SEQ ID NO: 1250576 - RNA, 26 nt, Human
uggggagggaggcuggcgggggaccc

SEQ ID NO: 1250577 - RNA, 19 nt, Human
uggggauggucuuccuggc

SEQ ID NO: 1250578 - RNA, 20 nt, Human
uggggccugggacccugugc

SEQ ID NO: 1250579 - RNA, 22 nt, Human
ugguagagguagcacuggcugg

SEQ ID NO: 1250580 - RNA, 18 nt, Human
ugguccacggugaggagg

SEQ ID NO: 1250581 - RNA, 18 nt, Human
uguaaaugucauaggugu

SEQ ID NO: 1250582 - RNA, 24 nt, Human
ugucauaggugugcgcgaucuguu

SEQ ID NO: 1250583 - RNA, 22 nt, Human
ugucguuuggaagcuucuuggu

SEQ ID NO: 1250584 - RNA, 19 nt, Human
ugucucuauccugccacuc

SEQ ID NO: 1250585 - RNA, 21 nt, Human
uguucugcuggucacugcugg

SEQ ID NO: 1250586 - RNA, 19 nt, Human
uucagagggggcugugggu

SEQ ID NO: 1250587 - RNA, 22 nt, Human
uucagcaucuccucaaugcuca

SEQ ID NO: 1250588 - RNA, 19 nt, Human
uucagccucgggaaccugc

SEQ ID NO: 1250589 - RNA, 20 nt, Human
uucauuggaagcacuggcaa

SEQ ID NO: 1250590 - RNA, 25 nt, Human
uuccugugaaggucacuggugcuug

SEQ ID NO: 1250591 - RNA, 20 nt, Human
uucuucccuucaggccacag

SEQ ID NO: 1250592 - RNA, 25 nt, Human
uugcacacagaccgugcagauaccu

SEQ ID NO: 1250593 - RNA, 19 nt, Human
uuuggaagcuucuuggugc

SEQ ID NO: 1250594 - RNA, 21 nt, Human
aaaaaagaaaaaugcuaaagg

SEQ ID NO: 1250595 - RNA, 22 nt, Human
aaaaaagaaaaaugcuaaagga

SEQ ID NO: 1250596 - RNA, 18 nt, Human
aaaaagcucccccaaaag

SEQ ID NO: 1250597 - RNA, 19 nt, Human
aaauaaacuuaaacuauaa

SEQ ID NO: 1250598 - RNA, 21 nt, Human
aacauuaaaaaagcauggcag

SEQ ID NO: 1250599 - RNA, 22 nt, Human
aacucgauaugcacgcuaauga

SEQ ID NO: 1250600 - RNA, 23 nt, Human
aauucuuggccuuuaaacaacuc

SEQ ID NO: 1250601 - RNA, 21 nt, Human
acaaaguaauaaacagugcac

SEQ ID NO: 1250602 - RNA, 27 nt, Human
acacagaaaauggaggaaaggggaccc

SEQ ID NO: 1250603 - RNA, 21 nt, Human
acuuuccucuucugugagauu

SEQ ID NO: 1250604 - RNA, 24 nt, Human
aggcuguuuccaauucuuggccuu

SEQ ID NO: 1250605 - RNA, 23 nt, Human
agucuaacauucaaaggaaguaa

SEQ ID NO: 1250606 - RNA, 23 nt, Human
augccagagugaacaucagugag

SEQ ID NO: 1250607 - RNA, 19 nt, Human
cagccuauuccaaaccaaa

SEQ ID NO: 1250608 - RNA, 19 nt, Human
cagccuauuccaaaccaaa

SEQ ID NO: 1250609 - RNA, 25 nt, Human
cagugcacacuugggggcaaacuac

SEQ ID NO: 1250610 - RNA, 18 nt, Human
ccaaaccaaagagaacag

SEQ ID NO: 1250611 - RNA, 19 nt, Human
ccagaggaggccacuuucc

SEQ ID NO: 1250612 - RNA, 21 nt, Human
cucccaucaccaauacacaga

SEQ ID NO: 1250613 - RNA, 22 nt, Human
cuuaaacuauaaauuagaaaca

SEQ ID NO: 1250614 - RNA, 20 nt, Human
gaagagcucacugugauuaa

SEQ ID NO: 1250615 - RNA, 21 nt, Human
gaggaggccacuuuccucuuc

SEQ ID NO: 1250616 - RNA, 23 nt, Human
gauaugcacgcuaaugaccuaca

SEQ ID NO: 1250617 - RNA, 22 nt, Human
uaaauuagaaacacaaauaauc

SEQ ID NO: 1250618 - RNA, 19 nt, Human
uacaaaguaauaaacagug

SEQ ID NO: 1250619 - RNA, 21 nt, Human
uagaaacacaaauaaucauga

SEQ ID NO: 1250620 - RNA, 20 nt, Human
ucugaaugcuguagugaaua

SEQ ID NO: 1250621 - RNA, 23 nt, Human
ucuugagcagcuguuugaugaug

SEQ ID NO: 1250622 - RNA, 22 nt, Human
ugaaauuaaaaaagaaaaaugc

SEQ ID NO: 1250623 - RNA, 28 nt, Human
ugaacucccaccacguaagggcaaacuc

SEQ ID NO: 1250624 - RNA, 24 nt, Human
ugaauauacaugcugcaauaacau

SEQ ID NO: 1250625 - RNA, 20 nt, Human
uggcagccuauuccaaacca

SEQ ID NO: 1250626 - RNA, 18 nt, Human
ugggcaaagagugggucu

SEQ ID NO: 1250627 - RNA, 21 nt, Human
uugagcuaaggaagagcucac

SEQ ID NO: 1250628 - RNA, 22 nt, Human
uuggccuuuaaacaacucuaaa

SEQ ID NO: 1250629 - RNA, 20 nt, Human
uuuaaaaauuucuugagcag

SEQ ID NO: 1250630 - RNA, 19 nt, Human
gaacccaggacgaagccgg

SEQ ID NO: 1250631 - RNA, 20 nt, Human
uccagaacccaggacgaagc

SEQ ID NO: 1250632 - RNA, 18 nt, Human
cagagacaugaacagcac

SEQ ID NO: 1250633 - RNA, 22 nt, Human
caugaacagcaccaaagaccca

SEQ ID NO: 1250634 - RNA, 19 nt, Human
ccuuauggggagcugggaa

SEQ ID NO: 1250635 - RNA, 18 nt, Human
gaacagcaccaaagaccc

SEQ ID NO: 1250636 - RNA, 21 nt, Human
uauggggagcugggaagaagg

SEQ ID NO: 1250637 - RNA, 21 nt, Human
uuacuacugugcgcuuaaguu

SEQ ID NO: 1250638 - RNA, 23 nt, Human
ugagucccuuauaucaaagcccu

SEQ ID NO: 1250639 - RNA, 23 nt, Human
uggucugcauucagcuggugagu

SEQ ID NO: 1250640 - RNA, 25 nt, Human
uggugagucccuuauaucaaagccc

SEQ ID NO: 1250641 - RNA, 28 nt, Human
ccacauucugagcucuccauuccaauuu

SEQ ID NO: 1250642 - RNA, 21 nt, Human
ggguccccuuucccucugccc

SEQ ID NO: 1250643 - RNA, 21 nt, Human
ugagcucuccauuccaauuuu

SEQ ID NO: 1250644 - RNA, 21 nt, Human
uucucuggggccacauucuga

SEQ ID NO: 1250645 - RNA, 19 nt, Human
cagccggggcggugggcgg

SEQ ID NO: 1250646 - RNA, 21 nt, Human
cccgugcuaaccccccagagc

SEQ ID NO: 1250647 - RNA, 21 nt, Human
ccgacagccggggcggugggc

SEQ ID NO: 1250648 - RNA, 18 nt, Human
ccgccgccgccgcguucg

SEQ ID NO: 1250649 - RNA, 18 nt, Human
ccgccgccgccgcguucg

SEQ ID NO: 1250650 - RNA, 20 nt, Human
cgacccccgugcuaaccccc

SEQ ID NO: 1250651 - RNA, 19 nt, Human
cugggcggaaggagagggg

SEQ ID NO: 1250652 - RNA, 21 nt, Human
cugggcggaaggagagggggc

SEQ ID NO: 1250653 - RNA, 20 nt, Human
cuucuggccgccgccgccgc

SEQ ID NO: 1250654 - RNA, 18 nt, Human
gcggaaggagagggggcg

SEQ ID NO: 1250655 - RNA, 18 nt, Human
gcggugggcgggcagggg

SEQ ID NO: 1250656 - RNA, 24 nt, Human
ggagagggggcgcaggccucuggc

SEQ ID NO: 1250657 - RNA, 19 nt, Human
ggcauggaggugcugggcg

SEQ ID NO: 1250658 - RNA, 19 nt, Human
ggccgccgccgccgcguuc

SEQ ID NO: 1250659 - RNA, 19 nt, Human
ggcggugggcgggcagggg

SEQ ID NO: 1250660 - RNA, 20 nt, Human
ucgugcaccgagggcaugga

SEQ ID NO: 1250661 - RNA, 18 nt, Human
ugcaccgagggcauggag

SEQ ID NO: 1250662 - RNA, 22 nt, Human
agaggaagggaggccauguagc

SEQ ID NO: 1250663 - RNA, 20 nt, Human
cauagccgggucgccuccgc

SEQ ID NO: 1250664 - RNA, 18 nt, Human
ccuggcggagaggaaggg

SEQ ID NO: 1250665 - RNA, 23 nt, Human
cuccgcgcuaaccccguugaacc

SEQ ID NO: 1250666 - RNA, 21 nt, Human
gaagggaggccauguagcugc

SEQ ID NO: 1250667 - RNA, 20 nt, Human
uuccuggcggagaggaaggg

SEQ ID NO: 1250668 - RNA, 19 nt, Human
augugcaugcauguacgug

SEQ ID NO: 1250669 - RNA, 18 nt, Human
auugugggcucacgugaa

SEQ ID NO: 1250670 - RNA, 27 nt, Human
caccuggcauugauuuagcacacuugu

SEQ ID NO: 1250671 - RNA, 20 nt, Human
gagaggaagauaacguccuc

SEQ ID NO: 1250672 - RNA, 20 nt, Human
gcuacagcccaccuggcauu

SEQ ID NO: 1250673 - RNA, 21 nt, Human
gggcuauugugggcucacgug

SEQ ID NO: 1250674 - RNA, 25 nt, Human
uucguuuuccagucguaucucugag

SEQ ID NO: 1250675 - RNA, 20 nt, Human
uuguggauuuucuggcuggg

SEQ ID NO: 1250676 - RNA, 25 nt, Human
uuugcuacaacugcuacagcccacc

SEQ ID NO: 1250677 - RNA, 23 nt, Human
aggggcgggcgggggucuggggg

SEQ ID NO: 1250678 - RNA, 21 nt, Human
ggcgggcgggggucugggggg

SEQ ID NO: 1250679 - RNA, 20 nt, Human
gggcgggggucugggggggu

SEQ ID NO: 1250680 - RNA, 21 nt, Human
cuggucuguucaccuucucag

SEQ ID NO: 1250681 - RNA, 21 nt, Human
uaaauugcacagcacgccggc

SEQ ID NO: 1250682 - RNA, 18 nt, Human
ucuguucaccuucucagg

SEQ ID NO: 1250683 - RNA, 27 nt, Human
uggucuguucaccuucucaggacucca

SEQ ID NO: 1250684 - RNA, 18 nt, Human
agguguggcgucuugucc

SEQ ID NO: 1250685 - RNA, 23 nt, Human
caccguccagguccacguuaccu

SEQ ID NO: 1250686 - RNA, 22 nt, Human
cgucuugucccccagcaucacu

SEQ ID NO: 1250687 - RNA, 24 nt, Human
cgucuugucccccagcaucacuca

SEQ ID NO: 1250688 - RNA, 22 nt, Human
aaggcagcuuccauacuucagu

SEQ ID NO: 1250689 - RNA, 23 nt, Human
caucuggaaaccaugacaaccgu

SEQ ID NO: 1250690 - RNA, 21 nt, Human
cccuuuguuguaacuguugau

SEQ ID NO: 1250691 - RNA, 18 nt, Human
gggggcugaucugggauc

SEQ ID NO: 1250692 - RNA, 20 nt, Human
guggcccuuuguuguaacug

SEQ ID NO: 1250693 - RNA, 19 nt, Human
ugcuuuuaguucagcuugg

SEQ ID NO: 1250694 - RNA, 22 nt, Human
ugggcacuguuucuaugaaggg

SEQ ID NO: 1250695 - RNA, 24 nt, Human
ugggggcugaucugggaucaagag

SEQ ID NO: 1250696 - RNA, 21 nt, Human
uuuucccaacacaucauagcu

SEQ ID NO: 1250697 - RNA, 24 nt, Human
uaugcaaacacagugugauuccua

SEQ ID NO: 1250698 - RNA, 22 nt, Human
aaaaaaauuaaccgggcagcug

SEQ ID NO: 1250699 - RNA, 24 nt, Human
aaacaaaacaaggacccagccuag

SEQ ID NO: 1250700 - RNA, 24 nt, Human
aaacacccugucuccaaaaaaaaa

SEQ ID NO: 1250701 - RNA, 19 nt, Human
aaagcuccuccccauucuc

SEQ ID NO: 1250702 - RNA, 19 nt, Human
aacaaggugaaaccucauc

SEQ ID NO: 1250703 - RNA, 20 nt, Human
aacaaggugaaaccucaucu

SEQ ID NO: 1250704 - RNA, 21 nt, Human
aacaaggugaaaccucaucuc

SEQ ID NO: 1250705 - RNA, 18 nt, Human
aacauagugagaccuucu

SEQ ID NO: 1250706 - RNA, 18 nt, Human
aaccaggcggcaggguca

SEQ ID NO: 1250707 - RNA, 18 nt, Human
aaccagggccaagcuugg

SEQ ID NO: 1250708 - RNA, 25 nt, Human
aagaaagcaaaaccuaucccacgac

SEQ ID NO: 1250709 - RNA, 23 nt, Human
aagagacacaggagacagaguca

SEQ ID NO: 1250710 - RNA, 22 nt, Human
aagagacugcuaaccccagucc

SEQ ID NO: 1250711 - RNA, 22 nt, Human
aagcagaaaccaaacucagaaa

SEQ ID NO: 1250712 - RNA, 20 nt, Human
aagccugggcaacauaguga

SEQ ID NO: 1250713 - RNA, 21 nt, Human
aaucaggcugagagggcgggg

SEQ ID NO: 1250714 - RNA, 24 nt, Human
aaucgcuugaacucgggaggugga

SEQ ID NO: 1250715 - RNA, 18 nt, Human
acaaaacaaggacccagc

SEQ ID NO: 1250716 - RNA, 19 nt, Human
acaagcuccccaccauaag

SEQ ID NO: 1250717 - RNA, 19 nt, Human
acacagugagacccugucu

SEQ ID NO: 1250718 - RNA, 20 nt, Human
acacagugagacccugucuc

SEQ ID NO: 1250719 - RNA, 21 nt, Human
acacggaaccagggccaagcu

SEQ ID NO: 1250720 - RNA, 20 nt, Human
accaaacucagaaaggcaga

SEQ ID NO: 1250721 - RNA, 19 nt, Human
accaagaugggagcggggg

SEQ ID NO: 1250722 - RNA, 20 nt, Human
accagccuggccaacaaggu

SEQ ID NO: 1250723 - RNA, 23 nt, Human
acccugucucuaaaaacaaaaca

SEQ ID NO: 1250724 - RNA, 20 nt, Human
accgggcagcuggacguggu

SEQ ID NO: 1250725 - RNA, 24 nt, Human
accucaucucuacuaaaaauauaa

SEQ ID NO: 1250726 - RNA, 18 nt, Human
acgccacuguacuccagc

SEQ ID NO: 1250727 - RNA, 24 nt, Human
acggaaccagggccaagcuugggc

SEQ ID NO: 1250728 - RNA, 24 nt, Human
acuccagccugggagacacaguga

SEQ ID NO: 1250729 - RNA, 23 nt, Human
acucuugaaggcugagcugggag

SEQ ID NO: 1250730 - RNA, 18 nt, Human
acugcacucuagccuggg

SEQ ID NO: 1250731 - RNA, 24 nt, Human
acugcacucuagccugggugacag

SEQ ID NO: 1250732 - RNA, 18 nt, Human
acuguacuccagccuggg

SEQ ID NO: 1250733 - RNA, 20 nt, Human
acuguacuccagccugggag

SEQ ID NO: 1250734 - RNA, 18 nt, Human
agaaggaaggaaaccaug

SEQ ID NO: 1250735 - RNA, 22 nt, Human
agaaucgcuugaacucgggagg

SEQ ID NO: 1250736 - RNA, 24 nt, Human
agacacagugagacccugucucua

SEQ ID NO: 1250737 - RNA, 19 nt, Human
agaccagccuggccaacaa

SEQ ID NO: 1250738 - RNA, 21 nt, Human
agacugcuaaccccagucccu

SEQ ID NO: 1250739 - RNA, 23 nt, Human
agaugggagcggggguggggggu

SEQ ID NO: 1250740 - RNA, 24 nt, Human
agaugggagcggggguggggggug

SEQ ID NO: 1250741 - RNA, 24 nt, Human
agcacuuugggacgccacaguggg

SEQ ID NO: 1250742 - RNA, 18 nt, Human
agccaagucagaaaucca

SEQ ID NO: 1250743 - RNA, 23 nt, Human
agccaggcgugguggugcaugcc

SEQ ID NO: 1250744 - RNA, 23 nt, Human
agccuggccaacaaggugaaacc

SEQ ID NO: 1250745 - RNA, 23 nt, Human
agccugggcaacauagugagacc

SEQ ID NO: 1250746 - RNA, 24 nt, Human
agccugggcaacauagugagaccu

SEQ ID NO: 1250747 - RNA, 25 nt, Human
agccugggcaacauagugagaccuu

SEQ ID NO: 1250748 - RNA, 23 nt, Human
agcgagcaucaucuuggccugga

SEQ ID NO: 1250749 - RNA, 21 nt, Human
agcuggacgugguggugcagg

SEQ ID NO: 1250750 - RNA, 23 nt, Human
agcuggacgugguggugcagguc

SEQ ID NO: 1250751 - RNA, 18 nt, Human
agcugggaggaucacuug

SEQ ID NO: 1250752 - RNA, 23 nt, Human
agcugggaggaucacuugagccc

SEQ ID NO: 1250753 - RNA, 20 nt, Human
aggacugggcugaauugggc

SEQ ID NO: 1250754 - RNA, 22 nt, Human
aggauggagacaguaaaagaaa

SEQ ID NO: 1250755 - RNA, 24 nt, Human
aggcaggagaaucgcuugaacucg

SEQ ID NO: 1250756 - RNA, 27 nt, Human
aggcaggaggcagaugggagaacaaaa

SEQ ID NO: 1250757 - RNA, 24 nt, Human
aggcgcaguggcccacgccuguaa

SEQ ID NO: 1250758 - RNA, 21 nt, Human
aggcggguggaucaccugagg

SEQ ID NO: 1250759 - RNA, 26 nt, Human
aggcggguggaucaccugaggccagg

SEQ ID NO: 1250760 - RNA, 24 nt, Human
aggcgugguggugcaugccuguaa

SEQ ID NO: 1250761 - RNA, 22 nt, Human
aggcucagaaccaggcggcagg

SEQ ID NO: 1250762 - RNA, 21 nt, Human
aggcugagcugggaggaucac

SEQ ID NO: 1250763 - RNA, 24 nt, Human
aggcugagcugggaggaucacuug

SEQ ID NO: 1250764 - RNA, 20 nt, Human
aggcugaggcaggagaaucg

SEQ ID NO: 1250765 - RNA, 24 nt, Human
aggcugaggcaggagaaucgcuug

SEQ ID NO: 1250766 - RNA, 22 nt, Human
aggcuggagccaagccccaggg

SEQ ID NO: 1250767 - RNA, 24 nt, Human
aggcuggagccaagccccagggga

SEQ ID NO: 1250768 - RNA, 22 nt, Human
aggggaccggauuagcccccau

SEQ ID NO: 1250769 - RNA, 22 nt, Human
aggucgagguugcagugagcag

SEQ ID NO: 1250770 - RNA, 19 nt, Human
aggugaggcggguggauca

SEQ ID NO: 1250771 - RNA, 24 nt, Human
agguggagguggcagugagccgag

SEQ ID NO: 1250772 - RNA, 19 nt, Human
aguaaaagaaagcaaaacc

SEQ ID NO: 1250773 - RNA, 24 nt, Human
aguccgccauaaaaagcuccuccc

SEQ ID NO: 1250774 - RNA, 24 nt, Human
aguggcccacgccuguaaucccag

SEQ ID NO: 1250775 - RNA, 18 nt, Human
auaaagcauuauccaagg

SEQ ID NO: 1250776 - RNA, 24 nt, Human
aucacgccacuguacuccagccug

SEQ ID NO: 1250777 - RNA, 24 nt, Human
aucccgccacugcacucuagccug

SEQ ID NO: 1250778 - RNA, 21 nt, Human
augggagcggggguggggggu

SEQ ID NO: 1250779 - RNA, 24 nt, Human
cacaccuguaaccccagcacuuug

SEQ ID NO: 1250780 - RNA, 24 nt, Human
cacagugagacccugucucuaaaa

SEQ ID NO: 1250781 - RNA, 18 nt, Human
caccauaagcagaaacca

SEQ ID NO: 1250782 - RNA, 18 nt, Human
caccauaagcagaaacca

SEQ ID NO: 1250783 - RNA, 21 nt, Human
caccauaagcagaaaccaaac

SEQ ID NO: 1250784 - RNA, 23 nt, Human
caccuguaaccccagcacuuugg

SEQ ID NO: 1250785 - RNA, 24 nt, Human
caccuguaaccccagcacuuuggg

SEQ ID NO: 1250786 - RNA, 24 nt, Human
caccuuggccuacagaguugagag

SEQ ID NO: 1250787 - RNA, 24 nt, Human
caccuugguccagggaguugggag

SEQ ID NO: 1250788 - RNA, 23 nt, Human
cacgccuguaaucccagcauuuu

SEQ ID NO: 1250789 - RNA, 18 nt, Human
cacucuagccugggugac

SEQ ID NO: 1250790 - RNA, 20 nt, Human
cacucuagccugggugacag

SEQ ID NO: 1250791 - RNA, 19 nt, Human
cacugcacucuagccuggg

SEQ ID NO: 1250792 - RNA, 21 nt, Human
cacugcacucuagccugggug

SEQ ID NO: 1250793 - RNA, 22 nt, Human
cacugcacucuagccuggguga

SEQ ID NO: 1250794 - RNA, 23 nt, Human
cacugcacucuagccugggugac

SEQ ID NO: 1250795 - RNA, 24 nt, Human
cacugcacucuagccugggugaca

SEQ ID NO: 1250796 - RNA, 24 nt, Human
cacugcacucuagccugggugaca

SEQ ID NO: 1250797 - RNA, 18 nt, Human
cacuguacuccagccugg

SEQ ID NO: 1250798 - RNA, 19 nt, Human
cacuguacuccagccuggg

SEQ ID NO: 1250799 - RNA, 22 nt, Human
cacuguacuccagccugggaga

SEQ ID NO: 1250800 - RNA, 24 nt, Human
cacuguacuccagccugggagaca

SEQ ID NO: 1250801 - RNA, 20 nt, Human
cagaacaaggacccagcugg

SEQ ID NO: 1250802 - RNA, 25 nt, Human
cagaaggaaggaaaccauggggagu

SEQ ID NO: 1250803 - RNA, 18 nt, Human
cagcaaggccuaccccca

SEQ ID NO: 1250804 - RNA, 21 nt, Human
cagcacuuugggacgccacag

SEQ ID NO: 1250805 - RNA, 24 nt, Human
cagcacuuugggacgccacagugg

SEQ ID NO: 1250806 - RNA, 23 nt, Human
cagcauuuuaggaggugaggcgg

SEQ ID NO: 1250807 - RNA, 18 nt, Human
cagcuggacgugguggug

SEQ ID NO: 1250808 - RNA, 25 nt, Human
caggaaaugccaccuugguccaggg

SEQ ID NO: 1250809 - RNA, 21 nt, Human
caggagacagagucagguccc

SEQ ID NO: 1250810 - RNA, 25 nt, Human
caggaucagggagguguaaguagga

SEQ ID NO: 1250811 - RNA, 21 nt, Human
caggucccagaggcagcaagg

SEQ ID NO: 1250812 - RNA, 21 nt, Human
ccaaaaaaaaaaaaaaaaaaa

SEQ ID NO: 1250813 - RNA, 22 nt, Human
ccaaaaaaaaaaaaaaaaaaaa

SEQ ID NO: 1250814 - RNA, 23 nt, Human
ccaaaaaaaaaaaaaaaaaaaaa

SEQ ID NO: 1250815 - RNA, 24 nt, Human
ccaccauaagcagaaaccaaacuc

SEQ ID NO: 1250816 - RNA, 19 nt, Human
ccacgccuguaaucccagc

SEQ ID NO: 1250817 - RNA, 20 nt, Human
ccacugcacucuagccuggg

SEQ ID NO: 1250818 - RNA, 20 nt, Human
ccacugcacucuagccuggg

SEQ ID NO: 1250819 - RNA, 21 nt, Human
ccacugcacucuagccugggu

SEQ ID NO: 1250820 - RNA, 21 nt, Human
ccacugcacucuagccugggu

SEQ ID NO: 1250821 - RNA, 24 nt, Human
ccacugcacucuagccugggugac

SEQ ID NO: 1250822 - RNA, 19 nt, Human
ccacuguacuccagccugg

SEQ ID NO: 1250823 - RNA, 20 nt, Human
ccacuguacuccagccuggg

SEQ ID NO: 1250824 - RNA, 22 nt, Human
ccacuguacuccagccugggag

SEQ ID NO: 1250825 - RNA, 24 nt, Human
ccacuguacuccagccugggagac

SEQ ID NO: 1250826 - RNA, 22 nt, Human
ccaggaggucgagguugcagug

SEQ ID NO: 1250827 - RNA, 20 nt, Human
ccaggaguucgagaccagcc

SEQ ID NO: 1250828 - RNA, 19 nt, Human
ccauaaaaagcuccucccc

SEQ ID NO: 1250829 - RNA, 21 nt, Human
cccacgccuguaaucccagca

SEQ ID NO: 1250830 - RNA, 21 nt, Human
cccacgccuguaaucccagca

SEQ ID NO: 1250831 - RNA, 21 nt, Human
cccagugugugguggcucaca

SEQ ID NO: 1250832 - RNA, 23 nt, Human
ccccaccauaagcagaaaccaaa

SEQ ID NO: 1250833 - RNA, 19 nt, Human
ccccagaccccaggaucag

SEQ ID NO: 1250834 - RNA, 20 nt, Human
ccccagcacuuugggacgcc

SEQ ID NO: 1250835 - RNA, 19 nt, Human
ccccagucccugagccaag

SEQ ID NO: 1250836 - RNA, 23 nt, Human
ccccauucuccaucuugggggcu

SEQ ID NO: 1250837 - RNA, 19 nt, Human
ccuacccccaaauugcagu

SEQ ID NO: 1250838 - RNA, 24 nt, Human
ccuccccauucuccaucuuggggg

SEQ ID NO: 1250839 - RNA, 22 nt, Human
ccugaggccaggaguucgagac

SEQ ID NO: 1250840 - RNA, 24 nt, Human
ccuggccaacaaggugaaaccuca

SEQ ID NO: 1250841 - RNA, 19 nt, Human
ccuguaauccuagcuacuc

SEQ ID NO: 1250842 - RNA, 18 nt, Human
cgacagaaaaaaauuaac

SEQ ID NO: 1250843 - RNA, 24 nt, Human
cgagaccagccuggccaacaaggu

SEQ ID NO: 1250844 - RNA, 24 nt, Human
cgagaucacgccacuguacuccag

SEQ ID NO: 1250845 - RNA, 21 nt, Human
cgccacagugggaggauugcu

SEQ ID NO: 1250846 - RNA, 24 nt, Human
cgggagguggagguggcagugagc

SEQ ID NO: 1250847 - RNA, 19 nt, Human
cgggcagcuggacguggug

SEQ ID NO: 1250848 - RNA, 24 nt, Human
cggguggaucaccugaggccagga

SEQ ID NO: 1250849 - RNA, 21 nt, Human
cuaggcgcaguggcccacgcc

SEQ ID NO: 1250850 - RNA, 24 nt, Human
cucacaccuguaaccccagcacuu

SEQ ID NO: 1250851 - RNA, 27 nt, Human
cucacaccuguaaccccagcacuuugg

SEQ ID NO: 1250852 - RNA, 23 nt, Human
cuggccaacaaggugaaaccuca

SEQ ID NO: 1250853 - RNA, 23 nt, Human
cuggcuaggcgcaguggcccacg

SEQ ID NO: 1250854 - RNA, 18 nt, Human
cuucaaaccgacagaaaa

SEQ ID NO: 1250855 - RNA, 24 nt, Human
cuucggguugagaugagggacagg

SEQ ID NO: 1250856 - RNA, 21 nt, Human
gaaccggcagcugacgcucgg

SEQ ID NO: 1250857 - RNA, 22 nt, Human
gaacucgggagguggagguggc

SEQ ID NO: 1250858 - RNA, 22 nt, Human
gaaggcugagcugggaggauca

SEQ ID NO: 1250859 - RNA, 21 nt, Human
gacacagugagacccugucuc

SEQ ID NO: 1250860 - RNA, 19 nt, Human
gacccugucucuaaaaaca

SEQ ID NO: 1250861 - RNA, 23 nt, Human
gacuugggaaacagaaaucaggc

SEQ ID NO: 1250862 - RNA, 19 nt, Human
gagaccuucuccccucuuc

SEQ ID NO: 1250863 - RNA, 20 nt, Human
gaggcaggaggcagauggga

SEQ ID NO: 1250864 - RNA, 21 nt, Human
gaggucgagguugcagugagc

SEQ ID NO: 1250865 - RNA, 22 nt, Human
gagguggcagugagccgagauc

SEQ ID NO: 1250866 - RNA, 18 nt, Human
gaucaccugaggccagga

SEQ ID NO: 1250867 - RNA, 24 nt, Human
gaucaccugaggccaggaguucga

SEQ ID NO: 1250868 - RNA, 24 nt, Human
gaucacuugagcccaggaggucga

SEQ ID NO: 1250869 - RNA, 22 nt, Human
gauuagcccccaugggugacac

SEQ ID NO: 1250870 - RNA, 18 nt, Human
gauugcuugagcccggga

SEQ ID NO: 1250871 - RNA, 22 nt, Human
gauugcuugagcccgggaguuu

SEQ ID NO: 1250872 - RNA, 24 nt, Human
gauugcuugagcccgggaguuuga

SEQ ID NO: 1250873 - RNA, 18 nt, Human
gcagaaaccaaacucaga

SEQ ID NO: 1250874 - RNA, 25 nt, Human
gcaggaggcagaugggaggucgacc

SEQ ID NO: 1250875 - RNA, 21 nt, Human
gccaccuuggccuacagaguu

SEQ ID NO: 1250876 - RNA, 21 nt, Human
gccaccuugguccagggaguu

SEQ ID NO: 1250877 - RNA, 24 nt, Human
gccacugcacucuagccuggguga

SEQ ID NO: 1250878 - RNA, 22 nt, Human
gccacuguacuccagccuggga

SEQ ID NO: 1250879 - RNA, 20 nt, Human
gcgcaguggcccacgccugu

SEQ ID NO: 1250880 - RNA, 22 nt, Human
gcucaaaggggaggaggcagga

SEQ ID NO: 1250881 - RNA, 24 nt, Human
ggaagaaaacacaggugaaaagga

SEQ ID NO: 1250882 - RNA, 18 nt, Human
ggaagcugugccacaucc

SEQ ID NO: 1250883 - RNA, 23 nt, Human
ggaccagagcugggaucggaaga

SEQ ID NO: 1250884 - RNA, 27 nt, Human
ggagacaguaaaagaaagccgguaccc

SEQ ID NO: 1250885 - RNA, 18 nt, Human
ggagagucaagaggagac

SEQ ID NO: 1250886 - RNA, 18 nt, Human
ggagguggcagugagccg

SEQ ID NO: 1250887 - RNA, 24 nt, Human
ggagguggcagugagccgagauca

SEQ ID NO: 1250888 - RNA, 20 nt, Human
ggcucagaaccaggcggcag

SEQ ID NO: 1250889 - RNA, 19 nt, Human
gggaccggauuagccccca

SEQ ID NO: 1250890 - RNA, 20 nt, Human
ggggguggggggugauaaga

SEQ ID NO: 1250891 - RNA, 24 nt, Human
gguggcucacaccuguaaccccag

SEQ ID NO: 1250892 - RNA, 18 nt, Human
gguggugcaggucugcag

SEQ ID NO: 1250893 - RNA, 20 nt, Human
gguugagaugagggacaggg

SEQ ID NO: 1250894 - RNA, 23 nt, Human
guaaucccgccacugcacucuag

SEQ ID NO: 1250895 - RNA, 21 nt, Human
gucccagaggcagcaaggccu

SEQ ID NO: 1250896 - RNA, 27 nt, Human
gugaggcggguggaucaccugaggcca

SEQ ID NO: 1250897 - RNA, 22 nt, Human
guggaucaccugaggccaggag

SEQ ID NO: 1250898 - RNA, 21 nt, Human
gugggaggauugcuugagccc

SEQ ID NO: 1250899 - RNA, 18 nt, Human
guggugcaggucugcagu

SEQ ID NO: 1250900 - RNA, 20 nt, Human
guggugcaugccuguaaucc

SEQ ID NO: 1250901 - RNA, 18 nt, Human
gugugguggcucacaccu

SEQ ID NO: 1250902 - RNA, 24 nt, Human
gugugugguggcucacaccuguaa

SEQ ID NO: 1250903 - RNA, 23 nt, Human
uaaaagaaagcaaaaccuauccc

SEQ ID NO: 1250904 - RNA, 23 nt, Human
uaaacacccugucuccaaaaaaa

SEQ ID NO: 1250905 - RNA, 18 nt, Human
uaagaguuuuaaucaguc

SEQ ID NO: 1250906 - RNA, 28 nt, Human
uaagcagaaaccaaacucaaccccgggg

SEQ ID NO: 1250907 - RNA, 22 nt, Human
uacuccagccugggagacacag

SEQ ID NO: 1250908 - RNA, 24 nt, Human
uacuccagccugggagacacagug

SEQ ID NO: 1250909 - RNA, 23 nt, Human
uagccaggcgugguggugcaugc

SEQ ID NO: 1250910 - RNA, 24 nt, Human
uagcuacucgggaggcugaggcag

SEQ ID NO: 1250911 - RNA, 19 nt, Human
uaggucuggagagucaaga

SEQ ID NO: 1250912 - RNA, 19 nt, Human
ucaccugaggccaggaguu

SEQ ID NO: 1250913 - RNA, 23 nt, Human
ucacgccacuguacuccagccug

SEQ ID NO: 1250914 - RNA, 25 nt, Human
ucauaucguucuuaucugcaaagug

SEQ ID NO: 1250915 - RNA, 19 nt, Human
uccagggaguugggaggaa

SEQ ID NO: 1250916 - RNA, 19 nt, Human
ucccagaggcagcaaggcc

SEQ ID NO: 1250917 - RNA, 23 nt, Human
uccccaccauaagcagaaaccaa

SEQ ID NO: 1250918 - RNA, 24 nt, Human
ucgcuugaacucgggagguggagg

SEQ ID NO: 1250919 - RNA, 24 nt, Human
ucgggaggcugaggcaggagaauc

SEQ ID NO: 1250920 - RNA, 18 nt, Human
ucuagccugggugacaga

SEQ ID NO: 1250921 - RNA, 20 nt, Human
ucuccaaaaaaaaaaaaaaa

SEQ ID NO: 1250922 - RNA, 18 nt, Human
ucucuaaaaacaaaacaa

SEQ ID NO: 1250923 - RNA, 21 nt, Human
ucucuacuaaaaauauaaaaa

SEQ ID NO: 1250924 - RNA, 22 nt, Human
ucugcagucccagcuacucuug

SEQ ID NO: 1250925 - RNA, 18 nt, Human
ucuugggggcucagaucu

SEQ ID NO: 1250926 - RNA, 19 nt, Human
ugaaaccucaucucuacua

SEQ ID NO: 1250927 - RNA, 19 nt, Human
ugaaagcaccaggacuggg

SEQ ID NO: 1250928 - RNA, 22 nt, Human
ugaaagcaccaggacugggcug

SEQ ID NO: 1250929 - RNA, 23 nt, Human
ugaaagcaccaggacugggcuga

SEQ ID NO: 1250930 - RNA, 20 nt, Human
ugaaggcaguucuggaagug

SEQ ID NO: 1250931 - RNA, 20 nt, Human
ugaagggugucacuuuaggu

SEQ ID NO: 1250932 - RNA, 23 nt, Human
ugacagauaaacacccugucucc

SEQ ID NO: 1250933 - RNA, 18 nt, Human
ugagccaagucagaaauc

SEQ ID NO: 1250934 - RNA, 22 nt, Human
ugagccgagaucacgccacugu

SEQ ID NO: 1250935 - RNA, 24 nt, Human
ugagcugggaggaucacuugagcc

SEQ ID NO: 1250936 - RNA, 20 nt, Human
ugaggcaggagaaucgcuug

SEQ ID NO: 1250937 - RNA, 23 nt, Human
ugaggcaggagaaucgcuugaac

SEQ ID NO: 1250938 - RNA, 24 nt, Human
ugaggcaggagaaucgcuugaacu

SEQ ID NO: 1250939 - RNA, 25 nt, Human
ugaggcaggagaaucgcuugaacuc

SEQ ID NO: 1250940 - RNA, 19 nt, Human
ugaggcggguggaucaccu

SEQ ID NO: 1250941 - RNA, 20 nt, Human
ugaggcggguggaucaccug

SEQ ID NO: 1250942 - RNA, 22 nt, Human
ugaggcggguggaucaccugag

SEQ ID NO: 1250943 - RNA, 23 nt, Human
ugaggcggguggaucaccugagg

SEQ ID NO: 1250944 - RNA, 22 nt, Human
ugcaggaaaugccaccuugguc

SEQ ID NO: 1250945 - RNA, 18 nt, Human
ugcagugagcaguaaucc

SEQ ID NO: 1250946 - RNA, 24 nt, Human
ugccuguaauccuagcuacucggg

SEQ ID NO: 1250947 - RNA, 24 nt, Human
uggaucaccugaggccaggaguuc

SEQ ID NO: 1250948 - RNA, 27 nt, Human
uggaucaccugaggccaggaguucgag

SEQ ID NO: 1250949 - RNA, 18 nt, Human
uggcagugagccgagauc

SEQ ID NO: 1250950 - RNA, 20 nt, Human
uggcagugagccgagaucac

SEQ ID NO: 1250951 - RNA, 21 nt, Human
uggcccacgccuguaauccca

SEQ ID NO: 1250952 - RNA, 24 nt, Human
uggcccacgccuguaaucccagca

SEQ ID NO: 1250953 - RNA, 23 nt, Human
uggcuaggcgcaguggcccacgg

SEQ ID NO: 1250954 - RNA, 21 nt, Human
uggcucacaccuguaacccca

SEQ ID NO: 1250955 - RNA, 23 nt, Human
uggcucacaccuguaaccccagc

SEQ ID NO: 1250956 - RNA, 24 nt, Human
uggcucacaccuguaaccccagca

SEQ ID NO: 1250957 - RNA, 23 nt, Human
ugggagaacaaaaaguagaacca

SEQ ID NO: 1250958 - RNA, 20 nt, Human
ugggagcgggggugggggga

SEQ ID NO: 1250959 - RNA, 24 nt, Human
ugggaggaagauccccugccuugg

SEQ ID NO: 1250960 - RNA, 18 nt, Human
ugggcagcagaacaagga

SEQ ID NO: 1250961 - RNA, 19 nt, Human
uggugcaugccuguaaucc

SEQ ID NO: 1250962 - RNA, 21 nt, Human
uggugcaugccuguaauccua

SEQ ID NO: 1250963 - RNA, 22 nt, Human
ugguggugcaugccuguaaucc

SEQ ID NO: 1250964 - RNA, 25 nt, Human
uugaaggcugagcugggaggaucac

SEQ ID NO: 1250965 - RNA, 21 nt, Human
uugcuugagcccgggaguuug

SEQ ID NO: 1250966 - RNA, 21 nt, Human
uugggggcucagaucuuggcu

SEQ ID NO: 1250967 - RNA, 20 nt, Human
aaaguuacccuuucuccaga

SEQ ID NO: 1250968 - RNA, 20 nt, Human
aaccaaaguuacccuuucuc

SEQ ID NO: 1250969 - RNA, 24 nt, Human
acacacaaaugcagucaccagcca

SEQ ID NO: 1250970 - RNA, 20 nt, Human
acaggccuuuccccccguuc

SEQ ID NO: 1250971 - RNA, 24 nt, Human
acaggcuccaagacacgucaaaac

SEQ ID NO: 1250972 - RNA, 19 nt, Human
acauggagcgucucaguuu

SEQ ID NO: 1250973 - RNA, 21 nt, Human
accaaaguuacccuuucucca

SEQ ID NO: 1250974 - RNA, 22 nt, Human
agaugcugaagacuccucggcu

SEQ ID NO: 1250975 - RNA, 21 nt, Human
agccaugcacggaaacucaca

SEQ ID NO: 1250976 - RNA, 19 nt, Human
aggcaggcugggucugggg

SEQ ID NO: 1250977 - RNA, 21 nt, Human
aggcaggcugggucugggguc

SEQ ID NO: 1250978 - RNA, 28 nt, Human
aggcaggcugggucuggggucggacccc

SEQ ID NO: 1250979 - RNA, 21 nt, Human
caaacgugcaaaccaaaguua

SEQ ID NO: 1250980 - RNA, 22 nt, Human
caaccucacaaacgugcaaacc

SEQ ID NO: 1250981 - RNA, 23 nt, Human
caaccucacaaacgugcaaacca

SEQ ID NO: 1250982 - RNA, 21 nt, Human
cacauucccaggcucguugaa

SEQ ID NO: 1250983 - RNA, 19 nt, Human
cacggaaacucacauugac

SEQ ID NO: 1250984 - RNA, 22 nt, Human
cagagccccagagcaggcccgu

SEQ ID NO: 1250985 - RNA, 18 nt, Human
cagcuccuggaucugcuc

SEQ ID NO: 1250986 - RNA, 22 nt, Human
caggcuccaagacacgucaaaa

SEQ ID NO: 1250987 - RNA, 18 nt, Human
caggguucugggcagccc

SEQ ID NO: 1250988 - RNA, 22 nt, Human
caggguucugggcagccccgcc

SEQ ID NO: 1250989 - RNA, 18 nt, Human
caguuuuucccugugagg

SEQ ID NO: 1250990 - RNA, 22 nt, Human
caugcacagacacacaaaugca

SEQ ID NO: 1250991 - RNA, 19 nt, Human
cauggguucacgggacccu

SEQ ID NO: 1250992 - RNA, 24 nt, Human
cccacagcuguuggacgggcaguu

SEQ ID NO: 1250993 - RNA, 28 nt, Human
cccacaggcuccaagacacgucaaaacc

SEQ ID NO: 1250994 - RNA, 18 nt, Human
cccagagcaggcccguca

SEQ ID NO: 1250995 - RNA, 22 nt, Human
ccccagguccugggguccugcc

SEQ ID NO: 1250996 - RNA, 20 nt, Human
ccccuuuaggcaggcugggu

SEQ ID NO: 1250997 - RNA, 18 nt, Human
cccuucuccuuccucucu

SEQ ID NO: 1250998 - RNA, 19 nt, Human
cccuucuccuuccucucuu

SEQ ID NO: 1250999 - RNA, 20 nt, Human
ccgccuucccuugcuccugc

SEQ ID NO: 1251000 - RNA, 31 nt, Human
ccggcgcuggcagcuggccuggcuucucucu

SEQ ID NO: 1251001 - RNA, 23 nt, Human
ccggucacaagggugcucuuucc

SEQ ID NO: 1251002 - RNA, 21 nt, Human
ccucacaaacgugcaaaccaa

SEQ ID NO: 1251003 - RNA, 22 nt, Human
ccuggcuucucucggcuggaga

SEQ ID NO: 1251004 - RNA, 24 nt, Human
cgagagacacggauguacccaggc

SEQ ID NO: 1251005 - RNA, 23 nt, Human
cggaaacucacauugacagacgc

SEQ ID NO: 1251006 - RNA, 18 nt, Human
cggauccgagaacgcaug

SEQ ID NO: 1251007 - RNA, 23 nt, Human
cggcgggcuccccccacaggcuc

SEQ ID NO: 1251008 - RNA, 23 nt, Human
cgggccccaccucacugaugucg

SEQ ID NO: 1251009 - RNA, 23 nt, Human
cucacaaacgugcaaaccaaagu

SEQ ID NO: 1251010 - RNA, 24 nt, Human
cuccagaccucacauucccaggcu

SEQ ID NO: 1251011 - RNA, 19 nt, Human
gaacucgccuuucuugcuc

SEQ ID NO: 1251012 - RNA, 21 nt, Human
gacacacaaaugcagucacca

SEQ ID NO: 1251013 - RNA, 20 nt, Human
gcccauguggcccuuuccug

SEQ ID NO: 1251014 - RNA, 19 nt, Human
gccccuuuaggcaggcugg

SEQ ID NO: 1251015 - RNA, 23 nt, Human
gcccggugcugcuggccacgugu

SEQ ID NO: 1251016 - RNA, 22 nt, Human
gcccucgucuuugacucuccau

SEQ ID NO: 1251017 - RNA, 24 nt, Human
gcgggccccaccucacugaugucg

SEQ ID NO: 1251018 - RNA, 22 nt, Human
ggagcgggcaccguggggcugc

SEQ ID NO: 1251019 - RNA, 24 nt, Human
ggauguacccaggcccaugcacag

SEQ ID NO: 1251020 - RNA, 19 nt, Human
ggccugcgggccccaccuc

SEQ ID NO: 1251021 - RNA, 20 nt, Human
ggcugcgcgcugcggcgggc

SEQ ID NO: 1251022 - RNA, 22 nt, Human
gggcagggaggccuugagccug

SEQ ID NO: 1251023 - RNA, 21 nt, Human
gggcugcgcgcugcggcgggc

SEQ ID NO: 1251024 - RNA, 25 nt, Human
ggggagcgggcaccguggggcugcg

SEQ ID NO: 1251025 - RNA, 18 nt, Human
gguggagaggaaaagggc

SEQ ID NO: 1251026 - RNA, 20 nt, Human
gucucagaugccuggugcug

SEQ ID NO: 1251027 - RNA, 20 nt, Human
guuucaccaucucccuuccg

SEQ ID NO: 1251028 - RNA, 19 nt, Human
ucaguuuuucccugugagg

SEQ ID NO: 1251029 - RNA, 19 nt, Human
uccaugauacagcuccugg

SEQ ID NO: 1251030 - RNA, 18 nt, Human
uccccagguccugggguc

SEQ ID NO: 1251031 - RNA, 21 nt, Human
ucccuuccggucacaaggguu

SEQ ID NO: 1251032 - RNA, 19 nt, Human
uccgcggcgaggcgagaga

SEQ ID NO: 1251033 - RNA, 22 nt, Human
uccucggcuggucgcccgaggc

SEQ ID NO: 1251034 - RNA, 18 nt, Human
uccugggguccugccugg

SEQ ID NO: 1251035 - RNA, 21 nt, Human
uccugggguccugccuggugg

SEQ ID NO: 1251036 - RNA, 22 nt, Human
ucguuccaugauacagcuccug

SEQ ID NO: 1251037 - RNA, 19 nt, Human
ucuucgggcuccccugugu

SEQ ID NO: 1251038 - RNA, 24 nt, Human
ucuuuccggcuccaggcucugcaa

SEQ ID NO: 1251039 - RNA, 26 nt, Human
ugaacucgccuuucuugcuccccagg

SEQ ID NO: 1251040 - RNA, 24 nt, Human
ugaagggagcagggugcuucaggc

SEQ ID NO: 1251041 - RNA, 20 nt, Human
ugacagacgcucaaccucac

SEQ ID NO: 1251042 - RNA, 21 nt, Human
ugacagacgcucaaccucaca

SEQ ID NO: 1251043 - RNA, 21 nt, Human
ugagguggagaggaaaagggc

SEQ ID NO: 1251044 - RNA, 21 nt, Human
ugagguggagaggaaaagggc

SEQ ID NO: 1251045 - RNA, 19 nt, Human
ugcccacagcuguuggacg

SEQ ID NO: 1251046 - RNA, 23 nt, Human
ugcccggugcugcuggccacgug

SEQ ID NO: 1251047 - RNA, 23 nt, Human
ugccuugguuggcaggguucugg

SEQ ID NO: 1251048 - RNA, 23 nt, Human
ugcuggccacgugugcccccgug

SEQ ID NO: 1251049 - RNA, 18 nt, Human
uggagaugcugaagacuc

SEQ ID NO: 1251050 - RNA, 23 nt, Human
uggcccgccuucccuugcuccug

SEQ ID NO: 1251051 - RNA, 23 nt, Human
uggccuaggguggccugcgggcc

SEQ ID NO: 1251052 - RNA, 22 nt, Human
uggccugcgggccccaccucac

SEQ ID NO: 1251053 - RNA, 19 nt, Human
uggcucugaaggcagcccc

SEQ ID NO: 1251054 - RNA, 22 nt, Human
ugggaaaggcgcgggcggccac

SEQ ID NO: 1251055 - RNA, 20 nt, Human
uggggcugcgcgcugcggcg

SEQ ID NO: 1251056 - RNA, 22 nt, Human
aagaccacagccacauccuuga

SEQ ID NO: 1251057 - RNA, 25 nt, Human
aaguguugacgacuacugggaagcc

SEQ ID NO: 1251058 - RNA, 19 nt, Human
accacagccacauccuuga

SEQ ID NO: 1251059 - RNA, 19 nt, Human
acugugcucacugcucuuc

SEQ ID NO: 1251060 - RNA, 19 nt, Human
agcagccccagcuccuccu

SEQ ID NO: 1251061 - RNA, 23 nt, Human
auucugaagcucuuuccacauuc

SEQ ID NO: 1251062 - RNA, 21 nt, Human
caacugccggagcuaaaccga

SEQ ID NO: 1251063 - RNA, 23 nt, Human
cacugcucuucccacaauccuca

SEQ ID NO: 1251064 - RNA, 19 nt, Human
cagugugaauucugaagcu

SEQ ID NO: 1251065 - RNA, 22 nt, Human
ccacugagcgucuggacuacac

SEQ ID NO: 1251066 - RNA, 19 nt, Human
ccacugauagcagguuucu

SEQ ID NO: 1251067 - RNA, 21 nt, Human
cccacugauagcagguuucug

SEQ ID NO: 1251068 - RNA, 18 nt, Human
ccccacugauagcagguu

SEQ ID NO: 1251069 - RNA, 22 nt, Human
cccugagagucguccuucccuc

SEQ ID NO: 1251070 - RNA, 18 nt, Human
cccugggacccaacugcc

SEQ ID NO: 1251071 - RNA, 20 nt, Human
cccugggacccaacugccgg

SEQ ID NO: 1251072 - RNA, 19 nt, Human
ccugggacccaacugccgg

SEQ ID NO: 1251073 - RNA, 21 nt, Human
ccuuacaauuauaaggucucu

SEQ ID NO: 1251074 - RNA, 21 nt, Human
ccuugaaggucacugccuccu

SEQ ID NO: 1251075 - RNA, 25 nt, Human
cggggaacgaaucucguacccccga

SEQ ID NO: 1251076 - RNA, 20 nt, Human
cguccuucccucucccuggg

SEQ ID NO: 1251077 - RNA, 19 nt, Human
cucccguguggacccucug

SEQ ID NO: 1251078 - RNA, 22 nt, Human
cuccucggugaagaccacagcc

SEQ ID NO: 1251079 - RNA, 19 nt, Human
cucucucccguguggaccc

SEQ ID NO: 1251080 - RNA, 21 nt, Human
cugaaucccuuuccacacucc

SEQ ID NO: 1251081 - RNA, 24 nt, Human
cugagagucguccuucccucuccc

SEQ ID NO: 1251082 - RNA, 24 nt, Human
cugugcucacugcucuucccacaa

SEQ ID NO: 1251083 - RNA, 27 nt, Human
cuguggucgcuuuguuggucuugaagg

SEQ ID NO: 1251084 - RNA, 22 nt, Human
cuuacuaauguagcccuuccca

SEQ ID NO: 1251085 - RNA, 24 nt, Human
cuucccacaauccucacauuggaa

SEQ ID NO: 1251086 - RNA, 21 nt, Human
cuucugacauuuauacaguuc

SEQ ID NO: 1251087 - RNA, 23 nt, Human
cuugccuccugaauucccuucuc

SEQ ID NO: 1251088 - RNA, 18 nt, Human
gaaacguccagcagcccc

SEQ ID NO: 1251089 - RNA, 20 nt, Human
gaagcucuuuccacauuccu

SEQ ID NO: 1251090 - RNA, 19 nt, Human
gacccaacugccggagcua

SEQ ID NO: 1251091 - RNA, 18 nt, Human
gaugugaauggcccugug

SEQ ID NO: 1251092 - RNA, 23 nt, Human
gggaagcccuugaccacucuucc

SEQ ID NO: 1251093 - RNA, 21 nt, Human
gucucucucccguguggaccc

SEQ ID NO: 1251094 - RNA, 21 nt, Human
uacacuucccagaauucccug

SEQ ID NO: 1251095 - RNA, 19 nt, Human
uacuccugcagcauuacac

SEQ ID NO: 1251096 - RNA, 21 nt, Human
ucaguuuggaucuugccuccu

SEQ ID NO: 1251097 - RNA, 20 nt, Human
uccaaaacuuuucuucucuu

SEQ ID NO: 1251098 - RNA, 20 nt, Human
uccagugugaauucugaagc

SEQ ID NO: 1251099 - RNA, 20 nt, Human
ucccagaauucccugggacc

SEQ ID NO: 1251100 - RNA, 21 nt, Human
ucccuuuccacacuccucaca

SEQ ID NO: 1251101 - RNA, 18 nt, Human
uccucugggaaacgucca

SEQ ID NO: 1251102 - RNA, 24 nt, Human
uccugcgucaaccugggaggggac

SEQ ID NO: 1251103 - RNA, 20 nt, Human
ucugacauuuauacaguucu

SEQ ID NO: 1251104 - RNA, 20 nt, Human
ugcagcauuacacucaaagg

SEQ ID NO: 1251105 - RNA, 22 nt, Human
uggaacagacuccaacucaguu

SEQ ID NO: 1251106 - RNA, 24 nt, Human
uggguuagaugaguugaggcccau

SEQ ID NO: 1251107 - RNA, 23 nt, Human
uucaugugguccuguuucuggaa

SEQ ID NO: 1251108 - RNA, 20 nt, Human
uucuccacuguggucgcuuu

SEQ ID NO: 1251109 - RNA, 18 nt, Human
uucucugcuguggagucu

SEQ ID NO: 1251110 - RNA, 23 nt, Human
uucucugcuguggagucuuugau

SEQ ID NO: 1251111 - RNA, 20 nt, Human
uuggguugcugucuccauga

SEQ ID NO: 1251112 - RNA, 24 nt, Human
uuggucuugaaggcaugaacugug

SEQ ID NO: 1251113 - RNA, 21 nt, Human
uuucuccagugugaauucuga

SEQ ID NO: 1251114 - RNA, 19 nt, Human
agagaauucuauggccaca

SEQ ID NO: 1251115 - RNA, 20 nt, Human
agcaggcagcccugcgcccu

SEQ ID NO: 1251116 - RNA, 21 nt, Human
agggggcagcaggcagcccug

SEQ ID NO: 1251117 - RNA, 20 nt, Human
agggugcuuuccgcacccug

SEQ ID NO: 1251118 - RNA, 18 nt, Human
agucccagggugcuuucc

SEQ ID NO: 1251119 - RNA, 21 nt, Human
aucccuaaaugucaacagucc

SEQ ID NO: 1251120 - RNA, 22 nt, Human
caacagucccagggugcuuucc

SEQ ID NO: 1251121 - RNA, 22 nt, Human
cagcaggcagcccugcgcccuu

SEQ ID NO: 1251122 - RNA, 23 nt, Human
cccugcgcccuuacccuuuccug

SEQ ID NO: 1251123 - RNA, 20 nt, Human
cugcucugccgauuugaccu

SEQ ID NO: 1251124 - RNA, 19 nt, Human
cugggcagaggacacuggc

SEQ ID NO: 1251125 - RNA, 20 nt, Human
gaauucuauggccacauccc

SEQ ID NO: 1251126 - RNA, 22 nt, Human
gggcagcaggcagcccugcgcc

SEQ ID NO: 1251127 - RNA, 23 nt, Human
ucaacagucccagggugcuuucc

SEQ ID NO: 1251128 - RNA, 19 nt, Human
uccuccagagagaauucua

SEQ ID NO: 1251129 - RNA, 21 nt, Human
ugagggggcagcaggcagccc

SEQ ID NO: 1251130 - RNA, 23 nt, Human
uuuccuggcuggcaguuguggug

SEQ ID NO: 1251131 - RNA, 21 nt, Human
augguggcaguuuuucuuuuc

SEQ ID NO: 1251132 - RNA, 23 nt, Human
auuuccaguggaauuugagaguu

SEQ ID NO: 1251133 - RNA, 23 nt, Human
gaauuuccaguggaauuugagag

SEQ ID NO: 1251134 - RNA, 24 nt, Human
uuaaagaugguggcaguuuuucuu

SEQ ID NO: 1251135 - RNA, 22 nt, Human
uuugaaauauuaaugccucuga

SEQ ID NO: 1251136 - RNA, 22 nt, Human
aguggcccuggcugucuguagg

SEQ ID NO: 1251137 - RNA, 21 nt, Human
caacacggagggacugguaca

SEQ ID NO: 1251138 - RNA, 21 nt, Human
cacuuggagacacagaucugu

SEQ ID NO: 1251139 - RNA, 22 nt, Human
cagguuaaaguaaaacaaaaug

SEQ ID NO: 1251140 - RNA, 19 nt, Human
cggagggacugguacagcg

SEQ ID NO: 1251141 - RNA, 22 nt, Human
ggauaggcugcucuucuggggu

SEQ ID NO: 1251142 - RNA, 18 nt, Human
ucucauugggagugcccu

SEQ ID NO: 1251143 - RNA, 21 nt, Human
ucuggccacaaaaguggcccu

SEQ ID NO: 1251144 - RNA, 20 nt, Human
ucugggguccccauguaccc

SEQ ID NO: 1251145 - RNA, 23 nt, Human
ucugugugguagggcacuguagg

SEQ ID NO: 1251146 - RNA, 19 nt, Human
ugguacagcguaacagguu

SEQ ID NO: 1251147 - RNA, 22 nt, Human
accuuuuuuuuuuuucaggggc

SEQ ID NO: 1251148 - RNA, 19 nt, Human
agcuccuggccacaagcuc

SEQ ID NO: 1251149 - RNA, 20 nt, Human
caccuuuuuuuuuuuucagg

SEQ ID NO: 1251150 - RNA, 22 nt, Human
caccuuuuuuuuuuuucagggg

SEQ ID NO: 1251151 - RNA, 20 nt, Human
cagcacaccgauccuccuag

SEQ ID NO: 1251152 - RNA, 19 nt, Human
ccaccuuuuuuuuuuuuca

SEQ ID NO: 1251153 - RNA, 25 nt, Human
ccccagagcgccgccgacacucgcc

SEQ ID NO: 1251154 - RNA, 21 nt, Human
ccccucagaccgcaguugcga

SEQ ID NO: 1251155 - RNA, 20 nt, Human
ccuucccagccucuccuccc

SEQ ID NO: 1251156 - RNA, 22 nt, Human
cuccgggccguccucugccucc

SEQ ID NO: 1251157 - RNA, 19 nt, Human
cuccuggccacaagcucag

SEQ ID NO: 1251158 - RNA, 20 nt, Human
cucgcagccccuucccagcc

SEQ ID NO: 1251159 - RNA, 25 nt, Human
cucgcagccccuucccagccucucc

SEQ ID NO: 1251160 - RNA, 21 nt, Human
cuucccagccucuccucccca

SEQ ID NO: 1251161 - RNA, 23 nt, Human
cuucccagccucuccuccccaga

SEQ ID NO: 1251162 - RNA, 19 nt, Human
gagacuccgggccguccuc

SEQ ID NO: 1251163 - RNA, 24 nt, Human
gagacuccgggccguccucugccu

SEQ ID NO: 1251164 - RNA, 19 nt, Human
gcgaaaguggcucggggag

SEQ ID NO: 1251165 - RNA, 19 nt, Human
ucgcagccccuucccagcc

SEQ ID NO: 1251166 - RNA, 24 nt, Human
ucgcagccccuucccagccucucc

SEQ ID NO: 1251167 - RNA, 23 nt, Human
ucucgcagccccuucccagccuc

SEQ ID NO: 1251168 - RNA, 19 nt, Human
ugggaccagggcggugcgc

SEQ ID NO: 1251169 - RNA, 21 nt, Human
ugggaccagggcggugcgcua

SEQ ID NO: 1251170 - RNA, 21 nt, Human
uuuuuuuuuuuucaggggcuc

SEQ ID NO: 1251171 - RNA, 23 nt, Human
aaacauugcaguguggguccagc

SEQ ID NO: 1251172 - RNA, 21 nt, Human
aagcacagacuggccaagccc

SEQ ID NO: 1251173 - RNA, 21 nt, Human
aagccugcugguuccagcccu

SEQ ID NO: 1251174 - RNA, 22 nt, Human
acagaugagaacacacaccacg

SEQ ID NO: 1251175 - RNA, 18 nt, Human
acaggcaucucccacccu

SEQ ID NO: 1251176 - RNA, 24 nt, Human
acccugcuguugcucuccaggccu

SEQ ID NO: 1251177 - RNA, 22 nt, Human
accucuggccugcgucgcccag

SEQ ID NO: 1251178 - RNA, 25 nt, Human
accucuggccugcgucgcccaguuc

SEQ ID NO: 1251179 - RNA, 20 nt, Human
accuguagcgugaagacccu

SEQ ID NO: 1251180 - RNA, 21 nt, Human
agcagccgucacagcuccaug

SEQ ID NO: 1251181 - RNA, 21 nt, Human
agccacugaaaacgagagcag

SEQ ID NO: 1251182 - RNA, 18 nt, Human
agccccggccaggcagca

SEQ ID NO: 1251183 - RNA, 22 nt, Human
agccugcagcugcagcagcccc

SEQ ID NO: 1251184 - RNA, 21 nt, Human
agcgggauucgaaccaagggc

SEQ ID NO: 1251185 - RNA, 25 nt, Human
agcguggccuccagggcugcgaggg

SEQ ID NO: 1251186 - RNA, 24 nt, Human
aggaaagagcuuccccuugggggg

SEQ ID NO: 1251187 - RNA, 21 nt, Human
aggcagcagggucggccugcg

SEQ ID NO: 1251188 - RNA, 22 nt, Human
aggcaggggcuccugcaaccuu

SEQ ID NO: 1251189 - RNA, 18 nt, Human
agugaucccaggagagcu

SEQ ID NO: 1251190 - RNA, 26 nt, Human
caauacagaugagaacacacaccacg

SEQ ID NO: 1251191 - RNA, 19 nt, Human
cacacccgagguucccagu

SEQ ID NO: 1251192 - RNA, 22 nt, Human
cacggcaggaguguccgaugcc

SEQ ID NO: 1251193 - RNA, 20 nt, Human
cagaaaggccuggcugggug

SEQ ID NO: 1251194 - RNA, 21 nt, Human
cagcagaucccagggcagcgc

SEQ ID NO: 1251195 - RNA, 18 nt, Human
cagcuccagcucccagcg

SEQ ID NO: 1251196 - RNA, 23 nt, Human
caggauggcagggagcccacggc

SEQ ID NO: 1251197 - RNA, 23 nt, Human
caguguggguccagcccaggagg

SEQ ID NO: 1251198 - RNA, 18 nt, Human
ccacaaacacagaagcgu

SEQ ID NO: 1251199 - RNA, 19 nt, Human
ccacaccucuggccugcgu

SEQ ID NO: 1251200 - RNA, 19 nt, Human
ccacacgcgugcccaggag

SEQ ID NO: 1251201 - RNA, 18 nt, Human
ccacgaccgcggcccagg

SEQ ID NO: 1251202 - RNA, 19 nt, Human
ccacgaccgcggcccaggc

SEQ ID NO: 1251203 - RNA, 18 nt, Human
ccagcccgugagcgacgg

SEQ ID NO: 1251204 - RNA, 20 nt, Human
ccagcccgugagcgacggcc

SEQ ID NO: 1251205 - RNA, 24 nt, Human
ccagcccugcuccaccugggugcc

SEQ ID NO: 1251206 - RNA, 19 nt, Human
cccagccccggccaggcag

SEQ ID NO: 1251207 - RNA, 22 nt, Human
ccccaggaugccagcccaguuc

SEQ ID NO: 1251208 - RNA, 18 nt, Human
cccccagcuccagcuccc

SEQ ID NO: 1251209 - RNA, 21 nt, Human
cccccagcuccagcucccagc

SEQ ID NO: 1251210 - RNA, 21 nt, Human
cccccagcugagggugggagc

SEQ ID NO: 1251211 - RNA, 23 nt, Human
ccccggagccauuguccacaaac

SEQ ID NO: 1251212 - RNA, 24 nt, Human
ccccucgcgggaggacgcgcuggc

SEQ ID NO: 1251213 - RNA, 19 nt, Human
cccgcagccgggccuugcc

SEQ ID NO: 1251214 - RNA, 18 nt, Human
cccgugagcgacggcccc

SEQ ID NO: 1251215 - RNA, 23 nt, Human
cccgugagcgacggccccaggac

SEQ ID NO: 1251216 - RNA, 18 nt, Human
cccugccccggggacccc

SEQ ID NO: 1251217 - RNA, 18 nt, Human
ccgcggcccaggcccagc

SEQ ID NO: 1251218 - RNA, 25 nt, Human
ccucccgccgggccccgacgccccc

SEQ ID NO: 1251219 - RNA, 24 nt, Human
ccucuggccugcgucgcccaguuc

SEQ ID NO: 1251220 - RNA, 19 nt, Human
ccucugugccucccgccgg

SEQ ID NO: 1251221 - RNA, 24 nt, Human
ccugaggccugggauggcuugggg

SEQ ID NO: 1251222 - RNA, 23 nt, Human
ccugcagcugcagcagccccugc

SEQ ID NO: 1251223 - RNA, 21 nt, Human
ccugcuccaccugggugcccc

SEQ ID NO: 1251224 - RNA, 19 nt, Human
cgagagcaggcgaggagaa

SEQ ID NO: 1251225 - RNA, 18 nt, Human
cgccgggccccgacgccc

SEQ ID NO: 1251226 - RNA, 22 nt, Human
cgcggcgccgagcucugccccc

SEQ ID NO: 1251227 - RNA, 18 nt, Human
cggcacggucugggcgca

SEQ ID NO: 1251228 - RNA, 21 nt, Human
cugcagcugcagcagccccug

SEQ ID NO: 1251229 - RNA, 24 nt, Human
cuggcgguggcguuggggggaucu

SEQ ID NO: 1251230 - RNA, 22 nt, Human
cuuucagcuccacacgcgugcc

SEQ ID NO: 1251231 - RNA, 21 nt, Human
gaaaacgagagcaggcgagga

SEQ ID NO: 1251232 - RNA, 20 nt, Human
gaacugggaguccaagcaca

SEQ ID NO: 1251233 - RNA, 20 nt, Human
gacaguggaugagugauccc

SEQ ID NO: 1251234 - RNA, 23 nt, Human
gagcacagcagaucccagggcag

SEQ ID NO: 1251235 - RNA, 19 nt, Human
gagcagcccggagaagcug

SEQ ID NO: 1251236 - RNA, 18 nt, Human
gagcucugcccccagcuc

SEQ ID NO: 1251237 - RNA, 22 nt, Human
gaggaccacgaccgcggcccag

SEQ ID NO: 1251238 - RNA, 21 nt, Human
gaggagaagccugcugguucc

SEQ ID NO: 1251239 - RNA, 22 nt, Human
gcagccccaggaugccagccca

SEQ ID NO: 1251240 - RNA, 22 nt, Human
gcagcugcagcagccccugcac

SEQ ID NO: 1251241 - RNA, 24 nt, Human
gccagagucaggagcguggccucc

SEQ ID NO: 1251242 - RNA, 24 nt, Human
gcccaggaggugaggcuccgggac

SEQ ID NO: 1251243 - RNA, 22 nt, Human
gccccgucccuggaccccuuca

SEQ ID NO: 1251244 - RNA, 21 nt, Human
gccucccgccgggccccgacg

SEQ ID NO: 1251245 - RNA, 24 nt, Human
gcguggccuccagggcugcgaggg

SEQ ID NO: 1251246 - RNA, 20 nt, Human
gcugucccgggcauggcccc

SEQ ID NO: 1251247 - RNA, 30 nt, Human
ggaccccuucacgcaguucagggagccccc

SEQ ID NO: 1251248 - RNA, 26 nt, Human
ggagaacucagguccugaggccuggg

SEQ ID NO: 1251249 - RNA, 22 nt, Human
ggccaggcagcagggucggccu

SEQ ID NO: 1251250 - RNA, 19 nt, Human
ggcccgaggaggaccacga

SEQ ID NO: 1251251 - RNA, 20 nt, Human
ggccugagacggccuccagg

SEQ ID NO: 1251252 - RNA, 26 nt, Human
ggcgaggagaagccugcugguuccag

SEQ ID NO: 1251253 - RNA, 20 nt, Human
gggaggagccacugaaaacg

SEQ ID NO: 1251254 - RNA, 24 nt, Human
ggggggaucugcgcgcuggccagg

SEQ ID NO: 1251255 - RNA, 20 nt, Human
gggugccuuucagcuccaca

SEQ ID NO: 1251256 - RNA, 21 nt, Human
gggugcugccugauccugggu

SEQ ID NO: 1251257 - RNA, 22 nt, Human
gguagggugggggacuggcugc

SEQ ID NO: 1251258 - RNA, 21 nt, Human
ggucggccugcgguucuggga

SEQ ID NO: 1251259 - RNA, 20 nt, Human
ggugagugacaggcaucucc

SEQ ID NO: 1251260 - RNA, 23 nt, Human
ggugcagacgcaggcaggggcuc

SEQ ID NO: 1251261 - RNA, 22 nt, Human
guacuguccagccugcagcugc

SEQ ID NO: 1251262 - RNA, 24 nt, Human
ucaggagcguggccuccagggccg

SEQ ID NO: 1251263 - RNA, 21 nt, Human
uccacaaacacagaagcguac

SEQ ID NO: 1251264 - RNA, 22 nt, Human
uccacaaacacagaagcguacu

SEQ ID NO: 1251265 - RNA, 18 nt, Human
uccacacgcgugcccagg

SEQ ID NO: 1251266 - RNA, 18 nt, Human
uccacacgcgugcccagg

SEQ ID NO: 1251267 - RNA, 21 nt, Human
uccacacgcgugcccaggagc

SEQ ID NO: 1251268 - RNA, 20 nt, Human
ucccaggauggcagggagcc

SEQ ID NO: 1251269 - RNA, 23 nt, Human
ucccaggauggcagggagcccac

SEQ ID NO: 1251270 - RNA, 23 nt, Human
ucccgggcccgcagccgggccuu

SEQ ID NO: 1251271 - RNA, 19 nt, Human
ucccuggaccccuucacgc

SEQ ID NO: 1251272 - RNA, 21 nt, Human
ucccugugcccggcgcucuuc

SEQ ID NO: 1251273 - RNA, 21 nt, Human
uccgaugcccccagccccggc

SEQ ID NO: 1251274 - RNA, 18 nt, Human
ucugcaggcaggaaagag

SEQ ID NO: 1251275 - RNA, 20 nt, Human
ugagaacacacaccacgucc

SEQ ID NO: 1251276 - RNA, 18 nt, Human
ugagaaccccauggacag

SEQ ID NO: 1251277 - RNA, 21 nt, Human
ugagcgacggccccaggacgc

SEQ ID NO: 1251278 - RNA, 22 nt, Human
ugagugaucccaggagagcugg

SEQ ID NO: 1251279 - RNA, 18 nt, Human
ugauccugggugccugcc

SEQ ID NO: 1251280 - RNA, 21 nt, Human
ugauccugggugccugccccc

SEQ ID NO: 1251281 - RNA, 20 nt, Human
ugcaccuguagcgugaagac

SEQ ID NO: 1251282 - RNA, 21 nt, Human
ugccagcccaguucccugugc

SEQ ID NO: 1251283 - RNA, 18 nt, Human
ugcccaggagcagcccgg

SEQ ID NO: 1251284 - RNA, 24 nt, Human
ugcccccagccccggccaggcagc

SEQ ID NO: 1251285 - RNA, 22 nt, Human
ugcucuccaggccugagacggc

SEQ ID NO: 1251286 - RNA, 25 nt, Human
ugcugaagaaccuagagggccccca

SEQ ID NO: 1251287 - RNA, 26 nt, Human
ugcugaagaaccuagagggccccccc

SEQ ID NO: 1251288 - RNA, 21 nt, Human
ugcuuggagaggccagagggc

SEQ ID NO: 1251289 - RNA, 28 nt, Human
uggagcccgccuggauggucgguagacc

SEQ ID NO: 1251290 - RNA, 24 nt, Human
uggcaucacagacgcccagcacug

SEQ ID NO: 1251291 - RNA, 18 nt, Human
uggcgguggcguuggggg

SEQ ID NO: 1251292 - RNA, 20 nt, Human
uggcugcagccaaggggcug

SEQ ID NO: 1251293 - RNA, 19 nt, Human
ugggauggcuugggggccu

SEQ ID NO: 1251294 - RNA, 22 nt, Human
uggggggaucugcgcgcuggcc

SEQ ID NO: 1251295 - RNA, 23 nt, Human
uguggcucugaagaauuggccgc

SEQ ID NO: 1251296 - RNA, 19 nt, Human
uucccggauggugaggccc

SEQ ID NO: 1251297 - RNA, 20 nt, Human
uugcucuccaggccugagac

SEQ ID NO: 1251298 - RNA, 19 nt, Human
uuggccgccagagucagga

SEQ ID NO: 1251299 - RNA, 23 nt, Human
agcgguguaguaggagcaggggg

SEQ ID NO: 1251300 - RNA, 20 nt, Human
ccgcggcggguggguggaga

SEQ ID NO: 1251301 - RNA, 20 nt, Human
cgugggugugccuguaggug

SEQ ID NO: 1251302 - RNA, 21 nt, Human
gagcggugguccguaggcagg

SEQ ID NO: 1251303 - RNA, 22 nt, Human
gagugugggugguaagugcgcu

SEQ ID NO: 1251304 - RNA, 24 nt, Human
gcggcggguggguggagagggugc

SEQ ID NO: 1251305 - RNA, 23 nt, Human
gggccgugggcagggggccgggg

SEQ ID NO: 1251306 - RNA, 24 nt, Human
gggggccgggguggcgcguggaug

SEQ ID NO: 1251307 - RNA, 19 nt, Human
gggggggccguggggggag

SEQ ID NO: 1251308 - RNA, 19 nt, Human
gggggucgcagggagggua

SEQ ID NO: 1251309 - RNA, 19 nt, Human
guccguccgugguguggag

SEQ ID NO: 1251310 - RNA, 19 nt, Human
guggaggcccccggauacc

SEQ ID NO: 1251311 - RNA, 24 nt, Human
gugggagcgggagugaccgccugg

SEQ ID NO: 1251312 - RNA, 24 nt, Human
ugcgcugggggucgcagggagggu

SEQ ID NO: 1251313 - RNA, 20 nt, Human
ugcugguggagugugggugg

SEQ ID NO: 1251314 - RNA, 20 nt, Human
uggaggcccccggauaccag

SEQ ID NO: 1251315 - RNA, 20 nt, Human
uggcgugggugugccuguag

SEQ ID NO: 1251316 - RNA, 18 nt, Human
uggggggaggguagggug

SEQ ID NO: 1251317 - RNA, 19 nt, Human
uggggggaggguagggugc

SEQ ID NO: 1251318 - RNA, 21 nt, Human
ugggggucgcagggaggguag

SEQ ID NO: 1251319 - RNA, 25 nt, Human
uggguagggccgugggcagggggcc

SEQ ID NO: 1251320 - RNA, 22 nt, Human
uggugcugguggagugugggug

SEQ ID NO: 1251321 - RNA, 23 nt, Human
uggugugcgacaguaggcagcgg

SEQ ID NO: 1251322 - RNA, 22 nt, Human
ugguguggagcggugcccagug

SEQ ID NO: 1251323 - RNA, 20 nt, Human
acucuuguuuuccucgcggc

SEQ ID NO: 1251324 - RNA, 21 nt, Human
agaguucuuuggaagaggaga

SEQ ID NO: 1251325 - RNA, 21 nt, Human
agauagaguaacuucuggguu

SEQ ID NO: 1251326 - RNA, 24 nt, Human
aggcagccaggaugucuugaugga

SEQ ID NO: 1251327 - RNA, 27 nt, Human
cagccggaucuccucccuuaggccauc

SEQ ID NO: 1251328 - RNA, 20 nt, Human
cccgccgcgccggggcuccg

SEQ ID NO: 1251329 - RNA, 23 nt, Human
ccucccuuaggccaucucucucc

SEQ ID NO: 1251330 - RNA, 21 nt, Human
ccugcagggcugguucccgga

SEQ ID NO: 1251331 - RNA, 20 nt, Human
gcgccggggcuccgggcugg

SEQ ID NO: 1251332 - RNA, 24 nt, Human
ggaaacgccccucuagcaauucca

SEQ ID NO: 1251333 - RNA, 24 nt, Human
ggcggcgccguccccgccgcgccg

SEQ ID NO: 1251334 - RNA, 18 nt, Human
ggguucaaggcuucugcc

SEQ ID NO: 1251335 - RNA, 20 nt, Human
ucccuuaggccaucucucuc

SEQ ID NO: 1251336 - RNA, 24 nt, Human
ucuccucuuccagcugggccacag

SEQ ID NO: 1251337 - RNA, 18 nt, Human
uucuuuggaagaggagaa

SEQ ID NO: 1251338 - RNA, 21 nt, Human
ugcccugggcuuucuggaagc

SEQ ID NO: 1251339 - RNA, 23 nt, Human
uuuucucugcccugggcuuucug

SEQ ID NO: 1251340 - RNA, 21 nt, Human
ugcugaggccguggggaaugu

SEQ ID NO: 1251341 - RNA, 19 nt, Human
uuaagguggaggcaagggc

SEQ ID NO: 1251342 - RNA, 18 nt, Human
uuuaagguggaggcaagg

SEQ ID NO: 1251343 - RNA, 23 nt, Human
agagugggcgcggagcuggggcc

SEQ ID NO: 1251344 - RNA, 18 nt, Human
agugggcgcggagcuggg

SEQ ID NO: 1251345 - RNA, 18 nt, Human
cacgcauccuuuacgcca

SEQ ID NO: 1251346 - RNA, 18 nt, Human
ccagugcugugcgccccg

SEQ ID NO: 1251347 - RNA, 22 nt, Human
ccucgaaccuugccaaucacca

SEQ ID NO: 1251348 - RNA, 21 nt, Human
ccucucugggcacgcauccuu

SEQ ID NO: 1251349 - RNA, 23 nt, Human
cucagagagcucaccgcagccag

SEQ ID NO: 1251350 - RNA, 20 nt, Human
cuucagcagccgccuccucu

SEQ ID NO: 1251351 - RNA, 23 nt, Human
gcaggagagagugggcgcggagc

SEQ ID NO: 1251352 - RNA, 18 nt, Human
gccacgggcuuucagggg

SEQ ID NO: 1251353 - RNA, 19 nt, Human
gccgccuccucugcggacu

SEQ ID NO: 1251354 - RNA, 24 nt, Human
ucucagagagcucaccgcagccag

SEQ ID NO: 1251355 - RNA, 18 nt, Human
ugcugugcgccccgcuug

SEQ ID NO: 1251356 - RNA, 18 nt, Human
ugcuguuucuucagcagc

SEQ ID NO: 1251357 - RNA, 22 nt, Human
uggggccagcgcagggccgugg

SEQ ID NO: 1251358 - RNA, 25 nt, Human
ugucaaaacagauugcuguuucuuc

SEQ ID NO: 1251359 - RNA, 22 nt, Human
aaacagggcuggugaugaccuu

SEQ ID NO: 1251360 - RNA, 20 nt, Human
acaaggcugcucugcagcag

SEQ ID NO: 1251361 - RNA, 24 nt, Human
acagugacuggugggggugggcac

SEQ ID NO: 1251362 - RNA, 22 nt, Human
accuuggcccugugcggugggg

SEQ ID NO: 1251363 - RNA, 19 nt, Human
agagccccuuccucuugcu

SEQ ID NO: 1251364 - RNA, 23 nt, Human
agcagaagccacugguggcgugu

SEQ ID NO: 1251365 - RNA, 23 nt, Human
aggcauucccagugaucaggagc

SEQ ID NO: 1251366 - RNA, 19 nt, Human
agguggaggccugguugag

SEQ ID NO: 1251367 - RNA, 19 nt, Human
aggugggugccuugggggu

SEQ ID NO: 1251368 - RNA, 19 nt, Human
auccagcugccuccacagu

SEQ ID NO: 1251369 - RNA, 23 nt, Human
aucuggacccccucucagaccug

SEQ ID NO: 1251370 - RNA, 23 nt, Human
augcacccacacacucgcacaca

SEQ ID NO: 1251371 - RNA, 25 nt, Human
cacccacacacucgcacacaugccc

SEQ ID NO: 1251372 - RNA, 19 nt, Human
cacccauccguggggguug

SEQ ID NO: 1251373 - RNA, 23 nt, Human
cagaccaguugaccaggaagccc

SEQ ID NO: 1251374 - RNA, 21 nt, Human
cagcagaagccacugguggcg

SEQ ID NO: 1251375 - RNA, 19 nt, Human
cagcagcagcagaagccac

SEQ ID NO: 1251376 - RNA, 22 nt, Human
cagcagcagcagaagccacugg

SEQ ID NO: 1251377 - RNA, 21 nt, Human
cauccagaugcacccacacac

SEQ ID NO: 1251378 - RNA, 22 nt, Human
caucuguugcccccuccccacu

SEQ ID NO: 1251379 - RNA, 20 nt, Human
ccauccguggggguugucug

SEQ ID NO: 1251380 - RNA, 24 nt, Human
cccacccccagugagauaagaggg

SEQ ID NO: 1251381 - RNA, 23 nt, Human
cccccuggugaccauacagaguu

SEQ ID NO: 1251382 - RNA, 21 nt, Human
ccccgccgccccaucuguugc

SEQ ID NO: 1251383 - RNA, 19 nt, Human
cccugagcugcacuggccc

SEQ ID NO: 1251384 - RNA, 18 nt, Human
ccgcacccggggcucggu

SEQ ID NO: 1251385 - RNA, 24 nt, Human
ccgugcucggugggagcagccgcg

SEQ ID NO: 1251386 - RNA, 23 nt, Human
ccuccacagugacuggugggggu

SEQ ID NO: 1251387 - RNA, 22 nt, Human
ccucccagcuguggcccugagc

SEQ ID NO: 1251388 - RNA, 26 nt, Human
ccucuugcucuuucucuucgggccgc

SEQ ID NO: 1251389 - RNA, 24 nt, Human
cgcacacaugccucuacguguacg

SEQ ID NO: 1251390 - RNA, 21 nt, Human
cuccauggcagguggaggccu

SEQ ID NO: 1251391 - RNA, 20 nt, Human
cucugcgcuccccgccgccc

SEQ ID NO: 1251392 - RNA, 22 nt, Human
cugagagccccuuccucuugcu

SEQ ID NO: 1251393 - RNA, 20 nt, Human
cuggacccccucucagaccu

SEQ ID NO: 1251394 - RNA, 18 nt, Human
cugggugggguuggggag

SEQ ID NO: 1251395 - RNA, 18 nt, Human
cuuggcccugugcggugg

SEQ ID NO: 1251396 - RNA, 20 nt, Human
gagagccccuuccucuugcu

SEQ ID NO: 1251397 - RNA, 21 nt, Human
gagcaagcggggccacaaggc

SEQ ID NO: 1251398 - RNA, 22 nt, Human
gagcagccgcguugcugcccca

SEQ ID NO: 1251399 - RNA, 22 nt, Human
gcagcagcagcagaagccacug

SEQ ID NO: 1251400 - RNA, 19 nt, Human
gccccaucuguugcccccu

SEQ ID NO: 1251401 - RNA, 24 nt, Human
gccccaucuguugcccccucccca

SEQ ID NO: 1251402 - RNA, 21 nt, Human
gcccugagcugcacuggcccc

SEQ ID NO: 1251403 - RNA, 24 nt, Human
gcgguggaaccccgugggcccccu

SEQ ID NO: 1251404 - RNA, 21 nt, Human
ggacugggacggggugcacug

SEQ ID NO: 1251405 - RNA, 18 nt, Human
ggagcaaagggcaggcau

SEQ ID NO: 1251406 - RNA, 22 nt, Human
ggagcagccgcguugcugccug

SEQ ID NO: 1251407 - RNA, 25 nt, Human
ggaggugggugccuugggggggauc

SEQ ID NO: 1251408 - RNA, 23 nt, Human
ggcuggugaugaccuuggcccug

SEQ ID NO: 1251409 - RNA, 22 nt, Human
gggcacgggugaguggcgaacc

SEQ ID NO: 1251410 - RNA, 21 nt, Human
gggguugucugugacaguauc

SEQ ID NO: 1251411 - RNA, 18 nt, Human
ggugggagggugaguagc

SEQ ID NO: 1251412 - RNA, 25 nt, Human
guacauccagaugcacccacacaac

SEQ ID NO: 1251413 - RNA, 18 nt, Human
gugaucaggagcuggggc

SEQ ID NO: 1251414 - RNA, 22 nt, Human
gugggcccccucguugcguggc

SEQ ID NO: 1251415 - RNA, 18 nt, Human
uaacccccuggugaccau

SEQ ID NO: 1251416 - RNA, 18 nt, Human
uaaggcggggaccccacc

SEQ ID NO: 1251417 - RNA, 26 nt, Human
uacguguacgcccaugggcacgugug

SEQ ID NO: 1251418 - RNA, 18 nt, Human
uacucuaaggcggggacc

SEQ ID NO: 1251419 - RNA, 21 nt, Human
ucccagcuguggcccugagcu

SEQ ID NO: 1251420 - RNA, 24 nt, Human
uccccgccgccccaucuguugccc

SEQ ID NO: 1251421 - RNA, 19 nt, Human
uccugggcugugaggggcu

SEQ ID NO: 1251422 - RNA, 18 nt, Human
ucgcacacaugccucuac

SEQ ID NO: 1251423 - RNA, 22 nt, Human
ucgcccgaaggccaaggacugc

SEQ ID NO: 1251424 - RNA, 19 nt, Human
ucuccauggcagguggagg

SEQ ID NO: 1251425 - RNA, 19 nt, Human
ucuccauggcagguggagg

SEQ ID NO: 1251426 - RNA, 22 nt, Human
ucuccauggcagguggaggccu

SEQ ID NO: 1251427 - RNA, 18 nt, Human
ugacuggugggggugggc

SEQ ID NO: 1251428 - RNA, 24 nt, Human
ugcacccacacacucgcacacaug

SEQ ID NO: 1251429 - RNA, 18 nt, Human
ugcagagcucaucaaugg

SEQ ID NO: 1251430 - RNA, 24 nt, Human
ugcagcagcagcagaagccacugg

SEQ ID NO: 1251431 - RNA, 19 nt, Human
ugccccagucuggccguca

SEQ ID NO: 1251432 - RNA, 19 nt, Human
ugccuugggggugguccca

SEQ ID NO: 1251433 - RNA, 22 nt, Human
ugcucuuucucuuccaacaggg

SEQ ID NO: 1251434 - RNA, 23 nt, Human
ugggacaggucugacuguggcuc

SEQ ID NO: 1251435 - RNA, 18 nt, Human
ugggacggggugcacugg

SEQ ID NO: 1251436 - RNA, 21 nt, Human
ugggagcagccgcguugcugc

SEQ ID NO: 1251437 - RNA, 21 nt, Human
ugggcaggaaccucucaccug

SEQ ID NO: 1251438 - RNA, 21 nt, Human
ugggcugugaggggcuucugg

SEQ ID NO: 1251439 - RNA, 18 nt, Human
uggggaugcaaacagggc

SEQ ID NO: 1251440 - RNA, 18 nt, Human
uggggccugcacucaacu

SEQ ID NO: 1251441 - RNA, 21 nt, Human
ugggugggguuggggagccug

SEQ ID NO: 1251442 - RNA, 23 nt, Human
ugggugggguuggggagccuggg

SEQ ID NO: 1251443 - RNA, 21 nt, Human
uggugaggggggcccgggagg

SEQ ID NO: 1251444 - RNA, 19 nt, Human
uuaacccccuggugaccau

SEQ ID NO: 1251445 - RNA, 23 nt, Human
uucuccuacacagggggcuccau

SEQ ID NO: 1251446 - RNA, 21 nt, Human
uugaguggagcaaagggcagg

SEQ ID NO: 1251447 - RNA, 22 nt, Human
uugcccccuccccacugagagc

SEQ ID NO: 1251448 - RNA, 19 nt, Human
uuggggguggucccaacug

SEQ ID NO: 1251449 - RNA, 25 nt, Human
uuuccacgcgacgauggcugccgug

SEQ ID NO: 1251450 - RNA, 23 nt, Human
accaggggagggcucaugggcug

SEQ ID NO: 1251451 - RNA, 22 nt, Human
agcucacacaggacacaaccuc

SEQ ID NO: 1251452 - RNA, 20 nt, Human
aucaucccugccugccucag

SEQ ID NO: 1251453 - RNA, 24 nt, Human
cacaaccucacuguaaaaacucca

SEQ ID NO: 1251454 - RNA, 20 nt, Human
cagggugaguugucugaaga

SEQ ID NO: 1251455 - RNA, 24 nt, Human
caucccugccugccucagccuucc

SEQ ID NO: 1251456 - RNA, 21 nt, Human
ccagggcccuuugugcucccu

SEQ ID NO: 1251457 - RNA, 21 nt, Human
ccccuggagcucuccagccgc

SEQ ID NO: 1251458 - RNA, 20 nt, Human
ccggcagagguccugccagg

SEQ ID NO: 1251459 - RNA, 19 nt, Human
ccucccaccuccucuccgc

SEQ ID NO: 1251460 - RNA, 20 nt, Human
ccugcuugggauucuccucu

SEQ ID NO: 1251461 - RNA, 19 nt, Human
cgagggcagcuccggcaga

SEQ ID NO: 1251462 - RNA, 21 nt, Human
cgagggcagcuccggcagagg

SEQ ID NO: 1251463 - RNA, 22 nt, Human
cuccagccgcagccgcggggcc

SEQ ID NO: 1251464 - RNA, 20 nt, Human
cuccgccccuggagcucucc

SEQ ID NO: 1251465 - RNA, 23 nt, Human
cuccucuccgccccuggagcucu

SEQ ID NO: 1251466 - RNA, 19 nt, Human
cuguggggugcgcagggag

SEQ ID NO: 1251467 - RNA, 23 nt, Human
cuugggauucuccucuccuaagg

SEQ ID NO: 1251468 - RNA, 24 nt, Human
gcagccgcggggccugcuugggau

SEQ ID NO: 1251469 - RNA, 22 nt, Human
ggagggcucaugggcuguggag

SEQ ID NO: 1251470 - RNA, 23 nt, Human
ggcaucaucccugccugccucag

SEQ ID NO: 1251471 - RNA, 23 nt, Human
ggccugcuugggauucuccucug

SEQ ID NO: 1251472 - RNA, 20 nt, Human
ggcuguggaggaaugggcug

SEQ ID NO: 1251473 - RNA, 23 nt, Human
uagcucacacaggacacaaccuc

SEQ ID NO: 1251474 - RNA, 19 nt, Human
ucccaccuccucuccgccc

SEQ ID NO: 1251475 - RNA, 24 nt, Human
ucccaggcccaauccugcccgauc

SEQ ID NO: 1251476 - RNA, 27 nt, Human
ucccugccugccucagccuucccaggc

SEQ ID NO: 1251477 - RNA, 23 nt, Human
uccucugcuggcaucaucccugc

SEQ ID NO: 1251478 - RNA, 24 nt, Human
ugccagggcccuuugugcucccuu

SEQ ID NO: 1251479 - RNA, 21 nt, Human
ugccucagccuucccaggccc

SEQ ID NO: 1251480 - RNA, 22 nt, Human
ugccucagccuucccaggccca

SEQ ID NO: 1251481 - RNA, 21 nt, Human
uggagcucuccagccgcagcc

SEQ ID NO: 1251482 - RNA, 23 nt, Human
ugggcuguggggugcgcagggag

SEQ ID NO: 1251483 - RNA, 25 nt, Human
uguggaggaaugggcuguggggaaa

SEQ ID NO: 1251484 - RNA, 18 nt, Human
uucccaggcccaauccug

SEQ ID NO: 1251485 - RNA, 23 nt, Human
uugcagggaccaggggagggcuc

SEQ ID NO: 1251486 - RNA, 23 nt, Human
cauuguacggccuuugucagagc

SEQ ID NO: 1251487 - RNA, 19 nt, Human
cuuugucagagcuguccuc

SEQ ID NO: 1251488 - RNA, 24 nt, Human
caaagugcccagauuaaugucugu

SEQ ID NO: 1251489 - RNA, 18 nt, Human
caccaggaaagacacaug

SEQ ID NO: 1251490 - RNA, 24 nt, Human
caccaggaaagacacauggauccc

SEQ ID NO: 1251491 - RNA, 19 nt, Human
cauggaucccgguccuccu

SEQ ID NO: 1251492 - RNA, 18 nt, Human
cuguaucgucccuccagc

SEQ ID NO: 1251493 - RNA, 24 nt, Human
cuguaucgucccuccagcggagau

SEQ ID NO: 1251494 - RNA, 21 nt, Human
ugccuuauuuccccuauucaa

SEQ ID NO: 1251495 - RNA, 21 nt, Human
uucaacagcagcucagugaac

SEQ ID NO: 1251496 - RNA, 22 nt, Human
cuucuucuuguuguuguaagau

SEQ ID NO: 1251497 - RNA, 19 nt, Human
uaagauaaaucuguaguua

SEQ ID NO: 1251498 - RNA, 20 nt, Human
ggagugggaguccaguguga

SEQ ID NO: 1251499 - RNA, 21 nt, Human
ugacagcuaaauaagcaacca

SEQ ID NO: 1251500 - RNA, 18 nt, Human
aaaccagguucccugaaa

SEQ ID NO: 1251501 - RNA, 23 nt, Human
aaggcuuugcggagcaaggggug

SEQ ID NO: 1251502 - RNA, 21 nt, Human
acaggcaggcagaugggggca

SEQ ID NO: 1251503 - RNA, 21 nt, Human
aggcaacuccagggaggcagg

SEQ ID NO: 1251504 - RNA, 23 nt, Human
aggcaggcagaugggggcaccuu

SEQ ID NO: 1251505 - RNA, 21 nt, Human
agugcagguagccggccgccu

SEQ ID NO: 1251506 - RNA, 19 nt, Human
caccccucuuuccaaccag

SEQ ID NO: 1251507 - RNA, 21 nt, Human
caccuugccaggcccccugca

SEQ ID NO: 1251508 - RNA, 24 nt, Human
caccuugccaggcccccugcagcc

SEQ ID NO: 1251509 - RNA, 23 nt, Human
cacgacaggcaacuccagggagg

SEQ ID NO: 1251510 - RNA, 21 nt, Human
cagggagcgccgggaucaggg

SEQ ID NO: 1251511 - RNA, 20 nt, Human
cagguagccggccgccuggc

SEQ ID NO: 1251512 - RNA, 23 nt, Human
ccagacugcagccaugauuggua

SEQ ID NO: 1251513 - RNA, 19 nt, Human
ccaggcccccugcagccag

SEQ ID NO: 1251514 - RNA, 23 nt, Human
ccccugcagccagacugcagcca

SEQ ID NO: 1251515 - RNA, 25 nt, Human
ccccugcagccagacugcagccaug

SEQ ID NO: 1251516 - RNA, 26 nt, Human
ccgccaggcgaugggggcagcugugu

SEQ ID NO: 1251517 - RNA, 22 nt, Human
ccugcccugguccgccaacucc

SEQ ID NO: 1251518 - RNA, 21 nt, Human
ccuucagaaaggcuuugcgga

SEQ ID NO: 1251519 - RNA, 22 nt, Human
cucaccccucuuuccaaccagg

SEQ ID NO: 1251520 - RNA, 20 nt, Human
cugcaucccugauggagcag

SEQ ID NO: 1251521 - RNA, 22 nt, Human
cuugccaggcccccugcagcca

SEQ ID NO: 1251522 - RNA, 20 nt, Human
gaacccggcaagugcaggua

SEQ ID NO: 1251523 - RNA, 22 nt, Human
gcucagggcaccuugccaggcc

SEQ ID NO: 1251524 - RNA, 18 nt, Human
ggagggaccuggaaggaa

SEQ ID NO: 1251525 - RNA, 20 nt, Human
gggcaggggggcgcacgggc

SEQ ID NO: 1251526 - RNA, 18 nt, Human
gggccccgaaggcuccag

SEQ ID NO: 1251527 - RNA, 22 nt, Human
ggggcagcuguguggccagccu

SEQ ID NO: 1251528 - RNA, 21 nt, Human
gugcugcccaggggagcucag

SEQ ID NO: 1251529 - RNA, 19 nt, Human
uaucaaucacggcgcgggg

SEQ ID NO: 1251530 - RNA, 21 nt, Human
ucaccccucuuuccaaccagg

SEQ ID NO: 1251531 - RNA, 19 nt, Human
ucuuggcagcagggaccug

SEQ ID NO: 1251532 - RNA, 26 nt, Human
ugcccugccugcccugguccgccaac

SEQ ID NO: 1251533 - RNA, 24 nt, Human
uggagcaggcccgagggagguucc

SEQ ID NO: 1251534 - RNA, 19 nt, Human
uggcagcagggaccugaac

SEQ ID NO: 1251535 - RNA, 19 nt, Human
uggcagggagcgccgggau

SEQ ID NO: 1251536 - RNA, 18 nt, Human
uucaggaagggugcugcc

SEQ ID NO: 1251537 - RNA, 19 nt, Human
aaaaccaaucaacuggcca

SEQ ID NO: 1251538 - RNA, 21 nt, Human
cuccgggccuccggagacggg

SEQ ID NO: 1251539 - RNA, 21 nt, Human
uagaaaaccaaucaacuggcc

SEQ ID NO: 1251540 - RNA, 23 nt, Human
uagaaaaccaaucaacuggccau

SEQ ID NO: 1251541 - RNA, 18 nt, Human
aacaagcaacacuccagg

SEQ ID NO: 1251542 - RNA, 20 nt, Human
aacacuccaggaagagccgg

SEQ ID NO: 1251543 - RNA, 18 nt, Human
aacauggugaaacccugu

SEQ ID NO: 1251544 - RNA, 19 nt, Human
aacauggugaaacccuguc

SEQ ID NO: 1251545 - RNA, 20 nt, Human
aacauggugaaacccugucc

SEQ ID NO: 1251546 - RNA, 20 nt, Human
aagaagucauuucuuuccgg

SEQ ID NO: 1251547 - RNA, 23 nt, Human
acagcucaugccuguaaucccag

SEQ ID NO: 1251548 - RNA, 23 nt, Human
accuucagguccuuucuccuccc

SEQ ID NO: 1251549 - RNA, 24 nt, Human
acugguuaacauggugaaacccug

SEQ ID NO: 1251550 - RNA, 19 nt, Human
acuguaagcucuucaccgc

SEQ ID NO: 1251551 - RNA, 23 nt, Human
acugugugccagauguuccaugc

SEQ ID NO: 1251552 - RNA, 21 nt, Human
agaccagacugguuaacaugg

SEQ ID NO: 1251553 - RNA, 24 nt, Human
agacugguuaacauggugaaaccc

SEQ ID NO: 1251554 - RNA, 19 nt, Human
agcacagucucucucagca

SEQ ID NO: 1251555 - RNA, 20 nt, Human
aggaagagccggccauggca

SEQ ID NO: 1251556 - RNA, 23 nt, Human
aggaauucaagaccagacugguu

SEQ ID NO: 1251557 - RNA, 24 nt, Human
aggaccaccauccuccaggaacuu

SEQ ID NO: 1251558 - RNA, 26 nt, Human
agguaggcagaucacuugaggucagg

SEQ ID NO: 1251559 - RNA, 18 nt, Human
agguggccaugaggggga

SEQ ID NO: 1251560 - RNA, 19 nt, Human
augccuguaaucccagcac

SEQ ID NO: 1251561 - RNA, 25 nt, Human
auucucuuccucugagcagucucaa

SEQ ID NO: 1251562 - RNA, 24 nt, Human
caagaccagacugguuaacauggu

SEQ ID NO: 1251563 - RNA, 24 nt, Human
caagguaggcagaucacuugaggu

SEQ ID NO: 1251564 - RNA, 26 nt, Human
caagguaggcagaucacuugagguca

SEQ ID NO: 1251565 - RNA, 25 nt, Human
caccagguccuuugucucccauucu

SEQ ID NO: 1251566 - RNA, 24 nt, Human
cacccgagacacaagcagacagcc

SEQ ID NO: 1251567 - RNA, 27 nt, Human
cagaucacuugaggucaggaauucaag

SEQ ID NO: 1251568 - RNA, 24 nt, Human
cagcacuuugggaggccaagguag

SEQ ID NO: 1251569 - RNA, 25 nt, Human
cagcacuuugggaggccaagguagg

SEQ ID NO: 1251570 - RNA, 24 nt, Human
cagcucaugccuguaaucccagca

SEQ ID NO: 1251571 - RNA, 18 nt, Human
caggaagagccggccaug

SEQ ID NO: 1251572 - RNA, 24 nt, Human
caugccuguaaucccagcacuuug

SEQ ID NO: 1251573 - RNA, 21 nt, Human
ccacauguuuagcuauccaga

SEQ ID NO: 1251574 - RNA, 19 nt, Human
ccacccgagacacaagcag

SEQ ID NO: 1251575 - RNA, 21 nt, Human
ccauggcaggcggggacugug

SEQ ID NO: 1251576 - RNA, 22 nt, Human
cccuggaagcacucuacugcuu

SEQ ID NO: 1251577 - RNA, 26 nt, Human
ccucugagcagucucauaauuaauuc

SEQ ID NO: 1251578 - RNA, 19 nt, Human
cgagacacaagcagacagc

SEQ ID NO: 1251579 - RNA, 24 nt, Human
cucaugccuguaaucccagcacuu

SEQ ID NO: 1251580 - RNA, 18 nt, Human
cucgcugggccuguucca

SEQ ID NO: 1251581 - RNA, 18 nt, Human
cucucgcugggccuguuc

SEQ ID NO: 1251582 - RNA, 21 nt, Human
cugguuaacauggugaaaccc

SEQ ID NO: 1251583 - RNA, 24 nt, Human
cugguuaacauggugaaacccugu

SEQ ID NO: 1251584 - RNA, 18 nt, Human
cuguauuuucucucagca

SEQ ID NO: 1251585 - RNA, 21 nt, Human
cuugcucacccgacuguaagc

SEQ ID NO: 1251586 - RNA, 21 nt, Human
cuuuaaauuuucugguaaccc

SEQ ID NO: 1251587 - RNA, 26 nt, Human
cuuuugguuuuuacggaagcuucauu

SEQ ID NO: 1251588 - RNA, 23 nt, Human
gacagcucaugccuguaauccca

SEQ ID NO: 1251589 - RNA, 24 nt, Human
gacagcucaugccuguaaucccag

SEQ ID NO: 1251590 - RNA, 18 nt, Human
gaccaccauccuccagga

SEQ ID NO: 1251591 - RNA, 18 nt, Human
gagccggccauggcaggc

SEQ ID NO: 1251592 - RNA, 18 nt, Human
gaucacuugaggucagga

SEQ ID NO: 1251593 - RNA, 24 nt, Human
gaucacuugaggucaggaauucaa

SEQ ID NO: 1251594 - RNA, 19 nt, Human
gcaggcggggacugugugg

SEQ ID NO: 1251595 - RNA, 20 nt, Human
gcgacagcucaugccuguaa

SEQ ID NO: 1251596 - RNA, 22 nt, Human
ggccuguuccacccgagacaca

SEQ ID NO: 1251597 - RNA, 21 nt, Human
gggggacagaauggggcggaa

SEQ ID NO: 1251598 - RNA, 21 nt, Human
guccaccacauucucuucuca

SEQ ID NO: 1251599 - RNA, 18 nt, Human
uaacauggugaaacccug

SEQ ID NO: 1251600 - RNA, 20 nt, Human
uaacauggugaaacccuguc

SEQ ID NO: 1251601 - RNA, 25 nt, Human
uaggaccaccauccuccaggaacuu

SEQ ID NO: 1251602 - RNA, 18 nt, Human
uaggcagaucacuugagg

SEQ ID NO: 1251603 - RNA, 24 nt, Human
uaggcagaucacuugaggucagga

SEQ ID NO: 1251604 - RNA, 21 nt, Human
uauccagaagcucaaucaaac

SEQ ID NO: 1251605 - RNA, 21 nt, Human
uaucuugcucacccgacugua

SEQ ID NO: 1251606 - RNA, 20 nt, Human
ucagguccuuucuccucccu

SEQ ID NO: 1251607 - RNA, 25 nt, Human
ucaucuaugauucacugauuauucc

SEQ ID NO: 1251608 - RNA, 22 nt, Human
ucaugccuguaaucccagcacu

SEQ ID NO: 1251609 - RNA, 24 nt, Human
uccagggcagggauuuuugucucc

SEQ ID NO: 1251610 - RNA, 24 nt, Human
uccaugcugagccaguaucaagga

SEQ ID NO: 1251611 - RNA, 25 nt, Human
ucccaagugccuagaacaagggcuc

SEQ ID NO: 1251612 - RNA, 23 nt, Human
ucccauucucuuccucugagcag

SEQ ID NO: 1251613 - RNA, 23 nt, Human
ucccuggaagcacucuacugcuu

SEQ ID NO: 1251614 - RNA, 18 nt, Human
uccucagugcauacugug

SEQ ID NO: 1251615 - RNA, 22 nt, Human
ucgcugggccuguuccacccga

SEQ ID NO: 1251616 - RNA, 23 nt, Human
ucucucagcaauagaaugggagu

SEQ ID NO: 1251617 - RNA, 18 nt, Human
ucucuguaaagcacaguc

SEQ ID NO: 1251618 - RNA, 27 nt, Human
ucugggcgccggcggaccggggcuccg

SEQ ID NO: 1251619 - RNA, 23 nt, Human
ugccuguaaucccagcacuuugg

SEQ ID NO: 1251620 - RNA, 23 nt, Human
ugccuguaaucccagcacuuugg

SEQ ID NO: 1251621 - RNA, 24 nt, Human
ugccuguaaucccagcacuuuggg

SEQ ID NO: 1251622 - RNA, 21 nt, Human
uggcaagccugguucugggcg

SEQ ID NO: 1251623 - RNA, 24 nt, Human
uggcugagugcgacagcucaugcc

SEQ ID NO: 1251624 - RNA, 24 nt, Human
ugggaggccaagguaggcagauca

SEQ ID NO: 1251625 - RNA, 20 nt, Human
ugggagugacuggcguaacu

SEQ ID NO: 1251626 - RNA, 19 nt, Human
ugggcuguuuacugccugu

SEQ ID NO: 1251627 - RNA, 18 nt, Human
uguggcaagccugguucu

SEQ ID NO: 1251628 - RNA, 22 nt, Human
uuccacccgagacacaagcaga

SEQ ID NO: 1251629 - RNA, 24 nt, Human
uuccucugagcagucucauaauua

SEQ ID NO: 1251630 - RNA, 23 nt, Human
uuggcugagugcgacagcucaug

SEQ ID NO: 1251631 - RNA, 24 nt, Human
agggcaggggugugaugaagugga

SEQ ID NO: 1251632 - RNA, 22 nt, Human
aguggacaccaagugcucugag

SEQ ID NO: 1251633 - RNA, 21 nt, Human
caagugcucugaggagcagug

SEQ ID NO: 1251634 - RNA, 20 nt, Human
caccaagugcucugaggagc

SEQ ID NO: 1251635 - RNA, 28 nt, Human
cccauagaaccugccuguagcccccgga

SEQ ID NO: 1251636 - RNA, 23 nt, Human
cccauagaaccugccuguagccu

SEQ ID NO: 1251637 - RNA, 19 nt, Human
cccccggauccugccggcc

SEQ ID NO: 1251638 - RNA, 22 nt, Human
cccccggauccugccggcccag

SEQ ID NO: 1251639 - RNA, 19 nt, Human
ccccggauccugccggccc

SEQ ID NO: 1251640 - RNA, 22 nt, Human
ccugccggcccagggcaggggu

SEQ ID NO: 1251641 - RNA, 22 nt, Human
cucugaggagcagugugaggga

SEQ ID NO: 1251642 - RNA, 21 nt, Human
uagaaccugccuguagccccc

SEQ ID NO: 1251643 - RNA, 18 nt, Human
uagcccccggauccugcc

SEQ ID NO: 1251644 - RNA, 23 nt, Human
uagcccccggauccugccggccc

SEQ ID NO: 1251645 - RNA, 20 nt, Human
ugccuguagcccccggaucc

SEQ ID NO: 1251646 - RNA, 24 nt, Human
ugcucugaggagcagugugaggga

SEQ ID NO: 1251647 - RNA, 22 nt, Human
aaaacaucuuugcccuccccuu

SEQ ID NO: 1251648 - RNA, 23 nt, Human
aaaacaucuuugcccuccccuug

SEQ ID NO: 1251649 - RNA, 19 nt, Human
aaaauaaucccguccuuca

SEQ ID NO: 1251650 - RNA, 20 nt, Human
agagguuuucuagcuggugc

SEQ ID NO: 1251651 - RNA, 21 nt, Human
agcugcggagcucugccuccu

SEQ ID NO: 1251652 - RNA, 21 nt, Human
agcuggugccaguucuacacg

SEQ ID NO: 1251653 - RNA, 22 nt, Human
aggggcccuuguugaacgcgug

SEQ ID NO: 1251654 - RNA, 21 nt, Human
caagagccuguaggaggggcc

SEQ ID NO: 1251655 - RNA, 24 nt, Human
caccgggcuguggcggaagggauc

SEQ ID NO: 1251656 - RNA, 22 nt, Human
cagcugcggagcucugccuccu

SEQ ID NO: 1251657 - RNA, 27 nt, Human
caggacuaguaaaacaucuuugcccuc

SEQ ID NO: 1251658 - RNA, 19 nt, Human
ccuugaggauguuggagag

SEQ ID NO: 1251659 - RNA, 20 nt, Human
cggaagggaucaaggccgua

SEQ ID NO: 1251660 - RNA, 23 nt, Human
cggagcucugccuccuucuggga

SEQ ID NO: 1251661 - RNA, 20 nt, Human
cggauggagaggccagugaa

SEQ ID NO: 1251662 - RNA, 19 nt, Human
cggggcggauggagaggcc

SEQ ID NO: 1251663 - RNA, 20 nt, Human
cucaggacugagccaccggg

SEQ ID NO: 1251664 - RNA, 18 nt, Human
cuuggggacugagcccgg

SEQ ID NO: 1251665 - RNA, 20 nt, Human
gagcuuacggcgagagccaa

SEQ ID NO: 1251666 - RNA, 21 nt, Human
gcggauggagaggccagugaa

SEQ ID NO: 1251667 - RNA, 20 nt, Human
gcuggcauguccaggcugug

SEQ ID NO: 1251668 - RNA, 20 nt, Human
gggcggauggagaggccagu

SEQ ID NO: 1251669 - RNA, 23 nt, Human
guaaaacaucuuugcccuccccu

SEQ ID NO: 1251670 - RNA, 18 nt, Human
uaaaacaucuuugcccuc

SEQ ID NO: 1251671 - RNA, 23 nt, Human
uaaaauaaucccguccuucaggc

SEQ ID NO: 1251672 - RNA, 19 nt, Human
uauccugaugcguguaggg

SEQ ID NO: 1251673 - RNA, 24 nt, Human
ugaacagaagccuguucuggacgu

SEQ ID NO: 1251674 - RNA, 23 nt, Human
ugagacaccaacaggacuaguaa

SEQ ID NO: 1251675 - RNA, 19 nt, Human
ugagccaccgggcuguggc

SEQ ID NO: 1251676 - RNA, 22 nt, Human
ugaggauguuggagagguuuuc

SEQ ID NO: 1251677 - RNA, 20 nt, Human
uggcggaagggaucaaggcc

SEQ ID NO: 1251678 - RNA, 18 nt, Human
gcggugcugcuucucugg

SEQ ID NO: 1251679 - RNA, 18 nt, Human
aacgcucacaaugagggc

SEQ ID NO: 1251680 - RNA, 22 nt, Human
acagaaaacauaucuggagcag

SEQ ID NO: 1251681 - RNA, 21 nt, Human
agccccuagcaggaacaacuu

SEQ ID NO: 1251682 - RNA, 20 nt, Human
cacacuaaaacguuuacucc

SEQ ID NO: 1251683 - RNA, 25 nt, Human
caccaggaaauaaauacugaaccac

SEQ ID NO: 1251684 - RNA, 20 nt, Human
cacucugccaguccauucuu

SEQ ID NO: 1251685 - RNA, 20 nt, Human
cacucugccaguccauucuu

SEQ ID NO: 1251686 - RNA, 19 nt, Human
cagggacugcuuguaagca

SEQ ID NO: 1251687 - RNA, 19 nt, Human
ccagccccuagcaggaaca

SEQ ID NO: 1251688 - RNA, 22 nt, Human
ccagccuccaacaacgcucaca

SEQ ID NO: 1251689 - RNA, 23 nt, Human
ccagccuccaacaacgcucacaa

SEQ ID NO: 1251690 - RNA, 21 nt, Human
ccaguccauucuuuccagccc

SEQ ID NO: 1251691 - RNA, 21 nt, Human
ccauucuuuccagccccuagc

SEQ ID NO: 1251692 - RNA, 21 nt, Human
cccaggccugugugccccgac

SEQ ID NO: 1251693 - RNA, 23 nt, Human
ccccgacaggcuaaaccuccgcc

SEQ ID NO: 1251694 - RNA, 27 nt, Human
ccgcccaggggcuucccgaugucggcu

SEQ ID NO: 1251695 - RNA, 18 nt, Human
gcaauuccuuugagaagc

SEQ ID NO: 1251696 - RNA, 20 nt, Human
gcacagaaaacauaucugga

SEQ ID NO: 1251697 - RNA, 20 nt, Human
ggaaaggccucucccaggga

SEQ ID NO: 1251698 - RNA, 20 nt, Human
ggccugcgcuccagucuuac

SEQ ID NO: 1251699 - RNA, 18 nt, Human
ggcucagcuggaaggccc

SEQ ID NO: 1251700 - RNA, 21 nt, Human
ggggacgcagccagaaaugga

SEQ ID NO: 1251701 - RNA, 18 nt, Human
uaucuggagcagucucca

SEQ ID NO: 1251702 - RNA, 21 nt, Human
uaucuggagcagucuccagga

SEQ ID NO: 1251703 - RNA, 19 nt, Human
uccacuuugggcagaagga

SEQ ID NO: 1251704 - RNA, 19 nt, Human
ugacagagccacuggacac

SEQ ID NO: 1251705 - RNA, 21 nt, Human
ugagaagccuggaggaagggc

SEQ ID NO: 1251706 - RNA, 22 nt, Human
ugagaagccuggaggaagggcu

SEQ ID NO: 1251707 - RNA, 23 nt, Human
ugccccgacaggcuaaaccuccg

SEQ ID NO: 1251708 - RNA, 23 nt, Human
uggguuuucggccugcagagcuc

SEQ ID NO: 1251709 - RNA, 21 nt, Human
uguaagcacagaaaacauauc

SEQ ID NO: 1251710 - RNA, 20 nt, Human
uucaagaccccugugacccu

SEQ ID NO: 1251711 - RNA, 19 nt, Human
uuccugcugauuuacaacu

SEQ ID NO: 1251712 - RNA, 19 nt, Human
uucggccugcagagcucgc

SEQ ID NO: 1251713 - RNA, 24 nt, Human
uugcccacucuuuuuaucaccaug

SEQ ID NO: 1251714 - RNA, 26 nt, Human
aaaaaaaaaaaaaaagccauuuagag

SEQ ID NO: 1251715 - RNA, 22 nt, Human
aaaaaaaaaaagccauuuagag

SEQ ID NO: 1251716 - RNA, 21 nt, Human
aaaaaagccauccaaucauag

SEQ ID NO: 1251717 - RNA, 23 nt, Human
aaaaacacaaaaggcagggugca

SEQ ID NO: 1251718 - RNA, 22 nt, Human
aaaaagccauccaaucauagug

SEQ ID NO: 1251719 - RNA, 18 nt, Human
aaaacagcaucguaccuu

SEQ ID NO: 1251720 - RNA, 21 nt, Human
aaacaaauagaaaaaaagcca

SEQ ID NO: 1251721 - RNA, 19 nt, Human
aaacaaauguggacaaagg

SEQ ID NO: 1251722 - RNA, 24 nt, Human
aaacacaauuauggugaaccacac

SEQ ID NO: 1251723 - RNA, 26 nt, Human
aaaccccagaaugucuuacccaaaau

SEQ ID NO: 1251724 - RNA, 22 nt, Human
aaacgggcagaaggaaacuuca

SEQ ID NO: 1251725 - RNA, 18 nt, Human
aaacuuucccuuguaacu

SEQ ID NO: 1251726 - RNA, 22 nt, Human
aagagaaaugaaaauauuucca

SEQ ID NO: 1251727 - RNA, 25 nt, Human
aagcaauccuccugccuuagccucc

SEQ ID NO: 1251728 - RNA, 22 nt, Human
aagucccacuauguugcccagg

SEQ ID NO: 1251729 - RNA, 18 nt, Human
aauuuuguuuuguuuugu

SEQ ID NO: 1251730 - RNA, 19 nt, Human
acuauguugcccagguugg

SEQ ID NO: 1251731 - RNA, 24 nt, Human
acuuacucuuaauacccauucaac

SEQ ID NO: 1251732 - RNA, 21 nt, Human
agaaaaucaguuauuuccaac

SEQ ID NO: 1251733 - RNA, 23 nt, Human
agaauccuuucucaugaaucucu

SEQ ID NO: 1251734 - RNA, 18 nt, Human
agagaugcuguucugcag

SEQ ID NO: 1251735 - RNA, 20 nt, Human
agccaaggauuauuaaacaa

SEQ ID NO: 1251736 - RNA, 21 nt, Human
agccuccugaguagcuggaac

SEQ ID NO: 1251737 - RNA, 19 nt, Human
aggcacgugccaccacacc

SEQ ID NO: 1251738 - RNA, 21 nt, Human
aggcugauuuauuuccuugau

SEQ ID NO: 1251739 - RNA, 21 nt, Human
agguggaggguggcggagggg

SEQ ID NO: 1251740 - RNA, 22 nt, Human
aguguuaaaacaccaaaaagaa

SEQ ID NO: 1251741 - RNA, 21 nt, Human
auguugcccagguuggagugc

SEQ ID NO: 1251742 - RNA, 23 nt, Human
caaaaacacaaaaggcagggugc

SEQ ID NO: 1251743 - RNA, 20 nt, Human
caaaacugacaaugcagcua

SEQ ID NO: 1251744 - RNA, 19 nt, Human
caaacacaauuauggugaa

SEQ ID NO: 1251745 - RNA, 27 nt, Human
caaacacaauuauggugaaccacacag

SEQ ID NO: 1251746 - RNA, 19 nt, Human
caaaggcacaauccaaaag

SEQ ID NO: 1251747 - RNA, 24 nt, Human
caaauuaauaacugcucacauuca

SEQ ID NO: 1251748 - RNA, 19 nt, Human
caacauaauacuacuuugu

SEQ ID NO: 1251749 - RNA, 25 nt, Human
caagaaaccccagaaugucuuaccc

SEQ ID NO: 1251750 - RNA, 22 nt, Human
caagcaauccuccugccuuagc

SEQ ID NO: 1251751 - RNA, 27 nt, Human
caagcaauccuccugccuuagccuccu

SEQ ID NO: 1251752 - RNA, 23 nt, Human
caccuggcuauguuuuuaaaaac

SEQ ID NO: 1251753 - RNA, 24 nt, Human
cagccugggcucaagcaauccucc

SEQ ID NO: 1251754 - RNA, 18 nt, Human
cagugucuuuuuuuuuuu

SEQ ID NO: 1251755 - RNA, 19 nt, Human
cauccaaucauagugcuua

SEQ ID NO: 1251756 - RNA, 21 nt, Human
ccaauuacaaugucaauguug

SEQ ID NO: 1251757 - RNA, 22 nt, Human
ccacuauguugcccagguugga

SEQ ID NO: 1251758 - RNA, 21 nt, Human
ccccauaccccaaaacugaca

SEQ ID NO: 1251759 - RNA, 21 nt, Human
ccccccauaccccaaaacuga

SEQ ID NO: 1251760 - RNA, 24 nt, Human
ccccccauaccccaaaacugacaa

SEQ ID NO: 1251761 - RNA, 23 nt, Human
ccugccuuagccuccugaguagc

SEQ ID NO: 1251762 - RNA, 20 nt, Human
ccugggcucaagcaauccuc

SEQ ID NO: 1251763 - RNA, 22 nt, Human
cgagagcgguucggagguggag

SEQ ID NO: 1251764 - RNA, 18 nt, Human
cggcccggccgggagccg

SEQ ID NO: 1251765 - RNA, 24 nt, Human
cucaagcaauccuccugccuuagc

SEQ ID NO: 1251766 - RNA, 23 nt, Human
cugccuuagccuccugaguagcu

SEQ ID NO: 1251767 - RNA, 25 nt, Human
cuuuaaaaaaaaaaaaaaagccauu

SEQ ID NO: 1251768 - RNA, 21 nt, Human
cuuucauuuuaagggucuuau

SEQ ID NO: 1251769 - RNA, 20 nt, Human
cuuuucucaacucaugacaa

SEQ ID NO: 1251770 - RNA, 24 nt, Human
gacaagauucaagaaaccccagaa

SEQ ID NO: 1251771 - RNA, 22 nt, Human
gaucuauggaaucuguuuccuu

SEQ ID NO: 1251772 - RNA, 19 nt, Human
gcagaaggaaacuucaccc

SEQ ID NO: 1251773 - RNA, 21 nt, Human
gcagaaggaaacuucacccaa

SEQ ID NO: 1251774 - RNA, 18 nt, Human
gccgcggcccggccggga

SEQ ID NO: 1251775 - RNA, 18 nt, Human
ggagaaacauugacuuag

SEQ ID NO: 1251776 - RNA, 22 nt, Human
gggcucaagcaauccuccugcc

SEQ ID NO: 1251777 - RNA, 21 nt, Human
ggucggcggccgcggcccggc

SEQ ID NO: 1251778 - RNA, 19 nt, Human
gguugacauuuauuagauc

SEQ ID NO: 1251779 - RNA, 20 nt, Human
uaaaaaaaaaaaaaaagcca

SEQ ID NO: 1251780 - RNA, 22 nt, Human
uaaaauauaauucugggaagaa

SEQ ID NO: 1251781 - RNA, 23 nt, Human
uaaaaugucaccaaauuaguuua

SEQ ID NO: 1251782 - RNA, 21 nt, Human
uaacucaauccaaauuaauaa

SEQ ID NO: 1251783 - RNA, 24 nt, Human
uaacugcucacauucacaagcaaa

SEQ ID NO: 1251784 - RNA, 23 nt, Human
uaaguuuuaaacaaauguggaca

SEQ ID NO: 1251785 - RNA, 18 nt, Human
uaauaaacaacaaacugc

SEQ ID NO: 1251786 - RNA, 19 nt, Human
uacaaugucaauguugguu

SEQ ID NO: 1251787 - RNA, 21 nt, Human
uagaaaaaaagccauccaauc

SEQ ID NO: 1251788 - RNA, 24 nt, Human
uagcaauguaauuuugcauuuugg

SEQ ID NO: 1251789 - RNA, 22 nt, Human
uagccaaggauuauuaaacaaa

SEQ ID NO: 1251790 - RNA, 19 nt, Human
uagccuccugaguagcugg

SEQ ID NO: 1251791 - RNA, 23 nt, Human
uagugcuuaaguguaauuuuguu

SEQ ID NO: 1251792 - RNA, 19 nt, Human
uaguuuaaaacauuacuca

SEQ ID NO: 1251793 - RNA, 21 nt, Human
uauaauuaagcauucacauac

SEQ ID NO: 1251794 - RNA, 18 nt, Human
uauguugcccagguugga

SEQ ID NO: 1251795 - RNA, 24 nt, Human
uauguugcccagguuggagugcag

SEQ ID NO: 1251796 - RNA, 23 nt, Human
uauuaaacaaauagaaaaaaagc

SEQ ID NO: 1251797 - RNA, 19 nt, Human
ucaacucaugacaaaggca

SEQ ID NO: 1251798 - RNA, 30 nt, Human
ucaagaaaccccagaaugucuuacccaaaa

SEQ ID NO: 1251799 - RNA, 21 nt, Human
ucaaggaguuuacaaaaacac

SEQ ID NO: 1251800 - RNA, 19 nt, Human
ucaugugaaaauaaaugcu

SEQ ID NO: 1251801 - RNA, 24 nt, Human
ucauuaagguauuaagcuucagug

SEQ ID NO: 1251802 - RNA, 19 nt, Human
ucccacuauguugcccagg

SEQ ID NO: 1251803 - RNA, 24 nt, Human
ucccacuauguugcccagguugga

SEQ ID NO: 1251804 - RNA, 26 nt, Human
ucccacuauguugcccagguuggagu

SEQ ID NO: 1251805 - RNA, 26 nt, Human
uccuccugccuuagccuccugaguag

SEQ ID NO: 1251806 - RNA, 20 nt, Human
uccuuucucaugaaucucug

SEQ ID NO: 1251807 - RNA, 18 nt, Human
ucuggagaaacauugacu

SEQ ID NO: 1251808 - RNA, 20 nt, Human
ucuggagaaacauugacuua

SEQ ID NO: 1251809 - RNA, 20 nt, Human
ucuuuaaaaaaaaaaaaaaa

SEQ ID NO: 1251810 - RNA, 26 nt, Human
ucuuuuggcagacaaaaucaugcuuc

SEQ ID NO: 1251811 - RNA, 23 nt, Human
ugaaaauaaaugcuuuuucuucc

SEQ ID NO: 1251812 - RNA, 19 nt, Human
ugcacauuacacucacauu

SEQ ID NO: 1251813 - RNA, 18 nt, Human
ugcccagguuggagugca

SEQ ID NO: 1251814 - RNA, 19 nt, Human
ugcccagguuggagugcag

SEQ ID NO: 1251815 - RNA, 24 nt, Human
ugccuuagccuccugaguagcugg

SEQ ID NO: 1251816 - RNA, 24 nt, Human
uggaacuaaaggcacgugccacca

SEQ ID NO: 1251817 - RNA, 23 nt, Human
uggacaagauucaagaaacccca

SEQ ID NO: 1251818 - RNA, 24 nt, Human
uggagugcaguagcuagucacaaa

SEQ ID NO: 1251819 - RNA, 19 nt, Human
ugggaagaaaccaagaaau

SEQ ID NO: 1251820 - RNA, 21 nt, Human
ugggaagaaaccaagaaauua

SEQ ID NO: 1251821 - RNA, 24 nt, Human
ugggcucaagcaauccuccugccu

SEQ ID NO: 1251822 - RNA, 22 nt, Human
uguaacuuuucuuauagcaaug

SEQ ID NO: 1251823 - RNA, 19 nt, Human
uguaguacauuuuuaucca

SEQ ID NO: 1251824 - RNA, 23 nt, Human
uguuuuguuuuguuuuagagaug

SEQ ID NO: 1251825 - RNA, 23 nt, Human
uuaaacaaauguggacaaaggac

SEQ ID NO: 1251826 - RNA, 22 nt, Human
uuaaaucauuugugucuucaaa

SEQ ID NO: 1251827 - RNA, 23 nt, Human
uuaacauuacaauaaguuuuaaa

SEQ ID NO: 1251828 - RNA, 19 nt, Human
uuacuuuuccauuucaguu

SEQ ID NO: 1251829 - RNA, 22 nt, Human
uuaguccuaaagcagcauguua

SEQ ID NO: 1251830 - RNA, 24 nt, Human
uuauuagaucuggauuucucaaag

SEQ ID NO: 1251831 - RNA, 23 nt, Human
uucaaaaagacugauauaaugaa

SEQ ID NO: 1251832 - RNA, 19 nt, Human
uucaacacugucucauuuu

SEQ ID NO: 1251833 - RNA, 20 nt, Human
uucacaagcaaaaaauacua

SEQ ID NO: 1251834 - RNA, 21 nt, Human
uuccuugaugggaauuuuugg

SEQ ID NO: 1251835 - RNA, 24 nt, Human
uugaauauauuuucauuccagaaa

SEQ ID NO: 1251836 - RNA, 24 nt, Human
uugcccagguuggagugcaguagc

SEQ ID NO: 1251837 - RNA, 23 nt, Human
uuguaacuuuucuuauagcaaug

SEQ ID NO: 1251838 - RNA, 23 nt, Human
uuuaaaaaaaaaaaaaaagccau

SEQ ID NO: 1251839 - RNA, 19 nt, Human
aagaauugccucacuggug

SEQ ID NO: 1251840 - RNA, 21 nt, Human
cggcagagcugagaggagagg

SEQ ID NO: 1251841 - RNA, 22 nt, Human
cugguggugauuauggccuugc

SEQ ID NO: 1251842 - RNA, 18 nt, Human
gaaggacggcagagcuga

SEQ ID NO: 1251843 - RNA, 20 nt, Human
ggccaggaauucuuagguac

SEQ ID NO: 1251844 - RNA, 22 nt, Human
ugagaggagaggaaagaaaggc

SEQ ID NO: 1251845 - RNA, 23 nt, Human
ugauugcucuagggguucugaaa

SEQ ID NO: 1251846 - RNA, 21 nt, Human
ugcggaaggacggcagagcug

SEQ ID NO: 1251847 - RNA, 18 nt, Human
uugccucacuggugguga

SEQ ID NO: 1251848 - RNA, 21 nt, Human
aacaggucggccaaggccagg

SEQ ID NO: 1251849 - RNA, 20 nt, Human
aggcagccaagaugggcaau

SEQ ID NO: 1251850 - RNA, 18 nt, Human
caggucggccaaggccag

SEQ ID NO: 1251851 - RNA, 20 nt, Human
ucggugacaguggcugacuc

SEQ ID NO: 1251852 - RNA, 19 nt, Human
aguucucaaguucuugcuc

SEQ ID NO: 1251853 - RNA, 19 nt, Human
auagagcagaaccaaaccc

SEQ ID NO: 1251854 - RNA, 20 nt, Human
uagagcagaaccaaacccug

SEQ ID NO: 1251855 - RNA, 22 nt, Human
uagagcagaaccaaacccuggc

SEQ ID NO: 1251856 - RNA, 20 nt, Human
uccacagugcccugcugccu

SEQ ID NO: 1251857 - RNA, 24 nt, Human
uggaagagauagagcagaaccaaa

SEQ ID NO: 1251858 - RNA, 20 nt, Human
uuuccacagugcccugcugc

SEQ ID NO: 1251859 - RNA, 21 nt, Human
ggggcugugggugucgggagc

SEQ ID NO: 1251860 - RNA, 20 nt, Human
ugaaggggcugcuccgaaug

SEQ ID NO: 1251861 - RNA, 24 nt, Human
uuaggagaaaguaggggcuguggg

SEQ ID NO: 1251862 - RNA, 25 nt, Human
cagcaacauccacaucagcagcaac

SEQ ID NO: 1251863 - RNA, 20 nt, Human
ccugcuccuucucccccucc

SEQ ID NO: 1251864 - RNA, 19 nt, Human
ccuggguuacaucagcaac

SEQ ID NO: 1251865 - RNA, 20 nt, Human
ccuucucccccuccucauua

SEQ ID NO: 1251866 - RNA, 20 nt, Human
gcagcaacauacugucccug

SEQ ID NO: 1251867 - RNA, 25 nt, Human
uacaucagcaacauccacaucagca

SEQ ID NO: 1251868 - RNA, 19 nt, Human
ucugaaggaccuggccagc

SEQ ID NO: 1251869 - RNA, 25 nt, Human
ugcuccuucucccccuccucauuaa

SEQ ID NO: 1251870 - RNA, 19 nt, Human
cccgcagacacagcagagc

SEQ ID NO: 1251871 - RNA, 19 nt, Human
cccgcagacacagcagagc

SEQ ID NO: 1251872 - RNA, 19 nt, Human
cgcagacacagcagagcca

SEQ ID NO: 1251873 - RNA, 23 nt, Human
ggcuuugagugugcuccaagcac

SEQ ID NO: 1251874 - RNA, 24 nt, Human
aacagcugccaggcacccucuacg

SEQ ID NO: 1251875 - RNA, 26 nt, Human
aagaacccacaggguaggccuuggcc

SEQ ID NO: 1251876 - RNA, 21 nt, Human
aaucaccaauggcaaaaugac

SEQ ID NO: 1251877 - RNA, 22 nt, Human
acagccagcagcggccccgggc

SEQ ID NO: 1251878 - RNA, 22 nt, Human
acagccagcagcggccccgggc

SEQ ID NO: 1251879 - RNA, 22 nt, Human
accccgcaaaccuguggcugcc

SEQ ID NO: 1251880 - RNA, 22 nt, Human
acccugcaaaccuguggcugcc

SEQ ID NO: 1251881 - RNA, 22 nt, Human
acgccgucaccuuggccagccc

SEQ ID NO: 1251882 - RNA, 28 nt, Human
agaccagggccauggcuagacuagaaga

SEQ ID NO: 1251883 - RNA, 19 nt, Human
agacggccaagggccuccu

SEQ ID NO: 1251884 - RNA, 19 nt, Human
agagcucagcuggaacugc

SEQ ID NO: 1251885 - RNA, 21 nt, Human
agcagacuucacuggggccug

SEQ ID NO: 1251886 - RNA, 20 nt, Human
agcagguacugcgcuugggg

SEQ ID NO: 1251887 - RNA, 18 nt, Human
aggagggcaaggacccug

SEQ ID NO: 1251888 - RNA, 21 nt, Human
aggcagccaugccagcguuuc

SEQ ID NO: 1251889 - RNA, 20 nt, Human
aggcagcucccagccagagg

SEQ ID NO: 1251890 - RNA, 20 nt, Human
agggccauggcuagacuaga

SEQ ID NO: 1251891 - RNA, 18 nt, Human
aggggugggauggaggca

SEQ ID NO: 1251892 - RNA, 21 nt, Human
aggguucuccacgcucuccac

SEQ ID NO: 1251893 - RNA, 23 nt, Human
aggucccccagccgggucagcuc

SEQ ID NO: 1251894 - RNA, 21 nt, Human
agucucuggagauggcagccc

SEQ ID NO: 1251895 - RNA, 18 nt, Human
aucucaaucacuacagca

SEQ ID NO: 1251896 - RNA, 20 nt, Human
aucuggacagcugaucuggg

SEQ ID NO: 1251897 - RNA, 20 nt, Human
caacagugcccccguguggc

SEQ ID NO: 1251898 - RNA, 22 nt, Human
cacacccucgucaaagccaucu

SEQ ID NO: 1251899 - RNA, 19 nt, Human
caccccaaggcagcagagu

SEQ ID NO: 1251900 - RNA, 25 nt, Human
caccccgcaaaccuguggcugccca

SEQ ID NO: 1251901 - RNA, 19 nt, Human
cacccucuacgaucccacu

SEQ ID NO: 1251902 - RNA, 20 nt, Human
cacccuugcccugggaaccu

SEQ ID NO: 1251903 - RNA, 23 nt, Human
cacccuugcccugggaaccugca

SEQ ID NO: 1251904 - RNA, 18 nt, Human
caccugagcauccacagc

SEQ ID NO: 1251905 - RNA, 22 nt, Human
caccuuggccagcaccgggccc

SEQ ID NO: 1251906 - RNA, 23 nt, Human
cacgccgucaccuuggccagccc

SEQ ID NO: 1251907 - RNA, 21 nt, Human
cagacaggcucggacacagcg

SEQ ID NO: 1251908 - RNA, 18 nt, Human
cagauccacgcugugcuc

SEQ ID NO: 1251909 - RNA, 23 nt, Human
cagccccgggcccaggacugucc

SEQ ID NO: 1251910 - RNA, 18 nt, Human
cagggccauggcuagacu

SEQ ID NO: 1251911 - RNA, 26 nt, Human
cagguacugcgcuuggggcucugccc

SEQ ID NO: 1251912 - RNA, 19 nt, Human
caguggcugucggcuccug

SEQ ID NO: 1251913 - RNA, 23 nt, Human
cauccauuguccuggccugcauu

SEQ ID NO: 1251914 - RNA, 22 nt, Human
caugccccccaaggccucacug

SEQ ID NO: 1251915 - RNA, 24 nt, Human
cauuauggggcucccagaccaggg

SEQ ID NO: 1251916 - RNA, 25 nt, Human
cauuccacucccucuggggcuccuc

SEQ ID NO: 1251917 - RNA, 21 nt, Human
ccacaccaucaccuuggggug

SEQ ID NO: 1251918 - RNA, 21 nt, Human
ccacacggcaccugcuggcca

SEQ ID NO: 1251919 - RNA, 22 nt, Human
ccacagccagcagcggccccgg

SEQ ID NO: 1251920 - RNA, 22 nt, Human
ccacagccagcagcggccccgg

SEQ ID NO: 1251921 - RNA, 24 nt, Human
ccagcaccgggcccaggacugucc

SEQ ID NO: 1251922 - RNA, 23 nt, Human
ccagccacccuguccgaagggga

SEQ ID NO: 1251923 - RNA, 24 nt, Human
ccagccgcgagcccaggacugucc

SEQ ID NO: 1251924 - RNA, 21 nt, Human
cccacgcacggucagcgcccg

SEQ ID NO: 1251925 - RNA, 23 nt, Human
cccagccgggucagcuccuccug

SEQ ID NO: 1251926 - RNA, 25 nt, Human
ccccaacagcugccaggcacccucu

SEQ ID NO: 1251927 - RNA, 23 nt, Human
ccccaggggcugccaggggcugu

SEQ ID NO: 1251928 - RNA, 25 nt, Human
ccccaggggcugccaggggcugucu

SEQ ID NO: 1251929 - RNA, 18 nt, Human
ccccauuccacucccucu

SEQ ID NO: 1251930 - RNA, 19 nt, Human
cccccaacagcugccaggc

SEQ ID NO: 1251931 - RNA, 22 nt, Human
cccccaggccggcugucccuac

SEQ ID NO: 1251932 - RNA, 20 nt, Human
cccccggggaacgccugucc

SEQ ID NO: 1251933 - RNA, 21 nt, Human
ccccgggcccaggacuguccc

SEQ ID NO: 1251934 - RNA, 24 nt, Human
ccccgugcaugccccccaaggccu

SEQ ID NO: 1251935 - RNA, 21 nt, Human
ccccguguggccgcgaggagc

SEQ ID NO: 1251936 - RNA, 21 nt, Human
cccgggcccaggacugucccc

SEQ ID NO: 1251937 - RNA, 21 nt, Human
cccugagcuccaacagugccc

SEQ ID NO: 1251938 - RNA, 22 nt, Human
cccugagcuccaacagugcccc

SEQ ID NO: 1251939 - RNA, 23 nt, Human
cccugcaaaccuguggcugccag

SEQ ID NO: 1251940 - RNA, 19 nt, Human
cccuggucagcaugcgugg

SEQ ID NO: 1251941 - RNA, 21 nt, Human
ccgcgaggagcgcugcagggg

SEQ ID NO: 1251942 - RNA, 23 nt, Human
ccggucuucccugcuggcugugg

SEQ ID NO: 1251943 - RNA, 19 nt, Human
ccucagaugaagucaggug

SEQ ID NO: 1251944 - RNA, 21 nt, Human
ccuccagacggccaagggccu

SEQ ID NO: 1251945 - RNA, 20 nt, Human
ccuccgcagacaggcucgga

SEQ ID NO: 1251946 - RNA, 22 nt, Human
ccugcaggagcucguucuccuc

SEQ ID NO: 1251947 - RNA, 24 nt, Human
cgccgucaccuuggccagccccgg

SEQ ID NO: 1251948 - RNA, 19 nt, Human
cggaaaggaccaccagcca

SEQ ID NO: 1251949 - RNA, 24 nt, Human
cggaaaggaccaccagccacccug

SEQ ID NO: 1251950 - RNA, 25 nt, Human
cggagucugggccuccuggggccuc

SEQ ID NO: 1251951 - RNA, 21 nt, Human
cgggcagagcagacuucacug

SEQ ID NO: 1251952 - RNA, 23 nt, Human
cucgcucggcgcuggccugggcc

SEQ ID NO: 1251953 - RNA, 22 nt, Human
cucgggccacaguggcugucgg

SEQ ID NO: 1251954 - RNA, 22 nt, Human
cugagcuccaacagugcccccg

SEQ ID NO: 1251955 - RNA, 21 nt, Human
cugcaggagcucguucuccuc

SEQ ID NO: 1251956 - RNA, 22 nt, Human
cugcaggagcucguucuccucu

SEQ ID NO: 1251957 - RNA, 20 nt, Human
cugcucccugcucacucugg

SEQ ID NO: 1251958 - RNA, 20 nt, Human
cugcugcccaucuggacagc

SEQ ID NO: 1251959 - RNA, 19 nt, Human
cuggcacccgccugcuccc

SEQ ID NO: 1251960 - RNA, 18 nt, Human
cuggcccagccccgugca

SEQ ID NO: 1251961 - RNA, 21 nt, Human
cuggcccagccccgugcaugc

SEQ ID NO: 1251962 - RNA, 23 nt, Human
cugucuuuccuguuuaucccugu

SEQ ID NO: 1251963 - RNA, 21 nt, Human
cuuuccagggcgcgagggcug

SEQ ID NO: 1251964 - RNA, 21 nt, Human
gagccucgguggucuccagcc

SEQ ID NO: 1251965 - RNA, 22 nt, Human
gagcucguucuccucuugcacc

SEQ ID NO: 1251966 - RNA, 21 nt, Human
gaggagcgcugcagggggcug

SEQ ID NO: 1251967 - RNA, 23 nt, Human
gaggagcgcugcagggggcugcc

SEQ ID NO: 1251968 - RNA, 19 nt, Human
gagggcuggcccagccccg

SEQ ID NO: 1251969 - RNA, 22 nt, Human
gaguccccccaggaugccuuuc

SEQ ID NO: 1251970 - RNA, 21 nt, Human
gaguuuccugaacguccacag

SEQ ID NO: 1251971 - RNA, 18 nt, Human
gcaaugggagggaagcag

SEQ ID NO: 1251972 - RNA, 26 nt, Human
gcacgggggugggcgaggccugccgg

SEQ ID NO: 1251973 - RNA, 19 nt, Human
gcagcggccccgggcucuc

SEQ ID NO: 1251974 - RNA, 19 nt, Human
gcagcggccccgggcucuc

SEQ ID NO: 1251975 - RNA, 18 nt, Human
gcaggguucuccacgcuc

SEQ ID NO: 1251976 - RNA, 22 nt, Human
gccagccgcgagcccaggacug

SEQ ID NO: 1251977 - RNA, 19 nt, Human
gcccggucuucccugcugg

SEQ ID NO: 1251978 - RNA, 19 nt, Human
gccuuuccagggcgcgagg

SEQ ID NO: 1251979 - RNA, 22 nt, Human
gcgcuuggggcucugcccuguc

SEQ ID NO: 1251980 - RNA, 23 nt, Human
gcucagcuggaacugccucaggu

SEQ ID NO: 1251981 - RNA, 19 nt, Human
gcucggagucugggccucc

SEQ ID NO: 1251982 - RNA, 23 nt, Human
gcucggagucugggccuccuggg

SEQ ID NO: 1251983 - RNA, 24 nt, Human
gcucggagucugggccuccugggg

SEQ ID NO: 1251984 - RNA, 20 nt, Human
gcuggcaggagucccugccu

SEQ ID NO: 1251985 - RNA, 21 nt, Human
gcuucgguucugcugcccauc

SEQ ID NO: 1251986 - RNA, 21 nt, Human
ggaagcagggccaugccugcc

SEQ ID NO: 1251987 - RNA, 18 nt, Human
ggaccuggagcccaggcg

SEQ ID NO: 1251988 - RNA, 24 nt, Human
ggagcgcugcagggggcugccagg

SEQ ID NO: 1251989 - RNA, 23 nt, Human
ggaggcagcucccagccagaggg

SEQ ID NO: 1251990 - RNA, 21 nt, Human
ggcagccuccagacggccaac

SEQ ID NO: 1251991 - RNA, 23 nt, Human
ggccggagccuggcugggccccc

SEQ ID NO: 1251992 - RNA, 20 nt, Human
ggcgucuggcacccgccugc

SEQ ID NO: 1251993 - RNA, 18 nt, Human
ggcucugcccugucuugg

SEQ ID NO: 1251994 - RNA, 21 nt, Human
ggcugucggcuccuguacccc

SEQ ID NO: 1251995 - RNA, 21 nt, Human
gggccaugccugccaccccca

SEQ ID NO: 1251996 - RNA, 22 nt, Human
ggguucuccacgcucuccacuu

SEQ ID NO: 1251997 - RNA, 18 nt, Human
gguggcuccucacucagg

SEQ ID NO: 1251998 - RNA, 19 nt, Human
uagaagaacccacagggua

SEQ ID NO: 1251999 - RNA, 19 nt, Human
uagacuagaagaacccaca

SEQ ID NO: 1252000 - RNA, 22 nt, Human
ucacuacagcaaaaauaacagg

SEQ ID NO: 1252001 - RNA, 21 nt, Human
ucacuggggccugcguagccu

SEQ ID NO: 1252002 - RNA, 19 nt, Human
ucagaagacugagagcuca

SEQ ID NO: 1252003 - RNA, 20 nt, Human
ucagaagacuuggagggaaa

SEQ ID NO: 1252004 - RNA, 21 nt, Human
ucagcgcccggucuucccugc

SEQ ID NO: 1252005 - RNA, 21 nt, Human
ucaguggaaaaugaaagaugu

SEQ ID NO: 1252006 - RNA, 24 nt, Human
uccacccuugcccugggaaccugc

SEQ ID NO: 1252007 - RNA, 21 nt, Human
ucccccagccgggucagcucc

SEQ ID NO: 1252008 - RNA, 25 nt, Human
ucccccagccgggucagcuccuccu

SEQ ID NO: 1252009 - RNA, 18 nt, Human
ucccugagcuccaacagu

SEQ ID NO: 1252010 - RNA, 19 nt, Human
ucccugcucacucuggggu

SEQ ID NO: 1252011 - RNA, 19 nt, Human
ucccuucccugagcuccaa

SEQ ID NO: 1252012 - RNA, 21 nt, Human
ucccuucccugagcuccaaca

SEQ ID NO: 1252013 - RNA, 20 nt, Human
uccugagugaggggugggau

SEQ ID NO: 1252014 - RNA, 25 nt, Human
uccuggggccucagaugaagucagg

SEQ ID NO: 1252015 - RNA, 26 nt, Human
uccuggggccucagaugaagucaggu

SEQ ID NO: 1252016 - RNA, 21 nt, Human
ucgggccacaguggcugucgg

SEQ ID NO: 1252017 - RNA, 18 nt, Human
ucgguggucuccagccgg

SEQ ID NO: 1252018 - RNA, 25 nt, Human
ucuccaccccgcaaaccuguggcug

SEQ ID NO: 1252019 - RNA, 27 nt, Human
ucuccaccccgcaaaccuguggcugcc

SEQ ID NO: 1252020 - RNA, 25 nt, Human
ucuccacccugcaaaccuguggcug

SEQ ID NO: 1252021 - RNA, 18 nt, Human
ucucuggagauggcagcc

SEQ ID NO: 1252022 - RNA, 23 nt, Human
ugaaagauguguguccacgagag

SEQ ID NO: 1252023 - RNA, 18 nt, Human
ugaccacacggcaccugc

SEQ ID NO: 1252024 - RNA, 20 nt, Human
ugaccuccgcagcugagccu

SEQ ID NO: 1252025 - RNA, 21 nt, Human
ugacucagaacaaggaacucg

SEQ ID NO: 1252026 - RNA, 20 nt, Human
ugagccucgguggucuccag

SEQ ID NO: 1252027 - RNA, 21 nt, Human
ugagcugggaccuccuugagc

SEQ ID NO: 1252028 - RNA, 21 nt, Human
ugaggggugggauggaggcag

SEQ ID NO: 1252029 - RNA, 23 nt, Human
ugccaggcacccucuacgauccc

SEQ ID NO: 1252030 - RNA, 22 nt, Human
ugccagggcagggcagcuuccc

SEQ ID NO: 1252031 - RNA, 19 nt, Human
ugccccagccgaggucagc

SEQ ID NO: 1252032 - RNA, 25 nt, Human
ugccccagccgaggucagcaggagc

SEQ ID NO: 1252033 - RNA, 20 nt, Human
ugcuccagcucugaccuccg

SEQ ID NO: 1252034 - RNA, 19 nt, Human
ugcucuuguagaacggagg

SEQ ID NO: 1252035 - RNA, 21 nt, Human
uggaaucggaaaggaccacca

SEQ ID NO: 1252036 - RNA, 21 nt, Human
uggaugccagggcagggcagc

SEQ ID NO: 1252037 - RNA, 22 nt, Human
uggcagcccccaacagcugcca

SEQ ID NO: 1252038 - RNA, 22 nt, Human
uggccugcauuggaggcuucug

SEQ ID NO: 1252039 - RNA, 24 nt, Human
ugggaccuccuugagcugaugcug

SEQ ID NO: 1252040 - RNA, 18 nt, Human
ugggagggaagcagggcc

SEQ ID NO: 1252041 - RNA, 18 nt, Human
ugggauggaggcagcucc

SEQ ID NO: 1252042 - RNA, 18 nt, Human
ugggcgucuggcacccgc

SEQ ID NO: 1252043 - RNA, 21 nt, Human
ugucuggaugccagggcaggg

SEQ ID NO: 1252044 - RNA, 25 nt, Human
uucacuggggccugcguagccucca

SEQ ID NO: 1252045 - RNA, 19 nt, Human
uuccagggcgcgagggcug

SEQ ID NO: 1252046 - RNA, 18 nt, Human
uuccccacgcacggucag

SEQ ID NO: 1252047 - RNA, 21 nt, Human
uucuccucuugcacucgggcc

SEQ ID NO: 1252048 - RNA, 18 nt, Human
cacuuggcaaaugcacag

SEQ ID NO: 1252049 - RNA, 18 nt, Human
cagcaggagaugcacaua

SEQ ID NO: 1252050 - RNA, 24 nt, Human
caggagaugcacauaacucccaau

SEQ ID NO: 1252051 - RNA, 26 nt, Human
cccaccuguuuuuaucugcuucugau

SEQ ID NO: 1252052 - RNA, 23 nt, Human
cugcccacuuuccacccugaaau

SEQ ID NO: 1252053 - RNA, 18 nt, Human
ugcacagauauuccgugu

SEQ ID NO: 1252054 - RNA, 21 nt, Human
uggcaaaugcacagauauucc

SEQ ID NO: 1252055 - RNA, 23 nt, Human
uugggcucuccuuaagggcucac

SEQ ID NO: 1252056 - RNA, 21 nt, Human
aaguggagcugcugugguggg

SEQ ID NO: 1252057 - RNA, 18 nt, Human
acuugcuccuggcagggu

SEQ ID NO: 1252058 - RNA, 19 nt, Human
agagggauuucgagggcuu

SEQ ID NO: 1252059 - RNA, 23 nt, Human
agcugcugugguggggucauuga

SEQ ID NO: 1252060 - RNA, 18 nt, Human
gagcugcugugguggggu

SEQ ID NO: 1252061 - RNA, 19 nt, Human
gcuccuggcaggguagcuu

SEQ ID NO: 1252062 - RNA, 21 nt, Human
gcuuaccgaggagcccugcag

SEQ ID NO: 1252063 - RNA, 21 nt, Human
ggcccuggugauugucagaca

SEQ ID NO: 1252064 - RNA, 19 nt, Human
gggccucugacuugcuccu

SEQ ID NO: 1252065 - RNA, 20 nt, Human
gguagcuuggaaaccagcag

SEQ ID NO: 1252066 - RNA, 23 nt, Human
guggagcugcuguggugggguca

SEQ ID NO: 1252067 - RNA, 25 nt, Human
uaugggcccuggugauugucagaca

SEQ ID NO: 1252068 - RNA, 21 nt, Human
ugagcucuaugggcccuggug

SEQ ID NO: 1252069 - RNA, 24 nt, Human
uucuugaagcuguggugcaggaau

SEQ ID NO: 1252070 - RNA, 18 nt, Human
cagcaacugccacacgcc

SEQ ID NO: 1252071 - RNA, 19 nt, Human
cccugcugguagagguagg

SEQ ID NO: 1252072 - RNA, 23 nt, Human
ccucugagcugcuggggagcggg

SEQ ID NO: 1252073 - RNA, 26 nt, Human
cuuccugauaacaaggaauccucuga

SEQ ID NO: 1252074 - RNA, 21 nt, Human
gcgggcacuaaugaggcccca

SEQ ID NO: 1252075 - RNA, 19 nt, Human
uaacaaggaauccucugag

SEQ ID NO: 1252076 - RNA, 19 nt, Human
ugauaacaaggaauccucu

SEQ ID NO: 1252077 - RNA, 21 nt, Human
ccuuauguuucguuccaauga

SEQ ID NO: 1252078 - RNA, 20 nt, Human
ucccuuauguuucguuccaa

SEQ ID NO: 1252079 - RNA, 22 nt, Human
acucucugaccagcuggaauuu

SEQ ID NO: 1252080 - RNA, 22 nt, Human
ggcagagccacagcacugacuc

SEQ ID NO: 1252081 - RNA, 21 nt, Human
accacagauuuucgaaacaac

SEQ ID NO: 1252082 - RNA, 20 nt, Human
ugauaagagcuucaccuccu

SEQ ID NO: 1252083 - RNA, 22 nt, Human
uuagugauaagagcuucaccuc

SEQ ID NO: 1252084 - RNA, 26 nt, Human
gggcugcggcuuuccuuaacaagugg

SEQ ID NO: 1252085 - RNA, 25 nt, Human
ugcggcuuuccuuaacaagugggcc

SEQ ID NO: 1252086 - RNA, 20 nt, Human
uggcaggaaugggcugcggc

SEQ ID NO: 1252087 - RNA, 24 nt, Human
uggcaggaaugggcugcggcuuuc

SEQ ID NO: 1252088 - RNA, 21 nt, Human
uggcaggaaugggcugcggga

SEQ ID NO: 1252089 - RNA, 21 nt, Human
aagagcucugcaugccaccac

SEQ ID NO: 1252090 - RNA, 22 nt, Human
cacuauguggccuuugaugggc

SEQ ID NO: 1252091 - RNA, 20 nt, Human
ccaaagagcuggcuguagug

SEQ ID NO: 1252092 - RNA, 18 nt, Human
ccccaggaauggcuucuc

SEQ ID NO: 1252093 - RNA, 20 nt, Human
cuucucauagugccagggcc

SEQ ID NO: 1252094 - RNA, 19 nt, Human
uaguggaucucaaaguagg

SEQ ID NO: 1252095 - RNA, 19 nt, Human
ucccaaagagcuggcugua

SEQ ID NO: 1252096 - RNA, 22 nt, Human
ugcaugccaccacucuuugccc

SEQ ID NO: 1252097 - RNA, 21 nt, Human
ugcccaguguauucacuaugu

SEQ ID NO: 1252098 - RNA, 24 nt, Human
uggaucucaaaguaggccaggccc

SEQ ID NO: 1252099 - RNA, 22 nt, Human
cuucuuuauugcucuuucugau

SEQ ID NO: 1252100 - RNA, 18 nt, Human
uacaugaacuucuauagg

SEQ ID NO: 1252101 - RNA, 20 nt, Human
uacaugaacuucuauaggug

SEQ ID NO: 1252102 - RNA, 18 nt, Human
uaugucuaccacggucug

SEQ ID NO: 1252103 - RNA, 20 nt, Human
uauugcucuuucugauucca

SEQ ID NO: 1252104 - RNA, 24 nt, Human
uauugcucuuucugauuccacugu

SEQ ID NO: 1252105 - RNA, 23 nt, Human
uccuagccuuacaugaacuucua

SEQ ID NO: 1252106 - RNA, 22 nt, Human
uguguaaacuuccuagccuuac

SEQ ID NO: 1252107 - RNA, 28 nt, Human
ugguaguucugguagaguggcggaggcg

SEQ ID NO: 1252108 - RNA, 24 nt, Human
uguaaauaucuucaucaggaaguu

SEQ ID NO: 1252109 - RNA, 24 nt, Human
accacugcauaaagacacucuaua

SEQ ID NO: 1252110 - RNA, 20 nt, Human
acuuggcacucacuggagcu

SEQ ID NO: 1252111 - RNA, 21 nt, Human
cacucuauagcgcucaaaagc

SEQ ID NO: 1252112 - RNA, 24 nt, Human
cacuggagcugcccucugaagcuc

SEQ ID NO: 1252113 - RNA, 22 nt, Human
cauccaacaauccaccaggcac

SEQ ID NO: 1252114 - RNA, 21 nt, Human
ccaccaggcacugagaacagg

SEQ ID NO: 1252115 - RNA, 20 nt, Human
cucacuggagcugcccucug

SEQ ID NO: 1252116 - RNA, 20 nt, Human
cucuauagcgcucaaaagcc

SEQ ID NO: 1252117 - RNA, 23 nt, Human
ucaggaugaugguuguuuuuccu

SEQ ID NO: 1252118 - RNA, 25 nt, Human
uccaacaauccaccaggcacugaga

SEQ ID NO: 1252119 - RNA, 19 nt, Human
ugagaacagguggugucug

SEQ ID NO: 1252120 - RNA, 19 nt, Human
uuggcagaggaaugcgagc

SEQ ID NO: 1252121 - RNA, 24 nt, Human
aagggccuacuucaucaggugcca

SEQ ID NO: 1252122 - RNA, 19 nt, Human
augaagccagguaauauug

SEQ ID NO: 1252123 - RNA, 23 nt, Human
auugcaaagggucuguggaaacg

SEQ ID NO: 1252124 - RNA, 18 nt, Human
caggcuccccgaguccuc

SEQ ID NO: 1252125 - RNA, 21 nt, Human
caggcucgcggagggguccaa

SEQ ID NO: 1252126 - RNA, 20 nt, Human
ccccgaguccucgccugccc

SEQ ID NO: 1252127 - RNA, 21 nt, Human
ccgugcuuggggccggggcag

SEQ ID NO: 1252128 - RNA, 26 nt, Human
ccucccugccucaaaggccccagaag

SEQ ID NO: 1252129 - RNA, 21 nt, Human
ccugccucaaaggccccagaa

SEQ ID NO: 1252130 - RNA, 18 nt, Human
cggacccucaacaggcuc

SEQ ID NO: 1252131 - RNA, 23 nt, Human
cgggagcugggcccgcggacagc

SEQ ID NO: 1252132 - RNA, 19 nt, Human
gaguccucgccugcccucc

SEQ ID NO: 1252133 - RNA, 21 nt, Human
gggccggggcaggcucgcgga

SEQ ID NO: 1252134 - RNA, 21 nt, Human
uccucgccugcccucccugcc

SEQ ID NO: 1252135 - RNA, 21 nt, Human
ucgccugcccucccugccuca

SEQ ID NO: 1252136 - RNA, 19 nt, Human
uggcuacugacagcggcgg

SEQ ID NO: 1252137 - RNA, 26 nt, Human
auuggcuucucucccucucuuuuugg

SEQ ID NO: 1252138 - RNA, 20 nt, Human
cucccucucuuuuugugguc

SEQ ID NO: 1252139 - RNA, 22 nt, Human
cucucccucucuuuuugugguc

SEQ ID NO: 1252140 - RNA, 19 nt, Human
gaggauagugcugugcccc

SEQ ID NO: 1252141 - RNA, 22 nt, Human
gaggauagugcugugccccagg

SEQ ID NO: 1252142 - RNA, 19 nt, Human
gcuucucucccucucuuuu

SEQ ID NO: 1252143 - RNA, 22 nt, Human
ucagaagcucccugugacuugg

SEQ ID NO: 1252144 - RNA, 20 nt, Human
uggcuucucucccucucuuu

SEQ ID NO: 1252145 - RNA, 23 nt, Human
uuggcuucucucccucucuuuuu

SEQ ID NO: 1252146 - RNA, 27 nt, Human
aggcgagggaaacggggagcuccaggg

SEQ ID NO: 1252147 - RNA, 24 nt, Human
aggggggccgggggagguggggcc

SEQ ID NO: 1252148 - RNA, 22 nt, Human
ccccgcaggggacaggggcggg

SEQ ID NO: 1252149 - RNA, 19 nt, Human
ccccgggacugaacuugcc

SEQ ID NO: 1252150 - RNA, 24 nt, Human
ccccgggacugaacuugccccucc

SEQ ID NO: 1252151 - RNA, 24 nt, Human
cccgccaaccgccagccccgggac

SEQ ID NO: 1252152 - RNA, 19 nt, Human
cgagggaaacggggagcuc

SEQ ID NO: 1252153 - RNA, 24 nt, Human
cggccgcccgcuccccgcagggga

SEQ ID NO: 1252154 - RNA, 23 nt, Human
cuaaagccggucccgccaaccgc

SEQ ID NO: 1252155 - RNA, 19 nt, Human
gagguggggccgccgggga

SEQ ID NO: 1252156 - RNA, 20 nt, Human
gggacaggggcggggaggga

SEQ ID NO: 1252157 - RNA, 20 nt, Human
gggagguggggccgccgggg

SEQ ID NO: 1252158 - RNA, 18 nt, Human
gggcggggagggagagau

SEQ ID NO: 1252159 - RNA, 22 nt, Human
ggggaggaggcgagggaaacgg

SEQ ID NO: 1252160 - RNA, 20 nt, Human
uaaagccggucccgccaacc

SEQ ID NO: 1252161 - RNA, 21 nt, Human
uccagaggggggccgggggag

SEQ ID NO: 1252162 - RNA, 20 nt, Human
uccccgcaggggacaggggc

SEQ ID NO: 1252163 - RNA, 22 nt, Human
uggggccgccggggaggaggcg

SEQ ID NO: 1252164 - RNA, 18 nt, Human
accuccgucuuggaugau

SEQ ID NO: 1252165 - RNA, 18 nt, Human
agagaaaacaguggcuag

SEQ ID NO: 1252166 - RNA, 20 nt, Human
agagaaaacaguggcuagca

SEQ ID NO: 1252167 - RNA, 26 nt, Human
aguggaccagggaccuccgucuugga

SEQ ID NO: 1252168 - RNA, 22 nt, Human
caaagcgccaaaccaggaguuc

SEQ ID NO: 1252169 - RNA, 21 nt, Human
cacugcucuuacagagaaaac

SEQ ID NO: 1252170 - RNA, 22 nt, Human
ccagugauguuaaugugcuccc

SEQ ID NO: 1252171 - RNA, 18 nt, Human
ccauuuaugcauuucccc

SEQ ID NO: 1252172 - RNA, 25 nt, Human
cguacucauggaacccauuuaugca

SEQ ID NO: 1252173 - RNA, 24 nt, Human
cucuuacagagaaaacaguggcua

SEQ ID NO: 1252174 - RNA, 19 nt, Human
cuucacaaagcgccaaacc

SEQ ID NO: 1252175 - RNA, 18 nt, Human
guagaagaugcuguggcc

SEQ ID NO: 1252176 - RNA, 23 nt, Human
uagaagaugcuguggccucguac

SEQ ID NO: 1252177 - RNA, 20 nt, Human
ucuuggaugauauccccagu

SEQ ID NO: 1252178 - RNA, 22 nt, Human
ugaaaacugugaguccuuugua

SEQ ID NO: 1252179 - RNA, 22 nt, Human
ugcaggugucgccagcuggaag

SEQ ID NO: 1252180 - RNA, 20 nt, Human
uggaagaagaccuaguggca

SEQ ID NO: 1252181 - RNA, 19 nt, Human
uggaugauauccccaguga

SEQ ID NO: 1252182 - RNA, 19 nt, Human
ugggaaucauuguugcuuc

SEQ ID NO: 1252183 - RNA, 18 nt, Human
ggcuggugaauggguugg

SEQ ID NO: 1252184 - RNA, 19 nt, Human
cucuguccucuuccuucug

SEQ ID NO: 1252185 - RNA, 20 nt, Human
cuuugcucuguccucuuccu

SEQ ID NO: 1252186 - RNA, 24 nt, Human
cuuugcucuguccucuuccuucug

SEQ ID NO: 1252187 - RNA, 26 nt, Human
ugcucuguccucuuccuucugguuca

SEQ ID NO: 1252188 - RNA, 21 nt, Human
ugguucaguccuuguguaguc

SEQ ID NO: 1252189 - RNA, 21 nt, Human
uguccucuuccuucugguuca

SEQ ID NO: 1252190 - RNA, 19 nt, Human
cagaaagagcaggcaccau

SEQ ID NO: 1252191 - RNA, 21 nt, Human
ccagaaagagcaggcaccauu

SEQ ID NO: 1252192 - RNA, 23 nt, Human
ucagaaaaugccacuucucuuuc

SEQ ID NO: 1252193 - RNA, 19 nt, Human
uccagaaagagcaggcacc

SEQ ID NO: 1252194 - RNA, 22 nt, Human
auuaggugugguaauuggggca

SEQ ID NO: 1252195 - RNA, 25 nt, Human
caggagcugaaguugguuguuuagu

SEQ ID NO: 1252196 - RNA, 26 nt, Human
gagcugaggcggaugaugggucuagg

SEQ ID NO: 1252197 - RNA, 24 nt, Human
ggagguguggguggggcagcuggu

SEQ ID NO: 1252198 - RNA, 20 nt, Human
gggaagaauuagguguggua

SEQ ID NO: 1252199 - RNA, 22 nt, Human
gggugggacagcuguggucucu

SEQ ID NO: 1252200 - RNA, 22 nt, Human
ggguggggcagcuguggucucu

SEQ ID NO: 1252201 - RNA, 22 nt, Human
ggguggggcagcuguggucucu

SEQ ID NO: 1252202 - RNA, 24 nt, Human
ggugcaagaguaguuggggaagaa

SEQ ID NO: 1252203 - RNA, 18 nt, Human
guaguaguaguuugagua

SEQ ID NO: 1252204 - RNA, 24 nt, Human
guggagcugaggaagauaguggag

SEQ ID NO: 1252205 - RNA, 22 nt, Human
guggguggggcagcuguggucu

SEQ ID NO: 1252206 - RNA, 22 nt, Human
guggguggggcagcuguggucu

SEQ ID NO: 1252207 - RNA, 22 nt, Human
guggguggggcagcuguggucu

SEQ ID NO: 1252208 - RNA, 22 nt, Human
guggguggggcagcuguggucu

SEQ ID NO: 1252209 - RNA, 19 nt, Human
ucagaagugucaggugcaa

SEQ ID NO: 1252210 - RNA, 20 nt, Human
ucuggugugugggugcagcc

SEQ ID NO: 1252211 - RNA, 18 nt, Human
ugaccgaaguaguagucu

SEQ ID NO: 1252212 - RNA, 21 nt, Human
ugaggaagauaguggagcugg

SEQ ID NO: 1252213 - RNA, 21 nt, Human
ugaggaagaugguggagcugg

SEQ ID NO: 1252214 - RNA, 21 nt, Human
uggggaagacgguggagcugg

SEQ ID NO: 1252215 - RNA, 21 nt, Human
uggguggggcagcuguggucu

SEQ ID NO: 1252216 - RNA, 21 nt, Human
uggguggggcagcuguggucu

SEQ ID NO: 1252217 - RNA, 21 nt, Human
uggguggggcagcuguggucu

SEQ ID NO: 1252218 - RNA, 21 nt, Human
uggguggggcagcuguggucu

SEQ ID NO: 1252219 - RNA, 23 nt, Human
uggguggggcagcuguggucucu

SEQ ID NO: 1252220 - RNA, 22 nt, Human
uggugugugggugcagcugaag

SEQ ID NO: 1252221 - RNA, 24 nt, Human
uggugugugggugcagcugaaguu

SEQ ID NO: 1252222 - RNA, 26 nt, Human
uggugugugggugcagcugaaguuuc

SEQ ID NO: 1252223 - RNA, 21 nt, Human
uguggagcuggggaagacggu

SEQ ID NO: 1252224 - RNA, 20 nt, Human
uguggguggggcagcugugg

SEQ ID NO: 1252225 - RNA, 20 nt, Human
uguggguggggcagcugugg

SEQ ID NO: 1252226 - RNA, 20 nt, Human
uguggguggggcagcugugg

SEQ ID NO: 1252227 - RNA, 20 nt, Human
uguggguggggcagcugugg

SEQ ID NO: 1252228 - RNA, 19 nt, Human
uuucagaagugucaggugc

SEQ ID NO: 1252229 - RNA, 21 nt, Human
cccccacuccucgagcuucug

SEQ ID NO: 1252230 - RNA, 23 nt, Human
cugcagcucccuguccuucuucu

SEQ ID NO: 1252231 - RNA, 23 nt, Human
cuucugcagcucccuguccuucu

SEQ ID NO: 1252232 - RNA, 21 nt, Human
ucacacugcaccuucuggcug

SEQ ID NO: 1252233 - RNA, 20 nt, Human
ucugcagcucccuguccuuc

SEQ ID NO: 1252234 - RNA, 22 nt, Human
ugcagcucccuguccuucuucu

SEQ ID NO: 1252235 - RNA, 18 nt, Human
ccucucucuguggggucc

SEQ ID NO: 1252236 - RNA, 25 nt, Human
cugcuuuggccucucucuguggggu

SEQ ID NO: 1252237 - RNA, 19 nt, Human
gccaaaugccaugcacaau

SEQ ID NO: 1252238 - RNA, 22 nt, Human
ggccucucucugugggguccug

SEQ ID NO: 1252239 - RNA, 19 nt, Human
ucugggaacaaugcccugg

SEQ ID NO: 1252240 - RNA, 24 nt, Human
ugccaaaugccaugcacaauuucu

SEQ ID NO: 1252241 - RNA, 20 nt, Human
ugggaacaaugcccuggagc

SEQ ID NO: 1252242 - RNA, 23 nt, Human
ugggguccugggaaccagccacu

SEQ ID NO: 1252243 - RNA, 21 nt, Human
uuuuucuucugcuuuggccuc

SEQ ID NO: 1252244 - RNA, 24 nt, Human
uccuucagaaggcgaauuuguuga

SEQ ID NO: 1252245 - RNA, 18 nt, Human
acacgauaucuccuugga

SEQ ID NO: 1252246 - RNA, 23 nt, Human
agggauucugccucuucuacauu

SEQ ID NO: 1252247 - RNA, 18 nt, Human
ccacuuucuuuuuugccc

SEQ ID NO: 1252248 - RNA, 20 nt, Human
ccucauagcugauauggucc

SEQ ID NO: 1252249 - RNA, 24 nt, Human
ucugccucuucuacauuuucuccc

SEQ ID NO: 1252250 - RNA, 20 nt, Human
aagcaagauaaauuaaagau

SEQ ID NO: 1252251 - RNA, 18 nt, Human
ugagugacaggguagaua

SEQ ID NO: 1252252 - RNA, 19 nt, Human
uggaaagcaagauaaauua

SEQ ID NO: 1252253 - RNA, 19 nt, Human
ccagcaccgggucgcuggu

SEQ ID NO: 1252254 - RNA, 18 nt, Human
gaggaagcugccuuaucu

SEQ ID NO: 1252255 - RNA, 22 nt, Human
ucgcuggucaaccucugaaugc

SEQ ID NO: 1252256 - RNA, 19 nt, Human
ugaaugcaggagccuugag

SEQ ID NO: 1252257 - RNA, 20 nt, Human
ugagucaggugcccaacagu

SEQ ID NO: 1252258 - RNA, 19 nt, Human
ugccuuaucuccagcaccg

SEQ ID NO: 1252259 - RNA, 22 nt, Human
aacuugccaucuccagcaccuu

SEQ ID NO: 1252260 - RNA, 25 nt, Human
accuucagcuuucugugccuggucu

SEQ ID NO: 1252261 - RNA, 18 nt, Human
accuucucucccuucuuu

SEQ ID NO: 1252262 - RNA, 22 nt, Human
acuuggaucuuaaguguuuuuc

SEQ ID NO: 1252263 - RNA, 23 nt, Human
caggggccuucucugugccaucc

SEQ ID NO: 1252264 - RNA, 21 nt, Human
cauccuuuagacagccggaca

SEQ ID NO: 1252265 - RNA, 21 nt, Human
cccuuuuucccuuuggguacc

SEQ ID NO: 1252266 - RNA, 25 nt, Human
ccuugccagcaucggcuuuucccuu

SEQ ID NO: 1252267 - RNA, 26 nt, Human
cuccagcaccuucagcuuucugugcc

SEQ ID NO: 1252268 - RNA, 20 nt, Human
cucccuucuuugcaggggcc

SEQ ID NO: 1252269 - RNA, 24 nt, Human
cucucccuucuuugcaggggccuu

SEQ ID NO: 1252270 - RNA, 24 nt, Human
cuugccaucuccagcaccuucagc

SEQ ID NO: 1252271 - RNA, 18 nt, Human
guacauauccauaaugcc

SEQ ID NO: 1252272 - RNA, 23 nt, Human
guaccuucucucccuucuuugca

SEQ ID NO: 1252273 - RNA, 19 nt, Human
ucccuucuuugcaggggcc

SEQ ID NO: 1252274 - RNA, 24 nt, Human
ucuccagcaccuucagcuuucugu

SEQ ID NO: 1252275 - RNA, 20 nt, Human
ucucucccuucuuugcaggg

SEQ ID NO: 1252276 - RNA, 19 nt, Human
ucugugccuggucuguuuu

SEQ ID NO: 1252277 - RNA, 23 nt, Human
ucuuaaguguuuuuccugacuuc

SEQ ID NO: 1252278 - RNA, 23 nt, Human
ugcauacacucaacuugccaucu

SEQ ID NO: 1252279 - RNA, 21 nt, Human
uucccagucucaucacucaca

SEQ ID NO: 1252280 - RNA, 26 nt, Human
uucccagucucaucacucacauccuc

SEQ ID NO: 1252281 - RNA, 21 nt, Human
uugccagcaucggcuuuuccc

SEQ ID NO: 1252282 - RNA, 21 nt, Human
uuucccuuuggguaccuucuc

SEQ ID NO: 1252283 - RNA, 25 nt, Human
uuucccuuuuucccuuuggguaccu

SEQ ID NO: 1252284 - RNA, 18 nt, Human
aggcagagucccuuccuu

SEQ ID NO: 1252285 - RNA, 19 nt, Human
cuagaggcagagucccuuc

SEQ ID NO: 1252286 - RNA, 20 nt, Human
ucugcaaggcucuggucugc

SEQ ID NO: 1252287 - RNA, 21 nt, Human
ugcuggccugaaugaucacac

SEQ ID NO: 1252288 - RNA, 23 nt, Human
aaggcaaugccauaacauaaaac

SEQ ID NO: 1252289 - RNA, 25 nt, Human
aaggcagucuucaaggcccaaccag

SEQ ID NO: 1252290 - RNA, 18 nt, Human
auuucauuuucuggauga

SEQ ID NO: 1252291 - RNA, 19 nt, Human
auuucauuuucuggaugaa

SEQ ID NO: 1252292 - RNA, 21 nt, Human
ccaaccaacacgcaguuacaa

SEQ ID NO: 1252293 - RNA, 20 nt, Human
cccacucuuuaucacuuccc

SEQ ID NO: 1252294 - RNA, 21 nt, Human
cccacucuuuaucacuuccca

SEQ ID NO: 1252295 - RNA, 21 nt, Human
cuuuaucacuucccaaggcaa

SEQ ID NO: 1252296 - RNA, 19 nt, Human
ugccauaacauaaaaccac

SEQ ID NO: 1252297 - RNA, 19 nt, Human
ugccauaacauaaaaccac

SEQ ID NO: 1252298 - RNA, 23 nt, Human
ugucccacucuuuaucacuuccc

SEQ ID NO: 1252299 - RNA, 21 nt, Human
uuucuggaugauccacccauu

SEQ ID NO: 1252300 - RNA, 22 nt, Human
aaccaguuguuguagccauagg

SEQ ID NO: 1252301 - RNA, 19 nt, Human
caggagccggccaccugag

SEQ ID NO: 1252302 - RNA, 19 nt, Human
ccccaggagccggccaccu

SEQ ID NO: 1252303 - RNA, 22 nt, Human
cccuggauugccuggggguaag

SEQ ID NO: 1252304 - RNA, 21 nt, Human
cugggggcuccaauccaaccg

SEQ ID NO: 1252305 - RNA, 19 nt, Human
ucccuggauugccuggggg

SEQ ID NO: 1252306 - RNA, 20 nt, Human
ucccuggauugccugggggu

SEQ ID NO: 1252307 - RNA, 18 nt, Human
uccugggugugugagugc

SEQ ID NO: 1252308 - RNA, 24 nt, Human
uggggguaagggaaggucagcuuc

SEQ ID NO: 1252309 - RNA, 22 nt, Human
ugugugagugcugccugggggc

SEQ ID NO: 1252310 - RNA, 24 nt, Human
aaaaacagugguaaaauggaccgg

SEQ ID NO: 1252311 - RNA, 26 nt, Human
aaccaagaggugaaaagaagggaccc

SEQ ID NO: 1252312 - RNA, 24 nt, Human
aagcaaggggaggaagaagucaga

SEQ ID NO: 1252313 - RNA, 28 nt, Human
aagcagggaagaaauaaggggcaagguc

SEQ ID NO: 1252314 - RNA, 28 nt, Human
aagccaaaagugagaacagaagggaccc

SEQ ID NO: 1252315 - RNA, 21 nt, Human
aaggggaggaagaagucagaa

SEQ ID NO: 1252316 - RNA, 20 nt, Human
aagugagaacagaacauuuu

SEQ ID NO: 1252317 - RNA, 21 nt, Human
acagaacauuuucauauccuc

SEQ ID NO: 1252318 - RNA, 22 nt, Human
acagaacauuuucauauccucc

SEQ ID NO: 1252319 - RNA, 25 nt, Human
acagaacauuuucauauccucccca

SEQ ID NO: 1252320 - RNA, 21 nt, Human
agcaaggggaggaagaaguca

SEQ ID NO: 1252321 - RNA, 18 nt, Human
aggaagucagaggcaauc

SEQ ID NO: 1252322 - RNA, 22 nt, Human
agggaagaaauaaggggcaagg

SEQ ID NO: 1252323 - RNA, 19 nt, Human
aggggcaaggggggcuagg

SEQ ID NO: 1252324 - RNA, 22 nt, Human
agugguaaaauggacauaaagc

SEQ ID NO: 1252325 - RNA, 23 nt, Human
cacacuugaaaacauacuuccca

SEQ ID NO: 1252326 - RNA, 18 nt, Human
cacuccuuuucccuccag

SEQ ID NO: 1252327 - RNA, 18 nt, Human
cacugccaauaauguccc

SEQ ID NO: 1252328 - RNA, 18 nt, Human
cagcaaaagcccuggggu

SEQ ID NO: 1252329 - RNA, 19 nt, Human
caguccuugucuacccguu

SEQ ID NO: 1252330 - RNA, 19 nt, Human
cauauccuccccacacuug

SEQ ID NO: 1252331 - RNA, 21 nt, Human
ccaauaaugucccagauagcu

SEQ ID NO: 1252332 - RNA, 24 nt, Human
ccagagccccuuccaaaucucucu

SEQ ID NO: 1252333 - RNA, 18 nt, Human
ccauugucaggccuuggg

SEQ ID NO: 1252334 - RNA, 21 nt, Human
cccaaccaagaggugaaaaga

SEQ ID NO: 1252335 - RNA, 18 nt, Human
ccccacacuugaaaacau

SEQ ID NO: 1252336 - RNA, 21 nt, Human
cccccaggacucuaggagcca

SEQ ID NO: 1252337 - RNA, 23 nt, Human
cccccaggacucuaggagccacu

SEQ ID NO: 1252338 - RNA, 22 nt, Human
ccccgcaccuccgccgcccgcc

SEQ ID NO: 1252339 - RNA, 25 nt, Human
ccgccgcccgccgcccgcggccgcc

SEQ ID NO: 1252340 - RNA, 24 nt, Human
ccuugucuacccguucaucccuca

SEQ ID NO: 1252341 - RNA, 18 nt, Human
cuccuuuucccuccagcc

SEQ ID NO: 1252342 - RNA, 26 nt, Human
cucuaggagccacuccuuuucccucc

SEQ ID NO: 1252343 - RNA, 24 nt, Human
cucucucucuucaucuucccugga

SEQ ID NO: 1252344 - RNA, 21 nt, Human
gaaaagcagguagaugguucg

SEQ ID NO: 1252345 - RNA, 23 nt, Human
gaacagaacauuuucauauccuc

SEQ ID NO: 1252346 - RNA, 21 nt, Human
gaagcaaggggaggaagaagu

SEQ ID NO: 1252347 - RNA, 19 nt, Human
gagcaggccccgcaccucc

SEQ ID NO: 1252348 - RNA, 23 nt, Human
gcaaaagcccuggggugaccccc

SEQ ID NO: 1252349 - RNA, 18 nt, Human
gccgcccgccgcccgcgg

SEQ ID NO: 1252350 - RNA, 23 nt, Human
ggaggaagaagucagaacccagg

SEQ ID NO: 1252351 - RNA, 20 nt, Human
gggaagaaauaaggggcaag

SEQ ID NO: 1252352 - RNA, 24 nt, Human
gggaagcagggaagaaauaagggg

SEQ ID NO: 1252353 - RNA, 19 nt, Human
guaaaauggacauaaagcc

SEQ ID NO: 1252354 - RNA, 23 nt, Human
uaaaauggacauaaagccaaaag

SEQ ID NO: 1252355 - RNA, 20 nt, Human
uaaggggcaaggggggcuag

SEQ ID NO: 1252356 - RNA, 22 nt, Human
uaccauugucaggccuugggag

SEQ ID NO: 1252357 - RNA, 18 nt, Human
uccagcccaaccaagagg

SEQ ID NO: 1252358 - RNA, 21 nt, Human
ucccagagucagcaaaagccc

SEQ ID NO: 1252359 - RNA, 18 nt, Human
uccuugggacacagcauc

SEQ ID NO: 1252360 - RNA, 19 nt, Human
ucucucucuucaucuuccc

SEQ ID NO: 1252361 - RNA, 20 nt, Human
ucuucaucuucccuggaagc

SEQ ID NO: 1252362 - RNA, 19 nt, Human
ugaaaacauacuucccauc

SEQ ID NO: 1252363 - RNA, 19 nt, Human
ugaaaagaaauuccuuggg

SEQ ID NO: 1252364 - RNA, 29 nt, Human
ugagaacagaacauuuucauauccucccc

SEQ ID NO: 1252365 - RNA, 21 nt, Human
uggccuccagggcccacugcc

SEQ ID NO: 1252366 - RNA, 23 nt, Human
uuccaaaucucucucucuucauc

SEQ ID NO: 1252367 - RNA, 18 nt, Human
uucgagggaagcagggaa

SEQ ID NO: 1252368 - RNA, 24 nt, Human
uaaauugaaagcuaauuuccgaua

SEQ ID NO: 1252369 - RNA, 18 nt, Human
aggagcgggagaggggcu

SEQ ID NO: 1252370 - RNA, 23 nt, Human
aggggcuggugggggccccaggg

SEQ ID NO: 1252371 - RNA, 19 nt, Human
cggcgggcgccccgaaguc

SEQ ID NO: 1252372 - RNA, 21 nt, Human
gagcgggagaggggcuggugg

SEQ ID NO: 1252373 - RNA, 20 nt, Human
gccacggcuccagcuccgcc

SEQ ID NO: 1252374 - RNA, 18 nt, Human
gccgcaguuucuccuccu

SEQ ID NO: 1252375 - RNA, 18 nt, Human
ggagaggagcgggagagg

SEQ ID NO: 1252376 - RNA, 19 nt, Human
ggcugaggccguggcucug

SEQ ID NO: 1252377 - RNA, 20 nt, Human
ggcuggugggggccccaggg

SEQ ID NO: 1252378 - RNA, 21 nt, Human
gggcuggugggggccccaggg

SEQ ID NO: 1252379 - RNA, 25 nt, Human
uccagcuccgccggcuccggccgga

SEQ ID NO: 1252380 - RNA, 22 nt, Human
uccucccggcgccuucucucca

SEQ ID NO: 1252381 - RNA, 24 nt, Human
ucuccuccucccggcgccuucucu

SEQ ID NO: 1252382 - RNA, 18 nt, Human
ucuguaccgccaauaggg

SEQ ID NO: 1252383 - RNA, 18 nt, Human
ugacuucucccuguuccc

SEQ ID NO: 1252384 - RNA, 19 nt, Human
aaaaaaaacaaaacgaggc

SEQ ID NO: 1252385 - RNA, 22 nt, Human
aaaaaaacaaaacgaggcguga

SEQ ID NO: 1252386 - RNA, 23 nt, Human
aaaaaagaacauggcagcaaaga

SEQ ID NO: 1252387 - RNA, 24 nt, Human
aaaaagaacauggcagcaaagaca

SEQ ID NO: 1252388 - RNA, 22 nt, Human
aaacacccuuaucccccaaaaa

SEQ ID NO: 1252389 - RNA, 19 nt, Human
aaacagacagagguguccc

SEQ ID NO: 1252390 - RNA, 23 nt, Human
aaacagacagagguguccccucu

SEQ ID NO: 1252391 - RNA, 21 nt, Human
aaacgaggcgugaaaaguccc

SEQ ID NO: 1252392 - RNA, 24 nt, Human
aaacugccaaguccaguaaucuca

SEQ ID NO: 1252393 - RNA, 22 nt, Human
aaagaugggaagagcaaaaaaa

SEQ ID NO: 1252394 - RNA, 26 nt, Human
aacaauaugccugagauaccaggccc

SEQ ID NO: 1252395 - RNA, 18 nt, Human
aacacccuuaucccccaa

SEQ ID NO: 1252396 - RNA, 22 nt, Human
aacaguaauaaucauuauagcc

SEQ ID NO: 1252397 - RNA, 20 nt, Human
aacgcccgucucgcacgccc

SEQ ID NO: 1252398 - RNA, 21 nt, Human
aagaaaaaaaacaaaacgagg

SEQ ID NO: 1252399 - RNA, 20 nt, Human
aagaaaauucaacauugcug

SEQ ID NO: 1252400 - RNA, 19 nt, Human
aagaauccacugucucccc

SEQ ID NO: 1252401 - RNA, 18 nt, Human
aagcagaaucuuguucca

SEQ ID NO: 1252402 - RNA, 21 nt, Human
aauguaagaaauaguauuuug

SEQ ID NO: 1252403 - RNA, 23 nt, Human
acaaaaaaaaauuauuucucucu

SEQ ID NO: 1252404 - RNA, 28 nt, Human
acagagaagaauaggaggcucuucuuca

SEQ ID NO: 1252405 - RNA, 21 nt, Human
acaguggaaggaucagaugga

SEQ ID NO: 1252406 - RNA, 18 nt, Human
acaucugaagaaaaaaaa

SEQ ID NO: 1252407 - RNA, 23 nt, Human
acauggcaucgucagcugccucc

SEQ ID NO: 1252408 - RNA, 22 nt, Human
acccugcgucaggaaaaagcca

SEQ ID NO: 1252409 - RNA, 24 nt, Human
acucuguacauucaaguuuuucca

SEQ ID NO: 1252410 - RNA, 23 nt, Human
acuucuggauuuuugaucugaaa

SEQ ID NO: 1252411 - RNA, 22 nt, Human
agaaaaaaaacaaaacgaggcg

SEQ ID NO: 1252412 - RNA, 23 nt, Human
agaaaaaaaacaaaacgaggcgu

SEQ ID NO: 1252413 - RNA, 29 nt, Human
agaaaaaaaacaaaacgaggcgugaaaag

SEQ ID NO: 1252414 - RNA, 19 nt, Human
agacacauggcaucgucag

SEQ ID NO: 1252415 - RNA, 24 nt, Human
agagcaaaaaaaucuccuuuggag

SEQ ID NO: 1252416 - RNA, 18 nt, Human
agcagaaucuuguuccag

SEQ ID NO: 1252417 - RNA, 18 nt, Human
aggaaaaaaaaaaaaaca

SEQ ID NO: 1252418 - RNA, 25 nt, Human
aggaaaaagccacaucugaagaaaa

SEQ ID NO: 1252419 - RNA, 24 nt, Human
aggacagagaagaauaggaggcuc

SEQ ID NO: 1252420 - RNA, 21 nt, Human
aggcagccagaaacuggcugg

SEQ ID NO: 1252421 - RNA, 23 nt, Human
aggcagggugggauagagaaggg

SEQ ID NO: 1252422 - RNA, 19 nt, Human
aggggaugcuguggagagg

SEQ ID NO: 1252423 - RNA, 19 nt, Human
agggugggauagagaaggg

SEQ ID NO: 1252424 - RNA, 24 nt, Human
aguaaauuaugaaaaaaauagcaa

SEQ ID NO: 1252425 - RNA, 23 nt, Human
augaaagaacucauauaaaaaca

SEQ ID NO: 1252426 - RNA, 25 nt, Human
auggagugguccucaacuguccaag

SEQ ID NO: 1252427 - RNA, 18 nt, Human
auuggcagauaaguuaug

SEQ ID NO: 1252428 - RNA, 23 nt, Human
caaaacgaggcgugaaaaguccc

SEQ ID NO: 1252429 - RNA, 21 nt, Human
caaagacaggcagccagaaac

SEQ ID NO: 1252430 - RNA, 20 nt, Human
caccacaaacaggagaacac

SEQ ID NO: 1252431 - RNA, 19 nt, Human
caccuuagcaccacaaaca

SEQ ID NO: 1252432 - RNA, 23 nt, Human
cagagagaaagaacuaagguggg

SEQ ID NO: 1252433 - RNA, 23 nt, Human
cagauggaaaaccacaacucuug

SEQ ID NO: 1252434 - RNA, 18 nt, Human
cagccgccuggcugucuu

SEQ ID NO: 1252435 - RNA, 21 nt, Human
caggaaaaagccacaucugaa

SEQ ID NO: 1252436 - RNA, 19 nt, Human
caggagaacacuguuggaa

SEQ ID NO: 1252437 - RNA, 18 nt, Human
cagggugggauagagaag

SEQ ID NO: 1252438 - RNA, 18 nt, Human
caucucgucaacacuucu

SEQ ID NO: 1252439 - RNA, 19 nt, Human
ccaaggcacuaaugcccau

SEQ ID NO: 1252440 - RNA, 21 nt, Human
cccacggccuguuuaccgccc

SEQ ID NO: 1252441 - RNA, 21 nt, Human
cccaggaagggcuaugaucuc

SEQ ID NO: 1252442 - RNA, 18 nt, Human
cccccauuuccaacuucu

SEQ ID NO: 1252443 - RNA, 20 nt, Human
ccccuucccggcagccgccu

SEQ ID NO: 1252444 - RNA, 18 nt, Human
cccgccgccucuggggcc

SEQ ID NO: 1252445 - RNA, 19 nt, Human
ccgcuuuccucagaggaga

SEQ ID NO: 1252446 - RNA, 22 nt, Human
ccuaagacccagcccucccuca

SEQ ID NO: 1252447 - RNA, 22 nt, Human
ccugagauaccaggcccccuuc

SEQ ID NO: 1252448 - RNA, 19 nt, Human
cgcaccauucgccuggcau

SEQ ID NO: 1252449 - RNA, 21 nt, Human
cgcacgcccuccacaaguuca

SEQ ID NO: 1252450 - RNA, 18 nt, Human
cgccuggcugucuuucca

SEQ ID NO: 1252451 - RNA, 18 nt, Human
cucaaauauucucuccca

SEQ ID NO: 1252452 - RNA, 20 nt, Human
cucaaauauucucucccacc

SEQ ID NO: 1252453 - RNA, 18 nt, Human
cucacagauacggacugc

SEQ ID NO: 1252454 - RNA, 20 nt, Human
cucccaacccauggcugccu

SEQ ID NO: 1252455 - RNA, 21 nt, Human
cucccaccccuuacagaacuc

SEQ ID NO: 1252456 - RNA, 24 nt, Human
cucucuccauuccuucagccuuaa

SEQ ID NO: 1252457 - RNA, 18 nt, Human
cugaagaaaaaaaacaaa

SEQ ID NO: 1252458 - RNA, 23 nt, Human
cugaagaaaaaaaacaaaacgag

SEQ ID NO: 1252459 - RNA, 19 nt, Human
cugccucccuuccuugacu

SEQ ID NO: 1252460 - RNA, 25 nt, Human
cugcuggaccagcucaaggccgcac

SEQ ID NO: 1252461 - RNA, 22 nt, Human
cuuagcaccacaaacaggagaa

SEQ ID NO: 1252462 - RNA, 19 nt, Human
cuucccggcagccgccugg

SEQ ID NO: 1252463 - RNA, 21 nt, Human
gaaaaaaaaaaaaacaaaguu

SEQ ID NO: 1252464 - RNA, 19 nt, Human
gaaaaaaauucaguugugg

SEQ ID NO: 1252465 - RNA, 23 nt, Human
gaaaaaaauucaguuguggaaac

SEQ ID NO: 1252466 - RNA, 19 nt, Human
gaaaaagccacaucugaag

SEQ ID NO: 1252467 - RNA, 23 nt, Human
gaaaauucaacauugcuggggca

SEQ ID NO: 1252468 - RNA, 26 nt, Human
gaacauggcagcaaagacaggcagcc

SEQ ID NO: 1252469 - RNA, 24 nt, Human
gaacucauauaaaaacauugaaaa

SEQ ID NO: 1252470 - RNA, 22 nt, Human
gaauaggaggcucuucuucagg

SEQ ID NO: 1252471 - RNA, 19 nt, Human
gaaugggggucugaaaaaa

SEQ ID NO: 1252472 - RNA, 22 nt, Human
gacaucuugggaucacagagaa

SEQ ID NO: 1252473 - RNA, 21 nt, Human
gagaagaauaggaggcucuuc

SEQ ID NO: 1252474 - RNA, 22 nt, Human
gagaagcagaaucuuguuccag

SEQ ID NO: 1252475 - RNA, 19 nt, Human
gagacuuuccgcuuucaca

SEQ ID NO: 1252476 - RNA, 21 nt, Human
gaugcuguggagaggauggag

SEQ ID NO: 1252477 - RNA, 20 nt, Human
gcagccagaaacuggcuggg

SEQ ID NO: 1252478 - RNA, 22 nt, Human
gcaugaagaaugggggucugaa

SEQ ID NO: 1252479 - RNA, 20 nt, Human
gccgccucucuguccucccu

SEQ ID NO: 1252480 - RNA, 22 nt, Human
gccucccucagaccugucaucg

SEQ ID NO: 1252481 - RNA, 19 nt, Human
gcgcuuuuuccuuuuuucc

SEQ ID NO: 1252482 - RNA, 21 nt, Human
ggugaaagaugaggggaaaga

SEQ ID NO: 1252483 - RNA, 21 nt, Human
guagcccccauuuccaacuuc

SEQ ID NO: 1252484 - RNA, 23 nt, Human
gucccacucucuccauuccuuca

SEQ ID NO: 1252485 - RNA, 19 nt, Human
guccugaggaaaugaagag

SEQ ID NO: 1252486 - RNA, 19 nt, Human
uaaauuacaaacuaagagc

SEQ ID NO: 1252487 - RNA, 25 nt, Human
uaaccuacugucaaggcaggguggg

SEQ ID NO: 1252488 - RNA, 18 nt, Human
uaaguuauggaaagacac

SEQ ID NO: 1252489 - RNA, 23 nt, Human
uaccaggcccccuucuucuccug

SEQ ID NO: 1252490 - RNA, 26 nt, Human
uaccaggcccccuucuucuccugaca

SEQ ID NO: 1252491 - RNA, 22 nt, Human
uaccgcccaacccagccgcuuc

SEQ ID NO: 1252492 - RNA, 21 nt, Human
uagaagcaaauagagacacuu

SEQ ID NO: 1252493 - RNA, 21 nt, Human
uagcaaugaccucaccgaggc

SEQ ID NO: 1252494 - RNA, 22 nt, Human
uagcaccacaaacaggagaaca

SEQ ID NO: 1252495 - RNA, 23 nt, Human
uagcaccacaaacaggagaacac

SEQ ID NO: 1252496 - RNA, 19 nt, Human
uauggaaagacacaaugua

SEQ ID NO: 1252497 - RNA, 20 nt, Human
ucacaaaaaaaaauuauuuc

SEQ ID NO: 1252498 - RNA, 20 nt, Human
ucaggaaaaaaaaaaaaaca

SEQ ID NO: 1252499 - RNA, 21 nt, Human
ucaggaagaagauggagagug

SEQ ID NO: 1252500 - RNA, 18 nt, Human
uccaaggcacuaaugccc

SEQ ID NO: 1252501 - RNA, 23 nt, Human
ucccuaagacccagcccucccuc

SEQ ID NO: 1252502 - RNA, 21 nt, Human
ucccucagaccugucaucgag

SEQ ID NO: 1252503 - RNA, 19 nt, Human
uccgccucuuccuguucuc

SEQ ID NO: 1252504 - RNA, 26 nt, Human
ucuggaguggaggggaugcuguggag

SEQ ID NO: 1252505 - RNA, 21 nt, Human
ucuucuucaggaagaagaugg

SEQ ID NO: 1252506 - RNA, 24 nt, Human
ucuuuucuuuuucuaaauaacuga

SEQ ID NO: 1252507 - RNA, 23 nt, Human
ugaaaauccgugccacccaacuc

SEQ ID NO: 1252508 - RNA, 21 nt, Human
ugaaagaacucauauaaaaac

SEQ ID NO: 1252509 - RNA, 23 nt, Human
ugaaagaacucauauaaaaacau

SEQ ID NO: 1252510 - RNA, 21 nt, Human
ugacaacaguggaaggaucag

SEQ ID NO: 1252511 - RNA, 24 nt, Human
uggaaagacacaauguaagaaaua

SEQ ID NO: 1252512 - RNA, 20 nt, Human
uggagagugcaccucgcuuc

SEQ ID NO: 1252513 - RNA, 20 nt, Human
uggaguggaggggaugcugu

SEQ ID NO: 1252514 - RNA, 21 nt, Human
uggcagcccccuucccggcag

SEQ ID NO: 1252515 - RNA, 21 nt, Human
ugggaagagcaaaaaaaucuc

SEQ ID NO: 1252516 - RNA, 20 nt, Human
ugggaggugguuaaacaccc

SEQ ID NO: 1252517 - RNA, 21 nt, Human
ugggggugucuaauauagaaa

SEQ ID NO: 1252518 - RNA, 18 nt, Human
uuaccgcccaacccagcc

SEQ ID NO: 1252519 - RNA, 23 nt, Human
uuaccgcccaacccagccgcuuc

SEQ ID NO: 1252520 - RNA, 18 nt, Human
uucaggaagaagauggag

SEQ ID NO: 1252521 - RNA, 18 nt, Human
uuccaggucuucugaggc

SEQ ID NO: 1252522 - RNA, 21 nt, Human
uuccaggucuucugaggcuuu

SEQ ID NO: 1252523 - RNA, 24 nt, Human
uugcuuucugcuuuaagaugcuuu

SEQ ID NO: 1252524 - RNA, 23 nt, Human
uuggcagcccccuucccggcagc

SEQ ID NO: 1252525 - RNA, 23 nt, Human
uuguggaaaccaagguuagccag

SEQ ID NO: 1252526 - RNA, 22 nt, Human
uuuaagaaaauauuugcuggcc

SEQ ID NO: 1252527 - RNA, 24 nt, Human
uuuacaggauaaccucaacuuuuu

SEQ ID NO: 1252528 - RNA, 22 nt, Human
uuuauuggcagauaaguuaugg

SEQ ID NO: 1252529 - RNA, 21 nt, Human
uuugguaagucuucauauuua

SEQ ID NO: 1252530 - RNA, 22 nt, Human
aagcacgaccacgucaacaggc

SEQ ID NO: 1252531 - RNA, 20 nt, Human
accacgucaacaggcccugg

SEQ ID NO: 1252532 - RNA, 21 nt, Human
agcaaaggcagcccucuaaga

SEQ ID NO: 1252533 - RNA, 24 nt, Human
agccugucugaucuggugcuuguu

SEQ ID NO: 1252534 - RNA, 24 nt, Human
aggaagcaaaucugggucccugca

SEQ ID NO: 1252535 - RNA, 19 nt, Human
aguaggaagcaaaucuggg

SEQ ID NO: 1252536 - RNA, 18 nt, Human
cacgucaacaggcccuga

SEQ ID NO: 1252537 - RNA, 21 nt, Human
gccgcugcuggcagguuccug

SEQ ID NO: 1252538 - RNA, 18 nt, Human
gucacaggugggcagcag

SEQ ID NO: 1252539 - RNA, 21 nt, Human
gugccgcugcuggcagguucc

SEQ ID NO: 1252540 - RNA, 21 nt, Human
ucacaggugggcagcaggucu

SEQ ID NO: 1252541 - RNA, 18 nt, Human
uccauuuuucagugggua

SEQ ID NO: 1252542 - RNA, 23 nt, Human
ucucuggcaaaaggagcaaaggc

SEQ ID NO: 1252543 - RNA, 18 nt, Human
ugaguaggaagcaaaucu

SEQ ID NO: 1252544 - RNA, 24 nt, Human
ugucauagagcuucuucacagccu

SEQ ID NO: 1252545 - RNA, 21 nt, Human
uugguucucuggcaaaaggag

SEQ ID NO: 1252546 - RNA, 18 nt, Human
agaaguuggggggagggg

SEQ ID NO: 1252547 - RNA, 19 nt, Human
guccccgagaaguuggggg

SEQ ID NO: 1252548 - RNA, 20 nt, Human
uccccgagaaguugggggga

SEQ ID NO: 1252549 - RNA, 20 nt, Human
uuggggggaggggucggcaa

SEQ ID NO: 1252550 - RNA, 24 nt, Human
accccugugguccgagagggccgg

SEQ ID NO: 1252551 - RNA, 20 nt, Human
acccugaagcccccaccggc

SEQ ID NO: 1252552 - RNA, 21 nt, Human
acccugaagcccccaccggcu

SEQ ID NO: 1252553 - RNA, 21 nt, Human
acguggggugaauggggaggu

SEQ ID NO: 1252554 - RNA, 18 nt, Human
agagagaggccaugggga

SEQ ID NO: 1252555 - RNA, 18 nt, Human
agagaggccauggggagc

SEQ ID NO: 1252556 - RNA, 21 nt, Human
agggccggucacuccagcgug

SEQ ID NO: 1252557 - RNA, 24 nt, Human
caaacccugaagcccccaccggcu

SEQ ID NO: 1252558 - RNA, 27 nt, Human
caccggcugcugcugacccggccacac

SEQ ID NO: 1252559 - RNA, 20 nt, Human
cagcagccgggacugagggc

SEQ ID NO: 1252560 - RNA, 19 nt, Human
cagccgggacugagggcag

SEQ ID NO: 1252561 - RNA, 22 nt, Human
ccaacugaggcugccacagcca

SEQ ID NO: 1252562 - RNA, 21 nt, Human
ccacucguggggucagugcug

SEQ ID NO: 1252563 - RNA, 23 nt, Human
ccagcguggcuucugcucucucc

SEQ ID NO: 1252564 - RNA, 18 nt, Human
ccggcugcugcugacccg

SEQ ID NO: 1252565 - RNA, 21 nt, Human
cgagagggccggucacuccag

SEQ ID NO: 1252566 - RNA, 23 nt, Human
cgagugccgccagcagcagccgg

SEQ ID NO: 1252567 - RNA, 25 nt, Human
cgcuucgcuuccucggaggagccca

SEQ ID NO: 1252568 - RNA, 22 nt, Human
cggcccgagugccgccagcagc

SEQ ID NO: 1252569 - RNA, 24 nt, Human
cggcccgagugccgccagcagcag

SEQ ID NO: 1252570 - RNA, 22 nt, Human
cgguggggaggggcuucuguac

SEQ ID NO: 1252571 - RNA, 19 nt, Human
cucgcagggacccucccca

SEQ ID NO: 1252572 - RNA, 20 nt, Human
cugaagcccccaccggcugc

SEQ ID NO: 1252573 - RNA, 24 nt, Human
cugagggcagcgcuucgcuuccuc

SEQ ID NO: 1252574 - RNA, 18 nt, Human
cugcucucuccagagugg

SEQ ID NO: 1252575 - RNA, 19 nt, Human
gagagggccggucacucca

SEQ ID NO: 1252576 - RNA, 20 nt, Human
gagggccggucacuccagcg

SEQ ID NO: 1252577 - RNA, 23 nt, Human
gagggccggucacuccagcgugg

SEQ ID NO: 1252578 - RNA, 19 nt, Human
ggagcacguggggugaaug

SEQ ID NO: 1252579 - RNA, 27 nt, Human
gggacccuccccacucguggggcacuc

SEQ ID NO: 1252580 - RNA, 21 nt, Human
gggagcacguggggugaaugg

SEQ ID NO: 1252581 - RNA, 21 nt, Human
gggcagcgcuucgcuuccucg

SEQ ID NO: 1252582 - RNA, 23 nt, Human
ucaacaaacccugaagcccccac

SEQ ID NO: 1252583 - RNA, 28 nt, Human
ucaacaaacccugaagcccccaccggcu

SEQ ID NO: 1252584 - RNA, 24 nt, Human
ugccacagccaccgcuauguccac

SEQ ID NO: 1252585 - RNA, 20 nt, Human
ugccagagagaggccauggg

SEQ ID NO: 1252586 - RNA, 22 nt, Human
ugccaucaacaaacccugaagc

SEQ ID NO: 1252587 - RNA, 24 nt, Human
gugcucucgggcugccauaugugu

SEQ ID NO: 1252588 - RNA, 22 nt, Human
gacugagaagccccuguccccu

SEQ ID NO: 1252589 - RNA, 22 nt, Human
ggagagcacuguggcaagacug

SEQ ID NO: 1252590 - RNA, 18 nt, Human
uguggcaagacugagaag

SEQ ID NO: 1252591 - RNA, 19 nt, Human
agaauucuucugcuccaua

SEQ ID NO: 1252592 - RNA, 19 nt, Human
ccaggcaacuaaacugcac

SEQ ID NO: 1252593 - RNA, 18 nt, Human
ccuggaggaaguuccagg

SEQ ID NO: 1252594 - RNA, 23 nt, Human
ugagagcagaauucuucugcucc

SEQ ID NO: 1252595 - RNA, 19 nt, Human
cagcccaguguugccucca

SEQ ID NO: 1252596 - RNA, 22 nt, Human
cccaaauaugguccuccgcgcu

SEQ ID NO: 1252597 - RNA, 20 nt, Human
cuccauggccagaguaaggc

SEQ ID NO: 1252598 - RNA, 24 nt, Human
cuccauggccagaguaaggcccua

SEQ ID NO: 1252599 - RNA, 23 nt, Human
gagcuuugcuccagcccaguguu

SEQ ID NO: 1252600 - RNA, 20 nt, Human
gguuguagacagggauguug

SEQ ID NO: 1252601 - RNA, 21 nt, Human
uccaaggagcugacagccuaa

SEQ ID NO: 1252602 - RNA, 18 nt, Human
uccauggccagaguaagg

SEQ ID NO: 1252603 - RNA, 20 nt, Human
ucggugguugcaccuccaug

SEQ ID NO: 1252604 - RNA, 20 nt, Human
ucggugguugcaccuccaug

SEQ ID NO: 1252605 - RNA, 23 nt, Human
uucggugguugcaccuccauggc

SEQ ID NO: 1252606 - RNA, 22 nt, Human
uugagcuuugcuccagcccagu

SEQ ID NO: 1252607 - RNA, 18 nt, Human
aggguuucuguccagugu

SEQ ID NO: 1252608 - RNA, 24 nt, Human
agagaugucuggggacaccugugc

SEQ ID NO: 1252609 - RNA, 19 nt, Human
cagcagcccucccaggguu

SEQ ID NO: 1252610 - RNA, 19 nt, Human
cagccgcgccgccaccccc

SEQ ID NO: 1252611 - RNA, 23 nt, Human
ccgccuggguucccgggucuccg

SEQ ID NO: 1252612 - RNA, 22 nt, Human
ccggcagccgcgccgccacccc

SEQ ID NO: 1252613 - RNA, 21 nt, Human
ccugugcuggguuggcaggag

SEQ ID NO: 1252614 - RNA, 18 nt, Human
cgcccggccagcgcggga

SEQ ID NO: 1252615 - RNA, 21 nt, Human
cgcuggccucggucuccgcgc

SEQ ID NO: 1252616 - RNA, 24 nt, Human
cucccaggcgcugccuggcugcgg

SEQ ID NO: 1252617 - RNA, 21 nt, Human
cuccgccuggguucccggguc

SEQ ID NO: 1252618 - RNA, 24 nt, Human
cugccuggcugcggaggggagcgg

SEQ ID NO: 1252619 - RNA, 20 nt, Human
cugcgccguccuuuuccgcg

SEQ ID NO: 1252620 - RNA, 19 nt, Human
gaaugggacggagcagccc

SEQ ID NO: 1252621 - RNA, 23 nt, Human
gcagcagcccucccaggguuccu

SEQ ID NO: 1252622 - RNA, 19 nt, Human
ggcagccgcgccgccaccc

SEQ ID NO: 1252623 - RNA, 23 nt, Human
ucccggcagccgcgccgccaccc

SEQ ID NO: 1252624 - RNA, 19 nt, Human
ugcggaggggagcgggcag

SEQ ID NO: 1252625 - RNA, 22 nt, Human
ugcuuggggcacagguguggga

SEQ ID NO: 1252626 - RNA, 24 nt, Human
uggggacaccugugcuggguuggc

SEQ ID NO: 1252627 - RNA, 26 nt, Human
uuggcaggagcagcagcagcccuccc

SEQ ID NO: 1252628 - RNA, 20 nt, Human
ccgugggcuccucuuccccu

SEQ ID NO: 1252629 - RNA, 24 nt, Human
ccuugucaauucucucuuccaccu

SEQ ID NO: 1252630 - RNA, 22 nt, Human
ucccgugggcuccucuuccccu

SEQ ID NO: 1252631 - RNA, 22 nt, Human
ugccuugucaauucucucuucc

SEQ ID NO: 1252632 - RNA, 23 nt, Human
ugccuugucaauucucucuucca

SEQ ID NO: 1252633 - RNA, 23 nt, Human
uugccuugucaauucucucuucc

SEQ ID NO: 1252634 - RNA, 23 nt, Human
aagcguuggccugagaacuggaa

SEQ ID NO: 1252635 - RNA, 18 nt, Human
caagaagccacuuccagc

SEQ ID NO: 1252636 - RNA, 27 nt, Human
ccuccagcgccaacacugacugguccc

SEQ ID NO: 1252637 - RNA, 21 nt, Human
cgccaacacugacuggucccc

SEQ ID NO: 1252638 - RNA, 18 nt, Human
uccagacaguguuccaag

SEQ ID NO: 1252639 - RNA, 21 nt, Human
ucgugggccgccggcagccuc

SEQ ID NO: 1252640 - RNA, 22 nt, Human
aacacagaaccugauuggacaa

SEQ ID NO: 1252641 - RNA, 21 nt, Human
cacagaaccugauuggacaag

SEQ ID NO: 1252642 - RNA, 20 nt, Human
cacgcucugugaacacagaa

SEQ ID NO: 1252643 - RNA, 22 nt, Human
ccucuggacgaagagcugggga

SEQ ID NO: 1252644 - RNA, 21 nt, Human
ggaauguccgggaacucggug

SEQ ID NO: 1252645 - RNA, 24 nt, Human
ggcugggcuuccuacuucccucug

SEQ ID NO: 1252646 - RNA, 18 nt, Human
ucccucuggacgaagagc

SEQ ID NO: 1252647 - RNA, 20 nt, Human
ugaucugcagcacgcucugu

SEQ ID NO: 1252648 - RNA, 19 nt, Human
uggacgaagagcuggggau

SEQ ID NO: 1252649 - RNA, 19 nt, Human
accccgaggacaccgcggg

SEQ ID NO: 1252650 - RNA, 21 nt, Human
auagaaaacaggccacgucca

SEQ ID NO: 1252651 - RNA, 24 nt, Human
cacuaauacaaugcaugcauguag

SEQ ID NO: 1252652 - RNA, 21 nt, Human
cagcucgcaccccgaggacac

SEQ ID NO: 1252653 - RNA, 22 nt, Human
cagggccaaaaccuccuucugg

SEQ ID NO: 1252654 - RNA, 21 nt, Human
ccacguccagagaggcccagg

SEQ ID NO: 1252655 - RNA, 23 nt, Human
ccccgccccgccgccaucuugga

SEQ ID NO: 1252656 - RNA, 25 nt, Human
ccccgccccgccgccaucuuggaag

SEQ ID NO: 1252657 - RNA, 19 nt, Human
cccggccccgccccgccgc

SEQ ID NO: 1252658 - RNA, 19 nt, Human
ccgccaucuuggaaguggg

SEQ ID NO: 1252659 - RNA, 21 nt, Human
ccugccccggccccgccccgc

SEQ ID NO: 1252660 - RNA, 19 nt, Human
cgccccgccgccaucuugg

SEQ ID NO: 1252661 - RNA, 19 nt, Human
cggcuccguccgcccugcc

SEQ ID NO: 1252662 - RNA, 20 nt, Human
cuucuggaaggccgaagucc

SEQ ID NO: 1252663 - RNA, 18 nt, Human
gccaaaaccuccuucugg

SEQ ID NO: 1252664 - RNA, 18 nt, Human
gccccgccgccaucuugg

SEQ ID NO: 1252665 - RNA, 21 nt, Human
ggcggccugagggggcccugc

SEQ ID NO: 1252666 - RNA, 19 nt, Human
guccacgugcagcucgcac

SEQ ID NO: 1252667 - RNA, 18 nt, Human
guucuugggcuuccgucu

SEQ ID NO: 1252668 - RNA, 20 nt, Human
uauugauagaaaacaggcca

SEQ ID NO: 1252669 - RNA, 18 nt, Human
uccuucuggaaggccgaa

SEQ ID NO: 1252670 - RNA, 19 nt, Human
ucgcaccccgaggacaccg

SEQ ID NO: 1252671 - RNA, 19 nt, Human
uggaaggccgaagucccac

SEQ ID NO: 1252672 - RNA, 22 nt, Human
acucccguucugcccucgcugg

SEQ ID NO: 1252673 - RNA, 22 nt, Human
cagaucuccaugcggcuucugg

SEQ ID NO: 1252674 - RNA, 18 nt, Human
cccccgugccagaucucc

SEQ ID NO: 1252675 - RNA, 23 nt, Human
cuggcccccgugccagaucucca

SEQ ID NO: 1252676 - RNA, 19 nt, Human
gaucuccaugcggcuucug

SEQ ID NO: 1252677 - RNA, 25 nt, Human
ucccguucugcccucgcuggccccc

SEQ ID NO: 1252678 - RNA, 23 nt, Human
ucgcuggcccccgugccagaucu

SEQ ID NO: 1252679 - RNA, 25 nt, Human
ucgcuggcccccgugccagaucucc

SEQ ID NO: 1252680 - RNA, 19 nt, Human
ugacucccguucugcccuc

SEQ ID NO: 1252681 - RNA, 23 nt, Human
ugccagaucuccaugcggcuucu

SEQ ID NO: 1252682 - RNA, 19 nt, Human
ugcccguucugauguggga

SEQ ID NO: 1252683 - RNA, 22 nt, Human
uguucccauugcccguucugau

SEQ ID NO: 1252684 - RNA, 22 nt, Human
acccuuuugcugauacuccggg

SEQ ID NO: 1252685 - RNA, 19 nt, Human
acuccgggagcgcccaggg

SEQ ID NO: 1252686 - RNA, 21 nt, Human
agcgcccaggggcggagcuga

SEQ ID NO: 1252687 - RNA, 20 nt, Human
agcugggcacugagagcggg

SEQ ID NO: 1252688 - RNA, 22 nt, Human
aggcacaggaguggggacggca

SEQ ID NO: 1252689 - RNA, 22 nt, Human
cacuguaccauaaucucagagc

SEQ ID NO: 1252690 - RNA, 18 nt, Human
cccccggggagcccgggg

SEQ ID NO: 1252691 - RNA, 23 nt, Human
cccccggggagcccgggggcgga

SEQ ID NO: 1252692 - RNA, 24 nt, Human
ccgggggcggagccgauccuucuu

SEQ ID NO: 1252693 - RNA, 20 nt, Human
ccugggucguaggcacagga

SEQ ID NO: 1252694 - RNA, 19 nt, Human
cgcccaggggcggagcuga

SEQ ID NO: 1252695 - RNA, 22 nt, Human
cggcaaagggugggaaggaccc

SEQ ID NO: 1252696 - RNA, 23 nt, Human
cggggggagccgggcacuguggg

SEQ ID NO: 1252697 - RNA, 23 nt, Human
cgucgaggucugcgcagccucca

SEQ ID NO: 1252698 - RNA, 23 nt, Human
cugugggcggggcgaacccuuuu

SEQ ID NO: 1252699 - RNA, 19 nt, Human
cuuggggauccgacugcuc

SEQ ID NO: 1252700 - RNA, 22 nt, Human
gagcccagcuuugccggaaacg

SEQ ID NO: 1252701 - RNA, 21 nt, Human
gcgcugaaaccccggaggcca

SEQ ID NO: 1252702 - RNA, 23 nt, Human
gcugauacccggggggagcuggg

SEQ ID NO: 1252703 - RNA, 19 nt, Human
ggaaacguguuuuccguga

SEQ ID NO: 1252704 - RNA, 24 nt, Human
ggagccgggcacugugggcggggc

SEQ ID NO: 1252705 - RNA, 22 nt, Human
ggagcugauguuucagcugaua

SEQ ID NO: 1252706 - RNA, 20 nt, Human
gggaaggacccuucuaucaa

SEQ ID NO: 1252707 - RNA, 24 nt, Human
gucagcacuguaccauaaucucag

SEQ ID NO: 1252708 - RNA, 20 nt, Human
uaccauaaucucagagccca

SEQ ID NO: 1252709 - RNA, 22 nt, Human
uacccggggggagccgggcacu

SEQ ID NO: 1252710 - RNA, 22 nt, Human
uacccggggggagcugggcacu

SEQ ID NO: 1252711 - RNA, 18 nt, Human
uacuccgggagcgcccag

SEQ ID NO: 1252712 - RNA, 19 nt, Human
ucagagcccagcuuugccg

SEQ ID NO: 1252713 - RNA, 22 nt, Human
ucagcugauacccggggggagc

SEQ ID NO: 1252714 - RNA, 23 nt, Human
ugagagaacuucaauuucauguu

SEQ ID NO: 1252715 - RNA, 19 nt, Human
ugauacccggggggagccg

SEQ ID NO: 1252716 - RNA, 19 nt, Human
ugauacccggggggagcug

SEQ ID NO: 1252717 - RNA, 19 nt, Human
uggggacggcaaagggugg

SEQ ID NO: 1252718 - RNA, 24 nt, Human
uguaagcgcugaaaccccggaggc

SEQ ID NO: 1252719 - RNA, 25 nt, Human
ugucagcacuguaccauaaucucag

SEQ ID NO: 1252720 - RNA, 18 nt, Human
uuagugagagaacuucaa

SEQ ID NO: 1252721 - RNA, 19 nt, Human
cuuggcccgggccgccggc

SEQ ID NO: 1252722 - RNA, 22 nt, Human
ggcccgggccgccggcaccugg

SEQ ID NO: 1252723 - RNA, 21 nt, Human
uggcuuggcccgggccgccgg

SEQ ID NO: 1252724 - RNA, 23 nt, Human
ugggggugcuucccccagagugu

SEQ ID NO: 1252725 - RNA, 22 nt, Human
ccuucacuccuuuagcagucaa

SEQ ID NO: 1252726 - RNA, 24 nt, Human
ccuucccugaugcauuccuuuuuc

SEQ ID NO: 1252727 - RNA, 25 nt, Human
cuuucaguuuuaucaaaaccauuuc

SEQ ID NO: 1252728 - RNA, 21 nt, Human
gugaagacagucaacucuggu

SEQ ID NO: 1252729 - RNA, 18 nt, Human
uaaaaagagaaccuucac

SEQ ID NO: 1252730 - RNA, 21 nt, Human
uaaaaagagaaccuucacucc

SEQ ID NO: 1252731 - RNA, 20 nt, Human
uccaaacuccagcuuagcuu

SEQ ID NO: 1252732 - RNA, 21 nt, Human
uccaaagagaugguguagagu

SEQ ID NO: 1252733 - RNA, 22 nt, Human
ugaccccuucccugaugcauuc

SEQ ID NO: 1252734 - RNA, 23 nt, Human
ugcuugcuugcuuuuguucuguu

SEQ ID NO: 1252735 - RNA, 18 nt, Human
ugcuuuuguucuguuuga

SEQ ID NO: 1252736 - RNA, 23 nt, Human
ugugaagacagucaacucuggug

SEQ ID NO: 1252737 - RNA, 28 nt, Human
uuagcagucaagugaguuaauuuccuuu

SEQ ID NO: 1252738 - RNA, 20 nt, Human
uuccaaagagaugguguaga

SEQ ID NO: 1252739 - RNA, 21 nt, Human
uugauucuuuguccugcuugc

SEQ ID NO: 1252740 - RNA, 24 nt, Human
uuuguucuguuugaccccuucccu

SEQ ID NO: 1252741 - RNA, 18 nt, Human
aagaaguccccagccccu

SEQ ID NO: 1252742 - RNA, 22 nt, Human
aagccgggggcacccagaagga

SEQ ID NO: 1252743 - RNA, 23 nt, Human
aaggacccgucggacucugccuu

SEQ ID NO: 1252744 - RNA, 21 nt, Human
aaguccccagccccuugccgg

SEQ ID NO: 1252745 - RNA, 23 nt, Human
aggcgcacgugggcaagaagucc

SEQ ID NO: 1252746 - RNA, 21 nt, Human
agggagccugggcucggggcc

SEQ ID NO: 1252747 - RNA, 21 nt, Human
agggggcccggggccuuccca

SEQ ID NO: 1252748 - RNA, 21 nt, Human
ccacacugcacgccugcggug

SEQ ID NO: 1252749 - RNA, 20 nt, Human
ccccuugccggugcugccac

SEQ ID NO: 1252750 - RNA, 23 nt, Human
cccggggccuucccaggccugcu

SEQ ID NO: 1252751 - RNA, 23 nt, Human
ccguggccauuggcgccggugcc

SEQ ID NO: 1252752 - RNA, 24 nt, Human
cgccgcugcuggccggcgccgggg

SEQ ID NO: 1252753 - RNA, 25 nt, Human
cgggaccagcggaggccuccgccag

SEQ ID NO: 1252754 - RNA, 19 nt, Human
cucccgccgccucucagcc

SEQ ID NO: 1252755 - RNA, 19 nt, Human
cucccgccgccucucagcc

SEQ ID NO: 1252756 - RNA, 19 nt, Human
cucucagccuaucugcacc

SEQ ID NO: 1252757 - RNA, 19 nt, Human
cucucagccuaucugcacc

SEQ ID NO: 1252758 - RNA, 20 nt, Human
cugggcgggaccagcggagg

SEQ ID NO: 1252759 - RNA, 23 nt, Human
cugguggcggccaugaucugggc

SEQ ID NO: 1252760 - RNA, 18 nt, Human
cuucccaggccugcugga

SEQ ID NO: 1252761 - RNA, 22 nt, Human
cuucccaggccugcuggagucc

SEQ ID NO: 1252762 - RNA, 21 nt, Human
gagaaauggagacucucuggg

SEQ ID NO: 1252763 - RNA, 23 nt, Human
gagcggucccgugggggcggugu

SEQ ID NO: 1252764 - RNA, 21 nt, Human
gcaucggcuaagggggcccgg

SEQ ID NO: 1252765 - RNA, 23 nt, Human
ggaguccgggaagccgggggcac

SEQ ID NO: 1252766 - RNA, 20 nt, Human
ggccuucccaggccugcugg

SEQ ID NO: 1252767 - RNA, 22 nt, Human
ggcggccaugaucugggcggga

SEQ ID NO: 1252768 - RNA, 19 nt, Human
ggcgggaccagcggaggcc

SEQ ID NO: 1252769 - RNA, 19 nt, Human
ggcucggggccuugggcag

SEQ ID NO: 1252770 - RNA, 19 nt, Human
gggaagccgggggcaccca

SEQ ID NO: 1252771 - RNA, 22 nt, Human
gggagccugggcucggggccuu

SEQ ID NO: 1252772 - RNA, 18 nt, Human
gggcaagaaguccccagc

SEQ ID NO: 1252773 - RNA, 18 nt, Human
gucccgcuauuacggaau

SEQ ID NO: 1252774 - RNA, 19 nt, Human
gugcugccacgugagaagg

SEQ ID NO: 1252775 - RNA, 19 nt, Human
uccccagccccuugccggu

SEQ ID NO: 1252776 - RNA, 21 nt, Human
uccccagccccuugccggugc

SEQ ID NO: 1252777 - RNA, 22 nt, Human
ugaggagggccgacugccagug

SEQ ID NO: 1252778 - RNA, 19 nt, Human
ugaucugggcgggaccagc

SEQ ID NO: 1252779 - RNA, 27 nt, Human
ugccuuggcuugggggaccucgagagc

SEQ ID NO: 1252780 - RNA, 19 nt, Human
ugcggugugaggagggccg

SEQ ID NO: 1252781 - RNA, 18 nt, Human
ugcuggccggcgccgggg

SEQ ID NO: 1252782 - RNA, 22 nt, Human
uggagacucucugggcaucggc

SEQ ID NO: 1252783 - RNA, 25 nt, Human
uggcuugggggaccucgagagcggu

SEQ ID NO: 1252784 - RNA, 22 nt, Human
ugggcaucucucccgccgccuc

SEQ ID NO: 1252785 - RNA, 20 nt, Human
ugggcgggaccagcggaggc

SEQ ID NO: 1252786 - RNA, 21 nt, Human
agaagguagaugauggcaaag

SEQ ID NO: 1252787 - RNA, 21 nt, Human
agaagguagaugauggcaaag

SEQ ID NO: 1252788 - RNA, 23 nt, Human
agaagguagaugauggcaaaggg

SEQ ID NO: 1252789 - RNA, 20 nt, Human
ccucagaacgcaagagugag

SEQ ID NO: 1252790 - RNA, 19 nt, Human
ccucugggcuggggacagg

SEQ ID NO: 1252791 - RNA, 19 nt, Human
gcaucaucugguaucacac

SEQ ID NO: 1252792 - RNA, 19 nt, Human
ggaagagacucagggggcc

SEQ ID NO: 1252793 - RNA, 25 nt, Human
uccucagaacgcaagagugagccaa

SEQ ID NO: 1252794 - RNA, 18 nt, Human
ugggcuggggacaggcuu

SEQ ID NO: 1252795 - RNA, 25 nt, Human
aaaacuuacuuuagugguuuccagg

SEQ ID NO: 1252796 - RNA, 22 nt, Human
aaaagaaaaaagugcuugaaaa

SEQ ID NO: 1252797 - RNA, 22 nt, Human
aaaguuguauuccuuggcaugg

SEQ ID NO: 1252798 - RNA, 23 nt, Human
aagcaaaaggaagaaaaacuuaa

SEQ ID NO: 1252799 - RNA, 24 nt, Human
acaaagaccuccucgguccacgcu

SEQ ID NO: 1252800 - RNA, 25 nt, Human
acaacgcaauucaacccaccacaac

SEQ ID NO: 1252801 - RNA, 20 nt, Human
acuuagguuuggcuaaguuc

SEQ ID NO: 1252802 - RNA, 25 nt, Human
acuuuagugguuuccagggaaaagu

SEQ ID NO: 1252803 - RNA, 19 nt, Human
agaccuccucgguccacgc

SEQ ID NO: 1252804 - RNA, 22 nt, Human
agaggaaagaagggaaggaagg

SEQ ID NO: 1252805 - RNA, 21 nt, Human
agcgcaaccauggaucacgaa

SEQ ID NO: 1252806 - RNA, 19 nt, Human
aggaagaaaaacuuaaagg

SEQ ID NO: 1252807 - RNA, 28 nt, Human
aggaagaaaaacuuaaagguaaaaaaga

SEQ ID NO: 1252808 - RNA, 27 nt, Human
aggaaggaaacgugucuuggaagagga

SEQ ID NO: 1252809 - RNA, 18 nt, Human
aggccucuagacacuggc

SEQ ID NO: 1252810 - RNA, 19 nt, Human
aggccucuagacacuggcu

SEQ ID NO: 1252811 - RNA, 20 nt, Human
cacaaagaccuccucggucc

SEQ ID NO: 1252812 - RNA, 21 nt, Human
cacaaagaccuccucggucca

SEQ ID NO: 1252813 - RNA, 19 nt, Human
cagggcgggggacgggugg

SEQ ID NO: 1252814 - RNA, 18 nt, Human
caugacucuuacuuaggu

SEQ ID NO: 1252815 - RNA, 20 nt, Human
cauggaucacgaaaugccuc

SEQ ID NO: 1252816 - RNA, 23 nt, Human
cauggaucacgaaaugccucuaa

SEQ ID NO: 1252817 - RNA, 22 nt, Human
cccauccaccuuggccuggaag

SEQ ID NO: 1252818 - RNA, 24 nt, Human
cccugcaucuucaugccuuuccca

SEQ ID NO: 1252819 - RNA, 19 nt, Human
ccgcgcucgccgccgccgc

SEQ ID NO: 1252820 - RNA, 22 nt, Human
ccucucuccuagacucccugca

SEQ ID NO: 1252821 - RNA, 20 nt, Human
cgcucgccgccgccgcuucg

SEQ ID NO: 1252822 - RNA, 21 nt, Human
cuaaaucaaccugagccgcgc

SEQ ID NO: 1252823 - RNA, 18 nt, Human
cuugagaggagaaacccc

SEQ ID NO: 1252824 - RNA, 23 nt, Human
cuuucccaagcccuucaugucug

SEQ ID NO: 1252825 - RNA, 22 nt, Human
gagcgcaaccauggaucacgaa

SEQ ID NO: 1252826 - RNA, 22 nt, Human
gaggagaaacccccguguagca

SEQ ID NO: 1252827 - RNA, 22 nt, Human
gcaggaagcaugucugccuaca

SEQ ID NO: 1252828 - RNA, 24 nt, Human
ggcauggggcccauccaccuuggc

SEQ ID NO: 1252829 - RNA, 22 nt, Human
ggcccauccaccuuggccugga

SEQ ID NO: 1252830 - RNA, 18 nt, Human
gguguuauccggucccug

SEQ ID NO: 1252831 - RNA, 18 nt, Human
uaaaagacuuucuuuagg

SEQ ID NO: 1252832 - RNA, 27 nt, Human
uaggaaaagcaaaacuuacuuuagugg

SEQ ID NO: 1252833 - RNA, 22 nt, Human
ucagcgguuccuucaggccucu

SEQ ID NO: 1252834 - RNA, 23 nt, Human
ucaguauauuaaagcaaaaggaa

SEQ ID NO: 1252835 - RNA, 23 nt, Human
ucccucuuucugguguuauccgg

SEQ ID NO: 1252836 - RNA, 24 nt, Human
uccuucaggccucuagacacuggc

SEQ ID NO: 1252837 - RNA, 24 nt, Human
uccuuggcauggggcccauccacc

SEQ ID NO: 1252838 - RNA, 19 nt, Human
uggaagaggagaucuccuc

SEQ ID NO: 1252839 - RNA, 20 nt, Human
uggaagaggagaucuccucu

SEQ ID NO: 1252840 - RNA, 23 nt, Human
uggaagaggagaucuccucuggu

SEQ ID NO: 1252841 - RNA, 20 nt, Human
uggcauggggcccauccacc

SEQ ID NO: 1252842 - RNA, 25 nt, Human
uggcauggggcccauccaccuuggc

SEQ ID NO: 1252843 - RNA, 18 nt, Human
uguccagagcugagcaca

SEQ ID NO: 1252844 - RNA, 23 nt, Human
uuaaagcaaaaggaagaaaaacu

SEQ ID NO: 1252845 - RNA, 27 nt, Human
uucuaaaucaaccugagccgcgcucgc

SEQ ID NO: 1252846 - RNA, 25 nt, Human
uugaaaauaauucucagggacuuau

SEQ ID NO: 1252847 - RNA, 18 nt, Human
aaaaauagcaaaacacac

SEQ ID NO: 1252848 - RNA, 22 nt, Human
aaaagagaagauacauaagaaa

SEQ ID NO: 1252849 - RNA, 19 nt, Human
aaaaggaaacaaucauaaa

SEQ ID NO: 1252850 - RNA, 24 nt, Human
aaacauugaauuccuaauauaaaa

SEQ ID NO: 1252851 - RNA, 24 nt, Human
aaagacuuuaauauaccuuuuuca

SEQ ID NO: 1252852 - RNA, 23 nt, Human
aaagauauucaacagaaauaaag

SEQ ID NO: 1252853 - RNA, 22 nt, Human
aaaguuacuuugaaaagacuga

SEQ ID NO: 1252854 - RNA, 26 nt, Human
aaaugcaguguauagauaacuuugaa

SEQ ID NO: 1252855 - RNA, 22 nt, Human
aagaaaaaauauaaugugaaga

SEQ ID NO: 1252856 - RNA, 20 nt, Human
aagcugcaaaucuauagcaa

SEQ ID NO: 1252857 - RNA, 19 nt, Human
aaguagcuaggcucuuuug

SEQ ID NO: 1252858 - RNA, 21 nt, Human
aaugaaaucagcaaaagccaa

SEQ ID NO: 1252859 - RNA, 24 nt, Human
aauuccagcaacagccccucgcug

SEQ ID NO: 1252860 - RNA, 25 nt, Human
acagugacccuaacaucuacuuccu

SEQ ID NO: 1252861 - RNA, 25 nt, Human
acugagagaaauuaaagauauucaa

SEQ ID NO: 1252862 - RNA, 24 nt, Human
acugcugcacuccagccuggguga

SEQ ID NO: 1252863 - RNA, 21 nt, Human
agaaaaggaaacaaucauaaa

SEQ ID NO: 1252864 - RNA, 22 nt, Human
agaauagagagcucguaaagag

SEQ ID NO: 1252865 - RNA, 24 nt, Human
agaauagagagcucguaaagagaa

SEQ ID NO: 1252866 - RNA, 18 nt, Human
agacucaaaaaguaacga

SEQ ID NO: 1252867 - RNA, 21 nt, Human
agcaaaguggaccugcucucc

SEQ ID NO: 1252868 - RNA, 18 nt, Human
agcauaauuugucugcau

SEQ ID NO: 1252869 - RNA, 18 nt, Human
agcucguaaagagaacca

SEQ ID NO: 1252870 - RNA, 21 nt, Human
aggaacacuugagcccgagaa

SEQ ID NO: 1252871 - RNA, 19 nt, Human
aggcaaauuccagcaacag

SEQ ID NO: 1252872 - RNA, 20 nt, Human
aggcccaaaacaagaaucaa

SEQ ID NO: 1252873 - RNA, 21 nt, Human
aggcgggguccuggccugcuc

SEQ ID NO: 1252874 - RNA, 24 nt, Human
agguacaguggcucacgccauuaa

SEQ ID NO: 1252875 - RNA, 23 nt, Human
aguccuagcuacuccuaaguagc

SEQ ID NO: 1252876 - RNA, 20 nt, Human
agugagcucugagcaacugc

SEQ ID NO: 1252877 - RNA, 24 nt, Human
aguggcucacgccauuaaucccag

SEQ ID NO: 1252878 - RNA, 18 nt, Human
aguuuuuauaaauguaua

SEQ ID NO: 1252879 - RNA, 19 nt, Human
augaaacagaauagagagc

SEQ ID NO: 1252880 - RNA, 24 nt, Human
augaauauuaacauccaaccucac

SEQ ID NO: 1252881 - RNA, 19 nt, Human
caaaaauagcaaaacacac

SEQ ID NO: 1252882 - RNA, 18 nt, Human
caaccaugccaccacccc

SEQ ID NO: 1252883 - RNA, 19 nt, Human
caacugaaaaacugacuau

SEQ ID NO: 1252884 - RNA, 24 nt, Human
caacugcugcacuccagccugggu

SEQ ID NO: 1252885 - RNA, 19 nt, Human
caagaagccucuguauggc

SEQ ID NO: 1252886 - RNA, 24 nt, Human
caagcaacagaaugggaaaugaaa

SEQ ID NO: 1252887 - RNA, 24 nt, Human
caccaacagugacccuaacaucua

SEQ ID NO: 1252888 - RNA, 23 nt, Human
cacccaaaaauagcaaaacacac

SEQ ID NO: 1252889 - RNA, 24 nt, Human
cacgccauuaaucccagcacuuug

SEQ ID NO: 1252890 - RNA, 22 nt, Human
cacuccagccugggugacagag

SEQ ID NO: 1252891 - RNA, 22 nt, Human
cacuccagccugggugacagag

SEQ ID NO: 1252892 - RNA, 22 nt, Human
cagcaauggccagccagacucc

SEQ ID NO: 1252893 - RNA, 23 nt, Human
cagccaccaacagugacccuaac

SEQ ID NO: 1252894 - RNA, 22 nt, Human
cagccgacccccaccaccccgg

SEQ ID NO: 1252895 - RNA, 24 nt, Human
cagcgucuuuacugcccuccagga

SEQ ID NO: 1252896 - RNA, 18 nt, Human
caggagcucgggcucugu

SEQ ID NO: 1252897 - RNA, 21 nt, Human
caguguauagauaacuuugaa

SEQ ID NO: 1252898 - RNA, 23 nt, Human
cauaaaauaaaugaaaucagcaa

SEQ ID NO: 1252899 - RNA, 22 nt, Human
caugguggccguggccuguagu

SEQ ID NO: 1252900 - RNA, 18 nt, Human
ccaaaaauagcaaaacac

SEQ ID NO: 1252901 - RNA, 22 nt, Human
ccaaaaauagcaaaacacacaa

SEQ ID NO: 1252902 - RNA, 23 nt, Human
ccaaaacaagaaucaauaaauac

SEQ ID NO: 1252903 - RNA, 23 nt, Human
ccagagccugucaggcggggucc

SEQ ID NO: 1252904 - RNA, 23 nt, Human
cccaaaaauagcaaaacacacaa

SEQ ID NO: 1252905 - RNA, 26 nt, Human
ccccaccaccccguagcagcucacgg

SEQ ID NO: 1252906 - RNA, 23 nt, Human
cccccaccaccccguagcagcuc

SEQ ID NO: 1252907 - RNA, 18 nt, Human
cccgaggcugcagugccu

SEQ ID NO: 1252908 - RNA, 23 nt, Human
cccgcaaccaugccaccaccccu

SEQ ID NO: 1252909 - RNA, 26 nt, Human
cccgcaaccaugccaccaccccuuac

SEQ ID NO: 1252910 - RNA, 19 nt, Human
cccguagcagcucacgggc

SEQ ID NO: 1252911 - RNA, 22 nt, Human
ccgcaaccaugccaccaccccu

SEQ ID NO: 1252912 - RNA, 23 nt, Human
ccgcuggugcagcucuuccccaa

SEQ ID NO: 1252913 - RNA, 23 nt, Human
ccucugccucuacaaaaaauuua

SEQ ID NO: 1252914 - RNA, 18 nt, Human
ccugcagcuuugaggcca

SEQ ID NO: 1252915 - RNA, 20 nt, Human
ccuguaguccuagcuacucc

SEQ ID NO: 1252916 - RNA, 18 nt, Human
cguaaagagaaccacaca

SEQ ID NO: 1252917 - RNA, 22 nt, Human
cucacgccauuaaucccagcac

SEQ ID NO: 1252918 - RNA, 24 nt, Human
cucacgccauuaaucccagcacuu

SEQ ID NO: 1252919 - RNA, 20 nt, Human
cucgggcucuguguggccag

SEQ ID NO: 1252920 - RNA, 18 nt, Human
cugaaaaacugacuauaa

SEQ ID NO: 1252921 - RNA, 19 nt, Human
cugauaaaaauauaccaug

SEQ ID NO: 1252922 - RNA, 18 nt, Human
cugcacuccagccugggu

SEQ ID NO: 1252923 - RNA, 20 nt, Human
cugcacuccagccuggguga

SEQ ID NO: 1252924 - RNA, 21 nt, Human
cugcacuccagccugggugac

SEQ ID NO: 1252925 - RNA, 22 nt, Human
cugcacuccagccugggugaca

SEQ ID NO: 1252926 - RNA, 22 nt, Human
cugcacuccagccugggugaca

SEQ ID NO: 1252927 - RNA, 23 nt, Human
cugcacuccagccugggugacag

SEQ ID NO: 1252928 - RNA, 25 nt, Human
cugcacuccagccugggugacagag

SEQ ID NO: 1252929 - RNA, 21 nt, Human
cugcugcacuccagccugggu

SEQ ID NO: 1252930 - RNA, 24 nt, Human
cugcugcacuccagccugggugac

SEQ ID NO: 1252931 - RNA, 20 nt, Human
cuugaaaauuaauaaucuaa

SEQ ID NO: 1252932 - RNA, 24 nt, Human
gacuguggcagcacuggggcagcc

SEQ ID NO: 1252933 - RNA, 20 nt, Human
gagagaaauuaaagauauuc

SEQ ID NO: 1252934 - RNA, 24 nt, Human
gagcaacugcugcacuccagccug

SEQ ID NO: 1252935 - RNA, 19 nt, Human
gaggaaaagauucauuuuc

SEQ ID NO: 1252936 - RNA, 23 nt, Human
gagucagaaccaucuccaaaaaa

SEQ ID NO: 1252937 - RNA, 22 nt, Human
gagugaaaaggcaagcaacaga

SEQ ID NO: 1252938 - RNA, 24 nt, Human
gcacuccagccugggugacagagu

SEQ ID NO: 1252939 - RNA, 19 nt, Human
gcagcacuggggcagccac

SEQ ID NO: 1252940 - RNA, 21 nt, Human
gcaggagcucgggcucugugu

SEQ ID NO: 1252941 - RNA, 19 nt, Human
gcaucucccacaaggucau

SEQ ID NO: 1252942 - RNA, 21 nt, Human
gcucaacacccucacguccaa

SEQ ID NO: 1252943 - RNA, 24 nt, Human
gcugcacuccagccugggugacag

SEQ ID NO: 1252944 - RNA, 23 nt, Human
ggaaaagauucauuuucaauaaa

SEQ ID NO: 1252945 - RNA, 21 nt, Human
ggccagguacaguggcucacg

SEQ ID NO: 1252946 - RNA, 19 nt, Human
ggccuguaguccuagcuac

SEQ ID NO: 1252947 - RNA, 22 nt, Human
guagcagcucacgggcauggaa

SEQ ID NO: 1252948 - RNA, 24 nt, Human
gucagaaccaucuccaaaaaaaau

SEQ ID NO: 1252949 - RNA, 24 nt, Human
gucugggaggucaaggaugcagug

SEQ ID NO: 1252950 - RNA, 24 nt, Human
guggaccugcucucccugaaggug

SEQ ID NO: 1252951 - RNA, 27 nt, Human
uaaaauaaaugaaaucagcaaaagcca

SEQ ID NO: 1252952 - RNA, 22 nt, Human
uaaaauaacucacugagaguga

SEQ ID NO: 1252953 - RNA, 24 nt, Human
uaacugauagcaaaaaggauacaa

SEQ ID NO: 1252954 - RNA, 19 nt, Human
uaacuuuaagucaaaaauu

SEQ ID NO: 1252955 - RNA, 26 nt, Human
uacacaaaaauuauuucauauagaag

SEQ ID NO: 1252956 - RNA, 23 nt, Human
uacagugaauauuaaaauauauu

SEQ ID NO: 1252957 - RNA, 25 nt, Human
uacagugaauauuaaaauauauuuu

SEQ ID NO: 1252958 - RNA, 21 nt, Human
uacugcccuccaggacucagc

SEQ ID NO: 1252959 - RNA, 21 nt, Human
uacugcuuguuaaaagauggg

SEQ ID NO: 1252960 - RNA, 21 nt, Human
uacuuugaaaagacugauaaa

SEQ ID NO: 1252961 - RNA, 21 nt, Human
uagaaaaauuuaaagcaguag

SEQ ID NO: 1252962 - RNA, 22 nt, Human
uagauagauagauagauagaua

SEQ ID NO: 1252963 - RNA, 22 nt, Human
uagauagauagauagauagaua

SEQ ID NO: 1252964 - RNA, 22 nt, Human
uagauagauagauagauagaua

SEQ ID NO: 1252965 - RNA, 22 nt, Human
uagauagauagauagauagaua

SEQ ID NO: 1252966 - RNA, 22 nt, Human
uagauagauagauagauagaua

SEQ ID NO: 1252967 - RNA, 22 nt, Human
uagauagauagauagauagaua

SEQ ID NO: 1252968 - RNA, 22 nt, Human
uagauagauagauagauagaua

SEQ ID NO: 1252969 - RNA, 24 nt, Human
uagauagauagauagauagguuag

SEQ ID NO: 1252970 - RNA, 20 nt, Human
uagcaggcauguggaacccg

SEQ ID NO: 1252971 - RNA, 21 nt, Human
uauaaaauguaacauaucaua

SEQ ID NO: 1252972 - RNA, 19 nt, Human
uauagaagccaauguguac

SEQ ID NO: 1252973 - RNA, 22 nt, Human
uauggcaucucccacaagguca

SEQ ID NO: 1252974 - RNA, 21 nt, Human
ucaaaaaguaacgauugaagg

SEQ ID NO: 1252975 - RNA, 22 nt, Human
ucaggcgggguccuggccugcu

SEQ ID NO: 1252976 - RNA, 19 nt, Human
ucauggagaagaagaaccc

SEQ ID NO: 1252977 - RNA, 18 nt, Human
uccaaaaaaaauugaugu

SEQ ID NO: 1252978 - RNA, 18 nt, Human
uccaaagaauuagaaaag

SEQ ID NO: 1252979 - RNA, 24 nt, Human
uccagccugggugacagagucaga

SEQ ID NO: 1252980 - RNA, 18 nt, Human
ucccgaggcugcagugcc

SEQ ID NO: 1252981 - RNA, 21 nt, Human
uccuagcaggcauguggaacc

SEQ ID NO: 1252982 - RNA, 21 nt, Human
ucuccaaaaaaaauugaugua

SEQ ID NO: 1252983 - RNA, 21 nt, Human
ugaaaaaaaaaauauggccag

SEQ ID NO: 1252984 - RNA, 23 nt, Human
ugaaaaaaaaaauauggccaggu

SEQ ID NO: 1252985 - RNA, 27 nt, Human
ugaaauagauacauuucuagaaaauca

SEQ ID NO: 1252986 - RNA, 19 nt, Human
ugacagagucagaaccauc

SEQ ID NO: 1252987 - RNA, 24 nt, Human
ugagaaaaggaaacaaucauaaaa

SEQ ID NO: 1252988 - RNA, 21 nt, Human
ugagcaacugcugcacuccag

SEQ ID NO: 1252989 - RNA, 27 nt, Human
ugagguuaggcccaaaacaagaaucuu

SEQ ID NO: 1252990 - RNA, 18 nt, Human
ugauagcaaaaaggauac

SEQ ID NO: 1252991 - RNA, 22 nt, Human
uggaaaaggugcaaguauagau

SEQ ID NO: 1252992 - RNA, 18 nt, Human
uggaacccgagaacagcu

SEQ ID NO: 1252993 - RNA, 20 nt, Human
uggaacccgagaacagcucg

SEQ ID NO: 1252994 - RNA, 24 nt, Human
uggagacagaggccaaagaugcug

SEQ ID NO: 1252995 - RNA, 22 nt, Human
uggcucacgccauuaaucccag

SEQ ID NO: 1252996 - RNA, 24 nt, Human
uggcucacgccauuaaucccagca

SEQ ID NO: 1252997 - RNA, 22 nt, Human
ugguggccguggccuguagucc

SEQ ID NO: 1252998 - RNA, 21 nt, Human
ugugcugucuuucauacaucg

SEQ ID NO: 1252999 - RNA, 19 nt, Human
uguguggccaggcaaggag

SEQ ID NO: 1253000 - RNA, 24 nt, Human
uguuuagaaauuaagcaucacauu

SEQ ID NO: 1253001 - RNA, 18 nt, Human
uuaaagcuugaaaauuaa

SEQ ID NO: 1253002 - RNA, 26 nt, Human
uuaaauacuuugauauaaaaacugca

SEQ ID NO: 1253003 - RNA, 19 nt, Human
uuagccaggcaugguggcc

SEQ ID NO: 1253004 - RNA, 22 nt, Human
uuaggcaaaccucagcuuggag

SEQ ID NO: 1253005 - RNA, 24 nt, Human
uuccaggaagaaacauugaauucc

SEQ ID NO: 1253006 - RNA, 19 nt, Human
uucuaagaagugagagugg

SEQ ID NO: 1253007 - RNA, 24 nt, Human
uugaauuccuaauauaaaauguaa

SEQ ID NO: 1253008 - RNA, 23 nt, Human
uuuguaaucauaaaauaacucac

SEQ ID NO: 1253009 - RNA, 24 nt, Human
uuuguaaucauaaaauaacucacu

SEQ ID NO: 1253010 - RNA, 23 nt, Human
aagcaggagcuggacccgcagag

SEQ ID NO: 1253011 - RNA, 19 nt, Human
aaguagcuaggcucuuuug

SEQ ID NO: 1253012 - RNA, 24 nt, Human
aauuccagcaacagccccucgcug

SEQ ID NO: 1253013 - RNA, 25 nt, Human
acagugacccuaacaucuacuuccu

SEQ ID NO: 1253014 - RNA, 23 nt, Human
acccucccucgggggaccugcua

SEQ ID NO: 1253015 - RNA, 19 nt, Human
agacagaggccaaagaugc

SEQ ID NO: 1253016 - RNA, 21 nt, Human
aggaacacuugagcccgagaa

SEQ ID NO: 1253017 - RNA, 19 nt, Human
aggcaaauuccagcaacag

SEQ ID NO: 1253018 - RNA, 20 nt, Human
aggcgggguccuggccugcu

SEQ ID NO: 1253019 - RNA, 21 nt, Human
aggcgggguccuggccugcuc

SEQ ID NO: 1253020 - RNA, 20 nt, Human
aggcugagguuagggauuug

SEQ ID NO: 1253021 - RNA, 24 nt, Human
agguacaguggcucacgccauuaa

SEQ ID NO: 1253022 - RNA, 23 nt, Human
aguccuagcuacuccuaaguagc

SEQ ID NO: 1253023 - RNA, 20 nt, Human
agugagcucugagcaacugc

SEQ ID NO: 1253024 - RNA, 24 nt, Human
aguggcucacgccauuaaucccag

SEQ ID NO: 1253025 - RNA, 18 nt, Human
caaccaugccaccacccc

SEQ ID NO: 1253026 - RNA, 24 nt, Human
caacugcugcacuccagccugggu

SEQ ID NO: 1253027 - RNA, 20 nt, Human
caacuucacggaggucuacu

SEQ ID NO: 1253028 - RNA, 19 nt, Human
caagaagccucuguauggc

SEQ ID NO: 1253029 - RNA, 24 nt, Human
caagcaacagaaugggaaaugaaa

SEQ ID NO: 1253030 - RNA, 24 nt, Human
caccaacagugacccuaacaucua

SEQ ID NO: 1253031 - RNA, 24 nt, Human
cacgccauuaaucccagcacuuug

SEQ ID NO: 1253032 - RNA, 22 nt, Human
cacuccagccugggugacagag

SEQ ID NO: 1253033 - RNA, 22 nt, Human
cagcaaaguggaccugcucucc

SEQ ID NO: 1253034 - RNA, 22 nt, Human
cagcaauggccagccagacucc

SEQ ID NO: 1253035 - RNA, 23 nt, Human
cagccaccaacagugacccuaac

SEQ ID NO: 1253036 - RNA, 21 nt, Human
cagccgacccccaccaccccg

SEQ ID NO: 1253037 - RNA, 24 nt, Human
cagcgucuuuacugcccuccagga

SEQ ID NO: 1253038 - RNA, 18 nt, Human
caggagcucgggcucugu

SEQ ID NO: 1253039 - RNA, 20 nt, Human
caggagcuggacccgcagag

SEQ ID NO: 1253040 - RNA, 22 nt, Human
caugguggccguggccuguagu

SEQ ID NO: 1253041 - RNA, 23 nt, Human
ccagagccugucaggcggggucc

SEQ ID NO: 1253042 - RNA, 22 nt, Human
cccacaugcaggaggaggaggc

SEQ ID NO: 1253043 - RNA, 26 nt, Human
ccccaccaccccguagcagcucacgg

SEQ ID NO: 1253044 - RNA, 23 nt, Human
cccccaccaccccguagcagcuc

SEQ ID NO: 1253045 - RNA, 22 nt, Human
ccccgcaaccaugccaccaccc

SEQ ID NO: 1253046 - RNA, 23 nt, Human
cccgcaaccaugccaccaccccu

SEQ ID NO: 1253047 - RNA, 26 nt, Human
cccgcaaccaugccaccaccccuuac

SEQ ID NO: 1253048 - RNA, 22 nt, Human
cccgcagaggcugcagaucauc

SEQ ID NO: 1253049 - RNA, 19 nt, Human
cccguagcagcucacgggc

SEQ ID NO: 1253050 - RNA, 22 nt, Human
ccgcaaccaugccaccaccccu

SEQ ID NO: 1253051 - RNA, 23 nt, Human
ccgcuggugcagcucuuccccaa

SEQ ID NO: 1253052 - RNA, 23 nt, Human
ccucugccucuacaaaaaauuua

SEQ ID NO: 1253053 - RNA, 18 nt, Human
ccugcagcuuugaggcca

SEQ ID NO: 1253054 - RNA, 20 nt, Human
ccuguaguccuagcuacucc

SEQ ID NO: 1253055 - RNA, 23 nt, Human
cguccaacaggucccagcuacac

SEQ ID NO: 1253056 - RNA, 22 nt, Human
cuaccgcaagcugggcgagcag

SEQ ID NO: 1253057 - RNA, 22 nt, Human
cucacgccauuaaucccagcac

SEQ ID NO: 1253058 - RNA, 24 nt, Human
cucacgccauuaaucccagcacuu

SEQ ID NO: 1253059 - RNA, 20 nt, Human
cuccaaaaaaaauugaugua

SEQ ID NO: 1253060 - RNA, 20 nt, Human
cucccgaggcugcagugccu

SEQ ID NO: 1253061 - RNA, 20 nt, Human
cucgggcucuguguggccag

SEQ ID NO: 1253062 - RNA, 18 nt, Human
cugcacuccagccugggu

SEQ ID NO: 1253063 - RNA, 20 nt, Human
cugcacuccagccuggguga

SEQ ID NO: 1253064 - RNA, 21 nt, Human
cugcacuccagccugggugac

SEQ ID NO: 1253065 - RNA, 23 nt, Human
cugcacuccagccugggugacag

SEQ ID NO: 1253066 - RNA, 25 nt, Human
cugcacuccagccugggugacagag

SEQ ID NO: 1253067 - RNA, 20 nt, Human
cugcugcacuccagccuggg

SEQ ID NO: 1253068 - RNA, 21 nt, Human
cugcugcacuccagccugggu

SEQ ID NO: 1253069 - RNA, 24 nt, Human
cugcugcacuccagccugggugac

SEQ ID NO: 1253070 - RNA, 18 nt, Human
cuguauggcaucucccac

SEQ ID NO: 1253071 - RNA, 21 nt, Human
cuucccccacaugcaggagga

SEQ ID NO: 1253072 - RNA, 25 nt, Human
gacccccaccaccccguagcagcuc

SEQ ID NO: 1253073 - RNA, 18 nt, Human
gacggcggcaagcaggag

SEQ ID NO: 1253074 - RNA, 24 nt, Human
gacuguggcagcacuggggcagcc

SEQ ID NO: 1253075 - RNA, 24 nt, Human
gagcaacugcugcacuccagccug

SEQ ID NO: 1253076 - RNA, 19 nt, Human
gaggaggaggccuggcggc

SEQ ID NO: 1253077 - RNA, 20 nt, Human
gaggaggaggccuggcggca

SEQ ID NO: 1253078 - RNA, 23 nt, Human
gagucagaaccaucuccaaaaaa

SEQ ID NO: 1253079 - RNA, 22 nt, Human
gagugaaaaggcaagcaacaga

SEQ ID NO: 1253080 - RNA, 20 nt, Human
gcaacuucacggaggucuac

SEQ ID NO: 1253081 - RNA, 23 nt, Human
gcacuccagccugggugacagag

SEQ ID NO: 1253082 - RNA, 24 nt, Human
gcacuccagccugggugacagagu

SEQ ID NO: 1253083 - RNA, 19 nt, Human
gcagcacuggggcagccac

SEQ ID NO: 1253084 - RNA, 21 nt, Human
gcaggagcucgggcucugugu

SEQ ID NO: 1253085 - RNA, 19 nt, Human
gcaucucccacaaggucau

SEQ ID NO: 1253086 - RNA, 21 nt, Human
gccaccaacagugacccuaac

SEQ ID NO: 1253087 - RNA, 18 nt, Human
gccuguaguccuagcuac

SEQ ID NO: 1253088 - RNA, 21 nt, Human
gcucaacacccucacguccaa

SEQ ID NO: 1253089 - RNA, 24 nt, Human
gcugcacuccagccugggugacag

SEQ ID NO: 1253090 - RNA, 19 nt, Human
ggaggucaaggaugcagug

SEQ ID NO: 1253091 - RNA, 19 nt, Human
ggcaucucccacaagguca

SEQ ID NO: 1253092 - RNA, 21 nt, Human
ggccagguacaguggcucacg

SEQ ID NO: 1253093 - RNA, 21 nt, Human
guagcagcucacgggcaugga

SEQ ID NO: 1253094 - RNA, 24 nt, Human
gucagaaccaucuccaaaaaaaau

SEQ ID NO: 1253095 - RNA, 24 nt, Human
guggaccugcucucccugaaggug

SEQ ID NO: 1253096 - RNA, 22 nt, Human
uaaaauaacucacugagaguga

SEQ ID NO: 1253097 - RNA, 22 nt, Human
uacaagaagccucuguauggca

SEQ ID NO: 1253098 - RNA, 21 nt, Human
uacugcccuccaggacucagc

SEQ ID NO: 1253099 - RNA, 22 nt, Human
uagauagauagauagauagaua

SEQ ID NO: 1253100 - RNA, 22 nt, Human
uagauagauagauagauagaua

SEQ ID NO: 1253101 - RNA, 22 nt, Human
uagauagauagauagauagaua

SEQ ID NO: 1253102 - RNA, 22 nt, Human
uagauagauagauagauagaua

SEQ ID NO: 1253103 - RNA, 22 nt, Human
uagauagauagauagauagaua

SEQ ID NO: 1253104 - RNA, 22 nt, Human
uagauagauagauagauagaua

SEQ ID NO: 1253105 - RNA, 22 nt, Human
uagauagauagauagauagaua

SEQ ID NO: 1253106 - RNA, 24 nt, Human
uagauagauagauagauagguuag

SEQ ID NO: 1253107 - RNA, 20 nt, Human
uagcaggcauguggaacccg

SEQ ID NO: 1253108 - RNA, 24 nt, Human
ucacuuaguuccugcaugaagccu

SEQ ID NO: 1253109 - RNA, 19 nt, Human
ucauggagaagaagaaccc

SEQ ID NO: 1253110 - RNA, 18 nt, Human
uccaaaaaaaauugaugu

SEQ ID NO: 1253111 - RNA, 18 nt, Human
uccacuggcucuucccug

SEQ ID NO: 1253112 - RNA, 24 nt, Human
uccagccugggugacagagucaga

SEQ ID NO: 1253113 - RNA, 25 nt, Human
ucccccacaugcaggaggaggaggc

SEQ ID NO: 1253114 - RNA, 18 nt, Human
ucccgaggcugcagugcc

SEQ ID NO: 1253115 - RNA, 22 nt, Human
uccgugaauuccaggacuucug

SEQ ID NO: 1253116 - RNA, 21 nt, Human
uccuagcaggcauguggaacc

SEQ ID NO: 1253117 - RNA, 21 nt, Human
ugaaaaaaaaaauauggccag

SEQ ID NO: 1253118 - RNA, 23 nt, Human
ugaaaaaaaaaauauggccaggu

SEQ ID NO: 1253119 - RNA, 19 nt, Human
ugacagagucagaaccauc

SEQ ID NO: 1253120 - RNA, 21 nt, Human
ugagcaacugcugcacuccag

SEQ ID NO: 1253121 - RNA, 21 nt, Human
ugccugcagcuuugaggccaa

SEQ ID NO: 1253122 - RNA, 23 nt, Human
ugcugcacuccagccugggugac

SEQ ID NO: 1253123 - RNA, 24 nt, Human
ugcugcacuccagccugggugaca

SEQ ID NO: 1253124 - RNA, 25 nt, Human
ugcugcacuccagccugggugacag

SEQ ID NO: 1253125 - RNA, 20 nt, Human
uggaacccgagaacagcucg

SEQ ID NO: 1253126 - RNA, 22 nt, Human
uggcucacgccauuaaucccag

SEQ ID NO: 1253127 - RNA, 24 nt, Human
uggcucacgccauuaaucccagca

SEQ ID NO: 1253128 - RNA, 22 nt, Human
ugguggccguggccuguagucc

SEQ ID NO: 1253129 - RNA, 19 nt, Human
uguguggccaggcaaggag

SEQ ID NO: 1253130 - RNA, 22 nt, Human
uucacggaggucuacuuccccc

SEQ ID NO: 1253131 - RNA, 25 nt, Human
uucccugagcucuuccacuaccgca

SEQ ID NO: 1253132 - RNA, 19 nt, Human
uucuaagaagugagagugg

SEQ ID NO: 1253133 - RNA, 23 nt, Human
uuuguaaucauaaaauaacucac

SEQ ID NO: 1253134 - RNA, 24 nt, Human
uuuguaaucauaaaauaacucacu

SEQ ID NO: 1253135 - RNA, 19 nt, Human
agagccccauccuugggga

SEQ ID NO: 1253136 - RNA, 21 nt, Human
agcaauucuuccaggaauugg

SEQ ID NO: 1253137 - RNA, 24 nt, Human
ccccagagagccugcucagaagcc

SEQ ID NO: 1253138 - RNA, 23 nt, Human
cucuucccguuguuucucgggcu

SEQ ID NO: 1253139 - RNA, 22 nt, Human
cugggggcguccaguccucuuc

SEQ ID NO: 1253140 - RNA, 26 nt, Human
cugggggcguccaguccucuuccugu

SEQ ID NO: 1253141 - RNA, 24 nt, Human
gaugccagagccccauccuugggg

SEQ ID NO: 1253142 - RNA, 19 nt, Human
uccaggaauuggggaugaa

SEQ ID NO: 1253143 - RNA, 26 nt, Human
uccuuggggauuggccccagagagcc

SEQ ID NO: 1253144 - RNA, 20 nt, Human
ucggaugccagagccccauc

SEQ ID NO: 1253145 - RNA, 22 nt, Human
ucugggaacacagcuugucaau

SEQ ID NO: 1253146 - RNA, 30 nt, Human; identical to SEQ ID NO: 1033520

SEQ ID NO: 1253147 - RNA, 22 nt, Human
uugcccucuucccguuguuucu

SEQ ID NO: 1253148 - RNA, 19 nt, Human
uuggugacgaagucuuucu

SEQ ID NO: 1253149 - RNA, 18 nt, Human
aagcaggagguuguucag

SEQ ID NO: 1253150 - RNA, 23 nt, Human
accacaaacuccauccucuauga

SEQ ID NO: 1253151 - RNA, 18 nt, Human
aggaaggcagaccuguug

SEQ ID NO: 1253152 - RNA, 18 nt, Human
auggcaaagcagauccaa

SEQ ID NO: 1253153 - RNA, 22 nt, Human
augugcaauucugagacagagc

SEQ ID NO: 1253154 - RNA, 22 nt, Human
caauccccagaagacuuccagu

SEQ ID NO: 1253155 - RNA, 21 nt, Human
caccauggcaaagcagaucca

SEQ ID NO: 1253156 - RNA, 18 nt, Human
cacccaccauggcaaagc

SEQ ID NO: 1253157 - RNA, 20 nt, Human
cagauccaagccccacgcaa

SEQ ID NO: 1253158 - RNA, 23 nt, Human
caugugcaauucugagacagagc

SEQ ID NO: 1253159 - RNA, 23 nt, Human
cuacccacccaccauggcaaagc

SEQ ID NO: 1253160 - RNA, 21 nt, Human
cucuaugauccuguaugcucu

SEQ ID NO: 1253161 - RNA, 26 nt, Human
cuucccaaauuucaccccuuguucuc

SEQ ID NO: 1253162 - RNA, 19 nt, Human
gcaaagcagauccaagccc

SEQ ID NO: 1253163 - RNA, 18 nt, Human
gccacaugugcaauucug

SEQ ID NO: 1253164 - RNA, 22 nt, Human
uacccacccaccauggcaaagc

SEQ ID NO: 1253165 - RNA, 24 nt, Human
ucccaaauuucaccccuuguucuc

SEQ ID NO: 1253166 - RNA, 20 nt, Human
uccccagaagacuuccaguu

SEQ ID NO: 1253167 - RNA, 22 nt, Human
uccccagaagacuuccaguugu

SEQ ID NO: 1253168 - RNA, 24 nt, Human
uccuaggccaccuaugguuuuugc

SEQ ID NO: 1253169 - RNA, 18 nt, Human
ugaaagggcaccaagccc

SEQ ID NO: 1253170 - RNA, 22 nt, Human
ugccaaggugggcuguccagag

SEQ ID NO: 1253171 - RNA, 19 nt, Human
uggaacacagagacacugg

SEQ ID NO: 1253172 - RNA, 22 nt, Human
uggcuucccaaauuucaccccu

SEQ ID NO: 1253173 - RNA, 19 nt, Human
uguucaguguuuccagaag

SEQ ID NO: 1253174 - RNA, 22 nt, Human
uguucaguguuuccagaagacc

SEQ ID NO: 1253175 - RNA, 18 nt, Human
uugcuacccacccaccau

SEQ ID NO: 1253176 - RNA, 26 nt, Human
uuugcaguagcaacugggucuccucc

SEQ ID NO: 1253177 - RNA, 18 nt, Human
aacaaaagauuuauuuga

SEQ ID NO: 1253178 - RNA, 22 nt, Human
cagcaggugugggggugagggg

SEQ ID NO: 1253179 - RNA, 22 nt, Human
acacuguaauuucccaaggcug

SEQ ID NO: 1253180 - RNA, 22 nt, Human
uaaaacacuguaauuucccaag

SEQ ID NO: 1253181 - RNA, 26 nt, Human
uaaaacacuguaauuucccaaggcug

SEQ ID NO: 1253182 - RNA, 23 nt, Human
aaaaaaacugcaaucguuuacau

SEQ ID NO: 1253183 - RNA, 19 nt, Human
aaaaagaaacuugucaaaa

SEQ ID NO: 1253184 - RNA, 23 nt, Human
aaaaggacaaauauuuagccaga

SEQ ID NO: 1253185 - RNA, 20 nt, Human
aaacaaacacaacauaguau

SEQ ID NO: 1253186 - RNA, 22 nt, Human
aaagaaaaaacccuauacugau

SEQ ID NO: 1253187 - RNA, 19 nt, Human
aaagaaaguaucaagagua

SEQ ID NO: 1253188 - RNA, 24 nt, Human
aaaugacuucaucuaucuuucuua

SEQ ID NO: 1253189 - RNA, 26 nt, Human
aaauucaccuuaaaaauagaaacaaa

SEQ ID NO: 1253190 - RNA, 18 nt, Human
aaccaccgagcccgcugg

SEQ ID NO: 1253191 - RNA, 18 nt, Human
aagaaaugaggcagaaag

SEQ ID NO: 1253192 - RNA, 22 nt, Human
aagaaaugaggcagaaaguguc

SEQ ID NO: 1253193 - RNA, 21 nt, Human
aagaagaaaaaguaaauguaa

SEQ ID NO: 1253194 - RNA, 18 nt, Human
aagagccaggacaugagc

SEQ ID NO: 1253195 - RNA, 19 nt, Human
aagcaaaacaucuuugucu

SEQ ID NO: 1253196 - RNA, 25 nt, Human
aagcaaaacaucuuugucuucccga

SEQ ID NO: 1253197 - RNA, 19 nt, Human
aagccacuuuugaccaauu

SEQ ID NO: 1253198 - RNA, 22 nt, Human
aauaacugauuuagaaaccaua

SEQ ID NO: 1253199 - RNA, 20 nt, Human
aaucccuccccugacaaauc

SEQ ID NO: 1253200 - RNA, 21 nt, Human
acaaaaagccacuuuugacca

SEQ ID NO: 1253201 - RNA, 18 nt, Human
acaaaacaccucuagcca

SEQ ID NO: 1253202 - RNA, 22 nt, Human
acaaaacaccucuagccagggu

SEQ ID NO: 1253203 - RNA, 22 nt, Human
acagacagcaugauaccugagc

SEQ ID NO: 1253204 - RNA, 19 nt, Human
accaauugcucccuacaua

SEQ ID NO: 1253205 - RNA, 20 nt, Human
accaggcaaauuuaugcagu

SEQ ID NO: 1253206 - RNA, 21 nt, Human
acugaugcauggaaaaacguc

SEQ ID NO: 1253207 - RNA, 28 nt, Human
acugcaguuuuucucaagguaucuuaau

SEQ ID NO: 1253208 - RNA, 18 nt, Human
agaaacaaacaaaaggac

SEQ ID NO: 1253209 - RNA, 22 nt, Human
agacagaagccaugugacuuaa

SEQ ID NO: 1253210 - RNA, 21 nt, Human
agacagcaugauaccugagca

SEQ ID NO: 1253211 - RNA, 21 nt, Human
agcaaaaggacuuuagaaaau

SEQ ID NO: 1253212 - RNA, 18 nt, Human
agcaaauaaaucaacuac

SEQ ID NO: 1253213 - RNA, 18 nt, Human
aggagcugguaucucuga

SEQ ID NO: 1253214 - RNA, 24 nt, Human
aggccugauugcuauuauucugaa

SEQ ID NO: 1253215 - RNA, 19 nt, Human
agggagacugaagcacaga

SEQ ID NO: 1253216 - RNA, 18 nt, Human
auaagcuucuucagagaa

SEQ ID NO: 1253217 - RNA, 23 nt, Human
auacaacauuucccucuuucccu

SEQ ID NO: 1253218 - RNA, 18 nt, Human
auaccaccacugcaccag

SEQ ID NO: 1253219 - RNA, 19 nt, Human
auagugccuucuucaagaa

SEQ ID NO: 1253220 - RNA, 31 nt, Human
aucaucuccuuaucaauacggcacagauucc

SEQ ID NO: 1253221 - RNA, 21 nt, Human
augagcgcuuuagccucccag

SEQ ID NO: 1253222 - RNA, 18 nt, Human
auuuuauguuacauauau

SEQ ID NO: 1253223 - RNA, 22 nt, Human
caaaaauguaaaaacaaacaca

SEQ ID NO: 1253224 - RNA, 20 nt, Human
caaaaggacuuuagaaaaug

SEQ ID NO: 1253225 - RNA, 22 nt, Human
caacuaccaugaucggaagggc

SEQ ID NO: 1253226 - RNA, 26 nt, Human
caacuuaaacugacauuaacuaauaa

SEQ ID NO: 1253227 - RNA, 20 nt, Human
caagacagaagccaugugac

SEQ ID NO: 1253228 - RNA, 20 nt, Human
caagacagggagacugaagc

SEQ ID NO: 1253229 - RNA, 22 nt, Human
cacaacaacccugugagguagg

SEQ ID NO: 1253230 - RNA, 19 nt, Human
cacagcuucacuuuccucu

SEQ ID NO: 1253231 - RNA, 21 nt, Human
cacccccaaggaauucaaagc

SEQ ID NO: 1253232 - RNA, 19 nt, Human
caccuuaaaaauagaaaca

SEQ ID NO: 1253233 - RNA, 21 nt, Human
cacuuacaacuuacaccagcc

SEQ ID NO: 1253234 - RNA, 20 nt, Human
cagcccgcgggcggaccccg

SEQ ID NO: 1253235 - RNA, 18 nt, Human
cagcggcggcggcgggcg

SEQ ID NO: 1253236 - RNA, 18 nt, Human
cagucuuuccccuugggg

SEQ ID NO: 1253237 - RNA, 18 nt, Human
cauacuaugaaguacggu

SEQ ID NO: 1253238 - RNA, 24 nt, Human
caucaaggaaagaaaaaacccuau

SEQ ID NO: 1253239 - RNA, 25 nt, Human
caucaaggaaagaaaaaacccuaua

SEQ ID NO: 1253240 - RNA, 18 nt, Human
caugauagaaucuuuaau

SEQ ID NO: 1253241 - RNA, 26 nt, Human
caugaucucaacuugaaacauuagaa

SEQ ID NO: 1253242 - RNA, 22 nt, Human
cauguugguagaucaggcuggc

SEQ ID NO: 1253243 - RNA, 19 nt, Human
ccaacccugacccuauacg

SEQ ID NO: 1253244 - RNA, 21 nt, Human
ccacaaucccuccccugacaa

SEQ ID NO: 1253245 - RNA, 20 nt, Human
ccacccaaucacagcggcgg

SEQ ID NO: 1253246 - RNA, 21 nt, Human
ccacuuccacugcccugacuu

SEQ ID NO: 1253247 - RNA, 24 nt, Human
cccaagcaugaucucaacuugaaa

SEQ ID NO: 1253248 - RNA, 26 nt, Human
cccaaggucacacaguuaaauucacu

SEQ ID NO: 1253249 - RNA, 24 nt, Human
cccagaacaucuguuuaagcagcc

SEQ ID NO: 1253250 - RNA, 18 nt, Human
ccccagcccccgccugcc

SEQ ID NO: 1253251 - RNA, 20 nt, Human
ccccgagccgccgcggaccc

SEQ ID NO: 1253252 - RNA, 23 nt, Human
ccccugagcuuccugcauuucuc

SEQ ID NO: 1253253 - RNA, 23 nt, Human
cccgcccccggcuccgccccggc

SEQ ID NO: 1253254 - RNA, 24 nt, Human
cccgcccccggcuccgccccggcg

SEQ ID NO: 1253255 - RNA, 20 nt, Human
cccgccugccggccgccggc

SEQ ID NO: 1253256 - RNA, 18 nt, Human
cccgcucgcaccgcagcc

SEQ ID NO: 1253257 - RNA, 22 nt, Human
cccgcucgcaccgcagcccgcg

SEQ ID NO: 1253258 - RNA, 19 nt, Human
cccggccucgggccccagc

SEQ ID NO: 1253259 - RNA, 25 nt, Human
cccggccucgggccccagcccccgc

SEQ ID NO: 1253260 - RNA, 20 nt, Human
cccggcgcagggcgcagccg

SEQ ID NO: 1253261 - RNA, 19 nt, Human
cccucuuucccuguuccca

SEQ ID NO: 1253262 - RNA, 24 nt, Human
ccgccgcugccgucgucgccgccg

SEQ ID NO: 1253263 - RNA, 21 nt, Human
ccgcugccgucgucgccgccg

SEQ ID NO: 1253264 - RNA, 22 nt, Human
ccgcugggccgccgcugccguc

SEQ ID NO: 1253265 - RNA, 27 nt, Human
ccggccgccggcccgcccccggcuccg

SEQ ID NO: 1253266 - RNA, 25 nt, Human
ccucgggccccagcccccgccugcc

SEQ ID NO: 1253267 - RNA, 18 nt, Human
ccucuagccaggguaagg

SEQ ID NO: 1253268 - RNA, 24 nt, Human
ccugagcaaauaaaucaacuacca

SEQ ID NO: 1253269 - RNA, 18 nt, Human
ccuuuuuguuguuuucca

SEQ ID NO: 1253270 - RNA, 21 nt, Human
cgcagcccgcgggcggacccc

SEQ ID NO: 1253271 - RNA, 21 nt, Human
cgccgcggacccaaccaccga

SEQ ID NO: 1253272 - RNA, 21 nt, Human
cggccucgggccccagccccc

SEQ ID NO: 1253273 - RNA, 23 nt, Human
cggcgcagggcgcagccgcugcc

SEQ ID NO: 1253274 - RNA, 22 nt, Human
cggcggcgggcgggggaggagg

SEQ ID NO: 1253275 - RNA, 23 nt, Human
cggcggcgggcgggggaggaggg

SEQ ID NO: 1253276 - RNA, 23 nt, Human
cgggccccagcccccgccugccg

SEQ ID NO: 1253277 - RNA, 25 nt, Human
cucccagcucccagccaaauaccuc

SEQ ID NO: 1253278 - RNA, 27 nt, Human
cucgggccccagcccccgccugccggc

SEQ ID NO: 1253279 - RNA, 22 nt, Human
cuuuuguauucccggucuacuu

SEQ ID NO: 1253280 - RNA, 20 nt, Human
gaaaagaguuuaauaaagaa

SEQ ID NO: 1253281 - RNA, 21 nt, Human
gaaaauaacugauuuagaaac

SEQ ID NO: 1253282 - RNA, 23 nt, Human
gaagaaaugaggcagaaaguguc

SEQ ID NO: 1253283 - RNA, 22 nt, Human
gacagaagccaugugacuuaag

SEQ ID NO: 1253284 - RNA, 24 nt, Human
gacaugagcgcuuuagccucccag

SEQ ID NO: 1253285 - RNA, 27 nt, Human
gacccacauaauacaacauuucccucu

SEQ ID NO: 1253286 - RNA, 19 nt, Human
gaggccccaagacccacau

SEQ ID NO: 1253287 - RNA, 20 nt, Human
gauucuuucuacugcacccc

SEQ ID NO: 1253288 - RNA, 20 nt, Human
gcaaagugugcuacugcccc

SEQ ID NO: 1253289 - RNA, 24 nt, Human
gcaccagaauuuuuaauuauucca

SEQ ID NO: 1253290 - RNA, 18 nt, Human
gcauggaaaaacguccaa

SEQ ID NO: 1253291 - RNA, 24 nt, Human
gccaaauaccucaugauagaaucu

SEQ ID NO: 1253292 - RNA, 25 nt, Human
gccccaagacccacauaauacaaca

SEQ ID NO: 1253293 - RNA, 21 nt, Human
gccccagcccccgccugccgg

SEQ ID NO: 1253294 - RNA, 22 nt, Human
gccggcccgcccccggcuccgc

SEQ ID NO: 1253295 - RNA, 19 nt, Human
gcggcggcgggcgggggag

SEQ ID NO: 1253296 - RNA, 21 nt, Human
gcggcgggcgggggaggaggg

SEQ ID NO: 1253297 - RNA, 21 nt, Human
ggaaaaaauuauaauuacaaa

SEQ ID NO: 1253298 - RNA, 18 nt, Human
ggaagggaaggaaggacu

SEQ ID NO: 1253299 - RNA, 22 nt, Human
ggacaugagcgcuuuagccucc

SEQ ID NO: 1253300 - RNA, 18 nt, Human
ggccccagcccccgccug

SEQ ID NO: 1253301 - RNA, 24 nt, Human
ggcgggggaggaggggagccgggc

SEQ ID NO: 1253302 - RNA, 25 nt, Human
gggcgggggaggaggggagccgggc

SEQ ID NO: 1253303 - RNA, 22 nt, Human
gggggaggaggggagccgggcc

SEQ ID NO: 1253304 - RNA, 25 nt, Human
gguauaccaccacugcaccagaauu

SEQ ID NO: 1253305 - RNA, 23 nt, Human
guauaccaccacugcaccagaau

SEQ ID NO: 1253306 - RNA, 20 nt, Human
uaaaacccccaacagaauga

SEQ ID NO: 1253307 - RNA, 24 nt, Human
uaaaauuuccaagacagaagccau

SEQ ID NO: 1253308 - RNA, 18 nt, Human
uaaagaacauccaaggcc

SEQ ID NO: 1253309 - RNA, 20 nt, Human
uaagugacuugcccaagguc

SEQ ID NO: 1253310 - RNA, 24 nt, Human
uaagugacuugcccaaggucacac

SEQ ID NO: 1253311 - RNA, 18 nt, Human
uaauaauagcagcagacu

SEQ ID NO: 1253312 - RNA, 24 nt, Human
uaauacaacauuucccucuuuccc

SEQ ID NO: 1253313 - RNA, 19 nt, Human
uaauccccacaacaacccu

SEQ ID NO: 1253314 - RNA, 19 nt, Human
uaauguuaaaacugacaca

SEQ ID NO: 1253315 - RNA, 19 nt, Human
uacaacuuacaccagcccc

SEQ ID NO: 1253316 - RNA, 24 nt, Human
uacaagacagggagacugaagcac

SEQ ID NO: 1253317 - RNA, 21 nt, Human
uagaaacaaacaaaaggacaa

SEQ ID NO: 1253318 - RNA, 20 nt, Human
uagccucccagcucccagcc

SEQ ID NO: 1253319 - RNA, 21 nt, Human
uauuacuucuuaaaaccccca

SEQ ID NO: 1253320 - RNA, 18 nt, Human
uauuccaacaacuacagg

SEQ ID NO: 1253321 - RNA, 23 nt, Human
uauuuuguauuuauauagugccu

SEQ ID NO: 1253322 - RNA, 24 nt, Human
ucacugcaguuuuucucaagguau

SEQ ID NO: 1253323 - RNA, 24 nt, Human
ucccaagccuccugguuccugucu

SEQ ID NO: 1253324 - RNA, 21 nt, Human
ucgcaccgcagcccgcgggcg

SEQ ID NO: 1253325 - RNA, 24 nt, Human
ucgggccccagcccccgccugccg

SEQ ID NO: 1253326 - RNA, 20 nt, Human
ucgucgccgccggcgcucag

SEQ ID NO: 1253327 - RNA, 23 nt, Human
ucuaucuuucuuaaacauguuga

SEQ ID NO: 1253328 - RNA, 22 nt, Human
ucuguaccgaaagcugcagaaa

SEQ ID NO: 1253329 - RNA, 20 nt, Human
ucuucagagaagcaaaacau

SEQ ID NO: 1253330 - RNA, 23 nt, Human
ugaaaagaguuuaauaaagaaca

SEQ ID NO: 1253331 - RNA, 21 nt, Human
ugaaaauaacauaaaugcuau

SEQ ID NO: 1253332 - RNA, 21 nt, Human
ugagccaaaagauacagauaa

SEQ ID NO: 1253333 - RNA, 24 nt, Human
ugagcuuccugcauuucucuuuuc

SEQ ID NO: 1253334 - RNA, 19 nt, Human
ugaggucuuucuacugcca

SEQ ID NO: 1253335 - RNA, 20 nt, Human
ugcaaaaauguaaaaacaaa

SEQ ID NO: 1253336 - RNA, 22 nt, Human
ugcaaagugugcuacugccccc

SEQ ID NO: 1253337 - RNA, 24 nt, Human
uggaaaaacguccaaaaaaacugc

SEQ ID NO: 1253338 - RNA, 25 nt, Human
uggaaggcuguuuuaaaagaggagc

SEQ ID NO: 1253339 - RNA, 25 nt, Human
ugguauaccaccacugcaccagaau

SEQ ID NO: 1253340 - RNA, 18 nt, Human
uguaccgaaagcugcaga

SEQ ID NO: 1253341 - RNA, 19 nt, Human
uguuuuccauagucaacag

SEQ ID NO: 1253342 - RNA, 18 nt, Human
uuaaaugcuuuacagaca

SEQ ID NO: 1253343 - RNA, 23 nt, Human
uuacugaugcauggaaaaacguc

SEQ ID NO: 1253344 - RNA, 19 nt, Human
uuacuuagauccagcugca

SEQ ID NO: 1253345 - RNA, 20 nt, Human
uucaaagcauuauuggugca

SEQ ID NO: 1253346 - RNA, 20 nt, Human
uucaccuccuuguuguaugg

SEQ ID NO: 1253347 - RNA, 23 nt, Human
uuccauagucaacaguuuuagca

SEQ ID NO: 1253348 - RNA, 18 nt, Human
uucccccaacccugaccc

SEQ ID NO: 1253349 - RNA, 19 nt, Human
uucccucuuucccuguucc

SEQ ID NO: 1253350 - RNA, 23 nt, Human
uuccugcauuucucuuuucuuga

SEQ ID NO: 1253351 - RNA, 21 nt, Human
uuuacuuuuaguuacaauaau

SEQ ID NO: 1253352 - RNA, 22 nt, Human
uuuaguuacaauaauuuauaga

SEQ ID NO: 1253353 - RNA, 24 nt, Human
uuuccaggguaaaaaauggcaucu

SEQ ID NO: 1253354 - RNA, 23 nt, Human
uuucuugaaaaaucagugcuuga

SEQ ID NO: 1253355 - RNA, 23 nt, Human
uuuuaaagaaaguaucaagagua

SEQ ID NO: 1253356 - RNA, 27 nt, Human
aguggcuauuuaccaauaacaaguaac

SEQ ID NO: 1253357 - RNA, 23 nt, Human
aagagaccagcagcucacagagc

SEQ ID NO: 1253358 - RNA, 21 nt, Human
aagcacaaucccgacucccgc

SEQ ID NO: 1253359 - RNA, 21 nt, Human
acagagccuuccugaguucag

SEQ ID NO: 1253360 - RNA, 19 nt, Human
acucuagcuccaccuucuc

SEQ ID NO: 1253361 - RNA, 19 nt, Human
acucuagcuccaccuucuc

SEQ ID NO: 1253362 - RNA, 25 nt, Human
acucuguugcccaggcuggagugca

SEQ ID NO: 1253363 - RNA, 20 nt, Human
acugcaagcucugccucccg

SEQ ID NO: 1253364 - RNA, 20 nt, Human
agacagggacugugcagagc

SEQ ID NO: 1253365 - RNA, 21 nt, Human
agacuguccagccaguuuuuc

SEQ ID NO: 1253366 - RNA, 24 nt, Human
agagacuguccagccaguuuuucc

SEQ ID NO: 1253367 - RNA, 22 nt, Human
agagccuuccugaguucagcau

SEQ ID NO: 1253368 - RNA, 20 nt, Human
agaguuccaagugacuuuuc

SEQ ID NO: 1253369 - RNA, 22 nt, Human
agauucuugccucauucagcuu

SEQ ID NO: 1253370 - RNA, 23 nt, Human
agcaguaaacacuugcagacuuc

SEQ ID NO: 1253371 - RNA, 23 nt, Human
agccgcuggagcgcuacggucug

SEQ ID NO: 1253372 - RNA, 22 nt, Human
aggacacugcugcccuaccaga

SEQ ID NO: 1253373 - RNA, 21 nt, Human
aggaggagacaaugucugaga

SEQ ID NO: 1253374 - RNA, 19 nt, Human
aggccgcgggccgggggaa

SEQ ID NO: 1253375 - RNA, 25 nt, Human
aggcuggagugcaguggcgcaaucu

SEQ ID NO: 1253376 - RNA, 21 nt, Human
agugcaguggcgcaaucucag

SEQ ID NO: 1253377 - RNA, 27 nt, Human
aguuuuguucuccauacucuagcucca

SEQ ID NO: 1253378 - RNA, 22 nt, Human
caaccaugcugcugggacugaa

SEQ ID NO: 1253379 - RNA, 21 nt, Human
caacugcugucauuugggggu

SEQ ID NO: 1253380 - RNA, 21 nt, Human
caagcacaaucccgacucccg

SEQ ID NO: 1253381 - RNA, 21 nt, Human
cacaaucccgacucccgcgcg

SEQ ID NO: 1253382 - RNA, 24 nt, Human
cacucuguugcccaggcuggagug

SEQ ID NO: 1253383 - RNA, 23 nt, Human
cacugcaagcucugccucccggg

SEQ ID NO: 1253384 - RNA, 19 nt, Human
cagagccuuccugaguuca

SEQ ID NO: 1253385 - RNA, 22 nt, Human
caggccauucuccugccucagc

SEQ ID NO: 1253386 - RNA, 20 nt, Human
caggugcccgccgccacggc

SEQ ID NO: 1253387 - RNA, 24 nt, Human
cagugcccuccugggcuacucuuc

SEQ ID NO: 1253388 - RNA, 18 nt, Human
cauccaagagcugcugga

SEQ ID NO: 1253389 - RNA, 22 nt, Human
ccacaacugagagcacagggac

SEQ ID NO: 1253390 - RNA, 21 nt, Human
ccacccaccucagccucccac

SEQ ID NO: 1253391 - RNA, 23 nt, Human
ccagccaguuuuucccugguugu

SEQ ID NO: 1253392 - RNA, 21 nt, Human
ccauacucuagcuccaccuuc

SEQ ID NO: 1253393 - RNA, 20 nt, Human
cccaagaggcguuuguggag

SEQ ID NO: 1253394 - RNA, 21 nt, Human
cccaggaccugggcucacagg

SEQ ID NO: 1253395 - RNA, 23 nt, Human
cccggguucaggccauucuccug

SEQ ID NO: 1253396 - RNA, 18 nt, Human
cccuaaauccugugacuc

SEQ ID NO: 1253397 - RNA, 22 nt, Human
cccuccugggcuacucuucuug

SEQ ID NO: 1253398 - RNA, 23 nt, Human
ccgcgggccgggggaagucgugc

SEQ ID NO: 1253399 - RNA, 24 nt, Human
ccucccggguucaggccauucucc

SEQ ID NO: 1253400 - RNA, 20 nt, Human
ccucuuccccaucuucuugu

SEQ ID NO: 1253401 - RNA, 22 nt, Human
ccugaccuggugauccacccac

SEQ ID NO: 1253402 - RNA, 19 nt, Human
cucacagagccuuccugag

SEQ ID NO: 1253403 - RNA, 24 nt, Human
cucacucuguugcccaggcuggag

SEQ ID NO: 1253404 - RNA, 24 nt, Human
cucacugcaagcucugccucccgg

SEQ ID NO: 1253405 - RNA, 21 nt, Human
cuccaaaucacagcuuaguuu

SEQ ID NO: 1253406 - RNA, 18 nt, Human
cuccugaccuggugaucc

SEQ ID NO: 1253407 - RNA, 18 nt, Human
cuccugccucagccuccc

SEQ ID NO: 1253408 - RNA, 18 nt, Human
cuccugggcuacucuucu

SEQ ID NO: 1253409 - RNA, 19 nt, Human
cucuucuugucucuggcug

SEQ ID NO: 1253410 - RNA, 18 nt, Human
cucuuggcuucguccauc

SEQ ID NO: 1253411 - RNA, 21 nt, Human
cugccagugcccuccugggcu

SEQ ID NO: 1253412 - RNA, 21 nt, Human
cugccucagccucccaaauag

SEQ ID NO: 1253413 - RNA, 22 nt, Human
cuggauuugggaacuggguugc

SEQ ID NO: 1253414 - RNA, 23 nt, Human
cuggcugcucuccaggcccuggg

SEQ ID NO: 1253415 - RNA, 18 nt, Human
cuugcagacuucucaucc

SEQ ID NO: 1253416 - RNA, 23 nt, Human
cuuuaugugcaagcucugcagag

SEQ ID NO: 1253417 - RNA, 22 nt, Human
gaccuggugauccacccaccuc

SEQ ID NO: 1253418 - RNA, 24 nt, Human
gaccuggugauccacccaccucag

SEQ ID NO: 1253419 - RNA, 24 nt, Human
gacuuuucagcgaggcagucuguu

SEQ ID NO: 1253420 - RNA, 19 nt, Human
gcccaggcuggagugcagu

SEQ ID NO: 1253421 - RNA, 23 nt, Human
gcucgguucaccccaggaccugg

SEQ ID NO: 1253422 - RNA, 19 nt, Human
gcuggagugcaguggcgca

SEQ ID NO: 1253423 - RNA, 18 nt, Human
gcuucguccaucugcuuc

SEQ ID NO: 1253424 - RNA, 19 nt, Human
ggacugaagggaaagugcc

SEQ ID NO: 1253425 - RNA, 23 nt, Human
ggagucucacucuguugcccagg

SEQ ID NO: 1253426 - RNA, 23 nt, Human
gggaagucgugcaagcacaaucc

SEQ ID NO: 1253427 - RNA, 24 nt, Human
gugauccacccaccucagccuccc

SEQ ID NO: 1253428 - RNA, 21 nt, Human
uaaacacuugcagacuucuca

SEQ ID NO: 1253429 - RNA, 30 nt, Human
uaauuuuuuuuuguauuuuuuaguagagaa

SEQ ID NO: 1253430 - RNA, 21 nt, Human
uacucucggcccucuuggcuu

SEQ ID NO: 1253431 - RNA, 24 nt, Human
uagaacuuccuggguacaagaagu

SEQ ID NO: 1253432 - RNA, 26 nt, Human
uaguagagacaguguuucaccgucuc

SEQ ID NO: 1253433 - RNA, 22 nt, Human
uaucuucuaaggaggagacaau

SEQ ID NO: 1253434 - RNA, 24 nt, Human
ucacucuguugcccaggcuggagu

SEQ ID NO: 1253435 - RNA, 18 nt, Human
ucacugcaagcucugccu

SEQ ID NO: 1253436 - RNA, 18 nt, Human
ucacugcaagcucugccu

SEQ ID NO: 1253437 - RNA, 24 nt, Human
ucacugcaagcucugccucccggg

SEQ ID NO: 1253438 - RNA, 18 nt, Human
ucagaugccacagaagag

SEQ ID NO: 1253439 - RNA, 25 nt, Human
ucaggccauucuccugccucagccu

SEQ ID NO: 1253440 - RNA, 20 nt, Human
ucauccaagagcugcuggau

SEQ ID NO: 1253441 - RNA, 20 nt, Human
ucauuuggggguugccuugc

SEQ ID NO: 1253442 - RNA, 21 nt, Human
ucauuuggggguugccuugcu

SEQ ID NO: 1253443 - RNA, 18 nt, Human
uccaagagcugcuggauu

SEQ ID NO: 1253444 - RNA, 21 nt, Human
uccacccaccucagccuccca

SEQ ID NO: 1253445 - RNA, 20 nt, Human
uccaccuucucaggacacug

SEQ ID NO: 1253446 - RNA, 19 nt, Human
uccauacucuagcuccacc

SEQ ID NO: 1253447 - RNA, 20 nt, Human
uccccugugucuccacggaa

SEQ ID NO: 1253448 - RNA, 24 nt, Human
ucccggguucaggccauucuccug

SEQ ID NO: 1253449 - RNA, 19 nt, Human
ucccuaaauccugugacuc

SEQ ID NO: 1253450 - RNA, 23 nt, Human
ucgguucaccccaggaccugggc

SEQ ID NO: 1253451 - RNA, 18 nt, Human
ucuaagugguggucuggc

SEQ ID NO: 1253452 - RNA, 23 nt, Human
ucucacucuguugcccaggcugg

SEQ ID NO: 1253453 - RNA, 24 nt, Human
ucucacucuguugcccaggcugga

SEQ ID NO: 1253454 - RNA, 26 nt, Human
ucucacucuguugcccaggcuggagu

SEQ ID NO: 1253455 - RNA, 27 nt, Human
ucucacucuguugcccaggcuggagug

SEQ ID NO: 1253456 - RNA, 23 nt, Human
ucuccaggcccugggauggaggc

SEQ ID NO: 1253457 - RNA, 18 nt, Human
ucucuaagugguggucug

SEQ ID NO: 1253458 - RNA, 22 nt, Human
ucucuaagugguggucuggcuu

SEQ ID NO: 1253459 - RNA, 23 nt, Human
ucucuggcugcucuccaggcccu

SEQ ID NO: 1253460 - RNA, 21 nt, Human
ucugaagccuagcaccauuuc

SEQ ID NO: 1253461 - RNA, 21 nt, Human
ucugugucucucucuaagugg

SEQ ID NO: 1253462 - RNA, 18 nt, Human
ucuguugcccaggcugga

SEQ ID NO: 1253463 - RNA, 24 nt, Human
ucuguugcccaggcuggagugcag

SEQ ID NO: 1253464 - RNA, 24 nt, Human
ugaagccuagcaccauuuccuaga

SEQ ID NO: 1253465 - RNA, 25 nt, Human
ugacugguuaaugggagauccagug

SEQ ID NO: 1253466 - RNA, 22 nt, Human
ugacuuuucagcgaggcagucu

SEQ ID NO: 1253467 - RNA, 18 nt, Human
ugagacuacaggugcccg

SEQ ID NO: 1253468 - RNA, 24 nt, Human
ugagacuacaggugcccgccgcca

SEQ ID NO: 1253469 - RNA, 24 nt, Human
ugagagcacagggacucuccauua

SEQ ID NO: 1253470 - RNA, 24 nt, Human
ugauccacccaccucagccuccca

SEQ ID NO: 1253471 - RNA, 22 nt, Human
ugcaguggcgcaaucucagcuc

SEQ ID NO: 1253472 - RNA, 23 nt, Human
ugcaguggcgcaaucucagcuca

SEQ ID NO: 1253473 - RNA, 24 nt, Human
ugccacagaagaguuccaagugac

SEQ ID NO: 1253474 - RNA, 18 nt, Human
ugcccaggcuggagugca

SEQ ID NO: 1253475 - RNA, 21 nt, Human
ugcccaggcuggagugcagug

SEQ ID NO: 1253476 - RNA, 22 nt, Human
ugcccaggcuggagugcagugg

SEQ ID NO: 1253477 - RNA, 24 nt, Human
ugcccaggcuggagugcaguggcg

SEQ ID NO: 1253478 - RNA, 24 nt, Human
ugccucagccucccaaauaguuga

SEQ ID NO: 1253479 - RNA, 19 nt, Human
ugccucccggguucaggcc

SEQ ID NO: 1253480 - RNA, 21 nt, Human
ugcucuccaggcccugggaug

SEQ ID NO: 1253481 - RNA, 19 nt, Human
ugcuucagaugccacagaa

SEQ ID NO: 1253482 - RNA, 18 nt, Human
ugcuugcugccuuggugc

SEQ ID NO: 1253483 - RNA, 24 nt, Human
uggagucucacucuguugcccagg

SEQ ID NO: 1253484 - RNA, 18 nt, Human
uggagugcaguggcgcaa

SEQ ID NO: 1253485 - RNA, 23 nt, Human
uggagugcaguggcgcaaucuca

SEQ ID NO: 1253486 - RNA, 24 nt, Human
uggagugcaguggcgcaaucucag

SEQ ID NO: 1253487 - RNA, 22 nt, Human
uggauuuggcaacugcugucau

SEQ ID NO: 1253488 - RNA, 24 nt, Human
uggcgcaaucucagcucacugcaa

SEQ ID NO: 1253489 - RNA, 21 nt, Human
uggcucugagacugacaggcc

SEQ ID NO: 1253490 - RNA, 18 nt, Human
ugggagauuccaccuggu

SEQ ID NO: 1253491 - RNA, 18 nt, Human
ugggcuacucuucuuguc

SEQ ID NO: 1253492 - RNA, 20 nt, Human
uggugcuuguuaguuuuguu

SEQ ID NO: 1253493 - RNA, 18 nt, Human
ugguugugggaugaccug

SEQ ID NO: 1253494 - RNA, 22 nt, Human
uguagcacugacugccagugcc

SEQ ID NO: 1253495 - RNA, 24 nt, Human
uguggaugaugcucucugaagccu

SEQ ID NO: 1253496 - RNA, 22 nt, Human
uuaguagagacaguguuucacc

SEQ ID NO: 1253497 - RNA, 24 nt, Human
uuaguagagacaguguuucaccgu

SEQ ID NO: 1253498 - RNA, 21 nt, Human
uucaggccauucuccugccuc

SEQ ID NO: 1253499 - RNA, 22 nt, Human
uuccaccugguuuuccuggauu

SEQ ID NO: 1253500 - RNA, 25 nt, Human
uuccucuuccccaucuucuuguucu

SEQ ID NO: 1253501 - RNA, 19 nt, Human
uuccugaguucagcaucuu

SEQ ID NO: 1253502 - RNA, 22 nt, Human
uucuaaggaggagacaaugucu

SEQ ID NO: 1253503 - RNA, 21 nt, Human
uucuuguaaauggguggccuu

SEQ ID NO: 1253504 - RNA, 24 nt, Human
uugcccaggcuggagugcaguggc

SEQ ID NO: 1253505 - RNA, 20 nt, Human
uuuacacuuccucuucccca

SEQ ID NO: 1253506 - RNA, 23 nt, Human
uuuacacuuccucuuccccaucu

SEQ ID NO: 1253507 - RNA, 23 nt, Human
uuuuguauuuuuuaguagagaca

SEQ ID NO: 1253508 - RNA, 24 nt, Human
uuuuuaguagagacaguguuucac

SEQ ID NO: 1253509 - RNA, 23 nt, Human
uuuuuguauuuuuuaguagagaa

SEQ ID NO: 1253510 - RNA, 22 nt, Human
uuuuuuguauuuuuuaguagag

SEQ ID NO: 1253511 - RNA, 18 nt, Human
aggaaggaagucgagagg

SEQ ID NO: 1253512 - RNA, 20 nt, Human
aggaaggaagucgagaggac

SEQ ID NO: 1253513 - RNA, 23 nt, Human
caacaaaccacuuuaauggacac

SEQ ID NO: 1253514 - RNA, 25 nt, Human
caacaacaaaccacuuuaauggaca

SEQ ID NO: 1253515 - RNA, 26 nt, Human
caacaacaaaccacuuuaauggacac

SEQ ID NO: 1253516 - RNA, 26 nt, Human
caccuccaacugcugggcuccagcuc

SEQ ID NO: 1253517 - RNA, 22 nt, Human
cacucaaagggcccccaucugu

SEQ ID NO: 1253518 - RNA, 19 nt, Human
cagacacagaggagaccag

SEQ ID NO: 1253519 - RNA, 24 nt, Human
cagcagacacagaggagaccagaa

SEQ ID NO: 1253520 - RNA, 19 nt, Human
ccacauuuugagaagcaag

SEQ ID NO: 1253521 - RNA, 24 nt, Human
ccccuugcuuuucaccuauggcca

SEQ ID NO: 1253522 - RNA, 21 nt, Human
ccuauaaaugacaggaguggg

SEQ ID NO: 1253523 - RNA, 20 nt, Human
ccuccaggcauggaagugga

SEQ ID NO: 1253524 - RNA, 21 nt, Human
ccugagacccugauccccuug

SEQ ID NO: 1253525 - RNA, 19 nt, Human
cugagccuggaggggguug

SEQ ID NO: 1253526 - RNA, 22 nt, Human
cugcugggcuccagcuccaggg

SEQ ID NO: 1253527 - RNA, 21 nt, Human
gacagggcugguucugugggc

SEQ ID NO: 1253528 - RNA, 24 nt, Human
gacccugauccccuugcuuuucac

SEQ ID NO: 1253529 - RNA, 27 nt, Human
gagaccagaauagcuuuuagugggcac

SEQ ID NO: 1253530 - RNA, 19 nt, Human
gagacccugauccccuugc

SEQ ID NO: 1253531 - RNA, 20 nt, Human
gagcgcagcgccgcgucugc

SEQ ID NO: 1253532 - RNA, 18 nt, Human
gaggacagggcugguucu

SEQ ID NO: 1253533 - RNA, 22 nt, Human
gcaggcuuccuccaggcaugga

SEQ ID NO: 1253534 - RNA, 23 nt, Human
gcaggcuuccuccaggcauggaa

SEQ ID NO: 1253535 - RNA, 23 nt, Human
ggaggcuguaguuaaacggguua

SEQ ID NO: 1253536 - RNA, 22 nt, Human
gggcgcugccuggcaggugcac

SEQ ID NO: 1253537 - RNA, 19 nt, Human
guggagugagaggaggcug

SEQ ID NO: 1253538 - RNA, 27 nt, Human
uaaaaucccugggggucucccccgagg

SEQ ID NO: 1253539 - RNA, 24 nt, Human
uauggccacauuuugagaagcaag

SEQ ID NO: 1253540 - RNA, 20 nt, Human
uccaggcauggaaguggagu

SEQ ID NO: 1253541 - RNA, 19 nt, Human
ucccugggggucucauugc

SEQ ID NO: 1253542 - RNA, 24 nt, Human
ugacaggaguggggguguccccag

SEQ ID NO: 1253543 - RNA, 25 nt, Human
ugacaggaguggggguguccccagg

SEQ ID NO: 1253544 - RNA, 19 nt, Human
ugagccuggaggggguugc

SEQ ID NO: 1253545 - RNA, 18 nt, Human
ugcaccaccuccaacugc

SEQ ID NO: 1253546 - RNA, 28 nt, Human
ugccccuauaaaugacaggagugggggu

SEQ ID NO: 1253547 - RNA, 20 nt, Human
uggaaguggagugagaggag

SEQ ID NO: 1253548 - RNA, 23 nt, Human
uggaggggguugcaggcuuccuc

SEQ ID NO: 1253549 - RNA, 22 nt, Human
uggauuaaacagucuggguggg

SEQ ID NO: 1253550 - RNA, 18 nt, Human
uggcaggugcaccaccuc

SEQ ID NO: 1253551 - RNA, 23 nt, Human
uggggguguccccaggucugagc

SEQ ID NO: 1253552 - RNA, 19 nt, Human
uguccccaggucugagccu

SEQ ID NO: 1253553 - RNA, 26 nt, Human
uucaccuauggccacauuuugagaag

SEQ ID NO: 1253554 - RNA, 20 nt, Human
caccguaggucugguucaau

SEQ ID NO: 1253555 - RNA, 20 nt, Human
cuuaguacuaaacuuucuuc

SEQ ID NO: 1253556 - RNA, 21 nt, Human
ugcaacagccacuuggaaaca

SEQ ID NO: 1253557 - RNA, 24 nt, Human
uggaaacaccguaggucugguuca

SEQ ID NO: 1253558 - RNA, 24 nt, Human
aaacuguaggacaacuuuaaauau

SEQ ID NO: 1253559 - RNA, 19 nt, Human
aaagugcuggaauuacagg

SEQ ID NO: 1253560 - RNA, 19 nt, Human
aaagugcuggaauuacagg

SEQ ID NO: 1253561 - RNA, 22 nt, Human
aaauaacuuuuuauaaagcuua

SEQ ID NO: 1253562 - RNA, 20 nt, Human
aaauacacaugaaguuauac

SEQ ID NO: 1253563 - RNA, 19 nt, Human
aacucauaaaaaauacagc

SEQ ID NO: 1253564 - RNA, 19 nt, Human
aagcucaggucucuggagu

SEQ ID NO: 1253565 - RNA, 26 nt, Human
aagugcuggaauuacaggggugagcc

SEQ ID NO: 1253566 - RNA, 18 nt, Human
aauuacaggggugagcca

SEQ ID NO: 1253567 - RNA, 21 nt, Human
acaaccuccaccuccuggguu

SEQ ID NO: 1253568 - RNA, 18 nt, Human
acaggguuucaccauguu

SEQ ID NO: 1253569 - RNA, 21 nt, Human
acaggguuucaccauguuggc

SEQ ID NO: 1253570 - RNA, 24 nt, Human
acaggguuucaccauguuggccag

SEQ ID NO: 1253571 - RNA, 22 nt, Human
accauguuggccaggcuggucu

SEQ ID NO: 1253572 - RNA, 23 nt, Human
acuuggaaauuaagauuugaagu

SEQ ID NO: 1253573 - RNA, 24 nt, Human
agagauuaucacuuaaaauguguc

SEQ ID NO: 1253574 - RNA, 21 nt, Human
agauuugaaguucagaaaaga

SEQ ID NO: 1253575 - RNA, 20 nt, Human
agcacagaauuaaagauaaa

SEQ ID NO: 1253576 - RNA, 21 nt, Human
aggcgcccgccaccacaccca

SEQ ID NO: 1253577 - RNA, 24 nt, Human
aggugauccgccugccccagccuc

SEQ ID NO: 1253578 - RNA, 23 nt, Human
auaucucugaacuuauuuagaau

SEQ ID NO: 1253579 - RNA, 24 nt, Human
aucaaguuggcucuucaucuauau

SEQ ID NO: 1253580 - RNA, 20 nt, Human
augugucuauguaugugugu

SEQ ID NO: 1253581 - RNA, 21 nt, Human
caaaaaagaaaaaacaaaacc

SEQ ID NO: 1253582 - RNA, 24 nt, Human
caaagugcuggaauuacaggggug

SEQ ID NO: 1253583 - RNA, 24 nt, Human
caaccuccaccuccuggguuuaag

SEQ ID NO: 1253584 - RNA, 19 nt, Human
cacagcagcccggcccagc

SEQ ID NO: 1253585 - RNA, 24 nt, Human
caccacacccagcuaauuuuugua

SEQ ID NO: 1253586 - RNA, 21 nt, Human
caccauguuggccaggcuggu

SEQ ID NO: 1253587 - RNA, 23 nt, Human
caccauguuggccaggcuggucu

SEQ ID NO: 1253588 - RNA, 24 nt, Human
caccauguuggccaggcuggucuu

SEQ ID NO: 1253589 - RNA, 27 nt, Human
caccauguuggccaggcuggucuugaa

SEQ ID NO: 1253590 - RNA, 23 nt, Human
cacccgcgccccaaaagcucagg

SEQ ID NO: 1253591 - RNA, 21 nt, Human
caccuccguuuucccucgcug

SEQ ID NO: 1253592 - RNA, 21 nt, Human
cacuacaaccuccaccuccug

SEQ ID NO: 1253593 - RNA, 25 nt, Human
cagaaugaagcaaauagaggaaaua

SEQ ID NO: 1253594 - RNA, 18 nt, Human
cagagagugaaugcccuu

SEQ ID NO: 1253595 - RNA, 24 nt, Human
cagcaaaaaagaaaaaacaaaacc

SEQ ID NO: 1253596 - RNA, 27 nt, Human
cagcaaaaaagaaaaaacaaaaccaaa

SEQ ID NO: 1253597 - RNA, 19 nt, Human
cagcagcccggcccagcuu

SEQ ID NO: 1253598 - RNA, 24 nt, Human
caggguuucaccauguuggccagg

SEQ ID NO: 1253599 - RNA, 20 nt, Human
caggucucuggagucggaga

SEQ ID NO: 1253600 - RNA, 20 nt, Human
caggugauccgccugccccc

SEQ ID NO: 1253601 - RNA, 24 nt, Human
cauguuggccaggcuggucuugaa

SEQ ID NO: 1253602 - RNA, 22 nt, Human
cauuccuccuucccuccuccca

SEQ ID NO: 1253603 - RNA, 19 nt, Human
ccaaagugcuggaauuaca

SEQ ID NO: 1253604 - RNA, 24 nt, Human
ccaaagugcuggaauuacaggggu

SEQ ID NO: 1253605 - RNA, 24 nt, Human
ccaccuccuggguuuaagcgaucu

SEQ ID NO: 1253606 - RNA, 18 nt, Human
cccaaaagcucaggucuc

SEQ ID NO: 1253607 - RNA, 20 nt, Human
cccaccuuggccucccuagu

SEQ ID NO: 1253608 - RNA, 19 nt, Human
ccccaaaagcucaggucuc

SEQ ID NO: 1253609 - RNA, 20 nt, Human
ccccaaaagcucaggucucu

SEQ ID NO: 1253610 - RNA, 21 nt, Human
ccccaaaagcucaggucucug

SEQ ID NO: 1253611 - RNA, 19 nt, Human
cccccgcgcucccacccgc

SEQ ID NO: 1253612 - RNA, 22 nt, Human
cccccgcgcucccacccgcgcc

SEQ ID NO: 1253613 - RNA, 21 nt, Human
cccgccaccacacccagcuaa

SEQ ID NO: 1253614 - RNA, 19 nt, Human
cccguacgggcugccgcga

SEQ ID NO: 1253615 - RNA, 26 nt, Human
ccgccugccccagccucccaaagugc

SEQ ID NO: 1253616 - RNA, 20 nt, Human
ccgcgccccaaaagcucagg

SEQ ID NO: 1253617 - RNA, 19 nt, Human
ccuccucccaggcacagca

SEQ ID NO: 1253618 - RNA, 21 nt, Human
ccuccuucccuccucccaggc

SEQ ID NO: 1253619 - RNA, 20 nt, Human
ccuggguuuaagcgaucucc

SEQ ID NO: 1253620 - RNA, 18 nt, Human
cgcccgccaccacaccca

SEQ ID NO: 1253621 - RNA, 20 nt, Human
cgcuggagucgaacuugcuc

SEQ ID NO: 1253622 - RNA, 18 nt, Human
cuacaaccuccaccuccu

SEQ ID NO: 1253623 - RNA, 23 nt, Human
cuacaaccuccaccuccuggguu

SEQ ID NO: 1253624 - RNA, 21 nt, Human
cucaacuuuaauaaucgaaau

SEQ ID NO: 1253625 - RNA, 24 nt, Human
cucacuacaaccuccaccuccugg

SEQ ID NO: 1253626 - RNA, 24 nt, Human
cucccuaguagcuaggauuauagg

SEQ ID NO: 1253627 - RNA, 20 nt, Human
cugacuucaggugauccgcc

SEQ ID NO: 1253628 - RNA, 24 nt, Human
cugccccagccucccaaagugcug

SEQ ID NO: 1253629 - RNA, 20 nt, Human
cuugaguaacaguuacuucu

SEQ ID NO: 1253630 - RNA, 24 nt, Human
gaaauacacaugaaguuauaccaa

SEQ ID NO: 1253631 - RNA, 24 nt, Human
gaacuugcuccuccuguuucccgg

SEQ ID NO: 1253632 - RNA, 20 nt, Human
gacaccgagaggucccaccc

SEQ ID NO: 1253633 - RNA, 22 nt, Human
gacuucaggugauccgccugcc

SEQ ID NO: 1253634 - RNA, 23 nt, Human
gcuggaauuacaggggugagcca

SEQ ID NO: 1253635 - RNA, 21 nt, Human
ggaaggacagaaugaagcaaa

SEQ ID NO: 1253636 - RNA, 19 nt, Human
ggacauuagaaugaaggga

SEQ ID NO: 1253637 - RNA, 22 nt, Human
ggguuucaccauguuggccagg

SEQ ID NO: 1253638 - RNA, 23 nt, Human
ggugggacagucaccuggcgagg

SEQ ID NO: 1253639 - RNA, 20 nt, Human
gguucccccgcgcucccacc

SEQ ID NO: 1253640 - RNA, 21 nt, Human
guagagacaggguuucaccau

SEQ ID NO: 1253641 - RNA, 22 nt, Human
guagagacaggguuucaccaug

SEQ ID NO: 1253642 - RNA, 24 nt, Human
gugauccgccugccccagccuccc

SEQ ID NO: 1253643 - RNA, 20 nt, Human
uaaauucuguuuccagcuau

SEQ ID NO: 1253644 - RNA, 26 nt, Human
uaagcgaucucccaccuuggccuccc

SEQ ID NO: 1253645 - RNA, 23 nt, Human
uaauuuuuguauuuuuguagaga

SEQ ID NO: 1253646 - RNA, 18 nt, Human
uacaggggugagccacca

SEQ ID NO: 1253647 - RNA, 21 nt, Human
uacaggggugagccaccaugc

SEQ ID NO: 1253648 - RNA, 22 nt, Human
uacaggggugagccaccaugcu

SEQ ID NO: 1253649 - RNA, 21 nt, Human
uagaaugggucucugaaaucu

SEQ ID NO: 1253650 - RNA, 19 nt, Human
uagacugcagaaaacuguu

SEQ ID NO: 1253651 - RNA, 21 nt, Human
uagagacaggguuucaccaug

SEQ ID NO: 1253652 - RNA, 22 nt, Human
uagagacaggguuucaccaugu

SEQ ID NO: 1253653 - RNA, 19 nt, Human
uagaggaaauaaauucugu

SEQ ID NO: 1253654 - RNA, 21 nt, Human
uaggauuauaggcgcccgcca

SEQ ID NO: 1253655 - RNA, 22 nt, Human
uaggauuauaggcgcccgccac

SEQ ID NO: 1253656 - RNA, 24 nt, Human
uaggauuauaggcgcccgccacca

SEQ ID NO: 1253657 - RNA, 24 nt, Human
uaguagcuaggauuauaggcgccc

SEQ ID NO: 1253658 - RNA, 23 nt, Human
uauacagacuaucaaucuauaac

SEQ ID NO: 1253659 - RNA, 23 nt, Human
uauauuacacaccaaacauaagu

SEQ ID NO: 1253660 - RNA, 22 nt, Human
uauguaugugugugcuugugug

SEQ ID NO: 1253661 - RNA, 21 nt, Human
ucaaaaguaccuagcacagaa

SEQ ID NO: 1253662 - RNA, 24 nt, Human
ucacuacaaccuccaccuccuggg

SEQ ID NO: 1253663 - RNA, 25 nt, Human
ucacuacaaccuccaccuccugggu

SEQ ID NO: 1253664 - RNA, 20 nt, Human
ucauguagaaucaaaaguac

SEQ ID NO: 1253665 - RNA, 23 nt, Human
ucccaaagugcuggaauuacagg

SEQ ID NO: 1253666 - RNA, 21 nt, Human
ucccaccuuggccucccuagu

SEQ ID NO: 1253667 - RNA, 23 nt, Human
ucccaggcacagcagcccggccc

SEQ ID NO: 1253668 - RNA, 27 nt, Human
ucccccgcgcucccacccgcgccccaa

SEQ ID NO: 1253669 - RNA, 24 nt, Human
ucccucgcuggagucgaacuugcu

SEQ ID NO: 1253670 - RNA, 20 nt, Human
uccuggguuuaagcgaucuc

SEQ ID NO: 1253671 - RNA, 22 nt, Human
uccuggguuuaagcgaucuccc

SEQ ID NO: 1253672 - RNA, 19 nt, Human
uccuguggcagaaaaaccc

SEQ ID NO: 1253673 - RNA, 21 nt, Human
ucgcuggagucgaacuugccg

SEQ ID NO: 1253674 - RNA, 18 nt, Human
ucggagacccuccugccc

SEQ ID NO: 1253675 - RNA, 20 nt, Human
ucucaaaaauuagaauagcu

SEQ ID NO: 1253676 - RNA, 20 nt, Human
ucucccaccuccguuuuccc

SEQ ID NO: 1253677 - RNA, 19 nt, Human
ucuugcugugucacccagg

SEQ ID NO: 1253678 - RNA, 21 nt, Human
ugaagggaacugaaaagggua

SEQ ID NO: 1253679 - RNA, 21 nt, Human
ugaauagcacauucaucaagu

SEQ ID NO: 1253680 - RNA, 24 nt, Human
ugaaugcccuuguuuagaaugggu

SEQ ID NO: 1253681 - RNA, 18 nt, Human
ugacuucaggugauccgc

SEQ ID NO: 1253682 - RNA, 18 nt, Human
ugaggacauuagaaugaa

SEQ ID NO: 1253683 - RNA, 20 nt, Human
ugcagaaaacuguuuuaaau

SEQ ID NO: 1253684 - RNA, 24 nt, Human
ugccccagccucccaaagugcugg

SEQ ID NO: 1253685 - RNA, 18 nt, Human
ugccguggugcaaucuug

SEQ ID NO: 1253686 - RNA, 22 nt, Human
ugccguggugcaaucuuggcuc

SEQ ID NO: 1253687 - RNA, 19 nt, Human
ugcuggggcaacuagaugu

SEQ ID NO: 1253688 - RNA, 22 nt, Human
uggaauuacaggggugagccac

SEQ ID NO: 1253689 - RNA, 24 nt, Human
uggaauuacaggggugagccacca

SEQ ID NO: 1253690 - RNA, 24 nt, Human
uggagucuugcugugucacccagg

SEQ ID NO: 1253691 - RNA, 22 nt, Human
uggccaggcuggucuugaacuc

SEQ ID NO: 1253692 - RNA, 21 nt, Human
uggcgagggggggcagggacc

SEQ ID NO: 1253693 - RNA, 19 nt, Human
uggggcaacuagaugugga

SEQ ID NO: 1253694 - RNA, 20 nt, Human
uggggcaacuagauguggag

SEQ ID NO: 1253695 - RNA, 24 nt, Human
uggugcaaucuuggcucacuacaa

SEQ ID NO: 1253696 - RNA, 22 nt, Human
uguacaauguaauaguauacau

SEQ ID NO: 1253697 - RNA, 24 nt, Human
uguagagacaggguuucaccaugu

SEQ ID NO: 1253698 - RNA, 25 nt, Human
ugucuauguaugugugugcuugugu

SEQ ID NO: 1253699 - RNA, 26 nt, Human
ugugucacccaggcuagcgugccgug

SEQ ID NO: 1253700 - RNA, 19 nt, Human
ugugucuauguaugugugu

SEQ ID NO: 1253701 - RNA, 21 nt, Human
uuaccauuuaccaaaaauaac

SEQ ID NO: 1253702 - RNA, 18 nt, Human
uuaguuuggaaaaacugu

SEQ ID NO: 1253703 - RNA, 21 nt, Human
uucaaaucauguugacguuca

SEQ ID NO: 1253704 - RNA, 19 nt, Human
uuccagagagugaaugccc

SEQ ID NO: 1253705 - RNA, 21 nt, Human
uucccccgcgcucccacccgc

SEQ ID NO: 1253706 - RNA, 24 nt, Human
uuguagagacaggguuucaccaug

SEQ ID NO: 1253707 - RNA, 24 nt, Human
uuucaccauguuggccaggcuggu

SEQ ID NO: 1253708 - RNA, 28 nt, Human
uuucuagcuuaugaauagcacauucauc

SEQ ID NO: 1253709 - RNA, 23 nt, Human
uuugaaauacacaugaaguuaua

SEQ ID NO: 1253710 - RNA, 18 nt, Human
uuuguagagacaggguuu

SEQ ID NO: 1253711 - RNA, 24 nt, Human
uuuguagagacaggguuucaccau

SEQ ID NO: 1253712 - RNA, 18 nt, Human
uuuuaauaaggccuacau

SEQ ID NO: 1253713 - RNA, 23 nt, Human
uuuuuguagagacaggguuucac

SEQ ID NO: 1253714 - RNA, 24 nt, Human
uuuuuuuuuuuugagauggagucu

SEQ ID NO: 1253715 - RNA, 22 nt, Human
uuuuuuuuuuuuuugagaugga

SEQ ID NO: 1253716 - RNA, 18 nt, Human
cagcaguuagugauaacu

SEQ ID NO: 1253717 - RNA, 18 nt, Human
uaaagcuguuauuuuguc

SEQ ID NO: 1253718 - RNA, 19 nt, Human
ugaucucuuaaagcagcag

SEQ ID NO: 1253719 - RNA, 22 nt, Human
acucugaggagugcguucaaag

SEQ ID NO: 1253720 - RNA, 19 nt, Human
agagucggacucugaggag

SEQ ID NO: 1253721 - RNA, 22 nt, Human
aggugggagagucggacucuga

SEQ ID NO: 1253722 - RNA, 19 nt, Human
gaagcgcagcaggagcgcc

SEQ ID NO: 1253723 - RNA, 22 nt, Human
ggaaggagauauggaucccagg

SEQ ID NO: 1253724 - RNA, 18 nt, Human
ggagugcguucaaagucu

SEQ ID NO: 1253725 - RNA, 24 nt, Human
gggagagucggacucugaggagug

SEQ ID NO: 1253726 - RNA, 19 nt, Human
guucaaagucuucacuugg

SEQ ID NO: 1253727 - RNA, 24 nt, Human
uggaaggagauauggaucccaggg

SEQ ID NO: 1253728 - RNA, 18 nt, Human
agguagcagguacaaagc

SEQ ID NO: 1253729 - RNA, 25 nt, Human
caaagcacaaacugcaaagcuuuag

SEQ ID NO: 1253730 - RNA, 20 nt, Human
gaaggaaauagagaaacaaa

SEQ ID NO: 1253731 - RNA, 22 nt, Human
uacaaagcacaaacugcaaagc

SEQ ID NO: 1253732 - RNA, 20 nt, Human
uagagaaacaaaugcucucc

SEQ ID NO: 1253733 - RNA, 21 nt, Human
uagagaaacaaaugcucucca

SEQ ID NO: 1253734 - RNA, 24 nt, Human
uagagaaacaaaugcucuccaagu

SEQ ID NO: 1253735 - RNA, 25 nt, Human
uagcagguacaaagcacaaacugca

SEQ ID NO: 1253736 - RNA, 18 nt, Human
uaggguuucugcugcuag

SEQ ID NO: 1253737 - RNA, 23 nt, Human
uggaaggaaauagagaaacaaau

SEQ ID NO: 1253738 - RNA, 20 nt, Human
aaaagcacgauggggucacg

SEQ ID NO: 1253739 - RNA, 21 nt, Human
aacacaaagauucagagggca

SEQ ID NO: 1253740 - RNA, 27 nt, Human
aacauucuuucacguguccaucugcuu

SEQ ID NO: 1253741 - RNA, 21 nt, Human
acaggcaccaucuccucaaac

SEQ ID NO: 1253742 - RNA, 24 nt, Human
agggauggcagcauucagcucagg

SEQ ID NO: 1253743 - RNA, 22 nt, Human
caaucacagaucuugauuuagu

SEQ ID NO: 1253744 - RNA, 20 nt, Human
cacaggcagccaaagacugc

SEQ ID NO: 1253745 - RNA, 20 nt, Human
cagcauucagcucaggcucu

SEQ ID NO: 1253746 - RNA, 22 nt, Human
cagccaaacacaaagauucaga

SEQ ID NO: 1253747 - RNA, 19 nt, Human
cagcucaggcucuggcuua

SEQ ID NO: 1253748 - RNA, 21 nt, Human
ccagacacaucuucaauugcu

SEQ ID NO: 1253749 - RNA, 18 nt, Human
ccagcguuccuuaaauuu

SEQ ID NO: 1253750 - RNA, 20 nt, Human
cugaagcugguucccucugc

SEQ ID NO: 1253751 - RNA, 20 nt, Human
cugaagcugguucccucugc

SEQ ID NO: 1253752 - RNA, 20 nt, Human
cuggaagauuaagggaagcu

SEQ ID NO: 1253753 - RNA, 22 nt, Human
gacugagguacagugucuccag

SEQ ID NO: 1253754 - RNA, 19 nt, Human
uacaguucauuggaugaug

SEQ ID NO: 1253755 - RNA, 21 nt, Human
ucaacagucuggaugccuccc

SEQ ID NO: 1253756 - RNA, 21 nt, Human
ucaauauagacugagguacag

SEQ ID NO: 1253757 - RNA, 25 nt, Human
ucauccaaaaaccuuaaugacucau

SEQ ID NO: 1253758 - RNA, 23 nt, Human
ucuccagacacaucuucaauugc

SEQ ID NO: 1253759 - RNA, 21 nt, Human
ucuccagcuuccucccagguc

SEQ ID NO: 1253760 - RNA, 22 nt, Human
ucuucaauugcugcuggaagau

SEQ ID NO: 1253761 - RNA, 21 nt, Human
ugaagcugguucccucugcuu

SEQ ID NO: 1253762 - RNA, 20 nt, Human
ugacacaggcaccaucuccu

SEQ ID NO: 1253763 - RNA, 28 nt, Human
ugaucuguuaacaaaucggcuuuccucu

SEQ ID NO: 1253764 - RNA, 24 nt, Human
ugccucccuguucaaucacagauc

SEQ ID NO: 1253765 - RNA, 25 nt, Human
ugcuugcacagcuuuaucugggccc

SEQ ID NO: 1253766 - RNA, 22 nt, Human
ugguggcuucucucaucugagc

SEQ ID NO: 1253767 - RNA, 24 nt, Human
uucuucuucauccaaaaaccuuaa

SEQ ID NO: 1253768 - RNA, 24 nt, Human
uuugccaaagugguggcuucucuc

SEQ ID NO: 1253769 - RNA, 18 nt, Human
aagcgauucaucaaauga

SEQ ID NO: 1253770 - RNA, 22 nt, Human
aaguaucuccgcggaucuaccc

SEQ ID NO: 1253771 - RNA, 21 nt, Human
aaugggcccguugucuacaac

SEQ ID NO: 1253772 - RNA, 20 nt, Human
acaaaauagacaagaaacag

SEQ ID NO: 1253773 - RNA, 18 nt, Human
agagcagauagagcucag

SEQ ID NO: 1253774 - RNA, 20 nt, Human
agagguggcgcgcggugagg

SEQ ID NO: 1253775 - RNA, 24 nt, Human
agcccagagccuccccgcgcuccc

SEQ ID NO: 1253776 - RNA, 22 nt, Human
auagagcucaggcagcgccgac

SEQ ID NO: 1253777 - RNA, 21 nt, Human
caaaugaucaugccaugugaa

SEQ ID NO: 1253778 - RNA, 21 nt, Human
caagcucauuaccccaacuuu

SEQ ID NO: 1253779 - RNA, 24 nt, Human
cacccaccccccacccccaacacu

SEQ ID NO: 1253780 - RNA, 26 nt, Human
caccccccacccccaacacuucuacc

SEQ ID NO: 1253781 - RNA, 20 nt, Human
cagagccuccccgcgcuccc

SEQ ID NO: 1253782 - RNA, 18 nt, Human
caguuccugggcgugauc

SEQ ID NO: 1253783 - RNA, 23 nt, Human
ccacccaccccccacccccaaca

SEQ ID NO: 1253784 - RNA, 21 nt, Human
ccaccccccacccccaacacu

SEQ ID NO: 1253785 - RNA, 18 nt, Human
ccagucgcguccacuccc

SEQ ID NO: 1253786 - RNA, 21 nt, Human
cccacccaccccccaccccca

SEQ ID NO: 1253787 - RNA, 22 nt, Human
cccacccaccccccacccccaa

SEQ ID NO: 1253788 - RNA, 22 nt, Human
ccccccacccccaacacuucua

SEQ ID NO: 1253789 - RNA, 19 nt, Human
ccccugcggccggcgcgga

SEQ ID NO: 1253790 - RNA, 19 nt, Human
cccgcugcucucgcccaag

SEQ ID NO: 1253791 - RNA, 21 nt, Human
cccgcugcucucgcccaagac

SEQ ID NO: 1253792 - RNA, 20 nt, Human
ccgccgcccgucgccccgga

SEQ ID NO: 1253793 - RNA, 18 nt, Human
ccgccgccgcccgucgcc

SEQ ID NO: 1253794 - RNA, 20 nt, Human
ccgccgccgcccgucgcccc

SEQ ID NO: 1253795 - RNA, 22 nt, Human
ccgccgccgcccgucgccccgg

SEQ ID NO: 1253796 - RNA, 22 nt, Human
ccgccgcggggcccgggcuccu

SEQ ID NO: 1253797 - RNA, 18 nt, Human
ccgcggccuccugccggg

SEQ ID NO: 1253798 - RNA, 19 nt, Human
ccuggagcacuggccuucg

SEQ ID NO: 1253799 - RNA, 23 nt, Human
ccugguauuacugaguaaagcag

SEQ ID NO: 1253800 - RNA, 23 nt, Human
ccuuauaccugaagacgccaagc

SEQ ID NO: 1253801 - RNA, 19 nt, Human
cgcccugagauuccgggca

SEQ ID NO: 1253802 - RNA, 18 nt, Human
cgccgaagccacucggug

SEQ ID NO: 1253803 - RNA, 20 nt, Human
cgccgcggccuccugccggg

SEQ ID NO: 1253804 - RNA, 19 nt, Human
cuacggcgcggaggugcgg

SEQ ID NO: 1253805 - RNA, 24 nt, Human
cucgcccaagacggccggucucgg

SEQ ID NO: 1253806 - RNA, 21 nt, Human
cugcugccgguccuugcuggg

SEQ ID NO: 1253807 - RNA, 24 nt, Human
cugggucugcgccgcugcccggga

SEQ ID NO: 1253808 - RNA, 23 nt, Human
cuuuuaguuuauucccacccacc

SEQ ID NO: 1253809 - RNA, 23 nt, Human
gacccgccccuuccccugcggcc

SEQ ID NO: 1253810 - RNA, 19 nt, Human
gcccugagauuccgggcac

SEQ ID NO: 1253811 - RNA, 20 nt, Human
gcgccucuccgccgccgccc

SEQ ID NO: 1253812 - RNA, 21 nt, Human
gcgcgcaacuacggcgcggag

SEQ ID NO: 1253813 - RNA, 19 nt, Human
gcugccgguccuugcuggg

SEQ ID NO: 1253814 - RNA, 23 nt, Human
ggaagcccggggagcgccucucc

SEQ ID NO: 1253815 - RNA, 19 nt, Human
gggcaggcgaggucccggc

SEQ ID NO: 1253816 - RNA, 18 nt, Human
ggugaagaaggccuggag

SEQ ID NO: 1253817 - RNA, 18 nt, Human
guaaagcagggugcuccu

SEQ ID NO: 1253818 - RNA, 21 nt, Human
gucgcguccacucccggccgc

SEQ ID NO: 1253819 - RNA, 21 nt, Human
guuuauucccacccacccccc

SEQ ID NO: 1253820 - RNA, 22 nt, Human
uagagcagauagagcucaggca

SEQ ID NO: 1253821 - RNA, 20 nt, Human
uauuucucauuucuacagaa

SEQ ID NO: 1253822 - RNA, 19 nt, Human
ucauuaccccaacuuuuag

SEQ ID NO: 1253823 - RNA, 22 nt, Human
uccaaggccacucggagcgcag

SEQ ID NO: 1253824 - RNA, 22 nt, Human
ucccacccaccccccaccccca

SEQ ID NO: 1253825 - RNA, 24 nt, Human
ucccacccaccccccacccccaac

SEQ ID NO: 1253826 - RNA, 18 nt, Human
ucccagcgggcgcccggg

SEQ ID NO: 1253827 - RNA, 20 nt, Human
ucccugagcccagagccucc

SEQ ID NO: 1253828 - RNA, 21 nt, Human
ucuauagucagacaaaauaga

SEQ ID NO: 1253829 - RNA, 22 nt, Human
ucuccgccgccgcccgucgccc

SEQ ID NO: 1253830 - RNA, 19 nt, Human
ugagggcaggcgagguccc

SEQ ID NO: 1253831 - RNA, 24 nt, Human
ugaguaaagcagggugcuccuuuu

SEQ ID NO: 1253832 - RNA, 21 nt, Human
ugaucaugccaugugaagcug

SEQ ID NO: 1253833 - RNA, 24 nt, Human
ugccgguccuugcugggucugcgc

SEQ ID NO: 1253834 - RNA, 21 nt, Human
ugguggcaccaggcccaaggg

SEQ ID NO: 1253835 - RNA, 20 nt, Human
ugucccgcugcucucgccca

SEQ ID NO: 1253836 - RNA, 18 nt, Human
ugucuagauuugagucuu

SEQ ID NO: 1253837 - RNA, 19 nt, Human
aaacagagccugcauuaua

SEQ ID NO: 1253838 - RNA, 24 nt, Human
aaagccuucccacacugauuguau

SEQ ID NO: 1253839 - RNA, 24 nt, Human
aaagcuuucccacacucaagguau

SEQ ID NO: 1253840 - RNA, 19 nt, Human
aacaaagguuuuuccacau

SEQ ID NO: 1253841 - RNA, 20 nt, Human
aacucguagugauuuucccu

SEQ ID NO: 1253842 - RNA, 19 nt, Human
aaguaagaaaagguuucug

SEQ ID NO: 1253843 - RNA, 19 nt, Human
aagugccccaggauaaaac

SEQ ID NO: 1253844 - RNA, 21 nt, Human
aauucauggugacucuuccuu

SEQ ID NO: 1253845 - RNA, 21 nt, Human
acagaccuccucccacagcaa

SEQ ID NO: 1253846 - RNA, 24 nt, Human
acagcaauuaaacucguagugauu

SEQ ID NO: 1253847 - RNA, 25 nt, Human
acauucauuacauucauaggguuuu

SEQ ID NO: 1253848 - RNA, 20 nt, Human
acugauuguauucaaaacac

SEQ ID NO: 1253849 - RNA, 27 nt, Human
agaaagacuucccacauuuuguaccuc

SEQ ID NO: 1253850 - RNA, 21 nt, Human
agaauucaaaguggcuuuggc

SEQ ID NO: 1253851 - RNA, 18 nt, Human
agagcuuucccacacuca

SEQ ID NO: 1253852 - RNA, 24 nt, Human
agagcuuucccacacucauuacau

SEQ ID NO: 1253853 - RNA, 22 nt, Human
agcacacucucuuauggguacu

SEQ ID NO: 1253854 - RNA, 19 nt, Human
agguggcucugacuugggg

SEQ ID NO: 1253855 - RNA, 22 nt, Human
agguuuuuccacauucuuuacc

SEQ ID NO: 1253856 - RNA, 23 nt, Human
aguaagaaaagguuucuggacuu

SEQ ID NO: 1253857 - RNA, 22 nt, Human
auaucccacugagaggaggagg

SEQ ID NO: 1253858 - RNA, 23 nt, Human
augccacgggcaucccacccugc

SEQ ID NO: 1253859 - RNA, 23 nt, Human
auguugacaaggguuuccucuau

SEQ ID NO: 1253860 - RNA, 21 nt, Human
auucacagggccuuucuccag

SEQ ID NO: 1253861 - RNA, 18 nt, Human
auuucuccccugugugag

SEQ ID NO: 1253862 - RNA, 24 nt, Human
caaaaacccaaccaagacgacuga

SEQ ID NO: 1253863 - RNA, 19 nt, Human
caacagaccuccucccaca

SEQ ID NO: 1253864 - RNA, 24 nt, Human
caacuuucugcaaaugcuggucuu

SEQ ID NO: 1253865 - RNA, 21 nt, Human
caagagaaaauguuuuuccua

SEQ ID NO: 1253866 - RNA, 19 nt, Human
cacauucacuacaugcaua

SEQ ID NO: 1253867 - RNA, 21 nt, Human
cacccugcuaccagcugcccu

SEQ ID NO: 1253868 - RNA, 23 nt, Human
caccuguccaugcuccaacuugc

SEQ ID NO: 1253869 - RNA, 20 nt, Human
cagaagaugcuaacagggac

SEQ ID NO: 1253870 - RNA, 18 nt, Human
cagcaccuguccaugcuc

SEQ ID NO: 1253871 - RNA, 24 nt, Human
cagccacaucaaucagggccccaa

SEQ ID NO: 1253872 - RNA, 23 nt, Human
cagggccccaagucuuguaacuc

SEQ ID NO: 1253873 - RNA, 21 nt, Human
caggguccucucaauagggcc

SEQ ID NO: 1253874 - RNA, 18 nt, Human
cagugucaauaaagagug

SEQ ID NO: 1253875 - RNA, 24 nt, Human
cauaguauuucaucuccauaaccc

SEQ ID NO: 1253876 - RNA, 24 nt, Human
caugaaaagccuucccacacugau

SEQ ID NO: 1253877 - RNA, 20 nt, Human
cauggaaacugccgcagcgc

SEQ ID NO: 1253878 - RNA, 22 nt, Human
cauuacauucaaagcuuguuuu

SEQ ID NO: 1253879 - RNA, 23 nt, Human
cauucauuacauucauaggguug

SEQ ID NO: 1253880 - RNA, 20 nt, Human
cauucauuacauuuguaggg

SEQ ID NO: 1253881 - RNA, 23 nt, Human
cauucauuacauuuguaggguug

SEQ ID NO: 1253882 - RNA, 22 nt, Human
ccaacagaccuccucccacagc

SEQ ID NO: 1253883 - RNA, 19 nt, Human
ccacguauuuuucuugaua

SEQ ID NO: 1253884 - RNA, 18 nt, Human
ccagccuucuucaggaag

SEQ ID NO: 1253885 - RNA, 26 nt, Human
cccacagccacaucaaucagggcccc

SEQ ID NO: 1253886 - RNA, 20 nt, Human
cccugcuaccagcugcccuc

SEQ ID NO: 1253887 - RNA, 22 nt, Human
cccugcuaccagcugcccucuu

SEQ ID NO: 1253888 - RNA, 23 nt, Human
cccugcuaccagcugcccucuug

SEQ ID NO: 1253889 - RNA, 19 nt, Human
cccugugccccagaaucuc

SEQ ID NO: 1253890 - RNA, 18 nt, Human
ccgcagcgcucccugggc

SEQ ID NO: 1253891 - RNA, 19 nt, Human
ccuaauacaccauuucugu

SEQ ID NO: 1253892 - RNA, 18 nt, Human
ccuaugccacgggcaucc

SEQ ID NO: 1253893 - RNA, 22 nt, Human
ccucaaaugcuggucuugguuu

SEQ ID NO: 1253894 - RNA, 19 nt, Human
ccucucaccagaccuccuc

SEQ ID NO: 1253895 - RNA, 20 nt, Human
cgcugggaccgcggcugggc

SEQ ID NO: 1253896 - RNA, 21 nt, Human
cucaccagaccuccucucaca

SEQ ID NO: 1253897 - RNA, 22 nt, Human
cucccgcgugccuagcgggggc

SEQ ID NO: 1253898 - RNA, 20 nt, Human
cucucaccagaccuccucuc

SEQ ID NO: 1253899 - RNA, 23 nt, Human
cugagcagaguccagaugcugcc

SEQ ID NO: 1253900 - RNA, 20 nt, Human
cugagccuucaggauguuga

SEQ ID NO: 1253901 - RNA, 18 nt, Human
cugcaacuugaagaccac

SEQ ID NO: 1253902 - RNA, 20 nt, Human
cugcucccgcgugccuagcg

SEQ ID NO: 1253903 - RNA, 20 nt, Human
cuuguccgcuggccggacuu

SEQ ID NO: 1253904 - RNA, 22 nt, Human
cuuucagugucaauaaagagug

SEQ ID NO: 1253905 - RNA, 20 nt, Human
gagacggcuuucccauuucc

SEQ ID NO: 1253906 - RNA, 24 nt, Human
gcugccacuccuccugggugaagc

SEQ ID NO: 1253907 - RNA, 20 nt, Human
gcugggcguccgggggcggg

SEQ ID NO: 1253908 - RNA, 18 nt, Human
ggaagacacggcgcaguc

SEQ ID NO: 1253909 - RNA, 18 nt, Human
gggcggggccgccgaggg

SEQ ID NO: 1253910 - RNA, 19 nt, Human
gguacugaaggcugccucc

SEQ ID NO: 1253911 - RNA, 21 nt, Human
guucucugaugcacaauaagu

SEQ ID NO: 1253912 - RNA, 23 nt, Human
uaaagagugacuuuugccaaaau

SEQ ID NO: 1253913 - RNA, 19 nt, Human
uacauucaaagcuuguuuu

SEQ ID NO: 1253914 - RNA, 18 nt, Human
uaguaagugcugauuucu

SEQ ID NO: 1253915 - RNA, 21 nt, Human
uaguaagugcugauuucuggu

SEQ ID NO: 1253916 - RNA, 18 nt, Human
uauuuuguuguugacaaa

SEQ ID NO: 1253917 - RNA, 18 nt, Human
ucaacuuuccagaauuca

SEQ ID NO: 1253918 - RNA, 22 nt, Human
ucaauagggcccagaugcccaa

SEQ ID NO: 1253919 - RNA, 22 nt, Human
ucacagaauuuuuucccacauu

SEQ ID NO: 1253920 - RNA, 20 nt, Human
ucacaggauuucugccuucu

SEQ ID NO: 1253921 - RNA, 18 nt, Human
ucacagggccuuucucca

SEQ ID NO: 1253922 - RNA, 20 nt, Human
ucaccaacagaccuccuccc

SEQ ID NO: 1253923 - RNA, 21 nt, Human
ucaguacuguaaccaugcaac

SEQ ID NO: 1253924 - RNA, 19 nt, Human
ucaguguuuuauuguugac

SEQ ID NO: 1253925 - RNA, 19 nt, Human
uccaagaaggugaagguuu

SEQ ID NO: 1253926 - RNA, 21 nt, Human
ucccacguacauuacacucag

SEQ ID NO: 1253927 - RNA, 19 nt, Human
ucccagaagcacacucucu

SEQ ID NO: 1253928 - RNA, 18 nt, Human
uccccacgaaagcgaagg

SEQ ID NO: 1253929 - RNA, 24 nt, Human
ucccugggcggggccgccgagggg

SEQ ID NO: 1253930 - RNA, 18 nt, Human
uccucaugaaaagcuuuc

SEQ ID NO: 1253931 - RNA, 22 nt, Human
uccucucacauucauugaauuc

SEQ ID NO: 1253932 - RNA, 21 nt, Human
ucuccauaacccugugguguu

SEQ ID NO: 1253933 - RNA, 21 nt, Human
ucuguacgggguccucugagg

SEQ ID NO: 1253934 - RNA, 23 nt, Human
ucuuauggguacugcaggcugcc

SEQ ID NO: 1253935 - RNA, 27 nt, Human
ugacuacaagugccccaggauaaaaca

SEQ ID NO: 1253936 - RNA, 20 nt, Human
ugacuuggggacucuuccuc

SEQ ID NO: 1253937 - RNA, 22 nt, Human
ugagaaagacuucccacauucc

SEQ ID NO: 1253938 - RNA, 24 nt, Human
ugauguaacucauaggguuucucg

SEQ ID NO: 1253939 - RNA, 22 nt, Human
ugcaauaccccacugagaugag

SEQ ID NO: 1253940 - RNA, 26 nt, Human
ugccccaggauaaaacagagccugca

SEQ ID NO: 1253941 - RNA, 20 nt, Human
ugcuccaacuugcaaaccac

SEQ ID NO: 1253942 - RNA, 20 nt, Human
uggaacgaguccaagaaggu

SEQ ID NO: 1253943 - RNA, 22 nt, Human
uggccggacucuuaccccagcc

SEQ ID NO: 1253944 - RNA, 20 nt, Human
uggcugagagcuuucccaca

SEQ ID NO: 1253945 - RNA, 21 nt, Human
ugggcggggccgccgaggggc

SEQ ID NO: 1253946 - RNA, 21 nt, Human
ugggcguccgggggcggggcc

SEQ ID NO: 1253947 - RNA, 19 nt, Human
uggucuugauuuuccuguc

SEQ ID NO: 1253948 - RNA, 18 nt, Human
ugguuaaauguuuuguuc

SEQ ID NO: 1253949 - RNA, 24 nt, Human
uguaggguuucucuccuguguggg

SEQ ID NO: 1253950 - RNA, 23 nt, Human
ugucagaaaaggcucuuaguugu

SEQ ID NO: 1253951 - RNA, 21 nt, Human
ugugaguucuucucuuauggg

SEQ ID NO: 1253952 - RNA, 20 nt, Human
uguguguucucugauguguu

SEQ ID NO: 1253953 - RNA, 19 nt, Human
uuagagauuucucaccaac

SEQ ID NO: 1253954 - RNA, 21 nt, Human
uuagugaaguugggauucugg

SEQ ID NO: 1253955 - RNA, 22 nt, Human
uuaguuguucauuauauucaca

SEQ ID NO: 1253956 - RNA, 25 nt, Human
uuauggguacugcaggcugccucuu

SEQ ID NO: 1253957 - RNA, 24 nt, Human
uucaaagcuuguuuuuccuuuuug

SEQ ID NO: 1253958 - RNA, 18 nt, Human
uuccaaaugucuacuaca

SEQ ID NO: 1253959 - RNA, 23 nt, Human
uuccaaaugucuacuacagucaa

SEQ ID NO: 1253960 - RNA, 19 nt, Human
uuccagaauucaaaguggc

SEQ ID NO: 1253961 - RNA, 25 nt, Human
uucccacacucauuacauucauaga

SEQ ID NO: 1253962 - RNA, 19 nt, Human
uucuccagcaucaugucuc

SEQ ID NO: 1253963 - RNA, 19 nt, Human
uugaguucuuucaguguca

SEQ ID NO: 1253964 - RNA, 19 nt, Human
uugcuucauuacauucaaa

SEQ ID NO: 1253965 - RNA, 21 nt, Human
uuguuuuuccuuuuugaguuc

SEQ ID NO: 1253966 - RNA, 21 nt, Human
uuuccugguucuucuccauca

SEQ ID NO: 1253967 - RNA, 19 nt, Human
uuuccugucucuucuccau

SEQ ID NO: 1253968 - RNA, 18 nt, Human
uuuccugucucuucuccu

SEQ ID NO: 1253969 - RNA, 23 nt, Human
uuucucagauuagugaauucuga

SEQ ID NO: 1253970 - RNA, 21 nt, Human
uuuugaguucuuucaguguca

SEQ ID NO: 1253971 - RNA, 19 nt, Human
caguugaugaggagaagcu

SEQ ID NO: 1253972 - RNA, 18 nt, Human
gaucugcggcgagucccc

SEQ ID NO: 1253973 - RNA, 18 nt, Human
uccccaguugaugaggag

SEQ ID NO: 1253974 - RNA, 21 nt, Human
uguagagaagaaugacagcug

SEQ ID NO: 1253975 - RNA, 24 nt, Human
aaaaacaacaaaggacccgguacc

SEQ ID NO: 1253976 - RNA, 21 nt, Human
aagaaggaauacagguuugaa

SEQ ID NO: 1253977 - RNA, 22 nt, Human
aagaaggaauacagguuugaaa

SEQ ID NO: 1253978 - RNA, 18 nt, Human
aagcaggaagcaaggacc

SEQ ID NO: 1253979 - RNA, 20 nt, Human
aaggaauacagguuugaaag

SEQ ID NO: 1253980 - RNA, 18 nt, Human
aaucuucaucuucuuccu

SEQ ID NO: 1253981 - RNA, 23 nt, Human
aaugaagauuucuggaacaacua

SEQ ID NO: 1253982 - RNA, 21 nt, Human
agaaggaauacagguuugaaa

SEQ ID NO: 1253983 - RNA, 19 nt, Human
agacagaaucuucaucuuc

SEQ ID NO: 1253984 - RNA, 19 nt, Human
agaccuuggagggcuacag

SEQ ID NO: 1253985 - RNA, 22 nt, Human
agaccuuggagggcuacagcuu

SEQ ID NO: 1253986 - RNA, 22 nt, Human
aggacagccaggcauaugcuca

SEQ ID NO: 1253987 - RNA, 20 nt, Human
agguauugaaaaccaauacu

SEQ ID NO: 1253988 - RNA, 19 nt, Human
agguggugcuggcggaucg

SEQ ID NO: 1253989 - RNA, 19 nt, Human
aucuagcacugaaacaacu

SEQ ID NO: 1253990 - RNA, 23 nt, Human
caaacaagauaaacaacaauaug

SEQ ID NO: 1253991 - RNA, 23 nt, Human
cacaccgcaccccgaaggagcac

SEQ ID NO: 1253992 - RNA, 19 nt, Human
caccgcaccccgaaggagc

SEQ ID NO: 1253993 - RNA, 24 nt, Human
cacuuguuuccucaagaguugcua

SEQ ID NO: 1253994 - RNA, 21 nt, Human
cagccucuuuaaaaacaacaa

SEQ ID NO: 1253995 - RNA, 21 nt, Human
caggaagcaaggaccgaccga

SEQ ID NO: 1253996 - RNA, 19 nt, Human
cagggcccagccgcggggc

SEQ ID NO: 1253997 - RNA, 23 nt, Human
cccauagcgcgaggcgcggaggc

SEQ ID NO: 1253998 - RNA, 23 nt, Human
cccgcagggcuggcuggcccugg

SEQ ID NO: 1253999 - RNA, 18 nt, Human
ccgcaccccgaaggagcc

SEQ ID NO: 1254000 - RNA, 18 nt, Human
cggcagggcccagccgcg

SEQ ID NO: 1254001 - RNA, 19 nt, Human
cugccaggaaguagggagc

SEQ ID NO: 1254002 - RNA, 23 nt, Human
cuugccaagacauccuccuuugc

SEQ ID NO: 1254003 - RNA, 22 nt, Human
cuuugcacuuguuuccucaaga

SEQ ID NO: 1254004 - RNA, 21 nt, Human
cuuuggaaaacuggggagggg

SEQ ID NO: 1254005 - RNA, 23 nt, Human
gaaccaguuuuaacaaucucuga

SEQ ID NO: 1254006 - RNA, 19 nt, Human
gaacuggggaggagggugc

SEQ ID NO: 1254007 - RNA, 20 nt, Human
gaaggagcacggaggcccgc

SEQ ID NO: 1254008 - RNA, 20 nt, Human
gaccaaaaaauuggaaccag

SEQ ID NO: 1254009 - RNA, 22 nt, Human
gacggaaggagggaggaggagc

SEQ ID NO: 1254010 - RNA, 24 nt, Human
gagccgcagcggcgcggcagggcc

SEQ ID NO: 1254011 - RNA, 26 nt, Human
gaggacagccaggcauaugcucagac

SEQ ID NO: 1254012 - RNA, 22 nt, Human
gaggaggagccgcagcggcgcg

SEQ ID NO: 1254013 - RNA, 23 nt, Human
gaggagggugcuuggugacauuu

SEQ ID NO: 1254014 - RNA, 23 nt, Human
gcagggcccagccgcggggcggg

SEQ ID NO: 1254015 - RNA, 18 nt, Human
gccaagacauccuccuuu

SEQ ID NO: 1254016 - RNA, 22 nt, Human
gcugagggcgugacacagcagc

SEQ ID NO: 1254017 - RNA, 22 nt, Human
ggaaaaaaggcauuguaaacac

SEQ ID NO: 1254018 - RNA, 25 nt, Human
ggaucuggggugggagaaggggugg

SEQ ID NO: 1254019 - RNA, 23 nt, Human
ggcgcggaggacggaaggaggga

SEQ ID NO: 1254020 - RNA, 20 nt, Human
ggcgugacacagcagcucgg

SEQ ID NO: 1254021 - RNA, 21 nt, Human
ggcuacagcuuuucauaaaua

SEQ ID NO: 1254022 - RNA, 20 nt, Human
gggcccagccgcggggcggg

SEQ ID NO: 1254023 - RNA, 21 nt, Human
gggcgugacacagcagcucgg

SEQ ID NO: 1254024 - RNA, 21 nt, Human
ggggcaugaggcuccaccccc

SEQ ID NO: 1254025 - RNA, 20 nt, Human
uaaacacuucuauuuaaaau

SEQ ID NO: 1254026 - RNA, 21 nt, Human
uaaccucugguaacugaagug

SEQ ID NO: 1254027 - RNA, 19 nt, Human
uaauacccccaaaaaguaa

SEQ ID NO: 1254028 - RNA, 20 nt, Human
uacacugcagaaguagcuua

SEQ ID NO: 1254029 - RNA, 22 nt, Human
uagcacugaaacaacucuuaau

SEQ ID NO: 1254030 - RNA, 26 nt, Human
uaucuaauaaaugaguuugagaaugc

SEQ ID NO: 1254031 - RNA, 20 nt, Human
ucaaagucacucucaggugu

SEQ ID NO: 1254032 - RNA, 21 nt, Human
ucacuggacugaugauuucua

SEQ ID NO: 1254033 - RNA, 23 nt, Human
uccgcacaccgcaccccgaagga

SEQ ID NO: 1254034 - RNA, 22 nt, Human
ucuuccuuuugugaacugggga

SEQ ID NO: 1254035 - RNA, 24 nt, Human
ugacacagcagcucgguggcggag

SEQ ID NO: 1254036 - RNA, 20 nt, Human
ugcacaggaaacaacaaaac

SEQ ID NO: 1254037 - RNA, 20 nt, Human
uggccagcagccucuuuaaa

SEQ ID NO: 1254038 - RNA, 19 nt, Human
ugggaucuggggugggaga

SEQ ID NO: 1254039 - RNA, 22 nt, Human
uggggaggagggugcuugguga

SEQ ID NO: 1254040 - RNA, 20 nt, Human
uggggagggggaacagggag

SEQ ID NO: 1254041 - RNA, 19 nt, Human
uggggugggagaaggggug

SEQ ID NO: 1254042 - RNA, 21 nt, Human
ugguuacaaagucacaggaug

SEQ ID NO: 1254043 - RNA, 22 nt, Human
uguuugcccugccagcucaggc

SEQ ID NO: 1254044 - RNA, 20 nt, Human
uucuccgcacaccgcacccc

SEQ ID NO: 1254045 - RNA, 19 nt, Human
uugccaagacauccuccuu

SEQ ID NO: 1254046 - RNA, 21 nt, Human
uuggauguauuuccuucuagc

SEQ ID NO: 1254047 - RNA, 23 nt, Human
uuugcccugccagcucaggccuu

SEQ ID NO: 1254048 - RNA, 21 nt, Human
uuuggaaaacuggggaggggg

SEQ ID NO: 1254049 - RNA, 24 nt, Human
uuuuucugagaaaugaccaaaaaa

SEQ ID NO: 1254050 - RNA, 19 nt, Human
aauuacuagaaaauggcgg

SEQ ID NO: 1254051 - RNA, 22 nt, Human
caccuaugaugccauguauuca

SEQ ID NO: 1254052 - RNA, 23 nt, Human
caggugccuuucucuuuggcuuc

SEQ ID NO: 1254053 - RNA, 22 nt, Human
ccagcagcucaggcugcuuccc

SEQ ID NO: 1254054 - RNA, 23 nt, Human
gcugcuucccauugguucucaca

SEQ ID NO: 1254055 - RNA, 19 nt, Human
gggaauagguuccagcagc

SEQ ID NO: 1254056 - RNA, 18 nt, Human
guagagcaggcuggggcu

SEQ ID NO: 1254057 - RNA, 20 nt, Human
ucucuggguagagcaggcug

SEQ ID NO: 1254058 - RNA, 23 nt, Human
uuccagcagcucaggcugcuucc

SEQ ID NO: 1254059 - RNA, 23 nt, Human
uucucuggguagagcaggcuggg

SEQ ID NO: 1254060 - RNA, 20 nt, Human
uuggcuucuuucuuuuucug

SEQ ID NO: 1254061 - RNA, 23 nt, Human
aaagugcugggauuacaggcgug

SEQ ID NO: 1254062 - RNA, 24 nt, Human
aaagugcugggauuacaggcgugg

SEQ ID NO: 1254063 - RNA, 25 nt, Human
aaagugcugggauuacaggcguggg

SEQ ID NO: 1254064 - RNA, 19 nt, Human
aagugcugggauuacaggc

SEQ ID NO: 1254065 - RNA, 19 nt, Human
aagugcugggauuacaggc

SEQ ID NO: 1254066 - RNA, 24 nt, Human
agcgauucuccugccucagccucc

SEQ ID NO: 1254067 - RNA, 23 nt, Human
agcugaaucauucaccgcccagc

SEQ ID NO: 1254068 - RNA, 18 nt, Human
aguagcugggauugcagg

SEQ ID NO: 1254069 - RNA, 22 nt, Human
auuuuuguauuuuuaguagaga

SEQ ID NO: 1254070 - RNA, 24 nt, Human
caaagugcugggauuacaggcgug

SEQ ID NO: 1254071 - RNA, 20 nt, Human
caagcgauucuccugccuca

SEQ ID NO: 1254072 - RNA, 22 nt, Human
caagcgauucuccugccucagc

SEQ ID NO: 1254073 - RNA, 24 nt, Human
cacguugcccaggcugguuucgaa

SEQ ID NO: 1254074 - RNA, 19 nt, Human
cacugcacccagccuugca

SEQ ID NO: 1254075 - RNA, 20 nt, Human
cagccuccugaguagcuggg

SEQ ID NO: 1254076 - RNA, 22 nt, Human
ccaaagugcugggauuacaggc

SEQ ID NO: 1254077 - RNA, 22 nt, Human
ccaaagugcugggauuacaggc

SEQ ID NO: 1254078 - RNA, 22 nt, Human
ccaaagugcugggauuacaggc

SEQ ID NO: 1254079 - RNA, 24 nt, Human
ccaaagugcugggauuacaggcgu

SEQ ID NO: 1254080 - RNA, 23 nt, Human
ccacguugcccaggcugguuucg

SEQ ID NO: 1254081 - RNA, 19 nt, Human
ccacugcacccagccuugc

SEQ ID NO: 1254082 - RNA, 20 nt, Human
ccgcccagcuagcaaugugg

SEQ ID NO: 1254083 - RNA, 22 nt, Human
ccugaguagcugggauugcagg

SEQ ID NO: 1254084 - RNA, 22 nt, Human
ccugaguagcugggauugcagg

SEQ ID NO: 1254085 - RNA, 23 nt, Human
ccugaguagcugggauugcaggu

SEQ ID NO: 1254086 - RNA, 23 nt, Human
ccugccucagccuccugaguagc

SEQ ID NO: 1254087 - RNA, 24 nt, Human
ccugccucagccuccugaguagcu

SEQ ID NO: 1254088 - RNA, 24 nt, Human
cgccacguugcccaggcugguuuc

SEQ ID NO: 1254089 - RNA, 31 nt, Human
cgccacguugcccaggcugguuucgaacucc

SEQ ID NO: 1254090 - RNA, 24 nt, Human
cucagccuccugaguagcugggau

SEQ ID NO: 1254091 - RNA, 23 nt, Human
cugaguagcugggauugcaggug

SEQ ID NO: 1254092 - RNA, 24 nt, Human
cugaguagcugggauugcaggugu

SEQ ID NO: 1254093 - RNA, 24 nt, Human
gaagaugccauucagaugccccuc

SEQ ID NO: 1254094 - RNA, 24 nt, Human
gaggguuucgccacguugcccagg

SEQ ID NO: 1254095 - RNA, 19 nt, Human
gaguagcugggauugcagg

SEQ ID NO: 1254096 - RNA, 18 nt, Human
gauuacaggcgugggcca

SEQ ID NO: 1254097 - RNA, 22 nt, Human
gauuacaggcgugggccacugc

SEQ ID NO: 1254098 - RNA, 23 nt, Human
gauuacaggcgugggccacugca

SEQ ID NO: 1254099 - RNA, 24 nt, Human
gcgauucuccugccucagccuccu

SEQ ID NO: 1254100 - RNA, 18 nt, Human
ggagaguggacuucugga

SEQ ID NO: 1254101 - RNA, 18 nt, Human
gguucaagcgauucuccu

SEQ ID NO: 1254102 - RNA, 24 nt, Human
gugaucugcccgccucggccugcc

SEQ ID NO: 1254103 - RNA, 18 nt, Human
guggacaccuugcacaga

SEQ ID NO: 1254104 - RNA, 24 nt, Human
guuucgccacguugcccaggcugg

SEQ ID NO: 1254105 - RNA, 19 nt, Human
uacaggcgugggccacugc

SEQ ID NO: 1254106 - RNA, 24 nt, Human
uaguagagagaggguuucgccacg

SEQ ID NO: 1254107 - RNA, 20 nt, Human
ucagccuccugaguagcugg

SEQ ID NO: 1254108 - RNA, 23 nt, Human
uccugagcuccggugaucugccc

SEQ ID NO: 1254109 - RNA, 24 nt, Human
uccugaguagcugggauugcaggu

SEQ ID NO: 1254110 - RNA, 24 nt, Human
ucuccugccucagccuccugagua

SEQ ID NO: 1254111 - RNA, 24 nt, Human
ucugucagguggugccccacuuug

SEQ ID NO: 1254112 - RNA, 24 nt, Human
ugcccaggcugguuucgaacuccu

SEQ ID NO: 1254113 - RNA, 28 nt, Human
ugcccaggcugguuucgaacuccugagc

SEQ ID NO: 1254114 - RNA, 24 nt, Human
ugccucagccuccugaguagcugg

SEQ ID NO: 1254115 - RNA, 24 nt, Human
ugcugggauuacaggcgugggcca

SEQ ID NO: 1254116 - RNA, 22 nt, Human
uggaaagagcaggcaaucaaau

SEQ ID NO: 1254117 - RNA, 19 nt, Human
uggaaagggaugcacugca

SEQ ID NO: 1254118 - RNA, 18 nt, Human
ugggauuacaggcguggg

SEQ ID NO: 1254119 - RNA, 19 nt, Human
ugggauuacaggcgugggc

SEQ ID NO: 1254120 - RNA, 21 nt, Human
ugggauuacaggcgugggcca

SEQ ID NO: 1254121 - RNA, 22 nt, Human
ugggauuacaggcgugggccac

SEQ ID NO: 1254122 - RNA, 22 nt, Human
ugggauuacaggcgugggccac

SEQ ID NO: 1254123 - RNA, 24 nt, Human
ugggauuacaggcgugggccacug

SEQ ID NO: 1254124 - RNA, 18 nt, Human
ugggauugcaggugugcg

SEQ ID NO: 1254125 - RNA, 21 nt, Human
ugggauugcaggugugcgcca

SEQ ID NO: 1254126 - RNA, 22 nt, Human
ugggcugaccagcugcagggag

SEQ ID NO: 1254127 - RNA, 18 nt, Human
ugugcgccaacaugugca

SEQ ID NO: 1254128 - RNA, 21 nt, Human
uucaagcgauucuccugccuc

SEQ ID NO: 1254129 - RNA, 23 nt, Human
uucaagcgauucuccugccucag

SEQ ID NO: 1254130 - RNA, 24 nt, Human
uucaagcgauucuccugccucagc

SEQ ID NO: 1254131 - RNA, 20 nt, Human
uugagaauucugucaggugg

SEQ ID NO: 1254132 - RNA, 23 nt, Human
uuucgccacguugcccaggcugg

SEQ ID NO: 1254133 - RNA, 22 nt, Human
uuuuuaguagagagaggguuuc

SEQ ID NO: 1254134 - RNA, 20 nt, Human
uuuuuguauuuuuaguagag

SEQ ID NO: 1254135 - RNA, 18 nt, Human
aacuugcucuucgcucca

SEQ ID NO: 1254136 - RNA, 19 nt, Human
cauauguuggauuccugcu

SEQ ID NO: 1254137 - RNA, 19 nt, Human
uauguuggauuccugcuuu

SEQ ID NO: 1254138 - RNA, 18 nt, Human
ugaacgcauucagcaaca

SEQ ID NO: 1254139 - RNA, 18 nt, Human
ugaauugauuaucaguga

SEQ ID NO: 1254140 - RNA, 19 nt, Human
uuccugcuuugcugcggca

SEQ ID NO: 1254141 - RNA, 22 nt, Human
uugcugcggcacgcaggaagcc

SEQ ID NO: 1254142 - RNA, 21 nt, Human
aaacacaaaaugaagucagga

SEQ ID NO: 1254143 - RNA, 18 nt, Human
aaaggcauaacaaagaag

SEQ ID NO: 1254144 - RNA, 20 nt, Human
aacaaagcgagacuccaucu

SEQ ID NO: 1254145 - RNA, 27 nt, Human
aacaacuuugaacaaaacaguggugac

SEQ ID NO: 1254146 - RNA, 18 nt, Human
aacacggugaaaccccgu

SEQ ID NO: 1254147 - RNA, 19 nt, Human
aacacggugaaaccccguc

SEQ ID NO: 1254148 - RNA, 20 nt, Human
aacacggugaaaccccgucc

SEQ ID NO: 1254149 - RNA, 24 nt, Human
aaccccgucccuacuguaauccca

SEQ ID NO: 1254150 - RNA, 22 nt, Human
aagcaacaaaaauaaugugacc

SEQ ID NO: 1254151 - RNA, 24 nt, Human
aauuguuugaaccagggaggcgga

SEQ ID NO: 1254152 - RNA, 23 nt, Human
acaaagcgagacuccaucuggaa

SEQ ID NO: 1254153 - RNA, 18 nt, Human
acaccgucucuacuaaaa

SEQ ID NO: 1254154 - RNA, 22 nt, Human
acagggcacuuugaaugucccu

SEQ ID NO: 1254155 - RNA, 24 nt, Human
accagggaggcggaggcugcagug

SEQ ID NO: 1254156 - RNA, 24 nt, Human
agcacuuugagaggcugaggcagg

SEQ ID NO: 1254157 - RNA, 24 nt, Human
agccuauagucccagcuacucagg

SEQ ID NO: 1254158 - RNA, 19 nt, Human
agccuggccaauaugguga

SEQ ID NO: 1254159 - RNA, 24 nt, Human
agccugggcaacaaagcgagacuc

SEQ ID NO: 1254160 - RNA, 21 nt, Human
aggaggaauucugagacagcu

SEQ ID NO: 1254161 - RNA, 25 nt, Human
aggaggccaccuagguagagaggau

SEQ ID NO: 1254162 - RNA, 19 nt, Human
aggcagaucacaaggucaa

SEQ ID NO: 1254163 - RNA, 24 nt, Human
aggcaggaauuguuugaaccaggg

SEQ ID NO: 1254164 - RNA, 24 nt, Human
aggcaggcagaucacaaggucaag

SEQ ID NO: 1254165 - RNA, 24 nt, Human
aggcaggcagaucacaaggucaag

SEQ ID NO: 1254166 - RNA, 21 nt, Human
aggccgagguggcuggaucac

SEQ ID NO: 1254167 - RNA, 21 nt, Human
aggcggaggcugcagugagcc

SEQ ID NO: 1254168 - RNA, 24 nt, Human
aggcggaggcugcagugagccgag

SEQ ID NO: 1254169 - RNA, 22 nt, Human
aggcugaggcaggaauuguuug

SEQ ID NO: 1254170 - RNA, 20 nt, Human
agguagagaggauucagucg

SEQ ID NO: 1254171 - RNA, 18 nt, Human
agucccaggaggaggaau

SEQ ID NO: 1254172 - RNA, 20 nt, Human
agugguguuggaggaccuac

SEQ ID NO: 1254173 - RNA, 23 nt, Human
agugguguuggaggaccuacugu

SEQ ID NO: 1254174 - RNA, 24 nt, Human
aucgcgccaaggcacuccagccug

SEQ ID NO: 1254175 - RNA, 20 nt, Human
auggugaaacaccgucucua

SEQ ID NO: 1254176 - RNA, 22 nt, Human
caaacaacugccaggcgagagc

SEQ ID NO: 1254177 - RNA, 24 nt, Human
caaggcacuccagccugggcaaca

SEQ ID NO: 1254178 - RNA, 22 nt, Human
caaggguccgagaccagccugg

SEQ ID NO: 1254179 - RNA, 22 nt, Human
cacaagaaaaaggauggaacag

SEQ ID NO: 1254180 - RNA, 24 nt, Human
cagcacuuugagaggcugaggcag

SEQ ID NO: 1254181 - RNA, 24 nt, Human
cagcacuuugagaggcugaggcag

SEQ ID NO: 1254182 - RNA, 25 nt, Human
cagcaugggggugaccaccacagcg

SEQ ID NO: 1254183 - RNA, 19 nt, Human
cagcguacauuacugacgc

SEQ ID NO: 1254184 - RNA, 24 nt, Human
cagcuacucaggaggcugaggcag

SEQ ID NO: 1254185 - RNA, 23 nt, Human
caggcaaacacaaaaugaaguca

SEQ ID NO: 1254186 - RNA, 21 nt, Human
ccaucuggaaaauugggucac

SEQ ID NO: 1254187 - RNA, 22 nt, Human
cccuacuguaaucccagcacuu

SEQ ID NO: 1254188 - RNA, 22 nt, Human
ccggcacgguggcgggagccuu

SEQ ID NO: 1254189 - RNA, 21 nt, Human
ccuauagucccagcuacucag

SEQ ID NO: 1254190 - RNA, 22 nt, Human
ccucugagagucccaggaggag

SEQ ID NO: 1254191 - RNA, 23 nt, Human
ccuggccaauauggugaaacacc

SEQ ID NO: 1254192 - RNA, 24 nt, Human
ccuggccaauauggugaaacaccg

SEQ ID NO: 1254193 - RNA, 23 nt, Human
ccuggcuaacacggugaaacccc

SEQ ID NO: 1254194 - RNA, 24 nt, Human
ccuggcuaacacggugaaaccccg

SEQ ID NO: 1254195 - RNA, 24 nt, Human
cgagaccagccuggccaauauggu

SEQ ID NO: 1254196 - RNA, 24 nt, Human
cgagaccauccuggcuaacacggu

SEQ ID NO: 1254197 - RNA, 24 nt, Human
cgagaucgcgccaaggcacuccag

SEQ ID NO: 1254198 - RNA, 18 nt, Human
cgaggguccuacgcccac

SEQ ID NO: 1254199 - RNA, 22 nt, Human
cgagguggcuggaucacgacgu

SEQ ID NO: 1254200 - RNA, 24 nt, Human
cgagguggcuggaucacgacguca

SEQ ID NO: 1254201 - RNA, 24 nt, Human
cgccaaggcacuccagccugggca

SEQ ID NO: 1254202 - RNA, 26 nt, Human
cgccaaggcacuccagccugggcaac

SEQ ID NO: 1254203 - RNA, 19 nt, Human
cgcuaaacaaaggauccca

SEQ ID NO: 1254204 - RNA, 18 nt, Human
cggugaaaccccgucccu

SEQ ID NO: 1254205 - RNA, 21 nt, Human
cuaacgcacacaagaaaaagg

SEQ ID NO: 1254206 - RNA, 18 nt, Human
cuacgcccacggagucuc

SEQ ID NO: 1254207 - RNA, 19 nt, Human
cuacuaaaaaauacaaaaa

SEQ ID NO: 1254208 - RNA, 19 nt, Human
cucccacacgaauacugcg

SEQ ID NO: 1254209 - RNA, 21 nt, Human
cucuacuaaaaaauacaaaaa

SEQ ID NO: 1254210 - RNA, 20 nt, Human
cugcagugagccgagaucgc

SEQ ID NO: 1254211 - RNA, 22 nt, Human
cugcagugagccgagaucgcgc

SEQ ID NO: 1254212 - RNA, 18 nt, Human
cuggcuaacacggugaaa

SEQ ID NO: 1254213 - RNA, 19 nt, Human
cuguaaucccagcacuuug

SEQ ID NO: 1254214 - RNA, 24 nt, Human
gaacaaaacagugguguuggagga

SEQ ID NO: 1254215 - RNA, 20 nt, Human
gaauuguuugaaccagggag

SEQ ID NO: 1254216 - RNA, 25 nt, Human
gcaacaaagcgagacuccaucugga

SEQ ID NO: 1254217 - RNA, 24 nt, Human
gcacacaagaaaaaggauggaaca

SEQ ID NO: 1254218 - RNA, 22 nt, Human
gccaaggcacuccagccugggc

SEQ ID NO: 1254219 - RNA, 24 nt, Human
gccaauauggugaaacaccgucuc

SEQ ID NO: 1254220 - RNA, 18 nt, Human
gccaccacaucauuccug

SEQ ID NO: 1254221 - RNA, 18 nt, Human
gcccuuucuaacgcacac

SEQ ID NO: 1254222 - RNA, 22 nt, Human
gcuaacacggugaaaccccguc

SEQ ID NO: 1254223 - RNA, 25 nt, Human
ggaauuguuugaaccagggaggcgg

SEQ ID NO: 1254224 - RNA, 24 nt, Human
ggaggcugcagugagccgagaucg

SEQ ID NO: 1254225 - RNA, 24 nt, Human
ggcucuuuugggaggccgaggugg

SEQ ID NO: 1254226 - RNA, 23 nt, Human
gugauguuuacgcuaaacaaagg

SEQ ID NO: 1254227 - RNA, 22 nt, Human
uaaaagccaucaagcaacaaaa

SEQ ID NO: 1254228 - RNA, 22 nt, Human
uaaaauaagcaaacaacugcca

SEQ ID NO: 1254229 - RNA, 26 nt, Human
uaaaauaagcaaacaacugccaggcg

SEQ ID NO: 1254230 - RNA, 23 nt, Human
uaaaauaagcaaacaacugcccc

SEQ ID NO: 1254231 - RNA, 20 nt, Human
uaaaggaggccaccuaggua

SEQ ID NO: 1254232 - RNA, 19 nt, Human
uaaaggcauaacaaagaag

SEQ ID NO: 1254233 - RNA, 20 nt, Human
uaacacggugaaaccccguc

SEQ ID NO: 1254234 - RNA, 24 nt, Human
uaacacggugaaaccccgucccua

SEQ ID NO: 1254235 - RNA, 21 nt, Human
uaacgcacacaagaaaaagga

SEQ ID NO: 1254236 - RNA, 18 nt, Human
uacuguaaucccagcacu

SEQ ID NO: 1254237 - RNA, 21 nt, Human
uauugcucagaaacuaaagga

SEQ ID NO: 1254238 - RNA, 24 nt, Human
ucacaaggucaaggguccgagacc

SEQ ID NO: 1254239 - RNA, 24 nt, Human
ucacgacgucaggagaucgagacc

SEQ ID NO: 1254240 - RNA, 24 nt, Human
uccagccugggcaacaaagcgaga

SEQ ID NO: 1254241 - RNA, 21 nt, Human
ucccacacgaauacugcgcuu

SEQ ID NO: 1254242 - RNA, 22 nt, Human
ucucuacuaaaaaauacaaaaa

SEQ ID NO: 1254243 - RNA, 18 nt, Human
ucugcugugcagccucca

SEQ ID NO: 1254244 - RNA, 22 nt, Human
ucuuuugggaggccgagguggc

SEQ ID NO: 1254245 - RNA, 22 nt, Human
ugaaaaacggcgcaccacgaga

SEQ ID NO: 1254246 - RNA, 20 nt, Human
ugaagggguucagcaugggg

SEQ ID NO: 1254247 - RNA, 20 nt, Human
ugagaggcugaggcaggcag

SEQ ID NO: 1254248 - RNA, 24 nt, Human
ugagaggcugaggcaggcagauca

SEQ ID NO: 1254249 - RNA, 22 nt, Human
ugagccgagaucgcgccaaggc

SEQ ID NO: 1254250 - RNA, 22 nt, Human
ugaggcaggaauuguuugaacc

SEQ ID NO: 1254251 - RNA, 24 nt, Human
ugaggcaggcagaucacaagguca

SEQ ID NO: 1254252 - RNA, 18 nt, Human
uggccaauauggugaaac

SEQ ID NO: 1254253 - RNA, 19 nt, Human
ugggaggccgagguggcug

SEQ ID NO: 1254254 - RNA, 24 nt, Human
ugggaggccgagguggcuggauca

SEQ ID NO: 1254255 - RNA, 20 nt, Human
ugggggaugaugacacagcg

SEQ ID NO: 1254256 - RNA, 21 nt, Human
ugugcagccuccacagggcac

SEQ ID NO: 1254257 - RNA, 21 nt, Human
uguggaaaggaauaaaagcca

SEQ ID NO: 1254258 - RNA, 18 nt, Human
uuacgcuaaacaaaggau

SEQ ID NO: 1254259 - RNA, 21 nt, Human
uugaaaaacggcgcaccacga

SEQ ID NO: 1254260 - RNA, 25 nt, Human
uugagaggcugaggcaggcagauca

SEQ ID NO: 1254261 - RNA, 25 nt, Human
uugggaggccgagguggcuggauca

SEQ ID NO: 1254262 - RNA, 24 nt, Human
uuguuugaaccagggaggcggagg

SEQ ID NO: 1254263 - RNA, 24 nt, Human
uuucucaggcugcagaugaagggg

SEQ ID NO: 1254264 - RNA, 19 nt, Human
aaaaucauugcaacuuucc

SEQ ID NO: 1254265 - RNA, 18 nt, Human
aacacaccacagcuguau

SEQ ID NO: 1254266 - RNA, 19 nt, Human
aagagccaaagaggacagu

SEQ ID NO: 1254267 - RNA, 22 nt, Human
aagccaaauggcugaaaccagg

SEQ ID NO: 1254268 - RNA, 20 nt, Human
aagccaaauggcugaaaccg

SEQ ID NO: 1254269 - RNA, 21 nt, Human
aggacaguguugggacuaaac

SEQ ID NO: 1254270 - RNA, 21 nt, Human
agguaagaggugaacuuaagg

SEQ ID NO: 1254271 - RNA, 21 nt, Human
auugcaacuuuccagccaagg

SEQ ID NO: 1254272 - RNA, 19 nt, Human
caagcuccucauucccauc

SEQ ID NO: 1254273 - RNA, 22 nt, Human
cacaucuucuaagagccaaaga

SEQ ID NO: 1254274 - RNA, 25 nt, Human
ccaagguaagaggugaacuuaagga

SEQ ID NO: 1254275 - RNA, 22 nt, Human
ccacaucuucuaagagccaaag

SEQ ID NO: 1254276 - RNA, 21 nt, Human
ccugaccucuaucccuuggcc

SEQ ID NO: 1254277 - RNA, 19 nt, Human
cuggucccacaauuccugg

SEQ ID NO: 1254278 - RNA, 22 nt, Human
gaggacaguguugggacuaaac

SEQ ID NO: 1254279 - RNA, 19 nt, Human
gcccagaagggauaugggg

SEQ ID NO: 1254280 - RNA, 24 nt, Human
gcgauagacuauuugguuucuucu

SEQ ID NO: 1254281 - RNA, 25 nt, Human
gcuauugggugaauagaaauuuagg

SEQ ID NO: 1254282 - RNA, 18 nt, Human
gcugacaaaaacugaaca

SEQ ID NO: 1254283 - RNA, 26 nt, Human
ggaaaaaauucacuuauuagcgauaa

SEQ ID NO: 1254284 - RNA, 18 nt, Human
ggcacuguggggccaagg

SEQ ID NO: 1254285 - RNA, 23 nt, Human
uaaaaaacacuaugauaugaggg

SEQ ID NO: 1254286 - RNA, 19 nt, Human
uaagagccaaagaggacag

SEQ ID NO: 1254287 - RNA, 21 nt, Human
uaauuuguauuugauuuccuc

SEQ ID NO: 1254288 - RNA, 24 nt, Human
uagaaaacacuacaugugucgaca

SEQ ID NO: 1254289 - RNA, 19 nt, Human
uauccaagccaucauagcu

SEQ ID NO: 1254290 - RNA, 22 nt, Human
ucccacaauuccuggauuucug

SEQ ID NO: 1254291 - RNA, 27 nt, Human
ucccuuggcaagguaucguauccuggg

SEQ ID NO: 1254292 - RNA, 21 nt, Human
ucuaagagccaaagaggacag

SEQ ID NO: 1254293 - RNA, 25 nt, Human
ucuagguuagagcaugaccgggguc

SEQ ID NO: 1254294 - RNA, 22 nt, Human
ucucucuaauagaaauaaaaau

SEQ ID NO: 1254295 - RNA, 23 nt, Human
ucuuaugagacgcugacaaaaac

SEQ ID NO: 1254296 - RNA, 19 nt, Human
ugaaaccagguaacugcca

SEQ ID NO: 1254297 - RNA, 21 nt, Human
ugacaaaaacugaacacagua

SEQ ID NO: 1254298 - RNA, 26 nt, Human
ugacaaaaacugaacacaguaagccc

SEQ ID NO: 1254299 - RNA, 18 nt, Human
ugaccucuaucccuuggc

SEQ ID NO: 1254300 - RNA, 19 nt, Human
ugagacacuggcacugugg

SEQ ID NO: 1254301 - RNA, 21 nt, Human
ugagacgcugacaaaaacuga

SEQ ID NO: 1254302 - RNA, 19 nt, Human
ugagcaaagcauagaaugc

SEQ ID NO: 1254303 - RNA, 24 nt, Human
uuaaugguaagcuuuaucccuccu

SEQ ID NO: 1254304 - RNA, 22 nt, Human
uuuuuaaaccacuggaugaaua

SEQ ID NO: 1254305 - RNA, 18 nt, Human
agugacaguccucagacu

SEQ ID NO: 1254306 - RNA, 22 nt, Human
cccugcuaccaaaguuuuuuuu

SEQ ID NO: 1254307 - RNA, 24 nt, Human
cuggcccugcuaccaaaguuuuuu

SEQ ID NO: 1254308 - RNA, 20 nt, Human
ugcagugacaguccucagac

SEQ ID NO: 1254309 - RNA, 27 nt, Human
uggcuggcccugcuaccaaaguuuuuu

SEQ ID NO: 1254310 - RNA, 22 nt, Human
aaacagaaagaaaagucucugg

SEQ ID NO: 1254311 - RNA, 21 nt, Human
aaacuguuccagucucuuccg

SEQ ID NO: 1254312 - RNA, 23 nt, Human
accauggaaacuguuccagucuc

SEQ ID NO: 1254313 - RNA, 20 nt, Human
accgugguggcggcagcggc

SEQ ID NO: 1254314 - RNA, 19 nt, Human
acgagcuccucgcacgcgc

SEQ ID NO: 1254315 - RNA, 20 nt, Human
agaaaagccccguagccccc

SEQ ID NO: 1254316 - RNA, 20 nt, Human
agcaggcuguucuccuggag

SEQ ID NO: 1254317 - RNA, 23 nt, Human
aggcagcagaggccucucgcucu

SEQ ID NO: 1254318 - RNA, 23 nt, Human
aggccuuuucugcccucucccgu

SEQ ID NO: 1254319 - RNA, 21 nt, Human
aggcggcugaggccgcggaag

SEQ ID NO: 1254320 - RNA, 27 nt, Human
aggcugcagggcgguugacccaggucu

SEQ ID NO: 1254321 - RNA, 18 nt, Human
aggcugccuuuguacggg

SEQ ID NO: 1254322 - RNA, 22 nt, Human
agggccuggaggcggcggcggg

SEQ ID NO: 1254323 - RNA, 20 nt, Human
agggguuagcguugagccgg

SEQ ID NO: 1254324 - RNA, 18 nt, Human
agguacugcaggcugacc

SEQ ID NO: 1254325 - RNA, 18 nt, Human
cacaagaugcggagacag

SEQ ID NO: 1254326 - RNA, 20 nt, Human
caccccacgacagaucccug

SEQ ID NO: 1254327 - RNA, 21 nt, Human
cacgcccugcagccgguuccc

SEQ ID NO: 1254328 - RNA, 21 nt, Human
cagcaccccacgacagauccc

SEQ ID NO: 1254329 - RNA, 22 nt, Human
cagccgcccagcgcccgcgccc

SEQ ID NO: 1254330 - RNA, 23 nt, Human
cagccuccacuuccccauccucc

SEQ ID NO: 1254331 - RNA, 19 nt, Human
caguaggcuugccgggguc

SEQ ID NO: 1254332 - RNA, 20 nt, Human
ccaaaauaagcagccaccgu

SEQ ID NO: 1254333 - RNA, 22 nt, Human
ccacacccaacgggcugcuuca

SEQ ID NO: 1254334 - RNA, 19 nt, Human
ccagaauguaacaccccaa

SEQ ID NO: 1254335 - RNA, 21 nt, Human
ccaggcccagagcggccgcgc

SEQ ID NO: 1254336 - RNA, 24 nt, Human
ccaggcugccuuuguacgggcuug

SEQ ID NO: 1254337 - RNA, 21 nt, Human
ccaguagucguccucaguagg

SEQ ID NO: 1254338 - RNA, 22 nt, Human
cccagcuccucucugugccccu

SEQ ID NO: 1254339 - RNA, 23 nt, Human
ccccaaaauaagcagccaccgug

SEQ ID NO: 1254340 - RNA, 20 nt, Human
ccccagcaguuuccugcucu

SEQ ID NO: 1254341 - RNA, 20 nt, Human
ccccagcuccucucugugcc

SEQ ID NO: 1254342 - RNA, 20 nt, Human
cccccagcuccucucugugc

SEQ ID NO: 1254343 - RNA, 20 nt, Human
ccccgacuagggccugcgcc

SEQ ID NO: 1254344 - RNA, 20 nt, Human
ccccgcccuggcgcccccgc

SEQ ID NO: 1254345 - RNA, 22 nt, Human
ccccgcccuggcgcccccgcga

SEQ ID NO: 1254346 - RNA, 20 nt, Human
ccccugggcugccgcucccg

SEQ ID NO: 1254347 - RNA, 18 nt, Human
cccuggcgcuccgggggg

SEQ ID NO: 1254348 - RNA, 24 nt, Human
cccuuugccuuuuuccacaacaaa

SEQ ID NO: 1254349 - RNA, 19 nt, Human
ccgcccagcgcccgcgccc

SEQ ID NO: 1254350 - RNA, 18 nt, Human
ccgcgccccgcuagcugc

SEQ ID NO: 1254351 - RNA, 21 nt, Human
ccggagcgcaguggggcuggc

SEQ ID NO: 1254352 - RNA, 25 nt, Human
ccggggucucugcacucuguguccg

SEQ ID NO: 1254353 - RNA, 20 nt, Human
ccggguccaccugcccccug

SEQ ID NO: 1254354 - RNA, 23 nt, Human
ccggguccaccugcccccugcgu

SEQ ID NO: 1254355 - RNA, 21 nt, Human
ccuccacuuccccauccucca

SEQ ID NO: 1254356 - RNA, 19 nt, Human
ccugcgccuggggggaggg

SEQ ID NO: 1254357 - RNA, 18 nt, Human
ccuggcgcuccggggggg

SEQ ID NO: 1254358 - RNA, 24 nt, Human
ccuguagguggagcaggccggggc

SEQ ID NO: 1254359 - RNA, 18 nt, Human
ccuuuucugcccucuccc

SEQ ID NO: 1254360 - RNA, 19 nt, Human
cgaagcaauagccagagac

SEQ ID NO: 1254361 - RNA, 21 nt, Human
cgagcuccucgcacgcgcccg

SEQ ID NO: 1254362 - RNA, 19 nt, Human
cgcccuggcgcccccgcga

SEQ ID NO: 1254363 - RNA, 19 nt, Human
cgcgcgcgcgcuggaacca

SEQ ID NO: 1254364 - RNA, 18 nt, Human
cgcucgagaguccgucag

SEQ ID NO: 1254365 - RNA, 23 nt, Human
cggcggcggggagggaguguugg

SEQ ID NO: 1254366 - RNA, 26 nt, Human
cggcggcggggagggaguguuggggg

SEQ ID NO: 1254367 - RNA, 18 nt, Human
cgggcagcgaggccaggc

SEQ ID NO: 1254368 - RNA, 21 nt, Human
cggggcugcugagcccccugg

SEQ ID NO: 1254369 - RNA, 23 nt, Human
cggggcugcugagcccccugggc

SEQ ID NO: 1254370 - RNA, 20 nt, Human
cgggguuggggcugcuggag

SEQ ID NO: 1254371 - RNA, 19 nt, Human
cgggugagccgcugaaagu

SEQ ID NO: 1254372 - RNA, 23 nt, Human
cuccacacccaacgggcugcuuc

SEQ ID NO: 1254373 - RNA, 21 nt, Human
cuccccuuccugcugaugcuc

SEQ ID NO: 1254374 - RNA, 20 nt, Human
cucccuggaaaggcagcaga

SEQ ID NO: 1254375 - RNA, 19 nt, Human
cuccggggggguggcgcag

SEQ ID NO: 1254376 - RNA, 19 nt, Human
cucggccccccagcuccuc

SEQ ID NO: 1254377 - RNA, 22 nt, Human
cucggcccuggcgcuccggggg

SEQ ID NO: 1254378 - RNA, 21 nt, Human
cucuggaaggaggggcacagg

SEQ ID NO: 1254379 - RNA, 21 nt, Human
cucuguguccgggauccuccu

SEQ ID NO: 1254380 - RNA, 19 nt, Human
cugcccucucccgugcagc

SEQ ID NO: 1254381 - RNA, 20 nt, Human
cugcugagcccccugggcug

SEQ ID NO: 1254382 - RNA, 19 nt, Human
cuggaaggaggggcacagg

SEQ ID NO: 1254383 - RNA, 21 nt, Human
cuuaaugucagccuccacuuc

SEQ ID NO: 1254384 - RNA, 21 nt, Human
cuugacucggcccggcgcguc

SEQ ID NO: 1254385 - RNA, 18 nt, Human
cuugccggggucucugca

SEQ ID NO: 1254386 - RNA, 20 nt, Human
cuuggggaagcggggggggg

SEQ ID NO: 1254387 - RNA, 21 nt, Human
gaaggaggggcacaggguccc

SEQ ID NO: 1254388 - RNA, 20 nt, Human
gagcugccuccggagcgcag

SEQ ID NO: 1254389 - RNA, 18 nt, Human
gccccagcaguuuccugc

SEQ ID NO: 1254390 - RNA, 23 nt, Human
gccccgcugcccgcgccgcggcu

SEQ ID NO: 1254391 - RNA, 23 nt, Human
gccccguagcccccccaguaguc

SEQ ID NO: 1254392 - RNA, 19 nt, Human
gcccgcgccgcggcuccuc

SEQ ID NO: 1254393 - RNA, 21 nt, Human
gcccuggaaggugucgggcuc

SEQ ID NO: 1254394 - RNA, 21 nt, Human
gccgggcagcgaggccaggcu

SEQ ID NO: 1254395 - RNA, 20 nt, Human
gccugcgccuggggggaggg

SEQ ID NO: 1254396 - RNA, 18 nt, Human
gcgccgcggcuccuccuu

SEQ ID NO: 1254397 - RNA, 21 nt, Human
gcgcggcagucgcacgcccag

SEQ ID NO: 1254398 - RNA, 18 nt, Human
gcggcggcggggagggag

SEQ ID NO: 1254399 - RNA, 20 nt, Human
gcgugcaugucugagcuggu

SEQ ID NO: 1254400 - RNA, 22 nt, Human
gcucccagccaagugcccuccu

SEQ ID NO: 1254401 - RNA, 23 nt, Human
gcugcugagcccccugggcugcc

SEQ ID NO: 1254402 - RNA, 20 nt, Human
gcuguucuccuggagguaga

SEQ ID NO: 1254403 - RNA, 23 nt, Human
gcuucagggaagggcuggggccu

SEQ ID NO: 1254404 - RNA, 25 nt, Human
ggaaggaggggcacagggucccaga

SEQ ID NO: 1254405 - RNA, 20 nt, Human
ggaaggugucgggcuccagc

SEQ ID NO: 1254406 - RNA, 22 nt, Human
ggaggcuucgaagcaauagcca

SEQ ID NO: 1254407 - RNA, 24 nt, Human
ggagggccuggaggcggcggcggg

SEQ ID NO: 1254408 - RNA, 18 nt, Human
ggcacagggucccagacg

SEQ ID NO: 1254409 - RNA, 21 nt, Human
ggccaggcagcgcuggcgggg

SEQ ID NO: 1254410 - RNA, 26 nt, Human
ggccgcgcggugcacgcccugcagcc

SEQ ID NO: 1254411 - RNA, 19 nt, Human
gggaagcgggggggggggc

SEQ ID NO: 1254412 - RNA, 18 nt, Human
gggaguguuggggguagc

SEQ ID NO: 1254413 - RNA, 19 nt, Human
gggcaggcugcugagcugg

SEQ ID NO: 1254414 - RNA, 18 nt, Human
gggcuggcucccggggag

SEQ ID NO: 1254415 - RNA, 19 nt, Human
ggggaagcggggggggggg

SEQ ID NO: 1254416 - RNA, 20 nt, Human
gggggagggccuggaggcgg

SEQ ID NO: 1254417 - RNA, 18 nt, Human
ggggguggcgcaggucac

SEQ ID NO: 1254418 - RNA, 19 nt, Human
gggguuggggcugcuggag

SEQ ID NO: 1254419 - RNA, 19 nt, Human
gggguuggggcugcuggag

SEQ ID NO: 1254420 - RNA, 18 nt, Human
ggguagcagggugggguu

SEQ ID NO: 1254421 - RNA, 23 nt, Human
gguggcgcaggucacgucggagc

SEQ ID NO: 1254422 - RNA, 18 nt, Human
gguggcggcagcggcuga

SEQ ID NO: 1254423 - RNA, 22 nt, Human
gugcaaagcagccacagggcag

SEQ ID NO: 1254424 - RNA, 21 nt, Human
gugcagaguggucccaggaaa

SEQ ID NO: 1254425 - RNA, 18 nt, Human
gugcggcggugccggggc

SEQ ID NO: 1254426 - RNA, 19 nt, Human
guggagcaggcuguucucc

SEQ ID NO: 1254427 - RNA, 19 nt, Human
guggagcaggcuguucucc

SEQ ID NO: 1254428 - RNA, 19 nt, Human
gugguggcggcagcggcug

SEQ ID NO: 1254429 - RNA, 23 nt, Human
uaacaccccaaaauaagcagcca

SEQ ID NO: 1254430 - RNA, 19 nt, Human
uagcugcgcuguccgcucg

SEQ ID NO: 1254431 - RNA, 22 nt, Human
uaggaagaagcucuguuugaug

SEQ ID NO: 1254432 - RNA, 23 nt, Human
uaggccuuuucugcccucucccg

SEQ ID NO: 1254433 - RNA, 20 nt, Human
ucagggaagggcuggggccu

SEQ ID NO: 1254434 - RNA, 20 nt, Human
ucagguagaaacagaaagaa

SEQ ID NO: 1254435 - RNA, 19 nt, Human
uccacaacaaaaguccagu

SEQ ID NO: 1254436 - RNA, 19 nt, Human
ucccagccaagugcccucc

SEQ ID NO: 1254437 - RNA, 21 nt, Human
ucccucucuuacaacaccgcc

SEQ ID NO: 1254438 - RNA, 20 nt, Human
ucccuuugccuuuuuccaca

SEQ ID NO: 1254439 - RNA, 20 nt, Human
uccugcugaugcucugcugu

SEQ ID NO: 1254440 - RNA, 18 nt, Human
ucgaagcaauagccagag

SEQ ID NO: 1254441 - RNA, 22 nt, Human
ucggaccuucucggccccccag

SEQ ID NO: 1254442 - RNA, 20 nt, Human
ucucguuuucggaucaggua

SEQ ID NO: 1254443 - RNA, 20 nt, Human
ucugcugucccucucccaug

SEQ ID NO: 1254444 - RNA, 24 nt, Human
ucugugagcagccgcaggcgguuc

SEQ ID NO: 1254445 - RNA, 22 nt, Human
ugagcccccugggcugccgcuc

SEQ ID NO: 1254446 - RNA, 22 nt, Human
ugcagcagcagccgguccaggc

SEQ ID NO: 1254447 - RNA, 22 nt, Human
ugcagccgguucccgugcagca

SEQ ID NO: 1254448 - RNA, 19 nt, Human
ugccacugccgugcaaagc

SEQ ID NO: 1254449 - RNA, 18 nt, Human
ugcgugugggugggugug

SEQ ID NO: 1254450 - RNA, 20 nt, Human
ugcucugcugucccucuccc

SEQ ID NO: 1254451 - RNA, 21 nt, Human
ugcugguuccauuuucggacc

SEQ ID NO: 1254452 - RNA, 19 nt, Human
uggaaaggcagcagaggcc

SEQ ID NO: 1254453 - RNA, 19 nt, Human
uggaaggaggggcacaggg

SEQ ID NO: 1254454 - RNA, 19 nt, Human
uggaggaagagguggcuca

SEQ ID NO: 1254455 - RNA, 20 nt, Human
uggggcugcuggagccucag

SEQ ID NO: 1254456 - RNA, 21 nt, Human
uggggcuggcucccggggagc

SEQ ID NO: 1254457 - RNA, 18 nt, Human
uggggguagcaggguggg

SEQ ID NO: 1254458 - RNA, 18 nt, Human
ugucuguggucuugggga

SEQ ID NO: 1254459 - RNA, 18 nt, Human
uguugggcaaagcucuca

SEQ ID NO: 1254460 - RNA, 22 nt, Human
uuccucggcucucgggugcccc

SEQ ID NO: 1254461 - RNA, 21 nt, Human
uugacccaggucuugacucgg

SEQ ID NO: 1254462 - RNA, 19 nt, Human
uugagccgcaggaacucga

SEQ ID NO: 1254463 - RNA, 23 nt, Human
uugccgagcugccuccggagcgc

SEQ ID NO: 1254464 - RNA, 20 nt, Human
uugccggggucucugcacuc

SEQ ID NO: 1254465 - RNA, 21 nt, Human
uuggggaagcggggggggggg

SEQ ID NO: 1254466 - RNA, 25 nt, Human
uuggggguagcagggugggguuugg

SEQ ID NO: 1254467 - RNA, 20 nt, Human
uuucaugaucaugcgugugg

SEQ ID NO: 1254468 - RNA, 22 nt, Human
uuucaugaucaugcgugugggu

SEQ ID NO: 1254469 - RNA, 22 nt, Human
uuuucugaaagucccucucuua

SEQ ID NO: 1254470 - RNA, 22 nt, Human
uuuuuccacaacaaaaguccag

SEQ ID NO: 1254471 - RNA, 18 nt, Human
acuuuuucuuguuuuuga

SEQ ID NO: 1254472 - RNA, 21 nt, Human
cacuuuuucuuguuuuugaga

SEQ ID NO: 1254473 - RNA, 19 nt, Human
cauagaaaauggugacugc

SEQ ID NO: 1254474 - RNA, 20 nt, Human
ccccuggauaauggaguggg

SEQ ID NO: 1254475 - RNA, 23 nt, Human
uaagagagaaccccauagaaaau

SEQ ID NO: 1254476 - RNA, 21 nt, Human
aaaaaugcagauucccugagc

SEQ ID NO: 1254477 - RNA, 24 nt, Human
aaacugucucaccccuaucucccu

SEQ ID NO: 1254478 - RNA, 19 nt, Human
aaaguaccagaaaacacag

SEQ ID NO: 1254479 - RNA, 22 nt, Human
aaauaaaccucuaacaugacug

SEQ ID NO: 1254480 - RNA, 19 nt, Human
aacugcuuccucuacccua

SEQ ID NO: 1254481 - RNA, 20 nt, Human
aaguaccagaaaacacagau

SEQ ID NO: 1254482 - RNA, 18 nt, Human
aagucaagcugggaacug

SEQ ID NO: 1254483 - RNA, 19 nt, Human
aauagcuacaaagauaaaa

SEQ ID NO: 1254484 - RNA, 18 nt, Human
acugcacuccaggcuggg

SEQ ID NO: 1254485 - RNA, 25 nt, Human
acuuuuuuccuuuaaauauuaaagu

SEQ ID NO: 1254486 - RNA, 21 nt, Human
agaaagaauucagcuguaguc

SEQ ID NO: 1254487 - RNA, 22 nt, Human
agagaacaacccccuuugacug

SEQ ID NO: 1254488 - RNA, 21 nt, Human
agagaucuccuuuuguaaaaa

SEQ ID NO: 1254489 - RNA, 20 nt, Human
agcaaagacugagcagacuc

SEQ ID NO: 1254490 - RNA, 18 nt, Human
aggagugugauauccuug

SEQ ID NO: 1254491 - RNA, 24 nt, Human
aggaucaccugggcucaggaguuu

SEQ ID NO: 1254492 - RNA, 21 nt, Human
aggcaaaaugggaagaccuga

SEQ ID NO: 1254493 - RNA, 18 nt, Human
aggcaggaggaucaccug

SEQ ID NO: 1254494 - RNA, 18 nt, Human
aggcaggaggaucaccug

SEQ ID NO: 1254495 - RNA, 21 nt, Human
aggcaggaggaucaccugggc

SEQ ID NO: 1254496 - RNA, 24 nt, Human
aggcugaggcaggaggaucaccug

SEQ ID NO: 1254497 - RNA, 24 nt, Human
aguuugaggcugcagugagcugag

SEQ ID NO: 1254498 - RNA, 21 nt, Human
auacccacuuuuuuccuuuaa

SEQ ID NO: 1254499 - RNA, 22 nt, Human
auagcuacaaagauaaaaaagc

SEQ ID NO: 1254500 - RNA, 24 nt, Human
aucacaccacugcacuccaggcug

SEQ ID NO: 1254501 - RNA, 23 nt, Human
augauucucagaagcuccccauu

SEQ ID NO: 1254502 - RNA, 23 nt, Human
caaaaugggaagaccugagauca

SEQ ID NO: 1254503 - RNA, 22 nt, Human
caacuaaaucacuagagacuuu

SEQ ID NO: 1254504 - RNA, 20 nt, Human
caccucagacacagaagcac

SEQ ID NO: 1254505 - RNA, 19 nt, Human
cacugcacuccaggcuggg

SEQ ID NO: 1254506 - RNA, 22 nt, Human
cacugcacuccaggcuggguaa

SEQ ID NO: 1254507 - RNA, 23 nt, Human
cacugcacuccaggcuggguaac

SEQ ID NO: 1254508 - RNA, 24 nt, Human
cacugcacuccaggcuggguaaca

SEQ ID NO: 1254509 - RNA, 20 nt, Human
cacuggaggugaggcaaaau

SEQ ID NO: 1254510 - RNA, 21 nt, Human
cagacacagaagcaccucuga

SEQ ID NO: 1254511 - RNA, 19 nt, Human
cagauucccuaagccaaag

SEQ ID NO: 1254512 - RNA, 19 nt, Human
cagcaaagacugagcagac

SEQ ID NO: 1254513 - RNA, 24 nt, Human
cagcuacuugggaggcugaggcag

SEQ ID NO: 1254514 - RNA, 23 nt, Human
cagcuguagucccagcuacuugg

SEQ ID NO: 1254515 - RNA, 24 nt, Human
cagcuguagucccagcuacuuggg

SEQ ID NO: 1254516 - RNA, 21 nt, Human
caggaagagaagaccaacuaa

SEQ ID NO: 1254517 - RNA, 21 nt, Human
cauaucuaacugcuuccucua

SEQ ID NO: 1254518 - RNA, 20 nt, Human
ccacugcacuccaggcuggg

SEQ ID NO: 1254519 - RNA, 20 nt, Human
ccacugcacuccaggcuggg

SEQ ID NO: 1254520 - RNA, 21 nt, Human
ccacugcacuccaggcugggu

SEQ ID NO: 1254521 - RNA, 24 nt, Human
ccacugcacuccaggcuggguaac

SEQ ID NO: 1254522 - RNA, 24 nt, Human
ccaguggagaauucaaaugggauc

SEQ ID NO: 1254523 - RNA, 20 nt, Human
ccauuggagcaccuugugac

SEQ ID NO: 1254524 - RNA, 21 nt, Human
cccaagaucuuuccccuaaaa

SEQ ID NO: 1254525 - RNA, 18 nt, Human
cccacuuuguaccaggaa

SEQ ID NO: 1254526 - RNA, 22 nt, Human
cccauuggagcaccuugugacc

SEQ ID NO: 1254527 - RNA, 20 nt, Human
ccccgccccuggcugccaga

SEQ ID NO: 1254528 - RNA, 22 nt, Human
ccccuaaaauuguucuguuaaa

SEQ ID NO: 1254529 - RNA, 18 nt, Human
ccccuggcugccagagaa

SEQ ID NO: 1254530 - RNA, 20 nt, Human
cccucuuucccuuaauaccc

SEQ ID NO: 1254531 - RNA, 24 nt, Human
ccugugcucauccuuaaccuuggc

SEQ ID NO: 1254532 - RNA, 24 nt, Human
ccuuaaccuuggcaaauaaaccuc

SEQ ID NO: 1254533 - RNA, 21 nt, Human
ccuuuuuuuucccucuuuccc

SEQ ID NO: 1254534 - RNA, 26 nt, Human
cgccccuggcugccagagaacaaccc

SEQ ID NO: 1254535 - RNA, 21 nt, Human
cuaacugcuuccucuacccua

SEQ ID NO: 1254536 - RNA, 23 nt, Human
cuaagucauuccuccacucaccu

SEQ ID NO: 1254537 - RNA, 25 nt, Human
cucauccuuaaccuuggcaaauaaa

SEQ ID NO: 1254538 - RNA, 19 nt, Human
cugcagugagcugagauca

SEQ ID NO: 1254539 - RNA, 20 nt, Human
cugcagugagcugagaucac

SEQ ID NO: 1254540 - RNA, 23 nt, Human
cuggaggugaggcaaaaugggaa

SEQ ID NO: 1254541 - RNA, 21 nt, Human
cuuguaggcccccaagaucuu

SEQ ID NO: 1254542 - RNA, 23 nt, Human
gaaaguuuauccauuuauaagaa

SEQ ID NO: 1254543 - RNA, 21 nt, Human
gaccuuauccuuguuuuacag

SEQ ID NO: 1254544 - RNA, 18 nt, Human
gaggcugcagugagcuga

SEQ ID NO: 1254545 - RNA, 23 nt, Human
gaggcugcagugagcugagauca

SEQ ID NO: 1254546 - RNA, 24 nt, Human
gaucaccugggcucaggaguuuga

SEQ ID NO: 1254547 - RNA, 19 nt, Human
gaugggguucagaaaaugu

SEQ ID NO: 1254548 - RNA, 22 nt, Human
gauugaacagucugcaaaugaa

SEQ ID NO: 1254549 - RNA, 23 nt, Human
gcaaagacugagcagacucaaag

SEQ ID NO: 1254550 - RNA, 24 nt, Human
gcucaggaguuugaggcugcagug

SEQ ID NO: 1254551 - RNA, 20 nt, Human
gcugagaucacaccacugca

SEQ ID NO: 1254552 - RNA, 21 nt, Human
gcuguagucccagcuacuugg

SEQ ID NO: 1254553 - RNA, 23 nt, Human
ggagcaccuugugacccccgccc

SEQ ID NO: 1254554 - RNA, 22 nt, Human
ggaggaucaccugggcucagga

SEQ ID NO: 1254555 - RNA, 22 nt, Human
ggaucaccugggcucaggaguu

SEQ ID NO: 1254556 - RNA, 18 nt, Human
gggaagguauucuguucu

SEQ ID NO: 1254557 - RNA, 23 nt, Human
ggggcagaggacagaacuaaguc

SEQ ID NO: 1254558 - RNA, 19 nt, Human
guaccaggaagagaagacc

SEQ ID NO: 1254559 - RNA, 23 nt, Human
guauaugcacccccaauucaccu

SEQ ID NO: 1254560 - RNA, 22 nt, Human
uaagaaaaauuuacaucuauaa

SEQ ID NO: 1254561 - RNA, 19 nt, Human
uaagagagcacuggaggug

SEQ ID NO: 1254562 - RNA, 19 nt, Human
uacaagggucauaaggaca

SEQ ID NO: 1254563 - RNA, 19 nt, Human
uaccccagauucccuaagc

SEQ ID NO: 1254564 - RNA, 21 nt, Human
uaccccagauucccuaagcca

SEQ ID NO: 1254565 - RNA, 19 nt, Human
uauuccucuacucucuuuc

SEQ ID NO: 1254566 - RNA, 23 nt, Human
ucacaccacugcacuccaggcug

SEQ ID NO: 1254567 - RNA, 23 nt, Human
ucaccugggcucaggaguuugag

SEQ ID NO: 1254568 - RNA, 21 nt, Human
ucagaagcuccccauuggagc

SEQ ID NO: 1254569 - RNA, 25 nt, Human
ucagcaaagacugagcagacucaaa

SEQ ID NO: 1254570 - RNA, 19 nt, Human
ucaggaguuugaggcugca

SEQ ID NO: 1254571 - RNA, 19 nt, Human
ucauuccaucaaccuuugu

SEQ ID NO: 1254572 - RNA, 20 nt, Human
uccacauaugacuguaagag

SEQ ID NO: 1254573 - RNA, 21 nt, Human
uccuccacucaccugagacaa

SEQ ID NO: 1254574 - RNA, 18 nt, Human
uccuuuuuuuucccucuu

SEQ ID NO: 1254575 - RNA, 22 nt, Human
ucuccuggacaaugauucucag

SEQ ID NO: 1254576 - RNA, 18 nt, Human
ucugacaauguaaauuga

SEQ ID NO: 1254577 - RNA, 22 nt, Human
ucugcauaacagaccuuauccu

SEQ ID NO: 1254578 - RNA, 23 nt, Human
ucuucuguugcaggaguccugau

SEQ ID NO: 1254579 - RNA, 21 nt, Human
ugaauagucacuuuacaaggg

SEQ ID NO: 1254580 - RNA, 19 nt, Human
ugacugagacucgcugcag

SEQ ID NO: 1254581 - RNA, 18 nt, Human
ugagaucacaccacugca

SEQ ID NO: 1254582 - RNA, 24 nt, Human
ugagaucacaccacugcacuccag

SEQ ID NO: 1254583 - RNA, 20 nt, Human
ugaggcaggaggaucaccug

SEQ ID NO: 1254584 - RNA, 23 nt, Human
ugaggcaggaggaucaccugggc

SEQ ID NO: 1254585 - RNA, 25 nt, Human
ugaggcaggaggaucaccugggcuc

SEQ ID NO: 1254586 - RNA, 27 nt, Human
ugaggcaggaggaucaccugggcucca

SEQ ID NO: 1254587 - RNA, 20 nt, Human
uggaagaaagaauucagcug

SEQ ID NO: 1254588 - RNA, 22 nt, Human
uggagcaccuugugacccccgc

SEQ ID NO: 1254589 - RNA, 20 nt, Human
ugggaggcugaggcaggagg

SEQ ID NO: 1254590 - RNA, 24 nt, Human
ugggaggcugaggcaggaggauca

SEQ ID NO: 1254591 - RNA, 19 nt, Human
ugggagggggaaaacaaug

SEQ ID NO: 1254592 - RNA, 29 nt, Human
ugggagggggaaaacaaugauugaacagu

SEQ ID NO: 1254593 - RNA, 24 nt, Human
ugggauccuugguccuugauucuu

SEQ ID NO: 1254594 - RNA, 22 nt, Human
ugugaaaggaaaauaaaucuca

SEQ ID NO: 1254595 - RNA, 23 nt, Human
ugugauauccuugcugggaaggu

SEQ ID NO: 1254596 - RNA, 21 nt, Human
uguggauucagcaaagacuga

SEQ ID NO: 1254597 - RNA, 24 nt, Human
uucaccucuauggcaccucagaca

SEQ ID NO: 1254598 - RNA, 26 nt, Human
uucagcaaagacugagcagacucaaa

SEQ ID NO: 1254599 - RNA, 21 nt, Human
uucagcuguagucccagcuac

SEQ ID NO: 1254600 - RNA, 25 nt, Human
uucugaauagucacuuuacaagggu

SEQ ID NO: 1254601 - RNA, 25 nt, Human
uugggaggcugaggcaggaggauca

SEQ ID NO: 1254602 - RNA, 22 nt, Human
uugguccuugauucuucuugga

SEQ ID NO: 1254603 - RNA, 23 nt, Human
uuuaaauauuaaaguaccagaaa

SEQ ID NO: 1254604 - RNA, 23 nt, Human
uuucccucuuucccuuaauaccc

SEQ ID NO: 1254605 - RNA, 21 nt, Human
uuugguggucuuuucacgugg

SEQ ID NO: 1254606 - RNA, 18 nt, Human
uuuuuuuucccucuuucc

SEQ ID NO: 1254607 - RNA, 21 nt, Human
uuagaacugcaaucuccucuc

SEQ ID NO: 1254608 - RNA, 24 nt, Human
accaacgccacacacccuugccua

SEQ ID NO: 1254609 - RNA, 26 nt, Human
acccugcccaucucugcccacagagc

SEQ ID NO: 1254610 - RNA, 23 nt, Human
acgccacacacccuugccuaagc

SEQ ID NO: 1254611 - RNA, 22 nt, Human
agccccuggcucuggugccucc

SEQ ID NO: 1254612 - RNA, 22 nt, Human
cacacacccuugccuaagcccc

SEQ ID NO: 1254613 - RNA, 21 nt, Human
ccaacgccacacacccuugcc

SEQ ID NO: 1254614 - RNA, 18 nt, Human
cccacagagccagucacc

SEQ ID NO: 1254615 - RNA, 22 nt, Human
cccugcccaucucugcccacag

SEQ ID NO: 1254616 - RNA, 19 nt, Human
ccggcugccuuaguguugc

SEQ ID NO: 1254617 - RNA, 25 nt, Human
ccgggccguggcugcugagcugggc

SEQ ID NO: 1254618 - RNA, 18 nt, Human
ccuaagccccuggcucug

SEQ ID NO: 1254619 - RNA, 21 nt, Human
ccuugccuaagccccuggcuc

SEQ ID NO: 1254620 - RNA, 18 nt, Human
cuaagccccuggcucugg

SEQ ID NO: 1254621 - RNA, 24 nt, Human
cugggcacccugcccaucucugcc

SEQ ID NO: 1254622 - RNA, 20 nt, Human
gccguggcugcugagcuggg

SEQ ID NO: 1254623 - RNA, 21 nt, Human
uaaaaccaacgccacacaccc

SEQ ID NO: 1254624 - RNA, 20 nt, Human
uaagccccuggcucuggugc

SEQ ID NO: 1254625 - RNA, 25 nt, Human
uaagccccuggcucuggugccucca

SEQ ID NO: 1254626 - RNA, 21 nt, Human
ucuugacaccaccaauggcug

SEQ ID NO: 1254627 - RNA, 25 nt, Human
ugcaguuaaaaccaacgccacacac

SEQ ID NO: 1254628 - RNA, 18 nt, Human
ugccuaagccccuggcuc

SEQ ID NO: 1254629 - RNA, 22 nt, Human
uggcugcugagcugggcacccu

SEQ ID NO: 1254630 - RNA, 20 nt, Human
aaaaaggaauacagagaaaa

SEQ ID NO: 1254631 - RNA, 18 nt, Human
aaaagaacagaagagcaa

SEQ ID NO: 1254632 - RNA, 19 nt, Human
aaaaugcugggauuauagg

SEQ ID NO: 1254633 - RNA, 23 nt, Human
aaaaugcugggauuauaggugua

SEQ ID NO: 1254634 - RNA, 21 nt, Human
aaagaaaagacacauugaaaa

SEQ ID NO: 1254635 - RNA, 24 nt, Human
aaagaaaagacacauugaaaauga

SEQ ID NO: 1254636 - RNA, 24 nt, Human
aaagaucaugaagaagaaaaauaa

SEQ ID NO: 1254637 - RNA, 21 nt, Human
aaauaaagauggaauuuuuug

SEQ ID NO: 1254638 - RNA, 26 nt, Human
aaaugcugggauuauagguguaaacc

SEQ ID NO: 1254639 - RNA, 24 nt, Human
aacaacuugaaaucuacaauuuga

SEQ ID NO: 1254640 - RNA, 22 nt, Human
aaccaggagccagggaugaccc

SEQ ID NO: 1254641 - RNA, 23 nt, Human
aaccaggagccagggaugaccca

SEQ ID NO: 1254642 - RNA, 18 nt, Human
aagaaaagacacauugaa

SEQ ID NO: 1254643 - RNA, 20 nt, Human
aagaaaagacacauugaaaa

SEQ ID NO: 1254644 - RNA, 18 nt, Human
aagaaaggcagacuucaa

SEQ ID NO: 1254645 - RNA, 23 nt, Human
aagagaaaagaucaugaagaaga

SEQ ID NO: 1254646 - RNA, 22 nt, Human
aagcaagaggaaguggcuauga

SEQ ID NO: 1254647 - RNA, 19 nt, Human
aaggacaaaaaggaauaca

SEQ ID NO: 1254648 - RNA, 24 nt, Human
aaguagcugggauuacaggugugu

SEQ ID NO: 1254649 - RNA, 25 nt, Human
aaguagcugggauuacaggugugua

SEQ ID NO: 1254650 - RNA, 23 nt, Human
aauaacaauagagaauaaaagga

SEQ ID NO: 1254651 - RNA, 21 nt, Human
aauagcuaaaauugaagaagu

SEQ ID NO: 1254652 - RNA, 22 nt, Human
aaugcuccucucugggccaguu

SEQ ID NO: 1254653 - RNA, 21 nt, Human
aauucucgugccucagccucc

SEQ ID NO: 1254654 - RNA, 21 nt, Human
acacugcaccaagacgagaca

SEQ ID NO: 1254655 - RNA, 23 nt, Human
acaggauagagaaggucaaccac

SEQ ID NO: 1254656 - RNA, 20 nt, Human
acaucguuguuuaccagccc

SEQ ID NO: 1254657 - RNA, 21 nt, Human
acccuccuuaauguaagaaac

SEQ ID NO: 1254658 - RNA, 25 nt, Human
accuaccacaccauaaacuauaaac

SEQ ID NO: 1254659 - RNA, 23 nt, Human
accucagcuucccaaaaugcugg

SEQ ID NO: 1254660 - RNA, 24 nt, Human
acugaaggaccuaccacaccauaa

SEQ ID NO: 1254661 - RNA, 24 nt, Human
acugcaccaagacgagacaaagua

SEQ ID NO: 1254662 - RNA, 22 nt, Human
acuuuuuguauuuuuaguagag

SEQ ID NO: 1254663 - RNA, 20 nt, Human
agaaaagaucaugaagaaga

SEQ ID NO: 1254664 - RNA, 20 nt, Human
agaacagaagagcaaggaug

SEQ ID NO: 1254665 - RNA, 21 nt, Human
agaagaaaaauaaaacucaaa

SEQ ID NO: 1254666 - RNA, 20 nt, Human
agaagauuuucccaugaagg

SEQ ID NO: 1254667 - RNA, 18 nt, Human
agagaacaccauggagac

SEQ ID NO: 1254668 - RNA, 21 nt, Human
agaggaacaaagaaguucugg

SEQ ID NO: 1254669 - RNA, 21 nt, Human
agaggggcagagaggaacaaa

SEQ ID NO: 1254670 - RNA, 18 nt, Human
agauauacaguccagugu

SEQ ID NO: 1254671 - RNA, 19 nt, Human
agcaaaagaaccaggaagg

SEQ ID NO: 1254672 - RNA, 24 nt, Human
agccucaagugauucgcccaccuc

SEQ ID NO: 1254673 - RNA, 23 nt, Human
agccugcauguggagcuucuguu

SEQ ID NO: 1254674 - RNA, 24 nt, Human
agcuggucucaaacuccuagccuc

SEQ ID NO: 1254675 - RNA, 19 nt, Human
aggaacaaagaaguucugg

SEQ ID NO: 1254676 - RNA, 22 nt, Human
aggcaauagagccaccuaagca

SEQ ID NO: 1254677 - RNA, 21 nt, Human
agguguaaaccaccaugccca

SEQ ID NO: 1254678 - RNA, 19 nt, Human
aguauaaaauccuauaacc

SEQ ID NO: 1254679 - RNA, 19 nt, Human
agucaacaugaacuaaacu

SEQ ID NO: 1254680 - RNA, 24 nt, Human
agugauucgcccaccucagcuucc

SEQ ID NO: 1254681 - RNA, 18 nt, Human
agugcaguggugugaucc

SEQ ID NO: 1254682 - RNA, 20 nt, Human
agugcaguggugugaucccg

SEQ ID NO: 1254683 - RNA, 23 nt, Human
agugcaguggugugaucccggcu

SEQ ID NO: 1254684 - RNA, 24 nt, Human
agugcaguggugugaucccggcuc

SEQ ID NO: 1254685 - RNA, 24 nt, Human
auaagacaaagaaaggcagacuuc

SEQ ID NO: 1254686 - RNA, 22 nt, Human
augaagaagaaaaauaaaacuc

SEQ ID NO: 1254687 - RNA, 18 nt, Human
augggguuucgccauguu

SEQ ID NO: 1254688 - RNA, 25 nt, Human
augggguuucgccauguuggccaag

SEQ ID NO: 1254689 - RNA, 23 nt, Human
auuacaaaccucugaaaauucag

SEQ ID NO: 1254690 - RNA, 21 nt, Human
auuacagguguguaccaccau

SEQ ID NO: 1254691 - RNA, 19 nt, Human
auuugggagauguaauaug

SEQ ID NO: 1254692 - RNA, 24 nt, Human
caaaaugcugggauuauaggugua

SEQ ID NO: 1254693 - RNA, 22 nt, Human
caaagaaaggcagacuucaaac

SEQ ID NO: 1254694 - RNA, 20 nt, Human
caacagaggccaauggggga

SEQ ID NO: 1254695 - RNA, 23 nt, Human
caaccuccaccucccagguucaa

SEQ ID NO: 1254696 - RNA, 27 nt, Human
caagcaauucucgugccucagccuccc

SEQ ID NO: 1254697 - RNA, 22 nt, Human
cacaccauaaacuauaaacaga

SEQ ID NO: 1254698 - RNA, 24 nt, Human
cacaccauaaacuauaaacagaag

SEQ ID NO: 1254699 - RNA, 21 nt, Human
cacaucguuguuuaccagccc

SEQ ID NO: 1254700 - RNA, 25 nt, Human
caccauggagaccaagggaaacccu

SEQ ID NO: 1254701 - RNA, 22 nt, Human
cacugcaccaagacgagacaaa

SEQ ID NO: 1254702 - RNA, 24 nt, Human
cacugcaccaagacgagacaaagu

SEQ ID NO: 1254703 - RNA, 19 nt, Human
caggaagaagaggcauuuc

SEQ ID NO: 1254704 - RNA, 19 nt, Human
caucuuuaacauuuuuaag

SEQ ID NO: 1254705 - RNA, 23 nt, Human
caugaagaagaaaaauaaaacuc

SEQ ID NO: 1254706 - RNA, 24 nt, Human
cauguuggccaagcuggucucaaa

SEQ ID NO: 1254707 - RNA, 21 nt, Human
cauugcaaccuccaccuccca

SEQ ID NO: 1254708 - RNA, 20 nt, Human
ccaaaaugcugggauuauag

SEQ ID NO: 1254709 - RNA, 21 nt, Human
ccaaaaugcugggauuauagg

SEQ ID NO: 1254710 - RNA, 24 nt, Human
ccaaaaugcugggauuauaggugu

SEQ ID NO: 1254711 - RNA, 24 nt, Human
ccaaagggagcaaaaaacaugaca

SEQ ID NO: 1254712 - RNA, 21 nt, Human
ccaaguagcugggauuacagg

SEQ ID NO: 1254713 - RNA, 24 nt, Human
ccaaguagcugggauuacaggugu

SEQ ID NO: 1254714 - RNA, 26 nt, Human
ccaccucccagguucaagcaauucuu

SEQ ID NO: 1254715 - RNA, 22 nt, Human
ccauaaacuauaaacagaagau

SEQ ID NO: 1254716 - RNA, 22 nt, Human
ccauguuggccaagcuggucuc

SEQ ID NO: 1254717 - RNA, 23 nt, Human
cccaaguagcugggauuacaggu

SEQ ID NO: 1254718 - RNA, 24 nt, Human
cccaaguagcugggauuacaggug

SEQ ID NO: 1254719 - RNA, 23 nt, Human
cccaauuacuuuuuguauuuuua

SEQ ID NO: 1254720 - RNA, 19 nt, Human
cccaggcuggagugcagug

SEQ ID NO: 1254721 - RNA, 20 nt, Human
cccagguucaagcaauucuc

SEQ ID NO: 1254722 - RNA, 19 nt, Human
ccccacuuaaacaugaacc

SEQ ID NO: 1254723 - RNA, 22 nt, Human
ccccuuucuagauauacagucc

SEQ ID NO: 1254724 - RNA, 24 nt, Human
ccuagccucaagugauucgcccac

SEQ ID NO: 1254725 - RNA, 22 nt, Human
ccucccagguucaagcaauucu

SEQ ID NO: 1254726 - RNA, 19 nt, Human
ccuggacccucauaugaag

SEQ ID NO: 1254727 - RNA, 24 nt, Human
cgccauguuggccaagcuggucuc

SEQ ID NO: 1254728 - RNA, 27 nt, Human
cgccauguuggccaagcuggucucaaa

SEQ ID NO: 1254729 - RNA, 24 nt, Human
cgcucugucgcccaggcuggagug

SEQ ID NO: 1254730 - RNA, 22 nt, Human
cuaaauaacaauagagaauaaa

SEQ ID NO: 1254731 - RNA, 24 nt, Human
cuaagcaacacuuacaccuccacu

SEQ ID NO: 1254732 - RNA, 26 nt, Human
cuaccacaccauaaacuauaaacaga

SEQ ID NO: 1254733 - RNA, 23 nt, Human
cucaagugauucgcccaccucag

SEQ ID NO: 1254734 - RNA, 24 nt, Human
cucaagugauucgcccaccucagc

SEQ ID NO: 1254735 - RNA, 24 nt, Human
cucagccucccaaguagcugggau

SEQ ID NO: 1254736 - RNA, 19 nt, Human
cucauugcaaccuccaccu

SEQ ID NO: 1254737 - RNA, 24 nt, Human
cucauugcaaccuccaccucccag

SEQ ID NO: 1254738 - RNA, 19 nt, Human
cuccuagccucaagugauu

SEQ ID NO: 1254739 - RNA, 25 nt, Human
cuccucuaucucaucuuuuucacac

SEQ ID NO: 1254740 - RNA, 20 nt, Human
cuccucucuucuaaaggagc

SEQ ID NO: 1254741 - RNA, 19 nt, Human
cuccuuaauguaagaaacg

SEQ ID NO: 1254742 - RNA, 24 nt, Human
cuccuuaauguaagaaacgaaagc

SEQ ID NO: 1254743 - RNA, 24 nt, Human
cucgcucugucgcccaggcuggag

SEQ ID NO: 1254744 - RNA, 25 nt, Human
cucgugccucagccucccaaguagc

SEQ ID NO: 1254745 - RNA, 23 nt, Human
cucugucgcccaggcuggagugc

SEQ ID NO: 1254746 - RNA, 23 nt, Human
cugaaguccuauucuggauagca

SEQ ID NO: 1254747 - RNA, 18 nt, Human
cuggcuccaaggccucgg

SEQ ID NO: 1254748 - RNA, 21 nt, Human
cugggauuauagguguaaacc

SEQ ID NO: 1254749 - RNA, 21 nt, Human
cuuaaacaugaaccuggaccc

SEQ ID NO: 1254750 - RNA, 24 nt, Human
cuuuuuguauuuuuaguagagaug

SEQ ID NO: 1254751 - RNA, 20 nt, Human
gaaauaccgaauuugaacaa

SEQ ID NO: 1254752 - RNA, 21 nt, Human
gaaccaugcugcuacauuaga

SEQ ID NO: 1254753 - RNA, 18 nt, Human
gagaagaauuaaaauaga

SEQ ID NO: 1254754 - RNA, 18 nt, Human
gagaauaaaaggacagcc

SEQ ID NO: 1254755 - RNA, 20 nt, Human
gagaugggguuucgccaugu

SEQ ID NO: 1254756 - RNA, 24 nt, Human
gagaugggguuucgccauguuggc

SEQ ID NO: 1254757 - RNA, 20 nt, Human
gauggucuuuucccaaguga

SEQ ID NO: 1254758 - RNA, 22 nt, Human
gauuacagguguguaccaccau

SEQ ID NO: 1254759 - RNA, 24 nt, Human
gauuauagguguaaaccaccaugc

SEQ ID NO: 1254760 - RNA, 21 nt, Human
gcaaaaaacaugacaaggcca

SEQ ID NO: 1254761 - RNA, 24 nt, Human
gcaaauaaaaaggaaguaucuaaa

SEQ ID NO: 1254762 - RNA, 20 nt, Human
gcaacagaggccaauggggg

SEQ ID NO: 1254763 - RNA, 24 nt, Human
gcaugccaagaacagaggggcaga

SEQ ID NO: 1254764 - RNA, 24 nt, Human
gcauuucagggggcaacagaggcc

SEQ ID NO: 1254765 - RNA, 20 nt, Human
gcccaggcuggagugcagug

SEQ ID NO: 1254766 - RNA, 23 nt, Human
gcccaggcuggagugcaguggug

SEQ ID NO: 1254767 - RNA, 24 nt, Human
gcccaggcuggagugcaguggugu

SEQ ID NO: 1254768 - RNA, 19 nt, Human
gcuccaaggccucggccca

SEQ ID NO: 1254769 - RNA, 25 nt, Human
gcuggagugcaguggugugaucccg

SEQ ID NO: 1254770 - RNA, 23 nt, Human
ggaaggacaaaaaggaauacaga

SEQ ID NO: 1254771 - RNA, 19 nt, Human
ggaauuuuuugaagcaaga

SEQ ID NO: 1254772 - RNA, 21 nt, Human
ggagaccaagggaaacccucc

SEQ ID NO: 1254773 - RNA, 22 nt, Human
ggagagacagcaaggcacacug

SEQ ID NO: 1254774 - RNA, 23 nt, Human
ggagagguuacauaugcuggauu

SEQ ID NO: 1254775 - RNA, 24 nt, Human
ggauuacagguguguaccaccaug

SEQ ID NO: 1254776 - RNA, 24 nt, Human
ggauuauagguguaaaccaccaug

SEQ ID NO: 1254777 - RNA, 22 nt, Human
ggcaacagaggccaauggggga

SEQ ID NO: 1254778 - RNA, 22 nt, Human
ggcuggagugcaguggugugau

SEQ ID NO: 1254779 - RNA, 18 nt, Human
gggguuucgccauguugg

SEQ ID NO: 1254780 - RNA, 22 nt, Human
gggguuucgccauguuggccaa

SEQ ID NO: 1254781 - RNA, 18 nt, Human
ggguuucgccauguuggc

SEQ ID NO: 1254782 - RNA, 22 nt, Human
ggguuucgccauguuggccaag

SEQ ID NO: 1254783 - RNA, 23 nt, Human
guagagaugggguuucgccaugu

SEQ ID NO: 1254784 - RNA, 18 nt, Human
guagcugggauuacaggu

SEQ ID NO: 1254785 - RNA, 19 nt, Human
guagggcaaaagaacagaa

SEQ ID NO: 1254786 - RNA, 22 nt, Human
guagggcaaaagaacagaagag

SEQ ID NO: 1254787 - RNA, 18 nt, Human
gucuuuucccaagugagu

SEQ ID NO: 1254788 - RNA, 21 nt, Human
gugaguagggcaaaagaacag

SEQ ID NO: 1254789 - RNA, 23 nt, Human
gugaguagggcaaaagaacagaa

SEQ ID NO: 1254790 - RNA, 24 nt, Human
gugauucgcccaccucagcuuccc

SEQ ID NO: 1254791 - RNA, 22 nt, Human
gugccucagccucccaaguagc

SEQ ID NO: 1254792 - RNA, 23 nt, Human
gugccucagccucccaaguagcu

SEQ ID NO: 1254793 - RNA, 22 nt, Human
uaaaauccuauaaccauucccc

SEQ ID NO: 1254794 - RNA, 20 nt, Human
uaaauaagacaaagaaaggc

SEQ ID NO: 1254795 - RNA, 21 nt, Human
uaaauaagacaaagaaaggcu

SEQ ID NO: 1254796 - RNA, 21 nt, Human
uaagcaacacuuacaccucca

SEQ ID NO: 1254797 - RNA, 23 nt, Human
uaaguacacuugcauuuguuuaa

SEQ ID NO: 1254798 - RNA, 24 nt, Human
uaaguacacuugcauuuguuuaag

SEQ ID NO: 1254799 - RNA, 18 nt, Human
uacacacugaugugguca

SEQ ID NO: 1254800 - RNA, 23 nt, Human
uaccacaccauaaacuauaaaca

SEQ ID NO: 1254801 - RNA, 25 nt, Human
uaccacaccauaaacuauaaacaga

SEQ ID NO: 1254802 - RNA, 24 nt, Human
uacuuuuuguauuuuuaguagaga

SEQ ID NO: 1254803 - RNA, 18 nt, Human
uagaagccuacaacuccc

SEQ ID NO: 1254804 - RNA, 25 nt, Human
uagaagccuacaacucccaugaaag

SEQ ID NO: 1254805 - RNA, 22 nt, Human
uagagaugggguuucgccaugu

SEQ ID NO: 1254806 - RNA, 19 nt, Human
uagcaauaaaguuucuuua

SEQ ID NO: 1254807 - RNA, 20 nt, Human
uagguguaaaccaccaugcc

SEQ ID NO: 1254808 - RNA, 24 nt, Human
uaguagagaugggguuucgccaug

SEQ ID NO: 1254809 - RNA, 22 nt, Human
uauaaccauuccccuuucuaga

SEQ ID NO: 1254810 - RNA, 25 nt, Human
uauagagccaaagggagcaaaaaac

SEQ ID NO: 1254811 - RNA, 22 nt, Human
uaucucaucuuuuucacacaaa

SEQ ID NO: 1254812 - RNA, 23 nt, Human
uaucucaucuuuuucacacaaag

SEQ ID NO: 1254813 - RNA, 26 nt, Human
uaugaagcagcagaggaaaagaauua

SEQ ID NO: 1254814 - RNA, 23 nt, Human
uaugcuggauucuggcaccaggg

SEQ ID NO: 1254815 - RNA, 20 nt, Human
ucaagaggcaggaaaauuca

SEQ ID NO: 1254816 - RNA, 26 nt, Human
ucagaaaaaauauuugacuuuuauca

SEQ ID NO: 1254817 - RNA, 22 nt, Human
ucagcaauagcuaaaauugaag

SEQ ID NO: 1254818 - RNA, 24 nt, Human
ucagcaucucuaaaaaaaauuguc

SEQ ID NO: 1254819 - RNA, 18 nt, Human
ucagccucccaaguagcu

SEQ ID NO: 1254820 - RNA, 20 nt, Human
ucagccucccaaguagcugg

SEQ ID NO: 1254821 - RNA, 20 nt, Human
ucagugucuaaaccugcaug

SEQ ID NO: 1254822 - RNA, 24 nt, Human
ucauugcaaccuccaccucccagg

SEQ ID NO: 1254823 - RNA, 25 nt, Human
ucauugcaaccuccaccucccaggu

SEQ ID NO: 1254824 - RNA, 23 nt, Human
ucccaaaaugcugggauuauagg

SEQ ID NO: 1254825 - RNA, 23 nt, Human
ucccaaguagcugggauuacagg

SEQ ID NO: 1254826 - RNA, 24 nt, Human
ucccaaguagcugggauuacaggu

SEQ ID NO: 1254827 - RNA, 21 nt, Human
ucccagguucaagcaauucuc

SEQ ID NO: 1254828 - RNA, 21 nt, Human
ucccagguucaagcaauucuc

SEQ ID NO: 1254829 - RNA, 20 nt, Human
uccuacccaucuccaggacc

SEQ ID NO: 1254830 - RNA, 23 nt, Human
uccuagaaaauaaauuuaaguac

SEQ ID NO: 1254831 - RNA, 21 nt, Human
uccuuacuuuaugaauuucua

SEQ ID NO: 1254832 - RNA, 22 nt, Human
ucgccauguuggccaagcuggu

SEQ ID NO: 1254833 - RNA, 24 nt, Human
ucgccauguuggccaagcuggucu

SEQ ID NO: 1254834 - RNA, 24 nt, Human
ucgcccaggcuggagugcaguggu

SEQ ID NO: 1254835 - RNA, 24 nt, Human
ucgcucugucgcccaggcuggagu

SEQ ID NO: 1254836 - RNA, 18 nt, Human
ucuaaaggagcagucaac

SEQ ID NO: 1254837 - RNA, 19 nt, Human
ucuacacuuaacacaaaau

SEQ ID NO: 1254838 - RNA, 19 nt, Human
ucucgcucugucgcccagg

SEQ ID NO: 1254839 - RNA, 22 nt, Human
ucucgcucugucgcccaggcug

SEQ ID NO: 1254840 - RNA, 23 nt, Human
ucucgcucugucgcccaggcugg

SEQ ID NO: 1254841 - RNA, 24 nt, Human
ucucgcucugucgcccaggcugga

SEQ ID NO: 1254842 - RNA, 26 nt, Human
ucucgcucugucgcccaggcuggagu

SEQ ID NO: 1254843 - RNA, 27 nt, Human
ucucgcucugucgcccaggcuggagug

SEQ ID NO: 1254844 - RNA, 24 nt, Human
ucugucgcccaggcuggagugcag

SEQ ID NO: 1254845 - RNA, 22 nt, Human
ucugugaguagggcaaaagaac

SEQ ID NO: 1254846 - RNA, 20 nt, Human
ucuuccuuguucacaccuga

SEQ ID NO: 1254847 - RNA, 22 nt, Human
ugaacagguuaaugcuccucuc

SEQ ID NO: 1254848 - RNA, 23 nt, Human
ugaagaagaaaaauaaaacucaa

SEQ ID NO: 1254849 - RNA, 18 nt, Human
ugacucaauccagagaac

SEQ ID NO: 1254850 - RNA, 21 nt, Human
ugacucaauccagagaacacc

SEQ ID NO: 1254851 - RNA, 20 nt, Human
ugagaagaauuaaaauagau

SEQ ID NO: 1254852 - RNA, 18 nt, Human
ugauguggucaauguaug

SEQ ID NO: 1254853 - RNA, 23 nt, Human
ugauucgcccaccucagcuuccc

SEQ ID NO: 1254854 - RNA, 24 nt, Human
ugccucagccucccaaguagcugg

SEQ ID NO: 1254855 - RNA, 23 nt, Human
ugcuccucucuucuaaaggagca

SEQ ID NO: 1254856 - RNA, 21 nt, Human
uggaauuuuuugaagcaagag

SEQ ID NO: 1254857 - RNA, 19 nt, Human
uggagaccaagggaaaccc

SEQ ID NO: 1254858 - RNA, 19 nt, Human
uggagugcaguggugugau

SEQ ID NO: 1254859 - RNA, 23 nt, Human
uggagugcaguggugugaucccg

SEQ ID NO: 1254860 - RNA, 24 nt, Human
uggagugcaguggugugaucccgg

SEQ ID NO: 1254861 - RNA, 19 nt, Human
uggauucuggcaccagggc

SEQ ID NO: 1254862 - RNA, 24 nt, Human
uggccaagcuggucucaaacuccu

SEQ ID NO: 1254863 - RNA, 19 nt, Human
uggcuaaagaaaagacaca

SEQ ID NO: 1254864 - RNA, 21 nt, Human
ugggauuacagguguguacca

SEQ ID NO: 1254865 - RNA, 22 nt, Human
ugggauuacagguguguaccac

SEQ ID NO: 1254866 - RNA, 24 nt, Human
ugggauuacagguguguaccacca

SEQ ID NO: 1254867 - RNA, 25 nt, Human
ugggauuacagguguguaccaccau

SEQ ID NO: 1254868 - RNA, 25 nt, Human
ugggauuacagguguguaccaccau

SEQ ID NO: 1254869 - RNA, 22 nt, Human
ugggauuauagguguaaaccac

SEQ ID NO: 1254870 - RNA, 24 nt, Human
ugggauuauagguguaaaccacca

SEQ ID NO: 1254871 - RNA, 25 nt, Human
ugggauuauagguguaaaccaccau

SEQ ID NO: 1254872 - RNA, 24 nt, Human
ugggguuucgccauguuggccaag

SEQ ID NO: 1254873 - RNA, 20 nt, Human
uggguuaacuuacugaguug

SEQ ID NO: 1254874 - RNA, 20 nt, Human
uggucaauguaugugggguu

SEQ ID NO: 1254875 - RNA, 21 nt, Human
uguuuugucuccuagaaaaua

SEQ ID NO: 1254876 - RNA, 20 nt, Human
uuaacuuacugaguugucuu

SEQ ID NO: 1254877 - RNA, 18 nt, Human
uuaguagagaugggguuu

SEQ ID NO: 1254878 - RNA, 22 nt, Human
uuaguagagaugggguuucgcc

SEQ ID NO: 1254879 - RNA, 24 nt, Human
uuaguagagaugggguuucgccau

SEQ ID NO: 1254880 - RNA, 20 nt, Human
uucccaaaccuagaagccua

SEQ ID NO: 1254881 - RNA, 21 nt, Human
uucgcccaccucagcuuccca

SEQ ID NO: 1254882 - RNA, 24 nt, Human
uucgcccaccucagcuucccaaaa

SEQ ID NO: 1254883 - RNA, 23 nt, Human
uucuggcuccaaggccucggccc

SEQ ID NO: 1254884 - RNA, 24 nt, Human
uucuggcuccaaggccucggccca

SEQ ID NO: 1254885 - RNA, 23 nt, Human
uugcaaccuccaccucccagguu

SEQ ID NO: 1254886 - RNA, 24 nt, Human
uugcaaccuccaccucccagguuc

SEQ ID NO: 1254887 - RNA, 23 nt, Human
uuguauuuuuaguagagaugggg

SEQ ID NO: 1254888 - RNA, 22 nt, Human
uuuccuacccaucuccaggacc

SEQ ID NO: 1254889 - RNA, 21 nt, Human
uuucgccauguuggccaagcu

SEQ ID NO: 1254890 - RNA, 22 nt, Human
uuuuuaguagagaugggguuuc

SEQ ID NO: 1254891 - RNA, 23 nt, Human
uuuuuaguagagaugggguuucg

SEQ ID NO: 1254892 - RNA, 21 nt, Human
uuuuuguauuuuuaguagaga

SEQ ID NO: 1254893 - RNA, 23 nt, Human
aacaggagcuggccucugucccc

SEQ ID NO: 1254894 - RNA, 19 nt, Human
acaaaagagagagaagaaa

SEQ ID NO: 1254895 - RNA, 25 nt, Human
acagaacaaguccuaaaucagacaa

SEQ ID NO: 1254896 - RNA, 18 nt, Human
acccccccgcccuuucuc

SEQ ID NO: 1254897 - RNA, 23 nt, Human
aggaaaagccauccuggcaaaga

SEQ ID NO: 1254898 - RNA, 24 nt, Human
aggaaaagccauccuggcaaagag

SEQ ID NO: 1254899 - RNA, 24 nt, Human
cagaacaaguccuaaaucagacaa

SEQ ID NO: 1254900 - RNA, 19 nt, Human
cagcugcaggaugcuccca

SEQ ID NO: 1254901 - RNA, 20 nt, Human
caggaaaagccauccuggca

SEQ ID NO: 1254902 - RNA, 21 nt, Human
caggaaaagccauccuggcaa

SEQ ID NO: 1254903 - RNA, 18 nt, Human
cccucucucuccuaauuu

SEQ ID NO: 1254904 - RNA, 20 nt, Human
cugucccagcugcaggaugc

SEQ ID NO: 1254905 - RNA, 22 nt, Human
gaacaaguccuaaaucagacaa

SEQ ID NO: 1254906 - RNA, 18 nt, Human
gagcuggccucuguccca

SEQ ID NO: 1254907 - RNA, 19 nt, Human
gcagcuuuuaucagcaggu

SEQ ID NO: 1254908 - RNA, 20 nt, Human
gcaggaugcucccaaggcag

SEQ ID NO: 1254909 - RNA, 20 nt, Human
gccucaggcaccgccuaccu

SEQ ID NO: 1254910 - RNA, 20 nt, Human
ggaagagauguccaugagaa

SEQ ID NO: 1254911 - RNA, 19 nt, Human
uccaugagaaaaccaacug

SEQ ID NO: 1254912 - RNA, 19 nt, Human
ucccucucucuccuaauuu

SEQ ID NO: 1254913 - RNA, 19 nt, Human
ucuccuaauuuacuuaguc

SEQ ID NO: 1254914 - RNA, 19 nt, Human
ugccucaggcaccgccuac

SEQ ID NO: 1254915 - RNA, 18 nt, Human
uggaaggcagcuuuuauc

SEQ ID NO: 1254916 - RNA, 20 nt, Human
ugggaugagccuacaaaagc

SEQ ID NO: 1254917 - RNA, 23 nt, Human
uuaaagaaaacacagaacaaguc

SEQ ID NO: 1254918 - RNA, 21 nt, Human
uuuaaagaaaacacagaacaa

SEQ ID NO: 1254919 - RNA, 24 nt, Human
uuuuuuaaagaaaacacagaacaa

SEQ ID NO: 1254920 - RNA, 19 nt, Human
uuuuuuuuuuuuaaagaaa

SEQ ID NO: 1254921 - RNA, 18 nt, Human
augcugccaggguaccuc

SEQ ID NO: 1254922 - RNA, 19 nt, Human
cucgaggcccuacuugucc

SEQ ID NO: 1254923 - RNA, 20 nt, Human
cuucugucacgcaccugucc

SEQ ID NO: 1254924 - RNA, 21 nt, Human
uaugcugccaggguaccucuu

SEQ ID NO: 1254925 - RNA, 22 nt, Human
uuaucauaauauuuaugcugcc

SEQ ID NO: 1254926 - RNA, 22 nt, Human
uuuaaguagcacaaacuccuua

SEQ ID NO: 1254927 - RNA, 21 nt, Human
aagagaccagaauauuuaaug

SEQ ID NO: 1254928 - RNA, 21 nt, Human
accccacaggacgcaucaugg

SEQ ID NO: 1254929 - RNA, 24 nt, Human
agccaccaaucuuuguucucugcc

SEQ ID NO: 1254930 - RNA, 18 nt, Human
aucauggaauauguagag

SEQ ID NO: 1254931 - RNA, 20 nt, Human
caccaaucuuuguucucugc

SEQ ID NO: 1254932 - RNA, 22 nt, Human
ccaccaaucuuuguucucugcc

SEQ ID NO: 1254933 - RNA, 25 nt, Human
ucaacagcuuuccucuggguuuucu

SEQ ID NO: 1254934 - RNA, 24 nt, Human
uuaaugagauauuacuguuugcau

SEQ ID NO: 1254935 - RNA, 25 nt, Human
uuccucuggguuuucuuguuugugg

SEQ ID NO: 1254936 - RNA, 27 nt, Human
uugcauaaccccacaggacgcaucaug

SEQ ID NO: 1254937 - RNA, 23 nt, Human
uuuccucuggguuuucuuguuug

SEQ ID NO: 1254938 - RNA, 22 nt, Human
aauuauccagccaugagcccug

SEQ ID NO: 1254939 - RNA, 22 nt, Human
acagagcugcucacagauacca

SEQ ID NO: 1254940 - RNA, 25 nt, Human
accaacuacccgcgaccucuaccac

SEQ ID NO: 1254941 - RNA, 21 nt, Human
agagcugcucacagauaccac

SEQ ID NO: 1254942 - RNA, 19 nt, Human
agcuucgaaaaggcuuagg

SEQ ID NO: 1254943 - RNA, 18 nt, Human
aggccccuuguccucugg

SEQ ID NO: 1254944 - RNA, 23 nt, Human
aggggcugggcaugguuggcuuu

SEQ ID NO: 1254945 - RNA, 22 nt, Human
cacccacuugcucuuucggcug

SEQ ID NO: 1254946 - RNA, 19 nt, Human
cccaccaacuacccgcgac

SEQ ID NO: 1254947 - RNA, 22 nt, Human
ccccuuguccucuggcagccca

SEQ ID NO: 1254948 - RNA, 21 nt, Human
ccuuuucguauuucauaauga

SEQ ID NO: 1254949 - RNA, 21 nt, Human
cgucagaauucagaacgaugg

SEQ ID NO: 1254950 - RNA, 18 nt, Human
cucacuuguacaaucccc

SEQ ID NO: 1254951 - RNA, 22 nt, Human
cuccgucucacuuguacaaucc

SEQ ID NO: 1254952 - RNA, 18 nt, Human
cucucagggagaaaaccu

SEQ ID NO: 1254953 - RNA, 22 nt, Human
gaaaaccuuugaguccacagag

SEQ ID NO: 1254954 - RNA, 24 nt, Human
gagcugcucacagauaccacugcc

SEQ ID NO: 1254955 - RNA, 20 nt, Human
ggagaaaaccuuugagucca

SEQ ID NO: 1254956 - RNA, 24 nt, Human
ggagaaaaccuuugaguccacaga

SEQ ID NO: 1254957 - RNA, 22 nt, Human
ggcugggggugcugggaggggc

SEQ ID NO: 1254958 - RNA, 19 nt, Human
ggggcugggggugcuggga

SEQ ID NO: 1254959 - RNA, 26 nt, Human
ggggugcugggaggggcugggcaugg

SEQ ID NO: 1254960 - RNA, 18 nt, Human
gugcugggaggggcuggg

SEQ ID NO: 1254961 - RNA, 22 nt, Human
gugcugggaggggcugggcaug

SEQ ID NO: 1254962 - RNA, 19 nt, Human
uaaaacgaggacgcgaagc

SEQ ID NO: 1254963 - RNA, 28 nt, Human
uaggccccuuguccucuggcagcccagg

SEQ ID NO: 1254964 - RNA, 24 nt, Human
uauccagccaugagcccuggccca

SEQ ID NO: 1254965 - RNA, 20 nt, Human
ucacagauaccacugccugu

SEQ ID NO: 1254966 - RNA, 18 nt, Human
ucgaaaaggcuuaggccc

SEQ ID NO: 1254967 - RNA, 23 nt, Human
ucucucgagcugcacucuuucuu

SEQ ID NO: 1254968 - RNA, 26 nt, Human
ugaaucagcuggccugggucggaucc

SEQ ID NO: 1254969 - RNA, 21 nt, Human
ugcuucgccucccgcgcaguc

SEQ ID NO: 1254970 - RNA, 23 nt, Human
uggcuuugugaucuggggucugg

SEQ ID NO: 1254971 - RNA, 18 nt, Human
ugggaggggcugggcaug

SEQ ID NO: 1254972 - RNA, 18 nt, Human
ugggaggggcugggcaug

SEQ ID NO: 1254973 - RNA, 20 nt, Human
ugggaggggcugggcauggu

SEQ ID NO: 1254974 - RNA, 18 nt, Human
uggggcugggggugcugg

SEQ ID NO: 1254975 - RNA, 18 nt, Human
uggggcugggggugcugg

SEQ ID NO: 1254976 - RNA, 22 nt, Human
ugggggugcugggaggggcugg

SEQ ID NO: 1254977 - RNA, 20 nt, Human
uugugcccaccaacuacccg

SEQ ID NO: 1254978 - RNA, 19 nt, Human
agaggaaacugggagaggc

SEQ ID NO: 1254979 - RNA, 18 nt, Human
gggagucuuagccuccaa

SEQ ID NO: 1254980 - RNA, 21 nt, Human
uagccuccaaggacguuccgg

SEQ ID NO: 1254981 - RNA, 19 nt, Human
uccggaacccugcggacgc

SEQ ID NO: 1254982 - RNA, 21 nt, Human
ugggagaggccggagugcgac

SEQ ID NO: 1254983 - RNA, 23 nt, Human
uuccggaacccugcggacgcggg

SEQ ID NO: 1254984 - RNA, 18 nt, Human
cacauucagauugcugcc

SEQ ID NO: 1254985 - RNA, 20 nt, Human
ccagaaacacauucagauug

SEQ ID NO: 1254986 - RNA, 21 nt, Human
ccuugcuggaguugcuuuucu

SEQ ID NO: 1254987 - RNA, 23 nt, Human
cgagcaaauucccguugcuuuaa

SEQ ID NO: 1254988 - RNA, 19 nt, Human
ucuuguuuuuucucaucuu

SEQ ID NO: 1254989 - RNA, 23 nt, Human
ugcugguccauuuccagaaacac

SEQ ID NO: 1254990 - RNA, 22 nt, Human
uuucgagcaaauucccguugcu

SEQ ID NO: 1254991 - RNA, 19 nt, Human
agaaauccugcaucucagu

SEQ ID NO: 1254992 - RNA, 24 nt, Human
agacacauucaggugccuuugcag

SEQ ID NO: 1254993 - RNA, 21 nt, Human
agggugggcugucucuccacc

SEQ ID NO: 1254994 - RNA, 19 nt, Human
caagacagcugucucaggc

SEQ ID NO: 1254995 - RNA, 18 nt, Human
caggggucacaguggaca

SEQ ID NO: 1254996 - RNA, 20 nt, Human
cauucaggugccuuugcaga

SEQ ID NO: 1254997 - RNA, 23 nt, Human
cucacauuaugcuaacagggacg

SEQ ID NO: 1254998 - RNA, 18 nt, Human
cuggaagguucucagguc

SEQ ID NO: 1254999 - RNA, 22 nt, Human
gaacaagaaagaugacugggga

SEQ ID NO: 1255000 - RNA, 18 nt, Human
gaacaggggucacagugg

SEQ ID NO: 1255001 - RNA, 19 nt, Human
gcagaaagagaugccagag

SEQ ID NO: 1255002 - RNA, 20 nt, Human
gucacaguggacacaagggu

SEQ ID NO: 1255003 - RNA, 23 nt, Human
uaugcuaacagggacgcagacac

SEQ ID NO: 1255004 - RNA, 21 nt, Human
uauuugcucucucaaauucca

SEQ ID NO: 1255005 - RNA, 22 nt, Human
ucuggaacaagaaagaugacug

SEQ ID NO: 1255006 - RNA, 22 nt, Human
ucuuuauuugcucucucaaauu

SEQ ID NO: 1255007 - RNA, 18 nt, Human
ugaagucacaaaggggag

SEQ ID NO: 1255008 - RNA, 22 nt, Human
uggggaggaaacacaggucagc

SEQ ID NO: 1255009 - RNA, 22 nt, Human
aaaaaagaaggaaaacccaaaa

SEQ ID NO: 1255010 - RNA, 21 nt, Human
aaaagaaaacaaguccucaaa

SEQ ID NO: 1255011 - RNA, 25 nt, Human
aaaugcaaugaagggagcccugcua

SEQ ID NO: 1255012 - RNA, 23 nt, Human
acaaaaaagaaggaaaacccaaa

SEQ ID NO: 1255013 - RNA, 19 nt, Human
agacauccuaguuaacucc

SEQ ID NO: 1255014 - RNA, 22 nt, Human
agagcaaaaaaaaaaaaaagaa

SEQ ID NO: 1255015 - RNA, 19 nt, Human
aggaaaacccaaaaugcca

SEQ ID NO: 1255016 - RNA, 18 nt, Human
aggcugacgagagcuggg

SEQ ID NO: 1255017 - RNA, 25 nt, Human
caaaaaaccacaaacuggguaguaa

SEQ ID NO: 1255018 - RNA, 18 nt, Human
caacucaugaauaaagau

SEQ ID NO: 1255019 - RNA, 22 nt, Human
cacugcuuuugucuacuguuug

SEQ ID NO: 1255020 - RNA, 21 nt, Human
cuuucuggguuuuaccacaua

SEQ ID NO: 1255021 - RNA, 19 nt, Human
gagcaaaaaaaaaaaaaag

SEQ ID NO: 1255022 - RNA, 24 nt, Human
gagcugggaggcaucagcggagga

SEQ ID NO: 1255023 - RNA, 18 nt, Human
ggagauggccagcaggag

SEQ ID NO: 1255024 - RNA, 20 nt, Human
ggaggcugacgagagcuggg

SEQ ID NO: 1255025 - RNA, 19 nt, Human
uaaacagagcagugcaacu

SEQ ID NO: 1255026 - RNA, 22 nt, Human
uaaccgagucucuaggcaauau

SEQ ID NO: 1255027 - RNA, 19 nt, Human
uaggcaauauauuuaaaac

SEQ ID NO: 1255028 - RNA, 19 nt, Human
ucagagcaaaaaaaaaaaa

SEQ ID NO: 1255029 - RNA, 21 nt, Human
ucagagcaaaaaaaaaaaaaa

SEQ ID NO: 1255030 - RNA, 24 nt, Human
ucauacuagaagaaacucagccau

SEQ ID NO: 1255031 - RNA, 23 nt, Human
ucuccacaugggaacaaugauua

SEQ ID NO: 1255032 - RNA, 20 nt, Human
ucucccaaaaaaccacaaac

SEQ ID NO: 1255033 - RNA, 23 nt, Human
ugaaaguaucuugcauucaugau

SEQ ID NO: 1255034 - RNA, 23 nt, Human
ugacugcaggaggcuggaagaca

SEQ ID NO: 1255035 - RNA, 19 nt, Human
ugauggaugcuuucugggu

SEQ ID NO: 1255036 - RNA, 22 nt, Human
ugggaacaaugauuauaaaaac

SEQ ID NO: 1255037 - RNA, 18 nt, Human
uuaaaaggucacuaaagu

SEQ ID NO: 1255038 - RNA, 22 nt, Human
uucagagcaaaaaaaaaaaaaa

SEQ ID NO: 1255039 - RNA, 24 nt, Human
uucagagcaaaaaaaaaaaaaaga

SEQ ID NO: 1255040 - RNA, 25 nt, Human
uucagagcaaaaaaaaaaaaaagaa

SEQ ID NO: 1255041 - RNA, 25 nt, Human
uucagagcaaaaaaaaaaaaaagaa

SEQ ID NO: 1255042 - RNA, 26 nt, Human
uucagagcaaaaaaaaaaaaaagaaa

SEQ ID NO: 1255043 - RNA, 18 nt, Human
uuuacaaaaaagaaggaa

SEQ ID NO: 1255044 - RNA, 25 nt, Human
uuuuccaguuuccaacucaugaaua

SEQ ID NO: 1255045 - RNA, 24 nt, Human
uuuugcaaguuguuuuauuuacaa

SEQ ID NO: 1255046 - RNA, 22 nt, Human
gaaugcuguugugugcguugag

SEQ ID NO: 1255047 - RNA, 21 nt, Human
gcuugucgugcuggcagguga

SEQ ID NO: 1255048 - RNA, 24 nt, Human
ugguacugccagggaaugcuguug

SEQ ID NO: 1255049 - RNA, 22 nt, Human
aaaauggaugaaguuauuauca

SEQ ID NO: 1255050 - RNA, 21 nt, Human
aaagaaaauccggagacagaa

SEQ ID NO: 1255051 - RNA, 20 nt, Human
aacaagauuagaaauaacaa

SEQ ID NO: 1255052 - RNA, 28 nt, Human
acacugaaacguuuaaauaagaaaacca

SEQ ID NO: 1255053 - RNA, 26 nt, Human
accaaaugauuucaguaaaaaaaaaa

SEQ ID NO: 1255054 - RNA, 19 nt, Human
agaaucuuuucaugcuccu

SEQ ID NO: 1255055 - RNA, 18 nt, Human
agacagaaucuuuucaug

SEQ ID NO: 1255056 - RNA, 23 nt, Human
agacagaaucuuuucaugcuccu

SEQ ID NO: 1255057 - RNA, 21 nt, Human
aguacagaauaaauuaaagug

SEQ ID NO: 1255058 - RNA, 26 nt, Human
caaaugauuucaguaaaaaaaaaaaa

SEQ ID NO: 1255059 - RNA, 24 nt, Human
cuccuggaauucagugucucucuc

SEQ ID NO: 1255060 - RNA, 19 nt, Human
gcgugguucccgccggggu

SEQ ID NO: 1255061 - RNA, 22 nt, Human
ggagaguaacaagauuagaaau

SEQ ID NO: 1255062 - RNA, 21 nt, Human
ggcugguuuuguuuguuucug

SEQ ID NO: 1255063 - RNA, 21 nt, Human
uaaaaaaaaaaaaaaccucau

SEQ ID NO: 1255064 - RNA, 22 nt, Human
uaacaagauuagaaauaacaaa

SEQ ID NO: 1255065 - RNA, 22 nt, Human
ucaaaggacuaucauaaaagua

SEQ ID NO: 1255066 - RNA, 19 nt, Human
ucaguaaaaaaaaaaaaaa

SEQ ID NO: 1255067 - RNA, 23 nt, Human
ucaguaaaaaaaaaaaaaaccuc

SEQ ID NO: 1255068 - RNA, 24 nt, Human
ucaucuuucuuuauuucugguuau

SEQ ID NO: 1255069 - RNA, 21 nt, Human
uccgauucgggcgugguuccc

SEQ ID NO: 1255070 - RNA, 18 nt, Human
ugaaagaaaauccggaga

SEQ ID NO: 1255071 - RNA, 19 nt, Human
uguuaugggaugggagaua

SEQ ID NO: 1255072 - RNA, 22 nt, Human
uuagcaucacucuccuuguacc

SEQ ID NO: 1255073 - RNA, 28 nt, Human
uucacaguguuccaguaacguggcaguc

SEQ ID NO: 1255074 - RNA, 24 nt, Human
uuuaauaaccauuuauacauugcu

SEQ ID NO: 1255075 - RNA, 23 nt, Human
uuucaguaaaaaaaaaaaaaacc

SEQ ID NO: 1255076 - RNA, 20 nt, Human
augagaucaucagcucuacu

SEQ ID NO: 1255077 - RNA, 24 nt, Human
caaaaacuuuggccgucucaauga

SEQ ID NO: 1255078 - RNA, 23 nt, Human
gucccaauguccaaacuuucuca

SEQ ID NO: 1255079 - RNA, 19 nt, Human
uccaaacuuucucacauac

SEQ ID NO: 1255080 - RNA, 22 nt, Human
ugugauguuccuucagccugga

SEQ ID NO: 1255081 - RNA, 21 nt, Human
uuuggccgucucaaugagauc

SEQ ID NO: 1255082 - RNA, 24 nt, Human
aaaaauuuccaaaacaaaacacau

SEQ ID NO: 1255083 - RNA, 22 nt, Human
aaaacaaaacacaugcuuccac

SEQ ID NO: 1255084 - RNA, 19 nt, Human
aaagaguuaagauuucuuc

SEQ ID NO: 1255085 - RNA, 24 nt, Human
aaagugcugggauuacaggcguga

SEQ ID NO: 1255086 - RNA, 24 nt, Human
aaccucaggugaucugcccaccuc

SEQ ID NO: 1255087 - RNA, 23 nt, Human
aagcaggacuccuuccuccaugg

SEQ ID NO: 1255088 - RNA, 20 nt, Human
aagccaguuucagguuacga

SEQ ID NO: 1255089 - RNA, 20 nt, Human
aaggccccaggacucuccag

SEQ ID NO: 1255090 - RNA, 19 nt, Human
aagugcugggauuacaggc

SEQ ID NO: 1255091 - RNA, 19 nt, Human
aagugcugggauuacaggc

SEQ ID NO: 1255092 - RNA, 26 nt, Human
aagugcugggauuacaggcgugagcc

SEQ ID NO: 1255093 - RNA, 21 nt, Human
aaguguugggauuacaggcau

SEQ ID NO: 1255094 - RNA, 23 nt, Human
aaguguugggauuacaggcauga

SEQ ID NO: 1255095 - RNA, 26 nt, Human
aaguguugggauuacaggcaugagcc

SEQ ID NO: 1255096 - RNA, 18 nt, Human
aauacaguuuuuaguuac

SEQ ID NO: 1255097 - RNA, 21 nt, Human
acaggcaugagccaccacgac

SEQ ID NO: 1255098 - RNA, 18 nt, Human
acaggguuucaccauguu

SEQ ID NO: 1255099 - RNA, 21 nt, Human
acaggguuucaccauguuggc

SEQ ID NO: 1255100 - RNA, 24 nt, Human
acaggguuucaccauguuggccag

SEQ ID NO: 1255101 - RNA, 18 nt, Human
acaugaacauaugcuacu

SEQ ID NO: 1255102 - RNA, 23 nt, Human
accagccuccucuauuccuccca

SEQ ID NO: 1255103 - RNA, 21 nt, Human
acgcuggaggaccagucagcg

SEQ ID NO: 1255104 - RNA, 22 nt, Human
acugucuuuucuuuuuuuuuga

SEQ ID NO: 1255105 - RNA, 23 nt, Human
agcaauaguuuuuuuuuuuuuuu

SEQ ID NO: 1255106 - RNA, 21 nt, Human
agccucucgaguagcugggac

SEQ ID NO: 1255107 - RNA, 24 nt, Human
agcgauucuccugccucagccucc

SEQ ID NO: 1255108 - RNA, 20 nt, Human
aggcaugagccaccacgacc

SEQ ID NO: 1255109 - RNA, 20 nt, Human
aggcuaugcauagccccaug

SEQ ID NO: 1255110 - RNA, 24 nt, Human
aggugaucugcccaccucagccuc

SEQ ID NO: 1255111 - RNA, 18 nt, Human
aguagcugggacuacagg

SEQ ID NO: 1255112 - RNA, 19 nt, Human
aguagcugggacuacaggc

SEQ ID NO: 1255113 - RNA, 20 nt, Human
aguagcugggacuacaggca

SEQ ID NO: 1255114 - RNA, 23 nt, Human
aguagcugggauuacaggcacgu

SEQ ID NO: 1255115 - RNA, 21 nt, Human
agugcaauggcgugaucucag

SEQ ID NO: 1255116 - RNA, 24 nt, Human
agugcaauggcgugaucucagcuc

SEQ ID NO: 1255117 - RNA, 23 nt, Human
agugcacuggugcaaucuuggcu

SEQ ID NO: 1255118 - RNA, 24 nt, Human
agugcacuggugcaaucuuggcuc

SEQ ID NO: 1255119 - RNA, 23 nt, Human
augcacagguaucugagaagggu

SEQ ID NO: 1255120 - RNA, 22 nt, Human
auuuuuguauuuuuaguagaga

SEQ ID NO: 1255121 - RNA, 24 nt, Human
auuuuuguauuuuuaguagagaug

SEQ ID NO: 1255122 - RNA, 23 nt, Human
caaaaagaacuuguaaaguggca

SEQ ID NO: 1255123 - RNA, 19 nt, Human
caaaacaaggccccaggac

SEQ ID NO: 1255124 - RNA, 23 nt, Human
caaaacacaugcuuccacuucac

SEQ ID NO: 1255125 - RNA, 24 nt, Human
caaaauagaugauucacaucuuca

SEQ ID NO: 1255126 - RNA, 24 nt, Human
caaagugcugggauuacaggcgug

SEQ ID NO: 1255127 - RNA, 27 nt, Human
caacaaagcaggacuccuuccuccaug

SEQ ID NO: 1255128 - RNA, 27 nt, Human
caacagcaauaaaaaguaauuucaaag

SEQ ID NO: 1255129 - RNA, 23 nt, Human
caacuuccaccucccagguucaa

SEQ ID NO: 1255130 - RNA, 20 nt, Human
caagcgauucuccugccuca

SEQ ID NO: 1255131 - RNA, 22 nt, Human
caagcgauucuccugccucagc

SEQ ID NO: 1255132 - RNA, 22 nt, Human
caagcgauuuuccugccuuagc

SEQ ID NO: 1255133 - RNA, 24 nt, Human
caccaugcccggcuaauuuuugua

SEQ ID NO: 1255134 - RNA, 18 nt, Human
caccauguuggccaggau

SEQ ID NO: 1255135 - RNA, 22 nt, Human
caccauguuggccaggaugguc

SEQ ID NO: 1255136 - RNA, 24 nt, Human
caccauguuggccaggauggucuc

SEQ ID NO: 1255137 - RNA, 24 nt, Human
caccucagccucccuaaguguugg

SEQ ID NO: 1255138 - RNA, 20 nt, Human
cacugcaacuuccaccuccc

SEQ ID NO: 1255139 - RNA, 23 nt, Human
cacugcaaucucugccuccuggg

SEQ ID NO: 1255140 - RNA, 21 nt, Human
cacuggaauuuuuccuuggaa

SEQ ID NO: 1255141 - RNA, 23 nt, Human
cagaguuucgcuuguugcccagg

SEQ ID NO: 1255142 - RNA, 19 nt, Human
cagcccuuuucuuguaagu

SEQ ID NO: 1255143 - RNA, 20 nt, Human
cagccuccugaguagcuggg

SEQ ID NO: 1255144 - RNA, 24 nt, Human
caggguuucaccauguuggccagg

SEQ ID NO: 1255145 - RNA, 22 nt, Human
caucacugaaaaguuggaacac

SEQ ID NO: 1255146 - RNA, 21 nt, Human
cauggucugcccgccuuggcc

SEQ ID NO: 1255147 - RNA, 22 nt, Human
ccaaagugcugggauuacaggc

SEQ ID NO: 1255148 - RNA, 22 nt, Human
ccaaagugcugggauuacaggc

SEQ ID NO: 1255149 - RNA, 24 nt, Human
ccaaagugcugggauuacaggcgu

SEQ ID NO: 1255150 - RNA, 24 nt, Human
ccaccucccagguucaagcgauuc

SEQ ID NO: 1255151 - RNA, 19 nt, Human
ccauguuggucaggcuggu

SEQ ID NO: 1255152 - RNA, 22 nt, Human
ccauguuggucaggcuggucuc

SEQ ID NO: 1255153 - RNA, 23 nt, Human
ccauguuggucaggcuggucucg

SEQ ID NO: 1255154 - RNA, 24 nt, Human
cccaaccucaggugaucugcccac

SEQ ID NO: 1255155 - RNA, 23 nt, Human
cccaaugcagaaaacacuggaau

SEQ ID NO: 1255156 - RNA, 22 nt, Human
cccaggcuggagugcaauggcg

SEQ ID NO: 1255157 - RNA, 20 nt, Human
cccagguucaagcgauucuc

SEQ ID NO: 1255158 - RNA, 23 nt, Human
cccagguucaagcgauucuccug

SEQ ID NO: 1255159 - RNA, 22 nt, Human
cccgccuuggccucccaaagug

SEQ ID NO: 1255160 - RNA, 18 nt, Human
cccggccagcaauacagu

SEQ ID NO: 1255161 - RNA, 24 nt, Human
cccuaaguguugggauuacaggca

SEQ ID NO: 1255162 - RNA, 21 nt, Human
cccuugaggucccgcuaaccc

SEQ ID NO: 1255163 - RNA, 19 nt, Human
cccuuuccaguuucugaag

SEQ ID NO: 1255164 - RNA, 21 nt, Human
ccgcgcccggccagcaauaca

SEQ ID NO: 1255165 - RNA, 20 nt, Human
ccgcgcccggccagcaauag

SEQ ID NO: 1255166 - RNA, 19 nt, Human
ccuaaguguugggauuaca

SEQ ID NO: 1255167 - RNA, 22 nt, Human
ccuaaguguugggauuacaggc

SEQ ID NO: 1255168 - RNA, 24 nt, Human
ccuaaguguugggauuacaggcau

SEQ ID NO: 1255169 - RNA, 23 nt, Human
ccuaaucaggcauucacugaucc

SEQ ID NO: 1255170 - RNA, 18 nt, Human
ccucauggucugcccgcc

SEQ ID NO: 1255171 - RNA, 24 nt, Human
ccucccagguucaagcgauucucc

SEQ ID NO: 1255172 - RNA, 23 nt, Human
ccugaguagcugggauuacaggc

SEQ ID NO: 1255173 - RNA, 24 nt, Human
ccugaguagcugggauuacaggca

SEQ ID NO: 1255174 - RNA, 23 nt, Human
ccugccucagccuccugaguagc

SEQ ID NO: 1255175 - RNA, 23 nt, Human
ccugccuuagccucucgaguagc

SEQ ID NO: 1255176 - RNA, 23 nt, Human
ccuggguucaagcgauuuuccug

SEQ ID NO: 1255177 - RNA, 23 nt, Human
cgcucugucgcccagcuggagug

SEQ ID NO: 1255178 - RNA, 21 nt, Human
cgcuuguugcccaggcuggag

SEQ ID NO: 1255179 - RNA, 19 nt, Human
cuaagaguaugacaacagc

SEQ ID NO: 1255180 - RNA, 22 nt, Human
cuaaguguugggauuacaggca

SEQ ID NO: 1255181 - RNA, 21 nt, Human
cuaugcauagccccauguccu

SEQ ID NO: 1255182 - RNA, 24 nt, Human
cucacugcaacuuccaccucccag

SEQ ID NO: 1255183 - RNA, 18 nt, Human
cucacugcaaucucugcc

SEQ ID NO: 1255184 - RNA, 24 nt, Human
cucacugcaaucucugccuccugg

SEQ ID NO: 1255185 - RNA, 24 nt, Human
cucagccuccugaguagcugggau

SEQ ID NO: 1255186 - RNA, 24 nt, Human
cuccauguuggucaggcuggucuc

SEQ ID NO: 1255187 - RNA, 24 nt, Human
cuccugaccucauggucugcccgc

SEQ ID NO: 1255188 - RNA, 23 nt, Human
cucgaguagcugggacuacaggc

SEQ ID NO: 1255189 - RNA, 23 nt, Human
cucgcucugucgcccagcuggag

SEQ ID NO: 1255190 - RNA, 23 nt, Human
cugaguagcugggauuacaggca

SEQ ID NO: 1255191 - RNA, 23 nt, Human
cugcaacuuccaccucccagguu

SEQ ID NO: 1255192 - RNA, 24 nt, Human
cugcaacuuccaccucccagguuc

SEQ ID NO: 1255193 - RNA, 24 nt, Human
cugcaaucucugccuccuggguuc

SEQ ID NO: 1255194 - RNA, 20 nt, Human
cugcccgccuuggccuccca

SEQ ID NO: 1255195 - RNA, 23 nt, Human
cugccucagccuccugaguagcu

SEQ ID NO: 1255196 - RNA, 23 nt, Human
cugccuuagccucucgaguagcu

SEQ ID NO: 1255197 - RNA, 24 nt, Human
cuggagugcaauggcgugaucuca

SEQ ID NO: 1255198 - RNA, 23 nt, Human
cugucuuuucuuugacccuuucc

SEQ ID NO: 1255199 - RNA, 24 nt, Human
cuuagccucucgaguagcugggac

SEQ ID NO: 1255200 - RNA, 24 nt, Human
cuuguugcccaggcuggagugcaa

SEQ ID NO: 1255201 - RNA, 19 nt, Human
cuuuuuuuuugagacagag

SEQ ID NO: 1255202 - RNA, 21 nt, Human
gagauggagucucgcucuguc

SEQ ID NO: 1255203 - RNA, 21 nt, Human
gagauggcauuucuccauguu

SEQ ID NO: 1255204 - RNA, 24 nt, Human
gaguagcugggacuacaggcacgc

SEQ ID NO: 1255205 - RNA, 25 nt, Human
gaguagcugggauuacaggcacgug

SEQ ID NO: 1255206 - RNA, 20 nt, Human
gauacaaaagccaccagaua

SEQ ID NO: 1255207 - RNA, 18 nt, Human
gauuacaggcacgugcca

SEQ ID NO: 1255208 - RNA, 18 nt, Human
gauuacaggcaugagcca

SEQ ID NO: 1255209 - RNA, 21 nt, Human
gauuacaggcaugagccacca

SEQ ID NO: 1255210 - RNA, 22 nt, Human
gauuacaggcaugagccaccac

SEQ ID NO: 1255211 - RNA, 18 nt, Human
gauuacaggcgugagcca

SEQ ID NO: 1255212 - RNA, 22 nt, Human
gauuacaggcgugagccaccgc

SEQ ID NO: 1255213 - RNA, 22 nt, Human
gauuacaggcgugagccaccgc

SEQ ID NO: 1255214 - RNA, 22 nt, Human
gcaacuuccaccucccagguuc

SEQ ID NO: 1255215 - RNA, 22 nt, Human
gcaggucuccaucuauuuguac

SEQ ID NO: 1255216 - RNA, 24 nt, Human
gcccaggcuggagugcaauggcgu

SEQ ID NO: 1255217 - RNA, 22 nt, Human
gcccggcuaauuuuuguauuuu

SEQ ID NO: 1255218 - RNA, 24 nt, Human
gccuccucuauuccucccaaucuc

SEQ ID NO: 1255219 - RNA, 22 nt, Human
gccuuggccucccaaagugcug

SEQ ID NO: 1255220 - RNA, 23 nt, Human
gcgauucuccugccucagccucc

SEQ ID NO: 1255221 - RNA, 21 nt, Human
gcucacugcaaucucugccuc

SEQ ID NO: 1255222 - RNA, 19 nt, Human
gcuggagugcaauggcgug

SEQ ID NO: 1255223 - RNA, 23 nt, Human
gcuggucucgaacucccaaccuc

SEQ ID NO: 1255224 - RNA, 19 nt, Human
ggauuacaggcaugagcca

SEQ ID NO: 1255225 - RNA, 22 nt, Human
ggcuggagugcaauggcgugau

SEQ ID NO: 1255226 - RNA, 21 nt, Human
gggcaguuuucagcccugccu

SEQ ID NO: 1255227 - RNA, 22 nt, Human
ggguuucaccauguuggccagg

SEQ ID NO: 1255228 - RNA, 20 nt, Human
ggucucaaucuccugaccuc

SEQ ID NO: 1255229 - RNA, 20 nt, Human
ggucugcccgccuuggccuc

SEQ ID NO: 1255230 - RNA, 19 nt, Human
gguuacgauacaaaagcca

SEQ ID NO: 1255231 - RNA, 24 nt, Human
gguuucaccauguuggccaggaug

SEQ ID NO: 1255232 - RNA, 24 nt, Human
gugaucugcccaccucagccuccc

SEQ ID NO: 1255233 - RNA, 24 nt, Human
guuucgcuuguugcccaggcugga

SEQ ID NO: 1255234 - RNA, 21 nt, Human
uaaucaggcauucacugaucc

SEQ ID NO: 1255235 - RNA, 24 nt, Human
uaauuuuuguauuuuuaguagaga

SEQ ID NO: 1255236 - RNA, 21 nt, Human
uacaaaagccaccagauacac

SEQ ID NO: 1255237 - RNA, 24 nt, Human
uacaggcacgcgccaccacaccca

SEQ ID NO: 1255238 - RNA, 23 nt, Human
uacaggcacgugccaccaugccc

SEQ ID NO: 1255239 - RNA, 23 nt, Human
uacaggcaugagccaccacgacc

SEQ ID NO: 1255240 - RNA, 23 nt, Human
uacaggcgugagccaccgcgccc

SEQ ID NO: 1255241 - RNA, 21 nt, Human
uacuaguaaaugcaaaaagaa

SEQ ID NO: 1255242 - RNA, 22 nt, Human
uagagacaggguuucaccaugu

SEQ ID NO: 1255243 - RNA, 21 nt, Human
uaggaaaaaguacuaagccag

SEQ ID NO: 1255244 - RNA, 24 nt, Human
uaguagagacaggguuucaccaug

SEQ ID NO: 1255245 - RNA, 26 nt, Human
uaguagagacaggguuucaccauguu

SEQ ID NO: 1255246 - RNA, 24 nt, Human
uaguagagauggcauuucuccaug

SEQ ID NO: 1255247 - RNA, 22 nt, Human
uaucugagaagggucuaaacac

SEQ ID NO: 1255248 - RNA, 22 nt, Human
uaugcuacugucuuuucuuuuu

SEQ ID NO: 1255249 - RNA, 21 nt, Human
ucaaaacaaggccccaggacu

SEQ ID NO: 1255250 - RNA, 19 nt, Human
ucaagcgauuuuccugccu

SEQ ID NO: 1255251 - RNA, 24 nt, Human
ucaccauguuggccaggauggucu

SEQ ID NO: 1255252 - RNA, 23 nt, Human
ucacugaucccagcaggucucca

SEQ ID NO: 1255253 - RNA, 23 nt, Human
ucacugcaacuuccaccucccag

SEQ ID NO: 1255254 - RNA, 24 nt, Human
ucacugcaacuuccaccucccagg

SEQ ID NO: 1255255 - RNA, 24 nt, Human
ucacugcaaucucugccuccuggg

SEQ ID NO: 1255256 - RNA, 25 nt, Human
ucacugcaaucucugccuccugggu

SEQ ID NO: 1255257 - RNA, 20 nt, Human
ucagccuccugaguagcugg

SEQ ID NO: 1255258 - RNA, 26 nt, Human
ucagcucacugcaacuuccaccuccc

SEQ ID NO: 1255259 - RNA, 18 nt, Human
ucaggcauucacugaucc

SEQ ID NO: 1255260 - RNA, 25 nt, Human
uccaaaacaaaacacaugcuuccac

SEQ ID NO: 1255261 - RNA, 21 nt, Human
uccauggaaugugccgauuuc

SEQ ID NO: 1255262 - RNA, 24 nt, Human
ucccaaagugcugggauuacaggc

SEQ ID NO: 1255263 - RNA, 21 nt, Human
ucccagguucaagcgauucuc

SEQ ID NO: 1255264 - RNA, 24 nt, Human
ucccagguucaagcgauucuccug

SEQ ID NO: 1255265 - RNA, 24 nt, Human
ucccuaaguguugggauuacaggc

SEQ ID NO: 1255266 - RNA, 24 nt, Human
uccugaguagcugggauuacaggc

SEQ ID NO: 1255267 - RNA, 21 nt, Human
uccuggguucaagcgauuuuc

SEQ ID NO: 1255268 - RNA, 24 nt, Human
uccuggguucaagcgauuuuccug

SEQ ID NO: 1255269 - RNA, 20 nt, Human
ucgcuuguugcccaggcugg

SEQ ID NO: 1255270 - RNA, 21 nt, Human
ucgcuuguugcccaggcugga

SEQ ID NO: 1255271 - RNA, 18 nt, Human
ucucaaagccaucacuga

SEQ ID NO: 1255272 - RNA, 24 nt, Human
ucuccugccucagccuccugagua

SEQ ID NO: 1255273 - RNA, 24 nt, Human
ucucgaguagcugggacuacaggc

SEQ ID NO: 1255274 - RNA, 23 nt, Human
ucucgcucugucgcccagcugga

SEQ ID NO: 1255275 - RNA, 18 nt, Human
ucucugaagauacuugau

SEQ ID NO: 1255276 - RNA, 21 nt, Human
ucuuaggcuaugcauagcccc

SEQ ID NO: 1255277 - RNA, 20 nt, Human
ucuuuuuuuuugagacagag

SEQ ID NO: 1255278 - RNA, 22 nt, Human
ugacaacagcaauaaaaaguaa

SEQ ID NO: 1255279 - RNA, 19 nt, Human
ugaccauagagacgucugu

SEQ ID NO: 1255280 - RNA, 22 nt, Human
ugaccucauggucugcccgccu

SEQ ID NO: 1255281 - RNA, 22 nt, Human
ugagaagggucuaaacacccua

SEQ ID NO: 1255282 - RNA, 19 nt, Human
ugagaauucucaaagccag

SEQ ID NO: 1255283 - RNA, 21 nt, Human
ugagacagaguuucgcuuguu

SEQ ID NO: 1255284 - RNA, 19 nt, Human
ugagaggugcuugacauga

SEQ ID NO: 1255285 - RNA, 21 nt, Human
ugauaaaaauuuccaaaacaa

SEQ ID NO: 1255286 - RNA, 28 nt, Human
ugcagcaauaguuuuuuuuuuuuuuuuu

SEQ ID NO: 1255287 - RNA, 18 nt, Human
ugcccaggcuggagugca

SEQ ID NO: 1255288 - RNA, 21 nt, Human
ugcccaggcuggagugcaaug

SEQ ID NO: 1255289 - RNA, 21 nt, Human
ugcccaggcuggagugcaaug

SEQ ID NO: 1255290 - RNA, 24 nt, Human
ugcccggcuaauuuuuguauuuuu

SEQ ID NO: 1255291 - RNA, 24 nt, Human
ugccucagccuccugaguagcugg

SEQ ID NO: 1255292 - RNA, 24 nt, Human
ugcugggauuacaggcgugagcca

SEQ ID NO: 1255293 - RNA, 18 nt, Human
uggaauuuuuccuuggaa

SEQ ID NO: 1255294 - RNA, 19 nt, Human
uggagugcaauggcgugau

SEQ ID NO: 1255295 - RNA, 24 nt, Human
uggagugcaauggcgugaucucag

SEQ ID NO: 1255296 - RNA, 24 nt, Human
uggagugcacuggugcaaucuugg

SEQ ID NO: 1255297 - RNA, 24 nt, Human
uggcauuucuccauguuggucagg

SEQ ID NO: 1255298 - RNA, 24 nt, Human
uggccaggauggucucaaucuccu

SEQ ID NO: 1255299 - RNA, 24 nt, Human
uggcgugaucucagcucacugcaa

SEQ ID NO: 1255300 - RNA, 21 nt, Human
uggcucacugcaaucucugcc

SEQ ID NO: 1255301 - RNA, 21 nt, Human
ugggacuacaggcacgcgcca

SEQ ID NO: 1255302 - RNA, 22 nt, Human
ugggacuacaggcacgcgccac

SEQ ID NO: 1255303 - RNA, 24 nt, Human
ugggacuacaggcacgcgccacca

SEQ ID NO: 1255304 - RNA, 18 nt, Human
ugggauuacaggcacgug

SEQ ID NO: 1255305 - RNA, 21 nt, Human
ugggauuacaggcacgugcca

SEQ ID NO: 1255306 - RNA, 22 nt, Human
ugggauuacaggcacgugccac

SEQ ID NO: 1255307 - RNA, 24 nt, Human
ugggauuacaggcacgugccacca

SEQ ID NO: 1255308 - RNA, 18 nt, Human
ugggauuacaggcaugag

SEQ ID NO: 1255309 - RNA, 19 nt, Human
ugggauuacaggcaugagc

SEQ ID NO: 1255310 - RNA, 22 nt, Human
ugggauuacaggcaugagccac

SEQ ID NO: 1255311 - RNA, 23 nt, Human
ugggauuacaggcaugagccacc

SEQ ID NO: 1255312 - RNA, 24 nt, Human
ugggauuacaggcaugagccacca

SEQ ID NO: 1255313 - RNA, 24 nt, Human
ugggauuacaggcaugagccacca

SEQ ID NO: 1255314 - RNA, 18 nt, Human
ugggauuacaggcgugag

SEQ ID NO: 1255315 - RNA, 19 nt, Human
ugggauuacaggcgugagc

SEQ ID NO: 1255316 - RNA, 21 nt, Human
ugggauuacaggcgugagcca

SEQ ID NO: 1255317 - RNA, 22 nt, Human
ugggauuacaggcgugagccac

SEQ ID NO: 1255318 - RNA, 23 nt, Human
ugggauuacaggcgugagccacc

SEQ ID NO: 1255319 - RNA, 24 nt, Human
ugggauuacaggcgugagccaccg

SEQ ID NO: 1255320 - RNA, 19 nt, Human
ugggcuuggucgacugcug

SEQ ID NO: 1255321 - RNA, 23 nt, Human
uggguucaagcgauuuuccugcc

SEQ ID NO: 1255322 - RNA, 24 nt, Human
uggguucaagcgauuuuccugccu

SEQ ID NO: 1255323 - RNA, 23 nt, Human
uggucaggcuggucucgaacucc

SEQ ID NO: 1255324 - RNA, 22 nt, Human
ugugaugagaggugcuugacau

SEQ ID NO: 1255325 - RNA, 20 nt, Human
uguugcccaggcuggagugc

SEQ ID NO: 1255326 - RNA, 24 nt, Human
uuaguagagacaggguuucaccau

SEQ ID NO: 1255327 - RNA, 18 nt, Human
uuaguagagauggcauuu

SEQ ID NO: 1255328 - RNA, 24 nt, Human
uuaguagagauggcauuucuccau

SEQ ID NO: 1255329 - RNA, 20 nt, Human
uucaaaacccagcccuuuuc

SEQ ID NO: 1255330 - RNA, 21 nt, Human
uucaagcgauucuccugccuc

SEQ ID NO: 1255331 - RNA, 23 nt, Human
uucaagcgauucuccugccucag

SEQ ID NO: 1255332 - RNA, 24 nt, Human
uucaagcgauucuccugccucagc

SEQ ID NO: 1255333 - RNA, 20 nt, Human
uucaagcgauuuuccugccu

SEQ ID NO: 1255334 - RNA, 24 nt, Human
uucaagcgauuuuccugccuuagc

SEQ ID NO: 1255335 - RNA, 21 nt, Human
uucacugauaaaaaauuuacc

SEQ ID NO: 1255336 - RNA, 24 nt, Human
uucgcuuguugcccaggcuggagu

SEQ ID NO: 1255337 - RNA, 18 nt, Human
uuggccucccaaagugcu

SEQ ID NO: 1255338 - RNA, 19 nt, Human
uuggucgacugcugcagga

SEQ ID NO: 1255339 - RNA, 19 nt, Human
uuucaccauguuggccagg

SEQ ID NO: 1255340 - RNA, 20 nt, Human
uuucaccauguuggccagga

SEQ ID NO: 1255341 - RNA, 21 nt, Human
uuucgcuuguugcccaggcug

SEQ ID NO: 1255342 - RNA, 23 nt, Human
uuucgcuuguugcccaggcugga

SEQ ID NO: 1255343 - RNA, 21 nt, Human
uuucuccauguuggucaggcu

SEQ ID NO: 1255344 - RNA, 19 nt, Human
uuuucagcccugccucacc

SEQ ID NO: 1255345 - RNA, 22 nt, Human
uuuuguauuuuuaguagagaca

SEQ ID NO: 1255346 - RNA, 24 nt, Human
uuuuuaguagagacaggguuucac

SEQ ID NO: 1255347 - RNA, 19 nt, Human
uuuuuaguagagauggcau

SEQ ID NO: 1255348 - RNA, 20 nt, Human
uuuuuguauuuuuaguagag

SEQ ID NO: 1255349 - RNA, 20 nt, Human
uuuuuguauuuuuaguagag

SEQ ID NO: 1255350 - RNA, 18 nt, Human
uuuuuuuuuuuuuuuccg

SEQ ID NO: 1255351 - RNA, 20 nt, Human
uuuuuuuuuuuuuuuuccga

SEQ ID NO: 1255352 - RNA, 22 nt, Human
aaaauggaacgggaaaucagga

SEQ ID NO: 1255353 - RNA, 19 nt, Human
aaagugcugggauuacaga

SEQ ID NO: 1255354 - RNA, 24 nt, Human
aaagugcugggauuacagacguga

SEQ ID NO: 1255355 - RNA, 23 nt, Human
aacucccugccccucugggccuc

SEQ ID NO: 1255356 - RNA, 21 nt, Human
aagaaugagcaggagaggccg

SEQ ID NO: 1255357 - RNA, 18 nt, Human
aagacucuuccaucccua

SEQ ID NO: 1255358 - RNA, 23 nt, Human
aagacucuuccaucccuacauug

SEQ ID NO: 1255359 - RNA, 25 nt, Human
aagcaauucuccugccccagccucc

SEQ ID NO: 1255360 - RNA, 30 nt, Human
aagcaggacgagggggagacucaguuggaa

SEQ ID NO: 1255361 - RNA, 21 nt, Human
aagcucacgguggggcuucga

SEQ ID NO: 1255362 - RNA, 20 nt, Human
aaggugcugggauuauaggc

SEQ ID NO: 1255363 - RNA, 24 nt, Human
aaggugcugggauuauaggcauga

SEQ ID NO: 1255364 - RNA, 19 nt, Human
aagugcugggauuacagac

SEQ ID NO: 1255365 - RNA, 19 nt, Human
aagugcugggauuacagac

SEQ ID NO: 1255366 - RNA, 20 nt, Human
aauaagaaggcagauuggga

SEQ ID NO: 1255367 - RNA, 21 nt, Human
acaggcgcccgccaccacacc

SEQ ID NO: 1255368 - RNA, 21 nt, Human
acaguuaagagcaugcagagc

SEQ ID NO: 1255369 - RNA, 22 nt, Human
accacacacacacacacacaca

SEQ ID NO: 1255370 - RNA, 24 nt, Human
accacacacacacacacacacaca

SEQ ID NO: 1255371 - RNA, 26 nt, Human
accacaggcauacaugcacacauaca

SEQ ID NO: 1255372 - RNA, 18 nt, Human
accauguuggccaggcug

SEQ ID NO: 1255373 - RNA, 21 nt, Human
acccagagaggagccccaguu

SEQ ID NO: 1255374 - RNA, 25 nt, Human
acccgccucagccucccaaagugcu

SEQ ID NO: 1255375 - RNA, 25 nt, Human
acccgcuucggccucccaaggugcu

SEQ ID NO: 1255376 - RNA, 22 nt, Human
accgcaccuggccagcagagcu

SEQ ID NO: 1255377 - RNA, 27 nt, Human
accgcaccuggccagcaggacaucggg

SEQ ID NO: 1255378 - RNA, 24 nt, Human
accuugugauccacccgccucagc

SEQ ID NO: 1255379 - RNA, 24 nt, Human
acgacaaugaggguaucuuguacc

SEQ ID NO: 1255380 - RNA, 25 nt, Human
acucugucgcccaggcuggagugca

SEQ ID NO: 1255381 - RNA, 27 nt, Human
acugaagcauauggcccuaggaagcca

SEQ ID NO: 1255382 - RNA, 18 nt, Human
acugcaagcuccaccgcc

SEQ ID NO: 1255383 - RNA, 19 nt, Human
agaaagagcagggacccag

SEQ ID NO: 1255384 - RNA, 21 nt, Human
agagaggagccccaguuggca

SEQ ID NO: 1255385 - RNA, 23 nt, Human
agcaauucuccugccccagccuc

SEQ ID NO: 1255386 - RNA, 18 nt, Human
agccuccagaguagcugg

SEQ ID NO: 1255387 - RNA, 20 nt, Human
agcuagcgcuggcagccacg

SEQ ID NO: 1255388 - RNA, 24 nt, Human
agcucuuguugccuaggcuggagu

SEQ ID NO: 1255389 - RNA, 23 nt, Human
agcugggauuacaggugugugcc

SEQ ID NO: 1255390 - RNA, 21 nt, Human
aggaaaggcuuagccugccag

SEQ ID NO: 1255391 - RNA, 22 nt, Human
aggaagagcuggagcuugggug

SEQ ID NO: 1255392 - RNA, 25 nt, Human
aggaagccaugagugucaggcugcu

SEQ ID NO: 1255393 - RNA, 22 nt, Human
aggaaggcccagcugggcaugg

SEQ ID NO: 1255394 - RNA, 20 nt, Human
aggaggagagugagggaggg

SEQ ID NO: 1255395 - RNA, 19 nt, Human
aggcaugagccaccgcacc

SEQ ID NO: 1255396 - RNA, 19 nt, Human
aggccagggcagagcagua

SEQ ID NO: 1255397 - RNA, 25 nt, Human
aggcuggagugcagugacacgaucu

SEQ ID NO: 1255398 - RNA, 23 nt, Human
agggagcugaggcugaggaaggu

SEQ ID NO: 1255399 - RNA, 26 nt, Human
agggagcugaggcugaggauaccgug

SEQ ID NO: 1255400 - RNA, 18 nt, Human
agguauacgugcacaacc

SEQ ID NO: 1255401 - RNA, 24 nt, Human
aggugauccacccgcuucggccuc

SEQ ID NO: 1255402 - RNA, 18 nt, Human
aguagcugggacuacagg

SEQ ID NO: 1255403 - RNA, 19 nt, Human
aguagcugggacuacaggc

SEQ ID NO: 1255404 - RNA, 23 nt, Human
aguagcugggauuacaggugugu

SEQ ID NO: 1255405 - RNA, 24 nt, Human
agucagcacugaggccagagucca

SEQ ID NO: 1255406 - RNA, 24 nt, Human
agugcaauggcaugaucucggcuc

SEQ ID NO: 1255407 - RNA, 24 nt, Human
agugcagugacacgaucucggcuc

SEQ ID NO: 1255408 - RNA, 24 nt, Human
agugcugggauuacagacgugagu

SEQ ID NO: 1255409 - RNA, 20 nt, Human
auaagaaggcagauugggaa

SEQ ID NO: 1255410 - RNA, 30 nt, Human
auacgugcacaaccacacacacacacacag

SEQ ID NO: 1255411 - RNA, 18 nt, Human
augggguuucaccauguu

SEQ ID NO: 1255412 - RNA, 22 nt, Human
augggguuucaccauguuggcc

SEQ ID NO: 1255413 - RNA, 23 nt, Human
augggguuucaccauguuggcca

SEQ ID NO: 1255414 - RNA, 24 nt, Human
augggguuucaccauguuggccag

SEQ ID NO: 1255415 - RNA, 19 nt, Human
auuacaggugugugccacc

SEQ ID NO: 1255416 - RNA, 24 nt, Human
auuuuuaguagagacagguuucac

SEQ ID NO: 1255417 - RNA, 24 nt, Human
caaagugcugggauuacagacgug

SEQ ID NO: 1255418 - RNA, 19 nt, Human
caagggauggugaguagcc

SEQ ID NO: 1255419 - RNA, 24 nt, Human
caaggugcugggauuauaggcaug

SEQ ID NO: 1255420 - RNA, 19 nt, Human
cacaaaaugcuuugugacc

SEQ ID NO: 1255421 - RNA, 21 nt, Human
cacaaaaugcuuugugaccaa

SEQ ID NO: 1255422 - RNA, 20 nt, Human
cacacacacacacacacaca

SEQ ID NO: 1255423 - RNA, 22 nt, Human
cacaccauucuccugccucagc

SEQ ID NO: 1255424 - RNA, 22 nt, Human
caccaccgcacccacagcagac

SEQ ID NO: 1255425 - RNA, 23 nt, Human
caccaccgcacccacagcagaca

SEQ ID NO: 1255426 - RNA, 18 nt, Human
caccauguuggccaggcu

SEQ ID NO: 1255427 - RNA, 21 nt, Human
caccauguuggccaggcuggu

SEQ ID NO: 1255428 - RNA, 24 nt, Human
caccauguuggccaggcugguauc

SEQ ID NO: 1255429 - RNA, 31 nt, Human
caccauguuggccaggcugguaucaaacucc

SEQ ID NO: 1255430 - RNA, 19 nt, Human
cacccacagcagacaucac

SEQ ID NO: 1255431 - RNA, 23 nt, Human
cacccgccucagccucccaaagu

SEQ ID NO: 1255432 - RNA, 20 nt, Human
caccgcacccacagcagaca

SEQ ID NO: 1255433 - RNA, 22 nt, Human
caccgcaccuggccagcagagc

SEQ ID NO: 1255434 - RNA, 18 nt, Human
caccguguuagccaggau

SEQ ID NO: 1255435 - RNA, 24 nt, Human
caccguguuagccaggaugguuuc

SEQ ID NO: 1255436 - RNA, 20 nt, Human
cacuccucaccaccgcaccc

SEQ ID NO: 1255437 - RNA, 24 nt, Human
cacucugucgcccaggcuggagug

SEQ ID NO: 1255438 - RNA, 21 nt, Human
cacugcaaccuccgccuccug

SEQ ID NO: 1255439 - RNA, 23 nt, Human
cacugcaaccuccgccuccuggg

SEQ ID NO: 1255440 - RNA, 23 nt, Human
cagaaagagcagggacccagaga

SEQ ID NO: 1255441 - RNA, 24 nt, Human
cagaguagcugggauuacaggugu

SEQ ID NO: 1255442 - RNA, 20 nt, Human
cagccacguuugccagaccc

SEQ ID NO: 1255443 - RNA, 21 nt, Human
caggccccugaacuaugcuug

SEQ ID NO: 1255444 - RNA, 19 nt, Human
cagguaacucccugccccu

SEQ ID NO: 1255445 - RNA, 23 nt, Human
cagguuucaccguguuagccagg

SEQ ID NO: 1255446 - RNA, 21 nt, Human
cagugggcagggugugccgau

SEQ ID NO: 1255447 - RNA, 28 nt, Human
caugcacacauacagagacucagguaua

SEQ ID NO: 1255448 - RNA, 23 nt, Human
cauguuggccaggcugguaucaa

SEQ ID NO: 1255449 - RNA, 22 nt, Human
ccaaagugcugggauuacagac

SEQ ID NO: 1255450 - RNA, 24 nt, Human
ccaaagugcugggauuacagacgu

SEQ ID NO: 1255451 - RNA, 24 nt, Human
ccaaggugcugggauuauaggcau

SEQ ID NO: 1255452 - RNA, 19 nt, Human
ccacacacacacacacaca

SEQ ID NO: 1255453 - RNA, 21 nt, Human
ccacacacacacacacacaca

SEQ ID NO: 1255454 - RNA, 26 nt, Human
ccacccgccucagccucccaaagugc

SEQ ID NO: 1255455 - RNA, 19 nt, Human
ccacuccucaccaccgcac

SEQ ID NO: 1255456 - RNA, 21 nt, Human
ccacuccucaccaccgcaccc

SEQ ID NO: 1255457 - RNA, 19 nt, Human
ccagaguagcugggauuac

SEQ ID NO: 1255458 - RNA, 22 nt, Human
ccagaguagcugggauuacagg

SEQ ID NO: 1255459 - RNA, 22 nt, Human
ccagaguagcugggauuacagg

SEQ ID NO: 1255460 - RNA, 24 nt, Human
ccagaguagcugggauuacaggug

SEQ ID NO: 1255461 - RNA, 25 nt, Human
ccagaguagcugggauuacaggugu

SEQ ID NO: 1255462 - RNA, 21 nt, Human
cccacacauaccacaggcaua

SEQ ID NO: 1255463 - RNA, 27 nt, Human
cccacacauaccacaggcauacaugca

SEQ ID NO: 1255464 - RNA, 19 nt, Human
cccaggagcuuguuggaag

SEQ ID NO: 1255465 - RNA, 20 nt, Human
cccaggcagccacguccagu

SEQ ID NO: 1255466 - RNA, 19 nt, Human
ccccucugggccucaguuu

SEQ ID NO: 1255467 - RNA, 23 nt, Human
cccgaguagcugggacuacaggc

SEQ ID NO: 1255468 - RNA, 24 nt, Human
cccgaguagcugggacuacaggcg

SEQ ID NO: 1255469 - RNA, 23 nt, Human
cccggguucacaccauucuccug

SEQ ID NO: 1255470 - RNA, 19 nt, Human
cccuucucccuucccucuc

SEQ ID NO: 1255471 - RNA, 23 nt, Human
ccgcccggguucacaccauucuc

SEQ ID NO: 1255472 - RNA, 24 nt, Human
ccgcccggguucacaccauucucc

SEQ ID NO: 1255473 - RNA, 24 nt, Human
ccgccucagccucccaaagugcug

SEQ ID NO: 1255474 - RNA, 27 nt, Human
ccgccuccuggguucaagcaauucuuu

SEQ ID NO: 1255475 - RNA, 21 nt, Human
ccggcccgauguucuuauguu

SEQ ID NO: 1255476 - RNA, 19 nt, Human
ccuaggcuggagugcaaug

SEQ ID NO: 1255477 - RNA, 19 nt, Human
ccucaccaccgcacccaca

SEQ ID NO: 1255478 - RNA, 24 nt, Human
ccucagguaacucccugccccucu

SEQ ID NO: 1255479 - RNA, 19 nt, Human
ccuccaagcucacgguggg

SEQ ID NO: 1255480 - RNA, 19 nt, Human
ccuccgccuccuggguuca

SEQ ID NO: 1255481 - RNA, 24 nt, Human
ccuccuggguucaagcaauucucc

SEQ ID NO: 1255482 - RNA, 22 nt, Human
ccugaccucaggugauccaccc

SEQ ID NO: 1255483 - RNA, 23 nt, Human
ccugaccucaggugauccacccg

SEQ ID NO: 1255484 - RNA, 20 nt, Human
ccugaccuugugauccaccc

SEQ ID NO: 1255485 - RNA, 18 nt, Human
ccugcacggagcccagga

SEQ ID NO: 1255486 - RNA, 23 nt, Human
ccugccucagccucccgaguagc

SEQ ID NO: 1255487 - RNA, 23 nt, Human
ccuggguucaagcaauucuccug

SEQ ID NO: 1255488 - RNA, 19 nt, Human
cgcccggguucacaccauu

SEQ ID NO: 1255489 - RNA, 31 nt, Human
cgugcacaaccacacacacacacacacacag

SEQ ID NO: 1255490 - RNA, 22 nt, Human
cuagcucuuguugccuaggcug

SEQ ID NO: 1255491 - RNA, 24 nt, Human
cuagcucuuguugccuaggcugga

SEQ ID NO: 1255492 - RNA, 18 nt, Human
cuaguagagaugggguuu

SEQ ID NO: 1255493 - RNA, 22 nt, Human
cuaguagagaugggguuucacc

SEQ ID NO: 1255494 - RNA, 24 nt, Human
cuaguagagaugggguuucaccau

SEQ ID NO: 1255495 - RNA, 24 nt, Human
cucaccaccgcacccacagcagac

SEQ ID NO: 1255496 - RNA, 24 nt, Human
cucacucugucgcccaggcuggag

SEQ ID NO: 1255497 - RNA, 24 nt, Human
cucacugcaaccuccgccuccugg

SEQ ID NO: 1255498 - RNA, 24 nt, Human
cucagccucccgaguagcugggac

SEQ ID NO: 1255499 - RNA, 24 nt, Human
cuccugaccuugugauccacccgc

SEQ ID NO: 1255500 - RNA, 21 nt, Human
cuccuggguucaagcaauucu

SEQ ID NO: 1255501 - RNA, 19 nt, Human
cugaacuaugcuuguuaca

SEQ ID NO: 1255502 - RNA, 23 nt, Human
cugcaaccuccgccuccuggguu

SEQ ID NO: 1255503 - RNA, 24 nt, Human
cugcaaccuccgccuccuggguuc

SEQ ID NO: 1255504 - RNA, 23 nt, Human
cugccaggacccuucccuggcca

SEQ ID NO: 1255505 - RNA, 23 nt, Human
cugccucagccucccgaguagcu

SEQ ID NO: 1255506 - RNA, 24 nt, Human
cuggagugcaauggcaugaucucg

SEQ ID NO: 1255507 - RNA, 23 nt, Human
cuguccacaaagcauccacaagg

SEQ ID NO: 1255508 - RNA, 19 nt, Human
cuugcaugaacgacaauga

SEQ ID NO: 1255509 - RNA, 22 nt, Human
cuuguugccuaggcuggagugc

SEQ ID NO: 1255510 - RNA, 24 nt, Human
cuuguugccuaggcuggagugcaa

SEQ ID NO: 1255511 - RNA, 19 nt, Human
gaaugagcaggagaggccg

SEQ ID NO: 1255512 - RNA, 19 nt, Human
gaccucaggugauccaccc

SEQ ID NO: 1255513 - RNA, 22 nt, Human
gaccuugugauccacccgccuc

SEQ ID NO: 1255514 - RNA, 24 nt, Human
gaccuugugauccacccgccucag

SEQ ID NO: 1255515 - RNA, 26 nt, Human
gagaggccagggcagagcagugggca

SEQ ID NO: 1255516 - RNA, 18 nt, Human
gagaugggguuucaccau

SEQ ID NO: 1255517 - RNA, 24 nt, Human
gagaugggguuucaccauguuggc

SEQ ID NO: 1255518 - RNA, 23 nt, Human
gagcugaggcugaggaaggucac

SEQ ID NO: 1255519 - RNA, 20 nt, Human
gagggaggagacccaggcag

SEQ ID NO: 1255520 - RNA, 20 nt, Human
gaggggagagcacaggagag

SEQ ID NO: 1255521 - RNA, 25 nt, Human
gaguagcugggacuacaggcgcccg

SEQ ID NO: 1255522 - RNA, 26 nt, Human
gaguagcugggauuacaggugugugc

SEQ ID NO: 1255523 - RNA, 18 nt, Human
gauuacagacgugaguca

SEQ ID NO: 1255524 - RNA, 19 nt, Human
gauuacagacgugagucac

SEQ ID NO: 1255525 - RNA, 21 nt, Human
gauuacagacgugagucaccg

SEQ ID NO: 1255526 - RNA, 18 nt, Human
gauuacaggugugugcca

SEQ ID NO: 1255527 - RNA, 22 nt, Human
gauuauaggcaugagccaccgc

SEQ ID NO: 1255528 - RNA, 23 nt, Human
gauuauaggcaugagccaccgca

SEQ ID NO: 1255529 - RNA, 20 nt, Human
gcaccuaaaagccccuggca

SEQ ID NO: 1255530 - RNA, 19 nt, Human
gcagccacguuugccagac

SEQ ID NO: 1255531 - RNA, 18 nt, Human
gcagggcaggggugggag

SEQ ID NO: 1255532 - RNA, 24 nt, Human
gcauacaugcacacauacagagac

SEQ ID NO: 1255533 - RNA, 22 nt, Human
gccacuccucaccaccgcaccc

SEQ ID NO: 1255534 - RNA, 21 nt, Human
gccauugccacuccucaccac

SEQ ID NO: 1255535 - RNA, 19 nt, Human
gcccaggcuggagugcagu

SEQ ID NO: 1255536 - RNA, 23 nt, Human
gcccaggcuggagugcagugaca

SEQ ID NO: 1255537 - RNA, 24 nt, Human
gccuaggcuggagugcaauggcau

SEQ ID NO: 1255538 - RNA, 23 nt, Human
gccucagccucccaaagugcugg

SEQ ID NO: 1255539 - RNA, 21 nt, Human
gcucuuguugccuaggcugga

SEQ ID NO: 1255540 - RNA, 20 nt, Human
gcuggagcuugggugaaaau

SEQ ID NO: 1255541 - RNA, 19 nt, Human
gcuggagugcaauggcaug

SEQ ID NO: 1255542 - RNA, 23 nt, Human
gcugguaucaaacuccugaccuc

SEQ ID NO: 1255543 - RNA, 25 nt, Human
gcuugugugugugugugugugugug

SEQ ID NO: 1255544 - RNA, 21 nt, Human
ggacccagagaggagccccag

SEQ ID NO: 1255545 - RNA, 23 nt, Human
ggagagugggcauggcuccugca

SEQ ID NO: 1255546 - RNA, 24 nt, Human
ggcugguaucaaacuccugaccuc

SEQ ID NO: 1255547 - RNA, 22 nt, Human
gggguuucaccauguuggccag

SEQ ID NO: 1255548 - RNA, 23 nt, Human
gggguuucaccauguuggccagg

SEQ ID NO: 1255549 - RNA, 22 nt, Human
ggguuucaccauguuggccagg

SEQ ID NO: 1255550 - RNA, 19 nt, Human
gguuucgaucuccugaccu

SEQ ID NO: 1255551 - RNA, 20 nt, Human
gguuucgaucuccugaccuu

SEQ ID NO: 1255552 - RNA, 23 nt, Human
guagagaugggguuucaccaugu

SEQ ID NO: 1255553 - RNA, 18 nt, Human
guagcugggauuacaggu

SEQ ID NO: 1255554 - RNA, 21 nt, Human
guauacgugcacaaccacaca

SEQ ID NO: 1255555 - RNA, 18 nt, Human
guccaguauagcagugcu

SEQ ID NO: 1255556 - RNA, 24 nt, Human
gugauccacccgccucagccuccc

SEQ ID NO: 1255557 - RNA, 24 nt, Human
gugauccacccgcuucggccuccc

SEQ ID NO: 1255558 - RNA, 21 nt, Human
gugcugggauuauaggcauga

SEQ ID NO: 1255559 - RNA, 21 nt, Human
gugugugugugugugugugug

SEQ ID NO: 1255560 - RNA, 21 nt, Human
gugugugugugugugugugug

SEQ ID NO: 1255561 - RNA, 18 nt, Human
uaagaaggcagauuggga

SEQ ID NO: 1255562 - RNA, 22 nt, Human
uacagcaccuaaaagccccugg

SEQ ID NO: 1255563 - RNA, 22 nt, Human
uacaggcgcccgccaccacacc

SEQ ID NO: 1255564 - RNA, 24 nt, Human
uacaggugugugccaccacaccca

SEQ ID NO: 1255565 - RNA, 19 nt, Human
uacauugccuguugagaag

SEQ ID NO: 1255566 - RNA, 21 nt, Human
uacauuuauagaacccgcaac

SEQ ID NO: 1255567 - RNA, 30 nt, Human
uacgugcacaaccacacacacacacacaca

SEQ ID NO: 1255568 - RNA, 21 nt, Human
uagagacagguuucaccgugu

SEQ ID NO: 1255569 - RNA, 22 nt, Human
uagagaugggguuucaccaugu

SEQ ID NO: 1255570 - RNA, 21 nt, Human
uagccugcacacugcacaugc

SEQ ID NO: 1255571 - RNA, 20 nt, Human
uaguagagacagguuucacc

SEQ ID NO: 1255572 - RNA, 24 nt, Human
uaguagagacagguuucaccgugu

SEQ ID NO: 1255573 - RNA, 24 nt, Human
uaguagagaugggguuucaccaug

SEQ ID NO: 1255574 - RNA, 25 nt, Human
uaguagagaugggguuucaccaugu

SEQ ID NO: 1255575 - RNA, 19 nt, Human
uaucuuguaccucaccaag

SEQ ID NO: 1255576 - RNA, 21 nt, Human
ucacaccauucuccugccuca

SEQ ID NO: 1255577 - RNA, 18 nt, Human
ucaccgagcccggcccga

SEQ ID NO: 1255578 - RNA, 24 nt, Human
ucaccguguuagccaggaugguuu

SEQ ID NO: 1255579 - RNA, 22 nt, Human
ucacuaacugaucccagccguu

SEQ ID NO: 1255580 - RNA, 24 nt, Human
ucacucugucgcccaggcuggagu

SEQ ID NO: 1255581 - RNA, 23 nt, Human
ucacugcaaccuccgccuccugg

SEQ ID NO: 1255582 - RNA, 24 nt, Human
ucacugcaaccuccgccuccuggg

SEQ ID NO: 1255583 - RNA, 25 nt, Human
ucacugcaaccuccgccuccugggu

SEQ ID NO: 1255584 - RNA, 26 nt, Human
ucacugcaaccuccgccuccuggguu

SEQ ID NO: 1255585 - RNA, 18 nt, Human
ucacugcaagcuccaccg

SEQ ID NO: 1255586 - RNA, 21 nt, Human
ucacugcaagcuccaccgccc

SEQ ID NO: 1255587 - RNA, 24 nt, Human
ucacugcaagcuccaccgcccggg

SEQ ID NO: 1255588 - RNA, 23 nt, Human
ucagccucccgaguagcugggac

SEQ ID NO: 1255589 - RNA, 21 nt, Human
uccacccgccucagccuccca

SEQ ID NO: 1255590 - RNA, 22 nt, Human
uccaccgcccggguucacacca

SEQ ID NO: 1255591 - RNA, 24 nt, Human
uccagaguagcugggauuacaggu

SEQ ID NO: 1255592 - RNA, 18 nt, Human
ucccaaagugcugggauu

SEQ ID NO: 1255593 - RNA, 24 nt, Human
ucccaaagugcugggauuacagac

SEQ ID NO: 1255594 - RNA, 24 nt, Human
ucccaaggugcugggauuauaggc

SEQ ID NO: 1255595 - RNA, 24 nt, Human
ucccgaguagcugggacuacaggc

SEQ ID NO: 1255596 - RNA, 23 nt, Human
ucccucucguaauguaaccucag

SEQ ID NO: 1255597 - RNA, 24 nt, Human
uccgccuccuggguucaagcaauu

SEQ ID NO: 1255598 - RNA, 21 nt, Human
uccuggguucaagcaauucuc

SEQ ID NO: 1255599 - RNA, 24 nt, Human
uccuggguucaagcaauucuccug

SEQ ID NO: 1255600 - RNA, 24 nt, Human
ucgcccaggcuggagugcagugac

SEQ ID NO: 1255601 - RNA, 24 nt, Human
ucuagcucuuguugccuaggcugg

SEQ ID NO: 1255602 - RNA, 23 nt, Human
ucucacucugucgcccaggcugg

SEQ ID NO: 1255603 - RNA, 24 nt, Human
ucucacucugucgcccaggcugga

SEQ ID NO: 1255604 - RNA, 26 nt, Human
ucucacucugucgcccaggcuggagu

SEQ ID NO: 1255605 - RNA, 27 nt, Human
ucucacucugucgcccaggcuggagug

SEQ ID NO: 1255606 - RNA, 24 nt, Human
ucuccugccccagccuccagagua

SEQ ID NO: 1255607 - RNA, 24 nt, Human
ucuccugccucagccucccgagua

SEQ ID NO: 1255608 - RNA, 21 nt, Human
ucucugacugaagcauauggc

SEQ ID NO: 1255609 - RNA, 24 nt, Human
ucugucgcccaggcuggagugcag

SEQ ID NO: 1255610 - RNA, 19 nt, Human
ucuuguugccuaggcugga

SEQ ID NO: 1255611 - RNA, 22 nt, Human
ugacaggugcucccugcaaggg

SEQ ID NO: 1255612 - RNA, 21 nt, Human
ugaccaaagcacaaagggugg

SEQ ID NO: 1255613 - RNA, 20 nt, Human
ugaccucaggugauccaccc

SEQ ID NO: 1255614 - RNA, 22 nt, Human
ugaccucaggugauccacccgc

SEQ ID NO: 1255615 - RNA, 23 nt, Human
ugaccucaggugauccacccgcu

SEQ ID NO: 1255616 - RNA, 24 nt, Human
ugaccucaggugauccacccgcuu

SEQ ID NO: 1255617 - RNA, 23 nt, Human
ugaccuugugauccacccgccuc

SEQ ID NO: 1255618 - RNA, 23 nt, Human
ugagacagagucuagcucuuguu

SEQ ID NO: 1255619 - RNA, 21 nt, Human
ugaguuuggaauccugggaga

SEQ ID NO: 1255620 - RNA, 20 nt, Human
ugcacaaagguucugcgggg

SEQ ID NO: 1255621 - RNA, 21 nt, Human
ugcacaaagguucugcggggu

SEQ ID NO: 1255622 - RNA, 31 nt, Human
ugcacaaccacacacacacacacacacacag

SEQ ID NO: 1255623 - RNA, 22 nt, Human
ugcagugacacgaucucggcuc

SEQ ID NO: 1255624 - RNA, 23 nt, Human
ugcccaucucugacugaagcaua

SEQ ID NO: 1255625 - RNA, 24 nt, Human
ugccccagccuccagaguagcugg

SEQ ID NO: 1255626 - RNA, 20 nt, Human
ugccuaggcuggagugcaau

SEQ ID NO: 1255627 - RNA, 21 nt, Human
ugccuaggcuggagugcaaug

SEQ ID NO: 1255628 - RNA, 24 nt, Human
ugccuaggcuggagugcaauggca

SEQ ID NO: 1255629 - RNA, 24 nt, Human
ugccucagccucccgaguagcugg

SEQ ID NO: 1255630 - RNA, 25 nt, Human
ugccuccaagcucacgguggggcuu

SEQ ID NO: 1255631 - RNA, 18 nt, Human
ugccuggaugacaggugc

SEQ ID NO: 1255632 - RNA, 18 nt, Human
ugcggaggugaggaaggc

SEQ ID NO: 1255633 - RNA, 24 nt, Human
ugcugggauuacagacgugaguca

SEQ ID NO: 1255634 - RNA, 24 nt, Human
ugcuugugugugugugugugugug

SEQ ID NO: 1255635 - RNA, 24 nt, Human
uggaagauguggcacaaaaugcuu

SEQ ID NO: 1255636 - RNA, 22 nt, Human
uggaggggagagcacaggagag

SEQ ID NO: 1255637 - RNA, 23 nt, Human
uggaggguaucuuuuuuuguggu

SEQ ID NO: 1255638 - RNA, 24 nt, Human
uggagucucacucugucgcccagg

SEQ ID NO: 1255639 - RNA, 19 nt, Human
uggagugcaauggcaugau

SEQ ID NO: 1255640 - RNA, 24 nt, Human
uggagugcaauggcaugaucucgg

SEQ ID NO: 1255641 - RNA, 23 nt, Human
uggagugcagugacacgaucucg

SEQ ID NO: 1255642 - RNA, 24 nt, Human
uggagugcagugacacgaucucgg

SEQ ID NO: 1255643 - RNA, 19 nt, Human
uggccagcagagcuugugu

SEQ ID NO: 1255644 - RNA, 24 nt, Human
uggccaggcugguaucaaacuccu

SEQ ID NO: 1255645 - RNA, 21 nt, Human
ugggacuacaggcgcccgcca

SEQ ID NO: 1255646 - RNA, 22 nt, Human
ugggacuacaggcgcccgccac

SEQ ID NO: 1255647 - RNA, 24 nt, Human
ugggacuacaggcgcccgccacca

SEQ ID NO: 1255648 - RNA, 21 nt, Human
ugggagagagggcagggcagg

SEQ ID NO: 1255649 - RNA, 21 nt, Human
ugggaguccccuucucccuuc

SEQ ID NO: 1255650 - RNA, 18 nt, Human
ugggauuacagacgugag

SEQ ID NO: 1255651 - RNA, 18 nt, Human
ugggauuacagacgugag

SEQ ID NO: 1255652 - RNA, 21 nt, Human
ugggauuacagacgugaguca

SEQ ID NO: 1255653 - RNA, 22 nt, Human
ugggauuacagacgugagucac

SEQ ID NO: 1255654 - RNA, 23 nt, Human
ugggauuacagacgugagucacc

SEQ ID NO: 1255655 - RNA, 24 nt, Human
ugggauuacagacgugagucaccg

SEQ ID NO: 1255656 - RNA, 18 nt, Human
ugggauuacaggugugug

SEQ ID NO: 1255657 - RNA, 19 nt, Human
ugggauuacaggugugugc

SEQ ID NO: 1255658 - RNA, 21 nt, Human
ugggauuacaggugugugcca

SEQ ID NO: 1255659 - RNA, 22 nt, Human
ugggauuacaggugugugccac

SEQ ID NO: 1255660 - RNA, 24 nt, Human
ugggauuacaggugugugccacca

SEQ ID NO: 1255661 - RNA, 18 nt, Human
ugggauuauaggcaugag

SEQ ID NO: 1255662 - RNA, 19 nt, Human
ugggauuauaggcaugagc

SEQ ID NO: 1255663 - RNA, 21 nt, Human
ugggauuauaggcaugagcca

SEQ ID NO: 1255664 - RNA, 22 nt, Human
ugggauuauaggcaugagccac

SEQ ID NO: 1255665 - RNA, 23 nt, Human
ugggauuauaggcaugagccacc

SEQ ID NO: 1255666 - RNA, 24 nt, Human
ugggauuauaggcaugagccaccg

SEQ ID NO: 1255667 - RNA, 24 nt, Human
ugggccucaguuugcccaucucug

SEQ ID NO: 1255668 - RNA, 24 nt, Human
ugggguuucaccauguuggccagg

SEQ ID NO: 1255669 - RNA, 21 nt, Human
uggguucaagcaauucuccug

SEQ ID NO: 1255670 - RNA, 23 nt, Human
uggguucaagcaauucuccugcc

SEQ ID NO: 1255671 - RNA, 23 nt, Human
ugguggacgugggaagcaggacg

SEQ ID NO: 1255672 - RNA, 21 nt, Human
ugguuguucugucaagaagaa

SEQ ID NO: 1255673 - RNA, 18 nt, Human
ugugaauaagaaggcaga

SEQ ID NO: 1255674 - RNA, 24 nt, Human
ugugauccacccgccucagccucc

SEQ ID NO: 1255675 - RNA, 20 nt, Human
ugugugccaccacacccagc

SEQ ID NO: 1255676 - RNA, 18 nt, Human
ugugugugugugugugug

SEQ ID NO: 1255677 - RNA, 18 nt, Human
ugugugugugugugugug

SEQ ID NO: 1255678 - RNA, 18 nt, Human
ugugugugugugugugug

SEQ ID NO: 1255679 - RNA, 18 nt, Human
ugugugugugugugugug

SEQ ID NO: 1255680 - RNA, 18 nt, Human
ugugugugugugugugug

SEQ ID NO: 1255681 - RNA, 18 nt, Human
ugugugugugugugugug

SEQ ID NO: 1255682 - RNA, 18 nt, Human
ugugugugugugugugug

SEQ ID NO: 1255683 - RNA, 21 nt, Human
ugugugugugugugugugugu

SEQ ID NO: 1255684 - RNA, 21 nt, Human
ugugugugugugugugugugu

SEQ ID NO: 1255685 - RNA, 21 nt, Human
ugugugugugugugugugugu

SEQ ID NO: 1255686 - RNA, 21 nt, Human
ugugugugugugugugugugu

SEQ ID NO: 1255687 - RNA, 21 nt, Human
ugugugugugugugugugugu

SEQ ID NO: 1255688 - RNA, 21 nt, Human
ugugugugugugugugugugu

SEQ ID NO: 1255689 - RNA, 21 nt, Human
ugugugugugugugugugugu

SEQ ID NO: 1255690 - RNA, 21 nt, Human
ugugugugugugugugugugu

SEQ ID NO: 1255691 - RNA, 21 nt, Human
ugugugugugugugugugugu

SEQ ID NO: 1255692 - RNA, 21 nt, Human
ugugugugugugugugugugu

SEQ ID NO: 1255693 - RNA, 22 nt, Human
ugugugugugugugugugugug

SEQ ID NO: 1255694 - RNA, 22 nt, Human
ugugugugugugugugugugug

SEQ ID NO: 1255695 - RNA, 24 nt, Human
uguuuuguauuucuaguagagaug

SEQ ID NO: 1255696 - RNA, 21 nt, Human
uuaguagagacagguuucacc

SEQ ID NO: 1255697 - RNA, 23 nt, Human
uuaguagagacagguuucaccgu

SEQ ID NO: 1255698 - RNA, 24 nt, Human
uuaguagagacagguuucaccgug

SEQ ID NO: 1255699 - RNA, 24 nt, Human
uucaagcaauucuccugccccagc

SEQ ID NO: 1255700 - RNA, 23 nt, Human
uuccacacugccccaggcagcca

SEQ ID NO: 1255701 - RNA, 19 nt, Human
uucggccucccaaggugcu

SEQ ID NO: 1255702 - RNA, 23 nt, Human
uugggaagagcugccuggaugac

SEQ ID NO: 1255703 - RNA, 18 nt, Human
uugguauuuuuaguagag

SEQ ID NO: 1255704 - RNA, 25 nt, Human
uuuaagaugaagacucuuccauccu

SEQ ID NO: 1255705 - RNA, 20 nt, Human
uuuaguacgaaguggaccau

SEQ ID NO: 1255706 - RNA, 24 nt, Human
uuuaguagagacagguuucaccgu

SEQ ID NO: 1255707 - RNA, 24 nt, Human
uuucaccauguuggccaggcuggu

SEQ ID NO: 1255708 - RNA, 19 nt, Human
uuucaccguguuagccagg

SEQ ID NO: 1255709 - RNA, 24 nt, Human
uuucuaguagagaugggguuucac

SEQ ID NO: 1255710 - RNA, 19 nt, Human
uuuugugguggggcugaag

SEQ ID NO: 1255711 - RNA, 24 nt, Human
uuuuugguauuuuuaguagagaca

SEQ ID NO: 1255712 - RNA, 19 nt, Human
aaaaaaaccaucauccgag

SEQ ID NO: 1255713 - RNA, 22 nt, Human
aaaaacuuuucuuuccugcuaa

SEQ ID NO: 1255714 - RNA, 19 nt, Human
aaacagcagaaccaggucu

SEQ ID NO: 1255715 - RNA, 25 nt, Human
aaacagcagaaccaggucucaaacc

SEQ ID NO: 1255716 - RNA, 21 nt, Human
aaaggagcccccugugccccu

SEQ ID NO: 1255717 - RNA, 19 nt, Human
aaaggccuagaaacugcau

SEQ ID NO: 1255718 - RNA, 25 nt, Human
aacaagacaacuucucccgggacag

SEQ ID NO: 1255719 - RNA, 21 nt, Human
aacagaugcacccccagcaca

SEQ ID NO: 1255720 - RNA, 24 nt, Human
aagcacuucacggacaccuccuca

SEQ ID NO: 1255721 - RNA, 22 nt, Human
aagcagcccuaggaggcagggu

SEQ ID NO: 1255722 - RNA, 21 nt, Human
aagccauggcaaggggaagga

SEQ ID NO: 1255723 - RNA, 21 nt, Human
aaggagaaaaaaaaaccauca

SEQ ID NO: 1255724 - RNA, 18 nt, Human
acacacccuccaggaagc

SEQ ID NO: 1255725 - RNA, 19 nt, Human
acaggaucaggccgcauag

SEQ ID NO: 1255726 - RNA, 21 nt, Human
accacaggagguauagaagac

SEQ ID NO: 1255727 - RNA, 22 nt, Human
accaggucucaaacccaggagc

SEQ ID NO: 1255728 - RNA, 21 nt, Human
acccagugcuguagcugggua

SEQ ID NO: 1255729 - RNA, 25 nt, Human
acccuccaggaagccugccuucucu

SEQ ID NO: 1255730 - RNA, 18 nt, Human
acugcucugagagugggc

SEQ ID NO: 1255731 - RNA, 19 nt, Human
agaaaaaaaaaccaucauc

SEQ ID NO: 1255732 - RNA, 23 nt, Human
agaaaaaaaaaccaucauccgag

SEQ ID NO: 1255733 - RNA, 20 nt, Human
agaaaucacccaccccucgc

SEQ ID NO: 1255734 - RNA, 18 nt, Human
agacaggaucaggccgca

SEQ ID NO: 1255735 - RNA, 22 nt, Human
agagaagaggagagagcaccac

SEQ ID NO: 1255736 - RNA, 22 nt, Human
agauaaugcuuugggccccuuc

SEQ ID NO: 1255737 - RNA, 22 nt, Human
agcagcacucuaugaaaaggau

SEQ ID NO: 1255738 - RNA, 20 nt, Human
agcauggcacaggugcaggu

SEQ ID NO: 1255739 - RNA, 21 nt, Human
agccacucugacauucuggcc

SEQ ID NO: 1255740 - RNA, 26 nt, Human
agcccagggccaagcacuucacggaa

SEQ ID NO: 1255741 - RNA, 25 nt, Human
agcccagggccaagcacuucacggg

SEQ ID NO: 1255742 - RNA, 25 nt, Human
aggagaaaaaaaaaccaucauccga

SEQ ID NO: 1255743 - RNA, 18 nt, Human
aggagaaaacugcucuga

SEQ ID NO: 1255744 - RNA, 20 nt, Human
aggcaagagccauaagcaug

SEQ ID NO: 1255745 - RNA, 19 nt, Human
aggcaggcagagagcuggg

SEQ ID NO: 1255746 - RNA, 22 nt, Human
aggcucccccaaacucaggacc

SEQ ID NO: 1255747 - RNA, 23 nt, Human
aggcugugaccacccagugcugu

SEQ ID NO: 1255748 - RNA, 18 nt, Human
aggugaaggccacagagc

SEQ ID NO: 1255749 - RNA, 20 nt, Human
aggugaguggccucgggggg

SEQ ID NO: 1255750 - RNA, 21 nt, Human
auccuaagguggauacugagg

SEQ ID NO: 1255751 - RNA, 26 nt, Human
augcacccccagcacagccaguggga

SEQ ID NO: 1255752 - RNA, 18 nt, Human
augguggcugcucugggu

SEQ ID NO: 1255753 - RNA, 23 nt, Human
caaacucaggacccaggagccaa

SEQ ID NO: 1255754 - RNA, 23 nt, Human
caacgggauggggcccgccucuc

SEQ ID NO: 1255755 - RNA, 19 nt, Human
caagagcuaagaaacacgc

SEQ ID NO: 1255756 - RNA, 23 nt, Human
caagagucacuacaguaagagga

SEQ ID NO: 1255757 - RNA, 23 nt, Human
cacccaguuaguggcugagccaa

SEQ ID NO: 1255758 - RNA, 20 nt, Human
cacccuccagccaccuuccc

SEQ ID NO: 1255759 - RNA, 21 nt, Human
cacguuguugcaacauggugg

SEQ ID NO: 1255760 - RNA, 21 nt, Human
cacuucacggacaccuccuca

SEQ ID NO: 1255761 - RNA, 19 nt, Human
cagaaccaggucucaaacc

SEQ ID NO: 1255762 - RNA, 23 nt, Human
cagcugccggccuuccagucacu

SEQ ID NO: 1255763 - RNA, 21 nt, Human
caggacccaggagccaauggu

SEQ ID NO: 1255764 - RNA, 21 nt, Human
cagggacacuuucagagccuc

SEQ ID NO: 1255765 - RNA, 25 nt, Human
cagggccaagcacuucacggacacc

SEQ ID NO: 1255766 - RNA, 18 nt, Human
caggucucaaacccagga

SEQ ID NO: 1255767 - RNA, 23 nt, Human
caggugcaggugcaggggugaca

SEQ ID NO: 1255768 - RNA, 22 nt, Human
ccaaaucuuccccaacaccuug

SEQ ID NO: 1255769 - RNA, 26 nt, Human
ccaaugaccaggaauucugcugaagc

SEQ ID NO: 1255770 - RNA, 24 nt, Human
ccaaugguccuucucuggccccuc

SEQ ID NO: 1255771 - RNA, 21 nt, Human
ccacccuccagccaccuuccc

SEQ ID NO: 1255772 - RNA, 21 nt, Human
ccaccuucccugucuggaaaa

SEQ ID NO: 1255773 - RNA, 18 nt, Human
ccagcaucauuuucugag

SEQ ID NO: 1255774 - RNA, 23 nt, Human
cccaacaggucaauccuuacaga

SEQ ID NO: 1255775 - RNA, 20 nt, Human
cccaaccccuguccuaaggc

SEQ ID NO: 1255776 - RNA, 23 nt, Human
cccacaaaaccagauaaugcuuu

SEQ ID NO: 1255777 - RNA, 20 nt, Human
cccagcacagccagugggac

SEQ ID NO: 1255778 - RNA, 20 nt, Human
ccccaucugagugucucucu

SEQ ID NO: 1255779 - RNA, 22 nt, Human
cccccaaacucaggacccagga

SEQ ID NO: 1255780 - RNA, 23 nt, Human
cccccaaacucaggacccaggag

SEQ ID NO: 1255781 - RNA, 21 nt, Human
cccccccucucucuccccucc

SEQ ID NO: 1255782 - RNA, 24 nt, Human
cccccucucucuccccuccugaac

SEQ ID NO: 1255783 - RNA, 20 nt, Human
ccccgcccauccuaaggugg

SEQ ID NO: 1255784 - RNA, 26 nt, Human
ccccugaccccccccccucucucucc

SEQ ID NO: 1255785 - RNA, 21 nt, Human
cccuccagccaccuucccugu

SEQ ID NO: 1255786 - RNA, 22 nt, Human
cccugcucaaaaaggggcuugg

SEQ ID NO: 1255787 - RNA, 18 nt, Human
ccgaacuucgcccugaac

SEQ ID NO: 1255788 - RNA, 24 nt, Human
ccgagauugccuccuuuggcgugg

SEQ ID NO: 1255789 - RNA, 19 nt, Human
ccuccucaagucccucaag

SEQ ID NO: 1255790 - RNA, 24 nt, Human
ccugaccccccccccucucucucc

SEQ ID NO: 1255791 - RNA, 19 nt, Human
ccugcuaaaaccucacuuc

SEQ ID NO: 1255792 - RNA, 21 nt, Human
ccugcuaaaaccucacuuccc

SEQ ID NO: 1255793 - RNA, 22 nt, Human
ccugcuaaaaccucacuuccca

SEQ ID NO: 1255794 - RNA, 20 nt, Human
ccuuaccuggguacccagau

SEQ ID NO: 1255795 - RNA, 23 nt, Human
ccuuauagacuggaaacagcugc

SEQ ID NO: 1255796 - RNA, 20 nt, Human
ccuuggggcaaacacacgca

SEQ ID NO: 1255797 - RNA, 22 nt, Human
cguucaauguugccaacgucac

SEQ ID NO: 1255798 - RNA, 19 nt, Human
cuaaagccgcugugaaccc

SEQ ID NO: 1255799 - RNA, 20 nt, Human
cuacaguaagaggaacugcu

SEQ ID NO: 1255800 - RNA, 19 nt, Human
cucacggccacaugacauc

SEQ ID NO: 1255801 - RNA, 19 nt, Human
cucacggccacaugacauc

SEQ ID NO: 1255802 - RNA, 22 nt, Human
cuccucaagucccucaagcagc

SEQ ID NO: 1255803 - RNA, 22 nt, Human
cucguccugacauccaggggca

SEQ ID NO: 1255804 - RNA, 18 nt, Human
cucugagagugggcaugc

SEQ ID NO: 1255805 - RNA, 21 nt, Human
cucuugcccagagguccuguu

SEQ ID NO: 1255806 - RNA, 22 nt, Human
cugaacucagaauaccuccacu

SEQ ID NO: 1255807 - RNA, 19 nt, Human
cugagaggagcuaggagga

SEQ ID NO: 1255808 - RNA, 23 nt, Human
cugcauuccaaggcugaacuugg

SEQ ID NO: 1255809 - RNA, 18 nt, Human
cuggagcacaugugcccc

SEQ ID NO: 1255810 - RNA, 23 nt, Human
cugguuuccauaguugggcugug

SEQ ID NO: 1255811 - RNA, 25 nt, Human
cuguggugggagagaaaggagaggg

SEQ ID NO: 1255812 - RNA, 25 nt, Human
cuuccccaaaucuuccccaacaccu

SEQ ID NO: 1255813 - RNA, 21 nt, Human
cuuggcugagcuggcugugca

SEQ ID NO: 1255814 - RNA, 20 nt, Human
gaacacagucaacaggaugc

SEQ ID NO: 1255815 - RNA, 18 nt, Human
gagaaaaaaaaaccauca

SEQ ID NO: 1255816 - RNA, 23 nt, Human
gagagcaccacccuccagccacc

SEQ ID NO: 1255817 - RNA, 25 nt, Human
gagcaaccagggcuucacgaggggc

SEQ ID NO: 1255818 - RNA, 18 nt, Human
gagcaccacccuccagcc

SEQ ID NO: 1255819 - RNA, 20 nt, Human
gaggagaaaacugcucugag

SEQ ID NO: 1255820 - RNA, 21 nt, Human
gaucauaggccaccuccccuu

SEQ ID NO: 1255821 - RNA, 19 nt, Human
gccaccgaacuucgcccug

SEQ ID NO: 1255822 - RNA, 20 nt, Human
gccaccgaacuucgcccuga

SEQ ID NO: 1255823 - RNA, 25 nt, Human
gccaccuucccugucuggaaaauca

SEQ ID NO: 1255824 - RNA, 19 nt, Human
gccuaccugcccaccaagc

SEQ ID NO: 1255825 - RNA, 22 nt, Human
gccuggcuggguggggaacugg

SEQ ID NO: 1255826 - RNA, 26 nt, Human
gcuguggugggagagaaaggagaggg

SEQ ID NO: 1255827 - RNA, 20 nt, Human
gcuguuucccacccacaaaa

SEQ ID NO: 1255828 - RNA, 19 nt, Human
ggaaacagcugccggccuu

SEQ ID NO: 1255829 - RNA, 20 nt, Human
ggagaaaaaaaaaccaucau

SEQ ID NO: 1255830 - RNA, 18 nt, Human
ggagggaggcaggcagag

SEQ ID NO: 1255831 - RNA, 18 nt, Human
ggcaugcaagcugggagg

SEQ ID NO: 1255832 - RNA, 25 nt, Human
ggccaagcacuucacggacaccucc

SEQ ID NO: 1255833 - RNA, 24 nt, Human
ggccucgggggguugggggcuggg

SEQ ID NO: 1255834 - RNA, 18 nt, Human
ggcugcucugggugacag

SEQ ID NO: 1255835 - RNA, 18 nt, Human
gggaagcucucauguggg

SEQ ID NO: 1255836 - RNA, 22 nt, Human
gggacagacaauuuagagaaga

SEQ ID NO: 1255837 - RNA, 19 nt, Human
gggcacacccugcucaaaa

SEQ ID NO: 1255838 - RNA, 19 nt, Human
gggcaggagguguggguuu

SEQ ID NO: 1255839 - RNA, 19 nt, Human
ggugacuggcucgaggucu

SEQ ID NO: 1255840 - RNA, 19 nt, Human
gguggcugugccccagugc

SEQ ID NO: 1255841 - RNA, 21 nt, Human
ggugggagagaaaggagaggg

SEQ ID NO: 1255842 - RNA, 19 nt, Human
gguugggggcuggguacug

SEQ ID NO: 1255843 - RNA, 19 nt, Human
guggaagaaucuacaacuc

SEQ ID NO: 1255844 - RNA, 18 nt, Human
gugggugguggcgaggcu

SEQ ID NO: 1255845 - RNA, 21 nt, Human
uaaaaacuuuucuuuccugcu

SEQ ID NO: 1255846 - RNA, 23 nt, Human
uaaacuaaauccuuaccugggua

SEQ ID NO: 1255847 - RNA, 21 nt, Human
uacagugaccaaguguggaug

SEQ ID NO: 1255848 - RNA, 24 nt, Human
uacagugaccaaguguggauggaa

SEQ ID NO: 1255849 - RNA, 18 nt, Human
uaccccaaugugacagag

SEQ ID NO: 1255850 - RNA, 25 nt, Human
uagccaggucaccugaacaacggga

SEQ ID NO: 1255851 - RNA, 24 nt, Human
uaggagggaaggggccccgugggu

SEQ ID NO: 1255852 - RNA, 18 nt, Human
uaggcugugaccacccag

SEQ ID NO: 1255853 - RNA, 19 nt, Human
ucaagcagcccuaggaggc

SEQ ID NO: 1255854 - RNA, 18 nt, Human
ucaaggaacuuaaggucu

SEQ ID NO: 1255855 - RNA, 18 nt, Human
ucacauagccaggucacc

SEQ ID NO: 1255856 - RNA, 18 nt, Human
uccauaguugggcugugg

SEQ ID NO: 1255857 - RNA, 22 nt, Human
ucccccaaacucaggacccagg

SEQ ID NO: 1255858 - RNA, 24 nt, Human
uccuggugccuggguuagggcugu

SEQ ID NO: 1255859 - RNA, 19 nt, Human
uccuguugguggcugugcc

SEQ ID NO: 1255860 - RNA, 20 nt, Human
uccuuacagacuggaaacac

SEQ ID NO: 1255861 - RNA, 22 nt, Human
ucguacuccccucagagcagaa

SEQ ID NO: 1255862 - RNA, 19 nt, Human
ucucaaacccaggagcacc

SEQ ID NO: 1255863 - RNA, 22 nt, Human
ugacaccaaugaccaggaauuc

SEQ ID NO: 1255864 - RNA, 19 nt, Human
ugacagaggaacacaguca

SEQ ID NO: 1255865 - RNA, 23 nt, Human
ugaccaaguguggauggaaacaa

SEQ ID NO: 1255866 - RNA, 21 nt, Human
ugacccaaccccuguccuaag

SEQ ID NO: 1255867 - RNA, 27 nt, Human
ugaccccccccccucucucuccccucc

SEQ ID NO: 1255868 - RNA, 18 nt, Human
ugacucauauugaguucu

SEQ ID NO: 1255869 - RNA, 23 nt, Human
ugagagugggcaugcaagcuggg

SEQ ID NO: 1255870 - RNA, 23 nt, Human
ugccaagccuccccgcccauccu

SEQ ID NO: 1255871 - RNA, 25 nt, Human
ugccaggagaggugccaauagcuug

SEQ ID NO: 1255872 - RNA, 24 nt, Human
ugcccaccaagcuagagaagagag

SEQ ID NO: 1255873 - RNA, 22 nt, Human
ugccccugaacuccagggacac

SEQ ID NO: 1255874 - RNA, 20 nt, Human
ugccuaccugcccaccaagc

SEQ ID NO: 1255875 - RNA, 19 nt, Human
ugccuccuuuggcgugggc

SEQ ID NO: 1255876 - RNA, 18 nt, Human
ugcuguagcuggguagca

SEQ ID NO: 1255877 - RNA, 18 nt, Human
ugcuuugggccccuucuc

SEQ ID NO: 1255878 - RNA, 20 nt, Human
ugcuuugggccccuucucgu

SEQ ID NO: 1255879 - RNA, 23 nt, Human
uggaaacaagagcuaagaaacac

SEQ ID NO: 1255880 - RNA, 20 nt, Human
uggauggaaacaagagcuaa

SEQ ID NO: 1255881 - RNA, 19 nt, Human
uggcaaggggaaggaaggc

SEQ ID NO: 1255882 - RNA, 21 nt, Human
uggccuggcuggguggggaac

SEQ ID NO: 1255883 - RNA, 23 nt, Human
uggccuggcuggguggggaacuu

SEQ ID NO: 1255884 - RNA, 23 nt, Human
uggcugagaaaaggccuagaaac

SEQ ID NO: 1255885 - RNA, 21 nt, Human
uggcugcucugggugacagug

SEQ ID NO: 1255886 - RNA, 19 nt, Human
uggcuggguggggaacugg

SEQ ID NO: 1255887 - RNA, 21 nt, Human
ugggaccagaugacccaaccc

SEQ ID NO: 1255888 - RNA, 22 nt, Human
ugggaccagaugacccaacccc

SEQ ID NO: 1255889 - RNA, 19 nt, Human
ugggcaggaggaacuaaac

SEQ ID NO: 1255890 - RNA, 25 nt, Human
uggggccugagugccaggagaggug

SEQ ID NO: 1255891 - RNA, 18 nt, Human
uggguacuggccuggcug

SEQ ID NO: 1255892 - RNA, 21 nt, Human
ugguccuucucuggccccucc

SEQ ID NO: 1255893 - RNA, 24 nt, Human
uggugaaggaacaagacaacuucu

SEQ ID NO: 1255894 - RNA, 23 nt, Human
uguccuggguaguugggggaggu

SEQ ID NO: 1255895 - RNA, 24 nt, Human
uguccuggguaguugggggaggug

SEQ ID NO: 1255896 - RNA, 21 nt, Human
ugugacagaggaacacaguca

SEQ ID NO: 1255897 - RNA, 23 nt, Human
ugugcuccccaauguguacccca

SEQ ID NO: 1255898 - RNA, 18 nt, Human
uguggugggagagaaagg

SEQ ID NO: 1255899 - RNA, 19 nt, Human
ugugucucuccuggugccu

SEQ ID NO: 1255900 - RNA, 23 nt, Human
uguugccaagccuccccgcccau

SEQ ID NO: 1255901 - RNA, 19 nt, Human
uucucuggccccucccuga

SEQ ID NO: 1255902 - RNA, 22 nt, Human
uucugggccaucgacaaccugc

SEQ ID NO: 1255903 - RNA, 21 nt, Human
uuucccacccacaaaaccaga

SEQ ID NO: 1255904 - RNA, 23 nt, Human
aaaaacccaauaacgggaaacag

SEQ ID NO: 1255905 - RNA, 21 nt, Human
aaaacaaacaaaaaccaacca

SEQ ID NO: 1255906 - RNA, 28 nt, Human
aaaacaaacaaaaaccaaccaaaaaccc

SEQ ID NO: 1255907 - RNA, 22 nt, Human
aaaaugccucucuuuuuguuug

SEQ ID NO: 1255908 - RNA, 22 nt, Human
aaacaaaaaccaaccaaaaacc

SEQ ID NO: 1255909 - RNA, 24 nt, Human
aaacccaauaacgggaaacagaaa

SEQ ID NO: 1255910 - RNA, 21 nt, Human
aaacuccccaaauaaagcucc

SEQ ID NO: 1255911 - RNA, 19 nt, Human
aaagcauaguaaaaaacaa

SEQ ID NO: 1255912 - RNA, 18 nt, Human
aaagcgggaaccccagcc

SEQ ID NO: 1255913 - RNA, 20 nt, Human
aaauacaggacaagaacaua

SEQ ID NO: 1255914 - RNA, 26 nt, Human
aacaaacaaaaaccaaccaaaaaccc

SEQ ID NO: 1255915 - RNA, 23 nt, Human
aaccagaagguuggcaaaauacu

SEQ ID NO: 1255916 - RNA, 23 nt, Human
aacccaauaacgggaaacagaaa

SEQ ID NO: 1255917 - RNA, 21 nt, Human
aaccccagcucaccucaacac

SEQ ID NO: 1255918 - RNA, 18 nt, Human
aagaagaagaaggugcaa

SEQ ID NO: 1255919 - RNA, 21 nt, Human
aagaagaagaaggugcaagag

SEQ ID NO: 1255920 - RNA, 22 nt, Human
aagaagaagaaggugcaagaga

SEQ ID NO: 1255921 - RNA, 21 nt, Human
aagcagggcuggggcugcagg

SEQ ID NO: 1255922 - RNA, 23 nt, Human
aagcccgcugccacagcccccag

SEQ ID NO: 1255923 - RNA, 18 nt, Human
aagguucugggugggggc

SEQ ID NO: 1255924 - RNA, 18 nt, Human
aauggcaccuggccugca

SEQ ID NO: 1255925 - RNA, 23 nt, Human
acacugggcccagcuaucuugau

SEQ ID NO: 1255926 - RNA, 22 nt, Human
acacuguuugucaacacacaca

SEQ ID NO: 1255927 - RNA, 26 nt, Human
acagaccaaagcauaguaaaaaacaa

SEQ ID NO: 1255928 - RNA, 24 nt, Human
acaggacaagaacauauuaauaag

SEQ ID NO: 1255929 - RNA, 21 nt, Human
accccagcucaccucaacacc

SEQ ID NO: 1255930 - RNA, 19 nt, Human
accccaugcacagggcgac

SEQ ID NO: 1255931 - RNA, 21 nt, Human
acgccgcccaccacugcgaac

SEQ ID NO: 1255932 - RNA, 23 nt, Human
acgcugggcuuccacacugggcc

SEQ ID NO: 1255933 - RNA, 24 nt, Human
acggcaagguuggcaacagagaag

SEQ ID NO: 1255934 - RNA, 19 nt, Human
agaacaacagagcugaagg

SEQ ID NO: 1255935 - RNA, 19 nt, Human
agacaauauuuccuucuga

SEQ ID NO: 1255936 - RNA, 20 nt, Human
agacaauauuuccuucugaa

SEQ ID NO: 1255937 - RNA, 20 nt, Human
agaggcuauauuucuauagg

SEQ ID NO: 1255938 - RNA, 19 nt, Human
agaggggaaggaaagggag

SEQ ID NO: 1255939 - RNA, 19 nt, Human
agagugggugggaggcaga

SEQ ID NO: 1255940 - RNA, 24 nt, Human
agauucuccaggaauaaggcacac

SEQ ID NO: 1255941 - RNA, 20 nt, Human
agccaggacagugggcuccc

SEQ ID NO: 1255942 - RNA, 19 nt, Human
agcuggcaggccccaggca

SEQ ID NO: 1255943 - RNA, 23 nt, Human
agcuggcaggccccaggcauccu

SEQ ID NO: 1255944 - RNA, 24 nt, Human
aggcccgccugcaaaaagccccag

SEQ ID NO: 1255945 - RNA, 19 nt, Human
agggcuggggcugcagggg

SEQ ID NO: 1255946 - RNA, 23 nt, Human
aggucccccauggccgggucccu

SEQ ID NO: 1255947 - RNA, 23 nt, Human
aguaaaaaacaaacaaaaaccaa

SEQ ID NO: 1255948 - RNA, 21 nt, Human
aguggcuaccugcugaacagc

SEQ ID NO: 1255949 - RNA, 24 nt, Human
aguggcuuuccauacagggcaaac

SEQ ID NO: 1255950 - RNA, 23 nt, Human
auaagaagaagaaggugcaagag

SEQ ID NO: 1255951 - RNA, 22 nt, Human
caaaaaccaaccaaaaacccaa

SEQ ID NO: 1255952 - RNA, 23 nt, Human
caaaaaccaaccaaaaacccaau

SEQ ID NO: 1255953 - RNA, 18 nt, Human
caaaauacuuccagaaau

SEQ ID NO: 1255954 - RNA, 19 nt, Human
caaacaaaaaccaaccaaa

SEQ ID NO: 1255955 - RNA, 21 nt, Human
caaacaaaaaccaaccaaaaa

SEQ ID NO: 1255956 - RNA, 25 nt, Human
caaacaaaaaccaaccaaaaaccca

SEQ ID NO: 1255957 - RNA, 20 nt, Human
caaagcauaguaaaaaacaa

SEQ ID NO: 1255958 - RNA, 19 nt, Human
caaccaaaaacccaauaac

SEQ ID NO: 1255959 - RNA, 18 nt, Human
caaccccagcucaccuca

SEQ ID NO: 1255960 - RNA, 24 nt, Human
caacuagaucgcuagaucuaccaa

SEQ ID NO: 1255961 - RNA, 22 nt, Human
caacugcaagcgauugucccuu

SEQ ID NO: 1255962 - RNA, 21 nt, Human
caagacaaggacgcuaagagc

SEQ ID NO: 1255963 - RNA, 23 nt, Human
caagagaguuccccaguucagcc

SEQ ID NO: 1255964 - RNA, 25 nt, Human
cacacacaagacaaggacgcuaaga

SEQ ID NO: 1255965 - RNA, 21 nt, Human
caccaggacgcaucucuccag

SEQ ID NO: 1255966 - RNA, 18 nt, Human
caccucaacaccuuggag

SEQ ID NO: 1255967 - RNA, 25 nt, Human
caccucaacaccuuggagaagacgg

SEQ ID NO: 1255968 - RNA, 23 nt, Human
cacgaugcgggguaccuggcacc

SEQ ID NO: 1255969 - RNA, 24 nt, Human
cacuggcaaggucacuuuggggug

SEQ ID NO: 1255970 - RNA, 18 nt, Human
cacugggcccagcuaucu

SEQ ID NO: 1255971 - RNA, 24 nt, Human
cagaaaaacaacaauauggcuuaa

SEQ ID NO: 1255972 - RNA, 20 nt, Human
cagaagccugggccggggcc

SEQ ID NO: 1255973 - RNA, 26 nt, Human
cagaagccugggccggggccaacccc

SEQ ID NO: 1255974 - RNA, 21 nt, Human
cagccaggacagugggcuccc

SEQ ID NO: 1255975 - RNA, 21 nt, Human
cagcccccaggggaccgcuug

SEQ ID NO: 1255976 - RNA, 21 nt, Human
cagcggaggggcgggcaccgg

SEQ ID NO: 1255977 - RNA, 21 nt, Human
cagcuggcaggccccaggcau

SEQ ID NO: 1255978 - RNA, 24 nt, Human
caggacaagaacauauuaauaagu

SEQ ID NO: 1255979 - RNA, 26 nt, Human
caggggcuuugcugaccacaagagag

SEQ ID NO: 1255980 - RNA, 23 nt, Human
cagugaugucagagggggucugg

SEQ ID NO: 1255981 - RNA, 22 nt, Human
cauccccugggcuccuggcccu

SEQ ID NO: 1255982 - RNA, 23 nt, Human
cauucugggugaaacuccccaaa

SEQ ID NO: 1255983 - RNA, 21 nt, Human
cauuucaggguuagucguugg

SEQ ID NO: 1255984 - RNA, 22 nt, Human
cauuucuuggucugauuuuuuu

SEQ ID NO: 1255985 - RNA, 23 nt, Human
ccaaccccagcucaccucaacac

SEQ ID NO: 1255986 - RNA, 21 nt, Human
ccacugcccgccucccgagcc

SEQ ID NO: 1255987 - RNA, 20 nt, Human
cccaagguggcuggcucugc

SEQ ID NO: 1255988 - RNA, 23 nt, Human
ccccagcccccaagguggcuggc

SEQ ID NO: 1255989 - RNA, 26 nt, Human
ccccaggcccgccugcaaaaagcccc

SEQ ID NO: 1255990 - RNA, 19 nt, Human
ccccaugccuaaccccucc

SEQ ID NO: 1255991 - RNA, 22 nt, Human
cccccagagugggugggaggca

SEQ ID NO: 1255992 - RNA, 21 nt, Human
cccccaggggaccgcuuggcc

SEQ ID NO: 1255993 - RNA, 22 nt, Human
ccccgcaggccugcgagggcac

SEQ ID NO: 1255994 - RNA, 18 nt, Human
ccccgcgcgcugcccgca

SEQ ID NO: 1255995 - RNA, 22 nt, Human
ccccgcgcgcugcccgcagccg

SEQ ID NO: 1255996 - RNA, 19 nt, Human
cccgccucccgagccccga

SEQ ID NO: 1255997 - RNA, 21 nt, Human
cccgccucccgagccccgacg

SEQ ID NO: 1255998 - RNA, 23 nt, Human
cccgcugccacagcccccagggg

SEQ ID NO: 1255999 - RNA, 23 nt, Human
cccgcugccacagcccccagggg

SEQ ID NO: 1256000 - RNA, 21 nt, Human
cccucaaauccacccugcagc

SEQ ID NO: 1256001 - RNA, 19 nt, Human
cccuccccggccgcccgcu

SEQ ID NO: 1256002 - RNA, 22 nt, Human
cccugcagcucccuggcugcaa

SEQ ID NO: 1256003 - RNA, 22 nt, Human
cccugcgccccgcgcgcugccc

SEQ ID NO: 1256004 - RNA, 18 nt, Human
cccuggccacggacgugc

SEQ ID NO: 1256005 - RNA, 22 nt, Human
ccgccagccaggacagugggcu

SEQ ID NO: 1256006 - RNA, 18 nt, Human
ccgcucgcggccccccuc

SEQ ID NO: 1256007 - RNA, 22 nt, Human
ccgcucgcggccccccuccgca

SEQ ID NO: 1256008 - RNA, 18 nt, Human
ccgcugccgcugccgccg

SEQ ID NO: 1256009 - RNA, 18 nt, Human
ccggccagccugaauccc

SEQ ID NO: 1256010 - RNA, 23 nt, Human
ccucaaagcgggaaccccagccc

SEQ ID NO: 1256011 - RNA, 18 nt, Human
ccucccccaugccuaacc

SEQ ID NO: 1256012 - RNA, 21 nt, Human
ccuccgcagcggaggggcggg

SEQ ID NO: 1256013 - RNA, 18 nt, Human
ccugaaucccagaacaac

SEQ ID NO: 1256014 - RNA, 21 nt, Human
ccugcgccccgcgcgcugccc

SEQ ID NO: 1256015 - RNA, 19 nt, Human
ccugcuuucccuggccugu

SEQ ID NO: 1256016 - RNA, 26 nt, Human
ccuggcaccugggagguuucucccac

SEQ ID NO: 1256017 - RNA, 18 nt, Human
ccuggccuguggggggca

SEQ ID NO: 1256018 - RNA, 20 nt, Human
ccuguggccaauacaaggcc

SEQ ID NO: 1256019 - RNA, 22 nt, Human
ccuguggggacacccagggcuc

SEQ ID NO: 1256020 - RNA, 27 nt, Human
ccuugcccacucccugucccucuacaa

SEQ ID NO: 1256021 - RNA, 18 nt, Human
cgccucccgagccccgac

SEQ ID NO: 1256022 - RNA, 22 nt, Human
cgcggccccccuccgcagcgga

SEQ ID NO: 1256023 - RNA, 19 nt, Human
cgcugccgccgccuccccc

SEQ ID NO: 1256024 - RNA, 23 nt, Human
cggcagcagggcaaagacuugag

SEQ ID NO: 1256025 - RNA, 21 nt, Human
cggccccccuccgcagcggag

SEQ ID NO: 1256026 - RNA, 21 nt, Human
cggccccccuccgcagcggag

SEQ ID NO: 1256027 - RNA, 24 nt, Human
cgggagaaaggaagggucaagacc

SEQ ID NO: 1256028 - RNA, 20 nt, Human
cgguugacauuuccaaguuc

SEQ ID NO: 1256029 - RNA, 21 nt, Human
cgucggcagcagggcaaagga

SEQ ID NO: 1256030 - RNA, 24 nt, Human
cgugcagggaagcccuggccucca

SEQ ID NO: 1256031 - RNA, 23 nt, Human
cuacaaaauuaauaaaaccguaa

SEQ ID NO: 1256032 - RNA, 19 nt, Human
cucccccaugccuaacccc

SEQ ID NO: 1256033 - RNA, 23 nt, Human
cugagaccccaggcccgccugca

SEQ ID NO: 1256034 - RNA, 22 nt, Human
cugcaaaaagccccagacuccc

SEQ ID NO: 1256035 - RNA, 20 nt, Human
cuggacaccagaugggcauc

SEQ ID NO: 1256036 - RNA, 19 nt, Human
cuggcaccugggagguuuc

SEQ ID NO: 1256037 - RNA, 21 nt, Human
cuggccugcauggcaggggcu

SEQ ID NO: 1256038 - RNA, 23 nt, Human
cugggcccacggguucuguuuug

SEQ ID NO: 1256039 - RNA, 18 nt, Human
cuguggcuugucucaggg

SEQ ID NO: 1256040 - RNA, 21 nt, Human
cuugcccuccugaaaguucug

SEQ ID NO: 1256041 - RNA, 19 nt, Human
gaacacauguccccuugcc

SEQ ID NO: 1256042 - RNA, 23 nt, Human
gaacagacacgcugggcuuccac

SEQ ID NO: 1256043 - RNA, 19 nt, Human
gaaggaaagggaguggggc

SEQ ID NO: 1256044 - RNA, 21 nt, Human
gacaugggcuuuugcuugccu

SEQ ID NO: 1256045 - RNA, 25 nt, Human
gaccaaagcauaguaaaaaacaaac

SEQ ID NO: 1256046 - RNA, 27 nt, Human
gaccaaagcauaguaaaaaacaaacaa

SEQ ID NO: 1256047 - RNA, 21 nt, Human
gagaaggagggggcuccucca

SEQ ID NO: 1256048 - RNA, 22 nt, Human
gagagcccucccaccaagccaa

SEQ ID NO: 1256049 - RNA, 22 nt, Human
gaggugagaaggagggggcucc

SEQ ID NO: 1256050 - RNA, 24 nt, Human
gagucaaggggaguauggaaggug

SEQ ID NO: 1256051 - RNA, 21 nt, Human
gaguggggcugacaaaaccua

SEQ ID NO: 1256052 - RNA, 21 nt, Human
gcacgaucccgccgccagcca

SEQ ID NO: 1256053 - RNA, 21 nt, Human
gcccaccacugcgaacauucu

SEQ ID NO: 1256054 - RNA, 21 nt, Human
gcccacucccugucccucuac

SEQ ID NO: 1256055 - RNA, 21 nt, Human
gccgccagccaggacaguggg

SEQ ID NO: 1256056 - RNA, 19 nt, Human
gccgcugccgcugccgccg

SEQ ID NO: 1256057 - RNA, 21 nt, Human
gccgcugccgcugccgccgcc

SEQ ID NO: 1256058 - RNA, 22 nt, Human
gccgcugccgcugccgccgccu

SEQ ID NO: 1256059 - RNA, 20 nt, Human
gccugcauggcaggggcuuu

SEQ ID NO: 1256060 - RNA, 18 nt, Human
gcugcaggggccagcagg

SEQ ID NO: 1256061 - RNA, 20 nt, Human
gcuugccuuuguccccucca

SEQ ID NO: 1256062 - RNA, 20 nt, Human
ggaagcccuggccuccagug

SEQ ID NO: 1256063 - RNA, 19 nt, Human
ggacacagcaccggccagc

SEQ ID NO: 1256064 - RNA, 18 nt, Human
ggaggggcugccccacgu

SEQ ID NO: 1256065 - RNA, 20 nt, Human
ggccccccuccgcagcggag

SEQ ID NO: 1256066 - RNA, 21 nt, Human
ggccuggaggaggcguggcuc

SEQ ID NO: 1256067 - RNA, 22 nt, Human
ggcgggggguggcucugggugc

SEQ ID NO: 1256068 - RNA, 18 nt, Human
ggcuuugccccacuucuu

SEQ ID NO: 1256069 - RNA, 18 nt, Human
gggcaagggacagagagg

SEQ ID NO: 1256070 - RNA, 24 nt, Human
gggcucccuggccacggacgugcc

SEQ ID NO: 1256071 - RNA, 18 nt, Human
ggguucuguggcuugucu

SEQ ID NO: 1256072 - RNA, 19 nt, Human
gguggcuggcucugcacag

SEQ ID NO: 1256073 - RNA, 18 nt, Human
guggccaauacaaggcug

SEQ ID NO: 1256074 - RNA, 21 nt, Human
uaaaaaacaaacaaaaaccaa

SEQ ID NO: 1256075 - RNA, 22 nt, Human
uaaaaaacaaacaaaaaccaac

SEQ ID NO: 1256076 - RNA, 24 nt, Human
uaaaaaacaaacaaaaaccaacca

SEQ ID NO: 1256077 - RNA, 27 nt, Human
uaaaaaacaaacaaaaaccaaccaaaa

SEQ ID NO: 1256078 - RNA, 23 nt, Human
uaaaaaaggcaauacuuuccaaa

SEQ ID NO: 1256079 - RNA, 21 nt, Human
uaaaaaaggcaauacuuuccc

SEQ ID NO: 1256080 - RNA, 19 nt, Human
uaacaagauaagaagaaga

SEQ ID NO: 1256081 - RNA, 23 nt, Human
uaacgggaaacagaaaaguucuc

SEQ ID NO: 1256082 - RNA, 23 nt, Human
uaagcccgcugccacagccccca

SEQ ID NO: 1256083 - RNA, 18 nt, Human
uaauguaggggcaaaauc

SEQ ID NO: 1256084 - RNA, 24 nt, Human
uacaaaauuaauaaaaccguaaua

SEQ ID NO: 1256085 - RNA, 23 nt, Human
uagaucgcuagaucuaccaacug

SEQ ID NO: 1256086 - RNA, 24 nt, Human
uagcacagggaagcagcgucuccu

SEQ ID NO: 1256087 - RNA, 24 nt, Human
uauaaauacaggacaagaacauau

SEQ ID NO: 1256088 - RNA, 19 nt, Human
ucaaggggaguauggaagg

SEQ ID NO: 1256089 - RNA, 20 nt, Human
ucagcaucccucagcuugac

SEQ ID NO: 1256090 - RNA, 23 nt, Human
ucaguggcagcuucuccuuggga

SEQ ID NO: 1256091 - RNA, 21 nt, Human
uccacacugggcccagcuauc

SEQ ID NO: 1256092 - RNA, 20 nt, Human
uccacccugcagcucccugg

SEQ ID NO: 1256093 - RNA, 20 nt, Human
uccacugagaccccaggccc

SEQ ID NO: 1256094 - RNA, 22 nt, Human
uccccagugguggcaagggugu

SEQ ID NO: 1256095 - RNA, 25 nt, Human
ucccgagccccgacggugaucgccc

SEQ ID NO: 1256096 - RNA, 22 nt, Human
ucccuggaaggguuggcacagg

SEQ ID NO: 1256097 - RNA, 22 nt, Human
uccucgggcuggcggggggugg

SEQ ID NO: 1256098 - RNA, 21 nt, Human
uccuugggccaagguccccca

SEQ ID NO: 1256099 - RNA, 21 nt, Human
ucucagaggcgagccuguggg

SEQ ID NO: 1256100 - RNA, 20 nt, Human
ucuggugggggucgugggag

SEQ ID NO: 1256101 - RNA, 23 nt, Human
ucuuuuuagcuggacucacacgu

SEQ ID NO: 1256102 - RNA, 20 nt, Human
ugaacguacuaaaaccacag

SEQ ID NO: 1256103 - RNA, 20 nt, Human
ugaugucagagggggucugg

SEQ ID NO: 1256104 - RNA, 20 nt, Human
ugcaaaaagccccagacucc

SEQ ID NO: 1256105 - RNA, 21 nt, Human
ugcuguuuguuauccucagug

SEQ ID NO: 1256106 - RNA, 22 nt, Human
uggaagaggcacaaagggguca

SEQ ID NO: 1256107 - RNA, 20 nt, Human
uggacagacacagacacgga

SEQ ID NO: 1256108 - RNA, 20 nt, Human
uggacaugggcuuuugcuug

SEQ ID NO: 1256109 - RNA, 25 nt, Human
uggcaaagcucccgagcggcgaggc

SEQ ID NO: 1256110 - RNA, 22 nt, Human
uggcaggccccaggcauccuug

SEQ ID NO: 1256111 - RNA, 20 nt, Human
uggccccucaaauccacccu

SEQ ID NO: 1256112 - RNA, 22 nt, Human
uggccugcauggcaggggcuuu

SEQ ID NO: 1256113 - RNA, 19 nt, Human
uggcuggucuggggagguu

SEQ ID NO: 1256114 - RNA, 18 nt, Human
ugggaggcagaggggaag

SEQ ID NO: 1256115 - RNA, 20 nt, Human
ugggccccccaccuuugcag

SEQ ID NO: 1256116 - RNA, 24 nt, Human
ugggccggggccaaccccagcuca

SEQ ID NO: 1256117 - RNA, 22 nt, Human
ugggggcaggcggccuggcugg

SEQ ID NO: 1256118 - RNA, 22 nt, Human
ugggggcggaggaggucggacg

SEQ ID NO: 1256119 - RNA, 21 nt, Human
ugggguaaacaccauuaucuc

SEQ ID NO: 1256120 - RNA, 18 nt, Human
uggguccauagcgugggg

SEQ ID NO: 1256121 - RNA, 24 nt, Human
uguagacaauauuuccuucugaau

SEQ ID NO: 1256122 - RNA, 19 nt, Human
uuauugucuccauuuuaga

SEQ ID NO: 1256123 - RNA, 22 nt, Human
uucaccaggacgcaucucucca

SEQ ID NO: 1256124 - RNA, 21 nt, Human
uuccaaguucaaggagcaugg

SEQ ID NO: 1256125 - RNA, 18 nt, Human
uuccacacugggcccagc

SEQ ID NO: 1256126 - RNA, 21 nt, Human
uucccauccccugggcuccug

SEQ ID NO: 1256127 - RNA, 22 nt, Human
uucccauccccugggcuccugg

SEQ ID NO: 1256128 - RNA, 28 nt, Human
uucccuggccuguggggggggagagauc

SEQ ID NO: 1256129 - RNA, 28 nt, Human
uugaauacuucauaugggguaaacaccc

SEQ ID NO: 1256130 - RNA, 21 nt, Human
uugagccaugguaaacacuga

SEQ ID NO: 1256131 - RNA, 24 nt, Human
uugcaaagauuuuuuuuccucauc

SEQ ID NO: 1256132 - RNA, 19 nt, Human
uugcagcacagcuggcagg

SEQ ID NO: 1256133 - RNA, 27 nt, Human
uuuguggcggcggugccggccccuccc

SEQ ID NO: 1256134 - RNA, 18 nt, Human
uuuuuuuuuuucccacag

SEQ ID NO: 1256135 - RNA, 21 nt, Human
aaaaauaaaaugucaaugcug

SEQ ID NO: 1256136 - RNA, 26 nt, Human
aagugauccucucaccucagcuucca

SEQ ID NO: 1256137 - RNA, 22 nt, Human
aauaaucaaguacuaaaauacc

SEQ ID NO: 1256138 - RNA, 23 nt, Human
acaaaaauaaaaugucaaugcug

SEQ ID NO: 1256139 - RNA, 21 nt, Human
acagaacaccggacgggacca

SEQ ID NO: 1256140 - RNA, 21 nt, Human
accagggucgcgucaggagcc

SEQ ID NO: 1256141 - RNA, 19 nt, Human
agggcucaagugauccucu

SEQ ID NO: 1256142 - RNA, 20 nt, Human
caccucagcuuccagaguag

SEQ ID NO: 1256143 - RNA, 24 nt, Human
caccucagcuuccagaguagcugg

SEQ ID NO: 1256144 - RNA, 21 nt, Human
cauucauuuauuaaguggggu

SEQ ID NO: 1256145 - RNA, 20 nt, Human
ccagggcucaagugauccuc

SEQ ID NO: 1256146 - RNA, 20 nt, Human
ccagggucgcgucaggagcc

SEQ ID NO: 1256147 - RNA, 23 nt, Human
ccauagccggaacaggcggugac

SEQ ID NO: 1256148 - RNA, 26 nt, Human
ccauucaaguaauguuccccccacaa

SEQ ID NO: 1256149 - RNA, 24 nt, Human
cucaagugauccucucaccucagc

SEQ ID NO: 1256150 - RNA, 24 nt, Human
cucagcuuccagaguagcugggac

SEQ ID NO: 1256151 - RNA, 20 nt, Human
gaguagcugggaccacaugc

SEQ ID NO: 1256152 - RNA, 19 nt, Human
gauaacaaaaauaaaaugu

SEQ ID NO: 1256153 - RNA, 18 nt, Human
gcucaagugauccucuca

SEQ ID NO: 1256154 - RNA, 20 nt, Human
ggaacaggcggugacaggag

SEQ ID NO: 1256155 - RNA, 19 nt, Human
gggguuucaugauguugca

SEQ ID NO: 1256156 - RNA, 21 nt, Human
gugggguuucaugauguugca

SEQ ID NO: 1256157 - RNA, 24 nt, Human
gugggguuucaugauguugcauag

SEQ ID NO: 1256158 - RNA, 18 nt, Human
uaaaaaaugaaggaaaga

SEQ ID NO: 1256159 - RNA, 23 nt, Human
uaaaauaccaguggcucuuguga

SEQ ID NO: 1256160 - RNA, 24 nt, Human
uaaacacugucagucuuuuaaaaa

SEQ ID NO: 1256161 - RNA, 20 nt, Human
uaagaaaaaccaaccauaau

SEQ ID NO: 1256162 - RNA, 22 nt, Human
uaauaauaauaaacacugucaa

SEQ ID NO: 1256163 - RNA, 22 nt, Human
uaccaguggcucuugugacagg

SEQ ID NO: 1256164 - RNA, 19 nt, Human
uacuaaaauaccaguggcu

SEQ ID NO: 1256165 - RNA, 21 nt, Human
uauugcaauauaaccaacccu

SEQ ID NO: 1256166 - RNA, 18 nt, Human
uccaguggagcauaauug

SEQ ID NO: 1256167 - RNA, 21 nt, Human
ucugauuugugacuaaagaaa

SEQ ID NO: 1256168 - RNA, 21 nt, Human
ugaacagcaugacaaagcuaa

SEQ ID NO: 1256169 - RNA, 26 nt, Human
ugacuaaagaaaaaauaaucaaguac

SEQ ID NO: 1256170 - RNA, 22 nt, Human
ugagaagagagauaacaaaaau

SEQ ID NO: 1256171 - RNA, 19 nt, Human
uggagcauaauugugagaa

SEQ ID NO: 1256172 - RNA, 24 nt, Human
ugggaccacaugcccaucccacca

SEQ ID NO: 1256173 - RNA, 24 nt, Human
ugggguuucaugauguugcauagg

SEQ ID NO: 1256174 - RNA, 24 nt, Human
uuauuuaaaaaaugaaggaaagaa

SEQ ID NO: 1256175 - RNA, 21 nt, Human
uucaaguaauguuccccccac

SEQ ID NO: 1256176 - RNA, 23 nt, Human
uucaaguaauguuccccccacaa

SEQ ID NO: 1256177 - RNA, 24 nt, Human
uuccagaguagcugggaccacaug

SEQ ID NO: 1256178 - RNA, 25 nt, Human
uuccagggcucaagugauccucuca

SEQ ID NO: 1256179 - RNA, 23 nt, Human
uugugacuaaagaaaaaauaauc

SEQ ID NO: 1256180 - RNA, 22 nt, Human
uuuaaaaaaugaaggaaagaag

SEQ ID NO: 1256181 - RNA, 21 nt, Human
uuuaaagcgguuuagccagca

SEQ ID NO: 1256182 - RNA, 23 nt, Human
uuugaacagcaugacaaagcuaa

SEQ ID NO: 1256183 - RNA, 24 nt, Human
aaagugcugggauuacaggcauga

SEQ ID NO: 1256184 - RNA, 22 nt, Human
aaauaccgcaugguguagaaug

SEQ ID NO: 1256185 - RNA, 24 nt, Human
aacgauucuucugccucagccucc

SEQ ID NO: 1256186 - RNA, 21 nt, Human
aacuggccucuggggaaagac

SEQ ID NO: 1256187 - RNA, 22 nt, Human
aacuuuuaaagaaauucaguca

SEQ ID NO: 1256188 - RNA, 22 nt, Human
aagagacaggaucucccugugu

SEQ ID NO: 1256189 - RNA, 24 nt, Human
aaguaccaugaaaucacagaugcu

SEQ ID NO: 1256190 - RNA, 19 nt, Human
aaguagcugggauuacagg

SEQ ID NO: 1256191 - RNA, 19 nt, Human
aagugcugggauuacaggc

SEQ ID NO: 1256192 - RNA, 21 nt, Human
aagugcugggauuacaggcau

SEQ ID NO: 1256193 - RNA, 26 nt, Human
aagugcugggauuacaggcaugagcc

SEQ ID NO: 1256194 - RNA, 26 nt, Human
aaucccauacucucucucuagcccac

SEQ ID NO: 1256195 - RNA, 22 nt, Human
acaacauccuccuaugcucucu

SEQ ID NO: 1256196 - RNA, 18 nt, Human
acacaggccacaagcaga

SEQ ID NO: 1256197 - RNA, 20 nt, Human
accaaucuaaaccugaacac

SEQ ID NO: 1256198 - RNA, 20 nt, Human
accacaccaccacacccggc

SEQ ID NO: 1256199 - RNA, 20 nt, Human
accaccauuaggucccaaca

SEQ ID NO: 1256200 - RNA, 26 nt, Human
acucaugaucaugcucucacaccacu

SEQ ID NO: 1256201 - RNA, 24 nt, Human
acucuuguugcccaggcuggagug

SEQ ID NO: 1256202 - RNA, 21 nt, Human
agaagacuuugggucuaaucc

SEQ ID NO: 1256203 - RNA, 27 nt, Human
agacaguguacagagaacaacauccuc

SEQ ID NO: 1256204 - RNA, 19 nt, Human
agaccaccaacugggaagg

SEQ ID NO: 1256205 - RNA, 25 nt, Human
agccaaaaagcaccauuuuuagaga

SEQ ID NO: 1256206 - RNA, 18 nt, Human
aggcaggucucgaacucc

SEQ ID NO: 1256207 - RNA, 19 nt, Human
aggcuaccuguauacagaa

SEQ ID NO: 1256208 - RNA, 20 nt, Human
agggagggugaacuaguggg

SEQ ID NO: 1256209 - RNA, 19 nt, Human
aggggaaaugcaaucugac

SEQ ID NO: 1256210 - RNA, 22 nt, Human
aggugcucaauaaagagagggc

SEQ ID NO: 1256211 - RNA, 19 nt, Human
aggugugaacuaccaugcc

SEQ ID NO: 1256212 - RNA, 18 nt, Human
agugcugggauuacaggc

SEQ ID NO: 1256213 - RNA, 19 nt, Human
auaggacuuuaauguuggc

SEQ ID NO: 1256214 - RNA, 19 nt, Human
auauaccagcaucagcaga

SEQ ID NO: 1256215 - RNA, 21 nt, Human
augcucucucuggcugcagcc

SEQ ID NO: 1256216 - RNA, 24 nt, Human
augggguuucuccaugaucaucag

SEQ ID NO: 1256217 - RNA, 23 nt, Human
auuuuuuugcuuguuuguuuuuu

SEQ ID NO: 1256218 - RNA, 23 nt, Human
caaaaagcaccauuuuuagagac

SEQ ID NO: 1256219 - RNA, 22 nt, Human
caaacgauucuucugccucagc

SEQ ID NO: 1256220 - RNA, 27 nt, Human
caaacgauucuucugccucagccuccc

SEQ ID NO: 1256221 - RNA, 24 nt, Human
caaagugcugggauuacaggcaug

SEQ ID NO: 1256222 - RNA, 19 nt, Human
caacaggcguaaacucuca

SEQ ID NO: 1256223 - RNA, 25 nt, Human
caauuuccaaacaguuccgagaaca

SEQ ID NO: 1256224 - RNA, 19 nt, Human
cacaccaccacacccggcu

SEQ ID NO: 1256225 - RNA, 18 nt, Human
cacaggccacaagcagaa

SEQ ID NO: 1256226 - RNA, 21 nt, Human
cacaggccacaagcagaaccg

SEQ ID NO: 1256227 - RNA, 18 nt, Human
caccacaccaccacaccc

SEQ ID NO: 1256228 - RNA, 18 nt, Human
caccacaccaccacaccc

SEQ ID NO: 1256229 - RNA, 21 nt, Human
caccugcuuuggagccaagaa

SEQ ID NO: 1256230 - RNA, 23 nt, Human
cacucaaucagccuccaucacaa

SEQ ID NO: 1256231 - RNA, 24 nt, Human
cacucuuguugcccaggcuggagu

SEQ ID NO: 1256232 - RNA, 21 nt, Human
cacugcaaccucugccucccg

SEQ ID NO: 1256233 - RNA, 23 nt, Human
cacugcaaccucugccucccggg

SEQ ID NO: 1256234 - RNA, 21 nt, Human
cacugugagacuuugggccca

SEQ ID NO: 1256235 - RNA, 19 nt, Human
cagcaaugccgcaacuuuu

SEQ ID NO: 1256236 - RNA, 22 nt, Human
cagccaacuggcaaccagacug

SEQ ID NO: 1256237 - RNA, 25 nt, Human
caggugcccaccacaccaccacacc

SEQ ID NO: 1256238 - RNA, 25 nt, Human
cagucaccugagggccacugaauuu

SEQ ID NO: 1256239 - RNA, 22 nt, Human
caucaggcaggucucgaacucc

SEQ ID NO: 1256240 - RNA, 25 nt, Human
caugaaaucacagaugcuuaaaaca

SEQ ID NO: 1256241 - RNA, 18 nt, Human
caugccuucuguuuucuc

SEQ ID NO: 1256242 - RNA, 22 nt, Human
cauuauccauguaaauugaggg

SEQ ID NO: 1256243 - RNA, 23 nt, Human
cauucuuguuucucaucccagag

SEQ ID NO: 1256244 - RNA, 24 nt, Human
cauucuuguuucucaucccagaga

SEQ ID NO: 1256245 - RNA, 20 nt, Human
ccaaaaaagggguaguaaua

SEQ ID NO: 1256246 - RNA, 25 nt, Human
ccaaaaagcaccauuuuuagagaca

SEQ ID NO: 1256247 - RNA, 22 nt, Human
ccaaagugcugggauuacaggc

SEQ ID NO: 1256248 - RNA, 24 nt, Human
ccaaagugcugggauuacaggcau

SEQ ID NO: 1256249 - RNA, 27 nt, Human
ccaacaucugaauuuuggcagccaacu

SEQ ID NO: 1256250 - RNA, 21 nt, Human
ccaaguagcugggauuacagg

SEQ ID NO: 1256251 - RNA, 19 nt, Human
ccacaagcagaaccaccau

SEQ ID NO: 1256252 - RNA, 23 nt, Human
ccacugaauuuccugggccucca

SEQ ID NO: 1256253 - RNA, 19 nt, Human
ccagccaaaaagcaccauu

SEQ ID NO: 1256254 - RNA, 25 nt, Human
cccaacaucagcacugcauggugau

SEQ ID NO: 1256255 - RNA, 22 nt, Human
cccaaguagcugggauuacagg

SEQ ID NO: 1256256 - RNA, 23 nt, Human
cccaaguagcugggauuacaggu

SEQ ID NO: 1256257 - RNA, 24 nt, Human
cccaaguagcugggauuacaggug

SEQ ID NO: 1256258 - RNA, 21 nt, Human
cccaccacaccaccacacccg

SEQ ID NO: 1256259 - RNA, 20 nt, Human
cccacugugagacuuugggc

SEQ ID NO: 1256260 - RNA, 18 nt, Human
cccaggcuggagugcaau

SEQ ID NO: 1256261 - RNA, 22 nt, Human
cccauacucucucucuagccca

SEQ ID NO: 1256262 - RNA, 23 nt, Human
cccggguucaaacgauucuucug

SEQ ID NO: 1256263 - RNA, 24 nt, Human
ccgccgcagccuuccaaagugcug

SEQ ID NO: 1256264 - RNA, 23 nt, Human
ccuccauggacaggugcugaagu

SEQ ID NO: 1256265 - RNA, 24 nt, Human
ccucccgccucagccucaugagua

SEQ ID NO: 1256266 - RNA, 24 nt, Human
ccucccggguucaaacgauucuuc

SEQ ID NO: 1256267 - RNA, 23 nt, Human
ccuccuaugcucucucuggcugc

SEQ ID NO: 1256268 - RNA, 22 nt, Human
ccugaccgcaagugaucugccc

SEQ ID NO: 1256269 - RNA, 20 nt, Human
ccuggacucaagcaauccuc

SEQ ID NO: 1256270 - RNA, 23 nt, Human
ccuguguuacccaggcuggucuc

SEQ ID NO: 1256271 - RNA, 24 nt, Human
ccuguguuacccaggcuggucucg

SEQ ID NO: 1256272 - RNA, 25 nt, Human
cgaacuccuggacucaagcaauccu

SEQ ID NO: 1256273 - RNA, 24 nt, Human
cgccucagccucaugaguaacugg

SEQ ID NO: 1256274 - RNA, 20 nt, Human
cgucaguaucaguucaaaga

SEQ ID NO: 1256275 - RNA, 24 nt, Human
cucaagcaauccucccgccucagc

SEQ ID NO: 1256276 - RNA, 23 nt, Human
cucagccucccaaguagcuggga

SEQ ID NO: 1256277 - RNA, 25 nt, Human
cucaugaucaugcucucacaccacu

SEQ ID NO: 1256278 - RNA, 26 nt, Human
cuccugaccgcaagugaucugcccgc

SEQ ID NO: 1256279 - RNA, 18 nt, Human
cucuuguugcccaggcug

SEQ ID NO: 1256280 - RNA, 24 nt, Human
cugaaguguccacauauaccagca

SEQ ID NO: 1256281 - RNA, 19 nt, Human
cugcaaccucugccucccg

SEQ ID NO: 1256282 - RNA, 23 nt, Human
cugcaaccucugccucccggguu

SEQ ID NO: 1256283 - RNA, 24 nt, Human
cugcaaccucugccucccggguuc

SEQ ID NO: 1256284 - RNA, 20 nt, Human
cugccugcaagacaaaggag

SEQ ID NO: 1256285 - RNA, 22 nt, Human
cuuaguaaugauaauuuuccuu

SEQ ID NO: 1256286 - RNA, 20 nt, Human
gaaaucacagaugcuuaaaa

SEQ ID NO: 1256287 - RNA, 23 nt, Human
gaacacguaccagccauugcuaa

SEQ ID NO: 1256288 - RNA, 23 nt, Human
gaacuccuggacucaagcaaucc

SEQ ID NO: 1256289 - RNA, 28 nt, Human
gaccgcaagugaucugcccgccgcagcc

SEQ ID NO: 1256290 - RNA, 22 nt, Human
gacuacaggugugaacuaccau

SEQ ID NO: 1256291 - RNA, 18 nt, Human
gagaugggguuucuccau

SEQ ID NO: 1256292 - RNA, 25 nt, Human
gaguaacugggacuacaggugugaa

SEQ ID NO: 1256293 - RNA, 19 nt, Human
gagucccuggagcaggaca

SEQ ID NO: 1256294 - RNA, 18 nt, Human
gauuacaggcaugagcca

SEQ ID NO: 1256295 - RNA, 21 nt, Human
gauuacaggcaugagccaccg

SEQ ID NO: 1256296 - RNA, 24 nt, Human
gauuacaggcaugagccaccgugc

SEQ ID NO: 1256297 - RNA, 22 nt, Human
gcaaccucugccucccggguuc

SEQ ID NO: 1256298 - RNA, 19 nt, Human
gcuggagugcaauggcacg

SEQ ID NO: 1256299 - RNA, 24 nt, Human
ggacuacaggugugaacuaccaug

SEQ ID NO: 1256300 - RNA, 20 nt, Human
ggagguaggcuaccuguaua

SEQ ID NO: 1256301 - RNA, 24 nt, Human
ggauuacaggcaugagccaccgug

SEQ ID NO: 1256302 - RNA, 22 nt, Human
ggcaccaaucuaaaccugaaca

SEQ ID NO: 1256303 - RNA, 20 nt, Human
gggaaagacugccuggguuc

SEQ ID NO: 1256304 - RNA, 25 nt, Human
gggaacucaacacguggugauuugg

SEQ ID NO: 1256305 - RNA, 20 nt, Human
gucccaacaucagcacugca

SEQ ID NO: 1256306 - RNA, 23 nt, Human
uaaaacauuucaacacaggccac

SEQ ID NO: 1256307 - RNA, 18 nt, Human
uaaaccugaacacguacc

SEQ ID NO: 1256308 - RNA, 23 nt, Human
uaaugauggggaauccacuuucc

SEQ ID NO: 1256309 - RNA, 25 nt, Human
uaauuuugaauuuuuaguagagaug

SEQ ID NO: 1256310 - RNA, 24 nt, Human
uacaggcaugagccaccgugccca

SEQ ID NO: 1256311 - RNA, 23 nt, Human
uacaggugcccaccacaccacca

SEQ ID NO: 1256312 - RNA, 21 nt, Human
uaccaaguaccaugaaaucac

SEQ ID NO: 1256313 - RNA, 22 nt, Human
uaccaugaaaucacagaugcuu

SEQ ID NO: 1256314 - RNA, 24 nt, Human
uaccaugcccagcaaugccgcaac

SEQ ID NO: 1256315 - RNA, 24 nt, Human
uacccaggcuggucucgaacuccu

SEQ ID NO: 1256316 - RNA, 19 nt, Human
uagguuggucauggagacu

SEQ ID NO: 1256317 - RNA, 20 nt, Human
uaguaaugauaauuuuccuu

SEQ ID NO: 1256318 - RNA, 24 nt, Human
uaguagagaugggguuucuccaug

SEQ ID NO: 1256319 - RNA, 22 nt, Human
uauccaaaaaagggguaguaau

SEQ ID NO: 1256320 - RNA, 21 nt, Human
uauccccaaaguuccacugaa

SEQ ID NO: 1256321 - RNA, 20 nt, Human
ucaacacaggccacaagcag

SEQ ID NO: 1256322 - RNA, 22 nt, Human
ucaacacguggugauuuggcua

SEQ ID NO: 1256323 - RNA, 19 nt, Human
ucaaugguuuccuguuuuc

SEQ ID NO: 1256324 - RNA, 22 nt, Human
ucaaugguuuccuguuuuccgg

SEQ ID NO: 1256325 - RNA, 21 nt, Human
ucacucuuguugcccaggcug

SEQ ID NO: 1256326 - RNA, 23 nt, Human
ucacucuuguugcccaggcugga

SEQ ID NO: 1256327 - RNA, 23 nt, Human
ucacugcaaccucugccucccgg

SEQ ID NO: 1256328 - RNA, 24 nt, Human
ucacugcaaccucugccucccggg

SEQ ID NO: 1256329 - RNA, 25 nt, Human
ucacugcaaccucugccucccgggu

SEQ ID NO: 1256330 - RNA, 18 nt, Human
ucagccucccaaguagcu

SEQ ID NO: 1256331 - RNA, 20 nt, Human
ucagccucccaaguagcugg

SEQ ID NO: 1256332 - RNA, 24 nt, Human
ucaugaguaacugggacuacaggu

SEQ ID NO: 1256333 - RNA, 21 nt, Human
ucaugggggugaugaugucuu

SEQ ID NO: 1256334 - RNA, 23 nt, Human
uccaaagugcugggauuacaggc

SEQ ID NO: 1256335 - RNA, 24 nt, Human
uccaaagugcugggauuacaggca

SEQ ID NO: 1256336 - RNA, 20 nt, Human
uccaggcgcugggcaaucug

SEQ ID NO: 1256337 - RNA, 23 nt, Human
ucccaaguagcugggauuacagg

SEQ ID NO: 1256338 - RNA, 24 nt, Human
ucccaaguagcugggauuacaggu

SEQ ID NO: 1256339 - RNA, 20 nt, Human
ucccauacucucucucuagc

SEQ ID NO: 1256340 - RNA, 20 nt, Human
ucccggguucaaacgauucu

SEQ ID NO: 1256341 - RNA, 24 nt, Human
ucccggguucaaacgauucuucug

SEQ ID NO: 1256342 - RNA, 20 nt, Human
ucccuguguuacccaggcug

SEQ ID NO: 1256343 - RNA, 21 nt, Human
ucuagcccacugugagacuuu

SEQ ID NO: 1256344 - RNA, 24 nt, Human
ucucccuguguuacccaggcuggu

SEQ ID NO: 1256345 - RNA, 21 nt, Human
ucucgaacuccugaccgcaag

SEQ ID NO: 1256346 - RNA, 23 nt, Human
ucucgaacuccuggacucaagca

SEQ ID NO: 1256347 - RNA, 24 nt, Human
ucugccucagccucccaaguagcu

SEQ ID NO: 1256348 - RNA, 18 nt, Human
ucuggaugaguccagggc

SEQ ID NO: 1256349 - RNA, 22 nt, Human
ucuucauuuccuuaccucuaau

SEQ ID NO: 1256350 - RNA, 24 nt, Human
ucuucauuuccuuaccucuaauga

SEQ ID NO: 1256351 - RNA, 22 nt, Human
ucuuguugcccaggcuggagug

SEQ ID NO: 1256352 - RNA, 18 nt, Human
ugaccgcaagugaucugc

SEQ ID NO: 1256353 - RNA, 20 nt, Human
ugagggccacugaauuuccu

SEQ ID NO: 1256354 - RNA, 18 nt, Human
ugcccaggcuggagugca

SEQ ID NO: 1256355 - RNA, 21 nt, Human
ugcccaggcuggagugcaaug

SEQ ID NO: 1256356 - RNA, 24 nt, Human
ugcccaggcuggagugcaauggca

SEQ ID NO: 1256357 - RNA, 24 nt, Human
ugccucagccucccaaguagcugg

SEQ ID NO: 1256358 - RNA, 24 nt, Human
uggacucaagcaauccucccgccu

SEQ ID NO: 1256359 - RNA, 23 nt, Human
uggagugcaauggcacgaucuca

SEQ ID NO: 1256360 - RNA, 24 nt, Human
uggagugcaauggcacgaucucag

SEQ ID NO: 1256361 - RNA, 24 nt, Human
uggcaaccagacugccugcaagac

SEQ ID NO: 1256362 - RNA, 21 nt, Human
uggcaaugauaaugauucugg

SEQ ID NO: 1256363 - RNA, 22 nt, Human
ugggacuacaggugugaacuac

SEQ ID NO: 1256364 - RNA, 24 nt, Human
ugggacuacaggugugaacuacca

SEQ ID NO: 1256365 - RNA, 25 nt, Human
ugggacuacaggugugaacuaccau

SEQ ID NO: 1256366 - RNA, 19 nt, Human
ugggagggaaccacauaga

SEQ ID NO: 1256367 - RNA, 18 nt, Human
ugggauuacaggcaugag

SEQ ID NO: 1256368 - RNA, 21 nt, Human
ugggauuacaggcaugagcca

SEQ ID NO: 1256369 - RNA, 22 nt, Human
ugggauuacaggcaugagccac

SEQ ID NO: 1256370 - RNA, 23 nt, Human
ugggauuacaggcaugagccacc

SEQ ID NO: 1256371 - RNA, 23 nt, Human
ugggauuacaggcaugagccacc

SEQ ID NO: 1256372 - RNA, 24 nt, Human
ugggauuacaggcaugagccaccg

SEQ ID NO: 1256373 - RNA, 26 nt, Human
ugggauuacaggcaugagccaccgug

SEQ ID NO: 1256374 - RNA, 21 nt, Human
ugggauuacaggugcccacca

SEQ ID NO: 1256375 - RNA, 21 nt, Human
uggggaauccacuuuccuugg

SEQ ID NO: 1256376 - RNA, 21 nt, Human
ugggguuucuccaugaucauc

SEQ ID NO: 1256377 - RNA, 19 nt, Human
ugguauuaaaagccaguca

SEQ ID NO: 1256378 - RNA, 23 nt, Human
uguccacauauaccagcaucagc

SEQ ID NO: 1256379 - RNA, 24 nt, Human
uguguuacccaggcuggucucgaa

SEQ ID NO: 1256380 - RNA, 19 nt, Human
uguuacccaggcuggucuc

SEQ ID NO: 1256381 - RNA, 22 nt, Human
uguuacccaggcuggucucgaa

SEQ ID NO: 1256382 - RNA, 20 nt, Human
uguugcccaggcuggagugc

SEQ ID NO: 1256383 - RNA, 22 nt, Human
uguugcccaggcuggagugcaa

SEQ ID NO: 1256384 - RNA, 21 nt, Human
uguuuuuuuugagauggaguu

SEQ ID NO: 1256385 - RNA, 18 nt, Human
uuaguagagaugggguuu

SEQ ID NO: 1256386 - RNA, 24 nt, Human
uuaguagagaugggguuucuccau

SEQ ID NO: 1256387 - RNA, 18 nt, Human
uuaguagaugugugucca

SEQ ID NO: 1256388 - RNA, 24 nt, Human
uucaaacgauucuucugccucagc

SEQ ID NO: 1256389 - RNA, 24 nt, Human
uucacucuuguugcccaggcugga

SEQ ID NO: 1256390 - RNA, 23 nt, Human
uuccuuugcaggugaaacagcuc

SEQ ID NO: 1256391 - RNA, 18 nt, Human
uugcccaggcuggagugc

SEQ ID NO: 1256392 - RNA, 20 nt, Human
uuuacacaguaggugcucaa

SEQ ID NO: 1256393 - RNA, 24 nt, Human
uuucacucuuguugcccaggcugg

SEQ ID NO: 1256394 - RNA, 21 nt, Human
uuuccugggccuccauggaca

SEQ ID NO: 1256395 - RNA, 20 nt, Human
uuucuaacagcagcuccauc

SEQ ID NO: 1256396 - RNA, 19 nt, Human
uuuugaauuuuuaguagag

SEQ ID NO: 1256397 - RNA, 20 nt, Human
uuuugaauuuuuaguagaga

SEQ ID NO: 1256398 - RNA, 22 nt, Human
uuuuuaguagagaugggguuuc

SEQ ID NO: 1256399 - RNA, 22 nt, Human
aaaaaaaaaaaaaaaagccaag

SEQ ID NO: 1256400 - RNA, 21 nt, Human
aaaaaaagccaaguaugcugg

SEQ ID NO: 1256401 - RNA, 22 nt, Human
aaaaacaacaacaaaauuaccu

SEQ ID NO: 1256402 - RNA, 25 nt, Human
aaaaacaacaacaaaauuaccuggc

SEQ ID NO: 1256403 - RNA, 19 nt, Human
aaaaagacaauuuugaggc

SEQ ID NO: 1256404 - RNA, 21 nt, Human
aaaaagccaaguaugcuggca

SEQ ID NO: 1256405 - RNA, 23 nt, Human
aaaacaacaacaaaauuaccugg

SEQ ID NO: 1256406 - RNA, 25 nt, Human
aaaagaaagcaauacuugacgguga

SEQ ID NO: 1256407 - RNA, 20 nt, Human
aaaaugccuguuuacaagag

SEQ ID NO: 1256408 - RNA, 24 nt, Human
aaacaaaguugagagucagagcuc

SEQ ID NO: 1256409 - RNA, 24 nt, Human
aaagugcugggauuacaggcguga

SEQ ID NO: 1256410 - RNA, 19 nt, Human
aaauacaaaaauuagcugg

SEQ ID NO: 1256411 - RNA, 20 nt, Human
aacauagugagacccugucu

SEQ ID NO: 1256412 - RNA, 18 nt, Human
aacauggugaaaccccuu

SEQ ID NO: 1256413 - RNA, 19 nt, Human
aacauggugaaaccccuuu

SEQ ID NO: 1256414 - RNA, 24 nt, Human
aagcugaggcgggaggaucacuug

SEQ ID NO: 1256415 - RNA, 25 nt, Human
aagcugcuucuacccuguucaacug

SEQ ID NO: 1256416 - RNA, 20 nt, Human
aagcugguuguguggaauuu

SEQ ID NO: 1256417 - RNA, 19 nt, Human
aagugcugggauuacaggc

SEQ ID NO: 1256418 - RNA, 19 nt, Human
aagugcugggauuacaggc

SEQ ID NO: 1256419 - RNA, 26 nt, Human
aagugcugggauuacaggcgugagcc

SEQ ID NO: 1256420 - RNA, 23 nt, Human
aauccuugaaccugggaggcaga

SEQ ID NO: 1256421 - RNA, 23 nt, Human
aauuaccuggcuguggugguaug

SEQ ID NO: 1256422 - RNA, 20 nt, Human
acaaaaauuagcuggaccua

SEQ ID NO: 1256423 - RNA, 20 nt, Human
acaaaguugagagucagagc

SEQ ID NO: 1256424 - RNA, 22 nt, Human
acagaaugagaucaucucuuaa

SEQ ID NO: 1256425 - RNA, 18 nt, Human
acauagcccacuaacagc

SEQ ID NO: 1256426 - RNA, 25 nt, Human
accuuuugucuagacuugacagaau

SEQ ID NO: 1256427 - RNA, 18 nt, Human
acugcacuccagacuggg

SEQ ID NO: 1256428 - RNA, 19 nt, Human
acugcacuccagacugggu

SEQ ID NO: 1256429 - RNA, 21 nt, Human
acugcacuccagacugggugg

SEQ ID NO: 1256430 - RNA, 26 nt, Human
acugcacuccagacugggugguagag

SEQ ID NO: 1256431 - RNA, 24 nt, Human
acugcaguccagccagggcaacag

SEQ ID NO: 1256432 - RNA, 18 nt, Human
acugcccuccagccuggg

SEQ ID NO: 1256433 - RNA, 24 nt, Human
acugcccuccagccugggcaacag

SEQ ID NO: 1256434 - RNA, 22 nt, Human
acuuggugcuggccagaugugg

SEQ ID NO: 1256435 - RNA, 24 nt, Human
acuuggugcuggccagaugugguu

SEQ ID NO: 1256436 - RNA, 18 nt, Human
agacaggaggauugcuug

SEQ ID NO: 1256437 - RNA, 21 nt, Human
agacauauuuaaaaagacaau

SEQ ID NO: 1256438 - RNA, 24 nt, Human
agacugggugguagagcaagacuc

SEQ ID NO: 1256439 - RNA, 18 nt, Human
agagcaagacucugucuc

SEQ ID NO: 1256440 - RNA, 22 nt, Human
agaggcuacagugagccgagau

SEQ ID NO: 1256441 - RNA, 24 nt, Human
agaggcuacagugagccgagauug

SEQ ID NO: 1256442 - RNA, 18 nt, Human
agaugcgaugagcuauga

SEQ ID NO: 1256443 - RNA, 20 nt, Human
agcacucugggaggcugagg

SEQ ID NO: 1256444 - RNA, 19 nt, Human
agcacuuugggaggcugag

SEQ ID NO: 1256445 - RNA, 22 nt, Human
agccuaggcaacauagugagac

SEQ ID NO: 1256446 - RNA, 22 nt, Human
agccuggccaacauggugaaac

SEQ ID NO: 1256447 - RNA, 24 nt, Human
agccuggccaacauggugaaaccc

SEQ ID NO: 1256448 - RNA, 22 nt, Human
agcucgagacgauccugggcaa

SEQ ID NO: 1256449 - RNA, 21 nt, Human
aggaaagauuauuuaaaucaa

SEQ ID NO: 1256450 - RNA, 24 nt, Human
aggaucacuugagcccaggaguuc

SEQ ID NO: 1256451 - RNA, 21 nt, Human
aggcagaggcuacagugagcc

SEQ ID NO: 1256452 - RNA, 24 nt, Human
aggcagaggcuacagugagccgag

SEQ ID NO: 1256453 - RNA, 21 nt, Human
aggcaggagaauccuugaacc

SEQ ID NO: 1256454 - RNA, 23 nt, Human
aggcaggagaauccuugaaccug

SEQ ID NO: 1256455 - RNA, 26 nt, Human
aggcagguggauuacuugaggucagg

SEQ ID NO: 1256456 - RNA, 24 nt, Human
aggcaugguggcucaugccuguaa

SEQ ID NO: 1256457 - RNA, 18 nt, Human
aggcgggaggaucacuug

SEQ ID NO: 1256458 - RNA, 23 nt, Human
aggcgggaggaucacuugagccc

SEQ ID NO: 1256459 - RNA, 20 nt, Human
aggcuaaggugggaggauug

SEQ ID NO: 1256460 - RNA, 24 nt, Human
aggcugagacaggaggauugcuug

SEQ ID NO: 1256461 - RNA, 23 nt, Human
aggcugaggcaggagaauccuug

SEQ ID NO: 1256462 - RNA, 21 nt, Human
aggcugaggcagguggauuac

SEQ ID NO: 1256463 - RNA, 24 nt, Human
aggcugaggcagguggauuacuug

SEQ ID NO: 1256464 - RNA, 22 nt, Human
agguggauuacuugaggucagg

SEQ ID NO: 1256465 - RNA, 22 nt, Human
agguguuugcagggggcucugg

SEQ ID NO: 1256466 - RNA, 24 nt, Human
agucagaaggaucaauugagucca

SEQ ID NO: 1256467 - RNA, 18 nt, Human
agugcugggauuacaggc

SEQ ID NO: 1256468 - RNA, 19 nt, Human
agugcuuugggaggcugag

SEQ ID NO: 1256469 - RNA, 24 nt, Human
aguggugggcgucuguaaucucag

SEQ ID NO: 1256470 - RNA, 19 nt, Human
auauaccuguaacuucagu

SEQ ID NO: 1256471 - RNA, 21 nt, Human
aucacuugagcccaggaguuc

SEQ ID NO: 1256472 - RNA, 24 nt, Human
auccugggcaacuuugugagaccu

SEQ ID NO: 1256473 - RNA, 19 nt, Human
augccaugcuagcucaaaa

SEQ ID NO: 1256474 - RNA, 19 nt, Human
augccuguaauccuagcac

SEQ ID NO: 1256475 - RNA, 24 nt, Human
auugagccacugcccuccagccug

SEQ ID NO: 1256476 - RNA, 24 nt, Human
auugcaccacugcacuccagacug

SEQ ID NO: 1256477 - RNA, 18 nt, Human
auuuagacaucauaccuu

SEQ ID NO: 1256478 - RNA, 18 nt, Human
auuuccagcaagcucuuu

SEQ ID NO: 1256479 - RNA, 22 nt, Human
auuuugaggccaggcauggugg

SEQ ID NO: 1256480 - RNA, 23 nt, Human
caaaaacaacaacaaaauuaccu

SEQ ID NO: 1256481 - RNA, 24 nt, Human
caaaacacaaaguaugugagucag

SEQ ID NO: 1256482 - RNA, 24 nt, Human
caaagugcugggauuacaggcgug

SEQ ID NO: 1256483 - RNA, 23 nt, Human
caacaaaauuaccuggcuguggu

SEQ ID NO: 1256484 - RNA, 21 nt, Human
caacauagugagacccugucu

SEQ ID NO: 1256485 - RNA, 21 nt, Human
caacauagugagacccugucu

SEQ ID NO: 1256486 - RNA, 24 nt, Human
caacauagugagacccugucuuua

SEQ ID NO: 1256487 - RNA, 24 nt, Human
caacauggugaaaccccuuuucua

SEQ ID NO: 1256488 - RNA, 23 nt, Human
cacuacuccagaggcuaaggugg

SEQ ID NO: 1256489 - RNA, 23 nt, Human
cacuccagacugggugguagagc

SEQ ID NO: 1256490 - RNA, 19 nt, Human
cacugcacuccagacuggg

SEQ ID NO: 1256491 - RNA, 19 nt, Human
cacugcacuccagacuggg

SEQ ID NO: 1256492 - RNA, 23 nt, Human
cacugcacuccagacuggguggu

SEQ ID NO: 1256493 - RNA, 24 nt, Human
cacugcacuccagacuggguggua

SEQ ID NO: 1256494 - RNA, 25 nt, Human
cacugcacuccagacugggugguag

SEQ ID NO: 1256495 - RNA, 21 nt, Human
cacugcaguccagccagggca

SEQ ID NO: 1256496 - RNA, 24 nt, Human
cacugcaguccagccagggcaaca

SEQ ID NO: 1256497 - RNA, 24 nt, Human
cacugcccuccagccugggcaaca

SEQ ID NO: 1256498 - RNA, 18 nt, Human
cagaaugagaucaucucu

SEQ ID NO: 1256499 - RNA, 27 nt, Human
cagcaagcucuuugucccucaaagccc

SEQ ID NO: 1256500 - RNA, 24 nt, Human
cagcacucugggaggcugaggcag

SEQ ID NO: 1256501 - RNA, 26 nt, Human
cagcacucugggaggcugaggcaggu

SEQ ID NO: 1256502 - RNA, 20 nt, Human
cagccagggcaacagagcaa

SEQ ID NO: 1256503 - RNA, 25 nt, Human
cagcccguggaagacgagccacugg

SEQ ID NO: 1256504 - RNA, 24 nt, Human
cagcuacuugggaggcugaggcag

SEQ ID NO: 1256505 - RNA, 23 nt, Human
caggaggauugcuugcggccagg

SEQ ID NO: 1256506 - RNA, 23 nt, Human
caggugucucccuuugcaauuuc

SEQ ID NO: 1256507 - RNA, 24 nt, Human
cagugcuuugggaggcugagacag

SEQ ID NO: 1256508 - RNA, 20 nt, Human
caugccuguaauccuagcac

SEQ ID NO: 1256509 - RNA, 24 nt, Human
caugccuguaauccuagcacuuug

SEQ ID NO: 1256510 - RNA, 22 nt, Human
ccaaagugcugggauuacaggc

SEQ ID NO: 1256511 - RNA, 22 nt, Human
ccaaagugcugggauuacaggc

SEQ ID NO: 1256512 - RNA, 24 nt, Human
ccaaagugcugggauuacaggcgu

SEQ ID NO: 1256513 - RNA, 21 nt, Human
ccacuaacagcuucauuuaga

SEQ ID NO: 1256514 - RNA, 20 nt, Human
ccacugcacuccagacuggg

SEQ ID NO: 1256515 - RNA, 20 nt, Human
ccacugcacuccagacuggg

SEQ ID NO: 1256516 - RNA, 21 nt, Human
ccacugcacuccagacugggu

SEQ ID NO: 1256517 - RNA, 22 nt, Human
ccacugcacuccagacugggug

SEQ ID NO: 1256518 - RNA, 23 nt, Human
ccacugcacuccagacugggugg

SEQ ID NO: 1256519 - RNA, 24 nt, Human
ccacugcacuccagacuggguggu

SEQ ID NO: 1256520 - RNA, 21 nt, Human
ccacugcccuccagccugggc

SEQ ID NO: 1256521 - RNA, 22 nt, Human
ccacugcccuccagccugggca

SEQ ID NO: 1256522 - RNA, 23 nt, Human
ccacugcccuccagccugggcaa

SEQ ID NO: 1256523 - RNA, 24 nt, Human
ccacugcccuccagccugggcaac

SEQ ID NO: 1256524 - RNA, 23 nt, Human
ccaugcuagcucaaaaaacaaag

SEQ ID NO: 1256525 - RNA, 22 nt, Human
cccacagcugccuguugaccug

SEQ ID NO: 1256526 - RNA, 19 nt, Human
ccgcgcccggccggcuuac

SEQ ID NO: 1256527 - RNA, 18 nt, Human
ccuggccaacauggugaa

SEQ ID NO: 1256528 - RNA, 23 nt, Human
ccuggccaacauggugaaacccc

SEQ ID NO: 1256529 - RNA, 23 nt, Human
cgucuguaaucucagcuacuugg

SEQ ID NO: 1256530 - RNA, 24 nt, Human
cgucuguaaucucagcuacuuggg

SEQ ID NO: 1256531 - RNA, 24 nt, Human
cucaugccuguaauccuagcacuu

SEQ ID NO: 1256532 - RNA, 24 nt, Human
cuccugaccucgugauccgcccgc

SEQ ID NO: 1256533 - RNA, 21 nt, Human
cugggccucccaaagugcugg

SEQ ID NO: 1256534 - RNA, 21 nt, Human
cugggugguagagcaagacuc

SEQ ID NO: 1256535 - RNA, 20 nt, Human
cuuaaaaaaaaaaggagaaa

SEQ ID NO: 1256536 - RNA, 22 nt, Human
cuugagcccaggaguucgaggc

SEQ ID NO: 1256537 - RNA, 23 nt, Human
cuugugguccccacuacuccaga

SEQ ID NO: 1256538 - RNA, 20 nt, Human
gaccucgugauccgcccgcc

SEQ ID NO: 1256539 - RNA, 21 nt, Human
gaccucgugauccgcccgccu

SEQ ID NO: 1256540 - RNA, 23 nt, Human
gaccucgugauccgcccgccugg

SEQ ID NO: 1256541 - RNA, 22 nt, Human
gagaauccuugaaccugggagg

SEQ ID NO: 1256542 - RNA, 22 nt, Human
gagagacaccaugaaaaacaaa

SEQ ID NO: 1256543 - RNA, 23 nt, Human
gagauugcaccacugcacuccag

SEQ ID NO: 1256544 - RNA, 21 nt, Human
gagcccacagcugccuguuga

SEQ ID NO: 1256545 - RNA, 18 nt, Human
gagcccaggaguucgagg

SEQ ID NO: 1256546 - RNA, 24 nt, Human
gaggcaggagaauccuugaaccug

SEQ ID NO: 1256547 - RNA, 23 nt, Human
gaggcagguggauuacuugaggu

SEQ ID NO: 1256548 - RNA, 22 nt, Human
gaggcugagacaggaggauugc

SEQ ID NO: 1256549 - RNA, 24 nt, Human
gaucacuugagcccaggaguucga

SEQ ID NO: 1256550 - RNA, 18 nt, Human
gauuacaggcgugagcca

SEQ ID NO: 1256551 - RNA, 22 nt, Human
gauuacaggcgugagccaccgc

SEQ ID NO: 1256552 - RNA, 22 nt, Human
gauuacaggcgugagccaccgc

SEQ ID NO: 1256553 - RNA, 24 nt, Human
gauuacuugaggucaggcguuuga

SEQ ID NO: 1256554 - RNA, 18 nt, Human
gcacaagugcucaaaaga

SEQ ID NO: 1256555 - RNA, 24 nt, Human
gcacuccagacugggugguagagc

SEQ ID NO: 1256556 - RNA, 19 nt, Human
gccaacauggugaaacccc

SEQ ID NO: 1256557 - RNA, 22 nt, Human
gccacugcccuccagccugggc

SEQ ID NO: 1256558 - RNA, 22 nt, Human
gccaggcaugguggcucaugcc

SEQ ID NO: 1256559 - RNA, 24 nt, Human
gcccaggaguucgaggcugcagug

SEQ ID NO: 1256560 - RNA, 18 nt, Human
ggaaaggugacauaauaa

SEQ ID NO: 1256561 - RNA, 19 nt, Human
ggagaauccuugaaccugg

SEQ ID NO: 1256562 - RNA, 20 nt, Human
ggaggcagaggcuacaguga

SEQ ID NO: 1256563 - RNA, 21 nt, Human
ggaggcagaggcuacagugag

SEQ ID NO: 1256564 - RNA, 19 nt, Human
ggagugcaaaaccagccua

SEQ ID NO: 1256565 - RNA, 21 nt, Human
ggagugcaaaaccagccuagg

SEQ ID NO: 1256566 - RNA, 23 nt, Human
ggaucacuugagcccaggaguuc

SEQ ID NO: 1256567 - RNA, 24 nt, Human
ggauggucucgaucuccugaccuc

SEQ ID NO: 1256568 - RNA, 24 nt, Human
ggcgucuguaaucucagcuacuug

SEQ ID NO: 1256569 - RNA, 21 nt, Human
gggaggcagaggcuacaguga

SEQ ID NO: 1256570 - RNA, 22 nt, Human
gggcuuuccuuaugcuuguuuu

SEQ ID NO: 1256571 - RNA, 24 nt, Human
gguagagcaagacucugucucaga

SEQ ID NO: 1256572 - RNA, 21 nt, Human
ggucugccuuugugucuguuu

SEQ ID NO: 1256573 - RNA, 24 nt, Human
gguggcucaugccuguaauccuag

SEQ ID NO: 1256574 - RNA, 23 nt, Human
guagagcaagacucugucucaga

SEQ ID NO: 1256575 - RNA, 19 nt, Human
gucuuuacaaaaacaacaa

SEQ ID NO: 1256576 - RNA, 22 nt, Human
uaagcugguuguguggaauuug

SEQ ID NO: 1256577 - RNA, 23 nt, Human
uaaggugggaggauugcuuaagc

SEQ ID NO: 1256578 - RNA, 24 nt, Human
uacaaaaaaaaaaaaaaaaaaaaa

SEQ ID NO: 1256579 - RNA, 20 nt, Human
uacaaaaacaacaacaaaau

SEQ ID NO: 1256580 - RNA, 27 nt, Human
uacagcacucugggaggcugaggcagg

SEQ ID NO: 1256581 - RNA, 23 nt, Human
uacaggcgugagccaccgcgccc

SEQ ID NO: 1256582 - RNA, 25 nt, Human
uacccuguucaacugugaugagauu

SEQ ID NO: 1256583 - RNA, 24 nt, Human
uaccuguaacuucagugcuuuggg

SEQ ID NO: 1256584 - RNA, 21 nt, Human
uacucaaguaggaaaggggag

SEQ ID NO: 1256585 - RNA, 19 nt, Human
uacuccagaggcuaaggug

SEQ ID NO: 1256586 - RNA, 24 nt, Human
uacuuggugcuggccagauguggu

SEQ ID NO: 1256587 - RNA, 18 nt, Human
uagcacuuugggaggcug

SEQ ID NO: 1256588 - RNA, 24 nt, Human
uagcacuuugggaggcugagucag

SEQ ID NO: 1256589 - RNA, 27 nt, Human
uagcccacuaacagcuucauuuagaca

SEQ ID NO: 1256590 - RNA, 18 nt, Human
uagcuggaccuaguggug

SEQ ID NO: 1256591 - RNA, 21 nt, Human
uaggccaggugugguggcuca

SEQ ID NO: 1256592 - RNA, 24 nt, Human
uauaccuguaacuucagugcuuug

SEQ ID NO: 1256593 - RNA, 21 nt, Human
uauaguaguuacacuaugaaa

SEQ ID NO: 1256594 - RNA, 19 nt, Human
uauguuagaaaaacuagag

SEQ ID NO: 1256595 - RNA, 20 nt, Human
ucaaaagagcucaggugucu

SEQ ID NO: 1256596 - RNA, 18 nt, Human
ucacugcaguccagccag

SEQ ID NO: 1256597 - RNA, 21 nt, Human
ucacugcaguccagccagggc

SEQ ID NO: 1256598 - RNA, 20 nt, Human
ucacuugagcccaggaguuc

SEQ ID NO: 1256599 - RNA, 25 nt, Human
ucaucucuacaaaaaaaaaaaaaaa

SEQ ID NO: 1256600 - RNA, 29 nt, Human
ucaucucuacaaaaaaaaaaaaaaaaaaa

SEQ ID NO: 1256601 - RNA, 24 nt, Human
ucccaaagugcugggauuacaggc

SEQ ID NO: 1256602 - RNA, 22 nt, Human
uccucaaugucacagguacuuc

SEQ ID NO: 1256603 - RNA, 24 nt, Human
uccuggagaucugucucuuguagg

SEQ ID NO: 1256604 - RNA, 24 nt, Human
uccugggcaacuuugugagaccuc

SEQ ID NO: 1256605 - RNA, 23 nt, Human
ucucuuguaggaaauggaggggc

SEQ ID NO: 1256606 - RNA, 21 nt, Human
ucuguaaucucagcuacuugg

SEQ ID NO: 1256607 - RNA, 20 nt, Human
ucuguuugugagcgugucua

SEQ ID NO: 1256608 - RNA, 21 nt, Human
ugaaaaacaaaacacaaagua

SEQ ID NO: 1256609 - RNA, 23 nt, Human
ugagaccagccuggccaacaugg

SEQ ID NO: 1256610 - RNA, 24 nt, Human
ugagaccagccuggccaacauggu

SEQ ID NO: 1256611 - RNA, 18 nt, Human
ugagcccaggaguucgag

SEQ ID NO: 1256612 - RNA, 22 nt, Human
ugagccgagauugcaccacugc

SEQ ID NO: 1256613 - RNA, 21 nt, Human
ugaggaaaggugacauaauaa

SEQ ID NO: 1256614 - RNA, 19 nt, Human
ugaggcaggagaauccuug

SEQ ID NO: 1256615 - RNA, 23 nt, Human
ugaggcaggagaauccuugaacc

SEQ ID NO: 1256616 - RNA, 23 nt, Human
ugaggcaggagaauccuugaacc

SEQ ID NO: 1256617 - RNA, 20 nt, Human
ugaggcagguggauuacuuc

SEQ ID NO: 1256618 - RNA, 24 nt, Human
ugaggcagguggauuacuugaggu

SEQ ID NO: 1256619 - RNA, 26 nt, Human
ugaggcagguggauuacuugagguca

SEQ ID NO: 1256620 - RNA, 24 nt, Human
ugaggccaggcaugguggcucaug

SEQ ID NO: 1256621 - RNA, 19 nt, Human
ugaggcgggaggaucacuu

SEQ ID NO: 1256622 - RNA, 21 nt, Human
ugaggcgggaggaucacuuga

SEQ ID NO: 1256623 - RNA, 24 nt, Human
ugaggcgggaggaucacuugagcc

SEQ ID NO: 1256624 - RNA, 18 nt, Human
ugaggucaggcguuugag

SEQ ID NO: 1256625 - RNA, 19 nt, Human
ugcaaaaccagccuaggca

SEQ ID NO: 1256626 - RNA, 19 nt, Human
ugccauuauacauaugucc

SEQ ID NO: 1256627 - RNA, 23 nt, Human
ugccuguaauccuagcacuuugg

SEQ ID NO: 1256628 - RNA, 24 nt, Human
ugccuguaauccuagcacuuuggg

SEQ ID NO: 1256629 - RNA, 24 nt, Human
ugcugggauuacaggcgugagcca

SEQ ID NO: 1256630 - RNA, 22 nt, Human
uggaagggggaggacaaaaugc

SEQ ID NO: 1256631 - RNA, 23 nt, Human
uggauuacuugaggucaggcguu

SEQ ID NO: 1256632 - RNA, 24 nt, Human
uggauuacuugaggucaggcguuu

SEQ ID NO: 1256633 - RNA, 22 nt, Human
uggcacaucccagcuccuuggg

SEQ ID NO: 1256634 - RNA, 23 nt, Human
uggccaacauggugaaaccccuu

SEQ ID NO: 1256635 - RNA, 19 nt, Human
uggcucaugccuguaaucc

SEQ ID NO: 1256636 - RNA, 24 nt, Human
uggcucaugccuguaauccuagca

SEQ ID NO: 1256637 - RNA, 24 nt, Human
ugggaagcugaggcgggaggauca

SEQ ID NO: 1256638 - RNA, 22 nt, Human
ugggaggauugcuuaagcccug

SEQ ID NO: 1256639 - RNA, 22 nt, Human
ugggaggcugagacaggaggau

SEQ ID NO: 1256640 - RNA, 18 nt, Human
ugggaggcugaggcagga

SEQ ID NO: 1256641 - RNA, 19 nt, Human
ugggaggcugaggcaggag

SEQ ID NO: 1256642 - RNA, 22 nt, Human
ugggaggcugaggcagguggau

SEQ ID NO: 1256643 - RNA, 19 nt, Human
ugggaggcugagucagaag

SEQ ID NO: 1256644 - RNA, 24 nt, Human
ugggaggcugagucagaaggauca

SEQ ID NO: 1256645 - RNA, 18 nt, Human
ugggauuacaggcgugag

SEQ ID NO: 1256646 - RNA, 19 nt, Human
ugggauuacaggcgugagc

SEQ ID NO: 1256647 - RNA, 21 nt, Human
ugggauuacaggcgugagcca

SEQ ID NO: 1256648 - RNA, 22 nt, Human
ugggauuacaggcgugagccac

SEQ ID NO: 1256649 - RNA, 23 nt, Human
ugggauuacaggcgugagccacc

SEQ ID NO: 1256650 - RNA, 24 nt, Human
ugggauuacaggcgugagccaccg

SEQ ID NO: 1256651 - RNA, 19 nt, Human
ugguaugugcuuguggucc

SEQ ID NO: 1256652 - RNA, 18 nt, Human
ugguggcucaugacucua

SEQ ID NO: 1256653 - RNA, 22 nt, Human
ugguggcucaugccuguaaucc

SEQ ID NO: 1256654 - RNA, 21 nt, Human
uggugggcgucuguaaucuca

SEQ ID NO: 1256655 - RNA, 23 nt, Human
uggugguaugugcuugugguccc

SEQ ID NO: 1256656 - RNA, 19 nt, Human
uguaggaaauggaggggcu

SEQ ID NO: 1256657 - RNA, 22 nt, Human
ugucuaaaaaagaaagcaauac

SEQ ID NO: 1256658 - RNA, 21 nt, Human
uguggaauuuggccccuaccu

SEQ ID NO: 1256659 - RNA, 23 nt, Human
uuaaaaaaaaaaggagaaagaua

SEQ ID NO: 1256660 - RNA, 19 nt, Human
uuaauaccucuuugccauu

SEQ ID NO: 1256661 - RNA, 18 nt, Human
uuacuuggaauuacccua

SEQ ID NO: 1256662 - RNA, 21 nt, Human
uuacuuggaauuacccuaaua

SEQ ID NO: 1256663 - RNA, 24 nt, Human
uuagcuggaccuaguggugggcgu

SEQ ID NO: 1256664 - RNA, 24 nt, Human
uuaggccaggugugguggcucaug

SEQ ID NO: 1256665 - RNA, 18 nt, Human
uucacaguauuggaaggg

SEQ ID NO: 1256666 - RNA, 21 nt, Human
uuccccauggcuuaaaauuca

SEQ ID NO: 1256667 - RNA, 23 nt, Human
uugcaccacugcacuccagacug

SEQ ID NO: 1256668 - RNA, 20 nt, Human
uuggccccuaccuuccacau

SEQ ID NO: 1256669 - RNA, 21 nt, Human
uuggccccuaccuuccacauu

SEQ ID NO: 1256670 - RNA, 25 nt, Human
uugggaagcugaggcgggaggauca

SEQ ID NO: 1256671 - RNA, 20 nt, Human
uugggaggcugagacaggag

SEQ ID NO: 1256672 - RNA, 25 nt, Human
uugggaggcugagucagaaggauca

SEQ ID NO: 1256673 - RNA, 20 nt, Human
uuucuacaaaaauacaaaaa

SEQ ID NO: 1256674 - RNA, 18 nt, Human
uuugaaggaugaggaagg

SEQ ID NO: 1256675 - RNA, 18 nt, Human
accucuuccuccucuuuc

SEQ ID NO: 1256676 - RNA, 19 nt, Human
cacuuuuuccucuucuuuu

SEQ ID NO: 1256677 - RNA, 23 nt, Human
cagugaauuucuuguuugagccu

SEQ ID NO: 1256678 - RNA, 19 nt, Human
ucacuuuuuccucuucuuu

SEQ ID NO: 1256679 - RNA, 29 nt, Human
ucacuuuuuccucuucuuuuuuuccuuug

SEQ ID NO: 1256680 - RNA, 21 nt, Human
ucuuccuccucuuucacuuuu

SEQ ID NO: 1256681 - RNA, 25 nt, Human
ucuuccuccucuuucacuuuuuccu

SEQ ID NO: 1256682 - RNA, 24 nt, Human
uuuuuccucuucuuuuuuuccuuu

SEQ ID NO: 1256683 - RNA, 22 nt, Human
aucuuaauaagaugguccaauc

SEQ ID NO: 1256684 - RNA, 21 nt, Human
aaaagaaagcaaauuggacga

SEQ ID NO: 1256685 - RNA, 21 nt, Human
aaacagcguaauaacaagaac

SEQ ID NO: 1256686 - RNA, 19 nt, Human
aaacaggaaucaaaauggc

SEQ ID NO: 1256687 - RNA, 19 nt, Human
aaacaggaaucaaaauggc

SEQ ID NO: 1256688 - RNA, 21 nt, Human
aaagcaaaaaauaaacugaaa

SEQ ID NO: 1256689 - RNA, 22 nt, Human
aaagcagaaguaacagcaauau

SEQ ID NO: 1256690 - RNA, 21 nt, Human
aaccagcgcggccccgagcag

SEQ ID NO: 1256691 - RNA, 20 nt, Human
aagcaagacaaagcaauaga

SEQ ID NO: 1256692 - RNA, 18 nt, Human
acaaaacagcguaauaac

SEQ ID NO: 1256693 - RNA, 21 nt, Human
agaaaaugaaugcgagccaag

SEQ ID NO: 1256694 - RNA, 21 nt, Human
agacauagcagagaaggcaua

SEQ ID NO: 1256695 - RNA, 22 nt, Human
agcguaauaacaagaacgauca

SEQ ID NO: 1256696 - RNA, 23 nt, Human
auaaaaagcacuuguuuucuaca

SEQ ID NO: 1256697 - RNA, 24 nt, Human
auaacaacaaucuuucuuuucaau

SEQ ID NO: 1256698 - RNA, 19 nt, Human
aucauuuaaacaagucagu

SEQ ID NO: 1256699 - RNA, 20 nt, Human
auugugcuucuuuugcagaa

SEQ ID NO: 1256700 - RNA, 23 nt, Human
caaaacagcguaauaacaagaac

SEQ ID NO: 1256701 - RNA, 19 nt, Human
caaauaacugaugggugau

SEQ ID NO: 1256702 - RNA, 18 nt, Human
caacacuuacaaugggac

SEQ ID NO: 1256703 - RNA, 18 nt, Human
cacccucacaaauaacug

SEQ ID NO: 1256704 - RNA, 23 nt, Human
cacuuacaaugggacuguacaaa

SEQ ID NO: 1256705 - RNA, 26 nt, Human
caugaaacaauauucauauagaauaa

SEQ ID NO: 1256706 - RNA, 24 nt, Human
cccacauccccauugucucgcccc

SEQ ID NO: 1256707 - RNA, 18 nt, Human
ccccgaucucugccucuc

SEQ ID NO: 1256708 - RNA, 18 nt, Human
cccgagcagccgcggccg

SEQ ID NO: 1256709 - RNA, 20 nt, Human
ccgccgccgccuccucccgc

SEQ ID NO: 1256710 - RNA, 20 nt, Human
ccgccgccgccuccucccgc

SEQ ID NO: 1256711 - RNA, 22 nt, Human
ccgccgccgccuccucccgcuc

SEQ ID NO: 1256712 - RNA, 24 nt, Human
ccgccucgaccuccaacgccuccu

SEQ ID NO: 1256713 - RNA, 19 nt, Human
ccggcgccucggccuccuc

SEQ ID NO: 1256714 - RNA, 19 nt, Human
ccggcgccucggccuccuc

SEQ ID NO: 1256715 - RNA, 22 nt, Human
ccucccgcuccgcacucggggg

SEQ ID NO: 1256716 - RNA, 20 nt, Human
ccuccggccggccuccuccu

SEQ ID NO: 1256717 - RNA, 20 nt, Human
ccuccucggccgccgccgcc

SEQ ID NO: 1256718 - RNA, 22 nt, Human
ccucucauacuacgauuauuuc

SEQ ID NO: 1256719 - RNA, 25 nt, Human
ccuguagaagcucauaauaaauagc

SEQ ID NO: 1256720 - RNA, 22 nt, Human
cggaaaagacaaugaaaguuaa

SEQ ID NO: 1256721 - RNA, 19 nt, Human
cggccccgagcagccgcgg

SEQ ID NO: 1256722 - RNA, 21 nt, Human
cggccgccgccgccuccuccc

SEQ ID NO: 1256723 - RNA, 20 nt, Human
cucccgcgcccacaucccca

SEQ ID NO: 1256724 - RNA, 19 nt, Human
cuccgccucgaccuccaac

SEQ ID NO: 1256725 - RNA, 20 nt, Human
cuccgccucgaccuccaacc

SEQ ID NO: 1256726 - RNA, 23 nt, Human
cuccucggccgccgccgccuccu

SEQ ID NO: 1256727 - RNA, 22 nt, Human
cugcagaguacuuccaaaucca

SEQ ID NO: 1256728 - RNA, 23 nt, Human
cuuccaaauccaaacaaugguua

SEQ ID NO: 1256729 - RNA, 23 nt, Human
cuuuaaaguaaacauguauuacu

SEQ ID NO: 1256730 - RNA, 20 nt, Human
gacaaugaaaguuaaaaguc

SEQ ID NO: 1256731 - RNA, 21 nt, Human
gacaaugaaauguuuagcuac

SEQ ID NO: 1256732 - RNA, 21 nt, Human
gaccuccaacgccuccuccuc

SEQ ID NO: 1256733 - RNA, 22 nt, Human
gcagaguacuuccaaauccaaa

SEQ ID NO: 1256734 - RNA, 19 nt, Human
gccgccgccgccuccuccc

SEQ ID NO: 1256735 - RNA, 20 nt, Human
gcgaucgguuuuauucugcg

SEQ ID NO: 1256736 - RNA, 24 nt, Human
ggcgaucgaagcgggcggaaaaga

SEQ ID NO: 1256737 - RNA, 25 nt, Human
ggggagggcgcgcgcggagggggcg

SEQ ID NO: 1256738 - RNA, 19 nt, Human
guacaacaagcauaaugcc

SEQ ID NO: 1256739 - RNA, 19 nt, Human
guacuuccaaauccaaaca

SEQ ID NO: 1256740 - RNA, 19 nt, Human
uaaaauaaacgguaguacc

SEQ ID NO: 1256741 - RNA, 21 nt, Human
uaaagguuuuucuucacugca

SEQ ID NO: 1256742 - RNA, 19 nt, Human
uaacacagagaaaaagucu

SEQ ID NO: 1256743 - RNA, 25 nt, Human
uacaaaagaaagcaaauuggacgau

SEQ ID NO: 1256744 - RNA, 20 nt, Human
uagaagcucauaauaaauag

SEQ ID NO: 1256745 - RNA, 22 nt, Human
uagcaacagagaaguauaaauc

SEQ ID NO: 1256746 - RNA, 21 nt, Human
uauggcccaaugcuuaugucc

SEQ ID NO: 1256747 - RNA, 24 nt, Human
ucagggguuuaaaauuuuuuuccu

SEQ ID NO: 1256748 - RNA, 20 nt, Human
uccauuguuaacuguaaaag

SEQ ID NO: 1256749 - RNA, 22 nt, Human
uccuccuccggggccuccuccu

SEQ ID NO: 1256750 - RNA, 18 nt, Human
ucuauaauuagaaacaac

SEQ ID NO: 1256751 - RNA, 19 nt, Human
ucuuuuagcaaccugcugg

SEQ ID NO: 1256752 - RNA, 27 nt, Human
ugaaacaauauucauauagaauaaaca

SEQ ID NO: 1256753 - RNA, 22 nt, Human
ugacuucauaaaacauccuuua

SEQ ID NO: 1256754 - RNA, 19 nt, Human
ugagauuaacaaacuaugg

SEQ ID NO: 1256755 - RNA, 18 nt, Human
ugauaaaaaaucccggaa

SEQ ID NO: 1256756 - RNA, 21 nt, Human
ugggaggugcugcuaagccgg

SEQ ID NO: 1256757 - RNA, 26 nt, Human
ugugccaauugcuucuaauggaacag

SEQ ID NO: 1256758 - RNA, 23 nt, Human
uguugggugggguuauucauauu

SEQ ID NO: 1256759 - RNA, 19 nt, Human
uuaaagaaagcagaaguaa

SEQ ID NO: 1256760 - RNA, 20 nt, Human
uuaaugucacuacaaaagaa

SEQ ID NO: 1256761 - RNA, 22 nt, Human
uucgaccaaagcaaaaaauaaa

SEQ ID NO: 1256762 - RNA, 20 nt, Human
uuuuaaagaaagcagaagua

SEQ ID NO: 1256763 - RNA, 25 nt, Human
uuuuauagccaaauuuaaugucacu

SEQ ID NO: 1256764 - RNA, 30 nt, Human
aaaaaaacgaaaacaacaacaacaaaaaag

SEQ ID NO: 1256765 - RNA, 27 nt, Human
aaaaacgaaaacaacaacaacaaaaaa

SEQ ID NO: 1256766 - RNA, 22 nt, Human
aaacaacaacaacaaaaaagca

SEQ ID NO: 1256767 - RNA, 23 nt, Human
aaacaacaacaacaaaaaagcaa

SEQ ID NO: 1256768 - RNA, 19 nt, Human
aaacacccggcagccgccg

SEQ ID NO: 1256769 - RNA, 18 nt, Human
aaacuaugaaacugcccc

SEQ ID NO: 1256770 - RNA, 21 nt, Human
aaacuaugaaacugccccgcu

SEQ ID NO: 1256771 - RNA, 21 nt, Human
aacaaaaaagcaagaaucaag

SEQ ID NO: 1256772 - RNA, 18 nt, Human
aacgaaaacaacaacaac

SEQ ID NO: 1256773 - RNA, 21 nt, Human
aaucugcagagcugggccccc

SEQ ID NO: 1256774 - RNA, 23 nt, Human
acaacaaaaaagcaagaaucaag

SEQ ID NO: 1256775 - RNA, 21 nt, Human
acaacaacaacaaaaaagcaa

SEQ ID NO: 1256776 - RNA, 19 nt, Human
accaccaccaccaccacca

SEQ ID NO: 1256777 - RNA, 21 nt, Human
accaccaccaccaccaccauc

SEQ ID NO: 1256778 - RNA, 24 nt, Human
accaccaccaccaccaccaucacc

SEQ ID NO: 1256779 - RNA, 24 nt, Human
accaccaccaccaccaucaccacc

SEQ ID NO: 1256780 - RNA, 22 nt, Human
accaccaccaccaucaccacca

SEQ ID NO: 1256781 - RNA, 24 nt, Human
accaccaucaccaccaccaccacc

SEQ ID NO: 1256782 - RNA, 22 nt, Human
accaucaccaccaccaccacca

SEQ ID NO: 1256783 - RNA, 21 nt, Human
acgaaaacaacaacaacaaaa

SEQ ID NO: 1256784 - RNA, 19 nt, Human
acgcggccaacgacucgga

SEQ ID NO: 1256785 - RNA, 25 nt, Human
agaccaacacacuggcagaucagaa

SEQ ID NO: 1256786 - RNA, 18 nt, Human
agaggaggaggagggaga

SEQ ID NO: 1256787 - RNA, 20 nt, Human
agaggaggaggagggagagg

SEQ ID NO: 1256788 - RNA, 19 nt, Human
agaggaggaggaggggggc

SEQ ID NO: 1256789 - RNA, 18 nt, Human
aggaagaggaggaggagg

SEQ ID NO: 1256790 - RNA, 18 nt, Human
aggaagaggaggaggagg

SEQ ID NO: 1256791 - RNA, 18 nt, Human
aggaagaggaggaggagg

SEQ ID NO: 1256792 - RNA, 18 nt, Human
aggaagaggaggaggagg

SEQ ID NO: 1256793 - RNA, 19 nt, Human
aggaagaggaggaggaggg

SEQ ID NO: 1256794 - RNA, 20 nt, Human
aggaagaggaggaggagggg

SEQ ID NO: 1256795 - RNA, 23 nt, Human
aggaagaggaggaggaggggggc

SEQ ID NO: 1256796 - RNA, 21 nt, Human
aggaaggaauagaggggccca

SEQ ID NO: 1256797 - RNA, 18 nt, Human
aggaggaagaggaggagg

SEQ ID NO: 1256798 - RNA, 28 nt, Human
aggaggaggaagaggaggaggagggggg

SEQ ID NO: 1256799 - RNA, 19 nt, Human
aggaggaggaggaagagga

SEQ ID NO: 1256800 - RNA, 22 nt, Human
aggaggaggaggaggaagagga

SEQ ID NO: 1256801 - RNA, 21 nt, Human
aggaggaggagggagaggagg

SEQ ID NO: 1256802 - RNA, 21 nt, Human
aggaggaggagggagaggagg

SEQ ID NO: 1256803 - RNA, 26 nt, Human
aggaggaggaggggggcagcggggcc

SEQ ID NO: 1256804 - RNA, 22 nt, Human
aggaggaggggggcagcggggc

SEQ ID NO: 1256805 - RNA, 18 nt, Human
agggagaggaggaggagg

SEQ ID NO: 1256806 - RNA, 22 nt, Human
aggggcccagguacugaucugc

SEQ ID NO: 1256807 - RNA, 26 nt, Human
auuucaugggguuuccccccccccaa

SEQ ID NO: 1256808 - RNA, 20 nt, Human
auuuuuagcaaauaccccgg

SEQ ID NO: 1256809 - RNA, 20 nt, Human
caaacccccucuaaacuaug

SEQ ID NO: 1256810 - RNA, 19 nt, Human
caaauaccccggcucgcaa

SEQ ID NO: 1256811 - RNA, 20 nt, Human
caacaaaaaagcaagaauca

SEQ ID NO: 1256812 - RNA, 22 nt, Human
caacaacaacaaaaaagcaaga

SEQ ID NO: 1256813 - RNA, 25 nt, Human
caccaccaccaccaccaccgggccc

SEQ ID NO: 1256814 - RNA, 23 nt, Human
caccaccaccaccaccaucacca

SEQ ID NO: 1256815 - RNA, 22 nt, Human
caccaccaccaccaccgggccc

SEQ ID NO: 1256816 - RNA, 26 nt, Human
caccaccaccaccgggcccagccgcc

SEQ ID NO: 1256817 - RNA, 19 nt, Human
caccaccaccaucaccacc

SEQ ID NO: 1256818 - RNA, 19 nt, Human
caccaccaccgggcccagc

SEQ ID NO: 1256819 - RNA, 19 nt, Human
caccaucaccaccaccacc

SEQ ID NO: 1256820 - RNA, 19 nt, Human
caccccccucaccaccacc

SEQ ID NO: 1256821 - RNA, 23 nt, Human
caccccccucaccaccaccggcc

SEQ ID NO: 1256822 - RNA, 19 nt, Human
cagagucaccaccccccuc

SEQ ID NO: 1256823 - RNA, 22 nt, Human
cagcagagucaccaccccccuc

SEQ ID NO: 1256824 - RNA, 20 nt, Human
cagccccaucugggcagcuu

SEQ ID NO: 1256825 - RNA, 24 nt, Human
caucugggcagcuuucccgagagc

SEQ ID NO: 1256826 - RNA, 21 nt, Human
ccaccaccaccaccaccacca

SEQ ID NO: 1256827 - RNA, 26 nt, Human
ccaccaccaccaccaccaucaccacc

SEQ ID NO: 1256828 - RNA, 22 nt, Human
ccaccaccaccaccaccgggcc

SEQ ID NO: 1256829 - RNA, 21 nt, Human
ccaccaccaccaccaucacca

SEQ ID NO: 1256830 - RNA, 23 nt, Human
ccaccaccaccaucaccaccacc

SEQ ID NO: 1256831 - RNA, 20 nt, Human
ccaccaucaccaccaccacc

SEQ ID NO: 1256832 - RNA, 26 nt, Human
ccaccgagucggacuccagcuccggc

SEQ ID NO: 1256833 - RNA, 21 nt, Human
ccaccgggcccagccgccgca

SEQ ID NO: 1256834 - RNA, 27 nt, Human
cccccucaccaccaccggccgcagccc

SEQ ID NO: 1256835 - RNA, 23 nt, Human
ccgaccucaagaguagugucaaa

SEQ ID NO: 1256836 - RNA, 19 nt, Human
ccgcaccaccaccaccacc

SEQ ID NO: 1256837 - RNA, 22 nt, Human
ccgccgccgcgggggccacuug

SEQ ID NO: 1256838 - RNA, 24 nt, Human
ccgcugcaaccaaacccgcugcuu

SEQ ID NO: 1256839 - RNA, 20 nt, Human
ccucuaaacuaugaaacugc

SEQ ID NO: 1256840 - RNA, 20 nt, Human
cgacuccgaguccagcuccu

SEQ ID NO: 1256841 - RNA, 18 nt, Human
cgcaccaccaccaccacc

SEQ ID NO: 1256842 - RNA, 23 nt, Human
cgcaccaccaccaccaccaccac

SEQ ID NO: 1256843 - RNA, 22 nt, Human
cgccgugcaaacccccucuaaa

SEQ ID NO: 1256844 - RNA, 18 nt, Human
cucagaccaacacacugg

SEQ ID NO: 1256845 - RNA, 22 nt, Human
cugcagcagcgacuccgagucc

SEQ ID NO: 1256846 - RNA, 24 nt, Human
cugcauuucuuuucucuuucuccc

SEQ ID NO: 1256847 - RNA, 18 nt, Human
cugcccggccagccuggg

SEQ ID NO: 1256848 - RNA, 19 nt, Human
cuuucccgagagcugcagc

SEQ ID NO: 1256849 - RNA, 23 nt, Human
gaaaacaacaacaacaaaaaagc

SEQ ID NO: 1256850 - RNA, 24 nt, Human
gaccacgcggccaacgacucggau

SEQ ID NO: 1256851 - RNA, 24 nt, Human
gaggaggaggggggcagcggggcc

SEQ ID NO: 1256852 - RNA, 22 nt, Human
gcaaacccccucuaaacuauga

SEQ ID NO: 1256853 - RNA, 21 nt, Human
gcaccaccaccaccaccacca

SEQ ID NO: 1256854 - RNA, 26 nt, Human
gcagagcauccgauucaggcgcacca

SEQ ID NO: 1256855 - RNA, 24 nt, Human
gcccgccuccgcaccaccaccacc

SEQ ID NO: 1256856 - RNA, 21 nt, Human
gccgcgggggccacuugccug

SEQ ID NO: 1256857 - RNA, 20 nt, Human
gcucgcacuacccggagauc

SEQ ID NO: 1256858 - RNA, 24 nt, Human
gcugcaaccaaacccgcugcuuua

SEQ ID NO: 1256859 - RNA, 18 nt, Human
ggaggaggaggaagagga

SEQ ID NO: 1256860 - RNA, 29 nt, Human
ggaggaggaggaagaggaggaggaggggg

SEQ ID NO: 1256861 - RNA, 20 nt, Human
ggaggaggaggggggcagcg

SEQ ID NO: 1256862 - RNA, 22 nt, Human
ggaggaggaggggggcagcggg

SEQ ID NO: 1256863 - RNA, 18 nt, Human
ggcagcuuucccgagagc

SEQ ID NO: 1256864 - RNA, 22 nt, Human
uaacauacauacauguguaugu

SEQ ID NO: 1256865 - RNA, 22 nt, Human
uacauguguauguaugcgucac

SEQ ID NO: 1256866 - RNA, 23 nt, Human
uagcaaauaccccggcucgcacu

SEQ ID NO: 1256867 - RNA, 22 nt, Human
ucaacggcuucugcccgccucc

SEQ ID NO: 1256868 - RNA, 25 nt, Human
ucaccaccaccaccaccaccaccgg

SEQ ID NO: 1256869 - RNA, 27 nt, Human
ucaccaccaccggccgcagccccaucu

SEQ ID NO: 1256870 - RNA, 19 nt, Human
uccaccgagucggacucca

SEQ ID NO: 1256871 - RNA, 21 nt, Human
uccgcaccaccaccaccacca

SEQ ID NO: 1256872 - RNA, 21 nt, Human
ucgcacuacccggagaucgug

SEQ ID NO: 1256873 - RNA, 19 nt, Human
ucggagccugcugugcagc

SEQ ID NO: 1256874 - RNA, 27 nt, Human
ucgugcgcucgccgugcaaaccccucc

SEQ ID NO: 1256875 - RNA, 21 nt, Human
ucugcaagccucccagcgugc

SEQ ID NO: 1256876 - RNA, 18 nt, Human
ucugcccgccuccgcacc

SEQ ID NO: 1256877 - RNA, 22 nt, Human
ugaaacugccccgcuccaggga

SEQ ID NO: 1256878 - RNA, 19 nt, Human
ugagacacacgcagcaucu

SEQ ID NO: 1256879 - RNA, 28 nt, Human
ugaggauuaacauacauacauguguaug

SEQ ID NO: 1256880 - RNA, 25 nt, Human
ugcacaggaugguuuguacaagucc

SEQ ID NO: 1256881 - RNA, 21 nt, Human
ugcagcaaacacccggcagcc

SEQ ID NO: 1256882 - RNA, 21 nt, Human
uguauguaugcgucacguaua

SEQ ID NO: 1256883 - RNA, 23 nt, Human
uguauguaugcgucacguauaua

SEQ ID NO: 1256884 - RNA, 18 nt, Human
uguguauguaugcgucac

SEQ ID NO: 1256885 - RNA, 25 nt, Human
uguguauguaugcgucacguauaua

SEQ ID NO: 1256886 - RNA, 18 nt, Human
uuccagugaagucagcuc

SEQ ID NO: 1256887 - RNA, 24 nt, Human
uucuuuucucuuucucccuucaca

SEQ ID NO: 1256888 - RNA, 24 nt, Human
aaacauggccacagcagaugccgc

SEQ ID NO: 1256889 - RNA, 21 nt, Human
aacauggccacagcagaugcc

SEQ ID NO: 1256890 - RNA, 19 nt, Human
aauccuuaacccaggaccc

SEQ ID NO: 1256891 - RNA, 19 nt, Human
acacgguggcuggcgugca

SEQ ID NO: 1256892 - RNA, 21 nt, Human
acccagagaaccucaacccaa

SEQ ID NO: 1256893 - RNA, 18 nt, Human
acugagcgaugacuuucu

SEQ ID NO: 1256894 - RNA, 24 nt, Human
agaauaaggaguuuggaacuugaa

SEQ ID NO: 1256895 - RNA, 22 nt, Human
aggacaggcugagccucacugu

SEQ ID NO: 1256896 - RNA, 21 nt, Human
aggacccagagaaccucaacc

SEQ ID NO: 1256897 - RNA, 23 nt, Human
aggagagcuugaaggcaagaggc

SEQ ID NO: 1256898 - RNA, 20 nt, Human
aggaugcuuccagccugaaa

SEQ ID NO: 1256899 - RNA, 19 nt, Human
aggcacaggcacugggguc

SEQ ID NO: 1256900 - RNA, 18 nt, Human
aggcgccugauaaaaucc

SEQ ID NO: 1256901 - RNA, 20 nt, Human
aguccucguggcagcagccc

SEQ ID NO: 1256902 - RNA, 18 nt, Human
auccaguguguucugagc

SEQ ID NO: 1256903 - RNA, 19 nt, Human
auccgaaacaguuuugagg

SEQ ID NO: 1256904 - RNA, 24 nt, Human
augaaacaggacaggcugagccuc

SEQ ID NO: 1256905 - RNA, 20 nt, Human
caaaacauggccacagcaga

SEQ ID NO: 1256906 - RNA, 23 nt, Human
caccugccuccugagcugccggg

SEQ ID NO: 1256907 - RNA, 23 nt, Human
cagaauccuuaacccaggaccca

SEQ ID NO: 1256908 - RNA, 19 nt, Human
cagcagaugccgcuuuggc

SEQ ID NO: 1256909 - RNA, 18 nt, Human
cagcccugugccaccccc

SEQ ID NO: 1256910 - RNA, 23 nt, Human
cagccugaaaugauucauccccu

SEQ ID NO: 1256911 - RNA, 18 nt, Human
caggagagcuugaaggca

SEQ ID NO: 1256912 - RNA, 19 nt, Human
cauuacacccauuuucagc

SEQ ID NO: 1256913 - RNA, 21 nt, Human
ccaacccccucagucccugcc

SEQ ID NO: 1256914 - RNA, 20 nt, Human
ccagccccgugcugguccca

SEQ ID NO: 1256915 - RNA, 21 nt, Human
ccagugccuuccccuccuucc

SEQ ID NO: 1256916 - RNA, 22 nt, Human
cccagcccugugccacccccuc

SEQ ID NO: 1256917 - RNA, 19 nt, Human
cccccgcaaaacauggcca

SEQ ID NO: 1256918 - RNA, 20 nt, Human
ccccgugcuggucccagccc

SEQ ID NO: 1256919 - RNA, 22 nt, Human
cccgcaaaacauggccacagca

SEQ ID NO: 1256920 - RNA, 21 nt, Human
cccgugcuggucccagcccug

SEQ ID NO: 1256921 - RNA, 19 nt, Human
cccugagcccucaauuccc

SEQ ID NO: 1256922 - RNA, 20 nt, Human
ccucugcaggcuccacuccc

SEQ ID NO: 1256923 - RNA, 23 nt, Human
ccugcaaugcugcugcccagaaa

SEQ ID NO: 1256924 - RNA, 19 nt, Human
ccuucaucuuccugccucc

SEQ ID NO: 1256925 - RNA, 23 nt, Human
cgaugacuuucucucccccgcaa

SEQ ID NO: 1256926 - RNA, 25 nt, Human
cugugccacccccucugcaggcucc

SEQ ID NO: 1256927 - RNA, 23 nt, Human
cuuccagccugaaaugauucauc

SEQ ID NO: 1256928 - RNA, 19 nt, Human
cuuccugccacgccauuuc

SEQ ID NO: 1256929 - RNA, 22 nt, Human
gaacuugaacgacggcaaagug

SEQ ID NO: 1256930 - RNA, 22 nt, Human
gaaguucccggcauugcucaca

SEQ ID NO: 1256931 - RNA, 21 nt, Human
gagaggaaagagcagacauuu

SEQ ID NO: 1256932 - RNA, 22 nt, Human
gaggugggauguucaaagauuc

SEQ ID NO: 1256933 - RNA, 23 nt, Human
gaucauuacacccauuuucagca

SEQ ID NO: 1256934 - RNA, 26 nt, Human
gcagaauccuuaacccaggacccaga

SEQ ID NO: 1256935 - RNA, 20 nt, Human
gcccaacccccucagucccu

SEQ ID NO: 1256936 - RNA, 23 nt, Human
gcccaugcguggaagugagggag

SEQ ID NO: 1256937 - RNA, 22 nt, Human
gcccucaauuccccccaguccu

SEQ ID NO: 1256938 - RNA, 18 nt, Human
gccggaaaacguaaaacc

SEQ ID NO: 1256939 - RNA, 23 nt, Human
gcgccugauaaaaucccagggac

SEQ ID NO: 1256940 - RNA, 22 nt, Human
ggacccagagaaccucaaccca

SEQ ID NO: 1256941 - RNA, 23 nt, Human
ggccuggguggcagggcuggacc

SEQ ID NO: 1256942 - RNA, 27 nt, Human
gggccucgcuggucuuggguuggccuu

SEQ ID NO: 1256943 - RNA, 21 nt, Human
gggcucagaggcacaggcacu

SEQ ID NO: 1256944 - RNA, 22 nt, Human
ggugcaggagagcuugaaggca

SEQ ID NO: 1256945 - RNA, 22 nt, Human
uaaaaucccagggacugaccga

SEQ ID NO: 1256946 - RNA, 21 nt, Human
uaacuccucggcccagugccu

SEQ ID NO: 1256947 - RNA, 23 nt, Human
uagaacucagccccguugggacc

SEQ ID NO: 1256948 - RNA, 20 nt, Human
uauagcugagaggaaagagc

SEQ ID NO: 1256949 - RNA, 19 nt, Human
ucaaguggugaaaaggaaa

SEQ ID NO: 1256950 - RNA, 20 nt, Human
ucagaggcacaggcacuggg

SEQ ID NO: 1256951 - RNA, 20 nt, Human
ucagaggcacaggcacuggg

SEQ ID NO: 1256952 - RNA, 18 nt, Human
ucaggcuccguuuccuag

SEQ ID NO: 1256953 - RNA, 22 nt, Human
ucaucaaaagcuuuauugugga

SEQ ID NO: 1256954 - RNA, 23 nt, Human
ucccagcccugugccacccccuc

SEQ ID NO: 1256955 - RNA, 20 nt, Human
ucccagggacugaccgaguu

SEQ ID NO: 1256956 - RNA, 23 nt, Human
ucccccgcaaaacauggccacag

SEQ ID NO: 1256957 - RNA, 19 nt, Human
uccuuccacaucagcuucc

SEQ ID NO: 1256958 - RNA, 21 nt, Human
ucguggcagcagcccaacccc

SEQ ID NO: 1256959 - RNA, 24 nt, Human
ucuuggguuggccuuugcuauuug

SEQ ID NO: 1256960 - RNA, 24 nt, Human
ugaaacaggacaggcugagccuca

SEQ ID NO: 1256961 - RNA, 22 nt, Human
ugagaggaaagagcagacauuu

SEQ ID NO: 1256962 - RNA, 23 nt, Human
ugagccccaauuucuuccuuaau

SEQ ID NO: 1256963 - RNA, 24 nt, Human
ugaggugggauguucaaagauucc

SEQ ID NO: 1256964 - RNA, 24 nt, Human
ugcagaauccuuaacccaggaccc

SEQ ID NO: 1256965 - RNA, 19 nt, Human
ugcccugcucugucacagg

SEQ ID NO: 1256966 - RNA, 19 nt, Human
ugccgggccucgcuggucu

SEQ ID NO: 1256967 - RNA, 22 nt, Human
ugccgggccucgcuggucuugg

SEQ ID NO: 1256968 - RNA, 27 nt, Human
ugcugcccagaaaugggcaccucagag

SEQ ID NO: 1256969 - RNA, 21 nt, Human
ugcuuccagccugaaaugauu

SEQ ID NO: 1256970 - RNA, 22 nt, Human
ugcuuccagccugaaaugauuc

SEQ ID NO: 1256971 - RNA, 21 nt, Human
uggaacuucuaagccauggau

SEQ ID NO: 1256972 - RNA, 19 nt, Human
uggaagugagggagcuggg

SEQ ID NO: 1256973 - RNA, 19 nt, Human
uggauccaguguguucuga

SEQ ID NO: 1256974 - RNA, 26 nt, Human
uggauuucuagcauccgaaacaguuu

SEQ ID NO: 1256975 - RNA, 24 nt, Human
uggcagcagcccaacccccucagu

SEQ ID NO: 1256976 - RNA, 24 nt, Human
uggcuuaauaaccggugcaggaga

SEQ ID NO: 1256977 - RNA, 20 nt, Human
ugggguccagugcauuggcu

SEQ ID NO: 1256978 - RNA, 19 nt, Human
uggguuggccuuugcuauu

SEQ ID NO: 1256979 - RNA, 22 nt, Human
uggugcccugcucugucacagg

SEQ ID NO: 1256980 - RNA, 20 nt, Human
ugucagauaggaaagcucuc

SEQ ID NO: 1256981 - RNA, 21 nt, Human
ugucagauaggaaagcucucu

SEQ ID NO: 1256982 - RNA, 25 nt, Human
ugugccacccccucugcaggcucca

SEQ ID NO: 1256983 - RNA, 28 nt, Human
uuaacaguccuucaucuuccugccuccc

SEQ ID NO: 1256984 - RNA, 19 nt, Human
uuccugccuccccugagcc

SEQ ID NO: 1256985 - RNA, 20 nt, Human
uuuccuagccaugaucucag

SEQ ID NO: 1256986 - RNA, 20 nt, Human
aaaauaccguaauuagaaua

SEQ ID NO: 1256987 - RNA, 22 nt, Human
aauacaaggagagaacacuuug

SEQ ID NO: 1256988 - RNA, 20 nt, Human
gagaacacuuugcggaaggc

SEQ ID NO: 1256989 - RNA, 18 nt, Human
ggaaggccuaggguaagg

SEQ ID NO: 1256990 - RNA, 20 nt, Human
uguggggcuggauucuaccc

SEQ ID NO: 1256991 - RNA, 25 nt, Human
uuaaaaauaccguaauuagaauaau

SEQ ID NO: 1256992 - RNA, 20 nt, Human
uuuuaaggaaauuaaaaaua

SEQ ID NO: 1256993 - RNA, 24 nt, Human
acguaggugcccagcugguccagc

SEQ ID NO: 1256994 - RNA, 18 nt, Human
agacccggaggcuguacu

SEQ ID NO: 1256995 - RNA, 19 nt, Human
aggugcccagcugguccag

SEQ ID NO: 1256996 - RNA, 21 nt, Human
cagagggcgggggcgaagacg

SEQ ID NO: 1256997 - RNA, 20 nt, Human
cagcaggaugugacaggccc

SEQ ID NO: 1256998 - RNA, 21 nt, Human
ccagcaggaugugacaggccc

SEQ ID NO: 1256999 - RNA, 22 nt, Human
ccagcuggagccgcuugacugc

SEQ ID NO: 1257000 - RNA, 22 nt, Human
cggaggcuguacuccagggagg

SEQ ID NO: 1257001 - RNA, 21 nt, Human
cuccagcaccuccuucagugc

SEQ ID NO: 1257002 - RNA, 22 nt, Human
cuccagggaggugcagagggcg

SEQ ID NO: 1257003 - RNA, 22 nt, Human
cuccucauccagggucaccacc

SEQ ID NO: 1257004 - RNA, 23 nt, Human
cuggcaguagcaggguguguucu

SEQ ID NO: 1257005 - RNA, 18 nt, Human
gcaccuccuucagugcua

SEQ ID NO: 1257006 - RNA, 18 nt, Human
gcaggaugugacaggccc

SEQ ID NO: 1257007 - RNA, 21 nt, Human
ggaggugcagagggcgggggc

SEQ ID NO: 1257008 - RNA, 22 nt, Human
gggaggugcagagggcgggggc

SEQ ID NO: 1257009 - RNA, 23 nt, Human
gguccagcaggaugugacaggcc

SEQ ID NO: 1257010 - RNA, 23 nt, Human
uccgcuccagcuccagcaccucc

SEQ ID NO: 1257011 - RNA, 19 nt, Human
uccuucagugcuacaggcg

SEQ ID NO: 1257012 - RNA, 19 nt, Human
aaaggacacugaagcccag

SEQ ID NO: 1257013 - RNA, 23 nt, Human
aaaggccaggaugugcugagacg

SEQ ID NO: 1257014 - RNA, 21 nt, Human
aacccaaagagccucagaccg

SEQ ID NO: 1257015 - RNA, 23 nt, Human
aacccuagacguccaaaccuggg

SEQ ID NO: 1257016 - RNA, 23 nt, Human
aacccuggcaacccugcccacug

SEQ ID NO: 1257017 - RNA, 24 nt, Human
aagaacagggaggaggggcacggc

SEQ ID NO: 1257018 - RNA, 22 nt, Human
aagaagccccacgagcuacuga

SEQ ID NO: 1257019 - RNA, 19 nt, Human
aagagcucccugcaccaaa

SEQ ID NO: 1257020 - RNA, 22 nt, Human
aagcagcuucugaggguggggu

SEQ ID NO: 1257021 - RNA, 20 nt, Human
aagggacccggcucagcugc

SEQ ID NO: 1257022 - RNA, 21 nt, Human
acagccaggccacccgccucc

SEQ ID NO: 1257023 - RNA, 18 nt, Human
acagugaaaacccugucu

SEQ ID NO: 1257024 - RNA, 23 nt, Human
acccucaggagaaccccuacccc

SEQ ID NO: 1257025 - RNA, 22 nt, Human
acccuggcaacccugcccacug

SEQ ID NO: 1257026 - RNA, 18 nt, Human
acccugugggcucaggga

SEQ ID NO: 1257027 - RNA, 19 nt, Human
acuccuuggcuuuauggau

SEQ ID NO: 1257028 - RNA, 22 nt, Human
acugugagagaaggcagaggga

SEQ ID NO: 1257029 - RNA, 18 nt, Human
acuucugggccacauccc

SEQ ID NO: 1257030 - RNA, 19 nt, Human
agaaccccuaccccugagc

SEQ ID NO: 1257031 - RNA, 24 nt, Human
agagaaggcagugauaugccugaa

SEQ ID NO: 1257032 - RNA, 18 nt, Human
agagcucccugcaccaaa

SEQ ID NO: 1257033 - RNA, 18 nt, Human
agaggagcacacacacac

SEQ ID NO: 1257034 - RNA, 19 nt, Human
agagugcccuggagggucc

SEQ ID NO: 1257035 - RNA, 19 nt, Human
agauucuggauuccuggcc

SEQ ID NO: 1257036 - RNA, 22 nt, Human
agcacuccuuggcuuuauggau

SEQ ID NO: 1257037 - RNA, 19 nt, Human
agcagcuucugaggguggg

SEQ ID NO: 1257038 - RNA, 18 nt, Human
agccaggcuggggacgcu

SEQ ID NO: 1257039 - RNA, 19 nt, Human
agccuccuucuccacuccu

SEQ ID NO: 1257040 - RNA, 25 nt, Human
aggaaugcuaaagguuauuuauagg

SEQ ID NO: 1257041 - RNA, 20 nt, Human
aggcagagggagaggcacgu

SEQ ID NO: 1257042 - RNA, 21 nt, Human
aggcagagggagaggcacgua

SEQ ID NO: 1257043 - RNA, 19 nt, Human
aggcagcugcacagggcag

SEQ ID NO: 1257044 - RNA, 24 nt, Human
aggccuggccccucagcagcccug

SEQ ID NO: 1257045 - RNA, 18 nt, Human
aggcuggggacgcuggcu

SEQ ID NO: 1257046 - RNA, 19 nt, Human
agggaagccaggcugggga

SEQ ID NO: 1257047 - RNA, 26 nt, Human
agggcccacccacuccagcccucagc

SEQ ID NO: 1257048 - RNA, 21 nt, Human
aguugauucuuggucuuugga

SEQ ID NO: 1257049 - RNA, 21 nt, Human
aucccaacuuucuuaauccag

SEQ ID NO: 1257050 - RNA, 21 nt, Human
aucccuggggcccugcacccc

SEQ ID NO: 1257051 - RNA, 21 nt, Human
aucccuuucuaggagccacca

SEQ ID NO: 1257052 - RNA, 20 nt, Human
augcccguggaggacucccc

SEQ ID NO: 1257053 - RNA, 21 nt, Human
caaagcuccuggucaccuccc

SEQ ID NO: 1257054 - RNA, 21 nt, Human
caagcuccuguccugggggca

SEQ ID NO: 1257055 - RNA, 19 nt, Human
cacagccaggccacccgcc

SEQ ID NO: 1257056 - RNA, 22 nt, Human
cacagccaggccacccgccucc

SEQ ID NO: 1257057 - RNA, 23 nt, Human
caccaaacccuagacguccaaac

SEQ ID NO: 1257058 - RNA, 25 nt, Human
caccagaccaaaaccagacuggaac

SEQ ID NO: 1257059 - RNA, 18 nt, Human
cacccacuccagcccuca

SEQ ID NO: 1257060 - RNA, 19 nt, Human
caccccccucucccgggca

SEQ ID NO: 1257061 - RNA, 26 nt, Human
cacgcugcucuagaggcugcugggcu

SEQ ID NO: 1257062 - RNA, 22 nt, Human
cacggcagaucacaaggucccc

SEQ ID NO: 1257063 - RNA, 23 nt, Human
cagaagacaggcacaccaaaccc

SEQ ID NO: 1257064 - RNA, 21 nt, Human
cagaccaaaaccagacuggaa

SEQ ID NO: 1257065 - RNA, 19 nt, Human
cagacugcccucaaagcca

SEQ ID NO: 1257066 - RNA, 18 nt, Human
cagccuccgggcccagcc

SEQ ID NO: 1257067 - RNA, 21 nt, Human
cagcuagagaggacuucucag

SEQ ID NO: 1257068 - RNA, 21 nt, Human
caggcacaccaaacccuagac

SEQ ID NO: 1257069 - RNA, 22 nt, Human
caguggcugcucggagaccugc

SEQ ID NO: 1257070 - RNA, 20 nt, Human
cauaugaagcacagccaggc

SEQ ID NO: 1257071 - RNA, 19 nt, Human
cauggaggcaccagggucg

SEQ ID NO: 1257072 - RNA, 21 nt, Human
ccacgcugcucuagaggcugc

SEQ ID NO: 1257073 - RNA, 19 nt, Human
ccagaccaaaaccagacug

SEQ ID NO: 1257074 - RNA, 23 nt, Human
ccaggaguccagauguaucuccc

SEQ ID NO: 1257075 - RNA, 19 nt, Human
cccacacguguucaugggc

SEQ ID NO: 1257076 - RNA, 19 nt, Human
cccacagccaggccgcacc

SEQ ID NO: 1257077 - RNA, 20 nt, Human
cccacccacuccagcccuca

SEQ ID NO: 1257078 - RNA, 20 nt, Human
ccccacgagcuacugagucc

SEQ ID NO: 1257079 - RNA, 21 nt, Human
ccccagcggggcuggugggug

SEQ ID NO: 1257080 - RNA, 20 nt, Human
ccccuacagaagccuagaac

SEQ ID NO: 1257081 - RNA, 25 nt, Human
ccccucgaacagguugggugggggu

SEQ ID NO: 1257082 - RNA, 18 nt, Human
ccccugagcucuggagcc

SEQ ID NO: 1257083 - RNA, 21 nt, Human
ccccugagcucuggagccggg

SEQ ID NO: 1257084 - RNA, 23 nt, Human
ccccugagcucuggagccggggg

SEQ ID NO: 1257085 - RNA, 21 nt, Human
ccccugaugcaggccuggccc

SEQ ID NO: 1257086 - RNA, 22 nt, Human
cccgugccaugcagggccccuc

SEQ ID NO: 1257087 - RNA, 24 nt, Human
cccugcaccccccucucccgggca

SEQ ID NO: 1257088 - RNA, 21 nt, Human
ccguggaggacuccccucccc

SEQ ID NO: 1257089 - RNA, 24 nt, Human
ccuaaaaccugcccuccucucagg

SEQ ID NO: 1257090 - RNA, 18 nt, Human
ccucaaagccacgugacc

SEQ ID NO: 1257091 - RNA, 21 nt, Human
ccuccgggcccagccagagcc

SEQ ID NO: 1257092 - RNA, 24 nt, Human
ccuccgggcccagccagagccuag

SEQ ID NO: 1257093 - RNA, 21 nt, Human
ccuccuucuccacuccugggc

SEQ ID NO: 1257094 - RNA, 24 nt, Human
ccugcaccaaagcuccuggucacc

SEQ ID NO: 1257095 - RNA, 21 nt, Human
ccugcacccucaggagaaccc

SEQ ID NO: 1257096 - RNA, 21 nt, Human
ccuggccccucagcagcccug

SEQ ID NO: 1257097 - RNA, 21 nt, Human
cggcagaucacaagguccccu

SEQ ID NO: 1257098 - RNA, 22 nt, Human
cgggggcacugugagagaaggc

SEQ ID NO: 1257099 - RNA, 21 nt, Human
cggggugggugagaggagggu

SEQ ID NO: 1257100 - RNA, 23 nt, Human
cuaaccagcuaaaucuagacagu

SEQ ID NO: 1257101 - RNA, 21 nt, Human
cucaacccuggcaacccugcc

SEQ ID NO: 1257102 - RNA, 22 nt, Human
cucacaacuggccugagcaguc

SEQ ID NO: 1257103 - RNA, 26 nt, Human
cuccaggcaaguccuccuuugcccac

SEQ ID NO: 1257104 - RNA, 24 nt, Human
cuccccuacuucaucucucuguuu

SEQ ID NO: 1257105 - RNA, 21 nt, Human
cucccgggcauauaaccaugu

SEQ ID NO: 1257106 - RNA, 23 nt, Human
cugaagcccagagaaggcaguga

SEQ ID NO: 1257107 - RNA, 18 nt, Human
cugacugacaccgggaag

SEQ ID NO: 1257108 - RNA, 19 nt, Human
cugcaccccccucucccgg

SEQ ID NO: 1257109 - RNA, 24 nt, Human
cugcaccccccucucccgggcaua

SEQ ID NO: 1257110 - RNA, 24 nt, Human
cugcggcccuaaaaccugcccucc

SEQ ID NO: 1257111 - RNA, 19 nt, Human
cuggccaucaagagagcac

SEQ ID NO: 1257112 - RNA, 20 nt, Human
cuggccaucaagagagcacc

SEQ ID NO: 1257113 - RNA, 21 nt, Human
cuggcucacaacuggccugag

SEQ ID NO: 1257114 - RNA, 25 nt, Human
cuuagucucagccuccgggcccagc

SEQ ID NO: 1257115 - RNA, 22 nt, Human
gaaaaggacacugaagcccaga

SEQ ID NO: 1257116 - RNA, 23 nt, Human
gaacagguuggguggggguggua

SEQ ID NO: 1257117 - RNA, 21 nt, Human
gagccaccagaccaaaaccag

SEQ ID NO: 1257118 - RNA, 21 nt, Human
gagcucccugcaccaaagcuc

SEQ ID NO: 1257119 - RNA, 21 nt, Human
gagcucuggagccgggggcac

SEQ ID NO: 1257120 - RNA, 18 nt, Human
gaggcaccagggucgaaa

SEQ ID NO: 1257121 - RNA, 18 nt, Human
gagggcccacccacucca

SEQ ID NO: 1257122 - RNA, 24 nt, Human
gaggggaauggcacccccugucac

SEQ ID NO: 1257123 - RNA, 21 nt, Human
gaggguccaggagaugagaag

SEQ ID NO: 1257124 - RNA, 22 nt, Human
gagggugggguggggaggacag

SEQ ID NO: 1257125 - RNA, 20 nt, Human
gccaccagaccaaaaccaga

SEQ ID NO: 1257126 - RNA, 24 nt, Human
gcccacccacuccagcccucagca

SEQ ID NO: 1257127 - RNA, 19 nt, Human
gcccuaaaaccugcccucc

SEQ ID NO: 1257128 - RNA, 22 nt, Human
gcccuggaggguccaggagaug

SEQ ID NO: 1257129 - RNA, 22 nt, Human
ggaaaccagcuucucagccucc

SEQ ID NO: 1257130 - RNA, 21 nt, Human
ggagaaaccaagguuggggaa

SEQ ID NO: 1257131 - RNA, 21 nt, Human
ggaugagggugucagggcugg

SEQ ID NO: 1257132 - RNA, 19 nt, Human
ggcagggguccagcccuuu

SEQ ID NO: 1257133 - RNA, 20 nt, Human
ggcugaggaggggaugaggg

SEQ ID NO: 1257134 - RNA, 18 nt, Human
gggcucagggagggcaga

SEQ ID NO: 1257135 - RNA, 22 nt, Human
gggcugaggaggggaugagggu

SEQ ID NO: 1257136 - RNA, 20 nt, Human
gggugggggugguaugugcu

SEQ ID NO: 1257137 - RNA, 18 nt, Human
ggugggguggggaggaca

SEQ ID NO: 1257138 - RNA, 18 nt, Human
ggugggugagaggagggu

SEQ ID NO: 1257139 - RNA, 21 nt, Human
gucaccuccccuaagggaccc

SEQ ID NO: 1257140 - RNA, 21 nt, Human
gugguaugugcuguccccuca

SEQ ID NO: 1257141 - RNA, 18 nt, Human
uacaauaggaaugcuaaa

SEQ ID NO: 1257142 - RNA, 20 nt, Human
uaccccugagcucuggagcc

SEQ ID NO: 1257143 - RNA, 19 nt, Human
uagaacagugugucugaac

SEQ ID NO: 1257144 - RNA, 19 nt, Human
uagccccugaugcaggccu

SEQ ID NO: 1257145 - RNA, 22 nt, Human
uagcggggugggugagaggagg

SEQ ID NO: 1257146 - RNA, 19 nt, Human
uauaggaggugccugugga

SEQ ID NO: 1257147 - RNA, 21 nt, Human
uaugugcuguccccucaaccc

SEQ ID NO: 1257148 - RNA, 20 nt, Human
ucacugccuuugucugaggc

SEQ ID NO: 1257149 - RNA, 20 nt, Human
ucagccuccuucuccacucc

SEQ ID NO: 1257150 - RNA, 21 nt, Human
uccacauggaggcaccagggu

SEQ ID NO: 1257151 - RNA, 20 nt, Human
uccagauguaucucccuggg

SEQ ID NO: 1257152 - RNA, 22 nt, Human
uccauggcagggaagccaggcu

SEQ ID NO: 1257153 - RNA, 19 nt, Human
uccccuacagaagccuaga

SEQ ID NO: 1257154 - RNA, 22 nt, Human
uccccucaacccuggcaacccu

SEQ ID NO: 1257155 - RNA, 27 nt, Human
uccccugcacccucaggagaaccccua

SEQ ID NO: 1257156 - RNA, 20 nt, Human
ucccugcaccaaagcuccug

SEQ ID NO: 1257157 - RNA, 21 nt, Human
uccuucuccacuccugggcau

SEQ ID NO: 1257158 - RNA, 18 nt, Human
ucuagacagugaaaaccc

SEQ ID NO: 1257159 - RNA, 23 nt, Human
ucucccuggggcugugggaggga

SEQ ID NO: 1257160 - RNA, 19 nt, Human
ucuggagccgggggcacug

SEQ ID NO: 1257161 - RNA, 21 nt, Human
ucuuggucuuuggacugccag

SEQ ID NO: 1257162 - RNA, 18 nt, Human
ucuuuggacugccaggcu

SEQ ID NO: 1257163 - RNA, 21 nt, Human
ugaaaaggacacugaagccca

SEQ ID NO: 1257164 - RNA, 25 nt, Human
ugaaaaggacacugaagcccagaga

SEQ ID NO: 1257165 - RNA, 20 nt, Human
ugaagcacagccaggccacc

SEQ ID NO: 1257166 - RNA, 19 nt, Human
ugaccgaggcccacacgug

SEQ ID NO: 1257167 - RNA, 20 nt, Human
ugaccgaggcccacacgugu

SEQ ID NO: 1257168 - RNA, 23 nt, Human
ugagacgggucccaguggcugcu

SEQ ID NO: 1257169 - RNA, 19 nt, Human
ugagggugggguggggagg

SEQ ID NO: 1257170 - RNA, 23 nt, Human
ugagggugggguggggaggacag

SEQ ID NO: 1257171 - RNA, 21 nt, Human
ugcaccaaagcuccuggucac

SEQ ID NO: 1257172 - RNA, 23 nt, Human
ugccaggcagcugcacagggcag

SEQ ID NO: 1257173 - RNA, 21 nt, Human
ugcccguggaggacuccccuc

SEQ ID NO: 1257174 - RNA, 18 nt, Human
ugcccuagggucacugcc

SEQ ID NO: 1257175 - RNA, 18 nt, Human
ugccuggagguguugggg

SEQ ID NO: 1257176 - RNA, 21 nt, Human
ugccuggagguguuggggaag

SEQ ID NO: 1257177 - RNA, 22 nt, Human
ugcucuagaggcugcugggcug

SEQ ID NO: 1257178 - RNA, 21 nt, Human
uggcaacccugcccacuggga

SEQ ID NO: 1257179 - RNA, 21 nt, Human
uggcagggaagccaggcuggg

SEQ ID NO: 1257180 - RNA, 20 nt, Human
uggccugagcaguccuccuc

SEQ ID NO: 1257181 - RNA, 25 nt, Human
uggccugagcaguccuccucuuuca

SEQ ID NO: 1257182 - RNA, 21 nt, Human
uggcugcucggagaccugcug

SEQ ID NO: 1257183 - RNA, 22 nt, Human
ugggcugaggaggggaugaggg

SEQ ID NO: 1257184 - RNA, 22 nt, Human
ugggguggggaggacagaaaag

SEQ ID NO: 1257185 - RNA, 18 nt, Human
ugggugggggugguaugu

SEQ ID NO: 1257186 - RNA, 21 nt, Human
uggucagacugcccucaaagc

SEQ ID NO: 1257187 - RNA, 19 nt, Human
uguggagaucagagcuggg

SEQ ID NO: 1257188 - RNA, 21 nt, Human
uguuggggaagcgggcaccug

SEQ ID NO: 1257189 - RNA, 23 nt, Human
uuaauggcagauuugcaaguuga

SEQ ID NO: 1257190 - RNA, 18 nt, Human
uucaucucucuguuugag

SEQ ID NO: 1257191 - RNA, 18 nt, Human
uucaucucucuguuugag

SEQ ID NO: 1257192 - RNA, 21 nt, Human
uucaugggcuaacagugacca

SEQ ID NO: 1257193 - RNA, 23 nt, Human
uucucagccuccuucuccacucc

SEQ ID NO: 1257194 - RNA, 19 nt, Human
uugcaaguugauucuuggu

SEQ ID NO: 1257195 - RNA, 19 nt, Human
aagagcucccugcaccaaa

SEQ ID NO: 1257196 - RNA, 18 nt, Human
agagcucccugcaccaaa

SEQ ID NO: 1257197 - RNA, 25 nt, Human
aggaaugcuaaagguuauuuauagg

SEQ ID NO: 1257198 - RNA, 21 nt, Human
aucccuggggcccugcacccc

SEQ ID NO: 1257199 - RNA, 21 nt, Human
caaagcuccuggucaccuccc

SEQ ID NO: 1257200 - RNA, 24 nt, Human
caagagcucccugcaccaaagcuc

SEQ ID NO: 1257201 - RNA, 21 nt, Human
caagcuccuguccugggggca

SEQ ID NO: 1257202 - RNA, 20 nt, Human
caccccccucucccgggcaa

SEQ ID NO: 1257203 - RNA, 24 nt, Human
cccugcaccccccucucccgggca

SEQ ID NO: 1257204 - RNA, 21 nt, Human
cucccgggcauauaaccaugu

SEQ ID NO: 1257205 - RNA, 23 nt, Human
cugcaccaaagcuccuggucacc

SEQ ID NO: 1257206 - RNA, 19 nt, Human
cugcaccccccucucccgg

SEQ ID NO: 1257207 - RNA, 24 nt, Human
cugcaccccccucucccgggcaua

SEQ ID NO: 1257208 - RNA, 20 nt, Human
gcuccuguccugggggcaga

SEQ ID NO: 1257209 - RNA, 20 nt, Human
ucccugcaccaaagcuccug

SEQ ID NO: 1257210 - RNA, 21 nt, Human
ugcaccaaagcuccuggucac

SEQ ID NO: 1257211 - RNA, 20 nt, Human
uggcagggguccagcccuuu

SEQ ID NO: 1257212 - RNA, 19 nt, Human
uuacaauaggaaugcuaaa

SEQ ID NO: 1257213 - RNA, 24 nt, Human
aaagauccgccuaccucggccucc

SEQ ID NO: 1257214 - RNA, 24 nt, Human
aaagugcugggauuacagguguga

SEQ ID NO: 1257215 - RNA, 19 nt, Human
aagacuuuuccugccacaa

SEQ ID NO: 1257216 - RNA, 20 nt, Human
aagauccgccuaccucggcc

SEQ ID NO: 1257217 - RNA, 20 nt, Human
aagcaugguuauaucaacua

SEQ ID NO: 1257218 - RNA, 18 nt, Human
aagugcugggauuacagg

SEQ ID NO: 1257219 - RNA, 19 nt, Human
aagugcugggauuacaggu

SEQ ID NO: 1257220 - RNA, 26 nt, Human
aagugcugggauuacaggugugagcc

SEQ ID NO: 1257221 - RNA, 24 nt, Human
acagaguuucaccauguuggucag

SEQ ID NO: 1257222 - RNA, 23 nt, Human
accacagugcuggaauaaaagca

SEQ ID NO: 1257223 - RNA, 24 nt, Human
accauguuggucaggcuagucuug

SEQ ID NO: 1257224 - RNA, 18 nt, Human
acccugacgaaccucagg

SEQ ID NO: 1257225 - RNA, 26 nt, Human
acccugacgaaccucagucuucacua

SEQ ID NO: 1257226 - RNA, 23 nt, Human
accgugcccagccuggauccaag

SEQ ID NO: 1257227 - RNA, 23 nt, Human
acgcuaggcuaauuuuuuuguau

SEQ ID NO: 1257228 - RNA, 25 nt, Human
acucuguuguccaggcugaagugca

SEQ ID NO: 1257229 - RNA, 19 nt, Human
acugcagcuucaaacuccu

SEQ ID NO: 1257230 - RNA, 25 nt, Human
agacuaggcuucgcuguggcgccgc

SEQ ID NO: 1257231 - RNA, 20 nt, Human
agacuuuuuuauuuuucucu

SEQ ID NO: 1257232 - RNA, 23 nt, Human
agaguuucaccauguuggucagg

SEQ ID NO: 1257233 - RNA, 19 nt, Human
agccuccugaguagcuaag

SEQ ID NO: 1257234 - RNA, 23 nt, Human
agggcagagcagcagcuuuccaa

SEQ ID NO: 1257235 - RNA, 20 nt, Human
agguagaacacgagaggaug

SEQ ID NO: 1257236 - RNA, 19 nt, Human
agguucaagugauucuucu

SEQ ID NO: 1257237 - RNA, 21 nt, Human
agguucaagugauucuucugc

SEQ ID NO: 1257238 - RNA, 19 nt, Human
aguagcugggacuuacagg

SEQ ID NO: 1257239 - RNA, 19 nt, Human
agucuucacuaugcccagu

SEQ ID NO: 1257240 - RNA, 25 nt, Human
agucuuguucuguugcccaggcugg

SEQ ID NO: 1257241 - RNA, 26 nt, Human
agucuuguucuguugcccaggcuggu

SEQ ID NO: 1257242 - RNA, 24 nt, Human
agugauucuucugcuucagccucc

SEQ ID NO: 1257243 - RNA, 19 nt, Human
agugcaguggcgcgauguc

SEQ ID NO: 1257244 - RNA, 18 nt, Human
auacauacauaccuugug

SEQ ID NO: 1257245 - RNA, 18 nt, Human
auagcucacugcagcuuc

SEQ ID NO: 1257246 - RNA, 23 nt, Human
auugcaguggugugaucauagcu

SEQ ID NO: 1257247 - RNA, 25 nt, Human
caaaccucugagccaccaugcccag

SEQ ID NO: 1257248 - RNA, 24 nt, Human
caaagugcugggauuacaggugug

SEQ ID NO: 1257249 - RNA, 20 nt, Human
caaccucugccucccagguu

SEQ ID NO: 1257250 - RNA, 22 nt, Human
caagugauucuucugcuucagc

SEQ ID NO: 1257251 - RNA, 24 nt, Human
caauguuguaacgguucacaccua

SEQ ID NO: 1257252 - RNA, 19 nt, Human
cacacaagguggcagugac

SEQ ID NO: 1257253 - RNA, 21 nt, Human
cacaccuaccccaugcuuucu

SEQ ID NO: 1257254 - RNA, 23 nt, Human
cacagugcuggaauaaaagcaug

SEQ ID NO: 1257255 - RNA, 18 nt, Human
caccauauauagaaacua

SEQ ID NO: 1257256 - RNA, 24 nt, Human
caccauguuggucaggcuagucuu

SEQ ID NO: 1257257 - RNA, 24 nt, Human
cacucuguuguccaggcugaagug

SEQ ID NO: 1257258 - RNA, 18 nt, Human
cacugcaaccucugccuc

SEQ ID NO: 1257259 - RNA, 21 nt, Human
cacugcaaccucugccuccca

SEQ ID NO: 1257260 - RNA, 20 nt, Human
cacuguuaacagaaagcuca

SEQ ID NO: 1257261 - RNA, 24 nt, Human
cagaguuucaccauguuggucagg

SEQ ID NO: 1257262 - RNA, 23 nt, Human
cagauuccucaugugaagugcca

SEQ ID NO: 1257263 - RNA, 20 nt, Human
cagccuccugaguagcuaag

SEQ ID NO: 1257264 - RNA, 24 nt, Human
cagcuucaaacuccugggcucaag

SEQ ID NO: 1257265 - RNA, 18 nt, Human
caggcuagucuugaacuc

SEQ ID NO: 1257266 - RNA, 20 nt, Human
cagucuucacuaugcccagu

SEQ ID NO: 1257267 - RNA, 21 nt, Human
ccaaagugcugggauuacagg

SEQ ID NO: 1257268 - RNA, 21 nt, Human
ccaaagugcugggauuacagg

SEQ ID NO: 1257269 - RNA, 24 nt, Human
ccaaagugcugggauuacaggugu

SEQ ID NO: 1257270 - RNA, 23 nt, Human
ccacagugcuggaauaaaagcau

SEQ ID NO: 1257271 - RNA, 26 nt, Human
cccaaaccucugagccaccaugccca

SEQ ID NO: 1257272 - RNA, 22 nt, Human
cccagguucaagugauucuucu

SEQ ID NO: 1257273 - RNA, 23 nt, Human
cccagguucaagugauucuucug

SEQ ID NO: 1257274 - RNA, 22 nt, Human
cccaugcuuucucauccagaag

SEQ ID NO: 1257275 - RNA, 24 nt, Human
ccucacugcaaccucugccuccca

SEQ ID NO: 1257276 - RNA, 21 nt, Human
ccuccaaaugagggcagagca

SEQ ID NO: 1257277 - RNA, 24 nt, Human
ccucccagguucaagugauucuuc

SEQ ID NO: 1257278 - RNA, 25 nt, Human
ccucugagccaccaugcccagccau

SEQ ID NO: 1257279 - RNA, 20 nt, Human
ccugaguagcugggacuuac

SEQ ID NO: 1257280 - RNA, 19 nt, Human
ccugggccucccaaaccuc

SEQ ID NO: 1257281 - RNA, 18 nt, Human
ccugggcucaaguguucc

SEQ ID NO: 1257282 - RNA, 23 nt, Human
ccugggcucaaguguucguccug

SEQ ID NO: 1257283 - RNA, 19 nt, Human
cgaugucaccucacugcaa

SEQ ID NO: 1257284 - RNA, 23 nt, Human
cguccugccugggccucccaaac

SEQ ID NO: 1257285 - RNA, 24 nt, Human
cuaagccuccugaguagcugggac

SEQ ID NO: 1257286 - RNA, 24 nt, Human
cucaagcuauucuccuaccuaagc

SEQ ID NO: 1257287 - RNA, 24 nt, Human
cucacugcaaccucugccucccag

SEQ ID NO: 1257288 - RNA, 24 nt, Human
cucacugcaaccucugccucccag

SEQ ID NO: 1257289 - RNA, 21 nt, Human
cucacugcagcuucaaacucc

SEQ ID NO: 1257290 - RNA, 24 nt, Human
cucacugcagcuucaaacuccugg

SEQ ID NO: 1257291 - RNA, 20 nt, Human
cucccaaaccucugagccac

SEQ ID NO: 1257292 - RNA, 18 nt, Human
cucccagguucaagugau

SEQ ID NO: 1257293 - RNA, 23 nt, Human
cuccuaccuaagccuccugagua

SEQ ID NO: 1257294 - RNA, 25 nt, Human
cuccugggcucaagcuauucuccua

SEQ ID NO: 1257295 - RNA, 24 nt, Human
cugcaaccucugccucccagguuc

SEQ ID NO: 1257296 - RNA, 23 nt, Human
cugcuucagccuccugaguagcu

SEQ ID NO: 1257297 - RNA, 20 nt, Human
cuguugcccaggcuggucuu

SEQ ID NO: 1257298 - RNA, 21 nt, Human
gaaaaggaaaacgauaauuca

SEQ ID NO: 1257299 - RNA, 19 nt, Human
gaaugcugucuucaagugg

SEQ ID NO: 1257300 - RNA, 21 nt, Human
gagaagcacaaguugcuucaa

SEQ ID NO: 1257301 - RNA, 23 nt, Human
gagagguagaacacgagaggaug

SEQ ID NO: 1257302 - RNA, 22 nt, Human
gaguagcuaagacuacagcuac

SEQ ID NO: 1257303 - RNA, 18 nt, Human
gauuacaggugugagcca

SEQ ID NO: 1257304 - RNA, 21 nt, Human
gauuacaggugugagccaccg

SEQ ID NO: 1257305 - RNA, 24 nt, Human
gauuacaggugugagccaccgugc

SEQ ID NO: 1257306 - RNA, 22 nt, Human
gcaaccucugccucccagguuc

SEQ ID NO: 1257307 - RNA, 21 nt, Human
gccacaaggguggguugcaau

SEQ ID NO: 1257308 - RNA, 27 nt, Human
gcuccaggucacccugacgaaccucag

SEQ ID NO: 1257309 - RNA, 23 nt, Human
gcucuggagaaucccaaguuggg

SEQ ID NO: 1257310 - RNA, 19 nt, Human
gcugaagugcaguggcgcg

SEQ ID NO: 1257311 - RNA, 24 nt, Human
ggcuagucuugaacuccugaucuc

SEQ ID NO: 1257312 - RNA, 22 nt, Human
ggcuggauugcaguggugugau

SEQ ID NO: 1257313 - RNA, 22 nt, Human
gggcagagcagcagcuuuccaa

SEQ ID NO: 1257314 - RNA, 22 nt, Human
gggcucaagcuauucuccuacc

SEQ ID NO: 1257315 - RNA, 18 nt, Human
ggucuugaacgccugggc

SEQ ID NO: 1257316 - RNA, 21 nt, Human
guccugccugggccucccaaa

SEQ ID NO: 1257317 - RNA, 24 nt, Human
gugauucuucugcuucagccuccu

SEQ ID NO: 1257318 - RNA, 18 nt, Human
guuccaguguccccaggg

SEQ ID NO: 1257319 - RNA, 24 nt, Human
guucuguugcccaggcuggucuug

SEQ ID NO: 1257320 - RNA, 19 nt, Human
uaagacuacagcuaccacc

SEQ ID NO: 1257321 - RNA, 24 nt, Human
uacaggugugagccaccgugccca

SEQ ID NO: 1257322 - RNA, 22 nt, Human
uaccuaagccuccugaguagcu

SEQ ID NO: 1257323 - RNA, 24 nt, Human
uaccuaagccuccugaguagcugg

SEQ ID NO: 1257324 - RNA, 24 nt, Human
uaccucggccucccaaagugcugg

SEQ ID NO: 1257325 - RNA, 20 nt, Human
uagaacagaguuucaccaug

SEQ ID NO: 1257326 - RNA, 19 nt, Human
uagcaggaacccugaaagc

SEQ ID NO: 1257327 - RNA, 22 nt, Human
uauaauguuucuacaggauggg

SEQ ID NO: 1257328 - RNA, 25 nt, Human
uauaauguuucuacaggauggguac

SEQ ID NO: 1257329 - RNA, 21 nt, Human
ucaaugccuccaccuuuguuc

SEQ ID NO: 1257330 - RNA, 19 nt, Human
ucacugcaaccucugccuc

SEQ ID NO: 1257331 - RNA, 24 nt, Human
ucacugcaaccucugccucccagg

SEQ ID NO: 1257332 - RNA, 25 nt, Human
ucacugcaaccucugccucccaggu

SEQ ID NO: 1257333 - RNA, 24 nt, Human
ucacugcagcuucaaacuccuggg

SEQ ID NO: 1257334 - RNA, 19 nt, Human
ucagaggcccucugucaca

SEQ ID NO: 1257335 - RNA, 23 nt, Human
ucaguucaauuccugaagaagaa

SEQ ID NO: 1257336 - RNA, 24 nt, Human
uccaacucagaggcccucugucac

SEQ ID NO: 1257337 - RNA, 22 nt, Human
ucccaaaccucugagccaccau

SEQ ID NO: 1257338 - RNA, 23 nt, Human
ucccaaagugcugggauuacagg

SEQ ID NO: 1257339 - RNA, 20 nt, Human
ucccagguucaagugauucu

SEQ ID NO: 1257340 - RNA, 24 nt, Human
ucccagguucaagugauucuucug

SEQ ID NO: 1257341 - RNA, 25 nt, Human
uccugaguagcugggacuuacaggu

SEQ ID NO: 1257342 - RNA, 21 nt, Human
uccugggcucaagcuauucuc

SEQ ID NO: 1257343 - RNA, 22 nt, Human
uccugggcucaagcuauucucc

SEQ ID NO: 1257344 - RNA, 18 nt, Human
ucggccucccaaagugcu

SEQ ID NO: 1257345 - RNA, 24 nt, Human
ucuacaggauggguacuggaccaa

SEQ ID NO: 1257346 - RNA, 24 nt, Human
ucuagagaugagucuuguucuguu

SEQ ID NO: 1257347 - RNA, 19 nt, Human
ucucaaaagauccgccuac

SEQ ID NO: 1257348 - RNA, 19 nt, Human
ucucacucuguuguccagg

SEQ ID NO: 1257349 - RNA, 21 nt, Human
ucucacucuguuguccaggcu

SEQ ID NO: 1257350 - RNA, 22 nt, Human
ucucacucuguuguccaggcug

SEQ ID NO: 1257351 - RNA, 23 nt, Human
ucucacucuguuguccaggcuga

SEQ ID NO: 1257352 - RNA, 24 nt, Human
ucucacucuguuguccaggcugaa

SEQ ID NO: 1257353 - RNA, 19 nt, Human
ucuguagcaggaacccuga

SEQ ID NO: 1257354 - RNA, 21 nt, Human
ucuguagcaggaacccugaaa

SEQ ID NO: 1257355 - RNA, 24 nt, Human
ucuguugcccaggcuggucuugaa

SEQ ID NO: 1257356 - RNA, 24 nt, Human
ucuguuguccaggcugaagugcag

SEQ ID NO: 1257357 - RNA, 23 nt, Human
ucuugaacuccugaucucaaaag

SEQ ID NO: 1257358 - RNA, 23 nt, Human
ucuuguucuguugcccaggcugg

SEQ ID NO: 1257359 - RNA, 24 nt, Human
ucuuguucuguugcccaggcuggu

SEQ ID NO: 1257360 - RNA, 24 nt, Human
ucuuuuucuuuuuuuuuagagacu

SEQ ID NO: 1257361 - RNA, 18 nt, Human
ugaacgccugggcucaag

SEQ ID NO: 1257362 - RNA, 19 nt, Human
ugaagugcaguggcgcgau

SEQ ID NO: 1257363 - RNA, 20 nt, Human
ugaagugcaguggcgcgaug

SEQ ID NO: 1257364 - RNA, 25 nt, Human
ugaagugccacaaaaggcaucaaaa

SEQ ID NO: 1257365 - RNA, 22 nt, Human
ugagauggagucucacucuguu

SEQ ID NO: 1257366 - RNA, 20 nt, Human
ugagcggaugccuguugagu

SEQ ID NO: 1257367 - RNA, 20 nt, Human
ugaugcaaaucuuuuuucag

SEQ ID NO: 1257368 - RNA, 21 nt, Human
ugcagcuucaaacuccugggc

SEQ ID NO: 1257369 - RNA, 22 nt, Human
ugcaguggugugaucauagcuc

SEQ ID NO: 1257370 - RNA, 25 nt, Human
ugccacaaaaggcaucaaaauggau

SEQ ID NO: 1257371 - RNA, 24 nt, Human
ugcccaggcuggucuugaacgccu

SEQ ID NO: 1257372 - RNA, 20 nt, Human
ugcccagugaagcaugguua

SEQ ID NO: 1257373 - RNA, 24 nt, Human
ugcugggauuacaggugugagcca

SEQ ID NO: 1257374 - RNA, 22 nt, Human
ugcuggguaaauacuuguggaa

SEQ ID NO: 1257375 - RNA, 19 nt, Human
ugcuucaaugccuccaccu

SEQ ID NO: 1257376 - RNA, 23 nt, Human
ugcuucagccuccugaguagcua

SEQ ID NO: 1257377 - RNA, 24 nt, Human
ugcuucagccuccugaguagcuaa

SEQ ID NO: 1257378 - RNA, 22 nt, Human
uggagaguuugaaagucuguag

SEQ ID NO: 1257379 - RNA, 19 nt, Human
uggauugcaguggugugau

SEQ ID NO: 1257380 - RNA, 19 nt, Human
uggauugcaguggugugau

SEQ ID NO: 1257381 - RNA, 28 nt, Human
uggauugcaguggugugauggcucuagc

SEQ ID NO: 1257382 - RNA, 18 nt, Human
ugggauuacaggugugag

SEQ ID NO: 1257383 - RNA, 21 nt, Human
ugggauuacaggugugagcca

SEQ ID NO: 1257384 - RNA, 22 nt, Human
ugggauuacaggugugagccac

SEQ ID NO: 1257385 - RNA, 23 nt, Human
ugggauuacaggugugagccacc

SEQ ID NO: 1257386 - RNA, 23 nt, Human
ugggauuacaggugugagccacc

SEQ ID NO: 1257387 - RNA, 24 nt, Human
ugggauuacaggugugagccaccg

SEQ ID NO: 1257388 - RNA, 24 nt, Human
uggucaggcuagucuugaacuccu

SEQ ID NO: 1257389 - RNA, 18 nt, Human
uggugugaucauagcuca

SEQ ID NO: 1257390 - RNA, 24 nt, Human
uggugugaucauagcucacugcag

SEQ ID NO: 1257391 - RNA, 24 nt, Human
uguccaggcugaagugcaguggcg

SEQ ID NO: 1257392 - RNA, 20 nt, Human
uguggaagaugaucagucug

SEQ ID NO: 1257393 - RNA, 24 nt, Human
uguguuaccgaggcuggauugcag

SEQ ID NO: 1257394 - RNA, 24 nt, Human
uguucuguugcccaggcuggucuu

SEQ ID NO: 1257395 - RNA, 21 nt, Human
uguugaguuccagugucccca

SEQ ID NO: 1257396 - RNA, 18 nt, Human
uguugcccaggcuggucu

SEQ ID NO: 1257397 - RNA, 22 nt, Human
uguugcccaggcuggucuugaa

SEQ ID NO: 1257398 - RNA, 23 nt, Human
uuaguagaacagaguuucaccau

SEQ ID NO: 1257399 - RNA, 23 nt, Human
uucaagugauucuucugcuucag

SEQ ID NO: 1257400 - RNA, 24 nt, Human
uucaagugauucuucugcuucagc

SEQ ID NO: 1257401 - RNA, 19 nt, Human
uucuuuguuuucuuuuucu

SEQ ID NO: 1257402 - RNA, 24 nt, Human
uugauacugaaaaaauguuuuagc

SEQ ID NO: 1257403 - RNA, 24 nt, Human
uuguccaggcugaagugcaguggc

SEQ ID NO: 1257404 - RNA, 24 nt, Human
uuucaccauguuggucaggcuagu

SEQ ID NO: 1257405 - RNA, 22 nt, Human
uuugccuaggauggcagcacau

SEQ ID NO: 1257406 - RNA, 24 nt, Human
uuuuauuuuucucugagauggagu

SEQ ID NO: 1257407 - RNA, 28 nt, Human
uuuuuuauuuuucucugagauggagucu

SEQ ID NO: 1257408 - RNA, 18 nt, Human
uuuuuuguauuuuuagua

SEQ ID NO: 1257409 - RNA, 20 nt, Human
auaagcccacugaccucaca

SEQ ID NO: 1257410 - RNA, 20 nt, Human
cacacuccuuggccucaccc

SEQ ID NO: 1257411 - RNA, 18 nt, Human
cagagaaccuguugcucg

SEQ ID NO: 1257412 - RNA, 21 nt, Human
caggaggccagagaaccuguu

SEQ ID NO: 1257413 - RNA, 18 nt, Human
cuccuuggccucacccgg

SEQ ID NO: 1257414 - RNA, 23 nt, Human
gaccucacacuccuuggccucac

SEQ ID NO: 1257415 - RNA, 18 nt, Human
uuggccucacccggaagc

SEQ ID NO: 1257416 - RNA, 20 nt, Human
aagaagauuuucugugugga

SEQ ID NO: 1257417 - RNA, 18 nt, Human
aagcagccugucaccugu

SEQ ID NO: 1257418 - RNA, 22 nt, Human
aagcagccugucaccuguugaa

SEQ ID NO: 1257419 - RNA, 24 nt, Human
aagcagccugucaccuguugaagc

SEQ ID NO: 1257420 - RNA, 22 nt, Human
agaggggaaggugggcuccugg

SEQ ID NO: 1257421 - RNA, 24 nt, Human
caaggagcaccccaaaugccaggc

SEQ ID NO: 1257422 - RNA, 18 nt, Human
caccauagcuggcccgcu

SEQ ID NO: 1257423 - RNA, 18 nt, Human
caccuguugaagcugaga

SEQ ID NO: 1257424 - RNA, 32 nt, Human
cacucuccauuuuguccuuuccccaugaaaag

SEQ ID NO: 1257425 - RNA, 24 nt, Human
caggaucgcgcugccuggccggcc

SEQ ID NO: 1257426 - RNA, 23 nt, Human
ccaaaugcuaugacaccaauauc

SEQ ID NO: 1257427 - RNA, 21 nt, Human
ccauuuuguccuuuccccaug

SEQ ID NO: 1257428 - RNA, 18 nt, Human
ccuccauggguugccacc

SEQ ID NO: 1257429 - RNA, 20 nt, Human
cgccgcaggaucgcgcugcc

SEQ ID NO: 1257430 - RNA, 20 nt, Human
cgcgcugccuggccggccgc

SEQ ID NO: 1257431 - RNA, 20 nt, Human
cgcugcaggguucaccagcc

SEQ ID NO: 1257432 - RNA, 21 nt, Human
cucugcuuaggacguuucaga

SEQ ID NO: 1257433 - RNA, 21 nt, Human
cuguguggagaauaucucgug

SEQ ID NO: 1257434 - RNA, 18 nt, Human
cuuuugcuaugucggggg

SEQ ID NO: 1257435 - RNA, 22 nt, Human
gaaauuguggcuuuuaauguag

SEQ ID NO: 1257436 - RNA, 23 nt, Human
gacguuucagauaagggucaggc

SEQ ID NO: 1257437 - RNA, 19 nt, Human
gagaggcagugguggcugg

SEQ ID NO: 1257438 - RNA, 22 nt, Human
gagcagccaggauuaacucugc

SEQ ID NO: 1257439 - RNA, 18 nt, Human
gccaccuuuugcuauguc

SEQ ID NO: 1257440 - RNA, 18 nt, Human
gccaggcuucccaccaua

SEQ ID NO: 1257441 - RNA, 22 nt, Human
gcgcugcccgugggccucacuc

SEQ ID NO: 1257442 - RNA, 24 nt, Human
gggccgggacggaacucgacggaa

SEQ ID NO: 1257443 - RNA, 22 nt, Human
uaagucucuauagaaucaagaa

SEQ ID NO: 1257444 - RNA, 21 nt, Human
uaggccaaaugcuaugacacc

SEQ ID NO: 1257445 - RNA, 26 nt, Human
ucacucuccauuuuguccuuucccca

SEQ ID NO: 1257446 - RNA, 21 nt, Human
ucccaccauagcuggcccgcu

SEQ ID NO: 1257447 - RNA, 19 nt, Human
uccugagcagccaggauua

SEQ ID NO: 1257448 - RNA, 24 nt, Human
uccugggcgcugcccgugggccuc

SEQ ID NO: 1257449 - RNA, 23 nt, Human
ucguggagauuugaaaugugucg

SEQ ID NO: 1257450 - RNA, 19 nt, Human
ucucuauagaaucaagaag

SEQ ID NO: 1257451 - RNA, 18 nt, Human
ugagaggcagugguggcu

SEQ ID NO: 1257452 - RNA, 20 nt, Human
ugagaggcagugguggcugg

SEQ ID NO: 1257453 - RNA, 18 nt, Human
ugcaaggagcaccccaaa

SEQ ID NO: 1257454 - RNA, 20 nt, Human
ugggcuccugggcgcugccc

SEQ ID NO: 1257455 - RNA, 20 nt, Human
uucccaccauagcuggcccg

SEQ ID NO: 1257456 - RNA, 25 nt, Human
uucccaccauagcuggcccgcugca

SEQ ID NO: 1257457 - RNA, 21 nt, Human
uugcaaggagcaccccaaaug

SEQ ID NO: 1257458 - RNA, 25 nt, Human
uuugaaaugugucgccucuccugag

SEQ ID NO: 1257459 - RNA, 21 nt, Human
aaaaagcucaacaucauuagu

SEQ ID NO: 1257460 - RNA, 21 nt, Human
aaacucugucucuacaaaaaa

SEQ ID NO: 1257461 - RNA, 24 nt, Human
aaauguguuucuuuuuaaaucugu

SEQ ID NO: 1257462 - RNA, 20 nt, Human
aacauagcaagacucuaucu

SEQ ID NO: 1257463 - RNA, 21 nt, Human
aacaugacgaaacucugucuc

SEQ ID NO: 1257464 - RNA, 18 nt, Human
aagcaggaggccaccaga

SEQ ID NO: 1257465 - RNA, 23 nt, Human
aagcaggaggccaccagagcagc

SEQ ID NO: 1257466 - RNA, 24 nt, Human
aagccuguagucccagcuacccag

SEQ ID NO: 1257467 - RNA, 23 nt, Human
aaguagccaggguugggggggca

SEQ ID NO: 1257468 - RNA, 23 nt, Human
acagagugagaccuuauuucaaa

SEQ ID NO: 1257469 - RNA, 19 nt, Human
acaugacgaaacucugucu

SEQ ID NO: 1257470 - RNA, 23 nt, Human
acauguaucccaaagcucaugug

SEQ ID NO: 1257471 - RNA, 24 nt, Human
acuccagccuggaugacagaguga

SEQ ID NO: 1257472 - RNA, 24 nt, Human
acugcacuccagccuggaugacag

SEQ ID NO: 1257473 - RNA, 26 nt, Human
acugcacuccagccuggaugacagag

SEQ ID NO: 1257474 - RNA, 23 nt, Human
agaaaagccaggaagagccugag

SEQ ID NO: 1257475 - RNA, 23 nt, Human
agaaauguguuucuuuuuaaauc

SEQ ID NO: 1257476 - RNA, 18 nt, Human
agaaggcaaggaggacag

SEQ ID NO: 1257477 - RNA, 25 nt, Human
agacacugaaggcagcccaggagcc

SEQ ID NO: 1257478 - RNA, 24 nt, Human
agacaugguggcucacuccuguaa

SEQ ID NO: 1257479 - RNA, 19 nt, Human
agagcagcugccgcacgcg

SEQ ID NO: 1257480 - RNA, 24 nt, Human
agaguucagugucagccuggacaa

SEQ ID NO: 1257481 - RNA, 24 nt, Human
agcacuuuggaaggcugagacggg

SEQ ID NO: 1257482 - RNA, 18 nt, Human
agcccuuucaggggaaug

SEQ ID NO: 1257483 - RNA, 22 nt, Human
agccuggacaacauagcaagac

SEQ ID NO: 1257484 - RNA, 24 nt, Human
agccuggacaacauagcaagacuc

SEQ ID NO: 1257485 - RNA, 24 nt, Human
agccuggaugacagagugagaccu

SEQ ID NO: 1257486 - RNA, 22 nt, Human
agccugggcaacaugacgaaac

SEQ ID NO: 1257487 - RNA, 24 nt, Human
agccugggcaacaugacgaaacuc

SEQ ID NO: 1257488 - RNA, 18 nt, Human
agccuguagucccagcua

SEQ ID NO: 1257489 - RNA, 24 nt, Human
agccuguagucccagcuacccagg

SEQ ID NO: 1257490 - RNA, 24 nt, Human
agcuacccaggaggcugagguggg

SEQ ID NO: 1257491 - RNA, 18 nt, Human
agcugggugugguagugc

SEQ ID NO: 1257492 - RNA, 23 nt, Human
agcugggugugguagugcaagcc

SEQ ID NO: 1257493 - RNA, 18 nt, Human
aggaagagccugagugug

SEQ ID NO: 1257494 - RNA, 22 nt, Human
aggaagagccugagugugaaag

SEQ ID NO: 1257495 - RNA, 19 nt, Human
aggaggccaccagagcagc

SEQ ID NO: 1257496 - RNA, 20 nt, Human
aggcaaggaggacagcaggu

SEQ ID NO: 1257497 - RNA, 24 nt, Human
aggcagagccgaaaggcccaagca

SEQ ID NO: 1257498 - RNA, 20 nt, Human
aggcagcccaggagcccagc

SEQ ID NO: 1257499 - RNA, 18 nt, Human
aggcaggcggaucacuug

SEQ ID NO: 1257500 - RNA, 26 nt, Human
aggcaggcggaucacuugagcucagg

SEQ ID NO: 1257501 - RNA, 23 nt, Human
aggccggggcaggaggaucguug

SEQ ID NO: 1257502 - RNA, 22 nt, Human
aggcggaucacuugagcucagg

SEQ ID NO: 1257503 - RNA, 24 nt, Human
aggcugagacgggaggaccgcuug

SEQ ID NO: 1257504 - RNA, 24 nt, Human
aggcugaggugggaggacugcuug

SEQ ID NO: 1257505 - RNA, 21 nt, Human
agggagcugccuuucucuccu

SEQ ID NO: 1257506 - RNA, 20 nt, Human
aguuuaugguggcugaggca

SEQ ID NO: 1257507 - RNA, 19 nt, Human
auccggcagaaguguagag

SEQ ID NO: 1257508 - RNA, 21 nt, Human
augcauuuacuuucacguggg

SEQ ID NO: 1257509 - RNA, 23 nt, Human
auggagaaacccugaugccuaca

SEQ ID NO: 1257510 - RNA, 24 nt, Human
auuuugccacugcacuccagccug

SEQ ID NO: 1257511 - RNA, 18 nt, Human
caaaaccagcccuuucag

SEQ ID NO: 1257512 - RNA, 21 nt, Human
caaaauggagaaacccugaug

SEQ ID NO: 1257513 - RNA, 22 nt, Human
caacaugacgaaacucugucuc

SEQ ID NO: 1257514 - RNA, 24 nt, Human
caacaugacgaaacucugucucua

SEQ ID NO: 1257515 - RNA, 22 nt, Human
caacccaccagcucuccuagga

SEQ ID NO: 1257516 - RNA, 21 nt, Human
caaggaggacagcagguggcg

SEQ ID NO: 1257517 - RNA, 23 nt, Human
caaggaggacagcagguggcggc

SEQ ID NO: 1257518 - RNA, 23 nt, Human
cacaacccaccagcucuccuagg

SEQ ID NO: 1257519 - RNA, 24 nt, Human
cacaccugucaucccagcacuuug

SEQ ID NO: 1257520 - RNA, 19 nt, Human
caccgggccccgccugccu

SEQ ID NO: 1257521 - RNA, 23 nt, Human
caccugucaucccagcacuuugg

SEQ ID NO: 1257522 - RNA, 24 nt, Human
caccugucaucccagcacuuugga

SEQ ID NO: 1257523 - RNA, 22 nt, Human
cacuccagccuggaugacagag

SEQ ID NO: 1257524 - RNA, 24 nt, Human
cacuccagccuggaugacagagug

SEQ ID NO: 1257525 - RNA, 22 nt, Human
cacuccuguaaucccagcacug

SEQ ID NO: 1257526 - RNA, 18 nt, Human
cacugaaggcagcccagg

SEQ ID NO: 1257527 - RNA, 18 nt, Human
cacugcacuccagccugg

SEQ ID NO: 1257528 - RNA, 19 nt, Human
cacugcacuccagccugga

SEQ ID NO: 1257529 - RNA, 21 nt, Human
cacugcacuccagccuggaug

SEQ ID NO: 1257530 - RNA, 22 nt, Human
cacugcacuccagccuggauga

SEQ ID NO: 1257531 - RNA, 24 nt, Human
cacugcacuccagccuggaugaca

SEQ ID NO: 1257532 - RNA, 18 nt, Human
cacuuuggaaggcugagg

SEQ ID NO: 1257533 - RNA, 20 nt, Human
cagcaccggcgaaguuggug

SEQ ID NO: 1257534 - RNA, 24 nt, Human
cagcacugugggaggccaaggcag

SEQ ID NO: 1257535 - RNA, 24 nt, Human
cagcacugugggaggccaaggcag

SEQ ID NO: 1257536 - RNA, 18 nt, Human
cagcacuuuggaaggcug

SEQ ID NO: 1257537 - RNA, 20 nt, Human
cagcacuuuggaaggcugag

SEQ ID NO: 1257538 - RNA, 18 nt, Human
cagcccaggagcccagcc

SEQ ID NO: 1257539 - RNA, 24 nt, Human
cagcuacccaggaggcugaggugg

SEQ ID NO: 1257540 - RNA, 24 nt, Human
cagguacucaggaggccggggcag

SEQ ID NO: 1257541 - RNA, 20 nt, Human
cagugucagccuggacaaca

SEQ ID NO: 1257542 - RNA, 26 nt, Human
cauagcaagacucuaucucuguuuaa

SEQ ID NO: 1257543 - RNA, 22 nt, Human
cauggccauguugaggggcagg

SEQ ID NO: 1257544 - RNA, 19 nt, Human
ccacugcacuccagccugg

SEQ ID NO: 1257545 - RNA, 20 nt, Human
ccacugcacuccagccugga

SEQ ID NO: 1257546 - RNA, 21 nt, Human
ccacugcacuccagccuggau

SEQ ID NO: 1257547 - RNA, 24 nt, Human
ccacugcacuccagccuggaugac

SEQ ID NO: 1257548 - RNA, 18 nt, Human
ccaggguugggggggcag

SEQ ID NO: 1257549 - RNA, 30 nt, Human
ccagucuggccaaaauggagaaacccugaa

SEQ ID NO: 1257550 - RNA, 23 nt, Human
ccauagagucuucaguuucggag

SEQ ID NO: 1257551 - RNA, 18 nt, Human
cccaggaggcugaggugg

SEQ ID NO: 1257552 - RNA, 23 nt, Human
cccagguacucaggaggccgggg

SEQ ID NO: 1257553 - RNA, 23 nt, Human
ccugccuccuccuuguuucuccu

SEQ ID NO: 1257554 - RNA, 20 nt, Human
ccuggacaacauagcaagac

SEQ ID NO: 1257555 - RNA, 20 nt, Human
ccugggcaacaugacgaaac

SEQ ID NO: 1257556 - RNA, 21 nt, Human
ccuguaaucccagcacugugg

SEQ ID NO: 1257557 - RNA, 22 nt, Human
ccuguaaucccagcacuguggg

SEQ ID NO: 1257558 - RNA, 21 nt, Human
ccuguagucccagcuacccag

SEQ ID NO: 1257559 - RNA, 24 nt, Human
ccuguagucccagcuacccaggag

SEQ ID NO: 1257560 - RNA, 26 nt, Human
cggaucacuugagcucaggagugacu

SEQ ID NO: 1257561 - RNA, 21 nt, Human
cggcugggcauggugacuugu

SEQ ID NO: 1257562 - RNA, 18 nt, Human
cgggcaggggaggcagag

SEQ ID NO: 1257563 - RNA, 21 nt, Human
cggugccgaggugggugcgcc

SEQ ID NO: 1257564 - RNA, 24 nt, Human
cucacaccugucaucccagcacuu

SEQ ID NO: 1257565 - RNA, 23 nt, Human
cucacuccuguaaucccagcacu

SEQ ID NO: 1257566 - RNA, 24 nt, Human
cuccacaacccaccagcucuccua

SEQ ID NO: 1257567 - RNA, 24 nt, Human
cuccugagaccagccugggcaaca

SEQ ID NO: 1257568 - RNA, 21 nt, Human
cuccuggcuccacaacccacc

SEQ ID NO: 1257569 - RNA, 21 nt, Human
cugcaccugcagggcgcagcu

SEQ ID NO: 1257570 - RNA, 21 nt, Human
cuggccaaaauggagaaaccc

SEQ ID NO: 1257571 - RNA, 18 nt, Human
cugguuuccuagccuugc

SEQ ID NO: 1257572 - RNA, 27 nt, Human
cuguaguuggaacauguaucccaaagc

SEQ ID NO: 1257573 - RNA, 19 nt, Human
cuucagauuauuccggcug

SEQ ID NO: 1257574 - RNA, 23 nt, Human
cuuccucauaguuuuaaccuggg

SEQ ID NO: 1257575 - RNA, 18 nt, Human
cuucugguuuccuagccu

SEQ ID NO: 1257576 - RNA, 20 nt, Human
cuuuggucuucuagaaggcu

SEQ ID NO: 1257577 - RNA, 21 nt, Human
gaaaaaaaagcucaacaucau

SEQ ID NO: 1257578 - RNA, 22 nt, Human
gaaagagcuuggaagugcagaa

SEQ ID NO: 1257579 - RNA, 21 nt, Human
gacacugaaggcagcccagga

SEQ ID NO: 1257580 - RNA, 21 nt, Human
gaccuuauuucaaaaaaaagu

SEQ ID NO: 1257581 - RNA, 23 nt, Human
gagcagcugccgcacgcggugcu

SEQ ID NO: 1257582 - RNA, 20 nt, Human
gaucacuugagcucaggagu

SEQ ID NO: 1257583 - RNA, 22 nt, Human
gaucacuugagcucaggaguga

SEQ ID NO: 1257584 - RNA, 24 nt, Human
gaugauggcgggaugggaaaagga

SEQ ID NO: 1257585 - RNA, 21 nt, Human
gaugggaaaaggagggcuuug

SEQ ID NO: 1257586 - RNA, 24 nt, Human
gcacuccagccuggaugacagagu

SEQ ID NO: 1257587 - RNA, 18 nt, Human
gcagaagaagauaccaca

SEQ ID NO: 1257588 - RNA, 21 nt, Human
gcagaaguguagagaagaggg

SEQ ID NO: 1257589 - RNA, 25 nt, Human
gcagcccaggagcccagccgucauc

SEQ ID NO: 1257590 - RNA, 22 nt, Human
gcaggggaggcagagccgaaag

SEQ ID NO: 1257591 - RNA, 23 nt, Human
gccggggcaggaggaucguugga

SEQ ID NO: 1257592 - RNA, 23 nt, Human
gcgucuuugugccucaguuucgu

SEQ ID NO: 1257593 - RNA, 18 nt, Human
gcugcaagccccuguguc

SEQ ID NO: 1257594 - RNA, 22 nt, Human
gcugggcauggugacuugugcc

SEQ ID NO: 1257595 - RNA, 21 nt, Human
ggaacauguaucccaaagcuc

SEQ ID NO: 1257596 - RNA, 24 nt, Human
ggaauguacagggaaggugaaggg

SEQ ID NO: 1257597 - RNA, 22 nt, Human
ggagacggucauuccugugugg

SEQ ID NO: 1257598 - RNA, 21 nt, Human
ggaggacagcagguggcggcu

SEQ ID NO: 1257599 - RNA, 21 nt, Human
ggcaaaaccagcccuuucagg

SEQ ID NO: 1257600 - RNA, 20 nt, Human
ggcaccgggccccgccugcc

SEQ ID NO: 1257601 - RNA, 22 nt, Human
ggcaggaggaucguuggagccc

SEQ ID NO: 1257602 - RNA, 19 nt, Human
ggcagggacgggaagaggu

SEQ ID NO: 1257603 - RNA, 23 nt, Human
ggcauggugacuugugccuauaa

SEQ ID NO: 1257604 - RNA, 18 nt, Human
ggccgguggcucacaggc

SEQ ID NO: 1257605 - RNA, 24 nt, Human
ggcgaaguuggugucagguccagg

SEQ ID NO: 1257606 - RNA, 22 nt, Human
ggcuuccauagagucuucaguu

SEQ ID NO: 1257607 - RNA, 23 nt, Human
gggcaggaggaucguuggagccc

SEQ ID NO: 1257608 - RNA, 19 nt, Human
ggguugggggggcagucag

SEQ ID NO: 1257609 - RNA, 24 nt, Human
ggugacuugugccuauaaucccag

SEQ ID NO: 1257610 - RNA, 24 nt, Human
gguggcucacuccuguaaucccag

SEQ ID NO: 1257611 - RNA, 18 nt, Human
guagugcaagccuguagu

SEQ ID NO: 1257612 - RNA, 18 nt, Human
gucuuugugccucaguuu

SEQ ID NO: 1257613 - RNA, 23 nt, Human
gugauuuugccacugcacuccag

SEQ ID NO: 1257614 - RNA, 20 nt, Human
gugcagaagaagauaccaca

SEQ ID NO: 1257615 - RNA, 24 nt, Human
uaaagacacugaaggcagcccagu

SEQ ID NO: 1257616 - RNA, 25 nt, Human
uaacagagcuggagaagcaaccaca

SEQ ID NO: 1257617 - RNA, 20 nt, Human
uaagcugggugugguagugc

SEQ ID NO: 1257618 - RNA, 20 nt, Human
uaagguguuucagaggaagu

SEQ ID NO: 1257619 - RNA, 25 nt, Human
uauggagaaaaaaaagcucaacauc

SEQ ID NO: 1257620 - RNA, 20 nt, Human
uauucugucauauuuccagc

SEQ ID NO: 1257621 - RNA, 19 nt, Human
ucacgugggccgguggcuc

SEQ ID NO: 1257622 - RNA, 23 nt, Human
uccacaaauggucauguuuccau

SEQ ID NO: 1257623 - RNA, 18 nt, Human
uccacccggcacggcaga

SEQ ID NO: 1257624 - RNA, 23 nt, Human
uccagccuggaugacagagugag

SEQ ID NO: 1257625 - RNA, 24 nt, Human
uccagccuggaugacagagugaga

SEQ ID NO: 1257626 - RNA, 21 nt, Human
ucccaaagcucauguguugga

SEQ ID NO: 1257627 - RNA, 23 nt, Human
uccgugcuaacgguaaaguggag

SEQ ID NO: 1257628 - RNA, 24 nt, Human
uccugcuaaaagggucagaggacc

SEQ ID NO: 1257629 - RNA, 19 nt, Human
uccuggaaguaaagauggc

SEQ ID NO: 1257630 - RNA, 23 nt, Human
uccuguauuauggagaaaaaaaa

SEQ ID NO: 1257631 - RNA, 21 nt, Human
uccuuguuucuccucugcagu

SEQ ID NO: 1257632 - RNA, 20 nt, Human
ucugcagucccaggucucgg

SEQ ID NO: 1257633 - RNA, 24 nt, Human
ucuggccaaaauggagaaacccug

SEQ ID NO: 1257634 - RNA, 23 nt, Human
ucuuccagggccugcaccugcag

SEQ ID NO: 1257635 - RNA, 18 nt, Human
ugacagguuccccuaaag

SEQ ID NO: 1257636 - RNA, 19 nt, Human
ugacuccugagaccagccu

SEQ ID NO: 1257637 - RNA, 22 nt, Human
ugacuugugccuauaaucccag

SEQ ID NO: 1257638 - RNA, 19 nt, Human
ugaggcagaaaagccagga

SEQ ID NO: 1257639 - RNA, 23 nt, Human
ugaggggcagggacgggaagagg

SEQ ID NO: 1257640 - RNA, 23 nt, Human
ugaggugggaggacugcuugagc

SEQ ID NO: 1257641 - RNA, 24 nt, Human
ugaggugggaggacugcuugagcc

SEQ ID NO: 1257642 - RNA, 19 nt, Human
uggaugacagagugagacc

SEQ ID NO: 1257643 - RNA, 25 nt, Human
uggcaaaaccagcccuuucagggga

SEQ ID NO: 1257644 - RNA, 21 nt, Human
uggcaacuuuauguauaugca

SEQ ID NO: 1257645 - RNA, 21 nt, Human
uggcgggaugggaaaaggagg

SEQ ID NO: 1257646 - RNA, 21 nt, Human
uggcucacuccuguaauccca

SEQ ID NO: 1257647 - RNA, 24 nt, Human
uggcucacuccuguaaucccagca

SEQ ID NO: 1257648 - RNA, 24 nt, Human
ugggaggccaaggcaggcggauca

SEQ ID NO: 1257649 - RNA, 24 nt, Human
ugggcaacaugacgaaacucuguc

SEQ ID NO: 1257650 - RNA, 21 nt, Human
ugggggggcagucagaggacu

SEQ ID NO: 1257651 - RNA, 26 nt, Human
uggguuaaaauugacugcuuuuggga

SEQ ID NO: 1257652 - RNA, 24 nt, Human
uggguuugggucucuuuccuguau

SEQ ID NO: 1257653 - RNA, 19 nt, Human
ugguaacaauuaagugaug

SEQ ID NO: 1257654 - RNA, 24 nt, Human
ugguagugcaagccuguaguccca

SEQ ID NO: 1257655 - RNA, 24 nt, Human
uggugacuugugccuauaauccca

SEQ ID NO: 1257656 - RNA, 24 nt, Human
ugguggcucacuccuguaauccca

SEQ ID NO: 1257657 - RNA, 21 nt, Human
uguacacauugcaauagcaug

SEQ ID NO: 1257658 - RNA, 24 nt, Human
uguagagaagagggagaaggcaag

SEQ ID NO: 1257659 - RNA, 19 nt, Human
uguaugaaauuaaggggcu

SEQ ID NO: 1257660 - RNA, 22 nt, Human
uguauuauggagaaaaaaaagc

SEQ ID NO: 1257661 - RNA, 22 nt, Human
ugucauauuuccagcagcaaag

SEQ ID NO: 1257662 - RNA, 27 nt, Human
ugucuugucccuucugcugcguccugg

SEQ ID NO: 1257663 - RNA, 22 nt, Human
ugugguagugcaagccuguagu

SEQ ID NO: 1257664 - RNA, 21 nt, Human
uguugaggggcagggacggga

SEQ ID NO: 1257665 - RNA, 23 nt, Human
uuagcucuugucaccuccccuca

SEQ ID NO: 1257666 - RNA, 18 nt, Human
uuccagaccagucuggcc

SEQ ID NO: 1257667 - RNA, 22 nt, Human
uuccccuaaagguguucaaugc

SEQ ID NO: 1257668 - RNA, 20 nt, Human
uuccucauaguuuuaaccug

SEQ ID NO: 1257669 - RNA, 20 nt, Human
uugggggggcagucagaggg

SEQ ID NO: 1257670 - RNA, 21 nt, Human
uuucacgugggccgguggcuc

SEQ ID NO: 1257671 - RNA, 19 nt, Human
uuuggaaggcugagacggg

SEQ ID NO: 1257672 - RNA, 21 nt, Human
aaaaaaaaauucacuacagga

SEQ ID NO: 1257673 - RNA, 26 nt, Human
aaaaaaagccaguaauuagaacaaaa

SEQ ID NO: 1257674 - RNA, 21 nt, Human
aaaaagccaguaauuagaaca

SEQ ID NO: 1257675 - RNA, 18 nt, Human
aaaaagccuuaagacacc

SEQ ID NO: 1257676 - RNA, 26 nt, Human
aaagaacuucacccaaagguacgaac

SEQ ID NO: 1257677 - RNA, 19 nt, Human
aaagaaggccugaaaugua

SEQ ID NO: 1257678 - RNA, 20 nt, Human
aacacggugaaaccccgucu

SEQ ID NO: 1257679 - RNA, 21 nt, Human
aacacggugaaaccccgucuc

SEQ ID NO: 1257680 - RNA, 20 nt, Human
aacagagcaagacuccaucu

SEQ ID NO: 1257681 - RNA, 20 nt, Human
aagaggaaaaaaagccagua

SEQ ID NO: 1257682 - RNA, 24 nt, Human
acagagcaagacuccaucucaaag

SEQ ID NO: 1257683 - RNA, 22 nt, Human
acagcaaagaacuucacccaaa

SEQ ID NO: 1257684 - RNA, 20 nt, Human
accaaaagaggaaaaaaagc

SEQ ID NO: 1257685 - RNA, 24 nt, Human
accccgucucuacuaaaaauacaa

SEQ ID NO: 1257686 - RNA, 21 nt, Human
acugcacuccagccugggcaa

SEQ ID NO: 1257687 - RNA, 22 nt, Human
acugcacuccagccugggcaac

SEQ ID NO: 1257688 - RNA, 23 nt, Human
acugcacuccagccugggcaaca

SEQ ID NO: 1257689 - RNA, 24 nt, Human
acugcacuccagccugggcaacag

SEQ ID NO: 1257690 - RNA, 24 nt, Human
acugcacuccagccugggcaacag

SEQ ID NO: 1257691 - RNA, 22 nt, Human
agaaaaaaguagguuuccaaaa

SEQ ID NO: 1257692 - RNA, 22 nt, Human
agagguugcagugagccgagau

SEQ ID NO: 1257693 - RNA, 24 nt, Human
agagguugcagugagccgagauug

SEQ ID NO: 1257694 - RNA, 22 nt, Human
agcacagcaaagaacuucaccc

SEQ ID NO: 1257695 - RNA, 24 nt, Human
agccugggcaacagagcaagacuc

SEQ ID NO: 1257696 - RNA, 19 nt, Human
agcuggucaaagagaagcc

SEQ ID NO: 1257697 - RNA, 21 nt, Human
agcuggucaaagagaagcccc

SEQ ID NO: 1257698 - RNA, 21 nt, Human
aggcagagguugcagugagcc

SEQ ID NO: 1257699 - RNA, 24 nt, Human
aggcagagguugcagugagccgag

SEQ ID NO: 1257700 - RNA, 21 nt, Human
aggccgaggcggguggaucac

SEQ ID NO: 1257701 - RNA, 24 nt, Human
aggcggguggaucacgaggucagg

SEQ ID NO: 1257702 - RNA, 23 nt, Human
agggaggaaccagaggaacagua

SEQ ID NO: 1257703 - RNA, 24 nt, Human
aggugcgguggcucaugccuguaa

SEQ ID NO: 1257704 - RNA, 19 nt, Human
augccuguaaucccaacac

SEQ ID NO: 1257705 - RNA, 24 nt, Human
auugugcgacugcacuccagccug

SEQ ID NO: 1257706 - RNA, 21 nt, Human
caaagaacuucacccaaaggu

SEQ ID NO: 1257707 - RNA, 24 nt, Human
caacacuuugggaggccgaggcgg

SEQ ID NO: 1257708 - RNA, 22 nt, Human
caagacuccaucucaaagaagg

SEQ ID NO: 1257709 - RNA, 25 nt, Human
caagcuggucaaagagaagccccug

SEQ ID NO: 1257710 - RNA, 24 nt, Human
cacagcaaagaacuucacccaaag

SEQ ID NO: 1257711 - RNA, 21 nt, Human
cacaguaaaauaagcuucaaa

SEQ ID NO: 1257712 - RNA, 22 nt, Human
caccaaaagaggaaaaaaagcc

SEQ ID NO: 1257713 - RNA, 24 nt, Human
caccaaaagaggaaaaaaagccag

SEQ ID NO: 1257714 - RNA, 23 nt, Human
cacuccagccugggcaacagagc

SEQ ID NO: 1257715 - RNA, 18 nt, Human
cagcaaagaacuucaccc

SEQ ID NO: 1257716 - RNA, 21 nt, Human
cagcaaagaacuucacccaaa

SEQ ID NO: 1257717 - RNA, 20 nt, Human
caugccuguaaucccaacac

SEQ ID NO: 1257718 - RNA, 24 nt, Human
caugccuguaaucccaacacuuug

SEQ ID NO: 1257719 - RNA, 21 nt, Human
ccaaaagaggaaaaaaagcca

SEQ ID NO: 1257720 - RNA, 23 nt, Human
ccuggcuaacacggugaaacccc

SEQ ID NO: 1257721 - RNA, 24 nt, Human
ccuggcuaacacggugaaaccccg

SEQ ID NO: 1257722 - RNA, 25 nt, Human
ccugggaggcagagguugcagugag

SEQ ID NO: 1257723 - RNA, 22 nt, Human
ccugggcaacagagcaagacuc

SEQ ID NO: 1257724 - RNA, 22 nt, Human
ccuguaaucccaacacuuuggg

SEQ ID NO: 1257725 - RNA, 21 nt, Human
ccuguaaucccagcuacucgg

SEQ ID NO: 1257726 - RNA, 21 nt, Human
cgacugcacuccagccugggc

SEQ ID NO: 1257727 - RNA, 24 nt, Human
cgacugcacuccagccugggcaac

SEQ ID NO: 1257728 - RNA, 24 nt, Human
cgagaucauccuggcuaacacggu

SEQ ID NO: 1257729 - RNA, 24 nt, Human
cgaggcggguggaucacgagguca

SEQ ID NO: 1257730 - RNA, 23 nt, Human
cgccuguaaucccagcuacucgg

SEQ ID NO: 1257731 - RNA, 24 nt, Human
cgccuguaaucccagcuacucggg

SEQ ID NO: 1257732 - RNA, 24 nt, Human
cucaugccuguaaucccaacacuu

SEQ ID NO: 1257733 - RNA, 18 nt, Human
cuggcuaacacggugaaa

SEQ ID NO: 1257734 - RNA, 23 nt, Human
cuggggcaggagaauggcaugaa

SEQ ID NO: 1257735 - RNA, 24 nt, Human
cugggucaggugcgguggcucaug

SEQ ID NO: 1257736 - RNA, 25 nt, Human
gacaccaaaagaggaaaaaaagcca

SEQ ID NO: 1257737 - RNA, 23 nt, Human
gagauugugcgacugcacuccag

SEQ ID NO: 1257738 - RNA, 19 nt, Human
gcaaagaacuucacccaaa

SEQ ID NO: 1257739 - RNA, 24 nt, Human
gcacuccagccugggcaacagagc

SEQ ID NO: 1257740 - RNA, 19 nt, Human
gcagcagacacuguuuucu

SEQ ID NO: 1257741 - RNA, 18 nt, Human
gccagaugccucuugcca

SEQ ID NO: 1257742 - RNA, 21 nt, Human
gccaguaauuagaacaaaaug

SEQ ID NO: 1257743 - RNA, 22 nt, Human
gccgggugugguggcaggcgcc

SEQ ID NO: 1257744 - RNA, 22 nt, Human
gcgacugcacuccagccugggc

SEQ ID NO: 1257745 - RNA, 24 nt, Human
gcuaacacggugaaaccccgucuc

SEQ ID NO: 1257746 - RNA, 20 nt, Human
ggcaggagaauggcaugaac

SEQ ID NO: 1257747 - RNA, 21 nt, Human
ggcaggagaauggcaugaacc

SEQ ID NO: 1257748 - RNA, 23 nt, Human
ggcaggagaauggcaugaaccug

SEQ ID NO: 1257749 - RNA, 18 nt, Human
ggucaggugcgguggcuc

SEQ ID NO: 1257750 - RNA, 21 nt, Human
gguggaucacgaggucaggag

SEQ ID NO: 1257751 - RNA, 24 nt, Human
gguggcaggcgccuguaaucccag

SEQ ID NO: 1257752 - RNA, 23 nt, Human
gguggcucaugccuguaauccca

SEQ ID NO: 1257753 - RNA, 23 nt, Human
ggugugguggcaggcgccuguaa

SEQ ID NO: 1257754 - RNA, 19 nt, Human
guugcagugagccgagauu

SEQ ID NO: 1257755 - RNA, 22 nt, Human
uaacacggugaaaccccgucuc

SEQ ID NO: 1257756 - RNA, 24 nt, Human
uaacacggugaaaccccgucucua

SEQ ID NO: 1257757 - RNA, 24 nt, Human
uaagacaccaaaagaggaaaaaaa

SEQ ID NO: 1257758 - RNA, 19 nt, Human
ucaaaaagccuuaagacac

SEQ ID NO: 1257759 - RNA, 24 nt, Human
ucaaaaagccuuaagacaccaaaa

SEQ ID NO: 1257760 - RNA, 18 nt, Human
ucacgaggucaggagauc

SEQ ID NO: 1257761 - RNA, 24 nt, Human
ucacgaggucaggagaucgagauc

SEQ ID NO: 1257762 - RNA, 24 nt, Human
ucagucacauugggaaccauuugu

SEQ ID NO: 1257763 - RNA, 22 nt, Human
ucccaauaaacucacaguaaaa

SEQ ID NO: 1257764 - RNA, 24 nt, Human
ucucuacuaaaaauacaaaaaauu

SEQ ID NO: 1257765 - RNA, 19 nt, Human
ucuugcaacagacacugcu

SEQ ID NO: 1257766 - RNA, 19 nt, Human
ugaaaucuggugagaucca

SEQ ID NO: 1257767 - RNA, 21 nt, Human
ugaaauguagggaggaaccag

SEQ ID NO: 1257768 - RNA, 24 nt, Human
ugaaccugggaggcagagguugca

SEQ ID NO: 1257769 - RNA, 22 nt, Human
ugagccgagauugugcgacugc

SEQ ID NO: 1257770 - RNA, 19 nt, Human
ugagugguugacugcucuu

SEQ ID NO: 1257771 - RNA, 19 nt, Human
ugagugguugacugcucuu

SEQ ID NO: 1257772 - RNA, 23 nt, Human
ugcaacagacacugcuucaacac

SEQ ID NO: 1257773 - RNA, 18 nt, Human
ugccacaggaauuuucga

SEQ ID NO: 1257774 - RNA, 23 nt, Human
ugccuguaaucccaacacuuugg

SEQ ID NO: 1257775 - RNA, 24 nt, Human
ugcgacugcacuccagccugggca

SEQ ID NO: 1257776 - RNA, 18 nt, Human
ugcuucaacacacacugu

SEQ ID NO: 1257777 - RNA, 22 nt, Human
uggcaggcgccuguaaucccag

SEQ ID NO: 1257778 - RNA, 20 nt, Human
uggcaugaaccugggaggca

SEQ ID NO: 1257779 - RNA, 21 nt, Human
uggcucaugccuguaauccca

SEQ ID NO: 1257780 - RNA, 24 nt, Human
uggcucaugccuguaaucccaaca

SEQ ID NO: 1257781 - RNA, 24 nt, Human
ugggaggcagagguugcagugagc

SEQ ID NO: 1257782 - RNA, 23 nt, Human
ugggaggccgaggcggguggauc

SEQ ID NO: 1257783 - RNA, 24 nt, Human
ugggaggccgaggcggguggauca

SEQ ID NO: 1257784 - RNA, 24 nt, Human
uggggcaggagaauggcaugaacc

SEQ ID NO: 1257785 - RNA, 24 nt, Human
ugguggcaggcgccuguaauccca

SEQ ID NO: 1257786 - RNA, 19 nt, Human
ugugguggcaggcgccugu

SEQ ID NO: 1257787 - RNA, 18 nt, Human
uugcagugagccgagauu

SEQ ID NO: 1257788 - RNA, 22 nt, Human
uugcagugagccgagauugugc

SEQ ID NO: 1257789 - RNA, 19 nt, Human
uugccgggugugguggcag

SEQ ID NO: 1257790 - RNA, 25 nt, Human
uugggaggccgaggcggguggauca

SEQ ID NO: 1257791 - RNA, 19 nt, Human
aacauggcaaaaccccauc

SEQ ID NO: 1257792 - RNA, 21 nt, Human
aacauggcaaaaccccaucuc

SEQ ID NO: 1257793 - RNA, 21 nt, Human
aacauggcaaaaccccaucuc

SEQ ID NO: 1257794 - RNA, 22 nt, Human
agaaaaaaguagguuuccaaaa

SEQ ID NO: 1257795 - RNA, 22 nt, Human
agcauauggcucuuuggcuuua

SEQ ID NO: 1257796 - RNA, 24 nt, Human
caacauggcaaaaccccaucuccu

SEQ ID NO: 1257797 - RNA, 24 nt, Human
cccaucuccuuuuuauaaagaaaa

SEQ ID NO: 1257798 - RNA, 20 nt, Human
cgcaacauggcaaaacccca

SEQ ID NO: 1257799 - RNA, 21 nt, Human
gaccuaggcuuuuggaaaggc

SEQ ID NO: 1257800 - RNA, 24 nt, Human
ucuuuggcuuuaccaucaaagauu

SEQ ID NO: 1257801 - RNA, 23 nt, Human
uggcaaaauuagauggacuucau

SEQ ID NO: 1257802 - RNA, 21 nt, Human
aaacaaaaacagugcuaaaaa

SEQ ID NO: 1257803 - RNA, 22 nt, Human
aaaguagccaauaaaaauauac

SEQ ID NO: 1257804 - RNA, 26 nt, Human
aaggcaccaccagauccccuccaaaa

SEQ ID NO: 1257805 - RNA, 24 nt, Human
aagucccucucaacaaacccaccc

SEQ ID NO: 1257806 - RNA, 18 nt, Human
acaccaaggcccagcaag

SEQ ID NO: 1257807 - RNA, 19 nt, Human
acagugcuaaaaaagucug

SEQ ID NO: 1257808 - RNA, 20 nt, Human
accuaaaaguaucucgggaa

SEQ ID NO: 1257809 - RNA, 25 nt, Human
agauccccuccaaauaugccugcuc

SEQ ID NO: 1257810 - RNA, 22 nt, Human
agcaagucccucucaacaaacc

SEQ ID NO: 1257811 - RNA, 21 nt, Human
auguucacagaggugacccac

SEQ ID NO: 1257812 - RNA, 22 nt, Human
caaggcaccaccagauccccuc

SEQ ID NO: 1257813 - RNA, 22 nt, Human
cacuaccacuuguccuaaacaa

SEQ ID NO: 1257814 - RNA, 21 nt, Human
cacuuuggaaaugcuggacua

SEQ ID NO: 1257815 - RNA, 23 nt, Human
cagcaagucccucucaacaaacc

SEQ ID NO: 1257816 - RNA, 24 nt, Human
caucggaacauguuggcauccagc

SEQ ID NO: 1257817 - RNA, 23 nt, Human
ccaccuaaaaguaucucgggaac

SEQ ID NO: 1257818 - RNA, 20 nt, Human
cccaccccuaucagcccuca

SEQ ID NO: 1257819 - RNA, 21 nt, Human
cccuaagcccaaguccugcuc

SEQ ID NO: 1257820 - RNA, 21 nt, Human
cccucucaacaaacccacccc

SEQ ID NO: 1257821 - RNA, 23 nt, Human
ccuccaaauaugccugcucucac

SEQ ID NO: 1257822 - RNA, 20 nt, Human
cggcaugucuuccacaggca

SEQ ID NO: 1257823 - RNA, 18 nt, Human
cucacaccaaggcccagc

SEQ ID NO: 1257824 - RNA, 23 nt, Human
cucccaggcgcugugggucccug

SEQ ID NO: 1257825 - RNA, 21 nt, Human
cucccggcggcuccaggcggu

SEQ ID NO: 1257826 - RNA, 22 nt, Human
cuccgggccucggcggcgucca

SEQ ID NO: 1257827 - RNA, 18 nt, Human
cucucacaccaaggccca

SEQ ID NO: 1257828 - RNA, 26 nt, Human
cuucaaggcaccaccagauccccucc

SEQ ID NO: 1257829 - RNA, 20 nt, Human
gccacuaccacuuguccuaa

SEQ ID NO: 1257830 - RNA, 24 nt, Human
gccacuaccacuuguccuaaacaa

SEQ ID NO: 1257831 - RNA, 24 nt, Human
ggaaacacacaccugugguccccu

SEQ ID NO: 1257832 - RNA, 20 nt, Human
guccacucccggcggcucca

SEQ ID NO: 1257833 - RNA, 26 nt, Human
gugacccacgcugaguagaugcugug

SEQ ID NO: 1257834 - RNA, 23 nt, Human
uaaaacaaaaacagugcuaaaaa

SEQ ID NO: 1257835 - RNA, 18 nt, Human
uaacacaaaggggaaaca

SEQ ID NO: 1257836 - RNA, 20 nt, Human
uaugccugcucucacaccaa

SEQ ID NO: 1257837 - RNA, 25 nt, Human
ucaacaaacccaccccuaucagccc

SEQ ID NO: 1257838 - RNA, 18 nt, Human
ucacaccaaggcccagca

SEQ ID NO: 1257839 - RNA, 18 nt, Human
ucccucucaacaaaccca

SEQ ID NO: 1257840 - RNA, 18 nt, Human
ucucaacaaacccacccc

SEQ ID NO: 1257841 - RNA, 21 nt, Human
ugaugggcugcaccagaaauu

SEQ ID NO: 1257842 - RNA, 23 nt, Human
ugauguucacagaggugacccac

SEQ ID NO: 1257843 - RNA, 19 nt, Human
ugccacuuaaugcaggccc

SEQ ID NO: 1257844 - RNA, 20 nt, Human
ugggucccugaugggcugca

SEQ ID NO: 1257845 - RNA, 18 nt, Human
uuuuuuuuuuuuuuacuu

SEQ ID NO: 1257846 - RNA, 26 nt, Human
aaaacugacaagaacaaaaggaaaca

SEQ ID NO: 1257847 - RNA, 21 nt, Human
aaaaggaaacaaauaucccaa

SEQ ID NO: 1257848 - RNA, 20 nt, Human
aacagacuuaccacauagga

SEQ ID NO: 1257849 - RNA, 24 nt, Human
caaaaggaaacaaauaucccaaua

SEQ ID NO: 1257850 - RNA, 20 nt, Human
cucaaacuuaacacaucuac

SEQ ID NO: 1257851 - RNA, 22 nt, Human
uaaacagacuuaccacauagga

SEQ ID NO: 1257852 - RNA, 20 nt, Human
uacacgugaaucugaaauuc

SEQ ID NO: 1257853 - RNA, 20 nt, Human
ucuacacgugaaucugaaau

SEQ ID NO: 1257854 - RNA, 18 nt, Human
ugacaagaacaaaaggaa

SEQ ID NO: 1257855 - RNA, 22 nt, Human
ugacaagaacaaaaggaaacaa

SEQ ID NO: 1257856 - RNA, 24 nt, Human
ugacaagaacaaaaggaaacaaaa

SEQ ID NO: 1257857 - RNA, 23 nt, Human
uggcaacaucgcucaaacuuaac

SEQ ID NO: 1257858 - RNA, 23 nt, Human
aagaaagcaccccaaaacgggcu

SEQ ID NO: 1257859 - RNA, 24 nt, Human
aagcaccccaaaacgggcugccag

SEQ ID NO: 1257860 - RNA, 20 nt, Human
aaggauccauggggcugaag

SEQ ID NO: 1257861 - RNA, 19 nt, Human
acccaggcugugggcugga

SEQ ID NO: 1257862 - RNA, 19 nt, Human
acucugacugagaggcaga

SEQ ID NO: 1257863 - RNA, 20 nt, Human
agacaggagccaaggcccca

SEQ ID NO: 1257864 - RNA, 18 nt, Human
agagaacugggggcucaa

SEQ ID NO: 1257865 - RNA, 24 nt, Human
agcuagcgagcgaggaccccuacc

SEQ ID NO: 1257866 - RNA, 20 nt, Human
aggaaaaacaauacagcuga

SEQ ID NO: 1257867 - RNA, 21 nt, Human
aggaaaaacaauacagcugaa

SEQ ID NO: 1257868 - RNA, 25 nt, Human
aggaaaaacaauacagcugagucua

SEQ ID NO: 1257869 - RNA, 28 nt, Human
aggcacuccuguuucugucccguccccg

SEQ ID NO: 1257870 - RNA, 21 nt, Human
aggcagccugggccccugcag

SEQ ID NO: 1257871 - RNA, 19 nt, Human
aggggacagagaacugggg

SEQ ID NO: 1257872 - RNA, 19 nt, Human
caagaaagcaccccaaaac

SEQ ID NO: 1257873 - RNA, 19 nt, Human
caagaucccugagacccag

SEQ ID NO: 1257874 - RNA, 23 nt, Human
caauagaucauguuuauucccaa

SEQ ID NO: 1257875 - RNA, 22 nt, Human
caccccaaaacgggcugccagg

SEQ ID NO: 1257876 - RNA, 19 nt, Human
cagagcccaaagcccaguc

SEQ ID NO: 1257877 - RNA, 20 nt, Human
cagcaggaggcacuccuguu

SEQ ID NO: 1257878 - RNA, 24 nt, Human
caggagccaaggccccauugaagc

SEQ ID NO: 1257879 - RNA, 19 nt, Human
caggaggcacuccuguuuc

SEQ ID NO: 1257880 - RNA, 22 nt, Human
cauguuuauucccaagccccaa

SEQ ID NO: 1257881 - RNA, 18 nt, Human
ccaggcugugggcuggaa

SEQ ID NO: 1257882 - RNA, 20 nt, Human
cccaaagcccagucugcagu

SEQ ID NO: 1257883 - RNA, 26 nt, Human
ccccaaccagacauguucuaccccuc

SEQ ID NO: 1257884 - RNA, 23 nt, Human
ccccagagcccaaagcccagucu

SEQ ID NO: 1257885 - RNA, 21 nt, Human
cccucaagaucccugagaccc

SEQ ID NO: 1257886 - RNA, 23 nt, Human
cccucaagaucccugagacccag

SEQ ID NO: 1257887 - RNA, 22 nt, Human
cccugacucugacugagaggca

SEQ ID NO: 1257888 - RNA, 22 nt, Human
ccgagaaacagcaagcuagcga

SEQ ID NO: 1257889 - RNA, 22 nt, Human
ccucaagaucccugagacccag

SEQ ID NO: 1257890 - RNA, 19 nt, Human
ccugagacccaggcugugg

SEQ ID NO: 1257891 - RNA, 22 nt, Human
ccugagacccaggcugugggcu

SEQ ID NO: 1257892 - RNA, 20 nt, Human
ccugggccccugcaggggcu

SEQ ID NO: 1257893 - RNA, 22 nt, Human
cucaagaucccugagacccagg

SEQ ID NO: 1257894 - RNA, 20 nt, Human
cucaagaucccugagacccu

SEQ ID NO: 1257895 - RNA, 19 nt, Human
cugacugagaggcagacag

SEQ ID NO: 1257896 - RNA, 21 nt, Human
gaaagcaccccaaaacggggg

SEQ ID NO: 1257897 - RNA, 22 nt, Human
gaacagacgcaaaaccaggcac

SEQ ID NO: 1257898 - RNA, 24 nt, Human
gagaaguuugccccagagcccaaa

SEQ ID NO: 1257899 - RNA, 21 nt, Human
gccugggccccugcaggggcu

SEQ ID NO: 1257900 - RNA, 25 nt, Human
ggcccagaacuucugugcaguugga

SEQ ID NO: 1257901 - RNA, 18 nt, Human
ggccccugcaggggcugg

SEQ ID NO: 1257902 - RNA, 22 nt, Human
ggcugccagguuaaggauccau

SEQ ID NO: 1257903 - RNA, 18 nt, Human
gggacagagaacuggggg

SEQ ID NO: 1257904 - RNA, 26 nt, Human
gggcugggcccugaauccugaggccg

SEQ ID NO: 1257905 - RNA, 22 nt, Human
ggggaacagacgcaaaaccagg

SEQ ID NO: 1257906 - RNA, 19 nt, Human
ucaagagcgccccuguugg

SEQ ID NO: 1257907 - RNA, 19 nt, Human
ucagggaucugccugcacu

SEQ ID NO: 1257908 - RNA, 18 nt, Human
uccaggaugacgauggcc

SEQ ID NO: 1257909 - RNA, 18 nt, Human
ucccugagacccaggcug

SEQ ID NO: 1257910 - RNA, 18 nt, Human
ugaccuucagggaucugc

SEQ ID NO: 1257911 - RNA, 20 nt, Human
ugagaggcagacaggagcca

SEQ ID NO: 1257912 - RNA, 19 nt, Human
ugaguccuuugucagcccu

SEQ ID NO: 1257913 - RNA, 18 nt, Human
ugccccagagcccaaagc

SEQ ID NO: 1257914 - RNA, 19 nt, Human
uggguggagaugagaggca

SEQ ID NO: 1257915 - RNA, 22 nt, Human
ugucaggcccagaacuucugug

SEQ ID NO: 1257916 - RNA, 18 nt, Human
ugugcaguuggagugggc

SEQ ID NO: 1257917 - RNA, 25 nt, Human
ugugggcuggaaaaugaaggcacag

SEQ ID NO: 1257918 - RNA, 21 nt, Human
uguuucugucccuucugucuc

SEQ ID NO: 1257919 - RNA, 23 nt, Human
uucagagcaagguuucugcugag

SEQ ID NO: 1257920 - RNA, 22 nt, Human
agacauaccauacuuucuuuca

SEQ ID NO: 1257921 - RNA, 21 nt, Human
agacugcccagcuccagguac

SEQ ID NO: 1257922 - RNA, 18 nt, Human
caacauaaacacugugcu

SEQ ID NO: 1257923 - RNA, 22 nt, Human
cagagaugggguugcgccaugg

SEQ ID NO: 1257924 - RNA, 22 nt, Human
cagagaugggguugcgccaugu

SEQ ID NO: 1257925 - RNA, 22 nt, Human
ccacgccagacauaguuuucua

SEQ ID NO: 1257926 - RNA, 19 nt, Human
ccauguugcuaggcugcuc

SEQ ID NO: 1257927 - RNA, 25 nt, Human
cccccaugaugaacaguaacuccau

SEQ ID NO: 1257928 - RNA, 24 nt, Human
ccucccgccucggccacgccagac

SEQ ID NO: 1257929 - RNA, 24 nt, Human
ccuuuggguucaaguagcuggggg

SEQ ID NO: 1257930 - RNA, 26 nt, Human
ccuuuggguucaaguagcuggggguc

SEQ ID NO: 1257931 - RNA, 24 nt, Human
cuacagagaugggguugcgccaug

SEQ ID NO: 1257932 - RNA, 20 nt, Human
ggcaacacacaggaccuggc

SEQ ID NO: 1257933 - RNA, 21 nt, Human
gggguugcgccauguugcuag

SEQ ID NO: 1257934 - RNA, 21 nt, Human
gggucugagguaggacuacag

SEQ ID NO: 1257935 - RNA, 21 nt, Human
ggguugcgccauguugcuagg

SEQ ID NO: 1257936 - RNA, 21 nt, Human
uaagauuacaggacuuuucca

SEQ ID NO: 1257937 - RNA, 24 nt, Human
ucacuggagccuugaaccuuuggg

SEQ ID NO: 1257938 - RNA, 25 nt, Human
ucacuggagccuugaaccuuugggu

SEQ ID NO: 1257939 - RNA, 24 nt, Human
ugaacaguaacuccauuguguaaa

SEQ ID NO: 1257940 - RNA, 22 nt, Human
ugaugagaagacugcccagcuc

SEQ ID NO: 1257941 - RNA, 24 nt, Human
ugcuaggcugcucuuggccugaag

SEQ ID NO: 1257942 - RNA, 23 nt, Human
uggccugaaggguccucccgccu

SEQ ID NO: 1257943 - RNA, 21 nt, Human
ugggguugcgccauguugcua

SEQ ID NO: 1257944 - RNA, 23 nt, Human
ugggguugcgccauguugcuagg

SEQ ID NO: 1257945 - RNA, 18 nt, Human
ugugcugggucugaauuu

SEQ ID NO: 1257946 - RNA, 25 nt, Human
uucaaguagcugggggucugaggua

SEQ ID NO: 1257947 - RNA, 18 nt, Human
uugaccaacauaaacacu

SEQ ID NO: 1257948 - RNA, 19 nt, Human
uugcuaggcugcucuuggc

SEQ ID NO: 1257949 - RNA, 19 nt, Human
augggggcugcugcccaca

SEQ ID NO: 1257950 - RNA, 24 nt, Human
cuagcaacaauuaggcaagcucuc

SEQ ID NO: 1257951 - RNA, 23 nt, Human
cugcccacauugaccucaggggc

SEQ ID NO: 1257952 - RNA, 19 nt, Human
cugguacuguugcagugag

SEQ ID NO: 1257953 - RNA, 24 nt, Human
gcugauggggggaagcaggaagga

SEQ ID NO: 1257954 - RNA, 18 nt, Human
ggcaagcucucaucagga

SEQ ID NO: 1257955 - RNA, 25 nt, Human
ggggcugcugcccacauugaccuca

SEQ ID NO: 1257956 - RNA, 21 nt, Human
uugaccucaggggcugauggg

SEQ ID NO: 1257957 - RNA, 19 nt, Human
aaaacaaacaauagcaaaa

SEQ ID NO: 1257958 - RNA, 21 nt, Human
aaaagagcagggacaauaaaa

SEQ ID NO: 1257959 - RNA, 22 nt, Human
aaacagcccugagaucacccau

SEQ ID NO: 1257960 - RNA, 21 nt, Human
aaacauaaaaugaauccaaag

SEQ ID NO: 1257961 - RNA, 21 nt, Human
aagaaaaagaacaccccaaaa

SEQ ID NO: 1257962 - RNA, 26 nt, Human
aagaaaaagaacaccccaaaauuuca

SEQ ID NO: 1257963 - RNA, 22 nt, Human
aagcacauuuuucaacauguag

SEQ ID NO: 1257964 - RNA, 25 nt, Human
aagugcaccauaagaaaaagaacac

SEQ ID NO: 1257965 - RNA, 19 nt, Human
acaauaaaaacagcccuga

SEQ ID NO: 1257966 - RNA, 24 nt, Human
agaaaaaccagagauucauaaaua

SEQ ID NO: 1257967 - RNA, 19 nt, Human
agagaaaaaccagagauuc

SEQ ID NO: 1257968 - RNA, 18 nt, Human
agggcaggaaaaacuaug

SEQ ID NO: 1257969 - RNA, 24 nt, Human
auaagaaaaagaacaccccaaaau

SEQ ID NO: 1257970 - RNA, 18 nt, Human
auagcuuuguuaauaacu

SEQ ID NO: 1257971 - RNA, 20 nt, Human
aucaucauaacaaaaagcac

SEQ ID NO: 1257972 - RNA, 21 nt, Human
caaaaugaugugaagaaaagg

SEQ ID NO: 1257973 - RNA, 21 nt, Human
caaaauuucaaagugcucuuc

SEQ ID NO: 1257974 - RNA, 27 nt, Human
caaagaaccaauaauaagaacuuucuu

SEQ ID NO: 1257975 - RNA, 21 nt, Human
caauagcaaaaugaugugaag

SEQ ID NO: 1257976 - RNA, 24 nt, Human
caccauaagaaaaagaacacccca

SEQ ID NO: 1257977 - RNA, 22 nt, Human
cauuuuuauuucacaucagaaa

SEQ ID NO: 1257978 - RNA, 20 nt, Human
cccaaggaguuccuucuugu

SEQ ID NO: 1257979 - RNA, 18 nt, Human
ccuuugaaggagggcagg

SEQ ID NO: 1257980 - RNA, 21 nt, Human
cgccacuccuucaaagggaag

SEQ ID NO: 1257981 - RNA, 18 nt, Human
cuaauaguaauuacaaga

SEQ ID NO: 1257982 - RNA, 20 nt, Human
cuacaugagauaaaaauccu

SEQ ID NO: 1257983 - RNA, 18 nt, Human
cuccaacgcgaacugucc

SEQ ID NO: 1257984 - RNA, 20 nt, Human
cuuguaaauaaaguugcuau

SEQ ID NO: 1257985 - RNA, 22 nt, Human
gacaauaaaaacagcccugaga

SEQ ID NO: 1257986 - RNA, 19 nt, Human
gaccacaauaaaaugagcc

SEQ ID NO: 1257987 - RNA, 21 nt, Human
gagaaaaaccagagauucaua

SEQ ID NO: 1257988 - RNA, 19 nt, Human
gagggcaggaaaaacuaug

SEQ ID NO: 1257989 - RNA, 24 nt, Human
gcacauggauuuuuauauuaauag

SEQ ID NO: 1257990 - RNA, 18 nt, Human
ggacaauaaaaacagccc

SEQ ID NO: 1257991 - RNA, 22 nt, Human
ggcagaaaaaaaaguucacuag

SEQ ID NO: 1257992 - RNA, 21 nt, Human
gucaaauauuuacugcuaaua

SEQ ID NO: 1257993 - RNA, 20 nt, Human
uaaaaugaauccaaagaacc

SEQ ID NO: 1257994 - RNA, 21 nt, Human
uaaaaugaauccaaagaacca

SEQ ID NO: 1257995 - RNA, 22 nt, Human
uaacucagaacaaugcauuuua

SEQ ID NO: 1257996 - RNA, 21 nt, Human
uaagaaaaagaacaccccaaa

SEQ ID NO: 1257997 - RNA, 19 nt, Human
uaagucaaauauuuacugc

SEQ ID NO: 1257998 - RNA, 22 nt, Human
uacaauuuaaaauauuuacaga

SEQ ID NO: 1257999 - RNA, 22 nt, Human
uaguauuucugcaaccaaauau

SEQ ID NO: 1258000 - RNA, 24 nt, Human
ucagauaaccaagaaaaaaguaau

SEQ ID NO: 1258001 - RNA, 24 nt, Human
uccaugaucaaaacaaacaauagc

SEQ ID NO: 1258002 - RNA, 25 nt, Human
ucuuccuauauagcauguacuucag

SEQ ID NO: 1258003 - RNA, 22 nt, Human
ucuuccucaguaacuucuauug

SEQ ID NO: 1258004 - RNA, 18 nt, Human
ugaaguacaugaaagaag

SEQ ID NO: 1258005 - RNA, 21 nt, Human
ugauaauggaaauaaauguau

SEQ ID NO: 1258006 - RNA, 22 nt, Human
ugaucaaaacaaacaauagcaa

SEQ ID NO: 1258007 - RNA, 21 nt, Human
ugaugugaagaaaagggccca

SEQ ID NO: 1258008 - RNA, 26 nt, Human
ugcaaccaaauauccuacaugagaua

SEQ ID NO: 1258009 - RNA, 19 nt, Human
uggaaaaaaaagucugauu

SEQ ID NO: 1258010 - RNA, 20 nt, Human
uggauccuaaauaaauuccu

SEQ ID NO: 1258011 - RNA, 20 nt, Human
uguaaauaaaguugcuauac

SEQ ID NO: 1258012 - RNA, 19 nt, Human
ugugaagaaaagggcccau

SEQ ID NO: 1258013 - RNA, 20 nt, Human
uuaaaaacaaucaucauaac

SEQ ID NO: 1258014 - RNA, 21 nt, Human
uucaaagggaagauuugaaaa

SEQ ID NO: 1258015 - RNA, 21 nt, Human
uucacuagcaauaguugauaa

SEQ ID NO: 1258016 - RNA, 19 nt, Human
uucuauuguucuuucccug

SEQ ID NO: 1258017 - RNA, 20 nt, Human
uuuacagaauucucaaaaaa

SEQ ID NO: 1258018 - RNA, 21 nt, Human
uuugaaguacaugaaagaagu

SEQ ID NO: 1258019 - RNA, 25 nt, Human
uuuuuauauuaauaguuaguagcua

SEQ ID NO: 1258020 - RNA, 18 nt, Human
aagaggacaaaucgaggg

SEQ ID NO: 1258021 - RNA, 20 nt, Human
acccuuggggcugcucuuga

SEQ ID NO: 1258022 - RNA, 19 nt, Human
acgacacagacaggcuucc

SEQ ID NO: 1258023 - RNA, 25 nt, Human
acucucacgaacuggugguggaagu

SEQ ID NO: 1258024 - RNA, 21 nt, Human
agaacaggaacucucacgaac

SEQ ID NO: 1258025 - RNA, 22 nt, Human
agaagaaggaguggugacugag

SEQ ID NO: 1258026 - RNA, 22 nt, Human
agaagaaggaguggugacugag

SEQ ID NO: 1258027 - RNA, 21 nt, Human
aggaacucucacgaacuggug

SEQ ID NO: 1258028 - RNA, 19 nt, Human
aggaacucucacuuaauac

SEQ ID NO: 1258029 - RNA, 23 nt, Human
aggcaaguuugcugaucuuuucu

SEQ ID NO: 1258030 - RNA, 24 nt, Human
agggaaucagguacugcugugaag

SEQ ID NO: 1258031 - RNA, 19 nt, Human
aggggaaggcuguggguuc

SEQ ID NO: 1258032 - RNA, 19 nt, Human
cagccggaaaagacaguug

SEQ ID NO: 1258033 - RNA, 23 nt, Human
caggaaggagcaagaggacaaau

SEQ ID NO: 1258034 - RNA, 23 nt, Human
cagguacugcugugaagguggug

SEQ ID NO: 1258035 - RNA, 19 nt, Human
cccaaauccuccugccaag

SEQ ID NO: 1258036 - RNA, 19 nt, Human
ccccaaauccuccugccaa

SEQ ID NO: 1258037 - RNA, 23 nt, Human
ccccugaacccuuggggcugcuc

SEQ ID NO: 1258038 - RNA, 21 nt, Human
cccuuggggcugcucuugagc

SEQ ID NO: 1258039 - RNA, 19 nt, Human
ccgcucgaaauccacaauc

SEQ ID NO: 1258040 - RNA, 24 nt, Human
ccggaaaagacaguugacucaggc

SEQ ID NO: 1258041 - RNA, 24 nt, Human
ccugcuguccuagcaggaaggagc

SEQ ID NO: 1258042 - RNA, 24 nt, Human
cggaaaagacaguugacucaggca

SEQ ID NO: 1258043 - RNA, 20 nt, Human
cuccuuggcuugcgcccuga

SEQ ID NO: 1258044 - RNA, 18 nt, Human
cuuggcuugcgcccugac

SEQ ID NO: 1258045 - RNA, 22 nt, Human
gagacagaaacaccccugaacc

SEQ ID NO: 1258046 - RNA, 20 nt, Human
gaggggaaggcuguggguuc

SEQ ID NO: 1258047 - RNA, 20 nt, Human
gcuacagcauguguacgaga

SEQ ID NO: 1258048 - RNA, 18 nt, Human
ggaaaagacaguugacuc

SEQ ID NO: 1258049 - RNA, 21 nt, Human
ggaaaagacaguugacucagg

SEQ ID NO: 1258050 - RNA, 19 nt, Human
ggcuuugggguccucaaug

SEQ ID NO: 1258051 - RNA, 19 nt, Human
gggaaucagguacugcugu

SEQ ID NO: 1258052 - RNA, 25 nt, Human
gggagaagaaggaguggugacugag

SEQ ID NO: 1258053 - RNA, 18 nt, Human
gggcuccuuggcuugcgc

SEQ ID NO: 1258054 - RNA, 19 nt, Human
ggggaaggcuguggguucu

SEQ ID NO: 1258055 - RNA, 18 nt, Human
guacugcugugaaggugg

SEQ ID NO: 1258056 - RNA, 24 nt, Human
gugccagggguuuggggcuuuggg

SEQ ID NO: 1258057 - RNA, 19 nt, Human
uacugcugugaagguggug

SEQ ID NO: 1258058 - RNA, 18 nt, Human
uagcaggaaggagcaaga

SEQ ID NO: 1258059 - RNA, 22 nt, Human
uagggaaucagguacugcugug

SEQ ID NO: 1258060 - RNA, 19 nt, Human
ucccggugagcuuggaugu

SEQ ID NO: 1258061 - RNA, 27 nt, Human
ucccugacgacacagacaggcuucccg

SEQ ID NO: 1258062 - RNA, 19 nt, Human
ucccuggggcuccuuggcu

SEQ ID NO: 1258063 - RNA, 20 nt, Human
ucccuggggcuccuuggcuu

SEQ ID NO: 1258064 - RNA, 23 nt, Human
uccucaaugcccggcggauccgc

SEQ ID NO: 1258065 - RNA, 23 nt, Human
ucuguagccauuguaugcuuuuu

SEQ ID NO: 1258066 - RNA, 24 nt, Human
ucuguggcccacugucccuggggc

SEQ ID NO: 1258067 - RNA, 24 nt, Human
ugcagaacaggaacucucacuuaa

SEQ ID NO: 1258068 - RNA, 22 nt, Human
ugccagggguuuggggcuuugg

SEQ ID NO: 1258069 - RNA, 25 nt, Human
ugcgcccugacuucuucuccaguuu

SEQ ID NO: 1258070 - RNA, 18 nt, Human
ugcugggggugugggugg

SEQ ID NO: 1258071 - RNA, 18 nt, Human
ugcugggggugugggugg

SEQ ID NO: 1258072 - RNA, 25 nt, Human
uggaagccccaaauccuccugccaa

SEQ ID NO: 1258073 - RNA, 18 nt, Human
uggauaaucagccaauug

SEQ ID NO: 1258074 - RNA, 22 nt, Human
uggggcuuugggguccucaaug

SEQ ID NO: 1258075 - RNA, 21 nt, Human
ugggucacgugcugggggugu

SEQ ID NO: 1258076 - RNA, 23 nt, Human
uggugccgggagaagaaggagug

SEQ ID NO: 1258077 - RNA, 21 nt, Human
uucagcucagccuuuggacuc

SEQ ID NO: 1258078 - RNA, 21 nt, Human
uuucuguggcccacugucccu

SEQ ID NO: 1258079 - RNA, 19 nt, Human
uuugggguccucaaugccc

SEQ ID NO: 1258080 - RNA, 18 nt, Human
cccagccuugccuuucuu

SEQ ID NO: 1258081 - RNA, 24 nt, Human
cccagccuugccuuucuugauggc

SEQ ID NO: 1258082 - RNA, 20 nt, Human
ccccuaggcaucgcccuccg

SEQ ID NO: 1258083 - RNA, 19 nt, Human
cggcguccccagccuugcc

SEQ ID NO: 1258084 - RNA, 21 nt, Human
cuaggcaucgcccuccgcacc

SEQ ID NO: 1258085 - RNA, 22 nt, Human
guccccagccuugccuuucuug

SEQ ID NO: 1258086 - RNA, 19 nt, Human
ugauggcuaaagcaacagc

SEQ ID NO: 1258087 - RNA, 21 nt, Human
aaacaauggaguaggagucau

SEQ ID NO: 1258088 - RNA, 22 nt, Human
aagaagcccaaugcaacgcugc

SEQ ID NO: 1258089 - RNA, 25 nt, Human
aagaagcccaaugcaacgcugcagc

SEQ ID NO: 1258090 - RNA, 22 nt, Human
aagcuacaggacaagucuuaac

SEQ ID NO: 1258091 - RNA, 21 nt, Human
accacacuaauuauuagcaaa

SEQ ID NO: 1258092 - RNA, 21 nt, Human
acggggagugggguuggaagg

SEQ ID NO: 1258093 - RNA, 21 nt, Human
acuacacugaagacagguugc

SEQ ID NO: 1258094 - RNA, 18 nt, Human
acugaagacagguugcuc

SEQ ID NO: 1258095 - RNA, 22 nt, Human
acugagucuguaggcagaguga

SEQ ID NO: 1258096 - RNA, 22 nt, Human
acuucuggauucugggaguggg

SEQ ID NO: 1258097 - RNA, 19 nt, Human
agaguugggaggccaagaa

SEQ ID NO: 1258098 - RNA, 19 nt, Human
agcccaaugcaacgcugca

SEQ ID NO: 1258099 - RNA, 22 nt, Human
agcuuacuucuggauucuggga

SEQ ID NO: 1258100 - RNA, 23 nt, Human
agcuuacuucuggauucugggag

SEQ ID NO: 1258101 - RNA, 18 nt, Human
agggcuuguggggaaagc

SEQ ID NO: 1258102 - RNA, 21 nt, Human
agugaugaggaaaagccagga

SEQ ID NO: 1258103 - RNA, 19 nt, Human
cagguccuggggaccugca

SEQ ID NO: 1258104 - RNA, 21 nt, Human
cauucuugauacaggaagaag

SEQ ID NO: 1258105 - RNA, 20 nt, Human
ccaagaagcccaaugcaacg

SEQ ID NO: 1258106 - RNA, 19 nt, Human
ccauuggucaaagcuguaa

SEQ ID NO: 1258107 - RNA, 24 nt, Human
cucacucugccuuuguacuacacu

SEQ ID NO: 1258108 - RNA, 19 nt, Human
cugagggaagcaaggacuc

SEQ ID NO: 1258109 - RNA, 19 nt, Human
cuggaagagucucuuaacc

SEQ ID NO: 1258110 - RNA, 26 nt, Human
cuggggaccugcaggcuguguauccu

SEQ ID NO: 1258111 - RNA, 25 nt, Human
gacaagucuuaacaagagguuugug

SEQ ID NO: 1258112 - RNA, 22 nt, Human
gacugcuuaggaggugaaggau

SEQ ID NO: 1258113 - RNA, 23 nt, Human
gaggaaaagccaggacugcuuag

SEQ ID NO: 1258114 - RNA, 23 nt, Human
gaggugccauucaagaccuggcg

SEQ ID NO: 1258115 - RNA, 19 nt, Human
gauucugggagugggaaga

SEQ ID NO: 1258116 - RNA, 23 nt, Human
gcugcagcugagcuacuuuuauu

SEQ ID NO: 1258117 - RNA, 22 nt, Human
ggaaaagccaggacugcuuagg

SEQ ID NO: 1258118 - RNA, 21 nt, Human
ggagugaugaggaaaagccag

SEQ ID NO: 1258119 - RNA, 20 nt, Human
ggagugggguuggaaggagc

SEQ ID NO: 1258120 - RNA, 24 nt, Human
gggaagaguugggaggccaagaag

SEQ ID NO: 1258121 - RNA, 21 nt, Human
gggagugggguuggaaggagc

SEQ ID NO: 1258122 - RNA, 19 nt, Human
gugaaggaugggaggggag

SEQ ID NO: 1258123 - RNA, 21 nt, Human
uaaugcagcugggacucauua

SEQ ID NO: 1258124 - RNA, 19 nt, Human
uacauccuucugacaauug

SEQ ID NO: 1258125 - RNA, 20 nt, Human
uagaauuagcagcaauuaac

SEQ ID NO: 1258126 - RNA, 22 nt, Human
uaggaggugaaggaugggaggg

SEQ ID NO: 1258127 - RNA, 19 nt, Human
uauccuagggagaggugcc

SEQ ID NO: 1258128 - RNA, 22 nt, Human
ucuaaagcacauucuugauaca

SEQ ID NO: 1258129 - RNA, 18 nt, Human
ugaacggggagugggguu

SEQ ID NO: 1258130 - RNA, 23 nt, Human
ugaggaaaagccaggacugcuua

SEQ ID NO: 1258131 - RNA, 19 nt, Human
ugaguaggaagggggaggg

SEQ ID NO: 1258132 - RNA, 22 nt, Human
ugccacagugaggcggguguca

SEQ ID NO: 1258133 - RNA, 19 nt, Human
ugggaggccaagaagccca

SEQ ID NO: 1258134 - RNA, 19 nt, Human
ugggaggggagggggucau

SEQ ID NO: 1258135 - RNA, 19 nt, Human
ugggcagacagccuucacc

SEQ ID NO: 1258136 - RNA, 22 nt, Human
ugggcagugauuguaacaugau

SEQ ID NO: 1258137 - RNA, 22 nt, Human
uggggaccugcaggcuguguau

SEQ ID NO: 1258138 - RNA, 20 nt, Human
uguaacaaaucacuccagcc

SEQ ID NO: 1258139 - RNA, 20 nt, Human
uuaggaggugaaggauggga

SEQ ID NO: 1258140 - RNA, 18 nt, Human
uuucugagggaagcaagg

SEQ ID NO: 1258141 - RNA, 24 nt, Human
aaucaccaaagcccgguugccuga

SEQ ID NO: 1258142 - RNA, 24 nt, Human
accaaagcccgguugccugagggc

SEQ ID NO: 1258143 - RNA, 21 nt, Human
caaagcccgguugccugaggg

SEQ ID NO: 1258144 - RNA, 18 nt, Human
cacugcagcuucaacugu

SEQ ID NO: 1258145 - RNA, 18 nt, Human
ccugagggcuccucaucu

SEQ ID NO: 1258146 - RNA, 19 nt, Human
cuccucaucugaacucugg

SEQ ID NO: 1258147 - RNA, 18 nt, Human
aaaucuucaaaaccacag

SEQ ID NO: 1258148 - RNA, 20 nt, Human
aacaaaagcuacuucuccca

SEQ ID NO: 1258149 - RNA, 21 nt, Human
aacugcccugcuugcugcugg

SEQ ID NO: 1258150 - RNA, 23 nt, Human
aagggccaagguaucuggagaua

SEQ ID NO: 1258151 - RNA, 22 nt, Human
acaacaaaagcuacuucuccca

SEQ ID NO: 1258152 - RNA, 23 nt, Human
acaggaacgcaagcuugaaucug

SEQ ID NO: 1258153 - RNA, 19 nt, Human
accccucuuucuccucccc

SEQ ID NO: 1258154 - RNA, 19 nt, Human
accccucuuucuccucccc

SEQ ID NO: 1258155 - RNA, 21 nt, Human
accccucuuucuccuccccca

SEQ ID NO: 1258156 - RNA, 23 nt, Human
accccucuuucuccucccccauc

SEQ ID NO: 1258157 - RNA, 20 nt, Human
acuucucccacccucuuccc

SEQ ID NO: 1258158 - RNA, 19 nt, Human
agagccccccauuccaccu

SEQ ID NO: 1258159 - RNA, 23 nt, Human
agagucuucacuagguccuucag

SEQ ID NO: 1258160 - RNA, 18 nt, Human
agcacagagacaccagga

SEQ ID NO: 1258161 - RNA, 21 nt, Human
agccagguucccgcauuacca

SEQ ID NO: 1258162 - RNA, 18 nt, Human
agcgcaggagcacagaga

SEQ ID NO: 1258163 - RNA, 22 nt, Human
aggcagaaaagggcaguccuga

SEQ ID NO: 1258164 - RNA, 21 nt, Human
aggcugaucacauuacccagc

SEQ ID NO: 1258165 - RNA, 26 nt, Human
caaggucagaugcugggagcaaugcc

SEQ ID NO: 1258166 - RNA, 20 nt, Human
cacauuacccagcugagguc

SEQ ID NO: 1258167 - RNA, 18 nt, Human
caccaccuccucaucaag

SEQ ID NO: 1258168 - RNA, 19 nt, Human
caccuccucuuccuucuuc

SEQ ID NO: 1258169 - RNA, 25 nt, Human
caccuccucuuccuucuucucuucc

SEQ ID NO: 1258170 - RNA, 23 nt, Human
cagagucccugcugcacagggcu

SEQ ID NO: 1258171 - RNA, 23 nt, Human
caguccugaaggaccccacacug

SEQ ID NO: 1258172 - RNA, 20 nt, Human
caucaagccuccaccuccuc

SEQ ID NO: 1258173 - RNA, 23 nt, Human
caucuuaccaccccacuuccugu

SEQ ID NO: 1258174 - RNA, 18 nt, Human
cauuccagagcuuggcca

SEQ ID NO: 1258175 - RNA, 21 nt, Human
ccaaaucacccugugcuguuc

SEQ ID NO: 1258176 - RNA, 19 nt, Human
ccaccuccucuuccuucuu

SEQ ID NO: 1258177 - RNA, 20 nt, Human
ccaggaggagaggaagcgca

SEQ ID NO: 1258178 - RNA, 19 nt, Human
cccaaaucagggcucagaa

SEQ ID NO: 1258179 - RNA, 21 nt, Human
ccccagcugcauuccugggcu

SEQ ID NO: 1258180 - RNA, 22 nt, Human
ccccccauuccaccuuguuggc

SEQ ID NO: 1258181 - RNA, 19 nt, Human
cccgcuggacauucucccc

SEQ ID NO: 1258182 - RNA, 20 nt, Human
cccugcugcacagggcuccu

SEQ ID NO: 1258183 - RNA, 22 nt, Human
ccuaaaacuccaagaacaaggg

SEQ ID NO: 1258184 - RNA, 18 nt, Human
ccuccaccuccucuuccu

SEQ ID NO: 1258185 - RNA, 24 nt, Human
ccucccccaucucaccaagccaga

SEQ ID NO: 1258186 - RNA, 19 nt, Human
ccuccucuuccuucuucuc

SEQ ID NO: 1258187 - RNA, 19 nt, Human
ccuggcccuuacuucuccc

SEQ ID NO: 1258188 - RNA, 19 nt, Human
cuagaggaggcagaggggc

SEQ ID NO: 1258189 - RNA, 21 nt, Human
cucccccaucucaccaagcca

SEQ ID NO: 1258190 - RNA, 21 nt, Human
cucccgcuggacauucucccc

SEQ ID NO: 1258191 - RNA, 19 nt, Human
cucuuuguucuucccaaau

SEQ ID NO: 1258192 - RNA, 21 nt, Human
cuugcugcuggaccucucaga

SEQ ID NO: 1258193 - RNA, 18 nt, Human
cuuggcucugccaccucc

SEQ ID NO: 1258194 - RNA, 24 nt, Human
gacaggaacgcaagcuugaaucug

SEQ ID NO: 1258195 - RNA, 22 nt, Human
gagcuuggccaauuucaggccc

SEQ ID NO: 1258196 - RNA, 21 nt, Human
gaggaagcgcaggagcacaga

SEQ ID NO: 1258197 - RNA, 20 nt, Human
gaggcagaggggccuggccu

SEQ ID NO: 1258198 - RNA, 22 nt, Human
gaggcagaggggccuggccucu

SEQ ID NO: 1258199 - RNA, 21 nt, Human
gcagaaaagggcaguccugaa

SEQ ID NO: 1258200 - RNA, 20 nt, Human
gcaggagcacagagacacca

SEQ ID NO: 1258201 - RNA, 22 nt, Human
gcaguccugaaggaccccacac

SEQ ID NO: 1258202 - RNA, 23 nt, Human
ggaggcagaggggccuggccucu

SEQ ID NO: 1258203 - RNA, 18 nt, Human
ggcagaggggccuggccu

SEQ ID NO: 1258204 - RNA, 21 nt, Human
ggcuagaggaggcagaggggc

SEQ ID NO: 1258205 - RNA, 18 nt, Human
ggcucagaaccaugacag

SEQ ID NO: 1258206 - RNA, 25 nt, Human
gugcuggguccuucauaacaggccg

SEQ ID NO: 1258207 - RNA, 18 nt, Human
guucuucccaaaucaggg

SEQ ID NO: 1258208 - RNA, 24 nt, Human
uaaaacuccaagaacaagggccaa

SEQ ID NO: 1258209 - RNA, 18 nt, Human
uaccauagauaggaugcu

SEQ ID NO: 1258210 - RNA, 23 nt, Human
uagcagcuuuggaaugcagaaag

SEQ ID NO: 1258211 - RNA, 18 nt, Human
uaggaugcuuuucugacc

SEQ ID NO: 1258212 - RNA, 22 nt, Human
uaucagaacaaagccagguucc

SEQ ID NO: 1258213 - RNA, 24 nt, Human
ucaaaaccacagcucugcuucugc

SEQ ID NO: 1258214 - RNA, 27 nt, Human
ucacaggccaccaccuccucaucaagc

SEQ ID NO: 1258215 - RNA, 18 nt, Human
ucccacccucuucccuuc

SEQ ID NO: 1258216 - RNA, 21 nt, Human
ucccgcuggacauucucccca

SEQ ID NO: 1258217 - RNA, 24 nt, Human
uccucaucaagccuccaccuccuc

SEQ ID NO: 1258218 - RNA, 22 nt, Human
ucucaccaagccagagcccccc

SEQ ID NO: 1258219 - RNA, 22 nt, Human
ucuccucccccaucucaccaag

SEQ ID NO: 1258220 - RNA, 22 nt, Human
ucuuccugcaugcaaugaggau

SEQ ID NO: 1258221 - RNA, 19 nt, Human
ugaaaugaguggccucaac

SEQ ID NO: 1258222 - RNA, 19 nt, Human
ugaaucggccagugggaaa

SEQ ID NO: 1258223 - RNA, 19 nt, Human
ugacaucuuaccaccccac

SEQ ID NO: 1258224 - RNA, 19 nt, Human
ugaccccucuuucuccucc

SEQ ID NO: 1258225 - RNA, 22 nt, Human
ugaccugagcccccauuuaaac

SEQ ID NO: 1258226 - RNA, 20 nt, Human
ugagaaggcagaaaagggca

SEQ ID NO: 1258227 - RNA, 24 nt, Human
ugccaccuccuugcugugugaccu

SEQ ID NO: 1258228 - RNA, 24 nt, Human
ugcccagacccucauuccagagcu

SEQ ID NO: 1258229 - RNA, 21 nt, Human
ugcuggaccucucagaaccca

SEQ ID NO: 1258230 - RNA, 20 nt, Human
ugcuugcugcuggaccucuc

SEQ ID NO: 1258231 - RNA, 20 nt, Human
uggcccccagcugcauuccu

SEQ ID NO: 1258232 - RNA, 20 nt, Human
uggccucaaggagagucuuc

SEQ ID NO: 1258233 - RNA, 18 nt, Human
ugggcccaacugcccugc

SEQ ID NO: 1258234 - RNA, 24 nt, Human
uggggugggcccaacugcccugcu

SEQ ID NO: 1258235 - RNA, 20 nt, Human
uggguacacaacaaaagcua

SEQ ID NO: 1258236 - RNA, 22 nt, Human
ugugcuguucugaagaguuuua

SEQ ID NO: 1258237 - RNA, 25 nt, Human
uuccuucuucucuuccugcaugcaa

SEQ ID NO: 1258238 - RNA, 23 nt, Human
uucuccccaucucacucuugcca

SEQ ID NO: 1258239 - RNA, 19 nt, Human
uucuuggcucugccaccuc

SEQ ID NO: 1258240 - RNA, 19 nt, Human
aaacaucaucaucaacuuc

SEQ ID NO: 1258241 - RNA, 19 nt, Human
aaaguaugacacugcucuu

SEQ ID NO: 1258242 - RNA, 22 nt, Human
agagaacagcauauuccuuuca

SEQ ID NO: 1258243 - RNA, 18 nt, Human
agaggcugauagagaaca

SEQ ID NO: 1258244 - RNA, 20 nt, Human
auagaggcugauagagaaca

SEQ ID NO: 1258245 - RNA, 20 nt, Human
auuucuuuggggucuucuuu

SEQ ID NO: 1258246 - RNA, 21 nt, Human
caacauucuuagaaacaguua

SEQ ID NO: 1258247 - RNA, 23 nt, Human
cacauuguucuucuguggguuca

SEQ ID NO: 1258248 - RNA, 21 nt, Human
ccaguaaaguaugacacugcu

SEQ ID NO: 1258249 - RNA, 18 nt, Human
cucaaaucgcuuaucaaa

SEQ ID NO: 1258250 - RNA, 23 nt, Human
cuccaguaaaguaugacacugcu

SEQ ID NO: 1258251 - RNA, 20 nt, Human
gcucuugggauuauacgcuc

SEQ ID NO: 1258252 - RNA, 20 nt, Human
guaaacauuaccucauccgc

SEQ ID NO: 1258253 - RNA, 20 nt, Human
guuaccauucacauuguucu

SEQ ID NO: 1258254 - RNA, 26 nt, Human
ucacauuguucuucuguggguucaua

SEQ ID NO: 1258255 - RNA, 20 nt, Human
uccucugaaaucucaucuuc

SEQ ID NO: 1258256 - RNA, 20 nt, Human
uuucucaucuucgaucuugg

SEQ ID NO: 1258257 - RNA, 28 nt, Human
acugcauauuaaaaaaaaaaaaaaaaaa

SEQ ID NO: 1258258 - RNA, 20 nt, Human
aucagagcuggacgugacau

SEQ ID NO: 1258259 - RNA, 25 nt, Human
auuaaaaaaaaaaaaaaaaaaaaau

SEQ ID NO: 1258260 - RNA, 20 nt, Human
ccagacaauucugaugccau

SEQ ID NO: 1258261 - RNA, 18 nt, Human
ccccccuuuaauugacca

SEQ ID NO: 1258262 - RNA, 18 nt, Human
ccuaaaugugaugugcuc

SEQ ID NO: 1258263 - RNA, 19 nt, Human
cugaugccauccaguuuug

SEQ ID NO: 1258264 - RNA, 22 nt, Human
cugcccaagacaaaacuuccag

SEQ ID NO: 1258265 - RNA, 18 nt, Human
gauccgcggggcucccuc

SEQ ID NO: 1258266 - RNA, 24 nt, Human
uccgcggggcucccucagccaucc

SEQ ID NO: 1258267 - RNA, 23 nt, Human
ugcccaagacaaaacuuccagac

SEQ ID NO: 1258268 - RNA, 23 nt, Human
ugcccaagacaaaacuuccagac

SEQ ID NO: 1258269 - RNA, 20 nt, Human
uuaaaaaaaaaaaaaaaaaa

SEQ ID NO: 1258270 - RNA, 22 nt, Human
uuccccccuuuaauugaccaaa

SEQ ID NO: 1258271 - RNA, 24 nt, Human
aaaggcauuaguaagaaaccaaag

SEQ ID NO: 1258272 - RNA, 27 nt, Human
aaauacacuggacugguauagagacac

SEQ ID NO: 1258273 - RNA, 25 nt, Human
aagaaaccaaagcacuuucccagcg

SEQ ID NO: 1258274 - RNA, 23 nt, Human
aagagagugagaagcaggacaca

SEQ ID NO: 1258275 - RNA, 23 nt, Human
aagagagugagaagcaggacaca

SEQ ID NO: 1258276 - RNA, 20 nt, Human
aagcaggacacagggguaga

SEQ ID NO: 1258277 - RNA, 19 nt, Human
aagccccagccugcuucuc

SEQ ID NO: 1258278 - RNA, 24 nt, Human
aaguagcucugcuaugggaggggg

SEQ ID NO: 1258279 - RNA, 23 nt, Human
aauggaagagagugagaagcagg

SEQ ID NO: 1258280 - RNA, 20 nt, Human
acagaaacccuaacgaccau

SEQ ID NO: 1258281 - RNA, 18 nt, Human
acagggguagagaaaaga

SEQ ID NO: 1258282 - RNA, 26 nt, Human
acagggguagagaaaagagaaaggga

SEQ ID NO: 1258283 - RNA, 22 nt, Human
acucugucacccaccagcuccu

SEQ ID NO: 1258284 - RNA, 24 nt, Human
agaaaauccucuucaugcuauuca

SEQ ID NO: 1258285 - RNA, 18 nt, Human
agaaguggaaauacacug

SEQ ID NO: 1258286 - RNA, 19 nt, Human
agacagaaacccuaacgac

SEQ ID NO: 1258287 - RNA, 23 nt, Human
agacaggcauagaaugggucccc

SEQ ID NO: 1258288 - RNA, 20 nt, Human
agagaaagggagaaagagag

SEQ ID NO: 1258289 - RNA, 21 nt, Human
agagaggcccccucuguccuc

SEQ ID NO: 1258290 - RNA, 21 nt, Human
agagcaaaccucaggcucaga

SEQ ID NO: 1258291 - RNA, 19 nt, Human
agaggagaggcagaagugg

SEQ ID NO: 1258292 - RNA, 24 nt, Human
agcaaaccucaggcucagacagaa

SEQ ID NO: 1258293 - RNA, 18 nt, Human
agcugcugggcugugggc

SEQ ID NO: 1258294 - RNA, 22 nt, Human
aggaaaaaauaaaacgacucug

SEQ ID NO: 1258295 - RNA, 22 nt, Human
aggcagaaguggaaauacacug

SEQ ID NO: 1258296 - RNA, 21 nt, Human
agggagaaagagagaaacuag

SEQ ID NO: 1258297 - RNA, 20 nt, Human
agggcuugggcggggugcag

SEQ ID NO: 1258298 - RNA, 25 nt, Human
auagcagagcaccuacucugucacc

SEQ ID NO: 1258299 - RNA, 21 nt, Human
aucccugcaccugccuaugcc

SEQ ID NO: 1258300 - RNA, 21 nt, Human
augcaugagggcuugggcggg

SEQ ID NO: 1258301 - RNA, 21 nt, Human
augccaaccagcuccugcaug

SEQ ID NO: 1258302 - RNA, 24 nt, Human
auuggugugugucaggaaauguug

SEQ ID NO: 1258303 - RNA, 24 nt, Human
caaaaugccaaccagcuccugcau

SEQ ID NO: 1258304 - RNA, 24 nt, Human
caagccccagccugcuucucccau

SEQ ID NO: 1258305 - RNA, 22 nt, Human
cacacuucauugagcacguagc

SEQ ID NO: 1258306 - RNA, 19 nt, Human
cacuggacugguauagaga

SEQ ID NO: 1258307 - RNA, 26 nt, Human
cauagcagagcaccuacucugucacc

SEQ ID NO: 1258308 - RNA, 23 nt, Human
caugcuauucaaguagcucugcu

SEQ ID NO: 1258309 - RNA, 19 nt, Human
cauuggucuccugaaguag

SEQ ID NO: 1258310 - RNA, 18 nt, Human
ccaccagcuccugacuug

SEQ ID NO: 1258311 - RNA, 20 nt, Human
ccagcuccugacuugaccau

SEQ ID NO: 1258312 - RNA, 25 nt, Human
ccagcuccugacuugaccaucugca

SEQ ID NO: 1258313 - RNA, 20 nt, Human
cccacaaacuuagggucaca

SEQ ID NO: 1258314 - RNA, 18 nt, Human
ccccagccugcuucuccc

SEQ ID NO: 1258315 - RNA, 19 nt, Human
ccccagccugcuucuccca

SEQ ID NO: 1258316 - RNA, 19 nt, Human
ccccucuguccucaaaucc

SEQ ID NO: 1258317 - RNA, 20 nt, Human
ccucaaaucccaagaggugc

SEQ ID NO: 1258318 - RNA, 20 nt, Human
ccugaaguagagacgaaagg

SEQ ID NO: 1258319 - RNA, 28 nt, Human
ccugaucugugcagcugaucgggcggcc

SEQ ID NO: 1258320 - RNA, 23 nt, Human
ccugccuaugccuuucuccucca

SEQ ID NO: 1258321 - RNA, 23 nt, Human
cgggcuccuccauaacuugcuuc

SEQ ID NO: 1258322 - RNA, 25 nt, Human
cucaggcucagacagaaacccuaac

SEQ ID NO: 1258323 - RNA, 20 nt, Human
cuccugaaguagagacgaaa

SEQ ID NO: 1258324 - RNA, 21 nt, Human
cucuuugaagcaggaugaaua

SEQ ID NO: 1258325 - RNA, 19 nt, Human
cugaaguagagacgaaagg

SEQ ID NO: 1258326 - RNA, 22 nt, Human
cugaugaagggaagagagcaaa

SEQ ID NO: 1258327 - RNA, 19 nt, Human
cuggccuuuggagucaagg

SEQ ID NO: 1258328 - RNA, 18 nt, Human
cuuagccuugacugcuga

SEQ ID NO: 1258329 - RNA, 22 nt, Human
cuucauugagcacguagcauau

SEQ ID NO: 1258330 - RNA, 18 nt, Human
cuuggcuucccuucccug

SEQ ID NO: 1258331 - RNA, 19 nt, Human
cuuuccuuucuugcuugga

SEQ ID NO: 1258332 - RNA, 18 nt, Human
gaagaaagacaaagggaa

SEQ ID NO: 1258333 - RNA, 26 nt, Human
gaagaaaggcauuaguaagaaaccaa

SEQ ID NO: 1258334 - RNA, 20 nt, Human
gaggcugggaauggaagaga

SEQ ID NO: 1258335 - RNA, 23 nt, Human
gcaaaccucaggcucagacagaa

SEQ ID NO: 1258336 - RNA, 20 nt, Human
gcagagcugcugggcugugg

SEQ ID NO: 1258337 - RNA, 18 nt, Human
ggaaauaaauaaucaggc

SEQ ID NO: 1258338 - RNA, 19 nt, Human
ggaagaaagacaaagggaa

SEQ ID NO: 1258339 - RNA, 20 nt, Human
ggaagaaagacaaagggaag

SEQ ID NO: 1258340 - RNA, 21 nt, Human
ggauuugaacucaaggcacaa

SEQ ID NO: 1258341 - RNA, 21 nt, Human
gggcuccuccauaacuugcuu

SEQ ID NO: 1258342 - RNA, 20 nt, Human
gucaaggagagaggcccccu

SEQ ID NO: 1258343 - RNA, 25 nt, Human
uaauauuaguauucccauuuuuuaa

SEQ ID NO: 1258344 - RNA, 20 nt, Human
uagaaagcaacucaugaagg

SEQ ID NO: 1258345 - RNA, 23 nt, Human
uagaaagcaacucaugaaggaga

SEQ ID NO: 1258346 - RNA, 18 nt, Human
uagaauggguccccaggc

SEQ ID NO: 1258347 - RNA, 20 nt, Human
uagaauggguccccaggcaa

SEQ ID NO: 1258348 - RNA, 18 nt, Human
uagaugugcaugugucuc

SEQ ID NO: 1258349 - RNA, 20 nt, Human
uaguaagaaaccaaagcacu

SEQ ID NO: 1258350 - RNA, 24 nt, Human
uaguaagaaaccaaagcacuuucc

SEQ ID NO: 1258351 - RNA, 23 nt, Human
uauagagacaccgggcuccucca

SEQ ID NO: 1258352 - RNA, 19 nt, Human
uaucaaaaugccaaccagc

SEQ ID NO: 1258353 - RNA, 20 nt, Human
ucauuuuccuguucucuggg

SEQ ID NO: 1258354 - RNA, 25 nt, Human
ucggugaugacagcugauauccaaa

SEQ ID NO: 1258355 - RNA, 21 nt, Human
ucuguccucaaaucccaagag

SEQ ID NO: 1258356 - RNA, 22 nt, Human
ucuguccucaaaucccaagagg

SEQ ID NO: 1258357 - RNA, 21 nt, Human
ucuuugguucugugauucauu

SEQ ID NO: 1258358 - RNA, 18 nt, Human
ugaauaugcaugagggcu

SEQ ID NO: 1258359 - RNA, 20 nt, Human
ugacagcugauauccaaacc

SEQ ID NO: 1258360 - RNA, 22 nt, Human
ugacuugaccaucugcauuucg

SEQ ID NO: 1258361 - RNA, 22 nt, Human
ugagaagcaggacacaggggua

SEQ ID NO: 1258362 - RNA, 18 nt, Human
ugagagacaggcauagaa

SEQ ID NO: 1258363 - RNA, 22 nt, Human
ugaucugugcagcugauuccuu

SEQ ID NO: 1258364 - RNA, 21 nt, Human
ugcagauguguuuuggaaauu

SEQ ID NO: 1258365 - RNA, 21 nt, Human
ugcauuucggggagaaggagc

SEQ ID NO: 1258366 - RNA, 22 nt, Human
ugcugagaguaagggcaaaaca

SEQ ID NO: 1258367 - RNA, 20 nt, Human
uggaagaaagacaaagggaa

SEQ ID NO: 1258368 - RNA, 19 nt, Human
ugggaggcugggaauggaa

SEQ ID NO: 1258369 - RNA, 20 nt, Human
ugggauaaaggagggggcag

SEQ ID NO: 1258370 - RNA, 18 nt, Human
ugggcuucaagccccagc

SEQ ID NO: 1258371 - RNA, 23 nt, Human
uggguuuucuuucugaaguaucc

SEQ ID NO: 1258372 - RNA, 20 nt, Human
ugucaggaaauguugagucc

SEQ ID NO: 1258373 - RNA, 22 nt, Human
ugucccacaaacuuagggucac

SEQ ID NO: 1258374 - RNA, 19 nt, Human
uuagggucacaaaaugcuc

SEQ ID NO: 1258375 - RNA, 22 nt, Human
uuagggucacaaaaugcucccu

SEQ ID NO: 1258376 - RNA, 19 nt, Human
uucauuuuccuguucucug

SEQ ID NO: 1258377 - RNA, 21 nt, Human
uucccagcgagcaaaguggcc

SEQ ID NO: 1258378 - RNA, 18 nt, Human
uugaaggaggagagagga

SEQ ID NO: 1258379 - RNA, 25 nt, Human
uuuaacuuuaaaaauccaauuuguc

SEQ ID NO: 1258380 - RNA, 23 nt, Human
uuuuaggagauaagcugccuccc

SEQ ID NO: 1258381 - RNA, 25 nt, Human
uuuucaaaguuuacuaggaaaaaau

SEQ ID NO: 1258382 - RNA, 25 nt, Human
aacaaggcucugaauagugccuucu

SEQ ID NO: 1258383 - RNA, 23 nt, Human
acaaugaaggagagaacagguuu

SEQ ID NO: 1258384 - RNA, 21 nt, Human
agaaguugaagcucucagguu

SEQ ID NO: 1258385 - RNA, 23 nt, Human
auuuggcaauccuguuucuggaa

SEQ ID NO: 1258386 - RNA, 20 nt, Human
caguccuggauccacucucc

SEQ ID NO: 1258387 - RNA, 18 nt, Human
ccaaagcagaaguugaag

SEQ ID NO: 1258388 - RNA, 22 nt, Human
ccaaagcagaaguugaagcucu

SEQ ID NO: 1258389 - RNA, 20 nt, Human
ccagggccaaagcagaaguu

SEQ ID NO: 1258390 - RNA, 22 nt, Human
ccccaggcucuacucacaccuc

SEQ ID NO: 1258391 - RNA, 23 nt, Human
cccccaggcucuacucacaccuc

SEQ ID NO: 1258392 - RNA, 18 nt, Human
gaagccaggacuccagag

SEQ ID NO: 1258393 - RNA, 21 nt, Human
ucaaugucaucacaaugaagg

SEQ ID NO: 1258394 - RNA, 26 nt, Human
uccagggccaaagcagaaguugaagc

SEQ ID NO: 1258395 - RNA, 22 nt, Human
ucccccaggcucuacucacacc

SEQ ID NO: 1258396 - RNA, 24 nt, Human
uuagugauggacagauacuccucu

SEQ ID NO: 1258397 - RNA, 20 nt, Human
uucaagaggaugaaaacucc

SEQ ID NO: 1258398 - RNA, 18 nt, Human
acagcagugaugggcggg

SEQ ID NO: 1258399 - RNA, 19 nt, Human
accacagcgcuccugugcu

SEQ ID NO: 1258400 - RNA, 18 nt, Human
acugaggacauuaugggg

SEQ ID NO: 1258401 - RNA, 21 nt, Human
agagggacaaagagaggcugg

SEQ ID NO: 1258402 - RNA, 19 nt, Human
aggcagauuacagagguuu

SEQ ID NO: 1258403 - RNA, 19 nt, Human
aggcagcccuggggucugg

SEQ ID NO: 1258404 - RNA, 21 nt, Human
aggcagcccuggggucugggc

SEQ ID NO: 1258405 - RNA, 18 nt, Human
aggcugagucgacggagg

SEQ ID NO: 1258406 - RNA, 18 nt, Human
caaacccgccagucgucc

SEQ ID NO: 1258407 - RNA, 24 nt, Human
cacaacucagcccuagucccaucc

SEQ ID NO: 1258408 - RNA, 25 nt, Human
cacaacucagcccuagucccauccc

SEQ ID NO: 1258409 - RNA, 22 nt, Human
cagagcucaggccccugaaucu

SEQ ID NO: 1258410 - RNA, 23 nt, Human
cagcugccugaaugaaccauuca

SEQ ID NO: 1258411 - RNA, 23 nt, Human
cagcuuccagagcucaggccccu

SEQ ID NO: 1258412 - RNA, 21 nt, Human
caggcagauuacagagguuaa

SEQ ID NO: 1258413 - RNA, 24 nt, Human
cagugggcaacuuuaggcucagau

SEQ ID NO: 1258414 - RNA, 25 nt, Human
ccaaccccucuuucuacucucccca

SEQ ID NO: 1258415 - RNA, 20 nt, Human
cccacagcaccggcccccau

SEQ ID NO: 1258416 - RNA, 20 nt, Human
ccccgccggccggcccgccc

SEQ ID NO: 1258417 - RNA, 22 nt, Human
ccccucuuucuacucuccccac

SEQ ID NO: 1258418 - RNA, 20 nt, Human
cccucuuucuacucucccca

SEQ ID NO: 1258419 - RNA, 23 nt, Human
cccucuuucuacucuccccacag

SEQ ID NO: 1258420 - RNA, 20 nt, Human
cccuggggucugggcugggc

SEQ ID NO: 1258421 - RNA, 19 nt, Human
cccuucaaauuauguaccg

SEQ ID NO: 1258422 - RNA, 18 nt, Human
ccgcccccuugcgcccgc

SEQ ID NO: 1258423 - RNA, 18 nt, Human
ccuagcccggccgcuggc

SEQ ID NO: 1258424 - RNA, 21 nt, Human
ccuagcccggccgcuggcacc

SEQ ID NO: 1258425 - RNA, 18 nt, Human
ccuauagauacaggcaga

SEQ ID NO: 1258426 - RNA, 23 nt, Human
ccucaugcuuggcaguccccuuc

SEQ ID NO: 1258427 - RNA, 18 nt, Human
ccuggccccgcggccuga

SEQ ID NO: 1258428 - RNA, 20 nt, Human
ccuugugaagccuucugucu

SEQ ID NO: 1258429 - RNA, 18 nt, Human
cgagugcuggcccuggag

SEQ ID NO: 1258430 - RNA, 21 nt, Human
cgcaaacccgccagucguccc

SEQ ID NO: 1258431 - RNA, 27 nt, Human
cggggucggguccagcgcaaacccgcc

SEQ ID NO: 1258432 - RNA, 20 nt, Human
cguaaguccuucuugugucc

SEQ ID NO: 1258433 - RNA, 20 nt, Human
cuucuuguguccacugucua

SEQ ID NO: 1258434 - RNA, 18 nt, Human
gaacagcagugaugggcg

SEQ ID NO: 1258435 - RNA, 23 nt, Human
gacauagaaaaguggaaaaggga

SEQ ID NO: 1258436 - RNA, 19 nt, Human
gacuugggguggaaggagg

SEQ ID NO: 1258437 - RNA, 19 nt, Human
gagcagcagauggcaccag

SEQ ID NO: 1258438 - RNA, 18 nt, Human
gaggcugggcuccuuugg

SEQ ID NO: 1258439 - RNA, 19 nt, Human
gcagcccuggggucugggc

SEQ ID NO: 1258440 - RNA, 23 nt, Human
gcccuagucccaucccuuuugcu

SEQ ID NO: 1258441 - RNA, 18 nt, Human
gccuucccugcuugugga

SEQ ID NO: 1258442 - RNA, 19 nt, Human
ggagcagcagauggcacca

SEQ ID NO: 1258443 - RNA, 25 nt, Human
ggccuugugaagccuucugucuugg

SEQ ID NO: 1258444 - RNA, 19 nt, Human
gggaaggagagaugcccau

SEQ ID NO: 1258445 - RNA, 27 nt, Human
gggccaggaucagagugaggcaaggga

SEQ ID NO: 1258446 - RNA, 20 nt, Human
ggugaccacaucugcagcag

SEQ ID NO: 1258447 - RNA, 20 nt, Human
uacggcagcgcccgcccccu

SEQ ID NO: 1258448 - RNA, 19 nt, Human
uaguaggcacuccuuggca

SEQ ID NO: 1258449 - RNA, 19 nt, Human
uaucaaaauggagacacaa

SEQ ID NO: 1258450 - RNA, 20 nt, Human
uauggggccaggaucagagu

SEQ ID NO: 1258451 - RNA, 20 nt, Human
ucaaaauggagacacaacuc

SEQ ID NO: 1258452 - RNA, 24 nt, Human
ucagggcguaaguccuucuugugu

SEQ ID NO: 1258453 - RNA, 21 nt, Human
uccccacagcaccggccccca

SEQ ID NO: 1258454 - RNA, 27 nt, Human
uccccacagcaccggcccccaucaccu

SEQ ID NO: 1258455 - RNA, 18 nt, Human
uccccugccucgcccgag

SEQ ID NO: 1258456 - RNA, 18 nt, Human
ucccgggcuggacuggcu

SEQ ID NO: 1258457 - RNA, 22 nt, Human
ucccugcuuguggaaguuucca

SEQ ID NO: 1258458 - RNA, 20 nt, Human
uccuuaggcagcccuggggg

SEQ ID NO: 1258459 - RNA, 22 nt, Human
uccuuaggcagcccuggggucu

SEQ ID NO: 1258460 - RNA, 20 nt, Human
ucugggcugggcuggcuaau

SEQ ID NO: 1258461 - RNA, 24 nt, Human
ugaacaagcaagagucugagcauu

SEQ ID NO: 1258462 - RNA, 18 nt, Human
ugaaccauucaugcccuc

SEQ ID NO: 1258463 - RNA, 18 nt, Human
ugagaugcccaccuauag

SEQ ID NO: 1258464 - RNA, 19 nt, Human
ugcagcuuccagagcucaa

SEQ ID NO: 1258465 - RNA, 20 nt, Human
uggaggaacagcagugaugg

SEQ ID NO: 1258466 - RNA, 23 nt, Human
uggaggaacagcagugaugggcg

SEQ ID NO: 1258467 - RNA, 26 nt, Human
uggauagagggacaaagagaggcugg

SEQ ID NO: 1258468 - RNA, 18 nt, Human
ugggguggaaggaggaca

SEQ ID NO: 1258469 - RNA, 22 nt, Human
uggugccagugggcaacuuuag

SEQ ID NO: 1258470 - RNA, 21 nt, Human
uuuccaggcguuggccuugug

SEQ ID NO: 1258471 - RNA, 19 nt, Human
agguguaagaaacaagaac

SEQ ID NO: 1258472 - RNA, 19 nt, Human
cacacuggaaaacuccugg

SEQ ID NO: 1258473 - RNA, 21 nt, Human
cagaaagaguagcugucuuac

SEQ ID NO: 1258474 - RNA, 22 nt, Human
cagcaacacacuggaaaacucc

SEQ ID NO: 1258475 - RNA, 23 nt, Human
cagcagcagcggcaagcccacag

SEQ ID NO: 1258476 - RNA, 22 nt, Human
cccacggcugcaaggugggagc

SEQ ID NO: 1258477 - RNA, 22 nt, Human
cugaaggcuuuggaucuccccu

SEQ ID NO: 1258478 - RNA, 18 nt, Human
cugcaaggugggagcugc

SEQ ID NO: 1258479 - RNA, 18 nt, Human
cugcaggugcugaaggcu

SEQ ID NO: 1258480 - RNA, 18 nt, Human
gcagcagcggcaagcccc

SEQ ID NO: 1258481 - RNA, 20 nt, Human
gugggagcugcaggugcuga

SEQ ID NO: 1258482 - RNA, 19 nt, Human
uaagcucgugacuaugaug

SEQ ID NO: 1258483 - RNA, 22 nt, Human
uaguggcagcaacacacuggaa

SEQ ID NO: 1258484 - RNA, 24 nt, Human
ucagcagcagcggcaagcccacag

SEQ ID NO: 1258485 - RNA, 19 nt, Human
ugagaggaauaagguagug

SEQ ID NO: 1258486 - RNA, 24 nt, Human
ugggagcugcaggugcugaaggcu

SEQ ID NO: 1258487 - RNA, 27 nt, Human
uguaccaacagaaagaguagcugucuu

SEQ ID NO: 1258488 - RNA, 24 nt, Human
uuggaucuccccucuguggugcug

SEQ ID NO: 1258489 - RNA, 22 nt, Human
cgcguuguacauuuucaugagu

SEQ ID NO: 1258490 - RNA, 21 nt, Human
ucuccuguccuugcuugcucg

SEQ ID NO: 1258491 - RNA, 21 nt, Human
uuucaugagugagaugucgcu

SEQ ID NO: 1258492 - RNA, 25 nt, Human
aaaagaccagaauuugagacgggug

SEQ ID NO: 1258493 - RNA, 27 nt, Human
aaaggucuucucgaaccauauccaccc

SEQ ID NO: 1258494 - RNA, 25 nt, Human
aaauaauagaaauuuauuuucuuac

SEQ ID NO: 1258495 - RNA, 18 nt, Human
aacaagaggagaacacca

SEQ ID NO: 1258496 - RNA, 20 nt, Human
aacaccacaaauacggcaaa

SEQ ID NO: 1258497 - RNA, 19 nt, Human
aacacggugaaaccccauc

SEQ ID NO: 1258498 - RNA, 20 nt, Human
aacacggugaaaccccaucu

SEQ ID NO: 1258499 - RNA, 21 nt, Human
aacacggugaaaccccaucuc

SEQ ID NO: 1258500 - RNA, 21 nt, Human
aacacggugaaaccccaucuc

SEQ ID NO: 1258501 - RNA, 20 nt, Human
aacagagcaagacuccaucu

SEQ ID NO: 1258502 - RNA, 23 nt, Human
aagaucacgccacugcacuccag

SEQ ID NO: 1258503 - RNA, 19 nt, Human
aaggaaauucacucaguac

SEQ ID NO: 1258504 - RNA, 25 nt, Human
aaggccccaccucuacauacuaucu

SEQ ID NO: 1258505 - RNA, 27 nt, Human
aaucacuuccucaaggccccaccucua

SEQ ID NO: 1258506 - RNA, 28 nt, Human
aaucacuuccucaaggccccaccucuac

SEQ ID NO: 1258507 - RNA, 24 nt, Human
aauggcgugaacccgggaggugga

SEQ ID NO: 1258508 - RNA, 20 nt, Human
acaccacaaauacggcaaac

SEQ ID NO: 1258509 - RNA, 24 nt, Human
acagagcaagacuccaucucaaaa

SEQ ID NO: 1258510 - RNA, 24 nt, Human
acauaacgcugcuuuaaaagacca

SEQ ID NO: 1258511 - RNA, 20 nt, Human
accaagaucacgccacugca

SEQ ID NO: 1258512 - RNA, 22 nt, Human
accacaaaaguagaaaacguaa

SEQ ID NO: 1258513 - RNA, 18 nt, Human
accccaucucuacuaaaa

SEQ ID NO: 1258514 - RNA, 23 nt, Human
acgccacugcacuccagccuggg

SEQ ID NO: 1258515 - RNA, 25 nt, Human
acgccacugcacuccagccuggggc

SEQ ID NO: 1258516 - RNA, 28 nt, Human
acuccaucucaaaaaaaaaaaaaaaaaa

SEQ ID NO: 1258517 - RNA, 18 nt, Human
acugcacuccagccuggg

SEQ ID NO: 1258518 - RNA, 18 nt, Human
acugcacuccagccuggg

SEQ ID NO: 1258519 - RNA, 25 nt, Human
acugcacuccagccuggggcaacag

SEQ ID NO: 1258520 - RNA, 18 nt, Human
agaacaccacaaauacgg

SEQ ID NO: 1258521 - RNA, 18 nt, Human
agagacagcauggaagac

SEQ ID NO: 1258522 - RNA, 18 nt, Human
agagagaaauaaaccugg

SEQ ID NO: 1258523 - RNA, 24 nt, Human
agcacuuugggaggccgaggcagg

SEQ ID NO: 1258524 - RNA, 22 nt, Human
agccgggcguggugguggcggg

SEQ ID NO: 1258525 - RNA, 25 nt, Human
agccuggggcaacagagcaagacuc

SEQ ID NO: 1258526 - RNA, 19 nt, Human
aggaagcuuuaaacauuca

SEQ ID NO: 1258527 - RNA, 21 nt, Human
aggaaucuggcaucucaaaua

SEQ ID NO: 1258528 - RNA, 24 nt, Human
aggcagaucaugaggucaggagau

SEQ ID NO: 1258529 - RNA, 21 nt, Human
aggcaggagaauggcgugaac

SEQ ID NO: 1258530 - RNA, 24 nt, Human
aggcaggagaauggcgugaacccg

SEQ ID NO: 1258531 - RNA, 24 nt, Human
aggcaggcagaucaugaggucagg

SEQ ID NO: 1258532 - RNA, 21 nt, Human
aggccgaggcaggcagaucau

SEQ ID NO: 1258533 - RNA, 23 nt, Human
aggccgaggcaggcagaucauga

SEQ ID NO: 1258534 - RNA, 19 nt, Human
aggcugaggcaggagaaug

SEQ ID NO: 1258535 - RNA, 26 nt, Human
agggacagaaggggcugggcauggug

SEQ ID NO: 1258536 - RNA, 19 nt, Human
agguggagcuugcagugaa

SEQ ID NO: 1258537 - RNA, 24 nt, Human
agguggagcuugcagugaaccaag

SEQ ID NO: 1258538 - RNA, 20 nt, Human
agucacgguuaagcaccagu

SEQ ID NO: 1258539 - RNA, 20 nt, Human
agugggauuggugaaaagca

SEQ ID NO: 1258540 - RNA, 23 nt, Human
aucaacaagaggagaacaccaca

SEQ ID NO: 1258541 - RNA, 24 nt, Human
aucacgccacugcacuccagccug

SEQ ID NO: 1258542 - RNA, 19 nt, Human
auguaucaaaaaacugaac

SEQ ID NO: 1258543 - RNA, 24 nt, Human
caaaaaaaaaaaaaaaaaaaggga

SEQ ID NO: 1258544 - RNA, 20 nt, Human
caaaguaucuucaacugggu

SEQ ID NO: 1258545 - RNA, 23 nt, Human
caacaagaggagaacaccacaaa

SEQ ID NO: 1258546 - RNA, 23 nt, Human
caacaucaacaagaggagaacac

SEQ ID NO: 1258547 - RNA, 24 nt, Human
caagaccauccuggcuaacacggu

SEQ ID NO: 1258548 - RNA, 21 nt, Human
caagacuccaucucaaaaaaa

SEQ ID NO: 1258549 - RNA, 24 nt, Human
cacaccuauaaucccagcacuuug

SEQ ID NO: 1258550 - RNA, 19 nt, Human
caccaguugguuugguguc

SEQ ID NO: 1258551 - RNA, 19 nt, Human
caccuauaaucccagcacu

SEQ ID NO: 1258552 - RNA, 24 nt, Human
caccuauaaucccagcacuuuggg

SEQ ID NO: 1258553 - RNA, 23 nt, Human
caccuguagucccagcuacucgg

SEQ ID NO: 1258554 - RNA, 24 nt, Human
caccuguagucccagcuacucggg

SEQ ID NO: 1258555 - RNA, 21 nt, Human
cacucaguacugcagagacag

SEQ ID NO: 1258556 - RNA, 24 nt, Human
cacuccagccuggggcaacagagc

SEQ ID NO: 1258557 - RNA, 19 nt, Human
cacugcacuccagccuggg

SEQ ID NO: 1258558 - RNA, 19 nt, Human
cacugcacuccagccuggg

SEQ ID NO: 1258559 - RNA, 23 nt, Human
cacugcacuccagccuggggcaa

SEQ ID NO: 1258560 - RNA, 24 nt, Human
cacugcacuccagccuggggcaac

SEQ ID NO: 1258561 - RNA, 25 nt, Human
cacugcacuccagccuggggcaaca

SEQ ID NO: 1258562 - RNA, 24 nt, Human
cagcacuuugggaggccgaggcag

SEQ ID NO: 1258563 - RNA, 25 nt, Human
cagcacuuugggaggccgaggcagg

SEQ ID NO: 1258564 - RNA, 24 nt, Human
cagcuacucgggaggcugaggcag

SEQ ID NO: 1258565 - RNA, 22 nt, Human
caggcagaucaugaggucagga

SEQ ID NO: 1258566 - RNA, 21 nt, Human
caucuaugaggaagccucugu

SEQ ID NO: 1258567 - RNA, 19 nt, Human
cauggaagacaaagacuca

SEQ ID NO: 1258568 - RNA, 28 nt, Human
cauucauauuggaguuaagaauuaaaga

SEQ ID NO: 1258569 - RNA, 23 nt, Human
cauuuuauuaauaaauucaacaa

SEQ ID NO: 1258570 - RNA, 20 nt, Human
ccacugcacuccagccuggg

SEQ ID NO: 1258571 - RNA, 20 nt, Human
ccacugcacuccagccuggg

SEQ ID NO: 1258572 - RNA, 21 nt, Human
ccacugcacuccagccugggg

SEQ ID NO: 1258573 - RNA, 22 nt, Human
ccacugcacuccagccuggggc

SEQ ID NO: 1258574 - RNA, 25 nt, Human
ccacugcacuccagccuggggcaac

SEQ ID NO: 1258575 - RNA, 20 nt, Human
ccgggggugagugggauugg

SEQ ID NO: 1258576 - RNA, 19 nt, Human
ccucaaggccccaccucua

SEQ ID NO: 1258577 - RNA, 22 nt, Human
ccugcaugcacuguaaaaucca

SEQ ID NO: 1258578 - RNA, 24 nt, Human
ccuggcuaacacggugaaacccca

SEQ ID NO: 1258579 - RNA, 23 nt, Human
ccuggggcaacagagcaagacuc

SEQ ID NO: 1258580 - RNA, 21 nt, Human
ccuguaacuauaaaagucauc

SEQ ID NO: 1258581 - RNA, 21 nt, Human
ccuguagucccagcuacucgg

SEQ ID NO: 1258582 - RNA, 24 nt, Human
cgaggcaggcagaucaugagguca

SEQ ID NO: 1258583 - RNA, 25 nt, Human
cgccacugcacuccagccuggggca

SEQ ID NO: 1258584 - RNA, 29 nt, Human
cgggagguggagcuugcagugacaacggu

SEQ ID NO: 1258585 - RNA, 21 nt, Human
cgggcaccuguagucccagcu

SEQ ID NO: 1258586 - RNA, 18 nt, Human
cucaaaaaaaaaaaaaaa

SEQ ID NO: 1258587 - RNA, 22 nt, Human
cucacaccuauaaucccagcac

SEQ ID NO: 1258588 - RNA, 24 nt, Human
cucacaccuauaaucccagcacuu

SEQ ID NO: 1258589 - RNA, 25 nt, Human
cucagucucuguguuucugaaaggu

SEQ ID NO: 1258590 - RNA, 19 nt, Human
cuccaucucaaaaaaaaaa

SEQ ID NO: 1258591 - RNA, 20 nt, Human
cugaaaggucuucucgaacc

SEQ ID NO: 1258592 - RNA, 19 nt, Human
cugcugaguccccaguugc

SEQ ID NO: 1258593 - RNA, 19 nt, Human
cugcuuucaagaugguacc

SEQ ID NO: 1258594 - RNA, 21 nt, Human
cuggaggcugggaagucacgg

SEQ ID NO: 1258595 - RNA, 23 nt, Human
cuggcuaacacggugaaacccca

SEQ ID NO: 1258596 - RNA, 23 nt, Human
cuucuccuuaauuucuuuuucuu

SEQ ID NO: 1258597 - RNA, 24 nt, Human
gaaggggcugggcaugguggcuca

SEQ ID NO: 1258598 - RNA, 18 nt, Human
gagcuugcagugaaccaa

SEQ ID NO: 1258599 - RNA, 19 nt, Human
gaggaagccucugucuucc

SEQ ID NO: 1258600 - RNA, 23 nt, Human
gaggcaggcagaucaugagguca

SEQ ID NO: 1258601 - RNA, 20 nt, Human
gaguuaagaauuaaagacac

SEQ ID NO: 1258602 - RNA, 18 nt, Human
gaucaggaaugcaaauuu

SEQ ID NO: 1258603 - RNA, 25 nt, Human
gcacuccagccuggggcaacagagc

SEQ ID NO: 1258604 - RNA, 20 nt, Human
gcaugguggcucacaccuau

SEQ ID NO: 1258605 - RNA, 24 nt, Human
gcuaacacggugaaaccccaucuc

SEQ ID NO: 1258606 - RNA, 22 nt, Human
gcugaggcaggagaauggcgug

SEQ ID NO: 1258607 - RNA, 19 nt, Human
gcugggcaugguggcucac

SEQ ID NO: 1258608 - RNA, 20 nt, Human
ggaauaagaaucuagaggaa

SEQ ID NO: 1258609 - RNA, 20 nt, Human
ggagacagaagggcugaaca

SEQ ID NO: 1258610 - RNA, 24 nt, Human
ggagcuugcagugaaccaagauca

SEQ ID NO: 1258611 - RNA, 19 nt, Human
ggcaccuguagucccagcu

SEQ ID NO: 1258612 - RNA, 23 nt, Human
ggcaggcagaucaugaggucagg

SEQ ID NO: 1258613 - RNA, 23 nt, Human
ggcaggggcaaguuuggggaggc

SEQ ID NO: 1258614 - RNA, 23 nt, Human
ggcaugguggcucacaccuauaa

SEQ ID NO: 1258615 - RNA, 21 nt, Human
ggcgggcaccuguagucccag

SEQ ID NO: 1258616 - RNA, 18 nt, Human
ggucucuacuuccaagga

SEQ ID NO: 1258617 - RNA, 21 nt, Human
ggugagugggauuggugaaaa

SEQ ID NO: 1258618 - RNA, 24 nt, Human
gguggcucacaccuauaaucccag

SEQ ID NO: 1258619 - RNA, 18 nt, Human
guugcugcuuucaagaug

SEQ ID NO: 1258620 - RNA, 22 nt, Human
uaacacggugaaaccccaucuc

SEQ ID NO: 1258621 - RNA, 24 nt, Human
uaacacggugaaaccccaucucua

SEQ ID NO: 1258622 - RNA, 24 nt, Human
uaagacacacauaaaaguaauagg

SEQ ID NO: 1258623 - RNA, 20 nt, Human
uacauaaauaaccugcaugc

SEQ ID NO: 1258624 - RNA, 21 nt, Human
uacauaaauaaccugcaugca

SEQ ID NO: 1258625 - RNA, 24 nt, Human
uaccacaaaaguagaaaacguaac

SEQ ID NO: 1258626 - RNA, 20 nt, Human
uacugcagagacagcaugga

SEQ ID NO: 1258627 - RNA, 22 nt, Human
uagcaguaagugcugaaauaag

SEQ ID NO: 1258628 - RNA, 21 nt, Human
uaguguguggauaaccugaaa

SEQ ID NO: 1258629 - RNA, 18 nt, Human
uauauaggaauaagaauc

SEQ ID NO: 1258630 - RNA, 21 nt, Human
ucaaaaaaaaaaaaaaaaaaa

SEQ ID NO: 1258631 - RNA, 23 nt, Human
ucaaaaaacugaacuuguguaau

SEQ ID NO: 1258632 - RNA, 23 nt, Human
ucacgccacugcacuccagccug

SEQ ID NO: 1258633 - RNA, 18 nt, Human
ucaugaggucaggagauc

SEQ ID NO: 1258634 - RNA, 24 nt, Human
ucaugaggucaggagaucaagacc

SEQ ID NO: 1258635 - RNA, 23 nt, Human
uccaucucaaaaaaaaaaaaaaa

SEQ ID NO: 1258636 - RNA, 20 nt, Human
uccauguaucaaaaaacuga

SEQ ID NO: 1258637 - RNA, 20 nt, Human
ucccagagcccucaugacuu

SEQ ID NO: 1258638 - RNA, 22 nt, Human
uccucacuuccauaaauauucu

SEQ ID NO: 1258639 - RNA, 22 nt, Human
ucucuacuaaaaauauaaaaaa

SEQ ID NO: 1258640 - RNA, 22 nt, Human
ucuuacagcucuggaggcuggg

SEQ ID NO: 1258641 - RNA, 19 nt, Human
ucuuuguucucagucaucu

SEQ ID NO: 1258642 - RNA, 19 nt, Human
ucuuuuuucaugcugugac

SEQ ID NO: 1258643 - RNA, 19 nt, Human
ugaaaccccaucucuacua

SEQ ID NO: 1258644 - RNA, 20 nt, Human
ugaagaaguugggaagauca

SEQ ID NO: 1258645 - RNA, 23 nt, Human
ugaagaaguugggaagaucagga

SEQ ID NO: 1258646 - RNA, 19 nt, Human
ugaauuugaagaaguuggg

SEQ ID NO: 1258647 - RNA, 18 nt, Human
ugacauugugacaauaac

SEQ ID NO: 1258648 - RNA, 20 nt, Human
ugacuuaaucacuuccucaa

SEQ ID NO: 1258649 - RNA, 24 nt, Human
ugaggcaggagaauggcgugaacc

SEQ ID NO: 1258650 - RNA, 25 nt, Human
ugaggcaggagaauggcgugaaccc

SEQ ID NO: 1258651 - RNA, 26 nt, Human
ugauagcaguaagugcugaaauaaga

SEQ ID NO: 1258652 - RNA, 22 nt, Human
ugcaaauuucuucccccuuguc

SEQ ID NO: 1258653 - RNA, 24 nt, Human
ugcaugcacuguaaaauccaugua

SEQ ID NO: 1258654 - RNA, 23 nt, Human
uggaagacaaagacucagucucu

SEQ ID NO: 1258655 - RNA, 22 nt, Human
uggcgggcaccuguagucccag

SEQ ID NO: 1258656 - RNA, 22 nt, Human
uggcucacaccuauaaucccag

SEQ ID NO: 1258657 - RNA, 24 nt, Human
uggcucacaccuauaaucccagca

SEQ ID NO: 1258658 - RNA, 22 nt, Human
uggcucauucaccauuucaaca

SEQ ID NO: 1258659 - RNA, 20 nt, Human
ugggaggccgaggcaggcag

SEQ ID NO: 1258660 - RNA, 24 nt, Human
ugggaggccgaggcaggcagauca

SEQ ID NO: 1258661 - RNA, 18 nt, Human
ugggauuggugaaaagca

SEQ ID NO: 1258662 - RNA, 19 nt, Human
uggguccuagucucugggc

SEQ ID NO: 1258663 - RNA, 23 nt, Human
uggugaaaagcacuaaaugacau

SEQ ID NO: 1258664 - RNA, 24 nt, Human
ugguggcgggcaccuguaguccca

SEQ ID NO: 1258665 - RNA, 23 nt, Human
uggugucugcugaguccccaguu

SEQ ID NO: 1258666 - RNA, 26 nt, Human
uguauauuacaauguuaggacuacuu

SEQ ID NO: 1258667 - RNA, 22 nt, Human
ugucugcugaguccccaguugc

SEQ ID NO: 1258668 - RNA, 19 nt, Human
uguggauaaccugaaauac

SEQ ID NO: 1258669 - RNA, 20 nt, Human
uguggcaguacuguauauua

SEQ ID NO: 1258670 - RNA, 21 nt, Human
uguguggauaaccugaaauac

SEQ ID NO: 1258671 - RNA, 18 nt, Human
uuagccgggcgugguggu

SEQ ID NO: 1258672 - RNA, 27 nt, Human
uuagccgggcguggugguggcgggcac

SEQ ID NO: 1258673 - RNA, 21 nt, Human
uucaacaucaacaagaggaga

SEQ ID NO: 1258674 - RNA, 19 nt, Human
uuccucaaggccccaccuc

SEQ ID NO: 1258675 - RNA, 23 nt, Human
uucuuuggguccuagucucuggg

SEQ ID NO: 1258676 - RNA, 20 nt, Human
uugaagaaguugggaagauc

SEQ ID NO: 1258677 - RNA, 25 nt, Human
uugggaggccgaggcaggcagauca

SEQ ID NO: 1258678 - RNA, 20 nt, Human
uuucucccagaccuccucuc

SEQ ID NO: 1258679 - RNA, 23 nt, Human
acucaucugcacucaugcauaca

SEQ ID NO: 1258680 - RNA, 19 nt, Human
agcagcaucuuuucucagc

SEQ ID NO: 1258681 - RNA, 21 nt, Human
auaaagucucccuuugauuaa

SEQ ID NO: 1258682 - RNA, 18 nt, Human
caagagcaagggcuucca

SEQ ID NO: 1258683 - RNA, 20 nt, Human
caauuuuauuucaaaagcag

SEQ ID NO: 1258684 - RNA, 21 nt, Human
cacagcaccaauuuuauuuca

SEQ ID NO: 1258685 - RNA, 24 nt, Human
cauaagcucuucccccacaucccc

SEQ ID NO: 1258686 - RNA, 24 nt, Human
caucugcacucaugcauacauaca

SEQ ID NO: 1258687 - RNA, 25 nt, Human
cccccacaucccccaacuucauucc

SEQ ID NO: 1258688 - RNA, 22 nt, Human
cuacaguuucaaucuucaugac

SEQ ID NO: 1258689 - RNA, 23 nt, Human
cuugucuauacccagccuggauc

SEQ ID NO: 1258690 - RNA, 19 nt, Human
gugggaaagucauaagcuc

SEQ ID NO: 1258691 - RNA, 20 nt, Human
uaacuucuguucuguaacuc

SEQ ID NO: 1258692 - RNA, 21 nt, Human
uaagcucuucccccacauccc

SEQ ID NO: 1258693 - RNA, 21 nt, Human
uacaagugucuacacagcacc

SEQ ID NO: 1258694 - RNA, 18 nt, Human
uacccagccuggaucucc

SEQ ID NO: 1258695 - RNA, 23 nt, Human
ucauaagcucuucccccacaucc

SEQ ID NO: 1258696 - RNA, 22 nt, Human
ucuugucuauacccagccugga

SEQ ID NO: 1258697 - RNA, 21 nt, Human
ugaaagauaaagucucccuuu

SEQ ID NO: 1258698 - RNA, 19 nt, Human
ugacaaaagcaaagggcuc

SEQ ID NO: 1258699 - RNA, 19 nt, Human
ugacacaggugggaaaguc

SEQ ID NO: 1258700 - RNA, 26 nt, Human
ugcacucaugcauacauacacaaagc

SEQ ID NO: 1258701 - RNA, 25 nt, Human
ugcauacauacacaaagcaccuaca

SEQ ID NO: 1258702 - RNA, 25 nt, Human
uuccaauggaugacacaggguaccc

SEQ ID NO: 1258703 - RNA, 18 nt, Human
uuucauuaacuucuguuc

SEQ ID NO: 1258704 - RNA, 20 nt, Human
uuuuuccuacuuccaaaaau

SEQ ID NO: 1258705 - RNA, 25 nt, Human
aaaaaaaaauggaacugaaccaaaa

SEQ ID NO: 1258706 - RNA, 24 nt, Human
aaaaaaaauggaacugaaccaaaa

SEQ ID NO: 1258707 - RNA, 22 nt, Human
aaaaagccaaggagggagggua

SEQ ID NO: 1258708 - RNA, 20 nt, Human
aaaacacccaaaaauggccc

SEQ ID NO: 1258709 - RNA, 22 nt, Human
aaaauccuucccaaaccuaaac

SEQ ID NO: 1258710 - RNA, 25 nt, Human
aaaaugaaaaaaaaauggaacugaa

SEQ ID NO: 1258711 - RNA, 21 nt, Human
aaacagaacaaaacaaaacaa

SEQ ID NO: 1258712 - RNA, 22 nt, Human
aaacagaacaaaacaaaacaaa

SEQ ID NO: 1258713 - RNA, 27 nt, Human
aaacagaacaaaacaaaacaaaaacaa

SEQ ID NO: 1258714 - RNA, 19 nt, Human
aaaugcccugcaacaaguc

SEQ ID NO: 1258715 - RNA, 24 nt, Human
aacaaaacaaaaacaaccucuccc

SEQ ID NO: 1258716 - RNA, 21 nt, Human
aaccaaaaaacuaagcaacag

SEQ ID NO: 1258717 - RNA, 25 nt, Human
aaccaaaaaacuaagcaacaguacu

SEQ ID NO: 1258718 - RNA, 23 nt, Human
aacuauuagguaaaccacccauc

SEQ ID NO: 1258719 - RNA, 18 nt, Human
aagaagucggugauuucu

SEQ ID NO: 1258720 - RNA, 19 nt, Human
aagauucuuuuucuugaau

SEQ ID NO: 1258721 - RNA, 22 nt, Human
aagcaaaaauaaaagaacucug

SEQ ID NO: 1258722 - RNA, 23 nt, Human
aagcaaaaauaaaagaacucugg

SEQ ID NO: 1258723 - RNA, 24 nt, Human
aagcaaaaauaaaagaacucugga

SEQ ID NO: 1258724 - RNA, 30 nt, Human
aagcaaaaauaaaagaacucuggaaucugg

SEQ ID NO: 1258725 - RNA, 19 nt, Human
acaaaaacaaccucucccu

SEQ ID NO: 1258726 - RNA, 20 nt, Human
acaaaacaaaacaaaaacaa

SEQ ID NO: 1258727 - RNA, 24 nt, Human
acaaaacaaaacaaaaacaaccuc

SEQ ID NO: 1258728 - RNA, 25 nt, Human
acaaaauccuucccaaaccuaaaca

SEQ ID NO: 1258729 - RNA, 25 nt, Human
acaaaauccuucccaaaccuaaaca

SEQ ID NO: 1258730 - RNA, 18 nt, Human
acaaagucccagggaaac

SEQ ID NO: 1258731 - RNA, 23 nt, Human
acacaguaagaagucggugauuu

SEQ ID NO: 1258732 - RNA, 24 nt, Human
accuagucccccacucuggccgcc

SEQ ID NO: 1258733 - RNA, 23 nt, Human
acugaaccaaaaaacuaagcaac

SEQ ID NO: 1258734 - RNA, 20 nt, Human
acugcucuggggucuuaggu

SEQ ID NO: 1258735 - RNA, 23 nt, Human
agaaauaagaauuaugaacagaa

SEQ ID NO: 1258736 - RNA, 21 nt, Human
agaacaaaacaaaacaaaaac

SEQ ID NO: 1258737 - RNA, 19 nt, Human
agagagaaguucuggcccu

SEQ ID NO: 1258738 - RNA, 23 nt, Human
agagagggcacauacacuggaaa

SEQ ID NO: 1258739 - RNA, 21 nt, Human
agcggaaggaagaacugggag

SEQ ID NO: 1258740 - RNA, 18 nt, Human
aguaaugauaaccaagug

SEQ ID NO: 1258741 - RNA, 24 nt, Human
auaucacaaagucccagggaaaac

SEQ ID NO: 1258742 - RNA, 23 nt, Human
aucuccaucccuaaugccaaagg

SEQ ID NO: 1258743 - RNA, 22 nt, Human
augacacaggugggaaagucau

SEQ ID NO: 1258744 - RNA, 18 nt, Human
auucuacaucuacucuuc

SEQ ID NO: 1258745 - RNA, 23 nt, Human
caaaaaaaucacccagguugaga

SEQ ID NO: 1258746 - RNA, 24 nt, Human
caaaaaagccaaggagggagggua

SEQ ID NO: 1258747 - RNA, 25 nt, Human
caaaacaaaaacaaccucucccucc

SEQ ID NO: 1258748 - RNA, 27 nt, Human
caaaacaaaaacaaccucucccucccu

SEQ ID NO: 1258749 - RNA, 23 nt, Human
caaaacaaaacaaaaacaaccuc

SEQ ID NO: 1258750 - RNA, 21 nt, Human
caaaagggagaaaugagaaca

SEQ ID NO: 1258751 - RNA, 24 nt, Human
caaaauaguagagaagcauguugc

SEQ ID NO: 1258752 - RNA, 23 nt, Human
caaaauccuucccaaaccuaaac

SEQ ID NO: 1258753 - RNA, 23 nt, Human
caaaccuaaacagaacaaaacaa

SEQ ID NO: 1258754 - RNA, 21 nt, Human
caaaguaacugaaccaaaaaa

SEQ ID NO: 1258755 - RNA, 22 nt, Human
caaaugcccugcaacaaguccu

SEQ ID NO: 1258756 - RNA, 23 nt, Human
caacuaaauugaaauguaaaaca

SEQ ID NO: 1258757 - RNA, 18 nt, Human
caagagcaagggcuucca

SEQ ID NO: 1258758 - RNA, 24 nt, Human
cacacacaccacagauaguuuaug

SEQ ID NO: 1258759 - RNA, 24 nt, Human
cacacaccacagauaguuuaugag

SEQ ID NO: 1258760 - RNA, 24 nt, Human
cacccaaaaauggccccuacucac

SEQ ID NO: 1258761 - RNA, 21 nt, Human
cagccucgggccuggucccgg

SEQ ID NO: 1258762 - RNA, 23 nt, Human
cagguuaaaaaugcuuaaaacac

SEQ ID NO: 1258763 - RNA, 24 nt, Human
cagguugagaaauaagaauuauga

SEQ ID NO: 1258764 - RNA, 26 nt, Human
cauaguaacgaauaaaaaaucucuca

SEQ ID NO: 1258765 - RNA, 22 nt, Human
cauggucaaaauaguagagaag

SEQ ID NO: 1258766 - RNA, 21 nt, Human
ccaacaguaaugauaaccaag

SEQ ID NO: 1258767 - RNA, 22 nt, Human
ccacaugucaaaaugaaaaaaa

SEQ ID NO: 1258768 - RNA, 19 nt, Human
ccaccgcugucgccgccgc

SEQ ID NO: 1258769 - RNA, 19 nt, Human
ccaccgcugucgccgccgc

SEQ ID NO: 1258770 - RNA, 20 nt, Human
ccaccgcugucgccgccgcu

SEQ ID NO: 1258771 - RNA, 22 nt, Human
cccaaaccuaaacagaacaaaa

SEQ ID NO: 1258772 - RNA, 25 nt, Human
cccaaaccuaaacagaacaaaacaa

SEQ ID NO: 1258773 - RNA, 18 nt, Human
ccccacucuggccgccgg

SEQ ID NO: 1258774 - RNA, 25 nt, Human
cccccacaucccccaacuucauucc

SEQ ID NO: 1258775 - RNA, 22 nt, Human
cccugcaacaaguccuuaugug

SEQ ID NO: 1258776 - RNA, 19 nt, Human
ccgcugucgccgccgcuca

SEQ ID NO: 1258777 - RNA, 22 nt, Human
ccgcugucgccgccgcucagcc

SEQ ID NO: 1258778 - RNA, 18 nt, Human
ccucuccuccccccuccc

SEQ ID NO: 1258779 - RNA, 19 nt, Human
cgccucuccuccccccucc

SEQ ID NO: 1258780 - RNA, 20 nt, Human
cuagaguuuuuaacuguuuc

SEQ ID NO: 1258781 - RNA, 24 nt, Human
cucagccucgggccuggucccggc

SEQ ID NO: 1258782 - RNA, 20 nt, Human
cucguucaccaucaguaaca

SEQ ID NO: 1258783 - RNA, 23 nt, Human
cuucccaggacugcaaacucugg

SEQ ID NO: 1258784 - RNA, 19 nt, Human
gaacaaaacaaaacaaaaa

SEQ ID NO: 1258785 - RNA, 21 nt, Human
gagaucagacuguucugccgg

SEQ ID NO: 1258786 - RNA, 22 nt, Human
gaucguuaaaguggacuucuac

SEQ ID NO: 1258787 - RNA, 23 nt, Human
gccagccccggcccggcgccgcu

SEQ ID NO: 1258788 - RNA, 21 nt, Human
gcuuaaaacacuuucaauuau

SEQ ID NO: 1258789 - RNA, 19 nt, Human
gggcacauacacuggaaau

SEQ ID NO: 1258790 - RNA, 22 nt, Human
guaaaacaaaagaacuguucaa

SEQ ID NO: 1258791 - RNA, 18 nt, Human
guaaaccacaugucaaaa

SEQ ID NO: 1258792 - RNA, 20 nt, Human
gucgccgccgcucagccucg

SEQ ID NO: 1258793 - RNA, 19 nt, Human
gugggaaagucauaagcuc

SEQ ID NO: 1258794 - RNA, 21 nt, Human
uaaaacaaaagaacuguucaa

SEQ ID NO: 1258795 - RNA, 21 nt, Human
uaaaaucucccuuugauuaau

SEQ ID NO: 1258796 - RNA, 22 nt, Human
uaacauacaaagagaucagacu

SEQ ID NO: 1258797 - RNA, 27 nt, Human
uaaccacaucaaaguaacugaaccaaa

SEQ ID NO: 1258798 - RNA, 21 nt, Human
uaagcucuucccccacauccc

SEQ ID NO: 1258799 - RNA, 18 nt, Human
uacaaagagaucagacug

SEQ ID NO: 1258800 - RNA, 24 nt, Human
uagaaaacacccaaaaauggcccc

SEQ ID NO: 1258801 - RNA, 24 nt, Human
uaguaacgaauaaaaaaucucuca

SEQ ID NO: 1258802 - RNA, 21 nt, Human
uaucuucacagguucacccaa

SEQ ID NO: 1258803 - RNA, 21 nt, Human
ucaaaguaacugaaccaaaaa

SEQ ID NO: 1258804 - RNA, 25 nt, Human
ucauaagcucuucccccacaucccc

SEQ ID NO: 1258805 - RNA, 21 nt, Human
ucaucuuuccuuagagagggc

SEQ ID NO: 1258806 - RNA, 22 nt, Human
uccauccuuccaaaaagcaaga

SEQ ID NO: 1258807 - RNA, 19 nt, Human
ucccaaaccuaaacagaac

SEQ ID NO: 1258808 - RNA, 21 nt, Human
ucccaaaccuaaacagaacaa

SEQ ID NO: 1258809 - RNA, 18 nt, Human
uccccacacacaccacag

SEQ ID NO: 1258810 - RNA, 24 nt, Human
ucccggccaccgcugucgccgccg

SEQ ID NO: 1258811 - RNA, 21 nt, Human
ucccggccagccccggcccgg

SEQ ID NO: 1258812 - RNA, 22 nt, Human
ucccuaaugccaaaggaaugca

SEQ ID NO: 1258813 - RNA, 19 nt, Human
uccugugaagauuccuugu

SEQ ID NO: 1258814 - RNA, 19 nt, Human
ucuggcugcgccucuccuc

SEQ ID NO: 1258815 - RNA, 24 nt, Human
ucugugguagaaaacacccaaaaa

SEQ ID NO: 1258816 - RNA, 20 nt, Human
ucuuuaguucugccacuguu

SEQ ID NO: 1258817 - RNA, 24 nt, Human
ucuuucuucauuuccauagccucu

SEQ ID NO: 1258818 - RNA, 19 nt, Human
ugaaaaaaaaauggaacug

SEQ ID NO: 1258819 - RNA, 19 nt, Human
ugaaaguaauggcugacau

SEQ ID NO: 1258820 - RNA, 24 nt, Human
ugaaccaaaaaagccaaggaggga

SEQ ID NO: 1258821 - RNA, 19 nt, Human
ugacacaggugggaaaguc

SEQ ID NO: 1258822 - RNA, 19 nt, Human
ugagaacaaaaaaaucacc

SEQ ID NO: 1258823 - RNA, 23 nt, Human
ugagaacaaaaaaaucacccagg

SEQ ID NO: 1258824 - RNA, 22 nt, Human
ugaguuaguaacauacaaagag

SEQ ID NO: 1258825 - RNA, 23 nt, Human
ugcaacaaguccuuauguguaug

SEQ ID NO: 1258826 - RNA, 24 nt, Human
ugcagaagaggaauuccuaacaau

SEQ ID NO: 1258827 - RNA, 23 nt, Human
ugcggcggcuccucuggcugcgc

SEQ ID NO: 1258828 - RNA, 20 nt, Human
ugcucauuucuuccaccuga

SEQ ID NO: 1258829 - RNA, 21 nt, Human
uggaaacugauggcaaucugg

SEQ ID NO: 1258830 - RNA, 19 nt, Human
uggaaauguggccaauucc

SEQ ID NO: 1258831 - RNA, 20 nt, Human
uggaacauccacauaguaac

SEQ ID NO: 1258832 - RNA, 24 nt, Human
uggaaucugacauauuucauguua

SEQ ID NO: 1258833 - RNA, 20 nt, Human
ugggaauaaaaucucccuuu

SEQ ID NO: 1258834 - RNA, 22 nt, Human
ugggaauaaaaucucccuuuga

SEQ ID NO: 1258835 - RNA, 19 nt, Human
ugggagagagaaguucugg

SEQ ID NO: 1258836 - RNA, 25 nt, Human
ugguauauggcugcagaagaggaau

SEQ ID NO: 1258837 - RNA, 23 nt, Human
uguauguuuuucacaaggcuggu

SEQ ID NO: 1258838 - RNA, 18 nt, Human
uguuucuuuaguucugcc

SEQ ID NO: 1258839 - RNA, 25 nt, Human
uguuugguccagacgaaugcucauu

SEQ ID NO: 1258840 - RNA, 24 nt, Human
uuaaaguggacuucuacuuuugca

SEQ ID NO: 1258841 - RNA, 21 nt, Human
uuaguuuaucaaugucuuccc

SEQ ID NO: 1258842 - RNA, 19 nt, Human
uuauguguauguuuuucac

SEQ ID NO: 1258843 - RNA, 22 nt, Human
uucauucuacaucuacucuucg

SEQ ID NO: 1258844 - RNA, 25 nt, Human
uuccaauggaugacacaggguaccc

SEQ ID NO: 1258845 - RNA, 23 nt, Human
uuccaguuugggaaaugaauuua

SEQ ID NO: 1258846 - RNA, 22 nt, Human
uucccaaaccuaaacagaacaa

SEQ ID NO: 1258847 - RNA, 20 nt, Human
uucuacuuuugcacugcucu

SEQ ID NO: 1258848 - RNA, 21 nt, Human
uuuccgcccucagcccgggag

SEQ ID NO: 1258849 - RNA, 18 nt, Human
uuucuuugucaucuuucc

SEQ ID NO: 1258850 - RNA, 22 nt, Human
aucuuauuuuccuuaucuacac

SEQ ID NO: 1258851 - RNA, 22 nt, Human
cauauuuccaaccugguuccca

SEQ ID NO: 1258852 - RNA, 23 nt, Human
cccucuagcgaugacugaccugg

SEQ ID NO: 1258853 - RNA, 21 nt, Human
ccucagagauaacauguuagc

SEQ ID NO: 1258854 - RNA, 26 nt, Human
cggccaagaaucuucuauuuaaguau

SEQ ID NO: 1258855 - RNA, 25 nt, Human
cucauuucuauuauagaauaguuca

SEQ ID NO: 1258856 - RNA, 22 nt, Human
cugacaucacauuuuaugauga

SEQ ID NO: 1258857 - RNA, 18 nt, Human
cuggaaaccaggaacugc

SEQ ID NO: 1258858 - RNA, 23 nt, Human
gaacugcacuccgagcugguagg

SEQ ID NO: 1258859 - RNA, 19 nt, Human
uaaacuggaaaccaggaac

SEQ ID NO: 1258860 - RNA, 19 nt, Human
ucagagauaacauguuagc

SEQ ID NO: 1258861 - RNA, 27 nt, Human
uccauaaucuggagcaagccggggucc

SEQ ID NO: 1258862 - RNA, 22 nt, Human
uuguguauauauccucauuucu

SEQ ID NO: 1258863 - RNA, 22 nt, Human
aagcuucuaaagcuugcaaggg

SEQ ID NO: 1258864 - RNA, 21 nt, Human
agaagcaagugcgucagaggg

SEQ ID NO: 1258865 - RNA, 24 nt, Human
agaaggaagacacagcucgugcag

SEQ ID NO: 1258866 - RNA, 22 nt, Human
agcgggcucccucgaugcgcuu

SEQ ID NO: 1258867 - RNA, 19 nt, Human
agggaugaggcaggggcug

SEQ ID NO: 1258868 - RNA, 28 nt, Human
auguccccucuggguccgccccauagug

SEQ ID NO: 1258869 - RNA, 18 nt, Human
cacagcucgugcagcgcu

SEQ ID NO: 1258870 - RNA, 18 nt, Human
cacaucucaccaccaccu

SEQ ID NO: 1258871 - RNA, 21 nt, Human
cacaucucaccaccaccuggu

SEQ ID NO: 1258872 - RNA, 24 nt, Human
cagccagucacaucucaccaccac

SEQ ID NO: 1258873 - RNA, 18 nt, Human
cagcgccccggcugcgcc

SEQ ID NO: 1258874 - RNA, 20 nt, Human
ccgcccagcgccccggcugc

SEQ ID NO: 1258875 - RNA, 24 nt, Human
cgcccagcgccccggcugcgcccc

SEQ ID NO: 1258876 - RNA, 20 nt, Human
cgcccccucggcgcccucuu

SEQ ID NO: 1258877 - RNA, 21 nt, Human
cggagacuccccgcuccccgg

SEQ ID NO: 1258878 - RNA, 22 nt, Human
cggcugcgcccccucggcgccc

SEQ ID NO: 1258879 - RNA, 23 nt, Human
gaaauaguaaugcccaccgcaga

SEQ ID NO: 1258880 - RNA, 24 nt, Human
gcccccucggcgcccucuuugccg

SEQ ID NO: 1258881 - RNA, 27 nt, Human
gcgcccucuuugccgggucuuuugcuc

SEQ ID NO: 1258882 - RNA, 22 nt, Human
gcggcggagagaaggaagacac

SEQ ID NO: 1258883 - RNA, 20 nt, Human
gcguuccucuccaugucccc

SEQ ID NO: 1258884 - RNA, 20 nt, Human
gcugcgcccccucggcgccc

SEQ ID NO: 1258885 - RNA, 21 nt, Human
gcugcgcccccucggcgcccu

SEQ ID NO: 1258886 - RNA, 23 nt, Human
ggacuggggcggggaggucaggc

SEQ ID NO: 1258887 - RNA, 18 nt, Human
ggaugaggcaggggcugg

SEQ ID NO: 1258888 - RNA, 23 nt, Human
guuccucuccauguccccucugg

SEQ ID NO: 1258889 - RNA, 19 nt, Human
guugcugaguuguggaaaa

SEQ ID NO: 1258890 - RNA, 18 nt, Human
ucacaucucaccaccacc

SEQ ID NO: 1258891 - RNA, 23 nt, Human
uccgcccagcgccccggcugcgc

SEQ ID NO: 1258892 - RNA, 20 nt, Human
ugaggcaggggcuggcagcc

SEQ ID NO: 1258893 - RNA, 19 nt, Human
ugggcccuggggaacugug

SEQ ID NO: 1258894 - RNA, 23 nt, Human
ugugugaagcuguagcggcacac

SEQ ID NO: 1258895 - RNA, 19 nt, Human
aaacugcagaccuucgcgg

SEQ ID NO: 1258896 - RNA, 20 nt, Human
aaagucccuucauggucgcc

SEQ ID NO: 1258897 - RNA, 19 nt, Human
aagcugcagaccuuugcgg

SEQ ID NO: 1258898 - RNA, 18 nt, Human
acagagcugaagggcucc

SEQ ID NO: 1258899 - RNA, 21 nt, Human
acagaguguugacacaaaggu

SEQ ID NO: 1258900 - RNA, 18 nt, Human
acccaaagagugaacagu

SEQ ID NO: 1258901 - RNA, 19 nt, Human
agaccaggguucugugaaa

SEQ ID NO: 1258902 - RNA, 20 nt, Human
agcaagauuuauugcaaaga

SEQ ID NO: 1258903 - RNA, 22 nt, Human
agggcugugaggacugccagca

SEQ ID NO: 1258904 - RNA, 23 nt, Human
auaaagguucuccaaggacccau

SEQ ID NO: 1258905 - RNA, 21 nt, Human
auacagaguguugacacaaag

SEQ ID NO: 1258906 - RNA, 19 nt, Human
auuuggccgaugacugcuc

SEQ ID NO: 1258907 - RNA, 18 nt, Human
caagaaugaagccaugga

SEQ ID NO: 1258908 - RNA, 25 nt, Human
caccagaguagcuagauacagagug

SEQ ID NO: 1258909 - RNA, 18 nt, Human
cacugcucagcgauuguc

SEQ ID NO: 1258910 - RNA, 21 nt, Human
ccaggcagaggaggugccgag

SEQ ID NO: 1258911 - RNA, 21 nt, Human
ccaggggcucgggcuccccuc

SEQ ID NO: 1258912 - RNA, 23 nt, Human
cccaggcagaggaggugccgaga

SEQ ID NO: 1258913 - RNA, 21 nt, Human
cccggccagucuaaccuagaa

SEQ ID NO: 1258914 - RNA, 18 nt, Human
cccugagcuagacacagg

SEQ ID NO: 1258915 - RNA, 24 nt, Human
ccucaaucaacaggacaccccaac

SEQ ID NO: 1258916 - RNA, 21 nt, Human
cuaggccaggggaagugccag

SEQ ID NO: 1258917 - RNA, 23 nt, Human
cuccaaggccccaccagaguagc

SEQ ID NO: 1258918 - RNA, 19 nt, Human
cuuggucucucacugacuu

SEQ ID NO: 1258919 - RNA, 22 nt, Human
cuuugcgcugugcuggccuccu

SEQ ID NO: 1258920 - RNA, 18 nt, Human
gaaugaagccguggaccc

SEQ ID NO: 1258921 - RNA, 18 nt, Human
gacccaaagagugaacag

SEQ ID NO: 1258922 - RNA, 21 nt, Human
gaggaggugccgagagugagc

SEQ ID NO: 1258923 - RNA, 20 nt, Human
gaguuguucguuccucccag

SEQ ID NO: 1258924 - RNA, 23 nt, Human
gaguuguucguuccucccagugg

SEQ ID NO: 1258925 - RNA, 22 nt, Human
gcgccuggaguuguucauugcg

SEQ ID NO: 1258926 - RNA, 19 nt, Human
gcuagauacagagugucca

SEQ ID NO: 1258927 - RNA, 21 nt, Human
gcucgggcuccccucuugcug

SEQ ID NO: 1258928 - RNA, 22 nt, Human
gcugcagaccuuugcggugagu

SEQ ID NO: 1258929 - RNA, 19 nt, Human
ggagcccaggcagaggagg

SEQ ID NO: 1258930 - RNA, 27 nt, Human
ggaguuguucguuccucccagugggac

SEQ ID NO: 1258931 - RNA, 21 nt, Human
ggcucgggcuccccucuugcu

SEQ ID NO: 1258932 - RNA, 24 nt, Human
gggcagcagcauccaucaacagaa

SEQ ID NO: 1258933 - RNA, 19 nt, Human
ggggaagugccagcugguc

SEQ ID NO: 1258934 - RNA, 20 nt, Human
ggggaagugccagcugguca

SEQ ID NO: 1258935 - RNA, 20 nt, Human
gugaaagagcugagggagcg

SEQ ID NO: 1258936 - RNA, 21 nt, Human
guuuggaguuucuuccuucug

SEQ ID NO: 1258937 - RNA, 21 nt, Human
guuuggaguuucuuccuucug

SEQ ID NO: 1258938 - RNA, 21 nt, Human
uagcaagauuuauugcaaaga

SEQ ID NO: 1258939 - RNA, 24 nt, Human
uaggccaggggaagugccagcugg

SEQ ID NO: 1258940 - RNA, 25 nt, Human
ucuggaguuuguuucuucugauguu

SEQ ID NO: 1258941 - RNA, 18 nt, Human
ucuguagugcagagcgug

SEQ ID NO: 1258942 - RNA, 21 nt, Human
ugaaagaacaaagcuuccaca

SEQ ID NO: 1258943 - RNA, 20 nt, Human
ugacacaaagguucuccaag

SEQ ID NO: 1258944 - RNA, 22 nt, Human
ugaggagagggcagcagcaucc

SEQ ID NO: 1258945 - RNA, 20 nt, Human
ugcagaccuuugcggugagu

SEQ ID NO: 1258946 - RNA, 20 nt, Human
uggugcgucuggaguuuguu

SEQ ID NO: 1258947 - RNA, 21 nt, Human
ugucacauggccgguugugug

SEQ ID NO: 1258948 - RNA, 18 nt, Human
uguccggaauuggugggu

SEQ ID NO: 1258949 - RNA, 18 nt, Human
uguccggaauuggugggu

SEQ ID NO: 1258950 - RNA, 24 nt, Human
uguggucucgcuggcuucaggagu

SEQ ID NO: 1258951 - RNA, 21 nt, Human
uguuacagcucuuaagguggu

SEQ ID NO: 1258952 - RNA, 27 nt, Human
uucccggccagucuaaccuagaauugc

SEQ ID NO: 1258953 - RNA, 25 nt, Human
uucugugaaagagcugagggagcgg

SEQ ID NO: 1258954 - RNA, 18 nt, Human
uuugcaguuguagugucc

SEQ ID NO: 1258955 - RNA, 21 nt, Human
uuugcaguuguaguguccuuc

SEQ ID NO: 1258956 - RNA, 27 nt, Human
aaaaagcaccugcugcacuguaagccc

SEQ ID NO: 1258957 - RNA, 24 nt, Human
aaaguuuuauccgcuuucccauau

SEQ ID NO: 1258958 - RNA, 24 nt, Human
aagggagcacccacaugcuuagau

SEQ ID NO: 1258959 - RNA, 19 nt, Human
acacuuccuaucuucuucu

SEQ ID NO: 1258960 - RNA, 22 nt, Human
agcacccacaugcuuagauagc

SEQ ID NO: 1258961 - RNA, 21 nt, Human
cagcgccucccaguggccaga

SEQ ID NO: 1258962 - RNA, 22 nt, Human
caguggccagaaggugaaauga

SEQ ID NO: 1258963 - RNA, 21 nt, Human
ccagagauuucaugucugauu

SEQ ID NO: 1258964 - RNA, 18 nt, Human
ccauauaaaaacucuucc

SEQ ID NO: 1258965 - RNA, 22 nt, Human
ccucauccugcguuugcucucc

SEQ ID NO: 1258966 - RNA, 21 nt, Human
ccuucccgcagcuucuucucg

SEQ ID NO: 1258967 - RNA, 22 nt, Human
ccuuucgagcagcgccucccag

SEQ ID NO: 1258968 - RNA, 21 nt, Human
cgagcagcgccucccaguggc

SEQ ID NO: 1258969 - RNA, 19 nt, Human
cuguucugcgacuuccgug

SEQ ID NO: 1258970 - RNA, 18 nt, Human
cuuggcucugauuucuuu

SEQ ID NO: 1258971 - RNA, 21 nt, Human
gagcagcgccucccaguggcc

SEQ ID NO: 1258972 - RNA, 22 nt, Human
gaguguguccacauugggggaa

SEQ ID NO: 1258973 - RNA, 20 nt, Human
gcagaaagggagcacccaca

SEQ ID NO: 1258974 - RNA, 18 nt, Human
gcagcugcagcgggcuug

SEQ ID NO: 1258975 - RNA, 23 nt, Human
ggcaguuugugguuccugauuug

SEQ ID NO: 1258976 - RNA, 20 nt, Human
gugaccucugcaguacuccu

SEQ ID NO: 1258977 - RNA, 20 nt, Human
ucuccaggugucaucuuucc

SEQ ID NO: 1258978 - RNA, 21 nt, Human
ucuucuguucuucacgcccca

SEQ ID NO: 1258979 - RNA, 22 nt, Human
ucuucuucuguucuucacgccc

SEQ ID NO: 1258980 - RNA, 22 nt, Human
ugcugcacuguaagcccaggga

SEQ ID NO: 1258981 - RNA, 22 nt, Human
uggagccagagauuucaugucu

SEQ ID NO: 1258982 - RNA, 24 nt, Human
uguggcagcugcagcgggcuuggc

SEQ ID NO: 1258983 - RNA, 23 nt, Human
uuccaguccaaugaaaguuuuau

SEQ ID NO: 1258984 - RNA, 23 nt, Human
uucccauauaaaaacucuuccca

SEQ ID NO: 1258985 - RNA, 24 nt, Human
uucccauauaaaaacucuucccac

SEQ ID NO: 1258986 - RNA, 20 nt, Human
uucuucuguucuucacgccc

SEQ ID NO: 1258987 - RNA, 24 nt, Human
uuggcucugauuucuuuucuggag

SEQ ID NO: 1258988 - RNA, 18 nt, Human
uugguucugugacccggg

SEQ ID NO: 1258989 - RNA, 23 nt, Human
uuuauccgcuuucccauauaaaa

SEQ ID NO: 1258990 - RNA, 23 nt, Human
uuucuggaggcucggaaacacuu

SEQ ID NO: 1258991 - RNA, 21 nt, Human
uuuguggggaaccgagugugu

SEQ ID NO: 1258992 - RNA, 19 nt, Human
aaaaagaaauuccuagccc

SEQ ID NO: 1258993 - RNA, 23 nt, Human
aaacugggaaggacaacaggaga

SEQ ID NO: 1258994 - RNA, 19 nt, Human
aaagaaauuccuagcccuu

SEQ ID NO: 1258995 - RNA, 21 nt, Human
aaagucuuucccuucucuagc

SEQ ID NO: 1258996 - RNA, 20 nt, Human
aaccuagcagcucacccauu

SEQ ID NO: 1258997 - RNA, 19 nt, Human
aagguuugaaauacugguu

SEQ ID NO: 1258998 - RNA, 19 nt, Human
acaaacaucagcuaacaga

SEQ ID NO: 1258999 - RNA, 23 nt, Human
acuaugccuuucuuuucucggga

SEQ ID NO: 1259000 - RNA, 24 nt, Human
acucuaaagggucuacgugaaaaa

SEQ ID NO: 1259001 - RNA, 18 nt, Human
acuuguggaccuccccuc

SEQ ID NO: 1259002 - RNA, 26 nt, Human
agaaggaagagguuuuuuuauucagc

SEQ ID NO: 1259003 - RNA, 22 nt, Human
agccaggagcguuggcagacug

SEQ ID NO: 1259004 - RNA, 25 nt, Human
agccaggagcguuggcagacuggug

SEQ ID NO: 1259005 - RNA, 19 nt, Human
aggcguagacagagaaacc

SEQ ID NO: 1259006 - RNA, 22 nt, Human
agggaaaaggggagguugggga

SEQ ID NO: 1259007 - RNA, 20 nt, Human
aguccaaaauuuaagaaaaa

SEQ ID NO: 1259008 - RNA, 24 nt, Human
aguggcauuauacaaacaaguuuc

SEQ ID NO: 1259009 - RNA, 18 nt, Human
aguugcuagcuucggccu

SEQ ID NO: 1259010 - RNA, 19 nt, Human
auugucuuuguugugcugu

SEQ ID NO: 1259011 - RNA, 21 nt, Human
cacucgaucaucucuacacuu

SEQ ID NO: 1259012 - RNA, 18 nt, Human
cagcacaggagggguugg

SEQ ID NO: 1259013 - RNA, 22 nt, Human
caggagcuggaucaguaggcac

SEQ ID NO: 1259014 - RNA, 22 nt, Human
cauaauagaucaaguaagccug

SEQ ID NO: 1259015 - RNA, 28 nt, Human
ccaccuggagaucuucaaagggggcugc

SEQ ID NO: 1259016 - RNA, 18 nt, Human
cccuguccuauugauccc

SEQ ID NO: 1259017 - RNA, 19 nt, Human
cgagcucccggaaaaagaa

SEQ ID NO: 1259018 - RNA, 18 nt, Human
cggggccaggugguggcg

SEQ ID NO: 1259019 - RNA, 19 nt, Human
cggggccaggugguggcgc

SEQ ID NO: 1259020 - RNA, 21 nt, Human
cucaugacaaacauuuauuuc

SEQ ID NO: 1259021 - RNA, 26 nt, Human
cucaugacaaacauuuauuucuacuc

SEQ ID NO: 1259022 - RNA, 23 nt, Human
cuccauaagcuuguaugccgggu

SEQ ID NO: 1259023 - RNA, 20 nt, Human
cucugugccuacauaucuaa

SEQ ID NO: 1259024 - RNA, 18 nt, Human
cugugccuacauaucuag

SEQ ID NO: 1259025 - RNA, 22 nt, Human
gaaguugcuagcuucggccuuc

SEQ ID NO: 1259026 - RNA, 20 nt, Human
gagauucuggaugagccuaa

SEQ ID NO: 1259027 - RNA, 21 nt, Human
gagccgagcucccggaaaaag

SEQ ID NO: 1259028 - RNA, 19 nt, Human
gaucaucucuacacuuuga

SEQ ID NO: 1259029 - RNA, 18 nt, Human
gcguacauaacaagaagu

SEQ ID NO: 1259030 - RNA, 21 nt, Human
gggaaaaggggagguugggga

SEQ ID NO: 1259031 - RNA, 18 nt, Human
gggagguuggggagaaac

SEQ ID NO: 1259032 - RNA, 21 nt, Human
gggagguuggggagaaacugg

SEQ ID NO: 1259033 - RNA, 20 nt, Human
ggguuaucugggcuuggucu

SEQ ID NO: 1259034 - RNA, 19 nt, Human
gucggucauuucucgggcu

SEQ ID NO: 1259035 - RNA, 19 nt, Human
guuggcuucccccuucugg

SEQ ID NO: 1259036 - RNA, 18 nt, Human
uaagaaaaaugaaucuca

SEQ ID NO: 1259037 - RNA, 19 nt, Human
uaagaaaaaugaaucucau

SEQ ID NO: 1259038 - RNA, 24 nt, Human
uaagccugaggaacgugacugggg

SEQ ID NO: 1259039 - RNA, 23 nt, Human
uaauugucuuuguugugcuguua

SEQ ID NO: 1259040 - RNA, 27 nt, Human
uacacguucucccuuuuuccaaugggg

SEQ ID NO: 1259041 - RNA, 20 nt, Human
uaccuuguacugaguggcau

SEQ ID NO: 1259042 - RNA, 22 nt, Human
uacuucuguuuuuuccaacuuu

SEQ ID NO: 1259043 - RNA, 25 nt, Human
uauuuccccccuuugagcauuuuca

SEQ ID NO: 1259044 - RNA, 21 nt, Human
uauuucuagcuuuuuacuauu

SEQ ID NO: 1259045 - RNA, 21 nt, Human
ucaaguaagccugaggaacgu

SEQ ID NO: 1259046 - RNA, 22 nt, Human
ucagcuuccgggugacuggagc

SEQ ID NO: 1259047 - RNA, 23 nt, Human
ucucauaccauauuuccccccuu

SEQ ID NO: 1259048 - RNA, 23 nt, Human
ucuggugcuggcagauucagcuc

SEQ ID NO: 1259049 - RNA, 26 nt, Human
ucuuuagcuccuuucucaggggccgc

SEQ ID NO: 1259050 - RNA, 20 nt, Human
ucuuuuucagaaguucuggu

SEQ ID NO: 1259051 - RNA, 21 nt, Human
ugaguggcauuauacaaacaa

SEQ ID NO: 1259052 - RNA, 25 nt, Human
uggacacaaacaggcaacuuuccag

SEQ ID NO: 1259053 - RNA, 21 nt, Human
uggcugcacaagcaucaaauc

SEQ ID NO: 1259054 - RNA, 21 nt, Human
uggugcagggggcucagaugg

SEQ ID NO: 1259055 - RNA, 23 nt, Human
uggugcagggggcucagaugggu

SEQ ID NO: 1259056 - RNA, 18 nt, Human
uguggaccuccccucuaa

SEQ ID NO: 1259057 - RNA, 19 nt, Human
uguuauacaacuucugucc

SEQ ID NO: 1259058 - RNA, 20 nt, Human
uguuggauccaggcugggau

SEQ ID NO: 1259059 - RNA, 19 nt, Human
uguuuuaauuugcuguccu

SEQ ID NO: 1259060 - RNA, 25 nt, Human
uuacuaaauggauucuuuucagugu

SEQ ID NO: 1259061 - RNA, 23 nt, Human
uuacuucuguuuuuuccaacuuu

SEQ ID NO: 1259062 - RNA, 21 nt, Human
uuccucaggcuucggccgugc

SEQ ID NO: 1259063 - RNA, 20 nt, Human
uugcuuucucccuuuuuugc

SEQ ID NO: 1259064 - RNA, 20 nt, Human
uuuaaaguagccuaaauaac

SEQ ID NO: 1259065 - RNA, 22 nt, Human
uuuacaaaccccugacucauga

SEQ ID NO: 1259066 - RNA, 23 nt, Human
uuuccaccguggacacaaacagg

SEQ ID NO: 1259067 - RNA, 23 nt, Human
uuucuuuuucuucuguucuaguu

SEQ ID NO: 1259068 - RNA, 21 nt, Human
uuuucagaaguucuggugcug

SEQ ID NO: 1259069 - RNA, 20 nt, Human
aaccuccaccuccugggcuc

SEQ ID NO: 1259070 - RNA, 19 nt, Human
aaguagcugggaaugcagg

SEQ ID NO: 1259071 - RNA, 24 nt, Human
aaugugcugagaucacagguguga

SEQ ID NO: 1259072 - RNA, 21 nt, Human
acaggugcccaccaccacacc

SEQ ID NO: 1259073 - RNA, 22 nt, Human
accauagggaaaugucuucuca

SEQ ID NO: 1259074 - RNA, 23 nt, Human
accuaucagguacuggaggugaa

SEQ ID NO: 1259075 - RNA, 25 nt, Human
acucuguugcccaggcuggagugca

SEQ ID NO: 1259076 - RNA, 18 nt, Human
agaacucaagggacagga

SEQ ID NO: 1259077 - RNA, 25 nt, Human
agacaagauggggguuuugcucuaa

SEQ ID NO: 1259078 - RNA, 19 nt, Human
agaucacaggugugagcca

SEQ ID NO: 1259079 - RNA, 20 nt, Human
agcuaugacagagaggggca

SEQ ID NO: 1259080 - RNA, 18 nt, Human
aggaaggagaugaguugg

SEQ ID NO: 1259081 - RNA, 21 nt, Human
aggaaggcagguuugggcugg

SEQ ID NO: 1259082 - RNA, 25 nt, Human
aggcuggagugcaguggcaugaucu

SEQ ID NO: 1259083 - RNA, 24 nt, Human
agggauucuccugccucagccucc

SEQ ID NO: 1259084 - RNA, 24 nt, Human
aggugauccgccugccucggccuc

SEQ ID NO: 1259085 - RNA, 18 nt, Human
aguaggugggauuacagg

SEQ ID NO: 1259086 - RNA, 24 nt, Human
agugauucuccugccucagccucc

SEQ ID NO: 1259087 - RNA, 18 nt, Human
agugcaguggcaugaucu

SEQ ID NO: 1259088 - RNA, 19 nt, Human
agugcaguggcaugaucuc

SEQ ID NO: 1259089 - RNA, 21 nt, Human
agugcaguggcaugaucucug

SEQ ID NO: 1259090 - RNA, 22 nt, Human
augacagagaggggcaagguac

SEQ ID NO: 1259091 - RNA, 20 nt, Human
augggguuucaccacauugg

SEQ ID NO: 1259092 - RNA, 24 nt, Human
augggguuucaccacauuggccag

SEQ ID NO: 1259093 - RNA, 22 nt, Human
auugugcugggaguacuugugg

SEQ ID NO: 1259094 - RNA, 24 nt, Human
auuuuuguauuuuuaguagagaug

SEQ ID NO: 1259095 - RNA, 23 nt, Human
caaccuccaccuccugggcucaa

SEQ ID NO: 1259096 - RNA, 24 nt, Human
caaccuccaccuccugggcucaag

SEQ ID NO: 1259097 - RNA, 24 nt, Human
caagauggggguuuugcucuaagc

SEQ ID NO: 1259098 - RNA, 22 nt, Human
caagccccugcagagaagcaag

SEQ ID NO: 1259099 - RNA, 22 nt, Human
caagggauucuccugccucagc

SEQ ID NO: 1259100 - RNA, 20 nt, Human
caagugauucuccugccuca

SEQ ID NO: 1259101 - RNA, 22 nt, Human
caagugauucuccugccucagc

SEQ ID NO: 1259102 - RNA, 24 nt, Human
caaugugcugagaucacaggugug

SEQ ID NO: 1259103 - RNA, 23 nt, Human
caaugugugccaggacugauggg

SEQ ID NO: 1259104 - RNA, 24 nt, Human
cacacuggacauuucaagccccug

SEQ ID NO: 1259105 - RNA, 19 nt, Human
cacagaacucaagggacag

SEQ ID NO: 1259106 - RNA, 19 nt, Human
cacaggugugagccaccac

SEQ ID NO: 1259107 - RNA, 24 nt, Human
cacauuggccaggcuggucucaaa

SEQ ID NO: 1259108 - RNA, 24 nt, Human
caccacaccuggcuaauuuuugua

SEQ ID NO: 1259109 - RNA, 21 nt, Human
caccacauuggccaggcuggu

SEQ ID NO: 1259110 - RNA, 24 nt, Human
caccacauuggccaggcuggucuc

SEQ ID NO: 1259111 - RNA, 27 nt, Human
caccacauuggccaggcuggucucaaa

SEQ ID NO: 1259112 - RNA, 21 nt, Human
cacccugggcuuuaauuauuu

SEQ ID NO: 1259113 - RNA, 21 nt, Human
cacugcaaccuccaccuccug

SEQ ID NO: 1259114 - RNA, 23 nt, Human
cacugcaaccuccaccuccuggg

SEQ ID NO: 1259115 - RNA, 20 nt, Human
cacuggacauuucaagcccc

SEQ ID NO: 1259116 - RNA, 24 nt, Human
cagagucuuacucuguugcccagg

SEQ ID NO: 1259117 - RNA, 20 nt, Human
cagguacaugccaccauacc

SEQ ID NO: 1259118 - RNA, 24 nt, Human
caggugcccaccaccacaccuggc

SEQ ID NO: 1259119 - RNA, 19 nt, Human
cagguucaagggauucucc

SEQ ID NO: 1259120 - RNA, 23 nt, Human
ccaaagcacugauggaccuauca

SEQ ID NO: 1259121 - RNA, 24 nt, Human
ccaaugugcugagaucacaggugu

SEQ ID NO: 1259122 - RNA, 24 nt, Human
ccaccuccugggcucaagugauuc

SEQ ID NO: 1259123 - RNA, 23 nt, Human
cccaaguagcugggaaugcaggu

SEQ ID NO: 1259124 - RNA, 23 nt, Human
cccaggcuggagugcaguggcau

SEQ ID NO: 1259125 - RNA, 23 nt, Human
cccgaguaggugggauuacaggu

SEQ ID NO: 1259126 - RNA, 22 nt, Human
ccuccaccuccugggcucaagu

SEQ ID NO: 1259127 - RNA, 24 nt, Human
ccucccagguucaagggauucucc

SEQ ID NO: 1259128 - RNA, 24 nt, Human
ccuccugggcucaagugauucucc

SEQ ID NO: 1259129 - RNA, 21 nt, Human
ccugaccuaaggugauccgcc

SEQ ID NO: 1259130 - RNA, 23 nt, Human
ccugaccuaaggugauccgccug

SEQ ID NO: 1259131 - RNA, 24 nt, Human
ccugccucagccucccaaguagcu

SEQ ID NO: 1259132 - RNA, 21 nt, Human
ccugccucggccucccaaugu

SEQ ID NO: 1259133 - RNA, 23 nt, Human
ccugggcucaagugauucuccuc

SEQ ID NO: 1259134 - RNA, 23 nt, Human
ccugggcucaagugauucuccug

SEQ ID NO: 1259135 - RNA, 23 nt, Human
cuaaggugauccgccugccucgg

SEQ ID NO: 1259136 - RNA, 23 nt, Human
cuaauuuuuguauuuuuaguaga

SEQ ID NO: 1259137 - RNA, 23 nt, Human
cucaagugauucuccugccucag

SEQ ID NO: 1259138 - RNA, 24 nt, Human
cucaagugauucuccugccucagc

SEQ ID NO: 1259139 - RNA, 24 nt, Human
cucacugcaaccuccaccuccugg

SEQ ID NO: 1259140 - RNA, 26 nt, Human
cucacugcaaccuccaccuccugggc

SEQ ID NO: 1259141 - RNA, 26 nt, Human
cuccugaccuaaggugauccgccugc

SEQ ID NO: 1259142 - RNA, 20 nt, Human
cuccugggcucaagugauuc

SEQ ID NO: 1259143 - RNA, 21 nt, Human
cuccugggcucaagugauucu

SEQ ID NO: 1259144 - RNA, 23 nt, Human
cugcaaccuccaccuccugggcu

SEQ ID NO: 1259145 - RNA, 24 nt, Human
cugcaaccuccaccuccugggcuc

SEQ ID NO: 1259146 - RNA, 21 nt, Human
cugccucagccucccgaguag

SEQ ID NO: 1259147 - RNA, 23 nt, Human
cugccucggccucccaaugugcu

SEQ ID NO: 1259148 - RNA, 21 nt, Human
cuggaucuugauauguguuuc

SEQ ID NO: 1259149 - RNA, 24 nt, Human
cuggggaacccaccucccagguuc

SEQ ID NO: 1259150 - RNA, 19 nt, Human
cuuguggagugggggcugu

SEQ ID NO: 1259151 - RNA, 21 nt, Human
cuuguggagugggggcugugu

SEQ ID NO: 1259152 - RNA, 22 nt, Human
gaaggcagguuugggcuggaga

SEQ ID NO: 1259153 - RNA, 24 nt, Human
gaaugcagguacaugccaccauac

SEQ ID NO: 1259154 - RNA, 19 nt, Human
gacacagaacucaagggac

SEQ ID NO: 1259155 - RNA, 21 nt, Human
gacaggaaggagaugaguugg

SEQ ID NO: 1259156 - RNA, 24 nt, Human
gaccuaaggugauccgccugccuc

SEQ ID NO: 1259157 - RNA, 20 nt, Human
gagaugaguuggaggcuggg

SEQ ID NO: 1259158 - RNA, 20 nt, Human
gagaugggguuucaccacau

SEQ ID NO: 1259159 - RNA, 24 nt, Human
gagaugggguuucaccacauuggc

SEQ ID NO: 1259160 - RNA, 20 nt, Human
gaggcugggacagggguccc

SEQ ID NO: 1259161 - RNA, 19 nt, Human
gaguuggaggcugggacag

SEQ ID NO: 1259162 - RNA, 18 nt, Human
gaucacaggugugagcca

SEQ ID NO: 1259163 - RNA, 22 nt, Human
gauucuccugccucagccuccc

SEQ ID NO: 1259164 - RNA, 21 nt, Human
gcagguacaugccaccauacc

SEQ ID NO: 1259165 - RNA, 20 nt, Human
gccucagccucccaaguagc

SEQ ID NO: 1259166 - RNA, 20 nt, Human
gccugguuuggggaauguuu

SEQ ID NO: 1259167 - RNA, 25 nt, Human
gcuggagugcaguggcaugaucucu

SEQ ID NO: 1259168 - RNA, 25 nt, Human
ggacaggggucccugccagggaugc

SEQ ID NO: 1259169 - RNA, 20 nt, Human
ggagacagacaagauggggg

SEQ ID NO: 1259170 - RNA, 26 nt, Human
gggcaaugugugccaggacugauggg

SEQ ID NO: 1259171 - RNA, 19 nt, Human
gggcuaggaaggcagguuu

SEQ ID NO: 1259172 - RNA, 22 nt, Human
gggcucaagugauucuccugcc

SEQ ID NO: 1259173 - RNA, 22 nt, Human
gggguuucaccacauuggccag

SEQ ID NO: 1259174 - RNA, 19 nt, Human
gugauccgccugccucggc

SEQ ID NO: 1259175 - RNA, 24 nt, Human
gugauucuccugccucagccuccc

SEQ ID NO: 1259176 - RNA, 21 nt, Human
gugcugagaucacagguguga

SEQ ID NO: 1259177 - RNA, 21 nt, Human
gugugagccaccacgcugggc

SEQ ID NO: 1259178 - RNA, 18 nt, Human
uaagacagagucuuacuc

SEQ ID NO: 1259179 - RNA, 22 nt, Human
uaagacagagucuuacucuguu

SEQ ID NO: 1259180 - RNA, 22 nt, Human
uaauuuuuguacuuuuaguaga

SEQ ID NO: 1259181 - RNA, 24 nt, Human
uaauuuuuguauuuuuaguagaga

SEQ ID NO: 1259182 - RNA, 22 nt, Human
uacaggugcccaccaccacacc

SEQ ID NO: 1259183 - RNA, 24 nt, Human
uacucuguugcccaggcuggagug

SEQ ID NO: 1259184 - RNA, 18 nt, Human
uagcugggaaugcaggua

SEQ ID NO: 1259185 - RNA, 19 nt, Human
uaguagagaugggguuuca

SEQ ID NO: 1259186 - RNA, 23 nt, Human
uaguagagaugggguuucaccac

SEQ ID NO: 1259187 - RNA, 26 nt, Human
uaguagagaugggguuucaccacauu

SEQ ID NO: 1259188 - RNA, 19 nt, Human
uauguguuucucaguugga

SEQ ID NO: 1259189 - RNA, 25 nt, Human
uauugugcugggaguacuuguggag

SEQ ID NO: 1259190 - RNA, 24 nt, Human
uauugugcugggaguacuuguggg

SEQ ID NO: 1259191 - RNA, 23 nt, Human
ucacugcaaccuccaccuccugg

SEQ ID NO: 1259192 - RNA, 24 nt, Human
ucacugcaaccuccaccuccuggg

SEQ ID NO: 1259193 - RNA, 25 nt, Human
ucacugcaaccuccaccuccugggc

SEQ ID NO: 1259194 - RNA, 27 nt, Human
ucacugcaaccuccaccuccugggcuc

SEQ ID NO: 1259195 - RNA, 20 nt, Human
ucagccucccaaguagcugg

SEQ ID NO: 1259196 - RNA, 23 nt, Human
ucccaaguagcugggaaugcagg

SEQ ID NO: 1259197 - RNA, 23 nt, Human
ucccaaugugcugagaucacagg

SEQ ID NO: 1259198 - RNA, 24 nt, Human
ucccagguagacagugguugaggc

SEQ ID NO: 1259199 - RNA, 21 nt, Human
ucccagguucaagggauucuc

SEQ ID NO: 1259200 - RNA, 24 nt, Human
ucccagguucaagggauucuccug

SEQ ID NO: 1259201 - RNA, 23 nt, Human
ucccgaguaggugggauuacagg

SEQ ID NO: 1259202 - RNA, 24 nt, Human
ucccgaguaggugggauuacaggu

SEQ ID NO: 1259203 - RNA, 21 nt, Human
uccugggcucaagugauucuc

SEQ ID NO: 1259204 - RNA, 22 nt, Human
uccugggcucaagugauucucc

SEQ ID NO: 1259205 - RNA, 24 nt, Human
uccugggcucaagugauucuccug

SEQ ID NO: 1259206 - RNA, 22 nt, Human
ucuagacuccauccuccauccc

SEQ ID NO: 1259207 - RNA, 19 nt, Human
ucuccugccucagccuccc

SEQ ID NO: 1259208 - RNA, 26 nt, Human
ucuccugccucagccucccaaguagc

SEQ ID NO: 1259209 - RNA, 24 nt, Human
ucuguugcccaggcuggagugcag

SEQ ID NO: 1259210 - RNA, 23 nt, Human
ucuuacucuguugcccaggcugg

SEQ ID NO: 1259211 - RNA, 24 nt, Human
ucuuacucuguugcccaggcugga

SEQ ID NO: 1259212 - RNA, 19 nt, Human
ugacacagaacucaaggga

SEQ ID NO: 1259213 - RNA, 18 nt, Human
ugacagagaggggcaagg

SEQ ID NO: 1259214 - RNA, 18 nt, Human
ugaccuaaggugauccgc

SEQ ID NO: 1259215 - RNA, 24 nt, Human
ugaccuaaggugauccgccugccu

SEQ ID NO: 1259216 - RNA, 18 nt, Human
ugacguuggacucacugg

SEQ ID NO: 1259217 - RNA, 22 nt, Human
ugagaucacaggugugagccac

SEQ ID NO: 1259218 - RNA, 24 nt, Human
ugagaucacaggugugagccacca

SEQ ID NO: 1259219 - RNA, 23 nt, Human
ugaucucugcucacugcaaccuc

SEQ ID NO: 1259220 - RNA, 20 nt, Human
ugauucuccugccucagccu

SEQ ID NO: 1259221 - RNA, 18 nt, Human
ugcccaggcuggagugca

SEQ ID NO: 1259222 - RNA, 21 nt, Human
ugcccaggcuggagugcagug

SEQ ID NO: 1259223 - RNA, 22 nt, Human
ugcccaggcuggagugcagugg

SEQ ID NO: 1259224 - RNA, 24 nt, Human
ugcccaggcuggagugcaguggca

SEQ ID NO: 1259225 - RNA, 24 nt, Human
ugccucagccucccaaguagcugg

SEQ ID NO: 1259226 - RNA, 24 nt, Human
ugccucagccucccgaguaggugg

SEQ ID NO: 1259227 - RNA, 21 nt, Human
ugccucggccucccaaugugc

SEQ ID NO: 1259228 - RNA, 24 nt, Human
ugccucggccucccaaugugcuga

SEQ ID NO: 1259229 - RNA, 22 nt, Human
ugccugggaugagaguggagac

SEQ ID NO: 1259230 - RNA, 24 nt, Human
ugcugagaucacaggugugagcca

SEQ ID NO: 1259231 - RNA, 19 nt, Human
uggagugcaguggcaugau

SEQ ID NO: 1259232 - RNA, 22 nt, Human
uggagugcaguggcaugaucuc

SEQ ID NO: 1259233 - RNA, 23 nt, Human
uggagugcaguggcaugaucucu

SEQ ID NO: 1259234 - RNA, 24 nt, Human
uggagugcaguggcaugaucucug

SEQ ID NO: 1259235 - RNA, 20 nt, Human
uggcagugucaggcaaggac

SEQ ID NO: 1259236 - RNA, 24 nt, Human
uggccaggcuggucucaaacuccu

SEQ ID NO: 1259237 - RNA, 22 nt, Human
ugggaaugcagguacaugccac

SEQ ID NO: 1259238 - RNA, 24 nt, Human
ugggaaugcagguacaugccacca

SEQ ID NO: 1259239 - RNA, 20 nt, Human
ugggaugagaguggagacag

SEQ ID NO: 1259240 - RNA, 21 nt, Human
ugggauuacaggugcccacca

SEQ ID NO: 1259241 - RNA, 24 nt, Human
ugggauuacaggugcccaccacca

SEQ ID NO: 1259242 - RNA, 18 nt, Human
ugggcucaagugauucuc

SEQ ID NO: 1259243 - RNA, 24 nt, Human
ugggcucaagugauucuccugccu

SEQ ID NO: 1259244 - RNA, 20 nt, Human
ugggcuggagacucaggcuu

SEQ ID NO: 1259245 - RNA, 22 nt, Human
ugggggcugugucacccugggc

SEQ ID NO: 1259246 - RNA, 24 nt, Human
ugggguuucaccacauuggccagg

SEQ ID NO: 1259247 - RNA, 25 nt, Human
uggucaagucugaucucagggcugg

SEQ ID NO: 1259248 - RNA, 21 nt, Human
uguauuuuuaguagagauggg

SEQ ID NO: 1259249 - RNA, 22 nt, Human
ugugacacagaacucaagggac

SEQ ID NO: 1259250 - RNA, 24 nt, Human
uuacucuguugcccaggcuggagu

SEQ ID NO: 1259251 - RNA, 18 nt, Human
uuaguagagaugggguuu

SEQ ID NO: 1259252 - RNA, 22 nt, Human
uuaguagagaugggguuucacc

SEQ ID NO: 1259253 - RNA, 25 nt, Human
uuaguagagaugggguuucaccaca

SEQ ID NO: 1259254 - RNA, 23 nt, Human
uucaagggauucuccugccucag

SEQ ID NO: 1259255 - RNA, 18 nt, Human
uucuucuuguggccucug

SEQ ID NO: 1259256 - RNA, 19 nt, Human
uugauauguguuucucagu

SEQ ID NO: 1259257 - RNA, 24 nt, Human
uugcccaggcuggagugcaguggc

SEQ ID NO: 1259258 - RNA, 19 nt, Human
uugcuugggacccaggggg

SEQ ID NO: 1259259 - RNA, 20 nt, Human
uuggaggcugggacaggggu

SEQ ID NO: 1259260 - RNA, 21 nt, Human
uugggaggcaucccagguaga

SEQ ID NO: 1259261 - RNA, 23 nt, Human
uuguauuuuuaguagagaugggg

SEQ ID NO: 1259262 - RNA, 24 nt, Human
uuuuuaguagagaugggguuucac

SEQ ID NO: 1259263 - RNA, 21 nt, Human
uuuuucuucuuguggccucug

SEQ ID NO: 1259264 - RNA, 20 nt, Human
uuuuuguacuuuuaguagag

SEQ ID NO: 1259265 - RNA, 20 nt, Human
uuuuuguauuuuuaguagag

SEQ ID NO: 1259266 - RNA, 20 nt, Human
uuuuuuuuaagacagagucu

SEQ ID NO: 1259267 - RNA, 21 nt, Human
aaaaagacauucuuggccuuu

SEQ ID NO: 1259268 - RNA, 19 nt, Human
aaaagacaaaaugacaaca

SEQ ID NO: 1259269 - RNA, 22 nt, Human
aaaggcagcaguagcccagaac

SEQ ID NO: 1259270 - RNA, 19 nt, Human
aacauuccacauaauauua

SEQ ID NO: 1259271 - RNA, 20 nt, Human
aaccuggucccucccucugg

SEQ ID NO: 1259272 - RNA, 26 nt, Human
aacgcuggggagcagagucaaggggc

SEQ ID NO: 1259273 - RNA, 22 nt, Human
aacucagaacgcuggggagcag

SEQ ID NO: 1259274 - RNA, 22 nt, Human
aacucccccccaccccagaagc

SEQ ID NO: 1259275 - RNA, 23 nt, Human
aacuccgccccaccccucccccg

SEQ ID NO: 1259276 - RNA, 24 nt, Human
aagaggcagagcccggagacaggc

SEQ ID NO: 1259277 - RNA, 22 nt, Human
aagcaaccugcccaaggucucc

SEQ ID NO: 1259278 - RNA, 25 nt, Human
aagcugcaggucugggccaaaugca

SEQ ID NO: 1259279 - RNA, 22 nt, Human
aaggacccaggagagugcggag

SEQ ID NO: 1259280 - RNA, 23 nt, Human
aaggccccuucaggccccugccc

SEQ ID NO: 1259281 - RNA, 22 nt, Human
aagggugagagaggcacaggcg

SEQ ID NO: 1259282 - RNA, 23 nt, Human
acaaccaguaagaggcagagccc

SEQ ID NO: 1259283 - RNA, 19 nt, Human
acaaguaguuuaggucagg

SEQ ID NO: 1259284 - RNA, 22 nt, Human
acaccgggauucccagggccca

SEQ ID NO: 1259285 - RNA, 23 nt, Human
acaccgggauucccagggcccac

SEQ ID NO: 1259286 - RNA, 21 nt, Human
accaggugccauuagcauccc

SEQ ID NO: 1259287 - RNA, 18 nt, Human
accaguaagaggcagagc

SEQ ID NO: 1259288 - RNA, 21 nt, Human
acccacagcgagcacccagga

SEQ ID NO: 1259289 - RNA, 18 nt, Human
accccccuguccccaccc

SEQ ID NO: 1259290 - RNA, 19 nt, Human
accgaugcugggcccuggg

SEQ ID NO: 1259291 - RNA, 19 nt, Human
accuccccucaccggucac

SEQ ID NO: 1259292 - RNA, 21 nt, Human
acuccgccccaccccuccccc

SEQ ID NO: 1259293 - RNA, 18 nt, Human
acuccuuacaaccucaca

SEQ ID NO: 1259294 - RNA, 20 nt, Human
agaaggaagagguuuauuca

SEQ ID NO: 1259295 - RNA, 22 nt, Human
agaaggaagagguuuauucagc

SEQ ID NO: 1259296 - RNA, 22 nt, Human
agacaggccugaugguggcucg

SEQ ID NO: 1259297 - RNA, 18 nt, Human
agagggaaggaggaaagg

SEQ ID NO: 1259298 - RNA, 18 nt, Human
agcaagagaccuccccuc

SEQ ID NO: 1259299 - RNA, 21 nt, Human
agcaauagugaggagggaggc

SEQ ID NO: 1259300 - RNA, 18 nt, Human
agccuccagcccgcccag

SEQ ID NO: 1259301 - RNA, 23 nt, Human
agccuucugcucuucuggauuug

SEQ ID NO: 1259302 - RNA, 18 nt, Human
agcuacacugcaggagau

SEQ ID NO: 1259303 - RNA, 21 nt, Human
aggaaaccgaggcagagaagg

SEQ ID NO: 1259304 - RNA, 21 nt, Human
aggaagaaugagagaacgggc

SEQ ID NO: 1259305 - RNA, 19 nt, Human
aggaagaugguggguucag

SEQ ID NO: 1259306 - RNA, 21 nt, Human
aggacccaggagagugcggag

SEQ ID NO: 1259307 - RNA, 24 nt, Human
aggagcucaguucaaaaucacagc

SEQ ID NO: 1259308 - RNA, 22 nt, Human
aggaggaaacagaaaaauagga

SEQ ID NO: 1259309 - RNA, 25 nt, Human
aggaggaagggcagcuuggcagagc

SEQ ID NO: 1259310 - RNA, 23 nt, Human
aggaguucccuauucuguguguc

SEQ ID NO: 1259311 - RNA, 19 nt, Human
aggcaaggugguaggagga

SEQ ID NO: 1259312 - RNA, 24 nt, Human
aggcaaggugguaggaggagggca

SEQ ID NO: 1259313 - RNA, 19 nt, Human
aggcagaaaggaggaaaca

SEQ ID NO: 1259314 - RNA, 29 nt, Human
aggcagaaaggaggaaacagaagggaccc

SEQ ID NO: 1259315 - RNA, 18 nt, Human
aggcagcaguagcccaga

SEQ ID NO: 1259316 - RNA, 19 nt, Human
aggcagcaguagcccagaa

SEQ ID NO: 1259317 - RNA, 18 nt, Human
aggcaguggcagagcagg

SEQ ID NO: 1259318 - RNA, 19 nt, Human
agggaggugggagcugagg

SEQ ID NO: 1259319 - RNA, 21 nt, Human
aggggaggcauugagggaagg

SEQ ID NO: 1259320 - RNA, 23 nt, Human
aggggguucauaaggcagaaagg

SEQ ID NO: 1259321 - RNA, 20 nt, Human
agguggguagaguguaacca

SEQ ID NO: 1259322 - RNA, 21 nt, Human
auaacauuccacauaauauua

SEQ ID NO: 1259323 - RNA, 25 nt, Human
auaaggcagaaaggaggaaacagaa

SEQ ID NO: 1259324 - RNA, 18 nt, Human
aucagccccuggaccuca

SEQ ID NO: 1259325 - RNA, 19 nt, Human
auguguccuguggcccugg

SEQ ID NO: 1259326 - RNA, 18 nt, Human
caaaacacccagagcuga

SEQ ID NO: 1259327 - RNA, 20 nt, Human
caaaacacccagagcugacc

SEQ ID NO: 1259328 - RNA, 24 nt, Human
caaccugcccaaggucuccccacu

SEQ ID NO: 1259329 - RNA, 23 nt, Human
caacucccccccaccccagaagc

SEQ ID NO: 1259330 - RNA, 18 nt, Human
caagagaccuccccucac

SEQ ID NO: 1259331 - RNA, 21 nt, Human
caagcaaccugcccaaggucu

SEQ ID NO: 1259332 - RNA, 19 nt, Human
caaugccagggcugguugc

SEQ ID NO: 1259333 - RNA, 22 nt, Human
cacaaccaguaagaggcagagc

SEQ ID NO: 1259334 - RNA, 18 nt, Human
cacaccgggauucccagg

SEQ ID NO: 1259335 - RNA, 20 nt, Human
cacacugguccagcagggcc

SEQ ID NO: 1259336 - RNA, 24 nt, Human
cacagaugaggaaaccgaggcaga

SEQ ID NO: 1259337 - RNA, 19 nt, Human
caccaaugaggggauacgc

SEQ ID NO: 1259338 - RNA, 21 nt, Human
caccacggguccuuggcaccg

SEQ ID NO: 1259339 - RNA, 19 nt, Human
caccaggcaguggcagagc

SEQ ID NO: 1259340 - RNA, 21 nt, Human
caccaggcaguggcagagcag

SEQ ID NO: 1259341 - RNA, 21 nt, Human
caccccacaccgggauuccca

SEQ ID NO: 1259342 - RNA, 22 nt, Human
caccccucccacagcuggccua

SEQ ID NO: 1259343 - RNA, 22 nt, Human
cacucuguucccggagccugug

SEQ ID NO: 1259344 - RNA, 25 nt, Human
cacugcaggagaucagaaucggaga

SEQ ID NO: 1259345 - RNA, 23 nt, Human
cagaacauucaaccuggucccuc

SEQ ID NO: 1259346 - RNA, 20 nt, Human
cagaacuccaucccccacag

SEQ ID NO: 1259347 - RNA, 23 nt, Human
cagcaagagaccuccccucaccg

SEQ ID NO: 1259348 - RNA, 23 nt, Human
cagcaguagcccagaacauucaa

SEQ ID NO: 1259349 - RNA, 24 nt, Human
cagcaguagcccagaacauucaac

SEQ ID NO: 1259350 - RNA, 27 nt, Human
cagccaggaggaagggcagcuuggcag

SEQ ID NO: 1259351 - RNA, 18 nt, Human
cagcccgcccagagccag

SEQ ID NO: 1259352 - RNA, 23 nt, Human
cagccuugggucugccguccagg

SEQ ID NO: 1259353 - RNA, 18 nt, Human
cagggccaccaggcagag

SEQ ID NO: 1259354 - RNA, 19 nt, Human
cagggccaggugguggcgc

SEQ ID NO: 1259355 - RNA, 22 nt, Human
caggggucuccucccugagccc

SEQ ID NO: 1259356 - RNA, 22 nt, Human
cagggugauguccuugucuccc

SEQ ID NO: 1259357 - RNA, 24 nt, Human
cauaaggcagaaaggaggaaacag

SEQ ID NO: 1259358 - RNA, 23 nt, Human
cauccccauuucacagaugagga

SEQ ID NO: 1259359 - RNA, 20 nt, Human
caucccuguccucaguuggg

SEQ ID NO: 1259360 - RNA, 23 nt, Human
caugaaaauccagcuuaaggcca

SEQ ID NO: 1259361 - RNA, 21 nt, Human
ccacaaccaguaagaggcaga

SEQ ID NO: 1259362 - RNA, 21 nt, Human
ccacaguccaccauucacguu

SEQ ID NO: 1259363 - RNA, 19 nt, Human
ccaccccucccccggggac

SEQ ID NO: 1259364 - RNA, 22 nt, Human
ccagggcccacugccccacucc

SEQ ID NO: 1259365 - RNA, 26 nt, Human
ccaggggucuccucccugagcccucc

SEQ ID NO: 1259366 - RNA, 22 nt, Human
cccaccccacaccgggauuccc

SEQ ID NO: 1259367 - RNA, 23 nt, Human
cccaggauccccccaaucucagg

SEQ ID NO: 1259368 - RNA, 20 nt, Human
cccagugucccuucccccaa

SEQ ID NO: 1259369 - RNA, 21 nt, Human
ccccaaggacuuggcugccca

SEQ ID NO: 1259370 - RNA, 18 nt, Human
ccccacucuguucccgga

SEQ ID NO: 1259371 - RNA, 20 nt, Human
ccccagagacccuugggccc

SEQ ID NO: 1259372 - RNA, 22 nt, Human
ccccagagacccuugggcccau

SEQ ID NO: 1259373 - RNA, 22 nt, Human
ccccagcccagugucccuuccc

SEQ ID NO: 1259374 - RNA, 19 nt, Human
ccccaggggucuccucccu

SEQ ID NO: 1259375 - RNA, 23 nt, Human
cccccaaggacuuggcugcccau

SEQ ID NO: 1259376 - RNA, 18 nt, Human
cccccaggcccucuaccc

SEQ ID NO: 1259377 - RNA, 18 nt, Human
cccccccaccccagaagc

SEQ ID NO: 1259378 - RNA, 18 nt, Human
cccccuguccccacccuc

SEQ ID NO: 1259379 - RNA, 25 nt, Human
cccccuguccccacccucagcaggc

SEQ ID NO: 1259380 - RNA, 20 nt, Human
ccccucaccggucaccccuc

SEQ ID NO: 1259381 - RNA, 23 nt, Human
ccccucagcucggagcucagccc

SEQ ID NO: 1259382 - RNA, 20 nt, Human
cccucagugggcggccgugg

SEQ ID NO: 1259383 - RNA, 23 nt, Human
cccucuacccaccauguucaguc

SEQ ID NO: 1259384 - RNA, 23 nt, Human
cccucugucaccacaucccuguc

SEQ ID NO: 1259385 - RNA, 21 nt, Human
cccugccccaggggucuccuc

SEQ ID NO: 1259386 - RNA, 22 nt, Human
cccugccugccagcucuggcug

SEQ ID NO: 1259387 - RNA, 19 nt, Human
cccuggaccucaguggcuc

SEQ ID NO: 1259388 - RNA, 24 nt, Human
cccugggcacucccugggggccuc

SEQ ID NO: 1259389 - RNA, 19 nt, Human
cccuugggcccaucagccc

SEQ ID NO: 1259390 - RNA, 22 nt, Human
cccuugggcccaucagccccug

SEQ ID NO: 1259391 - RNA, 21 nt, Human
ccgcuugccaggguccugccc

SEQ ID NO: 1259392 - RNA, 19 nt, Human
ccggagccugugggcaccc

SEQ ID NO: 1259393 - RNA, 21 nt, Human
ccgggggcugcaugcgucagc

SEQ ID NO: 1259394 - RNA, 22 nt, Human
ccuaccggaguccacccagccu

SEQ ID NO: 1259395 - RNA, 20 nt, Human
ccucaggcugccccucagcu

SEQ ID NO: 1259396 - RNA, 24 nt, Human
ccuccuccucaggcugccccucag

SEQ ID NO: 1259397 - RNA, 18 nt, Human
ccuccuccucaggcuggc

SEQ ID NO: 1259398 - RNA, 20 nt, Human
ccuccuccucaggcuggccc

SEQ ID NO: 1259399 - RNA, 26 nt, Human
ccuccugccuucccaucccagcugca

SEQ ID NO: 1259400 - RNA, 22 nt, Human
ccuccugucuuguaaaccaggc

SEQ ID NO: 1259401 - RNA, 20 nt, Human
ccugcagaacuccauccccc

SEQ ID NO: 1259402 - RNA, 21 nt, Human
ccugcagaccggagcaggucc

SEQ ID NO: 1259403 - RNA, 19 nt, Human
ccugccagcucuggcuggc

SEQ ID NO: 1259404 - RNA, 22 nt, Human
ccugcccugggcacucccuggg

SEQ ID NO: 1259405 - RNA, 21 nt, Human
ccuggcccccaggccagagga

SEQ ID NO: 1259406 - RNA, 21 nt, Human
ccuggcuccccaagggagggg

SEQ ID NO: 1259407 - RNA, 18 nt, Human
ccugugggcacccacagc

SEQ ID NO: 1259408 - RNA, 21 nt, Human
ccuuaggggaggcauugaggg

SEQ ID NO: 1259409 - RNA, 25 nt, Human
ccuucaggccccugccccagggguc

SEQ ID NO: 1259410 - RNA, 21 nt, Human
ccuucccaucccagcugcagg

SEQ ID NO: 1259411 - RNA, 22 nt, Human
ccuucggcucugauuccaccuu

SEQ ID NO: 1259412 - RNA, 18 nt, Human
ccuucucucuuuccuccu

SEQ ID NO: 1259413 - RNA, 24 nt, Human
ccuugggucugccguccaggcccc

SEQ ID NO: 1259414 - RNA, 21 nt, Human
ccuugucuccccaacacccac

SEQ ID NO: 1259415 - RNA, 24 nt, Human
cgccccaccccucccccggggacu

SEQ ID NO: 1259416 - RNA, 26 nt, Human
cgcccucucccuucggcucugauucc

SEQ ID NO: 1259417 - RNA, 22 nt, Human
cggggucccagugcuugaauuc

SEQ ID NO: 1259418 - RNA, 24 nt, Human
cguccaggccccagcccagugucc

SEQ ID NO: 1259419 - RNA, 26 nt, Human
cuaggccccuacccugccugccagcu

SEQ ID NO: 1259420 - RNA, 23 nt, Human
cucaccggucaccccucccacag

SEQ ID NO: 1259421 - RNA, 25 nt, Human
cucagccuccaucuccuucaguggg

SEQ ID NO: 1259422 - RNA, 20 nt, Human
cucccacagcuggccuaccg

SEQ ID NO: 1259423 - RNA, 19 nt, Human
cucccugagcccuccucug

SEQ ID NO: 1259424 - RNA, 18 nt, Human
cuccugccuucccauccc

SEQ ID NO: 1259425 - RNA, 18 nt, Human
cuccugggucucaguccu

SEQ ID NO: 1259426 - RNA, 19 nt, Human
cuccuucaguggggugaau

SEQ ID NO: 1259427 - RNA, 19 nt, Human
cucuccuccuccuccucag

SEQ ID NO: 1259428 - RNA, 23 nt, Human
cucugagccucagccuccaucuc

SEQ ID NO: 1259429 - RNA, 21 nt, Human
cugaccaggcucucaguagca

SEQ ID NO: 1259430 - RNA, 19 nt, Human
cugauuccaccuccugccu

SEQ ID NO: 1259431 - RNA, 18 nt, Human
cugcacagccucuccucc

SEQ ID NO: 1259432 - RNA, 21 nt, Human
cugcugcacagccucuccucc

SEQ ID NO: 1259433 - RNA, 21 nt, Human
cuggaaucuccugcuucccgg

SEQ ID NO: 1259434 - RNA, 21 nt, Human
cuggcccucagcucagugcuc

SEQ ID NO: 1259435 - RNA, 23 nt, Human
cuggggagcagagucaaggggcc

SEQ ID NO: 1259436 - RNA, 19 nt, Human
cuugcagccuccagcccgc

SEQ ID NO: 1259437 - RNA, 23 nt, Human
gaaauaagggagauguggacagg

SEQ ID NO: 1259438 - RNA, 19 nt, Human
gaagaugguggguucagcc

SEQ ID NO: 1259439 - RNA, 22 nt, Human
gaaggcugggaguggggggucg

SEQ ID NO: 1259440 - RNA, 22 nt, Human
gacauuucuuaacagcagggcc

SEQ ID NO: 1259441 - RNA, 19 nt, Human
gaccauggugccuguccug

SEQ ID NO: 1259442 - RNA, 19 nt, Human
gacccaggagagugcggag

SEQ ID NO: 1259443 - RNA, 18 nt, Human
gaccuggucaccccccug

SEQ ID NO: 1259444 - RNA, 20 nt, Human
gagcaggaagaugguggguu

SEQ ID NO: 1259445 - RNA, 19 nt, Human
gagccagagucaggcacga

SEQ ID NO: 1259446 - RNA, 23 nt, Human
gagcgggacagccaggaggaagg

SEQ ID NO: 1259447 - RNA, 20 nt, Human
gagcucccggcccacagucc

SEQ ID NO: 1259448 - RNA, 21 nt, Human
gaggaaagggacucggagagg

SEQ ID NO: 1259449 - RNA, 22 nt, Human
gaggcagucucagaccccacaa

SEQ ID NO: 1259450 - RNA, 18 nt, Human
gaggcuggggcuguagug

SEQ ID NO: 1259451 - RNA, 19 nt, Human
gagggggaaauaagggaga

SEQ ID NO: 1259452 - RNA, 20 nt, Human
gagucaggcacgaggcuagg

SEQ ID NO: 1259453 - RNA, 25 nt, Human
gaugaggaaacugaggcaggaagaa

SEQ ID NO: 1259454 - RNA, 24 nt, Human
gcagagcgggacagccaggaggaa

SEQ ID NO: 1259455 - RNA, 19 nt, Human
gcagcaauagugaggaggg

SEQ ID NO: 1259456 - RNA, 18 nt, Human
gcaguggcagagcagggg

SEQ ID NO: 1259457 - RNA, 18 nt, Human
gcauuuggcaugagugcc

SEQ ID NO: 1259458 - RNA, 19 nt, Human
gccaaaugcaccucaaccu

SEQ ID NO: 1259459 - RNA, 19 nt, Human
gcccaaggucccacaacca

SEQ ID NO: 1259460 - RNA, 20 nt, Human
gcccagggacggucccugcu

SEQ ID NO: 1259461 - RNA, 21 nt, Human
gccccagagacccuugggccc

SEQ ID NO: 1259462 - RNA, 19 nt, Human
gccccaggggucuccuccc

SEQ ID NO: 1259463 - RNA, 31 nt, Human
gccccugccccaggggucuccucccugagcc

SEQ ID NO: 1259464 - RNA, 19 nt, Human
gcccugggcacucccuggg

SEQ ID NO: 1259465 - RNA, 21 nt, Human
gcccugggcacucccuggggg

SEQ ID NO: 1259466 - RNA, 21 nt, Human
gccgcgggggugggcuugggg

SEQ ID NO: 1259467 - RNA, 20 nt, Human
gccuggccccacaaucacuc

SEQ ID NO: 1259468 - RNA, 23 nt, Human
gcggacugcuuuuuucuaagggg

SEQ ID NO: 1259469 - RNA, 24 nt, Human
gcgugguuugccuuugaccacugg

SEQ ID NO: 1259470 - RNA, 19 nt, Human
gcuauucugggccauaaca

SEQ ID NO: 1259471 - RNA, 19 nt, Human
gcugagcuuugggaggccu

SEQ ID NO: 1259472 - RNA, 21 nt, Human
gcugcccagcacccucgggag

SEQ ID NO: 1259473 - RNA, 21 nt, Human
gcugcugagcuuugggaggcc

SEQ ID NO: 1259474 - RNA, 20 nt, Human
gcugguccugcccuggcccc

SEQ ID NO: 1259475 - RNA, 23 nt, Human
ggaagaaugagagaacgggcaga

SEQ ID NO: 1259476 - RNA, 20 nt, Human
ggaauccaaacagcaagaga

SEQ ID NO: 1259477 - RNA, 20 nt, Human
ggaggcauugagggaaggcu

SEQ ID NO: 1259478 - RNA, 22 nt, Human
ggaggccgaggaaauggaaucc

SEQ ID NO: 1259479 - RNA, 24 nt, Human
ggaggcuggggcuguagugggccg

SEQ ID NO: 1259480 - RNA, 23 nt, Human
ggaggggcugcugagcuuuggga

SEQ ID NO: 1259481 - RNA, 20 nt, Human
ggaggugggagcugaggugg

SEQ ID NO: 1259482 - RNA, 23 nt, Human
ggauacgcuggucccuggcuccc

SEQ ID NO: 1259483 - RNA, 22 nt, Human
ggcaacuccgccccaccccucc

SEQ ID NO: 1259484 - RNA, 19 nt, Human
ggcaguggcagagcagggg

SEQ ID NO: 1259485 - RNA, 22 nt, Human
ggcccaggauccccccaaucuc

SEQ ID NO: 1259486 - RNA, 18 nt, Human
ggcuccugaccaggcucu

SEQ ID NO: 1259487 - RNA, 21 nt, Human
gggacggucccugcugugagg

SEQ ID NO: 1259488 - RNA, 20 nt, Human
gggcacaacagcaaauguuu

SEQ ID NO: 1259489 - RNA, 20 nt, Human
gggcccacugccccacuccu

SEQ ID NO: 1259490 - RNA, 19 nt, Human
gggcuggguuggcccgagc

SEQ ID NO: 1259491 - RNA, 22 nt, Human
gggucccccaggcccucuaccc

SEQ ID NO: 1259492 - RNA, 18 nt, Human
ggguccuuggcaccaggc

SEQ ID NO: 1259493 - RNA, 20 nt, Human
ggucccccaggcccucuacc

SEQ ID NO: 1259494 - RNA, 27 nt, Human
guagaguaucccggggaggcuggggcu

SEQ ID NO: 1259495 - RNA, 22 nt, Human
guggcagcaauagugaggaggg

SEQ ID NO: 1259496 - RNA, 18 nt, Human
guggcucuagccuggcgc

SEQ ID NO: 1259497 - RNA, 19 nt, Human
gugggcugccuggaggaag

SEQ ID NO: 1259498 - RNA, 22 nt, Human
guggguucagccuggccccaca

SEQ ID NO: 1259499 - RNA, 22 nt, Human
gugguggugaaaugagcgaggg

SEQ ID NO: 1259500 - RNA, 19 nt, Human
guuccuccccacucuguuc

SEQ ID NO: 1259501 - RNA, 18 nt, Human
uaaacccaggucauuggg

SEQ ID NO: 1259502 - RNA, 21 nt, Human
uaacacaaguaguuuagguca

SEQ ID NO: 1259503 - RNA, 24 nt, Human
uaacagcagggccaccaggcagag

SEQ ID NO: 1259504 - RNA, 21 nt, Human
uaacaugagaggcuucaagca

SEQ ID NO: 1259505 - RNA, 24 nt, Human
uaagcaguguggggaguggcagca

SEQ ID NO: 1259506 - RNA, 21 nt, Human
uaaguaggcacagaggggccu

SEQ ID NO: 1259507 - RNA, 22 nt, Human
uaaguaggcacagaggggccug

SEQ ID NO: 1259508 - RNA, 23 nt, Human
uaaguaggcacagaggggccugc

SEQ ID NO: 1259509 - RNA, 23 nt, Human
uacaauaauaguuccccacccca

SEQ ID NO: 1259510 - RNA, 19 nt, Human
uacauccguccuccaugga

SEQ ID NO: 1259511 - RNA, 18 nt, Human
uagcaaaacacccagagc

SEQ ID NO: 1259512 - RNA, 23 nt, Human
uagcaaaacacccagagcugacc

SEQ ID NO: 1259513 - RNA, 24 nt, Human
uagccuucugcucuucuggauuug

SEQ ID NO: 1259514 - RNA, 19 nt, Human
uaggaaacaccaaaccgcc

SEQ ID NO: 1259515 - RNA, 24 nt, Human
uaggcacagaggggccugccuccc

SEQ ID NO: 1259516 - RNA, 23 nt, Human
uaggccccuacccugccugccag

SEQ ID NO: 1259517 - RNA, 23 nt, Human
uagugauccccgccuucuggcug

SEQ ID NO: 1259518 - RNA, 23 nt, Human
uaucaggcaagcucuggcccucu

SEQ ID NO: 1259519 - RNA, 23 nt, Human
ucaccacggguccuuggcaccag

SEQ ID NO: 1259520 - RNA, 18 nt, Human
ucacuccagcugagggcu

SEQ ID NO: 1259521 - RNA, 19 nt, Human
ucagccaagcugagaucug

SEQ ID NO: 1259522 - RNA, 20 nt, Human
ucagccccguuccuccccac

SEQ ID NO: 1259523 - RNA, 18 nt, Human
ucaggccccugccccagg

SEQ ID NO: 1259524 - RNA, 22 nt, Human
ucagggagccgaggcuguucag

SEQ ID NO: 1259525 - RNA, 19 nt, Human
ucagugcucagcccugcug

SEQ ID NO: 1259526 - RNA, 18 nt, Human
uccaaugugaggagcugg

SEQ ID NO: 1259527 - RNA, 23 nt, Human
uccacauaauauuauaauagaau

SEQ ID NO: 1259528 - RNA, 23 nt, Human
uccagagugagugacccguaggg

SEQ ID NO: 1259529 - RNA, 21 nt, Human
ucccacagcuggccuaccgga

SEQ ID NO: 1259530 - RNA, 30 nt, Human
uccccaacacccaccuuggaucaaggcccc

SEQ ID NO: 1259531 - RNA, 24 nt, Human
ucccccccaccccagaagcugcag

SEQ ID NO: 1259532 - RNA, 22 nt, Human
ucccggagaaacuggucugugg

SEQ ID NO: 1259533 - RNA, 27 nt, Human
ucccggagccugugggcaacucagaga

SEQ ID NO: 1259534 - RNA, 20 nt, Human
ucccggggaggcuggggcug

SEQ ID NO: 1259535 - RNA, 21 nt, Human
ucccuauucuguguguccaca

SEQ ID NO: 1259536 - RNA, 19 nt, Human
ucccucagugggcggccgu

SEQ ID NO: 1259537 - RNA, 22 nt, Human
ucccucuggaccuggucacccc

SEQ ID NO: 1259538 - RNA, 25 nt, Human
ucccugaaaaagacauucuuggccu

SEQ ID NO: 1259539 - RNA, 18 nt, Human
ucccugggggccucaguc

SEQ ID NO: 1259540 - RNA, 19 nt, Human
ucccugggggccucagucc

SEQ ID NO: 1259541 - RNA, 21 nt, Human
ucccuguccucaguugggucu

SEQ ID NO: 1259542 - RNA, 21 nt, Human
ucccugugauaugucagcccc

SEQ ID NO: 1259543 - RNA, 24 nt, Human
uccugcccuggcccccaggccaga

SEQ ID NO: 1259544 - RNA, 21 nt, Human
uccugggucucaguccugcuc

SEQ ID NO: 1259545 - RNA, 23 nt, Human
uccuugucuccccaacacccacc

SEQ ID NO: 1259546 - RNA, 21 nt, Human
ucgaggcccccgagggaggcg

SEQ ID NO: 1259547 - RNA, 22 nt, Human
ucucagggugauguccuugucu

SEQ ID NO: 1259548 - RNA, 18 nt, Human
ucuccccaacacccaccu

SEQ ID NO: 1259549 - RNA, 19 nt, Human
ucuccccacucacacaugu

SEQ ID NO: 1259550 - RNA, 20 nt, Human
ucucugagccucagccucca

SEQ ID NO: 1259551 - RNA, 22 nt, Human
ucugccguccaggccccagccc

SEQ ID NO: 1259552 - RNA, 22 nt, Human
ucugggaggagaugucgaggcc

SEQ ID NO: 1259553 - RNA, 25 nt, Human
ucuucuggauuuggguuuuccaaaa

SEQ ID NO: 1259554 - RNA, 25 nt, Human
ugaaaaagacauucuuggccuuuuu

SEQ ID NO: 1259555 - RNA, 23 nt, Human
ugaaaucuuggcuugcagccucc

SEQ ID NO: 1259556 - RNA, 18 nt, Human
ugagaggaaguggcuggu

SEQ ID NO: 1259557 - RNA, 20 nt, Human
ugagaguagaauggagaagg

SEQ ID NO: 1259558 - RNA, 21 nt, Human
ugagaguagaauggagaagga

SEQ ID NO: 1259559 - RNA, 20 nt, Human
ugagcgagggcaggcauggg

SEQ ID NO: 1259560 - RNA, 19 nt, Human
ugaggaaaccgaggcagag

SEQ ID NO: 1259561 - RNA, 21 nt, Human
ugaggaaacugaggcaggaag

SEQ ID NO: 1259562 - RNA, 20 nt, Human
ugagggaggugggagcugag

SEQ ID NO: 1259563 - RNA, 21 nt, Human
ugagggaggugggagcugagg

SEQ ID NO: 1259564 - RNA, 18 nt, Human
ugagggcuggccuggggc

SEQ ID NO: 1259565 - RNA, 23 nt, Human
ugagugacccguaggggcaaugc

SEQ ID NO: 1259566 - RNA, 21 nt, Human
ugagugccuccauuuugguuu

SEQ ID NO: 1259567 - RNA, 18 nt, Human
ugauguggcaacuccccc

SEQ ID NO: 1259568 - RNA, 19 nt, Human
ugcacagccucuccuccuc

SEQ ID NO: 1259569 - RNA, 18 nt, Human
ugcagagauucuuacaaa

SEQ ID NO: 1259570 - RNA, 21 nt, Human
ugccaggguccugcccugggc

SEQ ID NO: 1259571 - RNA, 20 nt, Human
ugcccaaggucuccccacuc

SEQ ID NO: 1259572 - RNA, 19 nt, Human
ugccccacuccuccuccuc

SEQ ID NO: 1259573 - RNA, 23 nt, Human
ugcccugggcacucccugggggc

SEQ ID NO: 1259574 - RNA, 20 nt, Human
ugcccugugggagagaugug

SEQ ID NO: 1259575 - RNA, 21 nt, Human
ugccgcgggggugggcuuggg

SEQ ID NO: 1259576 - RNA, 20 nt, Human
ugccggcucagguggacugg

SEQ ID NO: 1259577 - RNA, 25 nt, Human
ugccuuugaccacuggcagaagucu

SEQ ID NO: 1259578 - RNA, 18 nt, Human
ugcgggccacugcccagc

SEQ ID NO: 1259579 - RNA, 18 nt, Human
ugcgucagcuaacagaac

SEQ ID NO: 1259580 - RNA, 21 nt, Human
ugcuauucugggccauaacau

SEQ ID NO: 1259581 - RNA, 20 nt, Human
ugcugugagguugggggcag

SEQ ID NO: 1259582 - RNA, 19 nt, Human
ugcuguguggcucuagccu

SEQ ID NO: 1259583 - RNA, 25 nt, Human
uggaauccaaacagcaagagaccuc

SEQ ID NO: 1259584 - RNA, 18 nt, Human
uggaccucaguggcucag

SEQ ID NO: 1259585 - RNA, 19 nt, Human
uggaugagggcauaaucug

SEQ ID NO: 1259586 - RNA, 19 nt, Human
uggcacaacucagaacgcu

SEQ ID NO: 1259587 - RNA, 19 nt, Human
uggcagagcaggggguuca

SEQ ID NO: 1259588 - RNA, 23 nt, Human
uggcagcaauagugaggagggag

SEQ ID NO: 1259589 - RNA, 18 nt, Human
uggcaggugccaucauua

SEQ ID NO: 1259590 - RNA, 18 nt, Human
uggccuggggcuccugac

SEQ ID NO: 1259591 - RNA, 24 nt, Human
uggcuccugggucucaguccugcu

SEQ ID NO: 1259592 - RNA, 19 nt, Human
uggcugcccagcacccucg

SEQ ID NO: 1259593 - RNA, 24 nt, Human
uggggcuccugaccaggcucucag

SEQ ID NO: 1259594 - RNA, 20 nt, Human
ugguaggaggagggcagcag

SEQ ID NO: 1259595 - RNA, 19 nt, Human
ugguuuugggcucugucug

SEQ ID NO: 1259596 - RNA, 23 nt, Human
ugucagccccguuccuccccacu

SEQ ID NO: 1259597 - RNA, 21 nt, Human
ugucuaggccccuacccugcc

SEQ ID NO: 1259598 - RNA, 25 nt, Human
ugugacaguggaugagggcauaauc

SEQ ID NO: 1259599 - RNA, 19 nt, Human
ugugaggagcuggguggua

SEQ ID NO: 1259600 - RNA, 19 nt, Human
uguggacaggguugggagg

SEQ ID NO: 1259601 - RNA, 24 nt, Human
uucaagcacuaggucucaaauaag

SEQ ID NO: 1259602 - RNA, 23 nt, Human
uucacagaugaggaaaccgaggc

SEQ ID NO: 1259603 - RNA, 19 nt, Human
uucccuggaauccaaccca

SEQ ID NO: 1259604 - RNA, 20 nt, Human
uucuuggccuuuuuaaaggc

SEQ ID NO: 1259605 - RNA, 22 nt, Human
uugccaggguccugcccugggc

SEQ ID NO: 1259606 - RNA, 19 nt, Human
uuuaauccucacaaugaca

SEQ ID NO: 1259607 - RNA, 24 nt, Human
uuugugguuucugcagagauucuu

SEQ ID NO: 1259608 - RNA, 21 nt, Human
agacaaagcccagcacuucac

SEQ ID NO: 1259609 - RNA, 21 nt, Human
caagauccuuucuggccuaau

SEQ ID NO: 1259610 - RNA, 26 nt, Human
cauguccagcccuggagccccagaca

SEQ ID NO: 1259611 - RNA, 19 nt, Human
ccagcccuggagccccaga

SEQ ID NO: 1259612 - RNA, 20 nt, Human
ccggaggacagucugcgggg

SEQ ID NO: 1259613 - RNA, 19 nt, Human
cugucugcauguccagccc

SEQ ID NO: 1259614 - RNA, 20 nt, Human
uaacucgguaaucacaacaa

SEQ ID NO: 1259615 - RNA, 22 nt, Human
uccagcccuggagccccagaca

SEQ ID NO: 1259616 - RNA, 21 nt, Human
ugauucuuggccaugauucug

SEQ ID NO: 1259617 - RNA, 24 nt, Human
ugcggggucgugacgauucuuuuc

SEQ ID NO: 1259618 - RNA, 22 nt, Human
uggagccccagacaaagcccag

SEQ ID NO: 1259619 - RNA, 20 nt, Human
uucuuggccaugauucuguc

SEQ ID NO: 1259620 - RNA, 22 nt, Human
uuggccaugauucugucuuuuc

SEQ ID NO: 1259621 - RNA, 21 nt, Human
uuucuggccuaauugcacugu

SEQ ID NO: 1259622 - RNA, 19 nt, Human
acagcacaucucuuuauuc

SEQ ID NO: 1259623 - RNA, 20 nt, Human
agaacuccuaugggacagga

SEQ ID NO: 1259624 - RNA, 24 nt, Human
agcaagaagacuccagugcugaca

SEQ ID NO: 1259625 - RNA, 25 nt, Human
cagcaagaagacuccagugcugaca

SEQ ID NO: 1259626 - RNA, 22 nt, Human
ccugcuggagucuuucugccca

SEQ ID NO: 1259627 - RNA, 25 nt, Human
cuggagucuuucugcccaggucugg

SEQ ID NO: 1259628 - RNA, 22 nt, Human
cuucuuggcucccuccuuccau

SEQ ID NO: 1259629 - RNA, 18 nt, Human
ggaaggucauugaaggga

SEQ ID NO: 1259630 - RNA, 18 nt, Human
gucuggcccuucuucagg

SEQ ID NO: 1259631 - RNA, 22 nt, Human
uaccaggcccccuucuuggcuc

SEQ ID NO: 1259632 - RNA, 23 nt, Human
uaccaggcccccuucuuggcucc

SEQ ID NO: 1259633 - RNA, 21 nt, Human
uccuaugggacaggaagguca

SEQ ID NO: 1259634 - RNA, 28 nt, Human
uggcucccuccuuccauugaagcugccu

SEQ ID NO: 1259635 - RNA, 20 nt, Human
aaaaaguaagccucuaguug

SEQ ID NO: 1259636 - RNA, 19 nt, Human
aacacugaagaccaagggg

SEQ ID NO: 1259637 - RNA, 21 nt, Human
aacauucaagaaauggaaacg

SEQ ID NO: 1259638 - RNA, 23 nt, Human
aaccuuaccucaucuugcugagc

SEQ ID NO: 1259639 - RNA, 24 nt, Human
aagcccuaggacaugcccgaggug

SEQ ID NO: 1259640 - RNA, 18 nt, Human
acccaccccaaaccccua

SEQ ID NO: 1259641 - RNA, 25 nt, Human
accuuugcuccaagugccuuaaggg

SEQ ID NO: 1259642 - RNA, 18 nt, Human
agaaagaaagaguucgaa

SEQ ID NO: 1259643 - RNA, 25 nt, Human
agaaagaagacaaaauacagcaaga

SEQ ID NO: 1259644 - RNA, 18 nt, Human
agaaagagagagagaggg

SEQ ID NO: 1259645 - RNA, 18 nt, Human
agacaaaauacagcaaga

SEQ ID NO: 1259646 - RNA, 21 nt, Human
agcucaucuaaaacuugcccc

SEQ ID NO: 1259647 - RNA, 20 nt, Human
aggaaggagauucagcccaa

SEQ ID NO: 1259648 - RNA, 23 nt, Human
aggaaggagauucagcccaacug

SEQ ID NO: 1259649 - RNA, 25 nt, Human
aggaaggagauucagcccaacuggc

SEQ ID NO: 1259650 - RNA, 18 nt, Human
aggagucacugacaugaa

SEQ ID NO: 1259651 - RNA, 24 nt, Human
aggcaacccccuguggacaggaag

SEQ ID NO: 1259652 - RNA, 20 nt, Human
caaaauacagcaagauauca

SEQ ID NO: 1259653 - RNA, 25 nt, Human
caaaccccuagggaaaaaucagaaa

SEQ ID NO: 1259654 - RNA, 22 nt, Human
caaagaaaguggaagaaagaaa

SEQ ID NO: 1259655 - RNA, 18 nt, Human
caagcgguucccaggccu

SEQ ID NO: 1259656 - RNA, 23 nt, Human
caagcgguucccaggccuccucc

SEQ ID NO: 1259657 - RNA, 18 nt, Human
cacacugccugcucaccc

SEQ ID NO: 1259658 - RNA, 19 nt, Human
cacacuguacaauuucaag

SEQ ID NO: 1259659 - RNA, 23 nt, Human
cacccacacugccugcucacccc

SEQ ID NO: 1259660 - RNA, 24 nt, Human
cacccacacugccugcucaccccc

SEQ ID NO: 1259661 - RNA, 25 nt, Human
cacccacacugccugcucaccccca

SEQ ID NO: 1259662 - RNA, 18 nt, Human
cacccucuguguguccuc

SEQ ID NO: 1259663 - RNA, 20 nt, Human
caccucagucuaaaguucca

SEQ ID NO: 1259664 - RNA, 24 nt, Human
cacuguacaauuucaagguagggg

SEQ ID NO: 1259665 - RNA, 22 nt, Human
cagaaaggucacagguaggcac

SEQ ID NO: 1259666 - RNA, 21 nt, Human
cagcaagauaucaggagccag

SEQ ID NO: 1259667 - RNA, 20 nt, Human
cagcaccaugaagcacccua

SEQ ID NO: 1259668 - RNA, 22 nt, Human
cagcaccaugaagcacccuagc

SEQ ID NO: 1259669 - RNA, 18 nt, Human
cagguaggcacuaacauc

SEQ ID NO: 1259670 - RNA, 18 nt, Human
caguggcucucccagacc

SEQ ID NO: 1259671 - RNA, 21 nt, Human
cauacauacauacagaaaaga

SEQ ID NO: 1259672 - RNA, 23 nt, Human
caucccaucaaguaccuuccucc

SEQ ID NO: 1259673 - RNA, 23 nt, Human
caucuucccuuucccuccccaaa

SEQ ID NO: 1259674 - RNA, 23 nt, Human
cauggaucgggggucgcccccaa

SEQ ID NO: 1259675 - RNA, 19 nt, Human
ccaacaauuccccuuucua

SEQ ID NO: 1259676 - RNA, 19 nt, Human
ccaaccuuaccucaucuug

SEQ ID NO: 1259677 - RNA, 18 nt, Human
ccacaagcgguucccagg

SEQ ID NO: 1259678 - RNA, 23 nt, Human
ccacacuguacaauuucaaggua

SEQ ID NO: 1259679 - RNA, 23 nt, Human
ccacccacacugccugcucaccc

SEQ ID NO: 1259680 - RNA, 22 nt, Human
ccaggugaaauggaggaaagaa

SEQ ID NO: 1259681 - RNA, 25 nt, Human
cccaaaccccuagggaaaaaucaga

SEQ ID NO: 1259682 - RNA, 23 nt, Human
cccacacugccugcucaccccca

SEQ ID NO: 1259683 - RNA, 21 nt, Human
cccacccacacugccugcuca

SEQ ID NO: 1259684 - RNA, 23 nt, Human
cccacccacacugccugcucacc

SEQ ID NO: 1259685 - RNA, 21 nt, Human
cccaccccaaaccccuaggga

SEQ ID NO: 1259686 - RNA, 23 nt, Human
cccauaccauaaagucagcugcc

SEQ ID NO: 1259687 - RNA, 18 nt, Human
ccccaaaaugaagagucc

SEQ ID NO: 1259688 - RNA, 21 nt, Human
ccccagccccacaccuggcag

SEQ ID NO: 1259689 - RNA, 22 nt, Human
ccccaucuucccuuucccuccc

SEQ ID NO: 1259690 - RNA, 24 nt, Human
cccccaaagaaaguggaagaaaga

SEQ ID NO: 1259691 - RNA, 23 nt, Human
cccccuguggacaggaagugugu

SEQ ID NO: 1259692 - RNA, 22 nt, Human
ccccuaagucacccaccccaaa

SEQ ID NO: 1259693 - RNA, 21 nt, Human
ccccuccccacccacacugcc

SEQ ID NO: 1259694 - RNA, 21 nt, Human
ccccuuucuaacaccucaguc

SEQ ID NO: 1259695 - RNA, 24 nt, Human
cccuaagucacccaccccaaaccc

SEQ ID NO: 1259696 - RNA, 25 nt, Human
cccuaagucacccaccccaaacccc

SEQ ID NO: 1259697 - RNA, 19 nt, Human
ccgccccuaagucacccac

SEQ ID NO: 1259698 - RNA, 22 nt, Human
ccgccccuaagucacccacccc

SEQ ID NO: 1259699 - RNA, 20 nt, Human
ccuaagucacccaccccaaa

SEQ ID NO: 1259700 - RNA, 21 nt, Human
ccuaagucacccaccccaaac

SEQ ID NO: 1259701 - RNA, 18 nt, Human
ccucuucccccaccuccu

SEQ ID NO: 1259702 - RNA, 23 nt, Human
ccuggcauggaucgggggucgcc

SEQ ID NO: 1259703 - RNA, 21 nt, Human
ccuggggaagagaaaaacacu

SEQ ID NO: 1259704 - RNA, 20 nt, Human
ccuguuggaggcugaggaau

SEQ ID NO: 1259705 - RNA, 23 nt, Human
ccuuccucccagucccuggacuc

SEQ ID NO: 1259706 - RNA, 21 nt, Human
cgggauguggucccuucacgu

SEQ ID NO: 1259707 - RNA, 22 nt, Human
cuaaaguuccagaaucaagacc

SEQ ID NO: 1259708 - RNA, 18 nt, Human
cuccaaugccacaggcaa

SEQ ID NO: 1259709 - RNA, 21 nt, Human
cuccccuagccaacaauuccc

SEQ ID NO: 1259710 - RNA, 23 nt, Human
cuccccuagccaacaauucccuc

SEQ ID NO: 1259711 - RNA, 22 nt, Human
cucugagacuccacccuccaau

SEQ ID NO: 1259712 - RNA, 25 nt, Human
cugacacugauacagacgacuuagc

SEQ ID NO: 1259713 - RNA, 24 nt, Human
cuggagguccccucugacacccaa

SEQ ID NO: 1259714 - RNA, 19 nt, Human
cuguguguccucagaccac

SEQ ID NO: 1259715 - RNA, 21 nt, Human
cuugggcuggcccugguggga

SEQ ID NO: 1259716 - RNA, 23 nt, Human
gaaaugagagcaagaaaucucau

SEQ ID NO: 1259717 - RNA, 23 nt, Human
gagagguacagaguuuguaaggg

SEQ ID NO: 1259718 - RNA, 24 nt, Human
gauaucaggagccagugggaggaa

SEQ ID NO: 1259719 - RNA, 18 nt, Human
ggccaguggcucucccag

SEQ ID NO: 1259720 - RNA, 18 nt, Human
ggcuggcucuucagagaa

SEQ ID NO: 1259721 - RNA, 25 nt, Human
gggaaaaaucagaaagaagacaaaa

SEQ ID NO: 1259722 - RNA, 21 nt, Human
gggcuggcucuucagagaagc

SEQ ID NO: 1259723 - RNA, 18 nt, Human
gggucugggggagguagc

SEQ ID NO: 1259724 - RNA, 20 nt, Human
ggucugggggagguagcccc

SEQ ID NO: 1259725 - RNA, 20 nt, Human
gugaaauggaggaaagaagc

SEQ ID NO: 1259726 - RNA, 23 nt, Human
gugccuuaagggcuggcucuuca

SEQ ID NO: 1259727 - RNA, 26 nt, Human
gugggccaguggcucucccagaccuu

SEQ ID NO: 1259728 - RNA, 19 nt, Human
guggucccuucacgucagu

SEQ ID NO: 1259729 - RNA, 19 nt, Human
uaaagucagcugcccaaac

SEQ ID NO: 1259730 - RNA, 21 nt, Human
uaaagucagcugcccaaacuc

SEQ ID NO: 1259731 - RNA, 23 nt, Human
uaaaguuccagaaucaagaccau

SEQ ID NO: 1259732 - RNA, 21 nt, Human
uaauguugaacaaaagucagc

SEQ ID NO: 1259733 - RNA, 22 nt, Human
uacaauuucaagguaggggcua

SEQ ID NO: 1259734 - RNA, 19 nt, Human
uacaauuuguugguuuguc

SEQ ID NO: 1259735 - RNA, 24 nt, Human
uacagaguuuguaaggggucuggg

SEQ ID NO: 1259736 - RNA, 18 nt, Human
uagaauggugacaugugg

SEQ ID NO: 1259737 - RNA, 22 nt, Human
uagccccuccccacccacacug

SEQ ID NO: 1259738 - RNA, 25 nt, Human
uagccccuccccacccacacugccc

SEQ ID NO: 1259739 - RNA, 25 nt, Human
uaggcacuaacauccccuccacacu

SEQ ID NO: 1259740 - RNA, 21 nt, Human
uauccagaaaagaagaacuac

SEQ ID NO: 1259741 - RNA, 20 nt, Human
ucaagaaauggaaacgaggu

SEQ ID NO: 1259742 - RNA, 18 nt, Human
ucaagaccuucugacacu

SEQ ID NO: 1259743 - RNA, 23 nt, Human
ucaagguaggggcuauggcccca

SEQ ID NO: 1259744 - RNA, 20 nt, Human
ucaaguucacacucaaaggu

SEQ ID NO: 1259745 - RNA, 20 nt, Human
ucacugacaugaagcgggau

SEQ ID NO: 1259746 - RNA, 24 nt, Human
ucagaaagaagacaaaauacagca

SEQ ID NO: 1259747 - RNA, 25 nt, Human
ucagccaacccauaccauaaaguca

SEQ ID NO: 1259748 - RNA, 19 nt, Human
ucaggcuccuggcaguggc

SEQ ID NO: 1259749 - RNA, 24 nt, Human
uccaaugccacaggcaacccccug

SEQ ID NO: 1259750 - RNA, 18 nt, Human
ucccagucccuggacucu

SEQ ID NO: 1259751 - RNA, 18 nt, Human
ucccaucaaguaccuucc

SEQ ID NO: 1259752 - RNA, 27 nt, Human
uccccacccacacugccugcucacccc

SEQ ID NO: 1259753 - RNA, 20 nt, Human
ucccccaccuccuacuuuca

SEQ ID NO: 1259754 - RNA, 23 nt, Human
ucccuggacucugagacuccacc

SEQ ID NO: 1259755 - RNA, 23 nt, Human
ucugggcccucuauccccagccc

SEQ ID NO: 1259756 - RNA, 19 nt, Human
ucuucccuuucccucccca

SEQ ID NO: 1259757 - RNA, 18 nt, Human
ugaaauggaggaaagaag

SEQ ID NO: 1259758 - RNA, 23 nt, Human
ugaaauggaggaaagaagcucau

SEQ ID NO: 1259759 - RNA, 22 nt, Human
ugaguuacauaccugaaguuca

SEQ ID NO: 1259760 - RNA, 21 nt, Human
ugcuccaagugccuuaagggc

SEQ ID NO: 1259761 - RNA, 19 nt, Human
ugcucuucuccccuagcca

SEQ ID NO: 1259762 - RNA, 18 nt, Human
uggaaacgagguuggaac

SEQ ID NO: 1259763 - RNA, 19 nt, Human
ugggcuggcccugguggga

SEQ ID NO: 1259764 - RNA, 24 nt, Human
uggggaagagaaaaacacugaaga

SEQ ID NO: 1259765 - RNA, 22 nt, Human
ugggggagguagccccucccca

SEQ ID NO: 1259766 - RNA, 21 nt, Human
uguaaggggucugggggaggu

SEQ ID NO: 1259767 - RNA, 25 nt, Human
ugugugcagcuguacaauuuguugg

SEQ ID NO: 1259768 - RNA, 19 nt, Human
uguugaacaaaagucagcc

SEQ ID NO: 1259769 - RNA, 22 nt, Human
uucaagaaauggaaacgagguu

SEQ ID NO: 1259770 - RNA, 19 nt, Human
uuggaacggucuucacagg

SEQ ID NO: 1259771 - RNA, 20 nt, Human
aaaaugcaccuaugcugugg

SEQ ID NO: 1259772 - RNA, 23 nt, Human
aaauaccauccuguugaagguca

SEQ ID NO: 1259773 - RNA, 22 nt, Human
aacaccucuccacucccguuuc

SEQ ID NO: 1259774 - RNA, 23 nt, Human
aaccaugaaguucucacgcgaga

SEQ ID NO: 1259775 - RNA, 24 nt, Human
aacccaauggcaaaaaaauaggcc

SEQ ID NO: 1259776 - RNA, 28 nt, Human
aacuccauaaccucuuuucuuccuacua

SEQ ID NO: 1259777 - RNA, 19 nt, Human
aagccagggcaggcucaga

SEQ ID NO: 1259778 - RNA, 24 nt, Human
aagcggggacggaggggagaaagg

SEQ ID NO: 1259779 - RNA, 18 nt, Human
aagggaggagggaagaag

SEQ ID NO: 1259780 - RNA, 19 nt, Human
aaggugcuaaucccaucca

SEQ ID NO: 1259781 - RNA, 18 nt, Human
aagugcucgaaugccuga

SEQ ID NO: 1259782 - RNA, 22 nt, Human
aaucaccucccaaaggucccac

SEQ ID NO: 1259783 - RNA, 19 nt, Human
acacuuccuaugacccccc

SEQ ID NO: 1259784 - RNA, 19 nt, Human
acagagcaaccaccaugcc

SEQ ID NO: 1259785 - RNA, 21 nt, Human
acagagcaggaagaagaggaa

SEQ ID NO: 1259786 - RNA, 20 nt, Human
acuaaaguuuauugaacauu

SEQ ID NO: 1259787 - RNA, 20 nt, Human
acuacaucacaccagggccu

SEQ ID NO: 1259788 - RNA, 21 nt, Human
acuacaucacaccagggccua

SEQ ID NO: 1259789 - RNA, 18 nt, Human
agauguuggagucagacu

SEQ ID NO: 1259790 - RNA, 19 nt, Human
agcaaggaaggaaggaaag

SEQ ID NO: 1259791 - RNA, 23 nt, Human
agcagcgccggcccucacucucc

SEQ ID NO: 1259792 - RNA, 23 nt, Human
agcgcaaugcucgcuggcugccu

SEQ ID NO: 1259793 - RNA, 19 nt, Human
aggaagaagaggaaggcug

SEQ ID NO: 1259794 - RNA, 19 nt, Human
aggagggaagaagggagga

SEQ ID NO: 1259795 - RNA, 22 nt, Human
aggaggucggggcugcgggcgu

SEQ ID NO: 1259796 - RNA, 19 nt, Human
aggcccgcagccgcuccca

SEQ ID NO: 1259797 - RNA, 22 nt, Human
aggcuccgcuucugggagcaac

SEQ ID NO: 1259798 - RNA, 19 nt, Human
agggaggagggaagaaggg

SEQ ID NO: 1259799 - RNA, 24 nt, Human
agguaggaugcuuucaauaaaggc

SEQ ID NO: 1259800 - RNA, 20 nt, Human
agugguuuucucauuauuau

SEQ ID NO: 1259801 - RNA, 19 nt, Human
auaaaggcugauagaaaug

SEQ ID NO: 1259802 - RNA, 21 nt, Human
auaauuagaaguuagcagagc

SEQ ID NO: 1259803 - RNA, 22 nt, Human
aucccauccaugagagccccac

SEQ ID NO: 1259804 - RNA, 25 nt, Human
auggcugagagaaaaaccggggucc

SEQ ID NO: 1259805 - RNA, 18 nt, Human
auuucucacaauucugga

SEQ ID NO: 1259806 - RNA, 19 nt, Human
caaaugguucuccgcagca

SEQ ID NO: 1259807 - RNA, 23 nt, Human
cacagguaggaugcuuucaauaa

SEQ ID NO: 1259808 - RNA, 21 nt, Human
caccccacguuuucucuuccu

SEQ ID NO: 1259809 - RNA, 21 nt, Human
caccgccauuucccgccccca

SEQ ID NO: 1259810 - RNA, 21 nt, Human
cacugugccaggcacccccuc

SEQ ID NO: 1259811 - RNA, 25 nt, Human
cagacgagcccucuggggugaaguc

SEQ ID NO: 1259812 - RNA, 22 nt, Human
cagcccaacgucggggucacug

SEQ ID NO: 1259813 - RNA, 24 nt, Human
cauccaugagagccccacugucau

SEQ ID NO: 1259814 - RNA, 19 nt, Human
ccaagaucaaggcacuggc

SEQ ID NO: 1259815 - RNA, 20 nt, Human
ccaccuccaaauaccauccu

SEQ ID NO: 1259816 - RNA, 23 nt, Human
ccacgccgcgccccgcucacccc

SEQ ID NO: 1259817 - RNA, 24 nt, Human
ccacugucaugaucuaaucaccuc

SEQ ID NO: 1259818 - RNA, 20 nt, Human
ccaggcaccgugcuaggaac

SEQ ID NO: 1259819 - RNA, 18 nt, Human
ccauuccuucaccugcaa

SEQ ID NO: 1259820 - RNA, 20 nt, Human
cccaaaggucccaccuccaa

SEQ ID NO: 1259821 - RNA, 18 nt, Human
cccaccuccaaauaccau

SEQ ID NO: 1259822 - RNA, 23 nt, Human
cccacggccacguggggaauauu

SEQ ID NO: 1259823 - RNA, 27 nt, Human
cccacguuuucucuuccuuucauuuua

SEQ ID NO: 1259824 - RNA, 23 nt, Human
cccauaagcgccuagagagccac

SEQ ID NO: 1259825 - RNA, 22 nt, Human
ccccauaagcgccuagagagcc

SEQ ID NO: 1259826 - RNA, 27 nt, Human
ccccccgcuuguuguaaaggccggggc

SEQ ID NO: 1259827 - RNA, 20 nt, Human
ccccugcaggcccgcagccg

SEQ ID NO: 1259828 - RNA, 25 nt, Human
cccgcuuguuguaaaggccggggcc

SEQ ID NO: 1259829 - RNA, 18 nt, Human
cccugagcucagcuucua

SEQ ID NO: 1259830 - RNA, 21 nt, Human
cccuggagcugcacccugagc

SEQ ID NO: 1259831 - RNA, 18 nt, Human
ccgcagccgcucccaagg

SEQ ID NO: 1259832 - RNA, 22 nt, Human
ccgccgcgcaucagugcacccg

SEQ ID NO: 1259833 - RNA, 20 nt, Human
ccucuggacugaagccaggg

SEQ ID NO: 1259834 - RNA, 18 nt, Human
ccucuuuucuuccuacua

SEQ ID NO: 1259835 - RNA, 18 nt, Human
ccugcagcuaucccgggg

SEQ ID NO: 1259836 - RNA, 22 nt, Human
ccugugcuggacugagcaggga

SEQ ID NO: 1259837 - RNA, 19 nt, Human
cgcuucgugcucugguugg

SEQ ID NO: 1259838 - RNA, 26 nt, Human
cggcugcggggcugcccacggccuug

SEQ ID NO: 1259839 - RNA, 25 nt, Human
cggggcugcgggcguugacgagacc

SEQ ID NO: 1259840 - RNA, 20 nt, Human
cuacaucacaccagggccuu

SEQ ID NO: 1259841 - RNA, 22 nt, Human
cuagagagccacgccgcgcccc

SEQ ID NO: 1259842 - RNA, 18 nt, Human
cuauggccaacuccauaa

SEQ ID NO: 1259843 - RNA, 21 nt, Human
cucccaggcaugcggucucau

SEQ ID NO: 1259844 - RNA, 22 nt, Human
cuccggggcaccgccauuuccc

SEQ ID NO: 1259845 - RNA, 22 nt, Human
cugccccaaacaauggcuccuc

SEQ ID NO: 1259846 - RNA, 24 nt, Human
cugccccaaacaauggcuccucuu

SEQ ID NO: 1259847 - RNA, 24 nt, Human
cuuuguucaugcugucugccucca

SEQ ID NO: 1259848 - RNA, 22 nt, Human
gaccuuccccacggccacgugg

SEQ ID NO: 1259849 - RNA, 23 nt, Human
gagggaagaagggggagacgggc

SEQ ID NO: 1259850 - RNA, 19 nt, Human
gaguccuggcaguccuacc

SEQ ID NO: 1259851 - RNA, 21 nt, Human
gcaaaggcacgcggcaccugc

SEQ ID NO: 1259852 - RNA, 18 nt, Human
gcaaugcucgcuggcugc

SEQ ID NO: 1259853 - RNA, 18 nt, Human
gcaccugcagcuauuccg

SEQ ID NO: 1259854 - RNA, 20 nt, Human
gcagcgcagaggcuucuaga

SEQ ID NO: 1259855 - RNA, 25 nt, Human
gccggcccucacucuccagggacgc

SEQ ID NO: 1259856 - RNA, 20 nt, Human
gcgccccgcucaccccugca

SEQ ID NO: 1259857 - RNA, 22 nt, Human
gcuguggcgaagggcaaauggu

SEQ ID NO: 1259858 - RNA, 18 nt, Human
ggagaaaggggaggaggg

SEQ ID NO: 1259859 - RNA, 20 nt, Human
ggaggggagaaaggggagga

SEQ ID NO: 1259860 - RNA, 24 nt, Human
ggauggggcaccugcugccccaaa

SEQ ID NO: 1259861 - RNA, 19 nt, Human
gggaaggaggucggggcug

SEQ ID NO: 1259862 - RNA, 20 nt, Human
ggggaggagggaagaaggga

SEQ ID NO: 1259863 - RNA, 19 nt, Human
ggggccagcccaacgucgg

SEQ ID NO: 1259864 - RNA, 19 nt, Human
guccuggcaguccuacccg

SEQ ID NO: 1259865 - RNA, 21 nt, Human
gugguuuucucauuauuaucc

SEQ ID NO: 1259866 - RNA, 24 nt, Human
uaaacaccucuccacucccguuuc

SEQ ID NO: 1259867 - RNA, 21 nt, Human
uaagaauucuaauuaucccua

SEQ ID NO: 1259868 - RNA, 19 nt, Human
uacuacaucacaccagggc

SEQ ID NO: 1259869 - RNA, 24 nt, Human
uacuccggggcaccugcagcuauu

SEQ ID NO: 1259870 - RNA, 24 nt, Human
uacuccggggcaccugcagcuauu

SEQ ID NO: 1259871 - RNA, 18 nt, Human
uagaagguggugugacuu

SEQ ID NO: 1259872 - RNA, 19 nt, Human
uauaaggugcuaaucccau

SEQ ID NO: 1259873 - RNA, 24 nt, Human
ucaggaaacugaauauccaggaag

SEQ ID NO: 1259874 - RNA, 20 nt, Human
uccaagaucaaggcacuggc

SEQ ID NO: 1259875 - RNA, 22 nt, Human
uccacuuacaacccaauggcaa

SEQ ID NO: 1259876 - RNA, 22 nt, Human
ucccacuagaaacagagaaaug

SEQ ID NO: 1259877 - RNA, 22 nt, Human
uccccagccccaagggacacuu

SEQ ID NO: 1259878 - RNA, 21 nt, Human
uccgaggagcuggcaaaggca

SEQ ID NO: 1259879 - RNA, 22 nt, Human
uccgaggagcuggcaaaggcac

SEQ ID NO: 1259880 - RNA, 20 nt, Human
uccgugagaucucccaggca

SEQ ID NO: 1259881 - RNA, 20 nt, Human
uccuugggauggggcaccug

SEQ ID NO: 1259882 - RNA, 20 nt, Human
ucuuccuacuacaucacacc

SEQ ID NO: 1259883 - RNA, 18 nt, Human
ugaaggaaggaagcgggg

SEQ ID NO: 1259884 - RNA, 21 nt, Human
ugacccgacaaaccuuugcag

SEQ ID NO: 1259885 - RNA, 24 nt, Human
ugagagaaaaaccaucuuucucac

SEQ ID NO: 1259886 - RNA, 19 nt, Human
ugaucuaaucaccucccaa

SEQ ID NO: 1259887 - RNA, 18 nt, Human
ugcagcgcagaggcuucu

SEQ ID NO: 1259888 - RNA, 24 nt, Human
ugccaggcacccccuccagguccu

SEQ ID NO: 1259889 - RNA, 19 nt, Human
ugcccuggguccccagccc

SEQ ID NO: 1259890 - RNA, 20 nt, Human
ugccugaguccuggcagucc

SEQ ID NO: 1259891 - RNA, 21 nt, Human
ugccugagugacgguuauuca

SEQ ID NO: 1259892 - RNA, 18 nt, Human
uggaaaauacacagguag

SEQ ID NO: 1259893 - RNA, 18 nt, Human
uggaaguggaggccacag

SEQ ID NO: 1259894 - RNA, 19 nt, Human
uggaggccacaguagucac

SEQ ID NO: 1259895 - RNA, 26 nt, Human
uggcagauguggugucugacgaagga

SEQ ID NO: 1259896 - RNA, 18 nt, Human
uggccaacuccauaaccu

SEQ ID NO: 1259897 - RNA, 21 nt, Human
ugggagcacaggauuuugaca

SEQ ID NO: 1259898 - RNA, 19 nt, Human
ugggaggaagagcaagcgg

SEQ ID NO: 1259899 - RNA, 20 nt, Human
uggggccagcccaacgucgg

SEQ ID NO: 1259900 - RNA, 21 nt, Human
ugugccaggcacccccuccag

SEQ ID NO: 1259901 - RNA, 21 nt, Human
uugccgaagugaguucugcac

SEQ ID NO: 1259902 - RNA, 19 nt, Human
uuggaaccaugaaguucuc

SEQ ID NO: 1259903 - RNA, 21 nt, Human
uuggaaguggaggccacagua

SEQ ID NO: 1259904 - RNA, 22 nt, Human
uuggaaguggaggccacaguag

SEQ ID NO: 1259905 - RNA, 23 nt, Human
uuggagucagacuugcccggguu

SEQ ID NO: 1259906 - RNA, 21 nt, Human
uuucucacaauucuggaggcu

SEQ ID NO: 1259907 - RNA, 18 nt, Human
aaauuggaaacaacugca

SEQ ID NO: 1259908 - RNA, 23 nt, Human
aacuguucccucuccccaauccc

SEQ ID NO: 1259909 - RNA, 18 nt, Human
aagauggagaaaacagaa

SEQ ID NO: 1259910 - RNA, 23 nt, Human
acagcggccagcaagcuuugggc

SEQ ID NO: 1259911 - RNA, 21 nt, Human
accacacuggagaugagagaa

SEQ ID NO: 1259912 - RNA, 26 nt, Human
accacacuggagaugagagaaaccag

SEQ ID NO: 1259913 - RNA, 26 nt, Human
agacagccccagccacucaccagccc

SEQ ID NO: 1259914 - RNA, 18 nt, Human
agauguuugaggucaccc

SEQ ID NO: 1259915 - RNA, 22 nt, Human
aggcagaaacucuuagagcuca

SEQ ID NO: 1259916 - RNA, 23 nt, Human
aggcagaaacucuuagagcucac

SEQ ID NO: 1259917 - RNA, 25 nt, Human
agucccaacuguucccucuccccaa

SEQ ID NO: 1259918 - RNA, 19 nt, Human
agucugucaacauagagcc

SEQ ID NO: 1259919 - RNA, 23 nt, Human
caaaugcauucaggugaagacag

SEQ ID NO: 1259920 - RNA, 20 nt, Human
caaauguucacauugucccu

SEQ ID NO: 1259921 - RNA, 24 nt, Human
caaauuggaaacaacugcaaacuu

SEQ ID NO: 1259922 - RNA, 23 nt, Human
cacacuggagaugagagaaacca

SEQ ID NO: 1259923 - RNA, 18 nt, Human
cacauugucccuccgcua

SEQ ID NO: 1259924 - RNA, 24 nt, Human
cacauugucccuccgcuauuuuua

SEQ ID NO: 1259925 - RNA, 23 nt, Human
cagaguaaauucauagcuuccaa

SEQ ID NO: 1259926 - RNA, 23 nt, Human
cagccacucaccagcccuacaca

SEQ ID NO: 1259927 - RNA, 18 nt, Human
cagcuggaaaaaguggaa

SEQ ID NO: 1259928 - RNA, 19 nt, Human
caggaaagguaaugaccau

SEQ ID NO: 1259929 - RNA, 19 nt, Human
caguaugaauuuccuggcc

SEQ ID NO: 1259930 - RNA, 19 nt, Human
cauugggaaaggacaucug

SEQ ID NO: 1259931 - RNA, 24 nt, Human
ccagcccuacacagcggccagcaa

SEQ ID NO: 1259932 - RNA, 21 nt, Human
cccaacuguucccucucccca

SEQ ID NO: 1259933 - RNA, 24 nt, Human
cccaaucccaaccuuauccaugua

SEQ ID NO: 1259934 - RNA, 25 nt, Human
cccaaucccaaccuuauccauguaa

SEQ ID NO: 1259935 - RNA, 22 nt, Human
ccuacacagcggccagcaagcu

SEQ ID NO: 1259936 - RNA, 19 nt, Human
ccuuccuuaauaacuuaaa

SEQ ID NO: 1259937 - RNA, 18 nt, Human
cucaaaguuaaaaagcag

SEQ ID NO: 1259938 - RNA, 23 nt, Human
cuuucuuuucagauguuugaggu

SEQ ID NO: 1259939 - RNA, 22 nt, Human
cuuuucagggcucuuccaggcu

SEQ ID NO: 1259940 - RNA, 18 nt, Human
gaaacaacugcaaacuuc

SEQ ID NO: 1259941 - RNA, 21 nt, Human
gaguguucaucaaggggcagc

SEQ ID NO: 1259942 - RNA, 26 nt, Human
gcaccagaaucuuuuccaaccggagg

SEQ ID NO: 1259943 - RNA, 19 nt, Human
ggaagaugaagggguagua

SEQ ID NO: 1259944 - RNA, 19 nt, Human
ggcccagagaccuaaacaa

SEQ ID NO: 1259945 - RNA, 18 nt, Human
gugugugugugugugugu

SEQ ID NO: 1259946 - RNA, 20 nt, Human
uagagcucacaaauuggaaa

SEQ ID NO: 1259947 - RNA, 18 nt, Human
uauaacaggaggacagga

SEQ ID NO: 1259948 - RNA, 23 nt, Human
ucaaaguuaaaaagcaguagcca

SEQ ID NO: 1259949 - RNA, 19 nt, Human
ucacauugucccuccgcua

SEQ ID NO: 1259950 - RNA, 22 nt, Human
ucagacagccccagccacucac

SEQ ID NO: 1259951 - RNA, 27 nt, Human
ucagcaaugaccacacuggagaugaga

SEQ ID NO: 1259952 - RNA, 23 nt, Human
uccccaaucccaaccuuauccau

SEQ ID NO: 1259953 - RNA, 18 nt, Human
ucccucuccccaauccca

SEQ ID NO: 1259954 - RNA, 19 nt, Human
ugaugacaccagucagaag

SEQ ID NO: 1259955 - RNA, 20 nt, Human
ugcuuaggaaaacagagugg

SEQ ID NO: 1259956 - RNA, 20 nt, Human
uggaaaaaguggaauuggca

SEQ ID NO: 1259957 - RNA, 19 nt, Human
ugguugcacuugccauuuc

SEQ ID NO: 1259958 - RNA, 20 nt, Human
uguguguguguguguucaua

SEQ ID NO: 1259959 - RNA, 20 nt, Human
uguucccucuccccaauccc

SEQ ID NO: 1259960 - RNA, 23 nt, Human
uuccuauuuuagucccagaauca

SEQ ID NO: 1259961 - RNA, 26 nt, Human
uucuuacaggcagaaacucuuagagc

SEQ ID NO: 1259962 - RNA, 22 nt, Human
uuuccaguuuuuacccaucuuu

SEQ ID NO: 1259963 - RNA, 26 nt, Human
uuuccaguuuuuacccaucuuucauu

SEQ ID NO: 1259964 - RNA, 18 nt, Human
uuuccuggcccagagacc

SEQ ID NO: 1259965 - RNA, 21 nt, Human
uuuugcuucuagucccaacug

SEQ ID NO: 1259966 - RNA, 24 nt, Human
aaaaaagauaaagcacaguaagga

SEQ ID NO: 1259967 - RNA, 20 nt, Human
aaaagcaaagcaggccaaaa

SEQ ID NO: 1259968 - RNA, 23 nt, Human
aaaaggcuggugauacucacuga

SEQ ID NO: 1259969 - RNA, 21 nt, Human
aaacaaguagaacccaccaaa

SEQ ID NO: 1259970 - RNA, 23 nt, Human
aaagaaaccagcagaaguaucac

SEQ ID NO: 1259971 - RNA, 21 nt, Human
aaaggcauguaguggaaaugg

SEQ ID NO: 1259972 - RNA, 23 nt, Human
aacagcagaaagaucacgaaggc

SEQ ID NO: 1259973 - RNA, 22 nt, Human
aaccugucccucccacccccca

SEQ ID NO: 1259974 - RNA, 20 nt, Human
aagaaaaaggacuucucagc

SEQ ID NO: 1259975 - RNA, 24 nt, Human
aagaacagcagaaagaucacgaag

SEQ ID NO: 1259976 - RNA, 24 nt, Human
aagaacagcagaaagaucacgaag

SEQ ID NO: 1259977 - RNA, 20 nt, Human
aagaagaaaaaggacuucuc

SEQ ID NO: 1259978 - RNA, 24 nt, Human
aagaagcugugcucucuggagggg

SEQ ID NO: 1259979 - RNA, 18 nt, Human
aagauagaacagaaacag

SEQ ID NO: 1259980 - RNA, 24 nt, Human
aagcaggccaaacuuagcuuccau

SEQ ID NO: 1259981 - RNA, 21 nt, Human
aagcaucugcccaacucgccc

SEQ ID NO: 1259982 - RNA, 19 nt, Human
aauaaucaaguauucacuu

SEQ ID NO: 1259983 - RNA, 22 nt, Human
aaucaccaucuuacugagccuu

SEQ ID NO: 1259984 - RNA, 23 nt, Human
aaugcaaaacagaacugaguaaa

SEQ ID NO: 1259985 - RNA, 21 nt, Human
acaaauccagggacccgugca

SEQ ID NO: 1259986 - RNA, 24 nt, Human
acacugcagagcugguuuggagac

SEQ ID NO: 1259987 - RNA, 21 nt, Human
acagcagaaagaucacgaagg

SEQ ID NO: 1259988 - RNA, 24 nt, Human
acaggacagcugguuuuaacagag

SEQ ID NO: 1259989 - RNA, 23 nt, Human
acccaauccuuuucccgcugcaa

SEQ ID NO: 1259990 - RNA, 19 nt, Human
acccgugcaaacuggcugg

SEQ ID NO: 1259991 - RNA, 18 nt, Human
acccuguaguuguagcag

SEQ ID NO: 1259992 - RNA, 20 nt, Human
accugucccucccacccccc

SEQ ID NO: 1259993 - RNA, 23 nt, Human
acuaccaacaaauccagggaccc

SEQ ID NO: 1259994 - RNA, 19 nt, Human
acucgcccuuguagcaacu

SEQ ID NO: 1259995 - RNA, 23 nt, Human
agaaacagauuaaaauacaucag

SEQ ID NO: 1259996 - RNA, 20 nt, Human
agaacagaaacagauuaaaa

SEQ ID NO: 1259997 - RNA, 24 nt, Human
agaacagcagaaagaucacgaagg

SEQ ID NO: 1259998 - RNA, 23 nt, Human
agaaggaagcauggcuuacugaa

SEQ ID NO: 1259999 - RNA, 21 nt, Human
agacauccucucaccauaggg

SEQ ID NO: 1260000 - RNA, 18 nt, Human
agagaaggagagagaagg

SEQ ID NO: 1260001 - RNA, 21 nt, Human
agagacaaccccuguaaacag

SEQ ID NO: 1260002 - RNA, 18 nt, Human
agauggagaacaggacag

SEQ ID NO: 1260003 - RNA, 24 nt, Human
agcagcugacaguuucuccaguuu

SEQ ID NO: 1260004 - RNA, 20 nt, Human
agcaggaaaaagacauaacc

SEQ ID NO: 1260005 - RNA, 18 nt, Human
agccaaaaggagguacag

SEQ ID NO: 1260006 - RNA, 20 nt, Human
agcugguuuggagacauccu

SEQ ID NO: 1260007 - RNA, 21 nt, Human
aggaaaaagacauaaccaugu

SEQ ID NO: 1260008 - RNA, 21 nt, Human
aggaggaaaagggugacccag

SEQ ID NO: 1260009 - RNA, 18 nt, Human
agggaagaguucgggaca

SEQ ID NO: 1260010 - RNA, 18 nt, Human
aggguuuuucuccucuug

SEQ ID NO: 1260011 - RNA, 22 nt, Human
auaccauaaccugucccuccca

SEQ ID NO: 1260012 - RNA, 24 nt, Human
aucaaggaguaagcuguagguuuu

SEQ ID NO: 1260013 - RNA, 21 nt, Human
auggcagcagugcagguggca

SEQ ID NO: 1260014 - RNA, 22 nt, Human
caaaaagccacacugccaaagc

SEQ ID NO: 1260015 - RNA, 23 nt, Human
caaacccaggccccuggcugccu

SEQ ID NO: 1260016 - RNA, 20 nt, Human
cacagaagguaaagaaacca

SEQ ID NO: 1260017 - RNA, 30 nt, Human
cacauaaauacauguauggggugugugugg

SEQ ID NO: 1260018 - RNA, 20 nt, Human
cacccaacaaguccauuuca

SEQ ID NO: 1260019 - RNA, 22 nt, Human
caccuuguauuucuucagcagc

SEQ ID NO: 1260020 - RNA, 24 nt, Human
cacuaaagaaggcacggaagccug

SEQ ID NO: 1260021 - RNA, 25 nt, Human
cagccuagaccugggcauaagccaa

SEQ ID NO: 1260022 - RNA, 25 nt, Human
cagcugguuuguguuuagaagaggu

SEQ ID NO: 1260023 - RNA, 20 nt, Human
caggaaaaagacauaaccau

SEQ ID NO: 1260024 - RNA, 20 nt, Human
caggaggacugccaaugaua

SEQ ID NO: 1260025 - RNA, 18 nt, Human
caggagggugcugcugug

SEQ ID NO: 1260026 - RNA, 20 nt, Human
caggcuacuagugaggauca

SEQ ID NO: 1260027 - RNA, 18 nt, Human
caggcuguagcugugcuc

SEQ ID NO: 1260028 - RNA, 19 nt, Human
cagggcaagugugcaaaaa

SEQ ID NO: 1260029 - RNA, 18 nt, Human
cauaguccuccacaucaa

SEQ ID NO: 1260030 - RNA, 24 nt, Human
caucaaggaguaagcuguagguuu

SEQ ID NO: 1260031 - RNA, 25 nt, Human
cauguauggggugugugugugugua

SEQ ID NO: 1260032 - RNA, 25 nt, Human
ccaauccaaacaaaaaagauaaagc

SEQ ID NO: 1260033 - RNA, 20 nt, Human
ccauuucaucucucucucca

SEQ ID NO: 1260034 - RNA, 25 nt, Human
cccaccccccaacuacauucgaaaa

SEQ ID NO: 1260035 - RNA, 24 nt, Human
cccaugguguggagacuaaaaagc

SEQ ID NO: 1260036 - RNA, 19 nt, Human
ccucagaacuucagaucca

SEQ ID NO: 1260037 - RNA, 20 nt, Human
ccuccaagaagcugugcucu

SEQ ID NO: 1260038 - RNA, 21 nt, Human
ccugagcaagcagugguccuc

SEQ ID NO: 1260039 - RNA, 20 nt, Human
ccugcaauuauucaaaccca

SEQ ID NO: 1260040 - RNA, 25 nt, Human
ccuguaguuguagcaggaaaaagac

SEQ ID NO: 1260041 - RNA, 18 nt, Human
cggaagccuggugcuggg

SEQ ID NO: 1260042 - RNA, 23 nt, Human
cguucagaaaggucccgaucauc

SEQ ID NO: 1260043 - RNA, 22 nt, Human
cucagaacuucagauccauccc

SEQ ID NO: 1260044 - RNA, 25 nt, Human
cucauggucacccaacaaguccauu

SEQ ID NO: 1260045 - RNA, 21 nt, Human
cuccaagaagcugugcucucu

SEQ ID NO: 1260046 - RNA, 18 nt, Human
cugaagaccacauaaaua

SEQ ID NO: 1260047 - RNA, 22 nt, Human
cugccugggaacgggacuuggg

SEQ ID NO: 1260048 - RNA, 24 nt, Human
cuggugauacucacugauggaaga

SEQ ID NO: 1260049 - RNA, 23 nt, Human
cuguaaacaggaaucgaucccac

SEQ ID NO: 1260050 - RNA, 20 nt, Human
cuuacugagccuuucugcca

SEQ ID NO: 1260051 - RNA, 20 nt, Human
cuuucugccagauucuccuc

SEQ ID NO: 1260052 - RNA, 21 nt, Human
cuuuggcaggcuacaaucuac

SEQ ID NO: 1260053 - RNA, 19 nt, Human
gaacaggaggaacacuagg

SEQ ID NO: 1260054 - RNA, 21 nt, Human
gaaucuguugggugaagcugg

SEQ ID NO: 1260055 - RNA, 21 nt, Human
gagaugucacaacagcaucaa

SEQ ID NO: 1260056 - RNA, 23 nt, Human
gauaagcuuggugcgcuccuucu

SEQ ID NO: 1260057 - RNA, 26 nt, Human
gaugauagagaaggagagagaaggga

SEQ ID NO: 1260058 - RNA, 24 nt, Human
gcaaguggacuaccaacaaaucca

SEQ ID NO: 1260059 - RNA, 19 nt, Human
gcaaugaaaaaacaacuuc

SEQ ID NO: 1260060 - RNA, 19 nt, Human
gcaggaaaaagacauaacc

SEQ ID NO: 1260061 - RNA, 19 nt, Human
gcaggugggguccugggcc

SEQ ID NO: 1260062 - RNA, 21 nt, Human
gcugaaugggagaggaguaag

SEQ ID NO: 1260063 - RNA, 19 nt, Human
gcuuauaggcgugcuccag

SEQ ID NO: 1260064 - RNA, 24 nt, Human
ggaaaaagcuaccuuccuucccuc

SEQ ID NO: 1260065 - RNA, 19 nt, Human
ggaaauaaaggugggaaga

SEQ ID NO: 1260066 - RNA, 22 nt, Human
ggaacagcugguggagccuggg

SEQ ID NO: 1260067 - RNA, 19 nt, Human
ggacucaguaagcauggca

SEQ ID NO: 1260068 - RNA, 21 nt, Human
ggagaugaucuugaugacugc

SEQ ID NO: 1260069 - RNA, 21 nt, Human
ggaguaguggagggauaaagg

SEQ ID NO: 1260070 - RNA, 23 nt, Human
gggaacagcugguggagccuggg

SEQ ID NO: 1260071 - RNA, 19 nt, Human
gggaagaaauggagaugga

SEQ ID NO: 1260072 - RNA, 18 nt, Human
gggaucagugcuuugcag

SEQ ID NO: 1260073 - RNA, 20 nt, Human
gggcaaagaaaaugcaaaac

SEQ ID NO: 1260074 - RNA, 19 nt, Human
gggguccugggccaggagg

SEQ ID NO: 1260075 - RNA, 18 nt, Human
gguaaugagacaacuaaa

SEQ ID NO: 1260076 - RNA, 20 nt, Human
ggugcugcuguggagguggu

SEQ ID NO: 1260077 - RNA, 21 nt, Human
ggugcuguggauggaggugag

SEQ ID NO: 1260078 - RNA, 21 nt, Human
guagagggaagcuagguaaca

SEQ ID NO: 1260079 - RNA, 21 nt, Human
guauggggugugugugugugu

SEQ ID NO: 1260080 - RNA, 19 nt, Human
guccaggcuguagcugugc

SEQ ID NO: 1260081 - RNA, 19 nt, Human
gugcucucuggagggggcu

SEQ ID NO: 1260082 - RNA, 22 nt, Human
guggagcacuaaagaaggcacg

SEQ ID NO: 1260083 - RNA, 26 nt, Human
guggauggaggugaguuguguccggu

SEQ ID NO: 1260084 - RNA, 18 nt, Human
guggcauugggggccgaa

SEQ ID NO: 1260085 - RNA, 22 nt, Human
guguggagacuaaaaagcaaag

SEQ ID NO: 1260086 - RNA, 23 nt, Human
guuucgauuaagguggacagaaa

SEQ ID NO: 1260087 - RNA, 25 nt, Human
uaaaaagcaaagcaggccaaacuua

SEQ ID NO: 1260088 - RNA, 20 nt, Human
uaaaacaaguagaacccacc

SEQ ID NO: 1260089 - RNA, 22 nt, Human
uaaaacaaguagaacccaccaa

SEQ ID NO: 1260090 - RNA, 21 nt, Human
uaaacaggaaucgaucccaca

SEQ ID NO: 1260091 - RNA, 23 nt, Human
uaaagaaaccagcagaaguauca

SEQ ID NO: 1260092 - RNA, 19 nt, Human
uaaccugucccucccaccc

SEQ ID NO: 1260093 - RNA, 20 nt, Human
uaagaacagcagaaagauca

SEQ ID NO: 1260094 - RNA, 23 nt, Human
uaauacagacacuguaggcauuu

SEQ ID NO: 1260095 - RNA, 21 nt, Human
uacaagauagaacagaaacag

SEQ ID NO: 1260096 - RNA, 21 nt, Human
uacaaucuacucugaggugga

SEQ ID NO: 1260097 - RNA, 20 nt, Human
uacagacacuguaggcauuu

SEQ ID NO: 1260098 - RNA, 22 nt, Human
uacauguauggggugugugugu

SEQ ID NO: 1260099 - RNA, 19 nt, Human
uaccaacaaauccagggac

SEQ ID NO: 1260100 - RNA, 19 nt, Human
uacccuauaaaaauguaaa

SEQ ID NO: 1260101 - RNA, 19 nt, Human
uagaaccaauccaaacaaa

SEQ ID NO: 1260102 - RNA, 19 nt, Human
uagaagagguaaugagaca

SEQ ID NO: 1260103 - RNA, 21 nt, Human
uagcaggaaaaagacauaacc

SEQ ID NO: 1260104 - RNA, 19 nt, Human
uagcugugcuccuccaaga

SEQ ID NO: 1260105 - RNA, 26 nt, Human
uaguaaagacagcaguucugcccaug

SEQ ID NO: 1260106 - RNA, 22 nt, Human
uaucuauguguguguguauaaa

SEQ ID NO: 1260107 - RNA, 19 nt, Human
ucaccauagggagcaggau

SEQ ID NO: 1260108 - RNA, 18 nt, Human
ucacuaggccucucuugu

SEQ ID NO: 1260109 - RNA, 23 nt, Human
ucauauuaauauggggcaaugaa

SEQ ID NO: 1260110 - RNA, 22 nt, Human
ucccacaagacuuugcuuuggg

SEQ ID NO: 1260111 - RNA, 18 nt, Human
ucgggacacugcagagcu

SEQ ID NO: 1260112 - RNA, 23 nt, Human
ucguucagaaaggucccgaucau

SEQ ID NO: 1260113 - RNA, 22 nt, Human
ucucaccauagggagcaggaua

SEQ ID NO: 1260114 - RNA, 24 nt, Human
ucucaggaagacagggcaagugug

SEQ ID NO: 1260115 - RNA, 21 nt, Human
ucucuuguccaggcaauuucc

SEQ ID NO: 1260116 - RNA, 23 nt, Human
ucugaagaccacauaaauacaug

SEQ ID NO: 1260117 - RNA, 19 nt, Human
ucugagguggaguagugga

SEQ ID NO: 1260118 - RNA, 18 nt, Human
ucugcccaugguguggag

SEQ ID NO: 1260119 - RNA, 19 nt, Human
ucuggacccugggggggcc

SEQ ID NO: 1260120 - RNA, 23 nt, Human
ucuucuaguucauuuucaaucac

SEQ ID NO: 1260121 - RNA, 21 nt, Human
ucuuuugucucaucauccuca

SEQ ID NO: 1260122 - RNA, 23 nt, Human
ucuuuugucucaucauccucacu

SEQ ID NO: 1260123 - RNA, 22 nt, Human
ugaaaaaacaacuucaauagga

SEQ ID NO: 1260124 - RNA, 23 nt, Human
ugaagggaagguaggaaaggcau

SEQ ID NO: 1260125 - RNA, 21 nt, Human
ugagggaaggaauccuuuggc

SEQ ID NO: 1260126 - RNA, 20 nt, Human
ugauaggugaaguugaccgc

SEQ ID NO: 1260127 - RNA, 22 nt, Human
uggaagaugauagagaaggaga

SEQ ID NO: 1260128 - RNA, 18 nt, Human
uggacagaaacuaaggaa

SEQ ID NO: 1260129 - RNA, 25 nt, Human
uggccaccugaggggugauaagcuu

SEQ ID NO: 1260130 - RNA, 19 nt, Human
uggcuuauaggcgugcucc

SEQ ID NO: 1260131 - RNA, 22 nt, Human
uggcuuauaggcgugcuccagu

SEQ ID NO: 1260132 - RNA, 22 nt, Human
uggcuuauaggcgugcuccagu

SEQ ID NO: 1260133 - RNA, 18 nt, Human
ugggaagaaauggagaug

SEQ ID NO: 1260134 - RNA, 29 nt, Human
ugggguguguguguguguaucuaugugug

SEQ ID NO: 1260135 - RNA, 19 nt, Human
ugggugacuucgaaugcac

SEQ ID NO: 1260136 - RNA, 20 nt, Human
uggugcugggggaagcaucu

SEQ ID NO: 1260137 - RNA, 20 nt, Human
uguagcggaggguggagcac

SEQ ID NO: 1260138 - RNA, 20 nt, Human
ugucucgaacuuguuuuucu

SEQ ID NO: 1260139 - RNA, 24 nt, Human
ugugcaaaaagccacacugccaaa

SEQ ID NO: 1260140 - RNA, 19 nt, Human
uguguaucuaugugugugu

SEQ ID NO: 1260141 - RNA, 25 nt, Human
uguguaucuauguguguguguauaa

SEQ ID NO: 1260142 - RNA, 22 nt, Human
ugugucucuagggcaaagaaaa

SEQ ID NO: 1260143 - RNA, 21 nt, Human
uguguguguaucuaugugugu

SEQ ID NO: 1260144 - RNA, 23 nt, Human
uguguguguaucuaugugugugu

SEQ ID NO: 1260145 - RNA, 19 nt, Human
uguguguguguaucuaugu

SEQ ID NO: 1260146 - RNA, 22 nt, Human
uguguguguguaucuaugugug

SEQ ID NO: 1260147 - RNA, 23 nt, Human
uguguguguguaucuaugugugu

SEQ ID NO: 1260148 - RNA, 29 nt, Human
uguguguguguaucuauguguguguguaa

SEQ ID NO: 1260149 - RNA, 27 nt, Human
uguguguguguguaucuaugugugugu

SEQ ID NO: 1260150 - RNA, 28 nt, Human
uguguguguguguaucuaugugugugug

SEQ ID NO: 1260151 - RNA, 19 nt, Human
uuaaaacaaguagaaccca

SEQ ID NO: 1260152 - RNA, 22 nt, Human
uuacugagccuuucugccagau

SEQ ID NO: 1260153 - RNA, 24 nt, Human
uuagggccaucaccuuguauuucu

SEQ ID NO: 1260154 - RNA, 18 nt, Human
uuccaugguuacauuugg

SEQ ID NO: 1260155 - RNA, 20 nt, Human
uuccugguugggguuguaaa

SEQ ID NO: 1260156 - RNA, 24 nt, Human
uuccugguugggguuguaaaacug

SEQ ID NO: 1260157 - RNA, 19 nt, Human
uucggauacacaugaucug

SEQ ID NO: 1260158 - RNA, 24 nt, Human
uuggugauggcagcagugcaggug

SEQ ID NO: 1260159 - RNA, 19 nt, Human
uuucggagaugaucuugau

SEQ ID NO: 1260160 - RNA, 19 nt, Human
agaaauacacauucacuaa

SEQ ID NO: 1260161 - RNA, 23 nt, Human
agaccuccagcacaggacaacuc

SEQ ID NO: 1260162 - RNA, 23 nt, Human
aguggcgacugguuuaagugauu

SEQ ID NO: 1260163 - RNA, 24 nt, Human
cagaaagaacuuaaauguauaaua

SEQ ID NO: 1260164 - RNA, 25 nt, Human
cagccauaccccuacugaauacaaa

SEQ ID NO: 1260165 - RNA, 21 nt, Human
cauaacaccagcuucaaguuu

SEQ ID NO: 1260166 - RNA, 22 nt, Human
ccauaccccuacugaauacaaa

SEQ ID NO: 1260167 - RNA, 22 nt, Human
ccugcaaaauacauaacaccag

SEQ ID NO: 1260168 - RNA, 22 nt, Human
gcacaggacaacucaggaaaca

SEQ ID NO: 1260169 - RNA, 25 nt, Human
uaagugauuuuuauauggcauccca

SEQ ID NO: 1260170 - RNA, 19 nt, Human
uacacagaacagaaagaac

SEQ ID NO: 1260171 - RNA, 21 nt, Human
ucguuuuccuccuuauuuggg

SEQ ID NO: 1260172 - RNA, 21 nt, Human
ucuauucuuuauucuuccuga

SEQ ID NO: 1260173 - RNA, 22 nt, Human
ugagcagaccuccagcacagga

SEQ ID NO: 1260174 - RNA, 21 nt, Human
uuaaucagccauaccccuacu

SEQ ID NO: 1260175 - RNA, 20 nt, Human
uucgucugagcagaccucca

SEQ ID NO: 1260176 - RNA, 19 nt, Human
uuggagguucuuaucaauu

SEQ ID NO: 1260177 - RNA, 23 nt, Human
agaaaaaagagcaauggaaagga

SEQ ID NO: 1260178 - RNA, 19 nt, Human
agcaauggaaaggauuuca

SEQ ID NO: 1260179 - RNA, 19 nt, Human
aggaugaauggaaucuauc

SEQ ID NO: 1260180 - RNA, 22 nt, Human
caaauuaugaagaaauagaagu

SEQ ID NO: 1260181 - RNA, 23 nt, Human
caaggauuccgacagugagauuu

SEQ ID NO: 1260182 - RNA, 20 nt, Human
cauuagaaugcguuuuccau

SEQ ID NO: 1260183 - RNA, 20 nt, Human
ccaacagagugugaucuggc

SEQ ID NO: 1260184 - RNA, 18 nt, Human
ccccgggagcccgguggg

SEQ ID NO: 1260185 - RNA, 19 nt, Human
ccgacagugagauuuccga

SEQ ID NO: 1260186 - RNA, 25 nt, Human
ccucgguggcgccccucacccugcc

SEQ ID NO: 1260187 - RNA, 21 nt, Human
gcguggugugauuuccaagga

SEQ ID NO: 1260188 - RNA, 21 nt, Human
ggcgcuuccucgguggcgccc

SEQ ID NO: 1260189 - RNA, 22 nt, Human
gguggcgccccucacccugccu

SEQ ID NO: 1260190 - RNA, 20 nt, Human
uagaaaggaugaauggaauc

SEQ ID NO: 1260191 - RNA, 26 nt, Human
ucacaauuaaucuuuuguucuugacu

SEQ ID NO: 1260192 - RNA, 22 nt, Human
ugaauggaaucuaucugcgugg

SEQ ID NO: 1260193 - RNA, 21 nt, Human
ugaguugaugaacugagcucc

SEQ ID NO: 1260194 - RNA, 19 nt, Human
uggaaucuaucugcguggg

SEQ ID NO: 1260195 - RNA, 18 nt, Human
uggcagccccgggagccc

SEQ ID NO: 1260196 - RNA, 21 nt, Human
uggcgccccucacccugccuc

SEQ ID NO: 1260197 - RNA, 25 nt, Human
uuaaugcaaaaguugcaaucuccau

SEQ ID NO: 1260198 - RNA, 21 nt, Human
aaaauugaugaguuuuccucc

SEQ ID NO: 1260199 - RNA, 22 nt, Human
cacaucugcuacucagacgacu

SEQ ID NO: 1260200 - RNA, 28 nt, Human
cacgcugccaaagccgggauuccccgaa

SEQ ID NO: 1260201 - RNA, 23 nt, Human
caucugcuacucagacgacuccu

SEQ ID NO: 1260202 - RNA, 23 nt, Human
cugggcccagagggaaaaggcug

SEQ ID NO: 1260203 - RNA, 19 nt, Human
gggcccagagggaaaaggc

SEQ ID NO: 1260204 - RNA, 25 nt, Human
uaugccacauugucauaggcagggg

SEQ ID NO: 1260205 - RNA, 23 nt, Human
uccuccuucaagcguaacuucaa

SEQ ID NO: 1260206 - RNA, 19 nt, Human
ugaugaguuuuccuccuuc

SEQ ID NO: 1260207 - RNA, 23 nt, Human
ugggcccagagggaaaaggcugg

SEQ ID NO: 1260208 - RNA, 23 nt, Human
aagcaggaagcagggagagugga

SEQ ID NO: 1260209 - RNA, 19 nt, Human
acccaaaaggccuccccag

SEQ ID NO: 1260210 - RNA, 18 nt, Human
agcugcccuuguccacug

SEQ ID NO: 1260211 - RNA, 19 nt, Human
aggaagcagggagagugga

SEQ ID NO: 1260212 - RNA, 23 nt, Human
agggaagcaggaagcagggagag

SEQ ID NO: 1260213 - RNA, 24 nt, Human
agggagcuggccucagccccuggg

SEQ ID NO: 1260214 - RNA, 26 nt, Human
agggagcuggccucagccccuggggg

SEQ ID NO: 1260215 - RNA, 27 nt, Human
caccuggaugagcacuagcccagggac

SEQ ID NO: 1260216 - RNA, 25 nt, Human
cagaguggacagcaccaguuugccc

SEQ ID NO: 1260217 - RNA, 19 nt, Human
cagccccugggggccuccu

SEQ ID NO: 1260218 - RNA, 19 nt, Human
cagccccugggggccuccu

SEQ ID NO: 1260219 - RNA, 23 nt, Human
ccacagaggcugaagagguggcc

SEQ ID NO: 1260220 - RNA, 23 nt, Human
ccuccugcugugcugcccuacca

SEQ ID NO: 1260221 - RNA, 24 nt, Human
cuagcccagggacugggagggccu

SEQ ID NO: 1260222 - RNA, 22 nt, Human
cugugcugcccuaccauccagg

SEQ ID NO: 1260223 - RNA, 24 nt, Human
gaagcuucuuccacccagacacag

SEQ ID NO: 1260224 - RNA, 21 nt, Human
gagguggccggagggaagcag

SEQ ID NO: 1260225 - RNA, 22 nt, Human
gcuggccucagccccugggggc

SEQ ID NO: 1260226 - RNA, 19 nt, Human
ggaagcagggagaguggag

SEQ ID NO: 1260227 - RNA, 22 nt, Human
ggacugggagggccuagaagcu

SEQ ID NO: 1260228 - RNA, 22 nt, Human
gggagcuggccucagccccugg

SEQ ID NO: 1260229 - RNA, 23 nt, Human
gggggccuccugcugugcugccc

SEQ ID NO: 1260230 - RNA, 22 nt, Human
uccuguuauuuauacccaaaag

SEQ ID NO: 1260231 - RNA, 22 nt, Human
ugagcacuagcccagggacugg

SEQ ID NO: 1260232 - RNA, 18 nt, Human
uucugcuucagcuagugg

SEQ ID NO: 1260233 - RNA, 20 nt, Human
agaacagucaggagaauuag

SEQ ID NO: 1260234 - RNA, 19 nt, Human
aucuaaagugggcacagga

SEQ ID NO: 1260235 - RNA, 24 nt, Human
caagaccuccacacuccccuggga

SEQ ID NO: 1260236 - RNA, 18 nt, Human
caccagacccagcagcag

SEQ ID NO: 1260237 - RNA, 23 nt, Human
cagcagcagcagccacuucaugg

SEQ ID NO: 1260238 - RNA, 19 nt, Human
ccagacccagcagcagcag

SEQ ID NO: 1260239 - RNA, 33 nt, Human
ccagcagcagcagccacuucaugguucuucuuu

SEQ ID NO: 1260240 - RNA, 22 nt, Human
cgccaccagacccagcagcagc

SEQ ID NO: 1260241 - RNA, 21 nt, Human
cuggcuggguugagguugugc

SEQ ID NO: 1260242 - RNA, 19 nt, Human
cuucaugguucuucccggg

SEQ ID NO: 1260243 - RNA, 22 nt, Human
cuucaugguucuucccgggucc

SEQ ID NO: 1260244 - RNA, 20 nt, Human
gauacaucuaaagugggcac

SEQ ID NO: 1260245 - RNA, 30 nt, Human
gcagcagcagccacuucaugguucuucccu

SEQ ID NO: 1260246 - RNA, 25 nt, Human
ggacagaggccagaucuuccuggga

SEQ ID NO: 1260247 - RNA, 18 nt, Human
ggacagggaacagggcca

SEQ ID NO: 1260248 - RNA, 18 nt, Human
ggcacaggacagaggccg

SEQ ID NO: 1260249 - RNA, 25 nt, Human
uaaagugggcacaggacagaggcca

SEQ ID NO: 1260250 - RNA, 24 nt, Human
uacaugaugcacucagagagcgcc

SEQ ID NO: 1260251 - RNA, 20 nt, Human
uaccagggugggagccuccc

SEQ ID NO: 1260252 - RNA, 23 nt, Human
uccacaaaaccuguuucaguggg

SEQ ID NO: 1260253 - RNA, 22 nt, Human
ucuucccgggucccaacucgag

SEQ ID NO: 1260254 - RNA, 19 nt, Human
ugggaagaacagucaggag

SEQ ID NO: 1260255 - RNA, 27 nt, Human
aacccagagaggcagacgugggggccc

SEQ ID NO: 1260256 - RNA, 20 nt, Human
acacucgcacacaaacccac

SEQ ID NO: 1260257 - RNA, 22 nt, Human
acaguggaaacgacuuccucca

SEQ ID NO: 1260258 - RNA, 18 nt, Human
agcagccacucccaaacc

SEQ ID NO: 1260259 - RNA, 18 nt, Human
agccacucccaaacccag

SEQ ID NO: 1260260 - RNA, 23 nt, Human
agccgaaggagcagaggggcagg

SEQ ID NO: 1260261 - RNA, 23 nt, Human
agcugcccugcacacacccuggg

SEQ ID NO: 1260262 - RNA, 21 nt, Human
auggugacagacucgccucuc

SEQ ID NO: 1260263 - RNA, 22 nt, Human
caacucuuccuccaggagaacu

SEQ ID NO: 1260264 - RNA, 22 nt, Human
cacacacccugggccaccccug

SEQ ID NO: 1260265 - RNA, 22 nt, Human
cacacaguggcccucgcaggag

SEQ ID NO: 1260266 - RNA, 22 nt, Human
cacucgcacacaaacccaccuu

SEQ ID NO: 1260267 - RNA, 23 nt, Human
cagagguccucucuccagagucu

SEQ ID NO: 1260268 - RNA, 22 nt, Human
cagaugccacucccacagccga

SEQ ID NO: 1260269 - RNA, 18 nt, Human
cagcagccacucccaaac

SEQ ID NO: 1260270 - RNA, 23 nt, Human
cagcagccacucccaaacccaga

SEQ ID NO: 1260271 - RNA, 18 nt, Human
cagcugcaugcccggccc

SEQ ID NO: 1260272 - RNA, 21 nt, Human
cagucccagugaguggaaucc

SEQ ID NO: 1260273 - RNA, 21 nt, Human
ccacacucgcacacaaaccca

SEQ ID NO: 1260274 - RNA, 23 nt, Human
ccaccuccugacagccuccaugg

SEQ ID NO: 1260275 - RNA, 21 nt, Human
ccacuggcagagguccucucu

SEQ ID NO: 1260276 - RNA, 18 nt, Human
ccagggaggaugcugaca

SEQ ID NO: 1260277 - RNA, 22 nt, Human
cccacagccgaaggagcagagg

SEQ ID NO: 1260278 - RNA, 25 nt, Human
cccacagccgaaggagcagaggggc

SEQ ID NO: 1260279 - RNA, 24 nt, Human
cccacaugaccggcggcggcgggu

SEQ ID NO: 1260280 - RNA, 23 nt, Human
cccacaugguccauggguuucug

SEQ ID NO: 1260281 - RNA, 22 nt, Human
cccaccacccauagagggcgcc

SEQ ID NO: 1260282 - RNA, 24 nt, Human
cccccgggcugggcucggcuccug

SEQ ID NO: 1260283 - RNA, 21 nt, Human
cccgguguagccucgggcugg

SEQ ID NO: 1260284 - RNA, 18 nt, Human
ccucaccagggccccugc

SEQ ID NO: 1260285 - RNA, 20 nt, Human
ccugcacacacccugggcca

SEQ ID NO: 1260286 - RNA, 21 nt, Human
ccugcacacacccugggccac

SEQ ID NO: 1260287 - RNA, 21 nt, Human
cggcccgaaggagcaguccgg

SEQ ID NO: 1260288 - RNA, 19 nt, Human
cggccgcgaagugcccggg

SEQ ID NO: 1260289 - RNA, 20 nt, Human
cuccugacagccuccauggu

SEQ ID NO: 1260290 - RNA, 18 nt, Human
cucggccgcgaagugccc

SEQ ID NO: 1260291 - RNA, 24 nt, Human
cugacaguggaaacgacuuccucc

SEQ ID NO: 1260292 - RNA, 21 nt, Human
cuugcucuccauccuggcagg

SEQ ID NO: 1260293 - RNA, 21 nt, Human
gaaggagcagaggggcagggu

SEQ ID NO: 1260294 - RNA, 22 nt, Human
gacucgccucuccaauggccuc

SEQ ID NO: 1260295 - RNA, 24 nt, Human
gacucgccucuccaauggccuccg

SEQ ID NO: 1260296 - RNA, 24 nt, Human
gagcugcccugcacacacccuggg

SEQ ID NO: 1260297 - RNA, 21 nt, Human
gcagcaggagcgcgacacagg

SEQ ID NO: 1260298 - RNA, 21 nt, Human
gccaacagcugucuccgucau

SEQ ID NO: 1260299 - RNA, 18 nt, Human
gcccgaaggagcaguccg

SEQ ID NO: 1260300 - RNA, 26 nt, Human
gcggcccgaaggagcaguccggccca

SEQ ID NO: 1260301 - RNA, 23 nt, Human
gcggucagcucggagccugaagc

SEQ ID NO: 1260302 - RNA, 22 nt, Human
gcuuccucccgguguagccucg

SEQ ID NO: 1260303 - RNA, 22 nt, Human
ggagggagcccaggcaucccca

SEQ ID NO: 1260304 - RNA, 20 nt, Human
gggcgcccagccagggcagc

SEQ ID NO: 1260305 - RNA, 21 nt, Human
gguuacauccagccuuggggg

SEQ ID NO: 1260306 - RNA, 23 nt, Human
gucagcucggagccugaagccag

SEQ ID NO: 1260307 - RNA, 21 nt, Human
guggccccuugcucuccaucc

SEQ ID NO: 1260308 - RNA, 21 nt, Human
uacauccagccuugggggucu

SEQ ID NO: 1260309 - RNA, 21 nt, Human
uagccucgggcuggugccccc

SEQ ID NO: 1260310 - RNA, 22 nt, Human
ucagcucggagccugaagccag

SEQ ID NO: 1260311 - RNA, 18 nt, Human
ucauccuuggagcugccc

SEQ ID NO: 1260312 - RNA, 22 nt, Human
uccauggguuucugggcaggug

SEQ ID NO: 1260313 - RNA, 24 nt, Human
ucccccgggcugggcucggcuccc

SEQ ID NO: 1260314 - RNA, 19 nt, Human
ucgcacacaaacccaccuu

SEQ ID NO: 1260315 - RNA, 20 nt, Human
ucgcacacaaacccaccuuc

SEQ ID NO: 1260316 - RNA, 22 nt, Human
ugcaugcccggcccacacucgc

SEQ ID NO: 1260317 - RNA, 22 nt, Human
uggcagauggggccagcacggc

SEQ ID NO: 1260318 - RNA, 19 nt, Human
uggcaggaauggugacaga

SEQ ID NO: 1260319 - RNA, 18 nt, Human
uggccuccgacacucguu

SEQ ID NO: 1260320 - RNA, 20 nt, Human
ugggaacaagguuacaucca

SEQ ID NO: 1260321 - RNA, 18 nt, Human
ugggagcgaugcagaugc

SEQ ID NO: 1260322 - RNA, 21 nt, Human
uggggccagcacggcuuucgg

SEQ ID NO: 1260323 - RNA, 18 nt, Human
ugggggucuuccauccuc

SEQ ID NO: 1260324 - RNA, 24 nt, Human
uugggggucuuccauccucaccag

SEQ ID NO: 1260325 - RNA, 18 nt, Human
aaaaaagccacagcagca

SEQ ID NO: 1260326 - RNA, 20 nt, Human
aaaaagccacagcagcaaca

SEQ ID NO: 1260327 - RNA, 21 nt, Human
aagaagagcaacagcucaagc

SEQ ID NO: 1260328 - RNA, 23 nt, Human
aagacccuucccgcucuccaccc

SEQ ID NO: 1260329 - RNA, 24 nt, Human
aagcacagcagucugaagcuuggg

SEQ ID NO: 1260330 - RNA, 19 nt, Human
aagucacaaaucuccacug

SEQ ID NO: 1260331 - RNA, 20 nt, Human
acccuauuuccuccccugaa

SEQ ID NO: 1260332 - RNA, 18 nt, Human
acugggacaucuggggac

SEQ ID NO: 1260333 - RNA, 19 nt, Human
agaaggcaaaaaagccaca

SEQ ID NO: 1260334 - RNA, 18 nt, Human
agacccuucccgcucucc

SEQ ID NO: 1260335 - RNA, 23 nt, Human
agcaacacuuaggagcaagaccc

SEQ ID NO: 1260336 - RNA, 20 nt, Human
agcagccaugguggggccag

SEQ ID NO: 1260337 - RNA, 23 nt, Human
aggacaucccaguggcuuugaag

SEQ ID NO: 1260338 - RNA, 26 nt, Human
aggcaagcagccaugguggggccagg

SEQ ID NO: 1260339 - RNA, 22 nt, Human
aggcaggaaggcccugauccag

SEQ ID NO: 1260340 - RNA, 24 nt, Human
aggugggcuccaaaccccaggcuu

SEQ ID NO: 1260341 - RNA, 23 nt, Human
auggagauggggagcuggucaug

SEQ ID NO: 1260342 - RNA, 19 nt, Human
auuuuuguuauagcagccu

SEQ ID NO: 1260343 - RNA, 23 nt, Human
caaaaaagccacagcagcaacac

SEQ ID NO: 1260344 - RNA, 19 nt, Human
caagcagccaugguggggc

SEQ ID NO: 1260345 - RNA, 20 nt, Human
cacccuauuuccuccccuga

SEQ ID NO: 1260346 - RNA, 21 nt, Human
cagccugaacaaagacagcuu

SEQ ID NO: 1260347 - RNA, 20 nt, Human
cagcucaagcucuagcaugg

SEQ ID NO: 1260348 - RNA, 21 nt, Human
caggaaggcccugauccagca

SEQ ID NO: 1260349 - RNA, 18 nt, Human
caguggcucccagggcug

SEQ ID NO: 1260350 - RNA, 22 nt, Human
caucuggggacaggcucuguuc

SEQ ID NO: 1260351 - RNA, 22 nt, Human
caugggacccaggugccuggag

SEQ ID NO: 1260352 - RNA, 22 nt, Human
ccagccagucaagacggucaau

SEQ ID NO: 1260353 - RNA, 24 nt, Human
ccaggugccuggaggacaucccag

SEQ ID NO: 1260354 - RNA, 23 nt, Human
cccaggugccuggaggacauccc

SEQ ID NO: 1260355 - RNA, 28 nt, Human
ccgcucuccacccuauuuccuccccuga

SEQ ID NO: 1260356 - RNA, 19 nt, Human
ccugaagaagagcaacagc

SEQ ID NO: 1260357 - RNA, 21 nt, Human
cucccagggcugcugcacacu

SEQ ID NO: 1260358 - RNA, 24 nt, Human
cugcugcacacuggacaccacaac

SEQ ID NO: 1260359 - RNA, 22 nt, Human
gaaacucgagcuucauaaacca

SEQ ID NO: 1260360 - RNA, 18 nt, Human
gaggggcuggggcccugc

SEQ ID NO: 1260361 - RNA, 19 nt, Human
gcaaggagaaguagaggaa

SEQ ID NO: 1260362 - RNA, 23 nt, Human
gccacagcagcaacacuuaggag

SEQ ID NO: 1260363 - RNA, 19 nt, Human
ggaaggcccugauccagca

SEQ ID NO: 1260364 - RNA, 23 nt, Human
ggcagugcgucuuuggagaaggc

SEQ ID NO: 1260365 - RNA, 19 nt, Human
gggagcuggucaugggacc

SEQ ID NO: 1260366 - RNA, 24 nt, Human
ggggagcuggucaugggacccagg

SEQ ID NO: 1260367 - RNA, 22 nt, Human
guccacagccaccucuguuacu

SEQ ID NO: 1260368 - RNA, 23 nt, Human
uaaaccagugaaaugccuacccc

SEQ ID NO: 1260369 - RNA, 18 nt, Human
uaccccuauggagauggg

SEQ ID NO: 1260370 - RNA, 23 nt, Human
uagaagaaggagaagucacaaau

SEQ ID NO: 1260371 - RNA, 21 nt, Human
uagaggaaguccacagccacc

SEQ ID NO: 1260372 - RNA, 19 nt, Human
uagcauggcacagaacgcu

SEQ ID NO: 1260373 - RNA, 23 nt, Human
uagcauggcacagaacgcuaggu

SEQ ID NO: 1260374 - RNA, 21 nt, Human
uauagcagccugaacaaagac

SEQ ID NO: 1260375 - RNA, 23 nt, Human
ucaauauuagcccuucugccaac

SEQ ID NO: 1260376 - RNA, 19 nt, Human
uccagcaaggagaaguaga

SEQ ID NO: 1260377 - RNA, 20 nt, Human
ugaaaugccuaccccuaugg

SEQ ID NO: 1260378 - RNA, 22 nt, Human
ugcauggugagcugcagagugg

SEQ ID NO: 1260379 - RNA, 23 nt, Human
ugcugcacacuggacaccacaac

SEQ ID NO: 1260380 - RNA, 22 nt, Human
uggagaaggcaaaaaagccaca

SEQ ID NO: 1260381 - RNA, 20 nt, Human
uggccugauguugccaggag

SEQ ID NO: 1260382 - RNA, 18 nt, Human
ugggacaucuggggacag

SEQ ID NO: 1260383 - RNA, 24 nt, Human
uggucaugggacccaggugccugg

SEQ ID NO: 1260384 - RNA, 18 nt, Human
uggugagcugcagagugg

SEQ ID NO: 1260385 - RNA, 21 nt, Human
ugugaggcugggguggacguu

SEQ ID NO: 1260386 - RNA, 23 nt, Human
ugugaggcugggguggacguugg

SEQ ID NO: 1260387 - RNA, 22 nt, Human
uguuauagcagccugaacaaag

SEQ ID NO: 1260388 - RNA, 21 nt, Human
uuacucaucgcuacugggaca

SEQ ID NO: 1260389 - RNA, 22 nt, Human
aaacggggcccaguugaguccu

SEQ ID NO: 1260390 - RNA, 23 nt, Human
aaaugccucccagagccccuucc

SEQ ID NO: 1260391 - RNA, 21 nt, Human
aagcaggaaaaugccucccag

SEQ ID NO: 1260392 - RNA, 23 nt, Human
aagcaggaaaaugccucccagag

SEQ ID NO: 1260393 - RNA, 22 nt, Human
agaaacggggcccaguugaguc

SEQ ID NO: 1260394 - RNA, 20 nt, Human
aggaagaaaaggggcaaagc

SEQ ID NO: 1260395 - RNA, 22 nt, Human
aggaagaaaaggggcaaagcag

SEQ ID NO: 1260396 - RNA, 22 nt, Human
aggccgcagaggacgacaguga

SEQ ID NO: 1260397 - RNA, 21 nt, Human
caaagcaggaaaaugccuccc

SEQ ID NO: 1260398 - RNA, 22 nt, Human
caaagcaggaaaaugccuccca

SEQ ID NO: 1260399 - RNA, 25 nt, Human
caccugaaacugcccuggggauggg

SEQ ID NO: 1260400 - RNA, 18 nt, Human
cacugcgcccacgcccug

SEQ ID NO: 1260401 - RNA, 26 nt, Human
cacugcgcccacgcccugagucuggc

SEQ ID NO: 1260402 - RNA, 20 nt, Human
cagccuccccuccccggguc

SEQ ID NO: 1260403 - RNA, 21 nt, Human
cagccuccccuccccgggucc

SEQ ID NO: 1260404 - RNA, 21 nt, Human
ccacagcuccaggacccagga

SEQ ID NO: 1260405 - RNA, 24 nt, Human
ccaccuggcgggccucuggagggg

SEQ ID NO: 1260406 - RNA, 20 nt, Human
ccagagccccuuccccggag

SEQ ID NO: 1260407 - RNA, 21 nt, Human
ccagccggcaccugaaacugc

SEQ ID NO: 1260408 - RNA, 20 nt, Human
ccccggagcuggacuguggg

SEQ ID NO: 1260409 - RNA, 21 nt, Human
ccccggagcuggacugugggg

SEQ ID NO: 1260410 - RNA, 19 nt, Human
ccccugggccucccuuggc

SEQ ID NO: 1260411 - RNA, 21 nt, Human
cccucggcccccugggccucc

SEQ ID NO: 1260412 - RNA, 25 nt, Human
cccuggcugagcccucaggguccuc

SEQ ID NO: 1260413 - RNA, 20 nt, Human
cccugggccucccuuggccc

SEQ ID NO: 1260414 - RNA, 21 nt, Human
cccugggccucccuuggcccc

SEQ ID NO: 1260415 - RNA, 22 nt, Human
cccuggggaugggccucuccug

SEQ ID NO: 1260416 - RNA, 18 nt, Human
ccucccagagccccuucc

SEQ ID NO: 1260417 - RNA, 19 nt, Human
ccuccugcaggcaacuuga

SEQ ID NO: 1260418 - RNA, 27 nt, Human
ccugaaacugcccuggggaugggccuc

SEQ ID NO: 1260419 - RNA, 23 nt, Human
cuggagagggaguggccucucuc

SEQ ID NO: 1260420 - RNA, 21 nt, Human
cuggccuggcacgggggcugu

SEQ ID NO: 1260421 - RNA, 19 nt, Human
cugugggggauggggcugg

SEQ ID NO: 1260422 - RNA, 18 nt, Human
gcccucaggguccucccc

SEQ ID NO: 1260423 - RNA, 21 nt, Human
gccucagccuccccuccccgg

SEQ ID NO: 1260424 - RNA, 21 nt, Human
gcuccaggacccaggagcggg

SEQ ID NO: 1260425 - RNA, 19 nt, Human
gcugacaccaguggcagag

SEQ ID NO: 1260426 - RNA, 21 nt, Human
ggcaacuugauagccuucuuc

SEQ ID NO: 1260427 - RNA, 22 nt, Human
gggaccugggcccucggccccc

SEQ ID NO: 1260428 - RNA, 21 nt, Human
ggugucuggccuggcacgggg

SEQ ID NO: 1260429 - RNA, 21 nt, Human
gugucuggccuggcacggggg

SEQ ID NO: 1260430 - RNA, 22 nt, Human
uagcguuugcccaguuugcgcu

SEQ ID NO: 1260431 - RNA, 18 nt, Human
ucaggguccuccccuccc

SEQ ID NO: 1260432 - RNA, 21 nt, Human
uccaaggaauucuuguagcgu

SEQ ID NO: 1260433 - RNA, 19 nt, Human
ucccuauggcagggggcuc

SEQ ID NO: 1260434 - RNA, 19 nt, Human
uccugggaccccucccugg

SEQ ID NO: 1260435 - RNA, 22 nt, Human
uccugggaccccucccuggcug

SEQ ID NO: 1260436 - RNA, 23 nt, Human
ucgagcucccccaacuucuuuag

SEQ ID NO: 1260437 - RNA, 19 nt, Human
ucggcccccugggccuccc

SEQ ID NO: 1260438 - RNA, 18 nt, Human
ucuggccuggcacggggg

SEQ ID NO: 1260439 - RNA, 18 nt, Human
ugagggcaugauggggac

SEQ ID NO: 1260440 - RNA, 18 nt, Human
ugccuuaaagaaaauggg

SEQ ID NO: 1260441 - RNA, 19 nt, Human
uggcagagaccagcaggac

SEQ ID NO: 1260442 - RNA, 18 nt, Human
uggccuggcacgggggcu

SEQ ID NO: 1260443 - RNA, 21 nt, Human
uggggaugggccucuccuggc

SEQ ID NO: 1260444 - RNA, 25 nt, Human
ugggggauggggcugguacuuccua

SEQ ID NO: 1260445 - RNA, 20 nt, Human
uggggugucuggccuggcac

SEQ ID NO: 1260446 - RNA, 18 nt, Human
uggugagggcaugauggg

SEQ ID NO: 1260447 - RNA, 18 nt, Human
ugugggggauggggcugg

SEQ ID NO: 1260448 - RNA, 20 nt, Human
uucucacugcgcccacgccc

SEQ ID NO: 1260449 - RNA, 19 nt, Human
aacacagccuuccucggcu

SEQ ID NO: 1260450 - RNA, 24 nt, Human
aaccauccaaagcgcaaucccuga

SEQ ID NO: 1260451 - RNA, 22 nt, Human
aaucccugaccucaggcagcuc

SEQ ID NO: 1260452 - RNA, 21 nt, Human
acgacucccccgacucccccg

SEQ ID NO: 1260453 - RNA, 21 nt, Human
aggaccaagcccagagcgcca

SEQ ID NO: 1260454 - RNA, 19 nt, Human
aggcagcucacaguccagu

SEQ ID NO: 1260455 - RNA, 23 nt, Human
caggaccaagcccagagcgccag

SEQ ID NO: 1260456 - RNA, 23 nt, Human
ccagagcgccaggccuggcuguu

SEQ ID NO: 1260457 - RNA, 21 nt, Human
gcuuccuccuucccaggggaa

SEQ ID NO: 1260458 - RNA, 23 nt, Human
uccaaagcgcaaucccugaccuc

SEQ ID NO: 1260459 - RNA, 19 nt, Human
ucccccgugugagucagaa

SEQ ID NO: 1260460 - RNA, 27 nt, Human
uggcuguucucuucaggguuguuuacg

SEQ ID NO: 1260461 - RNA, 21 nt, Human
ugucaaacgggugucccagga

SEQ ID NO: 1260462 - RNA, 23 nt, Human
uuacagugucaaacggguguccc

SEQ ID NO: 1260463 - RNA, 19 nt, Human
aaagauaugcucugucccu

SEQ ID NO: 1260464 - RNA, 18 nt, Human
aacaccagcuaaugcgua

SEQ ID NO: 1260465 - RNA, 22 nt, Human
aacccuccucaggagcuucagc

SEQ ID NO: 1260466 - RNA, 24 nt, Human
aagacccccucccucccucccucu

SEQ ID NO: 1260467 - RNA, 21 nt, Human
aaggaacuugcccaaagucac

SEQ ID NO: 1260468 - RNA, 19 nt, Human
acaaggaagggacauaagg

SEQ ID NO: 1260469 - RNA, 19 nt, Human
acacugccugccccaggag

SEQ ID NO: 1260470 - RNA, 22 nt, Human
acccccucccucccucccucug

SEQ ID NO: 1260471 - RNA, 27 nt, Human
agacucuccucuccccgcccccugccc

SEQ ID NO: 1260472 - RNA, 20 nt, Human
agagaccagucagcagcucu

SEQ ID NO: 1260473 - RNA, 19 nt, Human
agcaagcucuaggaggggc

SEQ ID NO: 1260474 - RNA, 24 nt, Human
agcaggaggauacuaguggccucg

SEQ ID NO: 1260475 - RNA, 19 nt, Human
agccugcccagcaagcucu

SEQ ID NO: 1260476 - RNA, 21 nt, Human
agcuauuggaggucaucaacu

SEQ ID NO: 1260477 - RNA, 19 nt, Human
aggggcuggaugccugggg

SEQ ID NO: 1260478 - RNA, 26 nt, Human
agguacugcaagcccuaucauaagcc

SEQ ID NO: 1260479 - RNA, 19 nt, Human
auaggacccccuuugacug

SEQ ID NO: 1260480 - RNA, 19 nt, Human
aucaacccaacaccagcua

SEQ ID NO: 1260481 - RNA, 21 nt, Human
aucaaucccuucccagucuug

SEQ ID NO: 1260482 - RNA, 22 nt, Human
caacuaggcccucaagacugga

SEQ ID NO: 1260483 - RNA, 24 nt, Human
caacucaccaagaaaagaaggggc

SEQ ID NO: 1260484 - RNA, 19 nt, Human
caagcucuaggaggggcug

SEQ ID NO: 1260485 - RNA, 18 nt, Human
cacacugccugccccagg

SEQ ID NO: 1260486 - RNA, 22 nt, Human
cacagccugacaucaaucccuu

SEQ ID NO: 1260487 - RNA, 22 nt, Human
caccaagaaaagaaggggcuua

SEQ ID NO: 1260488 - RNA, 24 nt, Human
cagcaaagauaugcucugucccuc

SEQ ID NO: 1260489 - RNA, 18 nt, Human
caggagcuucagcucacu

SEQ ID NO: 1260490 - RNA, 21 nt, Human
caguggaugcugccaccuucu

SEQ ID NO: 1260491 - RNA, 24 nt, Human
cauaagccccucagccaagccuca

SEQ ID NO: 1260492 - RNA, 21 nt, Human
ccaccuucugagauaggaccc

SEQ ID NO: 1260493 - RNA, 23 nt, Human
cccaacaccagcuaaugcguacu

SEQ ID NO: 1260494 - RNA, 22 nt, Human
cccaccagaccaggagcucuaa

SEQ ID NO: 1260495 - RNA, 22 nt, Human
ccccaggaacugccccaggucu

SEQ ID NO: 1260496 - RNA, 20 nt, Human
ccccaggucucaaucaaccc

SEQ ID NO: 1260497 - RNA, 22 nt, Human
ccccaggucucaaucaacccaa

SEQ ID NO: 1260498 - RNA, 18 nt, Human
cccccagcugacuugguu

SEQ ID NO: 1260499 - RNA, 20 nt, Human
cccccaucucugagcgcccc

SEQ ID NO: 1260500 - RNA, 21 nt, Human
cccccgcuggacacccauccu

SEQ ID NO: 1260501 - RNA, 22 nt, Human
cccccgcuggacacccauccuc

SEQ ID NO: 1260502 - RNA, 18 nt, Human
cccccugcccccaucucu

SEQ ID NO: 1260503 - RNA, 22 nt, Human
cccccugcccccaucucugagc

SEQ ID NO: 1260504 - RNA, 23 nt, Human
cccccugcccccaucucugagcc

SEQ ID NO: 1260505 - RNA, 25 nt, Human
cccccugcccccaucucugagcgcc

SEQ ID NO: 1260506 - RNA, 23 nt, Human
ccccucagccaagccucagcaaa

SEQ ID NO: 1260507 - RNA, 18 nt, Human
ccccucccucccucccuc

SEQ ID NO: 1260508 - RNA, 18 nt, Human
cccucaagacuggacagg

SEQ ID NO: 1260509 - RNA, 20 nt, Human
ccuauggccacagccugaca

SEQ ID NO: 1260510 - RNA, 23 nt, Human
ccuccuucccuucgggugaggau

SEQ ID NO: 1260511 - RNA, 22 nt, Human
ccugcaacuaggcccucaagac

SEQ ID NO: 1260512 - RNA, 20 nt, Human
ccugcaugaccaugugaagu

SEQ ID NO: 1260513 - RNA, 19 nt, Human
ccugccaccucugaggucc

SEQ ID NO: 1260514 - RNA, 22 nt, Human
ccugcccagcaagcucuaggag

SEQ ID NO: 1260515 - RNA, 21 nt, Human
cuccauagggcccugccaccu

SEQ ID NO: 1260516 - RNA, 19 nt, Human
cucuccccgcccccugccc

SEQ ID NO: 1260517 - RNA, 21 nt, Human
cuggcuucuugccccaggaac

SEQ ID NO: 1260518 - RNA, 19 nt, Human
cuggucuggggaggggucc

SEQ ID NO: 1260519 - RNA, 20 nt, Human
cuugcugaagacccccuccc

SEQ ID NO: 1260520 - RNA, 21 nt, Human
cuugcugaagacccccucccu

SEQ ID NO: 1260521 - RNA, 27 nt, Human
gagaauggcagggggaagccgguaccc

SEQ ID NO: 1260522 - RNA, 20 nt, Human
gagagcccuuguccugcuaa

SEQ ID NO: 1260523 - RNA, 22 nt, Human
gccaccuucugagauaggaccc

SEQ ID NO: 1260524 - RNA, 20 nt, Human
gcgccccccuucgggaaccc

SEQ ID NO: 1260525 - RNA, 19 nt, Human
gcucuggcucuacccaccu

SEQ ID NO: 1260526 - RNA, 18 nt, Human
gcuggugcuugcugaaga

SEQ ID NO: 1260527 - RNA, 22 nt, Human
ggaagggagcagaaacugagga

SEQ ID NO: 1260528 - RNA, 22 nt, Human
ggaccugcaacuaggcccucaa

SEQ ID NO: 1260529 - RNA, 21 nt, Human
ggagagagauggaagggagca

SEQ ID NO: 1260530 - RNA, 23 nt, Human
ggauacuaguggccucggccccc

SEQ ID NO: 1260531 - RNA, 19 nt, Human
ggcaugguggccucaggca

SEQ ID NO: 1260532 - RNA, 25 nt, Human
ggcccagaguggggaaggaacuugc

SEQ ID NO: 1260533 - RNA, 28 nt, Human
ggcccagaguggggaaggaacuugccgu

SEQ ID NO: 1260534 - RNA, 21 nt, Human
gggaggggucccuuggguuga

SEQ ID NO: 1260535 - RNA, 22 nt, Human
gggaggggucccuuggguugag

SEQ ID NO: 1260536 - RNA, 22 nt, Human
ggggaggggucccuuggguuga

SEQ ID NO: 1260537 - RNA, 24 nt, Human
ggggaggggucccuuggguugagu

SEQ ID NO: 1260538 - RNA, 20 nt, Human
ggggcuggaugccuggggga

SEQ ID NO: 1260539 - RNA, 19 nt, Human
ggggcuggugcuugcugaa

SEQ ID NO: 1260540 - RNA, 18 nt, Human
ggucaucaacucaccaag

SEQ ID NO: 1260541 - RNA, 24 nt, Human
ggucuggggaggggucccuugggu

SEQ ID NO: 1260542 - RNA, 22 nt, Human
guccagcccuggagaauggcag

SEQ ID NO: 1260543 - RNA, 19 nt, Human
gugagaaacugaggcccag

SEQ ID NO: 1260544 - RNA, 22 nt, Human
uaagccccucagccaagacccu

SEQ ID NO: 1260545 - RNA, 23 nt, Human
uaagccccucagccaagccucag

SEQ ID NO: 1260546 - RNA, 25 nt, Human
uacccaccagaccaggagcucuaau

SEQ ID NO: 1260547 - RNA, 19 nt, Human
uacgacagcccccagcuga

SEQ ID NO: 1260548 - RNA, 20 nt, Human
uaggaggggcuggaugccug

SEQ ID NO: 1260549 - RNA, 20 nt, Human
uagggucaguccagcccugg

SEQ ID NO: 1260550 - RNA, 21 nt, Human
uaguggccucggcccccgcug

SEQ ID NO: 1260551 - RNA, 21 nt, Human
ucacacugccugccccaggag

SEQ ID NO: 1260552 - RNA, 19 nt, Human
ucauaagccccucagccaa

SEQ ID NO: 1260553 - RNA, 21 nt, Human
ucaugcuaccuauggccacag

SEQ ID NO: 1260554 - RNA, 19 nt, Human
uccaauaaauccccucugg

SEQ ID NO: 1260555 - RNA, 21 nt, Human
uccagcccuggagaauggcag

SEQ ID NO: 1260556 - RNA, 21 nt, Human
ucucaguggaugcugccaccu

SEQ ID NO: 1260557 - RNA, 19 nt, Human
ucucugagcgccccccuuc

SEQ ID NO: 1260558 - RNA, 18 nt, Human
ucuggcucuacccaccag

SEQ ID NO: 1260559 - RNA, 19 nt, Human
ugacaucaaucccuuccca

SEQ ID NO: 1260560 - RNA, 26 nt, Human
ugacuugguucuggucuggggagggg

SEQ ID NO: 1260561 - RNA, 19 nt, Human
ugagaaacugaggcccaga

SEQ ID NO: 1260562 - RNA, 20 nt, Human
ugagaaacugaggcccagag

SEQ ID NO: 1260563 - RNA, 22 nt, Human
ugagaaacugaggcccagagug

SEQ ID NO: 1260564 - RNA, 25 nt, Human
ugagggcaguuggugcuccauaggg

SEQ ID NO: 1260565 - RNA, 20 nt, Human
ugcccacagggggcugugag

SEQ ID NO: 1260566 - RNA, 18 nt, Human
ugcccagaugaggugcag

SEQ ID NO: 1260567 - RNA, 26 nt, Human
ugcucugucccuccuugggcaacuca

SEQ ID NO: 1260568 - RNA, 21 nt, Human
uggaagggagcagaaacugag

SEQ ID NO: 1260569 - RNA, 24 nt, Human
uggagaauggcagggggaagcagg

SEQ ID NO: 1260570 - RNA, 21 nt, Human
uggaggucaucaacucaccaa

SEQ ID NO: 1260571 - RNA, 20 nt, Human
uggcagggggaagcaggagg

SEQ ID NO: 1260572 - RNA, 18 nt, Human
ugggagagagauggaagg

SEQ ID NO: 1260573 - RNA, 23 nt, Human
ugggggaccugcaacuaggcccu

SEQ ID NO: 1260574 - RNA, 19 nt, Human
ugggguugagggcaguugg

SEQ ID NO: 1260575 - RNA, 20 nt, Human
ugucugugcccacagggggc

SEQ ID NO: 1260576 - RNA, 18 nt, Human
uucuggucuggggagggg

SEQ ID NO: 1260577 - RNA, 23 nt, Human
aaaaaccaccagaggccaacccc

SEQ ID NO: 1260578 - RNA, 23 nt, Human
aaaacuuuuuucaaccugcccac

SEQ ID NO: 1260579 - RNA, 25 nt, Human
aaaacuuuuuucaaccugcccacaa

SEQ ID NO: 1260580 - RNA, 22 nt, Human
aaaccaccagaggccaaccccg

SEQ ID NO: 1260581 - RNA, 23 nt, Human
aaacugauguaaaugacccgcgc

SEQ ID NO: 1260582 - RNA, 21 nt, Human
aaagacagguccacagggaca

SEQ ID NO: 1260583 - RNA, 20 nt, Human
aaagagccaaucugagcaga

SEQ ID NO: 1260584 - RNA, 19 nt, Human
aacaaguucaccagaaggg

SEQ ID NO: 1260585 - RNA, 19 nt, Human
aacagaaggacauccugga

SEQ ID NO: 1260586 - RNA, 21 nt, Human
aaccaugggggcccugagaga

SEQ ID NO: 1260587 - RNA, 27 nt, Human
aagacaccuccauucccuccaaccucc

SEQ ID NO: 1260588 - RNA, 20 nt, Human
aagaggcccaccucauacuu

SEQ ID NO: 1260589 - RNA, 21 nt, Human
aaucaugaaguuucuaauuua

SEQ ID NO: 1260590 - RNA, 24 nt, Human
aaucaugaaguuucuaauuuacug

SEQ ID NO: 1260591 - RNA, 25 nt, Human
acacacagagacauccaaaaagaca

SEQ ID NO: 1260592 - RNA, 23 nt, Human
acaccuccauucccuccaaccuc

SEQ ID NO: 1260593 - RNA, 20 nt, Human
acagcgggaaagacuuaggc

SEQ ID NO: 1260594 - RNA, 20 nt, Human
acauggagccauacaaagac

SEQ ID NO: 1260595 - RNA, 23 nt, Human
accaccagaggccaaccccgccc

SEQ ID NO: 1260596 - RNA, 20 nt, Human
accagaagggaacacacagc

SEQ ID NO: 1260597 - RNA, 18 nt, Human
accccgcccagcccugag

SEQ ID NO: 1260598 - RNA, 25 nt, Human
accccgcccagcccugagcuucaac

SEQ ID NO: 1260599 - RNA, 22 nt, Human
acccuccccaucucccuuuucu

SEQ ID NO: 1260600 - RNA, 24 nt, Human
accuccauucccuccaaccuccag

SEQ ID NO: 1260601 - RNA, 18 nt, Human
accucucccuacaccccc

SEQ ID NO: 1260602 - RNA, 18 nt, Human
acucgggccauggccucg

SEQ ID NO: 1260603 - RNA, 20 nt, Human
agagcacccuaaccugacug

SEQ ID NO: 1260604 - RNA, 21 nt, Human
agcacugaagaugcaaaaacc

SEQ ID NO: 1260605 - RNA, 23 nt, Human
agcuaguggagcuucugccuccu

SEQ ID NO: 1260606 - RNA, 18 nt, Human
aggaagcucauacccaca

SEQ ID NO: 1260607 - RNA, 22 nt, Human
aggcuuggcuccauggagcagg

SEQ ID NO: 1260608 - RNA, 19 nt, Human
aggggugcugggagaggag

SEQ ID NO: 1260609 - RNA, 23 nt, Human
aucaugaaguuucuaauuuacug

SEQ ID NO: 1260610 - RNA, 26 nt, Human
auccuccccacaccccaggguggcug

SEQ ID NO: 1260611 - RNA, 23 nt, Human
aucuccuuccucucaucccccaa

SEQ ID NO: 1260612 - RNA, 20 nt, Human
augaagacuggcagagguca

SEQ ID NO: 1260613 - RNA, 23 nt, Human
auggagcaggguugaacaaguuc

SEQ ID NO: 1260614 - RNA, 22 nt, Human
caaacagcucuguagucaccac

SEQ ID NO: 1260615 - RNA, 18 nt, Human
caaccacccaucucuggc

SEQ ID NO: 1260616 - RNA, 18 nt, Human
caaccccgcccagcccug

SEQ ID NO: 1260617 - RNA, 24 nt, Human
caagacucaaguauccugcaaccc

SEQ ID NO: 1260618 - RNA, 21 nt, Human
caagggcuauacccuggcucg

SEQ ID NO: 1260619 - RNA, 22 nt, Human
caauacccaaaugggaaaugcu

SEQ ID NO: 1260620 - RNA, 23 nt, Human
cacaaacauccuggaaacaggga

SEQ ID NO: 1260621 - RNA, 21 nt, Human
caccacucaaacuccuccugu

SEQ ID NO: 1260622 - RNA, 25 nt, Human
cacccccaaguccaguaucucccca

SEQ ID NO: 1260623 - RNA, 24 nt, Human
cacccuccccuaccaaagagccaa

SEQ ID NO: 1260624 - RNA, 20 nt, Human
caccucaccagccccuucgc

SEQ ID NO: 1260625 - RNA, 21 nt, Human
caccucaccagccccuucgcu

SEQ ID NO: 1260626 - RNA, 22 nt, Human
caccuccauucccuccaaccuc

SEQ ID NO: 1260627 - RNA, 25 nt, Human
caccuggacaucccacaggaagcuc

SEQ ID NO: 1260628 - RNA, 21 nt, Human
cacgcuaguguccaacugcau

SEQ ID NO: 1260629 - RNA, 21 nt, Human
cacugaagaugcaaaaaccac

SEQ ID NO: 1260630 - RNA, 19 nt, Human
cagacagggcugggggcag

SEQ ID NO: 1260631 - RNA, 18 nt, Human
cagaugauccaaggggga

SEQ ID NO: 1260632 - RNA, 21 nt, Human
cagcccugagcuucaacuccu

SEQ ID NO: 1260633 - RNA, 22 nt, Human
cagucauuuccuucccuccuca

SEQ ID NO: 1260634 - RNA, 22 nt, Human
caucccacaggaagcucauacc

SEQ ID NO: 1260635 - RNA, 20 nt, Human
cauuuccuucccuccucacc

SEQ ID NO: 1260636 - RNA, 18 nt, Human
ccacccuccccuaccaaa

SEQ ID NO: 1260637 - RNA, 19 nt, Human
ccaccugaacagucuggcc

SEQ ID NO: 1260638 - RNA, 21 nt, Human
ccaccuggagcuaagucccug

SEQ ID NO: 1260639 - RNA, 19 nt, Human
ccagcccugagcuucaacu

SEQ ID NO: 1260640 - RNA, 22 nt, Human
cccacaggaagcucauacccac

SEQ ID NO: 1260641 - RNA, 22 nt, Human
cccaccucaccagccccuucgc

SEQ ID NO: 1260642 - RNA, 26 nt, Human
cccagcccugagcuucaacuccugac

SEQ ID NO: 1260643 - RNA, 20 nt, Human
cccaucucuggcuggaccaa

SEQ ID NO: 1260644 - RNA, 22 nt, Human
ccccaaacagcucuguagucac

SEQ ID NO: 1260645 - RNA, 24 nt, Human
ccccaaacagcucuguagucacca

SEQ ID NO: 1260646 - RNA, 25 nt, Human
ccccaaacagcucuguagucaccac

SEQ ID NO: 1260647 - RNA, 19 nt, Human
ccccacaccccaggguggc

SEQ ID NO: 1260648 - RNA, 23 nt, Human
ccccacgguuucaaccacccauc

SEQ ID NO: 1260649 - RNA, 23 nt, Human
ccccaggggcaagggcuauaccc

SEQ ID NO: 1260650 - RNA, 27 nt, Human
ccccgcccagcccugagcuucaacucc

SEQ ID NO: 1260651 - RNA, 19 nt, Human
cccgcgccaaacaccuggg

SEQ ID NO: 1260652 - RNA, 25 nt, Human
cccuccccaucucccuuuucuucaa

SEQ ID NO: 1260653 - RNA, 19 nt, Human
cccugagcuucaacuccug

SEQ ID NO: 1260654 - RNA, 24 nt, Human
cccuguacagccauccauucagca

SEQ ID NO: 1260655 - RNA, 21 nt, Human
ccgcgccaaacaccugggugu

SEQ ID NO: 1260656 - RNA, 24 nt, Human
ccuccugggauccuccccacaccc

SEQ ID NO: 1260657 - RNA, 18 nt, Human
ccucucauauugcugccu

SEQ ID NO: 1260658 - RNA, 20 nt, Human
ccugaccucucccuacaccc

SEQ ID NO: 1260659 - RNA, 20 nt, Human
ccugagcuucaacuccugac

SEQ ID NO: 1260660 - RNA, 19 nt, Human
ccuguaauugagagcuggg

SEQ ID NO: 1260661 - RNA, 18 nt, Human
ccuuccuaggccuuucuu

SEQ ID NO: 1260662 - RNA, 22 nt, Human
ccuuccucucaucccccaaaca

SEQ ID NO: 1260663 - RNA, 18 nt, Human
ccuuuggcugggccaggg

SEQ ID NO: 1260664 - RNA, 18 nt, Human
cgcucagagucaccugcu

SEQ ID NO: 1260665 - RNA, 18 nt, Human
cguccugaccuuccuagg

SEQ ID NO: 1260666 - RNA, 24 nt, Human
cuaguggagcuucugccuccuggg

SEQ ID NO: 1260667 - RNA, 18 nt, Human
cucaaguauccugcaacc

SEQ ID NO: 1260668 - RNA, 20 nt, Human
cuccagggacucccuucucc

SEQ ID NO: 1260669 - RNA, 22 nt, Human
cuccuccagaccccucugccaa

SEQ ID NO: 1260670 - RNA, 20 nt, Human
cuccuuccucucauccccca

SEQ ID NO: 1260671 - RNA, 20 nt, Human
cucggccccuccucgcacuu

SEQ ID NO: 1260672 - RNA, 19 nt, Human
cucugguuggcucagaccc

SEQ ID NO: 1260673 - RNA, 22 nt, Human
cugaaggcugccugcccagcac

SEQ ID NO: 1260674 - RNA, 23 nt, Human
cugagagagccuaagaggcccac

SEQ ID NO: 1260675 - RNA, 20 nt, Human
cugaucugacccuggguccc

SEQ ID NO: 1260676 - RNA, 22 nt, Human
cuggaagaggagggaaagcaag

SEQ ID NO: 1260677 - RNA, 24 nt, Human
cuggaccaaguucaagacucaagu

SEQ ID NO: 1260678 - RNA, 20 nt, Human
cuggcucuggaagguagggg

SEQ ID NO: 1260679 - RNA, 21 nt, Human
cugggggcagaggaggaggcc

SEQ ID NO: 1260680 - RNA, 21 nt, Human
cuuggcuccauggagcagggu

SEQ ID NO: 1260681 - RNA, 19 nt, Human
cuuuggcugggccagggcu

SEQ ID NO: 1260682 - RNA, 21 nt, Human
cuuuggcugggccagggcucc

SEQ ID NO: 1260683 - RNA, 21 nt, Human
gaacacacagagacauccaaa

SEQ ID NO: 1260684 - RNA, 19 nt, Human
gacucgggccauggccucg

SEQ ID NO: 1260685 - RNA, 21 nt, Human
gagagggugagagagcaggag

SEQ ID NO: 1260686 - RNA, 24 nt, Human
gagaugggguuggguguggccucu

SEQ ID NO: 1260687 - RNA, 20 nt, Human
gaggaggccaccggcccugc

SEQ ID NO: 1260688 - RNA, 24 nt, Human
gaucagaguggggaggggugcugg

SEQ ID NO: 1260689 - RNA, 21 nt, Human
gcacugaagaugcaaaaacca

SEQ ID NO: 1260690 - RNA, 21 nt, Human
gcaugccuucaccuguuuucu

SEQ ID NO: 1260691 - RNA, 23 nt, Human
gcaugccuucaccuguuuucuug

SEQ ID NO: 1260692 - RNA, 24 nt, Human
gccaaacaccugggugugagcccc

SEQ ID NO: 1260693 - RNA, 20 nt, Human
gcgcaagcauacaggcuccc

SEQ ID NO: 1260694 - RNA, 19 nt, Human
gcucggggcuccagagcag

SEQ ID NO: 1260695 - RNA, 25 nt, Human
gcucuguucucuaucuccuuccucu

SEQ ID NO: 1260696 - RNA, 23 nt, Human
gcuucaacuccugaccugaaccu

SEQ ID NO: 1260697 - RNA, 19 nt, Human
ggaaugcaaggagacuuca

SEQ ID NO: 1260698 - RNA, 25 nt, Human
ggaggggugcugggagaggagaggg

SEQ ID NO: 1260699 - RNA, 21 nt, Human
gggcaagggcuauacccuggc

SEQ ID NO: 1260700 - RNA, 23 nt, Human
gggcagaggaggaggccaccggc

SEQ ID NO: 1260701 - RNA, 23 nt, Human
gggcaugccuucaccuguuuucu

SEQ ID NO: 1260702 - RNA, 20 nt, Human
gggccagggcuccaggcugg

SEQ ID NO: 1260703 - RNA, 22 nt, Human
gggguuggguguggccucuuug

SEQ ID NO: 1260704 - RNA, 22 nt, Human
gggguuggguguggccucuuug

SEQ ID NO: 1260705 - RNA, 18 nt, Human
gggucugaucugacccug

SEQ ID NO: 1260706 - RNA, 23 nt, Human
ggugcugggagaggagaggguga

SEQ ID NO: 1260707 - RNA, 20 nt, Human
guccccaacaccgaggccaa

SEQ ID NO: 1260708 - RNA, 18 nt, Human
gugagagagcaggagccg

SEQ ID NO: 1260709 - RNA, 21 nt, Human
guggccaaaugggaacuccuc

SEQ ID NO: 1260710 - RNA, 19 nt, Human
uaaaaauacugaccgccac

SEQ ID NO: 1260711 - RNA, 19 nt, Human
uaaguacaaacccuacacg

SEQ ID NO: 1260712 - RNA, 22 nt, Human
uaagucuucaaauuccucuggu

SEQ ID NO: 1260713 - RNA, 25 nt, Human
uacacccccaaguccaguaucuccc

SEQ ID NO: 1260714 - RNA, 21 nt, Human
uacauggagccauacaaagac

SEQ ID NO: 1260715 - RNA, 23 nt, Human
uaccaaagagccaaucugagcag

SEQ ID NO: 1260716 - RNA, 20 nt, Human
uacccugcagauaugaagac

SEQ ID NO: 1260717 - RNA, 18 nt, Human
uaucacauucaaaacuga

SEQ ID NO: 1260718 - RNA, 23 nt, Human
uaugaagacuggcagaggucagg

SEQ ID NO: 1260719 - RNA, 22 nt, Human
ucaccagaagggaacacacagc

SEQ ID NO: 1260720 - RNA, 25 nt, Human
ucaccagccccuucgcuggauccuc

SEQ ID NO: 1260721 - RNA, 18 nt, Human
ucagagcacccuaaccug

SEQ ID NO: 1260722 - RNA, 20 nt, Human
ucagggagacguggcaacag

SEQ ID NO: 1260723 - RNA, 19 nt, Human
ucauacccacaguggccaa

SEQ ID NO: 1260724 - RNA, 24 nt, Human
uccagcucaacacuuuugcaaagu

SEQ ID NO: 1260725 - RNA, 22 nt, Human
uccccacaccccaggguggcug

SEQ ID NO: 1260726 - RNA, 22 nt, Human
ucccucagaccacaggccccca

SEQ ID NO: 1260727 - RNA, 18 nt, Human
ucccugacucuccagcag

SEQ ID NO: 1260728 - RNA, 25 nt, Human
ucccugacucuccagcaggccuggg

SEQ ID NO: 1260729 - RNA, 20 nt, Human
ucccugacucuccagcaggg

SEQ ID NO: 1260730 - RNA, 22 nt, Human
ucccugcuccagggacucccuu

SEQ ID NO: 1260731 - RNA, 21 nt, Human
uccuccagaccccucugccaa

SEQ ID NO: 1260732 - RNA, 19 nt, Human
uccugaccugaaccugguu

SEQ ID NO: 1260733 - RNA, 21 nt, Human
ucucccuuuucuucaaacccg

SEQ ID NO: 1260734 - RNA, 21 nt, Human
ucugacccuggguccccaacc

SEQ ID NO: 1260735 - RNA, 19 nt, Human
ucugcugccaccaaguuca

SEQ ID NO: 1260736 - RNA, 19 nt, Human
ucuguagucaccacucaaa

SEQ ID NO: 1260737 - RNA, 24 nt, Human
ucuguagucaccacucaaacuccu

SEQ ID NO: 1260738 - RNA, 22 nt, Human
ugaaaacaaguuguaaaaauac

SEQ ID NO: 1260739 - RNA, 21 nt, Human
ugacccuggguccccaacacc

SEQ ID NO: 1260740 - RNA, 20 nt, Human
ugaccucucccuacaccccc

SEQ ID NO: 1260741 - RNA, 20 nt, Human
ugagagcugggcccagagau

SEQ ID NO: 1260742 - RNA, 19 nt, Human
ugagcagagaacaaucaug

SEQ ID NO: 1260743 - RNA, 21 nt, Human
ugagcagagaacaaucaugaa

SEQ ID NO: 1260744 - RNA, 19 nt, Human
ugccuccugggauccuccc

SEQ ID NO: 1260745 - RNA, 28 nt, Human
ugccuccugggauccuccccacaccccc

SEQ ID NO: 1260746 - RNA, 22 nt, Human
ugccugagaaacagaaggacau

SEQ ID NO: 1260747 - RNA, 18 nt, Human
ugccugggcuggcucugg

SEQ ID NO: 1260748 - RNA, 19 nt, Human
uggaagaggagggaaagca

SEQ ID NO: 1260749 - RNA, 22 nt, Human
uggaagaugagaaucacccucc

SEQ ID NO: 1260750 - RNA, 18 nt, Human
uggaagguaggggcaggg

SEQ ID NO: 1260751 - RNA, 23 nt, Human
uggaagguaggggcagggucuga

SEQ ID NO: 1260752 - RNA, 19 nt, Human
uggcaacagccaccugaac

SEQ ID NO: 1260753 - RNA, 22 nt, Human
uggcucagacccuguuuugguc

SEQ ID NO: 1260754 - RNA, 21 nt, Human
uggcuggaccaaguucaagac

SEQ ID NO: 1260755 - RNA, 21 nt, Human
uggcugggccagggcuccagg

SEQ ID NO: 1260756 - RNA, 20 nt, Human
ugggagaggagagggugaga

SEQ ID NO: 1260757 - RNA, 19 nt, Human
ugggcuggcucuggaaggu

SEQ ID NO: 1260758 - RNA, 23 nt, Human
ugggcuggcucuggaagguagaa

SEQ ID NO: 1260759 - RNA, 19 nt, Human
uggggaggggugcugggag

SEQ ID NO: 1260760 - RNA, 28 nt, Human
uggggaggggugcugggagaggagaggg

SEQ ID NO: 1260761 - RNA, 18 nt, Human
ugggggcagaggaggagg

SEQ ID NO: 1260762 - RNA, 20 nt, Human
ugggggcagaggaggaggcc

SEQ ID NO: 1260763 - RNA, 23 nt, Human
ugggggcagaggaggaggccacc

SEQ ID NO: 1260764 - RNA, 19 nt, Human
ugggggcccugagagagcc

SEQ ID NO: 1260765 - RNA, 19 nt, Human
uggugaacuccuauagauc

SEQ ID NO: 1260766 - RNA, 24 nt, Human
ugugcaaacacaugcgaacacaca

SEQ ID NO: 1260767 - RNA, 23 nt, Human
ugugcagaugauccaagggggau

SEQ ID NO: 1260768 - RNA, 23 nt, Human
uucaaaacugauguaaaugaccc

SEQ ID NO: 1260769 - RNA, 21 nt, Human
uucagagcacccuaaccugac

SEQ ID NO: 1260770 - RNA, 22 nt, Human
uuccuucccuccucaccucagg

SEQ ID NO: 1260771 - RNA, 22 nt, Human
uucgcuggauccucucugccca

SEQ ID NO: 1260772 - RNA, 21 nt, Human
uucuuggcaguaucauccacc

SEQ ID NO: 1260773 - RNA, 24 nt, Human
uugcaaaguuaauuucuucugugu

SEQ ID NO: 1260774 - RNA, 19 nt, Human
uuucuggccccaccucacc

SEQ ID NO: 1260775 - RNA, 19 nt, Human
uuugcagugucuacgaaac

SEQ ID NO: 1260776 - RNA, 19 nt, Human
aaacucagaggugagacaa

SEQ ID NO: 1260777 - RNA, 18 nt, Human
aacuccaagugcugguca

SEQ ID NO: 1260778 - RNA, 19 nt, Human
aauggaggaaggugaagug

SEQ ID NO: 1260779 - RNA, 19 nt, Human
acagaaagucuggagaagc

SEQ ID NO: 1260780 - RNA, 20 nt, Human
acagcaacaccuccuccccu

SEQ ID NO: 1260781 - RNA, 21 nt, Human
accccugucaaccagaggcac

SEQ ID NO: 1260782 - RNA, 22 nt, Human
accuggacagcaacaccuccuc

SEQ ID NO: 1260783 - RNA, 19 nt, Human
acuagaggcaggggcauug

SEQ ID NO: 1260784 - RNA, 20 nt, Human
acuguccuagccccagcuga

SEQ ID NO: 1260785 - RNA, 18 nt, Human
agagaggcccagccccuc

SEQ ID NO: 1260786 - RNA, 22 nt, Human
agcacggaguaagggaggaaga

SEQ ID NO: 1260787 - RNA, 24 nt, Human
agcagcccucacuguccuagcccc

SEQ ID NO: 1260788 - RNA, 18 nt, Human
aggauggacaggcugggc

SEQ ID NO: 1260789 - RNA, 18 nt, Human
aggcauagaggugugcag

SEQ ID NO: 1260790 - RNA, 21 nt, Human
aggcauagaggugugcagugg

SEQ ID NO: 1260791 - RNA, 21 nt, Human
agggggagauaauggggagga

SEQ ID NO: 1260792 - RNA, 30 nt, Human
agugaugggagcacggaguaagggaggaaa

SEQ ID NO: 1260793 - RNA, 23 nt, Human
auccacucugccugucuuugcca

SEQ ID NO: 1260794 - RNA, 18 nt, Human
auucauccuuccaggccu

SEQ ID NO: 1260795 - RNA, 26 nt, Human
caaacaccuccaggaagucuucucag

SEQ ID NO: 1260796 - RNA, 21 nt, Human
cacaggcccuccuucccucca

SEQ ID NO: 1260797 - RNA, 18 nt, Human
caccagaccuguucgugc

SEQ ID NO: 1260798 - RNA, 21 nt, Human
cagaaugcaguagaagagaug

SEQ ID NO: 1260799 - RNA, 19 nt, Human
cagcaacaccuccucccca

SEQ ID NO: 1260800 - RNA, 25 nt, Human
cagcaacaccuccuccccagggugc

SEQ ID NO: 1260801 - RNA, 19 nt, Human
caugccuggacugcagcca

SEQ ID NO: 1260802 - RNA, 21 nt, Human
cauucauccuuccaggccuca

SEQ ID NO: 1260803 - RNA, 26 nt, Human
ccacaggcccuccuucccuccagcuu

SEQ ID NO: 1260804 - RNA, 21 nt, Human
ccaggccucaggguggaaaca

SEQ ID NO: 1260805 - RNA, 19 nt, Human
cccacugcaaggcauagag

SEQ ID NO: 1260806 - RNA, 21 nt, Human
cccacugcaaggcauagaggu

SEQ ID NO: 1260807 - RNA, 18 nt, Human
ccccacacaugagucuuc

SEQ ID NO: 1260808 - RNA, 21 nt, Human
ccccagggugcuaagggcugu

SEQ ID NO: 1260809 - RNA, 20 nt, Human
cccucuagcagcccucacug

SEQ ID NO: 1260810 - RNA, 23 nt, Human
cccuuggucuggucuccucuucu

SEQ ID NO: 1260811 - RNA, 18 nt, Human
ccuagccccagcugaccc

SEQ ID NO: 1260812 - RNA, 21 nt, Human
ccucacuguccuagccccagc

SEQ ID NO: 1260813 - RNA, 20 nt, Human
ccugucuuugccauucuccc

SEQ ID NO: 1260814 - RNA, 18 nt, Human
cggaguaagggaggaaga

SEQ ID NO: 1260815 - RNA, 20 nt, Human
cuagcagcccucacuguccu

SEQ ID NO: 1260816 - RNA, 24 nt, Human
cucaaauuauccucugguuccugc

SEQ ID NO: 1260817 - RNA, 21 nt, Human
cuccauuccuuccaacccuaa

SEQ ID NO: 1260818 - RNA, 23 nt, Human
cuccuugaaucugcuggguugug

SEQ ID NO: 1260819 - RNA, 23 nt, Human
cucggugcaggugcccaccccca

SEQ ID NO: 1260820 - RNA, 18 nt, Human
cuggagaagccagaggaa

SEQ ID NO: 1260821 - RNA, 31 nt, Human
cuggagaguggcaaacggcaggcugagaagg

SEQ ID NO: 1260822 - RNA, 19 nt, Human
cuuccguugaccccuccag

SEQ ID NO: 1260823 - RNA, 18 nt, Human
cuucucagcacagcaccu

SEQ ID NO: 1260824 - RNA, 18 nt, Human
cuugcuccuggcuccucc

SEQ ID NO: 1260825 - RNA, 23 nt, Human
gaagagagaugaggauggacagg

SEQ ID NO: 1260826 - RNA, 19 nt, Human
gacaauauagcugagacaa

SEQ ID NO: 1260827 - RNA, 18 nt, Human
gacaggcugggccagaug

SEQ ID NO: 1260828 - RNA, 26 nt, Human
gagaggcccagccccucuagcagccc

SEQ ID NO: 1260829 - RNA, 22 nt, Human
gagauaauggggaggauauggc

SEQ ID NO: 1260830 - RNA, 26 nt, Human
gaggaagagagaugaggauggacagg

SEQ ID NO: 1260831 - RNA, 18 nt, Human
gaggauggacaggcuggg

SEQ ID NO: 1260832 - RNA, 24 nt, Human
gaggugugcagccuaggacucgag

SEQ ID NO: 1260833 - RNA, 18 nt, Human
gaguaagggaggaagaga

SEQ ID NO: 1260834 - RNA, 24 nt, Human
gauaaaaucaguauuguaggauga

SEQ ID NO: 1260835 - RNA, 21 nt, Human
gauccugauccucuggauuca

SEQ ID NO: 1260836 - RNA, 21 nt, Human
gcaaaaacucagaggugagac

SEQ ID NO: 1260837 - RNA, 20 nt, Human
gcaggagucugggaaggcuc

SEQ ID NO: 1260838 - RNA, 21 nt, Human
gccuaggguaggcaagggacc

SEQ ID NO: 1260839 - RNA, 24 nt, Human
gccuggacugcagccacaggcccu

SEQ ID NO: 1260840 - RNA, 19 nt, Human
gcucgggccuggaagugga

SEQ ID NO: 1260841 - RNA, 20 nt, Human
ggagggagugcacuagaggc

SEQ ID NO: 1260842 - RNA, 21 nt, Human
ggagucugggaaggcucugca

SEQ ID NO: 1260843 - RNA, 24 nt, Human
ggcucccuaauguuggcccugccc

SEQ ID NO: 1260844 - RNA, 24 nt, Human
gggagauaauggggaggauauggc

SEQ ID NO: 1260845 - RNA, 21 nt, Human
gugagacaggaugcagguccu

SEQ ID NO: 1260846 - RNA, 23 nt, Human
guggaggaacagaaagucuggag

SEQ ID NO: 1260847 - RNA, 20 nt, Human
gugugcagccuaggacucga

SEQ ID NO: 1260848 - RNA, 21 nt, Human
gugugcaguggccuaggguag

SEQ ID NO: 1260849 - RNA, 19 nt, Human
uagagaggggcccaguguc

SEQ ID NO: 1260850 - RNA, 22 nt, Human
ucaccagaccuguucgugcccc

SEQ ID NO: 1260851 - RNA, 18 nt, Human
ucaugggcaaaaacucag

SEQ ID NO: 1260852 - RNA, 22 nt, Human
ucaugggcaaaaacucagaggu

SEQ ID NO: 1260853 - RNA, 21 nt, Human
uccccagggugcuaagggcug

SEQ ID NO: 1260854 - RNA, 19 nt, Human
uccuagccccagcugaccc

SEQ ID NO: 1260855 - RNA, 18 nt, Human
ucgugccccuugaccagc

SEQ ID NO: 1260856 - RNA, 22 nt, Human
ucugguuccugcuggauccuga

SEQ ID NO: 1260857 - RNA, 23 nt, Human
ucuucugcauugccugcucugac

SEQ ID NO: 1260858 - RNA, 21 nt, Human
ugaagugggaaugcuugcucc

SEQ ID NO: 1260859 - RNA, 22 nt, Human
ugaccccuuggucuggucuccu

SEQ ID NO: 1260860 - RNA, 23 nt, Human
ugagacaggaugcagguccuguu

SEQ ID NO: 1260861 - RNA, 20 nt, Human
ugauccucuggauucagacu

SEQ ID NO: 1260862 - RNA, 24 nt, Human
ugcaaagagaggcccagccccucu

SEQ ID NO: 1260863 - RNA, 18 nt, Human
ugcacuagaggcaggggc

SEQ ID NO: 1260864 - RNA, 20 nt, Human
ugcagcugguucaccuccuc

SEQ ID NO: 1260865 - RNA, 23 nt, Human
ugccccuugaccagcaauggccc

SEQ ID NO: 1260866 - RNA, 22 nt, Human
ugccuggacugcagccacaggc

SEQ ID NO: 1260867 - RNA, 18 nt, Human
ugcuugugaggugugcag

SEQ ID NO: 1260868 - RNA, 19 nt, Human
uggacagcaacaccuccuc

SEQ ID NO: 1260869 - RNA, 20 nt, Human
uggagaguggcaaacggcag

SEQ ID NO: 1260870 - RNA, 18 nt, Human
uggaggaacagaaagucu

SEQ ID NO: 1260871 - RNA, 23 nt, Human
uggaggaacagaaagucuggaga

SEQ ID NO: 1260872 - RNA, 19 nt, Human
ugggaaggcucugcagaua

SEQ ID NO: 1260873 - RNA, 22 nt, Human
ugggcaaaaacucagaggugag

SEQ ID NO: 1260874 - RNA, 19 nt, Human
uggucuggucuccucuucu

SEQ ID NO: 1260875 - RNA, 24 nt, Human
uggucuggucuccucuucugcauu

SEQ ID NO: 1260876 - RNA, 22 nt, Human
ugugaggugugcagccuaggac

SEQ ID NO: 1260877 - RNA, 26 nt, Human
uguuccgucuuccguugaccccucca

SEQ ID NO: 1260878 - RNA, 21 nt, Human
uuacuccauuccuuccaaccc

SEQ ID NO: 1260879 - RNA, 24 nt, Human
uuauuugugagacaggaugcaggu

SEQ ID NO: 1260880 - RNA, 19 nt, Human
uucaggaacugcugcuucc

SEQ ID NO: 1260881 - RNA, 24 nt, Human
uuccauucauccuuccaggccuca

SEQ ID NO: 1260882 - RNA, 19 nt, Human
uugcagggucaccagaccu

SEQ ID NO: 1260883 - RNA, 21 nt, Human
uugcagggucaccagaccugu

SEQ ID NO: 1260884 - RNA, 22 nt, Human
uugcagggucaccagaccuguu

SEQ ID NO: 1260885 - RNA, 20 nt, Human
uuugccauucucccuuuccc

SEQ ID NO: 1260886 - RNA, 21 nt, Human
uuuggaaucagccaccaauga

SEQ ID NO: 1260887 - RNA, 18 nt, Human
cagcucccguggccugug

SEQ ID NO: 1260888 - RNA, 21 nt, Human
cagcucccguggccugugcuc

SEQ ID NO: 1260889 - RNA, 21 nt, Human
cucucugcugcgcucagcucc

SEQ ID NO: 1260890 - RNA, 20 nt, Human
cugcucucugcugcgcucag

SEQ ID NO: 1260891 - RNA, 20 nt, Human
ucagcucccguggccugugc

SEQ ID NO: 1260892 - RNA, 23 nt, Human
ucccguggccugugcucgccgcu

SEQ ID NO: 1260893 - RNA, 24 nt, Human
ucccguggccugugcucgccgcuc

SEQ ID NO: 1260894 - RNA, 20 nt, Human
ucugcugcgcucagcucccg

SEQ ID NO: 1260895 - RNA, 22 nt, Human
ucugcugcgcucagcucccgug

SEQ ID NO: 1260896 - RNA, 21 nt, Human
ugcgcucagcucccguggccu

SEQ ID NO: 1260897 - RNA, 19 nt, Human
ccucuugccuugguugaug

SEQ ID NO: 1260898 - RNA, 20 nt, Human
ucagcaacacugguccucuu

SEQ ID NO: 1260899 - RNA, 22 nt, Human
aaacacagaaggcuaugucaga

SEQ ID NO: 1260900 - RNA, 24 nt, Human
aaccacuccccaccaucaccaccc

SEQ ID NO: 1260901 - RNA, 23 nt, Human
acacagcaguuuuccccuugccu

SEQ ID NO: 1260902 - RNA, 18 nt, Human
acccuuaggcagagagag

SEQ ID NO: 1260903 - RNA, 18 nt, Human
agaggaagaagcagggga

SEQ ID NO: 1260904 - RNA, 23 nt, Human
agcgagagcacaaugguuccccu

SEQ ID NO: 1260905 - RNA, 22 nt, Human
agguguuaggaugagauaaacc

SEQ ID NO: 1260906 - RNA, 18 nt, Human
caaccacuccccaccauc

SEQ ID NO: 1260907 - RNA, 21 nt, Human
caaugguuccccugagagccu

SEQ ID NO: 1260908 - RNA, 18 nt, Human
cacaaugguuccccugag

SEQ ID NO: 1260909 - RNA, 23 nt, Human
caccacccuuaggcagagagagg

SEQ ID NO: 1260910 - RNA, 18 nt, Human
cacgcugggagcugcaga

SEQ ID NO: 1260911 - RNA, 21 nt, Human
cacuccccaccaucaccaccc

SEQ ID NO: 1260912 - RNA, 19 nt, Human
cauggggaucucuuagagg

SEQ ID NO: 1260913 - RNA, 23 nt, Human
ccaccaucaccacccuuaggcag

SEQ ID NO: 1260914 - RNA, 22 nt, Human
ccacuccccaccaucaccaccc

SEQ ID NO: 1260915 - RNA, 18 nt, Human
ccccugagagccuccgug

SEQ ID NO: 1260916 - RNA, 22 nt, Human
ccccugagagccuccguggccc

SEQ ID NO: 1260917 - RNA, 19 nt, Human
cguggcccuucugugugcc

SEQ ID NO: 1260918 - RNA, 21 nt, Human
cuuuaucaaccacuccccacc

SEQ ID NO: 1260919 - RNA, 20 nt, Human
gcagagagaggaagaagcag

SEQ ID NO: 1260920 - RNA, 19 nt, Human
ggcagagagaggaagaagc

SEQ ID NO: 1260921 - RNA, 23 nt, Human
ggcagagagaggaagaagcaggg

SEQ ID NO: 1260922 - RNA, 24 nt, Human
ggcagagagaggaagaagcagggg

SEQ ID NO: 1260923 - RNA, 20 nt, Human
uaggaugagauaaaccugac

SEQ ID NO: 1260924 - RNA, 21 nt, Human
uaggcagagagaggaagaagc

SEQ ID NO: 1260925 - RNA, 24 nt, Human
uaggcagagagaggaagaagcagg

SEQ ID NO: 1260926 - RNA, 21 nt, Human
ucaguuggaaaugcagaaauc

SEQ ID NO: 1260927 - RNA, 20 nt, Human
ucuaucuaucuaucuaucuu

SEQ ID NO: 1260928 - RNA, 22 nt, Human
uguuaggaugagauaaaccuga

SEQ ID NO: 1260929 - RNA, 19 nt, Human
uuauaugcacagucacucc

SEQ ID NO: 1260930 - RNA, 28 nt, Human
uugauagcgagagcacaaugguuccccu

SEQ ID NO: 1260931 - RNA, 22 nt, Human
aaaacaaacuaaauagaaaccc

SEQ ID NO: 1260932 - RNA, 22 nt, Human
aaacaauccaaaccaauccuca

SEQ ID NO: 1260933 - RNA, 21 nt, Human
aaauuccaaagucacuuaacu

SEQ ID NO: 1260934 - RNA, 20 nt, Human
aacccucuaacccugccccc

SEQ ID NO: 1260935 - RNA, 25 nt, Human
aacccucuaacccugccccccacua

SEQ ID NO: 1260936 - RNA, 22 nt, Human
aacuauuagaaauguuaaacag

SEQ ID NO: 1260937 - RNA, 18 nt, Human
aacuuagaagggccuaua

SEQ ID NO: 1260938 - RNA, 23 nt, Human
aagaacaaauugaggcuaucaag

SEQ ID NO: 1260939 - RNA, 24 nt, Human
aagaagcacuuccacguguauacu

SEQ ID NO: 1260940 - RNA, 19 nt, Human
aagauuaaugucucugucc

SEQ ID NO: 1260941 - RNA, 26 nt, Human
aagcauagccgaguagcacugauacu

SEQ ID NO: 1260942 - RNA, 23 nt, Human
aaggacacagaaaaaaaaucuug

SEQ ID NO: 1260943 - RNA, 24 nt, Human
aagugauccucccaccucagcuuc

SEQ ID NO: 1260944 - RNA, 22 nt, Human
acaaaaaucauaaaaggugacc

SEQ ID NO: 1260945 - RNA, 18 nt, Human
acaguucauugcagccuc

SEQ ID NO: 1260946 - RNA, 24 nt, Human
accucaaaauaaauauuuugguau

SEQ ID NO: 1260947 - RNA, 27 nt, Human
acuccaucgcccaggcuggaaugcugu

SEQ ID NO: 1260948 - RNA, 18 nt, Human
agaaucugguccccugcc

SEQ ID NO: 1260949 - RNA, 19 nt, Human
agacaaaaggcgagaguug

SEQ ID NO: 1260950 - RNA, 26 nt, Human
agcagcucauuuuuuccuggugcuuu

SEQ ID NO: 1260951 - RNA, 28 nt, Human
agcauccuaagugaaaagccugcucugu

SEQ ID NO: 1260952 - RNA, 20 nt, Human
agcugaaauccugacaggug

SEQ ID NO: 1260953 - RNA, 19 nt, Human
auaaagggcuacuuugauc

SEQ ID NO: 1260954 - RNA, 19 nt, Human
auucgguucuccuuugaca

SEQ ID NO: 1260955 - RNA, 21 nt, Human
caaaaagcauagccgaguagc

SEQ ID NO: 1260956 - RNA, 21 nt, Human
caacucuauugggaauauaau

SEQ ID NO: 1260957 - RNA, 20 nt, Human
caagugauccucccaccuca

SEQ ID NO: 1260958 - RNA, 25 nt, Human
cacacaauguuuauuuagugaauag

SEQ ID NO: 1260959 - RNA, 22 nt, Human
cagaaaaauguccaaauuccuu

SEQ ID NO: 1260960 - RNA, 18 nt, Human
caggugauauggcucaag

SEQ ID NO: 1260961 - RNA, 21 nt, Human
caguucauugcagccuccacc

SEQ ID NO: 1260962 - RNA, 22 nt, Human
cauggccaaauucuucaaugac

SEQ ID NO: 1260963 - RNA, 20 nt, Human
cauuuugccauuucugucuu

SEQ ID NO: 1260964 - RNA, 18 nt, Human
ccaaaaagcauagccgag

SEQ ID NO: 1260965 - RNA, 18 nt, Human
ccaaaccaauccucaacu

SEQ ID NO: 1260966 - RNA, 23 nt, Human
ccuacagaaaaauguccaaauuc

SEQ ID NO: 1260967 - RNA, 23 nt, Human
ccucccauuuugcaaauagggaa

SEQ ID NO: 1260968 - RNA, 20 nt, Human
ccugcucuguugccuacaga

SEQ ID NO: 1260969 - RNA, 20 nt, Human
ccuggggcucaagugauccc

SEQ ID NO: 1260970 - RNA, 22 nt, Human
cgaggauacaguauguucccaa

SEQ ID NO: 1260971 - RNA, 23 nt, Human
cucaaaauaaauauuuugguauc

SEQ ID NO: 1260972 - RNA, 24 nt, Human
cucaagugauccucccaccucagc

SEQ ID NO: 1260973 - RNA, 21 nt, Human
cucacaacccucuaacccugc

SEQ ID NO: 1260974 - RNA, 23 nt, Human
cucacaacccucuaacccugccc

SEQ ID NO: 1260975 - RNA, 18 nt, Human
cucacuccaucgcccagg

SEQ ID NO: 1260976 - RNA, 18 nt, Human
cucuauacuacuguggcu

SEQ ID NO: 1260977 - RNA, 20 nt, Human
cuuccacguguauacuuuaa

SEQ ID NO: 1260978 - RNA, 23 nt, Human
gaagcacuuccacguguauacuu

SEQ ID NO: 1260979 - RNA, 22 nt, Human
gcaaaaucuaugaagccuaaag

SEQ ID NO: 1260980 - RNA, 20 nt, Human
gcagccuccaccccuggggc

SEQ ID NO: 1260981 - RNA, 20 nt, Human
gcccaggcuggaaugcugug

SEQ ID NO: 1260982 - RNA, 21 nt, Human
gggcucaagugauccucccac

SEQ ID NO: 1260983 - RNA, 19 nt, Human
gucuuccucuauagagcuc

SEQ ID NO: 1260984 - RNA, 21 nt, Human
uacagaaaaauguccaaauuc

SEQ ID NO: 1260985 - RNA, 23 nt, Human
uagagcucuuccccucacaaccc

SEQ ID NO: 1260986 - RNA, 22 nt, Human
uaggacaguauucacacaaugu

SEQ ID NO: 1260987 - RNA, 18 nt, Human
uauuagaaauguuaaaca

SEQ ID NO: 1260988 - RNA, 19 nt, Human
ucacacaauguuuauuuag

SEQ ID NO: 1260989 - RNA, 21 nt, Human
ucagaaacgugcacaucacca

SEQ ID NO: 1260990 - RNA, 22 nt, Human
ucauugcagccuccaccccugg

SEQ ID NO: 1260991 - RNA, 23 nt, Human
ucauugcagccuccaccccuggg

SEQ ID NO: 1260992 - RNA, 21 nt, Human
uccaaaccaauccucaacugc

SEQ ID NO: 1260993 - RNA, 19 nt, Human
uccaacagccuucuaccuc

SEQ ID NO: 1260994 - RNA, 19 nt, Human
uccaacagccuucuaccuc

SEQ ID NO: 1260995 - RNA, 21 nt, Human
uccccucacaacccucuaacc

SEQ ID NO: 1260996 - RNA, 18 nt, Human
ucccugaaggacacagaa

SEQ ID NO: 1260997 - RNA, 18 nt, Human
ucgcccaggcuggaaugc

SEQ ID NO: 1260998 - RNA, 22 nt, Human
ucuauagagcucuuccccucac

SEQ ID NO: 1260999 - RNA, 24 nt, Human
ucuaugaagccuaaagagaccccc

SEQ ID NO: 1261000 - RNA, 23 nt, Human
ucucacuccaucgcccaggcugg

SEQ ID NO: 1261001 - RNA, 24 nt, Human
ucucacuccaucgcccaggcugga

SEQ ID NO: 1261002 - RNA, 18 nt, Human
ugaagccuaaagagaccc

SEQ ID NO: 1261003 - RNA, 19 nt, Human
ugaaggacacagaaaaaaa

SEQ ID NO: 1261004 - RNA, 20 nt, Human
ugaaggacacagaaaaaaaa

SEQ ID NO: 1261005 - RNA, 23 nt, Human
ugacagcauccuaagugaaaagc

SEQ ID NO: 1261006 - RNA, 24 nt, Human
ugaggucucacuccaucgcccagg

SEQ ID NO: 1261007 - RNA, 23 nt, Human
ugcaaaaucuaugaagccuaaag

SEQ ID NO: 1261008 - RNA, 19 nt, Human
ugcagccuccaccccuggg

SEQ ID NO: 1261009 - RNA, 19 nt, Human
ugccuacagaaaaaugucc

SEQ ID NO: 1261010 - RNA, 21 nt, Human
ugcuacacaguacaaaaagca

SEQ ID NO: 1261011 - RNA, 23 nt, Human
ugcucuguugccuacagaaaaau

SEQ ID NO: 1261012 - RNA, 24 nt, Human
uggggcucaagugauccucccacc

SEQ ID NO: 1261013 - RNA, 22 nt, Human
uuaaauauguuugaucugugcu

SEQ ID NO: 1261014 - RNA, 23 nt, Human
uucaaugacagcauccuaaguga

SEQ ID NO: 1261015 - RNA, 23 nt, Human
uucauugcagccuccaccccugg

SEQ ID NO: 1261016 - RNA, 24 nt, Human
uucauugcagccuccaccccuggg

SEQ ID NO: 1261017 - RNA, 23 nt, Human
uuccuggugcuuuguuuuuaagu

SEQ ID NO: 1261018 - RNA, 19 nt, Human
uugaaacuagcaguuucga

SEQ ID NO: 1261019 - RNA, 20 nt, Human
uugcagccuccaccccuggg

SEQ ID NO: 1261020 - RNA, 22 nt, Human
uuuaagauuaaugucucugucc

SEQ ID NO: 1261021 - RNA, 19 nt, Human
uuuuuccuggugcuuuguu

SEQ ID NO: 1261022 - RNA, 22 nt, Human
aaaaagcaccauaaguucucac

SEQ ID NO: 1261023 - RNA, 20 nt, Human
aaaaucagaguggacaccgg

SEQ ID NO: 1261024 - RNA, 20 nt, Human
aaagagccccaaagagggug

SEQ ID NO: 1261025 - RNA, 24 nt, Human
aaagcacaaagcaguuaguugcaa

SEQ ID NO: 1261026 - RNA, 22 nt, Human
aagcuuggagacaccaggaacc

SEQ ID NO: 1261027 - RNA, 19 nt, Human
aaggggaacacaguggcac

SEQ ID NO: 1261028 - RNA, 23 nt, Human
acaccgggaacagggagaggcca

SEQ ID NO: 1261029 - RNA, 24 nt, Human
acacuacuggccucgaucucacac

SEQ ID NO: 1261030 - RNA, 22 nt, Human
accaggaaccaaagagccccaa

SEQ ID NO: 1261031 - RNA, 21 nt, Human
acuuggccuggcaggcugcgc

SEQ ID NO: 1261032 - RNA, 23 nt, Human
agcgcgcagccccagcugugccu

SEQ ID NO: 1261033 - RNA, 19 nt, Human
agcugggucgcgacagugc

SEQ ID NO: 1261034 - RNA, 18 nt, Human
aggagccugucugcuucc

SEQ ID NO: 1261035 - RNA, 22 nt, Human
aggcccccaccccuccaacucu

SEQ ID NO: 1261036 - RNA, 19 nt, Human
agggagaggccagacagug

SEQ ID NO: 1261037 - RNA, 21 nt, Human
aggggaacacaguggcacugg

SEQ ID NO: 1261038 - RNA, 22 nt, Human
aggggaacacaguggcacuggg

SEQ ID NO: 1261039 - RNA, 18 nt, Human
augaaggggaagcaaaua

SEQ ID NO: 1261040 - RNA, 19 nt, Human
caaaguccagagggggggc

SEQ ID NO: 1261041 - RNA, 23 nt, Human
caaauguaccacacauggcuuca

SEQ ID NO: 1261042 - RNA, 22 nt, Human
caacuuugcucuaaaaucagag

SEQ ID NO: 1261043 - RNA, 24 nt, Human
cacauggcuucagcuauaggcacc

SEQ ID NO: 1261044 - RNA, 19 nt, Human
caccagcacaagugccagc

SEQ ID NO: 1261045 - RNA, 21 nt, Human
caccaggaaccaaagagcccc

SEQ ID NO: 1261046 - RNA, 23 nt, Human
caccaggaaccaaagagccccaa

SEQ ID NO: 1261047 - RNA, 21 nt, Human
cacugcuggguggcugcacag

SEQ ID NO: 1261048 - RNA, 23 nt, Human
cagagggcuggccugucagcccu

SEQ ID NO: 1261049 - RNA, 18 nt, Human
cagccagaaaccucugug

SEQ ID NO: 1261050 - RNA, 22 nt, Human
cagccucaacuuugcucuaaaa

SEQ ID NO: 1261051 - RNA, 19 nt, Human
cagccuggcccccaugcuu

SEQ ID NO: 1261052 - RNA, 26 nt, Human
cagcgccuucugccugagucguaguc

SEQ ID NO: 1261053 - RNA, 21 nt, Human
caucagaaagaauuuggcaau

SEQ ID NO: 1261054 - RNA, 22 nt, Human
caucagaaagaauuuggcaaua

SEQ ID NO: 1261055 - RNA, 20 nt, Human
ccacacaggcugcagcugcc

SEQ ID NO: 1261056 - RNA, 21 nt, Human
ccaggagccugucugcuuccu

SEQ ID NO: 1261057 - RNA, 21 nt, Human
ccaggcaccagcacaagugcc

SEQ ID NO: 1261058 - RNA, 30 nt, Human
cccacaucgagcugccucagugcccccucu

SEQ ID NO: 1261059 - RNA, 22 nt, Human
cccaccccuccaacucugaaaa

SEQ ID NO: 1261060 - RNA, 18 nt, Human
ccccaccccuccaacucu

SEQ ID NO: 1261061 - RNA, 21 nt, Human
ccccaccccuccaacucugaa

SEQ ID NO: 1261062 - RNA, 21 nt, Human
ccccuaggucugggaucccug

SEQ ID NO: 1261063 - RNA, 27 nt, Human
ccccuccaacucugaaaagggcugggc

SEQ ID NO: 1261064 - RNA, 23 nt, Human
cccucccaugcucacgggcaccc

SEQ ID NO: 1261065 - RNA, 20 nt, Human
cccugaaagcacagggaaau

SEQ ID NO: 1261066 - RNA, 20 nt, Human
cccugaagggcugcagcucu

SEQ ID NO: 1261067 - RNA, 21 nt, Human
ccuaccccuuucugcccagga

SEQ ID NO: 1261068 - RNA, 22 nt, Human
ccuaccccuuucugcccaggag

SEQ ID NO: 1261069 - RNA, 23 nt, Human
ccuaggcucagccucaacuuugc

SEQ ID NO: 1261070 - RNA, 20 nt, Human
ccuccaacucugaaaagggc

SEQ ID NO: 1261071 - RNA, 24 nt, Human
ccucccaugcucacgggcacccaa

SEQ ID NO: 1261072 - RNA, 21 nt, Human
ccucuguggcaggcagcgccu

SEQ ID NO: 1261073 - RNA, 21 nt, Human
ccugcaggcccacaucgagcu

SEQ ID NO: 1261074 - RNA, 24 nt, Human
ccugccguaagugcaugcagcugg

SEQ ID NO: 1261075 - RNA, 22 nt, Human
ccuggcuccaacuggcucugug

SEQ ID NO: 1261076 - RNA, 24 nt, Human
ccugugggggccagggcuggagag

SEQ ID NO: 1261077 - RNA, 20 nt, Human
cgauuuuuuuuguuucccuu

SEQ ID NO: 1261078 - RNA, 18 nt, Human
cgcagccccagcugugcc

SEQ ID NO: 1261079 - RNA, 20 nt, Human
cgcuuggcucacacuacugg

SEQ ID NO: 1261080 - RNA, 23 nt, Human
cuccacacaggcugcagcugccc

SEQ ID NO: 1261081 - RNA, 21 nt, Human
cucuauccagaagcaggggcu

SEQ ID NO: 1261082 - RNA, 23 nt, Human
cucuguggcaggcagcgccuucu

SEQ ID NO: 1261083 - RNA, 20 nt, Human
cugcagcugcccucauaaug

SEQ ID NO: 1261084 - RNA, 25 nt, Human
cugcuggguggcugcacaguugcac

SEQ ID NO: 1261085 - RNA, 23 nt, Human
cuguaagccacggacucuaugca

SEQ ID NO: 1261086 - RNA, 23 nt, Human
cuguggcaggcagcgccuucugc

SEQ ID NO: 1261087 - RNA, 21 nt, Human
gaaauaaacauuuacuaggca

SEQ ID NO: 1261088 - RNA, 22 nt, Human
gagccccuaggucugggauccc

SEQ ID NO: 1261089 - RNA, 19 nt, Human
gagggggguguuucagccc

SEQ ID NO: 1261090 - RNA, 21 nt, Human
gcccacaucgagcugccucag

SEQ ID NO: 1261091 - RNA, 22 nt, Human
gcuauaggcaccugcaucugga

SEQ ID NO: 1261092 - RNA, 22 nt, Human
gcugcacaguugcacccaggag

SEQ ID NO: 1261093 - RNA, 19 nt, Human
gcugcagcucuucucuccu

SEQ ID NO: 1261094 - RNA, 21 nt, Human
gggaacagggagaggccagac

SEQ ID NO: 1261095 - RNA, 19 nt, Human
gggccagggcuggagaggg

SEQ ID NO: 1261096 - RNA, 21 nt, Human
gggcuccugccuguuccuggc

SEQ ID NO: 1261097 - RNA, 20 nt, Human
gggcuggagagggacacuuc

SEQ ID NO: 1261098 - RNA, 22 nt, Human
gggcuggccugucagcccugcc

SEQ ID NO: 1261099 - RNA, 21 nt, Human
ggggcugagggggcagagggc

SEQ ID NO: 1261100 - RNA, 18 nt, Human
gugccuaccccgcugcag

SEQ ID NO: 1261101 - RNA, 20 nt, Human
gugggggccagggcuggaga

SEQ ID NO: 1261102 - RNA, 20 nt, Human
uacacauacaucagaaagaa

SEQ ID NO: 1261103 - RNA, 19 nt, Human
uaccacacauggcuucagc

SEQ ID NO: 1261104 - RNA, 22 nt, Human
uacucuauccagaagcaggggc

SEQ ID NO: 1261105 - RNA, 19 nt, Human
uacuggccucgaucucaca

SEQ ID NO: 1261106 - RNA, 23 nt, Human
uaggucgggaaaaagcaccauaa

SEQ ID NO: 1261107 - RNA, 21 nt, Human
ucacgggacccuugggauguc

SEQ ID NO: 1261108 - RNA, 25 nt, Human
ucagcccuguuuguguugcagcucu

SEQ ID NO: 1261109 - RNA, 21 nt, Human
ucagugcccccucagccuccc

SEQ ID NO: 1261110 - RNA, 20 nt, Human
ucaguggccgcuccacacag

SEQ ID NO: 1261111 - RNA, 23 nt, Human
uccacagagccugcaggcccaca

SEQ ID NO: 1261112 - RNA, 22 nt, Human
uccagagggggggcugaggggg

SEQ ID NO: 1261113 - RNA, 21 nt, Human
ucuguggcaggcagcgccuuc

SEQ ID NO: 1261114 - RNA, 18 nt, Human
ucuucucuccuucucauc

SEQ ID NO: 1261115 - RNA, 24 nt, Human
ucuuggcuugaaggugaggcuuca

SEQ ID NO: 1261116 - RNA, 18 nt, Human
ucuuuacucuauccagaa

SEQ ID NO: 1261117 - RNA, 25 nt, Human
ugaaagcacaaagcaguuaguugcc

SEQ ID NO: 1261118 - RNA, 22 nt, Human
ugagcaugggguccagccacug

SEQ ID NO: 1261119 - RNA, 19 nt, Human
ugagcgaaugagcaugggg

SEQ ID NO: 1261120 - RNA, 22 nt, Human
ugaggcuucaccgggaaccuac

SEQ ID NO: 1261121 - RNA, 19 nt, Human
ugagggggcagagggcugg

SEQ ID NO: 1261122 - RNA, 21 nt, Human
ugcccccucagccucccuccc

SEQ ID NO: 1261123 - RNA, 21 nt, Human
ugccuaggcucagccucaacu

SEQ ID NO: 1261124 - RNA, 21 nt, Human
ugccucagugcccccucagcc

SEQ ID NO: 1261125 - RNA, 22 nt, Human
ugccugaguauugcucgcgccc

SEQ ID NO: 1261126 - RNA, 27 nt, Human
ugcuaaaagcuuucaaaauucuugggg

SEQ ID NO: 1261127 - RNA, 20 nt, Human
uggacaccgggaacagggag

SEQ ID NO: 1261128 - RNA, 21 nt, Human
uggaccaaauguaccacacau

SEQ ID NO: 1261129 - RNA, 20 nt, Human
uggauaaggggaacacagug

SEQ ID NO: 1261130 - RNA, 18 nt, Human
uggcaggcugcgcuuggg

SEQ ID NO: 1261131 - RNA, 20 nt, Human
uggcccccaugcuucaggcc

SEQ ID NO: 1261132 - RNA, 21 nt, Human
uggcuuggggagccccuaggu

SEQ ID NO: 1261133 - RNA, 20 nt, Human
ugggcuccugccuguuccug

SEQ ID NO: 1261134 - RNA, 22 nt, Human
ugggggccagggcuggagaggg

SEQ ID NO: 1261135 - RNA, 22 nt, Human
ugggucgcgacagugccuaggc

SEQ ID NO: 1261136 - RNA, 26 nt, Human
ugucacagcccuggcuuggggagccc

SEQ ID NO: 1261137 - RNA, 18 nt, Human
ugugcacagccacgcaug

SEQ ID NO: 1261138 - RNA, 20 nt, Human
ugugggggccagggcuggag

SEQ ID NO: 1261139 - RNA, 19 nt, Human
ugugggggccagggcuggc

SEQ ID NO: 1261140 - RNA, 21 nt, Human
uguuucagcccuguuuguguu

SEQ ID NO: 1261141 - RNA, 23 nt, Human
uuggccuggcaggcugcgcuugg

SEQ ID NO: 1261142 - RNA, 22 nt, Human
uugggguggggaugguauauga

SEQ ID NO: 1261143 - RNA, 18 nt, Human
aaaaggaaccucagagac

SEQ ID NO: 1261144 - RNA, 23 nt, Human
aagcgugcuuccguuuuggucac

SEQ ID NO: 1261145 - RNA, 21 nt, Human
cagcaugagaacagacuaaua

SEQ ID NO: 1261146 - RNA, 20 nt, Human
cccacugucaugcuucugaa

SEQ ID NO: 1261147 - RNA, 24 nt, Human
ccucagagacuaccuugaacccac

SEQ ID NO: 1261148 - RNA, 18 nt, Human
uaaauguaaauaugaccu

SEQ ID NO: 1261149 - RNA, 22 nt, Human
uaccuugaacccacugucaugc

SEQ ID NO: 1261150 - RNA, 22 nt, Human
uagcagcaugagaacagacuaa

SEQ ID NO: 1261151 - RNA, 23 nt, Human
uaugcaaacuucuaaguuuuucu

SEQ ID NO: 1261152 - RNA, 22 nt, Human
ucagagacuaccuugaacccac

SEQ ID NO: 1261153 - RNA, 23 nt, Human
uguaaguaaaaugggcaacggau

SEQ ID NO: 1261154 - RNA, 21 nt, Human
uucauacuggaaucacagauu

SEQ ID NO: 1261155 - RNA, 18 nt, Human
uuggucacucauaccaug

SEQ ID NO: 1261156 - RNA, 19 nt, Human
uuuuggucacucauaccau

SEQ ID NO: 1261157 - RNA, 21 nt, Human
aaaaagaaagaaaauaaaagg

SEQ ID NO: 1261158 - RNA, 18 nt, Human
aaacucacuuuugaauug

SEQ ID NO: 1261159 - RNA, 25 nt, Human
aagaaagaaaauaaaaggaaaaaga

SEQ ID NO: 1261160 - RNA, 23 nt, Human
aagauacucggccagaugagaua

SEQ ID NO: 1261161 - RNA, 19 nt, Human
aauuugaaucauuucccuc

SEQ ID NO: 1261162 - RNA, 18 nt, Human
acacuauaauaagaaaac

SEQ ID NO: 1261163 - RNA, 24 nt, Human
agaaaauucucuaucagagcauca

SEQ ID NO: 1261164 - RNA, 24 nt, Human
agaaagaaaauaaaaggaaaaaga

SEQ ID NO: 1261165 - RNA, 21 nt, Human
aggaaaaagauacucggccag

SEQ ID NO: 1261166 - RNA, 19 nt, Human
agggcaucggagaccaacc

SEQ ID NO: 1261167 - RNA, 22 nt, Human
agugucacucuggucaggugac

SEQ ID NO: 1261168 - RNA, 19 nt, Human
auguuccacaaaauuuugg

SEQ ID NO: 1261169 - RNA, 19 nt, Human
cacaaaauuuuggauauuc

SEQ ID NO: 1261170 - RNA, 21 nt, Human
cacuuguccgaaggguagcaa

SEQ ID NO: 1261171 - RNA, 20 nt, Human
cagugucacucuggucaggu

SEQ ID NO: 1261172 - RNA, 19 nt, Human
ccagaucaguccauucuua

SEQ ID NO: 1261173 - RNA, 20 nt, Human
ccagaucaguccauucuuac

SEQ ID NO: 1261174 - RNA, 22 nt, Human
ccaguugaccaaaaagaaagaa

SEQ ID NO: 1261175 - RNA, 18 nt, Human
ccccuaaacagaacgcca

SEQ ID NO: 1261176 - RNA, 22 nt, Human
ccgaaggguagcaacacagcca

SEQ ID NO: 1261177 - RNA, 19 nt, Human
ccuggcuccgccgccgccg

SEQ ID NO: 1261178 - RNA, 24 nt, Human
ccuuucaaauauacuuuugauggu

SEQ ID NO: 1261179 - RNA, 22 nt, Human
cgagagaacaacagucccagau

SEQ ID NO: 1261180 - RNA, 22 nt, Human
cugcauaauacuuuaucuuugg

SEQ ID NO: 1261181 - RNA, 22 nt, Human
gaaaauucucuaucagagcauc

SEQ ID NO: 1261182 - RNA, 21 nt, Human
gcaguucucgguugcucuguu

SEQ ID NO: 1261183 - RNA, 22 nt, Human
ggcgucagggaaccgggagaga

SEQ ID NO: 1261184 - RNA, 20 nt, Human
gggccgggggccggcgaaga

SEQ ID NO: 1261185 - RNA, 23 nt, Human
ggguguucguaacagcuccugcc

SEQ ID NO: 1261186 - RNA, 19 nt, Human
guggcuugggguucgcuca

SEQ ID NO: 1261187 - RNA, 18 nt, Human
gugggggguggcuugggg

SEQ ID NO: 1261188 - RNA, 19 nt, Human
guucucgguugcucuguuc

SEQ ID NO: 1261189 - RNA, 23 nt, Human
uagaccauuucauuucaaacuua

SEQ ID NO: 1261190 - RNA, 20 nt, Human
uauaauaagaaaacucacuu

SEQ ID NO: 1261191 - RNA, 20 nt, Human
uaucuuugguucuguuccac

SEQ ID NO: 1261192 - RNA, 19 nt, Human
uauggccgccugcucccca

SEQ ID NO: 1261193 - RNA, 21 nt, Human
ucaaugaguuucuucaguucu

SEQ ID NO: 1261194 - RNA, 24 nt, Human
ucaguucuuccuccaguaaagcag

SEQ ID NO: 1261195 - RNA, 26 nt, Human
ucaguucuuccuccaguaaagcagug

SEQ ID NO: 1261196 - RNA, 19 nt, Human
uccauucuuacuaggcuga

SEQ ID NO: 1261197 - RNA, 24 nt, Human
uccauucuuacuaggcugaagaaa

SEQ ID NO: 1261198 - RNA, 26 nt, Human
uccccagcggaccagguccgggucuc

SEQ ID NO: 1261199 - RNA, 19 nt, Human
ucuuugguucuguuccacu

SEQ ID NO: 1261200 - RNA, 18 nt, Human
ugaccaaaaagaaagaaa

SEQ ID NO: 1261201 - RNA, 23 nt, Human
ugacgcacacaucucugcauagu

SEQ ID NO: 1261202 - RNA, 18 nt, Human
uggcuugggguucgcuca

SEQ ID NO: 1261203 - RNA, 19 nt, Human
ugguucuguuccacuuguc

SEQ ID NO: 1261204 - RNA, 21 nt, Human
ugugauguuucuguuaacgga

SEQ ID NO: 1261205 - RNA, 22 nt, Human
uguucguaacagcuccugccgc

SEQ ID NO: 1261206 - RNA, 21 nt, Human
uugaccaaaaagaaagaaaau

SEQ ID NO: 1261207 - RNA, 24 nt, Human
uugaccaaaaagaaagaaaauaaa

SEQ ID NO: 1261208 - RNA, 20 nt, Human
uuuauggccgccugcucccc

SEQ ID NO: 1261209 - RNA, 20 nt, Human
aaaaacaaagcgagccaccg

SEQ ID NO: 1261210 - RNA, 22 nt, Human
aaaagaaaaaacaaaacaaaaa

SEQ ID NO: 1261211 - RNA, 24 nt, Human
aaacaaagcgagccaccguggaga

SEQ ID NO: 1261212 - RNA, 23 nt, Human
aaagcgagccaccguggagaucc

SEQ ID NO: 1261213 - RNA, 19 nt, Human
aacaaggcaaaaccccauc

SEQ ID NO: 1261214 - RNA, 20 nt, Human
aacaaggcaaaaccccaucu

SEQ ID NO: 1261215 - RNA, 21 nt, Human
aacaaggcaaaaccccaucuc

SEQ ID NO: 1261216 - RNA, 19 nt, Human
aagcaggccgggaguggug

SEQ ID NO: 1261217 - RNA, 22 nt, Human
aagcggcggcgcggggcaggcc

SEQ ID NO: 1261218 - RNA, 24 nt, Human
aaucacuugaauucaggaggcgga

SEQ ID NO: 1261219 - RNA, 18 nt, Human
acaaaacaaaaacaaagc

SEQ ID NO: 1261220 - RNA, 20 nt, Human
acaaaacaaaaacaaagcga

SEQ ID NO: 1261221 - RNA, 24 nt, Human
acaaaacaaaaacaaagcgagcca

SEQ ID NO: 1261222 - RNA, 23 nt, Human
acaaagcgagccaccguggagau

SEQ ID NO: 1261223 - RNA, 18 nt, Human
acaaugaggagaugccag

SEQ ID NO: 1261224 - RNA, 21 nt, Human
acaaugaggagaugccagcac

SEQ ID NO: 1261225 - RNA, 19 nt, Human
acagagugagacuccgucu

SEQ ID NO: 1261226 - RNA, 24 nt, Human
acagagugagacuccgucuuaaaa

SEQ ID NO: 1261227 - RNA, 20 nt, Human
accagccuggccaacaaggc

SEQ ID NO: 1261228 - RNA, 24 nt, Human
accccaucucuacuaaaaauacaa

SEQ ID NO: 1261229 - RNA, 22 nt, Human
acgcuacaaacgagcggugcac

SEQ ID NO: 1261230 - RNA, 22 nt, Human
acuugggcgugguggggggcgc

SEQ ID NO: 1261231 - RNA, 24 nt, Human
agaaaaaacaaaacaaaaacaaag

SEQ ID NO: 1261232 - RNA, 22 nt, Human
agaaucacuugaauucaggagg

SEQ ID NO: 1261233 - RNA, 20 nt, Human
agacccggcagcuucaggca

SEQ ID NO: 1261234 - RNA, 20 nt, Human
agacgagacccacuuccgga

SEQ ID NO: 1261235 - RNA, 20 nt, Human
agaguucgggaggaggagac

SEQ ID NO: 1261236 - RNA, 24 nt, Human
agcacuuugguagguggacguggg

SEQ ID NO: 1261237 - RNA, 21 nt, Human
agccggcagcuuaggcagcac

SEQ ID NO: 1261238 - RNA, 23 nt, Human
aggcacaaugaggagaugccagc

SEQ ID NO: 1261239 - RNA, 18 nt, Human
aggcagcacaacacaauc

SEQ ID NO: 1261240 - RNA, 19 nt, Human
aggcagcacaacacaaucc

SEQ ID NO: 1261241 - RNA, 18 nt, Human
aggcaggagaaucacuug

SEQ ID NO: 1261242 - RNA, 20 nt, Human
aggcaggagaaucacuugaa

SEQ ID NO: 1261243 - RNA, 21 nt, Human
aggcggagguuacagugagcc

SEQ ID NO: 1261244 - RNA, 24 nt, Human
aggcggagguuacagugagccgag

SEQ ID NO: 1261245 - RNA, 24 nt, Human
aggcugaggcaggagaaucacuug

SEQ ID NO: 1261246 - RNA, 20 nt, Human
agggguguggagagccagcg

SEQ ID NO: 1261247 - RNA, 23 nt, Human
aucauuucaggcugggaguucaa

SEQ ID NO: 1261248 - RNA, 19 nt, Human
caacaaggcaaaaccccau

SEQ ID NO: 1261249 - RNA, 25 nt, Human
caacaaggcaaaaccccaucucuac

SEQ ID NO: 1261250 - RNA, 18 nt, Human
caacacaauccacuagga

SEQ ID NO: 1261251 - RNA, 22 nt, Human
caacacaauccacuaggacauu

SEQ ID NO: 1261252 - RNA, 21 nt, Human
caagaccagccuggccaacaa

SEQ ID NO: 1261253 - RNA, 24 nt, Human
caauacacuccaaacucggcgaca

SEQ ID NO: 1261254 - RNA, 19 nt, Human
caccugccgcugcucccgc

SEQ ID NO: 1261255 - RNA, 19 nt, Human
cagcguguggggacuucgg

SEQ ID NO: 1261256 - RNA, 23 nt, Human
caggccgggagugguggcucaug

SEQ ID NO: 1261257 - RNA, 24 nt, Human
caugccugcaauuccagcacuuug

SEQ ID NO: 1261258 - RNA, 23 nt, Human
ccaauacacuccaaacucggcga

SEQ ID NO: 1261259 - RNA, 21 nt, Human
ccacacacgcagguuuagagu

SEQ ID NO: 1261260 - RNA, 21 nt, Human
cccuuggcccccggguuucug

SEQ ID NO: 1261261 - RNA, 22 nt, Human
ccuauaaucccagcuacuaggg

SEQ ID NO: 1261262 - RNA, 21 nt, Human
ccugcagccggcagcuuaggc

SEQ ID NO: 1261263 - RNA, 24 nt, Human
ccuggccaacaaggcaaaacccca

SEQ ID NO: 1261264 - RNA, 20 nt, Human
cgaccccuuaauaaucuccu

SEQ ID NO: 1261265 - RNA, 27 nt, Human
cgcgccaauacacuccaaacucggcga

SEQ ID NO: 1261266 - RNA, 21 nt, Human
cggaagcggcggcgcggggca

SEQ ID NO: 1261267 - RNA, 18 nt, Human
cggcgcggggcaggccgg

SEQ ID NO: 1261268 - RNA, 19 nt, Human
cggugcacagccacacacg

SEQ ID NO: 1261269 - RNA, 21 nt, Human
cggugcacagccacacacgca

SEQ ID NO: 1261270 - RNA, 19 nt, Human
cguggagauccaccugccg

SEQ ID NO: 1261271 - RNA, 24 nt, Human
cguggguggaucauuucaggcugg

SEQ ID NO: 1261272 - RNA, 23 nt, Human
cguucggucucuguucauccauc

SEQ ID NO: 1261273 - RNA, 24 nt, Human
cucaugccugcaauuccagcacuu

SEQ ID NO: 1261274 - RNA, 19 nt, Human
cugccgcugcucccgcggg

SEQ ID NO: 1261275 - RNA, 23 nt, Human
cuggaacaggagggguguggaga

SEQ ID NO: 1261276 - RNA, 23 nt, Human
cuggccaacaaggcaaaacccca

SEQ ID NO: 1261277 - RNA, 20 nt, Human
cuucucuggcuccugcagcc

SEQ ID NO: 1261278 - RNA, 20 nt, Human
cuuucggacaugcuuucugg

SEQ ID NO: 1261279 - RNA, 24 nt, Human
gacagagugagacuccgucuuaaa

SEQ ID NO: 1261280 - RNA, 20 nt, Human
gacccggcagcuucaggcac

SEQ ID NO: 1261281 - RNA, 23 nt, Human
gagggguguggagagccagcgug

SEQ ID NO: 1261282 - RNA, 21 nt, Human
gauccaccugccgcugcuccc

SEQ ID NO: 1261283 - RNA, 18 nt, Human
gauucauggcgaccccuu

SEQ ID NO: 1261284 - RNA, 21 nt, Human
gcaggagaaucacuugaauuc

SEQ ID NO: 1261285 - RNA, 21 nt, Human
ggagagccagcguguggggac

SEQ ID NO: 1261286 - RNA, 21 nt, Human
ggaggcggagguuacagugag

SEQ ID NO: 1261287 - RNA, 23 nt, Human
ggagguuacagugagccgagauc

SEQ ID NO: 1261288 - RNA, 24 nt, Human
ggagguuacagugagccgagaucg

SEQ ID NO: 1261289 - RNA, 20 nt, Human
ggagugguggcucaugccug

SEQ ID NO: 1261290 - RNA, 22 nt, Human
ggcacgcgggagggcccaaagc

SEQ ID NO: 1261291 - RNA, 21 nt, Human
ggcucaugccugcaauuccag

SEQ ID NO: 1261292 - RNA, 23 nt, Human
gggaggaggagaccuaaguccug

SEQ ID NO: 1261293 - RNA, 23 nt, Human
gggaggcugaggcaggagaauca

SEQ ID NO: 1261294 - RNA, 24 nt, Human
gguggcucaugccugcaauuccag

SEQ ID NO: 1261295 - RNA, 24 nt, Human
gguggggggcgccuauaaucccag

SEQ ID NO: 1261296 - RNA, 23 nt, Human
gucuuaaaagaaaaaacaaaaca

SEQ ID NO: 1261297 - RNA, 18 nt, Human
guggagagccagcgugug

SEQ ID NO: 1261298 - RNA, 23 nt, Human
guggaucauuucaggcugggagu

SEQ ID NO: 1261299 - RNA, 21 nt, Human
uaaaagaaaaaacaaaacaaa

SEQ ID NO: 1261300 - RNA, 18 nt, Human
uacuagggaggcugaggc

SEQ ID NO: 1261301 - RNA, 19 nt, Human
uacuagggaggcugaggca

SEQ ID NO: 1261302 - RNA, 20 nt, Human
ucaggaggcggagguuacag

SEQ ID NO: 1261303 - RNA, 22 nt, Human
ucaugccugcaauuccagcacu

SEQ ID NO: 1261304 - RNA, 23 nt, Human
ucauuucaggcugggaguucaag

SEQ ID NO: 1261305 - RNA, 24 nt, Human
uccaaacucggcgacagagugaga

SEQ ID NO: 1261306 - RNA, 24 nt, Human
uccagcacuuugguagguggacgu

SEQ ID NO: 1261307 - RNA, 20 nt, Human
ucucuacuaaaaauacaaaa

SEQ ID NO: 1261308 - RNA, 18 nt, Human
ugagccgagaucgcgcca

SEQ ID NO: 1261309 - RNA, 20 nt, Human
ugaggcaggagaaucacuug

SEQ ID NO: 1261310 - RNA, 24 nt, Human
ugaggcaggagaaucacuugaauu

SEQ ID NO: 1261311 - RNA, 25 nt, Human
ugaggcaggagaaucacuugaauuc

SEQ ID NO: 1261312 - RNA, 23 nt, Human
ugccugcaauuccagcacuuugg

SEQ ID NO: 1261313 - RNA, 24 nt, Human
uggagauccaccugccgcugcucc

SEQ ID NO: 1261314 - RNA, 24 nt, Human
uggcccccggguuucugcagcccc

SEQ ID NO: 1261315 - RNA, 22 nt, Human
uggcucaugccugcaauuccag

SEQ ID NO: 1261316 - RNA, 24 nt, Human
uggcucaugccugcaauuccagca

SEQ ID NO: 1261317 - RNA, 18 nt, Human
ugguagguggacgugggu

SEQ ID NO: 1261318 - RNA, 20 nt, Human
ugguagguggacgugggugg

SEQ ID NO: 1261319 - RNA, 21 nt, Human
ugguagguggacgugggugga

SEQ ID NO: 1261320 - RNA, 24 nt, Human
ugguggcucaugccugcaauucca

SEQ ID NO: 1261321 - RNA, 22 nt, Human
uuacagugagccgagaucgcgc

SEQ ID NO: 1261322 - RNA, 22 nt, Human
uuacuugggcguggugggggga

SEQ ID NO: 1261323 - RNA, 21 nt, Human
uucaaaaacaaaaagcaggcc

SEQ ID NO: 1261324 - RNA, 23 nt, Human
uuucaggcugggaguucaagacc

SEQ ID NO: 1261325 - RNA, 24 nt, Human
aacuuguggccucaagggauccuc

SEQ ID NO: 1261326 - RNA, 25 nt, Human
aagacacucucacuccguuuuccag

SEQ ID NO: 1261327 - RNA, 19 nt, Human
aaguagcugggacuacagg

SEQ ID NO: 1261328 - RNA, 20 nt, Human
aaguagcugggacuacaggu

SEQ ID NO: 1261329 - RNA, 24 nt, Human
aaguagcugggacuacaggugugc

SEQ ID NO: 1261330 - RNA, 19 nt, Human
aaucauggcucacugcagc

SEQ ID NO: 1261331 - RNA, 22 nt, Human
acaagaauagaggccuuccccc

SEQ ID NO: 1261332 - RNA, 20 nt, Human
acaccaccauauccaggucc

SEQ ID NO: 1261333 - RNA, 23 nt, Human
accucagccucccaaguagcugg

SEQ ID NO: 1261334 - RNA, 19 nt, Human
acugcagccucaaacuccu

SEQ ID NO: 1261335 - RNA, 21 nt, Human
acuugcuuaccucccaaagac

SEQ ID NO: 1261336 - RNA, 18 nt, Human
aggacaggggaggccaug

SEQ ID NO: 1261337 - RNA, 24 nt, Human
agggauccucccaccucagccucc

SEQ ID NO: 1261338 - RNA, 20 nt, Human
agugcaguggugcaaucaug

SEQ ID NO: 1261339 - RNA, 23 nt, Human
agugcaguggugcaaucauggcu

SEQ ID NO: 1261340 - RNA, 19 nt, Human
aucagcuccaguuuacuag

SEQ ID NO: 1261341 - RNA, 22 nt, Human
auccucccaccucagccuccca

SEQ ID NO: 1261342 - RNA, 24 nt, Human
auggggucuugccauguugcccag

SEQ ID NO: 1261343 - RNA, 25 nt, Human
caaagcacugggauugcagguucac

SEQ ID NO: 1261344 - RNA, 23 nt, Human
caagaauagaggccuucccccaa

SEQ ID NO: 1261345 - RNA, 25 nt, Human
caagaauagaggccuucccccaaua

SEQ ID NO: 1261346 - RNA, 21 nt, Human
cacaccaccauauccaggucc

SEQ ID NO: 1261347 - RNA, 24 nt, Human
caccauaccuggcuaauuuuugua

SEQ ID NO: 1261348 - RNA, 24 nt, Human
caccucagccucccaaagcacugg

SEQ ID NO: 1261349 - RNA, 19 nt, Human
caccucauaaaaccaucac

SEQ ID NO: 1261350 - RNA, 19 nt, Human
cacggcaacagaagcuggu

SEQ ID NO: 1261351 - RNA, 24 nt, Human
cacuccguuuuccaggcuggagug

SEQ ID NO: 1261352 - RNA, 24 nt, Human
cagccucaaacuccugggcucaag

SEQ ID NO: 1261353 - RNA, 21 nt, Human
caguggugcaaucauggcuca

SEQ ID NO: 1261354 - RNA, 23 nt, Human
cauguugcccaggcuggucucaa

SEQ ID NO: 1261355 - RNA, 24 nt, Human
cauguugcccaggcuggucucaaa

SEQ ID NO: 1261356 - RNA, 20 nt, Human
cauuugcuuuucucuccuuu

SEQ ID NO: 1261357 - RNA, 18 nt, Human
ccaggcuggagugcagug

SEQ ID NO: 1261358 - RNA, 21 nt, Human
ccaggcuggagugcaguggug

SEQ ID NO: 1261359 - RNA, 19 nt, Human
ccauguugcccaggcuggu

SEQ ID NO: 1261360 - RNA, 22 nt, Human
ccauguugcccaggcuggucuc

SEQ ID NO: 1261361 - RNA, 24 nt, Human
cccaaagcacugggauugcagguu

SEQ ID NO: 1261362 - RNA, 22 nt, Human
cccaaguagcugggacuacagg

SEQ ID NO: 1261363 - RNA, 23 nt, Human
cccaaguagcugggacuacaggu

SEQ ID NO: 1261364 - RNA, 20 nt, Human
cccaccucagccucccaagu

SEQ ID NO: 1261365 - RNA, 23 nt, Human
cccaccucagccucccaaguagc

SEQ ID NO: 1261366 - RNA, 18 nt, Human
ccccuuuuucuuuaagac

SEQ ID NO: 1261367 - RNA, 18 nt, Human
ccguuuuccaggcuggag

SEQ ID NO: 1261368 - RNA, 19 nt, Human
ccucccaaagaccccaccu

SEQ ID NO: 1261369 - RNA, 20 nt, Human
ccucccaaagcacugggauu

SEQ ID NO: 1261370 - RNA, 20 nt, Human
ccucucuccccuuugccucc

SEQ ID NO: 1261371 - RNA, 22 nt, Human
ccucucugacagugggggaccu

SEQ ID NO: 1261372 - RNA, 20 nt, Human
ccugggcucaagccauccuc

SEQ ID NO: 1261373 - RNA, 22 nt, Human
ccuuuuucccuucucacuaccc

SEQ ID NO: 1261374 - RNA, 21 nt, Human
cguuuuccaggcuggagugca

SEQ ID NO: 1261375 - RNA, 23 nt, Human
cuacccaccuccaauuucaaaau

SEQ ID NO: 1261376 - RNA, 24 nt, Human
cucaagccauccucccaccucagc

SEQ ID NO: 1261377 - RNA, 19 nt, Human
cucaagggauccucccacc

SEQ ID NO: 1261378 - RNA, 24 nt, Human
cucaagggauccucccaccucagc

SEQ ID NO: 1261379 - RNA, 18 nt, Human
cucacuacccaccuccaa

SEQ ID NO: 1261380 - RNA, 21 nt, Human
cucacuacccaccuccaauuu

SEQ ID NO: 1261381 - RNA, 21 nt, Human
cucacugcagccucaaacucc

SEQ ID NO: 1261382 - RNA, 24 nt, Human
cucacugcagccucaaacuccugg

SEQ ID NO: 1261383 - RNA, 24 nt, Human
cucagccucccaaguagcugggac

SEQ ID NO: 1261384 - RNA, 23 nt, Human
cuccugggcucaagccauccucc

SEQ ID NO: 1261385 - RNA, 25 nt, Human
cuccugggcucaagccauccuccca

SEQ ID NO: 1261386 - RNA, 22 nt, Human
cucuagacuguguccugcugcc

SEQ ID NO: 1261387 - RNA, 23 nt, Human
cucucugacagugggggaccugg

SEQ ID NO: 1261388 - RNA, 22 nt, Human
cugacagugggggaccugggcu

SEQ ID NO: 1261389 - RNA, 23 nt, Human
cugcagccucaaacuccugggcu

SEQ ID NO: 1261390 - RNA, 21 nt, Human
cuuagaucagcuccaguuuac

SEQ ID NO: 1261391 - RNA, 24 nt, Human
cuuaugacuugcuuaccucccaaa

SEQ ID NO: 1261392 - RNA, 24 nt, Human
cuugugcagggcacuucucaucuu

SEQ ID NO: 1261393 - RNA, 23 nt, Human
cuugugcuugcaaggugcccagg

SEQ ID NO: 1261394 - RNA, 23 nt, Human
cuuguggccucaagggauccucc

SEQ ID NO: 1261395 - RNA, 18 nt, Human
cuuuccuuuuucccuucu

SEQ ID NO: 1261396 - RNA, 21 nt, Human
gaagccucucuccccuuugcc

SEQ ID NO: 1261397 - RNA, 25 nt, Human
gaauuugggggguuggcacaaacgu

SEQ ID NO: 1261398 - RNA, 24 nt, Human
gacuacaggugugcaccaccauac

SEQ ID NO: 1261399 - RNA, 25 nt, Human
gacuugcuuaccucccaaagacccc

SEQ ID NO: 1261400 - RNA, 21 nt, Human
gagccaguuuuuguuugcugg

SEQ ID NO: 1261401 - RNA, 24 nt, Human
gauugcagguucacaccaccauau

SEQ ID NO: 1261402 - RNA, 22 nt, Human
gcuuaccucccaaagaccccac

SEQ ID NO: 1261403 - RNA, 23 nt, Human
ggcaguugugccaucagcucagg

SEQ ID NO: 1261404 - RNA, 18 nt, Human
gggaggccauggagccag

SEQ ID NO: 1261405 - RNA, 19 nt, Human
gggaggccauggagccagu

SEQ ID NO: 1261406 - RNA, 19 nt, Human
ggggaggccauggagccag

SEQ ID NO: 1261407 - RNA, 22 nt, Human
ggggucuugccauguugcccag

SEQ ID NO: 1261408 - RNA, 22 nt, Human
gggucuugccauguugcccagg

SEQ ID NO: 1261409 - RNA, 23 nt, Human
ggugaccagagcucaaggaagaa

SEQ ID NO: 1261410 - RNA, 20 nt, Human
gugcagggcacuucucaucu

SEQ ID NO: 1261411 - RNA, 24 nt, Human
uaauuuuuguauuuucuguauaga

SEQ ID NO: 1261412 - RNA, 22 nt, Human
uacccaccuccaauuucaaaau

SEQ ID NO: 1261413 - RNA, 22 nt, Human
uauagauggggucuugccaugu

SEQ ID NO: 1261414 - RNA, 20 nt, Human
uaucaaaaacugggugguuu

SEQ ID NO: 1261415 - RNA, 21 nt, Human
ucaacauaugaauuugggggg

SEQ ID NO: 1261416 - RNA, 25 nt, Human
ucaagccauccucccaccucagccu

SEQ ID NO: 1261417 - RNA, 24 nt, Human
ucacugcagccucaaacuccuggg

SEQ ID NO: 1261418 - RNA, 20 nt, Human
ucagccucccaaguagcugg

SEQ ID NO: 1261419 - RNA, 19 nt, Human
ucagcucagguucuggugc

SEQ ID NO: 1261420 - RNA, 23 nt, Human
ucccaaagcacugggauugcagg

SEQ ID NO: 1261421 - RNA, 19 nt, Human
ucccaaaggauccaaaacc

SEQ ID NO: 1261422 - RNA, 23 nt, Human
ucccaaguagcugggacuacagg

SEQ ID NO: 1261423 - RNA, 21 nt, Human
uccuauuuaugaagguucuac

SEQ ID NO: 1261424 - RNA, 25 nt, Human
uccucccaccucagccucccaaagc

SEQ ID NO: 1261425 - RNA, 27 nt, Human
uccucccaccucagccucccaaguagc

SEQ ID NO: 1261426 - RNA, 18 nt, Human
uccugggcucaagccauc

SEQ ID NO: 1261427 - RNA, 23 nt, Human
uccuuuuucccuucucacuaccc

SEQ ID NO: 1261428 - RNA, 19 nt, Human
ucucacuacccaccuccaa

SEQ ID NO: 1261429 - RNA, 22 nt, Human
ucucacuccguuuuccaggcug

SEQ ID NO: 1261430 - RNA, 24 nt, Human
ucucacuccguuuuccaggcugga

SEQ ID NO: 1261431 - RNA, 19 nt, Human
ucucucaccguuguggggg

SEQ ID NO: 1261432 - RNA, 22 nt, Human
ucugacagugggggaccugggc

SEQ ID NO: 1261433 - RNA, 23 nt, Human
ucuugccauguugcccaggcugg

SEQ ID NO: 1261434 - RNA, 24 nt, Human
ucuugccauguugcccaggcuggu

SEQ ID NO: 1261435 - RNA, 18 nt, Human
ucuuuccuuuuucccuuc

SEQ ID NO: 1261436 - RNA, 19 nt, Human
ugacuugcuuaccucccaa

SEQ ID NO: 1261437 - RNA, 27 nt, Human
ugacuugcuuaccucccaaagacccca

SEQ ID NO: 1261438 - RNA, 22 nt, Human
ugcaguggugcaaucauggcuc

SEQ ID NO: 1261439 - RNA, 24 nt, Human
ugccauguugcccaggcuggucuc

SEQ ID NO: 1261440 - RNA, 22 nt, Human
ugcccaggcuggucucaaacuu

SEQ ID NO: 1261441 - RNA, 18 nt, Human
ugcuugcaaggugcccag

SEQ ID NO: 1261442 - RNA, 21 nt, Human
uggagugcaguggugcaauca

SEQ ID NO: 1261443 - RNA, 24 nt, Human
uggagugcaguggugcaaucaugg

SEQ ID NO: 1261444 - RNA, 26 nt, Human
uggauacucucaucucccucaauuuu

SEQ ID NO: 1261445 - RNA, 26 nt, Human
uggcacaaacguuugguucauuacaa

SEQ ID NO: 1261446 - RNA, 24 nt, Human
uggcucacugcagccucaaacucc

SEQ ID NO: 1261447 - RNA, 21 nt, Human
ugggacuacaggugugcacca

SEQ ID NO: 1261448 - RNA, 24 nt, Human
ugggacuacaggugugcaccacca

SEQ ID NO: 1261449 - RNA, 25 nt, Human
ugggacuacaggugugcaccaccau

SEQ ID NO: 1261450 - RNA, 21 nt, Human
ugggauugcagguucacacca

SEQ ID NO: 1261451 - RNA, 24 nt, Human
uggggucuugccauguugcccagg

SEQ ID NO: 1261452 - RNA, 24 nt, Human
uggugcaaucauggcucacugcag

SEQ ID NO: 1261453 - RNA, 24 nt, Human
uguauagauggggucuugccaugu

SEQ ID NO: 1261454 - RNA, 23 nt, Human
uguccugcugcccaguugacuac

SEQ ID NO: 1261455 - RNA, 23 nt, Human
ugugcaaauagcagagcauccca

SEQ ID NO: 1261456 - RNA, 18 nt, Human
ugugcuugcaaggugccc

SEQ ID NO: 1261457 - RNA, 24 nt, Human
uguggccucaagggauccucccac

SEQ ID NO: 1261458 - RNA, 22 nt, Human
ugugugggcaccccgaacugga

SEQ ID NO: 1261459 - RNA, 19 nt, Human
uucauuacaagaauagagg

SEQ ID NO: 1261460 - RNA, 22 nt, Human
uuccaggcuggagugcaguggu

SEQ ID NO: 1261461 - RNA, 23 nt, Human
uugcuggggcugccauaagaaag

SEQ ID NO: 1261462 - RNA, 20 nt, Human
uuuaagacacucucacuccg

SEQ ID NO: 1261463 - RNA, 19 nt, Human
uuucuuuccuuuuucccuu

SEQ ID NO: 1261464 - RNA, 21 nt, Human
uuugcuggggcugccauaaga

SEQ ID NO: 1261465 - RNA, 24 nt, Human
uuuuccaggcuggagugcaguggu

SEQ ID NO: 1261466 - RNA, 24 nt, Human
uuuuuuuuuuuucguaaaaaauac

SEQ ID NO: 1261467 - RNA, 18 nt, Human
uuuuuuuuuuuuuuuucg

SEQ ID NO: 1261468 - RNA, 20 nt, Human
uuuuuuuuuuuuuuuuucgu

SEQ ID NO: 1261469 - RNA, 23 nt, Human
aaacugggaaggacaacaggaga

SEQ ID NO: 1261470 - RNA, 18 nt, Human
aaagaaauuccuagcucu

SEQ ID NO: 1261471 - RNA, 21 nt, Human
aaagucuuucccuucucuagc

SEQ ID NO: 1261472 - RNA, 19 nt, Human
aagguuugaaauacugguu

SEQ ID NO: 1261473 - RNA, 19 nt, Human
aaguagccgaaauaacaca

SEQ ID NO: 1261474 - RNA, 18 nt, Human
aaguuucuuuuauuguuu

SEQ ID NO: 1261475 - RNA, 19 nt, Human
aauugggguuuuuaggacc

SEQ ID NO: 1261476 - RNA, 19 nt, Human
acaaacaucagcuaacaga

SEQ ID NO: 1261477 - RNA, 23 nt, Human
acuaugccuuucuuuucucggga

SEQ ID NO: 1261478 - RNA, 24 nt, Human
acucuaaggggucuacgugaaaaa

SEQ ID NO: 1261479 - RNA, 18 nt, Human
acuuguggaccuccccuc

SEQ ID NO: 1261480 - RNA, 26 nt, Human
agaaggaagagguuuuuuuauucagc

SEQ ID NO: 1261481 - RNA, 19 nt, Human
aggcguagacagggaaacc

SEQ ID NO: 1261482 - RNA, 22 nt, Human
agggaaaaggggagguugggga

SEQ ID NO: 1261483 - RNA, 20 nt, Human
aguccaaaauuuaagaaaaa

SEQ ID NO: 1261484 - RNA, 24 nt, Human
aguggcauuauacaaacaaguuuc

SEQ ID NO: 1261485 - RNA, 19 nt, Human
auugucuuuguugugcugu

SEQ ID NO: 1261486 - RNA, 21 nt, Human
cacguacauaacaagaaguag

SEQ ID NO: 1261487 - RNA, 21 nt, Human
cacucgaucaccucuacacuu

SEQ ID NO: 1261488 - RNA, 18 nt, Human
cagcacaggagggguugg

SEQ ID NO: 1261489 - RNA, 22 nt, Human
caggagcuggaucaguaggcac

SEQ ID NO: 1261490 - RNA, 19 nt, Human
cagggccaggugguggcgc

SEQ ID NO: 1261491 - RNA, 28 nt, Human
ccaccuggagaucuucaaagggggcugc

SEQ ID NO: 1261492 - RNA, 18 nt, Human
cccuguccuauugauccc

SEQ ID NO: 1261493 - RNA, 20 nt, Human
cgagcucccugaaaaagaaa

SEQ ID NO: 1261494 - RNA, 25 nt, Human
cgucuugugcccauguggcaggccc

SEQ ID NO: 1261495 - RNA, 20 nt, Human
cucugugccuacauaucuaa

SEQ ID NO: 1261496 - RNA, 18 nt, Human
cugugccuacauaucuag

SEQ ID NO: 1261497 - RNA, 19 nt, Human
cuuaagagccgagcucccu

SEQ ID NO: 1261498 - RNA, 24 nt, Human
gaaauaacacauggccaauaggca

SEQ ID NO: 1261499 - RNA, 20 nt, Human
gagauucuggaugagccuaa

SEQ ID NO: 1261500 - RNA, 22 nt, Human
gagccgagcucccugaaaaaga

SEQ ID NO: 1261501 - RNA, 23 nt, Human
gccacucauuaucuuuccaguuu

SEQ ID NO: 1261502 - RNA, 20 nt, Human
gcugugguggauccaggcug

SEQ ID NO: 1261503 - RNA, 21 nt, Human
gggaaaaggggagguugggga

SEQ ID NO: 1261504 - RNA, 18 nt, Human
gggagguuggggagaaac

SEQ ID NO: 1261505 - RNA, 21 nt, Human
gggagguuggggagaaacugg

SEQ ID NO: 1261506 - RNA, 20 nt, Human
ggguugucugggcuuggucu

SEQ ID NO: 1261507 - RNA, 19 nt, Human
guuggcuucccccuucugg

SEQ ID NO: 1261508 - RNA, 18 nt, Human
uaagaaaaaugaaucuca

SEQ ID NO: 1261509 - RNA, 19 nt, Human
uaagaaaaaugaaucucau

SEQ ID NO: 1261510 - RNA, 23 nt, Human
uaauugucuuuguugugcuguua

SEQ ID NO: 1261511 - RNA, 20 nt, Human
uaccuuguacugaguggcau

SEQ ID NO: 1261512 - RNA, 22 nt, Human
uacuucuguuuuuuccaacuuu

SEQ ID NO: 1261513 - RNA, 25 nt, Human
uauuuccccccuuugagcauuuuca

SEQ ID NO: 1261514 - RNA, 21 nt, Human
uauuucuagcuuuuuacuauu

SEQ ID NO: 1261515 - RNA, 23 nt, Human
ucaggucggucauuucucgggcu

SEQ ID NO: 1261516 - RNA, 19 nt, Human
uccacaguggacacaaaga

SEQ ID NO: 1261517 - RNA, 21 nt, Human
uccacaguggacacaaagagg

SEQ ID NO: 1261518 - RNA, 21 nt, Human
ucccugaaaaagaaauuccua

SEQ ID NO: 1261519 - RNA, 24 nt, Human
ucuaauaauugggguuuuuaggac

SEQ ID NO: 1261520 - RNA, 23 nt, Human
ucucauaccauauuuccccccuu

SEQ ID NO: 1261521 - RNA, 26 nt, Human
ucuuuagcuccuuucucaggggccgc

SEQ ID NO: 1261522 - RNA, 23 nt, Human
ugaaugauccuuucagggggcca

SEQ ID NO: 1261523 - RNA, 21 nt, Human
ugaguggcauuauacaaacaa

SEQ ID NO: 1261524 - RNA, 20 nt, Human
uggacacaaagaggcuacgu

SEQ ID NO: 1261525 - RNA, 21 nt, Human
uggcugcacaagcaucaaauc

SEQ ID NO: 1261526 - RNA, 21 nt, Human
uggugcagggggcucagaugg

SEQ ID NO: 1261527 - RNA, 23 nt, Human
uggugcagggggcucagaugggu

SEQ ID NO: 1261528 - RNA, 18 nt, Human
uguggaccuccccucuaa

SEQ ID NO: 1261529 - RNA, 23 nt, Human
ugugguggauccaggcugggauu

SEQ ID NO: 1261530 - RNA, 23 nt, Human
uuacuucuguuuuuuccaacuuu

SEQ ID NO: 1261531 - RNA, 23 nt, Human
uucagggucacucugcagggguu

SEQ ID NO: 1261532 - RNA, 24 nt, Human
uuccuccacguacauaacaagaag

SEQ ID NO: 1261533 - RNA, 21 nt, Human
uugcuagcuucggccuucuga

SEQ ID NO: 1261534 - RNA, 20 nt, Human
uugcuuucucccuuuuuugc

SEQ ID NO: 1261535 - RNA, 22 nt, Human
uuuacaaaccccugacucauga

SEQ ID NO: 1261536 - RNA, 23 nt, Human
uuucuuuuucuucuguucuaguu

SEQ ID NO: 1261537 - RNA, 18 nt, Human
uuuuaagggcugacaacu

SEQ ID NO: 1261538 - RNA, 23 nt, Human
cucucugucuuccucuggauuuc

SEQ ID NO: 1261539 - RNA, 18 nt, Human
ucaggaacucaguuucuc

SEQ ID NO: 1261540 - RNA, 19 nt, Human
uccucuggauuuccacuug

SEQ ID NO: 1261541 - RNA, 20 nt, Human
ugcugcaggacacucagcag

SEQ ID NO: 1261542 - RNA, 18 nt, Human
aagaacacccacaccccc

SEQ ID NO: 1261543 - RNA, 22 nt, Human
aagggaacuucugggaccagcc

SEQ ID NO: 1261544 - RNA, 21 nt, Human
aaggugcuccagcgcaccaag

SEQ ID NO: 1261545 - RNA, 20 nt, Human
acaaacacaggcugugggcu

SEQ ID NO: 1261546 - RNA, 21 nt, Human
acacaaccccaccugcccucu

SEQ ID NO: 1261547 - RNA, 19 nt, Human
acacaggcugugggcugga

SEQ ID NO: 1261548 - RNA, 24 nt, Human
accugggaugggguggggacaggc

SEQ ID NO: 1261549 - RNA, 22 nt, Human
agcaaggcugaaaagaacaccc

SEQ ID NO: 1261550 - RNA, 21 nt, Human
aucuuuuaugugcugaaccag

SEQ ID NO: 1261551 - RNA, 19 nt, Human
caguaaagguccaggucag

SEQ ID NO: 1261552 - RNA, 23 nt, Human
cauggaauuaagaaaaacaugca

SEQ ID NO: 1261553 - RNA, 21 nt, Human
ccaagugagggaguuagggac

SEQ ID NO: 1261554 - RNA, 18 nt, Human
ccauggaauuaagaaaaa

SEQ ID NO: 1261555 - RNA, 21 nt, Human
cccacacccccuuguuaccca

SEQ ID NO: 1261556 - RNA, 21 nt, Human
cccacacccccuuguuacccu

SEQ ID NO: 1261557 - RNA, 25 nt, Human
cccugcauuuggucuccagguguca

SEQ ID NO: 1261558 - RNA, 23 nt, Human
ccucuggauuuauggagcugaca

SEQ ID NO: 1261559 - RNA, 24 nt, Human
ccugcugcauaguguguccaggga

SEQ ID NO: 1261560 - RNA, 25 nt, Human
cuggagccgggugggccaggcugca

SEQ ID NO: 1261561 - RNA, 20 nt, Human
cugggaugggguggggacag

SEQ ID NO: 1261562 - RNA, 18 nt, Human
cuggguugugaagggucu

SEQ ID NO: 1261563 - RNA, 22 nt, Human
cuuggcuuugugaggaaacgag

SEQ ID NO: 1261564 - RNA, 22 nt, Human
cuuggcuuugugaggaaacgag

SEQ ID NO: 1261565 - RNA, 18 nt, Human
gaagggucucaaguccaa

SEQ ID NO: 1261566 - RNA, 24 nt, Human
gagcagaagucacagaggcuggcc

SEQ ID NO: 1261567 - RNA, 19 nt, Human
gagcugacacuccacaaau

SEQ ID NO: 1261568 - RNA, 24 nt, Human
gagcugacacuccacaaaugaugc

SEQ ID NO: 1261569 - RNA, 20 nt, Human
gagggagcagaagucacaga

SEQ ID NO: 1261570 - RNA, 21 nt, Human
gauccuugauucagacaguuu

SEQ ID NO: 1261571 - RNA, 24 nt, Human
gaugggugggacuguguuggccag

SEQ ID NO: 1261572 - RNA, 25 nt, Human
gcaaggcugaaaagaacacccacac

SEQ ID NO: 1261573 - RNA, 18 nt, Human
gcagcugcagcgggcuug

SEQ ID NO: 1261574 - RNA, 18 nt, Human
gcagcugcagcgggcuug

SEQ ID NO: 1261575 - RNA, 18 nt, Human
gcagcugcagcgggcuug

SEQ ID NO: 1261576 - RNA, 23 nt, Human
ggaccuggguucagccagguggu

SEQ ID NO: 1261577 - RNA, 24 nt, Human
ggaccuggguucagccagguggug

SEQ ID NO: 1261578 - RNA, 21 nt, Human
ggaguuagggacuugggaggg

SEQ ID NO: 1261579 - RNA, 19 nt, Human
gggaugggguggggacagg

SEQ ID NO: 1261580 - RNA, 20 nt, Human
gggaugggguggggacaggc

SEQ ID NO: 1261581 - RNA, 21 nt, Human
gggugggacuguguuggccag

SEQ ID NO: 1261582 - RNA, 20 nt, Human
ggucucaaguccaagugagg

SEQ ID NO: 1261583 - RNA, 19 nt, Human
ggugcgugggcaaagggaa

SEQ ID NO: 1261584 - RNA, 18 nt, Human
gucaccuuucugccaugu

SEQ ID NO: 1261585 - RNA, 20 nt, Human
gugaccucugcaguacuccu

SEQ ID NO: 1261586 - RNA, 23 nt, Human
gugagggagcagaagucacagag

SEQ ID NO: 1261587 - RNA, 21 nt, Human
guggugugagaguagccacag

SEQ ID NO: 1261588 - RNA, 22 nt, Human
guucugugacuucccugugacc

SEQ ID NO: 1261589 - RNA, 23 nt, Human
uaagaaaaacaugcaaaaauaau

SEQ ID NO: 1261590 - RNA, 18 nt, Human
uacaguaggcucgggaaa

SEQ ID NO: 1261591 - RNA, 24 nt, Human
uaguauuuugcagaugcuuuucuc

SEQ ID NO: 1261592 - RNA, 19 nt, Human
uccaagugagggaguuagg

SEQ ID NO: 1261593 - RNA, 23 nt, Human
ucucaaguccaagugagggaguu

SEQ ID NO: 1261594 - RNA, 18 nt, Human
ucuccaggugucaccuuu

SEQ ID NO: 1261595 - RNA, 18 nt, Human
ucugcaguacuccuuacc

SEQ ID NO: 1261596 - RNA, 18 nt, Human
ucuguuguggugugagag

SEQ ID NO: 1261597 - RNA, 19 nt, Human
ucuucuguucuucacgccc

SEQ ID NO: 1261598 - RNA, 25 nt, Human
ugaaaaaagcaccugcugcauagug

SEQ ID NO: 1261599 - RNA, 25 nt, Human
ugaaaagaacacccacacccccuug

SEQ ID NO: 1261600 - RNA, 22 nt, Human
ugaagggucucaaguccaagug

SEQ ID NO: 1261601 - RNA, 18 nt, Human
ugacuucccugugaccuc

SEQ ID NO: 1261602 - RNA, 18 nt, Human
ugagggaguuagggacuu

SEQ ID NO: 1261603 - RNA, 20 nt, Human
ugaugcuggagccggguggg

SEQ ID NO: 1261604 - RNA, 20 nt, Human
ugaugugcacccccaggccu

SEQ ID NO: 1261605 - RNA, 19 nt, Human
ugcagaugcuuuucuccug

SEQ ID NO: 1261606 - RNA, 20 nt, Human
ugcauuuggucuccaggugu

SEQ ID NO: 1261607 - RNA, 26 nt, Human
ugcgugggcaaagggaacuucuggga

SEQ ID NO: 1261608 - RNA, 20 nt, Human
uggaauuaagaaaaacaugc

SEQ ID NO: 1261609 - RNA, 22 nt, Human
uggcagaaagggggaacccaca

SEQ ID NO: 1261610 - RNA, 19 nt, Human
uggccagaggcugagagga

SEQ ID NO: 1261611 - RNA, 22 nt, Human
uggccagaggcugagaggaggg

SEQ ID NO: 1261612 - RNA, 23 nt, Human
ugggaccagccuugaaagauggg

SEQ ID NO: 1261613 - RNA, 18 nt, Human
ugggaugggguggggaca

SEQ ID NO: 1261614 - RNA, 19 nt, Human
ugggguggggacaggcaau

SEQ ID NO: 1261615 - RNA, 19 nt, Human
uggucuccaggugucaccu

SEQ ID NO: 1261616 - RNA, 23 nt, Human
uggugaccugggauggggugggg

SEQ ID NO: 1261617 - RNA, 21 nt, Human
ugucuucuguucuucacgccc

SEQ ID NO: 1261618 - RNA, 19 nt, Human
ugugaagggucucaagucc

SEQ ID NO: 1261619 - RNA, 24 nt, Human
uguggcagcugcagcgggcuuggc

SEQ ID NO: 1261620 - RNA, 24 nt, Human
uguggcagcugcagcgggcuuggc

SEQ ID NO: 1261621 - RNA, 24 nt, Human
uguggcagcugcagcgggcuuggc

SEQ ID NO: 1261622 - RNA, 23 nt, Human
uguuguggugugagaguagccac

SEQ ID NO: 1261623 - RNA, 19 nt, Human
uuacaaacacaggcugugg

SEQ ID NO: 1261624 - RNA, 19 nt, Human
uucuguucuucacgcccca

SEQ ID NO: 1261625 - RNA, 22 nt, Human
uugugaagggucucaaguccaa

SEQ ID NO: 1261626 - RNA, 24 nt, Human
aaaaaaaaaaauuagcuggaugug

SEQ ID NO: 1261627 - RNA, 21 nt, Human
aaaaaaaaaagaaaagaaaag

SEQ ID NO: 1261628 - RNA, 20 nt, Human
aaaaaaggcugggcguggug

SEQ ID NO: 1261629 - RNA, 25 nt, Human
aaaaauacaaaaaaaggcugggcgu

SEQ ID NO: 1261630 - RNA, 19 nt, Human
aaaacaacaacaacaacaa

SEQ ID NO: 1261631 - RNA, 22 nt, Human
aaaacaacaacaacaacaaaac

SEQ ID NO: 1261632 - RNA, 22 nt, Human
aaaagaaaagaaaaggcuagag

SEQ ID NO: 1261633 - RNA, 23 nt, Human
aaaaggcugggcgugguggcuca

SEQ ID NO: 1261634 - RNA, 27 nt, Human
aaacagaauggaauuacuuugaucuga

SEQ ID NO: 1261635 - RNA, 23 nt, Human
aaagcagacggaucaccugaggu

SEQ ID NO: 1261636 - RNA, 28 nt, Human
aaagcagacggaucaccugaggucagga

SEQ ID NO: 1261637 - RNA, 22 nt, Human
aacaacaaaauuagccagucau

SEQ ID NO: 1261638 - RNA, 20 nt, Human
aacaacaacaacaacaaaau

SEQ ID NO: 1261639 - RNA, 19 nt, Human
aacauggcgaaaccccauc

SEQ ID NO: 1261640 - RNA, 20 nt, Human
aacauggcgaaaccccaucu

SEQ ID NO: 1261641 - RNA, 21 nt, Human
aacauggcgaaaccccaucuc

SEQ ID NO: 1261642 - RNA, 21 nt, Human
aacauggcgaaaccccaucuc

SEQ ID NO: 1261643 - RNA, 20 nt, Human
aacauggcgaaaccuugucu

SEQ ID NO: 1261644 - RNA, 21 nt, Human
aacauggcgaaaccuugucuc

SEQ ID NO: 1261645 - RNA, 19 nt, Human
aacauggugaaaccccguc

SEQ ID NO: 1261646 - RNA, 20 nt, Human
aacauggugaaaccccgucu

SEQ ID NO: 1261647 - RNA, 21 nt, Human
aacauggugaaaccccgucuc

SEQ ID NO: 1261648 - RNA, 26 nt, Human
aaccgucucaaaacaacaacaacaac

SEQ ID NO: 1261649 - RNA, 23 nt, Human
aagaucgugccacugcacuccag

SEQ ID NO: 1261650 - RNA, 20 nt, Human
aagcagaaucccagcauaua

SEQ ID NO: 1261651 - RNA, 26 nt, Human
aagcagacggaucaccugaggucagg

SEQ ID NO: 1261652 - RNA, 21 nt, Human
aagccgagguggguggaucac

SEQ ID NO: 1261653 - RNA, 18 nt, Human
aauuagccagucauggug

SEQ ID NO: 1261654 - RNA, 21 nt, Human
acaacaacaacaacaaaauua

SEQ ID NO: 1261655 - RNA, 19 nt, Human
acaacaacaacaacaacaa

SEQ ID NO: 1261656 - RNA, 21 nt, Human
acaacaacaacaacaacaaaa

SEQ ID NO: 1261657 - RNA, 20 nt, Human
acagagcgagacuccgucuc

SEQ ID NO: 1261658 - RNA, 23 nt, Human
acagagcgagacuccgucucaaa

SEQ ID NO: 1261659 - RNA, 24 nt, Human
acagagcgagacuccgucucaaaa

SEQ ID NO: 1261660 - RNA, 20 nt, Human
acagagugagacuccgucuc

SEQ ID NO: 1261661 - RNA, 24 nt, Human
acagagugagacuccgucucaaaa

SEQ ID NO: 1261662 - RNA, 21 nt, Human
acccacgucuccaguguccca

SEQ ID NO: 1261663 - RNA, 24 nt, Human
accccaucucuacuaaaaauacaa

SEQ ID NO: 1261664 - RNA, 24 nt, Human
accccgucucuacuaaaaauacaa

SEQ ID NO: 1261665 - RNA, 24 nt, Human
accugaggucaggaguucaagacc

SEQ ID NO: 1261666 - RNA, 24 nt, Human
accugaggucaggaguuugagacc

SEQ ID NO: 1261667 - RNA, 23 nt, Human
accuugucucuacuaaaauauaa

SEQ ID NO: 1261668 - RNA, 21 nt, Human
acgagugaaaccgucucaaaa

SEQ ID NO: 1261669 - RNA, 24 nt, Human
acuccagccugugugacagaguga

SEQ ID NO: 1261670 - RNA, 24 nt, Human
acugcacuccagccugggugacag

SEQ ID NO: 1261671 - RNA, 26 nt, Human
acugcacuccagccugggugacagag

SEQ ID NO: 1261672 - RNA, 24 nt, Human
acugcacuccagccugugugacag

SEQ ID NO: 1261673 - RNA, 26 nt, Human
acugcacuccagccugugugacagag

SEQ ID NO: 1261674 - RNA, 24 nt, Human
acuuugggaggcugaggugggcag

SEQ ID NO: 1261675 - RNA, 26 nt, Human
agacggaucaccugaggucaggaguu

SEQ ID NO: 1261676 - RNA, 22 nt, Human
agaucaccugaggucaggaguu

SEQ ID NO: 1261677 - RNA, 24 nt, Human
agcacuuugggaggcugagguggg

SEQ ID NO: 1261678 - RNA, 23 nt, Human
agccaggcgugguaguaggugcc

SEQ ID NO: 1261679 - RNA, 23 nt, Human
agccagucaugguggcaggcgcc

SEQ ID NO: 1261680 - RNA, 23 nt, Human
agccuggccaacauggcgaaacc

SEQ ID NO: 1261681 - RNA, 24 nt, Human
agccuggccaacauggcgaaaccc

SEQ ID NO: 1261682 - RNA, 24 nt, Human
agccugggugacagagcgagacuc

SEQ ID NO: 1261683 - RNA, 24 nt, Human
agccugugugacagagugagacuc

SEQ ID NO: 1261684 - RNA, 23 nt, Human
agcuggaugugguagcaggcgcc

SEQ ID NO: 1261685 - RNA, 20 nt, Human
aggaguuugagaccagccug

SEQ ID NO: 1261686 - RNA, 23 nt, Human
aggcaggagaaucgcuugaaccc

SEQ ID NO: 1261687 - RNA, 24 nt, Human
aggcaggagaaucgcuugaaccca

SEQ ID NO: 1261688 - RNA, 22 nt, Human
aggcaggagaaucucuugaacc

SEQ ID NO: 1261689 - RNA, 24 nt, Human
aggcaggagaaucucuugaaccug

SEQ ID NO: 1261690 - RNA, 21 nt, Human
aggcaggagaauggcgugaac

SEQ ID NO: 1261691 - RNA, 22 nt, Human
aggcaggagaauggcgugaacc

SEQ ID NO: 1261692 - RNA, 24 nt, Human
aggcaggagaauggcgugaaccug

SEQ ID NO: 1261693 - RNA, 19 nt, Human
aggcggagguugcagugag

SEQ ID NO: 1261694 - RNA, 20 nt, Human
aggcggagguugcagugagc

SEQ ID NO: 1261695 - RNA, 24 nt, Human
aggcggagguugcagugagcugag

SEQ ID NO: 1261696 - RNA, 24 nt, Human
aggcggaguuugcagugagccgag

SEQ ID NO: 1261697 - RNA, 20 nt, Human
aggcugaggcaggagaaucg

SEQ ID NO: 1261698 - RNA, 24 nt, Human
aggcugaggcaggagaaucgcuug

SEQ ID NO: 1261699 - RNA, 24 nt, Human
aggcugaggcaggagaaucucuug

SEQ ID NO: 1261700 - RNA, 19 nt, Human
aggcugaggcaggagaaug

SEQ ID NO: 1261701 - RNA, 21 nt, Human
aggcugaggugggcagaucac

SEQ ID NO: 1261702 - RNA, 24 nt, Human
aggcugagguugcagugagccaag

SEQ ID NO: 1261703 - RNA, 23 nt, Human
aggugcaguggcuuauccuguaa

SEQ ID NO: 1261704 - RNA, 22 nt, Human
aggugggcagaucaccugaggu

SEQ ID NO: 1261705 - RNA, 26 nt, Human
aggugggcagaucaccugaggucagg

SEQ ID NO: 1261706 - RNA, 24 nt, Human
agguggguggaucacaaggucagg

SEQ ID NO: 1261707 - RNA, 23 nt, Human
aguggcuuauccuguaauccuag

SEQ ID NO: 1261708 - RNA, 24 nt, Human
aucaccugaggucaggaguucaag

SEQ ID NO: 1261709 - RNA, 24 nt, Human
aucaccugaggucaggaguuugag

SEQ ID NO: 1261710 - RNA, 23 nt, Human
aucgcaccacugcacuccagcug

SEQ ID NO: 1261711 - RNA, 24 nt, Human
aucgugccacugcacuccagccug

SEQ ID NO: 1261712 - RNA, 24 nt, Human
aucgugccacugcacuccagccug

SEQ ID NO: 1261713 - RNA, 25 nt, Human
caaaacaacaacaacaacaacaaaa

SEQ ID NO: 1261714 - RNA, 20 nt, Human
caaaauaagacuagagcugg

SEQ ID NO: 1261715 - RNA, 18 nt, Human
caacaacaaaauuagcca

SEQ ID NO: 1261716 - RNA, 23 nt, Human
caacaacaacaaaauuagccagu

SEQ ID NO: 1261717 - RNA, 25 nt, Human
caacaacaacaacaaaauuagccag

SEQ ID NO: 1261718 - RNA, 24 nt, Human
caacauggcgaaaccuugucucua

SEQ ID NO: 1261719 - RNA, 23 nt, Human
caccugaggucaggaguucaaga

SEQ ID NO: 1261720 - RNA, 23 nt, Human
caccugaggucaggaguuugaga

SEQ ID NO: 1261721 - RNA, 24 nt, Human
cacgcuucuaaucccagcacuuug

SEQ ID NO: 1261722 - RNA, 22 nt, Human
cacuccagccugggugacagag

SEQ ID NO: 1261723 - RNA, 23 nt, Human
cacuccagccugggugacagagc

SEQ ID NO: 1261724 - RNA, 24 nt, Human
cacuccagccugggugacagagcg

SEQ ID NO: 1261725 - RNA, 22 nt, Human
cacuccagccugugugacagag

SEQ ID NO: 1261726 - RNA, 22 nt, Human
cacuccagccugugugacagag

SEQ ID NO: 1261727 - RNA, 24 nt, Human
cacuccagccugugugacagagug

SEQ ID NO: 1261728 - RNA, 19 nt, Human
cacugcacuccagccuggg

SEQ ID NO: 1261729 - RNA, 19 nt, Human
cacugcacuccagccuggg

SEQ ID NO: 1261730 - RNA, 22 nt, Human
cacugcacuccagccuggguga

SEQ ID NO: 1261731 - RNA, 23 nt, Human
cacugcacuccagccugggugac

SEQ ID NO: 1261732 - RNA, 24 nt, Human
cacugcacuccagccugggugaca

SEQ ID NO: 1261733 - RNA, 25 nt, Human
cacugcacuccagccugggugacag

SEQ ID NO: 1261734 - RNA, 19 nt, Human
cacugcacuccagccugug

SEQ ID NO: 1261735 - RNA, 22 nt, Human
cacugcacuccagccuguguga

SEQ ID NO: 1261736 - RNA, 24 nt, Human
cacugcacuccagccugugugaca

SEQ ID NO: 1261737 - RNA, 25 nt, Human
cacugcacuccagccugugugacag

SEQ ID NO: 1261738 - RNA, 18 nt, Human
cacugcacuccagcuggg

SEQ ID NO: 1261739 - RNA, 18 nt, Human
cacugcacuccagcuggg

SEQ ID NO: 1261740 - RNA, 18 nt, Human
cacugcacuccagcuggg

SEQ ID NO: 1261741 - RNA, 18 nt, Human
cacugcacuccagcuggg

SEQ ID NO: 1261742 - RNA, 22 nt, Human
cacugcacuccagcugggguga

SEQ ID NO: 1261743 - RNA, 22 nt, Human
cacugcacuccagcugggguga

SEQ ID NO: 1261744 - RNA, 23 nt, Human
cacugcacuccagcuggggugac

SEQ ID NO: 1261745 - RNA, 24 nt, Human
cagaucaccugaggucaggaguuu

SEQ ID NO: 1261746 - RNA, 27 nt, Human
cagaucaccugaggucaggaguuugag

SEQ ID NO: 1261747 - RNA, 23 nt, Human
cagcaaaauaagacuagagcugg

SEQ ID NO: 1261748 - RNA, 21 nt, Human
cagcacuuugggaggccaaag

SEQ ID NO: 1261749 - RNA, 24 nt, Human
cagcacuuugggaggccaaagcag

SEQ ID NO: 1261750 - RNA, 18 nt, Human
cagcaggcggagguugca

SEQ ID NO: 1261751 - RNA, 24 nt, Human
cagcuacucaggaggcugaggcag

SEQ ID NO: 1261752 - RNA, 24 nt, Human
cagcuacuugggaggcugaggcag

SEQ ID NO: 1261753 - RNA, 23 nt, Human
cagcucaaauuauuuauugucaa

SEQ ID NO: 1261754 - RNA, 22 nt, Human
caggugcccugggagucugggu

SEQ ID NO: 1261755 - RNA, 21 nt, Human
cauaggccaucuucuuggccu

SEQ ID NO: 1261756 - RNA, 27 nt, Human
ccaaagcagacggaucaccugagguca

SEQ ID NO: 1261757 - RNA, 18 nt, Human
ccacugcacuccagccug

SEQ ID NO: 1261758 - RNA, 18 nt, Human
ccacugcacuccagccug

SEQ ID NO: 1261759 - RNA, 20 nt, Human
ccacugcacuccagccuggg

SEQ ID NO: 1261760 - RNA, 20 nt, Human
ccacugcacuccagccuggg

SEQ ID NO: 1261761 - RNA, 21 nt, Human
ccacugcacuccagccugggu

SEQ ID NO: 1261762 - RNA, 21 nt, Human
ccacugcacuccagccugggu

SEQ ID NO: 1261763 - RNA, 23 nt, Human
ccacugcacuccagccuggguga

SEQ ID NO: 1261764 - RNA, 24 nt, Human
ccacugcacuccagccugggugac

SEQ ID NO: 1261765 - RNA, 21 nt, Human
ccacugcacuccagccugugu

SEQ ID NO: 1261766 - RNA, 24 nt, Human
ccacugcacuccagccugugugac

SEQ ID NO: 1261767 - RNA, 19 nt, Human
ccacugcacuccagcuggg

SEQ ID NO: 1261768 - RNA, 19 nt, Human
ccacugcacuccagcuggg

SEQ ID NO: 1261769 - RNA, 20 nt, Human
ccacugcacuccagcugggg

SEQ ID NO: 1261770 - RNA, 21 nt, Human
ccacugcacuccagcuggggu

SEQ ID NO: 1261771 - RNA, 23 nt, Human
ccacugcacuccagcugggguga

SEQ ID NO: 1261772 - RNA, 24 nt, Human
ccacugcacuccagcuggggugac

SEQ ID NO: 1261773 - RNA, 26 nt, Human
cccagcauauaaaacagaauggaauu

SEQ ID NO: 1261774 - RNA, 20 nt, Human
ccgcagucgcuuccucucca

SEQ ID NO: 1261775 - RNA, 18 nt, Human
ccgucucaaaacaacaac

SEQ ID NO: 1261776 - RNA, 18 nt, Human
ccuauagucccagcuacu

SEQ ID NO: 1261777 - RNA, 21 nt, Human
ccuauagucccagcuacuugg

SEQ ID NO: 1261778 - RNA, 22 nt, Human
ccugaggucaggaguuugagac

SEQ ID NO: 1261779 - RNA, 21 nt, Human
ccuggccaacauggcgaaacc

SEQ ID NO: 1261780 - RNA, 24 nt, Human
ccuggccaacauggcgaaacccca

SEQ ID NO: 1261781 - RNA, 24 nt, Human
ccuggccaacauggcgaaaccuug

SEQ ID NO: 1261782 - RNA, 22 nt, Human
ccuggcuaacauggugaaaccc

SEQ ID NO: 1261783 - RNA, 23 nt, Human
ccuggcuaacauggugaaacccc

SEQ ID NO: 1261784 - RNA, 24 nt, Human
ccuggcuaacauggugaaaccccg

SEQ ID NO: 1261785 - RNA, 22 nt, Human
ccugggugacagagcgagacuc

SEQ ID NO: 1261786 - RNA, 19 nt, Human
ccuguaaucccagcuacuc

SEQ ID NO: 1261787 - RNA, 21 nt, Human
ccuguaaucccagcuacucag

SEQ ID NO: 1261788 - RNA, 18 nt, Human
ccuguaauccuagcacuu

SEQ ID NO: 1261789 - RNA, 20 nt, Human
ccuguaauccuagcacuuug

SEQ ID NO: 1261790 - RNA, 22 nt, Human
ccuguaauccuagcacuuuggg

SEQ ID NO: 1261791 - RNA, 22 nt, Human
ccugugugacagagugagacuc

SEQ ID NO: 1261792 - RNA, 24 nt, Human
cgagaucgugccacugcacuccag

SEQ ID NO: 1261793 - RNA, 26 nt, Human
cgagguggguggaucacaaggucagg

SEQ ID NO: 1261794 - RNA, 24 nt, Human
cgccuguaaucccagcuacucagg

SEQ ID NO: 1261795 - RNA, 24 nt, Human
cggaucaccugaggucaggaguuc

SEQ ID NO: 1261796 - RNA, 27 nt, Human
cggaucaccugaggucaggaguucaag

SEQ ID NO: 1261797 - RNA, 22 nt, Human
cgucucaaaacaacaacaacaa

SEQ ID NO: 1261798 - RNA, 18 nt, Human
cucaaaaaaaaaaaaaag

SEQ ID NO: 1261799 - RNA, 25 nt, Human
cucaaaaaaaaaaaaaagaaaagaa

SEQ ID NO: 1261800 - RNA, 22 nt, Human
cucacgcuucuaaucccagcac

SEQ ID NO: 1261801 - RNA, 24 nt, Human
cucacgcuucuaaucccagcacuu

SEQ ID NO: 1261802 - RNA, 19 nt, Human
cuccgucucaaaaaaaaaa

SEQ ID NO: 1261803 - RNA, 25 nt, Human
cuccgucucaaaaaaaaaaauuagc

SEQ ID NO: 1261804 - RNA, 24 nt, Human
cucuacuaaaaauacaaaaaaagg

SEQ ID NO: 1261805 - RNA, 23 nt, Human
cuggccaacauggcgaaacccca

SEQ ID NO: 1261806 - RNA, 22 nt, Human
cuucuaaucccagcacuuuggg

SEQ ID NO: 1261807 - RNA, 23 nt, Human
cuugaaccugggaggcugagguu

SEQ ID NO: 1261808 - RNA, 18 nt, Human
gaaaccccaucucuacua

SEQ ID NO: 1261809 - RNA, 19 nt, Human
gaaaccuugucucuacuaa

SEQ ID NO: 1261810 - RNA, 24 nt, Human
gacagagugagacuccgucucaaa

SEQ ID NO: 1261811 - RNA, 23 nt, Human
gagaucgcaccacugcacuccag

SEQ ID NO: 1261812 - RNA, 22 nt, Human
gagguggguggaucacaagguc

SEQ ID NO: 1261813 - RNA, 18 nt, Human
gagguugcagugagccaa

SEQ ID NO: 1261814 - RNA, 23 nt, Human
gagguugcagugagccaagaucg

SEQ ID NO: 1261815 - RNA, 23 nt, Human
gagguugcagugagcugagaucg

SEQ ID NO: 1261816 - RNA, 23 nt, Human
gaguuugcagugagccgagaucg

SEQ ID NO: 1261817 - RNA, 23 nt, Human
gaucaccugaggucaggaguuca

SEQ ID NO: 1261818 - RNA, 24 nt, Human
gaucaccugaggucaggaguucaa

SEQ ID NO: 1261819 - RNA, 24 nt, Human
gaucaccugaggucaggaguuuga

SEQ ID NO: 1261820 - RNA, 18 nt, Human
gauugaagugggggcugg

SEQ ID NO: 1261821 - RNA, 24 nt, Human
gcacuccagccugggugacagagc

SEQ ID NO: 1261822 - RNA, 24 nt, Human
gcacuccagccugugugacagagu

SEQ ID NO: 1261823 - RNA, 22 nt, Human
gcaggagaaucgcuugaaccca

SEQ ID NO: 1261824 - RNA, 24 nt, Human
gccaacauggcgaaaccccaucuc

SEQ ID NO: 1261825 - RNA, 24 nt, Human
gccaacauggcgaaaccuugucuc

SEQ ID NO: 1261826 - RNA, 20 nt, Human
gccaagaucgugccacugca

SEQ ID NO: 1261827 - RNA, 19 nt, Human
gccacugcacuccagccug

SEQ ID NO: 1261828 - RNA, 24 nt, Human
gccacugcacuccagccuggguga

SEQ ID NO: 1261829 - RNA, 20 nt, Human
gccgagaucgugccacugca

SEQ ID NO: 1261830 - RNA, 24 nt, Human
gcuaacauggugaaaccccgucuc

SEQ ID NO: 1261831 - RNA, 20 nt, Human
gcugagaucgcaccacugca

SEQ ID NO: 1261832 - RNA, 22 nt, Human
gcugaggcaggagaauggcgug

SEQ ID NO: 1261833 - RNA, 19 nt, Human
gcugggcgugguggcucac

SEQ ID NO: 1261834 - RNA, 24 nt, Human
ggagaccauccuggcuaacauggu

SEQ ID NO: 1261835 - RNA, 22 nt, Human
ggagguugcagugagcugagau

SEQ ID NO: 1261836 - RNA, 23 nt, Human
ggagguugcagugagcugagauc

SEQ ID NO: 1261837 - RNA, 24 nt, Human
ggagguugcagugagcugagaucg

SEQ ID NO: 1261838 - RNA, 24 nt, Human
ggaguuugcagugagccgagaucg

SEQ ID NO: 1261839 - RNA, 23 nt, Human
ggaucaccugaggucaggaguuc

SEQ ID NO: 1261840 - RNA, 25 nt, Human
ggcagaucaccugaggucaggaguu

SEQ ID NO: 1261841 - RNA, 21 nt, Human
ggcucacgcuucuaaucccag

SEQ ID NO: 1261842 - RNA, 20 nt, Human
gggaagccgaggugggugga

SEQ ID NO: 1261843 - RNA, 23 nt, Human
gggaagccgagguggguggauca

SEQ ID NO: 1261844 - RNA, 24 nt, Human
gggcgugguggcucacgcuucuaa

SEQ ID NO: 1261845 - RNA, 24 nt, Human
ggguggaucacaaggucaggagau

SEQ ID NO: 1261846 - RNA, 19 nt, Human
ggguucagggauuguuucc

SEQ ID NO: 1261847 - RNA, 24 nt, Human
gguagcaggcgccuguaaucccag

SEQ ID NO: 1261848 - RNA, 24 nt, Human
gguaguaggugccuauagucccag

SEQ ID NO: 1261849 - RNA, 19 nt, Human
ggucaggaguuugagacca

SEQ ID NO: 1261850 - RNA, 24 nt, Human
gguggcucacgcuucuaaucccag

SEQ ID NO: 1261851 - RNA, 18 nt, Human
gucauggaggccugugag

SEQ ID NO: 1261852 - RNA, 20 nt, Human
gucucaaaaaaaaaaaaaag

SEQ ID NO: 1261853 - RNA, 24 nt, Human
gugcaagcaggugcccugggaguc

SEQ ID NO: 1261854 - RNA, 19 nt, Human
guugcagugagcugagauc

SEQ ID NO: 1261855 - RNA, 21 nt, Human
guugcagugagcugagaucgc

SEQ ID NO: 1261856 - RNA, 21 nt, Human
uaaaaauacaaaaaaaggcug

SEQ ID NO: 1261857 - RNA, 26 nt, Human
uaaacccacgucuccagugucccagg

SEQ ID NO: 1261858 - RNA, 22 nt, Human
uaacauggugaaaccccgucuc

SEQ ID NO: 1261859 - RNA, 24 nt, Human
uaacauggugaaaccccgucucua

SEQ ID NO: 1261860 - RNA, 25 nt, Human
uaagacuagagcuggccaggugcag

SEQ ID NO: 1261861 - RNA, 23 nt, Human
uaagcagaaucccagcauauaaa

SEQ ID NO: 1261862 - RNA, 19 nt, Human
uaagugacuucucaucugc

SEQ ID NO: 1261863 - RNA, 25 nt, Human
uaagugacuucucaucugcucaaca

SEQ ID NO: 1261864 - RNA, 24 nt, Human
uagcacuuugggaggcugaggugg

SEQ ID NO: 1261865 - RNA, 22 nt, Human
uagcaggcgccuguaaucccag

SEQ ID NO: 1261866 - RNA, 19 nt, Human
uagcuggaugugguagcag

SEQ ID NO: 1261867 - RNA, 19 nt, Human
uaggcauucauuccugugg

SEQ ID NO: 1261868 - RNA, 25 nt, Human
uaggccaucuucuuggccugucaug

SEQ ID NO: 1261869 - RNA, 24 nt, Human
ucacaaggucaggagauggagacc

SEQ ID NO: 1261870 - RNA, 20 nt, Human
ucacagcuacuggggaggcu

SEQ ID NO: 1261871 - RNA, 21 nt, Human
ucagcaaaauaagacuagagc

SEQ ID NO: 1261872 - RNA, 22 nt, Human
ucaucugcucaacagcucaaaa

SEQ ID NO: 1261873 - RNA, 22 nt, Human
ucauucaaaggugcaagcaggu

SEQ ID NO: 1261874 - RNA, 22 nt, Human
uccaccauuaggcauucauucc

SEQ ID NO: 1261875 - RNA, 23 nt, Human
uccagccugggugacagagcgag

SEQ ID NO: 1261876 - RNA, 24 nt, Human
uccagccugggugacagagcgaga

SEQ ID NO: 1261877 - RNA, 23 nt, Human
uccagccugugugacagagugag

SEQ ID NO: 1261878 - RNA, 24 nt, Human
uccagccugugugacagagugaga

SEQ ID NO: 1261879 - RNA, 21 nt, Human
uccagcuggggugacgaguga

SEQ ID NO: 1261880 - RNA, 19 nt, Human
uccagugucccaggccagc

SEQ ID NO: 1261881 - RNA, 22 nt, Human
uccgucucaaaaaaaaaaaaaa

SEQ ID NO: 1261882 - RNA, 23 nt, Human
uccgucucaaaaaaaaaaaaaag

SEQ ID NO: 1261883 - RNA, 25 nt, Human
uccgucucaaaaaaaaaaaaaagaa

SEQ ID NO: 1261884 - RNA, 21 nt, Human
uccuguaauccuagcacuuug

SEQ ID NO: 1261885 - RNA, 22 nt, Human
ucgcaccacugcacuccagcug

SEQ ID NO: 1261886 - RNA, 24 nt, Human
ucgcuugaacccagcaggcggagg

SEQ ID NO: 1261887 - RNA, 23 nt, Human
ucgugccacugcacuccagccug

SEQ ID NO: 1261888 - RNA, 22 nt, Human
ucucuacuaaaaauacaaaaaa

SEQ ID NO: 1261889 - RNA, 22 nt, Human
ucucuacuaaaaauacaaaaaa

SEQ ID NO: 1261890 - RNA, 21 nt, Human
ucucuacuaaaauauaaaaaa

SEQ ID NO: 1261891 - RNA, 18 nt, Human
ugaaccugggaggcugag

SEQ ID NO: 1261892 - RNA, 24 nt, Human
ugaaccugggaggcugagguugca

SEQ ID NO: 1261893 - RNA, 21 nt, Human
ugagaccagccuggccaacau

SEQ ID NO: 1261894 - RNA, 23 nt, Human
ugagaccagccuggccaacaugg

SEQ ID NO: 1261895 - RNA, 22 nt, Human
ugagccaagaucgugccacugc

SEQ ID NO: 1261896 - RNA, 22 nt, Human
ugagccgagaucgugccacugc

SEQ ID NO: 1261897 - RNA, 22 nt, Human
ugagcugagaucgcaccacugc

SEQ ID NO: 1261898 - RNA, 20 nt, Human
ugaggcaggagaaucgcuug

SEQ ID NO: 1261899 - RNA, 24 nt, Human
ugaggcaggagaaucgcuugaacc

SEQ ID NO: 1261900 - RNA, 25 nt, Human
ugaggcaggagaaucgcuugaaccc

SEQ ID NO: 1261901 - RNA, 24 nt, Human
ugaggcaggagaaucucuugaacc

SEQ ID NO: 1261902 - RNA, 25 nt, Human
ugaggcaggagaaucucuugaaccu

SEQ ID NO: 1261903 - RNA, 24 nt, Human
ugaggcaggagaauggcgugaacc

SEQ ID NO: 1261904 - RNA, 25 nt, Human
ugaggcaggagaauggcgugaaccu

SEQ ID NO: 1261905 - RNA, 19 nt, Human
ugaggcaucucuacagacc

SEQ ID NO: 1261906 - RNA, 21 nt, Human
ugaggcaucucuacagacccu

SEQ ID NO: 1261907 - RNA, 18 nt, Human
ugaggucaggaguuugag

SEQ ID NO: 1261908 - RNA, 20 nt, Human
ugaggugggcagaucaccug

SEQ ID NO: 1261909 - RNA, 24 nt, Human
ugaggugggcagaucaccugaggu

SEQ ID NO: 1261910 - RNA, 26 nt, Human
ugaggugggcagaucaccugagguca

SEQ ID NO: 1261911 - RNA, 24 nt, Human
ugagguugcagugagccaagaucg

SEQ ID NO: 1261912 - RNA, 24 nt, Human
ugccuauagucccagcuacuuggg

SEQ ID NO: 1261913 - RNA, 29 nt, Human
uggaaggcggaguuugcagugacaacggu

SEQ ID NO: 1261914 - RNA, 24 nt, Human
uggccaacauggcgaaaccuuguc

SEQ ID NO: 1261915 - RNA, 21 nt, Human
uggcucacgcuucuaauccca

SEQ ID NO: 1261916 - RNA, 22 nt, Human
uggcucacgcuucuaaucccag

SEQ ID NO: 1261917 - RNA, 24 nt, Human
uggcucacgcuucuaaucccagca

SEQ ID NO: 1261918 - RNA, 18 nt, Human
uggcuuauccuguaaucc

SEQ ID NO: 1261919 - RNA, 18 nt, Human
uggcuuauccuguaaucc

SEQ ID NO: 1261920 - RNA, 23 nt, Human
uggcuuauccuguaauccuagca

SEQ ID NO: 1261921 - RNA, 18 nt, Human
ugggaggccaaagcagac

SEQ ID NO: 1261922 - RNA, 24 nt, Human
ugggaggccaaagcagacggauca

SEQ ID NO: 1261923 - RNA, 18 nt, Human
ugggaggcugaggcagga

SEQ ID NO: 1261924 - RNA, 24 nt, Human
ugggaggcugaggcaggagaaugg

SEQ ID NO: 1261925 - RNA, 20 nt, Human
ugggaggcugaggugggcag

SEQ ID NO: 1261926 - RNA, 24 nt, Human
ugggaggcugaggugggcagauca

SEQ ID NO: 1261927 - RNA, 24 nt, Human
ugggaggcugagguugcagugagc

SEQ ID NO: 1261928 - RNA, 20 nt, Human
ugggagucuggguucagccu

SEQ ID NO: 1261929 - RNA, 24 nt, Human
ugggcagaucaccugaggucagga

SEQ ID NO: 1261930 - RNA, 19 nt, Human
ugggggaagccgagguggg

SEQ ID NO: 1261931 - RNA, 19 nt, Human
ugggggaagccgagguggg

SEQ ID NO: 1261932 - RNA, 24 nt, Human
ugguagcaggcgccuguaauccca

SEQ ID NO: 1261933 - RNA, 24 nt, Human
ugguggcucacgcuucuaauccca

SEQ ID NO: 1261934 - RNA, 19 nt, Human
ugucauggaggccugugag

SEQ ID NO: 1261935 - RNA, 24 nt, Human
uuagcuggaugugguagcaggcgc

SEQ ID NO: 1261936 - RNA, 20 nt, Human
uuccuguggguucagggauu

SEQ ID NO: 1261937 - RNA, 24 nt, Human
uugaacccagcaggcggagguugc

SEQ ID NO: 1261938 - RNA, 24 nt, Human
uugaaccugggaggcugagguugc

SEQ ID NO: 1261939 - RNA, 22 nt, Human
uugcagugagccaagaucgugc

SEQ ID NO: 1261940 - RNA, 21 nt, Human
uugcagugagccgagaucgug

SEQ ID NO: 1261941 - RNA, 22 nt, Human
uugcagugagccgagaucgugc

SEQ ID NO: 1261942 - RNA, 18 nt, Human
uugcagugagcugagauc

SEQ ID NO: 1261943 - RNA, 19 nt, Human
uugcagugagcugagaucg

SEQ ID NO: 1261944 - RNA, 22 nt, Human
uugcagugagcugagaucgcac

SEQ ID NO: 1261945 - RNA, 25 nt, Human
uugggaggcugaggugggcagauca

SEQ ID NO: 1261946 - RNA, 24 nt, Human
uuugcagugagccgagaucgugcc

SEQ ID NO: 1261947 - RNA, 24 nt, Human
uuuuuuaagcagaagauucuuuuu

SEQ ID NO: 1261948 - RNA, 21 nt, Human
uuuuuuuuuuaagcagaagau

SEQ ID NO: 1261949 - RNA, 20 nt, Human
uuuuuuuuuuuuaagcagaa

SEQ ID NO: 1261950 - RNA, 18 nt, Human
aacaauaacagccaagcc

SEQ ID NO: 1261951 - RNA, 24 nt, Human
acgacaggucccaaauuacaaacc

SEQ ID NO: 1261952 - RNA, 22 nt, Human
agcucccaaggucuccaacuuc

SEQ ID NO: 1261953 - RNA, 21 nt, Human
aggcauuugguggaugccaga

SEQ ID NO: 1261954 - RNA, 23 nt, Human
aggucuuuggguuuuuuuucccu

SEQ ID NO: 1261955 - RNA, 19 nt, Human
caacaauaacagccaagcc

SEQ ID NO: 1261956 - RNA, 24 nt, Human
caacgucacuuuauuaucaauguc

SEQ ID NO: 1261957 - RNA, 18 nt, Human
caauaacagccaagccag

SEQ ID NO: 1261958 - RNA, 22 nt, Human
caggucccaaauuacaaaccaa

SEQ ID NO: 1261959 - RNA, 26 nt, Human
caggucccaaauuacaaaccaacucu

SEQ ID NO: 1261960 - RNA, 26 nt, Human
cccaaauuacaaaccaacucucauaa

SEQ ID NO: 1261961 - RNA, 23 nt, Human
ccgcgcgugcauccaccgcgauc

SEQ ID NO: 1261962 - RNA, 22 nt, Human
cucccaaggucuccaacuuccu

SEQ ID NO: 1261963 - RNA, 19 nt, Human
gcauccaccgcgaucucag

SEQ ID NO: 1261964 - RNA, 21 nt, Human
ucccaaggucuccaacuuccu

SEQ ID NO: 1261965 - RNA, 22 nt, Human
ucccaaggucuccaacuuccua

SEQ ID NO: 1261966 - RNA, 20 nt, Human
ucccuggagcucccaagguc

SEQ ID NO: 1261967 - RNA, 24 nt, Human
ucccuggagcucccaaggucucca

SEQ ID NO: 1261968 - RNA, 22 nt, Human
uccuaaggcauuugguggaugc

SEQ ID NO: 1261969 - RNA, 22 nt, Human
ucugcagcagccaacgucacuu

SEQ ID NO: 1261970 - RNA, 20 nt, Human
ugcauccaccgcgaucucag

SEQ ID NO: 1261971 - RNA, 19 nt, Human
uucccuggagcucccaagg

SEQ ID NO: 1261972 - RNA, 19 nt, Human
aaggcgaggacgacaaagg

SEQ ID NO: 1261973 - RNA, 21 nt, Human
agccuccucacaccuuuauua

SEQ ID NO: 1261974 - RNA, 20 nt, Human
gcaggggauucucuuuugcc

SEQ ID NO: 1261975 - RNA, 24 nt, Human
gccuccucacaccuuuauuaaaac

SEQ ID NO: 1261976 - RNA, 19 nt, Human
ggcuggggaaggcgaggac

SEQ ID NO: 1261977 - RNA, 21 nt, Human
gggaaggcgaggacgacaaag

SEQ ID NO: 1261978 - RNA, 18 nt, Human
gggauucucuuuugccca

SEQ ID NO: 1261979 - RNA, 21 nt, Human
gucccggugcaaggccgaggc

SEQ ID NO: 1261980 - RNA, 19 nt, Human
gugucccaaacucggcguc

SEQ ID NO: 1261981 - RNA, 22 nt, Human
ucaacuggccccagccuccuca

SEQ ID NO: 1261982 - RNA, 19 nt, Human
ucccggugcaaggccgagg

SEQ ID NO: 1261983 - RNA, 23 nt, Human
uucggugucccaaacucggcguc

SEQ ID NO: 1261984 - RNA, 22 nt, Human
caucugcuucuucaccuucuuc

SEQ ID NO: 1261985 - RNA, 18 nt, Human
ggucauagucuggaucau

SEQ ID NO: 1261986 - RNA, 18 nt, Human
ucuccuuccucaucugcu

SEQ ID NO: 1261987 - RNA, 19 nt, Human
aagcagaagacaggauggc

SEQ ID NO: 1261988 - RNA, 20 nt, Human
acagaauaaaccaguucccc

SEQ ID NO: 1261989 - RNA, 22 nt, Human
aggaaggaaccaguuguucuua

SEQ ID NO: 1261990 - RNA, 21 nt, Human
aggauggcuccucagcguuac

SEQ ID NO: 1261991 - RNA, 24 nt, Human
auaguagguuuuucucaaauauuu

SEQ ID NO: 1261992 - RNA, 23 nt, Human
cagaauccccagagugaagacac

SEQ ID NO: 1261993 - RNA, 19 nt, Human
cagccugccagaaucccca

SEQ ID NO: 1261994 - RNA, 22 nt, Human
ccaggaaaccagccugccagaa

SEQ ID NO: 1261995 - RNA, 27 nt, Human
cccaccaggcuggaagcuaugggaaga

SEQ ID NO: 1261996 - RNA, 19 nt, Human
ccuuuauuccccaccaggc

SEQ ID NO: 1261997 - RNA, 24 nt, Human
cucaagcagaagacaggauggcuc

SEQ ID NO: 1261998 - RNA, 20 nt, Human
cuccucagcguuacucuggc

SEQ ID NO: 1261999 - RNA, 18 nt, Human
gaagacacucaagcagaa

SEQ ID NO: 1262000 - RNA, 19 nt, Human
gaagacaggauggcuccuc

SEQ ID NO: 1262001 - RNA, 18 nt, Human
gaaggaaggaaccaguug

SEQ ID NO: 1262002 - RNA, 21 nt, Human
ggagaagagagccgugggacc

SEQ ID NO: 1262003 - RNA, 22 nt, Human
guggaagaugaaggaagagcaa

SEQ ID NO: 1262004 - RNA, 24 nt, Human
uagaaaagugcuuggcauauagua

SEQ ID NO: 1262005 - RNA, 23 nt, Human
uagaaggagugaauacauggaua

SEQ ID NO: 1262006 - RNA, 19 nt, Human
uccaagaggauguaauauc

SEQ ID NO: 1262007 - RNA, 23 nt, Human
ucuucugaaggaaggaaccaguu

SEQ ID NO: 1262008 - RNA, 23 nt, Human
ugaagacacucaagcagaagaca

SEQ ID NO: 1262009 - RNA, 26 nt, Human
ugccagaauccccagagugaagacac

SEQ ID NO: 1262010 - RNA, 19 nt, Human
uggaauccaggcgcucacc

SEQ ID NO: 1262011 - RNA, 20 nt, Human
ugggaagaaagggcuauugc

SEQ ID NO: 1262012 - RNA, 23 nt, Human
uuggcauauaguagguuuuucuc

SEQ ID NO: 1262013 - RNA, 18 nt, Human
uuuggaauccaggcgcuc

SEQ ID NO: 1262014 - RNA, 25 nt, Human
aacucggcgccccccucagcgccuc

SEQ ID NO: 1262015 - RNA, 20 nt, Human
aaucaaaucagcuucacaaa

SEQ ID NO: 1262016 - RNA, 20 nt, Human
agcaacucggcgccccccuc

SEQ ID NO: 1262017 - RNA, 21 nt, Human
aucaagucuuuccccuuugga

SEQ ID NO: 1262018 - RNA, 23 nt, Human
ccacauuaaacccuuuagaccua

SEQ ID NO: 1262019 - RNA, 18 nt, Human
ccccgcuccucgcgcccg

SEQ ID NO: 1262020 - RNA, 20 nt, Human
cccgcgccgcgguccgccga

SEQ ID NO: 1262021 - RNA, 27 nt, Human
cccuuuagaccuacauuaauaugaaua

SEQ ID NO: 1262022 - RNA, 20 nt, Human
ccgccccgcuccucgcgccc

SEQ ID NO: 1262023 - RNA, 19 nt, Human
ccucgcacuaccuccuccu

SEQ ID NO: 1262024 - RNA, 21 nt, Human
ccucgcgcccgggccccggcc

SEQ ID NO: 1262025 - RNA, 22 nt, Human
cgacuccugguccccacgcccc

SEQ ID NO: 1262026 - RNA, 19 nt, Human
cgccccgcuccucgcgccc

SEQ ID NO: 1262027 - RNA, 27 nt, Human
cguaccaucaagucuuuccccuuugga

SEQ ID NO: 1262028 - RNA, 18 nt, Human
cucgcgcccgggccccgg

SEQ ID NO: 1262029 - RNA, 23 nt, Human
cucggcgccccccucagcgccuc

SEQ ID NO: 1262030 - RNA, 21 nt, Human
gacuccugguccccacgcccc

SEQ ID NO: 1262031 - RNA, 20 nt, Human
gcccccgccccgcuccucgc

SEQ ID NO: 1262032 - RNA, 21 nt, Human
gcccgggccccggccgggccc

SEQ ID NO: 1262033 - RNA, 19 nt, Human
uaacagugcuggcuguggu

SEQ ID NO: 1262034 - RNA, 24 nt, Human
uaaccacauuaaacccuuuagacc

SEQ ID NO: 1262035 - RNA, 21 nt, Human
uaucugguucucuuaacagug

SEQ ID NO: 1262036 - RNA, 19 nt, Human
uccccacgcccccgccccg

SEQ ID NO: 1262037 - RNA, 25 nt, Human
uccccacgcccccgccccgcuccuc

SEQ ID NO: 1262038 - RNA, 19 nt, Human
ucccgaaggcuacagaugc

SEQ ID NO: 1262039 - RNA, 21 nt, Human
ucccgaaggcuacagaugcca

SEQ ID NO: 1262040 - RNA, 22 nt, Human
ucgcgcccgggccccggccggg

SEQ ID NO: 1262041 - RNA, 19 nt, Human
ucucuuaacagugcuggcu

SEQ ID NO: 1262042 - RNA, 20 nt, Human
uuaaaaauaugaacuacugc

SEQ ID NO: 1262043 - RNA, 18 nt, Human
aacacguguagaaacuua

SEQ ID NO: 1262044 - RNA, 19 nt, Human
accccgaggagacugcgga

SEQ ID NO: 1262045 - RNA, 18 nt, Human
agcgcgguggggcuaggc

SEQ ID NO: 1262046 - RNA, 24 nt, Human
agcgcgguggggcuaggcgugggg

SEQ ID NO: 1262047 - RNA, 18 nt, Human
caauucgaugcagaaguc

SEQ ID NO: 1262048 - RNA, 19 nt, Human
cccacggcugggcgugggg

SEQ ID NO: 1262049 - RNA, 21 nt, Human
ccccaacacguguagaaacuu

SEQ ID NO: 1262050 - RNA, 18 nt, Human
cccgcggcuccuucgccc

SEQ ID NO: 1262051 - RNA, 23 nt, Human
ccucugaggcuggggcgggguac

SEQ ID NO: 1262052 - RNA, 22 nt, Human
ccuguaccgcagcgucgugugg

SEQ ID NO: 1262053 - RNA, 18 nt, Human
ccuucgcccucucgcugg

SEQ ID NO: 1262054 - RNA, 20 nt, Human
cgcugggccgacuaagcgug

SEQ ID NO: 1262055 - RNA, 21 nt, Human
cgggaccagggcggaggccgc

SEQ ID NO: 1262056 - RNA, 24 nt, Human
cggggccccgggcugucacguggc

SEQ ID NO: 1262057 - RNA, 18 nt, Human
gagcgcgguggggcuagg

SEQ ID NO: 1262058 - RNA, 19 nt, Human
gaggugcguugcagggcca

SEQ ID NO: 1262059 - RNA, 21 nt, Human
gaugcagaagucuuuuaaaua

SEQ ID NO: 1262060 - RNA, 24 nt, Human
gccccgggcugucacguggcccca

SEQ ID NO: 1262061 - RNA, 20 nt, Human
gcggggcgcggggccccggg

SEQ ID NO: 1262062 - RNA, 20 nt, Human
ggaggugcguugcagggcca

SEQ ID NO: 1262063 - RNA, 20 nt, Human
ggccgguccgcccucacucc

SEQ ID NO: 1262064 - RNA, 20 nt, Human
ggcgcggcggggcgcggggc

SEQ ID NO: 1262065 - RNA, 22 nt, Human
ggcggcgcggcggggcgcgggg

SEQ ID NO: 1262066 - RNA, 19 nt, Human
gggaccagggcggaggccg

SEQ ID NO: 1262067 - RNA, 21 nt, Human
gggcgagcaggguuggcgggg

SEQ ID NO: 1262068 - RNA, 19 nt, Human
uacaccaaguaaggcggcg

SEQ ID NO: 1262069 - RNA, 19 nt, Human
uccgcccucacuccacccu

SEQ ID NO: 1262070 - RNA, 22 nt, Human
ucgcugggccgacuaagcgugu

SEQ ID NO: 1262071 - RNA, 21 nt, Human
ucgugugguucgccaaggggc

SEQ ID NO: 1262072 - RNA, 18 nt, Human
ucuaggaggugcguugca

SEQ ID NO: 1262073 - RNA, 27 nt, Human
ucucuaaacggcgcugaugcccgauuu

SEQ ID NO: 1262074 - RNA, 20 nt, Human
uucgcccucucgcugggccg

SEQ ID NO: 1262075 - RNA, 20 nt, Human
uugcagggccaucuucgcau

SEQ ID NO: 1262076 - RNA, 23 nt, Human
aaaccgcuuccccggcgacccua

SEQ ID NO: 1262077 - RNA, 20 nt, Human
aaacucacgauacuaaucaa

SEQ ID NO: 1262078 - RNA, 24 nt, Human
aaagagucacauaauaauaaacac

SEQ ID NO: 1262079 - RNA, 26 nt, Human
auaaacacauaucauaaugugaauaa

SEQ ID NO: 1262080 - RNA, 22 nt, Human
caaguagguaguggcacgcuag

SEQ ID NO: 1262081 - RNA, 18 nt, Human
cagcgugacucaggaaca

SEQ ID NO: 1262082 - RNA, 19 nt, Human
cagcgugacucaggaacau

SEQ ID NO: 1262083 - RNA, 21 nt, Human
caucucagcaugaacuccuga

SEQ ID NO: 1262084 - RNA, 20 nt, Human
caugaacucaugaucaucuc

SEQ ID NO: 1262085 - RNA, 23 nt, Human
cauuccacuauaccuucucccuu

SEQ ID NO: 1262086 - RNA, 23 nt, Human
cauuucuguucuaugggacugca

SEQ ID NO: 1262087 - RNA, 23 nt, Human
ccaugggcucucccaaaccgcuu

SEQ ID NO: 1262088 - RNA, 24 nt, Human
cccaaaccgcuuccccggcgaccc

SEQ ID NO: 1262089 - RNA, 27 nt, Human
ccgaugcucacacucauuccacuauac

SEQ ID NO: 1262090 - RNA, 18 nt, Human
cuaguccacuccuuggcc

SEQ ID NO: 1262091 - RNA, 24 nt, Human
cucacgcagucaccaugggcucuc

SEQ ID NO: 1262092 - RNA, 18 nt, Human
cuguggucagcaucccuc

SEQ ID NO: 1262093 - RNA, 21 nt, Human
cuuuaggaaauguaaaaagag

SEQ ID NO: 1262094 - RNA, 24 nt, Human
ggaguucuagacuuuucaaacuca

SEQ ID NO: 1262095 - RNA, 19 nt, Human
uaauuucccacaaucacac

SEQ ID NO: 1262096 - RNA, 21 nt, Human
uaauuucccacaaucacacaa

SEQ ID NO: 1262097 - RNA, 23 nt, Human
uaggcauuauuaucuucauuuua

SEQ ID NO: 1262098 - RNA, 23 nt, Human
uaucuucauuuuaugguugagga

SEQ ID NO: 1262099 - RNA, 21 nt, Human
uaugguugaggaaauuggggc

SEQ ID NO: 1262100 - RNA, 21 nt, Human
ucagcaucccucugagguagg

SEQ ID NO: 1262101 - RNA, 18 nt, Human
ucuguucuaugggacugc

SEQ ID NO: 1262102 - RNA, 23 nt, Human
ugaacucaugaucaucucagcau

SEQ ID NO: 1262103 - RNA, 20 nt, Human
uuuuaugguugaggaaauug

SEQ ID NO: 1262104 - RNA, 18 nt, Human
aaacgacauagcgacaau

SEQ ID NO: 1262105 - RNA, 20 nt, Human
aaauguaaacgacaucaacc

SEQ ID NO: 1262106 - RNA, 27 nt, Human
aagaaacuuaacgucaaaaaaaaugua

SEQ ID NO: 1262107 - RNA, 18 nt, Human
aagucguagaagucgaaa

SEQ ID NO: 1262108 - RNA, 22 nt, Human
aaguugucuuuuuagaugagcc

SEQ ID NO: 1262109 - RNA, 23 nt, Human
acaaauacucgaagaagaacauc

SEQ ID NO: 1262110 - RNA, 21 nt, Human
acaguaacagcaguaucuaaa

SEQ ID NO: 1262111 - RNA, 18 nt, Human
acgacaucaaccagcaga

SEQ ID NO: 1262112 - RNA, 27 nt, Human
agaaaaaauaaagcaauagcuagagaa

SEQ ID NO: 1262113 - RNA, 18 nt, Human
agaaagacuggccucccg

SEQ ID NO: 1262114 - RNA, 23 nt, Human
agaagaacauccaugagaaaaaa

SEQ ID NO: 1262115 - RNA, 25 nt, Human
aggaaaacuccaaauauuccaacug

SEQ ID NO: 1262116 - RNA, 24 nt, Human
agugguuuggauguuucuuugucu

SEQ ID NO: 1262117 - RNA, 21 nt, Human
caaaggaugacacaauugaau

SEQ ID NO: 1262118 - RNA, 23 nt, Human
caacaagaucaggaaaacuccaa

SEQ ID NO: 1262119 - RNA, 18 nt, Human
caacugcaaaggaugaca

SEQ ID NO: 1262120 - RNA, 21 nt, Human
cacaauugaaugaacaauuuu

SEQ ID NO: 1262121 - RNA, 20 nt, Human
cagcaaagaucagagccaca

SEQ ID NO: 1262122 - RNA, 21 nt, Human
cagcaguaucuaaaauguuaa

SEQ ID NO: 1262123 - RNA, 21 nt, Human
caucaaccagcagaauaauca

SEQ ID NO: 1262124 - RNA, 27 nt, Human
ccaaauauuccaacugcaaaggaugac

SEQ ID NO: 1262125 - RNA, 24 nt, Human
ccaucugggaauauccuuaagaaa

SEQ ID NO: 1262126 - RNA, 19 nt, Human
cguaucaccuuuuguuucc

SEQ ID NO: 1262127 - RNA, 19 nt, Human
cuggccucccgaagaugga

SEQ ID NO: 1262128 - RNA, 22 nt, Human
gaagaagaacauccaugagaaa

SEQ ID NO: 1262129 - RNA, 21 nt, Human
gugaaaauuaggucagcaaag

SEQ ID NO: 1262130 - RNA, 26 nt, Human
uaagugaggucuaggucaaauccauc

SEQ ID NO: 1262131 - RNA, 19 nt, Human
uagaaugauacuccaaagg

SEQ ID NO: 1262132 - RNA, 25 nt, Human
uagagaaauagaaugauacuccaaa

SEQ ID NO: 1262133 - RNA, 21 nt, Human
ucagcaaagaucagagccaca

SEQ ID NO: 1262134 - RNA, 19 nt, Human
ucgaagaagaacauccaug

SEQ ID NO: 1262135 - RNA, 18 nt, Human
ugagaaaaaauaaagcaa

SEQ ID NO: 1262136 - RNA, 18 nt, Human
ugggaauauccuuaagaa

SEQ ID NO: 1262137 - RNA, 21 nt, Human
accaagauggcggcgcccgug

SEQ ID NO: 1262138 - RNA, 20 nt, Human
acgcaguaggugcagccaug

SEQ ID NO: 1262139 - RNA, 18 nt, Human
caagcagccgccguacgg

SEQ ID NO: 1262140 - RNA, 20 nt, Human
caagcagccgccguacggac

SEQ ID NO: 1262141 - RNA, 22 nt, Human
ccaagaugacggcaucuaugag

SEQ ID NO: 1262142 - RNA, 24 nt, Human
ccuguacgucgaggccguacaagc

SEQ ID NO: 1262143 - RNA, 22 nt, Human
gacaaacgggcaauguacggaa

SEQ ID NO: 1262144 - RNA, 18 nt, Human
ggagacacaggcaggagg

SEQ ID NO: 1262145 - RNA, 22 nt, Human
ggcaggagggaccccaugggga

SEQ ID NO: 1262146 - RNA, 22 nt, Human
uacaagcagccgccguacggac

SEQ ID NO: 1262147 - RNA, 26 nt, Human
uacgucgaggccguacaagcagccgc

SEQ ID NO: 1262148 - RNA, 25 nt, Human
uccaagaugacggcaucuaugagga

SEQ ID NO: 1262149 - RNA, 21 nt, Human
ugccugacaaacgggcaaugu

SEQ ID NO: 1262150 - RNA, 18 nt, Human
uguggagacacaggcagg

SEQ ID NO: 1262151 - RNA, 18 nt, Human
aaaugaaaacuuuacaca

SEQ ID NO: 1262152 - RNA, 21 nt, Human
aaaugcacgcaggaaaagcac

SEQ ID NO: 1262153 - RNA, 23 nt, Human
aacaaauaugacgugacuccaau

SEQ ID NO: 1262154 - RNA, 20 nt, Human
aaccugguccagcccuccuc

SEQ ID NO: 1262155 - RNA, 26 nt, Human
aagaggccucgcuaugggauaggaug

SEQ ID NO: 1262156 - RNA, 19 nt, Human
acagcugugaugaccaaau

SEQ ID NO: 1262157 - RNA, 19 nt, Human
accaacgauucacguagcu

SEQ ID NO: 1262158 - RNA, 19 nt, Human
accaacuucaagcagaggc

SEQ ID NO: 1262159 - RNA, 20 nt, Human
agaggcugguggaggccuuu

SEQ ID NO: 1262160 - RNA, 21 nt, Human
aggaaaagcacagaggaaacc

SEQ ID NO: 1262161 - RNA, 23 nt, Human
auccccacuauguaaaucagacc

SEQ ID NO: 1262162 - RNA, 23 nt, Human
auguggcguguguuccaggcgug

SEQ ID NO: 1262163 - RNA, 19 nt, Human
caagcagaggccugagcau

SEQ ID NO: 1262164 - RNA, 24 nt, Human
caauaggcuagcaggaauaagcac

SEQ ID NO: 1262165 - RNA, 22 nt, Human
cacccucccgcguccucaaaga

SEQ ID NO: 1262166 - RNA, 22 nt, Human
cacuucacagcugugaugacca

SEQ ID NO: 1262167 - RNA, 21 nt, Human
cagcagggguaccugggacaa

SEQ ID NO: 1262168 - RNA, 22 nt, Human
cagcggcucaaauuggaacugg

SEQ ID NO: 1262169 - RNA, 21 nt, Human
cagcugccugcacucuuuaag

SEQ ID NO: 1262170 - RNA, 22 nt, Human
caucucgggagggguccaccuc

SEQ ID NO: 1262171 - RNA, 22 nt, Human
cauuccaccuguggguuccuau

SEQ ID NO: 1262172 - RNA, 23 nt, Human
ccaaauguucccucucuuacguu

SEQ ID NO: 1262173 - RNA, 20 nt, Human
ccacaaggaagaggccucgc

SEQ ID NO: 1262174 - RNA, 20 nt, Human
ccaccuggccuuccacagca

SEQ ID NO: 1262175 - RNA, 18 nt, Human
ccagacccgugcugaugc

SEQ ID NO: 1262176 - RNA, 19 nt, Human
cccaaauguucccucucuu

SEQ ID NO: 1262177 - RNA, 21 nt, Human
cccaacacacgaaauaagaac

SEQ ID NO: 1262178 - RNA, 18 nt, Human
cccacaaccugguccagc

SEQ ID NO: 1262179 - RNA, 19 nt, Human
ccccaaauguucccucucu

SEQ ID NO: 1262180 - RNA, 20 nt, Human
ccucuccuuucuccuugccc

SEQ ID NO: 1262181 - RNA, 20 nt, Human
ccuguggguuccuaucaccu

SEQ ID NO: 1262182 - RNA, 21 nt, Human
cguccaucucccacccacggc

SEQ ID NO: 1262183 - RNA, 20 nt, Human
cucacugaacccaaaauuuc

SEQ ID NO: 1262184 - RNA, 19 nt, Human
cuucacagcugugaugacc

SEQ ID NO: 1262185 - RNA, 21 nt, Human
cuuccacagcacugugacacc

SEQ ID NO: 1262186 - RNA, 21 nt, Human
cuuccacagcacugugacacc

SEQ ID NO: 1262187 - RNA, 21 nt, Human
gacccgugcugaugcugcccc

SEQ ID NO: 1262188 - RNA, 21 nt, Human
gagggguccaccuggccuucc

SEQ ID NO: 1262189 - RNA, 23 nt, Human
gccccugaaaaugaaaacuuuac

SEQ ID NO: 1262190 - RNA, 19 nt, Human
ggaaacauucccaccccac

SEQ ID NO: 1262191 - RNA, 20 nt, Human
ggcaggaaguggugccagga

SEQ ID NO: 1262192 - RNA, 21 nt, Human
gggcaggaaguggugccagga

SEQ ID NO: 1262193 - RNA, 21 nt, Human
gggggcaggaaguggugccag

SEQ ID NO: 1262194 - RNA, 23 nt, Human
ggggguguguuccccaacacacg

SEQ ID NO: 1262195 - RNA, 21 nt, Human
gguccagcccuccucagucca

SEQ ID NO: 1262196 - RNA, 22 nt, Human
ggugagaggcugguggaggccu

SEQ ID NO: 1262197 - RNA, 23 nt, Human
guaaagaacuguaaacccaauaa

SEQ ID NO: 1262198 - RNA, 21 nt, Human
guuccaggcgugcccacaacc

SEQ ID NO: 1262199 - RNA, 21 nt, Human
uaaaaacaucagcagucaccu

SEQ ID NO: 1262200 - RNA, 20 nt, Human
uaaaaggccccugaaaauga

SEQ ID NO: 1262201 - RNA, 21 nt, Human
uaacugccaggcagccuggug

SEQ ID NO: 1262202 - RNA, 23 nt, Human
uaaggccagggacagccagaccc

SEQ ID NO: 1262203 - RNA, 21 nt, Human
uacacaguuccauaaagccac

SEQ ID NO: 1262204 - RNA, 21 nt, Human
uacgccuaauucauauccuuc

SEQ ID NO: 1262205 - RNA, 19 nt, Human
uagugacuggccagccuaa

SEQ ID NO: 1262206 - RNA, 19 nt, Human
uauggccagcugccugcac

SEQ ID NO: 1262207 - RNA, 22 nt, Human
ucagcagucaccucuccuuucu

SEQ ID NO: 1262208 - RNA, 23 nt, Human
ucaguccagaggccacacggcca

SEQ ID NO: 1262209 - RNA, 23 nt, Human
uccccaacacacgaaauaagaac

SEQ ID NO: 1262210 - RNA, 18 nt, Human
ucucuaaauuaggucagu

SEQ ID NO: 1262211 - RNA, 24 nt, Human
ucucuggaaacauuucacccuccc

SEQ ID NO: 1262212 - RNA, 20 nt, Human
ugaaaggaacuuuugagaug

SEQ ID NO: 1262213 - RNA, 22 nt, Human
ugaagcacaacucagcgugcga

SEQ ID NO: 1262214 - RNA, 20 nt, Human
ugccaacccaagagcuacgc

SEQ ID NO: 1262215 - RNA, 24 nt, Human
ugccaggaagugagcaccaacuuc

SEQ ID NO: 1262216 - RNA, 20 nt, Human
ugccaggcagccugguggca

SEQ ID NO: 1262217 - RNA, 24 nt, Human
ugccaggcagccugguggcauucu

SEQ ID NO: 1262218 - RNA, 24 nt, Human
ugccccacugcuucaguagauuua

SEQ ID NO: 1262219 - RNA, 22 nt, Human
ugcccugggcucugccagaagc

SEQ ID NO: 1262220 - RNA, 20 nt, Human
ugcgcaaaacuugugugaag

SEQ ID NO: 1262221 - RNA, 19 nt, Human
uggaacuggccuuccacag

SEQ ID NO: 1262222 - RNA, 24 nt, Human
ugggcucugccagaagcacuggug

SEQ ID NO: 1262223 - RNA, 31 nt, Human
ugggcucugccagaagcacuggugggggcaa

SEQ ID NO: 1262224 - RNA, 23 nt, Human
ugggggcagcagggguaccuggg

SEQ ID NO: 1262225 - RNA, 19 nt, Human
ugggggcaggaaguggugc

SEQ ID NO: 1262226 - RNA, 22 nt, Human
ugggggcaggaaguggugccag

SEQ ID NO: 1262227 - RNA, 26 nt, Human
uggguuccuaucaccuuacacaguuc

SEQ ID NO: 1262228 - RNA, 18 nt, Human
uggguugaugccccuugg

SEQ ID NO: 1262229 - RNA, 23 nt, Human
ugguggcauucuucaccuucagc

SEQ ID NO: 1262230 - RNA, 18 nt, Human
ugugaagcacaacucagc

SEQ ID NO: 1262231 - RNA, 20 nt, Human
uguggugggugccuucucuu

SEQ ID NO: 1262232 - RNA, 18 nt, Human
uguguuccccaacacacg

SEQ ID NO: 1262233 - RNA, 22 nt, Human
uuacacaugcaagcagagagga

SEQ ID NO: 1262234 - RNA, 25 nt, Human
uucacagcugugaugaccaaaugca

SEQ ID NO: 1262235 - RNA, 25 nt, Human
uuccaaccccaaauguucccucucu

SEQ ID NO: 1262236 - RNA, 19 nt, Human
uucuggugagaggcuggug

SEQ ID NO: 1262237 - RNA, 21 nt, Human
uucuggugagaggcuggugga

SEQ ID NO: 1262238 - RNA, 18 nt, Human
uuuaucugacagguaaau

SEQ ID NO: 1262239 - RNA, 21 nt, Human
uuuaugcugccaacccaagag

SEQ ID NO: 1262240 - RNA, 25 nt, Human
uuucauguauuuuucacgugucacu

SEQ ID NO: 1262241 - RNA, 20 nt, Human
agguucgcugcgugguggua

SEQ ID NO: 1262242 - RNA, 23 nt, Human
ugaagaauaacuggauaaacagg

SEQ ID NO: 1262243 - RNA, 21 nt, Human
uggaaacaugaagaauaacug

SEQ ID NO: 1262244 - RNA, 19 nt, Human
uguuugugacagcaacugg

SEQ ID NO: 1262245 - RNA, 20 nt, Human
aaggacagacccugugcuca

SEQ ID NO: 1262246 - RNA, 23 nt, Human
aaggacagacccugugcucagau

SEQ ID NO: 1262247 - RNA, 23 nt, Human
acacacacacacgcacacacaca

SEQ ID NO: 1262248 - RNA, 23 nt, Human
acacacacgcacacacacacacg

SEQ ID NO: 1262249 - RNA, 23 nt, Human
acacgcacacacacacacgagua

SEQ ID NO: 1262250 - RNA, 25 nt, Human
acccugugcucagaugggcggacug

SEQ ID NO: 1262251 - RNA, 21 nt, Human
aggaagcagaacuccaguuuu

SEQ ID NO: 1262252 - RNA, 19 nt, Human
aggugcccaucacccaggc

SEQ ID NO: 1262253 - RNA, 26 nt, Human
cacacacacacacacacgcacacaca

SEQ ID NO: 1262254 - RNA, 26 nt, Human
cacacacacacacacgcacacacaca

SEQ ID NO: 1262255 - RNA, 24 nt, Human
cacacacacacacgcacacacaca

SEQ ID NO: 1262256 - RNA, 19 nt, Human
cagaggguaaugaccccac

SEQ ID NO: 1262257 - RNA, 23 nt, Human
cauagauucccccaaagaaauuc

SEQ ID NO: 1262258 - RNA, 21 nt, Human
ccacugaaucaaggaagcaga

SEQ ID NO: 1262259 - RNA, 21 nt, Human
cccaucacccaggcauacccc

SEQ ID NO: 1262260 - RNA, 24 nt, Human
ccccaaagaaauucaauaaauaaa

SEQ ID NO: 1262261 - RNA, 19 nt, Human
ccccacagacggguccagg

SEQ ID NO: 1262262 - RNA, 24 nt, Human
ccgcaugcuucuuugucucucggg

SEQ ID NO: 1262263 - RNA, 20 nt, Human
ccucagcacauguuugauau

SEQ ID NO: 1262264 - RNA, 22 nt, Human
ccuccagcucugacucacaggc

SEQ ID NO: 1262265 - RNA, 21 nt, Human
ccugucagaacuuuaaaagcc

SEQ ID NO: 1262266 - RNA, 20 nt, Human
cuaaggacagacccugugcu

SEQ ID NO: 1262267 - RNA, 23 nt, Human
cuugcaccacuccucggccucca

SEQ ID NO: 1262268 - RNA, 20 nt, Human
gaggcagaggguaaugaccc

SEQ ID NO: 1262269 - RNA, 25 nt, Human
gcacacacacacacgaguagagcua

SEQ ID NO: 1262270 - RNA, 23 nt, Human
gcaccacuccucggccuccagcu

SEQ ID NO: 1262271 - RNA, 19 nt, Human
guaaaacauagauuccccc

SEQ ID NO: 1262272 - RNA, 24 nt, Human
uaaaacauagauucccccaaagaa

SEQ ID NO: 1262273 - RNA, 25 nt, Human
uacacacacacacacacacgcacac

SEQ ID NO: 1262274 - RNA, 21 nt, Human
uacgaugucauuugcagagcu

SEQ ID NO: 1262275 - RNA, 21 nt, Human
uaguguguucugaauuucaug

SEQ ID NO: 1262276 - RNA, 21 nt, Human
uauccugucacccucagcaca

SEQ ID NO: 1262277 - RNA, 25 nt, Human
ucaaggaagcagaacuccaguuuuu

SEQ ID NO: 1262278 - RNA, 21 nt, Human
ucagaacuuuaaaagccacag

SEQ ID NO: 1262279 - RNA, 23 nt, Human
ucgauguuucaucgugaaagaug

SEQ ID NO: 1262280 - RNA, 20 nt, Human
ucuacacacacacacacaca

SEQ ID NO: 1262281 - RNA, 23 nt, Human
ucuguuacugucagacccaaaga

SEQ ID NO: 1262282 - RNA, 20 nt, Human
ugaaagaugauugccaccgc

SEQ ID NO: 1262283 - RNA, 22 nt, Human
ugcccaucacccaggcauaccc

SEQ ID NO: 1262284 - RNA, 18 nt, Human
ugucagaacuuuaaaagc

SEQ ID NO: 1262285 - RNA, 26 nt, Human
ugucuacacacacacacacacacgca

SEQ ID NO: 1262286 - RNA, 26 nt, Human
ugucuacacacacacacacacacgca

SEQ ID NO: 1262287 - RNA, 25 nt, Human
ugucuacacacacacacacacacgg

SEQ ID NO: 1262288 - RNA, 22 nt, Human
ugucuacacacacacacacagu

SEQ ID NO: 1262289 - RNA, 21 nt, Human
uguuugauauauacuuguuau

SEQ ID NO: 1262290 - RNA, 18 nt, Human
uuuaaccuuccaauggga

SEQ ID NO: 1262291 - RNA, 27 nt, Human
uuuguacugcaauuggucuuccaggag

SEQ ID NO: 1262292 - RNA, 21 nt, Human
aaaagcaagggaaggauggga

SEQ ID NO: 1262293 - RNA, 18 nt, Human
aacuacgcugacuuuucc

SEQ ID NO: 1262294 - RNA, 23 nt, Human
agcaagggaaggaugggaaggga

SEQ ID NO: 1262295 - RNA, 24 nt, Human
aggccuucaacaucauaggagauu

SEQ ID NO: 1262296 - RNA, 19 nt, Human
agggaaggaugggaaggga

SEQ ID NO: 1262297 - RNA, 20 nt, Human
auccacauuccaggccuuca

SEQ ID NO: 1262298 - RNA, 21 nt, Human
caagccacagagcaaaagcaa

SEQ ID NO: 1262299 - RNA, 20 nt, Human
cagagcaaaagcaagggaag

SEQ ID NO: 1262300 - RNA, 23 nt, Human
ccaagccacagagcaaaagcaag

SEQ ID NO: 1262301 - RNA, 23 nt, Human
cccaagccacagagcaaaagcaa

SEQ ID NO: 1262302 - RNA, 20 nt, Human
cucuccacacacuucaacua

SEQ ID NO: 1262303 - RNA, 23 nt, Human
cugauggaucugaagcuucuucu

SEQ ID NO: 1262304 - RNA, 19 nt, Human
gccaaauucccugaguucu

SEQ ID NO: 1262305 - RNA, 23 nt, Human
gccacagagcaaaagcaagggaa

SEQ ID NO: 1262306 - RNA, 19 nt, Human
ucccugaguucuugcugcu

SEQ ID NO: 1262307 - RNA, 23 nt, Human
ucugaagcuucuucuugggguuu

SEQ ID NO: 1262308 - RNA, 24 nt, Human
ucugaccccaagccacagagcaaa

SEQ ID NO: 1262309 - RNA, 23 nt, Human
ucuugcugcuuucaauucugauu

SEQ ID NO: 1262310 - RNA, 24 nt, Human
ugaucaaugccccuguggcccaug

SEQ ID NO: 1262311 - RNA, 19 nt, Human
ugccaaauucccugaguuc

SEQ ID NO: 1262312 - RNA, 23 nt, Human
uucugaucaaugccccuguggcc

SEQ ID NO: 1262313 - RNA, 20 nt, Human
uuugaaguauccacauucca

SEQ ID NO: 1262314 - RNA, 20 nt, Human
agcaggacauaaagcuggaa

SEQ ID NO: 1262315 - RNA, 19 nt, Human
aggagguaaguuagucugc

SEQ ID NO: 1262316 - RNA, 19 nt, Human
ccucccgaccaagggcgag

SEQ ID NO: 1262317 - RNA, 18 nt, Human
uaaguuagucugcagcag

SEQ ID NO: 1262318 - RNA, 23 nt, Human
uccucccgaccaagggcgagagu

SEQ ID NO: 1262319 - RNA, 26 nt, Human
ucugcagcaggacauaaagcuggaac

SEQ ID NO: 1262320 - RNA, 23 nt, Human
ugaaaucacaaauuaguugguaa

SEQ ID NO: 1262321 - RNA, 25 nt, Human
ugaaaucacaaauuaguugguaauc

SEQ ID NO: 1262322 - RNA, 23 nt, Human
ugauuguuuugaaaucacaaauu

SEQ ID NO: 1262323 - RNA, 20 nt, Human
cccgaaaaucugggcaccug

SEQ ID NO: 1262324 - RNA, 21 nt, Human
gaaauaucagcagucccgaaa

SEQ ID NO: 1262325 - RNA, 24 nt, Human
guaaauggaugguggaaauaucag

SEQ ID NO: 1262326 - RNA, 22 nt, Human
ucugggcaccugugcugauggc

SEQ ID NO: 1262327 - RNA, 21 nt, Human
uggcagaggauguaguuuuga

SEQ ID NO: 1262328 - RNA, 18 nt, Human
ugggcaccugugcugaug

SEQ ID NO: 1262329 - RNA, 21 nt, Human
ugguggaaauaucagcagucc

SEQ ID NO: 1262330 - RNA, 26 nt, Human
uuccagacuuccuuguauuuggaucu

SEQ ID NO: 1262331 - RNA, 24 nt, Human
cagaggacuucccuuccacuacuu

SEQ ID NO: 1262332 - RNA, 26 nt, Human
ccuuucagggcuauuucucggaaauc

SEQ ID NO: 1262333 - RNA, 19 nt, Human
ugcuccacuuaucucugcu

SEQ ID NO: 1262334 - RNA, 24 nt, Human
uguucucagaggacuucccuucca

SEQ ID NO: 1262335 - RNA, 20 nt, Human
accucuggccaggcugccuc

SEQ ID NO: 1262336 - RNA, 19 nt, Human
caagcucuuggccugcccu

SEQ ID NO: 1262337 - RNA, 19 nt, Human
caaguccagugcccaagcu

SEQ ID NO: 1262338 - RNA, 21 nt, Human
cccaccucuggccaggcugcc

SEQ ID NO: 1262339 - RNA, 18 nt, Human
cucuggccaggcugccuc

SEQ ID NO: 1262340 - RNA, 21 nt, Human
cucuggccaggcugccucuuc

SEQ ID NO: 1262341 - RNA, 18 nt, Human
guccagugcccaagcucu

SEQ ID NO: 1262342 - RNA, 18 nt, Human
aaaauccuccuauggccu

SEQ ID NO: 1262343 - RNA, 19 nt, Human
aaacaaugacaaaagucag

SEQ ID NO: 1262344 - RNA, 24 nt, Human
aaacaaugacaaaagucagguaac

SEQ ID NO: 1262345 - RNA, 24 nt, Human
aaagguauauggagccacagaugg

SEQ ID NO: 1262346 - RNA, 20 nt, Human
aaauagcugggguuauaggc

SEQ ID NO: 1262347 - RNA, 24 nt, Human
aaauggucgaaagguauauggagc

SEQ ID NO: 1262348 - RNA, 24 nt, Human
aagauuucuuccucaaauuguuuu

SEQ ID NO: 1262349 - RNA, 24 nt, Human
aagccccuuucugggcccaccucc

SEQ ID NO: 1262350 - RNA, 18 nt, Human
aagcugcuuggauuaggg

SEQ ID NO: 1262351 - RNA, 22 nt, Human
aagcugcuuggauuagggagcc

SEQ ID NO: 1262352 - RNA, 22 nt, Human
aaggugggugaaguggggguca

SEQ ID NO: 1262353 - RNA, 20 nt, Human
aaguaguccuccugcccucg

SEQ ID NO: 1262354 - RNA, 22 nt, Human
accauguuggccaggcuggucu

SEQ ID NO: 1262355 - RNA, 19 nt, Human
acccccaagaggggacacu

SEQ ID NO: 1262356 - RNA, 20 nt, Human
acccugccacaccucaucuc

SEQ ID NO: 1262357 - RNA, 19 nt, Human
accucaucucugaccccca

SEQ ID NO: 1262358 - RNA, 24 nt, Human
acgacguuucaccauguuggccag

SEQ ID NO: 1262359 - RNA, 22 nt, Human
acucucagcucacugcaaccuc

SEQ ID NO: 1262360 - RNA, 24 nt, Human
acugccucagccucccaaauagcu

SEQ ID NO: 1262361 - RNA, 21 nt, Human
acuggcuacagauacuugcac

SEQ ID NO: 1262362 - RNA, 20 nt, Human
agacuccugggucccaccgu

SEQ ID NO: 1262363 - RNA, 21 nt, Human
agagauggagcccaggagaaa

SEQ ID NO: 1262364 - RNA, 27 nt, Human
agagauggagcccaggagaaaacugcu

SEQ ID NO: 1262365 - RNA, 24 nt, Human
agaguguugggauuacaggcauga

SEQ ID NO: 1262366 - RNA, 23 nt, Human
agauagcagacccuuucuaaagc

SEQ ID NO: 1262367 - RNA, 26 nt, Human
agccccuuucugggcccaccucccau

SEQ ID NO: 1262368 - RNA, 25 nt, Human
aggaaucccuugauucagcccuauc

SEQ ID NO: 1262369 - RNA, 23 nt, Human
aggcaugagccacugugccuggc

SEQ ID NO: 1262370 - RNA, 21 nt, Human
aggcgccugucaccacaccca

SEQ ID NO: 1262371 - RNA, 22 nt, Human
agggaugaaucaugacgugcag

SEQ ID NO: 1262372 - RNA, 20 nt, Human
agguggcucagugaggugag

SEQ ID NO: 1262373 - RNA, 20 nt, Human
aguguugggauuacaggcau

SEQ ID NO: 1262374 - RNA, 22 nt, Human
aguguugggauuacaggcauga

SEQ ID NO: 1262375 - RNA, 18 nt, Human
aucccauccucuccacca

SEQ ID NO: 1262376 - RNA, 25 nt, Human
auuacacuggcuacagauacuugca

SEQ ID NO: 1262377 - RNA, 21 nt, Human
caaaagucagguaacaggcug

SEQ ID NO: 1262378 - RNA, 27 nt, Human
caagugaucuucccgccucggccuccc

SEQ ID NO: 1262379 - RNA, 19 nt, Human
cacagcuucugcuacuugg

SEQ ID NO: 1262380 - RNA, 22 nt, Human
cacaggacugcaggggaaggcc

SEQ ID NO: 1262381 - RNA, 24 nt, Human
caccacacccagcuaauuuuugua

SEQ ID NO: 1262382 - RNA, 19 nt, Human
caccagggccuucuuacag

SEQ ID NO: 1262383 - RNA, 21 nt, Human
caccauguuggccaggcuggu

SEQ ID NO: 1262384 - RNA, 23 nt, Human
caccauguuggccaggcuggucu

SEQ ID NO: 1262385 - RNA, 24 nt, Human
caccauguuggccaggcuggucuu

SEQ ID NO: 1262386 - RNA, 27 nt, Human
caccauguuggccaggcuggucuugaa

SEQ ID NO: 1262387 - RNA, 23 nt, Human
cacugcaaccucugcuaucuggg

SEQ ID NO: 1262388 - RNA, 20 nt, Human
cagaugaagaaauggaggug

SEQ ID NO: 1262389 - RNA, 19 nt, Human
cagccaaacauggucaccc

SEQ ID NO: 1262390 - RNA, 24 nt, Human
cauguuggccaggcuggucuugaa

SEQ ID NO: 1262391 - RNA, 20 nt, Human
ccacagcuucugcuacuugg

SEQ ID NO: 1262392 - RNA, 24 nt, Human
ccacagcuucugcuacuuggucua

SEQ ID NO: 1262393 - RNA, 21 nt, Human
ccaccagggccuucuuacaga

SEQ ID NO: 1262394 - RNA, 23 nt, Human
ccagaguguugggauuacaggca

SEQ ID NO: 1262395 - RNA, 24 nt, Human
ccagaguguugggauuacaggcau

SEQ ID NO: 1262396 - RNA, 23 nt, Human
ccaggcuuccuuggcuuugagga

SEQ ID NO: 1262397 - RNA, 20 nt, Human
ccagugggggaggacccugg

SEQ ID NO: 1262398 - RNA, 18 nt, Human
cccaaauagcugggguua

SEQ ID NO: 1262399 - RNA, 24 nt, Human
cccaaauagcugggguuauaggcg

SEQ ID NO: 1262400 - RNA, 24 nt, Human
cccagaguguugggauuacaggca

SEQ ID NO: 1262401 - RNA, 24 nt, Human
ccccuuucugggcccaccucccau

SEQ ID NO: 1262402 - RNA, 20 nt, Human
ccgugaaucuuccucuucca

SEQ ID NO: 1262403 - RNA, 25 nt, Human
ccucaggggccgugaaucuuccucu

SEQ ID NO: 1262404 - RNA, 24 nt, Human
ccuccaagaccuggcugacaugag

SEQ ID NO: 1262405 - RNA, 20 nt, Human
ccucgcucugcagccucucc

SEQ ID NO: 1262406 - RNA, 23 nt, Human
ccucgcucugcagccucucccuc

SEQ ID NO: 1262407 - RNA, 20 nt, Human
ccucuagacccugccacacc

SEQ ID NO: 1262408 - RNA, 21 nt, Human
ccucucccuccgcgagcggcc

SEQ ID NO: 1262409 - RNA, 21 nt, Human
ccugagggcagggucuuaggg

SEQ ID NO: 1262410 - RNA, 20 nt, Human
ccugugucaccaggcuuccu

SEQ ID NO: 1262411 - RNA, 21 nt, Human
ccuugcugcacagcacccuug

SEQ ID NO: 1262412 - RNA, 24 nt, Human
cgacguuucaccauguuggccagg

SEQ ID NO: 1262413 - RNA, 18 nt, Human
cgccugucaccacaccca

SEQ ID NO: 1262414 - RNA, 23 nt, Human
cuaauuuuuguauuuuuagcaga

SEQ ID NO: 1262415 - RNA, 24 nt, Human
cucaagugaucuucccgccucggc

SEQ ID NO: 1262416 - RNA, 24 nt, Human
cucccaaauagcugggguuauagg

SEQ ID NO: 1262417 - RNA, 21 nt, Human
cuccugcccucgcucugcagc

SEQ ID NO: 1262418 - RNA, 23 nt, Human
cucgcucugcagccucucccucc

SEQ ID NO: 1262419 - RNA, 24 nt, Human
cugcaaccucugcuaucuggguuc

SEQ ID NO: 1262420 - RNA, 22 nt, Human
cugcagcucaaaauggcaagaa

SEQ ID NO: 1262421 - RNA, 22 nt, Human
cuucccgccucggccucccaga

SEQ ID NO: 1262422 - RNA, 28 nt, Human
cuuggagaccgucucuuuccucuggaac

SEQ ID NO: 1262423 - RNA, 21 nt, Human
cuuucuaaagccaggaauccc

SEQ ID NO: 1262424 - RNA, 18 nt, Human
gaaaaaugucuggucucu

SEQ ID NO: 1262425 - RNA, 25 nt, Human
gaaauggagguggcucagugaggug

SEQ ID NO: 1262426 - RNA, 23 nt, Human
gaagccccuuucugggcccaccu

SEQ ID NO: 1262427 - RNA, 21 nt, Human
gaccacagcuucugcuacuug

SEQ ID NO: 1262428 - RNA, 24 nt, Human
gaccucaagugaucuucccgccuc

SEQ ID NO: 1262429 - RNA, 23 nt, Human
gacguuucaccauguuggccagg

SEQ ID NO: 1262430 - RNA, 21 nt, Human
gaggacccuggggacucucaa

SEQ ID NO: 1262431 - RNA, 18 nt, Human
gauuacaggcaugagcca

SEQ ID NO: 1262432 - RNA, 21 nt, Human
gauuacaggcaugagccacug

SEQ ID NO: 1262433 - RNA, 24 nt, Human
gauuacaggcaugagccacugugc

SEQ ID NO: 1262434 - RNA, 21 nt, Human
gauucuacugccucagccucc

SEQ ID NO: 1262435 - RNA, 24 nt, Human
gcagacccuuucuaaagccaggaa

SEQ ID NO: 1262436 - RNA, 19 nt, Human
gccuuuacugcucaaggga

SEQ ID NO: 1262437 - RNA, 24 nt, Human
gcgauucuacugccucagccuccc

SEQ ID NO: 1262438 - RNA, 20 nt, Human
gcucuuuuguccuggcugga

SEQ ID NO: 1262439 - RNA, 23 nt, Human
gcuggucuugaacuccugaccuc

SEQ ID NO: 1262440 - RNA, 19 nt, Human
ggagaaaacugcugcucuu

SEQ ID NO: 1262441 - RNA, 20 nt, Human
ggagccacagauggugggga

SEQ ID NO: 1262442 - RNA, 18 nt, Human
ggaggacccuggggacuc

SEQ ID NO: 1262443 - RNA, 24 nt, Human
ggauuacaggcaugagccacugug

SEQ ID NO: 1262444 - RNA, 24 nt, Human
ggcuggucuugaacuccugaccuc

SEQ ID NO: 1262445 - RNA, 26 nt, Human
ggcuuugaggaccccugccccagagg

SEQ ID NO: 1262446 - RNA, 22 nt, Human
gggaaggugggugaaguggggg

SEQ ID NO: 1262447 - RNA, 21 nt, Human
ggggaaggugggugaaguggg

SEQ ID NO: 1262448 - RNA, 21 nt, Human
gggggaggacccuggggacuc

SEQ ID NO: 1262449 - RNA, 22 nt, Human
gggugggacacaggacugcagg

SEQ ID NO: 1262450 - RNA, 20 nt, Human
ggguucaagcgauucuacug

SEQ ID NO: 1262451 - RNA, 19 nt, Human
ggucuugaacuccugaccu

SEQ ID NO: 1262452 - RNA, 19 nt, Human
gguucaagcgauucuacug

SEQ ID NO: 1262453 - RNA, 24 nt, Human
gugaucuucccgccucggccuccc

SEQ ID NO: 1262454 - RNA, 22 nt, Human
guucucaucccauccucuccac

SEQ ID NO: 1262455 - RNA, 24 nt, Human
uaauuuuuguauuuuuagcagaga

SEQ ID NO: 1262456 - RNA, 22 nt, Human
uacaggcaugagccacugugcc

SEQ ID NO: 1262457 - RNA, 20 nt, Human
uagaaaagagcuaacuuuga

SEQ ID NO: 1262458 - RNA, 25 nt, Human
uagcagacccuuucuaaagccagga

SEQ ID NO: 1262459 - RNA, 24 nt, Human
uagcagagacgacguuucaccaug

SEQ ID NO: 1262460 - RNA, 23 nt, Human
uaguggcuucacugcuucugcaa

SEQ ID NO: 1262461 - RNA, 22 nt, Human
uauauggagccacagauggugg

SEQ ID NO: 1262462 - RNA, 21 nt, Human
uauuucacagaugaagaaaug

SEQ ID NO: 1262463 - RNA, 22 nt, Human
ucaaggccaaacucacuuuagg

SEQ ID NO: 1262464 - RNA, 18 nt, Human
ucaccaggcuuccuuggc

SEQ ID NO: 1262465 - RNA, 24 nt, Human
ucacugcaaccucugcuaucuggg

SEQ ID NO: 1262466 - RNA, 19 nt, Human
ucacuugucauaauaaacc

SEQ ID NO: 1262467 - RNA, 24 nt, Human
ucagaaaaaugucuggucucucaa

SEQ ID NO: 1262468 - RNA, 20 nt, Human
ucagccucccaaauagcugg

SEQ ID NO: 1262469 - RNA, 20 nt, Human
ucagccucccaaauagcugg

SEQ ID NO: 1262470 - RNA, 18 nt, Human
ucagugaggugagugacu

SEQ ID NO: 1262471 - RNA, 22 nt, Human
ucagugaggugagugacuugca

SEQ ID NO: 1262472 - RNA, 20 nt, Human
ucauuccucuagacccugcc

SEQ ID NO: 1262473 - RNA, 24 nt, Human
ucccaaauagcugggguuauaggc

SEQ ID NO: 1262474 - RNA, 24 nt, Human
ucccaaguacccuuggccugggac

SEQ ID NO: 1262475 - RNA, 24 nt, Human
ucccagaguguugggauuacaggc

SEQ ID NO: 1262476 - RNA, 23 nt, Human
uccgcgagcggccagcgcagcuu

SEQ ID NO: 1262477 - RNA, 18 nt, Human
uccugcccucgcucugca

SEQ ID NO: 1262478 - RNA, 19 nt, Human
uccuuggcuuugaggaccc

SEQ ID NO: 1262479 - RNA, 18 nt, Human
ucucaucccauccucucc

SEQ ID NO: 1262480 - RNA, 21 nt, Human
ucucaucccauccucuccacc

SEQ ID NO: 1262481 - RNA, 21 nt, Human
ucuccaguguuguuggggucc

SEQ ID NO: 1262482 - RNA, 18 nt, Human
ucucugacccccaagagg

SEQ ID NO: 1262483 - RNA, 21 nt, Human
ucuugaacuccugaccucaag

SEQ ID NO: 1262484 - RNA, 21 nt, Human
ugaagaaauggagguggcuca

SEQ ID NO: 1262485 - RNA, 18 nt, Human
ugaccucaagugaucuuc

SEQ ID NO: 1262486 - RNA, 20 nt, Human
ugaccucaagugaucuuccc

SEQ ID NO: 1262487 - RNA, 21 nt, Human
ugaccucaagugaucuucccg

SEQ ID NO: 1262488 - RNA, 24 nt, Human
ugaccucaagugaucuucccgccu

SEQ ID NO: 1262489 - RNA, 23 nt, Human
ugacuuacaggggauagaaaaga

SEQ ID NO: 1262490 - RNA, 26 nt, Human
ugaggugagugacuugcauaaaguca

SEQ ID NO: 1262491 - RNA, 24 nt, Human
ugagugacuugcauaaagucacac

SEQ ID NO: 1262492 - RNA, 22 nt, Human
ugauuuguaagauuucuuccuc

SEQ ID NO: 1262493 - RNA, 18 nt, Human
ugcaaagauagcagaccc

SEQ ID NO: 1262494 - RNA, 20 nt, Human
ugcaacuucucuaaagucaa

SEQ ID NO: 1262495 - RNA, 21 nt, Human
ugcacagcauuccaagccagc

SEQ ID NO: 1262496 - RNA, 19 nt, Human
ugcccucgcucugcagccu

SEQ ID NO: 1262497 - RNA, 21 nt, Human
ugccucagccucccaaauagc

SEQ ID NO: 1262498 - RNA, 27 nt, Human
ugccucagccucccaaauagcuggggu

SEQ ID NO: 1262499 - RNA, 20 nt, Human
ugcuggaaguaguccuccug

SEQ ID NO: 1262500 - RNA, 24 nt, Human
uggaagugauuucauuacacuggc

SEQ ID NO: 1262501 - RNA, 18 nt, Human
uggagguggcucagugag

SEQ ID NO: 1262502 - RNA, 22 nt, Human
uggaugcacccuggggagggag

SEQ ID NO: 1262503 - RNA, 18 nt, Human
uggauuuggaagugauuu

SEQ ID NO: 1262504 - RNA, 24 nt, Human
uggcacacucucagcucacugcaa

SEQ ID NO: 1262505 - RNA, 24 nt, Human
uggccaggcuggucuugaacuccu

SEQ ID NO: 1262506 - RNA, 21 nt, Human
uggcuggaaaauccuccuaug

SEQ ID NO: 1262507 - RNA, 18 nt, Human
ugggauuacaggcaugag

SEQ ID NO: 1262508 - RNA, 21 nt, Human
ugggauuacaggcaugagcca

SEQ ID NO: 1262509 - RNA, 22 nt, Human
ugggauuacaggcaugagccac

SEQ ID NO: 1262510 - RNA, 22 nt, Human
ugggauuacaggcaugagccac

SEQ ID NO: 1262511 - RNA, 22 nt, Human
ugggauuacaggcaugagccac

SEQ ID NO: 1262512 - RNA, 23 nt, Human
ugggauuacaggcaugagccacu

SEQ ID NO: 1262513 - RNA, 24 nt, Human
ugggauuacaggcaugagccacug

SEQ ID NO: 1262514 - RNA, 18 nt, Human
uggggagggaggagcagg

SEQ ID NO: 1262515 - RNA, 22 nt, Human
ugggggaggacccuggggacuc

SEQ ID NO: 1262516 - RNA, 18 nt, Human
ugggugccugugucacca

SEQ ID NO: 1262517 - RNA, 22 nt, Human
ugggugccugugucaccaggcu

SEQ ID NO: 1262518 - RNA, 19 nt, Human
uggguucaagcgauucuac

SEQ ID NO: 1262519 - RNA, 19 nt, Human
ugucagagagacuccuggg

SEQ ID NO: 1262520 - RNA, 23 nt, Human
ugucagagagacuccuggguccc

SEQ ID NO: 1262521 - RNA, 22 nt, Human
uguuaguggcuucacugcuucu

SEQ ID NO: 1262522 - RNA, 24 nt, Human
uuagcagagacgacguuucaccau

SEQ ID NO: 1262523 - RNA, 20 nt, Human
uuaugaccacagcuucugcu

SEQ ID NO: 1262524 - RNA, 23 nt, Human
uucaagcgauucuacugccucag

SEQ ID NO: 1262525 - RNA, 19 nt, Human
uucacagaugaagaaaugg

SEQ ID NO: 1262526 - RNA, 25 nt, Human
uuccaagccagccaaacauggucac

SEQ ID NO: 1262527 - RNA, 25 nt, Human
uuccugagggcagggucuuaggggc

SEQ ID NO: 1262528 - RNA, 21 nt, Human
uuccugggacuccccaucucc

SEQ ID NO: 1262529 - RNA, 24 nt, Human
uuucaccauguuggccaggcuggu

SEQ ID NO: 1262530 - RNA, 24 nt, Human
uuuuuagcagagacgacguuucac

SEQ ID NO: 1262531 - RNA, 20 nt, Human
uuuuuguauuuuuagcagag

SEQ ID NO: 1262532 - RNA, 23 nt, Human
uuuuuguauuuuuagcagagacg

SEQ ID NO: 1262533 - RNA, 19 nt, Human
aagcaguuggcaaagucaa

SEQ ID NO: 1262534 - RNA, 20 nt, Human
cuccaggaccgccacucccc

SEQ ID NO: 1262535 - RNA, 19 nt, Human
cugagaggcacaaugugga

SEQ ID NO: 1262536 - RNA, 20 nt, Human
cugcucguccacucucuggc

SEQ ID NO: 1262537 - RNA, 19 nt, Human
cugcugggcagcugggcaa

SEQ ID NO: 1262538 - RNA, 23 nt, Human
gaaggaaauccuggauggguccu

SEQ ID NO: 1262539 - RNA, 20 nt, Human
gaaguuuccugugcagcuag

SEQ ID NO: 1262540 - RNA, 20 nt, Human
gaugguaccccuggaguucu

SEQ ID NO: 1262541 - RNA, 21 nt, Human
ucgucagugugccucagcugc

SEQ ID NO: 1262542 - RNA, 19 nt, Human
ucucugcugggcagcuggg

SEQ ID NO: 1262543 - RNA, 26 nt, Human
ucugcaaggaagcugcccugcugaag

SEQ ID NO: 1262544 - RNA, 20 nt, Human
ugcaagcugcagccuggauu

SEQ ID NO: 1262545 - RNA, 18 nt, Human
uggguccugcaagggagu

SEQ ID NO: 1262546 - RNA, 19 nt, Human
ugugauggacauauucuga

SEQ ID NO: 1262547 - RNA, 19 nt, Human
uguggaugguaccccugga

SEQ ID NO: 1262548 - RNA, 22 nt, Human
uguggaugguaccccuggaguu

SEQ ID NO: 1262549 - RNA, 20 nt, Human
ccuugcuucaucuuucuuuu

SEQ ID NO: 1262550 - RNA, 22 nt, Human
ccuugcuucaucuuucuuuuuu

SEQ ID NO: 1262551 - RNA, 18 nt, Human
cuuggaaacucuugccau

SEQ ID NO: 1262552 - RNA, 19 nt, Human
ggagaugaaguagggaaaa

SEQ ID NO: 1262553 - RNA, 18 nt, Human
uccaggguucuauccuug

SEQ ID NO: 1262554 - RNA, 18 nt, Human
ucuuucuuuuuuaaaaau

SEQ ID NO: 1262555 - RNA, 19 nt, Human
uggcugaaguauccguauu

SEQ ID NO: 1262556 - RNA, 23 nt, Human
uguuccaucucuccuugucuuca

SEQ ID NO: 1262557 - RNA, 21 nt, Human
uuggaaacucuugccauuugg

SEQ ID NO: 1262558 - RNA, 24 nt, Human
uuuuaaaaauucccucucaggaau

SEQ ID NO: 1262559 - RNA, 18 nt, Human
aaguggucucugaagagg

SEQ ID NO: 1262560 - RNA, 19 nt, Human
agaaguggucucugaagag

SEQ ID NO: 1262561 - RNA, 21 nt, Human
agacaaggaugucucccaggg

SEQ ID NO: 1262562 - RNA, 21 nt, Human
cacacuggaagugucccccau

SEQ ID NO: 1262563 - RNA, 26 nt, Human
ccagugauagagggucugcucucccc

SEQ ID NO: 1262564 - RNA, 22 nt, Human
cccacaaaccaacacacaagcu

SEQ ID NO: 1262565 - RNA, 24 nt, Human
ccccacucuggcaugcacacugga

SEQ ID NO: 1262566 - RNA, 23 nt, Human
cccccaucuuuccuuuuccccac

SEQ ID NO: 1262567 - RNA, 24 nt, Human
cccccaucuuuccuuuuccccaca

SEQ ID NO: 1262568 - RNA, 24 nt, Human
uaaacuggggucccuuccuccauc

SEQ ID NO: 1262569 - RNA, 20 nt, Human
uccccacaaaccaacacaca

SEQ ID NO: 1262570 - RNA, 26 nt, Human
ucugaagaggugaauaaacugggguc

SEQ ID NO: 1262571 - RNA, 23 nt, Human
ugagaaguggucucugaagaggu

SEQ ID NO: 1262572 - RNA, 19 nt, Human
ugcacacuggaaguguccc

SEQ ID NO: 1262573 - RNA, 21 nt, Human
uugcaaagacaaggaugucuc

SEQ ID NO: 1262574 - RNA, 18 nt, Human
uuguaauguccuccuaca

SEQ ID NO: 1262575 - RNA, 23 nt, Human
uuuccccacaaaccaacacacaa

SEQ ID NO: 1262576 - RNA, 21 nt, Human
cucaccaguuuucuugauuuu

SEQ ID NO: 1262577 - RNA, 19 nt, Human
guugagcugaggugaaggg

SEQ ID NO: 1262578 - RNA, 18 nt, Human
uaccccaagguaucucac

SEQ ID NO: 1262579 - RNA, 22 nt, Human
ucaccaguuuucuugauuuuag

SEQ ID NO: 1262580 - RNA, 18 nt, Human
ugaggugaagggugaaca

SEQ ID NO: 1262581 - RNA, 23 nt, Human
uuauaugcagguuucucuacccc

SEQ ID NO: 1262582 - RNA, 19 nt, Human
uucuugauuuuagaaguug

SEQ ID NO: 1262583 - RNA, 24 nt, Human
acuaacacauccaccuuggcaaaa

SEQ ID NO: 1262584 - RNA, 21 nt, Human
agcaggcuguacagcagcagc

SEQ ID NO: 1262585 - RNA, 20 nt, Human
agguaugcucaaagaucuau

SEQ ID NO: 1262586 - RNA, 22 nt, Human
aguugcuucuucuuauuucuac

SEQ ID NO: 1262587 - RNA, 26 nt, Human
caccaaggagacugcagucaaauaaa

SEQ ID NO: 1262588 - RNA, 18 nt, Human
caccaccugugccucugc

SEQ ID NO: 1262589 - RNA, 18 nt, Human
caccaccugugccucugc

SEQ ID NO: 1262590 - RNA, 18 nt, Human
cacgacaggucaguaugu

SEQ ID NO: 1262591 - RNA, 18 nt, Human
ccccugcugcugggucaa

SEQ ID NO: 1262592 - RNA, 18 nt, Human
ccucuacugccugccacc

SEQ ID NO: 1262593 - RNA, 22 nt, Human
cgaaaaguacugaaaaugcuau

SEQ ID NO: 1262594 - RNA, 26 nt, Human
cgccucuacugccugccaccaccugu

SEQ ID NO: 1262595 - RNA, 21 nt, Human
cuacugccugccaccaccugu

SEQ ID NO: 1262596 - RNA, 24 nt, Human
cuagcugaauuugugauuuccuuu

SEQ ID NO: 1262597 - RNA, 24 nt, Human
cucacagcuuuggccacgcacucc

SEQ ID NO: 1262598 - RNA, 22 nt, Human
cuccugccauccuguccucagc

SEQ ID NO: 1262599 - RNA, 20 nt, Human
gacuugggcaauguggccag

SEQ ID NO: 1262600 - RNA, 21 nt, Human
gggcaauguggccaggagggc

SEQ ID NO: 1262601 - RNA, 20 nt, Human
ggucagaaaaaucaacauuu

SEQ ID NO: 1262602 - RNA, 22 nt, Human
gugcacacgacaggucaguaug

SEQ ID NO: 1262603 - RNA, 27 nt, Human
uaaauacauaauacagaagccugugug

SEQ ID NO: 1262604 - RNA, 19 nt, Human
uaugucuuauggucagaaa

SEQ ID NO: 1262605 - RNA, 19 nt, Human
uauuuuucccauuuuguuu

SEQ ID NO: 1262606 - RNA, 20 nt, Human
ucccggucacgaaccuggug

SEQ ID NO: 1262607 - RNA, 18 nt, Human
uccuaggccgaggcuaug

SEQ ID NO: 1262608 - RNA, 21 nt, Human
uccucagcuccugccuuccuc

SEQ ID NO: 1262609 - RNA, 21 nt, Human
ugaaaaugcuauuacuagcug

SEQ ID NO: 1262610 - RNA, 22 nt, Human
ugaguuauccuuauuuuuccca

SEQ ID NO: 1262611 - RNA, 24 nt, Human
ugaguuauccuuauuuuucccauu

SEQ ID NO: 1262612 - RNA, 19 nt, Human
ugccaccaccugugccucu

SEQ ID NO: 1262613 - RNA, 21 nt, Human
ugccugccaccaccugugccu

SEQ ID NO: 1262614 - RNA, 21 nt, Human
ugggucaaacucgaggcugac

SEQ ID NO: 1262615 - RNA, 18 nt, Human
uguccuaggccgaggcua

SEQ ID NO: 1262616 - RNA, 23 nt, Human
ugugauaugaugagguaucucca

SEQ ID NO: 1262617 - RNA, 24 nt, Human
uuauggucagaaaaaucaacauuu

SEQ ID NO: 1262618 - RNA, 21 nt, Human
uuccucuggaauauugugcuu

SEQ ID NO: 1262619 - RNA, 22 nt, Human
uuggcagaaggguuaaacucca

SEQ ID NO: 1262620 - RNA, 21 nt, Human
aaaaugccccccccccgagac

SEQ ID NO: 1262621 - RNA, 18 nt, Human
aaagcuaaaauaaucaca

SEQ ID NO: 1262622 - RNA, 20 nt, Human
aacauccucacugcacagaa

SEQ ID NO: 1262623 - RNA, 18 nt, Human
aagaacauuuugacacag

SEQ ID NO: 1262624 - RNA, 23 nt, Human
aagguaaacagauguauuagcca

SEQ ID NO: 1262625 - RNA, 19 nt, Human
acucugccaccacuuuucc

SEQ ID NO: 1262626 - RNA, 22 nt, Human
acugcagcugccuagggcuggc

SEQ ID NO: 1262627 - RNA, 25 nt, Human
acugcuuuuugaagaugauguggaa

SEQ ID NO: 1262628 - RNA, 19 nt, Human
agccgguuuuuuuuuuuuu

SEQ ID NO: 1262629 - RNA, 21 nt, Human
aggagaaugagucacucugcc

SEQ ID NO: 1262630 - RNA, 24 nt, Human
agucaccacuuuggcugaucuaaa

SEQ ID NO: 1262631 - RNA, 24 nt, Human
auuggguuuaauauucauaacaau

SEQ ID NO: 1262632 - RNA, 21 nt, Human
caaaagcaacagacugugaua

SEQ ID NO: 1262633 - RNA, 19 nt, Human
caacugcuacacauucaaa

SEQ ID NO: 1262634 - RNA, 21 nt, Human
caccuugugcccuuucugcug

SEQ ID NO: 1262635 - RNA, 26 nt, Human
cacgcugugaaauguaaccuccugug

SEQ ID NO: 1262636 - RNA, 19 nt, Human
cacucugccaccacuuuuc

SEQ ID NO: 1262637 - RNA, 20 nt, Human
cacucugccaccacuuuucc

SEQ ID NO: 1262638 - RNA, 21 nt, Human
cacucugccaccacuuuuccu

SEQ ID NO: 1262639 - RNA, 24 nt, Human
cauuacuguuccaaaaaguaaagg

SEQ ID NO: 1262640 - RNA, 22 nt, Human
cauucaaagaacaggcauucac

SEQ ID NO: 1262641 - RNA, 26 nt, Human
cauugggugggagguccucugcugga

SEQ ID NO: 1262642 - RNA, 23 nt, Human
ccaggcucuuuuuagcaccgugg

SEQ ID NO: 1262643 - RNA, 22 nt, Human
cccacauguguaagcuggaaaa

SEQ ID NO: 1262644 - RNA, 18 nt, Human
cccccgagacucgucagg

SEQ ID NO: 1262645 - RNA, 22 nt, Human
ccugcuuauaggccaugaaaau

SEQ ID NO: 1262646 - RNA, 22 nt, Human
cucugccaccacuuuuccugcc

SEQ ID NO: 1262647 - RNA, 18 nt, Human
cucugggcuacuuugugu

SEQ ID NO: 1262648 - RNA, 28 nt, Human
cugcagcccuggagaagguugggcuuug

SEQ ID NO: 1262649 - RNA, 22 nt, Human
cugcugcccuggcgccaccuug

SEQ ID NO: 1262650 - RNA, 23 nt, Human
cugcugcugggggucucauuggc

SEQ ID NO: 1262651 - RNA, 22 nt, Human
cuggacuuaggcuggugggguu

SEQ ID NO: 1262652 - RNA, 19 nt, Human
cuggcccugcugcccuggc

SEQ ID NO: 1262653 - RNA, 18 nt, Human
cuggcuuugugugggcag

SEQ ID NO: 1262654 - RNA, 22 nt, Human
cugggugauagggaaagguaaa

SEQ ID NO: 1262655 - RNA, 20 nt, Human
cuucguuucccucgguugcu

SEQ ID NO: 1262656 - RNA, 27 nt, Human
cuucuggaaacauccucacugcacaga

SEQ ID NO: 1262657 - RNA, 22 nt, Human
cuucuggccaucauuauccauu

SEQ ID NO: 1262658 - RNA, 21 nt, Human
gagaaucauggggaacagaga

SEQ ID NO: 1262659 - RNA, 18 nt, Human
gaggaugcucagcccugc

SEQ ID NO: 1262660 - RNA, 20 nt, Human
gccugugguuugaccuggga

SEQ ID NO: 1262661 - RNA, 21 nt, Human
gcugcugggggucucauuggc

SEQ ID NO: 1262662 - RNA, 18 nt, Human
gcuggacuuaggcuggug

SEQ ID NO: 1262663 - RNA, 22 nt, Human
gcugggggucucauuggcucag

SEQ ID NO: 1262664 - RNA, 20 nt, Human
ggcaggaggaugcucagccc

SEQ ID NO: 1262665 - RNA, 22 nt, Human
ggcaggaggaugcucagcccug

SEQ ID NO: 1262666 - RNA, 20 nt, Human
gggcaucccuugggugggcc

SEQ ID NO: 1262667 - RNA, 20 nt, Human
guaauggcuguacuagaagc

SEQ ID NO: 1262668 - RNA, 23 nt, Human
gugggguugcucugggcugcagc

SEQ ID NO: 1262669 - RNA, 19 nt, Human
guguaagcuggaaaaaucc

SEQ ID NO: 1262670 - RNA, 18 nt, Human
uaaaaaugcccccccccc

SEQ ID NO: 1262671 - RNA, 19 nt, Human
uaaaaaugccccccccccg

SEQ ID NO: 1262672 - RNA, 19 nt, Human
uaagcuggaaaaauccacg

SEQ ID NO: 1262673 - RNA, 24 nt, Human
uacaaaaggaaagaaaauggcaca

SEQ ID NO: 1262674 - RNA, 22 nt, Human
uaccuuauaggagaaucauggg

SEQ ID NO: 1262675 - RNA, 26 nt, Human
uagaaaaagguaugugaaaaaauuag

SEQ ID NO: 1262676 - RNA, 18 nt, Human
uagcaaaccaaagcauga

SEQ ID NO: 1262677 - RNA, 20 nt, Human
uagccaaguuuuaaagaguu

SEQ ID NO: 1262678 - RNA, 19 nt, Human
uagcuucuggaaacauccu

SEQ ID NO: 1262679 - RNA, 21 nt, Human
ucagagugcuuaguaaacauc

SEQ ID NO: 1262680 - RNA, 22 nt, Human
uccuacaguuuaauuugcugcu

SEQ ID NO: 1262681 - RNA, 21 nt, Human
uccugccuuggauuuguagag

SEQ ID NO: 1262682 - RNA, 21 nt, Human
ucuuagagugucauuuguuuu

SEQ ID NO: 1262683 - RNA, 18 nt, Human
ugaccugggaaaggggcu

SEQ ID NO: 1262684 - RNA, 19 nt, Human
ugcccuggcgccaccuugu

SEQ ID NO: 1262685 - RNA, 21 nt, Human
ugcccuuucugcugcuggggg

SEQ ID NO: 1262686 - RNA, 18 nt, Human
ugccuggaacccaugaag

SEQ ID NO: 1262687 - RNA, 18 nt, Human
ugcuggacuuaggcuggu

SEQ ID NO: 1262688 - RNA, 20 nt, Human
ugcuuaguaaacaucagugg

SEQ ID NO: 1262689 - RNA, 24 nt, Human
uggagaagguugggcuuugggcau

SEQ ID NO: 1262690 - RNA, 26 nt, Human
ugggaaaggggcuugugucuggguga

SEQ ID NO: 1262691 - RNA, 19 nt, Human
ugggagggacaggagaaug

SEQ ID NO: 1262692 - RNA, 18 nt, Human
uguaauggcuguacuaga

SEQ ID NO: 1262693 - RNA, 21 nt, Human
uguaauggcuguacuagaagc

SEQ ID NO: 1262694 - RNA, 18 nt, Human
uguacaaaagcaacagac

SEQ ID NO: 1262695 - RNA, 21 nt, Human
uguaggaagaaaaguagccuc

SEQ ID NO: 1262696 - RNA, 21 nt, Human
uguagggauagccacacacug

SEQ ID NO: 1262697 - RNA, 18 nt, Human
uguauuagccacuggcuu

SEQ ID NO: 1262698 - RNA, 24 nt, Human
ugucaggaaaacaaacuuaaaaaa

SEQ ID NO: 1262699 - RNA, 28 nt, Human
ugucaggaaaacaaacuuaaaaaauuuc

SEQ ID NO: 1262700 - RNA, 19 nt, Human
ugugcccuuucugcugcug

SEQ ID NO: 1262701 - RNA, 19 nt, Human
uguguaagcuggaaaaauc

SEQ ID NO: 1262702 - RNA, 25 nt, Human
uucucauaugaaacuguaauggcug

SEQ ID NO: 1262703 - RNA, 19 nt, Human
uucuuuggaggauuuaaaa

SEQ ID NO: 1262704 - RNA, 23 nt, Human
uugcugcuuuugugguuucugug

SEQ ID NO: 1262705 - RNA, 22 nt, Human
uuguuuuuccuauaucugcccu

SEQ ID NO: 1262706 - RNA, 19 nt, Human
uuuaccugucgaaccccaa

SEQ ID NO: 1262707 - RNA, 24 nt, Human
uuuauacaauuuauuggguuuaau

SEQ ID NO: 1262708 - RNA, 28 nt, Human
uuugacacaguuuuagccgguuuuuuuu

SEQ ID NO: 1262709 - RNA, 18 nt, Human
uuugaccugggaaagggg

SEQ ID NO: 1262710 - RNA, 19 nt, Human
uuugaggaugcauugaugu

SEQ ID NO: 1262711 - RNA, 20 nt, Human
uuugugugggcagcuguguu

SEQ ID NO: 1262712 - RNA, 21 nt, Human
uuuuuuguaaagcuaaaauaa

SEQ ID NO: 1262713 - RNA, 19 nt, Human
uuuuuuuuuuuuuugagga

SEQ ID NO: 1262714 - RNA, 18 nt, Human
uuuuuuuuuuuuuuuuug

SEQ ID NO: 1262715 - RNA, 21 nt, Human
uuuuuuuuuuuuuuuuugagg

SEQ ID NO: 1262716 - RNA, 21 nt, Human
aaacacaauaacaaauggaca

SEQ ID NO: 1262717 - RNA, 22 nt, Human
aaacugacaagguauggaaaac

SEQ ID NO: 1262718 - RNA, 20 nt, Human
aaauggacaucugauuggga

SEQ ID NO: 1262719 - RNA, 21 nt, Human
aacacaauaacaaauggacau

SEQ ID NO: 1262720 - RNA, 25 nt, Human
aacccuauucuuucaauagcaaauc

SEQ ID NO: 1262721 - RNA, 22 nt, Human
aaccuuucagucauagcaauuc

SEQ ID NO: 1262722 - RNA, 21 nt, Human
aagaaacaaaauggcuggaua

SEQ ID NO: 1262723 - RNA, 19 nt, Human
aaugucauuauuuaugacc

SEQ ID NO: 1262724 - RNA, 22 nt, Human
acauguaggacaauuucuacug

SEQ ID NO: 1262725 - RNA, 23 nt, Human
agcauugaaaguuuacugcaacu

SEQ ID NO: 1262726 - RNA, 19 nt, Human
agcuuuuaugaaagacaag

SEQ ID NO: 1262727 - RNA, 22 nt, Human
agugcaaaagcccauuauaaug

SEQ ID NO: 1262728 - RNA, 19 nt, Human
auaaaguuuuaauuaggac

SEQ ID NO: 1262729 - RNA, 19 nt, Human
auggcaaacauguucaaga

SEQ ID NO: 1262730 - RNA, 20 nt, Human
augguaacugaaauaaagua

SEQ ID NO: 1262731 - RNA, 23 nt, Human
caacacugcacauuuaaaaaaaa

SEQ ID NO: 1262732 - RNA, 26 nt, Human
cauaaaauguaagcaaggcuucucaa

SEQ ID NO: 1262733 - RNA, 23 nt, Human
cauuuaaaaaaaaaaaaaaaaaa

SEQ ID NO: 1262734 - RNA, 24 nt, Human
gauuuucauuuuagguaacaauuu

SEQ ID NO: 1262735 - RNA, 23 nt, Human
gcaaacauguucaagaggagcua

SEQ ID NO: 1262736 - RNA, 21 nt, Human
gcacauuuaaaaaaaaaaaaa

SEQ ID NO: 1262737 - RNA, 18 nt, Human
gcugcugcacauccaaaa

SEQ ID NO: 1262738 - RNA, 19 nt, Human
ggcauaucaaauauaugau

SEQ ID NO: 1262739 - RNA, 19 nt, Human
guaagcaaggcuucucaaa

SEQ ID NO: 1262740 - RNA, 25 nt, Human
guaagcugcugcacauccaaaaagu

SEQ ID NO: 1262741 - RNA, 21 nt, Human
guauaauauauauuuauauau

SEQ ID NO: 1262742 - RNA, 21 nt, Human
gucuaagaaaauauuccagaa

SEQ ID NO: 1262743 - RNA, 22 nt, Human
guuagaauaguugucucuaacu

SEQ ID NO: 1262744 - RNA, 24 nt, Human
uaaaauguaagcaaggcuucucaa

SEQ ID NO: 1262745 - RNA, 21 nt, Human
uaaaggguuguuaacaaacac

SEQ ID NO: 1262746 - RNA, 20 nt, Human
uaaaguuuuaauuaggacuc

SEQ ID NO: 1262747 - RNA, 24 nt, Human
uaaauccuaagagcuuuguuaaaa

SEQ ID NO: 1262748 - RNA, 24 nt, Human
uaacacaaauguccuuuuuaauau

SEQ ID NO: 1262749 - RNA, 23 nt, Human
uaagaagugaaauugaagcccua

SEQ ID NO: 1262750 - RNA, 21 nt, Human
uaaguuuauaaccugugccac

SEQ ID NO: 1262751 - RNA, 22 nt, Human
uaaguuuauaaccugugccaca

SEQ ID NO: 1262752 - RNA, 21 nt, Human
uacaaaggacuugggauggua

SEQ ID NO: 1262753 - RNA, 23 nt, Human
uaggacaauuucuacugaaaaau

SEQ ID NO: 1262754 - RNA, 22 nt, Human
uauaaugucauuauuuaugacc

SEQ ID NO: 1262755 - RNA, 21 nt, Human
uauaccauuaagaaacaaaau

SEQ ID NO: 1262756 - RNA, 18 nt, Human
uauccuguacacaucaua

SEQ ID NO: 1262757 - RNA, 24 nt, Human
ucaaaacaugaaguugauuuucau

SEQ ID NO: 1262758 - RNA, 26 nt, Human
ucaaaaucaaaacccucauucagacc

SEQ ID NO: 1262759 - RNA, 20 nt, Human
uccagaaacucagagauuac

SEQ ID NO: 1262760 - RNA, 24 nt, Human
ucuaagaaaauauuccagaaacuc

SEQ ID NO: 1262761 - RNA, 25 nt, Human
ugaaacauucaaaaucaaaacccuc

SEQ ID NO: 1262762 - RNA, 22 nt, Human
ugaaagacaagguggcauauaa

SEQ ID NO: 1262763 - RNA, 23 nt, Human
ugaaaguuuacugcaacucuaau

SEQ ID NO: 1262764 - RNA, 19 nt, Human
ugugccacagcaaagaaug

SEQ ID NO: 1262765 - RNA, 20 nt, Human
uuaaaaaaaaaaaaaaaaaa

SEQ ID NO: 1262766 - RNA, 20 nt, Human
uuaaguuuauaaccugugcc

SEQ ID NO: 1262767 - RNA, 21 nt, Human
uuauaccauuaagaaacaaaa

SEQ ID NO: 1262768 - RNA, 22 nt, Human
uuccaaaggaaaaauaauaaca

SEQ ID NO: 1262769 - RNA, 28 nt, Human
uuccaaugacuacaccauaagguacccc

SEQ ID NO: 1262770 - RNA, 20 nt, Human
uugaaaguuuacugcaacuc

SEQ ID NO: 1262771 - RNA, 21 nt, Human
uuuacugcaacucuaauuucc

SEQ ID NO: 1262772 - RNA, 23 nt, Human
uuuauaccauuaagaaacaaaau

SEQ ID NO: 1262773 - RNA, 25 nt, Human
uuuuauuuuuuaaagcugaaacauu

SEQ ID NO: 1262774 - RNA, 23 nt, Human
aaaaaagagaauauacuguaugc

SEQ ID NO: 1262775 - RNA, 21 nt, Human
aaugguucccacaacgauuuu

SEQ ID NO: 1262776 - RNA, 22 nt, Human
agaacccaauugugggggcugc

SEQ ID NO: 1262777 - RNA, 20 nt, Human
aguuagauaaagaggaagaa

SEQ ID NO: 1262778 - RNA, 24 nt, Human
aguucaccucaaggucagaagcuc

SEQ ID NO: 1262779 - RNA, 21 nt, Human
caaaagaucccgacugucuuc

SEQ ID NO: 1262780 - RNA, 21 nt, Human
caguccaccaggaaaagaaau

SEQ ID NO: 1262781 - RNA, 19 nt, Human
caguucuaagugcaguccu

SEQ ID NO: 1262782 - RNA, 19 nt, Human
cauucagacaugucuguca

SEQ ID NO: 1262783 - RNA, 22 nt, Human
ccaccaggaaaagaaauccccc

SEQ ID NO: 1262784 - RNA, 20 nt, Human
ccuggaguucuuuuaauggu

SEQ ID NO: 1262785 - RNA, 18 nt, Human
cuucauucagacaugucu

SEQ ID NO: 1262786 - RNA, 25 nt, Human
gaaaagaaaucccccgcuggcugga

SEQ ID NO: 1262787 - RNA, 18 nt, Human
gccaaaaugcaguucuaa

SEQ ID NO: 1262788 - RNA, 21 nt, Human
uaaaauagagccuauuugucc

SEQ ID NO: 1262789 - RNA, 26 nt, Human
uaacauuagaaggcaauucaagacau

SEQ ID NO: 1262790 - RNA, 18 nt, Human
uacaguccaccaggaaaa

SEQ ID NO: 1262791 - RNA, 24 nt, Human
uacguauacuuuuagcguuuucag

SEQ ID NO: 1262792 - RNA, 21 nt, Human
uaguuagauaaagaggaagaa

SEQ ID NO: 1262793 - RNA, 21 nt, Human
ucagaggucgccaaaaugcag

SEQ ID NO: 1262794 - RNA, 26 nt, Human
uccaaaaauaauuuuguuaaguucac

SEQ ID NO: 1262795 - RNA, 22 nt, Human
uccaaguuuuuugcaugaagca

SEQ ID NO: 1262796 - RNA, 19 nt, Human
uccaccaggaaaagaaauc

SEQ ID NO: 1262797 - RNA, 21 nt, Human
ucuccuucagagaaaacugag

SEQ ID NO: 1262798 - RNA, 24 nt, Human
ucucuuccguguccuuuuauaaga

SEQ ID NO: 1262799 - RNA, 22 nt, Human
ugacagucauaaauaaagaaaa

SEQ ID NO: 1262800 - RNA, 19 nt, Human
ugcuuaagcaaaugugaga

SEQ ID NO: 1262801 - RNA, 22 nt, Human
ugguuuaaagucaauagggggc

SEQ ID NO: 1262802 - RNA, 23 nt, Human
uguaauauaguuagauaaagagg

SEQ ID NO: 1262803 - RNA, 19 nt, Human
aaagugcugggauuauagg

SEQ ID NO: 1262804 - RNA, 24 nt, Human
aaagugcugggauuauagguguga

SEQ ID NO: 1262805 - RNA, 18 nt, Human
aagugcugggauuauagg

SEQ ID NO: 1262806 - RNA, 26 nt, Human
aagugcugggauuauaggugugagcc

SEQ ID NO: 1262807 - RNA, 19 nt, Human
agaaggcuguuucagaagg

SEQ ID NO: 1262808 - RNA, 22 nt, Human
aggcaauccgccugccucggcc

SEQ ID NO: 1262809 - RNA, 24 nt, Human
aggcaauccgccugccucggccuc

SEQ ID NO: 1262810 - RNA, 18 nt, Human
agggagcagaguauucag

SEQ ID NO: 1262811 - RNA, 18 nt, Human
agggauucagcagugagg

SEQ ID NO: 1262812 - RNA, 18 nt, Human
aguagcugggacuacagg

SEQ ID NO: 1262813 - RNA, 19 nt, Human
aguagcugggacuacaggc

SEQ ID NO: 1262814 - RNA, 19 nt, Human
augggguuucaucguguug

SEQ ID NO: 1262815 - RNA, 24 nt, Human
augggguuucaucguguugcccag

SEQ ID NO: 1262816 - RNA, 24 nt, Human
auuuuuuguauuuuaguagagaug

SEQ ID NO: 1262817 - RNA, 22 nt, Human
caagcaauucuccugccucagc

SEQ ID NO: 1262818 - RNA, 21 nt, Human
cacugcaaccuccgccucccg

SEQ ID NO: 1262819 - RNA, 23 nt, Human
cacugcaaccuccgccucccggg

SEQ ID NO: 1262820 - RNA, 20 nt, Human
cagccuccugaguagcuggg

SEQ ID NO: 1262821 - RNA, 24 nt, Human
caucguguugcccagacugaucuu

SEQ ID NO: 1262822 - RNA, 27 nt, Human
caucguguugcccagacugaucuugaa

SEQ ID NO: 1262823 - RNA, 23 nt, Human
cccaggcuggagugauguggcau

SEQ ID NO: 1262824 - RNA, 23 nt, Human
cccggguucaagcaauucuccug

SEQ ID NO: 1262825 - RNA, 26 nt, Human
ccgccucccggguucaagcaauucuu

SEQ ID NO: 1262826 - RNA, 22 nt, Human
ccuaaagugcugggauuauagg

SEQ ID NO: 1262827 - RNA, 24 nt, Human
ccucccggguucaagcaauucucc

SEQ ID NO: 1262828 - RNA, 23 nt, Human
ccugaguagcugggacuacaggc

SEQ ID NO: 1262829 - RNA, 24 nt, Human
ccugaguagcugggacuacaggca

SEQ ID NO: 1262830 - RNA, 23 nt, Human
ccugccucagccuccugaguagc

SEQ ID NO: 1262831 - RNA, 21 nt, Human
ccugugauaucuguucuucuu

SEQ ID NO: 1262832 - RNA, 24 nt, Human
cguguugcccagacugaucuugaa

SEQ ID NO: 1262833 - RNA, 23 nt, Human
cuaaagugcugggauuauaggug

SEQ ID NO: 1262834 - RNA, 24 nt, Human
cuaaagugcugggauuauaggugu

SEQ ID NO: 1262835 - RNA, 24 nt, Human
cucacugcaaccuccgccucccgg

SEQ ID NO: 1262836 - RNA, 24 nt, Human
cucagccuccugaguagcugggac

SEQ ID NO: 1262837 - RNA, 21 nt, Human
cucaggcaauccgccugccuc

SEQ ID NO: 1262838 - RNA, 18 nt, Human
cuccucguauucagaagg

SEQ ID NO: 1262839 - RNA, 23 nt, Human
cugcaaccuccgccucccggguu

SEQ ID NO: 1262840 - RNA, 23 nt, Human
cugccucagccuccugaguagcu

SEQ ID NO: 1262841 - RNA, 24 nt, Human
cuggagugauguggcaugaucuug

SEQ ID NO: 1262842 - RNA, 21 nt, Human
cugggauuauaggugugagcc

SEQ ID NO: 1262843 - RNA, 19 nt, Human
cuguugcccaggcuggagu

SEQ ID NO: 1262844 - RNA, 18 nt, Human
cuguuggcaggcuucucc

SEQ ID NO: 1262845 - RNA, 20 nt, Human
cuugaacuccugagcucagg

SEQ ID NO: 1262846 - RNA, 18 nt, Human
cuuguucuguugcccagg

SEQ ID NO: 1262847 - RNA, 24 nt, Human
gacuacaggcacacgccaucaugc

SEQ ID NO: 1262848 - RNA, 22 nt, Human
gagaugggguuucaucguguug

SEQ ID NO: 1262849 - RNA, 24 nt, Human
gagcucaggcaauccgccugccuc

SEQ ID NO: 1262850 - RNA, 24 nt, Human
gaguagcugggacuacaggcacac

SEQ ID NO: 1262851 - RNA, 22 nt, Human
gaugggguuucaucguguugcc

SEQ ID NO: 1262852 - RNA, 18 nt, Human
gauuauaggugugagcca

SEQ ID NO: 1262853 - RNA, 22 nt, Human
gcaaccuccgccucccggguuc

SEQ ID NO: 1262854 - RNA, 23 nt, Human
gcccagcuaauuuuuuguauuuu

SEQ ID NO: 1262855 - RNA, 24 nt, Human
ggacuacaggcacacgccaucaug

SEQ ID NO: 1262856 - RNA, 22 nt, Human
gguucuuguucuguugcccagg

SEQ ID NO: 1262857 - RNA, 20 nt, Human
gugagccauagugcccagcc

SEQ ID NO: 1262858 - RNA, 18 nt, Human
guggcaugaucuuggcuc

SEQ ID NO: 1262859 - RNA, 20 nt, Human
uaaaaaguugagaagaugga

SEQ ID NO: 1262860 - RNA, 24 nt, Human
uaaagugcugggauuauaggugug

SEQ ID NO: 1262861 - RNA, 23 nt, Human
uaauuuuuuguauuuuaguagag

SEQ ID NO: 1262862 - RNA, 24 nt, Human
uacaggcacacgccaucaugccca

SEQ ID NO: 1262863 - RNA, 19 nt, Human
uaguagagaugggguuuca

SEQ ID NO: 1262864 - RNA, 24 nt, Human
uaguagagaugggguuucaucgug

SEQ ID NO: 1262865 - RNA, 18 nt, Human
ucaaagcccaggccauca

SEQ ID NO: 1262866 - RNA, 23 nt, Human
ucacugcaaccuccgccucccgg

SEQ ID NO: 1262867 - RNA, 24 nt, Human
ucacugcaaccuccgccucccggg

SEQ ID NO: 1262868 - RNA, 25 nt, Human
ucacugcaaccuccgccucccgggu

SEQ ID NO: 1262869 - RNA, 27 nt, Human
ucacugcaaccuccgccucccggguuc

SEQ ID NO: 1262870 - RNA, 23 nt, Human
ucagccuccugaguagcugggac

SEQ ID NO: 1262871 - RNA, 21 nt, Human
ucccggguucaagcaauucuc

SEQ ID NO: 1262872 - RNA, 24 nt, Human
ucccggguucaagcaauucuccug

SEQ ID NO: 1262873 - RNA, 24 nt, Human
uccgccucccggguucaagcaauu

SEQ ID NO: 1262874 - RNA, 24 nt, Human
uccuaaagugcugggauuauaggu

SEQ ID NO: 1262875 - RNA, 24 nt, Human
uccugaguagcugggacuacaggc

SEQ ID NO: 1262876 - RNA, 18 nt, Human
ucggccuccuaaagugcu

SEQ ID NO: 1262877 - RNA, 24 nt, Human
ucuccugccucagccuccugagua

SEQ ID NO: 1262878 - RNA, 25 nt, Human
ucuggaggggagagaaugagaugga

SEQ ID NO: 1262879 - RNA, 18 nt, Human
ucuguugcccaggcugga

SEQ ID NO: 1262880 - RNA, 22 nt, Human
ucuguugcccaggcuggaguga

SEQ ID NO: 1262881 - RNA, 23 nt, Human
ucuugaacuccugagcucaggca

SEQ ID NO: 1262882 - RNA, 22 nt, Human
ucuuguucuguugcccaggcug

SEQ ID NO: 1262883 - RNA, 23 nt, Human
ucuuguucuguugcccaggcugg

SEQ ID NO: 1262884 - RNA, 24 nt, Human
ucuuguucuguugcccaggcugga

SEQ ID NO: 1262885 - RNA, 24 nt, Human
ugaacuccugagcucaggcaaucc

SEQ ID NO: 1262886 - RNA, 21 nt, Human
ugagauggaguucaccagcag

SEQ ID NO: 1262887 - RNA, 22 nt, Human
ugagauggguucuuguucuguu

SEQ ID NO: 1262888 - RNA, 23 nt, Human
ugagauggguucuuguucuguug

SEQ ID NO: 1262889 - RNA, 24 nt, Human
ugaucuugaacuccugagcucagg

SEQ ID NO: 1262890 - RNA, 24 nt, Human
ugcccagacugaucuugaacuccu

SEQ ID NO: 1262891 - RNA, 21 nt, Human
ugcccaggcuggagugaugug

SEQ ID NO: 1262892 - RNA, 24 nt, Human
ugcccaggcuggagugauguggca

SEQ ID NO: 1262893 - RNA, 24 nt, Human
ugccucagccuccugaguagcugg

SEQ ID NO: 1262894 - RNA, 24 nt, Human
ugccucggccuccuaaagugcugg

SEQ ID NO: 1262895 - RNA, 18 nt, Human
uggaaacugaauccuccu

SEQ ID NO: 1262896 - RNA, 24 nt, Human
uggaggggagagaaugagauggag

SEQ ID NO: 1262897 - RNA, 24 nt, Human
uggagugauguggcaugaucuugg

SEQ ID NO: 1262898 - RNA, 19 nt, Human
uggcaugaucuuggcucac

SEQ ID NO: 1262899 - RNA, 21 nt, Human
uggcaugaucuuggcucacug

SEQ ID NO: 1262900 - RNA, 21 nt, Human
ugggacuacaggcacacgcca

SEQ ID NO: 1262901 - RNA, 22 nt, Human
ugggacuacaggcacacgccau

SEQ ID NO: 1262902 - RNA, 24 nt, Human
ugggacuacaggcacacgccauca

SEQ ID NO: 1262903 - RNA, 26 nt, Human
ugggacuacaggcacacgccaucaug

SEQ ID NO: 1262904 - RNA, 18 nt, Human
ugggauuauaggugugag

SEQ ID NO: 1262905 - RNA, 19 nt, Human
ugggauuauaggugugagc

SEQ ID NO: 1262906 - RNA, 21 nt, Human
ugggauuauaggugugagcca

SEQ ID NO: 1262907 - RNA, 21 nt, Human
ugggauuauaggugugagcca

SEQ ID NO: 1262908 - RNA, 21 nt, Human
ugggauuauaggugugagcca

SEQ ID NO: 1262909 - RNA, 22 nt, Human
ugggauuauaggugugagccau

SEQ ID NO: 1262910 - RNA, 24 nt, Human
uggguucuuguucuguugcccagg

SEQ ID NO: 1262911 - RNA, 24 nt, Human
uguucuguugcccaggcuggagug

SEQ ID NO: 1262912 - RNA, 18 nt, Human
uguugcccagacugaucu

SEQ ID NO: 1262913 - RNA, 22 nt, Human
uguugcccagacugaucuugaa

SEQ ID NO: 1262914 - RNA, 23 nt, Human
uguuucagaaggucacuguuggc

SEQ ID NO: 1262915 - RNA, 21 nt, Human
uuaaaaaguugagaagaugga

SEQ ID NO: 1262916 - RNA, 18 nt, Human
uuaguagagaugggguuu

SEQ ID NO: 1262917 - RNA, 20 nt, Human
uuaguagagaugggguuuca

SEQ ID NO: 1262918 - RNA, 24 nt, Human
uuaguagagaugggguuucaucgu

SEQ ID NO: 1262919 - RNA, 21 nt, Human
uucaagcaauucuccugccuc

SEQ ID NO: 1262920 - RNA, 24 nt, Human
uucaagcaauucuccugccucagc

SEQ ID NO: 1262921 - RNA, 24 nt, Human
uucuuguucuguugcccaggcugg

SEQ ID NO: 1262922 - RNA, 21 nt, Human
uugagauggguucuuguucug

SEQ ID NO: 1262923 - RNA, 19 nt, Human
uugcccaggcuggagugau

SEQ ID NO: 1262924 - RNA, 20 nt, Human
uuucuguguuaaaaaguuga

SEQ ID NO: 1262925 - RNA, 25 nt, Human
uuucuguguuaaaaaguugagaagg

SEQ ID NO: 1262926 - RNA, 22 nt, Human
uuuuaguagagaugggguuuca

SEQ ID NO: 1262927 - RNA, 20 nt, Human
uuuuuguauuuuaguagaga

SEQ ID NO: 1262928 - RNA, 26 nt, Human
aaaaauuaacugaaaaucuaaacuua

SEQ ID NO: 1262929 - RNA, 18 nt, Human
aagaaaggagggaaaaag

SEQ ID NO: 1262930 - RNA, 20 nt, Human
agaaauagacucuaaaauca

SEQ ID NO: 1262931 - RNA, 20 nt, Human
agccuguauccaagaauacu

SEQ ID NO: 1262932 - RNA, 20 nt, Human
auaacugaaguaccuaaagc

SEQ ID NO: 1262933 - RNA, 21 nt, Human
aucccaaucucuccccaugaa

SEQ ID NO: 1262934 - RNA, 27 nt, Human
auuacuagaagaaaggagggaaaaaga

SEQ ID NO: 1262935 - RNA, 22 nt, Human
caaucucuccccaugaaaagcc

SEQ ID NO: 1262936 - RNA, 19 nt, Human
cauaaacgacuacuucucg

SEQ ID NO: 1262937 - RNA, 24 nt, Human
caugaaaagccuacuucauaacug

SEQ ID NO: 1262938 - RNA, 22 nt, Human
ccaauacagggaaaucacuaga

SEQ ID NO: 1262939 - RNA, 19 nt, Human
ccaugaaaagccuacuuca

SEQ ID NO: 1262940 - RNA, 19 nt, Human
cuagaagaaaggagggaaa

SEQ ID NO: 1262941 - RNA, 18 nt, Human
uaaaaaaggugaagugga

SEQ ID NO: 1262942 - RNA, 25 nt, Human
uaaagcccaugaacugcauuacuag

SEQ ID NO: 1262943 - RNA, 23 nt, Human
uauggauacuucuuuguucuugg

SEQ ID NO: 1262944 - RNA, 19 nt, Human
uccccaugaaaagccuacu

SEQ ID NO: 1262945 - RNA, 21 nt, Human
ucuaaacuuaauauggauacu

SEQ ID NO: 1262946 - RNA, 18 nt, Human
ucucauagaaauagacuc

SEQ ID NO: 1262947 - RNA, 23 nt, Human
ugaaaagccuacuucauaacuga

SEQ ID NO: 1262948 - RNA, 23 nt, Human
ugaaguggacaaucaguauuuca

SEQ ID NO: 1262949 - RNA, 28 nt, Human
ugaaguggacaaucaguauuucaaaccc

SEQ ID NO: 1262950 - RNA, 21 nt, Human
uggagcauaaacgacuacuuc

SEQ ID NO: 1262951 - RNA, 18 nt, Human
uggauacuucuuuguucu

SEQ ID NO: 1262952 - RNA, 22 nt, Human
uucaaacccaauacagggaaau

SEQ ID NO: 1262953 - RNA, 31 nt, Human
aaacacagguucccccacguuccccccaccc

SEQ ID NO: 1262954 - RNA, 24 nt, Human
aaaggaacuguuaaacugaaaaag

SEQ ID NO: 1262955 - RNA, 23 nt, Human
aacggagugaaugcauagcuggu

SEQ ID NO: 1262956 - RNA, 27 nt, Human
aagcaagaauagagugaaaagggaccc

SEQ ID NO: 1262957 - RNA, 23 nt, Human
aagcaguuuacaaacgaaacuca

SEQ ID NO: 1262958 - RNA, 19 nt, Human
aaggaacuguuaaacugaa

SEQ ID NO: 1262959 - RNA, 21 nt, Human
acagaugcauuugcuugaaaa

SEQ ID NO: 1262960 - RNA, 22 nt, Human
acagccuuuaaauuaaaaaccu

SEQ ID NO: 1262961 - RNA, 20 nt, Human
acguuccccccacccccgcc

SEQ ID NO: 1262962 - RNA, 21 nt, Human
acguuccccccacccccgccg

SEQ ID NO: 1262963 - RNA, 20 nt, Human
acuacugcaaagacgcgggc

SEQ ID NO: 1262964 - RNA, 27 nt, Human
agacacagacacagguccacuuuccaa

SEQ ID NO: 1262965 - RNA, 24 nt, Human
agacacagguccacuuuccaagca

SEQ ID NO: 1262966 - RNA, 22 nt, Human
agacaucugcucacuggaaacg

SEQ ID NO: 1262967 - RNA, 23 nt, Human
agaggccccaggcccacugagcc

SEQ ID NO: 1262968 - RNA, 18 nt, Human
agaugcauuugcuugaaa

SEQ ID NO: 1262969 - RNA, 20 nt, Human
agcaccugcucccgggcgac

SEQ ID NO: 1262970 - RNA, 21 nt, Human
aggagacccagccggccagcc

SEQ ID NO: 1262971 - RNA, 25 nt, Human
agguucccccacguuccccccaccc

SEQ ID NO: 1262972 - RNA, 19 nt, Human
augacagucuaaucuaaag

SEQ ID NO: 1262973 - RNA, 25 nt, Human
caaaaugggauguaagcuuguucau

SEQ ID NO: 1262974 - RNA, 23 nt, Human
caaagagcauucccaauagaaac

SEQ ID NO: 1262975 - RNA, 24 nt, Human
cacaaagagcauucccaauagaaa

SEQ ID NO: 1262976 - RNA, 24 nt, Human
cacagacuucaagcaguuuacaaa

SEQ ID NO: 1262977 - RNA, 24 nt, Human
cacggcauggcugaguaacagggu

SEQ ID NO: 1262978 - RNA, 20 nt, Human
cagaugugugccugaaugcc

SEQ ID NO: 1262979 - RNA, 19 nt, Human
caucaugcuccugccccuc

SEQ ID NO: 1262980 - RNA, 25 nt, Human
cauccccagccuugaagcucagcuc

SEQ ID NO: 1262981 - RNA, 21 nt, Human
ccaagcaagacaucugcucac

SEQ ID NO: 1262982 - RNA, 19 nt, Human
ccacugagcccgggaggag

SEQ ID NO: 1262983 - RNA, 25 nt, Human
cccaccauugacucggaagguuuuc

SEQ ID NO: 1262984 - RNA, 22 nt, Human
cccacguuccccccacccccgc

SEQ ID NO: 1262985 - RNA, 23 nt, Human
cccaggcccacugagcccgggag

SEQ ID NO: 1262986 - RNA, 18 nt, Human
cccccacccccgccggcc

SEQ ID NO: 1262987 - RNA, 21 nt, Human
cccccacguuccccccacccc

SEQ ID NO: 1262988 - RNA, 20 nt, Human
ccccccacccccgccggccc

SEQ ID NO: 1262989 - RNA, 23 nt, Human
ccccgccggcccgcguggccccc

SEQ ID NO: 1262990 - RNA, 23 nt, Human
cccggacucgcacuuccgucccc

SEQ ID NO: 1262991 - RNA, 22 nt, Human
ccgaccauaacccggucccacc

SEQ ID NO: 1262992 - RNA, 18 nt, Human
ccggcccgcguggccccc

SEQ ID NO: 1262993 - RNA, 23 nt, Human
ccggcccgcguggcccccgcgua

SEQ ID NO: 1262994 - RNA, 21 nt, Human
ccuacacacggcauggcugag

SEQ ID NO: 1262995 - RNA, 25 nt, Human
ccuugcaccagcccugcucauccuc

SEQ ID NO: 1262996 - RNA, 21 nt, Human
cgacuccgggcagcccgagac

SEQ ID NO: 1262997 - RNA, 22 nt, Human
cggguaagacccagcuucuguu

SEQ ID NO: 1262998 - RNA, 20 nt, Human
cucaaaaucuucacucaaaa

SEQ ID NO: 1262999 - RNA, 18 nt, Human
cucauagucauacagggc

SEQ ID NO: 1263000 - RNA, 25 nt, Human
cucauccccagccuugaagcucagc

SEQ ID NO: 1263001 - RNA, 19 nt, Human
cugaaaucugcaacuacug

SEQ ID NO: 1263002 - RNA, 20 nt, Human
cugcagcaccugcucccggg

SEQ ID NO: 1263003 - RNA, 22 nt, Human
cuugaagcucagcucaucaugc

SEQ ID NO: 1263004 - RNA, 23 nt, Human
cuugcccguuguccaagcguccc

SEQ ID NO: 1263005 - RNA, 18 nt, Human
cuuuagauucucugaaua

SEQ ID NO: 1263006 - RNA, 20 nt, Human
gacaaaggccggucagaagc

SEQ ID NO: 1263007 - RNA, 25 nt, Human
gagaggccccaggcccacugagccc

SEQ ID NO: 1263008 - RNA, 19 nt, Human
gagccaggacaaaggccgg

SEQ ID NO: 1263009 - RNA, 21 nt, Human
gaguucuaccuaagguucuau

SEQ ID NO: 1263010 - RNA, 20 nt, Human
gccccaggcccacugagccc

SEQ ID NO: 1263011 - RNA, 23 nt, Human
gcccugcucauccucguccucca

SEQ ID NO: 1263012 - RNA, 23 nt, Human
gccggcccgcguggcccccgcgu

SEQ ID NO: 1263013 - RNA, 18 nt, Human
gcugcagcaccugcuccc

SEQ ID NO: 1263014 - RNA, 23 nt, Human
ggacaaaggccggucagaagccg

SEQ ID NO: 1263015 - RNA, 20 nt, Human
ggaccagcagucagcuggug

SEQ ID NO: 1263016 - RNA, 21 nt, Human
ggagacccagccggccagcca

SEQ ID NO: 1263017 - RNA, 21 nt, Human
ggagaucguuuccucaagacu

SEQ ID NO: 1263018 - RNA, 19 nt, Human
ggccccaggcccacugagc

SEQ ID NO: 1263019 - RNA, 27 nt, Human
guaaagcuuccauucagaugcccaaaa

SEQ ID NO: 1263020 - RNA, 21 nt, Human
uaaacugaaaaagacuugaca

SEQ ID NO: 1263021 - RNA, 23 nt, Human
uaacacgacgacugaaaucugca

SEQ ID NO: 1263022 - RNA, 18 nt, Human
uaacccaccauugacucg

SEQ ID NO: 1263023 - RNA, 20 nt, Human
ucaaauaauauauacagaua

SEQ ID NO: 1263024 - RNA, 19 nt, Human
uccauucagaugcccaaaa

SEQ ID NO: 1263025 - RNA, 23 nt, Human
uccccagccuugaagcucagcuc

SEQ ID NO: 1263026 - RNA, 26 nt, Human
uccccagccuugaagcucagcucauc

SEQ ID NO: 1263027 - RNA, 22 nt, Human
uccguagcacagaaaugaggau

SEQ ID NO: 1263028 - RNA, 24 nt, Human
ucgugcugcggguaagacccagcu

SEQ ID NO: 1263029 - RNA, 23 nt, Human
ucuaaagcaucuuuacagaugca

SEQ ID NO: 1263030 - RNA, 21 nt, Human
ugacucggaaaggagagacaa

SEQ ID NO: 1263031 - RNA, 18 nt, Human
ugagucacgugaaacaca

SEQ ID NO: 1263032 - RNA, 24 nt, Human
ugcaacuacugcaaagacgcgggc

SEQ ID NO: 1263033 - RNA, 19 nt, Human
ugccacagacuucaagcag

SEQ ID NO: 1263034 - RNA, 21 nt, Human
ugcuacggagccaggacaaag

SEQ ID NO: 1263035 - RNA, 19 nt, Human
ugcucacuggaaacggagu

SEQ ID NO: 1263036 - RNA, 19 nt, Human
ugcuccugccccucauagu

SEQ ID NO: 1263037 - RNA, 23 nt, Human
uggcugcagcaccugcucccggg

SEQ ID NO: 1263038 - RNA, 21 nt, Human
uggugacggcggcgggcacug

SEQ ID NO: 1263039 - RNA, 21 nt, Human
uuaaaagcuguuaaaucucau

SEQ ID NO: 1263040 - RNA, 22 nt, Human
uuccccccacccccgccggccc

SEQ ID NO: 1263041 - RNA, 18 nt, Human
uuuuccucaaauacuaca

SEQ ID NO: 1263042 - RNA, 23 nt, Human
aaacgaaaaccuuacaguagucc

SEQ ID NO: 1263043 - RNA, 24 nt, Human
aacuccacaaccaaccucuaguau

SEQ ID NO: 1263044 - RNA, 23 nt, Human
aauaaauucaaacaagcuuaggc

SEQ ID NO: 1263045 - RNA, 22 nt, Human
acaaaacagcaagaaauacaaa

SEQ ID NO: 1263046 - RNA, 21 nt, Human
acacuauuuccaacuccacaa

SEQ ID NO: 1263047 - RNA, 29 nt, Human
acacuauuuccaacuccacaaccaaccuu

SEQ ID NO: 1263048 - RNA, 22 nt, Human
acagcuccagaagcaaaaucac

SEQ ID NO: 1263049 - RNA, 18 nt, Human
agcacaguccucuggcuu

SEQ ID NO: 1263050 - RNA, 21 nt, Human
aggcauaucaaguuuucaaag

SEQ ID NO: 1263051 - RNA, 21 nt, Human
aguccuugaauagcacagucc

SEQ ID NO: 1263052 - RNA, 22 nt, Human
caaaacacugggcugcucugua

SEQ ID NO: 1263053 - RNA, 21 nt, Human
caaagcgcagaaaaaggcaua

SEQ ID NO: 1263054 - RNA, 23 nt, Human
caacuccacaaccaaccucuagu

SEQ ID NO: 1263055 - RNA, 21 nt, Human
cacaaccaaccucuaguaucc

SEQ ID NO: 1263056 - RNA, 22 nt, Human
cacaaccaaccucuaguauccu

SEQ ID NO: 1263057 - RNA, 18 nt, Human
cacugcuaccaggaaaca

SEQ ID NO: 1263058 - RNA, 23 nt, Human
cagcaagaaauacaaauucucuu

SEQ ID NO: 1263059 - RNA, 24 nt, Human
cgaaguguucaaaauuggaaacac

SEQ ID NO: 1263060 - RNA, 22 nt, Human
cuuaaaaugcacaaaggagcuc

SEQ ID NO: 1263061 - RNA, 22 nt, Human
gcuccacagcuccagaagcaaa

SEQ ID NO: 1263062 - RNA, 24 nt, Human
uaguauccugaaaguggcacugcu

SEQ ID NO: 1263063 - RNA, 24 nt, Human
uccacagcuccagaagcaaaauca

SEQ ID NO: 1263064 - RNA, 20 nt, Human
ugacaaaacagcaagaaaua

SEQ ID NO: 1263065 - RNA, 21 nt, Human
ugacaaaacagcaagaaauac

SEQ ID NO: 1263066 - RNA, 20 nt, Human
ugcuaccaggaaacaaucgg

SEQ ID NO: 1263067 - RNA, 18 nt, Human
uggaaagcucugcgaagu

SEQ ID NO: 1263068 - RNA, 19 nt, Human
uggaaagcucugcgaagug

SEQ ID NO: 1263069 - RNA, 22 nt, Human
uguagaacgagugugacuuuac

SEQ ID NO: 1263070 - RNA, 21 nt, Human
uguucaaaauuggaaacacac

SEQ ID NO: 1263071 - RNA, 19 nt, Human
uucaaagcgcagaaaaagg

SEQ ID NO: 1263072 - RNA, 20 nt, Human
uucaaagcgcagaaaaaggc

SEQ ID NO: 1263073 - RNA, 26 nt, Human
uucuuuuuuucucauugucuuuugag

SEQ ID NO: 1263074 - RNA, 19 nt, Human
aaacuugggguccccaagc

SEQ ID NO: 1263075 - RNA, 18 nt, Human
aacuugggguccccaagc

SEQ ID NO: 1263076 - RNA, 19 nt, Human
acacagcacugccguccuc

SEQ ID NO: 1263077 - RNA, 18 nt, Human
acagaaucuucuucagag

SEQ ID NO: 1263078 - RNA, 20 nt, Human
acgggcccgcugagccgcgc

SEQ ID NO: 1263079 - RNA, 21 nt, Human
agacaggugagcagugccccc

SEQ ID NO: 1263080 - RNA, 18 nt, Human
agagguugauggugcugg

SEQ ID NO: 1263081 - RNA, 20 nt, Human
agagguugauggugcugguu

SEQ ID NO: 1263082 - RNA, 24 nt, Human
aggaggauuugguggaaacagcug

SEQ ID NO: 1263083 - RNA, 18 nt, Human
aggcagcugcccagccac

SEQ ID NO: 1263084 - RNA, 18 nt, Human
aguaucuugucccuggau

SEQ ID NO: 1263085 - RNA, 20 nt, Human
aucccacugaccggggagca

SEQ ID NO: 1263086 - RNA, 22 nt, Human
augaaauuggcaggugaggggg

SEQ ID NO: 1263087 - RNA, 19 nt, Human
cacagcacugccguccucu

SEQ ID NO: 1263088 - RNA, 25 nt, Human
cacagcgaugaagguggacgcgauc

SEQ ID NO: 1263089 - RNA, 20 nt, Human
cacauggacaagagcggcug

SEQ ID NO: 1263090 - RNA, 18 nt, Human
caccucagucacauccac

SEQ ID NO: 1263091 - RNA, 19 nt, Human
cacugaccggggagcagac

SEQ ID NO: 1263092 - RNA, 19 nt, Human
cagcagguuccccgccuuu

SEQ ID NO: 1263093 - RNA, 19 nt, Human
cagccggggcuccuccacg

SEQ ID NO: 1263094 - RNA, 20 nt, Human
cagcgaagaacucagagguc

SEQ ID NO: 1263095 - RNA, 22 nt, Human
caggggaagcccgucccccaau

SEQ ID NO: 1263096 - RNA, 21 nt, Human
caguagccagcagguuccccg

SEQ ID NO: 1263097 - RNA, 19 nt, Human
cagugcagugucuguggug

SEQ ID NO: 1263098 - RNA, 21 nt, Human
cagugucuguggugaucugac

SEQ ID NO: 1263099 - RNA, 22 nt, Human
cauccggaccuggccguccugg

SEQ ID NO: 1263100 - RNA, 25 nt, Human
ccaccauccggaccuggccguccug

SEQ ID NO: 1263101 - RNA, 19 nt, Human
ccacugaccggggagcaga

SEQ ID NO: 1263102 - RNA, 24 nt, Human
ccagcagcagacgggggccccaag

SEQ ID NO: 1263103 - RNA, 24 nt, Human
ccagugcagugucuguggugaucu

SEQ ID NO: 1263104 - RNA, 22 nt, Human
cccaaaguccucuuccucaucc

SEQ ID NO: 1263105 - RNA, 22 nt, Human
cccacugaccggggagcagacc

SEQ ID NO: 1263106 - RNA, 23 nt, Human
cccacugaccggggagcagaccu

SEQ ID NO: 1263107 - RNA, 21 nt, Human
cccagcagcucccaccaccau

SEQ ID NO: 1263108 - RNA, 22 nt, Human
ccccaaaguccucuuccucauc

SEQ ID NO: 1263109 - RNA, 20 nt, Human
ccccagcagcucccaccacc

SEQ ID NO: 1263110 - RNA, 18 nt, Human
ccugaaggucaagggagg

SEQ ID NO: 1263111 - RNA, 23 nt, Human
ccuuugaggauguugaggaugag

SEQ ID NO: 1263112 - RNA, 21 nt, Human
cgggugagugguguggucaga

SEQ ID NO: 1263113 - RNA, 19 nt, Human
cucacacucugcugaagcc

SEQ ID NO: 1263114 - RNA, 21 nt, Human
cugcccagccaccagccgugc

SEQ ID NO: 1263115 - RNA, 22 nt, Human
cuggagcacucaguagccagca

SEQ ID NO: 1263116 - RNA, 22 nt, Human
cuucucguucuccugaagguca

SEQ ID NO: 1263117 - RNA, 19 nt, Human
gaaagacaggaggauuugg

SEQ ID NO: 1263118 - RNA, 18 nt, Human
gaccuggccguccuggcc

SEQ ID NO: 1263119 - RNA, 18 nt, Human
gaggggggugccccaaac

SEQ ID NO: 1263120 - RNA, 19 nt, Human
gaguaucuugucccuggau

SEQ ID NO: 1263121 - RNA, 24 nt, Human
gcacaguaguuguucagguccuca

SEQ ID NO: 1263122 - RNA, 21 nt, Human
gccucuagcugguuucucugu

SEQ ID NO: 1263123 - RNA, 18 nt, Human
gcugguuucucugucucc

SEQ ID NO: 1263124 - RNA, 19 nt, Human
gcuugcaccacagcgauga

SEQ ID NO: 1263125 - RNA, 22 nt, Human
ggcagaagcuuguugugcagcc

SEQ ID NO: 1263126 - RNA, 25 nt, Human
gggaccggagcugggcagcgaagaa

SEQ ID NO: 1263127 - RNA, 19 nt, Human
gucucccucacacucugcu

SEQ ID NO: 1263128 - RNA, 18 nt, Human
gugacguugggcagaagc

SEQ ID NO: 1263129 - RNA, 19 nt, Human
gugccgggucuccagggcu

SEQ ID NO: 1263130 - RNA, 19 nt, Human
guggugaucugcgugcccc

SEQ ID NO: 1263131 - RNA, 24 nt, Human
uaaccggggucucccucacacucu

SEQ ID NO: 1263132 - RNA, 19 nt, Human
uagagguugauggugcugg

SEQ ID NO: 1263133 - RNA, 23 nt, Human
uagccacagaaucuucuucagag

SEQ ID NO: 1263134 - RNA, 19 nt, Human
uagcugguuucucugucuu

SEQ ID NO: 1263135 - RNA, 21 nt, Human
ucagccuugucugccuggagc

SEQ ID NO: 1263136 - RNA, 25 nt, Human
uccacaaacuugggguccccaagca

SEQ ID NO: 1263137 - RNA, 19 nt, Human
uccagccuggaugacggca

SEQ ID NO: 1263138 - RNA, 23 nt, Human
uccauucauuauugaacaggauc

SEQ ID NO: 1263139 - RNA, 20 nt, Human
uccccaagcaggguccucuu

SEQ ID NO: 1263140 - RNA, 19 nt, Human
ucccccaaaguccucuucc

SEQ ID NO: 1263141 - RNA, 20 nt, Human
ucccucugccucuagcuggu

SEQ ID NO: 1263142 - RNA, 22 nt, Human
ucuccacugucgugacguuggg

SEQ ID NO: 1263143 - RNA, 24 nt, Human
ucuccagggcugcagucacugccu

SEQ ID NO: 1263144 - RNA, 22 nt, Human
ucuccaguugaacucugcugug

SEQ ID NO: 1263145 - RNA, 23 nt, Human
ucucccgggagaaguuguacccu

SEQ ID NO: 1263146 - RNA, 18 nt, Human
ucugggaccggagcuggg

SEQ ID NO: 1263147 - RNA, 22 nt, Human
ugaggaaauaaccggggucucc

SEQ ID NO: 1263148 - RNA, 18 nt, Human
ugauggccagugcagugu

SEQ ID NO: 1263149 - RNA, 22 nt, Human
ugauggugcugguggcggacac

SEQ ID NO: 1263150 - RNA, 18 nt, Human
ugcagccggggcuccucc

SEQ ID NO: 1263151 - RNA, 19 nt, Human
ugcccccagcagcucccac

SEQ ID NO: 1263152 - RNA, 20 nt, Human
ugccuggagcacucaguagc

SEQ ID NO: 1263153 - RNA, 19 nt, Human
ugccugggguguuggccac

SEQ ID NO: 1263154 - RNA, 21 nt, Human
uggagcacucaguagccagca

SEQ ID NO: 1263155 - RNA, 21 nt, Human
uggaguccgaggcagcugccc

SEQ ID NO: 1263156 - RNA, 22 nt, Human
uggauugcuugucagccuuguc

SEQ ID NO: 1263157 - RNA, 22 nt, Human
uggcuggaugaaauuggcaggu

SEQ ID NO: 1263158 - RNA, 18 nt, Human
ugggugugauggugccgg

SEQ ID NO: 1263159 - RNA, 24 nt, Human
uggucagagaucugggaccggagc

SEQ ID NO: 1263160 - RNA, 19 nt, Human
uggugcugguggcggacac

SEQ ID NO: 1263161 - RNA, 21 nt, Human
ugguguggucagagaucuggg

SEQ ID NO: 1263162 - RNA, 25 nt, Human
uguagaacucgggcuuguaguagga

SEQ ID NO: 1263163 - RNA, 24 nt, Human
uguaguaggagaucgggugagugg

SEQ ID NO: 1263164 - RNA, 20 nt, Human
uguggucagagaucugggac

SEQ ID NO: 1263165 - RNA, 21 nt, Human
uguggucagagaucugggacc

SEQ ID NO: 1263166 - RNA, 20 nt, Human
uguugugcagccggggcucc

SEQ ID NO: 1263167 - RNA, 19 nt, Human
uucugcucgggggucuccc

SEQ ID NO: 1263168 - RNA, 19 nt, Human
uugaacaggaucccacuga

SEQ ID NO: 1263169 - RNA, 22 nt, Human
uugcggaccaccucagucacau

SEQ ID NO: 1263170 - RNA, 18 nt, Human
uuggugaugcugggagag

SEQ ID NO: 1263171 - RNA, 23 nt, Human
aagaacaucagggaaagaccaac

SEQ ID NO: 1263172 - RNA, 20 nt, Human
aagaauggcacgcaggguuu

SEQ ID NO: 1263173 - RNA, 24 nt, Human
aaugcuaaaggaugccagaaagaa

SEQ ID NO: 1263174 - RNA, 23 nt, Human
acaaaguaauaaacagugcgcac

SEQ ID NO: 1263175 - RNA, 22 nt, Human
acacaccugccagagcaggccc

SEQ ID NO: 1263176 - RNA, 21 nt, Human
acacacuguauccugcacaca

SEQ ID NO: 1263177 - RNA, 19 nt, Human
acucaugugauuaaaacag

SEQ ID NO: 1263178 - RNA, 21 nt, Human
acuuuccucuucugugagauu

SEQ ID NO: 1263179 - RNA, 21 nt, Human
aguaaaaaauaaaaaugcuaa

SEQ ID NO: 1263180 - RNA, 23 nt, Human
aguucucggccuuuaaacaacuc

SEQ ID NO: 1263181 - RNA, 22 nt, Human
auaagcccagagcacacacaaa

SEQ ID NO: 1263182 - RNA, 20 nt, Human
augaaacacacuguauccug

SEQ ID NO: 1263183 - RNA, 19 nt, Human
caacugcugcagcucauga

SEQ ID NO: 1263184 - RNA, 22 nt, Human
caccagaacaaaugaaacacac

SEQ ID NO: 1263185 - RNA, 19 nt, Human
caggagacagcugcacgau

SEQ ID NO: 1263186 - RNA, 23 nt, Human
caggcuccacauuguuguccagg

SEQ ID NO: 1263187 - RNA, 18 nt, Human
caucagggaaagaccaac

SEQ ID NO: 1263188 - RNA, 19 nt, Human
caucgagaaaggguacaac

SEQ ID NO: 1263189 - RNA, 21 nt, Human
caucgagaaaggguacaacug

SEQ ID NO: 1263190 - RNA, 21 nt, Human
ccagaaagaacaucagggaaa

SEQ ID NO: 1263191 - RNA, 19 nt, Human
ccagaacaaaugaaacaca

SEQ ID NO: 1263192 - RNA, 20 nt, Human
ccagaacaaaugaaacacac

SEQ ID NO: 1263193 - RNA, 19 nt, Human
ccugcacacaccugccaga

SEQ ID NO: 1263194 - RNA, 21 nt, Human
cgcuagaaaagguuuuccaca

SEQ ID NO: 1263195 - RNA, 18 nt, Human
cggccuuuaaacaacucu

SEQ ID NO: 1263196 - RNA, 18 nt, Human
cucccuggccgcuccugg

SEQ ID NO: 1263197 - RNA, 18 nt, Human
cucccuguucucggcugc

SEQ ID NO: 1263198 - RNA, 18 nt, Human
cugcacacaccugccaga

SEQ ID NO: 1263199 - RNA, 21 nt, Human
cugugcagugggguugucaug

SEQ ID NO: 1263200 - RNA, 23 nt, Human
guaaaaaauaaaaaugcuaaagg

SEQ ID NO: 1263201 - RNA, 19 nt, Human
uaaaaagcauggcagccug

SEQ ID NO: 1263202 - RNA, 24 nt, Human
uaaaaagcuccccaaaauguuaug

SEQ ID NO: 1263203 - RNA, 22 nt, Human
uaaauuagaaacacaaauaaau

SEQ ID NO: 1263204 - RNA, 19 nt, Human
uaagcccagagcacacaca

SEQ ID NO: 1263205 - RNA, 19 nt, Human
uacaaaguaauaaacagug

SEQ ID NO: 1263206 - RNA, 27 nt, Human
uacgcuagaaaagguuuuccacaucca

SEQ ID NO: 1263207 - RNA, 19 nt, Human
uaggauucaaucaaacgua

SEQ ID NO: 1263208 - RNA, 21 nt, Human
uaguuuugugcaaauaguggg

SEQ ID NO: 1263209 - RNA, 22 nt, Human
ucggccuuuaaacaacucuaaa

SEQ ID NO: 1263210 - RNA, 21 nt, Human
ugaagagcucacugugguuag

SEQ ID NO: 1263211 - RNA, 24 nt, Human
ugaauauaugugcugcaauaacau

SEQ ID NO: 1263212 - RNA, 26 nt, Human
ugaauauaugugcugcaauaacauuu

SEQ ID NO: 1263213 - RNA, 18 nt, Human
uggcaccagaacaaauga

SEQ ID NO: 1263214 - RNA, 21 nt, Human
uggcaccagaacaaaugaaac

SEQ ID NO: 1263215 - RNA, 19 nt, Human
ugggagccuuucauuccuc

SEQ ID NO: 1263216 - RNA, 23 nt, Human
ugggugcuccuagguguccugca

SEQ ID NO: 1263217 - RNA, 23 nt, Human
uguuaugacucccauccccaaua

SEQ ID NO: 1263218 - RNA, 18 nt, Human
uuuccaguucucggccuu

SEQ ID NO: 1263219 - RNA, 18 nt, Human
aacuccuagcccaguccc

SEQ ID NO: 1263220 - RNA, 19 nt, Human
aagcaagagguggcccugg

SEQ ID NO: 1263221 - RNA, 24 nt, Human
aaguccccucccagaucugugacc

SEQ ID NO: 1263222 - RNA, 21 nt, Human
acacguugcauuucucuuccu

SEQ ID NO: 1263223 - RNA, 22 nt, Human
acagcuucaccauuuugguuca

SEQ ID NO: 1263224 - RNA, 20 nt, Human
acagucccagaagggcccag

SEQ ID NO: 1263225 - RNA, 22 nt, Human
acccucccuguccucuccuggu

SEQ ID NO: 1263226 - RNA, 19 nt, Human
acccugauguccccacuuc

SEQ ID NO: 1263227 - RNA, 21 nt, Human
accuaugcaaccugcagcccc

SEQ ID NO: 1263228 - RNA, 22 nt, Human
acugaguccuggagguggucgu

SEQ ID NO: 1263229 - RNA, 20 nt, Human
acuuccaaguccugacuccu

SEQ ID NO: 1263230 - RNA, 18 nt, Human
acuugcaugacacuuccc

SEQ ID NO: 1263231 - RNA, 20 nt, Human
acuugcaugacacuucccuc

SEQ ID NO: 1263232 - RNA, 19 nt, Human
agaaagacaauaggcugcc

SEQ ID NO: 1263233 - RNA, 20 nt, Human
agaacccucccuguccucuc

SEQ ID NO: 1263234 - RNA, 22 nt, Human
agaacccucccuguccucuccu

SEQ ID NO: 1263235 - RNA, 21 nt, Human
agaggccaguguguguggggu

SEQ ID NO: 1263236 - RNA, 20 nt, Human
agagggaagccgggggaguu

SEQ ID NO: 1263237 - RNA, 27 nt, Human
agagggagggggggugggaaucugagc

SEQ ID NO: 1263238 - RNA, 20 nt, Human
agcaggcucacggaccuugg

SEQ ID NO: 1263239 - RNA, 22 nt, Human
agccuccccugcuccugccugc

SEQ ID NO: 1263240 - RNA, 19 nt, Human
aggagcagaggcgagucug

SEQ ID NO: 1263241 - RNA, 21 nt, Human
aggcagccagggcuggcagag

SEQ ID NO: 1263242 - RNA, 22 nt, Human
aggcagccagggcuggcagagc

SEQ ID NO: 1263243 - RNA, 19 nt, Human
agggcuggcagagccugcc

SEQ ID NO: 1263244 - RNA, 24 nt, Human
aucuuccuccccuuucccuuccaa

SEQ ID NO: 1263245 - RNA, 25 nt, Human
caaggacacacagcccccuucccuc

SEQ ID NO: 1263246 - RNA, 21 nt, Human
caccccgccugagggcucuac

SEQ ID NO: 1263247 - RNA, 20 nt, Human
cacugaguccuggagguggu

SEQ ID NO: 1263248 - RNA, 20 nt, Human
cagauguccuccuccaucuc

SEQ ID NO: 1263249 - RNA, 22 nt, Human
cagcacacccaagcuccugggc

SEQ ID NO: 1263250 - RNA, 22 nt, Human
cagcagcggcugcggcuaaagc

SEQ ID NO: 1263251 - RNA, 19 nt, Human
cagcccccaggcacuaccu

SEQ ID NO: 1263252 - RNA, 19 nt, Human
cagcccccuucccucccuc

SEQ ID NO: 1263253 - RNA, 20 nt, Human
cagguaccaucacagcugcu

SEQ ID NO: 1263254 - RNA, 23 nt, Human
cauccuccauuccguccaacucc

SEQ ID NO: 1263255 - RNA, 21 nt, Human
caugcaaggacacacagcccc

SEQ ID NO: 1263256 - RNA, 19 nt, Human
ccaaaaagaauggcaugca

SEQ ID NO: 1263257 - RNA, 19 nt, Human
ccacuuccaaguccugacu

SEQ ID NO: 1263258 - RNA, 24 nt, Human
ccagcaggcucacggaccuuggcc

SEQ ID NO: 1263259 - RNA, 23 nt, Human
ccagccccucuuuuccaggaacc

SEQ ID NO: 1263260 - RNA, 20 nt, Human
ccagcucccagccugggagu

SEQ ID NO: 1263261 - RNA, 21 nt, Human
ccaggaaccuugccacgccca

SEQ ID NO: 1263262 - RNA, 23 nt, Human
ccagggucccuucaguggacccu

SEQ ID NO: 1263263 - RNA, 18 nt, Human
ccaguguguguggggugg

SEQ ID NO: 1263264 - RNA, 23 nt, Human
ccaucuuccuccccuuucccuuc

SEQ ID NO: 1263265 - RNA, 18 nt, Human
cccaagcaagagguggcc

SEQ ID NO: 1263266 - RNA, 20 nt, Human
ccccagggaucacugagucc

SEQ ID NO: 1263267 - RNA, 20 nt, Human
ccccuuucccuuccagcccc

SEQ ID NO: 1263268 - RNA, 23 nt, Human
cccgccugagggcucuacucacc

SEQ ID NO: 1263269 - RNA, 19 nt, Human
cccggggcucccccgcggg

SEQ ID NO: 1263270 - RNA, 24 nt, Human
cccuccaucuuccuccccuuuccc

SEQ ID NO: 1263271 - RNA, 21 nt, Human
cccucuuuuccaggaaccuug

SEQ ID NO: 1263272 - RNA, 21 nt, Human
cccugccuuccccaggguccc

SEQ ID NO: 1263273 - RNA, 21 nt, Human
cccugcuccugccugcccacc

SEQ ID NO: 1263274 - RNA, 18 nt, Human
cccugggccaguggguug

SEQ ID NO: 1263275 - RNA, 22 nt, Human
cccuuccagccccucuuuucca

SEQ ID NO: 1263276 - RNA, 22 nt, Human
ccuccccuuucccuuccagccc

SEQ ID NO: 1263277 - RNA, 24 nt, Human
ccucccugccuuccccaggguccc

SEQ ID NO: 1263278 - RNA, 19 nt, Human
ccucccuguccucuccugg

SEQ ID NO: 1263279 - RNA, 22 nt, Human
ccugcccucccugccuucccca

SEQ ID NO: 1263280 - RNA, 19 nt, Human
ccugccugcccaccccgcc

SEQ ID NO: 1263281 - RNA, 23 nt, Human
ccugcucacuguccagauguccu

SEQ ID NO: 1263282 - RNA, 18 nt, Human
ccugcuccugccugccca

SEQ ID NO: 1263283 - RNA, 22 nt, Human
cgcggagaaagacaauaggcug

SEQ ID NO: 1263284 - RNA, 20 nt, Human
cggccacuggaccacaggag

SEQ ID NO: 1263285 - RNA, 19 nt, Human
cggcucccggggcuccccc

SEQ ID NO: 1263286 - RNA, 22 nt, Human
cggucaucccacaacacacuuc

SEQ ID NO: 1263287 - RNA, 23 nt, Human
cuacugaagcacuacugccagcc

SEQ ID NO: 1263288 - RNA, 27 nt, Human
cucacuguccagauguccuccuccauc

SEQ ID NO: 1263289 - RNA, 21 nt, Human
cuccagccagccaucccuuac

SEQ ID NO: 1263290 - RNA, 19 nt, Human
cucccuccaucuuccuccc

SEQ ID NO: 1263291 - RNA, 21 nt, Human
cucccucuucugcuuuuccca

SEQ ID NO: 1263292 - RNA, 22 nt, Human
cuccuagcccagucccgggggc

SEQ ID NO: 1263293 - RNA, 20 nt, Human
cuccuccaucuccgugcggc

SEQ ID NO: 1263294 - RNA, 23 nt, Human
cuccugggcuauuggggcuccua

SEQ ID NO: 1263295 - RNA, 19 nt, Human
cugccgccuucuguccagc

SEQ ID NO: 1263296 - RNA, 22 nt, Human
cugccgcggagucucccucuuc

SEQ ID NO: 1263297 - RNA, 23 nt, Human
cuggaccucgguguccccaucug

SEQ ID NO: 1263298 - RNA, 24 nt, Human
cuggaucugcugugcagugggguu

SEQ ID NO: 1263299 - RNA, 19 nt, Human
cuggcagagccugcccccc

SEQ ID NO: 1263300 - RNA, 21 nt, Human
cuuaaguccccucccagaucu

SEQ ID NO: 1263301 - RNA, 21 nt, Human
cuuccuuucuucucgcugucc

SEQ ID NO: 1263302 - RNA, 23 nt, Human
cuuucccuuccagccccucuuuu

SEQ ID NO: 1263303 - RNA, 18 nt, Human
gaagagggaagccggggg

SEQ ID NO: 1263304 - RNA, 21 nt, Human
gacaauaggcugccucucccc

SEQ ID NO: 1263305 - RNA, 21 nt, Human
gaucuucagagagagggaggg

SEQ ID NO: 1263306 - RNA, 24 nt, Human
gcaaggcagccagggcuggcagag

SEQ ID NO: 1263307 - RNA, 25 nt, Human
gcccacacguugcauuucucuuccu

SEQ ID NO: 1263308 - RNA, 20 nt, Human
gcccccuucccucccuccca

SEQ ID NO: 1263309 - RNA, 20 nt, Human
gccugggugcuccuggggag

SEQ ID NO: 1263310 - RNA, 19 nt, Human
gcggcagcagcggcugcgg

SEQ ID NO: 1263311 - RNA, 22 nt, Human
gcggcucccggggcucccccgc

SEQ ID NO: 1263312 - RNA, 21 nt, Human
ggaaccuugccacgcccacac

SEQ ID NO: 1263313 - RNA, 22 nt, Human
ggaagauggggugaccacagaa

SEQ ID NO: 1263314 - RNA, 21 nt, Human
ggcagccagggcuggcagagc

SEQ ID NO: 1263315 - RNA, 18 nt, Human
ggcggcggcagcagcggc

SEQ ID NO: 1263316 - RNA, 22 nt, Human
ggcugggucccuggccagcacu

SEQ ID NO: 1263317 - RNA, 21 nt, Human
gggaagccgggggaguugagc

SEQ ID NO: 1263318 - RNA, 18 nt, Human
gggaaucugagcacagug

SEQ ID NO: 1263319 - RNA, 19 nt, Human
gggcucgucccaccugccg

SEQ ID NO: 1263320 - RNA, 22 nt, Human
ggggagguggaucuuccagucg

SEQ ID NO: 1263321 - RNA, 21 nt, Human
ggggcuccuagagugggcuca

SEQ ID NO: 1263322 - RNA, 20 nt, Human
gggucccuggccagcacuac

SEQ ID NO: 1263323 - RNA, 23 nt, Human
ggguggggaggaccgccacagcc

SEQ ID NO: 1263324 - RNA, 23 nt, Human
ggucugaacuguggguggacugc

SEQ ID NO: 1263325 - RNA, 18 nt, Human
gguggggaggaccgccac

SEQ ID NO: 1263326 - RNA, 22 nt, Human
gguggggaggaccgccacagcc

SEQ ID NO: 1263327 - RNA, 23 nt, Human
gucuuuuccucuggaccucggug

SEQ ID NO: 1263328 - RNA, 19 nt, Human
guucaagcaguguuccuuc

SEQ ID NO: 1263329 - RNA, 24 nt, Human
guuuaucucccuguucuugggagc

SEQ ID NO: 1263330 - RNA, 19 nt, Human
uacaggaagcagcugcugg

SEQ ID NO: 1263331 - RNA, 24 nt, Human
uagcuucucccuccaucuuccucc

SEQ ID NO: 1263332 - RNA, 20 nt, Human
uaggauaaaagccugagagu

SEQ ID NO: 1263333 - RNA, 25 nt, Human
uaggcugccucucccccggcggcgg

SEQ ID NO: 1263334 - RNA, 22 nt, Human
ucagcaggguucugggcaaugg

SEQ ID NO: 1263335 - RNA, 21 nt, Human
ucaguggacccugggcuuucu

SEQ ID NO: 1263336 - RNA, 19 nt, Human
uccacgcuaucagugaggc

SEQ ID NO: 1263337 - RNA, 27 nt, Human
uccagcgcacagucccagaagggcccc

SEQ ID NO: 1263338 - RNA, 23 nt, Human
ucccccgcgggccgagccgagac

SEQ ID NO: 1263339 - RNA, 22 nt, Human
ucccugccuuccccaggguccc

SEQ ID NO: 1263340 - RNA, 19 nt, Human
uccggccacuggaccacag

SEQ ID NO: 1263341 - RNA, 21 nt, Human
uccggccacuggaccacagga

SEQ ID NO: 1263342 - RNA, 19 nt, Human
uccgugcggcucccggggc

SEQ ID NO: 1263343 - RNA, 22 nt, Human
uccuagagugggcucaucagca

SEQ ID NO: 1263344 - RNA, 22 nt, Human
uccuuucuucucgcuguccucc

SEQ ID NO: 1263345 - RNA, 18 nt, Human
ucuacucaccacccugcu

SEQ ID NO: 1263346 - RNA, 26 nt, Human
ucuagcuucucccuccaucuuccucc

SEQ ID NO: 1263347 - RNA, 21 nt, Human
ucucccucuucugcuuuuccc

SEQ ID NO: 1263348 - RNA, 22 nt, Human
ucugcuuuucccagcaggaagg

SEQ ID NO: 1263349 - RNA, 20 nt, Human
ucugucaggcuugguggcug

SEQ ID NO: 1263350 - RNA, 21 nt, Human
ucugucaggcuugguggcugu

SEQ ID NO: 1263351 - RNA, 22 nt, Human
ugaccacagaagagggaagccg

SEQ ID NO: 1263352 - RNA, 20 nt, Human
ugacuccuuugagccauccc

SEQ ID NO: 1263353 - RNA, 20 nt, Human
ugagaaaaggcaguggggag

SEQ ID NO: 1263354 - RNA, 21 nt, Human
ugagaaaaggcaguggggagg

SEQ ID NO: 1263355 - RNA, 23 nt, Human
ugagaaaaggcaguggggaggug

SEQ ID NO: 1263356 - RNA, 22 nt, Human
ugccagggcagguauccagcuc

SEQ ID NO: 1263357 - RNA, 20 nt, Human
ugcccagagaggggccucug

SEQ ID NO: 1263358 - RNA, 23 nt, Human
ugccugggugcuccuggggaguc

SEQ ID NO: 1263359 - RNA, 20 nt, Human
ugcuccugccugcccacccc

SEQ ID NO: 1263360 - RNA, 26 nt, Human
uggauuuccuucagcuacccugaugu

SEQ ID NO: 1263361 - RNA, 20 nt, Human
ugggcuuucugacugcccag

SEQ ID NO: 1263362 - RNA, 19 nt, Human
uggggagaacccucccugu

SEQ ID NO: 1263363 - RNA, 21 nt, Human
ugugagccuccccugcuccug

SEQ ID NO: 1263364 - RNA, 18 nt, Human
ugugcuauucagccaagg

SEQ ID NO: 1263365 - RNA, 24 nt, Human
uuacagcuucaccauuuugguuca

SEQ ID NO: 1263366 - RNA, 20 nt, Human
uucagagagagggagggggg

SEQ ID NO: 1263367 - RNA, 23 nt, Human
uucaguggacccugggcuuucug

SEQ ID NO: 1263368 - RNA, 20 nt, Human
uuccguccaacuccuagccc

SEQ ID NO: 1263369 - RNA, 24 nt, Human
uuccuccccuuucccuuccagccc

SEQ ID NO: 1263370 - RNA, 19 nt, Human
uugaggagggggcuguggg

SEQ ID NO: 1263371 - RNA, 18 nt, Human
uugguggcuguugggugg

SEQ ID NO: 1263372 - RNA, 18 nt, Human
uugguucaagcaguguuc

SEQ ID NO: 1263373 - RNA, 19 nt, Human
uuuugaggagggggcugug

SEQ ID NO: 1263374 - RNA, 21 nt, Human
aacauuaaaaaagcauggcag

SEQ ID NO: 1263375 - RNA, 23 nt, Human
aagaacaucagggaaagaccaac

SEQ ID NO: 1263376 - RNA, 20 nt, Human
aagaauggcacgcaggguuu

SEQ ID NO: 1263377 - RNA, 24 nt, Human
aaugcuaaaggaugccagaaagaa

SEQ ID NO: 1263378 - RNA, 21 nt, Human
acaaaguaauaaacagugcuc

SEQ ID NO: 1263379 - RNA, 22 nt, Human
acacaccugccagagcaggccc

SEQ ID NO: 1263380 - RNA, 24 nt, Human
acauccugcucaccggcagcccca

SEQ ID NO: 1263381 - RNA, 19 nt, Human
acucaugugauuaaaacag

SEQ ID NO: 1263382 - RNA, 20 nt, Human
acucccauccccaauacaca

SEQ ID NO: 1263383 - RNA, 23 nt, Human
acugcccccuggcuuucauauac

SEQ ID NO: 1263384 - RNA, 18 nt, Human
acuucauaacauccugcu

SEQ ID NO: 1263385 - RNA, 21 nt, Human
acuuuccucuucugugagauu

SEQ ID NO: 1263386 - RNA, 18 nt, Human
agagcucacugugguuag

SEQ ID NO: 1263387 - RNA, 22 nt, Human
agcuagaaaagguuuuccacag

SEQ ID NO: 1263388 - RNA, 24 nt, Human
aggcuguuuccaguucuuggccuu

SEQ ID NO: 1263389 - RNA, 23 nt, Human
aguucuuggccuuuaaacaacuc

SEQ ID NO: 1263390 - RNA, 22 nt, Human
auccugcucaccggcagcccca

SEQ ID NO: 1263391 - RNA, 22 nt, Human
augagcccagagcacauacaaa

SEQ ID NO: 1263392 - RNA, 27 nt, Human
caacaccaacucuugcagcuccagcag

SEQ ID NO: 1263393 - RNA, 26 nt, Human
caacucuugcagcuccagcagcuuca

SEQ ID NO: 1263394 - RNA, 19 nt, Human
caacugcugcagcucauga

SEQ ID NO: 1263395 - RNA, 22 nt, Human
caccagaacaaaugaaacacac

SEQ ID NO: 1263396 - RNA, 20 nt, Human
caccggcagccccaaguucc

SEQ ID NO: 1263397 - RNA, 19 nt, Human
caggagacagcugcacgau

SEQ ID NO: 1263398 - RNA, 23 nt, Human
caggcuccacguuguuguccagg

SEQ ID NO: 1263399 - RNA, 19 nt, Human
caucaagaaaggguacaac

SEQ ID NO: 1263400 - RNA, 21 nt, Human
caucaagaaaggguacaacug

SEQ ID NO: 1263401 - RNA, 18 nt, Human
caucagggaaagaccaac

SEQ ID NO: 1263402 - RNA, 19 nt, Human
caucuccuccuccuucugg

SEQ ID NO: 1263403 - RNA, 19 nt, Human
cauuuuaucugaauucugg

SEQ ID NO: 1263404 - RNA, 21 nt, Human
ccagaaagaacaucagggaaa

SEQ ID NO: 1263405 - RNA, 19 nt, Human
ccagaacaaaugaaacaca

SEQ ID NO: 1263406 - RNA, 20 nt, Human
ccagaacaaaugaaacacac

SEQ ID NO: 1263407 - RNA, 18 nt, Human
ccagagcacauacaaauc

SEQ ID NO: 1263408 - RNA, 19 nt, Human
ccugcacacaccugccaga

SEQ ID NO: 1263409 - RNA, 18 nt, Human
ccuggggggcuggggccc

SEQ ID NO: 1263410 - RNA, 24 nt, Human
cgauaugcauacuaaugaccuaca

SEQ ID NO: 1263411 - RNA, 18 nt, Human
cuccagcagcuucaccuu

SEQ ID NO: 1263412 - RNA, 18 nt, Human
cucccuggccgcuccugg

SEQ ID NO: 1263413 - RNA, 18 nt, Human
cucccuguucucggcugc

SEQ ID NO: 1263414 - RNA, 18 nt, Human
cugaugacauccuccauc

SEQ ID NO: 1263415 - RNA, 18 nt, Human
cugcacacaccugccaga

SEQ ID NO: 1263416 - RNA, 22 nt, Human
cugcucaccggcagccccaagu

SEQ ID NO: 1263417 - RNA, 21 nt, Human
cuguacagugggguugucaug

SEQ ID NO: 1263418 - RNA, 19 nt, Human
cuucauaacauccugcucc

SEQ ID NO: 1263419 - RNA, 19 nt, Human
gagcacauacaaauccuaa

SEQ ID NO: 1263420 - RNA, 19 nt, Human
gagcccagagcacauacaa

SEQ ID NO: 1263421 - RNA, 22 nt, Human
gcacugcccccuggcuuucaua

SEQ ID NO: 1263422 - RNA, 20 nt, Human
gcucacuucauaacauccug

SEQ ID NO: 1263423 - RNA, 24 nt, Human
gcuggggccccuggagugggcuca

SEQ ID NO: 1263424 - RNA, 18 nt, Human
ggacucucucaugccguc

SEQ ID NO: 1263425 - RNA, 19 nt, Human
ggggcuggggccccuggag

SEQ ID NO: 1263426 - RNA, 22 nt, Human
uaaauuagaaacacaaauaaau

SEQ ID NO: 1263427 - RNA, 27 nt, Human
uaagcuagaaaagguuuuccacaucca

SEQ ID NO: 1263428 - RNA, 19 nt, Human
uacaaaguaauaaacagug

SEQ ID NO: 1263429 - RNA, 19 nt, Human
uagaagaauggcacgcagg

SEQ ID NO: 1263430 - RNA, 26 nt, Human
ucauaacauccugcucaccggcagcc

SEQ ID NO: 1263431 - RNA, 18 nt, Human
ucauagcagaacauaagc

SEQ ID NO: 1263432 - RNA, 18 nt, Human
ucaugguugcccacaagg

SEQ ID NO: 1263433 - RNA, 20 nt, Human
ucugaauucuggaaugaaua

SEQ ID NO: 1263434 - RNA, 24 nt, Human
ugaauauacaugcugcaauaacau

SEQ ID NO: 1263435 - RNA, 22 nt, Human
ugcaugacaggagacagcugca

SEQ ID NO: 1263436 - RNA, 21 nt, Human
ugccgcguguuuggcacugcc

SEQ ID NO: 1263437 - RNA, 20 nt, Human
ugccugguagaagaauggca

SEQ ID NO: 1263438 - RNA, 22 nt, Human
uggaaugaauauacaugcugca

SEQ ID NO: 1263439 - RNA, 18 nt, Human
uggcaccagaacaaauga

SEQ ID NO: 1263440 - RNA, 21 nt, Human
uggcaccagaacaaaugaaac

SEQ ID NO: 1263441 - RNA, 18 nt, Human
uggccuuuaaacaacucu

SEQ ID NO: 1263442 - RNA, 19 nt, Human
ugggagccuuucauuccuc

SEQ ID NO: 1263443 - RNA, 19 nt, Human
uggggccccuggagugggc

SEQ ID NO: 1263444 - RNA, 19 nt, Human
uggggccccuggagugggc

SEQ ID NO: 1263445 - RNA, 23 nt, Human
ugggugcuccuagguguccugca

SEQ ID NO: 1263446 - RNA, 22 nt, Human
uuaaaaauaaaaaugcuaaagg

SEQ ID NO: 1263447 - RNA, 23 nt, Human
uuccuggggggcuggggccccug

SEQ ID NO: 1263448 - RNA, 24 nt, Human
uuccuggggggcuggggccccugg

SEQ ID NO: 1263449 - RNA, 21 nt, Human
uugccaugccccucaugguug

SEQ ID NO: 1263450 - RNA, 21 nt, Human
uuggcacugcccccuggcuuu

SEQ ID NO: 1263451 - RNA, 22 nt, Human
uuggccuuuaaacaacucuaaa

SEQ ID NO: 1263452 - RNA, 18 nt, Human
aaaacaaagguguagaac

SEQ ID NO: 1263453 - RNA, 21 nt, Human
aaacaggccauagccaacucg

SEQ ID NO: 1263454 - RNA, 20 nt, Human
acaagaccacuguuaaaagc

SEQ ID NO: 1263455 - RNA, 19 nt, Human
accacuguuaaaagcccgg

SEQ ID NO: 1263456 - RNA, 18 nt, Human
accagccccagcuucccu

SEQ ID NO: 1263457 - RNA, 19 nt, Human
accaugguaggcauuaccg

SEQ ID NO: 1263458 - RNA, 18 nt, Human
acccagcacaucaccugg

SEQ ID NO: 1263459 - RNA, 19 nt, Human
acccaggcuggagugcagu

SEQ ID NO: 1263460 - RNA, 23 nt, Human
acccaggcuggagugcaguggug

SEQ ID NO: 1263461 - RNA, 20 nt, Human
accgcgccgcucccgccucc

SEQ ID NO: 1263462 - RNA, 18 nt, Human
acugcagccucaaccucc

SEQ ID NO: 1263463 - RNA, 18 nt, Human
agaaaaccccagccaugu

SEQ ID NO: 1263464 - RNA, 22 nt, Human
agaaaaccccagccaugucacc

SEQ ID NO: 1263465 - RNA, 19 nt, Human
agacccggggcucccggcg

SEQ ID NO: 1263466 - RNA, 20 nt, Human
agacccggggcucccggcgg

SEQ ID NO: 1263467 - RNA, 18 nt, Human
agcagcgcguucauccac

SEQ ID NO: 1263468 - RNA, 24 nt, Human
agcaguggcgagaggaagucaugg

SEQ ID NO: 1263469 - RNA, 21 nt, Human
aggccuaggcccuccaccccc

SEQ ID NO: 1263470 - RNA, 19 nt, Human
aggcggguuagcaguggcc

SEQ ID NO: 1263471 - RNA, 18 nt, Human
aggguuugggacccagca

SEQ ID NO: 1263472 - RNA, 20 nt, Human
aguagcugggacaaccaugc

SEQ ID NO: 1263473 - RNA, 20 nt, Human
agugcaguggugcgaucaug

SEQ ID NO: 1263474 - RNA, 23 nt, Human
agugcaguggugcgaucauggcu

SEQ ID NO: 1263475 - RNA, 24 nt, Human
agugcaguggugcgaucauggcuc

SEQ ID NO: 1263476 - RNA, 25 nt, Human
auucugucacccaggcuggagugca

SEQ ID NO: 1263477 - RNA, 22 nt, Human
caaaagcugcuugugucuaaaa

SEQ ID NO: 1263478 - RNA, 24 nt, Human
caacggcaccaacuauucgcggag

SEQ ID NO: 1263479 - RNA, 20 nt, Human
caacuauucgcggagcugga

SEQ ID NO: 1263480 - RNA, 19 nt, Human
caacucgccccucacccag

SEQ ID NO: 1263481 - RNA, 24 nt, Human
cacaagagguguggggagcggcag

SEQ ID NO: 1263482 - RNA, 21 nt, Human
caccaacggcaccaacuauuc

SEQ ID NO: 1263483 - RNA, 19 nt, Human
caccaacggcacugggacc

SEQ ID NO: 1263484 - RNA, 24 nt, Human
cacccaggcuggagugcaguggug

SEQ ID NO: 1263485 - RNA, 18 nt, Human
caccgcgccgcucccgcc

SEQ ID NO: 1263486 - RNA, 19 nt, Human
cacugcagccucaaccucc

SEQ ID NO: 1263487 - RNA, 26 nt, Human
cacugugcuugacuuugucgggcccg

SEQ ID NO: 1263488 - RNA, 23 nt, Human
cacuucugaaaguugcaccagcc

SEQ ID NO: 1263489 - RNA, 23 nt, Human
cagccucaaccuccugggcgcaa

SEQ ID NO: 1263490 - RNA, 21 nt, Human
caguggugcgaucauggcuca

SEQ ID NO: 1263491 - RNA, 19 nt, Human
cauagccaacucgccccuc

SEQ ID NO: 1263492 - RNA, 23 nt, Human
cauagccaacucgccccucaccc

SEQ ID NO: 1263493 - RNA, 24 nt, Human
cauucugucacccaggcuggagug

SEQ ID NO: 1263494 - RNA, 23 nt, Human
ccaaaaaugccucugcgaauccc

SEQ ID NO: 1263495 - RNA, 23 nt, Human
ccacuucugaaaguugcaccagc

SEQ ID NO: 1263496 - RNA, 21 nt, Human
ccagugguacuccuaaugacu

SEQ ID NO: 1263497 - RNA, 19 nt, Human
cccagcacaucaccuggca

SEQ ID NO: 1263498 - RNA, 21 nt, Human
cccagcacaucaccuggcaca

SEQ ID NO: 1263499 - RNA, 18 nt, Human
cccccgcccgccgccgcc

SEQ ID NO: 1263500 - RNA, 23 nt, Human
cccccgggagccgggcgcagcuu

SEQ ID NO: 1263501 - RNA, 21 nt, Human
ccccgccccgaccucccgggc

SEQ ID NO: 1263502 - RNA, 22 nt, Human
ccccgccccgaccucccgggcu

SEQ ID NO: 1263503 - RNA, 22 nt, Human
ccccgcccgccgccgccuccuc

SEQ ID NO: 1263504 - RNA, 21 nt, Human
ccccggcugggggaggaaggc

SEQ ID NO: 1263505 - RNA, 22 nt, Human
ccccggggucucggcugagcgg

SEQ ID NO: 1263506 - RNA, 19 nt, Human
cccgccgccgccuccuccu

SEQ ID NO: 1263507 - RNA, 27 nt, Human
cccggggcugaagccgagacccggggc

SEQ ID NO: 1263508 - RNA, 25 nt, Human
ccgaugaccuuuucccggacuuccu

SEQ ID NO: 1263509 - RNA, 24 nt, Human
ccgcagagccccggggucucggcu

SEQ ID NO: 1263510 - RNA, 18 nt, Human
ccgcccgccgccgccucc

SEQ ID NO: 1263511 - RNA, 20 nt, Human
ccgccugcuccucgucgucc

SEQ ID NO: 1263512 - RNA, 20 nt, Human
ccgccugcuccucgucgucc

SEQ ID NO: 1263513 - RNA, 18 nt, Human
ccggcccgggaccccgcc

SEQ ID NO: 1263514 - RNA, 21 nt, Human
ccuaggcccuccacccccggg

SEQ ID NO: 1263515 - RNA, 20 nt, Human
ccuccuccuucuccuccuuc

SEQ ID NO: 1263516 - RNA, 18 nt, Human
ccuccuucuccuccuucu

SEQ ID NO: 1263517 - RNA, 19 nt, Human
ccuccuucuccuccuucuc

SEQ ID NO: 1263518 - RNA, 20 nt, Human
ccuccuucuccuccuucucc

SEQ ID NO: 1263519 - RNA, 24 nt, Human
ccuccuucucggcuuccuccucag

SEQ ID NO: 1263520 - RNA, 22 nt, Human
ccucgggcgggccgaggccuag

SEQ ID NO: 1263521 - RNA, 21 nt, Human
ccucgucguccucguccuccg

SEQ ID NO: 1263522 - RNA, 18 nt, Human
ccucuccccucccugcuu

SEQ ID NO: 1263523 - RNA, 22 nt, Human
ccugugcugcgggcucaggcgg

SEQ ID NO: 1263524 - RNA, 23 nt, Human
ccuguggcuuugcaggagcuccg

SEQ ID NO: 1263525 - RNA, 19 nt, Human
cgagaggaagucaugggug

SEQ ID NO: 1263526 - RNA, 19 nt, Human
cggcggcaccaacggcacc

SEQ ID NO: 1263527 - RNA, 21 nt, Human
cggcggcgcggccagcggagc

SEQ ID NO: 1263528 - RNA, 18 nt, Human
cggcuuccuccucagccc

SEQ ID NO: 1263529 - RNA, 21 nt, Human
cucacugcagccucaaccucc

SEQ ID NO: 1263530 - RNA, 24 nt, Human
cucacugcagccucaaccuccugg

SEQ ID NO: 1263531 - RNA, 24 nt, Human
cucauucugucacccaggcuggag

SEQ ID NO: 1263532 - RNA, 18 nt, Human
cuccccuucauccaccuc

SEQ ID NO: 1263533 - RNA, 21 nt, Human
cuccuccgccccggcuggggg

SEQ ID NO: 1263534 - RNA, 22 nt, Human
cuccuccuucuccuccuucucc

SEQ ID NO: 1263535 - RNA, 21 nt, Human
cucguccuccgcggccccggc

SEQ ID NO: 1263536 - RNA, 22 nt, Human
cucuccccucccugcuuguuca

SEQ ID NO: 1263537 - RNA, 18 nt, Human
cucugccuccugaguagc

SEQ ID NO: 1263538 - RNA, 21 nt, Human
cucuugccaaaaagcuuccaa

SEQ ID NO: 1263539 - RNA, 23 nt, Human
cugcaaaccuucuuucagguuuc

SEQ ID NO: 1263540 - RNA, 18 nt, Human
cugcacugagucuccucc

SEQ ID NO: 1263541 - RNA, 22 nt, Human
cugcagccucaaccuccugggc

SEQ ID NO: 1263542 - RNA, 21 nt, Human
cugccgccaccgccugcuccu

SEQ ID NO: 1263543 - RNA, 22 nt, Human
cugccgccaccgccugcuccuc

SEQ ID NO: 1263544 - RNA, 19 nt, Human
cuucauccaccucucucuc

SEQ ID NO: 1263545 - RNA, 19 nt, Human
cuucccccgcccgccgccg

SEQ ID NO: 1263546 - RNA, 18 nt, Human
gaacacagcuuggcaggc

SEQ ID NO: 1263547 - RNA, 23 nt, Human
gacccagcacaucaccuggcaca

SEQ ID NO: 1263548 - RNA, 19 nt, Human
gaccucccgggcuccgccu

SEQ ID NO: 1263549 - RNA, 23 nt, Human
gacgucgccuccccuucauccac

SEQ ID NO: 1263550 - RNA, 24 nt, Human
gagccgcagagccccggggucucg

SEQ ID NO: 1263551 - RNA, 22 nt, Human
gagcgggguguuggcggcggcc

SEQ ID NO: 1263552 - RNA, 23 nt, Human
gaggaagcguaagugauguccac

SEQ ID NO: 1263553 - RNA, 21 nt, Human
gaggaaggccgcggggaggcg

SEQ ID NO: 1263554 - RNA, 21 nt, Human
gagguguggggagcggcagca

SEQ ID NO: 1263555 - RNA, 19 nt, Human
gaucauggcucacugcagc

SEQ ID NO: 1263556 - RNA, 18 nt, Human
gcaccaacggcaccaacu

SEQ ID NO: 1263557 - RNA, 25 nt, Human
gcacugagucuccuccaaccggagg

SEQ ID NO: 1263558 - RNA, 18 nt, Human
gcagaaugccuuuguucc

SEQ ID NO: 1263559 - RNA, 19 nt, Human
gccauagccaacucgcccc

SEQ ID NO: 1263560 - RNA, 21 nt, Human
gccccgaccucccgggcuccg

SEQ ID NO: 1263561 - RNA, 21 nt, Human
gccgcagagccccggggucuc

SEQ ID NO: 1263562 - RNA, 19 nt, Human
gccucaaccuccugggcgc

SEQ ID NO: 1263563 - RNA, 21 nt, Human
gccugcuccucgucguccucg

SEQ ID NO: 1263564 - RNA, 21 nt, Human
gccuuuguucccgaauccugg

SEQ ID NO: 1263565 - RNA, 18 nt, Human
gcggcgcggccagcggag

SEQ ID NO: 1263566 - RNA, 24 nt, Human
gcggcggcggcggcaccaacggca

SEQ ID NO: 1263567 - RNA, 21 nt, Human
gcucacugcagccucaaccuc

SEQ ID NO: 1263568 - RNA, 22 nt, Human
gcuggaaugacuggcaacccag

SEQ ID NO: 1263569 - RNA, 19 nt, Human
ggaggcgaggccuaagugc

SEQ ID NO: 1263570 - RNA, 20 nt, Human
ggaucaaaggggacgaaggu

SEQ ID NO: 1263571 - RNA, 19 nt, Human
ggccggagcgggguguugg

SEQ ID NO: 1263572 - RNA, 26 nt, Human
ggccuaggcccuccacccccgggagc

SEQ ID NO: 1263573 - RNA, 21 nt, Human
ggcugagcggcggcggcggca

SEQ ID NO: 1263574 - RNA, 22 nt, Human
ggcugggggaggaaggccgcgg

SEQ ID NO: 1263575 - RNA, 21 nt, Human
gguguggggagcggcagcagc

SEQ ID NO: 1263576 - RNA, 21 nt, Human
guacggagcagaaauguguug

SEQ ID NO: 1263577 - RNA, 22 nt, Human
gucaggcaaccaccaacggcac

SEQ ID NO: 1263578 - RNA, 22 nt, Human
uaaaaugguccauggagagcaa

SEQ ID NO: 1263579 - RNA, 23 nt, Human
uaaauuuagcucuugccaaaaag

SEQ ID NO: 1263580 - RNA, 20 nt, Human
uaaccaaaagaucuaggcau

SEQ ID NO: 1263581 - RNA, 20 nt, Human
uaagugccucuccccucccu

SEQ ID NO: 1263582 - RNA, 24 nt, Human
ucacccaggcuggagugcaguggu

SEQ ID NO: 1263583 - RNA, 19 nt, Human
ucaccuggcacagucagug

SEQ ID NO: 1263584 - RNA, 23 nt, Human
ucacugcagccucaaccuccugg

SEQ ID NO: 1263585 - RNA, 24 nt, Human
ucacugcagccucaaccuccuggg

SEQ ID NO: 1263586 - RNA, 24 nt, Human
ucagcacacagggaucaaagggga

SEQ ID NO: 1263587 - RNA, 22 nt, Human
ucauucugucacccaggcugga

SEQ ID NO: 1263588 - RNA, 24 nt, Human
ucauucugucacccaggcuggagu

SEQ ID NO: 1263589 - RNA, 18 nt, Human
uccaguggguuugugcag

SEQ ID NO: 1263590 - RNA, 19 nt, Human
ucccgggcuccgccucggg

SEQ ID NO: 1263591 - RNA, 18 nt, Human
ucccugaggacaaggcug

SEQ ID NO: 1263592 - RNA, 21 nt, Human
ucccugcuuguucagcccggg

SEQ ID NO: 1263593 - RNA, 20 nt, Human
uccugaguagcugggacaac

SEQ ID NO: 1263594 - RNA, 21 nt, Human
uccugcaauuuuuuccaaaga

SEQ ID NO: 1263595 - RNA, 19 nt, Human
uccugggucuccuccgccc

SEQ ID NO: 1263596 - RNA, 23 nt, Human
ucucauucugucacccaggcugg

SEQ ID NO: 1263597 - RNA, 24 nt, Human
ucucauucugucacccaggcugga

SEQ ID NO: 1263598 - RNA, 20 nt, Human
ucuccuccuucucggcuucc

SEQ ID NO: 1263599 - RNA, 21 nt, Human
ucugcacugagucuccuccag

SEQ ID NO: 1263600 - RNA, 24 nt, Human
ucugucacccaggcuggagugcag

SEQ ID NO: 1263601 - RNA, 25 nt, Human
ugaagauacugcaaaccuucuuuca

SEQ ID NO: 1263602 - RNA, 20 nt, Human
ugagagaaaaccccagccau

SEQ ID NO: 1263603 - RNA, 18 nt, Human
ugaggacaaggcugaguc

SEQ ID NO: 1263604 - RNA, 19 nt, Human
ugaggacaaggcugaguca

SEQ ID NO: 1263605 - RNA, 23 nt, Human
ugaggacaaggcugagucacgaa

SEQ ID NO: 1263606 - RNA, 22 nt, Human
ugagugccagggcugggucugg

SEQ ID NO: 1263607 - RNA, 23 nt, Human
ugauggcaggauuacuuggaucc

SEQ ID NO: 1263608 - RNA, 22 nt, Human
ugcaguggugcgaucauggcuc

SEQ ID NO: 1263609 - RNA, 22 nt, Human
ugccaaaaagcuuccaauauaa

SEQ ID NO: 1263610 - RNA, 20 nt, Human
ugccgccaccgccugcuccc

SEQ ID NO: 1263611 - RNA, 18 nt, Human
ugcuugugucuaaaaaca

SEQ ID NO: 1263612 - RNA, 23 nt, Human
uggaaugacuggcaacccaggug

SEQ ID NO: 1263613 - RNA, 19 nt, Human
uggacgaggcugagcugca

SEQ ID NO: 1263614 - RNA, 21 nt, Human
uggagugcaguggugcgauca

SEQ ID NO: 1263615 - RNA, 24 nt, Human
uggagugcaguggugcgaucaugg

SEQ ID NO: 1263616 - RNA, 20 nt, Human
uggcagcaucuggcgauugu

SEQ ID NO: 1263617 - RNA, 19 nt, Human
uggcgagaggaagucaugg

SEQ ID NO: 1263618 - RNA, 24 nt, Human
uggcucacugcagccucaaccucc

SEQ ID NO: 1263619 - RNA, 22 nt, Human
ugggacaaccaugcccggcuaa

SEQ ID NO: 1263620 - RNA, 21 nt, Human
ugggguugcuggcugguccug

SEQ ID NO: 1263621 - RNA, 23 nt, Human
ugggguugcuggcugguccuggu

SEQ ID NO: 1263622 - RNA, 19 nt, Human
ugguccugagcucaucacc

SEQ ID NO: 1263623 - RNA, 24 nt, Human
uggugcgaucauggcucacugcag

SEQ ID NO: 1263624 - RNA, 21 nt, Human
ugucacccaggcuggagugca

SEQ ID NO: 1263625 - RNA, 23 nt, Human
ugucuaaaaacaaagguguagaa

SEQ ID NO: 1263626 - RNA, 19 nt, Human
uuccaaaaaugccucugcg

SEQ ID NO: 1263627 - RNA, 19 nt, Human
uuccuagcuggaucuccgu

SEQ ID NO: 1263628 - RNA, 20 nt, Human
uuccugggucuccuccgccc

SEQ ID NO: 1263629 - RNA, 26 nt, Human
uugcugagagaaaaccccagccaugu

SEQ ID NO: 1263630 - RNA, 25 nt, Human
uuggccaugucgugucggggaaggu

SEQ ID NO: 1263631 - RNA, 22 nt, Human
uuuccaaagauguuccaaaaau

SEQ ID NO: 1263632 - RNA, 20 nt, Human
uuugcugagagaaaacccca

SEQ ID NO: 1263633 - RNA, 21 nt, Human
uuugcugagagaaaaccccag

SEQ ID NO: 1263634 - RNA, 23 nt, Human
cauguccauuucgagaccagaag

SEQ ID NO: 1263635 - RNA, 20 nt, Human
gagaccagaagauagucuuc

SEQ ID NO: 1263636 - RNA, 23 nt, Human
guuuuuugauuuuuuucuuuuuu

SEQ ID NO: 1263637 - RNA, 25 nt, Human
uguuuuguuuuuugauuuuuuucuu

SEQ ID NO: 1263638 - RNA, 22 nt, Human
uuuuugauuuuuuucuuuuuuu

SEQ ID NO: 1263639 - RNA, 18 nt, Human
aaacggaaaaaaaagcau

SEQ ID NO: 1263640 - RNA, 21 nt, Human
aacaguaaaaaccaggaaaaa

SEQ ID NO: 1263641 - RNA, 25 nt, Human
aaccaggaaaaaaauauaaaccuag

SEQ ID NO: 1263642 - RNA, 20 nt, Human
aagaggcggcggccgcggug

SEQ ID NO: 1263643 - RNA, 23 nt, Human
aaggacuuugguggcgagaacuu

SEQ ID NO: 1263644 - RNA, 20 nt, Human
aaggugccuggggagccugg

SEQ ID NO: 1263645 - RNA, 23 nt, Human
aaugaacaaaaacggaaaaaaaa

SEQ ID NO: 1263646 - RNA, 20 nt, Human
accaggaaaaaaauauaaac

SEQ ID NO: 1263647 - RNA, 19 nt, Human
acuuuauugcuuggauguu

SEQ ID NO: 1263648 - RNA, 20 nt, Human
aggaaaaaaauauaaaccua

SEQ ID NO: 1263649 - RNA, 21 nt, Human
aggcggcggcggcagaggugg

SEQ ID NO: 1263650 - RNA, 22 nt, Human
aggcggcggcggcagagguggg

SEQ ID NO: 1263651 - RNA, 21 nt, Human
caccccggccagucacacugg

SEQ ID NO: 1263652 - RNA, 18 nt, Human
cacuggcugcuucugcac

SEQ ID NO: 1263653 - RNA, 21 nt, Human
cacuggcugcuucugcacccu

SEQ ID NO: 1263654 - RNA, 22 nt, Human
cagcauccaaaaugaacaaaaa

SEQ ID NO: 1263655 - RNA, 20 nt, Human
cagcggaggcagcucgagcu

SEQ ID NO: 1263656 - RNA, 22 nt, Human
caggaauucccagguucucagu

SEQ ID NO: 1263657 - RNA, 24 nt, Human
cauuuucuuuuuguaguuguuucu

SEQ ID NO: 1263658 - RNA, 25 nt, Human
ccaaaaugaacaaaaacggaaaaaa

SEQ ID NO: 1263659 - RNA, 24 nt, Human
ccacaggaacuccaccccggccag

SEQ ID NO: 1263660 - RNA, 24 nt, Human
ccgauggugaaggugccuggggag

SEQ ID NO: 1263661 - RNA, 21 nt, Human
ccggggcugaucucgcggcgc

SEQ ID NO: 1263662 - RNA, 21 nt, Human
ccucgcucaugccuccuccuc

SEQ ID NO: 1263663 - RNA, 22 nt, Human
ccucgcucaugccuccuccucc

SEQ ID NO: 1263664 - RNA, 22 nt, Human
cgacugcccuccacaggaacuc

SEQ ID NO: 1263665 - RNA, 25 nt, Human
cgcagauauuucuguggguuauucu

SEQ ID NO: 1263666 - RNA, 21 nt, Human
cucgcggcgcaggcggcggcg

SEQ ID NO: 1263667 - RNA, 22 nt, Human
cuuuaggucacccugccgaugg

SEQ ID NO: 1263668 - RNA, 24 nt, Human
gacugcccuccacaggaacuccac

SEQ ID NO: 1263669 - RNA, 26 nt, Human
gcccuccacaggaacuccaccccggc

SEQ ID NO: 1263670 - RNA, 24 nt, Human
gccucgcucaugccuccuccuccu

SEQ ID NO: 1263671 - RNA, 21 nt, Human
gcggcgcaggcggcggcggca

SEQ ID NO: 1263672 - RNA, 18 nt, Human
gcggcggcagaggugggg

SEQ ID NO: 1263673 - RNA, 18 nt, Human
gcggcgguggcuaaagag

SEQ ID NO: 1263674 - RNA, 20 nt, Human
gcugguggucgccgcggccg

SEQ ID NO: 1263675 - RNA, 19 nt, Human
ggccggggcucgcucucgg

SEQ ID NO: 1263676 - RNA, 19 nt, Human
gguaaggcuguggccugcu

SEQ ID NO: 1263677 - RNA, 30 nt, Human
gucggcggcgguggcuaaagaggcggcgac

SEQ ID NO: 1263678 - RNA, 25 nt, Human
uaaaccuagcgcuugcugaaacugg

SEQ ID NO: 1263679 - RNA, 20 nt, Human
uaaagaauaacagcaaacau

SEQ ID NO: 1263680 - RNA, 21 nt, Human
uauccauuucugacguugaac

SEQ ID NO: 1263681 - RNA, 21 nt, Human
uauuucagauuucuuugguug

SEQ ID NO: 1263682 - RNA, 23 nt, Human
ucagcgcguaacgacugcccucc

SEQ ID NO: 1263683 - RNA, 21 nt, Human
ucaugccuccuccuccucucc

SEQ ID NO: 1263684 - RNA, 24 nt, Human
uccaaaaugaacaaaaacggaaaa

SEQ ID NO: 1263685 - RNA, 25 nt, Human
uccaaaaugaacaaaaacggaaaaa

SEQ ID NO: 1263686 - RNA, 21 nt, Human
ucgcugucggcggcgguggcu

SEQ ID NO: 1263687 - RNA, 19 nt, Human
ucgguggcgguuggucggc

SEQ ID NO: 1263688 - RNA, 22 nt, Human
ucuuugguguugguaaggcugu

SEQ ID NO: 1263689 - RNA, 22 nt, Human
ucuuugguugggguucucccca

SEQ ID NO: 1263690 - RNA, 21 nt, Human
ugaacaaaaacggaaaaaaaa

SEQ ID NO: 1263691 - RNA, 25 nt, Human
ugaacaaaaacggaaaaaaaagcau

SEQ ID NO: 1263692 - RNA, 22 nt, Human
ugacagugccaaggacuuuggu

SEQ ID NO: 1263693 - RNA, 20 nt, Human
uggccugcuuuuugcuuugu

SEQ ID NO: 1263694 - RNA, 21 nt, Human
uggcuaaagaggcggcggccc

SEQ ID NO: 1263695 - RNA, 23 nt, Human
uggggucgcgcagcggaggcagc

SEQ ID NO: 1263696 - RNA, 20 nt, Human
ugguggcgagaacuuuuuuc

SEQ ID NO: 1263697 - RNA, 24 nt, Human
uuaaagaauaacagcaaacauucc

SEQ ID NO: 1263698 - RNA, 24 nt, Human
uucuguggguuauucuucuugaug

SEQ ID NO: 1263699 - RNA, 18 nt, Human
uugacauuuucuuuuugu

SEQ ID NO: 1263700 - RNA, 24 nt, Human
uugcuuggauguuucuuugguguu

SEQ ID NO: 1263701 - RNA, 22 nt, Human
uuugguguugguaaggcugugg

SEQ ID NO: 1263702 - RNA, 25 nt, Human
aaaaguucuagucacuugggaggug

SEQ ID NO: 1263703 - RNA, 22 nt, Human
aaacagcuacuuccaaagccca

SEQ ID NO: 1263704 - RNA, 21 nt, Human
aaagcccaagucauuaacagu

SEQ ID NO: 1263705 - RNA, 24 nt, Human
aacauccugaucaggguuuaaugu

SEQ ID NO: 1263706 - RNA, 24 nt, Human
aacauggcaaacaucaacacaucu

SEQ ID NO: 1263707 - RNA, 19 nt, Human
aacccucagcucuugcccc

SEQ ID NO: 1263708 - RNA, 24 nt, Human
aagaacaagucuaaguugguuguu

SEQ ID NO: 1263709 - RNA, 23 nt, Human
aagaucuucucagccucauagcu

SEQ ID NO: 1263710 - RNA, 22 nt, Human
aagcaaacgagcaauacagcua

SEQ ID NO: 1263711 - RNA, 19 nt, Human
aaggaggaggaggaggagg

SEQ ID NO: 1263712 - RNA, 28 nt, Human
acacauuugcaaagcaauucccguaccg

SEQ ID NO: 1263713 - RNA, 22 nt, Human
acaccccgcuccggcccggggc

SEQ ID NO: 1263714 - RNA, 21 nt, Human
acagaacuucuuaacaaugga

SEQ ID NO: 1263715 - RNA, 18 nt, Human
acagaugaaaaggcuuuc

SEQ ID NO: 1263716 - RNA, 19 nt, Human
acagcaauucccuguauag

SEQ ID NO: 1263717 - RNA, 20 nt, Human
acauagugcuucuaccacca

SEQ ID NO: 1263718 - RNA, 19 nt, Human
accccgcuccggcccgggg

SEQ ID NO: 1263719 - RNA, 18 nt, Human
acgccggggccccggagg

SEQ ID NO: 1263720 - RNA, 19 nt, Human
acuaauaacaucagagaaa

SEQ ID NO: 1263721 - RNA, 20 nt, Human
acugacuaacauccugauca

SEQ ID NO: 1263722 - RNA, 20 nt, Human
acugcugcaugccugcagac

SEQ ID NO: 1263723 - RNA, 19 nt, Human
acuucucuuccagggccau

SEQ ID NO: 1263724 - RNA, 21 nt, Human
agaacuggcaaagacugugaa

SEQ ID NO: 1263725 - RNA, 20 nt, Human
agaagaagaacaagucuaaa

SEQ ID NO: 1263726 - RNA, 19 nt, Human
agaaggaggaggaggagga

SEQ ID NO: 1263727 - RNA, 22 nt, Human
agacagaauaaaggugcauaug

SEQ ID NO: 1263728 - RNA, 21 nt, Human
agacagcaauucccuguauag

SEQ ID NO: 1263729 - RNA, 27 nt, Human
agacggaagacagaauaaaggggaccc

SEQ ID NO: 1263730 - RNA, 21 nt, Human
agagaaggaggaggaggagga

SEQ ID NO: 1263731 - RNA, 22 nt, Human
agaggacagagcagguagacug

SEQ ID NO: 1263732 - RNA, 19 nt, Human
agauauuccagauacugca

SEQ ID NO: 1263733 - RNA, 18 nt, Human
agccaccaaaagaaugca

SEQ ID NO: 1263734 - RNA, 23 nt, Human
agcuccgcgaauaguuggugccg

SEQ ID NO: 1263735 - RNA, 18 nt, Human
agcuuagaaagaacagug

SEQ ID NO: 1263736 - RNA, 21 nt, Human
agcuuuggugaugacacugau

SEQ ID NO: 1263737 - RNA, 19 nt, Human
aggaagagaaggaggagga

SEQ ID NO: 1263738 - RNA, 24 nt, Human
aggacgacgaggagcaggcggugg

SEQ ID NO: 1263739 - RNA, 22 nt, Human
aggaggaagagaaggaggagga

SEQ ID NO: 1263740 - RNA, 18 nt, Human
aggaggaggaggaggagg

SEQ ID NO: 1263741 - RNA, 18 nt, Human
aggaggaggaggaggagg

SEQ ID NO: 1263742 - RNA, 18 nt, Human
aggaggaggaggaggagg

SEQ ID NO: 1263743 - RNA, 18 nt, Human
aggaggaggaggaggagg

SEQ ID NO: 1263744 - RNA, 19 nt, Human
aggaggaggaggaggagga

SEQ ID NO: 1263745 - RNA, 19 nt, Human
aggaggaggaggaggagga

SEQ ID NO: 1263746 - RNA, 19 nt, Human
aggaggaggaggaggagga

SEQ ID NO: 1263747 - RNA, 21 nt, Human
aggcggcggcggagggcgggg

SEQ ID NO: 1263748 - RNA, 18 nt, Human
auagugcuucuaccacca

SEQ ID NO: 1263749 - RNA, 23 nt, Human
auggauuucugagguucccuugg

SEQ ID NO: 1263750 - RNA, 19 nt, Human
auggccaagcgccgccgcc

SEQ ID NO: 1263751 - RNA, 23 nt, Human
caaaauggcuccaaacucugcaa

SEQ ID NO: 1263752 - RNA, 20 nt, Human
caaacucugcaaccacccag

SEQ ID NO: 1263753 - RNA, 26 nt, Human
caacuccugaagcaauuugcuacuuu

SEQ ID NO: 1263754 - RNA, 20 nt, Human
cacauuguuaacccucagcu

SEQ ID NO: 1263755 - RNA, 22 nt, Human
caccucuaucucuggaugaaga

SEQ ID NO: 1263756 - RNA, 21 nt, Human
cacugauggaggagggacguc

SEQ ID NO: 1263757 - RNA, 23 nt, Human
cacugcaggcuggccugccaaca

SEQ ID NO: 1263758 - RNA, 18 nt, Human
cagaugaaaaggcuuucu

SEQ ID NO: 1263759 - RNA, 23 nt, Human
cagcaauucccuguauagcuuca

SEQ ID NO: 1263760 - RNA, 20 nt, Human
cagccuguugagccacugag

SEQ ID NO: 1263761 - RNA, 22 nt, Human
cagggccaugcgcggcccacga

SEQ ID NO: 1263762 - RNA, 21 nt, Human
cauggccaagcgccgccgccc

SEQ ID NO: 1263763 - RNA, 23 nt, Human
ccaaacaaacagaacuucuuaac

SEQ ID NO: 1263764 - RNA, 21 nt, Human
ccaaagcccaagucauuaaca

SEQ ID NO: 1263765 - RNA, 26 nt, Human
ccaauuguuuaacuaguaccagcuua

SEQ ID NO: 1263766 - RNA, 22 nt, Human
ccaccaucauaaugguuacuuc

SEQ ID NO: 1263767 - RNA, 19 nt, Human
ccacugacuaacauccuga

SEQ ID NO: 1263768 - RNA, 24 nt, Human
ccacugaguuaauccacagaagau

SEQ ID NO: 1263769 - RNA, 23 nt, Human
cccaagucauuaacaguuuccuc

SEQ ID NO: 1263770 - RNA, 21 nt, Human
cccagcauuggcuaaggugag

SEQ ID NO: 1263771 - RNA, 19 nt, Human
ccccagaggccacauggcu

SEQ ID NO: 1263772 - RNA, 19 nt, Human
cccgcaacgcagaaugagg

SEQ ID NO: 1263773 - RNA, 21 nt, Human
ccgcugccgacaccccgcucc

SEQ ID NO: 1263774 - RNA, 28 nt, Human
ccuacagucucuagugcuuuguaggugg

SEQ ID NO: 1263775 - RNA, 20 nt, Human
ccucaguaauuggaggaccc

SEQ ID NO: 1263776 - RNA, 23 nt, Human
ccuccugucucaacuccugaagc

SEQ ID NO: 1263777 - RNA, 19 nt, Human
ccugcugcgugagcgaagg

SEQ ID NO: 1263778 - RNA, 22 nt, Human
cgaaccggccgcugccgacacc

SEQ ID NO: 1263779 - RNA, 20 nt, Human
cgaaugauaccuucaauugu

SEQ ID NO: 1263780 - RNA, 24 nt, Human
cgacgaggagcaggcgguggcggc

SEQ ID NO: 1263781 - RNA, 18 nt, Human
cggggcucugcggcucau

SEQ ID NO: 1263782 - RNA, 26 nt, Human
cuacuuccaaagcccaagucauuaac

SEQ ID NO: 1263783 - RNA, 20 nt, Human
cucaaagcugcuuaaugauu

SEQ ID NO: 1263784 - RNA, 21 nt, Human
cucaucacaauaagacaucga

SEQ ID NO: 1263785 - RNA, 21 nt, Human
cuccacagaggccuuuucaaa

SEQ ID NO: 1263786 - RNA, 25 nt, Human
cucuaugccauccaacuaauauauc

SEQ ID NO: 1263787 - RNA, 23 nt, Human
cugccgacaccccgcuccggccc

SEQ ID NO: 1263788 - RNA, 20 nt, Human
cugcggcucauuaccuuccc

SEQ ID NO: 1263789 - RNA, 23 nt, Human
cuguauagcuucaggacaaugaa

SEQ ID NO: 1263790 - RNA, 21 nt, Human
cuuaacacauuugcaaagcaa

SEQ ID NO: 1263791 - RNA, 19 nt, Human
cuucaacuguuggcuaaaa

SEQ ID NO: 1263792 - RNA, 19 nt, Human
cuucaacuguuggcuaaaa

SEQ ID NO: 1263793 - RNA, 22 nt, Human
cuuccaaagcccaagucauuaa

SEQ ID NO: 1263794 - RNA, 25 nt, Human
cuucuuaacaauggaacuucaaugg

SEQ ID NO: 1263795 - RNA, 24 nt, Human
cuuucaacugcuuuacagugacca

SEQ ID NO: 1263796 - RNA, 18 nt, Human
gaaagacggaagacagaa

SEQ ID NO: 1263797 - RNA, 22 nt, Human
gaagaggacagagcagguagac

SEQ ID NO: 1263798 - RNA, 21 nt, Human
gaagguugcaguccguaagag

SEQ ID NO: 1263799 - RNA, 22 nt, Human
gaauugggcugaagcguucccc

SEQ ID NO: 1263800 - RNA, 21 nt, Human
gagaccccggggcucugcggc

SEQ ID NO: 1263801 - RNA, 18 nt, Human
gaggaggaggaggcggcg

SEQ ID NO: 1263802 - RNA, 20 nt, Human
gaggcggcggcggagggcgg

SEQ ID NO: 1263803 - RNA, 19 nt, Human
gagggcgggguaagaggac

SEQ ID NO: 1263804 - RNA, 18 nt, Human
gcaaccacccagauaccc

SEQ ID NO: 1263805 - RNA, 18 nt, Human
gcaagaucagcuacccaa

SEQ ID NO: 1263806 - RNA, 21 nt, Human
gcacaaagaaggccaagacag

SEQ ID NO: 1263807 - RNA, 24 nt, Human
gcacuaguugaacauggcaaacau

SEQ ID NO: 1263808 - RNA, 22 nt, Human
gcaguccguaagaggaagaacc

SEQ ID NO: 1263809 - RNA, 22 nt, Human
gccccggaggacgaggacgacg

SEQ ID NO: 1263810 - RNA, 20 nt, Human
gccgacaccccgcuccggcc

SEQ ID NO: 1263811 - RNA, 18 nt, Human
gccugccaacaauccuac

SEQ ID NO: 1263812 - RNA, 18 nt, Human
gcggcggcggagggcggg

SEQ ID NO: 1263813 - RNA, 19 nt, Human
gcugcauuacagaugaaaa

SEQ ID NO: 1263814 - RNA, 21 nt, Human
ggaggaggaggaggaggagga

SEQ ID NO: 1263815 - RNA, 21 nt, Human
ggaggaggaggaggaggagga

SEQ ID NO: 1263816 - RNA, 21 nt, Human
ggaggaggaggaggaggagga

SEQ ID NO: 1263817 - RNA, 19 nt, Human
ggguugccagucauuccag

SEQ ID NO: 1263818 - RNA, 18 nt, Human
gguuguuuucaucucugu

SEQ ID NO: 1263819 - RNA, 22 nt, Human
gucagcguggacucugguauca

SEQ ID NO: 1263820 - RNA, 18 nt, Human
gugaacucagggcugguc

SEQ ID NO: 1263821 - RNA, 18 nt, Human
gugaacucagggcugguc

SEQ ID NO: 1263822 - RNA, 23 nt, Human
guucacauagugcuucuaccacc

SEQ ID NO: 1263823 - RNA, 21 nt, Human
uaaaacagcuacuuccaaagc

SEQ ID NO: 1263824 - RNA, 22 nt, Human
uaaaacuaauaacaucagagaa

SEQ ID NO: 1263825 - RNA, 21 nt, Human
uaaaagaucaucuggcaagga

SEQ ID NO: 1263826 - RNA, 21 nt, Human
uaaaaggccuuugcaaaauuu

SEQ ID NO: 1263827 - RNA, 24 nt, Human
uaaaguagaaagucucagaggucc

SEQ ID NO: 1263828 - RNA, 18 nt, Human
uaaauucuuucaacugcu

SEQ ID NO: 1263829 - RNA, 23 nt, Human
uaaauucuuucaacugcuuuaca

SEQ ID NO: 1263830 - RNA, 19 nt, Human
uaacccucagcucuugccc

SEQ ID NO: 1263831 - RNA, 28 nt, Human
uaacccucagcucuugccccaacgacuu

SEQ ID NO: 1263832 - RNA, 18 nt, Human
uaagacaucgaucucucc

SEQ ID NO: 1263833 - RNA, 20 nt, Human
uacccaaaauggcuccaaac

SEQ ID NO: 1263834 - RNA, 19 nt, Human
uacugguacucuuuuucaa

SEQ ID NO: 1263835 - RNA, 23 nt, Human
uacuuccaaagcccaagucauua

SEQ ID NO: 1263836 - RNA, 20 nt, Human
uagaacagucuuuccaacca

SEQ ID NO: 1263837 - RNA, 20 nt, Human
uagaacuggcaaagacugug

SEQ ID NO: 1263838 - RNA, 18 nt, Human
uagcucagagaagcacaa

SEQ ID NO: 1263839 - RNA, 19 nt, Human
uagugcuuuguagguggca

SEQ ID NO: 1263840 - RNA, 18 nt, Human
uauagacugccacuucug

SEQ ID NO: 1263841 - RNA, 19 nt, Human
uaucauggcacacaggugu

SEQ ID NO: 1263842 - RNA, 20 nt, Human
uaugucagcguggacucugg

SEQ ID NO: 1263843 - RNA, 18 nt, Human
ucacauagugcuucuacc

SEQ ID NO: 1263844 - RNA, 19 nt, Human
ucacauagugcuucuacca

SEQ ID NO: 1263845 - RNA, 19 nt, Human
ucacugcaggcuggccugc

SEQ ID NO: 1263846 - RNA, 19 nt, Human
ucagagaaaucuugggggu

SEQ ID NO: 1263847 - RNA, 19 nt, Human
ucagccucauagcucagag

SEQ ID NO: 1263848 - RNA, 20 nt, Human
ucagccuguugagccacuga

SEQ ID NO: 1263849 - RNA, 20 nt, Human
ucaggacaaugaaguucaca

SEQ ID NO: 1263850 - RNA, 19 nt, Human
ucaugcuuauccagucucu

SEQ ID NO: 1263851 - RNA, 23 nt, Human
uccaacaauagaugaugaccaga

SEQ ID NO: 1263852 - RNA, 19 nt, Human
uccacugacuaacauccug

SEQ ID NO: 1263853 - RNA, 20 nt, Human
uccacugacuaacauccuga

SEQ ID NO: 1263854 - RNA, 21 nt, Human
ucccauacggcccacugccaa

SEQ ID NO: 1263855 - RNA, 20 nt, Human
uccccgacacgacauggcca

SEQ ID NO: 1263856 - RNA, 22 nt, Human
ucccuaaaauuagcgcugaaaa

SEQ ID NO: 1263857 - RNA, 25 nt, Human
ucucacugucacugcaggcuggccu

SEQ ID NO: 1263858 - RNA, 20 nt, Human
ucuccugguaacaauucuaa

SEQ ID NO: 1263859 - RNA, 21 nt, Human
ucuggcaaggaagaggacaga

SEQ ID NO: 1263860 - RNA, 19 nt, Human
ucugugugauuguuauugc

SEQ ID NO: 1263861 - RNA, 21 nt, Human
ucugugugauuguuauugcuu

SEQ ID NO: 1263862 - RNA, 24 nt, Human
ucuucagucucugucgucuucccg

SEQ ID NO: 1263863 - RNA, 23 nt, Human
ugaaacuguuaaaguagaaaguc

SEQ ID NO: 1263864 - RNA, 18 nt, Human
ugaccagacagcaauucc

SEQ ID NO: 1263865 - RNA, 26 nt, Human
ugaccagacagcaauucccuguauag

SEQ ID NO: 1263866 - RNA, 21 nt, Human
ugacuggucaugcuuauccag

SEQ ID NO: 1263867 - RNA, 22 nt, Human
ugagagagaggcggaugaaggg

SEQ ID NO: 1263868 - RNA, 21 nt, Human
ugagcgaagguuucugaguau

SEQ ID NO: 1263869 - RNA, 19 nt, Human
ugagcucugcccagugggg

SEQ ID NO: 1263870 - RNA, 19 nt, Human
ugaggaggaagccgaggag

SEQ ID NO: 1263871 - RNA, 21 nt, Human
ugaggaggaagccgaggagga

SEQ ID NO: 1263872 - RNA, 20 nt, Human
ugcuuuacagugaccaaucu

SEQ ID NO: 1263873 - RNA, 22 nt, Human
uggaauaagacaguccucuguu

SEQ ID NO: 1263874 - RNA, 19 nt, Human
ugguauagaaaaaaguucu

SEQ ID NO: 1263875 - RNA, 20 nt, Human
uggugaugacacugauggag

SEQ ID NO: 1263876 - RNA, 18 nt, Human
ugucuuugguggcuaaag

SEQ ID NO: 1263877 - RNA, 22 nt, Human
ugugacuucuuaaugcuaaaga

SEQ ID NO: 1263878 - RNA, 23 nt, Human
uuaauccacagaagauuuuuucc

SEQ ID NO: 1263879 - RNA, 20 nt, Human
uucacauagugcuucuacca

SEQ ID NO: 1263880 - RNA, 24 nt, Human
uuccccugagauaggcugguuguu

SEQ ID NO: 1263881 - RNA, 21 nt, Human
uucccuguauagcuucaggac

SEQ ID NO: 1263882 - RNA, 21 nt, Human
uucuccaacaacugauucugg

SEQ ID NO: 1263883 - RNA, 20 nt, Human
uugauuucaacaguuuucca

SEQ ID NO: 1263884 - RNA, 25 nt, Human
uugcugaauaaauucuuucaacugc

SEQ ID NO: 1263885 - RNA, 24 nt, Human
uuggugaugacacugauggaggag

SEQ ID NO: 1263886 - RNA, 20 nt, Human
uuucaugucuauuuuuucuu

SEQ ID NO: 1263887 - RNA, 24 nt, Human
uuugcuaaaaauccacuugaagau

SEQ ID NO: 1263888 - RNA, 21 nt, Human
uuuggcgauugguauagaaaa

SEQ ID NO: 1263889 - RNA, 22 nt, Human
uuuucuccaacaacugauucug

SEQ ID NO: 1263890 - RNA, 25 nt, Human
aagcgauccucccaccuuggccucc

SEQ ID NO: 1263891 - RNA, 20 nt, Human
acccugagagguggucucag

SEQ ID NO: 1263892 - RNA, 25 nt, Human
acccugagagguggucucagugggg

SEQ ID NO: 1263893 - RNA, 25 nt, Human
agggagcagggcucaguggcauugg

SEQ ID NO: 1263894 - RNA, 24 nt, Human
aucuugcuaugcugcccaggcugg

SEQ ID NO: 1263895 - RNA, 21 nt, Human
augcugcccaggcuggucucg

SEQ ID NO: 1263896 - RNA, 27 nt, Human
caagcgauccucccaccuuggccuccc

SEQ ID NO: 1263897 - RNA, 27 nt, Human
caagcgauccucccaccuuggccuccc

SEQ ID NO: 1263898 - RNA, 19 nt, Human
cagcugacucaggcugggg

SEQ ID NO: 1263899 - RNA, 18 nt, Human
caggcuggggaggaacca

SEQ ID NO: 1263900 - RNA, 19 nt, Human
ccacaguggcagagggagc

SEQ ID NO: 1263901 - RNA, 21 nt, Human
cccaccuuggccucccaaagc

SEQ ID NO: 1263902 - RNA, 21 nt, Human
cccccgugcccagccuccuug

SEQ ID NO: 1263903 - RNA, 24 nt, Human
ccucccaccuuggccucccaaagc

SEQ ID NO: 1263904 - RNA, 18 nt, Human
ccuggucucaagcgaucc

SEQ ID NO: 1263905 - RNA, 24 nt, Human
cucaagcgauccucccaccuuggc

SEQ ID NO: 1263906 - RNA, 27 nt, Human
cuccuggucucaagcgauccucccacc

SEQ ID NO: 1263907 - RNA, 23 nt, Human
gaaccagggcaggcacccugaga

SEQ ID NO: 1263908 - RNA, 19 nt, Human
gcagagggagcagggcuca

SEQ ID NO: 1263909 - RNA, 22 nt, Human
gcuggucucgaacuccuggucu

SEQ ID NO: 1263910 - RNA, 22 nt, Human
ggaucuugcuaugcugcccagg

SEQ ID NO: 1263911 - RNA, 24 nt, Human
ggcuggucucgaacuccuggucuc

SEQ ID NO: 1263912 - RNA, 24 nt, Human
ggggaucuugcuaugcugcccagg

SEQ ID NO: 1263913 - RNA, 22 nt, Human
ggguacgugguccaccagccug

SEQ ID NO: 1263914 - RNA, 20 nt, Human
guggagaggauguguccaca

SEQ ID NO: 1263915 - RNA, 19 nt, Human
guggcagagggagcagggc

SEQ ID NO: 1263916 - RNA, 19 nt, Human
uacaucaagacacugaggc

SEQ ID NO: 1263917 - RNA, 21 nt, Human
uacaucaagacacugaggccc

SEQ ID NO: 1263918 - RNA, 21 nt, Human
uaugcugcccaggcuggucuc

SEQ ID NO: 1263919 - RNA, 23 nt, Human
uaugcugcccaggcuggucucga

SEQ ID NO: 1263920 - RNA, 24 nt, Human
uaugcugcccaggcuggucucgaa

SEQ ID NO: 1263921 - RNA, 25 nt, Human
ucaagcgauccucccaccuuggccu

SEQ ID NO: 1263922 - RNA, 19 nt, Human
ucaguggcauuggagcaag

SEQ ID NO: 1263923 - RNA, 21 nt, Human
ucucgaacuccuggucucaag

SEQ ID NO: 1263924 - RNA, 19 nt, Human
ucuggcacccacucagggc

SEQ ID NO: 1263925 - RNA, 22 nt, Human
ucugguuuugccugcuccauga

SEQ ID NO: 1263926 - RNA, 23 nt, Human
ucuugcuaugcugcccaggcugg

SEQ ID NO: 1263927 - RNA, 24 nt, Human
ucuugcuaugcugcccaggcuggu

SEQ ID NO: 1263928 - RNA, 18 nt, Human
ugagcccccgugcccagc

SEQ ID NO: 1263929 - RNA, 22 nt, Human
ugagcccccgugcccagccucc

SEQ ID NO: 1263930 - RNA, 23 nt, Human
ugcccagccuccuugcaguccag

SEQ ID NO: 1263931 - RNA, 24 nt, Human
ugcccaggcuggucucgaacuccu

SEQ ID NO: 1263932 - RNA, 24 nt, Human
ugcuaugcugcccaggcuggucuc

SEQ ID NO: 1263933 - RNA, 27 nt, Human
ugcuaugcugcccaggcuggucucgaa

SEQ ID NO: 1263934 - RNA, 21 nt, Human
uggccucccaaagcucugggg

SEQ ID NO: 1263935 - RNA, 21 nt, Human
uggggaggaaccagggcaggc

SEQ ID NO: 1263936 - RNA, 24 nt, Human
uggggugacaggcgugagcccccg

SEQ ID NO: 1263937 - RNA, 25 nt, Human
uggggugacaggcgugagcccccgu

SEQ ID NO: 1263938 - RNA, 18 nt, Human
ugguccaccagccugugu

SEQ ID NO: 1263939 - RNA, 21 nt, Human
uuauuuuguuuuuaaaagaug

SEQ ID NO: 1263940 - RNA, 22 nt, Human
uucacggucuucccagacgucu

SEQ ID NO: 1263941 - RNA, 24 nt, Human
uuggccucccaaagcucuggggug

SEQ ID NO: 1263942 - RNA, 18 nt, Human
uuuuguuuuuaaaagaug

SEQ ID NO: 1263943 - RNA, 23 nt, Human
aaaaaagcacucaggucaaaacu

SEQ ID NO: 1263944 - RNA, 22 nt, Human
aaaaaaugaaguaaacaaagaa

SEQ ID NO: 1263945 - RNA, 21 nt, Human
aaaaagcaagaaagacaaaga

SEQ ID NO: 1263946 - RNA, 24 nt, Human
aaacaaaaagcaagaaagacaaag

SEQ ID NO: 1263947 - RNA, 21 nt, Human
aaacaaagcaaaacuaaaguu

SEQ ID NO: 1263948 - RNA, 19 nt, Human
aaacacaaaggcaaaaaca

SEQ ID NO: 1263949 - RNA, 19 nt, Human
aaacauaaacacaaaggca

SEQ ID NO: 1263950 - RNA, 25 nt, Human
aaagaaacauaacuuucaaugacua

SEQ ID NO: 1263951 - RNA, 19 nt, Human
aaagcaagaaagacaaaga

SEQ ID NO: 1263952 - RNA, 19 nt, Human
aaauauuggcaacugcucc

SEQ ID NO: 1263953 - RNA, 18 nt, Human
aagaaagacaaagaaagg

SEQ ID NO: 1263954 - RNA, 22 nt, Human
aagccuccagagauccagcuuc

SEQ ID NO: 1263955 - RNA, 22 nt, Human
aaggcaaaaacaaaaagcaaga

SEQ ID NO: 1263956 - RNA, 30 nt, Human
aaggcaaaaacaaaaagcaagaaagacaaa

SEQ ID NO: 1263957 - RNA, 26 nt, Human
aaguaaacaaagaaacauaacuuuca

SEQ ID NO: 1263958 - RNA, 22 nt, Human
acaaaaagcaagaaagacaaag

SEQ ID NO: 1263959 - RNA, 26 nt, Human
acaaagaccaaaaauaaggugaaaca

SEQ ID NO: 1263960 - RNA, 18 nt, Human
acaaccaguauaacaaac

SEQ ID NO: 1263961 - RNA, 19 nt, Human
acaaggagucaucucccuc

SEQ ID NO: 1263962 - RNA, 19 nt, Human
acaaggagucaucucccuc

SEQ ID NO: 1263963 - RNA, 22 nt, Human
acacaaaggcaaaaacaaaaag

SEQ ID NO: 1263964 - RNA, 26 nt, Human
acacaaaggcaaaaacaaaaagcaag

SEQ ID NO: 1263965 - RNA, 24 nt, Human
acaugcaaacaaagcaaaacuaaa

SEQ ID NO: 1263966 - RNA, 19 nt, Human
acugaccacucuaugcccc

SEQ ID NO: 1263967 - RNA, 20 nt, Human
acuggccucagauaucagaa

SEQ ID NO: 1263968 - RNA, 20 nt, Human
agacaaagaaaggguaugga

SEQ ID NO: 1263969 - RNA, 21 nt, Human
aggcaaaaacaaaaagcaaga

SEQ ID NO: 1263970 - RNA, 25 nt, Human
aggcaaaaacaaaaagcaagaaaga

SEQ ID NO: 1263971 - RNA, 18 nt, Human
auagcccuuagagccauc

SEQ ID NO: 1263972 - RNA, 23 nt, Human
auaucaugucaucccuagacaac

SEQ ID NO: 1263973 - RNA, 18 nt, Human
aucaggaaggguggaagc

SEQ ID NO: 1263974 - RNA, 25 nt, Human
aucuuccccuagcucuuccucaccg

SEQ ID NO: 1263975 - RNA, 23 nt, Human
caaaaaagcacucaggucaaaac

SEQ ID NO: 1263976 - RNA, 29 nt, Human
caaaaacaaaaagcaagaaagacaagacg

SEQ ID NO: 1263977 - RNA, 20 nt, Human
caaaaagcaagaaagacaaa

SEQ ID NO: 1263978 - RNA, 19 nt, Human
caaacacagaucaaacaac

SEQ ID NO: 1263979 - RNA, 24 nt, Human
caaagaccaaaaauaaggugaaac

SEQ ID NO: 1263980 - RNA, 22 nt, Human
caaaggcaaaaacaaaaagcaa

SEQ ID NO: 1263981 - RNA, 21 nt, Human
caacauuaguagauugugcua

SEQ ID NO: 1263982 - RNA, 20 nt, Human
cacauccacuuucuucaccu

SEQ ID NO: 1263983 - RNA, 19 nt, Human
cacggagacagcuguccag

SEQ ID NO: 1263984 - RNA, 24 nt, Human
cagaauccugggcuuggagagcuc

SEQ ID NO: 1263985 - RNA, 20 nt, Human
cagaauggaauaaaacuuca

SEQ ID NO: 1263986 - RNA, 22 nt, Human
cagcuacaaggagucaucuccc

SEQ ID NO: 1263987 - RNA, 23 nt, Human
cauaaacacaaaggcaaaaacaa

SEQ ID NO: 1263988 - RNA, 20 nt, Human
caucuuccccuagcucuucc

SEQ ID NO: 1263989 - RNA, 20 nt, Human
cauuaguagauugugcuacc

SEQ ID NO: 1263990 - RNA, 23 nt, Human
ccacaguauuuaauuuguuugga

SEQ ID NO: 1263991 - RNA, 25 nt, Human
ccacugaucauuuacaaacugaaau

SEQ ID NO: 1263992 - RNA, 25 nt, Human
ccgacucugcuccacacucucaugc

SEQ ID NO: 1263993 - RNA, 18 nt, Human
ccuccagagauccagcuu

SEQ ID NO: 1263994 - RNA, 22 nt, Human
cuaaagucagugcauugucaac

SEQ ID NO: 1263995 - RNA, 22 nt, Human
cuaaaugaauaaacaaagacca

SEQ ID NO: 1263996 - RNA, 24 nt, Human
cucaaacauaaacacaaaggcaaa

SEQ ID NO: 1263997 - RNA, 23 nt, Human
cucuuguugcaacaugugcaugu

SEQ ID NO: 1263998 - RNA, 19 nt, Human
cuggccucagauaucagaa

SEQ ID NO: 1263999 - RNA, 18 nt, Human
gacaacuugcaugagacu

SEQ ID NO: 1264000 - RNA, 20 nt, Human
gcaagaaagacaaagaaagg

SEQ ID NO: 1264001 - RNA, 23 nt, Human
gcaagaaagacaaagaaagggua

SEQ ID NO: 1264002 - RNA, 22 nt, Human
ggaaaaacaguacauagaggca

SEQ ID NO: 1264003 - RNA, 26 nt, Human
ggaaaagaacaaccacuaauugugaa

SEQ ID NO: 1264004 - RNA, 22 nt, Human
ggacaagcacaauugaauucuu

SEQ ID NO: 1264005 - RNA, 20 nt, Human
ggaucugccugaaaguucuc

SEQ ID NO: 1264006 - RNA, 23 nt, Human
ggcuggugccaaaccuuuuguuu

SEQ ID NO: 1264007 - RNA, 22 nt, Human
guaguacaucucaucuuccccu

SEQ ID NO: 1264008 - RNA, 21 nt, Human
gugccaaaccuuuuguuuaca

SEQ ID NO: 1264009 - RNA, 23 nt, Human
uaaaaaaauuaguggacaugcaa

SEQ ID NO: 1264010 - RNA, 25 nt, Human
uaaaaaacuacacgaaaaaaauucu

SEQ ID NO: 1264011 - RNA, 23 nt, Human
uaaacacaaaggcaaaaacaaaa

SEQ ID NO: 1264012 - RNA, 24 nt, Human
uaaaugaauaaacaaagaccaaaa

SEQ ID NO: 1264013 - RNA, 18 nt, Human
uaaugagaaucaacuugc

SEQ ID NO: 1264014 - RNA, 19 nt, Human
uacaaccaguauaacaaac

SEQ ID NO: 1264015 - RNA, 21 nt, Human
uacaaccaguauaacaaacac

SEQ ID NO: 1264016 - RNA, 26 nt, Human
uacacacaagcaaguucauuugcaug

SEQ ID NO: 1264017 - RNA, 20 nt, Human
uacaggcuaauggugggauc

SEQ ID NO: 1264018 - RNA, 23 nt, Human
uacaguucauauuucaguacauc

SEQ ID NO: 1264019 - RNA, 25 nt, Human
uaccaaaaaagcacucaggucaaaa

SEQ ID NO: 1264020 - RNA, 22 nt, Human
uauaacaaacacagaucaaaca

SEQ ID NO: 1264021 - RNA, 19 nt, Human
uaucuggacaagcacaauu

SEQ ID NO: 1264022 - RNA, 21 nt, Human
ucaaacauaaacacaaaggca

SEQ ID NO: 1264023 - RNA, 22 nt, Human
ucaaauacacacaagcaaguuc

SEQ ID NO: 1264024 - RNA, 23 nt, Human
ucaaauacacacaagcaaguuca

SEQ ID NO: 1264025 - RNA, 18 nt, Human
ucagaacacaaaugcuua

SEQ ID NO: 1264026 - RNA, 23 nt, Human
ucagauaucagaacacaaaugcu

SEQ ID NO: 1264027 - RNA, 24 nt, Human
uccccuagcucuuccucaccggug

SEQ ID NO: 1264028 - RNA, 22 nt, Human
ucccuagacaacauuauaauuu

SEQ ID NO: 1264029 - RNA, 19 nt, Human
uccugggcuuggagagcuc

SEQ ID NO: 1264030 - RNA, 19 nt, Human
ucucuugccagaauccugg

SEQ ID NO: 1264031 - RNA, 23 nt, Human
ucuuaagagagccucccuuucag

SEQ ID NO: 1264032 - RNA, 24 nt, Human
ugacuccaaggaaaucuuuaauau

SEQ ID NO: 1264033 - RNA, 24 nt, Human
ugacuuccuaaaaccaccaauuuc

SEQ ID NO: 1264034 - RNA, 26 nt, Human
ugacuuccuaaaaccaccaauuucau

SEQ ID NO: 1264035 - RNA, 18 nt, Human
ugagaaucaacuugcagg

SEQ ID NO: 1264036 - RNA, 23 nt, Human
ugaggaaaaacaguacauagagg

SEQ ID NO: 1264037 - RNA, 21 nt, Human
ugcacauccacuuucuucacc

SEQ ID NO: 1264038 - RNA, 23 nt, Human
ugcgcucgccgacucugcuccac

SEQ ID NO: 1264039 - RNA, 18 nt, Human
ugcuuucuccaucuuguc

SEQ ID NO: 1264040 - RNA, 25 nt, Human
uggacaugcaaacaaagcaaaacua

SEQ ID NO: 1264041 - RNA, 23 nt, Human
ugguaccaaaaaagcacucaggu

SEQ ID NO: 1264042 - RNA, 21 nt, Human
uguaaagaaauuauuuaaaau

SEQ ID NO: 1264043 - RNA, 18 nt, Human
uguaguggaaucugacaa

SEQ ID NO: 1264044 - RNA, 18 nt, Human
uuaaaaucucccacuuuu

SEQ ID NO: 1264045 - RNA, 19 nt, Human
uuaaagugcaaaauaaaca

SEQ ID NO: 1264046 - RNA, 22 nt, Human
uuaguuacacugguaauuacua

SEQ ID NO: 1264047 - RNA, 27 nt, Human
uuggaacaguaguacaucucaucuucc

SEQ ID NO: 1264048 - RNA, 23 nt, Human
uuuacaaacugaaaucacuuaag

SEQ ID NO: 1264049 - RNA, 18 nt, Human
uuugcacaccuucaugau

SEQ ID NO: 1264050 - RNA, 20 nt, Human
aaauagagacagggucucug

SEQ ID NO: 1264051 - RNA, 21 nt, Human
aaaugucggaggucgaauucu

SEQ ID NO: 1264052 - RNA, 23 nt, Human
aacaauacaggcauaaugcaaca

SEQ ID NO: 1264053 - RNA, 25 nt, Human
aagcaauccucccaccucagccucc

SEQ ID NO: 1264054 - RNA, 18 nt, Human
aagugggaggaucgcuug

SEQ ID NO: 1264055 - RNA, 19 nt, Human
aauaggggagugagcaccu

SEQ ID NO: 1264056 - RNA, 18 nt, Human
acagcucacugcagccuc

SEQ ID NO: 1264057 - RNA, 24 nt, Human
accauguugcccaggcuggucuug

SEQ ID NO: 1264058 - RNA, 25 nt, Human
accauguugcccaggcuggucuuga

SEQ ID NO: 1264059 - RNA, 23 nt, Human
acccaggccuauaagaaccuagu

SEQ ID NO: 1264060 - RNA, 18 nt, Human
accucauuucuacuaaaa

SEQ ID NO: 1264061 - RNA, 19 nt, Human
acucuaguguguucugggc

SEQ ID NO: 1264062 - RNA, 18 nt, Human
acugcacuccggccuggg

SEQ ID NO: 1264063 - RNA, 24 nt, Human
acugcacuccggccugggugacag

SEQ ID NO: 1264064 - RNA, 21 nt, Human
acuggggcacaccagaaugug

SEQ ID NO: 1264065 - RNA, 21 nt, Human
agaaaaaaaaaaaaucagcug

SEQ ID NO: 1264066 - RNA, 18 nt, Human
agacagggucucuguugc

SEQ ID NO: 1264067 - RNA, 20 nt, Human
agagaagccagaaacccaga

SEQ ID NO: 1264068 - RNA, 20 nt, Human
agagagcaacaaaaagaggc

SEQ ID NO: 1264069 - RNA, 18 nt, Human
agagaggucuucggccuc

SEQ ID NO: 1264070 - RNA, 19 nt, Human
aggcacaaacccaggccua

SEQ ID NO: 1264071 - RNA, 24 nt, Human
aggcugaagugggaggaucgcuug

SEQ ID NO: 1264072 - RNA, 24 nt, Human
agggucaagcaauccucccaccuc

SEQ ID NO: 1264073 - RNA, 24 nt, Human
agggucucuguugcccaggccgga

SEQ ID NO: 1264074 - RNA, 21 nt, Human
agguaaucacagcucacugca

SEQ ID NO: 1264075 - RNA, 19 nt, Human
aggucuucggccucccagc

SEQ ID NO: 1264076 - RNA, 19 nt, Human
agguugagguugcagugag

SEQ ID NO: 1264077 - RNA, 24 nt, Human
agguugagguugcagugagccuug

SEQ ID NO: 1264078 - RNA, 21 nt, Human
aguauugaaaucacaaaguca

SEQ ID NO: 1264079 - RNA, 24 nt, Human
agucugagcaauauggcgagaccu

SEQ ID NO: 1264080 - RNA, 20 nt, Human
aguucccaaccuggcaauuc

SEQ ID NO: 1264081 - RNA, 24 nt, Human
aucagcugggugugguggcccaug

SEQ ID NO: 1264082 - RNA, 18 nt, Human
augggguuucaccauguu

SEQ ID NO: 1264083 - RNA, 19 nt, Human
augggguuucaccauguug

SEQ ID NO: 1264084 - RNA, 23 nt, Human
caagagaguagauaagugugcaa

SEQ ID NO: 1264085 - RNA, 27 nt, Human
caagcaauccucccaccucagccuccc

SEQ ID NO: 1264086 - RNA, 19 nt, Human
caaguucauuaucaggagg

SEQ ID NO: 1264087 - RNA, 21 nt, Human
cacacucagcuaauuuuugua

SEQ ID NO: 1264088 - RNA, 23 nt, Human
caccauguugcccaggcuggucu

SEQ ID NO: 1264089 - RNA, 24 nt, Human
caccauguugcccaggcuggucuu

SEQ ID NO: 1264090 - RNA, 27 nt, Human
caccauguugcccaggcuggucuugaa

SEQ ID NO: 1264091 - RNA, 24 nt, Human
caccucagccuccccaguagcugg

SEQ ID NO: 1264092 - RNA, 23 nt, Human
caccucagcuucccaaagugcag

SEQ ID NO: 1264093 - RNA, 22 nt, Human
cacuccggccugggugacagug

SEQ ID NO: 1264094 - RNA, 19 nt, Human
cacugcacuccggccuggg

SEQ ID NO: 1264095 - RNA, 19 nt, Human
cacugcacuccggccuggg

SEQ ID NO: 1264096 - RNA, 22 nt, Human
cacugcacuccggccuggguga

SEQ ID NO: 1264097 - RNA, 23 nt, Human
cacugcacuccggccugggugac

SEQ ID NO: 1264098 - RNA, 24 nt, Human
cacugcacuccggccugggugaca

SEQ ID NO: 1264099 - RNA, 24 nt, Human
cacugcacuccggccugggugaca

SEQ ID NO: 1264100 - RNA, 22 nt, Human
cacugcagccucgaccucccag

SEQ ID NO: 1264101 - RNA, 19 nt, Human
cagcaguucccaaccuggc

SEQ ID NO: 1264102 - RNA, 24 nt, Human
cagccucgaccucccagggucaag

SEQ ID NO: 1264103 - RNA, 19 nt, Human
cagggucucuguugcccag

SEQ ID NO: 1264104 - RNA, 24 nt, Human
caguagcugggaccacagaugugc

SEQ ID NO: 1264105 - RNA, 20 nt, Human
cagugggaagcaagagagua

SEQ ID NO: 1264106 - RNA, 28 nt, Human
caucuaaagucuccaugugacuguugcc

SEQ ID NO: 1264107 - RNA, 23 nt, Human
cauguugcccaggcuggucuuga

SEQ ID NO: 1264108 - RNA, 24 nt, Human
cauguugcccaggcuggucuugaa

SEQ ID NO: 1264109 - RNA, 22 nt, Human
ccaccucagccuccccaguagc

SEQ ID NO: 1264110 - RNA, 20 nt, Human
ccacugcacuccggccuggg

SEQ ID NO: 1264111 - RNA, 20 nt, Human
ccacugcacuccggccuggg

SEQ ID NO: 1264112 - RNA, 20 nt, Human
ccacugcacuccggccuggg

SEQ ID NO: 1264113 - RNA, 21 nt, Human
ccacugcacuccggccugggu

SEQ ID NO: 1264114 - RNA, 21 nt, Human
ccacugcacuccggccugggu

SEQ ID NO: 1264115 - RNA, 23 nt, Human
ccacugcacuccggccuggguga

SEQ ID NO: 1264116 - RNA, 24 nt, Human
ccacugcacuccggccugggugac

SEQ ID NO: 1264117 - RNA, 22 nt, Human
ccagaagguugagguugcagug

SEQ ID NO: 1264118 - RNA, 23 nt, Human
ccagagucccgcccauauuacac

SEQ ID NO: 1264119 - RNA, 28 nt, Human
ccaggccggaaugcagugagguaaucac

SEQ ID NO: 1264120 - RNA, 26 nt, Human
ccauuguucaccaaaccuuuuuuuuu

SEQ ID NO: 1264121 - RNA, 25 nt, Human
ccuaaggaaacaauacaggcauaau

SEQ ID NO: 1264122 - RNA, 25 nt, Human
ccucccaccucagccuccccaguag

SEQ ID NO: 1264123 - RNA, 19 nt, Human
ccugggugacagugagacu

SEQ ID NO: 1264124 - RNA, 21 nt, Human
cguacagagcucucugcuagg

SEQ ID NO: 1264125 - RNA, 24 nt, Human
cucagccuccccaguagcugggac

SEQ ID NO: 1264126 - RNA, 21 nt, Human
cucccaccucagccuccccag

SEQ ID NO: 1264127 - RNA, 19 nt, Human
cucuguugcccaggccgga

SEQ ID NO: 1264128 - RNA, 20 nt, Human
gaagagaagccagaaaccca

SEQ ID NO: 1264129 - RNA, 23 nt, Human
gaccucccagggucaagcaaucc

SEQ ID NO: 1264130 - RNA, 21 nt, Human
gagaauggggagcgaugggga

SEQ ID NO: 1264131 - RNA, 27 nt, Human
gagagcaacaaaaagaggccgguaccc

SEQ ID NO: 1264132 - RNA, 20 nt, Human
gagaugggguuucaccaugu

SEQ ID NO: 1264133 - RNA, 23 nt, Human
gagaugggguuucaccauguugc

SEQ ID NO: 1264134 - RNA, 25 nt, Human
gagcugccauggcuggccaaggcug

SEQ ID NO: 1264135 - RNA, 21 nt, Human
gagguugcagugagccuugau

SEQ ID NO: 1264136 - RNA, 23 nt, Human
gagguugcagugagccuugauug

SEQ ID NO: 1264137 - RNA, 22 nt, Human
gaugggguuucaccauguugcc

SEQ ID NO: 1264138 - RNA, 19 nt, Human
gauugugccacugcacucc

SEQ ID NO: 1264139 - RNA, 24 nt, Human
gcaccuaccacguacagagcucuc

SEQ ID NO: 1264140 - RNA, 18 nt, Human
gcauggagucucuccacc

SEQ ID NO: 1264141 - RNA, 23 nt, Human
gccaaggcugucuuuuaaaaagc

SEQ ID NO: 1264142 - RNA, 19 nt, Human
gccacugcacuccggccug

SEQ ID NO: 1264143 - RNA, 19 nt, Human
gccacugcacuccggccug

SEQ ID NO: 1264144 - RNA, 24 nt, Human
gccacugcacuccggccuggguga

SEQ ID NO: 1264145 - RNA, 20 nt, Human
gcccaaagaagguaucugca

SEQ ID NO: 1264146 - RNA, 22 nt, Human
gccccauuguucaccaaaccuu

SEQ ID NO: 1264147 - RNA, 19 nt, Human
gccugggugacagugagac

SEQ ID NO: 1264148 - RNA, 20 nt, Human
gccugggugacagugagacu

SEQ ID NO: 1264149 - RNA, 19 nt, Human
ggaggcugaauauagaauu

SEQ ID NO: 1264150 - RNA, 23 nt, Human
ggcucaagcuaucugcccaccuc

SEQ ID NO: 1264151 - RNA, 18 nt, Human
ggcuggucuugaacuccu

SEQ ID NO: 1264152 - RNA, 24 nt, Human
gggcacgugcccaucuaaagucuc

SEQ ID NO: 1264153 - RNA, 22 nt, Human
gggguuucaccauguugcccag

SEQ ID NO: 1264154 - RNA, 23 nt, Human
gggguuucaccauguugcccagg

SEQ ID NO: 1264155 - RNA, 22 nt, Human
ggguuucaccauguugcccagg

SEQ ID NO: 1264156 - RNA, 27 nt, Human
gguggcccaugccuguagucaucccag

SEQ ID NO: 1264157 - RNA, 22 nt, Human
ggugugguggcccaugccugua

SEQ ID NO: 1264158 - RNA, 19 nt, Human
guagagaugggguuucacc

SEQ ID NO: 1264159 - RNA, 21 nt, Human
guagagaugggguuucaccau

SEQ ID NO: 1264160 - RNA, 22 nt, Human
guagagaugggguuucaccaug

SEQ ID NO: 1264161 - RNA, 19 nt, Human
guauuuuuuguagagaugg

SEQ ID NO: 1264162 - RNA, 24 nt, Human
gucaagcaauccucccaccucagc

SEQ ID NO: 1264163 - RNA, 24 nt, Human
gugacagugagacuuugucucaaa

SEQ ID NO: 1264164 - RNA, 22 nt, Human
uaaguaggcacagagcuugcca

SEQ ID NO: 1264165 - RNA, 27 nt, Human
uaaguaggcacagagcuugccaccuau

SEQ ID NO: 1264166 - RNA, 23 nt, Human
uaagugugcaacaggcacaaacc

SEQ ID NO: 1264167 - RNA, 22 nt, Human
uaauuuuuguauuuuuuguaga

SEQ ID NO: 1264168 - RNA, 24 nt, Human
uaauuuuuguauuuuuuguagaga

SEQ ID NO: 1264169 - RNA, 22 nt, Human
uagagaugggguuucaccaugu

SEQ ID NO: 1264170 - RNA, 23 nt, Human
uagggagaugagcaagcauuuug

SEQ ID NO: 1264171 - RNA, 24 nt, Human
uagguucucugggggcagcaguuc

SEQ ID NO: 1264172 - RNA, 21 nt, Human
uaguauugaaaucacaaaguc

SEQ ID NO: 1264173 - RNA, 24 nt, Human
uaguauugaaaucacaaagucaga

SEQ ID NO: 1264174 - RNA, 21 nt, Human
ucaccauguugcccaggcugg

SEQ ID NO: 1264175 - RNA, 19 nt, Human
ucacugcagccucgaccuc

SEQ ID NO: 1264176 - RNA, 23 nt, Human
ucacugcagccucgaccucccag

SEQ ID NO: 1264177 - RNA, 24 nt, Human
ucacugcagccucgaccucccagg

SEQ ID NO: 1264178 - RNA, 18 nt, Human
ucagccuccccaguagcu

SEQ ID NO: 1264179 - RNA, 20 nt, Human
ucagccuccccaguagcugg

SEQ ID NO: 1264180 - RNA, 18 nt, Human
ucagcugggugugguggc

SEQ ID NO: 1264181 - RNA, 24 nt, Human
ucagcugggugugguggcccaugc

SEQ ID NO: 1264182 - RNA, 28 nt, Human
ucauuucuacuaaaaagaaaaaaaaaaa

SEQ ID NO: 1264183 - RNA, 21 nt, Human
ucccaccucagccuccccagu

SEQ ID NO: 1264184 - RNA, 18 nt, Human
ucccagggucaagcaauc

SEQ ID NO: 1264185 - RNA, 18 nt, Human
ucccaugaagagaagcca

SEQ ID NO: 1264186 - RNA, 22 nt, Human
uccccaguagcugggaccacag

SEQ ID NO: 1264187 - RNA, 22 nt, Human
ucuacuaaaaagaaaaaaaaaa

SEQ ID NO: 1264188 - RNA, 18 nt, Human
ucuccaugugacuguugc

SEQ ID NO: 1264189 - RNA, 19 nt, Human
ucuccaugugacuguugcc

SEQ ID NO: 1264190 - RNA, 18 nt, Human
ucucuggcugaagguggc

SEQ ID NO: 1264191 - RNA, 19 nt, Human
ucucuggcugaagguggcg

SEQ ID NO: 1264192 - RNA, 18 nt, Human
ucucugggggcagcaguu

SEQ ID NO: 1264193 - RNA, 18 nt, Human
ucucuguugcccaggccg

SEQ ID NO: 1264194 - RNA, 25 nt, Human
ucucuguugcccaggccggaaugca

SEQ ID NO: 1264195 - RNA, 18 nt, Human
ucugcaagccagguacaa

SEQ ID NO: 1264196 - RNA, 25 nt, Human
ucugcaagccagguacaaaccagca

SEQ ID NO: 1264197 - RNA, 19 nt, Human
ucugcauggagucucucca

SEQ ID NO: 1264198 - RNA, 19 nt, Human
ucugcccaccucagcuucc

SEQ ID NO: 1264199 - RNA, 21 nt, Human
ucugcccaccucagcuuccca

SEQ ID NO: 1264200 - RNA, 19 nt, Human
ucugcuagguucucugggg

SEQ ID NO: 1264201 - RNA, 18 nt, Human
ucuguugcccaggccgga

SEQ ID NO: 1264202 - RNA, 24 nt, Human
ucuucggccucccagccucucugg

SEQ ID NO: 1264203 - RNA, 23 nt, Human
ucuugaacuccucggcucaagcu

SEQ ID NO: 1264204 - RNA, 19 nt, Human
ugaacauugugcugcccaa

SEQ ID NO: 1264205 - RNA, 20 nt, Human
ugaacauugugcugcccaaa

SEQ ID NO: 1264206 - RNA, 24 nt, Human
ugacagugagacuuugucucaaaa

SEQ ID NO: 1264207 - RNA, 18 nt, Human
ugacuguugcccugcagg

SEQ ID NO: 1264208 - RNA, 22 nt, Human
ugacuucuuacuucuaaacacu

SEQ ID NO: 1264209 - RNA, 26 nt, Human
ugagcaccuaccacguacagagcucu

SEQ ID NO: 1264210 - RNA, 24 nt, Human
ugagguugcagugagccuugauug

SEQ ID NO: 1264211 - RNA, 23 nt, Human
ugcaacaggcacaaacccaggcc

SEQ ID NO: 1264212 - RNA, 22 nt, Human
ugcccaaagaagguaucugcaa

SEQ ID NO: 1264213 - RNA, 20 nt, Human
ugcccaggccggaaugcagu

SEQ ID NO: 1264214 - RNA, 24 nt, Human
ugcccaggcuggucuugaacuccu

SEQ ID NO: 1264215 - RNA, 20 nt, Human
uggcgagaccucauuucuac

SEQ ID NO: 1264216 - RNA, 20 nt, Human
uggcuggccaaggcugucuu

SEQ ID NO: 1264217 - RNA, 21 nt, Human
ugggaccacagaugugcacca

SEQ ID NO: 1264218 - RNA, 22 nt, Human
ugggcacgugcccaucuaaagu

SEQ ID NO: 1264219 - RNA, 24 nt, Human
ugggguuucaccauguugcccagg

SEQ ID NO: 1264220 - RNA, 21 nt, Human
ugguggcccaugccuguaguc

SEQ ID NO: 1264221 - RNA, 24 nt, Human
uguagagaugggguuucaccaugu

SEQ ID NO: 1264222 - RNA, 26 nt, Human
ugucggaggucgaauucuaguucugc

SEQ ID NO: 1264223 - RNA, 28 nt, Human
ugucucaaaaagccucggaaggaguggc

SEQ ID NO: 1264224 - RNA, 22 nt, Human
uguguugguucaagaccagucu

SEQ ID NO: 1264225 - RNA, 20 nt, Human
uguugguucaagaccagucu

SEQ ID NO: 1264226 - RNA, 26 nt, Human
uucuacuaaaaagaaaaaaaaaaaau

SEQ ID NO: 1264227 - RNA, 19 nt, Human
uucucugggggcagcaguu

SEQ ID NO: 1264228 - RNA, 21 nt, Human
uugaaaucacaaagucagaaa

SEQ ID NO: 1264229 - RNA, 20 nt, Human
uugauacaaaguauccaguu

SEQ ID NO: 1264230 - RNA, 22 nt, Human
uugcagugagccuugauugugc

SEQ ID NO: 1264231 - RNA, 23 nt, Human
uugcagugagccuugauugugcc

SEQ ID NO: 1264232 - RNA, 21 nt, Human
uugccaccuauuagguacuca

SEQ ID NO: 1264233 - RNA, 24 nt, Human
uuggaggcugaauauagaauuuua

SEQ ID NO: 1264234 - RNA, 24 nt, Human
uuguagagaugggguuucaccaug

SEQ ID NO: 1264235 - RNA, 23 nt, Human
uugugccacugcacuccggccug

SEQ ID NO: 1264236 - RNA, 22 nt, Human
uuucaccauguugcccaggcug

SEQ ID NO: 1264237 - RNA, 24 nt, Human
uuucaccauguugcccaggcuggu

SEQ ID NO: 1264238 - RNA, 24 nt, Human
uuuguagagaugggguuucaccau

SEQ ID NO: 1264239 - RNA, 20 nt, Human
uuuuguauuuuuuguagaga

SEQ ID NO: 1264240 - RNA, 20 nt, Human
uuuuuguauuuuuuguagag

SEQ ID NO: 1264241 - RNA, 22 nt, Human
uuuuuuguagagaugggguuuc

SEQ ID NO: 1264242 - RNA, 24 nt, Human
uuuuuuguagagaugggguuucac

SEQ ID NO: 1264243 - RNA, 24 nt, Human
accccaagaaggcuggauucagga

SEQ ID NO: 1264244 - RNA, 18 nt, Human
accccgccaaggccuggg

SEQ ID NO: 1264245 - RNA, 19 nt, Human
agagcgcucagccccacca

SEQ ID NO: 1264246 - RNA, 21 nt, Human
agcgcucagccccaccagagc

SEQ ID NO: 1264247 - RNA, 23 nt, Human
caccaacucccccaaagucgccc

SEQ ID NO: 1264248 - RNA, 21 nt, Human
caccagagcccuuccaggggc

SEQ ID NO: 1264249 - RNA, 20 nt, Human
cccaaagucgcccacccccc

SEQ ID NO: 1264250 - RNA, 22 nt, Human
cccaaagucgcccaccccccgg

SEQ ID NO: 1264251 - RNA, 24 nt, Human
cccccagcgcccacgcggaccugc

SEQ ID NO: 1264252 - RNA, 23 nt, Human
ccccccgggguggcugccuuggc

SEQ ID NO: 1264253 - RNA, 18 nt, Human
cccccgcggcagagcgcu

SEQ ID NO: 1264254 - RNA, 24 nt, Human
cccccgcggcagagcgcucagccc

SEQ ID NO: 1264255 - RNA, 21 nt, Human
ccccgggguggcugccuuggc

SEQ ID NO: 1264256 - RNA, 18 nt, Human
ccgcgcccccgcggcaga

SEQ ID NO: 1264257 - RNA, 19 nt, Human
ccgguagcugaugccccca

SEQ ID NO: 1264258 - RNA, 21 nt, Human
gcagagcgcucagccccacca

SEQ ID NO: 1264259 - RNA, 23 nt, Human
gcggcagagcgcucagccccacc

SEQ ID NO: 1264260 - RNA, 21 nt, Human
gcucagccccaccagagcccu

SEQ ID NO: 1264261 - RNA, 19 nt, Human
ggcugccuuggcugccugg

SEQ ID NO: 1264262 - RNA, 21 nt, Human
gggagagcaccccaagaaggc

SEQ ID NO: 1264263 - RNA, 23 nt, Human
ucccccaaagucgcccacccccc

SEQ ID NO: 1264264 - RNA, 20 nt, Human
ugcugugcccgcgcccccgc

SEQ ID NO: 1264265 - RNA, 20 nt, Human
ugcugugcccgcgcccccgc

SEQ ID NO: 1264266 - RNA, 20 nt, Human
ugggagagcaccccaagaag

SEQ ID NO: 1264267 - RNA, 22 nt, Human
aaacucuauuuuaacccccaaa

SEQ ID NO: 1264268 - RNA, 22 nt, Human
aaauguaagaaacucuauuuua

SEQ ID NO: 1264269 - RNA, 19 nt, Human
agggaagggggaggaacca

SEQ ID NO: 1264270 - RNA, 26 nt, Human
agggggaggaaccaggcacugcucca

SEQ ID NO: 1264271 - RNA, 21 nt, Human
cacacaccaggagcgcccggc

SEQ ID NO: 1264272 - RNA, 18 nt, Human
caggagcgcccggcccag

SEQ ID NO: 1264273 - RNA, 22 nt, Human
cccccaaaaaggcuuauaaaaa

SEQ ID NO: 1264274 - RNA, 18 nt, Human
ccccugagggaaggggga

SEQ ID NO: 1264275 - RNA, 19 nt, Human
cccuugucuaccccugagg

SEQ ID NO: 1264276 - RNA, 21 nt, Human
ccggcccagccuggccccaca

SEQ ID NO: 1264277 - RNA, 21 nt, Human
cuccuguauggcagcagcugg

SEQ ID NO: 1264278 - RNA, 25 nt, Human
cucuauuuuaacccccaaaaaggcu

SEQ ID NO: 1264279 - RNA, 22 nt, Human
gaaaugccuauuaaaaaagucc

SEQ ID NO: 1264280 - RNA, 23 nt, Human
gcccggcccagccuggccccaca

SEQ ID NO: 1264281 - RNA, 20 nt, Human
ggcacuguaagagcaagcac

SEQ ID NO: 1264282 - RNA, 18 nt, Human
uauaaaaaaacaaagcua

SEQ ID NO: 1264283 - RNA, 25 nt, Human
ucaaaggucccuugucuaccccuga

SEQ ID NO: 1264284 - RNA, 20 nt, Human
ucuauuuuaacccccaaaaa

SEQ ID NO: 1264285 - RNA, 23 nt, Human
ugagagucacaguggccacaauc

SEQ ID NO: 1264286 - RNA, 20 nt, Human
ugagggaagggggaggaacc

SEQ ID NO: 1264287 - RNA, 26 nt, Human
uguaagaaacucuauuuuaaccccca

SEQ ID NO: 1264288 - RNA, 21 nt, Human
aacucgcccuccucagcaucc

SEQ ID NO: 1264289 - RNA, 23 nt, Human
aacucgcccuccucagcaucccg

SEQ ID NO: 1264290 - RNA, 18 nt, Human
aagauggcagacuuguag

SEQ ID NO: 1264291 - RNA, 23 nt, Human
aagcacucuucagggguugcucc

SEQ ID NO: 1264292 - RNA, 21 nt, Human
agaaagcgggcaaagcccaga

SEQ ID NO: 1264293 - RNA, 19 nt, Human
agagggguggggggagggc

SEQ ID NO: 1264294 - RNA, 24 nt, Human
agcagcuaucagaguuuaggcugc

SEQ ID NO: 1264295 - RNA, 22 nt, Human
agcaucuggugguggccacgcc

SEQ ID NO: 1264296 - RNA, 23 nt, Human
agcguccacucauuuaagauggc

SEQ ID NO: 1264297 - RNA, 19 nt, Human
agcugugacacggugagua

SEQ ID NO: 1264298 - RNA, 23 nt, Human
aggcgccgggacgcuggugagcc

SEQ ID NO: 1264299 - RNA, 19 nt, Human
aggcugagggaggaggcag

SEQ ID NO: 1264300 - RNA, 21 nt, Human
auccugggcugauaggaaacc

SEQ ID NO: 1264301 - RNA, 28 nt, Human
caaggacaugaggcccugcaggaagcua

SEQ ID NO: 1264302 - RNA, 20 nt, Human
cacccccggccuucagaguu

SEQ ID NO: 1264303 - RNA, 22 nt, Human
cagaaagcgggcaaagcccaga

SEQ ID NO: 1264304 - RNA, 24 nt, Human
cagagauuccuuccgcuguaguuc

SEQ ID NO: 1264305 - RNA, 19 nt, Human
cagcagcagcuucagguag

SEQ ID NO: 1264306 - RNA, 27 nt, Human
cagcagcuucagguagcacuccaucag

SEQ ID NO: 1264307 - RNA, 19 nt, Human
cagcucagaaagcgggcaa

SEQ ID NO: 1264308 - RNA, 27 nt, Human
cagcucagaaagcgggcaaagcccaga

SEQ ID NO: 1264309 - RNA, 23 nt, Human
cagcugggauggcugagccacag

SEQ ID NO: 1264310 - RNA, 22 nt, Human
caggucugagucauaggacaug

SEQ ID NO: 1264311 - RNA, 21 nt, Human
caucauggggacuuccugggc

SEQ ID NO: 1264312 - RNA, 20 nt, Human
ccaccuggaaacucuuaugc

SEQ ID NO: 1264313 - RNA, 23 nt, Human
ccaccuggaaacucuuaugcccc

SEQ ID NO: 1264314 - RNA, 19 nt, Human
ccacgccuccugcagcaga

SEQ ID NO: 1264315 - RNA, 23 nt, Human
ccagcccuaacggaggcgccggg

SEQ ID NO: 1264316 - RNA, 22 nt, Human
ccaugcccggcagcggcccaca

SEQ ID NO: 1264317 - RNA, 23 nt, Human
cccccuguaagaagcuauugggu

SEQ ID NO: 1264318 - RNA, 19 nt, Human
ccuccugcagcagaggggu

SEQ ID NO: 1264319 - RNA, 18 nt, Human
ccugcagcagaggggugg

SEQ ID NO: 1264320 - RNA, 22 nt, Human
ccugcagcagaggggugggggg

SEQ ID NO: 1264321 - RNA, 18 nt, Human
cgcaagcgggccugcucc

SEQ ID NO: 1264322 - RNA, 20 nt, Human
cuaacgcccccagggagcag

SEQ ID NO: 1264323 - RNA, 19 nt, Human
cucgcaauggucuggacuc

SEQ ID NO: 1264324 - RNA, 19 nt, Human
cucgcaauggucuggacuu

SEQ ID NO: 1264325 - RNA, 19 nt, Human
cugagccacacucaccccc

SEQ ID NO: 1264326 - RNA, 19 nt, Human
cugcagcagaggggugggg

SEQ ID NO: 1264327 - RNA, 21 nt, Human
cuggugguggccacgccuccu

SEQ ID NO: 1264328 - RNA, 21 nt, Human
gaaaauguuccccaagucccc

SEQ ID NO: 1264329 - RNA, 20 nt, Human
gacaucauggggacuuccug

SEQ ID NO: 1264330 - RNA, 20 nt, Human
gagcaguuuuuucuugguuc

SEQ ID NO: 1264331 - RNA, 18 nt, Human
gaggaggcagucggcuuc

SEQ ID NO: 1264332 - RNA, 23 nt, Human
gcagcagcagcuucagguagcac

SEQ ID NO: 1264333 - RNA, 18 nt, Human
gccuugacucuggagucc

SEQ ID NO: 1264334 - RNA, 23 nt, Human
ggacagcugggaugaacuggccg

SEQ ID NO: 1264335 - RNA, 22 nt, Human
ggacaugggcuccucgcaaugg

SEQ ID NO: 1264336 - RNA, 21 nt, Human
ggagcaguuuuuucuugguuc

SEQ ID NO: 1264337 - RNA, 23 nt, Human
ggagcaguuuuuucuugguucuu

SEQ ID NO: 1264338 - RNA, 21 nt, Human
ggauggggcugccugggcuug

SEQ ID NO: 1264339 - RNA, 21 nt, Human
ggcggugggcugguaguacuc

SEQ ID NO: 1264340 - RNA, 24 nt, Human
gggaucagcagaggggcaucaggc

SEQ ID NO: 1264341 - RNA, 19 nt, Human
gggauggggcugccugggc

SEQ ID NO: 1264342 - RNA, 25 nt, Human
gggccugcuccugcagcagcagcuu

SEQ ID NO: 1264343 - RNA, 21 nt, Human
ggguccagcucagaaagcggg

SEQ ID NO: 1264344 - RNA, 19 nt, Human
gguagagagaggguccagc

SEQ ID NO: 1264345 - RNA, 22 nt, Human
guugcucccgggaaggccggua

SEQ ID NO: 1264346 - RNA, 19 nt, Human
uaaacggcccugccugccc

SEQ ID NO: 1264347 - RNA, 22 nt, Human
uagaagucauccucugagaucc

SEQ ID NO: 1264348 - RNA, 23 nt, Human
uaggaggccagugcucuggucac

SEQ ID NO: 1264349 - RNA, 19 nt, Human
ucagggguugcucccggga

SEQ ID NO: 1264350 - RNA, 19 nt, Human
uccaggcugagggaggagg

SEQ ID NO: 1264351 - RNA, 18 nt, Human
uccccaaguccccuuucc

SEQ ID NO: 1264352 - RNA, 19 nt, Human
ugacaaggggacacagcug

SEQ ID NO: 1264353 - RNA, 18 nt, Human
ugacucuggagucccccu

SEQ ID NO: 1264354 - RNA, 19 nt, Human
ugagcguccacucauuuaa

SEQ ID NO: 1264355 - RNA, 21 nt, Human
ugagggaggaggcagucggcu

SEQ ID NO: 1264356 - RNA, 24 nt, Human
ugagggaggaggcagucggcuucu

SEQ ID NO: 1264357 - RNA, 23 nt, Human
ugaguccucagcauuugcugugc

SEQ ID NO: 1264358 - RNA, 20 nt, Human
ugcagcagaggggugggggg

SEQ ID NO: 1264359 - RNA, 20 nt, Human
ugccugggcuugccuucuuc

SEQ ID NO: 1264360 - RNA, 18 nt, Human
ugccuguggagaccaggc

SEQ ID NO: 1264361 - RNA, 22 nt, Human
ugcuccugcagcagcagcuuca

SEQ ID NO: 1264362 - RNA, 19 nt, Human
uggccagcccuaacggagg

SEQ ID NO: 1264363 - RNA, 21 nt, Human
ugggauggcugagccacacuc

SEQ ID NO: 1264364 - RNA, 18 nt, Human
ugggauggggcugccugg

SEQ ID NO: 1264365 - RNA, 19 nt, Human
ugggauggggcugccuggg

SEQ ID NO: 1264366 - RNA, 18 nt, Human
uggggggagggccagggg

SEQ ID NO: 1264367 - RNA, 23 nt, Human
ugguggccacgccuccugcagca

SEQ ID NO: 1264368 - RNA, 19 nt, Human
uguaagaagcuauugggug

SEQ ID NO: 1264369 - RNA, 22 nt, Human
uguccaggcugagggaggaggc

SEQ ID NO: 1264370 - RNA, 22 nt, Human
uguuuggccagcccuaacggag

SEQ ID NO: 1264371 - RNA, 23 nt, Human
uucuugagaaaaaugccugugga

SEQ ID NO: 1264372 - RNA, 21 nt, Human
aaccauuuuuccaugcugcuu

SEQ ID NO: 1264373 - RNA, 23 nt, Human
ucccuuuaaguuacgacgggaau

SEQ ID NO: 1264374 - RNA, 18 nt, Human
ucugcagguagcauggaa

SEQ ID NO: 1264375 - RNA, 20 nt, Human
uuccaugcugcuuaagagcc

SEQ ID NO: 1264376 - RNA, 22 nt, Human
acaguuuucuucuuggaacugu

SEQ ID NO: 1264377 - RNA, 18 nt, Human
accaaugucugcuacauu

SEQ ID NO: 1264378 - RNA, 23 nt, Human
aggucaaagccagcaacuaagga

SEQ ID NO: 1264379 - RNA, 18 nt, Human
auaagucuuggguggguu

SEQ ID NO: 1264380 - RNA, 19 nt, Human
auguuacaaucaaaaccaa

SEQ ID NO: 1264381 - RNA, 23 nt, Human
caacauaaaaggucaaagccagc

SEQ ID NO: 1264382 - RNA, 20 nt, Human
cacaccauccuggguauaag

SEQ ID NO: 1264383 - RNA, 18 nt, Human
caccccaggcaauacaac

SEQ ID NO: 1264384 - RNA, 18 nt, Human
cacuuuucagcuuugacc

SEQ ID NO: 1264385 - RNA, 18 nt, Human
caggaagcugccuggguu

SEQ ID NO: 1264386 - RNA, 18 nt, Human
cauaaaaggucaaagcca

SEQ ID NO: 1264387 - RNA, 21 nt, Human
cauccaucuaucacauugucu

SEQ ID NO: 1264388 - RNA, 22 nt, Human
cauggcccacuuugaugcucca

SEQ ID NO: 1264389 - RNA, 18 nt, Human
ccacgcuauucugauuua

SEQ ID NO: 1264390 - RNA, 19 nt, Human
ccacuuuucagcuuugacc

SEQ ID NO: 1264391 - RNA, 22 nt, Human
ccauccuggguauaagucuugg

SEQ ID NO: 1264392 - RNA, 21 nt, Human
cccauggcccacuuugaugcu

SEQ ID NO: 1264393 - RNA, 25 nt, Human
ccugccucggccaccucgccccgac

SEQ ID NO: 1264394 - RNA, 20 nt, Human
cugcaccucgaggucuccgc

SEQ ID NO: 1264395 - RNA, 20 nt, Human
gccucggccaccucgccccg

SEQ ID NO: 1264396 - RNA, 27 nt, Human
uaaaaggucaaagccagcaacuaagga

SEQ ID NO: 1264397 - RNA, 19 nt, Human
uagacgcaggcauauaggg

SEQ ID NO: 1264398 - RNA, 23 nt, Human
uauggcaguugagaaaauagaug

SEQ ID NO: 1264399 - RNA, 19 nt, Human
ucaaagccagcaacuaagg

SEQ ID NO: 1264400 - RNA, 22 nt, Human
ucugcaguagacaccccaggca

SEQ ID NO: 1264401 - RNA, 23 nt, Human
ugaaauaucugcaguagacaccc

SEQ ID NO: 1264402 - RNA, 20 nt, Human
ugcagaauaagaucuucuuc

SEQ ID NO: 1264403 - RNA, 18 nt, Human
ugccaggaagcugccugg

SEQ ID NO: 1264404 - RNA, 20 nt, Human
ugccaggaagcugccugggu

SEQ ID NO: 1264405 - RNA, 21 nt, Human
ugcuacauuuuccacuucuuc

SEQ ID NO: 1264406 - RNA, 24 nt, Human
uggcacugccaggaagcugccugg

SEQ ID NO: 1264407 - RNA, 23 nt, Human
uggcccacuuugaugcuccaaau

SEQ ID NO: 1264408 - RNA, 21 nt, Human
uuaaaaauuucccgaccuccu

SEQ ID NO: 1264409 - RNA, 23 nt, Human
uuaaaaauuucccgaccuccuga

SEQ ID NO: 1264410 - RNA, 20 nt, Human
uuauaaucuucaauuucagu

SEQ ID NO: 1264411 - RNA, 23 nt, Human
uuauggguacuccaagccuccua

SEQ ID NO: 1264412 - RNA, 19 nt, Human
uucauugcagaauaagauc

SEQ ID NO: 1264413 - RNA, 26 nt, Human
uucuucaucauccuuauuugaugaaa

SEQ ID NO: 1264414 - RNA, 19 nt, Human
uucuuggaacuguaacugu

SEQ ID NO: 1264415 - RNA, 19 nt, Human
uugugcuacaagugaagau

SEQ ID NO: 1264416 - RNA, 22 nt, Human
uuuaaaaauuucccgaccuccu

SEQ ID NO: 1264417 - RNA, 22 nt, Human
uuugguuuugacaguuuucuuc

SEQ ID NO: 1264418 - RNA, 20 nt, Human
aauugucaagagcaguuggu

SEQ ID NO: 1264419 - RNA, 21 nt, Human
acacugaagacacaaagaaug

SEQ ID NO: 1264420 - RNA, 18 nt, Human
acccagagauacgugguu

SEQ ID NO: 1264421 - RNA, 20 nt, Human
accuugagcagguauagaag

SEQ ID NO: 1264422 - RNA, 19 nt, Human
acuguaguuucauucaaau

SEQ ID NO: 1264423 - RNA, 19 nt, Human
agaguccugggugacaugc

SEQ ID NO: 1264424 - RNA, 23 nt, Human
agcaguuggugguucugaaauac

SEQ ID NO: 1264425 - RNA, 19 nt, Human
agccaacacugaagacaca

SEQ ID NO: 1264426 - RNA, 18 nt, Human
agguugccacuggcaugg

SEQ ID NO: 1264427 - RNA, 21 nt, Human
auagaagcucaaagacaugcc

SEQ ID NO: 1264428 - RNA, 23 nt, Human
auagagccaugcccacugaccca

SEQ ID NO: 1264429 - RNA, 20 nt, Human
augugcugcacaguuacgug

SEQ ID NO: 1264430 - RNA, 18 nt, Human
caaagaugacaaugaccu

SEQ ID NO: 1264431 - RNA, 26 nt, Human
caagccaacacugaagacacaaagaa

SEQ ID NO: 1264432 - RNA, 21 nt, Human
cacaguuacgugaacauguca

SEQ ID NO: 1264433 - RNA, 21 nt, Human
caucggcagaguccuggguga

SEQ ID NO: 1264434 - RNA, 26 nt, Human
ccagcggcuccugacuccuguucucu

SEQ ID NO: 1264435 - RNA, 22 nt, Human
cccaaaauaucucuucuccuuu

SEQ ID NO: 1264436 - RNA, 21 nt, Human
cuaagcguuuucugcaagaac

SEQ ID NO: 1264437 - RNA, 24 nt, Human
cuauagguccugccugcaggaaug

SEQ ID NO: 1264438 - RNA, 20 nt, Human
cuguggucuuccuaaguacu

SEQ ID NO: 1264439 - RNA, 18 nt, Human
gauuaccuccuaugaaac

SEQ ID NO: 1264440 - RNA, 19 nt, Human
gcagguauagaagcucaaa

SEQ ID NO: 1264441 - RNA, 25 nt, Human
ggauggaauugagaggagcagggcu

SEQ ID NO: 1264442 - RNA, 26 nt, Human
ggcuaaggccucccaaugcuguuugu

SEQ ID NO: 1264443 - RNA, 23 nt, Human
ggugauaaggacuaugugaagga

SEQ ID NO: 1264444 - RNA, 23 nt, Human
gucuccugccagcggcuccugac

SEQ ID NO: 1264445 - RNA, 25 nt, Human
gugguucugaaauacaauccucagc

SEQ ID NO: 1264446 - RNA, 22 nt, Human
uaaaacaagccaacacugaaga

SEQ ID NO: 1264447 - RNA, 24 nt, Human
uacagauggaucagcuaaaacaag

SEQ ID NO: 1264448 - RNA, 22 nt, Human
uagagccaugcccacugacccc

SEQ ID NO: 1264449 - RNA, 22 nt, Human
uagcuguggucuuccuaaguac

SEQ ID NO: 1264450 - RNA, 24 nt, Human
uaggaauagagccaugcccacuga

SEQ ID NO: 1264451 - RNA, 24 nt, Human
uagguucauugaaaccaggguaac

SEQ ID NO: 1264452 - RNA, 18 nt, Human
uauagaagcucaaagaca

SEQ ID NO: 1264453 - RNA, 18 nt, Human
ucauucaaaucuucacgu

SEQ ID NO: 1264454 - RNA, 21 nt, Human
ucauugaaaccaggguaacac

SEQ ID NO: 1264455 - RNA, 18 nt, Human
ucccggcaugugcugcac

SEQ ID NO: 1264456 - RNA, 19 nt, Human
ucucucggcuuaguaaggg

SEQ ID NO: 1264457 - RNA, 22 nt, Human
ucugaaauacaauccucagcca

SEQ ID NO: 1264458 - RNA, 21 nt, Human
ugaaaccaggguaacaccuuu

SEQ ID NO: 1264459 - RNA, 20 nt, Human
ugaaauacaauccucagcca

SEQ ID NO: 1264460 - RNA, 18 nt, Human
ugacaugcugucuccugc

SEQ ID NO: 1264461 - RNA, 24 nt, Human
ugacaugcugucuccugccagcgg

SEQ ID NO: 1264462 - RNA, 19 nt, Human
ugagaggagcagggcuaag

SEQ ID NO: 1264463 - RNA, 22 nt, Human
ugaggaauuuuguagcuaccca

SEQ ID NO: 1264464 - RNA, 21 nt, Human
ugcugcacaguuacgugaaca

SEQ ID NO: 1264465 - RNA, 21 nt, Human
ugucaagagcaguuggugguu

SEQ ID NO: 1264466 - RNA, 22 nt, Human
aaaaaaaaacacacacacaaaa

SEQ ID NO: 1264467 - RNA, 24 nt, Human
aaaaaaaaacacacacacaaaacu

SEQ ID NO: 1264468 - RNA, 21 nt, Human
aaaaaaacacacacacaaaac

SEQ ID NO: 1264469 - RNA, 22 nt, Human
aaaaaaacacacacacaaaacu

SEQ ID NO: 1264470 - RNA, 21 nt, Human
aaaaaagaacaagucagcuug

SEQ ID NO: 1264471 - RNA, 24 nt, Human
aaaccaagguggggggauugcuug

SEQ ID NO: 1264472 - RNA, 22 nt, Human
aaacuaccaccaccuaccccaa

SEQ ID NO: 1264473 - RNA, 24 nt, Human
aaagugcugggauuacaggcguga

SEQ ID NO: 1264474 - RNA, 24 nt, Human
aaagugcugggauuacagguguga

SEQ ID NO: 1264475 - RNA, 21 nt, Human
aacacacacacaaaacuacca

SEQ ID NO: 1264476 - RNA, 24 nt, Human
aacacuuugggaaaccaagguggg

SEQ ID NO: 1264477 - RNA, 20 nt, Human
aacauggcaaaacccggucu

SEQ ID NO: 1264478 - RNA, 20 nt, Human
aaguagcugggauuacaggc

SEQ ID NO: 1264479 - RNA, 23 nt, Human
aaguagcugggauuacaggcgug

SEQ ID NO: 1264480 - RNA, 24 nt, Human
aaguagcugggauuacaggcgugg

SEQ ID NO: 1264481 - RNA, 27 nt, Human
aaguagcugggauuacaggcgugggcc

SEQ ID NO: 1264482 - RNA, 22 nt, Human
aagucagcuuggaaaaaacuga

SEQ ID NO: 1264483 - RNA, 18 nt, Human
aagugcugggauuacagg

SEQ ID NO: 1264484 - RNA, 19 nt, Human
aagugcugggauuacaggc

SEQ ID NO: 1264485 - RNA, 19 nt, Human
aagugcugggauuacaggc

SEQ ID NO: 1264486 - RNA, 26 nt, Human
aagugcugggauuacaggcgugagcc

SEQ ID NO: 1264487 - RNA, 19 nt, Human
aagugcugggauuacaggu

SEQ ID NO: 1264488 - RNA, 26 nt, Human
aagugcugggauuacaggugugagcc

SEQ ID NO: 1264489 - RNA, 24 nt, Human
aaguggagguugcagugaacugag

SEQ ID NO: 1264490 - RNA, 21 nt, Human
aaguucuauucuuuuuuuuuu

SEQ ID NO: 1264491 - RNA, 24 nt, Human
aauugcuugaaccuaggaagugga

SEQ ID NO: 1264492 - RNA, 19 nt, Human
acacaaaacuaccaccacc

SEQ ID NO: 1264493 - RNA, 24 nt, Human
accacguuggccaggcuggucucg

SEQ ID NO: 1264494 - RNA, 21 nt, Human
accgcacuccagccugggcaa

SEQ ID NO: 1264495 - RNA, 24 nt, Human
accgcacuccagccugggcaacgg

SEQ ID NO: 1264496 - RNA, 18 nt, Human
accucacuccagccuggg

SEQ ID NO: 1264497 - RNA, 25 nt, Human
acggaguuucgcucguguugcccag

SEQ ID NO: 1264498 - RNA, 22 nt, Human
acuaccuauugguaaaggagau

SEQ ID NO: 1264499 - RNA, 24 nt, Human
acuccagccugggccuccuaggcu

SEQ ID NO: 1264500 - RNA, 23 nt, Human
acugcccugcccucccaaagugc

SEQ ID NO: 1264501 - RNA, 21 nt, Human
agacaacuuugaaaagaguuu

SEQ ID NO: 1264502 - RNA, 20 nt, Human
agauuugcucaaaaaagaac

SEQ ID NO: 1264503 - RNA, 30 nt, Human
agcaguuccaaguauuuuuuuuuuuuuuuu

SEQ ID NO: 1264504 - RNA, 23 nt, Human
agccgggugugguagugugggcc

SEQ ID NO: 1264505 - RNA, 18 nt, Human
agccuggccaacauggca

SEQ ID NO: 1264506 - RNA, 24 nt, Human
agccuggccaacauggcaaaaccc

SEQ ID NO: 1264507 - RNA, 24 nt, Human
agcgauucuccugccucagccuuc

SEQ ID NO: 1264508 - RNA, 23 nt, Human
agcugaggcaggagaauugcuug

SEQ ID NO: 1264509 - RNA, 23 nt, Human
agcugggaugacaggugugugcc

SEQ ID NO: 1264510 - RNA, 19 nt, Human
agcuuggaaaaaacugaug

SEQ ID NO: 1264511 - RNA, 23 nt, Human
aggaauucuccugccucagccuc

SEQ ID NO: 1264512 - RNA, 18 nt, Human
aggaguucaagaccggcc

SEQ ID NO: 1264513 - RNA, 22 nt, Human
aggcaggagaauugcuugaacc

SEQ ID NO: 1264514 - RNA, 23 nt, Human
aggcaggagaauugcuugaaccu

SEQ ID NO: 1264515 - RNA, 24 nt, Human
aggcaggagaauugcuugaaccua

SEQ ID NO: 1264516 - RNA, 18 nt, Human
aggcuagucuugaacucc

SEQ ID NO: 1264517 - RNA, 20 nt, Human
aggggguuucaccacguugg

SEQ ID NO: 1264518 - RNA, 24 nt, Human
aggggguuucaccacguuggccag

SEQ ID NO: 1264519 - RNA, 19 nt, Human
agguggagguugcagugaa

SEQ ID NO: 1264520 - RNA, 24 nt, Human
agguggagguugcagugaaccaag

SEQ ID NO: 1264521 - RNA, 24 nt, Human
aggugugugccaccacucccagcu

SEQ ID NO: 1264522 - RNA, 18 nt, Human
aguagcucaugccuguaa

SEQ ID NO: 1264523 - RNA, 23 nt, Human
aguagcucaugccuguaauccca

SEQ ID NO: 1264524 - RNA, 23 nt, Human
aguagcugggaugacaggugugu

SEQ ID NO: 1264525 - RNA, 27 nt, Human
aguccaggaguucaagaccggccuggg

SEQ ID NO: 1264526 - RNA, 24 nt, Human
aucaugccaccgcacuccagccug

SEQ ID NO: 1264527 - RNA, 22 nt, Human
aucccaacacuuugggaaacca

SEQ ID NO: 1264528 - RNA, 24 nt, Human
aucgugccaccucacuccagccug

SEQ ID NO: 1264529 - RNA, 24 nt, Human
augccaccgcacuccagccugggc

SEQ ID NO: 1264530 - RNA, 19 nt, Human
augccuguaaucccaacac

SEQ ID NO: 1264531 - RNA, 20 nt, Human
auggaguuucaccaugucag

SEQ ID NO: 1264532 - RNA, 24 nt, Human
auggaguuucaccaugucagccag

SEQ ID NO: 1264533 - RNA, 24 nt, Human
auugcuugaguccaggaguucaag

SEQ ID NO: 1264534 - RNA, 22 nt, Human
auuuuuguauuuuuaguagaga

SEQ ID NO: 1264535 - RNA, 24 nt, Human
caaagugcugggauuacaggcgug

SEQ ID NO: 1264536 - RNA, 24 nt, Human
caaagugcugggauuacaggugug

SEQ ID NO: 1264537 - RNA, 24 nt, Human
caacacuuugggaaaccaaggugg

SEQ ID NO: 1264538 - RNA, 23 nt, Human
caacauggcaaaacccggucucu

SEQ ID NO: 1264539 - RNA, 20 nt, Human
caaccuccaccucccagguu

SEQ ID NO: 1264540 - RNA, 23 nt, Human
caaccuccaccucccagguucaa

SEQ ID NO: 1264541 - RNA, 20 nt, Human
caagcgauucuccugccuca

SEQ ID NO: 1264542 - RNA, 22 nt, Human
caagcgauucuccugccucagc

SEQ ID NO: 1264543 - RNA, 19 nt, Human
caagcugaacuagcugcuu

SEQ ID NO: 1264544 - RNA, 22 nt, Human
caaggaauucuccugccucagc

SEQ ID NO: 1264545 - RNA, 20 nt, Human
caagugauuguugugccuca

SEQ ID NO: 1264546 - RNA, 21 nt, Human
cacaaaacuaccaccaccuac

SEQ ID NO: 1264547 - RNA, 23 nt, Human
cacacacacaaaacuaccaccac

SEQ ID NO: 1264548 - RNA, 21 nt, Human
caccacguuggccaggcuggu

SEQ ID NO: 1264549 - RNA, 24 nt, Human
caccacguuggccaggcuggucuc

SEQ ID NO: 1264550 - RNA, 27 nt, Human
caccacguuggccaggcuggucucgaa

SEQ ID NO: 1264551 - RNA, 21 nt, Human
caccaugucagccaggcuagu

SEQ ID NO: 1264552 - RNA, 27 nt, Human
caccaugucagccaggcuagucuugaa

SEQ ID NO: 1264553 - RNA, 26 nt, Human
caccgcacuccagccugggcaacggc

SEQ ID NO: 1264554 - RNA, 23 nt, Human
caccuagccucccaaagugcugg

SEQ ID NO: 1264555 - RNA, 25 nt, Human
caccucacuccagccugggccuccu

SEQ ID NO: 1264556 - RNA, 24 nt, Human
cacguuggccaggcuggucucgaa

SEQ ID NO: 1264557 - RNA, 21 nt, Human
cacuccagccugggcaacggc

SEQ ID NO: 1264558 - RNA, 22 nt, Human
cacuccagccugggcaacggcg

SEQ ID NO: 1264559 - RNA, 21 nt, Human
cacugcaaccuccaccuccca

SEQ ID NO: 1264560 - RNA, 18 nt, Human
cacugcaaccucugccuc

SEQ ID NO: 1264561 - RNA, 21 nt, Human
cacugcaaccucugccuccca

SEQ ID NO: 1264562 - RNA, 18 nt, Human
cagccugggcaacggcga

SEQ ID NO: 1264563 - RNA, 23 nt, Human
cagccugggcaacggcgagacuu

SEQ ID NO: 1264564 - RNA, 18 nt, Human
caggcuagucuugaacuc

SEQ ID NO: 1264565 - RNA, 24 nt, Human
caugccuguaaucccaacacuuug

SEQ ID NO: 1264566 - RNA, 23 nt, Human
caugucagccaggcuagucuuga

SEQ ID NO: 1264567 - RNA, 24 nt, Human
caugucagccaggcuagucuugaa

SEQ ID NO: 1264568 - RNA, 21 nt, Human
ccaaagugcugggauuacagg

SEQ ID NO: 1264569 - RNA, 21 nt, Human
ccaaagugcugggauuacagg

SEQ ID NO: 1264570 - RNA, 22 nt, Human
ccaaagugcugggauuacaggc

SEQ ID NO: 1264571 - RNA, 22 nt, Human
ccaaagugcugggauuacaggc

SEQ ID NO: 1264572 - RNA, 24 nt, Human
ccaaagugcugggauuacaggcgu

SEQ ID NO: 1264573 - RNA, 24 nt, Human
ccaaagugcugggauuacaggugu

SEQ ID NO: 1264574 - RNA, 21 nt, Human
ccaacugcccugcccucccaa

SEQ ID NO: 1264575 - RNA, 22 nt, Human
ccaaguagcugggauuacaggc

SEQ ID NO: 1264576 - RNA, 24 nt, Human
ccaaguagcugggauuacaggcgu

SEQ ID NO: 1264577 - RNA, 20 nt, Human
ccaccgcacuccagccuggg

SEQ ID NO: 1264578 - RNA, 20 nt, Human
ccaccgcacuccagccuggg

SEQ ID NO: 1264579 - RNA, 21 nt, Human
ccaccgcacuccagccugggc

SEQ ID NO: 1264580 - RNA, 22 nt, Human
ccaccgcacuccagccugggca

SEQ ID NO: 1264581 - RNA, 24 nt, Human
ccaccgcacuccagccugggcaac

SEQ ID NO: 1264582 - RNA, 24 nt, Human
ccaccucccagguucaagcgauuc

SEQ ID NO: 1264583 - RNA, 18 nt, Human
ccacugcauccagccaag

SEQ ID NO: 1264584 - RNA, 19 nt, Human
ccacugcauccagccaagu

SEQ ID NO: 1264585 - RNA, 20 nt, Human
cccaccuagccucccaaagu

SEQ ID NO: 1264586 - RNA, 20 nt, Human
cccagguucaagcgauucuc

SEQ ID NO: 1264587 - RNA, 23 nt, Human
cccagguucaagcgauucuccug

SEQ ID NO: 1264588 - RNA, 21 nt, Human
cccuggagguggagguugcag

SEQ ID NO: 1264589 - RNA, 24 nt, Human
ccucccagguucaagcgauucucc

SEQ ID NO: 1264590 - RNA, 24 nt, Human
ccucccagguucaaggaauucucc

SEQ ID NO: 1264591 - RNA, 23 nt, Human
ccugccucagccuuccaaguagc

SEQ ID NO: 1264592 - RNA, 24 nt, Human
ccugccucagccuuccaaguagcu

SEQ ID NO: 1264593 - RNA, 18 nt, Human
ccuggccucaagugaucc

SEQ ID NO: 1264594 - RNA, 19 nt, Human
ccuggccucaagugaucca

SEQ ID NO: 1264595 - RNA, 19 nt, Human
ccuggccucaagugaucca

SEQ ID NO: 1264596 - RNA, 23 nt, Human
ccuggccucaagugauccaacug

SEQ ID NO: 1264597 - RNA, 22 nt, Human
ccugggcaacauagugagaccc

SEQ ID NO: 1264598 - RNA, 19 nt, Human
ccugggcaacggcgagacu

SEQ ID NO: 1264599 - RNA, 21 nt, Human
ccuguagucccagcuacucug

SEQ ID NO: 1264600 - RNA, 23 nt, Human
ccuguagucccagcuacucugaa

SEQ ID NO: 1264601 - RNA, 21 nt, Human
cgagaccagccuggccaacau

SEQ ID NO: 1264602 - RNA, 23 nt, Human
cgugggccaccaugccuggcuau

SEQ ID NO: 1264603 - RNA, 19 nt, Human
cucaaaaaagaacaaguca

SEQ ID NO: 1264604 - RNA, 23 nt, Human
cucaagugauccaacugcccugc

SEQ ID NO: 1264605 - RNA, 24 nt, Human
cucacugcaaccuccaccucccag

SEQ ID NO: 1264606 - RNA, 24 nt, Human
cucagccuuccaaguagcugggau

SEQ ID NO: 1264607 - RNA, 24 nt, Human
cucaugccuguaaucccaacacuu

SEQ ID NO: 1264608 - RNA, 22 nt, Human
cuccugaccucgugaucugccc

SEQ ID NO: 1264609 - RNA, 22 nt, Human
cuccugccucagccucuugagu

SEQ ID NO: 1264610 - RNA, 24 nt, Human
cugaacccuggagguggagguugc

SEQ ID NO: 1264611 - RNA, 24 nt, Human
cugcaaccuccaccucccagguuc

SEQ ID NO: 1264612 - RNA, 23 nt, Human
cugcaaccucugccucccagguu

SEQ ID NO: 1264613 - RNA, 24 nt, Human
cugcaaccucugccucccagguuc

SEQ ID NO: 1264614 - RNA, 24 nt, Human
cugcccugcccucccaaagugcug

SEQ ID NO: 1264615 - RNA, 23 nt, Human
cugccucagccucuugaguagcu

SEQ ID NO: 1264616 - RNA, 23 nt, Human
cuguauuuuuaguagagauggag

SEQ ID NO: 1264617 - RNA, 19 nt, Human
cuucgagaccagccuggcc

SEQ ID NO: 1264618 - RNA, 18 nt, Human
gaaguggagguugcagug

SEQ ID NO: 1264619 - RNA, 21 nt, Human
gaccucgugaucugcccaccu

SEQ ID NO: 1264620 - RNA, 23 nt, Human
gaccucgugaucugcccaccuag

SEQ ID NO: 1264621 - RNA, 23 nt, Human
gagaauugcuugaaccuaggaag

SEQ ID NO: 1264622 - RNA, 23 nt, Human
gagaucaugccaccgcacuccag

SEQ ID NO: 1264623 - RNA, 23 nt, Human
gagguugcagugaaccaagaucg

SEQ ID NO: 1264624 - RNA, 18 nt, Human
gauuacaggcgugagcca

SEQ ID NO: 1264625 - RNA, 22 nt, Human
gauuacaggcgugagccaccgc

SEQ ID NO: 1264626 - RNA, 23 nt, Human
gauuacaggcgugagccaccgca

SEQ ID NO: 1264627 - RNA, 18 nt, Human
gauuacaggcgugggcca

SEQ ID NO: 1264628 - RNA, 21 nt, Human
gauuacaggcgugggccacca

SEQ ID NO: 1264629 - RNA, 24 nt, Human
gauuacaggcgugggccaccaugc

SEQ ID NO: 1264630 - RNA, 18 nt, Human
gauuacaggugugagcca

SEQ ID NO: 1264631 - RNA, 22 nt, Human
gauuacaggugugagccacugc

SEQ ID NO: 1264632 - RNA, 23 nt, Human
gauuacaggugugagccacugca

SEQ ID NO: 1264633 - RNA, 24 nt, Human
gauugcuugaguccaggaguucaa

SEQ ID NO: 1264634 - RNA, 22 nt, Human
gcaaccuccaccucccagguuc

SEQ ID NO: 1264635 - RNA, 22 nt, Human
gccaccgcacuccagccugggc

SEQ ID NO: 1264636 - RNA, 22 nt, Human
gccaccucacuccagccugggc

SEQ ID NO: 1264637 - RNA, 21 nt, Human
gccugggcaacauagugagac

SEQ ID NO: 1264638 - RNA, 23 nt, Human
gccugggcaacauagugagaccc

SEQ ID NO: 1264639 - RNA, 23 nt, Human
gccugggcaacauagugagaccc

SEQ ID NO: 1264640 - RNA, 19 nt, Human
gccugggccuccuaggcuc

SEQ ID NO: 1264641 - RNA, 18 nt, Human
gccuguagucccagcuac

SEQ ID NO: 1264642 - RNA, 24 nt, Human
gcgauucuccugccucagccuucc

SEQ ID NO: 1264643 - RNA, 19 nt, Human
gcuagucuugaacuccugg

SEQ ID NO: 1264644 - RNA, 23 nt, Human
gcuagucuugaacuccuggccuc

SEQ ID NO: 1264645 - RNA, 21 nt, Human
gcucguguugcccaggcugga

SEQ ID NO: 1264646 - RNA, 23 nt, Human
gcuggucucgaacuccugaccuc

SEQ ID NO: 1264647 - RNA, 19 nt, Human
ggaaaucuuuuagaaaucc

SEQ ID NO: 1264648 - RNA, 23 nt, Human
ggagguugcagugaaccaagauc

SEQ ID NO: 1264649 - RNA, 24 nt, Human
ggagguugcagugaaccaagaucg

SEQ ID NO: 1264650 - RNA, 20 nt, Human
ggagguugcagugaacugag

SEQ ID NO: 1264651 - RNA, 22 nt, Human
ggagguugcagugaacugagau

SEQ ID NO: 1264652 - RNA, 24 nt, Human
ggagguugcagugaacugagauca

SEQ ID NO: 1264653 - RNA, 20 nt, Human
ggagguugcagugaacuggc

SEQ ID NO: 1264654 - RNA, 22 nt, Human
ggaguuucaccaugucagccag

SEQ ID NO: 1264655 - RNA, 24 nt, Human
ggauuacaggcgugggccaccaug

SEQ ID NO: 1264656 - RNA, 23 nt, Human
ggauugcuugaguccaggaguuc

SEQ ID NO: 1264657 - RNA, 24 nt, Human
ggccuguagucccagcuacucuga

SEQ ID NO: 1264658 - RNA, 24 nt, Human
ggcuagucuugaacuccuggccuc

SEQ ID NO: 1264659 - RNA, 24 nt, Human
ggcuggucucgaacuccugaccuc

SEQ ID NO: 1264660 - RNA, 19 nt, Human
ggcuugacuacacugugug

SEQ ID NO: 1264661 - RNA, 24 nt, Human
gggauugcuugaguccaggaguuc

SEQ ID NO: 1264662 - RNA, 21 nt, Human
gggggauugcuugaguccagg

SEQ ID NO: 1264663 - RNA, 22 nt, Human
gggguuucaccacguuggccag

SEQ ID NO: 1264664 - RNA, 23 nt, Human
gggguuucaccacguuggccagg

SEQ ID NO: 1264665 - RNA, 22 nt, Human
ggguuucaccacguuggccagg

SEQ ID NO: 1264666 - RNA, 19 nt, Human
ggucucgaacuccugaccu

SEQ ID NO: 1264667 - RNA, 24 nt, Human
guagcugggaugacaggugugugc

SEQ ID NO: 1264668 - RNA, 24 nt, Human
guagcugggauuacaggcgugggc

SEQ ID NO: 1264669 - RNA, 18 nt, Human
guagugugggccuguagu

SEQ ID NO: 1264670 - RNA, 24 nt, Human
gugauccaacugcccugcccuccc

SEQ ID NO: 1264671 - RNA, 23 nt, Human
gugaucugcccaccuagccuccc

SEQ ID NO: 1264672 - RNA, 31 nt, Human
uaauuuuuuuuucuguauuuuuaguagagaa

SEQ ID NO: 1264673 - RNA, 24 nt, Human
uacaggcgugagccaccgcaucca

SEQ ID NO: 1264674 - RNA, 21 nt, Human
uacaggugugagccacugcau

SEQ ID NO: 1264675 - RNA, 24 nt, Human
uacaggugugagccacugcaucca

SEQ ID NO: 1264676 - RNA, 19 nt, Human
uaccugaguagcugggaug

SEQ ID NO: 1264677 - RNA, 24 nt, Human
uacuaccuauugguaaaggagauu

SEQ ID NO: 1264678 - RNA, 20 nt, Human
uacucugaacccuggaggug

SEQ ID NO: 1264679 - RNA, 22 nt, Human
uagagauggaguuucaccaugu

SEQ ID NO: 1264680 - RNA, 21 nt, Human
uagcucaugccuguaauccca

SEQ ID NO: 1264681 - RNA, 24 nt, Human
uagcucaugccuguaaucccaaca

SEQ ID NO: 1264682 - RNA, 23 nt, Human
uagcugggaugacaggugugugc

SEQ ID NO: 1264683 - RNA, 29 nt, Human
uaggaaguggagguugcagugacaacggu

SEQ ID NO: 1264684 - RNA, 24 nt, Human
uaguagagaggggguuucaccacg

SEQ ID NO: 1264685 - RNA, 24 nt, Human
uaguagagauggaguuucaccaug

SEQ ID NO: 1264686 - RNA, 26 nt, Human
uaguagagauggaguuucaccauguc

SEQ ID NO: 1264687 - RNA, 24 nt, Human
uaguagcucaugccuguaauccca

SEQ ID NO: 1264688 - RNA, 24 nt, Human
uagugugggccuguagucccagcu

SEQ ID NO: 1264689 - RNA, 21 nt, Human
uaguuugaaaaaaccugacaa

SEQ ID NO: 1264690 - RNA, 24 nt, Human
ucacugcaaccuccaccucccagg

SEQ ID NO: 1264691 - RNA, 25 nt, Human
ucacugcaaccuccaccucccaggu

SEQ ID NO: 1264692 - RNA, 27 nt, Human
ucacugcaaccuccaccucccagguuc

SEQ ID NO: 1264693 - RNA, 19 nt, Human
ucacugcaaccucugccuc

SEQ ID NO: 1264694 - RNA, 23 nt, Human
ucacugcaaccucugccucccag

SEQ ID NO: 1264695 - RNA, 23 nt, Human
ucacugcaaccucugccucccag

SEQ ID NO: 1264696 - RNA, 24 nt, Human
ucacugcaaccucugccucccagg

SEQ ID NO: 1264697 - RNA, 23 nt, Human
ucagccucuugaguagcugaggc

SEQ ID NO: 1264698 - RNA, 27 nt, Human
ucaguucacugcaaccucugccuccca

SEQ ID NO: 1264699 - RNA, 23 nt, Human
uccaaguagcugggauuacaggc

SEQ ID NO: 1264700 - RNA, 23 nt, Human
uccaaguagcugggauuacaggc

SEQ ID NO: 1264701 - RNA, 24 nt, Human
uccaaguagcugggauuacaggcg

SEQ ID NO: 1264702 - RNA, 22 nt, Human
uccagccugggcaacggcgaga

SEQ ID NO: 1264703 - RNA, 19 nt, Human
uccauggaugacuugcuug

SEQ ID NO: 1264704 - RNA, 23 nt, Human
ucccaaagugcugggauuacagg

SEQ ID NO: 1264705 - RNA, 24 nt, Human
ucccaaagugcugggauuacaggc

SEQ ID NO: 1264706 - RNA, 19 nt, Human
ucccagcuacucugaaccc

SEQ ID NO: 1264707 - RNA, 21 nt, Human
ucccagguucaagcgauucuc

SEQ ID NO: 1264708 - RNA, 24 nt, Human
ucccagguucaagcgauucuccug

SEQ ID NO: 1264709 - RNA, 21 nt, Human
ucccagguucaaggaauucuc

SEQ ID NO: 1264710 - RNA, 24 nt, Human
ucccagguucaaggaauucuccug

SEQ ID NO: 1264711 - RNA, 18 nt, Human
uccuaggcucaagugauu

SEQ ID NO: 1264712 - RNA, 19 nt, Human
uccuaggcucaagugauug

SEQ ID NO: 1264713 - RNA, 23 nt, Human
ucgcucguguugcccaggcugga

SEQ ID NO: 1264714 - RNA, 19 nt, Human
ucucaaaaaaaaacacaca

SEQ ID NO: 1264715 - RNA, 26 nt, Human
ucucaaaaaaaaacacacacacaaaa

SEQ ID NO: 1264716 - RNA, 26 nt, Human
ucuccugccucagccuuccaaguagc

SEQ ID NO: 1264717 - RNA, 18 nt, Human
ucucgaacuccugaccuc

SEQ ID NO: 1264718 - RNA, 18 nt, Human
ucucucugagaaagaaaa

SEQ ID NO: 1264719 - RNA, 22 nt, Human
ucuuaaacugaaacaguaguug

SEQ ID NO: 1264720 - RNA, 21 nt, Human
ucuugaacuccuggccucaag

SEQ ID NO: 1264721 - RNA, 18 nt, Human
ucuuuuuuuuuuuuuuuu

SEQ ID NO: 1264722 - RNA, 23 nt, Human
ugaaugaaacugcaaauguagua

SEQ ID NO: 1264723 - RNA, 23 nt, Human
ugacaagcauauuaaaagauuuc

SEQ ID NO: 1264724 - RNA, 26 nt, Human
ugacuugcuuggguaaggacaugaaa

SEQ ID NO: 1264725 - RNA, 24 nt, Human
ugaggcaggagaauugcuugaacc

SEQ ID NO: 1264726 - RNA, 25 nt, Human
ugaggcaggagaauugcuugaaccu

SEQ ID NO: 1264727 - RNA, 23 nt, Human
ugaucugcccaccuagccuccca

SEQ ID NO: 1264728 - RNA, 18 nt, Human
ugcccagaauggagugca

SEQ ID NO: 1264729 - RNA, 19 nt, Human
ugcccaggcuggaauguag

SEQ ID NO: 1264730 - RNA, 21 nt, Human
ugccucaacuaccugaguagc

SEQ ID NO: 1264731 - RNA, 22 nt, Human
ugccucaacuaccugaguagcu

SEQ ID NO: 1264732 - RNA, 24 nt, Human
ugccucaacuaccugaguagcugg

SEQ ID NO: 1264733 - RNA, 24 nt, Human
ugccucagccucuugaguagcuga

SEQ ID NO: 1264734 - RNA, 24 nt, Human
ugccucagccuuccaaguagcugg

SEQ ID NO: 1264735 - RNA, 23 nt, Human
ugccuguaaucccaacacuuugg

SEQ ID NO: 1264736 - RNA, 23 nt, Human
ugccuguaaucccaacacuuugg

SEQ ID NO: 1264737 - RNA, 24 nt, Human
ugccuguaaucccaacacuuuggg

SEQ ID NO: 1264738 - RNA, 24 nt, Human
ugcugggauuacaggcgugagcca

SEQ ID NO: 1264739 - RNA, 24 nt, Human
ugcugggauuacaggugugagcca

SEQ ID NO: 1264740 - RNA, 21 nt, Human
uggaaaaaugaaugaaacugc

SEQ ID NO: 1264741 - RNA, 24 nt, Human
uggaauguagcggcgcaaucuugg

SEQ ID NO: 1264742 - RNA, 19 nt, Human
uggagguggagguugcagu

SEQ ID NO: 1264743 - RNA, 24 nt, Human
uggaguuucaccaugucagccagg

SEQ ID NO: 1264744 - RNA, 24 nt, Human
uggccaggcuggucucgaacuccu

SEQ ID NO: 1264745 - RNA, 20 nt, Human
uggccucaagugauccaacu

SEQ ID NO: 1264746 - RNA, 22 nt, Human
ugggaugacaggugugugccac

SEQ ID NO: 1264747 - RNA, 24 nt, Human
ugggaugacaggugugugccacca

SEQ ID NO: 1264748 - RNA, 18 nt, Human
ugggauuacaggcgugag

SEQ ID NO: 1264749 - RNA, 19 nt, Human
ugggauuacaggcgugagc

SEQ ID NO: 1264750 - RNA, 21 nt, Human
ugggauuacaggcgugagcca

SEQ ID NO: 1264751 - RNA, 22 nt, Human
ugggauuacaggcgugagccac

SEQ ID NO: 1264752 - RNA, 23 nt, Human
ugggauuacaggcgugagccacc

SEQ ID NO: 1264753 - RNA, 24 nt, Human
ugggauuacaggcgugagccaccg

SEQ ID NO: 1264754 - RNA, 18 nt, Human
ugggauuacaggcguggg

SEQ ID NO: 1264755 - RNA, 21 nt, Human
ugggauuacaggcgugggcca

SEQ ID NO: 1264756 - RNA, 22 nt, Human
ugggauuacaggcgugggccac

SEQ ID NO: 1264757 - RNA, 23 nt, Human
ugggauuacaggcgugggccacc

SEQ ID NO: 1264758 - RNA, 24 nt, Human
ugggauuacaggcgugggccacca

SEQ ID NO: 1264759 - RNA, 25 nt, Human
ugggauuacaggcgugggccaccau

SEQ ID NO: 1264760 - RNA, 18 nt, Human
ugggauuacaggugugag

SEQ ID NO: 1264761 - RNA, 19 nt, Human
ugggauuacaggugugagc

SEQ ID NO: 1264762 - RNA, 21 nt, Human
ugggauuacaggugugagcca

SEQ ID NO: 1264763 - RNA, 22 nt, Human
ugggauuacaggugugagccac

SEQ ID NO: 1264764 - RNA, 22 nt, Human
ugggauuacaggugugagccac

SEQ ID NO: 1264765 - RNA, 24 nt, Human
ugggauuacaggugugagccacug

SEQ ID NO: 1264766 - RNA, 24 nt, Human
ugguagugugggccuguaguccca

SEQ ID NO: 1264767 - RNA, 22 nt, Human
uguagcggcgcaaucuuggcuc

SEQ ID NO: 1264768 - RNA, 23 nt, Human
uguagcggcgcaaucuuggcuca

SEQ ID NO: 1264769 - RNA, 23 nt, Human
uguggagcaaguuuuaaagaagc

SEQ ID NO: 1264770 - RNA, 22 nt, Human
ugugguagugugggccuguagu

SEQ ID NO: 1264771 - RNA, 20 nt, Human
ugugugccaccacucccagc

SEQ ID NO: 1264772 - RNA, 19 nt, Human
uguugcccaggcuggaaug

SEQ ID NO: 1264773 - RNA, 21 nt, Human
uguuuuguucuuacuuccccc

SEQ ID NO: 1264774 - RNA, 19 nt, Human
uuagccgggugugguagug

SEQ ID NO: 1264775 - RNA, 20 nt, Human
uuagccgggugugguagugu

SEQ ID NO: 1264776 - RNA, 18 nt, Human
uuaguagagaggggguuu

SEQ ID NO: 1264777 - RNA, 24 nt, Human
uuaguagagaggggguuucaccac

SEQ ID NO: 1264778 - RNA, 25 nt, Human
uuaguagagaggggguuucaccacg

SEQ ID NO: 1264779 - RNA, 18 nt, Human
uuaguagagauggaguuu

SEQ ID NO: 1264780 - RNA, 24 nt, Human
uuaguagagauggaguuucaccau

SEQ ID NO: 1264781 - RNA, 21 nt, Human
uucaagcgauucuccugccuc

SEQ ID NO: 1264782 - RNA, 23 nt, Human
uucaagcgauucuccugccucag

SEQ ID NO: 1264783 - RNA, 24 nt, Human
uucaagcgauucuccugccucagc

SEQ ID NO: 1264784 - RNA, 24 nt, Human
uucaguuguauguaguagcucaug

SEQ ID NO: 1264785 - RNA, 24 nt, Human
uucgcucguguugcccaggcugga

SEQ ID NO: 1264786 - RNA, 23 nt, Human
uucuuuuuuuuuuuuuuuuuggg

SEQ ID NO: 1264787 - RNA, 22 nt, Human
uugaguccaggaguucaagacc

SEQ ID NO: 1264788 - RNA, 22 nt, Human
uugcagugaaccaagaucgugc

SEQ ID NO: 1264789 - RNA, 20 nt, Human
uugcagugaacugagaucau

SEQ ID NO: 1264790 - RNA, 21 nt, Human
uugcagugaacugagaucaug

SEQ ID NO: 1264791 - RNA, 24 nt, Human
uugcuugaaccuaggaaguggagg

SEQ ID NO: 1264792 - RNA, 24 nt, Human
uuguucuuacuucccccacaagaa

SEQ ID NO: 1264793 - RNA, 21 nt, Human
uuucaccacguuggccaggcu

SEQ ID NO: 1264794 - RNA, 23 nt, Human
uuucgcucguguugcccaggcug

SEQ ID NO: 1264795 - RNA, 24 nt, Human
uuucgcucguguugcccaggcugg

SEQ ID NO: 1264796 - RNA, 22 nt, Human
uuucuguauuuuuaguagagaa

SEQ ID NO: 1264797 - RNA, 24 nt, Human
uuuucuguauuuuuaguagagaug

SEQ ID NO: 1264798 - RNA, 22 nt, Human
uuuucuguauuuuuaguagagg

SEQ ID NO: 1264799 - RNA, 24 nt, Human
uuuuuaguagagaggggguuucac

SEQ ID NO: 1264800 - RNA, 24 nt, Human
uuuuuaguagagauggaguuucac

SEQ ID NO: 1264801 - RNA, 20 nt, Human
uuuuuguauuuuuaguagag

SEQ ID NO: 1264802 - RNA, 25 nt, Human
uuuuuuuuuuuugagacggaguuuc

SEQ ID NO: 1264803 - RNA, 22 nt, Human
uuuuuuuuuuuuuugagacgga

SEQ ID NO: 1264804 - RNA, 21 nt, Human
auguucccucuccucaugaga

SEQ ID NO: 1264805 - RNA, 19 nt, Human
cagcauguucccucuccuc

SEQ ID NO: 1264806 - RNA, 27 nt, Human
cucagcauguucccucuccucaugaga

SEQ ID NO: 1264807 - RNA, 21 nt, Human
cuuggugaccagggaagucac

SEQ ID NO: 1264808 - RNA, 24 nt, Human
ucagcauguucccucuccucauga

SEQ ID NO: 1264809 - RNA, 21 nt, Human
aaccauuuuuccaugcugcuu

SEQ ID NO: 1264810 - RNA, 23 nt, Human
ucccuuuaaguuacgacgggaau

SEQ ID NO: 1264811 - RNA, 20 nt, Human
uuccaugcugcuuaagagcc

SEQ ID NO: 1264812 - RNA, 20 nt, Human
aaaaucuucccauacaucau

SEQ ID NO: 1264813 - RNA, 19 nt, Human
aagggccucuucaggaaca

SEQ ID NO: 1264814 - RNA, 18 nt, Human
aauuucaagcugagauaa

SEQ ID NO: 1264815 - RNA, 19 nt, Human
agcugccaucagucuuugc

SEQ ID NO: 1264816 - RNA, 24 nt, Human
aggaacagaaaaguggccgguacc

SEQ ID NO: 1264817 - RNA, 20 nt, Human
auccaagaaaaagugguuuc

SEQ ID NO: 1264818 - RNA, 23 nt, Human
caaaauucuaguaaauacuccuc

SEQ ID NO: 1264819 - RNA, 19 nt, Human
caggaacagaaaaguggca

SEQ ID NO: 1264820 - RNA, 19 nt, Human
cagguaaguacagaaaccc

SEQ ID NO: 1264821 - RNA, 21 nt, Human
caucaaaaacgaugacgcgau

SEQ ID NO: 1264822 - RNA, 22 nt, Human
ccauacaucaugaaaacuugga

SEQ ID NO: 1264823 - RNA, 21 nt, Human
cucagaauccaaacaugcaga

SEQ ID NO: 1264824 - RNA, 20 nt, Human
cuucccauacaucaugaaaa

SEQ ID NO: 1264825 - RNA, 22 nt, Human
uauuaugcacaaaagggccucu

SEQ ID NO: 1264826 - RNA, 21 nt, Human
uccuuaauugaauuaaguuug

SEQ ID NO: 1264827 - RNA, 18 nt, Human
ucuuugcucagaauccaa

SEQ ID NO: 1264828 - RNA, 19 nt, Human
ugaaaugucuucauuuuag

SEQ ID NO: 1264829 - RNA, 22 nt, Human
ugacacaaaauucuaguaaaaa

SEQ ID NO: 1264830 - RNA, 25 nt, Human
ugacacaaaauucuaguaaauacuc

SEQ ID NO: 1264831 - RNA, 20 nt, Human
ugacgcgauccgcuagauag

SEQ ID NO: 1264832 - RNA, 22 nt, Human
ugcccaaacaaagggcuaaagc

SEQ ID NO: 1264833 - RNA, 18 nt, Human
ugcucagaauccaaacau

SEQ ID NO: 1264834 - RNA, 19 nt, Human
uggcaaaccagguaaguac

SEQ ID NO: 1264835 - RNA, 22 nt, Human
uggggcauaaaauccugauuca

SEQ ID NO: 1264836 - RNA, 24 nt, Human
uguuuauuuaucaaaugucaauca

SEQ ID NO: 1264837 - RNA, 24 nt, Human
uucaagcugagauaaaaauuuauu

SEQ ID NO: 1264838 - RNA, 20 nt, Human
uucaggaacagaaaaguggc

SEQ ID NO: 1264839 - RNA, 22 nt, Human
uuucaacuacaauuuagaaccc

SEQ ID NO: 1264840 - RNA, 23 nt, Human
aaacagguagggaauauguccag

SEQ ID NO: 1264841 - RNA, 21 nt, Human
acagcagagugccaagggccc

SEQ ID NO: 1264842 - RNA, 24 nt, Human
agcagcagccagcggggcgggggg

SEQ ID NO: 1264843 - RNA, 19 nt, Human
agcgccgcucacagccgcc

SEQ ID NO: 1264844 - RNA, 21 nt, Human
auggggcagaggcccucgaag

SEQ ID NO: 1264845 - RNA, 19 nt, Human
caccaugugagcagcagcc

SEQ ID NO: 1264846 - RNA, 21 nt, Human
caccaugugagcagcagccag

SEQ ID NO: 1264847 - RNA, 23 nt, Human
cacggcguuacuaagccugcgcc

SEQ ID NO: 1264848 - RNA, 25 nt, Human
cacggcguuacuaagccugcgccac

SEQ ID NO: 1264849 - RNA, 21 nt, Human
cacugcauguggcggcagggc

SEQ ID NO: 1264850 - RNA, 18 nt, Human
cagaggcccucgaagguc

SEQ ID NO: 1264851 - RNA, 26 nt, Human
cauccacugauugucgcugcagucca

SEQ ID NO: 1264852 - RNA, 23 nt, Human
ccagcccggcucggcuccccgcc

SEQ ID NO: 1264853 - RNA, 24 nt, Human
ccccaggaggcgcuaccaggcucu

SEQ ID NO: 1264854 - RNA, 20 nt, Human
ccccguccgccugccgccag

SEQ ID NO: 1264855 - RNA, 21 nt, Human
cccgagcgccgcucacagccg

SEQ ID NO: 1264856 - RNA, 22 nt, Human
cccgcaugaacuacagcagagu

SEQ ID NO: 1264857 - RNA, 24 nt, Human
cccggcucgcgccgcacgcgcccg

SEQ ID NO: 1264858 - RNA, 23 nt, Human
cccggcucggcuccccgccuagc

SEQ ID NO: 1264859 - RNA, 21 nt, Human
ccgcacgcgcccgccccgucc

SEQ ID NO: 1264860 - RNA, 19 nt, Human
ccgccugccgccagcccgg

SEQ ID NO: 1264861 - RNA, 23 nt, Human
ccggccggccggcccuaccagcg

SEQ ID NO: 1264862 - RNA, 20 nt, Human
ccggcucgcgccgcacgcgc

SEQ ID NO: 1264863 - RNA, 23 nt, Human
cgcucacagccgcccgcccagcg

SEQ ID NO: 1264864 - RNA, 18 nt, Human
cggcccuaccagcggccc

SEQ ID NO: 1264865 - RNA, 18 nt, Human
cggcggcgcuccgcccgc

SEQ ID NO: 1264866 - RNA, 21 nt, Human
cucgaagguccccuccucagu

SEQ ID NO: 1264867 - RNA, 20 nt, Human
cugcgccacccacgugcugc

SEQ ID NO: 1264868 - RNA, 20 nt, Human
cuuguccucagcgcccggcc

SEQ ID NO: 1264869 - RNA, 21 nt, Human
gagcagcagccagcggggcgg

SEQ ID NO: 1264870 - RNA, 22 nt, Human
gagcagcagccagcggggcggg

SEQ ID NO: 1264871 - RNA, 23 nt, Human
gaggcgcuaccaggcucuucggg

SEQ ID NO: 1264872 - RNA, 23 nt, Human
gcagcagccagcggggcgggggg

SEQ ID NO: 1264873 - RNA, 23 nt, Human
gcccagacaccaugugagcagca

SEQ ID NO: 1264874 - RNA, 21 nt, Human
gccccgagcgccgcucacagc

SEQ ID NO: 1264875 - RNA, 22 nt, Human
gccccguccgccugccgccagc

SEQ ID NO: 1264876 - RNA, 18 nt, Human
gcgccacccacgugcugc

SEQ ID NO: 1264877 - RNA, 18 nt, Human
ggcuccaugauugugggg

SEQ ID NO: 1264878 - RNA, 23 nt, Human
gggcagcuucaagggcacauggg

SEQ ID NO: 1264879 - RNA, 20 nt, Human
uacagcagagugccaagggc

SEQ ID NO: 1264880 - RNA, 21 nt, Human
ucagcgcccggcucgcgccgc

SEQ ID NO: 1264881 - RNA, 20 nt, Human
uccacggcguuacuaagccu

SEQ ID NO: 1264882 - RNA, 23 nt, Human
uccacggcguuacuaagccugcg

SEQ ID NO: 1264883 - RNA, 22 nt, Human
uccugagcgcguggccuuccug

SEQ ID NO: 1264884 - RNA, 18 nt, Human
ucgaagguccccuccuca

SEQ ID NO: 1264885 - RNA, 19 nt, Human
ucgcugcaguccacggcgu

SEQ ID NO: 1264886 - RNA, 18 nt, Human
ucuucgggccacaggccu

SEQ ID NO: 1264887 - RNA, 22 nt, Human
ucuuuuuuuauacacaauacuu

SEQ ID NO: 1264888 - RNA, 21 nt, Human
ugaaauaaaacagguagggaa

SEQ ID NO: 1264889 - RNA, 21 nt, Human
uggcggcagggcggguagguc

SEQ ID NO: 1264890 - RNA, 21 nt, Human
uggcggcagggcggguagguc

SEQ ID NO: 1264891 - RNA, 21 nt, Human
uguccagugcaaacagaggac

SEQ ID NO: 1264892 - RNA, 23 nt, Human
uguggcggcagggcggguagguc

SEQ ID NO: 1264893 - RNA, 25 nt, Human
aaaaaucagugcaagauuccaauaa

SEQ ID NO: 1264894 - RNA, 23 nt, Human
aaaaauuucucaacaauuuauaa

SEQ ID NO: 1264895 - RNA, 21 nt, Human
aaaauaaucauuacacuuccu

SEQ ID NO: 1264896 - RNA, 18 nt, Human
aaacacugaaagcaccac

SEQ ID NO: 1264897 - RNA, 19 nt, Human
aaacacugaaagcaccacu

SEQ ID NO: 1264898 - RNA, 25 nt, Human
aagcgauucuccagccucagccucc

SEQ ID NO: 1264899 - RNA, 24 nt, Human
aagcuguuuacacacaggaaaggg

SEQ ID NO: 1264900 - RNA, 23 nt, Human
aaucaccgucaucuauaaucuuu

SEQ ID NO: 1264901 - RNA, 24 nt, Human
accaaagugcaaagucaguucccc

SEQ ID NO: 1264902 - RNA, 21 nt, Human
acuuccucucauugcagaaac

SEQ ID NO: 1264903 - RNA, 24 nt, Human
agacaccaugaaaucaccucaacu

SEQ ID NO: 1264904 - RNA, 22 nt, Human
agagacaaggucucgcucuguu

SEQ ID NO: 1264905 - RNA, 18 nt, Human
agagccuggaaagacacc

SEQ ID NO: 1264906 - RNA, 23 nt, Human
agaguacaaaccgcaucccacca

SEQ ID NO: 1264907 - RNA, 27 nt, Human
agaugcugaagacuaccauuaugugcu

SEQ ID NO: 1264908 - RNA, 22 nt, Human
aggaacugugaagauguagccg

SEQ ID NO: 1264909 - RNA, 25 nt, Human
aggugucaaaggcaaguaacacuuc

SEQ ID NO: 1264910 - RNA, 21 nt, Human
agugcagugguacaaucacag

SEQ ID NO: 1264911 - RNA, 24 nt, Human
aucuauaaucuuuauuagguaguc

SEQ ID NO: 1264912 - RNA, 21 nt, Human
augcaaacacauauacacacu

SEQ ID NO: 1264913 - RNA, 18 nt, Human
augcacaggugucaaagg

SEQ ID NO: 1264914 - RNA, 21 nt, Human
caaaaacacugaaagcaccac

SEQ ID NO: 1264915 - RNA, 21 nt, Human
caaaaacacugaaagcaccac

SEQ ID NO: 1264916 - RNA, 23 nt, Human
caaacucaacauaucagcagcaa

SEQ ID NO: 1264917 - RNA, 23 nt, Human
caaccuaucgaaguccaaaccaa

SEQ ID NO: 1264918 - RNA, 25 nt, Human
caaugaauuccacuguaagccaagc

SEQ ID NO: 1264919 - RNA, 25 nt, Human
cacacaggaaagggcaggcauaacg

SEQ ID NO: 1264920 - RNA, 25 nt, Human
cacaccuggccuugaaacauuauuu

SEQ ID NO: 1264921 - RNA, 18 nt, Human
cacuuuuaccaacaaagc

SEQ ID NO: 1264922 - RNA, 20 nt, Human
cagcaugcaugggagaucac

SEQ ID NO: 1264923 - RNA, 22 nt, Human
cagccucagccucccaaaguag

SEQ ID NO: 1264924 - RNA, 21 nt, Human
cauaaaaagaauuaagaccgc

SEQ ID NO: 1264925 - RNA, 23 nt, Human
ccaaaaacacugaaagcaccagu

SEQ ID NO: 1264926 - RNA, 19 nt, Human
ccaagccaaguaagaugcu

SEQ ID NO: 1264927 - RNA, 19 nt, Human
cccaauguacaagcagagc

SEQ ID NO: 1264928 - RNA, 19 nt, Human
cccgagcuggagugcagug

SEQ ID NO: 1264929 - RNA, 21 nt, Human
ccuauguauucuaguugacca

SEQ ID NO: 1264930 - RNA, 19 nt, Human
ccugagguuccagagaagu

SEQ ID NO: 1264931 - RNA, 23 nt, Human
cuccagccucagccucccaaagu

SEQ ID NO: 1264932 - RNA, 25 nt, Human
cuucauagccccuuaacaugucacu

SEQ ID NO: 1264933 - RNA, 18 nt, Human
gaaagaaaauuaagagua

SEQ ID NO: 1264934 - RNA, 21 nt, Human
gaacacuaucugccaaaaaca

SEQ ID NO: 1264935 - RNA, 20 nt, Human
gaaucagaguacaaaccgca

SEQ ID NO: 1264936 - RNA, 24 nt, Human
gagugcagugguacaaucacagcu

SEQ ID NO: 1264937 - RNA, 21 nt, Human
gcaucauuuucaaugucuucu

SEQ ID NO: 1264938 - RNA, 20 nt, Human
gcauuuguuucaagccuuga

SEQ ID NO: 1264939 - RNA, 23 nt, Human
gccucaagcgauucuccagccuc

SEQ ID NO: 1264940 - RNA, 24 nt, Human
gcgauucuccagccucagccuccc

SEQ ID NO: 1264941 - RNA, 21 nt, Human
ggaaagacgagauauaugaga

SEQ ID NO: 1264942 - RNA, 22 nt, Human
ggaacacuaucugccaaaaaca

SEQ ID NO: 1264943 - RNA, 21 nt, Human
ggagaggauucucaaaacaga

SEQ ID NO: 1264944 - RNA, 21 nt, Human
ggaucuagucauuaaaacaua

SEQ ID NO: 1264945 - RNA, 20 nt, Human
gggaaaauggagaggauucu

SEQ ID NO: 1264946 - RNA, 22 nt, Human
ggucuuugucagauaauuucug

SEQ ID NO: 1264947 - RNA, 20 nt, Human
guuuauuucaugcugaacua

SEQ ID NO: 1264948 - RNA, 22 nt, Human
uaaaacauaugcacagguguca

SEQ ID NO: 1264949 - RNA, 25 nt, Human
uaaacuguauuuuaacuuagcacaa

SEQ ID NO: 1264950 - RNA, 25 nt, Human
uaaugaacacuucucccuauguauu

SEQ ID NO: 1264951 - RNA, 24 nt, Human
uacucauagucaguguuacacuag

SEQ ID NO: 1264952 - RNA, 21 nt, Human
uacugccgagaaaugggcggg

SEQ ID NO: 1264953 - RNA, 24 nt, Human
uagaaguauuccuuccaucaaccu

SEQ ID NO: 1264954 - RNA, 22 nt, Human
uagagacaaggucucgcucugu

SEQ ID NO: 1264955 - RNA, 21 nt, Human
uauagauucaaaagcagucac

SEQ ID NO: 1264956 - RNA, 25 nt, Human
uauguaaaugcaaacacauauacac

SEQ ID NO: 1264957 - RNA, 23 nt, Human
uauuagguagucccuggucuuug

SEQ ID NO: 1264958 - RNA, 22 nt, Human
uauuucaugcugaacuagaagu

SEQ ID NO: 1264959 - RNA, 19 nt, Human
ucaagagccuggaaagaca

SEQ ID NO: 1264960 - RNA, 21 nt, Human
ucaaugucuucugccuuccug

SEQ ID NO: 1264961 - RNA, 23 nt, Human
ucaaugucuucugccuuccugug

SEQ ID NO: 1264962 - RNA, 18 nt, Human
ucagugcaagauuccaau

SEQ ID NO: 1264963 - RNA, 22 nt, Human
ucauggggcaaacgauggaaaa

SEQ ID NO: 1264964 - RNA, 18 nt, Human
ucaugucggcucugaaau

SEQ ID NO: 1264965 - RNA, 22 nt, Human
uccaaggagaaauacuucaaga

SEQ ID NO: 1264966 - RNA, 22 nt, Human
ucccuauguauucuaguugacc

SEQ ID NO: 1264967 - RNA, 25 nt, Human
ucggaggaacugugaagauguagca

SEQ ID NO: 1264968 - RNA, 24 nt, Human
ucucgcucuguuccccgagcugga

SEQ ID NO: 1264969 - RNA, 19 nt, Human
ucuguaaaucugaccuugc

SEQ ID NO: 1264970 - RNA, 20 nt, Human
ucuguguaaccaaagugcaa

SEQ ID NO: 1264971 - RNA, 22 nt, Human
ugaaaucaccucaacucaagug

SEQ ID NO: 1264972 - RNA, 18 nt, Human
ugaaggccauguuuuucc

SEQ ID NO: 1264973 - RNA, 23 nt, Human
ugaaugucuacacuaugaaaaug

SEQ ID NO: 1264974 - RNA, 20 nt, Human
ugagaauuacauuucuccuu

SEQ ID NO: 1264975 - RNA, 21 nt, Human
ugagugauauagucacuguug

SEQ ID NO: 1264976 - RNA, 20 nt, Human
ugauaggagcuauggugagg

SEQ ID NO: 1264977 - RNA, 19 nt, Human
uggaaaagcuguuuuagcc

SEQ ID NO: 1264978 - RNA, 23 nt, Human
uggaacacuaucugccaaaaaca

SEQ ID NO: 1264979 - RNA, 24 nt, Human
uggaacacuaucugccaaaaacac

SEQ ID NO: 1264980 - RNA, 18 nt, Human
uggagugcagugguacaa

SEQ ID NO: 1264981 - RNA, 19 nt, Human
uggagugcagugguacaau

SEQ ID NO: 1264982 - RNA, 21 nt, Human
uggagugcagugguacaauca

SEQ ID NO: 1264983 - RNA, 23 nt, Human
uggcagcaugcaugggagaucac

SEQ ID NO: 1264984 - RNA, 24 nt, Human
ugggauuucaggcaugaaucacca

SEQ ID NO: 1264985 - RNA, 20 nt, Human
ugggcggguccugagguucc

SEQ ID NO: 1264986 - RNA, 23 nt, Human
uggggcaaacgauggaaaagcug

SEQ ID NO: 1264987 - RNA, 22 nt, Human
ugguacaaucacagcucacuag

SEQ ID NO: 1264988 - RNA, 24 nt, Human
ugguauauacuacuccaaggagaa

SEQ ID NO: 1264989 - RNA, 22 nt, Human
uguaaccaaagugcaaagucag

SEQ ID NO: 1264990 - RNA, 18 nt, Human
uguacaagcagagcaggu

SEQ ID NO: 1264991 - RNA, 23 nt, Human
ugucaaaggcaaguaacacuacc

SEQ ID NO: 1264992 - RNA, 21 nt, Human
ugugaaucagaguacaaaccg

SEQ ID NO: 1264993 - RNA, 21 nt, Human
uguuaugacauucguaagugg

SEQ ID NO: 1264994 - RNA, 24 nt, Human
uuacugcauccaauauagcaaaag

SEQ ID NO: 1264995 - RNA, 20 nt, Human
uuagauccaaugcugaguga

SEQ ID NO: 1264996 - RNA, 18 nt, Human
uuccaauaagaaacaagg

SEQ ID NO: 1264997 - RNA, 23 nt, Human
uuccacuguaagccaagccaagu

SEQ ID NO: 1264998 - RNA, 24 nt, Human
uucgcuaguuaggucuguucuucu

SEQ ID NO: 1264999 - RNA, 22 nt, Human
uucggauuccagguaaagcagg

SEQ ID NO: 1265000 - RNA, 22 nt, Human
uuggaucuagucauuaaaacau

SEQ ID NO: 1265001 - RNA, 18 nt, Human
uuuaaagaacaaacucaa

SEQ ID NO: 1265002 - RNA, 21 nt, Human
uuucaugcugaacuagaaguc

SEQ ID NO: 1265003 - RNA, 19 nt, Human
aagaagcauuaagccaugg

SEQ ID NO: 1265004 - RNA, 22 nt, Human
aagagggagccagcccagcauc

SEQ ID NO: 1265005 - RNA, 25 nt, Human
aagugaacuccuauccucaaacccg

SEQ ID NO: 1265006 - RNA, 21 nt, Human
acucugugaagugcccugggg

SEQ ID NO: 1265007 - RNA, 20 nt, Human
agcaucaccccaugaaagac

SEQ ID NO: 1265008 - RNA, 23 nt, Human
aggagccggaagcgguggcaugg

SEQ ID NO: 1265009 - RNA, 18 nt, Human
agggaaagcacaggagcc

SEQ ID NO: 1265010 - RNA, 21 nt, Human
agugaacuccuauccucaaac

SEQ ID NO: 1265011 - RNA, 26 nt, Human
caaacagaaaaugaaagaagggaccc

SEQ ID NO: 1265012 - RNA, 19 nt, Human
caaagcaacuugcaaagau

SEQ ID NO: 1265013 - RNA, 24 nt, Human
caacuaagacauuuguauaaaaca

SEQ ID NO: 1265014 - RNA, 21 nt, Human
cacaggagccggaagcggugg

SEQ ID NO: 1265015 - RNA, 19 nt, Human
cagcucagggaaagcacag

SEQ ID NO: 1265016 - RNA, 24 nt, Human
cagggaaagcacaggagccggaag

SEQ ID NO: 1265017 - RNA, 19 nt, Human
ccagcacacucugugaagu

SEQ ID NO: 1265018 - RNA, 23 nt, Human
cccaggacccaauguuacugccc

SEQ ID NO: 1265019 - RNA, 21 nt, Human
cccaugaaagacccaggaccc

SEQ ID NO: 1265020 - RNA, 20 nt, Human
cccaugcacgucacacacag

SEQ ID NO: 1265021 - RNA, 21 nt, Human
cccaugcacgucacacacaga

SEQ ID NO: 1265022 - RNA, 22 nt, Human
cccaugcacgucacacacagaa

SEQ ID NO: 1265023 - RNA, 19 nt, Human
ccccucucagcaagccuca

SEQ ID NO: 1265024 - RNA, 18 nt, Human
cccgaugacccacaaaca

SEQ ID NO: 1265025 - RNA, 18 nt, Human
cccgcaaguucccggccc

SEQ ID NO: 1265026 - RNA, 21 nt, Human
cccgggacaccuggccccggg

SEQ ID NO: 1265027 - RNA, 21 nt, Human
ccuccagcacacucugugaag

SEQ ID NO: 1265028 - RNA, 18 nt, Human
cuaaacggccaccacuaa

SEQ ID NO: 1265029 - RNA, 19 nt, Human
cuaaacggccaccacuaaa

SEQ ID NO: 1265030 - RNA, 24 nt, Human
cuccagcacacucugugaagugcc

SEQ ID NO: 1265031 - RNA, 23 nt, Human
cugcccuaccagggcaaagcaac

SEQ ID NO: 1265032 - RNA, 21 nt, Human
gacagccccucucagcaagcc

SEQ ID NO: 1265033 - RNA, 25 nt, Human
gcccgggacaccuggccccgggggc

SEQ ID NO: 1265034 - RNA, 22 nt, Human
ggacaccuggccccgggggcuc

SEQ ID NO: 1265035 - RNA, 22 nt, Human
ggacagccccucucagcaagcc

SEQ ID NO: 1265036 - RNA, 19 nt, Human
ggccuugcagcagugaaaa

SEQ ID NO: 1265037 - RNA, 18 nt, Human
gggaagaccaagagggag

SEQ ID NO: 1265038 - RNA, 23 nt, Human
uaaaacaaacagaaaaugaaaga

SEQ ID NO: 1265039 - RNA, 18 nt, Human
uagcaggacaccaaaacc

SEQ ID NO: 1265040 - RNA, 21 nt, Human
ucccggccccaaaggaagccc

SEQ ID NO: 1265041 - RNA, 22 nt, Human
ucccuucucucauuuuuccaca

SEQ ID NO: 1265042 - RNA, 22 nt, Human
uccucaaacccgcaaguucccg

SEQ ID NO: 1265043 - RNA, 26 nt, Human
ugaaagaagcauuaagccaugggaga

SEQ ID NO: 1265044 - RNA, 24 nt, Human
ugaagugcccugggggcaaugaaa

SEQ ID NO: 1265045 - RNA, 23 nt, Human
ugcaaagaugguggcuaaacggc

SEQ ID NO: 1265046 - RNA, 20 nt, Human
uggcaugggcagcauuucuu

SEQ ID NO: 1265047 - RNA, 20 nt, Human
uggccccgggggcucggcgg

SEQ ID NO: 1265048 - RNA, 22 nt, Human
uggcuaaacggccaccacuaaa

SEQ ID NO: 1265049 - RNA, 21 nt, Human
ugggacuuuauuuguacaacu

SEQ ID NO: 1265050 - RNA, 20 nt, Human
ugucccuucucucauuuuuc

SEQ ID NO: 1265051 - RNA, 19 nt, Human
uuaagaguagaaauuggag

SEQ ID NO: 1265052 - RNA, 18 nt, Human
uucccgaugacccacaaa

SEQ ID NO: 1265053 - RNA, 24 nt, Human
uucccgaugacccacaaacaaguu

SEQ ID NO: 1265054 - RNA, 22 nt, Human
uucccggccccaaaggaagccc

SEQ ID NO: 1265055 - RNA, 24 nt, Human
uucccggccccaaaggaagcccuc

SEQ ID NO: 1265056 - RNA, 22 nt, Human
uugaaugugucccuucucucau

SEQ ID NO: 1265057 - RNA, 19 nt, Human
uuuguacaacuaagacauu

SEQ ID NO: 1265058 - RNA, 24 nt, Human
uuuguacaacuaagacauuuguau

SEQ ID NO: 1265059 - RNA, 24 nt, Human
aacaucauuuuuacaaagcaauuc

SEQ ID NO: 1265060 - RNA, 21 nt, Human
agacccagaaaucugugagcu

SEQ ID NO: 1265061 - RNA, 19 nt, Human
auaauacagcuuugcaaaa

SEQ ID NO: 1265062 - RNA, 23 nt, Human
auucugcaaucuucaacacaaga

SEQ ID NO: 1265063 - RNA, 20 nt, Human
auuuuuacaaagcaauucug

SEQ ID NO: 1265064 - RNA, 22 nt, Human
cgccuguaacauucaacggcuu

SEQ ID NO: 1265065 - RNA, 19 nt, Human
gcaaaauagaauccucuca

SEQ ID NO: 1265066 - RNA, 25 nt, Human
uaaagaagacccagaaaucugugag

SEQ ID NO: 1265067 - RNA, 23 nt, Human
uauuccauccaucuucaccuuca

SEQ ID NO: 1265068 - RNA, 26 nt, Human
uauuuugcucuuccaucaguaacauc

SEQ ID NO: 1265069 - RNA, 24 nt, Human
ucaacggcuuucucuguguuuucu

SEQ ID NO: 1265070 - RNA, 21 nt, Human
ucgcugcccuuucaacccagu

SEQ ID NO: 1265071 - RNA, 23 nt, Human
ucuuccaucaguaacaucauuuu

SEQ ID NO: 1265072 - RNA, 18 nt, Human
ugacugaauccagucaaa

SEQ ID NO: 1265073 - RNA, 23 nt, Human
ugacugaauccagucaaaaaguu

SEQ ID NO: 1265074 - RNA, 19 nt, Human
ugggaaaaguuucgcugcc

SEQ ID NO: 1265075 - RNA, 24 nt, Human
uucauaauacagcuuugcaaaaua

SEQ ID NO: 1265076 - RNA, 23 nt, Human
cuaaguugguugcuuuuugguga

SEQ ID NO: 1265077 - RNA, 21 nt, Human
uaaguugguugcuuuuuggug

SEQ ID NO: 1265078 - RNA, 26 nt, Human
aagacaguuaugacauugacacaugc

SEQ ID NO: 1265079 - RNA, 21 nt, Human
auucgugacagauucuucccc

SEQ ID NO: 1265080 - RNA, 22 nt, Human
caaagggcuucuucuguugccc

SEQ ID NO: 1265081 - RNA, 21 nt, Human
caauguacuccuucuucccca

SEQ ID NO: 1265082 - RNA, 22 nt, Human
cacaugcaugagcuauuauaca

SEQ ID NO: 1265083 - RNA, 20 nt, Human
cagcaaaucucaauuuguca

SEQ ID NO: 1265084 - RNA, 19 nt, Human
caguaggagugaauggcug

SEQ ID NO: 1265085 - RNA, 22 nt, Human
cagucagccucguucaaaguuu

SEQ ID NO: 1265086 - RNA, 22 nt, Human
caucuugucucaucaguaggag

SEQ ID NO: 1265087 - RNA, 24 nt, Human
ccagagugcagaagcguauaaaga

SEQ ID NO: 1265088 - RNA, 22 nt, Human
cccacacggaacacggcagcau

SEQ ID NO: 1265089 - RNA, 25 nt, Human
cccccuucaauguacuccuucuucc

SEQ ID NO: 1265090 - RNA, 25 nt, Human
ccggcgugcgcgccccgugacuccu

SEQ ID NO: 1265091 - RNA, 23 nt, Human
cgccucugcuccauugacggucu

SEQ ID NO: 1265092 - RNA, 20 nt, Human
cuccagggucuccaccaggu

SEQ ID NO: 1265093 - RNA, 21 nt, Human
gacagggugugcuuccuccag

SEQ ID NO: 1265094 - RNA, 18 nt, Human
gccccuggaugggcuugg

SEQ ID NO: 1265095 - RNA, 19 nt, Human
gcuggggggacaguggcac

SEQ ID NO: 1265096 - RNA, 19 nt, Human
gcuugcugauuuucccaca

SEQ ID NO: 1265097 - RNA, 22 nt, Human
gcuugcugauuuucccacaacc

SEQ ID NO: 1265098 - RNA, 22 nt, Human
ggacagggugugcuuccuccag

SEQ ID NO: 1265099 - RNA, 23 nt, Human
uaugacauugacacaugcauggu

SEQ ID NO: 1265100 - RNA, 21 nt, Human
ucagguucugcagcuccaggg

SEQ ID NO: 1265101 - RNA, 23 nt, Human
ucccacacggaacacggcagcau

SEQ ID NO: 1265102 - RNA, 20 nt, Human
ucuucagaugcuucaggucu

SEQ ID NO: 1265103 - RNA, 19 nt, Human
ucuucuguugccccuggau

SEQ ID NO: 1265104 - RNA, 25 nt, Human
ugacacaugcaugagcuauuauaca

SEQ ID NO: 1265105 - RNA, 20 nt, Human
ugacuccuuccccgccucug

SEQ ID NO: 1265106 - RNA, 24 nt, Human
ugauucugucaucaccacaucuug

SEQ ID NO: 1265107 - RNA, 20 nt, Human
ugcuuccuccagugcaccuc

SEQ ID NO: 1265108 - RNA, 21 nt, Human
uuccagaccauuccccgguca

SEQ ID NO: 1265109 - RNA, 19 nt, Human
uuccuccagugcaccucaa

SEQ ID NO: 1265110 - RNA, 22 nt, Human
aaaaauccaggagaaaagggga

SEQ ID NO: 1265111 - RNA, 23 nt, Human
aaaccccaaagugccacugaaaa

SEQ ID NO: 1265112 - RNA, 19 nt, Human
aaacucagagguccugaua

SEQ ID NO: 1265113 - RNA, 23 nt, Human
aaagugccacugaaaagcaauug

SEQ ID NO: 1265114 - RNA, 20 nt, Human
aagaacccagggcacuggaa

SEQ ID NO: 1265115 - RNA, 22 nt, Human
aagagccaggggagggcauggg

SEQ ID NO: 1265116 - RNA, 22 nt, Human
aaucagacaggaaaccccaaag

SEQ ID NO: 1265117 - RNA, 24 nt, Human
acaaagcagacaaaaauccaggag

SEQ ID NO: 1265118 - RNA, 25 nt, Human
acacacuuccccgucuucucuccca

SEQ ID NO: 1265119 - RNA, 20 nt, Human
acagccccaccugugaggcc

SEQ ID NO: 1265120 - RNA, 18 nt, Human
accagcaucaagcccugc

SEQ ID NO: 1265121 - RNA, 22 nt, Human
accccaaagugccacugaaaag

SEQ ID NO: 1265122 - RNA, 23 nt, Human
accccaaagugccacugaaaagc

SEQ ID NO: 1265123 - RNA, 22 nt, Human
accggcggguucaggccagucu

SEQ ID NO: 1265124 - RNA, 21 nt, Human
agaaagguugugaggcuggag

SEQ ID NO: 1265125 - RNA, 21 nt, Human
agagggcagggaggcaugggg

SEQ ID NO: 1265126 - RNA, 24 nt, Human
agaggugcuccagggacagggugc

SEQ ID NO: 1265127 - RNA, 23 nt, Human
agcagacaaaaauccaggagaaa

SEQ ID NO: 1265128 - RNA, 21 nt, Human
agccagcgucgcacuggcccc

SEQ ID NO: 1265129 - RNA, 21 nt, Human
agccaggggagggcauggggc

SEQ ID NO: 1265130 - RNA, 19 nt, Human
agccccucagcuccuggca

SEQ ID NO: 1265131 - RNA, 21 nt, Human
agccccugcaaccccagguac

SEQ ID NO: 1265132 - RNA, 24 nt, Human
agcccuggcucuuuugucacugug

SEQ ID NO: 1265133 - RNA, 18 nt, Human
agcuccacucucaccccu

SEQ ID NO: 1265134 - RNA, 23 nt, Human
aggaaacaagccggcuuuguuuu

SEQ ID NO: 1265135 - RNA, 23 nt, Human
aggaaaccccaaagugccacuga

SEQ ID NO: 1265136 - RNA, 26 nt, Human
aggaaacccuguccaggccccaaccc

SEQ ID NO: 1265137 - RNA, 18 nt, Human
aggaaccccuccagcucc

SEQ ID NO: 1265138 - RNA, 23 nt, Human
aggaauguguacacucuggcucu

SEQ ID NO: 1265139 - RNA, 21 nt, Human
aggagaagcccagaggacagc

SEQ ID NO: 1265140 - RNA, 21 nt, Human
aggaugcagagcuccagagcu

SEQ ID NO: 1265141 - RNA, 19 nt, Human
aggcagaagaguuguuucu

SEQ ID NO: 1265142 - RNA, 27 nt, Human
aggcaggaagcagguuccccgccugga

SEQ ID NO: 1265143 - RNA, 23 nt, Human
aggcagugagccagaccccaggg

SEQ ID NO: 1265144 - RNA, 19 nt, Human
agggagaugucugugagug

SEQ ID NO: 1265145 - RNA, 23 nt, Human
aggggcucugcaaggacaggcuu

SEQ ID NO: 1265146 - RNA, 24 nt, Human
agggggcugcgaggcagagcuggg

SEQ ID NO: 1265147 - RNA, 22 nt, Human
agggguaggggaaccucgacca

SEQ ID NO: 1265148 - RNA, 18 nt, Human
aggguauccugcuucccc

SEQ ID NO: 1265149 - RNA, 22 nt, Human
aucucauucccccaccugccag

SEQ ID NO: 1265150 - RNA, 20 nt, Human
auguccacuuucucaucuca

SEQ ID NO: 1265151 - RNA, 20 nt, Human
caaaacacugggcccugagc

SEQ ID NO: 1265152 - RNA, 23 nt, Human
cacagaaagucagaaaacucaga

SEQ ID NO: 1265153 - RNA, 22 nt, Human
caccaccagcaucaagcccugc

SEQ ID NO: 1265154 - RNA, 23 nt, Human
caccaccagcaucaagcccugcu

SEQ ID NO: 1265155 - RNA, 20 nt, Human
caccuguucccacucuuugg

SEQ ID NO: 1265156 - RNA, 24 nt, Human
cacuggccccaccgaggccucagc

SEQ ID NO: 1265157 - RNA, 20 nt, Human
cagaaagucagaaaacucag

SEQ ID NO: 1265158 - RNA, 21 nt, Human
cagacaaaaauccaggagaaa

SEQ ID NO: 1265159 - RNA, 22 nt, Human
cagagcccagaccccacucagc

SEQ ID NO: 1265160 - RNA, 19 nt, Human
cagcagacaguccccaccu

SEQ ID NO: 1265161 - RNA, 20 nt, Human
cagcuccuggcagccuuccu

SEQ ID NO: 1265162 - RNA, 21 nt, Human
caggaugcagagcuccagagc

SEQ ID NO: 1265163 - RNA, 23 nt, Human
caggcuggggagagcaaggaggu

SEQ ID NO: 1265164 - RNA, 21 nt, Human
caggucuugagucccuggaca

SEQ ID NO: 1265165 - RNA, 23 nt, Human
caggugcuagccccucagcuccu

SEQ ID NO: 1265166 - RNA, 22 nt, Human
cagguggagcgguggagcugug

SEQ ID NO: 1265167 - RNA, 21 nt, Human
ccaaagugccacugaaaagca

SEQ ID NO: 1265168 - RNA, 20 nt, Human
ccacagguaaagcaaaccca

SEQ ID NO: 1265169 - RNA, 21 nt, Human
ccacagguaaagcaaacccau

SEQ ID NO: 1265170 - RNA, 23 nt, Human
ccaccucccucugcuuccccccg

SEQ ID NO: 1265171 - RNA, 22 nt, Human
ccagaccccacucagcuccacu

SEQ ID NO: 1265172 - RNA, 20 nt, Human
ccagcccuagcccuggcucu

SEQ ID NO: 1265173 - RNA, 18 nt, Human
ccaggccccaacccugcc

SEQ ID NO: 1265174 - RNA, 23 nt, Human
ccaggcccugcagggguccgagg

SEQ ID NO: 1265175 - RNA, 18 nt, Human
ccagguggagcgguggag

SEQ ID NO: 1265176 - RNA, 22 nt, Human
ccagucugccggcccggccccu

SEQ ID NO: 1265177 - RNA, 21 nt, Human
ccaugccuggccugccccugg

SEQ ID NO: 1265178 - RNA, 22 nt, Human
cccacaucccccuaccccacuu

SEQ ID NO: 1265179 - RNA, 24 nt, Human
cccaggugagccugccuuuccagg

SEQ ID NO: 1265180 - RNA, 24 nt, Human
ccccaaaaacagaggggcucugca

SEQ ID NO: 1265181 - RNA, 28 nt, Human
ccccaccgaggccucagcccaccucccu

SEQ ID NO: 1265182 - RNA, 21 nt, Human
ccccagaaacuucagccccag

SEQ ID NO: 1265183 - RNA, 20 nt, Human
ccccagagcccgggcugccg

SEQ ID NO: 1265184 - RNA, 22 nt, Human
ccccagagcccgggcugccggg

SEQ ID NO: 1265185 - RNA, 24 nt, Human
ccccaggaugaccgggaagaaccc

SEQ ID NO: 1265186 - RNA, 23 nt, Human
ccccagugccacugugaggaccc

SEQ ID NO: 1265187 - RNA, 18 nt, Human
cccccaaaaacagagggg

SEQ ID NO: 1265188 - RNA, 24 nt, Human
ccccccaaucugaugcacccagac

SEQ ID NO: 1265189 - RNA, 20 nt, Human
ccccccgccaccuccaccaa

SEQ ID NO: 1265190 - RNA, 20 nt, Human
cccccuaccccacuuuugcc

SEQ ID NO: 1265191 - RNA, 18 nt, Human
ccccuccagcccuagccc

SEQ ID NO: 1265192 - RNA, 22 nt, Human
ccccugaccccaccuguuccca

SEQ ID NO: 1265193 - RNA, 24 nt, Human
ccccugcaaccccagguacagguc

SEQ ID NO: 1265194 - RNA, 22 nt, Human
ccccugcacucuggccccugac

SEQ ID NO: 1265195 - RNA, 21 nt, Human
ccccugggagcuagaccacaa

SEQ ID NO: 1265196 - RNA, 21 nt, Human
cccgccaggguauccugcuuc

SEQ ID NO: 1265197 - RNA, 19 nt, Human
cccucucaucccugagccu

SEQ ID NO: 1265198 - RNA, 20 nt, Human
cccugcacucuggccccuga

SEQ ID NO: 1265199 - RNA, 21 nt, Human
cccugcacucuggccccugac

SEQ ID NO: 1265200 - RNA, 20 nt, Human
cccuggagcugcgcucaggc

SEQ ID NO: 1265201 - RNA, 20 nt, Human
cccuguccaggccccaaccc

SEQ ID NO: 1265202 - RNA, 19 nt, Human
ccuccagcccuagcccugg

SEQ ID NO: 1265203 - RNA, 22 nt, Human
ccuccagcccuagcccuggcuc

SEQ ID NO: 1265204 - RNA, 21 nt, Human
ccucccucccucccuaagccc

SEQ ID NO: 1265205 - RNA, 18 nt, Human
ccucccugcccaaaagga

SEQ ID NO: 1265206 - RNA, 20 nt, Human
ccucgccucuggcgcccccc

SEQ ID NO: 1265207 - RNA, 19 nt, Human
ccucuggcgccccccaauc

SEQ ID NO: 1265208 - RNA, 21 nt, Human
ccugcagaaccaggcucagcc

SEQ ID NO: 1265209 - RNA, 20 nt, Human
ccugcucuugcccuauggcc

SEQ ID NO: 1265210 - RNA, 19 nt, Human
ccuggaaggggcuggggcu

SEQ ID NO: 1265211 - RNA, 25 nt, Human
ccuggccccuccagcccuagcccug

SEQ ID NO: 1265212 - RNA, 27 nt, Human
ccuggccccuccagcccuagcccuggc

SEQ ID NO: 1265213 - RNA, 24 nt, Human
ccuguggacaaagcagaccggggc

SEQ ID NO: 1265214 - RNA, 23 nt, Human
ccuguucccccaaaaacagaggg

SEQ ID NO: 1265215 - RNA, 22 nt, Human
ccuuccgccccagagcccgggc

SEQ ID NO: 1265216 - RNA, 21 nt, Human
ccuuggugcccagcucagggu

SEQ ID NO: 1265217 - RNA, 19 nt, Human
ccuuuguucccaagacccu

SEQ ID NO: 1265218 - RNA, 23 nt, Human
cgaggccucagcccaccucccuc

SEQ ID NO: 1265219 - RNA, 23 nt, Human
cgcagcccugcucguggguccaa

SEQ ID NO: 1265220 - RNA, 23 nt, Human
cgccuggaaggggcuggggcuuc

SEQ ID NO: 1265221 - RNA, 22 nt, Human
cggcacauccagucccagcggg

SEQ ID NO: 1265222 - RNA, 23 nt, Human
cggguucaggccagucuuggaau

SEQ ID NO: 1265223 - RNA, 23 nt, Human
cggucagagccagcaggcauggg

SEQ ID NO: 1265224 - RNA, 21 nt, Human
cgugaccccaugcugugcuga

SEQ ID NO: 1265225 - RNA, 19 nt, Human
cucaccccugccacaagca

SEQ ID NO: 1265226 - RNA, 24 nt, Human
cucagcuccuggcagccuuccucc

SEQ ID NO: 1265227 - RNA, 20 nt, Human
cuccccugcacucuggcccc

SEQ ID NO: 1265228 - RNA, 20 nt, Human
cuccuacuguggcccacacc

SEQ ID NO: 1265229 - RNA, 19 nt, Human
cucuccuuuuuugucuggg

SEQ ID NO: 1265230 - RNA, 21 nt, Human
cucugugcagagccccaggau

SEQ ID NO: 1265231 - RNA, 18 nt, Human
cugacugaagcccuguuc

SEQ ID NO: 1265232 - RNA, 18 nt, Human
cugagccaugccuggccu

SEQ ID NO: 1265233 - RNA, 22 nt, Human
cugcaaaggcagaccccgugga

SEQ ID NO: 1265234 - RNA, 18 nt, Human
cugcgaggcagagcuggg

SEQ ID NO: 1265235 - RNA, 21 nt, Human
cuggagugaagccagguggag

SEQ ID NO: 1265236 - RNA, 18 nt, Human
cuggccccugaccccacc

SEQ ID NO: 1265237 - RNA, 24 nt, Human
cuggcgccccccaaucugaugcac

SEQ ID NO: 1265238 - RNA, 25 nt, Human
cugggcccugagccagcagacaguc

SEQ ID NO: 1265239 - RNA, 21 nt, Human
cuguggacaaagcagacaaaa

SEQ ID NO: 1265240 - RNA, 22 nt, Human
cuucagccccagcagaaagguu

SEQ ID NO: 1265241 - RNA, 18 nt, Human
cuuccccccgccaccucc

SEQ ID NO: 1265242 - RNA, 18 nt, Human
cuugcgcugacugaagcc

SEQ ID NO: 1265243 - RNA, 21 nt, Human
gaaagugcuuagugcagaggg

SEQ ID NO: 1265244 - RNA, 20 nt, Human
gaaaguuugaacuccacucc

SEQ ID NO: 1265245 - RNA, 19 nt, Human
gaagaugguggagggccag

SEQ ID NO: 1265246 - RNA, 18 nt, Human
gaaugcucccuguucccc

SEQ ID NO: 1265247 - RNA, 19 nt, Human
gaccaugugaccccagaaa

SEQ ID NO: 1265248 - RNA, 18 nt, Human
gaccgggaagaacccagg

SEQ ID NO: 1265249 - RNA, 23 nt, Human
gacugcuggccccuccuacugug

SEQ ID NO: 1265250 - RNA, 19 nt, Human
gagcagucugcaaaggcag

SEQ ID NO: 1265251 - RNA, 23 nt, Human
gagccaugccuggccugccccug

SEQ ID NO: 1265252 - RNA, 21 nt, Human
gagcuuagccugccaagggga

SEQ ID NO: 1265253 - RNA, 18 nt, Human
gauacagcagggcaggag

SEQ ID NO: 1265254 - RNA, 23 nt, Human
gcagaggaaacccuguccaggcc

SEQ ID NO: 1265255 - RNA, 18 nt, Human
gcagaggagaagcccaga

SEQ ID NO: 1265256 - RNA, 22 nt, Human
gccccaccugugaggccccagc

SEQ ID NO: 1265257 - RNA, 19 nt, Human
gccccuccuacuguggcca

SEQ ID NO: 1265258 - RNA, 20 nt, Human
gcccuagcccuggcucuuuu

SEQ ID NO: 1265259 - RNA, 20 nt, Human
gcccucucaucccugagccu

SEQ ID NO: 1265260 - RNA, 21 nt, Human
gcccuggcucuuuugucacug

SEQ ID NO: 1265261 - RNA, 24 nt, Human
gccuccaucccgcagccaggccac

SEQ ID NO: 1265262 - RNA, 21 nt, Human
gcgguggagcuguggagccuu

SEQ ID NO: 1265263 - RNA, 20 nt, Human
gcuagccccucagcuccugg

SEQ ID NO: 1265264 - RNA, 23 nt, Human
gcuccacucucaccccugccaca

SEQ ID NO: 1265265 - RNA, 21 nt, Human
gcucccuguucccccaaaaac

SEQ ID NO: 1265266 - RNA, 18 nt, Human
gcuggaggaggccccaac

SEQ ID NO: 1265267 - RNA, 21 nt, Human
gcuuccccccgccaccuccac

SEQ ID NO: 1265268 - RNA, 20 nt, Human
gcuugugggguaaggcuggg

SEQ ID NO: 1265269 - RNA, 19 nt, Human
ggaaggcccuguccauguc

SEQ ID NO: 1265270 - RNA, 22 nt, Human
ggacagaggugcuccagggaca

SEQ ID NO: 1265271 - RNA, 19 nt, Human
ggagcccaggcacugcagu

SEQ ID NO: 1265272 - RNA, 20 nt, Human
ggagcgguggagcuguggag

SEQ ID NO: 1265273 - RNA, 18 nt, Human
gggcccaggccugccaca

SEQ ID NO: 1265274 - RNA, 21 nt, Human
gggccucuccuuuuuugucug

SEQ ID NO: 1265275 - RNA, 23 nt, Human
ggggaaggaacguugagucccag

SEQ ID NO: 1265276 - RNA, 18 nt, Human
ggggcacccaugcugagg

SEQ ID NO: 1265277 - RNA, 24 nt, Human
ggguccaagagcugcuuacuucug

SEQ ID NO: 1265278 - RNA, 19 nt, Human
gguaaggcugggugccuug

SEQ ID NO: 1265279 - RNA, 22 nt, Human
ggugcuggagugaagccaggug

SEQ ID NO: 1265280 - RNA, 23 nt, Human
guaaugcaccuguggacaaagca

SEQ ID NO: 1265281 - RNA, 20 nt, Human
gugaccccagaaacuucagc

SEQ ID NO: 1265282 - RNA, 25 nt, Human
gugcuggagugaagccagguggagc

SEQ ID NO: 1265283 - RNA, 20 nt, Human
guggcucacaguccaaggug

SEQ ID NO: 1265284 - RNA, 19 nt, Human
uaaggcagugagccagacc

SEQ ID NO: 1265285 - RNA, 20 nt, Human
uacacagaaagucagaaaac

SEQ ID NO: 1265286 - RNA, 19 nt, Human
uaccucugagccacaugcc

SEQ ID NO: 1265287 - RNA, 20 nt, Human
uaccucugagccacaugccc

SEQ ID NO: 1265288 - RNA, 21 nt, Human
ucaagcccugcuugucucagu

SEQ ID NO: 1265289 - RNA, 24 nt, Human
ucagcccaccucccucugcuuccc

SEQ ID NO: 1265290 - RNA, 21 nt, Human
ucaucucauucccccaccugc

SEQ ID NO: 1265291 - RNA, 23 nt, Human
uccacagguagccucccugccca

SEQ ID NO: 1265292 - RNA, 25 nt, Human
uccacuuucucaucucauuccccca

SEQ ID NO: 1265293 - RNA, 20 nt, Human
uccagagcuucacccggcug

SEQ ID NO: 1265294 - RNA, 20 nt, Human
uccaggccccaacccugccu

SEQ ID NO: 1265295 - RNA, 18 nt, Human
uccagggguaggggaacc

SEQ ID NO: 1265296 - RNA, 20 nt, Human
ucccacaucccccuacccca

SEQ ID NO: 1265297 - RNA, 22 nt, Human
ucccagcccaguuuuaagggcc

SEQ ID NO: 1265298 - RNA, 18 nt, Human
ucccccuaccccacuuuu

SEQ ID NO: 1265299 - RNA, 21 nt, Human
uccccuuccucaaggagagcc

SEQ ID NO: 1265300 - RNA, 19 nt, Human
ucccgcagccaggccacag

SEQ ID NO: 1265301 - RNA, 20 nt, Human
ucccuggaaagcagcaaccu

SEQ ID NO: 1265302 - RNA, 27 nt, Human
ucccuggagcugcgcucaggggucccc

SEQ ID NO: 1265303 - RNA, 21 nt, Human
ucccugugaaggagccagggu

SEQ ID NO: 1265304 - RNA, 19 nt, Human
uccuacuguggcccacacc

SEQ ID NO: 1265305 - RNA, 19 nt, Human
ucucaccccugccacaagc

SEQ ID NO: 1265306 - RNA, 22 nt, Human
ucucaccccugccacaagcaaa

SEQ ID NO: 1265307 - RNA, 19 nt, Human
ucucagucucagcagagga

SEQ ID NO: 1265308 - RNA, 21 nt, Human
ucugagccacaugcccagagg

SEQ ID NO: 1265309 - RNA, 20 nt, Human
ucugggagacucgauuccau

SEQ ID NO: 1265310 - RNA, 24 nt, Human
ucugggguggagggacggggggca

SEQ ID NO: 1265311 - RNA, 18 nt, Human
ugaaaagcaauugagagc

SEQ ID NO: 1265312 - RNA, 22 nt, Human
ugaagccagguggagcggugga

SEQ ID NO: 1265313 - RNA, 23 nt, Human
ugaagccagguggagcgguggag

SEQ ID NO: 1265314 - RNA, 23 nt, Human
ugaaugagcagucugcaaaggca

SEQ ID NO: 1265315 - RNA, 26 nt, Human
ugacaaaugaacccaucaccggucag

SEQ ID NO: 1265316 - RNA, 19 nt, Human
ugaccccagaaacuucagc

SEQ ID NO: 1265317 - RNA, 19 nt, Human
ugacugaagcccuguucac

SEQ ID NO: 1265318 - RNA, 21 nt, Human
ugacugaagcccuguucaccc

SEQ ID NO: 1265319 - RNA, 18 nt, Human
ugagagggggugggaacg

SEQ ID NO: 1265320 - RNA, 22 nt, Human
ugagccaugccuggccugcccc

SEQ ID NO: 1265321 - RNA, 18 nt, Human
ugaggucagggcuucugg

SEQ ID NO: 1265322 - RNA, 21 nt, Human
ugaggucagggcuucuggggu

SEQ ID NO: 1265323 - RNA, 21 nt, Human
ugauaaggcagugagccagac

SEQ ID NO: 1265324 - RNA, 19 nt, Human
ugauaccucugagccacau

SEQ ID NO: 1265325 - RNA, 21 nt, Human
ugcacugagccaugccuggcc

SEQ ID NO: 1265326 - RNA, 27 nt, Human
ugcagugaaagaccagcucagccccuu

SEQ ID NO: 1265327 - RNA, 19 nt, Human
ugccaggcacugucugccc

SEQ ID NO: 1265328 - RNA, 21 nt, Human
ugcccaaaaggaagccuggca

SEQ ID NO: 1265329 - RNA, 22 nt, Human
ugcccaaaaggaagccuggcag

SEQ ID NO: 1265330 - RNA, 23 nt, Human
ugcccuauggccaggccugccug

SEQ ID NO: 1265331 - RNA, 21 nt, Human
ugccucuugggucaccguggc

SEQ ID NO: 1265332 - RNA, 22 nt, Human
ugccuggccugccccugggagc

SEQ ID NO: 1265333 - RNA, 21 nt, Human
ugcgaggcagagcugggcuga

SEQ ID NO: 1265334 - RNA, 24 nt, Human
ugcucccuguucccccaaaaacag

SEQ ID NO: 1265335 - RNA, 19 nt, Human
ugcuggaggaggccccaac

SEQ ID NO: 1265336 - RNA, 21 nt, Human
ugcuugugggguaaggcuggg

SEQ ID NO: 1265337 - RNA, 22 nt, Human
uggaaguggcucacaguccaag

SEQ ID NO: 1265338 - RNA, 23 nt, Human
uggaaguggcucacaguccaagg

SEQ ID NO: 1265339 - RNA, 20 nt, Human
uggagggacggggggcacag

SEQ ID NO: 1265340 - RNA, 21 nt, Human
uggagggcugggcuuggcagg

SEQ ID NO: 1265341 - RNA, 20 nt, Human
uggagugagggugcuccugc

SEQ ID NO: 1265342 - RNA, 21 nt, Human
uggcaugaaaaauuaccaaau

SEQ ID NO: 1265343 - RNA, 18 nt, Human
uggcaugaauaaaagggc

SEQ ID NO: 1265344 - RNA, 21 nt, Human
uggcaugaauaaaagggcagg

SEQ ID NO: 1265345 - RNA, 24 nt, Human
uggccccugaccccaccuguuccc

SEQ ID NO: 1265346 - RNA, 27 nt, Human
uggcggcgggggaaggaacguugaguc

SEQ ID NO: 1265347 - RNA, 23 nt, Human
uggcucuggagggcugggcuugg

SEQ ID NO: 1265348 - RNA, 23 nt, Human
ugggagcuagaccacaaaccgac

SEQ ID NO: 1265349 - RNA, 18 nt, Human
uggggcagggagaccagg

SEQ ID NO: 1265350 - RNA, 19 nt, Human
uggggcagggagaccaggu

SEQ ID NO: 1265351 - RNA, 20 nt, Human
uggggcagggagaccagguu

SEQ ID NO: 1265352 - RNA, 22 nt, Human
uggggcagggagaccagguugg

SEQ ID NO: 1265353 - RNA, 23 nt, Human
uggggcagggagaccagguuggc

SEQ ID NO: 1265354 - RNA, 19 nt, Human
ugggguggagggacggggg

SEQ ID NO: 1265355 - RNA, 21 nt, Human
ugggguggagggacggggggc

SEQ ID NO: 1265356 - RNA, 22 nt, Human
ugguaaguaugcuuggguggcu

SEQ ID NO: 1265357 - RNA, 21 nt, Human
ugguggagggccagcugcugg

SEQ ID NO: 1265358 - RNA, 23 nt, Human
ugucacugugauaccucugagcc

SEQ ID NO: 1265359 - RNA, 23 nt, Human
uguccuggggccuuguaaugcac

SEQ ID NO: 1265360 - RNA, 18 nt, Human
uguuucuucugaaaguuu

SEQ ID NO: 1265361 - RNA, 27 nt, Human
uuagugcagagggcagggaggcauggg

SEQ ID NO: 1265362 - RNA, 25 nt, Human
uucaccccaaguccaggcccugcag

SEQ ID NO: 1265363 - RNA, 23 nt, Human
uucaggucaagauagaaagggac

SEQ ID NO: 1265364 - RNA, 24 nt, Human
uucccaagacccugugaaugcucc

SEQ ID NO: 1265365 - RNA, 21 nt, Human
uuccgccccagagcccgggcu

SEQ ID NO: 1265366 - RNA, 21 nt, Human
uucgcagagagcaaguccccc

SEQ ID NO: 1265367 - RNA, 25 nt, Human
uuggagugagggugcuccugccugg

SEQ ID NO: 1265368 - RNA, 20 nt, Human
uuguuuugucucacacacuu

SEQ ID NO: 1265369 - RNA, 18 nt, Human
uuugucucacacacuucc

SEQ ID NO: 1265370 - RNA, 21 nt, Human
uuuguuuugucucacacacuu

SEQ ID NO: 1265371 - RNA, 25 nt, Human
aaaagagaaaaaaaccccugcaaaa

SEQ ID NO: 1265372 - RNA, 22 nt, Human
aaagcaaaagagaaaaaaaccc

SEQ ID NO: 1265373 - RNA, 24 nt, Human
aagcaaaagagaaaaaaaccccug

SEQ ID NO: 1265374 - RNA, 23 nt, Human
aagcaaaagagaaaaaaagggac

SEQ ID NO: 1265375 - RNA, 25 nt, Human
acaaguuuggcucucuggguuuguu

SEQ ID NO: 1265376 - RNA, 23 nt, Human
acccuggaggcccuucucucccu

SEQ ID NO: 1265377 - RNA, 18 nt, Human
accgucaggaaaucucug

SEQ ID NO: 1265378 - RNA, 23 nt, Human
accuugaaggauuuucucuuggg

SEQ ID NO: 1265379 - RNA, 20 nt, Human
accuugaggauguugcugga

SEQ ID NO: 1265380 - RNA, 25 nt, Human
acucaccauucccugcaccuaccuc

SEQ ID NO: 1265381 - RNA, 19 nt, Human
agaaggaaagggggagggc

SEQ ID NO: 1265382 - RNA, 21 nt, Human
aggaagaccuugaggauguug

SEQ ID NO: 1265383 - RNA, 19 nt, Human
agggcugcccccugcuuuc

SEQ ID NO: 1265384 - RNA, 18 nt, Human
aggggacccuggaggccc

SEQ ID NO: 1265385 - RNA, 18 nt, Human
agggggagggcugccccc

SEQ ID NO: 1265386 - RNA, 21 nt, Human
aggugccucugccuuuagacu

SEQ ID NO: 1265387 - RNA, 24 nt, Human
caaacagggaucucaauuccuagc

SEQ ID NO: 1265388 - RNA, 23 nt, Human
caagaaaauccauuccuggcuca

SEQ ID NO: 1265389 - RNA, 23 nt, Human
caccaaggaucuuguucaaauac

SEQ ID NO: 1265390 - RNA, 21 nt, Human
cacccagcucacggagccacc

SEQ ID NO: 1265391 - RNA, 19 nt, Human
caccgcauggguccaggaa

SEQ ID NO: 1265392 - RNA, 24 nt, Human
cagugucucccacuucuucaucuu

SEQ ID NO: 1265393 - RNA, 19 nt, Human
cccugagccucaguuaccu

SEQ ID NO: 1265394 - RNA, 21 nt, Human
cccuggaggcccuucucuccc

SEQ ID NO: 1265395 - RNA, 20 nt, Human
ccucuaaaaaaagcaaagau

SEQ ID NO: 1265396 - RNA, 20 nt, Human
ccucuuucacaaacagggau

SEQ ID NO: 1265397 - RNA, 23 nt, Human
cgugcagggcuggggugugcagg

SEQ ID NO: 1265398 - RNA, 24 nt, Human
cucaccauucccugcaccuaccuc

SEQ ID NO: 1265399 - RNA, 22 nt, Human
cuggacugcccaccucuacaag

SEQ ID NO: 1265400 - RNA, 24 nt, Human
cuggagucacccagcucacggagc

SEQ ID NO: 1265401 - RNA, 22 nt, Human
gaaggaaagggggagggcugcc

SEQ ID NO: 1265402 - RNA, 19 nt, Human
gaauuuaaaauauugauau

SEQ ID NO: 1265403 - RNA, 18 nt, Human
gagaaggaaagggggagg

SEQ ID NO: 1265404 - RNA, 23 nt, Human
gagagaaggaaagggggagggcu

SEQ ID NO: 1265405 - RNA, 21 nt, Human
ggagagaaggaaagggggagg

SEQ ID NO: 1265406 - RNA, 22 nt, Human
ggcuugugucugaaucuugggu

SEQ ID NO: 1265407 - RNA, 21 nt, Human
ggggagcaguuaggugccucu

SEQ ID NO: 1265408 - RNA, 20 nt, Human
ggguggggugggcugcgggg

SEQ ID NO: 1265409 - RNA, 25 nt, Human
ggugaggcuggagucacccagcuca

SEQ ID NO: 1265410 - RNA, 18 nt, Human
gguugucaggaagaccuu

SEQ ID NO: 1265411 - RNA, 25 nt, Human
uaaaaaaagcaaagaugaauuuaaa

SEQ ID NO: 1265412 - RNA, 23 nt, Human
uaaaaagcaaaagagaaaaaaac

SEQ ID NO: 1265413 - RNA, 19 nt, Human
uacaaauguuccuccucag

SEQ ID NO: 1265414 - RNA, 20 nt, Human
uaccucggagaaccugcagc

SEQ ID NO: 1265415 - RNA, 22 nt, Human
uagagcuguuucaagaaaaucc

SEQ ID NO: 1265416 - RNA, 21 nt, Human
ucagaaaagucucuuguuggu

SEQ ID NO: 1265417 - RNA, 24 nt, Human
ucccugaacauggaggggagccgg

SEQ ID NO: 1265418 - RNA, 21 nt, Human
uccuccucagaaaagucucuu

SEQ ID NO: 1265419 - RNA, 24 nt, Human
uccucuaaaaaaagcaaagaugaa

SEQ ID NO: 1265420 - RNA, 20 nt, Human
ucuaaaaagcaaaagagaaa

SEQ ID NO: 1265421 - RNA, 19 nt, Human
ucucaacgcagugucuccc

SEQ ID NO: 1265422 - RNA, 21 nt, Human
ucucccacuucuucaucuuaa

SEQ ID NO: 1265423 - RNA, 20 nt, Human
ucugaggaucagggagagaa

SEQ ID NO: 1265424 - RNA, 21 nt, Human
ucugaggaucagggagagaag

SEQ ID NO: 1265425 - RNA, 23 nt, Human
ucugcaccucaguucccucuuuc

SEQ ID NO: 1265426 - RNA, 18 nt, Human
ucuugugguuuuguacuu

SEQ ID NO: 1265427 - RNA, 21 nt, Human
ugaggaucagggagagaagga

SEQ ID NO: 1265428 - RNA, 22 nt, Human
ugcagggcuggggugugcaggu

SEQ ID NO: 1265429 - RNA, 18 nt, Human
ugccucugccuuuagacu

SEQ ID NO: 1265430 - RNA, 21 nt, Human
ugcugggaggaaggagggccc

SEQ ID NO: 1265431 - RNA, 20 nt, Human
uggaaggaggcaagacccac

SEQ ID NO: 1265432 - RNA, 19 nt, Human
uggguggggugggcugcgg

SEQ ID NO: 1265433 - RNA, 20 nt, Human
ugguuuuguacuucgauuuu

SEQ ID NO: 1265434 - RNA, 21 nt, Human
ugucaggaagaccuugaggau

SEQ ID NO: 1265435 - RNA, 20 nt, Human
ugucugaaucuugggugggg

SEQ ID NO: 1265436 - RNA, 19 nt, Human
uuacaacaagggcguuggg

SEQ ID NO: 1265437 - RNA, 25 nt, Human
uuagacacucaccauucccugcacc

SEQ ID NO: 1265438 - RNA, 26 nt, Human
uuccuccucagaaaagucucuuguug

SEQ ID NO: 1265439 - RNA, 20 nt, Human
uugguugucaggaagaccuu

SEQ ID NO: 1265440 - RNA, 22 nt, Human
uuuauacacaaaagcuuguaua

SEQ ID NO: 1265441 - RNA, 19 nt, Human
uuucacaaacagggaucuc

SEQ ID NO: 1265442 - RNA, 20 nt, Human
aaaaaaaaccucacacagaa

SEQ ID NO: 1265443 - RNA, 18 nt, Human
aaaaaaccucacacagaa

SEQ ID NO: 1265444 - RNA, 26 nt, Human
aaugucuauuaagucuccuggauagc

SEQ ID NO: 1265445 - RNA, 18 nt, Human
acaaaaaauuuccuccuc

SEQ ID NO: 1265446 - RNA, 23 nt, Human
acccacauaaccucuugcacccc

SEQ ID NO: 1265447 - RNA, 19 nt, Human
accccgcggcccaggagca

SEQ ID NO: 1265448 - RNA, 19 nt, Human
accguccccugccccggcc

SEQ ID NO: 1265449 - RNA, 18 nt, Human
aggccggucccaguggga

SEQ ID NO: 1265450 - RNA, 21 nt, Human
agugggcucaaccaugagggu

SEQ ID NO: 1265451 - RNA, 24 nt, Human
aucaauccgggcaaucacuggcca

SEQ ID NO: 1265452 - RNA, 18 nt, Human
aucaaugcucgccagccc

SEQ ID NO: 1265453 - RNA, 22 nt, Human
aucuucagcggauugacccugg

SEQ ID NO: 1265454 - RNA, 25 nt, Human
augcaaaacacaaaauggcucccaa

SEQ ID NO: 1265455 - RNA, 22 nt, Human
caaaauggcucccaauccaggc

SEQ ID NO: 1265456 - RNA, 26 nt, Human
caaaauggcucccaauccaggcaaag

SEQ ID NO: 1265457 - RNA, 19 nt, Human
cacaggacaggcauccuca

SEQ ID NO: 1265458 - RNA, 22 nt, Human
cacugagcaguuacaauagccc

SEQ ID NO: 1265459 - RNA, 19 nt, Human
cagacccaaagucuccagg

SEQ ID NO: 1265460 - RNA, 23 nt, Human
cagacccaaagucuccagggcga

SEQ ID NO: 1265461 - RNA, 25 nt, Human
cagcaacuuccugccgaaugcugau

SEQ ID NO: 1265462 - RNA, 20 nt, Human
cagccccgaucccccagcca

SEQ ID NO: 1265463 - RNA, 24 nt, Human
caggacaggcauccucauuccgcu

SEQ ID NO: 1265464 - RNA, 21 nt, Human
caggcauccucauuccgcuuu

SEQ ID NO: 1265465 - RNA, 25 nt, Human
cagggucuuccauuuucaagggucu

SEQ ID NO: 1265466 - RNA, 25 nt, Human
cauccugaguucuccaguaaguucc

SEQ ID NO: 1265467 - RNA, 18 nt, Human
caugacccacauaaccuc

SEQ ID NO: 1265468 - RNA, 20 nt, Human
cauggccuugaggugaacug

SEQ ID NO: 1265469 - RNA, 19 nt, Human
ccaaccaucagcuucgacu

SEQ ID NO: 1265470 - RNA, 21 nt, Human
ccacaggcugaaucuucaugc

SEQ ID NO: 1265471 - RNA, 19 nt, Human
ccaccguccccugccccgg

SEQ ID NO: 1265472 - RNA, 21 nt, Human
ccagccuggagccccuuucgc

SEQ ID NO: 1265473 - RNA, 20 nt, Human
ccagcucugccuuguccucc

SEQ ID NO: 1265474 - RNA, 24 nt, Human
ccaguccagcauauucucccuggg

SEQ ID NO: 1265475 - RNA, 21 nt, Human
cccacagauggcacaguccac

SEQ ID NO: 1265476 - RNA, 23 nt, Human
cccacaggacaggcauccucauu

SEQ ID NO: 1265477 - RNA, 20 nt, Human
cccacauaaccucuugcacc

SEQ ID NO: 1265478 - RNA, 23 nt, Human
cccacauuuauccaccuccacaa

SEQ ID NO: 1265479 - RNA, 21 nt, Human
cccacggcgcccagcacagcc

SEQ ID NO: 1265480 - RNA, 23 nt, Human
ccccaacgcccuggcacaggacu

SEQ ID NO: 1265481 - RNA, 24 nt, Human
ccccaagaucugcagcaucucucu

SEQ ID NO: 1265482 - RNA, 23 nt, Human
ccccaugccaggaccaccuccuc

SEQ ID NO: 1265483 - RNA, 18 nt, Human
ccccugagacaccucagg

SEQ ID NO: 1265484 - RNA, 19 nt, Human
ccccugagacaccucaggc

SEQ ID NO: 1265485 - RNA, 20 nt, Human
cccgaccccgcggcccagga

SEQ ID NO: 1265486 - RNA, 21 nt, Human
cccgaccccgcggcccaggag

SEQ ID NO: 1265487 - RNA, 19 nt, Human
cccgcggcccaggagcagc

SEQ ID NO: 1265488 - RNA, 23 nt, Human
cccggccccacggcgcccagccg

SEQ ID NO: 1265489 - RNA, 19 nt, Human
cccuggggucgaugcggcc

SEQ ID NO: 1265490 - RNA, 23 nt, Human
ccgcgcucucggccccucuccug

SEQ ID NO: 1265491 - RNA, 19 nt, Human
ccugagacaccucaggcug

SEQ ID NO: 1265492 - RNA, 19 nt, Human
ccuggagccccuuucgcug

SEQ ID NO: 1265493 - RNA, 24 nt, Human
ccuggccucggucccccggguggc

SEQ ID NO: 1265494 - RNA, 24 nt, Human
ccuggggucgaugcggcccuccuc

SEQ ID NO: 1265495 - RNA, 20 nt, Human
cgaaugcugaucauggcauc

SEQ ID NO: 1265496 - RNA, 19 nt, Human
cgacagagauuacagagau

SEQ ID NO: 1265497 - RNA, 23 nt, Human
cgagacaucagacccaaagucuc

SEQ ID NO: 1265498 - RNA, 24 nt, Human
cgagacaucagacccaaagucucc

SEQ ID NO: 1265499 - RNA, 19 nt, Human
cgaugcggcccuccucaau

SEQ ID NO: 1265500 - RNA, 21 nt, Human
cgccaaugggccccaugccag

SEQ ID NO: 1265501 - RNA, 24 nt, Human
cgcucucggccccucuccuggccu

SEQ ID NO: 1265502 - RNA, 21 nt, Human
cgcuguccccgccggcacugc

SEQ ID NO: 1265503 - RNA, 21 nt, Human
cggcccaggagcagccccaac

SEQ ID NO: 1265504 - RNA, 25 nt, Human
cggccccacggcgcccagcacagcc

SEQ ID NO: 1265505 - RNA, 22 nt, Human
cgucuagguagaccuauccucc

SEQ ID NO: 1265506 - RNA, 18 nt, Human
cuccaguauauuuggcuc

SEQ ID NO: 1265507 - RNA, 21 nt, Human
cuccuggccucggucccccgg

SEQ ID NO: 1265508 - RNA, 19 nt, Human
cucgagucuggacaacagc

SEQ ID NO: 1265509 - RNA, 20 nt, Human
cugcagcaucucucucuggu

SEQ ID NO: 1265510 - RNA, 21 nt, Human
cugcugcugucccggccccac

SEQ ID NO: 1265511 - RNA, 22 nt, Human
cuggagccccauggggccgcac

SEQ ID NO: 1265512 - RNA, 23 nt, Human
gacccaaagucuccagggcgaca

SEQ ID NO: 1265513 - RNA, 24 nt, Human
gacccacauaaccucuugcacccc

SEQ ID NO: 1265514 - RNA, 21 nt, Human
gagcaguuacaauagcccaug

SEQ ID NO: 1265515 - RNA, 20 nt, Human
gaguaaacucuccagccucc

SEQ ID NO: 1265516 - RNA, 19 nt, Human
gaguucuccaguaaguucc

SEQ ID NO: 1265517 - RNA, 27 nt, Human
gcaaaacacaaaauggcucccaaucca

SEQ ID NO: 1265518 - RNA, 19 nt, Human
gcaaaccguucugugcccc

SEQ ID NO: 1265519 - RNA, 19 nt, Human
gccgcgcucucggccccuc

SEQ ID NO: 1265520 - RNA, 20 nt, Human
gcgagacaucagacccaaag

SEQ ID NO: 1265521 - RNA, 22 nt, Human
gcgcccagcacagccccgaucc

SEQ ID NO: 1265522 - RNA, 23 nt, Human
gcgcuguccccgccggcacugcu

SEQ ID NO: 1265523 - RNA, 21 nt, Human
gcggcggccgcccccgacccc

SEQ ID NO: 1265524 - RNA, 22 nt, Human
ggcaaugggggucaacaaaaaa

SEQ ID NO: 1265525 - RNA, 23 nt, Human
ggccaccguccccugccccggcc

SEQ ID NO: 1265526 - RNA, 19 nt, Human
gggcagaaggcgcuccagg

SEQ ID NO: 1265527 - RNA, 23 nt, Human
ggucuugugaagauuuaggugcg

SEQ ID NO: 1265528 - RNA, 22 nt, Human
gucuugugaagauuuaggugcg

SEQ ID NO: 1265529 - RNA, 18 nt, Human
gugccccucuccuuucug

SEQ ID NO: 1265530 - RNA, 20 nt, Human
uaggugcgagacaucagacc

SEQ ID NO: 1265531 - RNA, 21 nt, Human
uauguaaucaugauggcugcu

SEQ ID NO: 1265532 - RNA, 18 nt, Human
ucaaacaccccauuggug

SEQ ID NO: 1265533 - RNA, 25 nt, Human
ucacacagaaaaagaggaaaacacu

SEQ ID NO: 1265534 - RNA, 19 nt, Human
ucagaaaauggcaacucau

SEQ ID NO: 1265535 - RNA, 25 nt, Human
ucagcaacuuccugccgaaugcuga

SEQ ID NO: 1265536 - RNA, 19 nt, Human
ucauccagcagggaugcac

SEQ ID NO: 1265537 - RNA, 24 nt, Human
ucaugccugccaugugggcacuug

SEQ ID NO: 1265538 - RNA, 21 nt, Human
uccaaaauaaauucaugaccc

SEQ ID NO: 1265539 - RNA, 23 nt, Human
uccaggcaacuggcacacaugua

SEQ ID NO: 1265540 - RNA, 18 nt, Human
ucccggccccacggcgcc

SEQ ID NO: 1265541 - RNA, 27 nt, Human
ucccugccacaggccagggcaugauag

SEQ ID NO: 1265542 - RNA, 24 nt, Human
uccuaaaacuuucuaugcaaaaca

SEQ ID NO: 1265543 - RNA, 20 nt, Human
uccuggagucucuuggccac

SEQ ID NO: 1265544 - RNA, 22 nt, Human
ucucuuggccacauccacugcc

SEQ ID NO: 1265545 - RNA, 23 nt, Human
ucucuuggccacauccacugccu

SEQ ID NO: 1265546 - RNA, 19 nt, Human
ucugcagccgcagucccuc

SEQ ID NO: 1265547 - RNA, 18 nt, Human
ucuuacgccaaugggccc

SEQ ID NO: 1265548 - RNA, 20 nt, Human
ucuuggccacauccacugcc

SEQ ID NO: 1265549 - RNA, 19 nt, Human
ugaaaugaugggaugauug

SEQ ID NO: 1265550 - RNA, 19 nt, Human
ugagcaguuacaauagccc

SEQ ID NO: 1265551 - RNA, 24 nt, Human
ugcaaaacacaaaauggcucccaa

SEQ ID NO: 1265552 - RNA, 21 nt, Human
ugccacauuaaaaguuaaagu

SEQ ID NO: 1265553 - RNA, 21 nt, Human
ugccaugugggcacuuguugg

SEQ ID NO: 1265554 - RNA, 18 nt, Human
ugccuuguccuccgacuc

SEQ ID NO: 1265555 - RNA, 21 nt, Human
ugcuagguucuccuugugcuu

SEQ ID NO: 1265556 - RNA, 19 nt, Human
ugcuuauccaccauggccu

SEQ ID NO: 1265557 - RNA, 19 nt, Human
uggcagggaccgucuucuc

SEQ ID NO: 1265558 - RNA, 23 nt, Human
uggcggcugcguccagccuggag

SEQ ID NO: 1265559 - RNA, 21 nt, Human
uggcucgagucuggacaacag

SEQ ID NO: 1265560 - RNA, 22 nt, Human
uggcucgagucuggacaacagc

SEQ ID NO: 1265561 - RNA, 19 nt, Human
ugggaugauugggcaaaaa

SEQ ID NO: 1265562 - RNA, 19 nt, Human
ugggcagaaggcgcuccag

SEQ ID NO: 1265563 - RNA, 19 nt, Human
uggguuggucccauguguu

SEQ ID NO: 1265564 - RNA, 19 nt, Human
ugguauggaguauacuggg

SEQ ID NO: 1265565 - RNA, 21 nt, Human
uguaaacauuuguccugggau

SEQ ID NO: 1265566 - RNA, 26 nt, Human
uguaaacauuuguccugggauuuccc

SEQ ID NO: 1265567 - RNA, 26 nt, Human
uguccaaaauaaauucaugacccaca

SEQ ID NO: 1265568 - RNA, 20 nt, Human
uguuggguuggucccaugug

SEQ ID NO: 1265569 - RNA, 23 nt, Human
uuagggagagaggacuaagaaga

SEQ ID NO: 1265570 - RNA, 20 nt, Human
uucagaaaauggcaacucau

SEQ ID NO: 1265571 - RNA, 21 nt, Human
uucagaaaauggcaacucaua

SEQ ID NO: 1265572 - RNA, 20 nt, Human
uucauuuucacaaacagggu

SEQ ID NO: 1265573 - RNA, 21 nt, Human
uucccacaggacaggcauccu

SEQ ID NO: 1265574 - RNA, 22 nt, Human
uucccacauuuauccaccucca

SEQ ID NO: 1265575 - RNA, 26 nt, Human
aaaaaaacacuagacaccagcagcca

SEQ ID NO: 1265576 - RNA, 18 nt, Human
aaaaaagccaacaccaaa

SEQ ID NO: 1265577 - RNA, 20 nt, Human
aaaaaagccaacaccaaacu

SEQ ID NO: 1265578 - RNA, 18 nt, Human
aaaagucuccaccuccuc

SEQ ID NO: 1265579 - RNA, 21 nt, Human
aaaaugccucauagaauuucu

SEQ ID NO: 1265580 - RNA, 24 nt, Human
aaccacaccauggauaaaauugag

SEQ ID NO: 1265581 - RNA, 18 nt, Human
aagcauacuguucaucau

SEQ ID NO: 1265582 - RNA, 18 nt, Human
aagcauuagagaucaacu

SEQ ID NO: 1265583 - RNA, 18 nt, Human
aagcauuagagaucaacu

SEQ ID NO: 1265584 - RNA, 22 nt, Human
aagccaacaccaaacugcccaa

SEQ ID NO: 1265585 - RNA, 18 nt, Human
acaaggacaggagaggga

SEQ ID NO: 1265586 - RNA, 19 nt, Human
acagugaaggaaccuccag

SEQ ID NO: 1265587 - RNA, 22 nt, Human
acccgccucucuucuaaguacu

SEQ ID NO: 1265588 - RNA, 18 nt, Human
agaagguauugaugauga

SEQ ID NO: 1265589 - RNA, 18 nt, Human
agaauucuccauacuccu

SEQ ID NO: 1265590 - RNA, 19 nt, Human
agaguagagagggaauggg

SEQ ID NO: 1265591 - RNA, 20 nt, Human
agcagccaggugggacaggg

SEQ ID NO: 1265592 - RNA, 21 nt, Human
aggacaggagagggaaaaaaa

SEQ ID NO: 1265593 - RNA, 24 nt, Human
aggacaggagagggaaaaaaacac

SEQ ID NO: 1265594 - RNA, 22 nt, Human
aggagagggaaaaaaacacuag

SEQ ID NO: 1265595 - RNA, 23 nt, Human
aggcagaaaaaagccaacaccaa

SEQ ID NO: 1265596 - RNA, 20 nt, Human
agguaggcagaaaaaagcca

SEQ ID NO: 1265597 - RNA, 18 nt, Human
aguagagagggaaugggg

SEQ ID NO: 1265598 - RNA, 22 nt, Human
aucacaaccaguuucucugcca

SEQ ID NO: 1265599 - RNA, 26 nt, Human
aucacagcuguccaugaugaacacac

SEQ ID NO: 1265600 - RNA, 19 nt, Human
caaaagucuccaccuccuc

SEQ ID NO: 1265601 - RNA, 20 nt, Human
caaaagucuccaccuccucc

SEQ ID NO: 1265602 - RNA, 23 nt, Human
caacuccugaaggaaaaucuccu

SEQ ID NO: 1265603 - RNA, 23 nt, Human
caagggcacaaguuuuccaacua

SEQ ID NO: 1265604 - RNA, 22 nt, Human
caauacacaacauccaauccug

SEQ ID NO: 1265605 - RNA, 19 nt, Human
caaugggcucaccaugauc

SEQ ID NO: 1265606 - RNA, 22 nt, Human
cacagcuguccaugaugaacac

SEQ ID NO: 1265607 - RNA, 21 nt, Human
cacaucuuugaucuugggcuu

SEQ ID NO: 1265608 - RNA, 21 nt, Human
caccagguaggcagaaaaaag

SEQ ID NO: 1265609 - RNA, 23 nt, Human
cagaaaaaagccaacaccaaacu

SEQ ID NO: 1265610 - RNA, 21 nt, Human
cagauccucagagucaaccac

SEQ ID NO: 1265611 - RNA, 21 nt, Human
cagcagaagacucccaagcau

SEQ ID NO: 1265612 - RNA, 24 nt, Human
cagcgcagcagcucagacaggcgg

SEQ ID NO: 1265613 - RNA, 20 nt, Human
cagcucagagaagagcucaa

SEQ ID NO: 1265614 - RNA, 20 nt, Human
cagcucuuuaccacugucca

SEQ ID NO: 1265615 - RNA, 21 nt, Human
cagugaaggaaccuccagcag

SEQ ID NO: 1265616 - RNA, 18 nt, Human
caguuucucugccaccag

SEQ ID NO: 1265617 - RNA, 22 nt, Human
caucucaucuccagacugggag

SEQ ID NO: 1265618 - RNA, 24 nt, Human
ccaacaccaaacugcccaaucaug

SEQ ID NO: 1265619 - RNA, 21 nt, Human
ccaaugccugugucuaccaaa

SEQ ID NO: 1265620 - RNA, 22 nt, Human
ccaaugggcucaccaugaucag

SEQ ID NO: 1265621 - RNA, 20 nt, Human
ccagcagaagacucccaagc

SEQ ID NO: 1265622 - RNA, 24 nt, Human
ccaggguacguuccugaggguugg

SEQ ID NO: 1265623 - RNA, 19 nt, Human
ccuccucaucugaacccac

SEQ ID NO: 1265624 - RNA, 23 nt, Human
cucaucacagcuguccaugauga

SEQ ID NO: 1265625 - RNA, 19 nt, Human
cuuccucuucuuucucacc

SEQ ID NO: 1265626 - RNA, 20 nt, Human
cuucuuucucaccuuucucu

SEQ ID NO: 1265627 - RNA, 25 nt, Human
gacccgccucucuucuaaguacucu

SEQ ID NO: 1265628 - RNA, 22 nt, Human
gcagaaaaaagccaacaccaaa

SEQ ID NO: 1265629 - RNA, 21 nt, Human
ggacaggagagggaaaaaaac

SEQ ID NO: 1265630 - RNA, 18 nt, Human
ggagccauggggacacua

SEQ ID NO: 1265631 - RNA, 21 nt, Human
ggcaaaagucuccaccuccuc

SEQ ID NO: 1265632 - RNA, 20 nt, Human
ggcaucagaagcauuagaga

SEQ ID NO: 1265633 - RNA, 23 nt, Human
gggcucaccaugaucagcaugca

SEQ ID NO: 1265634 - RNA, 20 nt, Human
ggggcuugacacccuugguu

SEQ ID NO: 1265635 - RNA, 23 nt, Human
gucaauuuucagcucuuuaccac

SEQ ID NO: 1265636 - RNA, 22 nt, Human
gucuccaccuccuccucuccau

SEQ ID NO: 1265637 - RNA, 21 nt, Human
gugagcuugcuuucugauacc

SEQ ID NO: 1265638 - RNA, 22 nt, Human
guuugauguuguucuuuuucuu

SEQ ID NO: 1265639 - RNA, 26 nt, Human
uacacaacauccaauccugcugucaa

SEQ ID NO: 1265640 - RNA, 20 nt, Human
uacccaggcagcaccaacgc

SEQ ID NO: 1265641 - RNA, 21 nt, Human
uagcaaugcccugaauuccaa

SEQ ID NO: 1265642 - RNA, 22 nt, Human
uaggcagaaaaaagccaacacc

SEQ ID NO: 1265643 - RNA, 21 nt, Human
uauacaagggcacaaguuuuc

SEQ ID NO: 1265644 - RNA, 18 nt, Human
ucaccuuucucuucuucu

SEQ ID NO: 1265645 - RNA, 21 nt, Human
uccaugcaugcuuuaguacca

SEQ ID NO: 1265646 - RNA, 22 nt, Human
uccugaggguuggggaugaugu

SEQ ID NO: 1265647 - RNA, 20 nt, Human
ucuccaccuccuccucucca

SEQ ID NO: 1265648 - RNA, 22 nt, Human
ucuccaccuccuccucuccaug

SEQ ID NO: 1265649 - RNA, 24 nt, Human
ucuccauacuccucuugggugaug

SEQ ID NO: 1265650 - RNA, 22 nt, Human
ucuccuugucuucugccagcuc

SEQ ID NO: 1265651 - RNA, 21 nt, Human
ucugccugaaaggcaaaaguu

SEQ ID NO: 1265652 - RNA, 21 nt, Human
ucuucuuucucaccuuucucu

SEQ ID NO: 1265653 - RNA, 19 nt, Human
ugaagaaaauaaaauaaaa

SEQ ID NO: 1265654 - RNA, 24 nt, Human
ugacugccaaguggucuucccagu

SEQ ID NO: 1265655 - RNA, 20 nt, Human
ugagaaugcuucuucacuac

SEQ ID NO: 1265656 - RNA, 20 nt, Human
ugaggguuggggaugauguc

SEQ ID NO: 1265657 - RNA, 20 nt, Human
ugaugagggauaugaguugg

SEQ ID NO: 1265658 - RNA, 24 nt, Human
ugccaccagguaggcagaaaaaag

SEQ ID NO: 1265659 - RNA, 21 nt, Human
ugccucaucaucacuaauuuc

SEQ ID NO: 1265660 - RNA, 23 nt, Human
ugccucaucaucacuaauuuccu

SEQ ID NO: 1265661 - RNA, 19 nt, Human
uggaauagaagguauugau

SEQ ID NO: 1265662 - RNA, 18 nt, Human
ugggagccauggggacac

SEQ ID NO: 1265663 - RNA, 24 nt, Human
ugggauagccuaugaacugagaau

SEQ ID NO: 1265664 - RNA, 24 nt, Human
ugguaucaacucaucacagcuguc

SEQ ID NO: 1265665 - RNA, 27 nt, Human
uuagaaaaugccucauagaauuucuua

SEQ ID NO: 1265666 - RNA, 19 nt, Human
uucagaacaaaaugaagaa

SEQ ID NO: 1265667 - RNA, 23 nt, Human
uugucuuguuccuucuccaaaua

SEQ ID NO: 1265668 - RNA, 18 nt, Human
uuuuccaacuaugaacuc

SEQ ID NO: 1265669 - RNA, 25 nt, Human
aaaaaagaaaaaagaucuaugaagg

SEQ ID NO: 1265670 - RNA, 25 nt, Human
aaagagaaaaaacaaguuuaaagaa

SEQ ID NO: 1265671 - RNA, 19 nt, Human
aacccagcguuugcuucca

SEQ ID NO: 1265672 - RNA, 19 nt, Human
aaccuaaaaugagagacca

SEQ ID NO: 1265673 - RNA, 21 nt, Human
aacuagcccacugugaaaccc

SEQ ID NO: 1265674 - RNA, 19 nt, Human
aacuugguaacacaggacc

SEQ ID NO: 1265675 - RNA, 21 nt, Human
aagaaaaaagaucuaugaagg

SEQ ID NO: 1265676 - RNA, 19 nt, Human
aagaagacacggauuccaa

SEQ ID NO: 1265677 - RNA, 26 nt, Human
aagagaaaaaacaaguuuaaagaaga

SEQ ID NO: 1265678 - RNA, 24 nt, Human
aaguacuucuucauuugcagcugc

SEQ ID NO: 1265679 - RNA, 21 nt, Human
acaaaaggcgacacugccaca

SEQ ID NO: 1265680 - RNA, 20 nt, Human
accuucccugggguacuguc

SEQ ID NO: 1265681 - RNA, 24 nt, Human
agaaaaaacaaguuuaaagaagaa

SEQ ID NO: 1265682 - RNA, 25 nt, Human
agaaaaaacaaguuuaaagaagaaa

SEQ ID NO: 1265683 - RNA, 20 nt, Human
agaagcaaauagaaugguuu

SEQ ID NO: 1265684 - RNA, 25 nt, Human
agagaaaaaacaaguuuaaagaaga

SEQ ID NO: 1265685 - RNA, 18 nt, Human
agagggagcaaugcugau

SEQ ID NO: 1265686 - RNA, 22 nt, Human
agcauuugaggaggguuguuuu

SEQ ID NO: 1265687 - RNA, 19 nt, Human
agggagcagcuuggcacag

SEQ ID NO: 1265688 - RNA, 24 nt, Human
aguucugugucuuguuuuucuccu

SEQ ID NO: 1265689 - RNA, 23 nt, Human
auaaaaccacaaaaggcgacacu

SEQ ID NO: 1265690 - RNA, 18 nt, Human
aucauccccucaccauga

SEQ ID NO: 1265691 - RNA, 24 nt, Human
auccuuuucagaaguagcagaagu

SEQ ID NO: 1265692 - RNA, 19 nt, Human
augaagcaugcccugcacc

SEQ ID NO: 1265693 - RNA, 21 nt, Human
augcuuuuagaauccucuucu

SEQ ID NO: 1265694 - RNA, 19 nt, Human
augguaaaugaagcaugcc

SEQ ID NO: 1265695 - RNA, 19 nt, Human
auguggaacaccaugcccc

SEQ ID NO: 1265696 - RNA, 21 nt, Human
auguuaaugcuaaagaagaag

SEQ ID NO: 1265697 - RNA, 20 nt, Human
auuuuguccaacuuuuucuu

SEQ ID NO: 1265698 - RNA, 19 nt, Human
caaaaauaaauaaggagga

SEQ ID NO: 1265699 - RNA, 20 nt, Human
caaagacucacuucuuucuc

SEQ ID NO: 1265700 - RNA, 22 nt, Human
caaggaaguugcagagccagua

SEQ ID NO: 1265701 - RNA, 20 nt, Human
caaguccccuaaugaagaaa

SEQ ID NO: 1265702 - RNA, 20 nt, Human
caccucaucauccccucacc

SEQ ID NO: 1265703 - RNA, 20 nt, Human
cacuaugcugcuuccaauau

SEQ ID NO: 1265704 - RNA, 21 nt, Human
cacuuuauuuaaaaauggagu

SEQ ID NO: 1265705 - RNA, 20 nt, Human
cagaugaagaaguccauuuc

SEQ ID NO: 1265706 - RNA, 22 nt, Human
caggauuauuguggaaauauua

SEQ ID NO: 1265707 - RNA, 19 nt, Human
cauaaaaccacaaaaggcg

SEQ ID NO: 1265708 - RNA, 27 nt, Human
cauaaaaccacaaaaggcgacacugcc

SEQ ID NO: 1265709 - RNA, 27 nt, Human
caugcuuaagagcuucuucagggaaaa

SEQ ID NO: 1265710 - RNA, 22 nt, Human
cauuugcagcugcagauuguuc

SEQ ID NO: 1265711 - RNA, 22 nt, Human
ccaaaucuuauuuccauuaaaa

SEQ ID NO: 1265712 - RNA, 18 nt, Human
ccaagacucccugaaccu

SEQ ID NO: 1265713 - RNA, 19 nt, Human
cccaagacucccugaaccu

SEQ ID NO: 1265714 - RNA, 24 nt, Human
cccagcaaaucuuagugcaaacau

SEQ ID NO: 1265715 - RNA, 25 nt, Human
ccugugagccccagcauucucugaa

SEQ ID NO: 1265716 - RNA, 20 nt, Human
ccuuaauuuuuuucuggagg

SEQ ID NO: 1265717 - RNA, 23 nt, Human
ccuucucucucccuggcuagcca

SEQ ID NO: 1265718 - RNA, 23 nt, Human
ccuucuugucuccucccuuugga

SEQ ID NO: 1265719 - RNA, 22 nt, Human
cgacacugccacaaucugcuuu

SEQ ID NO: 1265720 - RNA, 22 nt, Human
cuauggguauguuugggcuggg

SEQ ID NO: 1265721 - RNA, 23 nt, Human
cucacugucaugccagacucacu

SEQ ID NO: 1265722 - RNA, 21 nt, Human
cucacuuugugccacucuguc

SEQ ID NO: 1265723 - RNA, 26 nt, Human
cuccaaacaccuugugaaucauuuuu

SEQ ID NO: 1265724 - RNA, 23 nt, Human
cugccacaaucugcuuuuuccua

SEQ ID NO: 1265725 - RNA, 23 nt, Human
cugcuuccaauauuccuagucau

SEQ ID NO: 1265726 - RNA, 20 nt, Human
cugugucuuguuuuucuccu

SEQ ID NO: 1265727 - RNA, 19 nt, Human
cuuaaaaaaaagaaaaaag

SEQ ID NO: 1265728 - RNA, 22 nt, Human
cuucagggacccucauuucucc

SEQ ID NO: 1265729 - RNA, 19 nt, Human
cuugcagauguuaaugcua

SEQ ID NO: 1265730 - RNA, 18 nt, Human
cuuuucuucucuugcucu

SEQ ID NO: 1265731 - RNA, 20 nt, Human
gaaaguggaguaaaacacug

SEQ ID NO: 1265732 - RNA, 22 nt, Human
gacugauggggucaagggggaa

SEQ ID NO: 1265733 - RNA, 27 nt, Human
gagaaaaaacaaguuuaaagaagaaau

SEQ ID NO: 1265734 - RNA, 18 nt, Human
gagcagcuuggcacagga

SEQ ID NO: 1265735 - RNA, 20 nt, Human
gagcagcuuggcacaggaga

SEQ ID NO: 1265736 - RNA, 18 nt, Human
gcagcugcagauuguucc

SEQ ID NO: 1265737 - RNA, 21 nt, Human
gcuaaagaagaaggaguagag

SEQ ID NO: 1265738 - RNA, 21 nt, Human
gcuaaagaagaaggaguagag

SEQ ID NO: 1265739 - RNA, 18 nt, Human
ggagcagcuuggcacagg

SEQ ID NO: 1265740 - RNA, 24 nt, Human
guguuacaaccuuugcucuguggc

SEQ ID NO: 1265741 - RNA, 22 nt, Human
guuccagcuucaugauuuuuuu

SEQ ID NO: 1265742 - RNA, 21 nt, Human
guuuugagagucucuccauuu

SEQ ID NO: 1265743 - RNA, 23 nt, Human
uaaaaccacaaaaggcgacacug

SEQ ID NO: 1265744 - RNA, 19 nt, Human
uaaauccuauuauuaagaa

SEQ ID NO: 1265745 - RNA, 22 nt, Human
uaacugaauuaagauacacccc

SEQ ID NO: 1265746 - RNA, 24 nt, Human
uaagaagcaaauagaaugguuuaa

SEQ ID NO: 1265747 - RNA, 21 nt, Human
uaaguacccuugucacuuugg

SEQ ID NO: 1265748 - RNA, 18 nt, Human
uacugcccuguucauuuu

SEQ ID NO: 1265749 - RNA, 20 nt, Human
uagcacaggacaaaggccuu

SEQ ID NO: 1265750 - RNA, 20 nt, Human
uagcagaaguugcuugauuu

SEQ ID NO: 1265751 - RNA, 26 nt, Human
uaggucacagcauggcuuaaaaaaaa

SEQ ID NO: 1265752 - RNA, 25 nt, Human
uagugcaaacauaauaguuaauuuc

SEQ ID NO: 1265753 - RNA, 20 nt, Human
uaguuaucauuuaaccuaaa

SEQ ID NO: 1265754 - RNA, 19 nt, Human
uauaauggaguaccacggg

SEQ ID NO: 1265755 - RNA, 20 nt, Human
uauaauugaaccaaacugug

SEQ ID NO: 1265756 - RNA, 20 nt, Human
uauuuuguccaacuuuuucu

SEQ ID NO: 1265757 - RNA, 23 nt, Human
uauuuuguccaacuuuuucuuca

SEQ ID NO: 1265758 - RNA, 19 nt, Human
ucaacuaaucuuaugacua

SEQ ID NO: 1265759 - RNA, 19 nt, Human
ucaacugucacauauaaac

SEQ ID NO: 1265760 - RNA, 27 nt, Human
ucacauggucucuaauaguuaccuucc

SEQ ID NO: 1265761 - RNA, 24 nt, Human
ucacugaucucugucucauucucu

SEQ ID NO: 1265762 - RNA, 20 nt, Human
ucagaaauguuggcuauuua

SEQ ID NO: 1265763 - RNA, 21 nt, Human
uccaccucaucauccccucac

SEQ ID NO: 1265764 - RNA, 19 nt, Human
uccacugagccuccucccu

SEQ ID NO: 1265765 - RNA, 18 nt, Human
uccaggagcagagcugcc

SEQ ID NO: 1265766 - RNA, 19 nt, Human
uccauggcuuuuuccucgg

SEQ ID NO: 1265767 - RNA, 23 nt, Human
uccauuaaaaaaaaugaaaaaaa

SEQ ID NO: 1265768 - RNA, 21 nt, Human
ucccauguggaacaccaugcc

SEQ ID NO: 1265769 - RNA, 21 nt, Human
uccguaaaccccaagacaauu

SEQ ID NO: 1265770 - RNA, 21 nt, Human
uccuuacaucauucacaaaag

SEQ ID NO: 1265771 - RNA, 23 nt, Human
ucuaaaggaagaggugcagaaaa

SEQ ID NO: 1265772 - RNA, 24 nt, Human
ucuauagugaagcucccuugucgc

SEQ ID NO: 1265773 - RNA, 23 nt, Human
ucugauucugaagauuuuuggga

SEQ ID NO: 1265774 - RNA, 18 nt, Human
ucuguacagaugaagaag

SEQ ID NO: 1265775 - RNA, 22 nt, Human
ucugugcccaagacucccugaa

SEQ ID NO: 1265776 - RNA, 22 nt, Human
ucuguuuuaacaguuucccaug

SEQ ID NO: 1265777 - RNA, 22 nt, Human
ucuugcaggguccuuauaaaug

SEQ ID NO: 1265778 - RNA, 20 nt, Human
ucuuuuccauagcauuugag

SEQ ID NO: 1265779 - RNA, 24 nt, Human
ugaaacccagcguuugcuuccaga

SEQ ID NO: 1265780 - RNA, 20 nt, Human
ugaaccucuuaauaaugcag

SEQ ID NO: 1265781 - RNA, 21 nt, Human
ugaagaaaauuuuaaccucau

SEQ ID NO: 1265782 - RNA, 23 nt, Human
ugaagaaguccauuucagggagc

SEQ ID NO: 1265783 - RNA, 19 nt, Human
ugacauacuacauuauacg

SEQ ID NO: 1265784 - RNA, 20 nt, Human
ugaccucuguguuacaaccu

SEQ ID NO: 1265785 - RNA, 18 nt, Human
ugagccccagcauucucu

SEQ ID NO: 1265786 - RNA, 22 nt, Human
ugaggaggguuguuuugugcua

SEQ ID NO: 1265787 - RNA, 19 nt, Human
ugaucucugucucauucuc

SEQ ID NO: 1265788 - RNA, 21 nt, Human
ugcacagagcuaguaacagcu

SEQ ID NO: 1265789 - RNA, 19 nt, Human
ugcccuguucauuuuacuc

SEQ ID NO: 1265790 - RNA, 20 nt, Human
ugcuggaauucuuuuguagg

SEQ ID NO: 1265791 - RNA, 19 nt, Human
uggaagcuggggaagaguu

SEQ ID NO: 1265792 - RNA, 24 nt, Human
uggggucaagggggaaaauccagg

SEQ ID NO: 1265793 - RNA, 18 nt, Human
uguacaaaaaagacgguu

SEQ ID NO: 1265794 - RNA, 23 nt, Human
uguacaaaaaagacgguuagucc

SEQ ID NO: 1265795 - RNA, 19 nt, Human
uguccaccuaccacuccca

SEQ ID NO: 1265796 - RNA, 20 nt, Human
ugugaaaggucugcuuuacu

SEQ ID NO: 1265797 - RNA, 20 nt, Human
ugugccacucugucuccuuu

SEQ ID NO: 1265798 - RNA, 20 nt, Human
uguggaaauauuaaagacca

SEQ ID NO: 1265799 - RNA, 20 nt, Human
uguuacaaccuuugcucugg

SEQ ID NO: 1265800 - RNA, 18 nt, Human
uguuucguuuauuccuuc

SEQ ID NO: 1265801 - RNA, 24 nt, Human
uuaaaaccuuuuuucagucuuccu

SEQ ID NO: 1265802 - RNA, 21 nt, Human
uuaacauuuuauccaucuccu

SEQ ID NO: 1265803 - RNA, 18 nt, Human
uuaggugcuucuuucucc

SEQ ID NO: 1265804 - RNA, 19 nt, Human
uuccucagcuuuucuucuc

SEQ ID NO: 1265805 - RNA, 21 nt, Human
uucugauucugaagauuuuug

SEQ ID NO: 1265806 - RNA, 19 nt, Human
uucuucuugaucaugccuu

SEQ ID NO: 1265807 - RNA, 23 nt, Human
uuguaggaaggguauugacaccg

SEQ ID NO: 1265808 - RNA, 20 nt, Human
uuuagaauccucuucuguuc

SEQ ID NO: 1265809 - RNA, 25 nt, Human
uuucauccaccucaucauccccuca

SEQ ID NO: 1265810 - RNA, 23 nt, Human
uuucuuagaacaaauauagcaca

SEQ ID NO: 1265811 - RNA, 20 nt, Human
uuucuucuugaucaugccuu

SEQ ID NO: 1265812 - RNA, 21 nt, Human
uuugcagcugcagauuguucc

SEQ ID NO: 1265813 - RNA, 24 nt, Human
uuugcagcugcagauuguuccucc

SEQ ID NO: 1265814 - RNA, 19 nt, Human
uuugcucuguggcucucaa

SEQ ID NO: 1265815 - RNA, 22 nt, Human
uuuuucaacaaucaagagaaag

SEQ ID NO: 1265816 - RNA, 22 nt, Human
uuuuucuugcuuccacuuccuc

SEQ ID NO: 1265817 - RNA, 19 nt, Human
uuuuugggacaacugaagc

SEQ ID NO: 1265818 - RNA, 19 nt, Human
aaaaaccaccaccggaaug

SEQ ID NO: 1265819 - RNA, 21 nt, Human
aaaagaaaaaaacauuacaaa

SEQ ID NO: 1265820 - RNA, 23 nt, Human
aaacagauuuggcagugcgugaa

SEQ ID NO: 1265821 - RNA, 21 nt, Human
aaaccaccaccggaaugccaa

SEQ ID NO: 1265822 - RNA, 21 nt, Human
aaagcucuuccagccagggau

SEQ ID NO: 1265823 - RNA, 24 nt, Human
aaaggaaacaaaaaccaccaccgg

SEQ ID NO: 1265824 - RNA, 18 nt, Human
aacaacaaaaccaaacaa

SEQ ID NO: 1265825 - RNA, 23 nt, Human
aacaacaaaaccaaacaaaccca

SEQ ID NO: 1265826 - RNA, 25 nt, Human
aacaacaacaaaaccaaacaaaccc

SEQ ID NO: 1265827 - RNA, 27 nt, Human
aacaacaacaacaaaaccaaacaaacc

SEQ ID NO: 1265828 - RNA, 24 nt, Human
aaccaaacaaacccaaacucgaga

SEQ ID NO: 1265829 - RNA, 20 nt, Human
aagcaggggugaggggaaga

SEQ ID NO: 1265830 - RNA, 20 nt, Human
aagcuccccaaagcaggaaa

SEQ ID NO: 1265831 - RNA, 30 nt, Human
acaacaacaacaaaaccaaacaaacccaaa

SEQ ID NO: 1265832 - RNA, 20 nt, Human
acaugggcacacacuggggu

SEQ ID NO: 1265833 - RNA, 20 nt, Human
accccagagucugucugccu

SEQ ID NO: 1265834 - RNA, 20 nt, Human
accggagccugcagcagcaa

SEQ ID NO: 1265835 - RNA, 25 nt, Human
accuucucccucugaaccuuaauuu

SEQ ID NO: 1265836 - RNA, 20 nt, Human
acguggguaaagccagcaag

SEQ ID NO: 1265837 - RNA, 19 nt, Human
acucaggaaaacugccaug

SEQ ID NO: 1265838 - RNA, 22 nt, Human
agaacaacaacaacaaaaccaa

SEQ ID NO: 1265839 - RNA, 23 nt, Human
agagaaaagucauggacacgagg

SEQ ID NO: 1265840 - RNA, 21 nt, Human
agagccaugacuccaggggag

SEQ ID NO: 1265841 - RNA, 22 nt, Human
agauagaaggugggaggcaggg

SEQ ID NO: 1265842 - RNA, 20 nt, Human
aggaaacaaaaaccaccacc

SEQ ID NO: 1265843 - RNA, 23 nt, Human
aggaagcagcucugccuggcccu

SEQ ID NO: 1265844 - RNA, 26 nt, Human
aggcaagaagucacaguaccccagag

SEQ ID NO: 1265845 - RNA, 21 nt, Human
aggcacuggucaccagcccgg

SEQ ID NO: 1265846 - RNA, 22 nt, Human
aggcuuuggggaaggggacacu

SEQ ID NO: 1265847 - RNA, 19 nt, Human
aggguggggaggggcgggg

SEQ ID NO: 1265848 - RNA, 19 nt, Human
aggguggggaggggcgggg

SEQ ID NO: 1265849 - RNA, 23 nt, Human
agguggugggcagugcccacugu

SEQ ID NO: 1265850 - RNA, 18 nt, Human
aguccagggcagccuuug

SEQ ID NO: 1265851 - RNA, 24 nt, Human
auccgccucacaggcuugccguaa

SEQ ID NO: 1265852 - RNA, 18 nt, Human
aucucuggggcagggcag

SEQ ID NO: 1265853 - RNA, 20 nt, Human
auguucccccaucuuccacc

SEQ ID NO: 1265854 - RNA, 18 nt, Human
caacaaaaccaaacaaac

SEQ ID NO: 1265855 - RNA, 23 nt, Human
caacaacaaaaccaaacaaaccc

SEQ ID NO: 1265856 - RNA, 26 nt, Human
caacaacaacaaaaccaaacaaaccc

SEQ ID NO: 1265857 - RNA, 19 nt, Human
caaccaccaggacccuggc

SEQ ID NO: 1265858 - RNA, 24 nt, Human
caauuuaggaggagugaauaaagc

SEQ ID NO: 1265859 - RNA, 23 nt, Human
caccagaaaccagaugccacccc

SEQ ID NO: 1265860 - RNA, 22 nt, Human
caccccacggagcugggcaguc

SEQ ID NO: 1265861 - RNA, 21 nt, Human
caccccccucacaaugaagcc

SEQ ID NO: 1265862 - RNA, 19 nt, Human
caccccuccccucacaucc

SEQ ID NO: 1265863 - RNA, 18 nt, Human
caccucgaccuucaggcc

SEQ ID NO: 1265864 - RNA, 18 nt, Human
cacgagggaaagaacaac

SEQ ID NO: 1265865 - RNA, 18 nt, Human
cagaaaccagaugccacc

SEQ ID NO: 1265866 - RNA, 23 nt, Human
cagagcccuccaggcuggcccuc

SEQ ID NO: 1265867 - RNA, 19 nt, Human
cagagggagggucacuuga

SEQ ID NO: 1265868 - RNA, 19 nt, Human
cagccuaagguccuucuca

SEQ ID NO: 1265869 - RNA, 27 nt, Human
cagcugggacgacauacacccaccaac

SEQ ID NO: 1265870 - RNA, 21 nt, Human
cagcuuagaagagggaacagg

SEQ ID NO: 1265871 - RNA, 25 nt, Human
caggaaauguggguuguaaucaagg

SEQ ID NO: 1265872 - RNA, 22 nt, Human
caggcccacuccugggggagcc

SEQ ID NO: 1265873 - RNA, 22 nt, Human
caggggccgggaggggcccgug

SEQ ID NO: 1265874 - RNA, 19 nt, Human
caggggcgcccgagguguc

SEQ ID NO: 1265875 - RNA, 20 nt, Human
cagugaugcugugauaggag

SEQ ID NO: 1265876 - RNA, 22 nt, Human
cagugcccacuguuccuggagg

SEQ ID NO: 1265877 - RNA, 22 nt, Human
caguuugacagaugaccacauc

SEQ ID NO: 1265878 - RNA, 22 nt, Human
caucccagucuacucagcaccu

SEQ ID NO: 1265879 - RNA, 20 nt, Human
caugccucuccagaccucag

SEQ ID NO: 1265880 - RNA, 21 nt, Human
cauggcucaggcuguuaggug

SEQ ID NO: 1265881 - RNA, 22 nt, Human
ccaaacaaacccaaacucgaga

SEQ ID NO: 1265882 - RNA, 24 nt, Human
ccacaucugcccuggguuucuuca

SEQ ID NO: 1265883 - RNA, 19 nt, Human
ccacccugacccacccacu

SEQ ID NO: 1265884 - RNA, 23 nt, Human
ccacccuuccuuaucuucaaucu

SEQ ID NO: 1265885 - RNA, 20 nt, Human
ccacgggccugaggcuuugg

SEQ ID NO: 1265886 - RNA, 23 nt, Human
ccacuuggccaccacuuagccag

SEQ ID NO: 1265887 - RNA, 21 nt, Human
ccagcaaggaccagcgggccc

SEQ ID NO: 1265888 - RNA, 20 nt, Human
ccagcgcugcugcuuccccc

SEQ ID NO: 1265889 - RNA, 22 nt, Human
cccacccuuccuuaucuucaau

SEQ ID NO: 1265890 - RNA, 21 nt, Human
cccaccucccuucuuccccug

SEQ ID NO: 1265891 - RNA, 19 nt, Human
ccgaaacucacucuccacc

SEQ ID NO: 1265892 - RNA, 21 nt, Human
ccguaaggauuaaaggagcgu

SEQ ID NO: 1265893 - RNA, 21 nt, Human
ccucacaggcuugccguaagg

SEQ ID NO: 1265894 - RNA, 26 nt, Human
ccucggucggguagaaugggaagggg

SEQ ID NO: 1265895 - RNA, 18 nt, Human
ccucuucccucuuccucc

SEQ ID NO: 1265896 - RNA, 20 nt, Human
ccugacccacccacugccug

SEQ ID NO: 1265897 - RNA, 19 nt, Human
ccugcagcagcaaagcgca

SEQ ID NO: 1265898 - RNA, 21 nt, Human
ccuggagggagguaagaaaug

SEQ ID NO: 1265899 - RNA, 19 nt, Human
cgaaggcacuaaagaugcu

SEQ ID NO: 1265900 - RNA, 22 nt, Human
cgauaacuuggcagaauagcac

SEQ ID NO: 1265901 - RNA, 19 nt, Human
cgcugcccguguuguucuc

SEQ ID NO: 1265902 - RNA, 22 nt, Human
cgggcacaaaggcauacauggg

SEQ ID NO: 1265903 - RNA, 20 nt, Human
cgguuccagcucugcagcuc

SEQ ID NO: 1265904 - RNA, 23 nt, Human
cguguuguucuccagcgcugcug

SEQ ID NO: 1265905 - RNA, 20 nt, Human
cuaaagaugcuacaggugau

SEQ ID NO: 1265906 - RNA, 22 nt, Human
cuacacaacagcccugcagaac

SEQ ID NO: 1265907 - RNA, 21 nt, Human
cuauuccccagggggcaacag

SEQ ID NO: 1265908 - RNA, 19 nt, Human
cucacagaauagcgaccac

SEQ ID NO: 1265909 - RNA, 24 nt, Human
cucaccccccucacaaugaagcca

SEQ ID NO: 1265910 - RNA, 19 nt, Human
cucaggguuuuccaaauuu

SEQ ID NO: 1265911 - RNA, 18 nt, Human
cucccuucuuccccuggc

SEQ ID NO: 1265912 - RNA, 24 nt, Human
cucugcucucuuacucugggcugg

SEQ ID NO: 1265913 - RNA, 18 nt, Human
cucuuccagccagggaug

SEQ ID NO: 1265914 - RNA, 20 nt, Human
cugcucucuuacucugggcu

SEQ ID NO: 1265915 - RNA, 22 nt, Human
cugcucucuuacucugggcugg

SEQ ID NO: 1265916 - RNA, 18 nt, Human
cugcucugcucucuuacu

SEQ ID NO: 1265917 - RNA, 19 nt, Human
cuggagcucagcucucccg

SEQ ID NO: 1265918 - RNA, 22 nt, Human
cuggccacccugacccacccac

SEQ ID NO: 1265919 - RNA, 25 nt, Human
cugggagcuagaaaugcuggguccu

SEQ ID NO: 1265920 - RNA, 22 nt, Human
cuggguccugauuuugcuucug

SEQ ID NO: 1265921 - RNA, 21 nt, Human
cuggugggggcaccuucuuuu

SEQ ID NO: 1265922 - RNA, 18 nt, Human
cugucauggagaugcagc

SEQ ID NO: 1265923 - RNA, 22 nt, Human
cuguccacuccucagccuaagg

SEQ ID NO: 1265924 - RNA, 19 nt, Human
cuucccugccugguuuguc

SEQ ID NO: 1265925 - RNA, 21 nt, Human
cuucuuuuucccacucugugc

SEQ ID NO: 1265926 - RNA, 18 nt, Human
cuugcuggaguuucucca

SEQ ID NO: 1265927 - RNA, 21 nt, Human
gaaacaaaaaccaccaccgga

SEQ ID NO: 1265928 - RNA, 22 nt, Human
gaacaacaacaacaaaaccaaa

SEQ ID NO: 1265929 - RNA, 19 nt, Human
gaaugcauuucuucaggau

SEQ ID NO: 1265930 - RNA, 19 nt, Human
gaauggcagauucuuucau

SEQ ID NO: 1265931 - RNA, 20 nt, Human
gaauuuccucaucuauaaag

SEQ ID NO: 1265932 - RNA, 20 nt, Human
gacuguggcuucaguacccg

SEQ ID NO: 1265933 - RNA, 20 nt, Human
gagaaaagucauggacacga

SEQ ID NO: 1265934 - RNA, 18 nt, Human
gagagugacuggccaccc

SEQ ID NO: 1265935 - RNA, 22 nt, Human
gaggggcccguggcuucgcugc

SEQ ID NO: 1265936 - RNA, 23 nt, Human
gagguggugggcagugcccacug

SEQ ID NO: 1265937 - RNA, 19 nt, Human
gaugcugacauggacagaa

SEQ ID NO: 1265938 - RNA, 18 nt, Human
gcagaagcagccagcacc

SEQ ID NO: 1265939 - RNA, 24 nt, Human
gcagagaaaagucauggacacgag

SEQ ID NO: 1265940 - RNA, 21 nt, Human
gcagccuuugguauaggcugc

SEQ ID NO: 1265941 - RNA, 18 nt, Human
gcagggcaggguggggag

SEQ ID NO: 1265942 - RNA, 18 nt, Human
gcagguagacacugagca

SEQ ID NO: 1265943 - RNA, 18 nt, Human
gcccccucaccccccuca

SEQ ID NO: 1265944 - RNA, 19 nt, Human
gcccccucaccccccucac

SEQ ID NO: 1265945 - RNA, 19 nt, Human
gcccucuaggcagaaaggg

SEQ ID NO: 1265946 - RNA, 18 nt, Human
gcccuuccccaccucccu

SEQ ID NO: 1265947 - RNA, 19 nt, Human
gccugaggcuuuggggaag

SEQ ID NO: 1265948 - RNA, 18 nt, Human
gccuggaagcugaugccg

SEQ ID NO: 1265949 - RNA, 19 nt, Human
gcgaugguguaauacucuu

SEQ ID NO: 1265950 - RNA, 23 nt, Human
gcucagagcccuccaggcuggcc

SEQ ID NO: 1265951 - RNA, 20 nt, Human
gcucugccugggacccucgu

SEQ ID NO: 1265952 - RNA, 22 nt, Human
ggagggaucaggcccaggggcg

SEQ ID NO: 1265953 - RNA, 20 nt, Human
ggcaagugggcccugcccaa

SEQ ID NO: 1265954 - RNA, 23 nt, Human
ggcacccacgaggcacucagcaa

SEQ ID NO: 1265955 - RNA, 23 nt, Human
ggcaggagcaguuucuucuuuuu

SEQ ID NO: 1265956 - RNA, 18 nt, Human
ggcagggcugccucgguc

SEQ ID NO: 1265957 - RNA, 18 nt, Human
ggcggcugagcggaucuc

SEQ ID NO: 1265958 - RNA, 21 nt, Human
gggaagaaaaaaaaaucucug

SEQ ID NO: 1265959 - RNA, 19 nt, Human
gggcagggcagggcagggc

SEQ ID NO: 1265960 - RNA, 19 nt, Human
gggcagggcagggugggga

SEQ ID NO: 1265961 - RNA, 23 nt, Human
gggcggggcagggcagggcaggg

SEQ ID NO: 1265962 - RNA, 19 nt, Human
gggcuggagggaugguggg

SEQ ID NO: 1265963 - RNA, 18 nt, Human
gguccugauuuugcuucu

SEQ ID NO: 1265964 - RNA, 19 nt, Human
ggugaucagaggaagcucc

SEQ ID NO: 1265965 - RNA, 21 nt, Human
gguuccagcucugcagcucug

SEQ ID NO: 1265966 - RNA, 25 nt, Human
guaccccagagucugucugccuugg

SEQ ID NO: 1265967 - RNA, 23 nt, Human
gucuacacaacagcccugcagaa

SEQ ID NO: 1265968 - RNA, 19 nt, Human
gucuuuuacagaggggagg

SEQ ID NO: 1265969 - RNA, 22 nt, Human
gugaauuuccucaucuauaaag

SEQ ID NO: 1265970 - RNA, 21 nt, Human
gugugagcaaggggcgggggg

SEQ ID NO: 1265971 - RNA, 22 nt, Human
guucuccagcgcugcugcuucc

SEQ ID NO: 1265972 - RNA, 18 nt, Human
guugaaacaugaggagga

SEQ ID NO: 1265973 - RNA, 20 nt, Human
guuucuucuuuuucccacuc

SEQ ID NO: 1265974 - RNA, 21 nt, Human
uaaaaugacuaccguaaccug

SEQ ID NO: 1265975 - RNA, 18 nt, Human
uaacguggcauauguucc

SEQ ID NO: 1265976 - RNA, 21 nt, Human
uaacguggcauauguuccccc

SEQ ID NO: 1265977 - RNA, 20 nt, Human
uaccaccagccacucaaguu

SEQ ID NO: 1265978 - RNA, 21 nt, Human
uacguggguaaagccagcaag

SEQ ID NO: 1265979 - RNA, 24 nt, Human
uacucagcaccuagcacagaguag

SEQ ID NO: 1265980 - RNA, 24 nt, Human
uagaaacgggaagauggaauguug

SEQ ID NO: 1265981 - RNA, 23 nt, Human
uagaguaaguguggggaucucca

SEQ ID NO: 1265982 - RNA, 21 nt, Human
uaggagagugacuggccaccc

SEQ ID NO: 1265983 - RNA, 22 nt, Human
uauaggcugcugugggcuggag

SEQ ID NO: 1265984 - RNA, 24 nt, Human
ucaaagcucuuccagccagggaug

SEQ ID NO: 1265985 - RNA, 27 nt, Human
ucaaagcucuuccagccagggauggag

SEQ ID NO: 1265986 - RNA, 23 nt, Human
ucaaccaccaggacccuggcauu

SEQ ID NO: 1265987 - RNA, 19 nt, Human
ucagcucucccgcagucuc

SEQ ID NO: 1265988 - RNA, 18 nt, Human
ucaggaaaacugccaugg

SEQ ID NO: 1265989 - RNA, 19 nt, Human
ucaggccugccuggaagcu

SEQ ID NO: 1265990 - RNA, 25 nt, Human
uccaaagagaaagguacggccucca

SEQ ID NO: 1265991 - RNA, 19 nt, Human
uccaaguuggggugggaac

SEQ ID NO: 1265992 - RNA, 18 nt, Human
uccaggcuggcccucgag

SEQ ID NO: 1265993 - RNA, 18 nt, Human
uccaguggaaccucagag

SEQ ID NO: 1265994 - RNA, 19 nt, Human
uccccaccucccuucuucc

SEQ ID NO: 1265995 - RNA, 18 nt, Human
ucccucuuccuccuggcu

SEQ ID NO: 1265996 - RNA, 25 nt, Human
ucggcgaugguguaauacucuuccu

SEQ ID NO: 1265997 - RNA, 24 nt, Human
ucugcucucuuacucugggcuggg

SEQ ID NO: 1265998 - RNA, 25 nt, Human
ucugcucugcucucuuacucugggg

SEQ ID NO: 1265999 - RNA, 21 nt, Human
ucuguagaaaggugcucugaa

SEQ ID NO: 1266000 - RNA, 21 nt, Human
ucuuagacucaggguuuucca

SEQ ID NO: 1266001 - RNA, 22 nt, Human
ucuuguacuugucaaugaaggu

SEQ ID NO: 1266002 - RNA, 25 nt, Human
ugaaaaaagaaaaaaacauuacaaa

SEQ ID NO: 1266003 - RNA, 21 nt, Human
ugaaaggcaaagagcaaauca

SEQ ID NO: 1266004 - RNA, 22 nt, Human
ugaauaggacaucuaaaaguga

SEQ ID NO: 1266005 - RNA, 19 nt, Human
ugacucaaggagagaacag

SEQ ID NO: 1266006 - RNA, 25 nt, Human
ugagauucuugcuuuagggggucuc

SEQ ID NO: 1266007 - RNA, 18 nt, Human
ugagcagacacgaggugg

SEQ ID NO: 1266008 - RNA, 19 nt, Human
ugauaggggguggagcugg

SEQ ID NO: 1266009 - RNA, 22 nt, Human
ugauuuagucaugccucuccag

SEQ ID NO: 1266010 - RNA, 21 nt, Human
ugccuggcccuugguuaccuu

SEQ ID NO: 1266011 - RNA, 21 nt, Human
ugcuccuacccagcugacccc

SEQ ID NO: 1266012 - RNA, 24 nt, Human
ugcuggaguuucuccaggcaaugg

SEQ ID NO: 1266013 - RNA, 19 nt, Human
uggaaccucagaggcccac

SEQ ID NO: 1266014 - RNA, 19 nt, Human
uggaacugguaauggaaug

SEQ ID NO: 1266015 - RNA, 23 nt, Human
uggaaggcaggagcaguuucuuc

SEQ ID NO: 1266016 - RNA, 21 nt, Human
uggagcucagcucucccgcag

SEQ ID NO: 1266017 - RNA, 20 nt, Human
uggaggucuuggagagucuu

SEQ ID NO: 1266018 - RNA, 19 nt, Human
uggcaagugggcccugccc

SEQ ID NO: 1266019 - RNA, 19 nt, Human
uggcagagaaaagucaugg

SEQ ID NO: 1266020 - RNA, 19 nt, Human
uggcagugcgugaaaaaag

SEQ ID NO: 1266021 - RNA, 22 nt, Human
uggcggcccuuccccaccuccc

SEQ ID NO: 1266022 - RNA, 19 nt, Human
uggcugguguguccuuggg

SEQ ID NO: 1266023 - RNA, 23 nt, Human
ugggagaggcgaaauaaauacca

SEQ ID NO: 1266024 - RNA, 20 nt, Human
ugggagcuagaaaugcuggg

SEQ ID NO: 1266025 - RNA, 26 nt, Human
ugggcccugcccaagccucucuggga

SEQ ID NO: 1266026 - RNA, 20 nt, Human
ugggcuccagcgauccccca

SEQ ID NO: 1266027 - RNA, 19 nt, Human
uggggaggggcggggcagg

SEQ ID NO: 1266028 - RNA, 21 nt, Human
ugucauggagaugcagcuguu

SEQ ID NO: 1266029 - RNA, 18 nt, Human
ugugagcaaaggccucuu

SEQ ID NO: 1266030 - RNA, 20 nt, Human
ugugggcuggagggauggug

SEQ ID NO: 1266031 - RNA, 19 nt, Human
uguuaauaagcagggguga

SEQ ID NO: 1266032 - RNA, 20 nt, Human
uguucuccagcgcugcugcu

SEQ ID NO: 1266033 - RNA, 25 nt, Human
uuaaaccaaaguggaucaagaacuc

SEQ ID NO: 1266034 - RNA, 20 nt, Human
uuaagccaacauguaagacu

SEQ ID NO: 1266035 - RNA, 24 nt, Human
uuacugugccauguccaagccaug

SEQ ID NO: 1266036 - RNA, 19 nt, Human
uuagguguccacugucaca

SEQ ID NO: 1266037 - RNA, 20 nt, Human
uucagggcugaccacggucc

SEQ ID NO: 1266038 - RNA, 22 nt, Human
uucuccagcgcugcugcuuccc

SEQ ID NO: 1266039 - RNA, 18 nt, Human
uugaaaccagucaagcac

SEQ ID NO: 1266040 - RNA, 18 nt, Human
uugaguccagggcagccu

SEQ ID NO: 1266041 - RNA, 26 nt, Human
uuuaaaaaaaaaaaaaggaaagaagu

SEQ ID NO: 1266042 - RNA, 19 nt, Human
aaaaaaggaaacauauaau

SEQ ID NO: 1266043 - RNA, 22 nt, Human
aaaaaggaaacauauaauaaga

SEQ ID NO: 1266044 - RNA, 22 nt, Human
aacaguucuucagaccuggcuc

SEQ ID NO: 1266045 - RNA, 18 nt, Human
aagagauuugaaaagucu

SEQ ID NO: 1266046 - RNA, 19 nt, Human
aagagauuugaaaagucug

SEQ ID NO: 1266047 - RNA, 23 nt, Human
acaacauugguggaugaagaaug

SEQ ID NO: 1266048 - RNA, 20 nt, Human
agauauuaaaggcaacgucu

SEQ ID NO: 1266049 - RNA, 20 nt, Human
agauuugaaaagucuggaca

SEQ ID NO: 1266050 - RNA, 22 nt, Human
agcgucgccccgcgcuccccgc

SEQ ID NO: 1266051 - RNA, 19 nt, Human
aggagcucuuuggacuuuc

SEQ ID NO: 1266052 - RNA, 23 nt, Human
aggagcucuuuggacuuucuuuu

SEQ ID NO: 1266053 - RNA, 19 nt, Human
aggguaccaccacaggaaa

SEQ ID NO: 1266054 - RNA, 22 nt, Human
cacacgacuauaaacauuguuc

SEQ ID NO: 1266055 - RNA, 19 nt, Human
cccccacuguacacacgac

SEQ ID NO: 1266056 - RNA, 28 nt, Human
cuaaaauaguggugcuuuuaggauuuac

SEQ ID NO: 1266057 - RNA, 24 nt, Human
cuaguacucugcgaaccucucacg

SEQ ID NO: 1266058 - RNA, 21 nt, Human
cuccaauacaaaguauggggc

SEQ ID NO: 1266059 - RNA, 21 nt, Human
cugccgcugccgcgccgcucc

SEQ ID NO: 1266060 - RNA, 20 nt, Human
gacuauaaacauuguucccu

SEQ ID NO: 1266061 - RNA, 23 nt, Human
gucgcuacucuaggcgccacggc

SEQ ID NO: 1266062 - RNA, 24 nt, Human
uaaaguauacaguacaccauuuuc

SEQ ID NO: 1266063 - RNA, 21 nt, Human
uacaaguaucaaagaagcgaa

SEQ ID NO: 1266064 - RNA, 21 nt, Human
uacaguacaccauuuucauac

SEQ ID NO: 1266065 - RNA, 24 nt, Human
uacauuauuguacucuccaauaca

SEQ ID NO: 1266066 - RNA, 22 nt, Human
uagaaugugcaaacugauauag

SEQ ID NO: 1266067 - RNA, 20 nt, Human
uaguacucugcgaaccucuc

SEQ ID NO: 1266068 - RNA, 23 nt, Human
uaucuggaguagucuauauagga

SEQ ID NO: 1266069 - RNA, 19 nt, Human
uauguaaacaaaaaaagga

SEQ ID NO: 1266070 - RNA, 19 nt, Human
uccaauacaaaguaugggg

SEQ ID NO: 1266071 - RNA, 18 nt, Human
uccccgcgggucgcuacu

SEQ ID NO: 1266072 - RNA, 19 nt, Human
uccccgcgggucgcuacuc

SEQ ID NO: 1266073 - RNA, 23 nt, Human
ucccuauguaaacaaaaaaagga

SEQ ID NO: 1266074 - RNA, 26 nt, Human
ucccuauguaaacaaaaaaaggaaac

SEQ ID NO: 1266075 - RNA, 27 nt, Human
ucccuauguaaacaaaaaaaggaaacu

SEQ ID NO: 1266076 - RNA, 23 nt, Human
uccugccgcugccgcgccgcucc

SEQ ID NO: 1266077 - RNA, 22 nt, Human
ucuccaauacaaaguauggggc

SEQ ID NO: 1266078 - RNA, 21 nt, Human
ucucugcagccagcgucgccc

SEQ ID NO: 1266079 - RNA, 20 nt, Human
ucucuuagcaguaauacugg

SEQ ID NO: 1266080 - RNA, 20 nt, Human
ucucuugugauacuggaaag

SEQ ID NO: 1266081 - RNA, 21 nt, Human
uggacauuuccuucccaacag

SEQ ID NO: 1266082 - RNA, 21 nt, Human
uguaaacaaaaaaaggaaaca

SEQ ID NO: 1266083 - RNA, 20 nt, Human
uguacacacgacuauaaaca

SEQ ID NO: 1266084 - RNA, 20 nt, Human
uuaaaguauacaguacacca

SEQ ID NO: 1266085 - RNA, 20 nt, Human
uucccuauguaaacaaaaaa

SEQ ID NO: 1266086 - RNA, 23 nt, Human
uuuaacaaaguuggaaugcuggc

SEQ ID NO: 1266087 - RNA, 21 nt, Human
aaaaauaaucaugguagacac

SEQ ID NO: 1266088 - RNA, 23 nt, Human
agaaaaauaaucaugguagacac

SEQ ID NO: 1266089 - RNA, 22 nt, Human
acugggaggagagcuaaggacu

SEQ ID NO: 1266090 - RNA, 21 nt, Human
agcucagcgggcggugugagc

SEQ ID NO: 1266091 - RNA, 27 nt, Human
aggauccacucauccuccacggucagc

SEQ ID NO: 1266092 - RNA, 24 nt, Human
aggggguguacugggaggagagcu

SEQ ID NO: 1266093 - RNA, 20 nt, Human
augggagaaggagaggaggg

SEQ ID NO: 1266094 - RNA, 24 nt, Human
augggagaaggagaggagggacuc

SEQ ID NO: 1266095 - RNA, 24 nt, Human
ccuacagacugaccaaguaggggg

SEQ ID NO: 1266096 - RNA, 21 nt, Human
ccuacgauggaguguagaggc

SEQ ID NO: 1266097 - RNA, 21 nt, Human
cuaugugcuuauuucuuuucc

SEQ ID NO: 1266098 - RNA, 21 nt, Human
cucauccuccacggucagcca

SEQ ID NO: 1266099 - RNA, 23 nt, Human
cucauccuccacggucagccauc

SEQ ID NO: 1266100 - RNA, 25 nt, Human
cuuauagaagccacucagauuugcc

SEQ ID NO: 1266101 - RNA, 19 nt, Human
gacuauugucucuucugcc

SEQ ID NO: 1266102 - RNA, 18 nt, Human
gcggugugagcacccuuu

SEQ ID NO: 1266103 - RNA, 18 nt, Human
ggaagagggcgcgccgug

SEQ ID NO: 1266104 - RNA, 21 nt, Human
ggaaggcaugggagaaggaga

SEQ ID NO: 1266105 - RNA, 27 nt, Human
ggaaggcaugggagaaggagaggaggg

SEQ ID NO: 1266106 - RNA, 21 nt, Human
gggcggugugagcacccuuuc

SEQ ID NO: 1266107 - RNA, 18 nt, Human
ggugccacauuaauuugu

SEQ ID NO: 1266108 - RNA, 21 nt, Human
ucaguuccuuuccaugcagca

SEQ ID NO: 1266109 - RNA, 18 nt, Human
ucugccaccaucaagcuc

SEQ ID NO: 1266110 - RNA, 23 nt, Human
ucuucugccaccaucaagcucau

SEQ ID NO: 1266111 - RNA, 21 nt, Human
uggaaaaaaccaggaacaaug

SEQ ID NO: 1266112 - RNA, 18 nt, Human
ugggaggagagcuaagga

SEQ ID NO: 1266113 - RNA, 24 nt, Human
uuccuuuccaugcagcacacaaua

SEQ ID NO: 1266114 - RNA, 18 nt, Human
aagcaucucccaagccag

SEQ ID NO: 1266115 - RNA, 19 nt, Human
uggggguagagaugaugac

SEQ ID NO: 1266116 - RNA, 19 nt, Human
aagcuguugaauacuaaac

SEQ ID NO: 1266117 - RNA, 22 nt, Human
aaguauugaggccucauaagcu

SEQ ID NO: 1266118 - RNA, 18 nt, Human
agaaaacagcacaaagaa

SEQ ID NO: 1266119 - RNA, 20 nt, Human
agaaaacagcacaaagaaaa

SEQ ID NO: 1266120 - RNA, 24 nt, Human
agaaaacagcacaaagaaaacuug

SEQ ID NO: 1266121 - RNA, 25 nt, Human
agaaaacagcacaaagaaaacuuga

SEQ ID NO: 1266122 - RNA, 20 nt, Human
aggaagcuguugaauacuaa

SEQ ID NO: 1266123 - RNA, 21 nt, Human
aggccucauaagcugaaccug

SEQ ID NO: 1266124 - RNA, 22 nt, Human
aggcuucugcugcccucucugc

SEQ ID NO: 1266125 - RNA, 21 nt, Human
aggguggaagggccggacagg

SEQ ID NO: 1266126 - RNA, 22 nt, Human
auacuaaacuaacucaaaucau

SEQ ID NO: 1266127 - RNA, 25 nt, Human
cacaaagaaaacuugauacuuaaac

SEQ ID NO: 1266128 - RNA, 21 nt, Human
cacagccauuaaauacagaga

SEQ ID NO: 1266129 - RNA, 18 nt, Human
cagaccccggguguggag

SEQ ID NO: 1266130 - RNA, 19 nt, Human
cagacgcagaucuggcagc

SEQ ID NO: 1266131 - RNA, 19 nt, Human
ccacaaaaagcggagggca

SEQ ID NO: 1266132 - RNA, 19 nt, Human
ccacuacuacuugcucagg

SEQ ID NO: 1266133 - RNA, 21 nt, Human
ccagcagaccccgggugugga

SEQ ID NO: 1266134 - RNA, 21 nt, Human
ccaucuaaagaauuugggaau

SEQ ID NO: 1266135 - RNA, 19 nt, Human
cccauuuugucuauuucca

SEQ ID NO: 1266136 - RNA, 21 nt, Human
cccucucugcuacugacgguc

SEQ ID NO: 1266137 - RNA, 21 nt, Human
ccgcggagaccagcagacccc

SEQ ID NO: 1266138 - RNA, 21 nt, Human
cucagugacggaaccggacac

SEQ ID NO: 1266139 - RNA, 23 nt, Human
cuugcucaggucacucuccuuca

SEQ ID NO: 1266140 - RNA, 28 nt, Human
gaaaacagcacaaagaaaaccgguaccc

SEQ ID NO: 1266141 - RNA, 19 nt, Human
gaagugcacacugaauuaa

SEQ ID NO: 1266142 - RNA, 26 nt, Human
gagccugugacauccgcggagaccag

SEQ ID NO: 1266143 - RNA, 26 nt, Human
uaagcugaaccugacacaauaaauuu

SEQ ID NO: 1266144 - RNA, 21 nt, Human
uacuuaaacuuaguuggaaac

SEQ ID NO: 1266145 - RNA, 23 nt, Human
ucaaggccuccucauuguauucu

SEQ ID NO: 1266146 - RNA, 22 nt, Human
ucacccgagcggaccucggcuc

SEQ ID NO: 1266147 - RNA, 22 nt, Human
ucagaaaaccaucuaaagaauu

SEQ ID NO: 1266148 - RNA, 21 nt, Human
uccucagacccauccacuucc

SEQ ID NO: 1266149 - RNA, 25 nt, Human
uccuucauugucgguguuuguucaa

SEQ ID NO: 1266150 - RNA, 20 nt, Human
ucucugcuacugacggucaa

SEQ ID NO: 1266151 - RNA, 18 nt, Human
ugccacagccauuaaaua

SEQ ID NO: 1266152 - RNA, 19 nt, Human
ugccgagccugugacaucc

SEQ ID NO: 1266153 - RNA, 20 nt, Human
ugcguggcuggguuuggcca

SEQ ID NO: 1266154 - RNA, 18 nt, Human
uuggaaacuuuaugccca

SEQ ID NO: 1266155 - RNA, 23 nt, Human
aaaaagucuacuuccuguaaaaa

SEQ ID NO: 1266156 - RNA, 18 nt, Human
aaggggaguugagggcag

SEQ ID NO: 1266157 - RNA, 19 nt, Human
aagugcugaagacuacaca

SEQ ID NO: 1266158 - RNA, 21 nt, Human
aagugcugaagacuacacacu

SEQ ID NO: 1266159 - RNA, 21 nt, Human
acucagcccacugugcuuucu

SEQ ID NO: 1266160 - RNA, 21 nt, Human
acuggagugcacgggugcugg

SEQ ID NO: 1266161 - RNA, 19 nt, Human
agaaauuuuccagaacuga

SEQ ID NO: 1266162 - RNA, 22 nt, Human
cacucugcuucaaauacgaagg

SEQ ID NO: 1266163 - RNA, 19 nt, Human
cagauuccuagggggcaca

SEQ ID NO: 1266164 - RNA, 21 nt, Human
cagcagcugguggaaugguuu

SEQ ID NO: 1266165 - RNA, 25 nt, Human
cagcuccugggcucccugagggucc

SEQ ID NO: 1266166 - RNA, 21 nt, Human
caggguggggaaaagagaaga

SEQ ID NO: 1266167 - RNA, 21 nt, Human
caugcaaaugcauuauacugg

SEQ ID NO: 1266168 - RNA, 25 nt, Human
cauggcacuggugguagagucuuuu

SEQ ID NO: 1266169 - RNA, 23 nt, Human
ccucugaaaaaagucuacuuccu

SEQ ID NO: 1266170 - RNA, 20 nt, Human
ccucugauggugaauuccag

SEQ ID NO: 1266171 - RNA, 21 nt, Human
cucagccuuaucucacccagc

SEQ ID NO: 1266172 - RNA, 22 nt, Human
cuccugggcucccugagggucc

SEQ ID NO: 1266173 - RNA, 21 nt, Human
cucugcugcaggagcugcugc

SEQ ID NO: 1266174 - RNA, 23 nt, Human
cugagccugggguuucugagauu

SEQ ID NO: 1266175 - RNA, 29 nt, Human
cugcaggagcugcugcgaaggauccucuu

SEQ ID NO: 1266176 - RNA, 19 nt, Human
cuggguccuuuuguggcuc

SEQ ID NO: 1266177 - RNA, 21 nt, Human
cugguggaaugguuuucuugg

SEQ ID NO: 1266178 - RNA, 18 nt, Human
gagaaguucuggguccuu

SEQ ID NO: 1266179 - RNA, 18 nt, Human
gagauugcagcacugugc

SEQ ID NO: 1266180 - RNA, 22 nt, Human
gcuucuccucucucugcuggcu

SEQ ID NO: 1266181 - RNA, 21 nt, Human
ggugggaacuggagugcacgg

SEQ ID NO: 1266182 - RNA, 19 nt, Human
gugauccaggcuguaugua

SEQ ID NO: 1266183 - RNA, 19 nt, Human
gugcacgggugcuggcagg

SEQ ID NO: 1266184 - RNA, 21 nt, Human
guuaaugguucauguguccuc

SEQ ID NO: 1266185 - RNA, 21 nt, Human
uaaacagcuccugaaugcuaa

SEQ ID NO: 1266186 - RNA, 18 nt, Human
uaaggggaguugagggca

SEQ ID NO: 1266187 - RNA, 23 nt, Human
uaaggggaguugagggcagggug

SEQ ID NO: 1266188 - RNA, 27 nt, Human
uacacacuccuucaaggcucugcugca

SEQ ID NO: 1266189 - RNA, 19 nt, Human
uauuuaaaccacauccugu

SEQ ID NO: 1266190 - RNA, 21 nt, Human
ucaaggcucugcugcaggagc

SEQ ID NO: 1266191 - RNA, 19 nt, Human
uccagcugcuucuccucuc

SEQ ID NO: 1266192 - RNA, 21 nt, Human
uccccauuuuagaggcuacag

SEQ ID NO: 1266193 - RNA, 19 nt, Human
uccugcaaggccucugaug

SEQ ID NO: 1266194 - RNA, 20 nt, Human
ucucucugcuggcugagccu

SEQ ID NO: 1266195 - RNA, 25 nt, Human
ucucucugcuggcugagccuggggu

SEQ ID NO: 1266196 - RNA, 23 nt, Human
ucugauggugaauuccagcagcu

SEQ ID NO: 1266197 - RNA, 22 nt, Human
ugagggcaggguggggaaaaga

SEQ ID NO: 1266198 - RNA, 24 nt, Human
ugagggcaggguggggaaaagaga

SEQ ID NO: 1266199 - RNA, 20 nt, Human
ugccauggcaucuguaagcu

SEQ ID NO: 1266200 - RNA, 18 nt, Human
uggagaaguucugggucc

SEQ ID NO: 1266201 - RNA, 21 nt, Human
uggagugcacgggugcuggca

SEQ ID NO: 1266202 - RNA, 23 nt, Human
uggcacuggugguagagucuuuu

SEQ ID NO: 1266203 - RNA, 18 nt, Human
uggcaggggcaaacucca

SEQ ID NO: 1266204 - RNA, 19 nt, Human
ugggaauaaacagcuccug

SEQ ID NO: 1266205 - RNA, 23 nt, Human
ugggaauaaacagcuccugaaug

SEQ ID NO: 1266206 - RNA, 19 nt, Human
uggggaaaagagaagagau

SEQ ID NO: 1266207 - RNA, 21 nt, Human
ugggucuugugauccaggcug

SEQ ID NO: 1266208 - RNA, 21 nt, Human
uuaaugguucauguguccucu

SEQ ID NO: 1266209 - RNA, 22 nt, Human
uuaguguagugugaaaauggga

SEQ ID NO: 1266210 - RNA, 18 nt, Human
uuccagaacugaggguuc

SEQ ID NO: 1266211 - RNA, 21 nt, Human
uuccagcagcuccugggcucc

SEQ ID NO: 1266212 - RNA, 22 nt, Human
uuccuagggggcacauccaggu

SEQ ID NO: 1266213 - RNA, 19 nt, Human
uugagguaugaugcuggga

SEQ ID NO: 1266214 - RNA, 18 nt, Human
uugguggguucuggcugg

SEQ ID NO: 1266215 - RNA, 24 nt, Human
uuuuagggugcucuaagguagcca

SEQ ID NO: 1266216 - RNA, 22 nt, Human
agccucgguccacuccaagcaa

SEQ ID NO: 1266217 - RNA, 18 nt, Human
auagaacacguauauaca

SEQ ID NO: 1266218 - RNA, 24 nt, Human
ccccaugacuggguggccuccagu

SEQ ID NO: 1266219 - RNA, 23 nt, Human
cccccaugacuggguggccucca

SEQ ID NO: 1266220 - RNA, 20 nt, Human
cccggcccucccugcauucc

SEQ ID NO: 1266221 - RNA, 18 nt, Human
cgcuagcuggggacugcg

SEQ ID NO: 1266222 - RNA, 20 nt, Human
cgggagccgcgcuggacagg

SEQ ID NO: 1266223 - RNA, 24 nt, Human
cuggggcggagcccggcccucccu

SEQ ID NO: 1266224 - RNA, 18 nt, Human
ggcgaugugacggaugaa

SEQ ID NO: 1266225 - RNA, 21 nt, Human
ggcgggagccgcgcuggacag

SEQ ID NO: 1266226 - RNA, 21 nt, Human
uccaagcaacauuuauugagg

SEQ ID NO: 1266227 - RNA, 23 nt, Human
ucccugcauuccugcagagccuc

SEQ ID NO: 1266228 - RNA, 23 nt, Human
ucgguccacuccaagcaacauuu

SEQ ID NO: 1266229 - RNA, 27 nt, Human
ugcccucggcguccagacgccaggcuc

SEQ ID NO: 1266230 - RNA, 21 nt, Human
aacccuuuguuggaaugcuuu

SEQ ID NO: 1266231 - RNA, 22 nt, Human
aacccuuuguuggaaugcuuuc

SEQ ID NO: 1266232 - RNA, 20 nt, Human
accaagguuuccgaagacaa

SEQ ID NO: 1266233 - RNA, 23 nt, Human
auagaaccuggcaucacccugaa

SEQ ID NO: 1266234 - RNA, 18 nt, Human
auugcauaggauguacca

SEQ ID NO: 1266235 - RNA, 26 nt, Human
auuuugcuuggauaaucccuuuuaau

SEQ ID NO: 1266236 - RNA, 18 nt, Human
caacagcaugggugcaaa

SEQ ID NO: 1266237 - RNA, 23 nt, Human
caacuacaccaagguuuccgaag

SEQ ID NO: 1266238 - RNA, 28 nt, Human
caacuacaccaagguuuccgaagacaau

SEQ ID NO: 1266239 - RNA, 21 nt, Human
caauggcuucuucacccaagc

SEQ ID NO: 1266240 - RNA, 20 nt, Human
cagcacauuaaaaaaaaaga

SEQ ID NO: 1266241 - RNA, 18 nt, Human
cugcugagcuuuguuucc

SEQ ID NO: 1266242 - RNA, 21 nt, Human
cuuuccacagaacagaaacua

SEQ ID NO: 1266243 - RNA, 24 nt, Human
gcuucauucccaucuauaauuuua

SEQ ID NO: 1266244 - RNA, 24 nt, Human
guuuuuugcccauacacaugaguc

SEQ ID NO: 1266245 - RNA, 26 nt, Human
uaaaaaaaaagacauuuauucagugu

SEQ ID NO: 1266246 - RNA, 21 nt, Human
uacaccaagguuuccgaagac

SEQ ID NO: 1266247 - RNA, 20 nt, Human
ucucuggcucuccucuccug

SEQ ID NO: 1266248 - RNA, 19 nt, Human
uguuguaaccuguagcuuc

SEQ ID NO: 1266249 - RNA, 20 nt, Human
uucagaguagacuaacuuua

SEQ ID NO: 1266250 - RNA, 23 nt, Human
aaacaucagaauauauuuaugac

SEQ ID NO: 1266251 - RNA, 19 nt, Human
aaagaaaacaaacggaggg

SEQ ID NO: 1266252 - RNA, 18 nt, Human
aagaaaacaaacggaggg

SEQ ID NO: 1266253 - RNA, 24 nt, Human
aagaguuucaggaaggguggggga

SEQ ID NO: 1266254 - RNA, 21 nt, Human
acacacacacacacacacaca

SEQ ID NO: 1266255 - RNA, 25 nt, Human
acacacacacacacacacacacggu

SEQ ID NO: 1266256 - RNA, 23 nt, Human
acacacacacacacacacgcaca

SEQ ID NO: 1266257 - RNA, 23 nt, Human
acacacacacacacacacgcaca

SEQ ID NO: 1266258 - RNA, 27 nt, Human
acacacacacacacacgcacacacaca

SEQ ID NO: 1266259 - RNA, 23 nt, Human
acacacacgcacacacacacaca

SEQ ID NO: 1266260 - RNA, 23 nt, Human
acacgcacacacacacacacaca

SEQ ID NO: 1266261 - RNA, 18 nt, Human
acagagccuggagaacac

SEQ ID NO: 1266262 - RNA, 19 nt, Human
accccaacucccucggugc

SEQ ID NO: 1266263 - RNA, 23 nt, Human
acccuggagcucccaaaacccuu

SEQ ID NO: 1266264 - RNA, 23 nt, Human
acccuggcgaaguccuucugaca

SEQ ID NO: 1266265 - RNA, 21 nt, Human
acgcacacacacacacacaca

SEQ ID NO: 1266266 - RNA, 24 nt, Human
agaaaagagugaggauuaggccua

SEQ ID NO: 1266267 - RNA, 18 nt, Human
agagcgcucagcuccccc

SEQ ID NO: 1266268 - RNA, 23 nt, Human
agagcgcucagcuccccccaccc

SEQ ID NO: 1266269 - RNA, 18 nt, Human
agcaagauaucaaaggcu

SEQ ID NO: 1266270 - RNA, 21 nt, Human
agcagagcgcucagcuccccc

SEQ ID NO: 1266271 - RNA, 19 nt, Human
agcgcucagcuccccccac

SEQ ID NO: 1266272 - RNA, 22 nt, Human
agcuccccccaccccaacuccc

SEQ ID NO: 1266273 - RNA, 20 nt, Human
aggaagaaaagagugaggau

SEQ ID NO: 1266274 - RNA, 18 nt, Human
agggaaagggggccgagg

SEQ ID NO: 1266275 - RNA, 22 nt, Human
aguaauaagggaaccagagaua

SEQ ID NO: 1266276 - RNA, 18 nt, Human
augaacccuggagcuccc

SEQ ID NO: 1266277 - RNA, 21 nt, Human
auggaaccaggggagcucucu

SEQ ID NO: 1266278 - RNA, 19 nt, Human
caaagccagccugcugcuc

SEQ ID NO: 1266279 - RNA, 23 nt, Human
caagaggauggugaaaacccacu

SEQ ID NO: 1266280 - RNA, 19 nt, Human
caagccgggugaugggugc

SEQ ID NO: 1266281 - RNA, 20 nt, Human
cacacacacacacacacaca

SEQ ID NO: 1266282 - RNA, 27 nt, Human
cacacacacacacacaccauguaaggc

SEQ ID NO: 1266283 - RNA, 26 nt, Human
cacacacacacacacacgcacacaca

SEQ ID NO: 1266284 - RNA, 26 nt, Human
cacacacacacacacgcacacacaca

SEQ ID NO: 1266285 - RNA, 22 nt, Human
cacacacacacgcacacacaca

SEQ ID NO: 1266286 - RNA, 18 nt, Human
cacagagccuggagaaca

SEQ ID NO: 1266287 - RNA, 21 nt, Human
caccuggacacuaccacugag

SEQ ID NO: 1266288 - RNA, 19 nt, Human
caccuggcucaggggaggg

SEQ ID NO: 1266289 - RNA, 20 nt, Human
caccuggcucaggggagggg

SEQ ID NO: 1266290 - RNA, 23 nt, Human
cacuaaggucucaucaggguuug

SEQ ID NO: 1266291 - RNA, 21 nt, Human
cagagccuggagaacacuaag

SEQ ID NO: 1266292 - RNA, 22 nt, Human
cagcagagcgcucagcuccccc

SEQ ID NO: 1266293 - RNA, 22 nt, Human
cagcccaucccccugugggccc

SEQ ID NO: 1266294 - RNA, 21 nt, Human
cagucgucagguucuggaggg

SEQ ID NO: 1266295 - RNA, 23 nt, Human
caguuuuacuuuaagaggauaau

SEQ ID NO: 1266296 - RNA, 18 nt, Human
ccaacccaagcaaugcuu

SEQ ID NO: 1266297 - RNA, 27 nt, Human
ccacagagccuggagaacagcggaccg

SEQ ID NO: 1266298 - RNA, 23 nt, Human
ccacagccagcccaucccccugu

SEQ ID NO: 1266299 - RNA, 19 nt, Human
ccacugagggaggagugaa

SEQ ID NO: 1266300 - RNA, 18 nt, Human
ccagagauaaaaccccaa

SEQ ID NO: 1266301 - RNA, 24 nt, Human
ccagcagagcgcucagcucccccc

SEQ ID NO: 1266302 - RNA, 21 nt, Human
ccagcgcagaguagaagggaa

SEQ ID NO: 1266303 - RNA, 19 nt, Human
cccaaaacccuggcgaagu

SEQ ID NO: 1266304 - RNA, 20 nt, Human
cccaagcaaugcuuugugcc

SEQ ID NO: 1266305 - RNA, 22 nt, Human
cccaccccaacucccucggugc

SEQ ID NO: 1266306 - RNA, 19 nt, Human
ccccaacucccucggugcc

SEQ ID NO: 1266307 - RNA, 22 nt, Human
ccccagccugggccaucuucuc

SEQ ID NO: 1266308 - RNA, 24 nt, Human
ccccccaccccaacucccucggug

SEQ ID NO: 1266309 - RNA, 25 nt, Human
cccccugcccuaaaccugccacagc

SEQ ID NO: 1266310 - RNA, 23 nt, Human
ccccugcccuaaaccugccacag

SEQ ID NO: 1266311 - RNA, 18 nt, Human
cccgggucgcgcgugggg

SEQ ID NO: 1266312 - RNA, 20 nt, Human
cccuaaaccugccacagcca

SEQ ID NO: 1266313 - RNA, 19 nt, Human
cccucggugccaccgcucu

SEQ ID NO: 1266314 - RNA, 23 nt, Human
cccugcccuaaaccugccacagc

SEQ ID NO: 1266315 - RNA, 23 nt, Human
cccuggagcucccaaaacccugg

SEQ ID NO: 1266316 - RNA, 19 nt, Human
ccugcccuaaaccugccac

SEQ ID NO: 1266317 - RNA, 18 nt, Human
ccuggcucaggggagggg

SEQ ID NO: 1266318 - RNA, 22 nt, Human
ccugugccuccagacacacaca

SEQ ID NO: 1266319 - RNA, 21 nt, Human
ccuugggucacauggcccagu

SEQ ID NO: 1266320 - RNA, 20 nt, Human
cgcacacacacacacacaca

SEQ ID NO: 1266321 - RNA, 24 nt, Human
cgcacacacacacacacacaccau

SEQ ID NO: 1266322 - RNA, 19 nt, Human
cuaaaccugccacagccag

SEQ ID NO: 1266323 - RNA, 19 nt, Human
cuaaaccugccacagccag

SEQ ID NO: 1266324 - RNA, 21 nt, Human
cucagacagagagcaagagga

SEQ ID NO: 1266325 - RNA, 23 nt, Human
cucagcuccccccaccccaacuc

SEQ ID NO: 1266326 - RNA, 22 nt, Human
cuccccccaccccaacucccuc

SEQ ID NO: 1266327 - RNA, 18 nt, Human
cugcucucagccugggcc

SEQ ID NO: 1266328 - RNA, 19 nt, Human
cugcugcucucagccuggu

SEQ ID NO: 1266329 - RNA, 23 nt, Human
cugugggcccucuguccaagucc

SEQ ID NO: 1266330 - RNA, 24 nt, Human
cuuaugaacccuggagcucccaaa

SEQ ID NO: 1266331 - RNA, 18 nt, Human
gaaagaaggaaggagggg

SEQ ID NO: 1266332 - RNA, 27 nt, Human
gcacacacacacacacacaccauguag

SEQ ID NO: 1266333 - RNA, 22 nt, Human
gccagcccaucccccugugggc

SEQ ID NO: 1266334 - RNA, 20 nt, Human
gcuaaagugagagaggccag

SEQ ID NO: 1266335 - RNA, 20 nt, Human
gcucagcuccccccacccca

SEQ ID NO: 1266336 - RNA, 25 nt, Human
gcucccaaaacccuggcgaaguccu

SEQ ID NO: 1266337 - RNA, 18 nt, Human
ggacaaaugcccccugcc

SEQ ID NO: 1266338 - RNA, 24 nt, Human
ggagggaaagggggccgaggauga

SEQ ID NO: 1266339 - RNA, 20 nt, Human
ggugagugggaagguagagg

SEQ ID NO: 1266340 - RNA, 19 nt, Human
gugccugugccuccagaca

SEQ ID NO: 1266341 - RNA, 18 nt, Human
guggcagaaggaauggaa

SEQ ID NO: 1266342 - RNA, 20 nt, Human
uaaggcaccacuggauuaua

SEQ ID NO: 1266343 - RNA, 22 nt, Human
ucagcuccccccaccccaacuc

SEQ ID NO: 1266344 - RNA, 23 nt, Human
ucagcuccccccaccccaacucc

SEQ ID NO: 1266345 - RNA, 19 nt, Human
uccaaguccuguggggagc

SEQ ID NO: 1266346 - RNA, 20 nt, Human
uccagacacacacacacaca

SEQ ID NO: 1266347 - RNA, 33 nt, Human; identical to SEQ ID NO: 51641

SEQ ID NO: 1266348 - RNA, 18 nt, Human
uccauggcuaaagugaga

SEQ ID NO: 1266349 - RNA, 23 nt, Human
uccauggcuaaagugagagaggc

SEQ ID NO: 1266350 - RNA, 18 nt, Human
ucccaaaacccuggcgaa

SEQ ID NO: 1266351 - RNA, 18 nt, Human
uccccccaccccaacucc

SEQ ID NO: 1266352 - RNA, 23 nt, Human
ucccccugugggcccucugucca

SEQ ID NO: 1266353 - RNA, 20 nt, Human
ucccucggugccaccgcucu

SEQ ID NO: 1266354 - RNA, 24 nt, Human
ucccucggugccaccgcucuuggg

SEQ ID NO: 1266355 - RNA, 18 nt, Human
uccuucugacacugcugu

SEQ ID NO: 1266356 - RNA, 21 nt, Human
ugaaaagaaaacaaacggagg

SEQ ID NO: 1266357 - RNA, 18 nt, Human
ugcaaaaggaaaagaagg

SEQ ID NO: 1266358 - RNA, 18 nt, Human
ugcaaaaggaaaagaagg

SEQ ID NO: 1266359 - RNA, 20 nt, Human
ugcccuaaaccugccacagc

SEQ ID NO: 1266360 - RNA, 20 nt, Human
uggaaccaggggagcucucu

SEQ ID NO: 1266361 - RNA, 22 nt, Human
uggaggggacaaaugcccccug

SEQ ID NO: 1266362 - RNA, 18 nt, Human
uggcagaaggaauggaac

SEQ ID NO: 1266363 - RNA, 28 nt, Human
uggggcgguagggaaagaaggaaggagg

SEQ ID NO: 1266364 - RNA, 19 nt, Human
ugguaaggaucccuccuug

SEQ ID NO: 1266365 - RNA, 24 nt, Human
ugguucaccuucuuaugaacccug

SEQ ID NO: 1266366 - RNA, 20 nt, Human
uucaaggcugggguuuagaa

SEQ ID NO: 1266367 - RNA, 19 nt, Human
uuccauggcuaaagugaga

SEQ ID NO: 1266368 - RNA, 26 nt, Human
aggagaccauuuuggagccacgggug

SEQ ID NO: 1266369 - RNA, 18 nt, Human
cacggaccaggagaccau

SEQ ID NO: 1266370 - RNA, 26 nt, Human
cacggaccaggagaccauuuuggagc

SEQ ID NO: 1266371 - RNA, 21 nt, Human
ccuguguccccaguccagagc

SEQ ID NO: 1266372 - RNA, 21 nt, Human
cucagccucugccuugggggc

SEQ ID NO: 1266373 - RNA, 22 nt, Human
cucgcaucauauuuccuggauc

SEQ ID NO: 1266374 - RNA, 22 nt, Human
cugucucuggcucagcuuccac

SEQ ID NO: 1266375 - RNA, 22 nt, Human
cuuccacccccagcuggggcuc

SEQ ID NO: 1266376 - RNA, 25 nt, Human
cuucugauucucagccucugccuug

SEQ ID NO: 1266377 - RNA, 18 nt, Human
ggcucagcuuccaccccc

SEQ ID NO: 1266378 - RNA, 19 nt, Human
ucaucuuccucgcaucaua

SEQ ID NO: 1266379 - RNA, 18 nt, Human
uccucucaucuuccucgc

SEQ ID NO: 1266380 - RNA, 19 nt, Human
uggcucagcuuccaccccc

SEQ ID NO: 1266381 - RNA, 25 nt, Human
uggcucagcuuccacccccagcugg

SEQ ID NO: 1266382 - RNA, 19 nt, Human
ugugcccagaugcuugaac

SEQ ID NO: 1266383 - RNA, 22 nt, Human
uguuccucugugacugucucug

SEQ ID NO: 1266384 - RNA, 22 nt, Human
uguuuuguccuucagauuugua

SEQ ID NO: 1266385 - RNA, 18 nt, Human
caacacgccguaccgcag

SEQ ID NO: 1266386 - RNA, 20 nt, Human
caauccuuuugauaagaaau

SEQ ID NO: 1266387 - RNA, 23 nt, Human
ccgcugggaccaacacgccguac

SEQ ID NO: 1266388 - RNA, 19 nt, Human
ccuacagcacgucccuacc

SEQ ID NO: 1266389 - RNA, 21 nt, Human
ccucagcugaaccgcugggac

SEQ ID NO: 1266390 - RNA, 19 nt, Human
cugggaccaacacgccgua

SEQ ID NO: 1266391 - RNA, 18 nt, Human
cuguaaaacaaauaccau

SEQ ID NO: 1266392 - RNA, 22 nt, Human
gaaguucuaagaaaaaaugaca

SEQ ID NO: 1266393 - RNA, 21 nt, Human
gcugaaccgcugggaccaaca

SEQ ID NO: 1266394 - RNA, 20 nt, Human
uaaaaaaaaggauauuauau

SEQ ID NO: 1266395 - RNA, 25 nt, Human
uaaacuccaaagccaauuucaaaag

SEQ ID NO: 1266396 - RNA, 23 nt, Human
uaaauaaaugcuugaaauauacc

SEQ ID NO: 1266397 - RNA, 21 nt, Human
uauccaauccuuuugauaaga

SEQ ID NO: 1266398 - RNA, 23 nt, Human
ugaaauauacccaguagaaacuu

SEQ ID NO: 1266399 - RNA, 18 nt, Human
uuucaugucauaaaaugg

SEQ ID NO: 1266400 - RNA, 19 nt, Human
aaagcaagauggaacccaa

SEQ ID NO: 1266401 - RNA, 19 nt, Human
aagcagcugggauccaugg

SEQ ID NO: 1266402 - RNA, 18 nt, Human
aagggcccuugggagggg

SEQ ID NO: 1266403 - RNA, 18 nt, Human
acaagagaaaggcacaaa

SEQ ID NO: 1266404 - RNA, 24 nt, Human
acacaaagaucggagccaggacag

SEQ ID NO: 1266405 - RNA, 26 nt, Human
acaccaaaaauagaagaccagagaau

SEQ ID NO: 1266406 - RNA, 21 nt, Human
acacugcccacugcccacagg

SEQ ID NO: 1266407 - RNA, 19 nt, Human
accacauguggggaagggu

SEQ ID NO: 1266408 - RNA, 21 nt, Human
accucacugaggccgaaacaa

SEQ ID NO: 1266409 - RNA, 19 nt, Human
acugcugggguucgcuggc

SEQ ID NO: 1266410 - RNA, 21 nt, Human
agaagagcacauucuaccaca

SEQ ID NO: 1266411 - RNA, 21 nt, Human
agaagcaaaccuuggcagggg

SEQ ID NO: 1266412 - RNA, 19 nt, Human
agaaggauggugacaaauc

SEQ ID NO: 1266413 - RNA, 21 nt, Human
agagaagcaaaccuuggcagg

SEQ ID NO: 1266414 - RNA, 19 nt, Human
agagagaaauuagagggaa

SEQ ID NO: 1266415 - RNA, 18 nt, Human
agcccaauacagaucaaa

SEQ ID NO: 1266416 - RNA, 22 nt, Human
aggaaagaaauuuaaagcaaga

SEQ ID NO: 1266417 - RNA, 18 nt, Human
agguuccccuguguuccc

SEQ ID NO: 1266418 - RNA, 21 nt, Human
aguagauacagaagagcacau

SEQ ID NO: 1266419 - RNA, 21 nt, Human
agugggaguaaagagagaaug

SEQ ID NO: 1266420 - RNA, 24 nt, Human
aguguacagagaugacaagagaaa

SEQ ID NO: 1266421 - RNA, 22 nt, Human
aucccuaagguacggauuccua

SEQ ID NO: 1266422 - RNA, 23 nt, Human
auggaaaagcagaagcacuuuaa

SEQ ID NO: 1266423 - RNA, 24 nt, Human
caaaucccaaaaaggaaauggagg

SEQ ID NO: 1266424 - RNA, 24 nt, Human
caacaccaaaaauagaagaccaga

SEQ ID NO: 1266425 - RNA, 18 nt, Human
caacagaaaugaccgaca

SEQ ID NO: 1266426 - RNA, 19 nt, Human
caaccucacugaggccgaa

SEQ ID NO: 1266427 - RNA, 18 nt, Human
caagacacugcccacugc

SEQ ID NO: 1266428 - RNA, 18 nt, Human
caagagaaaggcacaaau

SEQ ID NO: 1266429 - RNA, 24 nt, Human
caagagcaacagaaaugaccgaca

SEQ ID NO: 1266430 - RNA, 19 nt, Human
cacacaaucacaagugcca

SEQ ID NO: 1266431 - RNA, 19 nt, Human
caccaaaaauagaagacca

SEQ ID NO: 1266432 - RNA, 22 nt, Human
caccucuucccugccccuccaa

SEQ ID NO: 1266433 - RNA, 23 nt, Human
caccugaagggcuugcagagugc

SEQ ID NO: 1266434 - RNA, 18 nt, Human
cacugaggccgaaacaac

SEQ ID NO: 1266435 - RNA, 23 nt, Human
cagaacuccuugggucagugcug

SEQ ID NO: 1266436 - RNA, 22 nt, Human
cagaucccuaagguacggauuc

SEQ ID NO: 1266437 - RNA, 22 nt, Human
caggcaaccucacugaggccga

SEQ ID NO: 1266438 - RNA, 24 nt, Human
cagugcugagagaccugcacucaa

SEQ ID NO: 1266439 - RNA, 21 nt, Human
cauguuggaggagaccaaguu

SEQ ID NO: 1266440 - RNA, 24 nt, Human
ccaaagugaauggacccccugcca

SEQ ID NO: 1266441 - RNA, 25 nt, Human
ccaagacacugcccacugcccacua

SEQ ID NO: 1266442 - RNA, 18 nt, Human
ccaagucuuacucgcuug

SEQ ID NO: 1266443 - RNA, 23 nt, Human
ccacaggugaacucaaaucaaac

SEQ ID NO: 1266444 - RNA, 22 nt, Human
ccaggacaguccugagggggau

SEQ ID NO: 1266445 - RNA, 24 nt, Human
ccugagggggauggccuucccaaa

SEQ ID NO: 1266446 - RNA, 20 nt, Human
ccugccccuccauagaacac

SEQ ID NO: 1266447 - RNA, 18 nt, Human
ccugucucuuuaaaacua

SEQ ID NO: 1266448 - RNA, 20 nt, Human
cggaaaagauccaagucuua

SEQ ID NO: 1266449 - RNA, 20 nt, Human
cggaaaagauccaagucuua

SEQ ID NO: 1266450 - RNA, 24 nt, Human
cuacucaucaaucagguccugucu

SEQ ID NO: 1266451 - RNA, 21 nt, Human
cuacugcugggguucgcuggc

SEQ ID NO: 1266452 - RNA, 19 nt, Human
cucgcuugucaaguuuucu

SEQ ID NO: 1266453 - RNA, 21 nt, Human
cucuccaucucauucagauca

SEQ ID NO: 1266454 - RNA, 19 nt, Human
cucuucauucuucucucca

SEQ ID NO: 1266455 - RNA, 20 nt, Human
cucuucggaaaagauccaag

SEQ ID NO: 1266456 - RNA, 25 nt, Human
cuucucuccaucucauucagaucaa

SEQ ID NO: 1266457 - RNA, 23 nt, Human
gaaccaccaccucuucauucuuc

SEQ ID NO: 1266458 - RNA, 20 nt, Human
gaagucacuuucagucauuu

SEQ ID NO: 1266459 - RNA, 28 nt, Human
gagaauagaaggauggugaccgguaccc

SEQ ID NO: 1266460 - RNA, 22 nt, Human
gaggacaugaggagagaaccag

SEQ ID NO: 1266461 - RNA, 24 nt, Human
gaucccuaagguacggauuccuac

SEQ ID NO: 1266462 - RNA, 20 nt, Human
gcaacagaaaugaccgacag

SEQ ID NO: 1266463 - RNA, 21 nt, Human
gcaacagaaaugaccgacaga

SEQ ID NO: 1266464 - RNA, 20 nt, Human
gcaagcacuaguaccacgcu

SEQ ID NO: 1266465 - RNA, 21 nt, Human
gcagagaacaugcuuuauuga

SEQ ID NO: 1266466 - RNA, 21 nt, Human
gcagagugcugacaaugucca

SEQ ID NO: 1266467 - RNA, 19 nt, Human
gccaaucacaagagcaacg

SEQ ID NO: 1266468 - RNA, 22 nt, Human
gccaccucuucccugccccucc

SEQ ID NO: 1266469 - RNA, 21 nt, Human
gccuugcagccuuaacuucuc

SEQ ID NO: 1266470 - RNA, 26 nt, Human
ggggauggccuucccaaaggauacug

SEQ ID NO: 1266471 - RNA, 27 nt, Human
ggggauggccuucccaaaggauacugu

SEQ ID NO: 1266472 - RNA, 18 nt, Human
ggguucgcuggcucggaa

SEQ ID NO: 1266473 - RNA, 25 nt, Human
gguccuggugguggcagccauauuu

SEQ ID NO: 1266474 - RNA, 21 nt, Human
ggugacaaaucccaaaaagga

SEQ ID NO: 1266475 - RNA, 22 nt, Human
ggugagaggacaugaggagaga

SEQ ID NO: 1266476 - RNA, 23 nt, Human
gucacuuucagucauuuucaacu

SEQ ID NO: 1266477 - RNA, 26 nt, Human
gugaccagguggcaagcacuaguacc

SEQ ID NO: 1266478 - RNA, 21 nt, Human
uaaaauuagcucccucaaccc

SEQ ID NO: 1266479 - RNA, 21 nt, Human
uaaagcaagauggaacccaaa

SEQ ID NO: 1266480 - RNA, 19 nt, Human
uacaaccucauggggugag

SEQ ID NO: 1266481 - RNA, 22 nt, Human
uacggaagucacuuucagucau

SEQ ID NO: 1266482 - RNA, 20 nt, Human
uagaagacacaauacaaccu

SEQ ID NO: 1266483 - RNA, 22 nt, Human
uagaagacacaauacaaccuca

SEQ ID NO: 1266484 - RNA, 21 nt, Human
uagcccaauacagaucaaaaa

SEQ ID NO: 1266485 - RNA, 21 nt, Human
ucaaaucaaacccagaaccac

SEQ ID NO: 1266486 - RNA, 23 nt, Human
ucagucauuuucaacuucuccca

SEQ ID NO: 1266487 - RNA, 18 nt, Human
uccauagaacacacauau

SEQ ID NO: 1266488 - RNA, 26 nt, Human
ucccaaaaaggaaauggaggaggagu

SEQ ID NO: 1266489 - RNA, 23 nt, Human
ucccaaaggauacuguacuugcc

SEQ ID NO: 1266490 - RNA, 19 nt, Human
ucccucugugauuuggccu

SEQ ID NO: 1266491 - RNA, 21 nt, Human
ucuguaaaaggccuuuacccc

SEQ ID NO: 1266492 - RNA, 19 nt, Human
ucuuuggcuaucuacucau

SEQ ID NO: 1266493 - RNA, 20 nt, Human
ugaaaaguuuucugcaguau

SEQ ID NO: 1266494 - RNA, 21 nt, Human
ugaaggaaagaaauuuaaagc

SEQ ID NO: 1266495 - RNA, 18 nt, Human
ugaauggacccccugcca

SEQ ID NO: 1266496 - RNA, 21 nt, Human
ugacaaaucccaaaaaggaaa

SEQ ID NO: 1266497 - RNA, 20 nt, Human
ugacaauguccacaggauuc

SEQ ID NO: 1266498 - RNA, 21 nt, Human
ugaggcaaaaaguaguauccc

SEQ ID NO: 1266499 - RNA, 23 nt, Human
ugcccacugcccacaggugaacu

SEQ ID NO: 1266500 - RNA, 24 nt, Human
ugcccacugcccacaggugaacuc

SEQ ID NO: 1266501 - RNA, 19 nt, Human
uggaaaagcagaagcacuu

SEQ ID NO: 1266502 - RNA, 24 nt, Human
uggaacccaaagugaauggacccc

SEQ ID NO: 1266503 - RNA, 20 nt, Human
uggcaucugcaaacguaaaa

SEQ ID NO: 1266504 - RNA, 24 nt, Human
ugggaaacucuucaaaaguauuug

SEQ ID NO: 1266505 - RNA, 22 nt, Human
ugggagggguccauuuuaagca

SEQ ID NO: 1266506 - RNA, 24 nt, Human
ugggcuagagagaaauuagaggga

SEQ ID NO: 1266507 - RNA, 24 nt, Human
ugucgaaaagagaagcaaaccuug

SEQ ID NO: 1266508 - RNA, 22 nt, Human
uguuggaggagaccaaguuggg

SEQ ID NO: 1266509 - RNA, 19 nt, Human
uuaaagcaagauggaaccc

SEQ ID NO: 1266510 - RNA, 20 nt, Human
uucuaccacauguggggaag

SEQ ID NO: 1266511 - RNA, 22 nt, Human
uucuccaaauccucugaagccc

SEQ ID NO: 1266512 - RNA, 22 nt, Human
uugcccgaagauagcagguuau

SEQ ID NO: 1266513 - RNA, 22 nt, Human
uugggagggguccauuuuaagc

SEQ ID NO: 1266514 - RNA, 24 nt, Human
uuuaagcagcugggauccaugguu

SEQ ID NO: 1266515 - RNA, 24 nt, Human
uuuucaacuucucccagggcauuc

SEQ ID NO: 1266516 - RNA, 21 nt, Human
aaccauuuuuccaugcugcuu

SEQ ID NO: 1266517 - RNA, 21 nt, Human
cuauggaccccucuguaggua

SEQ ID NO: 1266518 - RNA, 23 nt, Human
ucccuuuaaguuacgacgggaau

SEQ ID NO: 1266519 - RNA, 20 nt, Human
uuccaugcugcuuaagagcc

SEQ ID NO: 1266520 - RNA, 24 nt, Human
accccacagccuuccaaagauccc

SEQ ID NO: 1266521 - RNA, 23 nt, Human
agauccccuaugguccgaagucc

SEQ ID NO: 1266522 - RNA, 18 nt, Human
agggacaaggugagagga

SEQ ID NO: 1266523 - RNA, 19 nt, Human
agggagugcuaaggcagag

SEQ ID NO: 1266524 - RNA, 23 nt, Human
auccugcucuucucucuaguccc

SEQ ID NO: 1266525 - RNA, 22 nt, Human
caagaccccacagccuuccaaa

SEQ ID NO: 1266526 - RNA, 30 nt, Human; identical to SEQ ID NO: 252583

SEQ ID NO: 1266527 - RNA, 22 nt, Human
cagcggguucugcccugggcag

SEQ ID NO: 1266528 - RNA, 25 nt, Human
cagcugcuuuguuuucuguugggag

SEQ ID NO: 1266529 - RNA, 22 nt, Human
cauuccucauuccagcugagga

SEQ ID NO: 1266530 - RNA, 24 nt, Human
ccagcggguucugcccugggcagc

SEQ ID NO: 1266531 - RNA, 21 nt, Human
cugggcagcuccccaccuucu

SEQ ID NO: 1266532 - RNA, 21 nt, Human
cugugucucagcuccagcagu

SEQ ID NO: 1266533 - RNA, 24 nt, Human
cugugucucagcuccagcagucuc

SEQ ID NO: 1266534 - RNA, 18 nt, Human
gaaguccuuugaccaccu

SEQ ID NO: 1266535 - RNA, 23 nt, Human
gacaaggugagaggagccagggg

SEQ ID NO: 1266536 - RNA, 24 nt, Human
gagcaagaccccacagccuuccaa

SEQ ID NO: 1266537 - RNA, 23 nt, Human
gaggagccagggguagucaucaa

SEQ ID NO: 1266538 - RNA, 23 nt, Human
gcagagcaagaccccacagccuu

SEQ ID NO: 1266539 - RNA, 21 nt, Human
gcagucucaacugggaagacc

SEQ ID NO: 1266540 - RNA, 24 nt, Human
ggacaaggugagaggagccagggg

SEQ ID NO: 1266541 - RNA, 19 nt, Human
ucccggucccggguuucuc

SEQ ID NO: 1266542 - RNA, 20 nt, Human
ucccuggaagacaaggucca

SEQ ID NO: 1266543 - RNA, 18 nt, Human
ugagaggagccaggggua

SEQ ID NO: 1266544 - RNA, 20 nt, Human
ugcuaaggcagagcaagacc

SEQ ID NO: 1266545 - RNA, 21 nt, Human
ugggaagacccagggauccug

SEQ ID NO: 1266546 - RNA, 22 nt, Human
ugguccgaaguccuuugaccac

SEQ ID NO: 1266547 - RNA, 23 nt, Human
cacauuuacccccucuuccugaa

SEQ ID NO: 1266548 - RNA, 23 nt, Human
cauuccauacaauccacauuuac

SEQ ID NO: 1266549 - RNA, 23 nt, Human
uccauacaauccacauuuacccc

SEQ ID NO: 1266550 - RNA, 25 nt, Human
uccauacaauccacauuuacccccu

SEQ ID NO: 1266551 - RNA, 25 nt, Human
ucucuuuuuccuuuaguuccugugc

SEQ ID NO: 1266552 - RNA, 21 nt, Human
ugacucgaucucuuuuuccuu

SEQ ID NO: 1266553 - RNA, 24 nt, Human
ugcugaguacugcuguccugcaac

SEQ ID NO: 1266554 - RNA, 22 nt, Human
aaaaauucccaaaacaacaaaa

SEQ ID NO: 1266555 - RNA, 27 nt, Human
aaaaauucccaaaacaacaaaacacau

SEQ ID NO: 1266556 - RNA, 19 nt, Human
aaagaguuaagauuucuuc

SEQ ID NO: 1266557 - RNA, 24 nt, Human
aaaguguugggauuacaggcauga

SEQ ID NO: 1266558 - RNA, 24 nt, Human
aaccucaggugaucugcccaccuc

SEQ ID NO: 1266559 - RNA, 19 nt, Human
aagaguaugacaacagcaa

SEQ ID NO: 1266560 - RNA, 19 nt, Human
aagucugugcuucuucagg

SEQ ID NO: 1266561 - RNA, 21 nt, Human
aaguguugggauuacaggcau

SEQ ID NO: 1266562 - RNA, 26 nt, Human
aaguguugggauuacaggcaugagcc

SEQ ID NO: 1266563 - RNA, 19 nt, Human
acccagcucacuuuugcau

SEQ ID NO: 1266564 - RNA, 24 nt, Human
agaguugaugaaaagucuuuguuu

SEQ ID NO: 1266565 - RNA, 23 nt, Human
agcagcugggaucacaggcacgc

SEQ ID NO: 1266566 - RNA, 21 nt, Human
agccucucgaguagcugggac

SEQ ID NO: 1266567 - RNA, 24 nt, Human
agcgauucuccugccucagccucc

SEQ ID NO: 1266568 - RNA, 20 nt, Human
aggcacgcaccaccacgccc

SEQ ID NO: 1266569 - RNA, 20 nt, Human
aggcaugagccaccaugacc

SEQ ID NO: 1266570 - RNA, 24 nt, Human
aggugaucugcccaccucagccuc

SEQ ID NO: 1266571 - RNA, 21 nt, Human
agugcaauggcgugaucucag

SEQ ID NO: 1266572 - RNA, 24 nt, Human
agugcaauggcgugaucucagcuc

SEQ ID NO: 1266573 - RNA, 20 nt, Human
agugcacuggcgcaaucccg

SEQ ID NO: 1266574 - RNA, 20 nt, Human
aguuuuuuuuuuuuuuuuuu

SEQ ID NO: 1266575 - RNA, 23 nt, Human
caaaacacaugcuuccacuucac

SEQ ID NO: 1266576 - RNA, 24 nt, Human
caaaauagaugauucacaucuuca

SEQ ID NO: 1266577 - RNA, 24 nt, Human
caaaguguugggauuacaggcaug

SEQ ID NO: 1266578 - RNA, 24 nt, Human
caaccuccaccucccagguccaag

SEQ ID NO: 1266579 - RNA, 22 nt, Human
caagcgauucuccugccucagc

SEQ ID NO: 1266580 - RNA, 22 nt, Human
caagcgauuuuccugccuuagc

SEQ ID NO: 1266581 - RNA, 24 nt, Human
cacaggcacgugccaccacaccca

SEQ ID NO: 1266582 - RNA, 20 nt, Human
caccacacccagcucacuuu

SEQ ID NO: 1266583 - RNA, 23 nt, Human
cacccagcucacuuuugcauucc

SEQ ID NO: 1266584 - RNA, 21 nt, Human
caccgcaaccuccaccuccca

SEQ ID NO: 1266585 - RNA, 21 nt, Human
caccgcaaccuccaccuccca

SEQ ID NO: 1266586 - RNA, 18 nt, Human
caccgcaaucucugccuc

SEQ ID NO: 1266587 - RNA, 23 nt, Human
caccgcaaucucugccuccuggg

SEQ ID NO: 1266588 - RNA, 24 nt, Human
caccucagccucccaaaguguugg

SEQ ID NO: 1266589 - RNA, 21 nt, Human
cacgcaccaccacgcccggcc

SEQ ID NO: 1266590 - RNA, 20 nt, Human
cacuuuugcauuccggugug

SEQ ID NO: 1266591 - RNA, 23 nt, Human
cagaguuucgcuuguugcccagg

SEQ ID NO: 1266592 - RNA, 23 nt, Human
cagccuccugagcagcugggauc

SEQ ID NO: 1266593 - RNA, 21 nt, Human
caggcacgcaccaccacgccc

SEQ ID NO: 1266594 - RNA, 25 nt, Human
ccaaaacaacaaaacacaugcuucc

SEQ ID NO: 1266595 - RNA, 23 nt, Human
ccaaaguguugggauuacaggca

SEQ ID NO: 1266596 - RNA, 24 nt, Human
ccaaaguguugggauuacaggcau

SEQ ID NO: 1266597 - RNA, 27 nt, Human
ccaccucccagguccaagcgauucuuu

SEQ ID NO: 1266598 - RNA, 24 nt, Human
cccaaaguguugggauuacaggca

SEQ ID NO: 1266599 - RNA, 24 nt, Human
cccaaccucaggugaucugcccac

SEQ ID NO: 1266600 - RNA, 23 nt, Human
ccgcaaccuccaccucccagguc

SEQ ID NO: 1266601 - RNA, 24 nt, Human
ccucccagguccaagcgauucucc

SEQ ID NO: 1266602 - RNA, 23 nt, Human
ccugccuuagccucucgaguagc

SEQ ID NO: 1266603 - RNA, 23 nt, Human
ccuggguucaagcgauuuuccug

SEQ ID NO: 1266604 - RNA, 21 nt, Human
ccuugcaucuuuaguagagau

SEQ ID NO: 1266605 - RNA, 24 nt, Human
cgcaccaccacgcccggccaaucc

SEQ ID NO: 1266606 - RNA, 23 nt, Human
cgcucugucgcccagcuggagug

SEQ ID NO: 1266607 - RNA, 21 nt, Human
cgcuuguugcccaggcuggag

SEQ ID NO: 1266608 - RNA, 19 nt, Human
cuaagaguaugacaacagc

SEQ ID NO: 1266609 - RNA, 24 nt, Human
cucaccgcaaccuccaccucccag

SEQ ID NO: 1266610 - RNA, 24 nt, Human
cucaccgcaaucucugccuccugg

SEQ ID NO: 1266611 - RNA, 23 nt, Human
cucgcucugucgcccagcuggag

SEQ ID NO: 1266612 - RNA, 24 nt, Human
cucucgaguagcugggaccacagg

SEQ ID NO: 1266613 - RNA, 23 nt, Human
cugccucagccuccugagcagcu

SEQ ID NO: 1266614 - RNA, 23 nt, Human
cugccuuagccucucgaguagcu

SEQ ID NO: 1266615 - RNA, 24 nt, Human
cuggagugcaauggcgugaucuca

SEQ ID NO: 1266616 - RNA, 23 nt, Human
cugucuuuucuuugacccuuccu

SEQ ID NO: 1266617 - RNA, 24 nt, Human
cuuagccucucgaguagcugggac

SEQ ID NO: 1266618 - RNA, 24 nt, Human
cuuguugcccaggcuggagugcaa

SEQ ID NO: 1266619 - RNA, 20 nt, Human
gagacagaguuucgcuuguu

SEQ ID NO: 1266620 - RNA, 21 nt, Human
gagauggaaucucgcucuguc

SEQ ID NO: 1266621 - RNA, 25 nt, Human
gaguagcugggaccacaggcacgug

SEQ ID NO: 1266622 - RNA, 19 nt, Human
gaguuuacccuauuuaggg

SEQ ID NO: 1266623 - RNA, 18 nt, Human
gauuacaggcaugagcca

SEQ ID NO: 1266624 - RNA, 21 nt, Human
gauuacaggcaugagccacca

SEQ ID NO: 1266625 - RNA, 22 nt, Human
gauuacaggcaugagccaccau

SEQ ID NO: 1266626 - RNA, 22 nt, Human
gcaauaguuuuuuuuuuuuuuu

SEQ ID NO: 1266627 - RNA, 20 nt, Human
gcaccaccacgcccggccaa

SEQ ID NO: 1266628 - RNA, 23 nt, Human
gcaccaccacgcccggccaaucc

SEQ ID NO: 1266629 - RNA, 24 nt, Human
gcccaggcuggagugcaauggcgu

SEQ ID NO: 1266630 - RNA, 23 nt, Human
gcgauucuccugccucagccucc

SEQ ID NO: 1266631 - RNA, 19 nt, Human
gcuggagugcaauggcgug

SEQ ID NO: 1266632 - RNA, 23 nt, Human
gcuggccucgaacucccaaccuc

SEQ ID NO: 1266633 - RNA, 24 nt, Human
ggauuacaggcaugagccaccaug

SEQ ID NO: 1266634 - RNA, 22 nt, Human
ggcuggagugcaauggcgugau

SEQ ID NO: 1266635 - RNA, 25 nt, Human
gggguaguuucuauuaauuucuuuu

SEQ ID NO: 1266636 - RNA, 23 nt, Human
guacuuguuaugguuaccacugu

SEQ ID NO: 1266637 - RNA, 24 nt, Human
gugaucugcccaccucagccuccc

SEQ ID NO: 1266638 - RNA, 24 nt, Human
guuucgcuuguugcccaggcugga

SEQ ID NO: 1266639 - RNA, 23 nt, Human
uacaggcaugagccaccaugacc

SEQ ID NO: 1266640 - RNA, 18 nt, Human
uaggguucuuugagccuc

SEQ ID NO: 1266641 - RNA, 24 nt, Human
uaguagagauggcauuucuccacg

SEQ ID NO: 1266642 - RNA, 19 nt, Human
ucaagcgauuuuccugccu

SEQ ID NO: 1266643 - RNA, 24 nt, Human
ucaccgcaaccuccaccucccagg

SEQ ID NO: 1266644 - RNA, 27 nt, Human
ucaccgcaaccuccaccucccaggucc

SEQ ID NO: 1266645 - RNA, 24 nt, Human
ucaccgcaaucucugccuccuggg

SEQ ID NO: 1266646 - RNA, 25 nt, Human
ucaccgcaaucucugccuccugggu

SEQ ID NO: 1266647 - RNA, 21 nt, Human
ucagauucuccucccucccca

SEQ ID NO: 1266648 - RNA, 26 nt, Human
ucagcucaccgcaaccuccaccuccc

SEQ ID NO: 1266649 - RNA, 24 nt, Human
uccaagcgauucuccugccucagc

SEQ ID NO: 1266650 - RNA, 21 nt, Human
ucccaaaacaacaaaacacau

SEQ ID NO: 1266651 - RNA, 18 nt, Human
ucccaaaacaacaaaacc

SEQ ID NO: 1266652 - RNA, 24 nt, Human
ucccaaaguguugggauuacaggc

SEQ ID NO: 1266653 - RNA, 21 nt, Human
ucccagguccaagcgauucuc

SEQ ID NO: 1266654 - RNA, 24 nt, Human
ucccagguccaagcgauucuccug

SEQ ID NO: 1266655 - RNA, 21 nt, Human
uccuggguucaagcgauuuuc

SEQ ID NO: 1266656 - RNA, 24 nt, Human
uccuggguucaagcgauuuuccug

SEQ ID NO: 1266657 - RNA, 20 nt, Human
ucgcuuguugcccaggcugg

SEQ ID NO: 1266658 - RNA, 21 nt, Human
ucgcuuguugcccaggcugga

SEQ ID NO: 1266659 - RNA, 24 nt, Human
ucucgaguagcugggaccacaggc

SEQ ID NO: 1266660 - RNA, 23 nt, Human
ucucgcucugucgcccagcugga

SEQ ID NO: 1266661 - RNA, 18 nt, Human
ucucugaagauacuugau

SEQ ID NO: 1266662 - RNA, 21 nt, Human
ucugcccaccucagccuccca

SEQ ID NO: 1266663 - RNA, 19 nt, Human
ucuuuaguagagauggcau

SEQ ID NO: 1266664 - RNA, 19 nt, Human
ugacaacagcaacaaaaag

SEQ ID NO: 1266665 - RNA, 21 nt, Human
ugacaacagcaacaaaaagua

SEQ ID NO: 1266666 - RNA, 27 nt, Human
ugacaacagcaacaaaaaguaauuuca

SEQ ID NO: 1266667 - RNA, 21 nt, Human
ugauaaaaauucccaaaacaa

SEQ ID NO: 1266668 - RNA, 24 nt, Human
ugaucugcccaccucagccuccca

SEQ ID NO: 1266669 - RNA, 30 nt, Human
ugcagcaauaguuuuuuuuuuuuuuuuuuu

SEQ ID NO: 1266670 - RNA, 22 nt, Human
ugccaccacacccagcucacuu

SEQ ID NO: 1266671 - RNA, 18 nt, Human
ugcccaggcuggagugca

SEQ ID NO: 1266672 - RNA, 21 nt, Human
ugcccaggcuggagugcaaug

SEQ ID NO: 1266673 - RNA, 21 nt, Human
ugcccaggcuggagugcaaug

SEQ ID NO: 1266674 - RNA, 24 nt, Human
ugcccaggcuggagugcaauggcg

SEQ ID NO: 1266675 - RNA, 24 nt, Human
ugccucagccuccugagcagcugg

SEQ ID NO: 1266676 - RNA, 19 nt, Human
ugccuuagccucucgagua

SEQ ID NO: 1266677 - RNA, 19 nt, Human
uggagugcaauggcgugau

SEQ ID NO: 1266678 - RNA, 24 nt, Human
uggagugcaauggcgugaucucag

SEQ ID NO: 1266679 - RNA, 24 nt, Human
uggagugcacuggcgcaaucccgg

SEQ ID NO: 1266680 - RNA, 20 nt, Human
uggccucgaacucccaaccu

SEQ ID NO: 1266681 - RNA, 21 nt, Human
uggccucgaacucccaaccuc

SEQ ID NO: 1266682 - RNA, 24 nt, Human
uggcgugaucucagcucaccgcaa

SEQ ID NO: 1266683 - RNA, 21 nt, Human
ugggaccacaggcacgugcca

SEQ ID NO: 1266684 - RNA, 24 nt, Human
ugggaccacaggcacgugccacca

SEQ ID NO: 1266685 - RNA, 21 nt, Human
ugggaucacaggcacgcacca

SEQ ID NO: 1266686 - RNA, 24 nt, Human
ugggaucacaggcacgcaccacca

SEQ ID NO: 1266687 - RNA, 18 nt, Human
ugggauuacaggcaugag

SEQ ID NO: 1266688 - RNA, 22 nt, Human
ugggauuacaggcaugagccac

SEQ ID NO: 1266689 - RNA, 23 nt, Human
ugggauuacaggcaugagccacc

SEQ ID NO: 1266690 - RNA, 24 nt, Human
ugggauuacaggcaugagccacca

SEQ ID NO: 1266691 - RNA, 25 nt, Human
ugggauuacaggcaugagccaccau

SEQ ID NO: 1266692 - RNA, 23 nt, Human
uggguucaagcgauuuuccugcc

SEQ ID NO: 1266693 - RNA, 24 nt, Human
uggguucaagcgauuuuccugccu

SEQ ID NO: 1266694 - RNA, 21 nt, Human
uggucaggcuggccucgaacu

SEQ ID NO: 1266695 - RNA, 20 nt, Human
uguugcccaggcuggagugc

SEQ ID NO: 1266696 - RNA, 23 nt, Human
uguuuuguacauccgaagucugu

SEQ ID NO: 1266697 - RNA, 18 nt, Human
uuaguagagauggcauuu

SEQ ID NO: 1266698 - RNA, 20 nt, Human
uucaagcgauuuuccugccu

SEQ ID NO: 1266699 - RNA, 24 nt, Human
uucaagcgauuuuccugccuuagc

SEQ ID NO: 1266700 - RNA, 21 nt, Human
uucacugauaaaaaauuuacc

SEQ ID NO: 1266701 - RNA, 23 nt, Human
uucauguauuucaucaaagcugg

SEQ ID NO: 1266702 - RNA, 22 nt, Human
uucgcuuguugcccaggcugga

SEQ ID NO: 1266703 - RNA, 24 nt, Human
uucgcuuguugcccaggcuggagu

SEQ ID NO: 1266704 - RNA, 20 nt, Human
uucuuugagccucuugaaua

SEQ ID NO: 1266705 - RNA, 23 nt, Human
uugcaucuuuaguagagauggca

SEQ ID NO: 1266706 - RNA, 21 nt, Human
uuucgcuuguugcccaggcug

SEQ ID NO: 1266707 - RNA, 22 nt, Human
uuucgcuuguugcccaggcugg

SEQ ID NO: 1266708 - RNA, 23 nt, Human
uuucgcuuguugcccaggcugga

SEQ ID NO: 1266709 - RNA, 20 nt, Human
uuuuccuugucauguaaucu

SEQ ID NO: 1266710 - RNA, 22 nt, Human
uuuugcauuccggugugggucu

SEQ ID NO: 1266711 - RNA, 25 nt, Human
uuuuuuuuuuucgagauggaaucuc

SEQ ID NO: 1266712 - RNA, 18 nt, Human
uuuuuuuuuuuuuuuucg

SEQ ID NO: 1266713 - RNA, 19 nt, Human
uuuuuuuuuuuuuuuuucg

SEQ ID NO: 1266714 - RNA, 20 nt, Human
aaacggaaaugcaaguggcc

SEQ ID NO: 1266715 - RNA, 21 nt, Human
aagagaaaaagacagaucuag

SEQ ID NO: 1266716 - RNA, 24 nt, Human
agaaaaagacagaucuagaagaua

SEQ ID NO: 1266717 - RNA, 19 nt, Human
aggccaaagccaugcagcu

SEQ ID NO: 1266718 - RNA, 21 nt, Human
augcagcugcuguacugccug

SEQ ID NO: 1266719 - RNA, 21 nt, Human
caccggccaagggggagcaac

SEQ ID NO: 1266720 - RNA, 22 nt, Human
caggccaaagccaugcagcugc

SEQ ID NO: 1266721 - RNA, 20 nt, Human
ccaugcagcugcuguacugc

SEQ ID NO: 1266722 - RNA, 21 nt, Human
gagaaaaagacagaucuagaa

SEQ ID NO: 1266723 - RNA, 18 nt, Human
gcagcugcuguacugccu

SEQ ID NO: 1266724 - RNA, 18 nt, Human
ucagaagagaaaaagaca

SEQ ID NO: 1266725 - RNA, 18 nt, Human
ucuuucaccggccaaggg

SEQ ID NO: 1266726 - RNA, 23 nt, Human
ucuuuuauucuuucaccggccaa

SEQ ID NO: 1266727 - RNA, 19 nt, Human
ugaaacggaaaugcaagug

SEQ ID NO: 1266728 - RNA, 21 nt, Human
ugcaggccaaagccaugcagc

SEQ ID NO: 1266729 - RNA, 22 nt, Human
aaaagaggcaggccuggaugug

SEQ ID NO: 1266730 - RNA, 21 nt, Human
aagaggcaggccuggauguga

SEQ ID NO: 1266731 - RNA, 18 nt, Human
aagcccccagcaucgugc

SEQ ID NO: 1266732 - RNA, 20 nt, Human
cagaacaagucucaggaaac

SEQ ID NO: 1266733 - RNA, 18 nt, Human
ccuguuccucaucugaga

SEQ ID NO: 1266734 - RNA, 19 nt, Human
gcuccacucccugcuagcu

SEQ ID NO: 1266735 - RNA, 19 nt, Human
uugaaaagaggcaggccug

SEQ ID NO: 1266736 - RNA, 18 nt, Human
uuggguuugaaaagaggc

SEQ ID NO: 1266737 - RNA, 19 nt, Human
aaaaggcacuuucacaggc

SEQ ID NO: 1266738 - RNA, 21 nt, Human
aagcaccaccauaaagcacga

SEQ ID NO: 1266739 - RNA, 19 nt, Human
aggcacuuucacaggcacu

SEQ ID NO: 1266740 - RNA, 24 nt, Human
aggguccccagcuuuuggucucug

SEQ ID NO: 1266741 - RNA, 24 nt, Human
auuuuuauaguuuuccuacagcgu

SEQ ID NO: 1266742 - RNA, 19 nt, Human
caccaccauaaagcacgaa

SEQ ID NO: 1266743 - RNA, 21 nt, Human
cacuuucacaggcacucugcu

SEQ ID NO: 1266744 - RNA, 19 nt, Human
cagcagucggggaggucaa

SEQ ID NO: 1266745 - RNA, 19 nt, Human
cccugaaaugccaaaauuu

SEQ ID NO: 1266746 - RNA, 19 nt, Human
ccuuaaccccaggcugccu

SEQ ID NO: 1266747 - RNA, 19 nt, Human
ccuuagguccugaucagag

SEQ ID NO: 1266748 - RNA, 24 nt, Human
cuuaaccccaggcugccuuggggu

SEQ ID NO: 1266749 - RNA, 22 nt, Human
cuucuaacuuuaacacuucagu

SEQ ID NO: 1266750 - RNA, 21 nt, Human
cuugccaccuugguggcugca

SEQ ID NO: 1266751 - RNA, 23 nt, Human
cuuuuggucucugaauucuuggg

SEQ ID NO: 1266752 - RNA, 20 nt, Human
guggaggguaucuuaucaca

SEQ ID NO: 1266753 - RNA, 19 nt, Human
guggcggcagagcucucuc

SEQ ID NO: 1266754 - RNA, 18 nt, Human
guggcugcauuaaagccu

SEQ ID NO: 1266755 - RNA, 26 nt, Human
ucaggguccccagcuuuuggucucug

SEQ ID NO: 1266756 - RNA, 24 nt, Human
uccagaagggauguuugauucacc

SEQ ID NO: 1266757 - RNA, 21 nt, Human
uccuuaaccccaggcugccuu

SEQ ID NO: 1266758 - RNA, 20 nt, Human
ucuuccuuuucucuuugcug

SEQ ID NO: 1266759 - RNA, 24 nt, Human
ucuuccuuuucucuuugcugcucc

SEQ ID NO: 1266760 - RNA, 20 nt, Human
ugacauggcagcauucugga

SEQ ID NO: 1266761 - RNA, 20 nt, Human
uggugguacugauacagaau

SEQ ID NO: 1266762 - RNA, 21 nt, Human
uggugguacugauacagaauu

SEQ ID NO: 1266763 - RNA, 21 nt, Human
uuauucugcaaaccuuuccua

SEQ ID NO: 1266764 - RNA, 19 nt, Human
uuucaggguccccagcuuu

SEQ ID NO: 1266765 - RNA, 21 nt, Human
uuucaggguccccagcuuuug

SEQ ID NO: 1266766 - RNA, 20 nt, Human
aaccuaauaaaaaaauccug

SEQ ID NO: 1266767 - RNA, 24 nt, Human
aagcaaggacaccguguugacaua

SEQ ID NO: 1266768 - RNA, 24 nt, Human
aagcaggaaggaaaccuaaaucua

SEQ ID NO: 1266769 - RNA, 25 nt, Human
aagcaggaaggaaaccuaaaucuaa

SEQ ID NO: 1266770 - RNA, 19 nt, Human
acagcaggugagggccggg

SEQ ID NO: 1266771 - RNA, 21 nt, Human
accuaauaaaaaaauccugcc

SEQ ID NO: 1266772 - RNA, 22 nt, Human
acuaaaaucaagagcaauuuua

SEQ ID NO: 1266773 - RNA, 19 nt, Human
agaaagagaacaugagaaa

SEQ ID NO: 1266774 - RNA, 19 nt, Human
agaaagagaacaugagaaa

SEQ ID NO: 1266775 - RNA, 23 nt, Human
agaaagagaacaugagaaaaugc

SEQ ID NO: 1266776 - RNA, 23 nt, Human
agaaaucccaaaacuuguaccaa

SEQ ID NO: 1266777 - RNA, 24 nt, Human
agaguucauuguuuagggaaaaug

SEQ ID NO: 1266778 - RNA, 24 nt, Human
agcuggaaaguuuuuuuuuccuuu

SEQ ID NO: 1266779 - RNA, 22 nt, Human
aggccagaaagagaacaugaga

SEQ ID NO: 1266780 - RNA, 21 nt, Human
agggcggggagcgcggaccgg

SEQ ID NO: 1266781 - RNA, 18 nt, Human
agguguugaggacauaga

SEQ ID NO: 1266782 - RNA, 26 nt, Human
agguucagagaucacaucugucagcc

SEQ ID NO: 1266783 - RNA, 18 nt, Human
aguccagguaucaauauu

SEQ ID NO: 1266784 - RNA, 18 nt, Human
augaggugaggaugaaca

SEQ ID NO: 1266785 - RNA, 21 nt, Human
caaacuaacuaaaccagaaac

SEQ ID NO: 1266786 - RNA, 24 nt, Human
caagcggaacuucuagccucucuu

SEQ ID NO: 1266787 - RNA, 18 nt, Human
caaggacaccguguugac

SEQ ID NO: 1266788 - RNA, 24 nt, Human
cacaguuuggcccaaacuaacuaa

SEQ ID NO: 1266789 - RNA, 22 nt, Human
caccguguugacauacacaagu

SEQ ID NO: 1266790 - RNA, 18 nt, Human
cacuuaaccaagcaaagc

SEQ ID NO: 1266791 - RNA, 22 nt, Human
cagaaaaggucaacaauauuaa

SEQ ID NO: 1266792 - RNA, 21 nt, Human
caguaauuuauucugagauuu

SEQ ID NO: 1266793 - RNA, 19 nt, Human
caucccgguucgcuugggg

SEQ ID NO: 1266794 - RNA, 22 nt, Human
cccaaaccugcccuuccccuca

SEQ ID NO: 1266795 - RNA, 23 nt, Human
ccccaaaccugcccuuccccuca

SEQ ID NO: 1266796 - RNA, 18 nt, Human
ccgcucuacuaaggaggc

SEQ ID NO: 1266797 - RNA, 19 nt, Human
ccuaaaucuaaauucuacu

SEQ ID NO: 1266798 - RNA, 20 nt, Human
ccucgccguccccaaaccug

SEQ ID NO: 1266799 - RNA, 19 nt, Human
ccuguggauaccuuagcuc

SEQ ID NO: 1266800 - RNA, 18 nt, Human
cgacugaaaaacauugua

SEQ ID NO: 1266801 - RNA, 24 nt, Human
cuaaauucuacuuaauacugaaga

SEQ ID NO: 1266802 - RNA, 22 nt, Human
cucacacuuaaccaagcaaagc

SEQ ID NO: 1266803 - RNA, 22 nt, Human
cucuaugaggugaggaugaaca

SEQ ID NO: 1266804 - RNA, 22 nt, Human
cucucuaugaggugaggaugaa

SEQ ID NO: 1266805 - RNA, 21 nt, Human
gaaaucaggguagcuguaaaa

SEQ ID NO: 1266806 - RNA, 20 nt, Human
gaagcaggaaggaaaccuaa

SEQ ID NO: 1266807 - RNA, 25 nt, Human
gagaacaugagaaaaugccgguacc

SEQ ID NO: 1266808 - RNA, 19 nt, Human
gcgcggaccggguguggga

SEQ ID NO: 1266809 - RNA, 20 nt, Human
gcuuauuuauuccauaaagu

SEQ ID NO: 1266810 - RNA, 21 nt, Human
ggaagugagacaagcaccgug

SEQ ID NO: 1266811 - RNA, 24 nt, Human
ggcugcgcgggucagguagccucu

SEQ ID NO: 1266812 - RNA, 22 nt, Human
gggccgggugcggauggggaag

SEQ ID NO: 1266813 - RNA, 21 nt, Human
ggucagaaaucaggguagcug

SEQ ID NO: 1266814 - RNA, 19 nt, Human
uaaaguuggucccaaagac

SEQ ID NO: 1266815 - RNA, 23 nt, Human
uaaauuuauugagcaccuacuau

SEQ ID NO: 1266816 - RNA, 24 nt, Human
uaagaaaaaaaaguuaccugaaaa

SEQ ID NO: 1266817 - RNA, 23 nt, Human
uaagauaaaaucagcaaucuauc

SEQ ID NO: 1266818 - RNA, 20 nt, Human
uacuuguccacaguuuggcc

SEQ ID NO: 1266819 - RNA, 21 nt, Human
uagcucugaguccugccaccu

SEQ ID NO: 1266820 - RNA, 25 nt, Human
uauaacuauauuacuugaaauacag

SEQ ID NO: 1266821 - RNA, 24 nt, Human
uaugaggugaggaugaacacugaa

SEQ ID NO: 1266822 - RNA, 19 nt, Human
uauguaccuuacugucaag

SEQ ID NO: 1266823 - RNA, 22 nt, Human
uauguaccuuacugucaagaac

SEQ ID NO: 1266824 - RNA, 19 nt, Human
uauguuagaagauuugggg

SEQ ID NO: 1266825 - RNA, 20 nt, Human
ucacuucccaucccgguucg

SEQ ID NO: 1266826 - RNA, 25 nt, Human
ucagaaaucccaaaacuuguaccaa

SEQ ID NO: 1266827 - RNA, 21 nt, Human
ucaggguagcuguaaaaaugu

SEQ ID NO: 1266828 - RNA, 18 nt, Human
ucccgguucgcuuggggg

SEQ ID NO: 1266829 - RNA, 18 nt, Human
uccuuggccccggggugc

SEQ ID NO: 1266830 - RNA, 19 nt, Human
ucucucuaugaggugagga

SEQ ID NO: 1266831 - RNA, 20 nt, Human
ugaaaagguacuuguccaca

SEQ ID NO: 1266832 - RNA, 21 nt, Human
ugaacagaguucauuguuuag

SEQ ID NO: 1266833 - RNA, 20 nt, Human
ugaccugauucgguaggcga

SEQ ID NO: 1266834 - RNA, 22 nt, Human
ugagaaaaugcuauuuguaaua

SEQ ID NO: 1266835 - RNA, 18 nt, Human
ugcuaggugauguacuac

SEQ ID NO: 1266836 - RNA, 19 nt, Human
uggaaaguuuuuuuuuccu

SEQ ID NO: 1266837 - RNA, 22 nt, Human
uggaaaguuuuuuuuuccuuuc

SEQ ID NO: 1266838 - RNA, 24 nt, Human
uggcccaaacuaacuaaaccagaa

SEQ ID NO: 1266839 - RNA, 25 nt, Human
uggccuguggauaccuuagcucuga

SEQ ID NO: 1266840 - RNA, 21 nt, Human
ugggaagcaggaaggaaaccu

SEQ ID NO: 1266841 - RNA, 22 nt, Human
ugggaggccgaggugacagcag

SEQ ID NO: 1266842 - RNA, 19 nt, Human
ugucucuucacuucaucuc

SEQ ID NO: 1266843 - RNA, 19 nt, Human
ugucucuucacuucaucuc

SEQ ID NO: 1266844 - RNA, 24 nt, Human
uguugaggacauagaaauaagaaa

SEQ ID NO: 1266845 - RNA, 30 nt, Human
uuaaagcaguaauuuauucugagauuuacu

SEQ ID NO: 1266846 - RNA, 24 nt, Human
uuaaccuaauaaaaaaauccugcc

SEQ ID NO: 1266847 - RNA, 21 nt, Human
uugaaauacagcucagcuuau

SEQ ID NO: 1266848 - RNA, 22 nt, Human
uuggcuacguacuccacuaggu

SEQ ID NO: 1266849 - RNA, 20 nt, Human
uuucagaaaucccaaaacuu

SEQ ID NO: 1266850 - RNA, 22 nt, Human
uuugucucuucacuucaucucu

SEQ ID NO: 1266851 - RNA, 21 nt, Human
uuuuaaaaaaaaaggugaaca

SEQ ID NO: 1266852 - RNA, 20 nt, Human
accaccagcucauaaaagca

SEQ ID NO: 1266853 - RNA, 24 nt, Human
agccggcgacuggugcuucccacg

SEQ ID NO: 1266854 - RNA, 21 nt, Human
agccgggaucucagguccucg

SEQ ID NO: 1266855 - RNA, 20 nt, Human
cagcgcccgcggcgaggacc

SEQ ID NO: 1266856 - RNA, 19 nt, Human
cauaaaagcauacuugaac

SEQ ID NO: 1266857 - RNA, 21 nt, Human
ccccugagggggguccccgcg

SEQ ID NO: 1266858 - RNA, 22 nt, Human
cccgcggcgaggaccccggggc

SEQ ID NO: 1266859 - RNA, 18 nt, Human
cggcgacuggugcuuccc

SEQ ID NO: 1266860 - RNA, 19 nt, Human
cggggcuggggcggacggc

SEQ ID NO: 1266861 - RNA, 20 nt, Human
cuggugcuucccacgugcgc

SEQ ID NO: 1266862 - RNA, 18 nt, Human
gaccccggggcuggggcg

SEQ ID NO: 1266863 - RNA, 22 nt, Human
gaggccgagccgggaucucagg

SEQ ID NO: 1266864 - RNA, 23 nt, Human
gcaacaccguuauugaacgaccc

SEQ ID NO: 1266865 - RNA, 20 nt, Human
gccccugagggggguccccg

SEQ ID NO: 1266866 - RNA, 18 nt, Human
gccgggagaagcauggga

SEQ ID NO: 1266867 - RNA, 22 nt, Human
ggcggcggccacgccaaggacg

SEQ ID NO: 1266868 - RNA, 20 nt, Human
ggggguccccgcgggagcgc

SEQ ID NO: 1266869 - RNA, 22 nt, Human
ucaggcaacaccguuauugaac

SEQ ID NO: 1266870 - RNA, 18 nt, Human
uccccgcgggagcgcgga

SEQ ID NO: 1266871 - RNA, 19 nt, Human
ugagggggguccccgcggg

SEQ ID NO: 1266872 - RNA, 20 nt, Human
ugagggggguccccgcggga

SEQ ID NO: 1266873 - RNA, 19 nt, Human
uggcaccaccagcucauaa

SEQ ID NO: 1266874 - RNA, 22 nt, Human
uguagcuuuucgauacagggaa

SEQ ID NO: 1266875 - RNA, 18 nt, Human
aaacagaagggaaacuga

SEQ ID NO: 1266876 - RNA, 21 nt, Human
agaauuuucacccaaacagaa

SEQ ID NO: 1266877 - RNA, 18 nt, Human
agauuggaaacucaucuu

SEQ ID NO: 1266878 - RNA, 20 nt, Human
aguucagauuggaaacucau

SEQ ID NO: 1266879 - RNA, 19 nt, Human
aucuuaaauucuuugguua

SEQ ID NO: 1266880 - RNA, 21 nt, Human
auggcucucuuaaauuuaggg

SEQ ID NO: 1266881 - RNA, 22 nt, Human
auggugggcuauaguuuuucuu

SEQ ID NO: 1266882 - RNA, 18 nt, Human
cauggauaaucaaaacua

SEQ ID NO: 1266883 - RNA, 21 nt, Human
cauuacagucaccaaagagcc

SEQ ID NO: 1266884 - RNA, 18 nt, Human
cauucagugaccguaacc

SEQ ID NO: 1266885 - RNA, 21 nt, Human
cccaaacagaagggaaacuga

SEQ ID NO: 1266886 - RNA, 22 nt, Human
cuucacagcuucaugugcuacc

SEQ ID NO: 1266887 - RNA, 25 nt, Human
gacgcccaaauguccaaaauuuuug

SEQ ID NO: 1266888 - RNA, 22 nt, Human
gauauuugucucagacgcccaa

SEQ ID NO: 1266889 - RNA, 22 nt, Human
gcaauuagaauuuucacccaaa

SEQ ID NO: 1266890 - RNA, 23 nt, Human
uaaaagauggugggcuauaguuu

SEQ ID NO: 1266891 - RNA, 20 nt, Human
uaccuagaacugaugaugcc

SEQ ID NO: 1266892 - RNA, 26 nt, Human
ucaccaaagagccauucagugaccgu

SEQ ID NO: 1266893 - RNA, 20 nt, Human
uccaaaauuuuugaguccau

SEQ ID NO: 1266894 - RNA, 22 nt, Human
ugucucagacgcccaaaugucc

SEQ ID NO: 1266895 - RNA, 24 nt, Human
uugaguccauuuuuaaggguucau

SEQ ID NO: 1266896 - RNA, 25 nt, Human
uuuaaggaaauggcucucuuaaauu

SEQ ID NO: 1266897 - RNA, 20 nt, Human
uuuuaaggguucauggauaa

SEQ ID NO: 1266898 - RNA, 21 nt, Human
aaaccuaguucuuaacauacc

SEQ ID NO: 1266899 - RNA, 20 nt, Human
aacauaccaccuucacaaga

SEQ ID NO: 1266900 - RNA, 22 nt, Human
aacauaccaccuucacaagaca

SEQ ID NO: 1266901 - RNA, 23 nt, Human
aacugagugcuguaaacaaccuc

SEQ ID NO: 1266902 - RNA, 25 nt, Human
aagaaaagcagaauaaaugcuugaa

SEQ ID NO: 1266903 - RNA, 24 nt, Human
aagaagacauuucccuuaucagcu

SEQ ID NO: 1266904 - RNA, 21 nt, Human
acaagacauucuuggaucccc

SEQ ID NO: 1266905 - RNA, 22 nt, Human
agaaaaacaauaagaaagagaa

SEQ ID NO: 1266906 - RNA, 24 nt, Human
agaaaaacaauaagaaagagaaca

SEQ ID NO: 1266907 - RNA, 21 nt, Human
agggcaucuauuuaucugaaa

SEQ ID NO: 1266908 - RNA, 20 nt, Human
auacccucaaccccccagaa

SEQ ID NO: 1266909 - RNA, 25 nt, Human
aucacaauacccucaaccccccaga

SEQ ID NO: 1266910 - RNA, 22 nt, Human
augacaauggaagaaccaggcc

SEQ ID NO: 1266911 - RNA, 22 nt, Human
cacaauacccucaaccccccag

SEQ ID NO: 1266912 - RNA, 24 nt, Human
cacugcuucccugucuaucccuac

SEQ ID NO: 1266913 - RNA, 25 nt, Human
cagcaaaagaaaaauaaaaaaccag

SEQ ID NO: 1266914 - RNA, 18 nt, Human
caucacagcugcaaaguc

SEQ ID NO: 1266915 - RNA, 23 nt, Human
cauccaaccaccugccugccugc

SEQ ID NO: 1266916 - RNA, 24 nt, Human
ccccugccucugacauuagucauc

SEQ ID NO: 1266917 - RNA, 21 nt, Human
ccuaccuguccuccccugccu

SEQ ID NO: 1266918 - RNA, 21 nt, Human
ccuccucccuccucccauucc

SEQ ID NO: 1266919 - RNA, 22 nt, Human
ccuucuauuuaccaguuuucag

SEQ ID NO: 1266920 - RNA, 24 nt, Human
cuaacauugauucucuaguuaugc

SEQ ID NO: 1266921 - RNA, 19 nt, Human
cuccccugcaccaggcucc

SEQ ID NO: 1266922 - RNA, 24 nt, Human
cucccuccucccauuccuugguua

SEQ ID NO: 1266923 - RNA, 22 nt, Human
cugcagcauuuuagcaucuucc

SEQ ID NO: 1266924 - RNA, 25 nt, Human
cugcagcauuuuagcaucuuccccu

SEQ ID NO: 1266925 - RNA, 24 nt, Human
cuugccacaggaucuuugcacaug

SEQ ID NO: 1266926 - RNA, 25 nt, Human
gaaaaacaauaagaaagagaacaac

SEQ ID NO: 1266927 - RNA, 24 nt, Human
gacaauggaagaaccaggccauga

SEQ ID NO: 1266928 - RNA, 22 nt, Human
gauggauggauggaaauguaua

SEQ ID NO: 1266929 - RNA, 21 nt, Human
gauggauggauggauggaugg

SEQ ID NO: 1266930 - RNA, 21 nt, Human
gauggauggauggauggaugg

SEQ ID NO: 1266931 - RNA, 21 nt, Human
gauggauggauggauggaugg

SEQ ID NO: 1266932 - RNA, 21 nt, Human
gauggauggauggauggaugg

SEQ ID NO: 1266933 - RNA, 21 nt, Human
gauggauggauggauggaugg

SEQ ID NO: 1266934 - RNA, 21 nt, Human
gauggauggauggauggaugg

SEQ ID NO: 1266935 - RNA, 21 nt, Human
gauggauggauggauggaugg

SEQ ID NO: 1266936 - RNA, 18 nt, Human
gccuccccauccaaccac

SEQ ID NO: 1266937 - RNA, 18 nt, Human
gccugacacauaguugga

SEQ ID NO: 1266938 - RNA, 18 nt, Human
ggauggauggauggaugg

SEQ ID NO: 1266939 - RNA, 18 nt, Human
ggauggauggauggaugg

SEQ ID NO: 1266940 - RNA, 19 nt, Human
ggauggauggauggauggg

SEQ ID NO: 1266941 - RNA, 21 nt, Human
ggccaguagaagccugggccc

SEQ ID NO: 1266942 - RNA, 23 nt, Human
gggcaucuauuuaucugaaaaua

SEQ ID NO: 1266943 - RNA, 20 nt, Human
gucuccuccucccuccuccc

SEQ ID NO: 1266944 - RNA, 19 nt, Human
gugaacugcuuuuauuuca

SEQ ID NO: 1266945 - RNA, 18 nt, Human
uaaaaaaccagacccuca

SEQ ID NO: 1266946 - RNA, 18 nt, Human
uaaacacuauaaaggcag

SEQ ID NO: 1266947 - RNA, 20 nt, Human
uaagaaagagaacaacccau

SEQ ID NO: 1266948 - RNA, 24 nt, Human
uacccucaaccccccagaagugcc

SEQ ID NO: 1266949 - RNA, 20 nt, Human
uagaaaaacaauaagaaaga

SEQ ID NO: 1266950 - RNA, 22 nt, Human
uagaaaaacaauaagaaagaga

SEQ ID NO: 1266951 - RNA, 22 nt, Human
uagaagccugggcccuuuugcc

SEQ ID NO: 1266952 - RNA, 21 nt, Human
uagaaucaaaacuccagaagg

SEQ ID NO: 1266953 - RNA, 24 nt, Human
uaucugacacaucugaaauuaguu

SEQ ID NO: 1266954 - RNA, 19 nt, Human
ucacagcugcaaagucacu

SEQ ID NO: 1266955 - RNA, 20 nt, Human
uccaaagguaacaaaugagu

SEQ ID NO: 1266956 - RNA, 28 nt, Human
ucccauauuguacuagagccauauccau

SEQ ID NO: 1266957 - RNA, 24 nt, Human
uccuugccuccccauccaaccacc

SEQ ID NO: 1266958 - RNA, 20 nt, Human
ucggaagauuuguuuuuuau

SEQ ID NO: 1266959 - RNA, 21 nt, Human
ucuaagaugaauauuuuucuc

SEQ ID NO: 1266960 - RNA, 22 nt, Human
ucucugagcaaaagccuaaucc

SEQ ID NO: 1266961 - RNA, 19 nt, Human
ucucugcacuccagccagc

SEQ ID NO: 1266962 - RNA, 23 nt, Human
ucugucuccuccucccuccuccc

SEQ ID NO: 1266963 - RNA, 19 nt, Human
ugaaaauauucauuauccc

SEQ ID NO: 1266964 - RNA, 23 nt, Human
ugacagacuccuccaaagguaac

SEQ ID NO: 1266965 - RNA, 19 nt, Human
ugagugcuguaaacaaccu

SEQ ID NO: 1266966 - RNA, 23 nt, Human
ugcaggcuggucagcuuccucgg

SEQ ID NO: 1266967 - RNA, 19 nt, Human
ugccacaggaucuuugcac

SEQ ID NO: 1266968 - RNA, 24 nt, Human
ugccacaggaucuuugcacaugcu

SEQ ID NO: 1266969 - RNA, 25 nt, Human
ugccacaggaucuuugcacaugcuc

SEQ ID NO: 1266970 - RNA, 20 nt, Human
ugccugucucccucucuggu

SEQ ID NO: 1266971 - RNA, 18 nt, Human
uggaaagccuucucuguc

SEQ ID NO: 1266972 - RNA, 21 nt, Human
uggaaagccuucucugucucc

SEQ ID NO: 1266973 - RNA, 18 nt, Human
uggaagaaccaggccaug

SEQ ID NO: 1266974 - RNA, 19 nt, Human
ugucucccucucugcacuc

SEQ ID NO: 1266975 - RNA, 21 nt, Human
ugugcuagaaucaaaacucca

SEQ ID NO: 1266976 - RNA, 26 nt, Human
uuagcaucuucccagcacugcuuccc

SEQ ID NO: 1266977 - RNA, 22 nt, Human
uuaucacuauguucccagcacu

SEQ ID NO: 1266978 - RNA, 26 nt, Human
uucucugucuccuccucccuccuccc

SEQ ID NO: 1266979 - RNA, 22 nt, Human
uugacauuuuauuuuugcucug

SEQ ID NO: 1266980 - RNA, 19 nt, Human
uugcaugucucuucguucc

SEQ ID NO: 1266981 - RNA, 25 nt, Human
uuuuuuguuaucacuauguucccag

SEQ ID NO: 1266982 - RNA, 19 nt, Human
aaagacaagcacagcugcc

SEQ ID NO: 1266983 - RNA, 19 nt, Human
aaagcuuuccuucuuaaag

SEQ ID NO: 1266984 - RNA, 18 nt, Human
aacgccaagcugcagcag

SEQ ID NO: 1266985 - RNA, 18 nt, Human
aagacaagcacagcugcc

SEQ ID NO: 1266986 - RNA, 22 nt, Human
aagcaccgaaagccuaggacag

SEQ ID NO: 1266987 - RNA, 22 nt, Human
aaggaaaaauggaagaaagcag

SEQ ID NO: 1266988 - RNA, 21 nt, Human
aauagagcaagagaaagaggc

SEQ ID NO: 1266989 - RNA, 21 nt, Human
aauggaagaaagcagacuaga

SEQ ID NO: 1266990 - RNA, 23 nt, Human
acaaagacaagcacagcugccca

SEQ ID NO: 1266991 - RNA, 19 nt, Human
acaaaugauaggagacuca

SEQ ID NO: 1266992 - RNA, 21 nt, Human
acuggagacaagguggcuggc

SEQ ID NO: 1266993 - RNA, 23 nt, Human
agauggacagagcuauccacaaa

SEQ ID NO: 1266994 - RNA, 27 nt, Human
aggaaaaauggaagaaagccgguaccc

SEQ ID NO: 1266995 - RNA, 19 nt, Human
agguaucuggcaaaggccu

SEQ ID NO: 1266996 - RNA, 19 nt, Human
aggugagaggguggccagg

SEQ ID NO: 1266997 - RNA, 20 nt, Human
aguguaagcagaugaaaagc

SEQ ID NO: 1266998 - RNA, 23 nt, Human
aguucuuugcacacaaagacaag

SEQ ID NO: 1266999 - RNA, 23 nt, Human
augacaccaugaaagcaaaacug

SEQ ID NO: 1267000 - RNA, 23 nt, Human
caaaauuccaaauaacagcacac

SEQ ID NO: 1267001 - RNA, 22 nt, Human
caaagacccuaaaauauaucag

SEQ ID NO: 1267002 - RNA, 22 nt, Human
cagcacacaaacaaucccaggc

SEQ ID NO: 1267003 - RNA, 23 nt, Human
cucuccugggcuccaggccucca

SEQ ID NO: 1267004 - RNA, 22 nt, Human
cugucugaaggugggugaaauu

SEQ ID NO: 1267005 - RNA, 23 nt, Human
cuguguggaaucuuccuuccuuc

SEQ ID NO: 1267006 - RNA, 21 nt, Human
gaaaagcuuuccuucuuaaag

SEQ ID NO: 1267007 - RNA, 23 nt, Human
gaagacaaguaguuaucagaagu

SEQ ID NO: 1267008 - RNA, 21 nt, Human
gaagacauuaaucaagggcac

SEQ ID NO: 1267009 - RNA, 22 nt, Human
gaagcauuuacaugcauaaaua

SEQ ID NO: 1267010 - RNA, 21 nt, Human
gagggacagaaugccauucug

SEQ ID NO: 1267011 - RNA, 20 nt, Human
gccaacaauaguguagacug

SEQ ID NO: 1267012 - RNA, 25 nt, Human
gcucuuaugacuuugggacagaaau

SEQ ID NO: 1267013 - RNA, 28 nt, Human
ggacagaaauaugacaccaugaaagcaa

SEQ ID NO: 1267014 - RNA, 23 nt, Human
ggacuggagacaagguggcuggc

SEQ ID NO: 1267015 - RNA, 22 nt, Human
uaaagaacagcucccaguggug

SEQ ID NO: 1267016 - RNA, 22 nt, Human
uaacaagaagcuguucaaagga

SEQ ID NO: 1267017 - RNA, 19 nt, Human
ucaguaaccaggacuggag

SEQ ID NO: 1267018 - RNA, 21 nt, Human
uccucuaaguuugcccugucu

SEQ ID NO: 1267019 - RNA, 18 nt, Human
uccugggcuccaggccuc

SEQ ID NO: 1267020 - RNA, 22 nt, Human
ucuccugggcuccaggccucca

SEQ ID NO: 1267021 - RNA, 18 nt, Human
ugaaacgccaagcugcag

SEQ ID NO: 1267022 - RNA, 24 nt, Human
ugagaggaaccaacaaagacccua

SEQ ID NO: 1267023 - RNA, 19 nt, Human
ugagaggguggccagggga

SEQ ID NO: 1267024 - RNA, 19 nt, Human
ugauuaggugagagggugg

SEQ ID NO: 1267025 - RNA, 22 nt, Human
ugcccugucuuucaaaauucca

SEQ ID NO: 1267026 - RNA, 21 nt, Human
uggaugaaacgccaagcugca

SEQ ID NO: 1267027 - RNA, 18 nt, Human
uggcuggcuaggaugcug

SEQ ID NO: 1267028 - RNA, 21 nt, Human
uggcuggcuaggaugcugcug

SEQ ID NO: 1267029 - RNA, 22 nt, Human
uggcuggcuaggaugcugcugu

SEQ ID NO: 1267030 - RNA, 21 nt, Human
ugggcuccaggccuccaguuc

SEQ ID NO: 1267031 - RNA, 23 nt, Human
uuaaagaacagcucccaguggug

SEQ ID NO: 1267032 - RNA, 21 nt, Human
uugcugccaauuuccucuaag

SEQ ID NO: 1267033 - RNA, 25 nt, Human
uuuagcacuccuuuugcccugugug

SEQ ID NO: 1267034 - RNA, 24 nt, Human
aaacagguaaaauuagcacuuccc

SEQ ID NO: 1267035 - RNA, 25 nt, Human
aaauaccuuaggaacugaaacaguu

SEQ ID NO: 1267036 - RNA, 20 nt, Human
aaccaugaagaaagucuaca

SEQ ID NO: 1267037 - RNA, 19 nt, Human
aagaagcaaaagugagcaa

SEQ ID NO: 1267038 - RNA, 23 nt, Human
aagaagcaaaagugagcaguggg

SEQ ID NO: 1267039 - RNA, 19 nt, Human
aagaugccuuuggacaauu

SEQ ID NO: 1267040 - RNA, 21 nt, Human
aagcaaauggauguuucccau

SEQ ID NO: 1267041 - RNA, 20 nt, Human
aaggguauuaauuucuuauu

SEQ ID NO: 1267042 - RNA, 18 nt, Human
aaguauaaaauaaucaua

SEQ ID NO: 1267043 - RNA, 23 nt, Human
acacacacacacacacacacaca

SEQ ID NO: 1267044 - RNA, 20 nt, Human
accaaaguuuaaaacccauu

SEQ ID NO: 1267045 - RNA, 19 nt, Human
agcaaaacagaauaguccc

SEQ ID NO: 1267046 - RNA, 19 nt, Human
agcaaauaccuuaggaacu

SEQ ID NO: 1267047 - RNA, 28 nt, Human
agcaugcauagcacacacacacacacac

SEQ ID NO: 1267048 - RNA, 21 nt, Human
aguggguaccaaacaacaugc

SEQ ID NO: 1267049 - RNA, 23 nt, Human
auagcacacacacacacacacac

SEQ ID NO: 1267050 - RNA, 29 nt, Human
augcauagcacacacacacacacacacac

SEQ ID NO: 1267051 - RNA, 24 nt, Human
caaaaauagugucuuccaauauuc

SEQ ID NO: 1267052 - RNA, 20 nt, Human
cacacacacacacacacaca

SEQ ID NO: 1267053 - RNA, 20 nt, Human
cacacacacacacacacaca

SEQ ID NO: 1267054 - RNA, 20 nt, Human
cacacacacacacacacaca

SEQ ID NO: 1267055 - RNA, 28 nt, Human
cacacacacacacacacacacacacuca

SEQ ID NO: 1267056 - RNA, 26 nt, Human
cacacacacacacacacacacacuca

SEQ ID NO: 1267057 - RNA, 29 nt, Human
cacuacauaaaaaauaggauauauaaaaa

SEQ ID NO: 1267058 - RNA, 22 nt, Human
cacugcaauucuuaaggcuguu

SEQ ID NO: 1267059 - RNA, 19 nt, Human
cacuuuaauuuccuggcug

SEQ ID NO: 1267060 - RNA, 19 nt, Human
cagccuacaccagcagaau

SEQ ID NO: 1267061 - RNA, 20 nt, Human
ccaaggacauuuuucuuaag

SEQ ID NO: 1267062 - RNA, 19 nt, Human
cuaaccuugacagggacua

SEQ ID NO: 1267063 - RNA, 23 nt, Human
cuagcaagucaaacauagagaag

SEQ ID NO: 1267064 - RNA, 23 nt, Human
cugaacauaacuggcaaaaagga

SEQ ID NO: 1267065 - RNA, 21 nt, Human
cuuuacacagagaaagccuuc

SEQ ID NO: 1267066 - RNA, 21 nt, Human
gaacacuuggcuauugguuua

SEQ ID NO: 1267067 - RNA, 19 nt, Human
gaagucuucuguuuacuag

SEQ ID NO: 1267068 - RNA, 20 nt, Human
gacuaaagaaugagguacag

SEQ ID NO: 1267069 - RNA, 27 nt, Human
gaguucacccacaucucagcaaauacc

SEQ ID NO: 1267070 - RNA, 21 nt, Human
gcaaaacagaauagucccauu

SEQ ID NO: 1267071 - RNA, 30 nt, Human
gcauagcacacacacacacacacacacaca

SEQ ID NO: 1267072 - RNA, 26 nt, Human
gcaugcauagcacacacacacacaca

SEQ ID NO: 1267073 - RNA, 19 nt, Human
gucugagugugguguagaa

SEQ ID NO: 1267074 - RNA, 22 nt, Human
guggauuaaauggagucggcag

SEQ ID NO: 1267075 - RNA, 20 nt, Human
guuugggcaacagccuacac

SEQ ID NO: 1267076 - RNA, 22 nt, Human
uaaaaaaugaccaauuugcucc

SEQ ID NO: 1267077 - RNA, 19 nt, Human
uaaaauagcaaaaauaggg

SEQ ID NO: 1267078 - RNA, 27 nt, Human
uaauccacuugaagucagccaguaucc

SEQ ID NO: 1267079 - RNA, 20 nt, Human
uaaugaaaacuggugacugu

SEQ ID NO: 1267080 - RNA, 21 nt, Human
uaccuuaggaacugaaacagu

SEQ ID NO: 1267081 - RNA, 23 nt, Human
uaccuuaggaacugaaacaguug

SEQ ID NO: 1267082 - RNA, 23 nt, Human
uagaaaauuugcuugagaaucug

SEQ ID NO: 1267083 - RNA, 18 nt, Human
uagacaacagauaacgcc

SEQ ID NO: 1267084 - RNA, 23 nt, Human
uagcaaaaauagugucuuccaau

SEQ ID NO: 1267085 - RNA, 22 nt, Human
uaggaacugaaacaguugcuca

SEQ ID NO: 1267086 - RNA, 18 nt, Human
uagggaauucugaugcau

SEQ ID NO: 1267087 - RNA, 19 nt, Human
uaguagcaaauaaaugcuu

SEQ ID NO: 1267088 - RNA, 22 nt, Human
uauugcccuuuuccauucccau

SEQ ID NO: 1267089 - RNA, 23 nt, Human
uauugcccuuuuccauucccaua

SEQ ID NO: 1267090 - RNA, 22 nt, Human
ucaaagucaaacuuuuucaggu

SEQ ID NO: 1267091 - RNA, 22 nt, Human
ucaaccaugaagaaagucuaca

SEQ ID NO: 1267092 - RNA, 23 nt, Human
ucagcaaauaccuuaggaacuga

SEQ ID NO: 1267093 - RNA, 19 nt, Human
ucagugagguaaauagaau

SEQ ID NO: 1267094 - RNA, 19 nt, Human
ucccaugcagacuuagagc

SEQ ID NO: 1267095 - RNA, 24 nt, Human
ucccauugaugguguggggaggag

SEQ ID NO: 1267096 - RNA, 19 nt, Human
uccccugaccucuuggguu

SEQ ID NO: 1267097 - RNA, 21 nt, Human
ugaagucagccaguaucccua

SEQ ID NO: 1267098 - RNA, 23 nt, Human
ugauuuuggcacaaugggaaggg

SEQ ID NO: 1267099 - RNA, 25 nt, Human
ugcagcccauccccacugugcccaa

SEQ ID NO: 1267100 - RNA, 22 nt, Human
ugccuccuauuuaaagaacacu

SEQ ID NO: 1267101 - RNA, 24 nt, Human
uggaaacagguaaaauuagcacuu

SEQ ID NO: 1267102 - RNA, 23 nt, Human
uggcacaaugggaagggugccuc

SEQ ID NO: 1267103 - RNA, 25 nt, Human
uggccaagaagcaaaagugagcaag

SEQ ID NO: 1267104 - RNA, 22 nt, Human
uuaucaugaugcuugcaucacu

SEQ ID NO: 1267105 - RNA, 20 nt, Human
uuccagaagucugagugugg

SEQ ID NO: 1267106 - RNA, 23 nt, Human
uuccugaacauaacuggcaaaaa

SEQ ID NO: 1267107 - RNA, 23 nt, Human
uuuuuaugucacuuauuuuauuu

SEQ ID NO: 1267108 - RNA, 20 nt, Human
aaaaacagcuaauacuacca

SEQ ID NO: 1267109 - RNA, 18 nt, Human
aacuugcuauuccuucuu

SEQ ID NO: 1267110 - RNA, 20 nt, Human
aagcgaauuucuuuuccucc

SEQ ID NO: 1267111 - RNA, 20 nt, Human
acaaagauaauaauucacaa

SEQ ID NO: 1267112 - RNA, 25 nt, Human
acacugaauuuuuucccaauuauau

SEQ ID NO: 1267113 - RNA, 21 nt, Human
acagcuaauacuaccacuaaa

SEQ ID NO: 1267114 - RNA, 20 nt, Human
agacuuaaaggacaagguag

SEQ ID NO: 1267115 - RNA, 20 nt, Human
agagccuagcagacuuaaag

SEQ ID NO: 1267116 - RNA, 22 nt, Human
caagguaguaaauguuuuauca

SEQ ID NO: 1267117 - RNA, 20 nt, Human
cagcuaauacuaccacuaaa

SEQ ID NO: 1267118 - RNA, 19 nt, Human
cugcuuggcauggaggaca

SEQ ID NO: 1267119 - RNA, 18 nt, Human
cuuagcaaggauggcaga

SEQ ID NO: 1267120 - RNA, 21 nt, Human
gaacuuugguaaccagaaaug

SEQ ID NO: 1267121 - RNA, 21 nt, Human
gagagccuagcagacuuaaag

SEQ ID NO: 1267122 - RNA, 19 nt, Human
uaaaggacaagguaguaaa

SEQ ID NO: 1267123 - RNA, 22 nt, Human
uaaccagaaauguaaaauuuca

SEQ ID NO: 1267124 - RNA, 19 nt, Human
uauauggcuaccuguugua

SEQ ID NO: 1267125 - RNA, 20 nt, Human
uccgggcucgcccggcacgc

SEQ ID NO: 1267126 - RNA, 18 nt, Human
ugcuuggcauggaggaca

SEQ ID NO: 1267127 - RNA, 19 nt, Human
ugugucaaaacuacuuagc

SEQ ID NO: 1267128 - RNA, 25 nt, Human
uuaggguacugagagccucccaaag

SEQ ID NO: 1267129 - RNA, 24 nt, Human
aaacagguaugagugacgagaaac

SEQ ID NO: 1267130 - RNA, 18 nt, Human
aaacugcccacccauuca

SEQ ID NO: 1267131 - RNA, 24 nt, Human
aaaggcagaggcugaaacaggaac

SEQ ID NO: 1267132 - RNA, 21 nt, Human
aaaugcaaaggaaacugaacu

SEQ ID NO: 1267133 - RNA, 22 nt, Human
aacacaugaccucagaagccuc

SEQ ID NO: 1267134 - RNA, 20 nt, Human
aagaagaaagagucugagga

SEQ ID NO: 1267135 - RNA, 24 nt, Human
aagaggccccaagcagaggacucc

SEQ ID NO: 1267136 - RNA, 22 nt, Human
aaugacaccacuuuccuccugu

SEQ ID NO: 1267137 - RNA, 18 nt, Human
acaaaaagggcaugacag

SEQ ID NO: 1267138 - RNA, 24 nt, Human
acaggaacaugcagcugcuagagg

SEQ ID NO: 1267139 - RNA, 21 nt, Human
acaggcacucucucugaagcc

SEQ ID NO: 1267140 - RNA, 22 nt, Human
acaguccucugggagguuuccu

SEQ ID NO: 1267141 - RNA, 21 nt, Human
acaucacagugccucagugau

SEQ ID NO: 1267142 - RNA, 22 nt, Human
accaucagccuggaugcagagg

SEQ ID NO: 1267143 - RNA, 20 nt, Human
accuucuacugcuguugcuu

SEQ ID NO: 1267144 - RNA, 21 nt, Human
acgaugaugaagacagaugcc

SEQ ID NO: 1267145 - RNA, 23 nt, Human
acucagaaaguuguuucucaguu

SEQ ID NO: 1267146 - RNA, 19 nt, Human
acugugacuuggggagcau

SEQ ID NO: 1267147 - RNA, 25 nt, Human
acuugcuucucaaugaacuagucau

SEQ ID NO: 1267148 - RNA, 20 nt, Human
agaaaaaaaagaauacuaag

SEQ ID NO: 1267149 - RNA, 22 nt, Human
agacaccaaggagaauaagaug

SEQ ID NO: 1267150 - RNA, 18 nt, Human
agacagaugccaggcucu

SEQ ID NO: 1267151 - RNA, 22 nt, Human
agagaacagcauguagaagcau

SEQ ID NO: 1267152 - RNA, 24 nt, Human
agccaauucacaauagacaucaga

SEQ ID NO: 1267153 - RNA, 25 nt, Human
agcugggcucagguggguggcagag

SEQ ID NO: 1267154 - RNA, 19 nt, Human
aggaagaagaaagagucug

SEQ ID NO: 1267155 - RNA, 20 nt, Human
aggaaggacacaugaaaaga

SEQ ID NO: 1267156 - RNA, 20 nt, Human
aggaaucuuggaggagcugu

SEQ ID NO: 1267157 - RNA, 22 nt, Human
aggagcuguggaaaggcagagg

SEQ ID NO: 1267158 - RNA, 18 nt, Human
aggcaaaagacaaacagg

SEQ ID NO: 1267159 - RNA, 19 nt, Human
agguggaguccuggagaaa

SEQ ID NO: 1267160 - RNA, 19 nt, Human
agguggguggcagagaaca

SEQ ID NO: 1267161 - RNA, 22 nt, Human
agugacaagaaaggcauccaga

SEQ ID NO: 1267162 - RNA, 22 nt, Human
auagccaagauaucaugaaaau

SEQ ID NO: 1267163 - RNA, 23 nt, Human
augaaaagaggauauguggccuu

SEQ ID NO: 1267164 - RNA, 23 nt, Human
auggaaggagaaugaaaagagga

SEQ ID NO: 1267165 - RNA, 21 nt, Human
caaaagacaaacagguaugaa

SEQ ID NO: 1267166 - RNA, 23 nt, Human
cacagguaggguggcuggcaugg

SEQ ID NO: 1267167 - RNA, 20 nt, Human
cacagugccucagugauggu

SEQ ID NO: 1267168 - RNA, 21 nt, Human
caccacauacagggucaggau

SEQ ID NO: 1267169 - RNA, 19 nt, Human
caccugcucagauguaaga

SEQ ID NO: 1267170 - RNA, 18 nt, Human
cacguggcugagguggcu

SEQ ID NO: 1267171 - RNA, 22 nt, Human
cacuaaaacuucuuuucuucag

SEQ ID NO: 1267172 - RNA, 21 nt, Human
cacucucucugaagccagagg

SEQ ID NO: 1267173 - RNA, 19 nt, Human
cagacagaggccagggcag

SEQ ID NO: 1267174 - RNA, 19 nt, Human
cagaggccagggcaggggc

SEQ ID NO: 1267175 - RNA, 23 nt, Human
cagcaaacugcccacccauucac

SEQ ID NO: 1267176 - RNA, 24 nt, Human
cagcaggucucucucugggcagcg

SEQ ID NO: 1267177 - RNA, 20 nt, Human
cagggcaggggcagggggcc

SEQ ID NO: 1267178 - RNA, 22 nt, Human
cauuugaaaguuuccagcagau

SEQ ID NO: 1267179 - RNA, 24 nt, Human
ccacacucugacaguuccuaaccc

SEQ ID NO: 1267180 - RNA, 24 nt, Human
ccacccauucacauaugaaauggc

SEQ ID NO: 1267181 - RNA, 18 nt, Human
ccacugacucuagcuggg

SEQ ID NO: 1267182 - RNA, 21 nt, Human
ccagaaugagaaaaaaaagaa

SEQ ID NO: 1267183 - RNA, 24 nt, Human
ccagccaauucacaauagacauca

SEQ ID NO: 1267184 - RNA, 21 nt, Human
cccacaggcacucucucugaa

SEQ ID NO: 1267185 - RNA, 18 nt, Human
cccaccucuacucagaaa

SEQ ID NO: 1267186 - RNA, 19 nt, Human
ccccacaggcacucucucu

SEQ ID NO: 1267187 - RNA, 18 nt, Human
ccucagugauggugaaca

SEQ ID NO: 1267188 - RNA, 21 nt, Human
ccuccuguggagaggcaggau

SEQ ID NO: 1267189 - RNA, 19 nt, Human
cggagagaccggggcggca

SEQ ID NO: 1267190 - RNA, 19 nt, Human
cuagcugggcucagguggg

SEQ ID NO: 1267191 - RNA, 19 nt, Human
cuauuucuuuugcuguuuc

SEQ ID NO: 1267192 - RNA, 21 nt, Human
cucacaguccucugggagguu

SEQ ID NO: 1267193 - RNA, 22 nt, Human
cucauagucauccacaaggguu

SEQ ID NO: 1267194 - RNA, 19 nt, Human
cuccaggaagaagaaagag

SEQ ID NO: 1267195 - RNA, 19 nt, Human
cuccauucagcugcugacc

SEQ ID NO: 1267196 - RNA, 23 nt, Human
cugaagccagaggguucagaccc

SEQ ID NO: 1267197 - RNA, 24 nt, Human
cugaagccagaggguucagacccc

SEQ ID NO: 1267198 - RNA, 23 nt, Human
cugaagccuugaaucucucauag

SEQ ID NO: 1267199 - RNA, 21 nt, Human
cugcagcucucucuaaggccg

SEQ ID NO: 1267200 - RNA, 20 nt, Human
cugccugcucuugcucuuuc

SEQ ID NO: 1267201 - RNA, 24 nt, Human
cuggaguaaucucugagcugcagu

SEQ ID NO: 1267202 - RNA, 20 nt, Human
cuguggauuuucucugcuuu

SEQ ID NO: 1267203 - RNA, 21 nt, Human
cuuaucaucagaacaaugagu

SEQ ID NO: 1267204 - RNA, 22 nt, Human
cuuccagucuaugucacaucug

SEQ ID NO: 1267205 - RNA, 20 nt, Human
gagcggggcggacggggcgg

SEQ ID NO: 1267206 - RNA, 21 nt, Human
gauaaaguaccagaaugagaa

SEQ ID NO: 1267207 - RNA, 19 nt, Human
gaugaguaucuucaacagc

SEQ ID NO: 1267208 - RNA, 24 nt, Human
gaugguggccaggcaaaagacaaa

SEQ ID NO: 1267209 - RNA, 18 nt, Human
gcaauagaggaaucuugg

SEQ ID NO: 1267210 - RNA, 24 nt, Human
gcagcaguucacuucagcgguaga

SEQ ID NO: 1267211 - RNA, 18 nt, Human
gcagggggccugggaaaa

SEQ ID NO: 1267212 - RNA, 24 nt, Human
gcauggcucacguggcugaggugg

SEQ ID NO: 1267213 - RNA, 18 nt, Human
gccccaagcagaggacuc

SEQ ID NO: 1267214 - RNA, 22 nt, Human
gcccuccugccugcucuugcuc

SEQ ID NO: 1267215 - RNA, 19 nt, Human
gccuccugguucuuaacuc

SEQ ID NO: 1267216 - RNA, 20 nt, Human
gcggagugaggggcgugcuc

SEQ ID NO: 1267217 - RNA, 20 nt, Human
gcuccaggaagaagaaagag

SEQ ID NO: 1267218 - RNA, 22 nt, Human
gcuccauucagcugcugaccug

SEQ ID NO: 1267219 - RNA, 20 nt, Human
gcucuugcucuuucuuucuc

SEQ ID NO: 1267220 - RNA, 23 nt, Human
gcuguggaaaggcagaggcugaa

SEQ ID NO: 1267221 - RNA, 21 nt, Human
ggaaggagaaugaaaagagga

SEQ ID NO: 1267222 - RNA, 21 nt, Human
ggaaggagaaugaaaagagga

SEQ ID NO: 1267223 - RNA, 20 nt, Human
ggaggcagacugugacuugg

SEQ ID NO: 1267224 - RNA, 27 nt, Human
ggcaacagcgaagaaaugccgguaccc

SEQ ID NO: 1267225 - RNA, 21 nt, Human
ggccugggcccacugcugggc

SEQ ID NO: 1267226 - RNA, 20 nt, Human
gggcaugacagcaaacugcc

SEQ ID NO: 1267227 - RNA, 24 nt, Human
gggcucagguggguggcagagaac

SEQ ID NO: 1267228 - RNA, 19 nt, Human
ggggcagggggccugggaa

SEQ ID NO: 1267229 - RNA, 20 nt, Human
gggucacagguaggguggcu

SEQ ID NO: 1267230 - RNA, 24 nt, Human
guaccagaaugagaaaaaaaagaa

SEQ ID NO: 1267231 - RNA, 22 nt, Human
gugauggugaacacaugaccuc

SEQ ID NO: 1267232 - RNA, 23 nt, Human
gugguaggucugcuguggauuuu

SEQ ID NO: 1267233 - RNA, 19 nt, Human
guucccagagcggggcgga

SEQ ID NO: 1267234 - RNA, 18 nt, Human
uaagaagcaacuccucau

SEQ ID NO: 1267235 - RNA, 24 nt, Human
uaagcuuuuuaccuagccaauucu

SEQ ID NO: 1267236 - RNA, 18 nt, Human
uaagugacaagaaaggca

SEQ ID NO: 1267237 - RNA, 23 nt, Human
uaccagaaugagaaaaaaaagaa

SEQ ID NO: 1267238 - RNA, 19 nt, Human
uaccuagccaauucuaggu

SEQ ID NO: 1267239 - RNA, 24 nt, Human
uaccuggugccccacaggcacucu

SEQ ID NO: 1267240 - RNA, 24 nt, Human
uaucaugaaaauucccauguggag

SEQ ID NO: 1267241 - RNA, 18 nt, Human
uaucuguaggugcauucu

SEQ ID NO: 1267242 - RNA, 20 nt, Human
uaugaaauggcagccacaaa

SEQ ID NO: 1267243 - RNA, 18 nt, Human
uauguugauauuuugauu

SEQ ID NO: 1267244 - RNA, 20 nt, Human
ucacaucugcuggagcggcg

SEQ ID NO: 1267245 - RNA, 21 nt, Human
ucacuuccagucuaugucaca

SEQ ID NO: 1267246 - RNA, 23 nt, Human
ucagaacaaugagugagugacca

SEQ ID NO: 1267247 - RNA, 20 nt, Human
uccacacagaaggcugaggu

SEQ ID NO: 1267248 - RNA, 23 nt, Human
uccaugauaacuggggccggggc

SEQ ID NO: 1267249 - RNA, 21 nt, Human
ucccacacaggcaguggcuuc

SEQ ID NO: 1267250 - RNA, 22 nt, Human
uccucaucuguucaaguuuuau

SEQ ID NO: 1267251 - RNA, 18 nt, Human
uccuccacuuccccacug

SEQ ID NO: 1267252 - RNA, 18 nt, Human
uccuggagaaagucuugg

SEQ ID NO: 1267253 - RNA, 19 nt, Human
ucugaggaugccacgauga

SEQ ID NO: 1267254 - RNA, 20 nt, Human
ucugcagcagcaggucucuc

SEQ ID NO: 1267255 - RNA, 20 nt, Human
ucuggccugggcccacugcu

SEQ ID NO: 1267256 - RNA, 20 nt, Human
ucuucaggcuccacuucuga

SEQ ID NO: 1267257 - RNA, 20 nt, Human
ucuuucuuucucuacucccc

SEQ ID NO: 1267258 - RNA, 24 nt, Human
ugaaaagaggauauguggccuuuc

SEQ ID NO: 1267259 - RNA, 18 nt, Human
ugaaaauucccaugugga

SEQ ID NO: 1267260 - RNA, 19 nt, Human
ugaaauggcagccacaaau

SEQ ID NO: 1267261 - RNA, 20 nt, Human
ugaaauggcagccacaaaug

SEQ ID NO: 1267262 - RNA, 20 nt, Human
ugagaagucccauuuccugc

SEQ ID NO: 1267263 - RNA, 23 nt, Human
ugauauccagacuccagaggggc

SEQ ID NO: 1267264 - RNA, 22 nt, Human
ugcaauagaggaaucuuggagg

SEQ ID NO: 1267265 - RNA, 19 nt, Human
ugcacaaaaagggcaugac

SEQ ID NO: 1267266 - RNA, 21 nt, Human
ugcagacagaggccagggcag

SEQ ID NO: 1267267 - RNA, 21 nt, Human
ugcucuggaacuucaagccac

SEQ ID NO: 1267268 - RNA, 18 nt, Human
ugcugaccugugguucca

SEQ ID NO: 1267269 - RNA, 23 nt, Human
uggaaaggcagaggcugaaacag

SEQ ID NO: 1267270 - RNA, 23 nt, Human
uggaaggagaaugaaaagaggau

SEQ ID NO: 1267271 - RNA, 19 nt, Human
uggaaugccaccuucuacu

SEQ ID NO: 1267272 - RNA, 21 nt, Human
uggaaugccaccuucuacugc

SEQ ID NO: 1267273 - RNA, 18 nt, Human
uggcaacagcgaagaaag

SEQ ID NO: 1267274 - RNA, 22 nt, Human
uggcaggcaccaucagccugga

SEQ ID NO: 1267275 - RNA, 19 nt, Human
uggcugcagauuguggaga

SEQ ID NO: 1267276 - RNA, 22 nt, Human
uggcugcagauuguggagaggg

SEQ ID NO: 1267277 - RNA, 24 nt, Human
ugguaggucugcuguggauuuucu

SEQ ID NO: 1267278 - RNA, 24 nt, Human
ugguucugauuguugucugggucc

SEQ ID NO: 1267279 - RNA, 21 nt, Human
uguaagaagcaacuccucauc

SEQ ID NO: 1267280 - RNA, 22 nt, Human
uguaagaagcaacuccucaucu

SEQ ID NO: 1267281 - RNA, 19 nt, Human
uguggaaaggcagaggcug

SEQ ID NO: 1267282 - RNA, 24 nt, Human
uguuucucaguugagccacacucu

SEQ ID NO: 1267283 - RNA, 20 nt, Human
uuaccuagccaauucuaggu

SEQ ID NO: 1267284 - RNA, 21 nt, Human
uuagcccaucuuuccccaccu

SEQ ID NO: 1267285 - RNA, 19 nt, Human
uucacauaugaaauggcag

SEQ ID NO: 1267286 - RNA, 22 nt, Human
uucaugguccucacaguccucu

SEQ ID NO: 1267287 - RNA, 23 nt, Human
uucuaggucugaucacaauccac

SEQ ID NO: 1267288 - RNA, 21 nt, Human
uugguucugauuguugucugg

SEQ ID NO: 1267289 - RNA, 22 nt, Human
uuuaugcauacuuauuuugugu

SEQ ID NO: 1267290 - RNA, 20 nt, Human
aaaaaaaagguacccacuaa

SEQ ID NO: 1267291 - RNA, 22 nt, Human
aaaaagacaaagcuacaacaga

SEQ ID NO: 1267292 - RNA, 23 nt, Human
aaaagaaaaagaaaaagacaaag

SEQ ID NO: 1267293 - RNA, 23 nt, Human
aaacaaauugguaacaacaugau

SEQ ID NO: 1267294 - RNA, 22 nt, Human
aacauucuuuacacccaaaacc

SEQ ID NO: 1267295 - RNA, 21 nt, Human
aaccaaauagaaauuuugaga

SEQ ID NO: 1267296 - RNA, 23 nt, Human
aagaaaaaaaagguacccacuaa

SEQ ID NO: 1267297 - RNA, 23 nt, Human
aaggaaacaccuucgaaacugca

SEQ ID NO: 1267298 - RNA, 24 nt, Human
aauaguaauuaacaaugaucuucu

SEQ ID NO: 1267299 - RNA, 25 nt, Human
aauauacacaagaaauaacagugug

SEQ ID NO: 1267300 - RNA, 19 nt, Human
acaaacaggaaagcaugcc

SEQ ID NO: 1267301 - RNA, 20 nt, Human
acaaggaaacaccuucgaaa

SEQ ID NO: 1267302 - RNA, 18 nt, Human
acuaccacaauuuacagg

SEQ ID NO: 1267303 - RNA, 20 nt, Human
agaaaaagacaaagcuacaa

SEQ ID NO: 1267304 - RNA, 22 nt, Human
auagauuccccuuaaacugcaa

SEQ ID NO: 1267305 - RNA, 21 nt, Human
augaaaagaaaaagaaaaaga

SEQ ID NO: 1267306 - RNA, 22 nt, Human
augauuuuuauucucuugcucu

SEQ ID NO: 1267307 - RNA, 22 nt, Human
caaacaaauugguaacaacaug

SEQ ID NO: 1267308 - RNA, 23 nt, Human
caaauugguaacaacaugauuua

SEQ ID NO: 1267309 - RNA, 22 nt, Human
cacccaaaaccuauggcagcag

SEQ ID NO: 1267310 - RNA, 22 nt, Human
cagcagguguuucuuuacaguu

SEQ ID NO: 1267311 - RNA, 18 nt, Human
caugccagccaguuaggg

SEQ ID NO: 1267312 - RNA, 19 nt, Human
cauugcaaacacacaaauu

SEQ ID NO: 1267313 - RNA, 19 nt, Human
ccaaaaccuauggcagcag

SEQ ID NO: 1267314 - RNA, 18 nt, Human
cccaaaaccuauggcagc

SEQ ID NO: 1267315 - RNA, 23 nt, Human
ccggacucgccucuuccaacucg

SEQ ID NO: 1267316 - RNA, 24 nt, Human
cuaaaacacacauugcaaacacac

SEQ ID NO: 1267317 - RNA, 20 nt, Human
cugaacuauccuugguuuca

SEQ ID NO: 1267318 - RNA, 24 nt, Human
cugauguaaugaaaagaaaaagaa

SEQ ID NO: 1267319 - RNA, 25 nt, Human
cuuaaacugcaagucagcagguguu

SEQ ID NO: 1267320 - RNA, 20 nt, Human
cuuuccugacaacuccucgc

SEQ ID NO: 1267321 - RNA, 19 nt, Human
gaaaagaaaaagaaaaaga

SEQ ID NO: 1267322 - RNA, 25 nt, Human
gcaguaaacauucuuuacacccaaa

SEQ ID NO: 1267323 - RNA, 18 nt, Human
gcuaugacaguccugaac

SEQ ID NO: 1267324 - RNA, 26 nt, Human
gcugcaguuagguuauuuuggacaau

SEQ ID NO: 1267325 - RNA, 21 nt, Human
ggagggcaguaaacauucuuu

SEQ ID NO: 1267326 - RNA, 23 nt, Human
uaaaagaaaaugcacaaaaacca

SEQ ID NO: 1267327 - RNA, 26 nt, Human
uaaauaagaaaaaaaagguacccacu

SEQ ID NO: 1267328 - RNA, 20 nt, Human
uaacucacaaggaaacaccu

SEQ ID NO: 1267329 - RNA, 22 nt, Human
uaagcugcaguaacuuuucuga

SEQ ID NO: 1267330 - RNA, 20 nt, Human
uagaauacaaacaggaaaga

SEQ ID NO: 1267331 - RNA, 23 nt, Human
uaugacaguccugaacaagaagg

SEQ ID NO: 1267332 - RNA, 23 nt, Human
uauuaauauauguauauaugacc

SEQ ID NO: 1267333 - RNA, 21 nt, Human
ucagcagguguuucuuuacag

SEQ ID NO: 1267334 - RNA, 22 nt, Human
ucuaaaacacacauugcaaaca

SEQ ID NO: 1267335 - RNA, 21 nt, Human
ucuaaacacagcuaggacuca

SEQ ID NO: 1267336 - RNA, 26 nt, Human
ucuaaacacagcuaggacucagcaag

SEQ ID NO: 1267337 - RNA, 20 nt, Human
ucuaacguaggagagggaaa

SEQ ID NO: 1267338 - RNA, 20 nt, Human
ucuuugggaauuuaagaacu

SEQ ID NO: 1267339 - RNA, 19 nt, Human
ugaaaagaaaaagaaaaag

SEQ ID NO: 1267340 - RNA, 24 nt, Human
ugcaagucagcagguguuucuuua

SEQ ID NO: 1267341 - RNA, 21 nt, Human
uggcuaugacaguccugaaca

SEQ ID NO: 1267342 - RNA, 21 nt, Human
ugguuuggaaauggggagaau

SEQ ID NO: 1267343 - RNA, 20 nt, Human
uguagaaaaacugaacuaca

SEQ ID NO: 1267344 - RNA, 21 nt, Human
ugucucaaaguaaccugcagc

SEQ ID NO: 1267345 - RNA, 22 nt, Human
ugugcuuuaaauaagaaaaaaa

SEQ ID NO: 1267346 - RNA, 22 nt, Human
uuaucuauucucuccacauguc

SEQ ID NO: 1267347 - RNA, 18 nt, Human
uugcaaacuguggcuaug

SEQ ID NO: 1267348 - RNA, 20 nt, Human
uuuucagaauuuaaauggaa

SEQ ID NO: 1267349 - RNA, 23 nt, Human
aaacuccugggcuuaagcaaucc

SEQ ID NO: 1267350 - RNA, 20 nt, Human
aaccaccagccaggggcugg

SEQ ID NO: 1267351 - RNA, 21 nt, Human
aaccgagccggcagggcugcg

SEQ ID NO: 1267352 - RNA, 24 nt, Human
aagcaauccugucucagccuccca

SEQ ID NO: 1267353 - RNA, 22 nt, Human
aaggccacagccacauccccaa

SEQ ID NO: 1267354 - RNA, 18 nt, Human
acuguucucccaggcaag

SEQ ID NO: 1267355 - RNA, 25 nt, Human
agaaggaauaaacuacucugcacaa

SEQ ID NO: 1267356 - RNA, 22 nt, Human
agagagucagcgaccacaccac

SEQ ID NO: 1267357 - RNA, 21 nt, Human
agccggcagggcugcggagcu

SEQ ID NO: 1267358 - RNA, 18 nt, Human
aggcuggagugcaguggc

SEQ ID NO: 1267359 - RNA, 23 nt, Human
aguaacugggacuacaggcauau

SEQ ID NO: 1267360 - RNA, 22 nt, Human
augcacaaucauagugcauuac

SEQ ID NO: 1267361 - RNA, 21 nt, Human
auguugcccaggcuggagugc

SEQ ID NO: 1267362 - RNA, 24 nt, Human
auucuuuucaauuagcacacagua

SEQ ID NO: 1267363 - RNA, 20 nt, Human
caccacgccguucggacagu

SEQ ID NO: 1267364 - RNA, 22 nt, Human
caccaugccuggcuuuguacag

SEQ ID NO: 1267365 - RNA, 18 nt, Human
cagcauccaggugucucc

SEQ ID NO: 1267366 - RNA, 23 nt, Human
cagccucccaaguaacugggacu

SEQ ID NO: 1267367 - RNA, 19 nt, Human
cagcgaccacaccacgccg

SEQ ID NO: 1267368 - RNA, 22 nt, Human
cauaauuuauuuaaugucuccu

SEQ ID NO: 1267369 - RNA, 21 nt, Human
ccacagccacauccccaaaug

SEQ ID NO: 1267370 - RNA, 19 nt, Human
ccagagagucagcgaccac

SEQ ID NO: 1267371 - RNA, 24 nt, Human
cccaaguaacugggacuacaggca

SEQ ID NO: 1267372 - RNA, 23 nt, Human
cccggccgcucacgaaccgaacc

SEQ ID NO: 1267373 - RNA, 22 nt, Human
cccuguacagggcccgcugagc

SEQ ID NO: 1267374 - RNA, 20 nt, Human
cuauguugcccaggcuggag

SEQ ID NO: 1267375 - RNA, 20 nt, Human
cugaacuguucucccaggca

SEQ ID NO: 1267376 - RNA, 22 nt, Human
cugggcuuaagcaauccugucu

SEQ ID NO: 1267377 - RNA, 24 nt, Human
gacuacaggcauaugccaccaugc

SEQ ID NO: 1267378 - RNA, 24 nt, Human
gcugcggagcugcacgcccagaga

SEQ ID NO: 1267379 - RNA, 22 nt, Human
gcuggagugcaguggcuauuca

SEQ ID NO: 1267380 - RNA, 24 nt, Human
ggacuacaggcauaugccaccaug

SEQ ID NO: 1267381 - RNA, 23 nt, Human
ggagucuugcuauguugcccagg

SEQ ID NO: 1267382 - RNA, 22 nt, Human
ggcccgcugagcagcauccagg

SEQ ID NO: 1267383 - RNA, 22 nt, Human
gucccuggaucugggcucuugg

SEQ ID NO: 1267384 - RNA, 21 nt, Human
uacagcuccaccucauucuuu

SEQ ID NO: 1267385 - RNA, 22 nt, Human
uacaggcauaugccaccaugcc

SEQ ID NO: 1267386 - RNA, 24 nt, Human
uagaaccucacaaugaauauccuc

SEQ ID NO: 1267387 - RNA, 22 nt, Human
uagagauggagucuugcuaugu

SEQ ID NO: 1267388 - RNA, 23 nt, Human
uauguugcccaggcuggagugca

SEQ ID NO: 1267389 - RNA, 25 nt, Human
uauucacaugcacaaucauagugca

SEQ ID NO: 1267390 - RNA, 18 nt, Human
uauuuuuuuacuuagaga

SEQ ID NO: 1267391 - RNA, 22 nt, Human
uccauacugacauacauuuagu

SEQ ID NO: 1267392 - RNA, 24 nt, Human
ucccaaguaacugggacuacaggc

SEQ ID NO: 1267393 - RNA, 19 nt, Human
ucccaggcaagggcugaga

SEQ ID NO: 1267394 - RNA, 19 nt, Human
uccccaaaugucagcgguc

SEQ ID NO: 1267395 - RNA, 18 nt, Human
uccugggcuuaagcaauc

SEQ ID NO: 1267396 - RNA, 20 nt, Human
uccugggcuuaagcaauccu

SEQ ID NO: 1267397 - RNA, 21 nt, Human
uccugggcuuaagcaauccug

SEQ ID NO: 1267398 - RNA, 23 nt, Human
ucuugcuauguugcccaggcugg

SEQ ID NO: 1267399 - RNA, 24 nt, Human
ucuugcuauguugcccaggcugga

SEQ ID NO: 1267400 - RNA, 18 nt, Human
ugcccaggcuggagugca

SEQ ID NO: 1267401 - RNA, 21 nt, Human
ugcccaggcuggagugcagug

SEQ ID NO: 1267402 - RNA, 22 nt, Human
ugcccaggcuggagugcagugg

SEQ ID NO: 1267403 - RNA, 25 nt, Human
ugcuauguugcccaggcuggagugc

SEQ ID NO: 1267404 - RNA, 24 nt, Human
uggagucuugcuauguugcccagg

SEQ ID NO: 1267405 - RNA, 21 nt, Human
ugggacuacaggcauaugcca

SEQ ID NO: 1267406 - RNA, 22 nt, Human
ugggacuacaggcauaugccac

SEQ ID NO: 1267407 - RNA, 24 nt, Human
ugggacuacaggcauaugccacca

SEQ ID NO: 1267408 - RNA, 24 nt, Human
ugucucagccucccaaguaacugg

SEQ ID NO: 1267409 - RNA, 21 nt, Human
ugucuccugaacuguucuccc

SEQ ID NO: 1267410 - RNA, 24 nt, Human
uucacuaguagaaccucacaauga

SEQ ID NO: 1267411 - RNA, 24 nt, Human
uugcccaggcuggagugcaguggc

SEQ ID NO: 1267412 - RNA, 24 nt, Human
uugcuauguugcccaggcuggagu

SEQ ID NO: 1267413 - RNA, 22 nt, Human
aaaacaaaacgagccauauuca

SEQ ID NO: 1267414 - RNA, 23 nt, Human
cccccggcugggcuccccggccu

SEQ ID NO: 1267415 - RNA, 21 nt, Human
ugaccagucgcucugcaagga

SEQ ID NO: 1267416 - RNA, 23 nt, Human
ugccagggacgucagucagccug

SEQ ID NO: 1267417 - RNA, 24 nt, Human
ugccagggacgucagucagccugg

SEQ ID NO: 1267418 - RNA, 19 nt, Human
uauaugguaugguauaaga

SEQ ID NO: 1267419 - RNA, 20 nt, Human
uaugguauaagacagugucc

SEQ ID NO: 1267420 - RNA, 23 nt, Human
aaaauaugcugccaggugccccc

SEQ ID NO: 1267421 - RNA, 20 nt, Human
aacccacaucagucaaaauu

SEQ ID NO: 1267422 - RNA, 19 nt, Human
aagagggcuguuggcugcc

SEQ ID NO: 1267423 - RNA, 18 nt, Human
aagcagggcccugcccug

SEQ ID NO: 1267424 - RNA, 23 nt, Human
aaggcucacuuccagaagugugc

SEQ ID NO: 1267425 - RNA, 23 nt, Human
acaccacgaagucagacauggga

SEQ ID NO: 1267426 - RNA, 22 nt, Human
acagcuucauacucagaguuca

SEQ ID NO: 1267427 - RNA, 18 nt, Human
accacagagcaggaagac

SEQ ID NO: 1267428 - RNA, 21 nt, Human
accccacaaaucccugaaagg

SEQ ID NO: 1267429 - RNA, 25 nt, Human
accggccccgccuccacgcuccccc

SEQ ID NO: 1267430 - RNA, 21 nt, Human
accucagaaagugcaaacaca

SEQ ID NO: 1267431 - RNA, 24 nt, Human
accucagaaagugcaaacacacug

SEQ ID NO: 1267432 - RNA, 23 nt, Human
acgaagucagacaugggaaaaug

SEQ ID NO: 1267433 - RNA, 22 nt, Human
agaaaacugacaacuccaugcu

SEQ ID NO: 1267434 - RNA, 22 nt, Human
agaggcaugggcagcaggccca

SEQ ID NO: 1267435 - RNA, 18 nt, Human
agcaggcagggcucacgu

SEQ ID NO: 1267436 - RNA, 18 nt, Human
aggaccagaggcaugggc

SEQ ID NO: 1267437 - RNA, 22 nt, Human
aggcagggcucacguugguuuu

SEQ ID NO: 1267438 - RNA, 26 nt, Human
aggcagggcucacguugguuuuggcu

SEQ ID NO: 1267439 - RNA, 20 nt, Human
agguacuagaacugaucacc

SEQ ID NO: 1267440 - RNA, 18 nt, Human
aguuuuaagccuuucuca

SEQ ID NO: 1267441 - RNA, 20 nt, Human
aucaauauacaaucuguacu

SEQ ID NO: 1267442 - RNA, 22 nt, Human
auccucacccaggcuuccccau

SEQ ID NO: 1267443 - RNA, 27 nt, Human
caaaaaaaacuuuguaagugccaaagg

SEQ ID NO: 1267444 - RNA, 22 nt, Human
caaaauggaccccaaccaguga

SEQ ID NO: 1267445 - RNA, 24 nt, Human
caaaccacagagcaggaagaccag

SEQ ID NO: 1267446 - RNA, 22 nt, Human
caaagcagggcccugcccuguu

SEQ ID NO: 1267447 - RNA, 20 nt, Human
cacagaaaauaugcugccag

SEQ ID NO: 1267448 - RNA, 22 nt, Human
cacagaaaauaugcugccaggu

SEQ ID NO: 1267449 - RNA, 18 nt, Human
caccacgaagucagacau

SEQ ID NO: 1267450 - RNA, 23 nt, Human
cagaagugugcggacgcgaccuc

SEQ ID NO: 1267451 - RNA, 20 nt, Human
cagcccaaaccacagagcag

SEQ ID NO: 1267452 - RNA, 19 nt, Human
cagcccagaaaacugacaa

SEQ ID NO: 1267453 - RNA, 26 nt, Human
cagccuuucccaaugucuucaggcuc

SEQ ID NO: 1267454 - RNA, 19 nt, Human
caggcucuuccaggagcuu

SEQ ID NO: 1267455 - RNA, 18 nt, Human
caggugcccccugccccu

SEQ ID NO: 1267456 - RNA, 19 nt, Human
caggugcccccugccccuc

SEQ ID NO: 1267457 - RNA, 18 nt, Human
caucagucaaaauuuaaa

SEQ ID NO: 1267458 - RNA, 18 nt, Human
ccaaaacugacguccugc

SEQ ID NO: 1267459 - RNA, 25 nt, Human
ccacagagcaggaagaccagacccc

SEQ ID NO: 1267460 - RNA, 20 nt, Human
ccaccagcccuccuauggag

SEQ ID NO: 1267461 - RNA, 22 nt, Human
ccaggaccagaggcaugggcag

SEQ ID NO: 1267462 - RNA, 23 nt, Human
ccauggucaguagggcccagggc

SEQ ID NO: 1267463 - RNA, 19 nt, Human
cccaaaccacagagcagga

SEQ ID NO: 1267464 - RNA, 23 nt, Human
cccagggcugccuccuccccagg

SEQ ID NO: 1267465 - RNA, 18 nt, Human
cccagguggagugggacu

SEQ ID NO: 1267466 - RNA, 21 nt, Human
ccccaugccaggcugcaccug

SEQ ID NO: 1267467 - RNA, 22 nt, Human
ccccaugccaggcugcaccugu

SEQ ID NO: 1267468 - RNA, 27 nt, Human
cccccugccccucccugaccccacaaa

SEQ ID NO: 1267469 - RNA, 19 nt, Human
ccccgccuccacgcucccc

SEQ ID NO: 1267470 - RNA, 22 nt, Human
ccccggagccgccaccggcccc

SEQ ID NO: 1267471 - RNA, 21 nt, Human
ccccugccccucccugacccc

SEQ ID NO: 1267472 - RNA, 21 nt, Human
cccggagccgccaccggcccc

SEQ ID NO: 1267473 - RNA, 19 nt, Human
cccucccuuaccuuauuuu

SEQ ID NO: 1267474 - RNA, 21 nt, Human
cccuccuauggagccucgcag

SEQ ID NO: 1267475 - RNA, 20 nt, Human
cccucuaaggcacuaacccc

SEQ ID NO: 1267476 - RNA, 20 nt, Human
ccuauggagccucgcagccc

SEQ ID NO: 1267477 - RNA, 22 nt, Human
ccucccagccaccagcccuccu

SEQ ID NO: 1267478 - RNA, 22 nt, Human
ccugagggcaggcgcccaggug

SEQ ID NO: 1267479 - RNA, 24 nt, Human
ccuggcccauccucacccaggcuu

SEQ ID NO: 1267480 - RNA, 23 nt, Human
ccuguccgcuacagcugggccca

SEQ ID NO: 1267481 - RNA, 22 nt, Human
cgaccucccagccaccagcccu

SEQ ID NO: 1267482 - RNA, 24 nt, Human
cgaccucccagccaccagcccucc

SEQ ID NO: 1267483 - RNA, 24 nt, Human
cgcgaccucccagccaccagcccu

SEQ ID NO: 1267484 - RNA, 20 nt, Human
cuaaccccgacgucagagac

SEQ ID NO: 1267485 - RNA, 18 nt, Human
cuccccucccccucccca

SEQ ID NO: 1267486 - RNA, 26 nt, Human
cuccugagggcaggcgcccaggugga

SEQ ID NO: 1267487 - RNA, 21 nt, Human
cucuaaaugucaccacccugg

SEQ ID NO: 1267488 - RNA, 20 nt, Human
cucuaaggcacuaaccccga

SEQ ID NO: 1267489 - RNA, 22 nt, Human
cucuccccucccccuccccaaa

SEQ ID NO: 1267490 - RNA, 21 nt, Human
cugcauuaugguacagcuuca

SEQ ID NO: 1267491 - RNA, 20 nt, Human
cugccaggugcccccugccc

SEQ ID NO: 1267492 - RNA, 18 nt, Human
cugggcccaaggaugcug

SEQ ID NO: 1267493 - RNA, 23 nt, Human
cuucauacucagaguucaucuca

SEQ ID NO: 1267494 - RNA, 20 nt, Human
gaagagggcuguuggcugcc

SEQ ID NO: 1267495 - RNA, 25 nt, Human
gauacucuccccucccccuccccaa

SEQ ID NO: 1267496 - RNA, 21 nt, Human
gcagcaggcccagggcugccu

SEQ ID NO: 1267497 - RNA, 20 nt, Human
gcccagggcugccuccuccc

SEQ ID NO: 1267498 - RNA, 23 nt, Human
gccuccagggacccagagaugag

SEQ ID NO: 1267499 - RNA, 21 nt, Human
gccuggcgaauuuucuguuuc

SEQ ID NO: 1267500 - RNA, 21 nt, Human
ggcucacaccacgaagucaga

SEQ ID NO: 1267501 - RNA, 21 nt, Human
ggcuggaaaggcguccgagca

SEQ ID NO: 1267502 - RNA, 25 nt, Human
gggaaugcagagagggaccgguacc

SEQ ID NO: 1267503 - RNA, 19 nt, Human
gugugucuuucagucacag

SEQ ID NO: 1267504 - RNA, 20 nt, Human
guuauuuaaaauaaacaaaa

SEQ ID NO: 1267505 - RNA, 22 nt, Human
uacaaucuguacuagcuagaac

SEQ ID NO: 1267506 - RNA, 22 nt, Human
uacagaaaccguucuaaggcug

SEQ ID NO: 1267507 - RNA, 19 nt, Human
uacucuccccucccccucc

SEQ ID NO: 1267508 - RNA, 26 nt, Human
uagaaccucagaaagugcaaacacac

SEQ ID NO: 1267509 - RNA, 27 nt, Human
uauuccugcuccacccaggaccagagg

SEQ ID NO: 1267510 - RNA, 22 nt, Human
ucaaauaccaaaacaucaaauc

SEQ ID NO: 1267511 - RNA, 21 nt, Human
ucaccgcagcccaaaccacag

SEQ ID NO: 1267512 - RNA, 22 nt, Human
ucaucucaaauaccaaaacauc

SEQ ID NO: 1267513 - RNA, 28 nt, Human
ucccagccaccagcccuccuauggagcc

SEQ ID NO: 1267514 - RNA, 25 nt, Human
ucccaugauacucuccccucccccu

SEQ ID NO: 1267515 - RNA, 18 nt, Human
uccccaaagcagggcccu

SEQ ID NO: 1267516 - RNA, 19 nt, Human
uccccaggcccagccuuuc

SEQ ID NO: 1267517 - RNA, 22 nt, Human
uccccaggcccagccuuuccca

SEQ ID NO: 1267518 - RNA, 19 nt, Human
uccccggagccgccaccgg

SEQ ID NO: 1267519 - RNA, 21 nt, Human
ucccugaaaggaaaaugaaaa

SEQ ID NO: 1267520 - RNA, 22 nt, Human
ucccugaccccacaaaucccug

SEQ ID NO: 1267521 - RNA, 22 nt, Human
uccugcuccacccaggaccaga

SEQ ID NO: 1267522 - RNA, 22 nt, Human
ucgcagcccaggcuccugaggg

SEQ ID NO: 1267523 - RNA, 20 nt, Human
ucuccccucccccuccccaa

SEQ ID NO: 1267524 - RNA, 21 nt, Human
ugagggcaggcgcccaggugg

SEQ ID NO: 1267525 - RNA, 24 nt, Human
ugcuccucuagcuggguguagaaa

SEQ ID NO: 1267526 - RNA, 21 nt, Human
ugcugccaggugcccccugcc

SEQ ID NO: 1267527 - RNA, 26 nt, Human
uggagaagacaacggacggcgucgac

SEQ ID NO: 1267528 - RNA, 19 nt, Human
uggauaccaucucccauga

SEQ ID NO: 1267529 - RNA, 18 nt, Human
uggauguguacagaaacc

SEQ ID NO: 1267530 - RNA, 19 nt, Human
uggccuggcgaauuuucug

SEQ ID NO: 1267531 - RNA, 18 nt, Human
ugggaaugcagagaggga

SEQ ID NO: 1267532 - RNA, 21 nt, Human
ugggacucaccgcagcccaaa

SEQ ID NO: 1267533 - RNA, 18 nt, Human
uguagaaaacaccucuca

SEQ ID NO: 1267534 - RNA, 21 nt, Human
ugucaccacccuggagucggc

SEQ ID NO: 1267535 - RNA, 21 nt, Human
uucauacucagaguucaucuc

SEQ ID NO: 1267536 - RNA, 23 nt, Human
uugaagcaaguauguccaguccu

SEQ ID NO: 1267537 - RNA, 22 nt, Human
uugucacagaaaauaugcugcc

SEQ ID NO: 1267538 - RNA, 18 nt, Human
uuuccuccuuucuaaaau

SEQ ID NO: 1267539 - RNA, 24 nt, Human
uuucuaaaauguaguugaagaaug

SEQ ID NO: 1267540 - RNA, 21 nt, Human
acaggagagacagcaccuaaa

SEQ ID NO: 1267541 - RNA, 21 nt, Human
gagacagcaccuaaaacaaaa

SEQ ID NO: 1267542 - RNA, 24 nt, Human
acauucuaucucgucacagacuga

SEQ ID NO: 1267543 - RNA, 30 nt, Human
augcuucuugaguucggagauuuguucucc

SEQ ID NO: 1267544 - RNA, 23 nt, Human
caaugaauuuuuuccugaagagu

SEQ ID NO: 1267545 - RNA, 23 nt, Human
cugaauggcuuucaguuuccuuc

SEQ ID NO: 1267546 - RNA, 26 nt, Human
uaagagcaagcagacgcucucaguca

SEQ ID NO: 1267547 - RNA, 19 nt, Human
uaaggcuaaaauaagagca

SEQ ID NO: 1267548 - RNA, 21 nt, Human
ucauucucuaaggccuucuua

SEQ ID NO: 1267549 - RNA, 19 nt, Human
ucggagauuuguucuccuu

SEQ ID NO: 1267550 - RNA, 19 nt, Human
ucugcuuuaucagcuccug

SEQ ID NO: 1267551 - RNA, 22 nt, Human
ucuucagcuuguguucucucca

SEQ ID NO: 1267552 - RNA, 24 nt, Human
ugacuaaacacucuaguucacauu

SEQ ID NO: 1267553 - RNA, 20 nt, Human
ugaugugcuagauuucucuc

SEQ ID NO: 1267554 - RNA, 25 nt, Human
uguuucauucucuaaggccuucuua

SEQ ID NO: 1267555 - RNA, 21 nt, Human
uuguuucauucucuaaggccu

SEQ ID NO: 1267556 - RNA, 20 nt, Human
uuuaucagcuccugaugugc

SEQ ID NO: 1267557 - RNA, 21 nt, Human
uuucuugacuaaacacucuag

SEQ ID NO: 1267558 - RNA, 24 nt, Human
uuuucugcuuuaucagcuccugau

SEQ ID NO: 1267559 - RNA, 24 nt, Human
uuuuuucugcuuuaucagcuccug

SEQ ID NO: 1267560 - RNA, 21 nt, Human
aaagcaucccccucagcauca

SEQ ID NO: 1267561 - RNA, 21 nt, Human
aaauguugacaauggugaacu

SEQ ID NO: 1267562 - RNA, 19 nt, Human
aaggcaacauccucucucc

SEQ ID NO: 1267563 - RNA, 25 nt, Human
acgcaacuaaaaugagguugggggc

SEQ ID NO: 1267564 - RNA, 23 nt, Human
agcuggaagcguggggagcaccg

SEQ ID NO: 1267565 - RNA, 22 nt, Human
aggcugacuucagugcugaugu

SEQ ID NO: 1267566 - RNA, 19 nt, Human
agguggccaguaaggcuga

SEQ ID NO: 1267567 - RNA, 18 nt, Human
cacaguacacaggaggca

SEQ ID NO: 1267568 - RNA, 19 nt, Human
cacuucacugcgggagacg

SEQ ID NO: 1267569 - RNA, 23 nt, Human
caucauacugagcaggugucuuc

SEQ ID NO: 1267570 - RNA, 22 nt, Human
cauguccacuucacugcgggag

SEQ ID NO: 1267571 - RNA, 22 nt, Human
ccacuucacugcgggagacgau

SEQ ID NO: 1267572 - RNA, 19 nt, Human
cccuccaagcugagcuugc

SEQ ID NO: 1267573 - RNA, 19 nt, Human
cuaaaaugagguugggggc

SEQ ID NO: 1267574 - RNA, 23 nt, Human
cucugcuaggcaaaggcaacauc

SEQ ID NO: 1267575 - RNA, 19 nt, Human
cugaaugcacuggaccagg

SEQ ID NO: 1267576 - RNA, 27 nt, Human
cugaugguccuuucaauguucaaagca

SEQ ID NO: 1267577 - RNA, 23 nt, Human
cuuugugguccuucucugcuagg

SEQ ID NO: 1267578 - RNA, 26 nt, Human
gaagcuuuuagcucagaagcaucaua

SEQ ID NO: 1267579 - RNA, 23 nt, Human
gcaaaauacaggggcuuguucug

SEQ ID NO: 1267580 - RNA, 22 nt, Human
gcuuguucugaaugcacuggac

SEQ ID NO: 1267581 - RNA, 20 nt, Human
gggacuguuagccacaagcu

SEQ ID NO: 1267582 - RNA, 24 nt, Human
gggcuuguucugaaugcacuggac

SEQ ID NO: 1267583 - RNA, 24 nt, Human
ggguagucguucuuagugucuugc

SEQ ID NO: 1267584 - RNA, 18 nt, Human
ggguguagagugaugacc

SEQ ID NO: 1267585 - RNA, 18 nt, Human
guaaauaguauacauuuu

SEQ ID NO: 1267586 - RNA, 19 nt, Human
uagagugaugacccuccaa

SEQ ID NO: 1267587 - RNA, 26 nt, Human
ucaaagcaucccccucagcaucaaag

SEQ ID NO: 1267588 - RNA, 18 nt, Human
ucagaagcaucauacuga

SEQ ID NO: 1267589 - RNA, 18 nt, Human
ucagcaaaauacaggggc

SEQ ID NO: 1267590 - RNA, 23 nt, Human
ucagugcugauguaaguuccuuu

SEQ ID NO: 1267591 - RNA, 25 nt, Human
ucuccagguggccaguaaggcugac

SEQ ID NO: 1267592 - RNA, 18 nt, Human
ucucugcuaggcaaaggc

SEQ ID NO: 1267593 - RNA, 23 nt, Human
ucucuugaauucagaccuaauuu

SEQ ID NO: 1267594 - RNA, 23 nt, Human
ucuggaagcucaagcuauguugg

SEQ ID NO: 1267595 - RNA, 22 nt, Human
ugcuggauguaauaguacgggg

SEQ ID NO: 1267596 - RNA, 21 nt, Human
ugcuuuuuggguagucguucu

SEQ ID NO: 1267597 - RNA, 25 nt, Human
uggaagcucaagcuauguugggcuu

SEQ ID NO: 1267598 - RNA, 23 nt, Human
uggccaguaaggcugacuucagu

SEQ ID NO: 1267599 - RNA, 19 nt, Human
uguaaguuccuuugugguc

SEQ ID NO: 1267600 - RNA, 18 nt, Human
uuagcuggaagcgugggg

SEQ ID NO: 1267601 - RNA, 21 nt, Human
uucaaagcaucccccucagca

SEQ ID NO: 1267602 - RNA, 18 nt, Human
uucuagaccuguuagcug

SEQ ID NO: 1267603 - RNA, 18 nt, Human
uuggaauguacauuucuu

SEQ ID NO: 1267604 - RNA, 22 nt, Human
uuucuugaugcucucucuugau

SEQ ID NO: 1267605 - RNA, 30 nt, Human
aaaaaggcuccuuucaaguauacuguggaa

SEQ ID NO: 1267606 - RNA, 21 nt, Human
aacacaguacaucacaaaggc

SEQ ID NO: 1267607 - RNA, 24 nt, Human
aacccacaggaaaagagaggaaag

SEQ ID NO: 1267608 - RNA, 23 nt, Human
aaguuugggaggccgaggcagga

SEQ ID NO: 1267609 - RNA, 24 nt, Human
aaucgcucgaacccgggaggcaga

SEQ ID NO: 1267610 - RNA, 20 nt, Human
acacaaaaggagguaaacac

SEQ ID NO: 1267611 - RNA, 20 nt, Human
acagagcaagacuccgucuc

SEQ ID NO: 1267612 - RNA, 24 nt, Human
acagagcaagacuccgucucaaaa

SEQ ID NO: 1267613 - RNA, 20 nt, Human
acagaguaauaaauaauuuc

SEQ ID NO: 1267614 - RNA, 28 nt, Human
acuccgucucaaaaaaaaaaaaaaaaaa

SEQ ID NO: 1267615 - RNA, 23 nt, Human
acugcacuccagccuggugacag

SEQ ID NO: 1267616 - RNA, 25 nt, Human
acugcacuccagccuggugacagag

SEQ ID NO: 1267617 - RNA, 24 nt, Human
agacaaggacaguguaacaguuau

SEQ ID NO: 1267618 - RNA, 23 nt, Human
agacaauguaugcauuauaccaa

SEQ ID NO: 1267619 - RNA, 23 nt, Human
agagguuguagugagccgagauc

SEQ ID NO: 1267620 - RNA, 24 nt, Human
agagguuguagugagccgagaucg

SEQ ID NO: 1267621 - RNA, 20 nt, Human
agcagcacaugucaaugcca

SEQ ID NO: 1267622 - RNA, 21 nt, Human
agccuggugacagagcaagac

SEQ ID NO: 1267623 - RNA, 23 nt, Human
agccuggugacagagcaagacuc

SEQ ID NO: 1267624 - RNA, 20 nt, Human
agccuuaagaauucaauaac

SEQ ID NO: 1267625 - RNA, 21 nt, Human
aggcagagguuguagugagcc

SEQ ID NO: 1267626 - RNA, 24 nt, Human
aggcagagguuguagugagccgag

SEQ ID NO: 1267627 - RNA, 18 nt, Human
aggcaggagaaucgcucg

SEQ ID NO: 1267628 - RNA, 24 nt, Human
aggcaggagaaucgcucgaacccg

SEQ ID NO: 1267629 - RNA, 20 nt, Human
aggccgaggcaggagaaucg

SEQ ID NO: 1267630 - RNA, 20 nt, Human
aucacuaaaaccaccaaaaa

SEQ ID NO: 1267631 - RNA, 24 nt, Human
aucgcgccacugcacuccagccug

SEQ ID NO: 1267632 - RNA, 23 nt, Human
augaaacccacaggaaaagagau

SEQ ID NO: 1267633 - RNA, 20 nt, Human
augaagaaugugaaauaauc

SEQ ID NO: 1267634 - RNA, 22 nt, Human
augucagaauacggcaaaaaca

SEQ ID NO: 1267635 - RNA, 21 nt, Human
caagacuccgucucaaaaaaa

SEQ ID NO: 1267636 - RNA, 20 nt, Human
caaguaaauuaccugaacaa

SEQ ID NO: 1267637 - RNA, 25 nt, Human
caauaaagauagcaucaguaaaaca

SEQ ID NO: 1267638 - RNA, 24 nt, Human
cacgccuguaaucccagaaguuug

SEQ ID NO: 1267639 - RNA, 22 nt, Human
cacuccagccuggugacagagc

SEQ ID NO: 1267640 - RNA, 18 nt, Human
cacugcacuccagccugg

SEQ ID NO: 1267641 - RNA, 20 nt, Human
cacugcacuccagccuggug

SEQ ID NO: 1267642 - RNA, 22 nt, Human
cacugcacuccagccuggugac

SEQ ID NO: 1267643 - RNA, 23 nt, Human
cacugcacuccagccuggugaca

SEQ ID NO: 1267644 - RNA, 24 nt, Human
cacugcacuccagccuggugacag

SEQ ID NO: 1267645 - RNA, 20 nt, Human
cacugcugaaucugaggccu

SEQ ID NO: 1267646 - RNA, 24 nt, Human
cagaaguuugggaggccgaggcag

SEQ ID NO: 1267647 - RNA, 21 nt, Human
cagaauacggcaaaaacaaua

SEQ ID NO: 1267648 - RNA, 24 nt, Human
cagauacaacacaaaaggagguaa

SEQ ID NO: 1267649 - RNA, 20 nt, Human
cagaucaaagaccucucgaa

SEQ ID NO: 1267650 - RNA, 18 nt, Human
ccacugcacuccagccug

SEQ ID NO: 1267651 - RNA, 19 nt, Human
ccacugcacuccagccugg

SEQ ID NO: 1267652 - RNA, 19 nt, Human
ccacugcacuccagccugg

SEQ ID NO: 1267653 - RNA, 23 nt, Human
ccacugcacuccagccuggugac

SEQ ID NO: 1267654 - RNA, 21 nt, Human
ccagauacaacacaaaaggag

SEQ ID NO: 1267655 - RNA, 21 nt, Human
ccuggugacagagcaagacuc

SEQ ID NO: 1267656 - RNA, 22 nt, Human
ccuguaaucccagaaguuuggg

SEQ ID NO: 1267657 - RNA, 24 nt, Human
cgagaucgcgccacugcacuccag

SEQ ID NO: 1267658 - RNA, 24 nt, Human
cgaggcaggagaaucgcucgaacc

SEQ ID NO: 1267659 - RNA, 25 nt, Human
cgccacugcacuccagccuggugac

SEQ ID NO: 1267660 - RNA, 24 nt, Human
cgggaggcagagguuguagugagc

SEQ ID NO: 1267661 - RNA, 24 nt, Human
cguccggggcgggugggcgcaggg

SEQ ID NO: 1267662 - RNA, 20 nt, Human
cuagucaggaauaaaagugc

SEQ ID NO: 1267663 - RNA, 19 nt, Human
cucacgccuguaaucccag

SEQ ID NO: 1267664 - RNA, 19 nt, Human
cucacgccuguaaucccag

SEQ ID NO: 1267665 - RNA, 19 nt, Human
cuccgucucaaaaaaaaaa

SEQ ID NO: 1267666 - RNA, 25 nt, Human
cugaucacuaaaaccaccaaaaaua

SEQ ID NO: 1267667 - RNA, 18 nt, Human
cuuaagaauucaauaacu

SEQ ID NO: 1267668 - RNA, 19 nt, Human
cuuugauaaagaauuuuga

SEQ ID NO: 1267669 - RNA, 23 nt, Human
gacaaacaaauagaacagucaag

SEQ ID NO: 1267670 - RNA, 24 nt, Human
gacagagcaagacuccgucucaaa

SEQ ID NO: 1267671 - RNA, 23 nt, Human
gcacuccagccuggugacagagc

SEQ ID NO: 1267672 - RNA, 20 nt, Human
gccgagaucgcgccacugca

SEQ ID NO: 1267673 - RNA, 23 nt, Human
ggaaagacaaggacaguguaagg

SEQ ID NO: 1267674 - RNA, 27 nt, Human
ggccgaggcaggagaaucgcucgaacc

SEQ ID NO: 1267675 - RNA, 21 nt, Human
ggcucacgccuguaaucccag

SEQ ID NO: 1267676 - RNA, 20 nt, Human
ggcugagaaaaauuauauga

SEQ ID NO: 1267677 - RNA, 21 nt, Human
ggcugggugcgguggcucacg

SEQ ID NO: 1267678 - RNA, 21 nt, Human
gggcuugggccccacguccgg

SEQ ID NO: 1267679 - RNA, 24 nt, Human
gggugcgguggcucacgccuguaa

SEQ ID NO: 1267680 - RNA, 23 nt, Human
gguggcucacgccuguaauccca

SEQ ID NO: 1267681 - RNA, 24 nt, Human
gguggcucacgccuguaaucccag

SEQ ID NO: 1267682 - RNA, 22 nt, Human
gguggcugggugcgguggcuca

SEQ ID NO: 1267683 - RNA, 20 nt, Human
gucacugcugaaucugaggc

SEQ ID NO: 1267684 - RNA, 21 nt, Human
guggcugggugcgguggcuca

SEQ ID NO: 1267685 - RNA, 20 nt, Human
guucuuggccaauacucuga

SEQ ID NO: 1267686 - RNA, 19 nt, Human
guuguagugagccgagauc

SEQ ID NO: 1267687 - RNA, 21 nt, Human
guuguagugagccgagaucgc

SEQ ID NO: 1267688 - RNA, 22 nt, Human
uaaaauggugcaaaucagcucc

SEQ ID NO: 1267689 - RNA, 18 nt, Human
uaaaccccaucacugcca

SEQ ID NO: 1267690 - RNA, 24 nt, Human
uaaaccccaucacugccacaauuu

SEQ ID NO: 1267691 - RNA, 22 nt, Human
uaaugcauaguuaucaguucaa

SEQ ID NO: 1267692 - RNA, 19 nt, Human
uaauuaccagauacaacac

SEQ ID NO: 1267693 - RNA, 21 nt, Human
uacaacacaaaaggagguaaa

SEQ ID NO: 1267694 - RNA, 19 nt, Human
uaccucuuugagacuaucu

SEQ ID NO: 1267695 - RNA, 28 nt, Human
uagaacagucaaguaaauuaccugaaca

SEQ ID NO: 1267696 - RNA, 19 nt, Human
uagcaucaguaaaacaguu

SEQ ID NO: 1267697 - RNA, 18 nt, Human
uaggcaacuucagaugau

SEQ ID NO: 1267698 - RNA, 18 nt, Human
uauaugaagaaugugaaa

SEQ ID NO: 1267699 - RNA, 22 nt, Human
ucaaaaaaaaaaaaaaaaaaaa

SEQ ID NO: 1267700 - RNA, 19 nt, Human
ucagaauacggcaaaaaca

SEQ ID NO: 1267701 - RNA, 25 nt, Human
ucccagaaguuugggaggccgaggc

SEQ ID NO: 1267702 - RNA, 23 nt, Human
uccgucucaaaaaaaaaaaaaaa

SEQ ID NO: 1267703 - RNA, 21 nt, Human
uccugaaccguaaaaaggcuc

SEQ ID NO: 1267704 - RNA, 24 nt, Human
uccugaaccguaaaaaggcuccuu

SEQ ID NO: 1267705 - RNA, 20 nt, Human
uccuuucaaguauacugugg

SEQ ID NO: 1267706 - RNA, 22 nt, Human
ucuauuucacaaaagcuaccau

SEQ ID NO: 1267707 - RNA, 23 nt, Human
ucucgaaucucucucaucauuuu

SEQ ID NO: 1267708 - RNA, 19 nt, Human
ucucucucaucauuuuauc

SEQ ID NO: 1267709 - RNA, 20 nt, Human
ucugucuugggauauuugac

SEQ ID NO: 1267710 - RNA, 20 nt, Human
ucuuugagacuaucuuugau

SEQ ID NO: 1267711 - RNA, 22 nt, Human
ugagccgagaucgcgccacugc

SEQ ID NO: 1267712 - RNA, 20 nt, Human
ugagucuagaaguacagagu

SEQ ID NO: 1267713 - RNA, 26 nt, Human
ugaguuagaagggaucuaagugcuaa

SEQ ID NO: 1267714 - RNA, 19 nt, Human
ugauaaagaauuuugaguc

SEQ ID NO: 1267715 - RNA, 27 nt, Human
uggacaaacaaauagaacagucaagua

SEQ ID NO: 1267716 - RNA, 21 nt, Human
uggcucacgccuguaauccca

SEQ ID NO: 1267717 - RNA, 22 nt, Human
uggcucacgccuguaaucccag

SEQ ID NO: 1267718 - RNA, 23 nt, Human
uggcugggugcgguggcucacgc

SEQ ID NO: 1267719 - RNA, 19 nt, Human
ugggaggccgaggcaggag

SEQ ID NO: 1267720 - RNA, 20 nt, Human
ugggaggccgaggcaggaga

SEQ ID NO: 1267721 - RNA, 22 nt, Human
uguugaugaauuugaaaacgga

SEQ ID NO: 1267722 - RNA, 22 nt, Human
uuaacaaaugaaacccacagga

SEQ ID NO: 1267723 - RNA, 18 nt, Human
uuaccagcuggcuucauu

SEQ ID NO: 1267724 - RNA, 21 nt, Human
uuagaauucauagaaauuugg

SEQ ID NO: 1267725 - RNA, 19 nt, Human
uuaggguaaaguagauaga

SEQ ID NO: 1267726 - RNA, 22 nt, Human
uuauguccuuguuaugucacug

SEQ ID NO: 1267727 - RNA, 24 nt, Human
uugggaggccgaggcaggagaauc

SEQ ID NO: 1267728 - RNA, 18 nt, Human
uuguagugagccgagauc

SEQ ID NO: 1267729 - RNA, 19 nt, Human
uuguagugagccgagaucg

SEQ ID NO: 1267730 - RNA, 22 nt, Human
uuguagugagccgagaucgcgc

SEQ ID NO: 1267731 - RNA, 23 nt, Human
uuucaaaaacuuucagcugaugg

SEQ ID NO: 1267732 - RNA, 21 nt, Human
uuucaucuuauaucucaggca

SEQ ID NO: 1267733 - RNA, 29 nt, Human
uacuaugaaauuuuacauacaugauggaa

SEQ ID NO: 1267734 - RNA, 19 nt, Human
aaccuaaaaauaucaaacu

SEQ ID NO: 1267735 - RNA, 22 nt, Human
aagguuaaguaaucccaguuca

SEQ ID NO: 1267736 - RNA, 18 nt, Human
agcugcugccgcugcaag

SEQ ID NO: 1267737 - RNA, 18 nt, Human
aggacuccuacaaucauu

SEQ ID NO: 1267738 - RNA, 18 nt, Human
augaagcuuaaagucagu

SEQ ID NO: 1267739 - RNA, 20 nt, Human
augaagucagaguuugagga

SEQ ID NO: 1267740 - RNA, 19 nt, Human
caaaacagcuauauagugc

SEQ ID NO: 1267741 - RNA, 18 nt, Human
caacaaccuaaaaauauc

SEQ ID NO: 1267742 - RNA, 22 nt, Human
caacaauauagcauagaauuuu

SEQ ID NO: 1267743 - RNA, 22 nt, Human
cacuuuaacaaaagcaagccaa

SEQ ID NO: 1267744 - RNA, 22 nt, Human
cauauacacuauaauacaaaac

SEQ ID NO: 1267745 - RNA, 18 nt, Human
ccaaaaauaaauacauca

SEQ ID NO: 1267746 - RNA, 25 nt, Human
ccuacaaucauuucugaagguuguu

SEQ ID NO: 1267747 - RNA, 23 nt, Human
cuugccuacuaaaccuucacuuu

SEQ ID NO: 1267748 - RNA, 19 nt, Human
uaaguaaucccaguucaac

SEQ ID NO: 1267749 - RNA, 20 nt, Human
uacaaaacagcuauauagug

SEQ ID NO: 1267750 - RNA, 22 nt, Human
uacaccuuuugaaaauguuuaa

SEQ ID NO: 1267751 - RNA, 20 nt, Human
uauauauguauauauuuaca

SEQ ID NO: 1267752 - RNA, 19 nt, Human
uaucaccguaaauauuuga

SEQ ID NO: 1267753 - RNA, 22 nt, Human
uaucuugccuacuaaaccuuca

SEQ ID NO: 1267754 - RNA, 21 nt, Human
ucaaagguggaggcuuugaaa

SEQ ID NO: 1267755 - RNA, 24 nt, Human
ucagaguuugaggauuagcugcug

SEQ ID NO: 1267756 - RNA, 19 nt, Human
ugaagcuuaaagucagugu

SEQ ID NO: 1267757 - RNA, 21 nt, Human
ugacauaugcuauacugcugu

SEQ ID NO: 1267758 - RNA, 22 nt, Human
ugaccacacuauuagacaaugu

SEQ ID NO: 1267759 - RNA, 20 nt, Human
ugagaugcaaucugaugugg

SEQ ID NO: 1267760 - RNA, 21 nt, Human
ugcuauacugcugugguguca

SEQ ID NO: 1267761 - RNA, 20 nt, Human
uggaggcuuugaaagagaug

SEQ ID NO: 1267762 - RNA, 25 nt, Human
uggaggcuuugaaagagauguuaua

SEQ ID NO: 1267763 - RNA, 20 nt, Human
uguauauauguauauauuua

SEQ ID NO: 1267764 - RNA, 27 nt, Human
uguccuauucucacaguaacugucuca

SEQ ID NO: 1267765 - RNA, 21 nt, Human
uucaacuuuaauguacaaagc

SEQ ID NO: 1267766 - RNA, 24 nt, Human
uucauugaccacacuauuagacaa

SEQ ID NO: 1267767 - RNA, 23 nt, Human
uucccagaugcaggcaauagcug

SEQ ID NO: 1267768 - RNA, 23 nt, Human
uuggauggguaugaucuuggugg

SEQ ID NO: 1267769 - RNA, 23 nt, Human
uuuacacuugaucaacaauauag

SEQ ID NO: 1267770 - RNA, 20 nt, Human
uuucugauuaugacaugacu

SEQ ID NO: 1267771 - RNA, 24 nt, Human
uuuucugauuaugacaugacugcu

SEQ ID NO: 1267772 - RNA, 20 nt, Human
aaagcacaagagcgccucuc

SEQ ID NO: 1267773 - RNA, 19 nt, Human
aaagcgcugggauuacagg

SEQ ID NO: 1267774 - RNA, 24 nt, Human
aaagcgcugggauuacaggcguga

SEQ ID NO: 1267775 - RNA, 18 nt, Human
aacacagcaaaccccguc

SEQ ID NO: 1267776 - RNA, 19 nt, Human
aacacagcaaaccccgucu

SEQ ID NO: 1267777 - RNA, 20 nt, Human
aacacagcaaaccccgucuc

SEQ ID NO: 1267778 - RNA, 19 nt, Human
aaccaacaggacuucccau

SEQ ID NO: 1267779 - RNA, 22 nt, Human
aaccccgucucuccucaagggc

SEQ ID NO: 1267780 - RNA, 20 nt, Human
aagaaaacaaaucauaccaa

SEQ ID NO: 1267781 - RNA, 20 nt, Human
aagcaaccgccuaguucucc

SEQ ID NO: 1267782 - RNA, 21 nt, Human
aagcauggccaagaacugacc

SEQ ID NO: 1267783 - RNA, 23 nt, Human
aagcgcagugcaaagacaaccuc

SEQ ID NO: 1267784 - RNA, 19 nt, Human
aagcgcugggauuacaggc

SEQ ID NO: 1267785 - RNA, 26 nt, Human
aagcgcugggauuacaggcgugagcc

SEQ ID NO: 1267786 - RNA, 19 nt, Human
aagcugcuggccuguuggu

SEQ ID NO: 1267787 - RNA, 24 nt, Human
aaggaaaaggcaaaguucgcagag

SEQ ID NO: 1267788 - RNA, 21 nt, Human
aagggcuuugguggucauuga

SEQ ID NO: 1267789 - RNA, 23 nt, Human
aagugaggaaaagagaauccacu

SEQ ID NO: 1267790 - RNA, 20 nt, Human
aaugaauagaaacuccuccu

SEQ ID NO: 1267791 - RNA, 22 nt, Human
acaaagaugacucaaccaacag

SEQ ID NO: 1267792 - RNA, 18 nt, Human
acaggguuucaccauguu

SEQ ID NO: 1267793 - RNA, 21 nt, Human
acaggguuucaccauguuggc

SEQ ID NO: 1267794 - RNA, 24 nt, Human
acaggguuucaccauguuggccag

SEQ ID NO: 1267795 - RNA, 24 nt, Human
acaguguuuggucuggaauguguu

SEQ ID NO: 1267796 - RNA, 18 nt, Human
accauguuggccagaaug

SEQ ID NO: 1267797 - RNA, 24 nt, Human
accauguuggccagaauggucuug

SEQ ID NO: 1267798 - RNA, 19 nt, Human
acccaggcuggagugcagu

SEQ ID NO: 1267799 - RNA, 18 nt, Human
accugcaccacggcucac

SEQ ID NO: 1267800 - RNA, 24 nt, Human
accugccgggacacccccgugggc

SEQ ID NO: 1267801 - RNA, 23 nt, Human
accuugugaucugcccgccucgc

SEQ ID NO: 1267802 - RNA, 23 nt, Human
acuccaggccacuacuucaacau

SEQ ID NO: 1267803 - RNA, 24 nt, Human
acuuccaccuucagcccuagagca

SEQ ID NO: 1267804 - RNA, 19 nt, Human
agaaacuccuccuauugcc

SEQ ID NO: 1267805 - RNA, 21 nt, Human
agacagcugcccagacucccu

SEQ ID NO: 1267806 - RNA, 19 nt, Human
agagcucucucaaaagcac

SEQ ID NO: 1267807 - RNA, 19 nt, Human
agaggcagacagcugccca

SEQ ID NO: 1267808 - RNA, 21 nt, Human
agaggcagacagcugcccaga

SEQ ID NO: 1267809 - RNA, 18 nt, Human
agaugcuagaagugaccu

SEQ ID NO: 1267810 - RNA, 24 nt, Human
agcgauucuccugccucagccucc

SEQ ID NO: 1267811 - RNA, 18 nt, Human
agcgcugggauuacaggc

SEQ ID NO: 1267812 - RNA, 21 nt, Human
aggaaaagagaauccacuugc

SEQ ID NO: 1267813 - RNA, 18 nt, Human
aggaaaaggcaaaguucg

SEQ ID NO: 1267814 - RNA, 18 nt, Human
aggaacuggugaaaauca

SEQ ID NO: 1267815 - RNA, 25 nt, Human
aggaccuucaauuaauuugccagaa

SEQ ID NO: 1267816 - RNA, 21 nt, Human
aggcaaaguucgcagagugug

SEQ ID NO: 1267817 - RNA, 20 nt, Human
aggcacgcaccaccaugccc

SEQ ID NO: 1267818 - RNA, 21 nt, Human
aggcagggguaggaggaacug

SEQ ID NO: 1267819 - RNA, 23 nt, Human
aggcagggguaggaggaacuggu

SEQ ID NO: 1267820 - RNA, 26 nt, Human
aggcauuggaugggccugagagcuga

SEQ ID NO: 1267821 - RNA, 20 nt, Human
aggccaagcauggccaagaa

SEQ ID NO: 1267822 - RNA, 25 nt, Human
aggcuggagugcaguggcacgaucu

SEQ ID NO: 1267823 - RNA, 27 nt, Human
agggagaggugaggggccacgaugcuu

SEQ ID NO: 1267824 - RNA, 21 nt, Human
agguguagaagugacaaagaa

SEQ ID NO: 1267825 - RNA, 18 nt, Human
aguagcugggauuacagg

SEQ ID NO: 1267826 - RNA, 20 nt, Human
agugcaguggcacgaucucg

SEQ ID NO: 1267827 - RNA, 23 nt, Human
agugcaguggcacgaucucggcu

SEQ ID NO: 1267828 - RNA, 24 nt, Human
agugcaguggcacgaucucggcuc

SEQ ID NO: 1267829 - RNA, 18 nt, Human
augaaacgcagcuuuccc

SEQ ID NO: 1267830 - RNA, 24 nt, Human
caaagcgcugggauuacaggcgug

SEQ ID NO: 1267831 - RNA, 18 nt, Human
caacaggacuucccauga

SEQ ID NO: 1267832 - RNA, 20 nt, Human
caacauugaauacuccaagu

SEQ ID NO: 1267833 - RNA, 19 nt, Human
caagcauggccaagaacug

SEQ ID NO: 1267834 - RNA, 20 nt, Human
caagcgauucuccugccuca

SEQ ID NO: 1267835 - RNA, 22 nt, Human
caagcgauucuccugccucagc

SEQ ID NO: 1267836 - RNA, 23 nt, Human
caagcugcuggccuguuggugcc

SEQ ID NO: 1267837 - RNA, 22 nt, Human
cacacagcacaaagggcuauuc

SEQ ID NO: 1267838 - RNA, 23 nt, Human
cacagcaaaccccgucucuccuc

SEQ ID NO: 1267839 - RNA, 22 nt, Human
caccaccaugcccagcuaauuu

SEQ ID NO: 1267840 - RNA, 24 nt, Human
caccaugcccagcuaauuuuugua

SEQ ID NO: 1267841 - RNA, 22 nt, Human
caccauguuggccagaaugguc

SEQ ID NO: 1267842 - RNA, 23 nt, Human
caccauguuggccagaauggucu

SEQ ID NO: 1267843 - RNA, 24 nt, Human
caccauguuggccagaauggucuu

SEQ ID NO: 1267844 - RNA, 23 nt, Human
cacgcaccaccaugcccagcuaa

SEQ ID NO: 1267845 - RNA, 21 nt, Human
cacugcaaccucugccucccg

SEQ ID NO: 1267846 - RNA, 23 nt, Human
cacugcaaccucugccucccggg

SEQ ID NO: 1267847 - RNA, 19 nt, Human
cacugugcacugccagagc

SEQ ID NO: 1267848 - RNA, 19 nt, Human
cagaggcagggguaggagg

SEQ ID NO: 1267849 - RNA, 18 nt, Human
cagccuucuauuacuuug

SEQ ID NO: 1267850 - RNA, 23 nt, Human
cagcguuacugggucgugaugac

SEQ ID NO: 1267851 - RNA, 24 nt, Human
caggaauggcacuugaagccaccu

SEQ ID NO: 1267852 - RNA, 22 nt, Human
caggggagaggaucaauccacu

SEQ ID NO: 1267853 - RNA, 23 nt, Human
caggguuucaccauguuggccag

SEQ ID NO: 1267854 - RNA, 22 nt, Human
caguguuuggucuggaaugugu

SEQ ID NO: 1267855 - RNA, 22 nt, Human
cauauaacaugcaccacaugua

SEQ ID NO: 1267856 - RNA, 21 nt, Human
caugcaccacauguaucugcu

SEQ ID NO: 1267857 - RNA, 26 nt, Human
cauucuagguucucuuccuguuuuau

SEQ ID NO: 1267858 - RNA, 22 nt, Human
ccaaagcgcugggauuacaggc

SEQ ID NO: 1267859 - RNA, 23 nt, Human
ccaaagcgcugggauuacaggcg

SEQ ID NO: 1267860 - RNA, 24 nt, Human
ccaaagcgcugggauuacaggcgu

SEQ ID NO: 1267861 - RNA, 23 nt, Human
ccaagacacuucuuaguaagcaa

SEQ ID NO: 1267862 - RNA, 22 nt, Human
ccacucuuccuuuuuuuaacuu

SEQ ID NO: 1267863 - RNA, 19 nt, Human
ccagagccgugcauggucc

SEQ ID NO: 1267864 - RNA, 24 nt, Human
ccaugaaacgcagcuuucccuggg

SEQ ID NO: 1267865 - RNA, 21 nt, Human
ccauggucaagaacgcaaagc

SEQ ID NO: 1267866 - RNA, 18 nt, Human
cccagacaggcagcugag

SEQ ID NO: 1267867 - RNA, 19 nt, Human
cccccauuccccccacccc

SEQ ID NO: 1267868 - RNA, 19 nt, Human
ccccccaccccgugugccu

SEQ ID NO: 1267869 - RNA, 20 nt, Human
ccccccauuccccccacccc

SEQ ID NO: 1267870 - RNA, 23 nt, Human
cccgaguagcugggauuacaggc

SEQ ID NO: 1267871 - RNA, 24 nt, Human
cccgaguagcugggauuacaggca

SEQ ID NO: 1267872 - RNA, 19 nt, Human
cccgcacuugccuuccuuu

SEQ ID NO: 1267873 - RNA, 20 nt, Human
cccggguucaagcgauucuc

SEQ ID NO: 1267874 - RNA, 23 nt, Human
cccggguucaagcgauucuccug

SEQ ID NO: 1267875 - RNA, 23 nt, Human
ccgaguagcugggauuacaggca

SEQ ID NO: 1267876 - RNA, 25 nt, Human
ccgcugggaagcagagccguagaga

SEQ ID NO: 1267877 - RNA, 18 nt, Human
ccuacgauucauccaggg

SEQ ID NO: 1267878 - RNA, 23 nt, Human
ccucagcccagcacccugggugc

SEQ ID NO: 1267879 - RNA, 18 nt, Human
ccuccaugaaacgcagcu

SEQ ID NO: 1267880 - RNA, 23 nt, Human
ccucccaccuacgauucauccag

SEQ ID NO: 1267881 - RNA, 24 nt, Human
ccucccggguucaagcgauucucc

SEQ ID NO: 1267882 - RNA, 27 nt, Human
ccugcaccacggcucaccuuucagagg

SEQ ID NO: 1267883 - RNA, 18 nt, Human
ccugccgggacacccccg

SEQ ID NO: 1267884 - RNA, 18 nt, Human
ccugggaaagaggacauc

SEQ ID NO: 1267885 - RNA, 23 nt, Human
cgaacagcgaggggggcaccugc

SEQ ID NO: 1267886 - RNA, 24 nt, Human
cgcugggauuacaggcgugagcca

SEQ ID NO: 1267887 - RNA, 23 nt, Human
cggcucaccuuucagagguucug

SEQ ID NO: 1267888 - RNA, 24 nt, Human
cgugugcccgcugggaagcagagc

SEQ ID NO: 1267889 - RNA, 25 nt, Human
cucaaaagcacaagagcgccucucu

SEQ ID NO: 1267890 - RNA, 18 nt, Human
cucaaugaauagaaacuc

SEQ ID NO: 1267891 - RNA, 19 nt, Human
cucaaugaauagaaacucc

SEQ ID NO: 1267892 - RNA, 24 nt, Human
cucacugcaaccucugccucccgg

SEQ ID NO: 1267893 - RNA, 24 nt, Human
cucagccucccgaguagcugggau

SEQ ID NO: 1267894 - RNA, 25 nt, Human
cucauaaaauagcaagccccagugg

SEQ ID NO: 1267895 - RNA, 20 nt, Human
cuccccccauuccccccacc

SEQ ID NO: 1267896 - RNA, 18 nt, Human
cuccucaagggcuuuggu

SEQ ID NO: 1267897 - RNA, 22 nt, Human
cuccuggaagccuccaugaaac

SEQ ID NO: 1267898 - RNA, 20 nt, Human
cucucccaaagcgcugggau

SEQ ID NO: 1267899 - RNA, 20 nt, Human
cucugucacccaggcuggag

SEQ ID NO: 1267900 - RNA, 23 nt, Human
cucugucacccaggcuggagugc

SEQ ID NO: 1267901 - RNA, 22 nt, Human
cugaaaccagucacugucuccu

SEQ ID NO: 1267902 - RNA, 23 nt, Human
cugaagcaauaggaaauuaaccc

SEQ ID NO: 1267903 - RNA, 23 nt, Human
cugaagcugcggcaguggcccua

SEQ ID NO: 1267904 - RNA, 23 nt, Human
cugcaaccucugccucccggguu

SEQ ID NO: 1267905 - RNA, 24 nt, Human
cugcaaccucugccucccggguuc

SEQ ID NO: 1267906 - RNA, 23 nt, Human
cugccucagccucccgaguagcu

SEQ ID NO: 1267907 - RNA, 21 nt, Human
cugcuuucugaaugcaaaugg

SEQ ID NO: 1267908 - RNA, 21 nt, Human
cuggaagccuccaugaaacgc

SEQ ID NO: 1267909 - RNA, 23 nt, Human
cuggccagccagaggaagagggc

SEQ ID NO: 1267910 - RNA, 21 nt, Human
cugggggagagggagagguga

SEQ ID NO: 1267911 - RNA, 18 nt, Human
cugucacccaggcuggag

SEQ ID NO: 1267912 - RNA, 23 nt, Human
cuguuuaugaaaaacgggaggag

SEQ ID NO: 1267913 - RNA, 19 nt, Human
cuuagccucagcccagcac

SEQ ID NO: 1267914 - RNA, 19 nt, Human
cuuccaccuucagcccuag

SEQ ID NO: 1267915 - RNA, 20 nt, Human
gaacuggugaaaaucagcca

SEQ ID NO: 1267916 - RNA, 18 nt, Human
gaagcagagccguagaga

SEQ ID NO: 1267917 - RNA, 19 nt, Human
gaagcugcggcaguggccc

SEQ ID NO: 1267918 - RNA, 19 nt, Human
gaaucccagucgugugcuu

SEQ ID NO: 1267919 - RNA, 21 nt, Human
gaauggcacuugaagccaccu

SEQ ID NO: 1267920 - RNA, 21 nt, Human
gacccgaacagcgaggggggc

SEQ ID NO: 1267921 - RNA, 22 nt, Human
gaccuugugaucugcccgccuc

SEQ ID NO: 1267922 - RNA, 23 nt, Human
gaccuugugaucugcccgccucg

SEQ ID NO: 1267923 - RNA, 22 nt, Human
gagguucugcacuuuuugggug

SEQ ID NO: 1267924 - RNA, 24 nt, Human
gaguagcugggauuacaggcacgc

SEQ ID NO: 1267925 - RNA, 24 nt, Human
gauuacaggcacgcaccaccaugc

SEQ ID NO: 1267926 - RNA, 18 nt, Human
gauuacaggcgugagcca

SEQ ID NO: 1267927 - RNA, 22 nt, Human
gauuacaggcgugagccacugc

SEQ ID NO: 1267928 - RNA, 22 nt, Human
gauuacaggcgugagccacugc

SEQ ID NO: 1267929 - RNA, 18 nt, Human
gcaaagccacucuuccuu

SEQ ID NO: 1267930 - RNA, 22 nt, Human
gcaaccucugccucccggguuc

SEQ ID NO: 1267931 - RNA, 19 nt, Human
gcacgcaccaccaugccca

SEQ ID NO: 1267932 - RNA, 24 nt, Human
gcagugcaaagacaaccucuuuuu

SEQ ID NO: 1267933 - RNA, 22 nt, Human
gcaucacucaacauucagccug

SEQ ID NO: 1267934 - RNA, 22 nt, Human
gcccagcuaauuuuuguauuuu

SEQ ID NO: 1267935 - RNA, 21 nt, Human
gccguagagaggcagacagcu

SEQ ID NO: 1267936 - RNA, 20 nt, Human
gccucagccucccgaguagc

SEQ ID NO: 1267937 - RNA, 24 nt, Human
gcgauucuccugccucagccuccc

SEQ ID NO: 1267938 - RNA, 19 nt, Human
gcuccccccauucccccca

SEQ ID NO: 1267939 - RNA, 19 nt, Human
gcuggagugcaguggcacg

SEQ ID NO: 1267940 - RNA, 19 nt, Human
ggauaucaucuuuccuuuc

SEQ ID NO: 1267941 - RNA, 25 nt, Human
ggcacuugcaggaauggcacuugaa

SEQ ID NO: 1267942 - RNA, 19 nt, Human
ggcucagagacucuacacc

SEQ ID NO: 1267943 - RNA, 21 nt, Human
gggaagcagagccguagagag

SEQ ID NO: 1267944 - RNA, 21 nt, Human
gggaagccagggaggcccaga

SEQ ID NO: 1267945 - RNA, 22 nt, Human
gggcagccuccuggaagccucc

SEQ ID NO: 1267946 - RNA, 23 nt, Human
gggcuccccccauuccccccacc

SEQ ID NO: 1267947 - RNA, 24 nt, Human
gggcuccccccauuccccccaccc

SEQ ID NO: 1267948 - RNA, 20 nt, Human
ggggagagggagaggugagg

SEQ ID NO: 1267949 - RNA, 22 nt, Human
gggguugccauuucucuaacac

SEQ ID NO: 1267950 - RNA, 22 nt, Human
ggguagacagaauagggaagaa

SEQ ID NO: 1267951 - RNA, 21 nt, Human
gguaggaggaacuggugaaaa

SEQ ID NO: 1267952 - RNA, 23 nt, Human
ggugggaucaggacaguacaggc

SEQ ID NO: 1267953 - RNA, 24 nt, Human
gguuucaccauguuggccagaaug

SEQ ID NO: 1267954 - RNA, 18 nt, Human
guagcugggauuacaggc

SEQ ID NO: 1267955 - RNA, 24 nt, Human
gugaucugcccgccucgcucuccc

SEQ ID NO: 1267956 - RNA, 23 nt, Human
gugugcccgcugggaagcagagc

SEQ ID NO: 1267957 - RNA, 21 nt, Human
gugugugugugugugugugug

SEQ ID NO: 1267958 - RNA, 21 nt, Human
gugugugugugugugugugug

SEQ ID NO: 1267959 - RNA, 25 nt, Human
guucugggggagagggagaggugag

SEQ ID NO: 1267960 - RNA, 22 nt, Human
uaaaagaagaccugaaggggua

SEQ ID NO: 1267961 - RNA, 23 nt, Human
uaacacagcaaaccccgucucuc

SEQ ID NO: 1267962 - RNA, 21 nt, Human
uaagaaaacaaaucauaccaa

SEQ ID NO: 1267963 - RNA, 21 nt, Human
uaagcaaccgccuaguucucc

SEQ ID NO: 1267964 - RNA, 20 nt, Human
uaagcugucauuccacaggg

SEQ ID NO: 1267965 - RNA, 22 nt, Human
uaauuuuuguauuuuuaguaga

SEQ ID NO: 1267966 - RNA, 23 nt, Human
uacaggcgugagccacugcgccc

SEQ ID NO: 1267967 - RNA, 24 nt, Human
uacaggcgugagccacugcgcccu

SEQ ID NO: 1267968 - RNA, 18 nt, Human
uacaguuucagaagaaca

SEQ ID NO: 1267969 - RNA, 22 nt, Human
uagaaacaggguuucaccaugu

SEQ ID NO: 1267970 - RNA, 24 nt, Human
uaguagaaacaggguuucaccaug

SEQ ID NO: 1267971 - RNA, 26 nt, Human
uaguagaaacaggguuucaccauguu

SEQ ID NO: 1267972 - RNA, 24 nt, Human
ucacccaggcuggagugcaguggc

SEQ ID NO: 1267973 - RNA, 24 nt, Human
ucacugcaaccucugccucccggg

SEQ ID NO: 1267974 - RNA, 25 nt, Human
ucacugcaaccucugccucccgggu

SEQ ID NO: 1267975 - RNA, 22 nt, Human
ucagaugcuagaagugaccaga

SEQ ID NO: 1267976 - RNA, 20 nt, Human
ucagccucccgaguagcugg

SEQ ID NO: 1267977 - RNA, 18 nt, Human
uccacuguccaucuucuu

SEQ ID NO: 1267978 - RNA, 21 nt, Human
uccaucuucuuuugcucgcuc

SEQ ID NO: 1267979 - RNA, 24 nt, Human
ucccaaagcgcugggauuacaggc

SEQ ID NO: 1267980 - RNA, 21 nt, Human
ucccaugacuggccagccaga

SEQ ID NO: 1267981 - RNA, 18 nt, Human
uccccaacgcgaagacuc

SEQ ID NO: 1267982 - RNA, 23 nt, Human
uccccaacgcgaagacucaauuc

SEQ ID NO: 1267983 - RNA, 24 nt, Human
ucccgaguagcugggauuacaggc

SEQ ID NO: 1267984 - RNA, 21 nt, Human
ucccggguucaagcgauucuc

SEQ ID NO: 1267985 - RNA, 24 nt, Human
ucccggguucaagcgauucuccug

SEQ ID NO: 1267986 - RNA, 21 nt, Human
ucccugggccacacacugccu

SEQ ID NO: 1267987 - RNA, 27 nt, Human
uccuagguaccagauucgggugcauuu

SEQ ID NO: 1267988 - RNA, 18 nt, Human
ucuaacacagcaaacccc

SEQ ID NO: 1267989 - RNA, 24 nt, Human
ucuccugccucagccucccgagua

SEQ ID NO: 1267990 - RNA, 18 nt, Human
ucugagaccccauuuguc

SEQ ID NO: 1267991 - RNA, 19 nt, Human
ucugggggagagggagagg

SEQ ID NO: 1267992 - RNA, 24 nt, Human
ucugucacccaggcuggagugcag

SEQ ID NO: 1267993 - RNA, 22 nt, Human
ucuugcucugucacccaggcug

SEQ ID NO: 1267994 - RNA, 23 nt, Human
ucuugcucugucacccaggcugg

SEQ ID NO: 1267995 - RNA, 24 nt, Human
ucuugcucugucacccaggcugga

SEQ ID NO: 1267996 - RNA, 22 nt, Human
ugaacaguguuuggucuggaau

SEQ ID NO: 1267997 - RNA, 21 nt, Human
ugacaaagaugacucaaccaa

SEQ ID NO: 1267998 - RNA, 22 nt, Human
ugacaaagaugacucaaccaac

SEQ ID NO: 1267999 - RNA, 22 nt, Human
ugacgcagaccugccgggacac

SEQ ID NO: 1268000 - RNA, 19 nt, Human
ugacugccggggcccugga

SEQ ID NO: 1268001 - RNA, 22 nt, Human
ugagacggagucuugcucuguc

SEQ ID NO: 1268002 - RNA, 19 nt, Human
ugagagcugaagcaggggc

SEQ ID NO: 1268003 - RNA, 25 nt, Human
ugagggaaaggccacuccaggccac

SEQ ID NO: 1268004 - RNA, 23 nt, Human
ugcaaagacaaccucuuuuuaac

SEQ ID NO: 1268005 - RNA, 22 nt, Human
ugcaguggcacgaucucggcuc

SEQ ID NO: 1268006 - RNA, 19 nt, Human
ugccgggacacccccgugg

SEQ ID NO: 1268007 - RNA, 24 nt, Human
ugccucagccucccgaguagcugg

SEQ ID NO: 1268008 - RNA, 23 nt, Human
uggagugcaguggcacgaucucg

SEQ ID NO: 1268009 - RNA, 24 nt, Human
uggagugcaguggcacgaucucgg

SEQ ID NO: 1268010 - RNA, 23 nt, Human
uggcacgcuuugccauagcucuu

SEQ ID NO: 1268011 - RNA, 19 nt, Human
ugggauaucaucuuuccuu

SEQ ID NO: 1268012 - RNA, 21 nt, Human
ugggaucaggacaguacaggc

SEQ ID NO: 1268013 - RNA, 23 nt, Human
ugggaucaggacaguacaggcug

SEQ ID NO: 1268014 - RNA, 21 nt, Human
ugggauuacaggcacgcacca

SEQ ID NO: 1268015 - RNA, 24 nt, Human
ugggauuacaggcacgcaccacca

SEQ ID NO: 1268016 - RNA, 19 nt, Human
ugggauuacaggcgugagc

SEQ ID NO: 1268017 - RNA, 21 nt, Human
ugggauuacaggcgugagcca

SEQ ID NO: 1268018 - RNA, 22 nt, Human
ugggauuacaggcgugagccac

SEQ ID NO: 1268019 - RNA, 22 nt, Human
ugggauuacaggcgugagccac

SEQ ID NO: 1268020 - RNA, 24 nt, Human
ugggauuacaggcgugagccacug

SEQ ID NO: 1268021 - RNA, 24 nt, Human
ugggauuacaggcgugagccacug

SEQ ID NO: 1268022 - RNA, 19 nt, Human
ugggggacuugggcucagg

SEQ ID NO: 1268023 - RNA, 20 nt, Human
ugggggacuugggcucagga

SEQ ID NO: 1268024 - RNA, 20 nt, Human
ugguguucucggcuucuguc

SEQ ID NO: 1268025 - RNA, 21 nt, Human
ugucagaccuucacgaaaggc

SEQ ID NO: 1268026 - RNA, 21 nt, Human
uguccacuguccaucuucuuu

SEQ ID NO: 1268027 - RNA, 19 nt, Human
ugugaaaagggccaagcug

SEQ ID NO: 1268028 - RNA, 18 nt, Human
ugugugugugugugugug

SEQ ID NO: 1268029 - RNA, 18 nt, Human
ugugugugugugugugug

SEQ ID NO: 1268030 - RNA, 18 nt, Human
ugugugugugugugugug

SEQ ID NO: 1268031 - RNA, 18 nt, Human
ugugugugugugugugug

SEQ ID NO: 1268032 - RNA, 18 nt, Human
ugugugugugugugugug

SEQ ID NO: 1268033 - RNA, 18 nt, Human
ugugugugugugugugug

SEQ ID NO: 1268034 - RNA, 18 nt, Human
ugugugugugugugugug

SEQ ID NO: 1268035 - RNA, 18 nt, Human
ugugugugugugugugug

SEQ ID NO: 1268036 - RNA, 18 nt, Human
ugugugugugugugugug

SEQ ID NO: 1268037 - RNA, 18 nt, Human
ugugugugugugugugug

SEQ ID NO: 1268038 - RNA, 18 nt, Human
ugugugugugugugugug

SEQ ID NO: 1268039 - RNA, 21 nt, Human
ugugugugugugugugugugu

SEQ ID NO: 1268040 - RNA, 21 nt, Human
ugugugugugugugugugugu

SEQ ID NO: 1268041 - RNA, 21 nt, Human
ugugugugugugugugugugu

SEQ ID NO: 1268042 - RNA, 21 nt, Human
ugugugugugugugugugugu

SEQ ID NO: 1268043 - RNA, 21 nt, Human
ugugugugugugugugugugu

SEQ ID NO: 1268044 - RNA, 21 nt, Human
ugugugugugugugugugugu

SEQ ID NO: 1268045 - RNA, 21 nt, Human
ugugugugugugugugugugu

SEQ ID NO: 1268046 - RNA, 21 nt, Human
ugugugugugugugugugugu

SEQ ID NO: 1268047 - RNA, 21 nt, Human
ugugugugugugugugugugu

SEQ ID NO: 1268048 - RNA, 21 nt, Human
ugugugugugugugugugugu

SEQ ID NO: 1268049 - RNA, 21 nt, Human
ugugugugugugugugugugu

SEQ ID NO: 1268050 - RNA, 21 nt, Human
ugugugugugugugugugugu

SEQ ID NO: 1268051 - RNA, 21 nt, Human
ugugugugugugugugugugu

SEQ ID NO: 1268052 - RNA, 21 nt, Human
ugugugugugugugugugugu

SEQ ID NO: 1268053 - RNA, 21 nt, Human
ugugugugugugugugugugu

SEQ ID NO: 1268054 - RNA, 21 nt, Human
ugugugugugugugugugugu

SEQ ID NO: 1268055 - RNA, 21 nt, Human
ugugugugugugugugugugu

SEQ ID NO: 1268056 - RNA, 21 nt, Human
ugugugugugugugugugugu

SEQ ID NO: 1268057 - RNA, 22 nt, Human
ugugugugugugugugugugug

SEQ ID NO: 1268058 - RNA, 22 nt, Human
ugugugugugugugugugugug

SEQ ID NO: 1268059 - RNA, 22 nt, Human
ugugugugugugugugugugug

SEQ ID NO: 1268060 - RNA, 22 nt, Human
ugugugugugugugugugugug

SEQ ID NO: 1268061 - RNA, 22 nt, Human
ugugugugugugugugugugug

SEQ ID NO: 1268062 - RNA, 22 nt, Human
ugugugugugugugugugugug

SEQ ID NO: 1268063 - RNA, 22 nt, Human
ugugugugugugugugugugug

SEQ ID NO: 1268064 - RNA, 19 nt, Human
uguugagacccggcgugug

SEQ ID NO: 1268065 - RNA, 20 nt, Human
uguuguugagacccggcgug

SEQ ID NO: 1268066 - RNA, 24 nt, Human
uuaguagaaacaggguuucaccau

SEQ ID NO: 1268067 - RNA, 21 nt, Human
uucaagcgauucuccugccuc

SEQ ID NO: 1268068 - RNA, 23 nt, Human
uucaagcgauucuccugccucag

SEQ ID NO: 1268069 - RNA, 24 nt, Human
uucaagcgauucuccugccucagc

SEQ ID NO: 1268070 - RNA, 19 nt, Human
uuccuguuuuauaagaaaa

SEQ ID NO: 1268071 - RNA, 19 nt, Human
uucuagucuccgacagagg

SEQ ID NO: 1268072 - RNA, 19 nt, Human
uugaagccaccugccuggc

SEQ ID NO: 1268073 - RNA, 24 nt, Human
uugcucugucacccaggcuggagu

SEQ ID NO: 1268074 - RNA, 19 nt, Human
uuucaccauguuggccaga

SEQ ID NO: 1268075 - RNA, 21 nt, Human
uuucaccauguuggccagaau

SEQ ID NO: 1268076 - RNA, 23 nt, Human
uuucagagguucugcacuuuuug

SEQ ID NO: 1268077 - RNA, 24 nt, Human
uuuuuaguagaaacaggguuucac

SEQ ID NO: 1268078 - RNA, 18 nt, Human
uuuuuguauuuuuaguag

SEQ ID NO: 1268079 - RNA, 22 nt, Human
aagcaaacaugugauucuugac

SEQ ID NO: 1268080 - RNA, 24 nt, Human
acaggagcaccacggcggagaagc

SEQ ID NO: 1268081 - RNA, 19 nt, Human
accaggcguccugcacccu

SEQ ID NO: 1268082 - RNA, 19 nt, Human
acucgccucuucucccgcc

SEQ ID NO: 1268083 - RNA, 24 nt, Human
agacaggagcaccacggcggagaa

SEQ ID NO: 1268084 - RNA, 18 nt, Human
aucuucuguuuugcaucu

SEQ ID NO: 1268085 - RNA, 20 nt, Human
auggugcccacagauacacu

SEQ ID NO: 1268086 - RNA, 18 nt, Human
cacucgccucuucucccg

SEQ ID NO: 1268087 - RNA, 22 nt, Human
cagagguaggggcuccguccag

SEQ ID NO: 1268088 - RNA, 23 nt, Human
cagcaggacggccugucuccaag

SEQ ID NO: 1268089 - RNA, 22 nt, Human
cagcauagacaggagcaccacg

SEQ ID NO: 1268090 - RNA, 18 nt, Human
ccacaaggcagaccaggc

SEQ ID NO: 1268091 - RNA, 28 nt, Human
ccaggcguccugcacccuuugggucccc

SEQ ID NO: 1268092 - RNA, 19 nt, Human
cccacaaggcagaccaggc

SEQ ID NO: 1268093 - RNA, 22 nt, Human
cccgccaucugcauggugccca

SEQ ID NO: 1268094 - RNA, 23 nt, Human
ccucucucagcauagacaggagc

SEQ ID NO: 1268095 - RNA, 20 nt, Human
gaacgaagccaggggaagcc

SEQ ID NO: 1268096 - RNA, 22 nt, Human
gcauagacaggagcaccacggc

SEQ ID NO: 1268097 - RNA, 22 nt, Human
gcaugaaaaucuucuguuuugc

SEQ ID NO: 1268098 - RNA, 18 nt, Human
gguacuaggaggcccugc

SEQ ID NO: 1268099 - RNA, 22 nt, Human
ucaucuuugcagagguaggggc

SEQ ID NO: 1268100 - RNA, 23 nt, Human
ugugauucuugacugauucuuuu

SEQ ID NO: 1268101 - RNA, 20 nt, Human
uugcaucuucacucgccucu

SEQ ID NO: 1268102 - RNA, 19 nt, Human
uuuuuugguucagcguuuu

SEQ ID NO: 1268103 - RNA, 19 nt, Human
aacauggugaaacaccguc

SEQ ID NO: 1268104 - RNA, 20 nt, Human
aacauggugaaacaccgucu

SEQ ID NO: 1268105 - RNA, 19 nt, Human
aaugcaagcugcuugcagu

SEQ ID NO: 1268106 - RNA, 24 nt, Human
accugaggucaggaguucgagacc

SEQ ID NO: 1268107 - RNA, 22 nt, Human
acuaacauggugaaacaccguc

SEQ ID NO: 1268108 - RNA, 24 nt, Human
agcacuuuggaaggccgagguggg

SEQ ID NO: 1268109 - RNA, 25 nt, Human
agccugggcaacaagggcaaaacuc

SEQ ID NO: 1268110 - RNA, 18 nt, Human
aggcaggagaaucaccug

SEQ ID NO: 1268111 - RNA, 22 nt, Human
aggcaggagaaucaccugaacc

SEQ ID NO: 1268112 - RNA, 24 nt, Human
aggcaggagaaucaccugaaccug

SEQ ID NO: 1268113 - RNA, 21 nt, Human
aggccgaggugggcggaucac

SEQ ID NO: 1268114 - RNA, 24 nt, Human
aggcugaggcaggagaaucaccug

SEQ ID NO: 1268115 - RNA, 22 nt, Human
aggugggcggaucaccugaggu

SEQ ID NO: 1268116 - RNA, 23 nt, Human
aguagcucaugccuguaauccca

SEQ ID NO: 1268117 - RNA, 24 nt, Human
aguagcucaugccuguaaucccag

SEQ ID NO: 1268118 - RNA, 19 nt, Human
aucacgucauagaggaggu

SEQ ID NO: 1268119 - RNA, 19 nt, Human
augccuguaaucccagcac

SEQ ID NO: 1268120 - RNA, 24 nt, Human
auugcacuccagccugggcaacaa

SEQ ID NO: 1268121 - RNA, 22 nt, Human
cacaaacucacugucaucucuu

SEQ ID NO: 1268122 - RNA, 23 nt, Human
caccugaggucaggaguucgaga

SEQ ID NO: 1268123 - RNA, 23 nt, Human
cacuccagccugggcaacaaggg

SEQ ID NO: 1268124 - RNA, 24 nt, Human
cagcacuuuggaaggccgaggugg

SEQ ID NO: 1268125 - RNA, 24 nt, Human
caugccuguaaucccagcacuuug

SEQ ID NO: 1268126 - RNA, 18 nt, Human
cauugcacuccagccugg

SEQ ID NO: 1268127 - RNA, 19 nt, Human
cauugcacuccagccuggg

SEQ ID NO: 1268128 - RNA, 21 nt, Human
cauugcacuccagccugggca

SEQ ID NO: 1268129 - RNA, 23 nt, Human
cauugcacuccagccugggcaac

SEQ ID NO: 1268130 - RNA, 24 nt, Human
cauugcacuccagccugggcaaca

SEQ ID NO: 1268131 - RNA, 20 nt, Human
ccauugcacuccagccuggg

SEQ ID NO: 1268132 - RNA, 21 nt, Human
ccauugcacuccagccugggc

SEQ ID NO: 1268133 - RNA, 23 nt, Human
ccauugcacuccagccugggcaa

SEQ ID NO: 1268134 - RNA, 24 nt, Human
ccauugcacuccagccugggcaac

SEQ ID NO: 1268135 - RNA, 19 nt, Human
ccccuguagcggggguggg

SEQ ID NO: 1268136 - RNA, 21 nt, Human
cccgugccuguaaccccagcc

SEQ ID NO: 1268137 - RNA, 24 nt, Human
ccggaggcugaggcaggagaauca

SEQ ID NO: 1268138 - RNA, 18 nt, Human
ccgugccuguaaccccag

SEQ ID NO: 1268139 - RNA, 23 nt, Human
ccugacuaacauggugaaacacc

SEQ ID NO: 1268140 - RNA, 24 nt, Human
ccugacuaacauggugaaacaccg

SEQ ID NO: 1268141 - RNA, 22 nt, Human
ccugaggucaggaguucgagac

SEQ ID NO: 1268142 - RNA, 23 nt, Human
ccuguaaccccagcuacuccgga

SEQ ID NO: 1268143 - RNA, 18 nt, Human
ccuguagcgggggugggg

SEQ ID NO: 1268144 - RNA, 24 nt, Human
cgagaccagccugacuaacauggu

SEQ ID NO: 1268145 - RNA, 24 nt, Human
cgaggugggcggaucaccugaggu

SEQ ID NO: 1268146 - RNA, 26 nt, Human
cgaggugggcggaucaccugagguca

SEQ ID NO: 1268147 - RNA, 24 nt, Human
cgccauugcacuccagccugggca

SEQ ID NO: 1268148 - RNA, 24 nt, Human
cggaucaccugaggucaggaguuc

SEQ ID NO: 1268149 - RNA, 23 nt, Human
cucaugccuguaaucccagcacu

SEQ ID NO: 1268150 - RNA, 24 nt, Human
cucaugccuguaaucccagcacuu

SEQ ID NO: 1268151 - RNA, 18 nt, Human
cuuagggggacaaaaacg

SEQ ID NO: 1268152 - RNA, 22 nt, Human
gaacaugucuucuaauccgcac

SEQ ID NO: 1268153 - RNA, 20 nt, Human
gacgcugugggccgcuuucc

SEQ ID NO: 1268154 - RNA, 20 nt, Human
gagaaaauguaagccgagau

SEQ ID NO: 1268155 - RNA, 24 nt, Human
gaucaccugaggucaggaguucga

SEQ ID NO: 1268156 - RNA, 23 nt, Human
gcaggagaaucaccugaaccugu

SEQ ID NO: 1268157 - RNA, 18 nt, Human
gcaguucaucauagcuaa

SEQ ID NO: 1268158 - RNA, 22 nt, Human
gccauugcacuccagccugggc

SEQ ID NO: 1268159 - RNA, 24 nt, Human
gccauugcacuccagccugggcaa

SEQ ID NO: 1268160 - RNA, 19 nt, Human
gcugggcacaguagcucau

SEQ ID NO: 1268161 - RNA, 23 nt, Human
ggacaggggcugggguugugcgu

SEQ ID NO: 1268162 - RNA, 22 nt, Human
ggaucaccugaggucaggaguu

SEQ ID NO: 1268163 - RNA, 23 nt, Human
ggaucaccugaggucaggaguuc

SEQ ID NO: 1268164 - RNA, 25 nt, Human
ggaucaccugaggucaggaguucga

SEQ ID NO: 1268165 - RNA, 23 nt, Human
ggcacaguagcucaugccuguaa

SEQ ID NO: 1268166 - RNA, 22 nt, Human
ggcugguggcccgugccuguaa

SEQ ID NO: 1268167 - RNA, 18 nt, Human
gggcacaguagcucaugc

SEQ ID NO: 1268168 - RNA, 24 nt, Human
gguggcccgugccuguaaccccag

SEQ ID NO: 1268169 - RNA, 22 nt, Human
gguucgcgccauugcacuccag

SEQ ID NO: 1268170 - RNA, 24 nt, Human
uaacacaggauaacgaaaccugca

SEQ ID NO: 1268171 - RNA, 20 nt, Human
uaacauggugaaacaccguc

SEQ ID NO: 1268172 - RNA, 21 nt, Human
uaacauggugaaacaccgucu

SEQ ID NO: 1268173 - RNA, 22 nt, Human
uaacauggugaaacaccgucug

SEQ ID NO: 1268174 - RNA, 19 nt, Human
uaacgaaaccugcacugcu

SEQ ID NO: 1268175 - RNA, 27 nt, Human
uaagccgagaugaugcucaaacuauaa

SEQ ID NO: 1268176 - RNA, 23 nt, Human
uacauagguacuuaaacaugaaa

SEQ ID NO: 1268177 - RNA, 19 nt, Human
uacuccggaggcugaggca

SEQ ID NO: 1268178 - RNA, 22 nt, Human
uagcucaugccuguaaucccag

SEQ ID NO: 1268179 - RNA, 24 nt, Human
uagcucaugccuguaaucccagca

SEQ ID NO: 1268180 - RNA, 20 nt, Human
ucaauuuaucaagcacuuaa

SEQ ID NO: 1268181 - RNA, 20 nt, Human
ucaccugaggucaggaguuc

SEQ ID NO: 1268182 - RNA, 21 nt, Human
uccacagagaaaauguaagcc

SEQ ID NO: 1268183 - RNA, 20 nt, Human
uccugugucucuauuugucu

SEQ ID NO: 1268184 - RNA, 23 nt, Human
ucgcgccauugcacuccagccug

SEQ ID NO: 1268185 - RNA, 24 nt, Human
ugaaaucauagaggcugggcacag

SEQ ID NO: 1268186 - RNA, 18 nt, Human
ugacuaacauggugaaac

SEQ ID NO: 1268187 - RNA, 20 nt, Human
ugaggcaggagaaucaccug

SEQ ID NO: 1268188 - RNA, 24 nt, Human
ugaggcaggagaaucaccugaacc

SEQ ID NO: 1268189 - RNA, 24 nt, Human
ugaggcaggagaaucaccugaacc

SEQ ID NO: 1268190 - RNA, 19 nt, Human
ugcacuccagccugggcaa

SEQ ID NO: 1268191 - RNA, 22 nt, Human
ugcacuccagccugggcaacaa

SEQ ID NO: 1268192 - RNA, 24 nt, Human
ugccuguaaccccagcuacuccgg

SEQ ID NO: 1268193 - RNA, 19 nt, Human
uggaaggccgaggugggcg

SEQ ID NO: 1268194 - RNA, 24 nt, Human
uggaaggccgaggugggcggauca

SEQ ID NO: 1268195 - RNA, 21 nt, Human
uggcccgugccuguaacccca

SEQ ID NO: 1268196 - RNA, 23 nt, Human
uggcccgugccuguaaccccagc

SEQ ID NO: 1268197 - RNA, 24 nt, Human
ugggcggaucaccugaggucagga

SEQ ID NO: 1268198 - RNA, 24 nt, Human
ugguggcccgugccuguaacccca

SEQ ID NO: 1268199 - RNA, 21 nt, Human
ugucuuuggaaaugcaagcug

SEQ ID NO: 1268200 - RNA, 23 nt, Human
uuagcugggcugguggcccgugc

SEQ ID NO: 1268201 - RNA, 19 nt, Human
uuggaaggccgaggugggc

SEQ ID NO: 1268202 - RNA, 25 nt, Human
uuggaaggccgaggugggcggauca

SEQ ID NO: 1268203 - RNA, 22 nt, Human
uuuauuaacuuaguuuugccac

SEQ ID NO: 1268204 - RNA, 19 nt, Human
aaaaaaaggcaaaccccaa

SEQ ID NO: 1268205 - RNA, 22 nt, Human
aaaaaaccauaauggugccaca

SEQ ID NO: 1268206 - RNA, 23 nt, Human
aaaaaaggcaaaccccaaaacgc

SEQ ID NO: 1268207 - RNA, 23 nt, Human
aaaaggcuuggauguuaagagag

SEQ ID NO: 1268208 - RNA, 24 nt, Human
aaacagaacccacguuacacaugg

SEQ ID NO: 1268209 - RNA, 18 nt, Human
aaacagccaaaaaaccau

SEQ ID NO: 1268210 - RNA, 18 nt, Human
aaacagccaaaaaaccau

SEQ ID NO: 1268211 - RNA, 21 nt, Human
aaagggguuaagaaaaccaac

SEQ ID NO: 1268212 - RNA, 21 nt, Human
aacaaaaaaaggcaaacccca

SEQ ID NO: 1268213 - RNA, 24 nt, Human
aacaaaaaaaggcaaaccccaaaa

SEQ ID NO: 1268214 - RNA, 18 nt, Human
aacaacaaaaagcgaggg

SEQ ID NO: 1268215 - RNA, 23 nt, Human
aaccaacaacaacaaaaagcgag

SEQ ID NO: 1268216 - RNA, 20 nt, Human
aagaaaaccaacaacaacaa

SEQ ID NO: 1268217 - RNA, 18 nt, Human
aagcaaaaucagacaacg

SEQ ID NO: 1268218 - RNA, 24 nt, Human
aagcaaaaucuaagcaaaaucaga

SEQ ID NO: 1268219 - RNA, 25 nt, Human
aagcgacaacaaaaaaaggcaaacc

SEQ ID NO: 1268220 - RNA, 21 nt, Human
aagggguuaagaaaaccaaca

SEQ ID NO: 1268221 - RNA, 22 nt, Human
acaaaaaaaggcaaaccccaaa

SEQ ID NO: 1268222 - RNA, 26 nt, Human
accccaaaacgcaaccuaaccaaagc

SEQ ID NO: 1268223 - RNA, 22 nt, Human
agcaaaagagacauccuuuaau

SEQ ID NO: 1268224 - RNA, 21 nt, Human
agggacugucuguugucacug

SEQ ID NO: 1268225 - RNA, 24 nt, Human
caaaacgcaaccuaaccaaagcaa

SEQ ID NO: 1268226 - RNA, 23 nt, Human
caaagcaaaaucuaagcaaaauc

SEQ ID NO: 1268227 - RNA, 18 nt, Human
caacaaaaaaaggcaaac

SEQ ID NO: 1268228 - RNA, 26 nt, Human
caacaaaaaaaggcaaaccccaaaac

SEQ ID NO: 1268229 - RNA, 30 nt, Human
caacaaaaaaaggcaaaccccaaaacgcaa

SEQ ID NO: 1268230 - RNA, 19 nt, Human
caacaacaacaaaaagcga

SEQ ID NO: 1268231 - RNA, 24 nt, Human
cacaguaggauuauugugauaaaa

SEQ ID NO: 1268232 - RNA, 22 nt, Human
caccacuuucagccaccuccuu

SEQ ID NO: 1268233 - RNA, 20 nt, Human
cacuguguugaaacgaggau

SEQ ID NO: 1268234 - RNA, 19 nt, Human
cagccaaaaaaccauaaug

SEQ ID NO: 1268235 - RNA, 22 nt, Human
cagcucuuuaagaagaaugcac

SEQ ID NO: 1268236 - RNA, 24 nt, Human
caucuggacaccacuuucagccac

SEQ ID NO: 1268237 - RNA, 25 nt, Human
cauuuacacggcaaacaggaaugca

SEQ ID NO: 1268238 - RNA, 23 nt, Human
ccagacucccacauugggugagc

SEQ ID NO: 1268239 - RNA, 26 nt, Human
cccaaaacgcaaccuaaccaaagcaa

SEQ ID NO: 1268240 - RNA, 18 nt, Human
cccauaggauuccagagu

SEQ ID NO: 1268241 - RNA, 26 nt, Human
cgaagcagcgaugcauagcuuuccuu

SEQ ID NO: 1268242 - RNA, 18 nt, Human
cgcaaccuaaccaaagca

SEQ ID NO: 1268243 - RNA, 18 nt, Human
cguccacguccgucccac

SEQ ID NO: 1268244 - RNA, 25 nt, Human
cuaacauuuacacggcaaacaggaa

SEQ ID NO: 1268245 - RNA, 25 nt, Human
cuuucuaacauuuacacggcaaaca

SEQ ID NO: 1268246 - RNA, 21 nt, Human
gagcauagcgacaucacgugc

SEQ ID NO: 1268247 - RNA, 19 nt, Human
gaggacucuuagcugauac

SEQ ID NO: 1268248 - RNA, 21 nt, Human
gauggagcagggaagggcauc

SEQ ID NO: 1268249 - RNA, 18 nt, Human
gcaaaaaguuucaucugu

SEQ ID NO: 1268250 - RNA, 19 nt, Human
gcaaaccccaaaacgcaac

SEQ ID NO: 1268251 - RNA, 27 nt, Human
gcuaaacagaacccacguuacaccgug

SEQ ID NO: 1268252 - RNA, 21 nt, Human
gcucgcuugcucaaaccagac

SEQ ID NO: 1268253 - RNA, 18 nt, Human
ggacaucuggacaccacu

SEQ ID NO: 1268254 - RNA, 18 nt, Human
ggaggacucuuagcugau

SEQ ID NO: 1268255 - RNA, 24 nt, Human
ggcaaaccccaaaacgcaaccuaa

SEQ ID NO: 1268256 - RNA, 22 nt, Human
gucccugguggcggauacgccg

SEQ ID NO: 1268257 - RNA, 24 nt, Human
uaaacagaacccacguuacacaug

SEQ ID NO: 1268258 - RNA, 22 nt, Human
uaaagcaaaagagacauccuuu

SEQ ID NO: 1268259 - RNA, 22 nt, Human
uaaccguauauacaaacagcca

SEQ ID NO: 1268260 - RNA, 26 nt, Human
uaagaaaaccaacaacaacaaaaagc

SEQ ID NO: 1268261 - RNA, 25 nt, Human
uaagauuuucuuuuuuuuuuuuaaa

SEQ ID NO: 1268262 - RNA, 19 nt, Human
uaaguucucaacgacagcu

SEQ ID NO: 1268263 - RNA, 23 nt, Human
uaauaacuguauaaaauccaggc

SEQ ID NO: 1268264 - RNA, 24 nt, Human
uacacaugauaacuagagagcaca

SEQ ID NO: 1268265 - RNA, 22 nt, Human
uagcgacaucacgugcgguuuc

SEQ ID NO: 1268266 - RNA, 23 nt, Human
uaucuucgcuaaacagaacccac

SEQ ID NO: 1268267 - RNA, 24 nt, Human
ucacgugcgguuucuuaauguccc

SEQ ID NO: 1268268 - RNA, 24 nt, Human
ucggaaggacaucuggacaccacu

SEQ ID NO: 1268269 - RNA, 24 nt, Human
ugcaguuuaaagcaaaagagacau

SEQ ID NO: 1268270 - RNA, 25 nt, Human
uggcagcaugcaguuuaaagcaaaa

SEQ ID NO: 1268271 - RNA, 25 nt, Human
uuaagaaaaccaacaacaacaaaaa

SEQ ID NO: 1268272 - RNA, 25 nt, Human
uuaagcgacaacaaaaaaaggcaaa

SEQ ID NO: 1268273 - RNA, 18 nt, Human
uucucaacgacagcuuca

SEQ ID NO: 1268274 - RNA, 21 nt, Human
uugcucaaaccagacucccac

SEQ ID NO: 1268275 - RNA, 20 nt, Human
uuggauaguacauaagauuu

SEQ ID NO: 1268276 - RNA, 22 nt, Human
uuggcaauuuuauauuccacag

SEQ ID NO: 1268277 - RNA, 24 nt, Human
uuggcaauuuuauauuccacaguc

SEQ ID NO: 1268278 - RNA, 26 nt, Human
uuuaagcgacaacaaaaaaaggcaaa

SEQ ID NO: 1268279 - RNA, 24 nt, Human
uuucuuuuuuuuuuuuaaauuuuu

SEQ ID NO: 1268280 - RNA, 21 nt, Human
aaaaaaauucaggcagaggca

SEQ ID NO: 1268281 - RNA, 24 nt, Human
aaaguguuaggauuacaggcauga

SEQ ID NO: 1268282 - RNA, 22 nt, Human
aagaaggaaagcugccuaucac

SEQ ID NO: 1268283 - RNA, 26 nt, Human
aaguguuaggauuacaggcaugagcc

SEQ ID NO: 1268284 - RNA, 21 nt, Human
aauuccuaaacauugcaguuu

SEQ ID NO: 1268285 - RNA, 19 nt, Human
accguaauucauugaaccc

SEQ ID NO: 1268286 - RNA, 25 nt, Human
accguguugcccaggcuggucucaa

SEQ ID NO: 1268287 - RNA, 18 nt, Human
acgggguuucaccguguu

SEQ ID NO: 1268288 - RNA, 19 nt, Human
acgggguuucaccguguug

SEQ ID NO: 1268289 - RNA, 24 nt, Human
acgggguuucaccguguugcccag

SEQ ID NO: 1268290 - RNA, 19 nt, Human
acuacaggcgcaugcugcg

SEQ ID NO: 1268291 - RNA, 19 nt, Human
acuuccuuggcaucgaagu

SEQ ID NO: 1268292 - RNA, 21 nt, Human
agaaaaaaaaaacuugacaaa

SEQ ID NO: 1268293 - RNA, 23 nt, Human
agcaaaggccuuguucucccucg

SEQ ID NO: 1268294 - RNA, 21 nt, Human
agcacaaaaccucagcuugca

SEQ ID NO: 1268295 - RNA, 24 nt, Human
aggcaaucuucccaccuuggccuc

SEQ ID NO: 1268296 - RNA, 25 nt, Human
aggcaaucuucccaccuuggccucc

SEQ ID NO: 1268297 - RNA, 23 nt, Human
aggcaugagccacugugccuggc

SEQ ID NO: 1268298 - RNA, 20 nt, Human
aguagagacgggguuucacc

SEQ ID NO: 1268299 - RNA, 21 nt, Human
aguagagacgggguuucaccg

SEQ ID NO: 1268300 - RNA, 21 nt, Human
agugcgguggcuuaaucucag

SEQ ID NO: 1268301 - RNA, 24 nt, Human
auaaaagccucaugcagacacacc

SEQ ID NO: 1268302 - RNA, 22 nt, Human
auccuuuggcagaaucuccuag

SEQ ID NO: 1268303 - RNA, 24 nt, Human
auuuuuuguauuuuaguagagacg

SEQ ID NO: 1268304 - RNA, 24 nt, Human
caaaguguuaggauuacaggcaug

SEQ ID NO: 1268305 - RNA, 22 nt, Human
caaucaauucuccugccucagc

SEQ ID NO: 1268306 - RNA, 24 nt, Human
cacaaucuuaagguuuugccaccu

SEQ ID NO: 1268307 - RNA, 23 nt, Human
cacacguauuacaaacaagcuuc

SEQ ID NO: 1268308 - RNA, 21 nt, Human
caccguguugcccaggcuggu

SEQ ID NO: 1268309 - RNA, 24 nt, Human
caccguguugcccaggcuggucuc

SEQ ID NO: 1268310 - RNA, 27 nt, Human
caccguguugcccaggcuggucucaaa

SEQ ID NO: 1268311 - RNA, 19 nt, Human
cacguauuacaaacaagcu

SEQ ID NO: 1268312 - RNA, 23 nt, Human
cagcaaaggccuuguucucccuc

SEQ ID NO: 1268313 - RNA, 22 nt, Human
cagccccuggcagaaaucacca

SEQ ID NO: 1268314 - RNA, 23 nt, Human
cagccuccugagcagcugggacu

SEQ ID NO: 1268315 - RNA, 22 nt, Human
caggauacauuccuagaaauaa

SEQ ID NO: 1268316 - RNA, 21 nt, Human
caggcagaggcauacauggca

SEQ ID NO: 1268317 - RNA, 18 nt, Human
caugcugcgacgcccggc

SEQ ID NO: 1268318 - RNA, 19 nt, Human
cauguauaaccaauaaaau

SEQ ID NO: 1268319 - RNA, 22 nt, Human
cauuucuucggcgaaggaaugc

SEQ ID NO: 1268320 - RNA, 19 nt, Human
ccaaaguguuaggauuaca

SEQ ID NO: 1268321 - RNA, 24 nt, Human
ccaaaguguuaggauuacaggcau

SEQ ID NO: 1268322 - RNA, 23 nt, Human
cccggguucaaucaauucuccug

SEQ ID NO: 1268323 - RNA, 24 nt, Human
ccucccggguucaaucaauucucc

SEQ ID NO: 1268324 - RNA, 23 nt, Human
ccugagcagcugggacuacaggc

SEQ ID NO: 1268325 - RNA, 24 nt, Human
cggaaucuugcucugucgcccagg

SEQ ID NO: 1268326 - RNA, 24 nt, Human
cgggguuucaccguguugcccagg

SEQ ID NO: 1268327 - RNA, 23 nt, Human
cguguugcccaggcuggucucaa

SEQ ID NO: 1268328 - RNA, 24 nt, Human
cguguugcccaggcuggucucaaa

SEQ ID NO: 1268329 - RNA, 23 nt, Human
cuagaaauaaaaauucugggccc

SEQ ID NO: 1268330 - RNA, 24 nt, Human
cucaggcaaucuucccaccuuggc

SEQ ID NO: 1268331 - RNA, 24 nt, Human
cucagugcaaccucugccucccgg

SEQ ID NO: 1268332 - RNA, 23 nt, Human
cucugucgcccaggcuggagugc

SEQ ID NO: 1268333 - RNA, 23 nt, Human
cugccucagccuccugagcagcu

SEQ ID NO: 1268334 - RNA, 20 nt, Human
cuuauauaguuaguuuuaaa

SEQ ID NO: 1268335 - RNA, 18 nt, Human
gaaaauguguuauacccc

SEQ ID NO: 1268336 - RNA, 21 nt, Human
gaaaauguguuauaccccaag

SEQ ID NO: 1268337 - RNA, 20 nt, Human
gaaauuuauauucccaguag

SEQ ID NO: 1268338 - RNA, 22 nt, Human
gacgggguuucaccguguugcc

SEQ ID NO: 1268339 - RNA, 19 nt, Human
gacuacaggcgcaugcugc

SEQ ID NO: 1268340 - RNA, 23 nt, Human
gagacgggguuucaccguguugc

SEQ ID NO: 1268341 - RNA, 24 nt, Human
gagcacaaaaccucagcuugcauu

SEQ ID NO: 1268342 - RNA, 20 nt, Human
gagcagcugggacuacaggc

SEQ ID NO: 1268343 - RNA, 26 nt, Human
gagcagcugggacuacaggcgcaugc

SEQ ID NO: 1268344 - RNA, 21 nt, Human
gagucuucgaugauugcuuca

SEQ ID NO: 1268345 - RNA, 18 nt, Human
gauuacaggcaugagcca

SEQ ID NO: 1268346 - RNA, 21 nt, Human
gauuacaggcaugagccacug

SEQ ID NO: 1268347 - RNA, 24 nt, Human
gauuacaggcaugagccacugugc

SEQ ID NO: 1268348 - RNA, 19 nt, Human
gcacacguauuacaaacaa

SEQ ID NO: 1268349 - RNA, 19 nt, Human
gcccaggcuggagugcggu

SEQ ID NO: 1268350 - RNA, 24 nt, Human
gccccuggcagaaaucaccauuuc

SEQ ID NO: 1268351 - RNA, 23 nt, Human
gcccggcuaauuuuuuguauuuu

SEQ ID NO: 1268352 - RNA, 22 nt, Human
gccucaugcagacacaccguaa

SEQ ID NO: 1268353 - RNA, 22 nt, Human
gccuucugggguugacagcccu

SEQ ID NO: 1268354 - RNA, 18 nt, Human
ggaucaggcuuuucucuc

SEQ ID NO: 1268355 - RNA, 22 nt, Human
ggauuacaggcaugagccacug

SEQ ID NO: 1268356 - RNA, 24 nt, Human
ggauuacaggcaugagccacugug

SEQ ID NO: 1268357 - RNA, 27 nt, Human
ggccuuguucucccucgugcaaucuca

SEQ ID NO: 1268358 - RNA, 18 nt, Human
ggcuggagugcgguggcu

SEQ ID NO: 1268359 - RNA, 22 nt, Human
gggaacggaaucuugcucuguc

SEQ ID NO: 1268360 - RNA, 23 nt, Human
gggguuucaccguguugcccagg

SEQ ID NO: 1268361 - RNA, 22 nt, Human
ggguuucaccguguugcccagg

SEQ ID NO: 1268362 - RNA, 23 nt, Human
guagagacgggguuucaccgugu

SEQ ID NO: 1268363 - RNA, 24 nt, Human
gugcaaccucugccucccggguuc

SEQ ID NO: 1268364 - RNA, 21 nt, Human
guuuuuucucucucucuuuca

SEQ ID NO: 1268365 - RNA, 20 nt, Human
uaaaaaaauucaggcagagg

SEQ ID NO: 1268366 - RNA, 25 nt, Human
uaaguaaaauucuagaaagucuuag

SEQ ID NO: 1268367 - RNA, 23 nt, Human
uaauuuuuuguauuuuaguagag

SEQ ID NO: 1268368 - RNA, 24 nt, Human
uacacaaucuuaagguuuugccac

SEQ ID NO: 1268369 - RNA, 22 nt, Human
uacaggcaugagccacugugcc

SEQ ID NO: 1268370 - RNA, 21 nt, Human
uaggauuacaggcaugagcca

SEQ ID NO: 1268371 - RNA, 22 nt, Human
uaggauuacaggcaugagccac

SEQ ID NO: 1268372 - RNA, 22 nt, Human
uaggauuacaggcaugagccac

SEQ ID NO: 1268373 - RNA, 23 nt, Human
uaggauuacaggcaugagccacu

SEQ ID NO: 1268374 - RNA, 24 nt, Human
uaggauuacaggcaugagccacug

SEQ ID NO: 1268375 - RNA, 21 nt, Human
uaguagagacgggguuucacc

SEQ ID NO: 1268376 - RNA, 24 nt, Human
uaguagagacgggguuucaccgug

SEQ ID NO: 1268377 - RNA, 26 nt, Human
uaguagagacgggguuucaccguguu

SEQ ID NO: 1268378 - RNA, 23 nt, Human
ucaaagaaaaaaaaaacuugaca

SEQ ID NO: 1268379 - RNA, 26 nt, Human
ucaaagaaaaaaaaaacuugacaaau

SEQ ID NO: 1268380 - RNA, 25 nt, Human
ucaaucaauucuccugccucagccu

SEQ ID NO: 1268381 - RNA, 21 nt, Human
ucaccguguugcccaggcugg

SEQ ID NO: 1268382 - RNA, 24 nt, Human
ucagugcaaccucugccucccggg

SEQ ID NO: 1268383 - RNA, 25 nt, Human
ucauguuacuccucuugcacuuaau

SEQ ID NO: 1268384 - RNA, 24 nt, Human
ucccaaaguguuaggauuacaggc

SEQ ID NO: 1268385 - RNA, 21 nt, Human
ucccggguucaaucaauucuc

SEQ ID NO: 1268386 - RNA, 24 nt, Human
ucccggguucaaucaauucuccug

SEQ ID NO: 1268387 - RNA, 22 nt, Human
ucccucgugcaaucucaaaagc

SEQ ID NO: 1268388 - RNA, 24 nt, Human
uccugagcagcugggacuacaggc

SEQ ID NO: 1268389 - RNA, 22 nt, Human
ucgcccaggcuggagugcggug

SEQ ID NO: 1268390 - RNA, 25 nt, Human
ucuaccagccccuggcagaaaucac

SEQ ID NO: 1268391 - RNA, 23 nt, Human
ucucaaacuccugagcucaggca

SEQ ID NO: 1268392 - RNA, 19 nt, Human
ucucccuuugcccuuauug

SEQ ID NO: 1268393 - RNA, 20 nt, Human
ucucuguuuuucuuguguau

SEQ ID NO: 1268394 - RNA, 24 nt, Human
ucugucgcccaggcuggagugcgg

SEQ ID NO: 1268395 - RNA, 23 nt, Human
ucuugcucugucgcccaggcugg

SEQ ID NO: 1268396 - RNA, 24 nt, Human
ucuugcucugucgcccaggcugga

SEQ ID NO: 1268397 - RNA, 18 nt, Human
ugagaagaaacgaacugu

SEQ ID NO: 1268398 - RNA, 19 nt, Human
ugagaagaaacgaacugug

SEQ ID NO: 1268399 - RNA, 20 nt, Human
ugcaaccucugccucccggg

SEQ ID NO: 1268400 - RNA, 23 nt, Human
ugcaaccucugccucccggguuc

SEQ ID NO: 1268401 - RNA, 24 nt, Human
ugcccaggcuggucucaaacuccu

SEQ ID NO: 1268402 - RNA, 28 nt, Human
ugcccaggcuggucucaaacuccugagc

SEQ ID NO: 1268403 - RNA, 24 nt, Human
ugccucagccuccugagcagcugg

SEQ ID NO: 1268404 - RNA, 19 nt, Human
ugccuuaaaaaauauuugc

SEQ ID NO: 1268405 - RNA, 22 nt, Human
ugcgguggcuuaaucucagcuc

SEQ ID NO: 1268406 - RNA, 23 nt, Human
ugcgguggcuuaaucucagcuca

SEQ ID NO: 1268407 - RNA, 24 nt, Human
ugcucugucgcccaggcuggagug

SEQ ID NO: 1268408 - RNA, 20 nt, Human
uggcaccuauaaaaaugaua

SEQ ID NO: 1268409 - RNA, 24 nt, Human
uggcuuaaucucagcucagugcaa

SEQ ID NO: 1268410 - RNA, 21 nt, Human
ugggacuacaggcgcaugcug

SEQ ID NO: 1268411 - RNA, 22 nt, Human
ugggacuacaggcgcaugcugc

SEQ ID NO: 1268412 - RNA, 24 nt, Human
uguauaaccaauaaaauuggauaa

SEQ ID NO: 1268413 - RNA, 20 nt, Human
ugugucggccuucugggguu

SEQ ID NO: 1268414 - RNA, 22 nt, Human
uguugcccaggcuggucucaaa

SEQ ID NO: 1268415 - RNA, 18 nt, Human
uuaguagagacgggguuu

SEQ ID NO: 1268416 - RNA, 22 nt, Human
uuaguagagacgggguuucacc

SEQ ID NO: 1268417 - RNA, 24 nt, Human
uuaguagagacgggguuucaccgu

SEQ ID NO: 1268418 - RNA, 24 nt, Human
uuauauaguuaguuuuaaaaaucu

SEQ ID NO: 1268419 - RNA, 25 nt, Human
uucaaagaaaaaaaaaacuugacaa

SEQ ID NO: 1268420 - RNA, 22 nt, Human
uuccuaauuuagaaagucuuca

SEQ ID NO: 1268421 - RNA, 22 nt, Human
uuccuagaaauaaaaauucugg

SEQ ID NO: 1268422 - RNA, 20 nt, Human
uuccucaggauacauuccua

SEQ ID NO: 1268423 - RNA, 20 nt, Human
uuccuuggcaucgaagucgc

SEQ ID NO: 1268424 - RNA, 23 nt, Human
uuccuuggcaucgaagucgcuua

SEQ ID NO: 1268425 - RNA, 24 nt, Human
uugcucugucgcccaggcuggagu

SEQ ID NO: 1268426 - RNA, 20 nt, Human
uuggccucccaaaguguuag

SEQ ID NO: 1268427 - RNA, 22 nt, Human
uuucaccguguugcccaggcug

SEQ ID NO: 1268428 - RNA, 23 nt, Human
uuuuaguagagacgggguuucac

SEQ ID NO: 1268429 - RNA, 22 nt, Human
uuuugcauuucuuucaugaaaa

SEQ ID NO: 1268430 - RNA, 20 nt, Human
uuuuuguauuuuaguagaga

SEQ ID NO: 1268431 - RNA, 22 nt, Human
aagacaaaauuucaauuaagga

SEQ ID NO: 1268432 - RNA, 18 nt, Human
agaaagauaaacgauucu

SEQ ID NO: 1268433 - RNA, 22 nt, Human
agcaagagcuucaucauggugu

SEQ ID NO: 1268434 - RNA, 25 nt, Human
caacaggcaucuguccacuuuaaau

SEQ ID NO: 1268435 - RNA, 19 nt, Human
caccuugagucugucuugg

SEQ ID NO: 1268436 - RNA, 25 nt, Human
caggcaucuguccacuuuaaauucu

SEQ ID NO: 1268437 - RNA, 20 nt, Human
caucaaaaaguugcaguugg

SEQ ID NO: 1268438 - RNA, 26 nt, Human
ccaaagacaaaauuucaauuaaggac

SEQ ID NO: 1268439 - RNA, 20 nt, Human
ccguuuaugggguaaacuug

SEQ ID NO: 1268440 - RNA, 24 nt, Human
cuaacuacuuuuuaaaaagcaaga

SEQ ID NO: 1268441 - RNA, 21 nt, Human
cuccaacaggcaucuguccac

SEQ ID NO: 1268442 - RNA, 23 nt, Human
gcaaugaaagaaacaaaguaaga

SEQ ID NO: 1268443 - RNA, 22 nt, Human
gggaaaaaaauuaacaucaaaa

SEQ ID NO: 1268444 - RNA, 23 nt, Human
uaaggacagucugauauuuauau

SEQ ID NO: 1268445 - RNA, 18 nt, Human
uacuaaaauucaugcaga

SEQ ID NO: 1268446 - RNA, 22 nt, Human
uacuuuuuaaaaagcaagagcu

SEQ ID NO: 1268447 - RNA, 20 nt, Human
uccacgcuuccuccaccuug

SEQ ID NO: 1268448 - RNA, 20 nt, Human
ucuggagcuccacagccuuu

SEQ ID NO: 1268449 - RNA, 18 nt, Human
ucugucuuggauggaggu

SEQ ID NO: 1268450 - RNA, 19 nt, Human
ugaaagauguugaagaucc

SEQ ID NO: 1268451 - RNA, 24 nt, Human
ugcacagggaaaaaaauuaacauc

SEQ ID NO: 1268452 - RNA, 18 nt, Human
ugggguaaacuuguaacc

SEQ ID NO: 1268453 - RNA, 19 nt, Human
uuccaaaaauaaaacugca

SEQ ID NO: 1268454 - RNA, 24 nt, Human
uucuuugacugugcacugggagcu

SEQ ID NO: 1268455 - RNA, 23 nt, Human
uuuuuaaaguuuacuaaaauuca

SEQ ID NO: 1268456 - RNA, 18 nt, Human
aaaaaaaaaaaaaccaca

SEQ ID NO: 1268457 - RNA, 21 nt, Human
aaaaaaaaaaccacagacagc

SEQ ID NO: 1268458 - RNA, 24 nt, Human
aaaaaaaaaucuuuuaaaaacaga

SEQ ID NO: 1268459 - RNA, 22 nt, Human
aaaaaaagaaaaaaaugcuuag

SEQ ID NO: 1268460 - RNA, 22 nt, Human
aaggggcugccgggcuuccacc

SEQ ID NO: 1268461 - RNA, 23 nt, Human
aauccacagccgcaaguuucccc

SEQ ID NO: 1268462 - RNA, 19 nt, Human
acagaaaauauaaucucau

SEQ ID NO: 1268463 - RNA, 19 nt, Human
acagccgcaaguuucccca

SEQ ID NO: 1268464 - RNA, 25 nt, Human
accaagagaaaugcuggaaaacggu

SEQ ID NO: 1268465 - RNA, 24 nt, Human
accccucccuuuccggucccccaa

SEQ ID NO: 1268466 - RNA, 21 nt, Human
agccaggcugacagcagcucg

SEQ ID NO: 1268467 - RNA, 26 nt, Human
aggcaauguuuucugguagagaugcu

SEQ ID NO: 1268468 - RNA, 21 nt, Human
aucccugguaaaacagcuggc

SEQ ID NO: 1268469 - RNA, 24 nt, Human
caaaugaaaauaugcuccagacau

SEQ ID NO: 1268470 - RNA, 25 nt, Human
cacccccuacuuccucuaugucucu

SEQ ID NO: 1268471 - RNA, 24 nt, Human
caccccucccuuuccgguccccca

SEQ ID NO: 1268472 - RNA, 24 nt, Human
cacugcguuacgcuacgccacgcc

SEQ ID NO: 1268473 - RNA, 23 nt, Human
cagcuggcagccuuuucuguuuc

SEQ ID NO: 1268474 - RNA, 23 nt, Human
caguuggccugacaacacuuugg

SEQ ID NO: 1268475 - RNA, 21 nt, Human
caucugcuuuucuuuauacuc

SEQ ID NO: 1268476 - RNA, 18 nt, Human
ccacaccucaucgaggca

SEQ ID NO: 1268477 - RNA, 25 nt, Human
ccccaacacugcguuacgcuacgcc

SEQ ID NO: 1268478 - RNA, 20 nt, Human
cccccggagguuccuaaccc

SEQ ID NO: 1268479 - RNA, 24 nt, Human
cccccuauuucucggcggaaaguc

SEQ ID NO: 1268480 - RNA, 19 nt, Human
ccugcggcccaccccuccc

SEQ ID NO: 1268481 - RNA, 19 nt, Human
cgccugcggcccaccccuc

SEQ ID NO: 1268482 - RNA, 20 nt, Human
cggcccaccccucccuuucc

SEQ ID NO: 1268483 - RNA, 21 nt, Human
cggcgccugcggcccaccccu

SEQ ID NO: 1268484 - RNA, 21 nt, Human
cggcggaaagucgcuuccggc

SEQ ID NO: 1268485 - RNA, 24 nt, Human
cguugcaaagaaccaaaaaaagaa

SEQ ID NO: 1268486 - RNA, 20 nt, Human
gaaccaaaaaaagaaaaaaa

SEQ ID NO: 1268487 - RNA, 22 nt, Human
gcccccggagguuccuaacccu

SEQ ID NO: 1268488 - RNA, 19 nt, Human
ggucccccaauccacagcc

SEQ ID NO: 1268489 - RNA, 24 nt, Human
gguguuuuguuuuuuuuuuucuuu

SEQ ID NO: 1268490 - RNA, 19 nt, Human
guaaaacagcuggcagccu

SEQ ID NO: 1268491 - RNA, 23 nt, Human
uaagccaggcugacagcagcucg

SEQ ID NO: 1268492 - RNA, 23 nt, Human
uacaaauuaaaacauuagaucac

SEQ ID NO: 1268493 - RNA, 18 nt, Human
uagaaggggcugccgggc

SEQ ID NO: 1268494 - RNA, 24 nt, Human
ucacugagccaaugccacucacgu

SEQ ID NO: 1268495 - RNA, 25 nt, Human
uccacagccgcaaguuuccccaaca

SEQ ID NO: 1268496 - RNA, 18 nt, Human
ucugagcauccaucccuc

SEQ ID NO: 1268497 - RNA, 28 nt, Human
ugacaacacuuugguuaaaaaaaaaaaa

SEQ ID NO: 1268498 - RNA, 19 nt, Human
ugcaaagaaccaaaaaaag

SEQ ID NO: 1268499 - RNA, 20 nt, Human
ugguaaaacagcuggcagcc

SEQ ID NO: 1268500 - RNA, 23 nt, Human
uguuuggaauuuucauuucugag

SEQ ID NO: 1268501 - RNA, 21 nt, Human
uguuuuuuuuuuucuuuccga

SEQ ID NO: 1268502 - RNA, 24 nt, Human
uuaaaaaaaaaaaaaccacagacu

SEQ ID NO: 1268503 - RNA, 23 nt, Human
uucaguuggccugacaacacuuu

SEQ ID NO: 1268504 - RNA, 19 nt, Human
uucugagcauccaucccuc

SEQ ID NO: 1268505 - RNA, 24 nt, Human
uugcaaagaaccaaaaaaagaaaa

SEQ ID NO: 1268506 - RNA, 19 nt, Human
uugguuaaaaaaaaaaaaa

SEQ ID NO: 1268507 - RNA, 18 nt, Human
uuucucaagccuagccga

SEQ ID NO: 1268508 - RNA, 19 nt, Human
uuuucugguagagaugcuc

SEQ ID NO: 1268509 - RNA, 23 nt, Human
uuuuuuuuuuucuuuccgaauua

SEQ ID NO: 1268510 - RNA, 23 nt, Human
cacaccacccaaggcugauguuu

SEQ ID NO: 1268511 - RNA, 22 nt, Human
cugaggcagucgguguguuucc

SEQ ID NO: 1268512 - RNA, 25 nt, Human
uaccuaucuguauaguuccaggagc

SEQ ID NO: 1268513 - RNA, 25 nt, Human
uaggaacacaccacccaaccuucag

SEQ ID NO: 1268514 - RNA, 23 nt, Human
uaggaacacaccacccaaggcug

SEQ ID NO: 1268515 - RNA, 18 nt, Human
uauauguacacacauaca

SEQ ID NO: 1268516 - RNA, 24 nt, Human
uauguacacacauacaaaggccug

SEQ ID NO: 1268517 - RNA, 22 nt, Human
uccaggagccuacaggcggucg

SEQ ID NO: 1268518 - RNA, 24 nt, Human
ucccuuuggaguuuauauaggaac

SEQ ID NO: 1268519 - RNA, 23 nt, Human
ucugggacaucaauguccacuuu

SEQ ID NO: 1268520 - RNA, 30 nt, Human
ugauguuuuguuauauauauauauauguaa

SEQ ID NO: 1268521 - RNA, 18 nt, Human
ugcugaggcagucggugu

SEQ ID NO: 1268522 - RNA, 22 nt, Human
uguacacacauacaaaggccug

SEQ ID NO: 1268523 - RNA, 25 nt, Human
uguuuuguuauauauauauauaugu

SEQ ID NO: 1268524 - RNA, 20 nt, Human
agcuucgaguggccagcacc

SEQ ID NO: 1268525 - RNA, 20 nt, Human
aguggccagcaccuuggagc

SEQ ID NO: 1268526 - RNA, 19 nt, Human
auggagaucuugggggccu

SEQ ID NO: 1268527 - RNA, 18 nt, Human
caccuuggagcucugguc

SEQ ID NO: 1268528 - RNA, 21 nt, Human
cagccguggcuugaucuucgu

SEQ ID NO: 1268529 - RNA, 18 nt, Human
ccccgagcccgagggcag

SEQ ID NO: 1268530 - RNA, 19 nt, Human
ccccgaggucuccuuccac

SEQ ID NO: 1268531 - RNA, 24 nt, Human
cggcucugggucuccccgaggucu

SEQ ID NO: 1268532 - RNA, 22 nt, Human
cuccuuccacuccaucuuccga

SEQ ID NO: 1268533 - RNA, 20 nt, Human
cugaagcagaaauggccccu

SEQ ID NO: 1268534 - RNA, 24 nt, Human
cuuucaacuuugcaucaggacacu

SEQ ID NO: 1268535 - RNA, 21 nt, Human
gaucacggucuucccagacug

SEQ ID NO: 1268536 - RNA, 19 nt, Human
ggagcuucgaguggccagc

SEQ ID NO: 1268537 - RNA, 19 nt, Human
ggauauccacagcagagcc

SEQ ID NO: 1268538 - RNA, 23 nt, Human
gguacuccucaucauccccgcuc

SEQ ID NO: 1268539 - RNA, 19 nt, Human
guccacaucaggcauggag

SEQ ID NO: 1268540 - RNA, 25 nt, Human
uccacagcagagccugucggagagg

SEQ ID NO: 1268541 - RNA, 21 nt, Human
ugcccccgagcccgagggcag

SEQ ID NO: 1268542 - RNA, 22 nt, Human
uggagcucugguccugaagcag

SEQ ID NO: 1268543 - RNA, 19 nt, Human
uucaacuuugcaucaggac

SEQ ID NO: 1268544 - RNA, 21 nt, Human
uucccggccagucacauccac

SEQ ID NO: 1268545 - RNA, 19 nt, Human
uucuggucacugugauggu

SEQ ID NO: 1268546 - RNA, 19 nt, Human
uugggggccuugaagugca

SEQ ID NO: 1268547 - RNA, 18 nt, Human
acccuccccccccaccac

SEQ ID NO: 1268548 - RNA, 18 nt, Human
caccccuccccggcagcu

SEQ ID NO: 1268549 - RNA, 20 nt, Human
caccccuccccggcagcuca

SEQ ID NO: 1268550 - RNA, 18 nt, Human
cacccuccccccccacca

SEQ ID NO: 1268551 - RNA, 21 nt, Human
cacccuccccccccaccaccc

SEQ ID NO: 1268552 - RNA, 25 nt, Human
cacccuccccccccaccaccccucc

SEQ ID NO: 1268553 - RNA, 19 nt, Human
caccuccccccucccccac

SEQ ID NO: 1268554 - RNA, 22 nt, Human
caccuccccccucccccacccc

SEQ ID NO: 1268555 - RNA, 21 nt, Human
cacuauccuggucaucucccu

SEQ ID NO: 1268556 - RNA, 18 nt, Human
cagcucagccccaccccg

SEQ ID NO: 1268557 - RNA, 23 nt, Human
cagcuucauggcugacaggugac

SEQ ID NO: 1268558 - RNA, 26 nt, Human
caucugagccugcugguuuugacuuu

SEQ ID NO: 1268559 - RNA, 24 nt, Human
caucuuuugccucuucuucaggag

SEQ ID NO: 1268560 - RNA, 22 nt, Human
cauguucauccuucucaucccg

SEQ ID NO: 1268561 - RNA, 23 nt, Human
ccaccaccccuccccggcagcuc

SEQ ID NO: 1268562 - RNA, 18 nt, Human
ccaccuccccccuccccc

SEQ ID NO: 1268563 - RNA, 21 nt, Human
cccaccaccccuccccggcag

SEQ ID NO: 1268564 - RNA, 18 nt, Human
ccccagaccaaagggugg

SEQ ID NO: 1268565 - RNA, 19 nt, Human
ccccagaccaaaggguggg

SEQ ID NO: 1268566 - RNA, 18 nt, Human
cccccaccaccccucccc

SEQ ID NO: 1268567 - RNA, 21 nt, Human
ccccccaccaccccuccccgg

SEQ ID NO: 1268568 - RNA, 25 nt, Human
ccccccgccgcucaccaucugagcc

SEQ ID NO: 1268569 - RNA, 20 nt, Human
ccccccucccccaccccugc

SEQ ID NO: 1268570 - RNA, 24 nt, Human
ccccuccccggcagcucagccccc

SEQ ID NO: 1268571 - RNA, 19 nt, Human
ccccuguuuuccuugguug

SEQ ID NO: 1268572 - RNA, 23 nt, Human
ccccuguuuuccuugguuguguu

SEQ ID NO: 1268573 - RNA, 23 nt, Human
cccugcuugagcacccucccccc

SEQ ID NO: 1268574 - RNA, 21 nt, Human
ccuccauagcggucuuugcuc

SEQ ID NO: 1268575 - RNA, 19 nt, Human
ccuccccggcagcucagcc

SEQ ID NO: 1268576 - RNA, 19 nt, Human
ccucggaucccggcgucuc

SEQ ID NO: 1268577 - RNA, 19 nt, Human
ccucggcggccuugucacc

SEQ ID NO: 1268578 - RNA, 25 nt, Human
ccugcuugagcacccucccccccca

SEQ ID NO: 1268579 - RNA, 22 nt, Human
cuccccccucccccaccccugc

SEQ ID NO: 1268580 - RNA, 23 nt, Human
cugagccugcugguuuugacuuu

SEQ ID NO: 1268581 - RNA, 22 nt, Human
cugcugguuuugacuuuucacu

SEQ ID NO: 1268582 - RNA, 21 nt, Human
cuucauggcugacaggugacc

SEQ ID NO: 1268583 - RNA, 23 nt, Human
cuucucaucccgcugucucuuua

SEQ ID NO: 1268584 - RNA, 22 nt, Human
gagaaaaguggcugcccuccau

SEQ ID NO: 1268585 - RNA, 21 nt, Human
guaagccuccucucggaauuc

SEQ ID NO: 1268586 - RNA, 24 nt, Human
guuuccaccuccccccucccccac

SEQ ID NO: 1268587 - RNA, 23 nt, Human
uaccuuugccucaaagcagacuu

SEQ ID NO: 1268588 - RNA, 23 nt, Human
uaguaagcucggccauguucauc

SEQ ID NO: 1268589 - RNA, 18 nt, Human
uauccuggucaucucccu

SEQ ID NO: 1268590 - RNA, 18 nt, Human
uccccccucccccacccc

SEQ ID NO: 1268591 - RNA, 18 nt, Human
uccccggcagcucagccc

SEQ ID NO: 1268592 - RNA, 19 nt, Human
ucccgcugucucuuuaccc

SEQ ID NO: 1268593 - RNA, 24 nt, Human
uccguaaguacuccuugccccaga

SEQ ID NO: 1268594 - RNA, 20 nt, Human
uccuugccccagaccaaagg

SEQ ID NO: 1268595 - RNA, 21 nt, Human
ucggccauguucauccuucuc

SEQ ID NO: 1268596 - RNA, 21 nt, Human
ucucuuuaccccccgccgcuc

SEQ ID NO: 1268597 - RNA, 23 nt, Human
ucugagccugcugguuuugacuu

SEQ ID NO: 1268598 - RNA, 19 nt, Human
ugagaaaaguggcugcccu

SEQ ID NO: 1268599 - RNA, 25 nt, Human
ugccccagaccaaaggguggggaac

SEQ ID NO: 1268600 - RNA, 24 nt, Human
ugcuugagcacccuccccccccaa

SEQ ID NO: 1268601 - RNA, 23 nt, Human
uggcugcccuccauagcggucuu

SEQ ID NO: 1268602 - RNA, 19 nt, Human
ugucucuuuaccccccgcc

SEQ ID NO: 1268603 - RNA, 24 nt, Human
ugucucuuuaccccccgccgcuca

SEQ ID NO: 1268604 - RNA, 20 nt, Human
uguuuguuuccaccuccccc

SEQ ID NO: 1268605 - RNA, 26 nt, Human
uguuuguuuccaccuccccccucccc

SEQ ID NO: 1268606 - RNA, 24 nt, Human
uuaccccccgccgcucaccaucug

SEQ ID NO: 1268607 - RNA, 21 nt, Human
uucaggaggcaguggagacuu

SEQ ID NO: 1268608 - RNA, 24 nt, Human
uuccuugguuguguuuugcggggg

SEQ ID NO: 1268609 - RNA, 19 nt, Human
uuuguuguuuguuuccacc

SEQ ID NO: 1268610 - RNA, 18 nt, Human
aucaccucugcgugaauc

SEQ ID NO: 1268611 - RNA, 22 nt, Human
cccggagccugggccuucggcc

SEQ ID NO: 1268612 - RNA, 20 nt, Human
uaaccugugagcaucaccuc

SEQ ID NO: 1268613 - RNA, 21 nt, Human
ugaaucccggagccugggccu

SEQ ID NO: 1268614 - RNA, 19 nt, Human
ugagcaucaccucugcgug

SEQ ID NO: 1268615 - RNA, 18 nt, Human
ugugagcaucaccucugc

SEQ ID NO: 1268616 - RNA, 18 nt, Human
ugugagcaucaccucugc

SEQ ID NO: 1268617 - RNA, 20 nt, Human
agagggaaagggauggcugc

SEQ ID NO: 1268618 - RNA, 19 nt, Human
agcuuguuuaacuggugau

SEQ ID NO: 1268619 - RNA, 21 nt, Human
agggaaagggauggcugcugg

SEQ ID NO: 1268620 - RNA, 19 nt, Human
agggauuggcuguucugcu

SEQ ID NO: 1268621 - RNA, 20 nt, Human
aucccacccccauuccugaa

SEQ ID NO: 1268622 - RNA, 19 nt, Human
cagcucccaucccaccccc

SEQ ID NO: 1268623 - RNA, 19 nt, Human
caugcacaggcguggugua

SEQ ID NO: 1268624 - RNA, 23 nt, Human
ccaucccacccccauuccugaac

SEQ ID NO: 1268625 - RNA, 20 nt, Human
ccuguacacaggccugucgu

SEQ ID NO: 1268626 - RNA, 23 nt, Human
cucacguguccacacgguggcca

SEQ ID NO: 1268627 - RNA, 24 nt, Human
cuggugaugggcggcagccaagac

SEQ ID NO: 1268628 - RNA, 23 nt, Human
cuguucugcugugggcuugguca

SEQ ID NO: 1268629 - RNA, 20 nt, Human
gauggcugcugguggaggga

SEQ ID NO: 1268630 - RNA, 22 nt, Human
gcggcagccaagacagagggaa

SEQ ID NO: 1268631 - RNA, 24 nt, Human
ggaaugggcagagaccccagaggg

SEQ ID NO: 1268632 - RNA, 21 nt, Human
ggugaugggcggcagccaaga

SEQ ID NO: 1268633 - RNA, 30 nt, Human
ggugaugggcggcagccaagacagagggaa

SEQ ID NO: 1268634 - RNA, 19 nt, Human
guguagacacacacaugua

SEQ ID NO: 1268635 - RNA, 25 nt, Human
guguagacacacacauguauuuuca

SEQ ID NO: 1268636 - RNA, 24 nt, Human
ucauaugcaugcugggacguguag

SEQ ID NO: 1268637 - RNA, 20 nt, Human
ucccaucccacccccauucc

SEQ ID NO: 1268638 - RNA, 21 nt, Human
ucccaucccacccccauuccu

SEQ ID NO: 1268639 - RNA, 18 nt, Human
ugcaugcucacgugucca

SEQ ID NO: 1268640 - RNA, 19 nt, Human
ugggagaagccuaagcuug

SEQ ID NO: 1268641 - RNA, 23 nt, Human
uguacacaggccugucguacaug

SEQ ID NO: 1268642 - RNA, 27 nt, Human
ugugcaugcucacgugucccggagccc

SEQ ID NO: 1268643 - RNA, 21 nt, Human
uguguugauuuuuguuaaguu

SEQ ID NO: 1268644 - RNA, 22 nt, Human
uucaugcacaggcgugguguac

SEQ ID NO: 1268645 - RNA, 22 nt, Human
uucaugcacaggcgugguguac

SEQ ID NO: 1268646 - RNA, 19 nt, Human
aagcaucuggcuuagucga

SEQ ID NO: 1268647 - RNA, 19 nt, Human
aagccuuuuugggggaugg

SEQ ID NO: 1268648 - RNA, 22 nt, Human
acacccaggguugccaaaacca

SEQ ID NO: 1268649 - RNA, 22 nt, Human
aggaacaugagaagcaucuggc

SEQ ID NO: 1268650 - RNA, 22 nt, Human
aggcaaaggcacugacuacaug

SEQ ID NO: 1268651 - RNA, 19 nt, Human
aggcagguugccaguagga

SEQ ID NO: 1268652 - RNA, 19 nt, Human
agguccauuuugagaauga

SEQ ID NO: 1268653 - RNA, 23 nt, Human
auuacauuugauuguuuuuuaac

SEQ ID NO: 1268654 - RNA, 24 nt, Human
cacacccaggguugccaaaaccac

SEQ ID NO: 1268655 - RNA, 23 nt, Human
ccacacccaggguugccaaaacc

SEQ ID NO: 1268656 - RNA, 23 nt, Human
cccacacccaggguugccaaaac

SEQ ID NO: 1268657 - RNA, 23 nt, Human
cuaaaugguguuuugcuuuccuc

SEQ ID NO: 1268658 - RNA, 23 nt, Human
cuuuuugggggaugguagcccua

SEQ ID NO: 1268659 - RNA, 28 nt, Human
gaagcagcucccacacccaggguugcca

SEQ ID NO: 1268660 - RNA, 23 nt, Human
gcucaggggauguaugaggucac

SEQ ID NO: 1268661 - RNA, 25 nt, Human
ggugcaacacaauuggccaggaggg

SEQ ID NO: 1268662 - RNA, 18 nt, Human
gucuuggauuuuuuuccc

SEQ ID NO: 1268663 - RNA, 26 nt, Human
uaacaucaaccuuucaggugguucag

SEQ ID NO: 1268664 - RNA, 26 nt, Human
ucagaagguacaugggauacugcauu

SEQ ID NO: 1268665 - RNA, 22 nt, Human
ucagugcccaaggugcaacaca

SEQ ID NO: 1268666 - RNA, 20 nt, Human
ucauuuacaaaaugcuauuu

SEQ ID NO: 1268667 - RNA, 20 nt, Human
ucccacacccaggguugcca

SEQ ID NO: 1268668 - RNA, 19 nt, Human
ugccaagagaagcagcucc

SEQ ID NO: 1268669 - RNA, 22 nt, Human
ugcugugauuauggaugagcac

SEQ ID NO: 1268670 - RNA, 23 nt, Human
uggacaggcugggcagagauggu

SEQ ID NO: 1268671 - RNA, 23 nt, Human
uggaugagcacuuaaacacaugg

SEQ ID NO: 1268672 - RNA, 18 nt, Human
uguaccugauuauggaag

SEQ ID NO: 1268673 - RNA, 20 nt, Human
ugugauuuaucauuuugcug

SEQ ID NO: 1268674 - RNA, 20 nt, Human
uuaaaagacuuaaugcagcg

SEQ ID NO: 1268675 - RNA, 19 nt, Human
uugaggcacaaauaugaug

SEQ ID NO: 1268676 - RNA, 19 nt, Human
uugccaaaaccacacgcag

SEQ ID NO: 1268677 - RNA, 22 nt, Human
gcuucuuaaaauuuggucacuu

SEQ ID NO: 1268678 - RNA, 24 nt, Human
agauccaggagguggaggaggagg

SEQ ID NO: 1268679 - RNA, 18 nt, Human
aggaggagaaggccaaga

SEQ ID NO: 1268680 - RNA, 23 nt, Human
aggaggagaaggccaagaagucg

SEQ ID NO: 1268681 - RNA, 24 nt, Human
aggagggggugucccccauggagg

SEQ ID NO: 1268682 - RNA, 21 nt, Human
caggagguggaggaggagggg

SEQ ID NO: 1268683 - RNA, 21 nt, Human
cagucucgcuucaagacgcag

SEQ ID NO: 1268684 - RNA, 20 nt, Human
cauggaggaggagaaggcca

SEQ ID NO: 1268685 - RNA, 19 nt, Human
ccaacacucucgcugaaca

SEQ ID NO: 1268686 - RNA, 19 nt, Human
ccgcagcacgcagagccug

SEQ ID NO: 1268687 - RNA, 21 nt, Human
ccugcgccgcagcacgcagag

SEQ ID NO: 1268688 - RNA, 22 nt, Human
cgccaacacucucgcugaacac

SEQ ID NO: 1268689 - RNA, 19 nt, Human
gccgcagcacgcagagccu

SEQ ID NO: 1268690 - RNA, 20 nt, Human
gcgccgcagcacgcagagcc

SEQ ID NO: 1268691 - RNA, 20 nt, Human
uccaggagguggaggaggag

SEQ ID NO: 1268692 - RNA, 22 nt, Human
ugcagagccuggagugccugcg

SEQ ID NO: 1268693 - RNA, 19 nt, Human
aaagcucaguuuccagcuc

SEQ ID NO: 1268694 - RNA, 24 nt, Human
aaucacuugaaccugggaggcgga

SEQ ID NO: 1268695 - RNA, 18 nt, Human
aauugcacuccagcagca

SEQ ID NO: 1268696 - RNA, 28 nt, Human
aauugcacuccagcagcagaacaguggu

SEQ ID NO: 1268697 - RNA, 26 nt, Human
aauugcacuccagcagcaggggugac

SEQ ID NO: 1268698 - RNA, 22 nt, Human
aggcaggagaaucacuugaacc

SEQ ID NO: 1268699 - RNA, 24 nt, Human
aggcaggagaaucacuugaaccug

SEQ ID NO: 1268700 - RNA, 21 nt, Human
aggcccuggcccagcagccaa

SEQ ID NO: 1268701 - RNA, 21 nt, Human
aggcggagcuugcaaugagcc

SEQ ID NO: 1268702 - RNA, 24 nt, Human
aggcggagcuugcaaugagccgag

SEQ ID NO: 1268703 - RNA, 24 nt, Human
aggcugaggcaggagaaucacuug

SEQ ID NO: 1268704 - RNA, 24 nt, Human
agggaggcugaggcaggagaauca

SEQ ID NO: 1268705 - RNA, 18 nt, Human
auugcacuccagcagcag

SEQ ID NO: 1268706 - RNA, 20 nt, Human
auugcacuccagcagcaggg

SEQ ID NO: 1268707 - RNA, 20 nt, Human
caccaugcuggccucaggag

SEQ ID NO: 1268708 - RNA, 21 nt, Human
cacuugaaccugggaggcgga

SEQ ID NO: 1268709 - RNA, 18 nt, Human
ccagcagccaagagggcc

SEQ ID NO: 1268710 - RNA, 24 nt, Human
ccaggcccuggcccagcagccaag

SEQ ID NO: 1268711 - RNA, 24 nt, Human
cgagauugugcaauugcacuccag

SEQ ID NO: 1268712 - RNA, 23 nt, Human
cugugaucaucacagucccuucu

SEQ ID NO: 1268713 - RNA, 20 nt, Human
cuuugggcugaacccuuuuc

SEQ ID NO: 1268714 - RNA, 23 nt, Human
gagaaucacuugaaccugggagg

SEQ ID NO: 1268715 - RNA, 23 nt, Human
gagcuugcaaugagccgagauug

SEQ ID NO: 1268716 - RNA, 23 nt, Human
gcaggagaaucacuugaaccugg

SEQ ID NO: 1268717 - RNA, 24 nt, Human
ggagcuugcaaugagccgagauug

SEQ ID NO: 1268718 - RNA, 23 nt, Human
gggaggcugaggcaggagaauca

SEQ ID NO: 1268719 - RNA, 19 nt, Human
ucacuugaaccugggaggc

SEQ ID NO: 1268720 - RNA, 21 nt, Human
ucagcugcugucucuggcugc

SEQ ID NO: 1268721 - RNA, 18 nt, Human
ucucuggcugcuaccacc

SEQ ID NO: 1268722 - RNA, 22 nt, Human
ugaaaaaccaggcccuggccca

SEQ ID NO: 1268723 - RNA, 24 nt, Human
ugaggcaggagaaucacuugaacc

SEQ ID NO: 1268724 - RNA, 25 nt, Human
ugaggcaggagaaucacuugaaccu

SEQ ID NO: 1268725 - RNA, 23 nt, Human
ugcacuccagcagcaggggugac

SEQ ID NO: 1268726 - RNA, 22 nt, Human
ugcccugugaaaaaccaggccc

SEQ ID NO: 1268727 - RNA, 26 nt, Human
uggcccagcagccaagagggccggga

SEQ ID NO: 1268728 - RNA, 29 nt, Human
ugggaggcggagcuugcaaugacaacggu

SEQ ID NO: 1268729 - RNA, 21 nt, Human
uggugcccugugaaaaaccag

SEQ ID NO: 1268730 - RNA, 19 nt, Human
uuaaagcucaguuuccagc

SEQ ID NO: 1268731 - RNA, 21 nt, Human
uuaaagcucaguuuccagcuc

SEQ ID NO: 1268732 - RNA, 20 nt, Human
uugaaccugggaggcggagc

SEQ ID NO: 1268733 - RNA, 22 nt, Human
uugcaaugagccgagauugugc

SEQ ID NO: 1268734 - RNA, 25 nt, Human
uuuccagcucccagagauccccuuu

SEQ ID NO: 1268735 - RNA, 23 nt, Human
cccacacauguguccugaggagu

SEQ ID NO: 1268736 - RNA, 22 nt, Human
cgcucucuacuuggcccacaca

SEQ ID NO: 1268737 - RNA, 18 nt, Human
gcccugggggugcagggg

SEQ ID NO: 1268738 - RNA, 18 nt, Human
ggccaugguccuugaggg

SEQ ID NO: 1268739 - RNA, 23 nt, Human
ggggaaguucacagagccauuua

SEQ ID NO: 1268740 - RNA, 22 nt, Human
ucuuggccucugcaccucuccu

SEQ ID NO: 1268741 - RNA, 24 nt, Human
ucuugggcaaaacggucuuggccu

SEQ ID NO: 1268742 - RNA, 20 nt, Human
ugagccccacaaccgaccag

SEQ ID NO: 1268743 - RNA, 20 nt, Human
uggcccacacauguguccug

SEQ ID NO: 1268744 - RNA, 19 nt, Human
uggccucugcaccucuccu

SEQ ID NO: 1268745 - RNA, 18 nt, Human
ugggcaaaacggucuugg

SEQ ID NO: 1268746 - RNA, 19 nt, Human
aaauagcccaguaauaaag

SEQ ID NO: 1268747 - RNA, 23 nt, Human
cccaguaauaaaguuuuauaauc

SEQ ID NO: 1268748 - RNA, 18 nt, Human
uccacaucuuuaagugug

SEQ ID NO: 1268749 - RNA, 25 nt, Human
uggagaauuuacauuccacaucuuu

SEQ ID NO: 1268750 - RNA, 23 nt, Human
uguguaaauagcccaguaauaaa

SEQ ID NO: 1268751 - RNA, 23 nt, Human
uaaggcaccuccagaggaaccgg

SEQ ID NO: 1268752 - RNA, 23 nt, Human
aaaaaaccagaaggaaaugugag

SEQ ID NO: 1268753 - RNA, 19 nt, Human
aaaccagaaggaaauguga

SEQ ID NO: 1268754 - RNA, 18 nt, Human
aacacauccuucccuacc

SEQ ID NO: 1268755 - RNA, 22 nt, Human
acacccacagacucaaaaacac

SEQ ID NO: 1268756 - RNA, 20 nt, Human
agacucaaaaacacccauau

SEQ ID NO: 1268757 - RNA, 28 nt, Human
agaggcaggccgcgaguuccccaagggg

SEQ ID NO: 1268758 - RNA, 25 nt, Human
aggaaaugugagcagugggagaaug

SEQ ID NO: 1268759 - RNA, 19 nt, Human
auagaaacacauccuuccc

SEQ ID NO: 1268760 - RNA, 21 nt, Human
auccauaaaauagaaacacau

SEQ ID NO: 1268761 - RNA, 19 nt, Human
cagaaucuaacagcagccc

SEQ ID NO: 1268762 - RNA, 21 nt, Human
cagccuuuucuuucggggucc

SEQ ID NO: 1268763 - RNA, 22 nt, Human
caggcagcucccgaucuccucu

SEQ ID NO: 1268764 - RNA, 19 nt, Human
caucguugcugggggaaau

SEQ ID NO: 1268765 - RNA, 21 nt, Human
ccacaugcaugcccuccggcu

SEQ ID NO: 1268766 - RNA, 19 nt, Human
ccugcgcaguagggcuguc

SEQ ID NO: 1268767 - RNA, 23 nt, Human
ccuucccuaccucaaaggagaac

SEQ ID NO: 1268768 - RNA, 19 nt, Human
cgcaaaaaaaccagaagga

SEQ ID NO: 1268769 - RNA, 23 nt, Human
cuacggcucugaggcugagcaca

SEQ ID NO: 1268770 - RNA, 21 nt, Human
cuccagcacucugccucaguu

SEQ ID NO: 1268771 - RNA, 22 nt, Human
cuccggcugguuuaugcucuuc

SEQ ID NO: 1268772 - RNA, 21 nt, Human
cuggucucuuggcagaggcag

SEQ ID NO: 1268773 - RNA, 23 nt, Human
gaaaucacuccagcacucugccu

SEQ ID NO: 1268774 - RNA, 23 nt, Human
gacacccacagacucaaaaacac

SEQ ID NO: 1268775 - RNA, 21 nt, Human
gagcagugggagaauggguaa

SEQ ID NO: 1268776 - RNA, 23 nt, Human
gaucuccucucugugacacccac

SEQ ID NO: 1268777 - RNA, 20 nt, Human
gcccauggcccugauaggcc

SEQ ID NO: 1268778 - RNA, 18 nt, Human
gccgagaugcuggucucu

SEQ ID NO: 1268779 - RNA, 19 nt, Human
ggagagaaagcccaugaua

SEQ ID NO: 1268780 - RNA, 19 nt, Human
ggcgaugggaggcugggag

SEQ ID NO: 1268781 - RNA, 19 nt, Human
uaacagcagcccacaugca

SEQ ID NO: 1268782 - RNA, 21 nt, Human
uaugcacacgcaaaaaaacca

SEQ ID NO: 1268783 - RNA, 21 nt, Human
ucaaaaacacccauaugcuca

SEQ ID NO: 1268784 - RNA, 23 nt, Human
ucaugcccauggcccugauaggc

SEQ ID NO: 1268785 - RNA, 23 nt, Human
ucauuguucccuuuccauuucug

SEQ ID NO: 1268786 - RNA, 23 nt, Human
ucccaaagugccugugagcaggc

SEQ ID NO: 1268787 - RNA, 22 nt, Human
ucuccucucugugacacccaca

SEQ ID NO: 1268788 - RNA, 23 nt, Human
ucugugacacccacagacucaaa

SEQ ID NO: 1268789 - RNA, 24 nt, Human
ugacacccacagacucaaaaacac

SEQ ID NO: 1268790 - RNA, 21 nt, Human
ugcacacgcaaaaaaaccaga

SEQ ID NO: 1268791 - RNA, 22 nt, Human
ugcccauggcccugauaggccc

SEQ ID NO: 1268792 - RNA, 23 nt, Human
ugcucauccauaaaauagaaaca

SEQ ID NO: 1268793 - RNA, 19 nt, Human
uucuguggagagaaagccc

SEQ ID NO: 1268794 - RNA, 23 nt, Human
uuggcagaggcaggccgcgaguu

SEQ ID NO: 1268795 - RNA, 19 nt, Human
aaacaauaaugaagaucgc

SEQ ID NO: 1268796 - RNA, 18 nt, Human
aaacauccagugugugac

SEQ ID NO: 1268797 - RNA, 20 nt, Human
aacccuacagcugcgcccga

SEQ ID NO: 1268798 - RNA, 21 nt, Human
acaauaaugaagaucgcacac

SEQ ID NO: 1268799 - RNA, 18 nt, Human
acccacucuuccuuccac

SEQ ID NO: 1268800 - RNA, 25 nt, Human
agcugguacacucuggccugggucu

SEQ ID NO: 1268801 - RNA, 23 nt, Human
aggcggcucgcaugccccagggc

SEQ ID NO: 1268802 - RNA, 18 nt, Human
agguggugagauaagaag

SEQ ID NO: 1268803 - RNA, 25 nt, Human
auaaacaucguuuuuuacuucuucu

SEQ ID NO: 1268804 - RNA, 20 nt, Human
auaagaaguggaacgugaca

SEQ ID NO: 1268805 - RNA, 19 nt, Human
caaaaagaggaaugugaca

SEQ ID NO: 1268806 - RNA, 18 nt, Human
cagaaagaccgacuggca

SEQ ID NO: 1268807 - RNA, 20 nt, Human
cagccuuggucugauccaga

SEQ ID NO: 1268808 - RNA, 21 nt, Human
caguccaaaacgccucggcgg

SEQ ID NO: 1268809 - RNA, 22 nt, Human
cagugugugaccucugcggagc

SEQ ID NO: 1268810 - RNA, 22 nt, Human
caucuuugccaguugucagaag

SEQ ID NO: 1268811 - RNA, 19 nt, Human
ccacuagaaacauccagug

SEQ ID NO: 1268812 - RNA, 19 nt, Human
ccaggccagggacagcucc

SEQ ID NO: 1268813 - RNA, 25 nt, Human
ccagggacagcuccaguuugggggg

SEQ ID NO: 1268814 - RNA, 24 nt, Human
cccaaauuucagcuaccacagaaa

SEQ ID NO: 1268815 - RNA, 24 nt, Human
cccgaggcagaggccaagguccug

SEQ ID NO: 1268816 - RNA, 23 nt, Human
ccuaaggaaacaauaaugaagau

SEQ ID NO: 1268817 - RNA, 27 nt, Human
ccuacagcugcgcccgaacccgccacu

SEQ ID NO: 1268818 - RNA, 21 nt, Human
ccucuggcccgaggcagaggc

SEQ ID NO: 1268819 - RNA, 20 nt, Human
ccuuccuguguuaugucacc

SEQ ID NO: 1268820 - RNA, 24 nt, Human
cgaggcagaggccaagguccuguc

SEQ ID NO: 1268821 - RNA, 20 nt, Human
cuacuacgaaaauacaaaaa

SEQ ID NO: 1268822 - RNA, 19 nt, Human
cucaucugacccacucuuc

SEQ ID NO: 1268823 - RNA, 22 nt, Human
cucgcaugccccagggccagcu

SEQ ID NO: 1268824 - RNA, 24 nt, Human
cugaaggucuucacgggccuccag

SEQ ID NO: 1268825 - RNA, 22 nt, Human
cuugaucuuuucuuuagauuga

SEQ ID NO: 1268826 - RNA, 23 nt, Human
cuuuuaaaucuacuacgaaaaua

SEQ ID NO: 1268827 - RNA, 20 nt, Human
gacacgucucaucugaccca

SEQ ID NO: 1268828 - RNA, 20 nt, Human
gagcucuagggacgcccucc

SEQ ID NO: 1268829 - RNA, 20 nt, Human
gcccucccuaaggaaacaau

SEQ ID NO: 1268830 - RNA, 20 nt, Human
gcugaaggauacacuggcug

SEQ ID NO: 1268831 - RNA, 22 nt, Human
ggcccgaggcagaggccaaggu

SEQ ID NO: 1268832 - RNA, 23 nt, Human
uaaagcauaauuggaauccuugg

SEQ ID NO: 1268833 - RNA, 18 nt, Human
uaccacagaaagaccgac

SEQ ID NO: 1268834 - RNA, 24 nt, Human
uaccacagaaagaccgacuggcag

SEQ ID NO: 1268835 - RNA, 22 nt, Human
uacuacgaaaauacaaaaagag

SEQ ID NO: 1268836 - RNA, 18 nt, Human
ucacgggccuccaggugg

SEQ ID NO: 1268837 - RNA, 24 nt, Human
ucagagacuuucagcucccacuag

SEQ ID NO: 1268838 - RNA, 19 nt, Human
ucaggagcccuugggcaag

SEQ ID NO: 1268839 - RNA, 20 nt, Human
ucaggcugaauaugaggaca

SEQ ID NO: 1268840 - RNA, 23 nt, Human
uccaaaacgccucggcggcgcgc

SEQ ID NO: 1268841 - RNA, 18 nt, Human
ugacacccccaagaccag

SEQ ID NO: 1268842 - RNA, 21 nt, Human
ugaggacaaagugggccacgu

SEQ ID NO: 1268843 - RNA, 23 nt, Human
ugaggacaaagugggccacguuc

SEQ ID NO: 1268844 - RNA, 18 nt, Human
uggcccgaggcagaggcc

SEQ ID NO: 1268845 - RNA, 24 nt, Human
uggcuguguguauuuaucucaauu

SEQ ID NO: 1268846 - RNA, 18 nt, Human
ugggucucugaauucagc

SEQ ID NO: 1268847 - RNA, 24 nt, Human
uguaaaaguuaguaguucuuuuuu

SEQ ID NO: 1268848 - RNA, 20 nt, Human
ugucagaagaauccaagcag

SEQ ID NO: 1268849 - RNA, 21 nt, Human
uuaaaagaggcuugcugaagg

SEQ ID NO: 1268850 - RNA, 22 nt, Human
uucacucccaaauuucagcuac

SEQ ID NO: 1268851 - RNA, 23 nt, Human
uuccuuccuguguuaugucaccg

SEQ ID NO: 1268852 - RNA, 24 nt, Human
uucugauuguugagacauccucug

SEQ ID NO: 1268853 - RNA, 22 nt, Human
uugcugaaggauacacuggcug

SEQ ID NO: 1268854 - RNA, 19 nt, Human
uuucuuaacauauaaacau

SEQ ID NO: 1268855 - RNA, 23 nt, Human
uuuugaaagccacuggggccaau

SEQ ID NO: 1268856 - RNA, 26 nt, Human
aaaucacaaauuuugacauuuggaac

SEQ ID NO: 1268857 - RNA, 21 nt, Human
acaugcuuauuucacacagaa

SEQ ID NO: 1268858 - RNA, 18 nt, Human
agaaagcaaguacaagac

SEQ ID NO: 1268859 - RNA, 25 nt, Human
agaaagcaaguacaagacaugcuua

SEQ ID NO: 1268860 - RNA, 21 nt, Human
agaauaucaaugaagacuuaa

SEQ ID NO: 1268861 - RNA, 19 nt, Human
agccuauuaggaacaugaa

SEQ ID NO: 1268862 - RNA, 20 nt, Human
augaaucagaaagcaaguac

SEQ ID NO: 1268863 - RNA, 27 nt, Human
augucuggaauugaugcuggccuuggg

SEQ ID NO: 1268864 - RNA, 19 nt, Human
cgccuaccgcuugggaacu

SEQ ID NO: 1268865 - RNA, 19 nt, Human
cuggaauugaugcuggccu

SEQ ID NO: 1268866 - RNA, 20 nt, Human
uaaguuuuuaacuucauuua

SEQ ID NO: 1268867 - RNA, 24 nt, Human
uaaguuuuuaacuucauuuagccu

SEQ ID NO: 1268868 - RNA, 24 nt, Human
uccagauagaacauugaaguuuac

SEQ ID NO: 1268869 - RNA, 24 nt, Human
ucccauauguauuuguuuuauccu

SEQ ID NO: 1268870 - RNA, 21 nt, Human
ucucccggcgccgccgccuac

SEQ ID NO: 1268871 - RNA, 26 nt, Human
ucucccggcgccgccgccuaccgcuu

SEQ ID NO: 1268872 - RNA, 23 nt, Human
ugacauuuggaacaauauaauug

SEQ ID NO: 1268873 - RNA, 23 nt, Human
ugcggaagcgcagcuaggcggcg

SEQ ID NO: 1268874 - RNA, 18 nt, Human
ugucuggaauugaugcug

SEQ ID NO: 1268875 - RNA, 27 nt, Human
uguuuuauccuuccagaaagcauauca

SEQ ID NO: 1268876 - RNA, 22 nt, Human
uucccauauguauuuguuuuau

SEQ ID NO: 1268877 - RNA, 18 nt, Human
aggcaggagaaucacuug

SEQ ID NO: 1268878 - RNA, 21 nt, Human
aggcaggagaaucacuugaac

SEQ ID NO: 1268879 - RNA, 24 nt, Human
aggcugaggcaggagaaucacuug

SEQ ID NO: 1268880 - RNA, 24 nt, Human
agguggaggucgcagugagcugag

SEQ ID NO: 1268881 - RNA, 23 nt, Human
auggugccauugcacuccagcuu

SEQ ID NO: 1268882 - RNA, 24 nt, Human
caaagugucauuuuuauauugaaa

SEQ ID NO: 1268883 - RNA, 24 nt, Human
caguuacuugggaggcugaggcag

SEQ ID NO: 1268884 - RNA, 24 nt, Human
caugccuguaaucccaguuacuug

SEQ ID NO: 1268885 - RNA, 21 nt, Human
cauugcacuccagcuuuuuca

SEQ ID NO: 1268886 - RNA, 23 nt, Human
ccauugcacuccagcuuuuucag

SEQ ID NO: 1268887 - RNA, 24 nt, Human
ccauugcacuccagcuuuuucagc

SEQ ID NO: 1268888 - RNA, 18 nt, Human
ccuguaaucccaguuacu

SEQ ID NO: 1268889 - RNA, 21 nt, Human
ccuguaaucccaguuacuugg

SEQ ID NO: 1268890 - RNA, 22 nt, Human
ccuguaaucccaguuacuuggg

SEQ ID NO: 1268891 - RNA, 23 nt, Human
gagaaucacuugaacaugggagg

SEQ ID NO: 1268892 - RNA, 23 nt, Human
gagauggugccauugcacuccag

SEQ ID NO: 1268893 - RNA, 19 nt, Human
gcaggagaaucacuugaac

SEQ ID NO: 1268894 - RNA, 20 nt, Human
gccuguaaucccaguuacuu

SEQ ID NO: 1268895 - RNA, 18 nt, Human
ggaggucgcagugagcug

SEQ ID NO: 1268896 - RNA, 24 nt, Human
ggaggucgcagugagcugagaugg

SEQ ID NO: 1268897 - RNA, 20 nt, Human
ggaggucgcagugagcuggc

SEQ ID NO: 1268898 - RNA, 24 nt, Human
gggcaugguggcgcaugccuguaa

SEQ ID NO: 1268899 - RNA, 19 nt, Human
gguggaggucgcagugagc

SEQ ID NO: 1268900 - RNA, 24 nt, Human
gguggcgcaugccuguaaucccag

SEQ ID NO: 1268901 - RNA, 22 nt, Human
ucgcagugagcugagauggugc

SEQ ID NO: 1268902 - RNA, 20 nt, Human
ugaggcaggagaaucacuug

SEQ ID NO: 1268903 - RNA, 23 nt, Human
ugaggcaggagaaucacuugaac

SEQ ID NO: 1268904 - RNA, 24 nt, Human
ugccuguaaucccaguuacuuggg

SEQ ID NO: 1268905 - RNA, 18 nt, Human
uggaggucgcagugagcu

SEQ ID NO: 1268906 - RNA, 21 nt, Human
uggcgcaugccuguaauccca

SEQ ID NO: 1268907 - RNA, 22 nt, Human
uggcgcaugccuguaaucccag

SEQ ID NO: 1268908 - RNA, 19 nt, Human
ugggaggcugaggcaggag

SEQ ID NO: 1268909 - RNA, 24 nt, Human
ugggaggcugaggcaggagaauca

SEQ ID NO: 1268910 - RNA, 29 nt, Human
ugggagguggaggucgcagugacaacggu

SEQ ID NO: 1268911 - RNA, 24 nt, Human
ugggagguggaggucgcagugagc

SEQ ID NO: 1268912 - RNA, 24 nt, Human
ugguggcgcaugccuguaauccca

SEQ ID NO: 1268913 - RNA, 18 nt, Human
uuaguggggcaugguggc

SEQ ID NO: 1268914 - RNA, 20 nt, Human
uuaguggggcaugguggcgc

SEQ ID NO: 1268915 - RNA, 25 nt, Human
uugggaggcugaggcaggagaauca

SEQ ID NO: 1268916 - RNA, 20 nt, Human
aaaaaaaaaaacugcaggga

SEQ ID NO: 1268917 - RNA, 23 nt, Human
aaaaaaaacugcagggauagcau

SEQ ID NO: 1268918 - RNA, 23 nt, Human
aaaaggagaugauuaucugcagg

SEQ ID NO: 1268919 - RNA, 24 nt, Human
aaaagguugcuuuugacccaaggc

SEQ ID NO: 1268920 - RNA, 19 nt, Human
aaacaacucuagcagagac

SEQ ID NO: 1268921 - RNA, 22 nt, Human
aaacauacacacacacaccccc

SEQ ID NO: 1268922 - RNA, 24 nt, Human
aaacaugggccuguuagaaaaaaa

SEQ ID NO: 1268923 - RNA, 18 nt, Human
aaagauucuccuaccuca

SEQ ID NO: 1268924 - RNA, 22 nt, Human
aaagauucuccuaccucagccu

SEQ ID NO: 1268925 - RNA, 20 nt, Human
aaagccagugugcagcagga

SEQ ID NO: 1268926 - RNA, 19 nt, Human
aaagccuuuugaaauccac

SEQ ID NO: 1268927 - RNA, 23 nt, Human
aaaggcagcugggucuccaaaga

SEQ ID NO: 1268928 - RNA, 24 nt, Human
aaagugcugggauuacaggcauga

SEQ ID NO: 1268929 - RNA, 21 nt, Human
aacacgugacucaaaucagga

SEQ ID NO: 1268930 - RNA, 20 nt, Human
aacauagacaaagaaaagga

SEQ ID NO: 1268931 - RNA, 22 nt, Human
aaccugacuuaacaaaaacaca

SEQ ID NO: 1268932 - RNA, 23 nt, Human
aagaaugacucuuaaacugaauc

SEQ ID NO: 1268933 - RNA, 19 nt, Human
aagacugcuaucucuaagc

SEQ ID NO: 1268934 - RNA, 18 nt, Human
aagcaguggauucuugag

SEQ ID NO: 1268935 - RNA, 20 nt, Human
aagcaguggauucuugagga

SEQ ID NO: 1268936 - RNA, 24 nt, Human
aaggaguaucagcaauuuggcuug

SEQ ID NO: 1268937 - RNA, 19 nt, Human
aagugcugggauuacaggc

SEQ ID NO: 1268938 - RNA, 21 nt, Human
aagugcugggauuacaggcau

SEQ ID NO: 1268939 - RNA, 18 nt, Human
aaguuagggcucagcugg

SEQ ID NO: 1268940 - RNA, 18 nt, Human
acacacccccacacaugc

SEQ ID NO: 1268941 - RNA, 24 nt, Human
acaccugcagacugaagaauacac

SEQ ID NO: 1268942 - RNA, 18 nt, Human
acuuggguccuccauuuc

SEQ ID NO: 1268943 - RNA, 18 nt, Human
agaaaaaaaaaaacugca

SEQ ID NO: 1268944 - RNA, 21 nt, Human
agaaaucuacugcuccaggau

SEQ ID NO: 1268945 - RNA, 18 nt, Human
agaagccugaugacaugc

SEQ ID NO: 1268946 - RNA, 21 nt, Human
agacugaaggugauuccaaga

SEQ ID NO: 1268947 - RNA, 19 nt, Human
agagaaaggcauagaggcg

SEQ ID NO: 1268948 - RNA, 20 nt, Human
agagagcaagauucccaaug

SEQ ID NO: 1268949 - RNA, 21 nt, Human
agcacacaagaaacaaagaca

SEQ ID NO: 1268950 - RNA, 22 nt, Human
agcaguuucuuagguuacagca

SEQ ID NO: 1268951 - RNA, 19 nt, Human
agccuuccauucuugaaga

SEQ ID NO: 1268952 - RNA, 22 nt, Human
agcuccauggaagcacagccuc

SEQ ID NO: 1268953 - RNA, 23 nt, Human
aggaaggaaguuuggcaaaugga

SEQ ID NO: 1268954 - RNA, 20 nt, Human
aggaaguccguggagguagg

SEQ ID NO: 1268955 - RNA, 24 nt, Human
aggcagcuucugauuuccaagaag

SEQ ID NO: 1268956 - RNA, 25 nt, Human
aggcuggagugcaguggugcgaucu

SEQ ID NO: 1268957 - RNA, 19 nt, Human
agguaggugggagccggaa

SEQ ID NO: 1268958 - RNA, 24 nt, Human
aggugauccaccugccuuggccuc

SEQ ID NO: 1268959 - RNA, 22 nt, Human
aggugauuccaagaccuucucu

SEQ ID NO: 1268960 - RNA, 22 nt, Human
aguagagacugggcuuugccau

SEQ ID NO: 1268961 - RNA, 21 nt, Human
aguagcugggauuacaggcau

SEQ ID NO: 1268962 - RNA, 21 nt, Human
agugcaguggugcgaucucag

SEQ ID NO: 1268963 - RNA, 23 nt, Human
agugcaguggugcgaucucagcu

SEQ ID NO: 1268964 - RNA, 24 nt, Human
agugcaguggugcgaucucagcuc

SEQ ID NO: 1268965 - RNA, 21 nt, Human
agugcugccuguaagcaugug

SEQ ID NO: 1268966 - RNA, 24 nt, Human
aguggugcgaucucagcucacugc

SEQ ID NO: 1268967 - RNA, 22 nt, Human
augucaucuuuucuuuucuugg

SEQ ID NO: 1268968 - RNA, 22 nt, Human
caaaauugcuguacauacaaac

SEQ ID NO: 1268969 - RNA, 24 nt, Human
caaagugcugggauuacaggcaug

SEQ ID NO: 1268970 - RNA, 21 nt, Human
caagauucccaaugaaauuca

SEQ ID NO: 1268971 - RNA, 25 nt, Human
cacacacacacccccacacaugccc

SEQ ID NO: 1268972 - RNA, 22 nt, Human
cacacacccccacacaugccac

SEQ ID NO: 1268973 - RNA, 25 nt, Human
cacaccugcagacugaagaauacac

SEQ ID NO: 1268974 - RNA, 19 nt, Human
cacacggucuuccuucugg

SEQ ID NO: 1268975 - RNA, 24 nt, Human
caccaugcccagcuaauuuuugua

SEQ ID NO: 1268976 - RNA, 23 nt, Human
caccugccuuggccucccaaagu

SEQ ID NO: 1268977 - RNA, 24 nt, Human
caccugccuuggccucccaaagug

SEQ ID NO: 1268978 - RNA, 22 nt, Human
cacucuauaaaacugacagggg

SEQ ID NO: 1268979 - RNA, 19 nt, Human
cagcauacuacugcugccc

SEQ ID NO: 1268980 - RNA, 20 nt, Human
cagcguguccaacacguccc

SEQ ID NO: 1268981 - RNA, 20 nt, Human
caggauucugcaaacauuca

SEQ ID NO: 1268982 - RNA, 22 nt, Human
caggcggucacagaauguucca

SEQ ID NO: 1268983 - RNA, 27 nt, Human
caguagcugggauuacaggcaugcgcc

SEQ ID NO: 1268984 - RNA, 22 nt, Human
caucuccucuuggggguucucu

SEQ ID NO: 1268985 - RNA, 20 nt, Human
caucuuuucuuuucuuggcc

SEQ ID NO: 1268986 - RNA, 19 nt, Human
cauugugucaaccccgucu

SEQ ID NO: 1268987 - RNA, 23 nt, Human
ccaaagugcugggauuacaggca

SEQ ID NO: 1268988 - RNA, 24 nt, Human
ccaaagugcugggauuacaggcau

SEQ ID NO: 1268989 - RNA, 23 nt, Human
ccaagguggcucagaauggacau

SEQ ID NO: 1268990 - RNA, 25 nt, Human
ccacagaagcaacucgggcugucag

SEQ ID NO: 1268991 - RNA, 22 nt, Human
ccagccuugcauagcaguuucu

SEQ ID NO: 1268992 - RNA, 23 nt, Human
ccaguagcugggauuacaggcau

SEQ ID NO: 1268993 - RNA, 24 nt, Human
ccauucuugaagaacucaggcaug

SEQ ID NO: 1268994 - RNA, 24 nt, Human
cccaaagugcugggauuacaggca

SEQ ID NO: 1268995 - RNA, 19 nt, Human
cccaggcuggagugcagug

SEQ ID NO: 1268996 - RNA, 22 nt, Human
cccaggcuggagugcaguggug

SEQ ID NO: 1268997 - RNA, 24 nt, Human
cccaguagcugggauuacaggcau

SEQ ID NO: 1268998 - RNA, 21 nt, Human
ccccacacaugccacaggacc

SEQ ID NO: 1268999 - RNA, 22 nt, Human
ccccacacaugccacaggaccu

SEQ ID NO: 1269000 - RNA, 22 nt, Human
cccuacaguuauugcuaaggug

SEQ ID NO: 1269001 - RNA, 24 nt, Human
ccguagucagagaauggccgaggc

SEQ ID NO: 1269002 - RNA, 19 nt, Human
ccuacaguuauugcuaagg

SEQ ID NO: 1269003 - RNA, 23 nt, Human
ccuaccucagccuucccaguagc

SEQ ID NO: 1269004 - RNA, 21 nt, Human
ccugaccucaggugauccacc

SEQ ID NO: 1269005 - RNA, 23 nt, Human
ccugaccucaggugauccaccug

SEQ ID NO: 1269006 - RNA, 23 nt, Human
ccugaccucaggugauccaccug

SEQ ID NO: 1269007 - RNA, 19 nt, Human
ccugcagcaacuucugucu

SEQ ID NO: 1269008 - RNA, 24 nt, Human
ccuggauugaagcacacaagaaac

SEQ ID NO: 1269009 - RNA, 22 nt, Human
cuaccucagccuucccaguagc

SEQ ID NO: 1269010 - RNA, 18 nt, Human
cuaguccgcaggccaaag

SEQ ID NO: 1269011 - RNA, 24 nt, Human
cucacugcaaccuccgcuucccag

SEQ ID NO: 1269012 - RNA, 24 nt, Human
cucagccuucccaguagcugggau

SEQ ID NO: 1269013 - RNA, 24 nt, Human
cucaggugauccaccugccuuggc

SEQ ID NO: 1269014 - RNA, 23 nt, Human
cuccuaccucagccuucccagua

SEQ ID NO: 1269015 - RNA, 23 nt, Human
cugcaaccuccgcuucccagauu

SEQ ID NO: 1269016 - RNA, 24 nt, Human
cugcaaccuccgcuucccagauuc

SEQ ID NO: 1269017 - RNA, 19 nt, Human
cugcagcaaccgagucuuc

SEQ ID NO: 1269018 - RNA, 21 nt, Human
cugcagcaaccgagucuuccc

SEQ ID NO: 1269019 - RNA, 23 nt, Human
cugccuuggccucccaaagugcu

SEQ ID NO: 1269020 - RNA, 22 nt, Human
cuggauguggggggcugcaggg

SEQ ID NO: 1269021 - RNA, 20 nt, Human
cugggucuccaaagacugaa

SEQ ID NO: 1269022 - RNA, 20 nt, Human
cuguaucucccaggcuggag

SEQ ID NO: 1269023 - RNA, 19 nt, Human
cuguccagggcacugagcg

SEQ ID NO: 1269024 - RNA, 24 nt, Human
cuucccagauucaaaagauucucc

SEQ ID NO: 1269025 - RNA, 19 nt, Human
cuugaagaacucaggcaug

SEQ ID NO: 1269026 - RNA, 20 nt, Human
cuugcucaucaucagcaggg

SEQ ID NO: 1269027 - RNA, 22 nt, Human
cuuuucuuuucuuggcccaucu

SEQ ID NO: 1269028 - RNA, 26 nt, Human
cuuuuuauauugcaaacaguuguuug

SEQ ID NO: 1269029 - RNA, 23 nt, Human
gaaaauguaacacaagcaaauga

SEQ ID NO: 1269030 - RNA, 24 nt, Human
gaaccuugcaggaugacauuugca

SEQ ID NO: 1269031 - RNA, 23 nt, Human
gaagcuccuuccugcagcaacuu

SEQ ID NO: 1269032 - RNA, 23 nt, Human
gaccucaggugauccaccugccu

SEQ ID NO: 1269033 - RNA, 18 nt, Human
gaggaggcucucuguucc

SEQ ID NO: 1269034 - RNA, 23 nt, Human
gauagcauacaaaaaugagcuuc

SEQ ID NO: 1269035 - RNA, 18 nt, Human
gauuacaggcaugagcca

SEQ ID NO: 1269036 - RNA, 23 nt, Human
gauuacaggcaugagccacagca

SEQ ID NO: 1269037 - RNA, 18 nt, Human
gauuacaggcaugcgcca

SEQ ID NO: 1269038 - RNA, 24 nt, Human
gauuacaggcaugcgccaccaugc

SEQ ID NO: 1269039 - RNA, 22 nt, Human
gcaaccuccgcuucccagauuc

SEQ ID NO: 1269040 - RNA, 25 nt, Human
gccccacggcagcuguagguccccc

SEQ ID NO: 1269041 - RNA, 22 nt, Human
gccuuggccucccaaagugcug

SEQ ID NO: 1269042 - RNA, 20 nt, Human
gcuccagcauacuacugcug

SEQ ID NO: 1269043 - RNA, 24 nt, Human
ggaaacauacacacacacaccccc

SEQ ID NO: 1269044 - RNA, 20 nt, Human
ggaacggcucuggauguggg

SEQ ID NO: 1269045 - RNA, 19 nt, Human
ggauguggggggcugcagg

SEQ ID NO: 1269046 - RNA, 22 nt, Human
ggauuacaggcaugagccacag

SEQ ID NO: 1269047 - RNA, 24 nt, Human
ggauuacaggcaugcgccaccaug

SEQ ID NO: 1269048 - RNA, 20 nt, Human
ggcaggguuuuuauauguuu

SEQ ID NO: 1269049 - RNA, 23 nt, Human
ggggcugcaggggagaagggagg

SEQ ID NO: 1269050 - RNA, 27 nt, Human
gggggucugcagcaaccgagucuucag

SEQ ID NO: 1269051 - RNA, 18 nt, Human
guagcugggauuacaggc

SEQ ID NO: 1269052 - RNA, 21 nt, Human
gucacggguguuucuguguag

SEQ ID NO: 1269053 - RNA, 22 nt, Human
gucagccccacggcagcuguag

SEQ ID NO: 1269054 - RNA, 19 nt, Human
gucaucuuuucuuuucuug

SEQ ID NO: 1269055 - RNA, 24 nt, Human
gugauccaccugccuuggccuccc

SEQ ID NO: 1269056 - RNA, 18 nt, Human
gugcaggcaggagggaau

SEQ ID NO: 1269057 - RNA, 20 nt, Human
guggccuuuguuaauaaaga

SEQ ID NO: 1269058 - RNA, 22 nt, Human
gugggagccggaaguuagggcu

SEQ ID NO: 1269059 - RNA, 21 nt, Human
gugucaaccccgucuugacgg

SEQ ID NO: 1269060 - RNA, 21 nt, Human
guugcucugcacugaggaccc

SEQ ID NO: 1269061 - RNA, 25 nt, Human
uaaaaaggcacaauauucagaaaua

SEQ ID NO: 1269062 - RNA, 22 nt, Human
uaaaacaauuuguucaaaauug

SEQ ID NO: 1269063 - RNA, 21 nt, Human
uaaaacccaagccagacaugc

SEQ ID NO: 1269064 - RNA, 19 nt, Human
uaaaggcagcuucugauuu

SEQ ID NO: 1269065 - RNA, 23 nt, Human
uaacaaagucgaccaauucugaa

SEQ ID NO: 1269066 - RNA, 23 nt, Human
uaacacaagcaaaugauucucuu

SEQ ID NO: 1269067 - RNA, 20 nt, Human
uaacacagcaucuccugucc

SEQ ID NO: 1269068 - RNA, 23 nt, Human
uaagugugaccagacacgugcag

SEQ ID NO: 1269069 - RNA, 23 nt, Human
uaauggagugacccucacacucu

SEQ ID NO: 1269070 - RNA, 24 nt, Human
uaauuuuuguauuauuaguagaga

SEQ ID NO: 1269071 - RNA, 24 nt, Human
uacaggcaugagccacagcaccca

SEQ ID NO: 1269072 - RNA, 24 nt, Human
uacaggcaugcgccaccaugccca

SEQ ID NO: 1269073 - RNA, 24 nt, Human
uaccucagccuucccaguagcugg

SEQ ID NO: 1269074 - RNA, 21 nt, Human
uagugcagaaauacucccccu

SEQ ID NO: 1269075 - RNA, 18 nt, Human
uauuaugggaaagcuggg

SEQ ID NO: 1269076 - RNA, 18 nt, Human
ucacugcaaccuccgcuu

SEQ ID NO: 1269077 - RNA, 19 nt, Human
ucacugcaaccuccgcuuc

SEQ ID NO: 1269078 - RNA, 23 nt, Human
ucacugcaaccuccgcuucccag

SEQ ID NO: 1269079 - RNA, 24 nt, Human
ucacugcaaccuccgcuucccaga

SEQ ID NO: 1269080 - RNA, 28 nt, Human
ucacugcaaccuccgcuucggguccucc

SEQ ID NO: 1269081 - RNA, 22 nt, Human
ucagagccaccuccggugccgg

SEQ ID NO: 1269082 - RNA, 19 nt, Human
ucagccuagguggccuuug

SEQ ID NO: 1269083 - RNA, 20 nt, Human
ucagccuagguggccuuugu

SEQ ID NO: 1269084 - RNA, 25 nt, Human
ucaggaacggcucuggauguggggg

SEQ ID NO: 1269085 - RNA, 21 nt, Human
ucaggugauccaccugccuug

SEQ ID NO: 1269086 - RNA, 22 nt, Human
uccaacacgucccugcccucag

SEQ ID NO: 1269087 - RNA, 20 nt, Human
uccacaaaggcagcuggguc

SEQ ID NO: 1269088 - RNA, 19 nt, Human
uccagaagcuccuuccugc

SEQ ID NO: 1269089 - RNA, 24 nt, Human
ucccaaagugcugggauuacaggc

SEQ ID NO: 1269090 - RNA, 21 nt, Human
ucccagauucaaaagauucuc

SEQ ID NO: 1269091 - RNA, 22 nt, Human
ucccaggcuggagugcaguggu

SEQ ID NO: 1269092 - RNA, 23 nt, Human
ucccaguagcugggauuacaggc

SEQ ID NO: 1269093 - RNA, 24 nt, Human
ucccaguagcugggauuacaggca

SEQ ID NO: 1269094 - RNA, 19 nt, Human
uccgcaggccaaagacaaa

SEQ ID NO: 1269095 - RNA, 24 nt, Human
ucucaaacaugggccuguuagaaa

SEQ ID NO: 1269096 - RNA, 24 nt, Human
ucucccagagccccaucuccucuu

SEQ ID NO: 1269097 - RNA, 24 nt, Human
ucucccaggcuggagugcaguggu

SEQ ID NO: 1269098 - RNA, 18 nt, Human
ucuccucccuuccacaaa

SEQ ID NO: 1269099 - RNA, 23 nt, Human
ucucgaacuccugaccucaggug

SEQ ID NO: 1269100 - RNA, 23 nt, Human
ucucgcuguaucucccaggcugg

SEQ ID NO: 1269101 - RNA, 24 nt, Human
ucucgcuguaucucccaggcugga

SEQ ID NO: 1269102 - RNA, 19 nt, Human
ucuguccuuuccucauccu

SEQ ID NO: 1269103 - RNA, 20 nt, Human
ucuugaagaacucaggcaug

SEQ ID NO: 1269104 - RNA, 21 nt, Human
ucuuuaauggagugacccuca

SEQ ID NO: 1269105 - RNA, 18 nt, Human
ucuuucucuccacuuugc

SEQ ID NO: 1269106 - RNA, 21 nt, Human
ugaacccuuagcagugcugcc

SEQ ID NO: 1269107 - RNA, 19 nt, Human
ugaagcacacaagaaacaa

SEQ ID NO: 1269108 - RNA, 22 nt, Human
ugaagcacacaagaaacaaaga

SEQ ID NO: 1269109 - RNA, 23 nt, Human
ugaagcacacaagaaacaaagac

SEQ ID NO: 1269110 - RNA, 19 nt, Human
ugaaggugauuccaagacc

SEQ ID NO: 1269111 - RNA, 22 nt, Human
ugacacuccuuugagggacaau

SEQ ID NO: 1269112 - RNA, 25 nt, Human
ugacaugcucacgugacaugguuaa

SEQ ID NO: 1269113 - RNA, 21 nt, Human
ugacaugguuaugcccuguuu

SEQ ID NO: 1269114 - RNA, 19 nt, Human
ugacccaaggcuacuucaa

SEQ ID NO: 1269115 - RNA, 24 nt, Human
ugaccucaggugauccaccugccu

SEQ ID NO: 1269116 - RNA, 23 nt, Human
ugacuuggguccuccauuucugg

SEQ ID NO: 1269117 - RNA, 24 nt, Human
ugacuuggguccuccauuucuggc

SEQ ID NO: 1269118 - RNA, 22 nt, Human
ugaugguggugaaauguuuuca

SEQ ID NO: 1269119 - RNA, 22 nt, Human
ugcaguggugcgaucucagcuc

SEQ ID NO: 1269120 - RNA, 25 nt, Human
ugccacaggaccucuccagaagcuc

SEQ ID NO: 1269121 - RNA, 24 nt, Human
ugccauauuggccacgcuugucuc

SEQ ID NO: 1269122 - RNA, 24 nt, Human
ugcccucagagccaccuccggugc

SEQ ID NO: 1269123 - RNA, 18 nt, Human
ugccucuguccuuuccuc

SEQ ID NO: 1269124 - RNA, 24 nt, Human
ugccugaaaagcaguggauucuug

SEQ ID NO: 1269125 - RNA, 18 nt, Human
ugcggcuggccagcuggc

SEQ ID NO: 1269126 - RNA, 21 nt, Human
ugcugcccucuuucuaguccg

SEQ ID NO: 1269127 - RNA, 18 nt, Human
uggaauaggugaaauuca

SEQ ID NO: 1269128 - RNA, 19 nt, Human
uggaccugcagcaggcacu

SEQ ID NO: 1269129 - RNA, 20 nt, Human
uggagguaggugggagccgg

SEQ ID NO: 1269130 - RNA, 23 nt, Human
uggagugcaguggugcgaucuca

SEQ ID NO: 1269131 - RNA, 24 nt, Human
uggagugcaguggugcgaucucag

SEQ ID NO: 1269132 - RNA, 23 nt, Human
uggaugcuguguuuggaccugca

SEQ ID NO: 1269133 - RNA, 21 nt, Human
uggcaucgguuuucaucuagg

SEQ ID NO: 1269134 - RNA, 24 nt, Human
uggccacgcuugucucgaacuccu

SEQ ID NO: 1269135 - RNA, 20 nt, Human
uggcucagaauggacaucag

SEQ ID NO: 1269136 - RNA, 23 nt, Human
uggcuugcagagauuucucgucg

SEQ ID NO: 1269137 - RNA, 19 nt, Human
ugggagccggaaguuaggg

SEQ ID NO: 1269138 - RNA, 18 nt, Human
ugggauuacaggcaugag

SEQ ID NO: 1269139 - RNA, 19 nt, Human
ugggauuacaggcaugagc

SEQ ID NO: 1269140 - RNA, 21 nt, Human
ugggauuacaggcaugagcca

SEQ ID NO: 1269141 - RNA, 22 nt, Human
ugggauuacaggcaugagccac

SEQ ID NO: 1269142 - RNA, 22 nt, Human
ugggauuacaggcaugagccac

SEQ ID NO: 1269143 - RNA, 23 nt, Human
ugggauuacaggcaugagccaca

SEQ ID NO: 1269144 - RNA, 24 nt, Human
ugggauuacaggcaugagccacag

SEQ ID NO: 1269145 - RNA, 26 nt, Human
ugggauuacaggcaugagccacagca

SEQ ID NO: 1269146 - RNA, 27 nt, Human
ugggauuacaggcaugagccacagcac

SEQ ID NO: 1269147 - RNA, 18 nt, Human
ugggauuacaggcaugcg

SEQ ID NO: 1269148 - RNA, 21 nt, Human
ugggauuacaggcaugcgcca

SEQ ID NO: 1269149 - RNA, 22 nt, Human
ugggauuacaggcaugcgccac

SEQ ID NO: 1269150 - RNA, 24 nt, Human
ugggauuacaggcaugcgccacca

SEQ ID NO: 1269151 - RNA, 23 nt, Human
ugggccuguuagaaaaaaaaaaa

SEQ ID NO: 1269152 - RNA, 20 nt, Human
ugggcuuugccauauuggcc

SEQ ID NO: 1269153 - RNA, 24 nt, Human
uggugcgaucucagcucacugcaa

SEQ ID NO: 1269154 - RNA, 20 nt, Human
uguaagcaugugugccaagg

SEQ ID NO: 1269155 - RNA, 24 nt, Human
uguaucucccaggcuggagugcag

SEQ ID NO: 1269156 - RNA, 19 nt, Human
ugugaaggucuuuuuuuau

SEQ ID NO: 1269157 - RNA, 20 nt, Human
ugugaccagacacgugcagc

SEQ ID NO: 1269158 - RNA, 18 nt, Human
ugugugccaagguggcuc

SEQ ID NO: 1269159 - RNA, 23 nt, Human
uuaaaaauguuagcaguuuucaa

SEQ ID NO: 1269160 - RNA, 18 nt, Human
uuaguagagacugggcuu

SEQ ID NO: 1269161 - RNA, 20 nt, Human
uuaguagagacugggcuuug

SEQ ID NO: 1269162 - RNA, 21 nt, Human
uuaguagagacugggcuuugc

SEQ ID NO: 1269163 - RNA, 24 nt, Human
uuaguagagacugggcuuugccau

SEQ ID NO: 1269164 - RNA, 28 nt, Human
uuauucucaaacaugggccuguuagaaa

SEQ ID NO: 1269165 - RNA, 24 nt, Human
uucaaaagauucuccuaccucagc

SEQ ID NO: 1269166 - RNA, 18 nt, Human
uucaaaaucaccugaaca

SEQ ID NO: 1269167 - RNA, 24 nt, Human
uucauacuucuugacacuccuuug

SEQ ID NO: 1269168 - RNA, 24 nt, Human
uucccaguagcugggauuacaggc

SEQ ID NO: 1269169 - RNA, 20 nt, Human
uucuaaguuucuucucuccc

SEQ ID NO: 1269170 - RNA, 19 nt, Human
uucugaccagugcauuuuc

SEQ ID NO: 1269171 - RNA, 21 nt, Human
uugaauguuuuuuguuuuugu

SEQ ID NO: 1269172 - RNA, 21 nt, Human
uuggaaugucuguucaagaag

SEQ ID NO: 1269173 - RNA, 24 nt, Human
uuggaaugucuguucaagaaggaa

SEQ ID NO: 1269174 - RNA, 18 nt, Human
uuggccucccaaagugcu

SEQ ID NO: 1269175 - RNA, 20 nt, Human
uuguuugaauguuuuuuguu

SEQ ID NO: 1269176 - RNA, 24 nt, Human
uuguuuuuguuuuuggagacaguc

SEQ ID NO: 1269177 - RNA, 26 nt, Human
uuugugaaggucuuuuuuucuuugag

SEQ ID NO: 1269178 - RNA, 20 nt, Human
uuuuuguauuauuaguagag

SEQ ID NO: 1269179 - RNA, 23 nt, Human
aagcaaaaggcaucaaaggggac

SEQ ID NO: 1269180 - RNA, 18 nt, Human
aagggccuccgaggagag

SEQ ID NO: 1269181 - RNA, 19 nt, Human
agcagauggaaaaguugaa

SEQ ID NO: 1269182 - RNA, 23 nt, Human
aggcaucaaaggugaucaaggcu

SEQ ID NO: 1269183 - RNA, 19 nt, Human
agggcccaugggagagaag

SEQ ID NO: 1269184 - RNA, 22 nt, Human
aggggcuugcagggcccauggg

SEQ ID NO: 1269185 - RNA, 22 nt, Human
auccccaggaaaacauggcccc

SEQ ID NO: 1269186 - RNA, 20 nt, Human
cacuguuuucuccagaaaug

SEQ ID NO: 1269187 - RNA, 23 nt, Human
cauggccccaaggggcuugcagg

SEQ ID NO: 1269188 - RNA, 23 nt, Human
cccaggaaaacauggccccaagg

SEQ ID NO: 1269189 - RNA, 22 nt, Human
cucaagaggauccccaggaaaa

SEQ ID NO: 1269190 - RNA, 21 nt, Human
gaaaacauggccccaaggggc

SEQ ID NO: 1269191 - RNA, 18 nt, Human
guaaaaauacugcacacc

SEQ ID NO: 1269192 - RNA, 25 nt, Human
ucaaaaauggaguaaaaauacugca

SEQ ID NO: 1269193 - RNA, 19 nt, Human
ucuccagaaauguucaggu

SEQ ID NO: 1269194 - RNA, 21 nt, Human
ucuccagaaauguucaggugu

SEQ ID NO: 1269195 - RNA, 22 nt, Human
ucuccagaaauguucagguguc

SEQ ID NO: 1269196 - RNA, 18 nt, Human
ugaggaccaggccucugg

SEQ ID NO: 1269197 - RNA, 23 nt, Human
ugcacaccaaagaugcuuacaug

SEQ ID NO: 1269198 - RNA, 22 nt, Human
ugucuuuggucaaaaauggagu

SEQ ID NO: 1269199 - RNA, 26 nt, Human
acgcuccccgauuccgcgcuccuugc

SEQ ID NO: 1269200 - RNA, 18 nt, Human
cuacauagaagcaugcaa

SEQ ID NO: 1269201 - RNA, 23 nt, Human
cucccugcccccggggcugggcg

SEQ ID NO: 1269202 - RNA, 20 nt, Human
gcuccccgauuccgcgcucc

SEQ ID NO: 1269203 - RNA, 27 nt, Human
ucauuuuauuauugcuuguuaguugau

SEQ ID NO: 1269204 - RNA, 26 nt, Human
ucuacauagaagcaugcaaaaaguuu

SEQ ID NO: 1269205 - RNA, 20 nt, Human
ugauuaaaguaauucuucuu

SEQ ID NO: 1269206 - RNA, 24 nt, Human
uugcucgcgguacuuccguaaucu

SEQ ID NO: 1269207 - RNA, 22 nt, Human
aaaaaggggaucgguaaaaaaa

SEQ ID NO: 1269208 - RNA, 20 nt, Human
aaaguacauucaauacuuaa

SEQ ID NO: 1269209 - RNA, 18 nt, Human
aagcaucaacaguugacu

SEQ ID NO: 1269210 - RNA, 25 nt, Human
aauuuuauucucaauaacaauucca

SEQ ID NO: 1269211 - RNA, 25 nt, Human
acucacugacagcuccaccuugcac

SEQ ID NO: 1269212 - RNA, 23 nt, Human
agaggaagccaguuuggccugga

SEQ ID NO: 1269213 - RNA, 25 nt, Human
agcccagcugggcuggaggaaguug

SEQ ID NO: 1269214 - RNA, 19 nt, Human
agcuccaccuugcacacgc

SEQ ID NO: 1269215 - RNA, 22 nt, Human
aggaagcccagcugggcuggag

SEQ ID NO: 1269216 - RNA, 21 nt, Human
aggggaucgguaaaaaaaggc

SEQ ID NO: 1269217 - RNA, 20 nt, Human
agguccgguuguaaaaaaua

SEQ ID NO: 1269218 - RNA, 21 nt, Human
aguugacuccaacaaaggaag

SEQ ID NO: 1269219 - RNA, 20 nt, Human
cacccacaaggaagcagagu

SEQ ID NO: 1269220 - RNA, 22 nt, Human
caccgcacggcugccgcugccc

SEQ ID NO: 1269221 - RNA, 18 nt, Human
caggcucagggcgcugcc

SEQ ID NO: 1269222 - RNA, 19 nt, Human
caucugccauuguucucuc

SEQ ID NO: 1269223 - RNA, 23 nt, Human
ccagccgcucgggguccgguccc

SEQ ID NO: 1269224 - RNA, 21 nt, Human
ccccgcugcuggggcaccccc

SEQ ID NO: 1269225 - RNA, 25 nt, Human
ccccgggagcugcuccugcucggcc

SEQ ID NO: 1269226 - RNA, 18 nt, Human
cccgcgggcgccaccgcc

SEQ ID NO: 1269227 - RNA, 25 nt, Human
cccgcgggcgccaccgcccucaccg

SEQ ID NO: 1269228 - RNA, 27 nt, Human
cccgcgggcgccaccgcccucaccgca

SEQ ID NO: 1269229 - RNA, 22 nt, Human
ccgagccgcccgggcauccccg

SEQ ID NO: 1269230 - RNA, 21 nt, Human
ccgcacggcugccgcugcccg

SEQ ID NO: 1269231 - RNA, 22 nt, Human
ccgcccgggcauccccgggagc

SEQ ID NO: 1269232 - RNA, 18 nt, Human
ccuggaagcaucaacagu

SEQ ID NO: 1269233 - RNA, 22 nt, Human
cgcuccgagccgcccgggcauc

SEQ ID NO: 1269234 - RNA, 22 nt, Human
cgcugcccgcgcuccgagccgc

SEQ ID NO: 1269235 - RNA, 20 nt, Human
cggccgggcccgcgggcgcg

SEQ ID NO: 1269236 - RNA, 19 nt, Human
cggcugccgcugcccgcgc

SEQ ID NO: 1269237 - RNA, 19 nt, Human
cugcccccgcugcuggggc

SEQ ID NO: 1269238 - RNA, 22 nt, Human
cugcccgcgcuccgagccgccc

SEQ ID NO: 1269239 - RNA, 20 nt, Human
gcccgcgcuccgagccgccc

SEQ ID NO: 1269240 - RNA, 20 nt, Human
gcgcuccgagccgcccgggc

SEQ ID NO: 1269241 - RNA, 21 nt, Human
ggaaguuggggguggaggucc

SEQ ID NO: 1269242 - RNA, 22 nt, Human
ggagaggaggagaggaagccag

SEQ ID NO: 1269243 - RNA, 21 nt, Human
ggccgggcccgcgggcgcggg

SEQ ID NO: 1269244 - RNA, 21 nt, Human
gggagcugcuccugcucggcc

SEQ ID NO: 1269245 - RNA, 19 nt, Human
ggggagaggaggagaggaa

SEQ ID NO: 1269246 - RNA, 20 nt, Human
ggggagaggaggagaggaag

SEQ ID NO: 1269247 - RNA, 21 nt, Human
gguaugugggccaugggagcc

SEQ ID NO: 1269248 - RNA, 24 nt, Human
gguggggagaggaggagaggaagc

SEQ ID NO: 1269249 - RNA, 20 nt, Human
uaaaaaaaggccacccacaa

SEQ ID NO: 1269250 - RNA, 23 nt, Human
ucaccgcacggcugccgcugccc

SEQ ID NO: 1269251 - RNA, 18 nt, Human
uccccgggagcugcuccu

SEQ ID NO: 1269252 - RNA, 20 nt, Human
uccugggggagggcaggagg

SEQ ID NO: 1269253 - RNA, 18 nt, Human
ucgggguccgguccuccu

SEQ ID NO: 1269254 - RNA, 20 nt, Human
ugacuccaacaaaggaagcc

SEQ ID NO: 1269255 - RNA, 21 nt, Human
ugcugcugcugggcacuggag

SEQ ID NO: 1269256 - RNA, 19 nt, Human
uggaggaaguugggggugg

SEQ ID NO: 1269257 - RNA, 22 nt, Human
uggaggaaguuggggguggagg

SEQ ID NO: 1269258 - RNA, 19 nt, Human
uggagguccgguuguaaaa

SEQ ID NO: 1269259 - RNA, 22 nt, Human
uggcaaagguggggagaggagg

SEQ ID NO: 1269260 - RNA, 22 nt, Human
ugggcuggaggaaguugggggu

SEQ ID NO: 1269261 - RNA, 19 nt, Human
uggguaugugggccauggg

SEQ ID NO: 1269262 - RNA, 23 nt, Human
uguccuggucaaagagcgcgaac

SEQ ID NO: 1269263 - RNA, 20 nt, Human
cugugcagcugcaggccucg

SEQ ID NO: 1269264 - RNA, 19 nt, Human
cccugugcagagucuccuc

SEQ ID NO: 1269265 - RNA, 20 nt, Human
cuccuccaagaacuggcucc

SEQ ID NO: 1269266 - RNA, 27 nt, Human
cucucuuauuucuugagcaggaauugg

SEQ ID NO: 1269267 - RNA, 18 nt, Human
cugugcagagucuccucc

SEQ ID NO: 1269268 - RNA, 19 nt, Human
gcagagucuccuccaagaa

SEQ ID NO: 1269269 - RNA, 19 nt, Human
aaguccucugucuggccag

SEQ ID NO: 1269270 - RNA, 21 nt, Human
agccugggagucagccuccuu

SEQ ID NO: 1269271 - RNA, 18 nt, Human
aguuaggcugaacuccug

SEQ ID NO: 1269272 - RNA, 19 nt, Human
ccugggagucagccuccuu

SEQ ID NO: 1269273 - RNA, 20 nt, Human
cggcagccugggagucagcc

SEQ ID NO: 1269274 - RNA, 18 nt, Human
ugacugcucaaugggcag

SEQ ID NO: 1269275 - RNA, 19 nt, Human
uggcaccguccggcagccu

SEQ ID NO: 1269276 - RNA, 27 nt, Human
aacuaucaaaaacagacaucaaaacag

SEQ ID NO: 1269277 - RNA, 19 nt, Human
aagccccugagcaccccag

SEQ ID NO: 1269278 - RNA, 19 nt, Human
acugugguuugugagaugg

SEQ ID NO: 1269279 - RNA, 18 nt, Human
agagaagagagggcagcu

SEQ ID NO: 1269280 - RNA, 21 nt, Human
agagaguugggucucugaaaa

SEQ ID NO: 1269281 - RNA, 23 nt, Human
agagaguugggucucugaaaagg

SEQ ID NO: 1269282 - RNA, 22 nt, Human
agauggccagagaagagagggc

SEQ ID NO: 1269283 - RNA, 18 nt, Human
agccagcccaguguaugc

SEQ ID NO: 1269284 - RNA, 23 nt, Human
caagccccugagcaccccagaga

SEQ ID NO: 1269285 - RNA, 23 nt, Human
caccccagagaguugggucucug

SEQ ID NO: 1269286 - RNA, 19 nt, Human
cacuuguuagccagcauuu

SEQ ID NO: 1269287 - RNA, 19 nt, Human
cagcauggugaaugccugg

SEQ ID NO: 1269288 - RNA, 22 nt, Human
cagcauucucaguuuacucuuc

SEQ ID NO: 1269289 - RNA, 18 nt, Human
cagcccaagccccugagc

SEQ ID NO: 1269290 - RNA, 18 nt, Human
caugacacuggaugccuc

SEQ ID NO: 1269291 - RNA, 19 nt, Human
ccagagaagagagggcagc

SEQ ID NO: 1269292 - RNA, 23 nt, Human
cccaagccccugagcaccccaga

SEQ ID NO: 1269293 - RNA, 25 nt, Human
ccccugagcaccccagagaguuggg

SEQ ID NO: 1269294 - RNA, 24 nt, Human
ccuggcacucagcauucucaguuu

SEQ ID NO: 1269295 - RNA, 18 nt, Human
ggaccaguuggcccgcac

SEQ ID NO: 1269296 - RNA, 18 nt, Human
gguuugugagauggccag

SEQ ID NO: 1269297 - RNA, 20 nt, Human
uaucaaaaacagacaucaaa

SEQ ID NO: 1269298 - RNA, 23 nt, Human
uaucaaaaacagacaucaaaaca

SEQ ID NO: 1269299 - RNA, 23 nt, Human
uaucaaaaacagacaucaaaacu

SEQ ID NO: 1269300 - RNA, 21 nt, Human
ucucaauccagcccaagcccc

SEQ ID NO: 1269301 - RNA, 23 nt, Human
ugacacaguagaguucaacagaa

SEQ ID NO: 1269302 - RNA, 21 nt, Human
ugacucguggaauucaacccu

SEQ ID NO: 1269303 - RNA, 20 nt, Human
ugagcaccccagagaguugg

SEQ ID NO: 1269304 - RNA, 23 nt, Human
ugccaugggcuuauccguggcag

SEQ ID NO: 1269305 - RNA, 19 nt, Human
ugccuggcacucagcauuc

SEQ ID NO: 1269306 - RNA, 19 nt, Human
uggaugccucuuguccuca

SEQ ID NO: 1269307 - RNA, 20 nt, Human
ugugguaaagaggcaggacc

SEQ ID NO: 1269308 - RNA, 19 nt, Human
uguuccacucaugacacug

SEQ ID NO: 1269309 - RNA, 22 nt, Human
aaggacacaagggcuuaggagg

SEQ ID NO: 1269310 - RNA, 18 nt, Human
aagggucauugaaggaga

SEQ ID NO: 1269311 - RNA, 19 nt, Human
agaagacgcacaggguccu

SEQ ID NO: 1269312 - RNA, 27 nt, Human
agccucccagccucccacuuggccuuc

SEQ ID NO: 1269313 - RNA, 24 nt, Human
aggaggaagagagacuugguagag

SEQ ID NO: 1269314 - RNA, 19 nt, Human
agggucauugaaggagaag

SEQ ID NO: 1269315 - RNA, 22 nt, Human
caaagugagagcuccugguccc

SEQ ID NO: 1269316 - RNA, 21 nt, Human
caaggugcccugccaucuccc

SEQ ID NO: 1269317 - RNA, 18 nt, Human
caccccagcucugcgugc

SEQ ID NO: 1269318 - RNA, 18 nt, Human
cacggcccaggcagugac

SEQ ID NO: 1269319 - RNA, 18 nt, Human
cagccggagcccccgggc

SEQ ID NO: 1269320 - RNA, 19 nt, Human
cagccggagcccccgggcc

SEQ ID NO: 1269321 - RNA, 24 nt, Human
cagccucccacuuggccuucccca

SEQ ID NO: 1269322 - RNA, 24 nt, Human
caggcagugacugcgcgcccuuuc

SEQ ID NO: 1269323 - RNA, 22 nt, Human
ccacuuggccuuccccaaggug

SEQ ID NO: 1269324 - RNA, 23 nt, Human
ccagcuguggccacuaccuccuc

SEQ ID NO: 1269325 - RNA, 23 nt, Human
ccccaaggugcccugccaucucc

SEQ ID NO: 1269326 - RNA, 22 nt, Human
ccgucagccuguccccagcugu

SEQ ID NO: 1269327 - RNA, 21 nt, Human
ccucccacuuggccuucccca

SEQ ID NO: 1269328 - RNA, 18 nt, Human
ccucccagccucccacuu

SEQ ID NO: 1269329 - RNA, 23 nt, Human
ccucccagccucccacuuggccu

SEQ ID NO: 1269330 - RNA, 20 nt, Human
ccucuuccuccaggucuucc

SEQ ID NO: 1269331 - RNA, 22 nt, Human
ccuuccccaaggugcccugcca

SEQ ID NO: 1269332 - RNA, 22 nt, Human
cuccaggucuuccaggucacuc

SEQ ID NO: 1269333 - RNA, 21 nt, Human
cucccacuuggccuuccccaa

SEQ ID NO: 1269334 - RNA, 20 nt, Human
cuccuccuccuccuccucuu

SEQ ID NO: 1269335 - RNA, 19 nt, Human
cuccuccuccuccucuucc

SEQ ID NO: 1269336 - RNA, 19 nt, Human
cuggcuagcaguaacuucu

SEQ ID NO: 1269337 - RNA, 20 nt, Human
cuucuuaaccuggagaugaa

SEQ ID NO: 1269338 - RNA, 19 nt, Human
gagcugcagcgcacggccc

SEQ ID NO: 1269339 - RNA, 22 nt, Human
gagggggagaagacgcacaggg

SEQ ID NO: 1269340 - RNA, 23 nt, Human
gccuccuggcuagcaguaacuuc

SEQ ID NO: 1269341 - RNA, 20 nt, Human
ggagaagcggggcgcagcca

SEQ ID NO: 1269342 - RNA, 20 nt, Human
ggcccaggcagugacugcgc

SEQ ID NO: 1269343 - RNA, 20 nt, Human
gggccuccuggcuagcagua

SEQ ID NO: 1269344 - RNA, 20 nt, Human
ggggugagcaggagaggaag

SEQ ID NO: 1269345 - RNA, 19 nt, Human
ggguggggcagccucccag

SEQ ID NO: 1269346 - RNA, 20 nt, Human
gguagagucggugggugggg

SEQ ID NO: 1269347 - RNA, 19 nt, Human
gguggaggugagagacagg

SEQ ID NO: 1269348 - RNA, 18 nt, Human
gucccuggcaaggucugg

SEQ ID NO: 1269349 - RNA, 24 nt, Human
gugagcaggagaggaagccuugcu

SEQ ID NO: 1269350 - RNA, 24 nt, Human
guggguggggcagccucccagccu

SEQ ID NO: 1269351 - RNA, 23 nt, Human
ucccacuuggccuuccccaaggu

SEQ ID NO: 1269352 - RNA, 21 nt, Human
ucuuaggcaaagugagagcuc

SEQ ID NO: 1269353 - RNA, 20 nt, Human
ucuuccaggucacucagccg

SEQ ID NO: 1269354 - RNA, 21 nt, Human
ugagcaggagaggaagccuug

SEQ ID NO: 1269355 - RNA, 20 nt, Human
ugagugggguugguggaggu

SEQ ID NO: 1269356 - RNA, 20 nt, Human
uggcaaggucuggcagcuuc

SEQ ID NO: 1269357 - RNA, 20 nt, Human
ugguggaggugagagacagg

SEQ ID NO: 1269358 - RNA, 20 nt, Human
ugguggaggugagagacagg

SEQ ID NO: 1269359 - RNA, 20 nt, Human
uuccuccuccuccuccuccu

SEQ ID NO: 1269360 - RNA, 21 nt, Human
acggggcagcaggaacagcag

SEQ ID NO: 1269361 - RNA, 23 nt, Human
cacacuuggcacagcccacgggg

SEQ ID NO: 1269362 - RNA, 23 nt, Human
cagcaggaacagcagccugggga

SEQ ID NO: 1269363 - RNA, 24 nt, Human
caggaacagcagccuggggaagaa

SEQ ID NO: 1269364 - RNA, 23 nt, Human
cccugggcacacuuggcacagcc

SEQ ID NO: 1269365 - RNA, 21 nt, Human
cgagcaaaggggaugcuggag

SEQ ID NO: 1269366 - RNA, 19 nt, Human
cggggcagcaggaacagcg

SEQ ID NO: 1269367 - RNA, 19 nt, Human
cugcacuucuccgaugccc

SEQ ID NO: 1269368 - RNA, 20 nt, Human
cugcacuucuccgaugcccc

SEQ ID NO: 1269369 - RNA, 22 nt, Human
cuggagcucacaccagugagac

SEQ ID NO: 1269370 - RNA, 22 nt, Human
cuugaccgggcaccucccugcc

SEQ ID NO: 1269371 - RNA, 30 nt, Human
ggcagcaggaacagcagccuggggaagaaa

SEQ ID NO: 1269372 - RNA, 26 nt, Human
gggcacacuuggcacagcccacgggg

SEQ ID NO: 1269373 - RNA, 21 nt, Human
gggcagcaggaacagcagccu

SEQ ID NO: 1269374 - RNA, 20 nt, Human
ucaggcacagcagcugcacu

SEQ ID NO: 1269375 - RNA, 21 nt, Human
uggcacagcccacggggcagc

SEQ ID NO: 1269376 - RNA, 23 nt, Human
uggcacagcccacggggcagcag

SEQ ID NO: 1269377 - RNA, 22 nt, Human
uggcucaguguuguauuuuuaa

SEQ ID NO: 1269378 - RNA, 21 nt, Human
ugggagaagagcuguucccac

SEQ ID NO: 1269379 - RNA, 19 nt, Human
uggggaagaaggggagagu

SEQ ID NO: 1269380 - RNA, 24 nt, Human
uucccacaucaggcacagcagcug

SEQ ID NO: 1269381 - RNA, 21 nt, Human
auccaugacggugagccccag

SEQ ID NO: 1269382 - RNA, 20 nt, Human
gacggugagccccaguucuc

SEQ ID NO: 1269383 - RNA, 21 nt, Human
gagcauccaugacggugagcc

SEQ ID NO: 1269384 - RNA, 25 nt, Human
uagcuuuuucaaaagguuuaaugca

SEQ ID NO: 1269385 - RNA, 19 nt, Human
uccgcgcagcugcccagga

SEQ ID NO: 1269386 - RNA, 22 nt, Human
ugacggugagccccaguucucc

SEQ ID NO: 1269387 - RNA, 18 nt, Human
aacucacaagaaagggac

SEQ ID NO: 1269388 - RNA, 20 nt, Human
aagaaaauccaaagucccug

SEQ ID NO: 1269389 - RNA, 19 nt, Human
acaagaaagggaccuugac

SEQ ID NO: 1269390 - RNA, 18 nt, Human
acucugugagucacuggc

SEQ ID NO: 1269391 - RNA, 19 nt, Human
agaaaauccaaagucccug

SEQ ID NO: 1269392 - RNA, 18 nt, Human
agaaagaaaagaugaaaa

SEQ ID NO: 1269393 - RNA, 21 nt, Human
aggaaagggguguggaaauca

SEQ ID NO: 1269394 - RNA, 20 nt, Human
auccaaagucccugccguuu

SEQ ID NO: 1269395 - RNA, 21 nt, Human
cacaagaaagggaccuugaca

SEQ ID NO: 1269396 - RNA, 24 nt, Human
cacucugugagucacuggccaauc

SEQ ID NO: 1269397 - RNA, 20 nt, Human
ccuaacuugucaucuucucu

SEQ ID NO: 1269398 - RNA, 18 nt, Human
cugccguuuauccaaagg

SEQ ID NO: 1269399 - RNA, 27 nt, Human
cuugucaucuucucuguuguccuucga

SEQ ID NO: 1269400 - RNA, 22 nt, Human
gucacuggccaaucugagaagu

SEQ ID NO: 1269401 - RNA, 20 nt, Human
gugccacucugugagucacu

SEQ ID NO: 1269402 - RNA, 19 nt, Human
uaaauuggagacaaguuca

SEQ ID NO: 1269403 - RNA, 21 nt, Human
uaacucacaagaaagggaccu

SEQ ID NO: 1269404 - RNA, 24 nt, Human
uaggagaauacuaaaacugcaaca

SEQ ID NO: 1269405 - RNA, 21 nt, Human
uaucaaagaagacaaauaaau

SEQ ID NO: 1269406 - RNA, 22 nt, Human
uaucaaagaagacaaauaaaug

SEQ ID NO: 1269407 - RNA, 26 nt, Human
uauucaaaaagaaaauccaaaguccc

SEQ ID NO: 1269408 - RNA, 20 nt, Human
ucacaguaugaccucugauc

SEQ ID NO: 1269409 - RNA, 18 nt, Human
ucagugguccuggaaucu

SEQ ID NO: 1269410 - RNA, 19 nt, Human
ucccuaacuugucaucuuc

SEQ ID NO: 1269411 - RNA, 19 nt, Human
ucuguguuggaugcaaggc

SEQ ID NO: 1269412 - RNA, 18 nt, Human
ugaccucugaucucuccc

SEQ ID NO: 1269413 - RNA, 19 nt, Human
ugaccucugaucucucccu

SEQ ID NO: 1269414 - RNA, 18 nt, Human
uggaaccagauaauuucc

SEQ ID NO: 1269415 - RNA, 22 nt, Human
uggccaaucugagaaguagcac

SEQ ID NO: 1269416 - RNA, 23 nt, Human
ugugccacucugugagucacugg

SEQ ID NO: 1269417 - RNA, 26 nt, Human
uuaugcuuauauucaaaaagaaaauc

SEQ ID NO: 1269418 - RNA, 25 nt, Human
uucaaagaaacagaaaacgucaucc

SEQ ID NO: 1269419 - RNA, 21 nt, Human
uucagaaagaaaagaugaaaa

SEQ ID NO: 1269420 - RNA, 22 nt, Human
uucagaaagaaaagaugaaaaa

SEQ ID NO: 1269421 - RNA, 20 nt, Human
uuucaaagaaacagaaaacg

SEQ ID NO: 1269422 - RNA, 25 nt, Human
uuuucaaagaaacagaaaacgucau

SEQ ID NO: 1269423 - RNA, 20 nt, Human
aaauaguagaaacacaaacu

SEQ ID NO: 1269424 - RNA, 24 nt, Human
accgagccgcgagggggagggcag

SEQ ID NO: 1269425 - RNA, 19 nt, Human
agaaccaaguuugcaagga

SEQ ID NO: 1269426 - RNA, 21 nt, Human
aggaagaucaaaugaaaagac

SEQ ID NO: 1269427 - RNA, 23 nt, Human
ccgcgagggggagggcaggcgcc

SEQ ID NO: 1269428 - RNA, 20 nt, Human
cgagccgcgagggggagggc

SEQ ID NO: 1269429 - RNA, 18 nt, Human
cgguggagguggugcuga

SEQ ID NO: 1269430 - RNA, 22 nt, Human
cgguggagguggugcugauggu

SEQ ID NO: 1269431 - RNA, 24 nt, Human
cucauuuccaaaguauuuuauguu

SEQ ID NO: 1269432 - RNA, 20 nt, Human
cugaugguggcgaggcuggc

SEQ ID NO: 1269433 - RNA, 28 nt, Human
gagggcaggcgccgagaagcggggucuc

SEQ ID NO: 1269434 - RNA, 23 nt, Human
gcggcggcggcggcgguggaggu

SEQ ID NO: 1269435 - RNA, 18 nt, Human
gcggcggcggcgguggag

SEQ ID NO: 1269436 - RNA, 19 nt, Human
gcggcggcggcgguggagg

SEQ ID NO: 1269437 - RNA, 22 nt, Human
gcggcggcgguggagguggugc

SEQ ID NO: 1269438 - RNA, 20 nt, Human
gcgguggugguggcggcggc

SEQ ID NO: 1269439 - RNA, 19 nt, Human
ggagguagcggugcuggcg

SEQ ID NO: 1269440 - RNA, 20 nt, Human
ggcgguggugguggcggcgg

SEQ ID NO: 1269441 - RNA, 23 nt, Human
ggcgguggugguggcggcggcgg

SEQ ID NO: 1269442 - RNA, 24 nt, Human
gggccggaccgagccgcgaggggg

SEQ ID NO: 1269443 - RNA, 23 nt, Human
gguggcggcggcggcggcggugg

SEQ ID NO: 1269444 - RNA, 23 nt, Human
ggugguggcggcggcggcggcgg

SEQ ID NO: 1269445 - RNA, 23 nt, Human
gguggugguggcggcggcggcgg

SEQ ID NO: 1269446 - RNA, 24 nt, Human
guggagguggugcugaugguggcg

SEQ ID NO: 1269447 - RNA, 19 nt, Human
guggcggcggcggcggcgg

SEQ ID NO: 1269448 - RNA, 20 nt, Human
guggcggcggcggcggcggu

SEQ ID NO: 1269449 - RNA, 22 nt, Human
guggcggcggcggcggcggugg

SEQ ID NO: 1269450 - RNA, 20 nt, Human
gugguggcggcggcggcggc

SEQ ID NO: 1269451 - RNA, 20 nt, Human
guggugguggcggcggcggc

SEQ ID NO: 1269452 - RNA, 20 nt, Human
guggugguggcggcggcggc

SEQ ID NO: 1269453 - RNA, 18 nt, Human
guuucuguggagaugaaa

SEQ ID NO: 1269454 - RNA, 22 nt, Human
uagaaacacaaacucauuucca

SEQ ID NO: 1269455 - RNA, 23 nt, Human
uaguagaaacacaaacucauuuc

SEQ ID NO: 1269456 - RNA, 25 nt, Human
uaguagaaacacaaacucauuucca

SEQ ID NO: 1269457 - RNA, 22 nt, Human
uaugaaaauaguagaaacacaa

SEQ ID NO: 1269458 - RNA, 24 nt, Human
ucagaaccaaguuugcaaggaaga

SEQ ID NO: 1269459 - RNA, 20 nt, Human
ucagaagcaugucaggauua

SEQ ID NO: 1269460 - RNA, 20 nt, Human
uccaaaguauuuuauguucu

SEQ ID NO: 1269461 - RNA, 18 nt, Human
ucuuguggaucaacauuc

SEQ ID NO: 1269462 - RNA, 19 nt, Human
ucuuguggaucaacauucu

SEQ ID NO: 1269463 - RNA, 24 nt, Human
ugaaaagacuaaaaaucaauacag

SEQ ID NO: 1269464 - RNA, 22 nt, Human
uggcgaggcuggcggagguagc

SEQ ID NO: 1269465 - RNA, 20 nt, Human
uggcggcggcggcggcggug

SEQ ID NO: 1269466 - RNA, 21 nt, Human
uggcggcggcggcggcggugg

SEQ ID NO: 1269467 - RNA, 23 nt, Human
uggcggcggcggcggcgguggag

SEQ ID NO: 1269468 - RNA, 18 nt, Human
ugguggcggcggcggcgg

SEQ ID NO: 1269469 - RNA, 18 nt, Human
uggugguggcggcggcgg

SEQ ID NO: 1269470 - RNA, 18 nt, Human
uggugguggcggcggcgg

SEQ ID NO: 1269471 - RNA, 20 nt, Human
uuugugucugguuucugugg

SEQ ID NO: 1269472 - RNA, 18 nt, Human
auagccgaugcuguucac

SEQ ID NO: 1269473 - RNA, 19 nt, Human
cauagccgaugcuguucac

SEQ ID NO: 1269474 - RNA, 19 nt, Human
caugcaaaccgaguauugc

SEQ ID NO: 1269475 - RNA, 18 nt, Human
cccugagcagguuguuua

SEQ ID NO: 1269476 - RNA, 18 nt, Human
ccucccuuccucuuucuc

SEQ ID NO: 1269477 - RNA, 19 nt, Human
ccucccuuccucuuucucc

SEQ ID NO: 1269478 - RNA, 24 nt, Human
ccucccuuccucuuucuccuggac

SEQ ID NO: 1269479 - RNA, 23 nt, Human
ccucuuucuccuggacuuucuca

SEQ ID NO: 1269480 - RNA, 25 nt, Human
cucacaggcagaagaggugcuacag

SEQ ID NO: 1269481 - RNA, 20 nt, Human
cuccagcagcccugcgcucc

SEQ ID NO: 1269482 - RNA, 21 nt, Human
cuccuggacuuucucagaggc

SEQ ID NO: 1269483 - RNA, 20 nt, Human
gaagaggucaucgcacagga

SEQ ID NO: 1269484 - RNA, 20 nt, Human
gaagggcugguggcugaaga

SEQ ID NO: 1269485 - RNA, 18 nt, Human
ggcugguggcugaagagg

SEQ ID NO: 1269486 - RNA, 24 nt, Human
uagucuccagcagcccugcgcucc

SEQ ID NO: 1269487 - RNA, 24 nt, Human
uccucccuuccucuuucuccugga

SEQ ID NO: 1269488 - RNA, 21 nt, Human
ucgcucacaggcagaagaggu

SEQ ID NO: 1269489 - RNA, 23 nt, Human
ugagcagguuguuuaccaggucg

SEQ ID NO: 1269490 - RNA, 26 nt, Human
ugauuccauccucccuuccucuuucu

SEQ ID NO: 1269491 - RNA, 23 nt, Human
uucaccacaggcaggcuccgcag

SEQ ID NO: 1269492 - RNA, 19 nt, Human
uuccucuuucuccuggacu

SEQ ID NO: 1269493 - RNA, 23 nt, Human
aagacuuuuccauccgcugacag

SEQ ID NO: 1269494 - RNA, 21 nt, Human
aaguguuagaaaaaaggaccc

SEQ ID NO: 1269495 - RNA, 23 nt, Human
agaaaaaaggacccauagcacgc

SEQ ID NO: 1269496 - RNA, 25 nt, Human
cccaauggcaaccaucuuugcaguc

SEQ ID NO: 1269497 - RNA, 25 nt, Human
cugaccugugaacccaauggcaacc

SEQ ID NO: 1269498 - RNA, 23 nt, Human
cuucugcaaguguuagaaaaaag

SEQ ID NO: 1269499 - RNA, 23 nt, Human
cuuuuccauccgcugacagcaaa

SEQ ID NO: 1269500 - RNA, 21 nt, Human
gggugagaguaggaggaucug

SEQ ID NO: 1269501 - RNA, 19 nt, Human
uagaaaaaaggacccauag

SEQ ID NO: 1269502 - RNA, 19 nt, Human
uaggaggaucugaccugug

SEQ ID NO: 1269503 - RNA, 23 nt, Human
ugcaaguguuagaaaaaaggacc

SEQ ID NO: 1269504 - RNA, 21 nt, Human
cauuuggagucauuuuuauuc

SEQ ID NO: 1269505 - RNA, 22 nt, Human
aaaugggcccacgagguguggg

SEQ ID NO: 1269506 - RNA, 20 nt, Human
augaaaccugggaauauucu

SEQ ID NO: 1269507 - RNA, 25 nt, Human
auucuuccucugugauuucuuuugu

SEQ ID NO: 1269508 - RNA, 23 nt, Human
cagauugcgaagagcgccgcuga

SEQ ID NO: 1269509 - RNA, 18 nt, Human
caggugaagguggugggg

SEQ ID NO: 1269510 - RNA, 19 nt, Human
cugcagaaaugggcccacg

SEQ ID NO: 1269511 - RNA, 20 nt, Human
ucagcugccccaacuuucag

SEQ ID NO: 1269512 - RNA, 18 nt, Human
ugggaauauucuuccucu

SEQ ID NO: 1269513 - RNA, 24 nt, Human
uuucagauugcgaagagcgccgcu

SEQ ID NO: 1269514 - RNA, 18 nt, Human
aaaaaauauauucuucag

SEQ ID NO: 1269515 - RNA, 21 nt, Human
aaaaauuuuuuagagacagag

SEQ ID NO: 1269516 - RNA, 21 nt, Human
aaaacagauucuccuauauga

SEQ ID NO: 1269517 - RNA, 19 nt, Human
aaaauaccucuccauuucu

SEQ ID NO: 1269518 - RNA, 19 nt, Human
aaaauaccucuccauuucu

SEQ ID NO: 1269519 - RNA, 24 nt, Human
aaacuauucuccucaacuuuccug

SEQ ID NO: 1269520 - RNA, 19 nt, Human
aaagugcugggauuacagg

SEQ ID NO: 1269521 - RNA, 24 nt, Human
aaagugcugggauuacagguguga

SEQ ID NO: 1269522 - RNA, 18 nt, Human
aacacuuugggaggcuga

SEQ ID NO: 1269523 - RNA, 24 nt, Human
aacacuuugggaggcugagguggg

SEQ ID NO: 1269524 - RNA, 18 nt, Human
aacaugaugaaacccccu

SEQ ID NO: 1269525 - RNA, 19 nt, Human
aacaugaugaaacccccuc

SEQ ID NO: 1269526 - RNA, 20 nt, Human
aacaugaugaaacccccucu

SEQ ID NO: 1269527 - RNA, 22 nt, Human
aacucacccacuguccaacaaa

SEQ ID NO: 1269528 - RNA, 22 nt, Human
aagaaucgcuugaaccagggag

SEQ ID NO: 1269529 - RNA, 22 nt, Human
aagaccccaucuacagcccuac

SEQ ID NO: 1269530 - RNA, 19 nt, Human
aagagcacuggccccgacc

SEQ ID NO: 1269531 - RNA, 19 nt, Human
aagcagaaguaauuuccaa

SEQ ID NO: 1269532 - RNA, 21 nt, Human
aaggaucaccugcaccaauuc

SEQ ID NO: 1269533 - RNA, 24 nt, Human
aaggaucaccugcaccaauucugc

SEQ ID NO: 1269534 - RNA, 19 nt, Human
aaguagcugggacuacagg

SEQ ID NO: 1269535 - RNA, 20 nt, Human
aaguagcugggacuacaggu

SEQ ID NO: 1269536 - RNA, 18 nt, Human
aagugcugggauuacagg

SEQ ID NO: 1269537 - RNA, 19 nt, Human
aagugcugggauuacaggc

SEQ ID NO: 1269538 - RNA, 19 nt, Human
aagugcugggauuacaggc

SEQ ID NO: 1269539 - RNA, 19 nt, Human
aagugcugggauuacaggu

SEQ ID NO: 1269540 - RNA, 24 nt, Human
aaucgcuugaaccagggaggcaga

SEQ ID NO: 1269541 - RNA, 20 nt, Human
acaaacuuuaaaacuuacag

SEQ ID NO: 1269542 - RNA, 18 nt, Human
acaggguuucacuguguu

SEQ ID NO: 1269543 - RNA, 19 nt, Human
acaggguuucacuguguua

SEQ ID NO: 1269544 - RNA, 20 nt, Human
acaggguuucacuguguuag

SEQ ID NO: 1269545 - RNA, 24 nt, Human
acaggguuucacuguguuagccag

SEQ ID NO: 1269546 - RNA, 19 nt, Human
acaggugccugccaccacg

SEQ ID NO: 1269547 - RNA, 23 nt, Human
accaccaccaccuccggcuccgg

SEQ ID NO: 1269548 - RNA, 19 nt, Human
acccaggcuggagugcagu

SEQ ID NO: 1269549 - RNA, 24 nt, Human
acccccucucuacuaaaaacacaa

SEQ ID NO: 1269550 - RNA, 25 nt, Human
accucccggguucacgccauucucc

SEQ ID NO: 1269551 - RNA, 24 nt, Human
accuugugauccgcccaccucggc

SEQ ID NO: 1269552 - RNA, 28 nt, Human
acuacaggcacccgccaccacgcccgcc

SEQ ID NO: 1269553 - RNA, 19 nt, Human
acuacaggugccugccacc

SEQ ID NO: 1269554 - RNA, 18 nt, Human
acuacuaaucuaauaaca

SEQ ID NO: 1269555 - RNA, 25 nt, Human
acuauauugcccaggcuggucucaa

SEQ ID NO: 1269556 - RNA, 24 nt, Human
acuccagccugagugacagaguga

SEQ ID NO: 1269557 - RNA, 18 nt, Human
acugcaagcuccgccucc

SEQ ID NO: 1269558 - RNA, 24 nt, Human
acuuggguauauugguuacuuagg

SEQ ID NO: 1269559 - RNA, 24 nt, Human
acuuugggaggcugaggugggcag

SEQ ID NO: 1269560 - RNA, 18 nt, Human
agacaggguuucacugug

SEQ ID NO: 1269561 - RNA, 19 nt, Human
agagacaggguuucacugu

SEQ ID NO: 1269562 - RNA, 19 nt, Human
agagaugggguuucaccgu

SEQ ID NO: 1269563 - RNA, 18 nt, Human
agagguugcagugagcug

SEQ ID NO: 1269564 - RNA, 22 nt, Human
agagguugcagugagcugagau

SEQ ID NO: 1269565 - RNA, 23 nt, Human
agagguugcagugagcugagauc

SEQ ID NO: 1269566 - RNA, 24 nt, Human
agagguugcagugagcugagauca

SEQ ID NO: 1269567 - RNA, 20 nt, Human
agagguugcagugagcuggc

SEQ ID NO: 1269568 - RNA, 20 nt, Human
agccaccgcacccggccuca

SEQ ID NO: 1269569 - RNA, 18 nt, Human
agcuccgccuccuggguu

SEQ ID NO: 1269570 - RNA, 20 nt, Human
agcugccaaguaacugcuac

SEQ ID NO: 1269571 - RNA, 23 nt, Human
agcugggcaugguggcgcaugcc

SEQ ID NO: 1269572 - RNA, 22 nt, Human
aggcagaagaaucgcuugaacc

SEQ ID NO: 1269573 - RNA, 24 nt, Human
aggcagaagaaucgcuugaaccag

SEQ ID NO: 1269574 - RNA, 20 nt, Human
aggcagagguugcagugagc

SEQ ID NO: 1269575 - RNA, 24 nt, Human
aggcagagguugcagugagcugag

SEQ ID NO: 1269576 - RNA, 27 nt, Human
aggcaguaagugaagcagaagggaccc

SEQ ID NO: 1269577 - RNA, 24 nt, Human
aggccgaggcagaagaaucgcuug

SEQ ID NO: 1269578 - RNA, 21 nt, Human
aggcugaggugggcagaucac

SEQ ID NO: 1269579 - RNA, 24 nt, Human
aggcugaggugggcagaucacuug

SEQ ID NO: 1269580 - RNA, 25 nt, Human
aggcuggagugcaguggcaccaucu

SEQ ID NO: 1269581 - RNA, 24 nt, Human
agggaggcagagguugcagugagc

SEQ ID NO: 1269582 - RNA, 22 nt, Human
aggugggcagaucacuugagau

SEQ ID NO: 1269583 - RNA, 26 nt, Human
aggugggcagaucacuugagaucagg

SEQ ID NO: 1269584 - RNA, 19 nt, Human
aguagagacaggguuucac

SEQ ID NO: 1269585 - RNA, 20 nt, Human
aguagagaugggguuucacc

SEQ ID NO: 1269586 - RNA, 18 nt, Human
aguagcugggacuacagg

SEQ ID NO: 1269587 - RNA, 19 nt, Human
aguagcugggacuacaggc

SEQ ID NO: 1269588 - RNA, 18 nt, Human
aguagcugggauuacagg

SEQ ID NO: 1269589 - RNA, 24 nt, Human
agugcaguggcaccaucucggcuc

SEQ ID NO: 1269590 - RNA, 23 nt, Human
aguggcucaugccuguaaucuca

SEQ ID NO: 1269591 - RNA, 20 nt, Human
aguguaguggcgccaucuug

SEQ ID NO: 1269592 - RNA, 24 nt, Human
aucacgucauugcacuccagccug

SEQ ID NO: 1269593 - RNA, 20 nt, Human
aucacuugagaucaggaguu

SEQ ID NO: 1269594 - RNA, 19 nt, Human
augccuguaaucucaacac

SEQ ID NO: 1269595 - RNA, 19 nt, Human
augggguuucaccguguua

SEQ ID NO: 1269596 - RNA, 22 nt, Human
auuacaugaaccaagacugugg

SEQ ID NO: 1269597 - RNA, 20 nt, Human
auuagcugggcaugguggcc

SEQ ID NO: 1269598 - RNA, 20 nt, Human
auuauuuuauauauacauau

SEQ ID NO: 1269599 - RNA, 21 nt, Human
auucuccugccucagccuccc

SEQ ID NO: 1269600 - RNA, 21 nt, Human
auugcacuccagccugaguga

SEQ ID NO: 1269601 - RNA, 24 nt, Human
auugcacuccagccugagugacag

SEQ ID NO: 1269602 - RNA, 24 nt, Human
caaaacaauggcaaauuuauagaa

SEQ ID NO: 1269603 - RNA, 19 nt, Human
caaaggaccucgaaagacc

SEQ ID NO: 1269604 - RNA, 21 nt, Human
caacacuuugggaggcugagg

SEQ ID NO: 1269605 - RNA, 24 nt, Human
caacacuuugggaggcugaggugg

SEQ ID NO: 1269606 - RNA, 19 nt, Human
caacugcauuucaguaggu

SEQ ID NO: 1269607 - RNA, 20 nt, Human
caagguggugaaccaccgca

SEQ ID NO: 1269608 - RNA, 24 nt, Human
caccccagcuuccugaguagcugg

SEQ ID NO: 1269609 - RNA, 19 nt, Human
caccgcacccggccucaac

SEQ ID NO: 1269610 - RNA, 23 nt, Human
caccguguuagccaggauggucu

SEQ ID NO: 1269611 - RNA, 24 nt, Human
caccguguuagccaggauggucuu

SEQ ID NO: 1269612 - RNA, 19 nt, Human
caccucccggguucacgcc

SEQ ID NO: 1269613 - RNA, 24 nt, Human
caccucggccucccaaagugcugg

SEQ ID NO: 1269614 - RNA, 26 nt, Human
caccucuaacuccagcucggcggcuc

SEQ ID NO: 1269615 - RNA, 22 nt, Human
cacgccauucuccugccucagc

SEQ ID NO: 1269616 - RNA, 22 nt, Human
cacgccauucuccugccucagc

SEQ ID NO: 1269617 - RNA, 19 nt, Human
cacguaccucagucuacau

SEQ ID NO: 1269618 - RNA, 24 nt, Human
cacuauauugcccaggcuggucuc

SEQ ID NO: 1269619 - RNA, 27 nt, Human
cacuauauugcccaggcuggucucaaa

SEQ ID NO: 1269620 - RNA, 22 nt, Human
cacuccagccugagugacagag

SEQ ID NO: 1269621 - RNA, 22 nt, Human
cacuccagccugagugacagag

SEQ ID NO: 1269622 - RNA, 24 nt, Human
cacuccagccugagugacagagug

SEQ ID NO: 1269623 - RNA, 21 nt, Human
cacuggccccgaccccaggcc

SEQ ID NO: 1269624 - RNA, 19 nt, Human
cacuguguuagccaggaug

SEQ ID NO: 1269625 - RNA, 24 nt, Human
cacuguguuagccaggauggucuc

SEQ ID NO: 1269626 - RNA, 23 nt, Human
cacuucucauuugaaaugaagaa

SEQ ID NO: 1269627 - RNA, 19 nt, Human
cagaccuggugaagagcua

SEQ ID NO: 1269628 - RNA, 21 nt, Human
cagagugagacaccauccccc

SEQ ID NO: 1269629 - RNA, 27 nt, Human
cagaucacuugagaucaggaguuugag

SEQ ID NO: 1269630 - RNA, 21 nt, Human
cagcaauagaacacuugggua

SEQ ID NO: 1269631 - RNA, 23 nt, Human
cagccgggggcccggccccacgg

SEQ ID NO: 1269632 - RNA, 24 nt, Human
cagcuacucaggaggccgaggcag

SEQ ID NO: 1269633 - RNA, 20 nt, Human
cagcuuccugaguagcuggg

SEQ ID NO: 1269634 - RNA, 27 nt, Human
caggaggccgaggcagaagaaucgcuu

SEQ ID NO: 1269635 - RNA, 21 nt, Human
caggauaaaugcuaauucuua

SEQ ID NO: 1269636 - RNA, 25 nt, Human
caggcacccgccaccacgcccgccc

SEQ ID NO: 1269637 - RNA, 24 nt, Human
caggguuucacuguguuagccagg

SEQ ID NO: 1269638 - RNA, 18 nt, Human
cagguacccgaguguggc

SEQ ID NO: 1269639 - RNA, 19 nt, Human
caggugccugccaccacgc

SEQ ID NO: 1269640 - RNA, 23 nt, Human
caggugccugccaccacgccugg

SEQ ID NO: 1269641 - RNA, 19 nt, Human
cauugcacuccagccugag

SEQ ID NO: 1269642 - RNA, 19 nt, Human
cauugcacuccagccugag

SEQ ID NO: 1269643 - RNA, 19 nt, Human
cauugcacuccagccugag

SEQ ID NO: 1269644 - RNA, 20 nt, Human
cauugcacuccagccugagu

SEQ ID NO: 1269645 - RNA, 21 nt, Human
cauugcacuccagccugagug

SEQ ID NO: 1269646 - RNA, 23 nt, Human
cauugcacuccagccugagugac

SEQ ID NO: 1269647 - RNA, 24 nt, Human
cauugcacuccagccugagugaca

SEQ ID NO: 1269648 - RNA, 25 nt, Human
cauugcacuccagccugagugacag

SEQ ID NO: 1269649 - RNA, 19 nt, Human
ccaaagugcugggauuaca

SEQ ID NO: 1269650 - RNA, 21 nt, Human
ccaaagugcugggauuacagg

SEQ ID NO: 1269651 - RNA, 21 nt, Human
ccaaagugcugggauuacagg

SEQ ID NO: 1269652 - RNA, 22 nt, Human
ccaaagugcugggauuacaggc

SEQ ID NO: 1269653 - RNA, 23 nt, Human
ccaaagugcugggauuacaggcu

SEQ ID NO: 1269654 - RNA, 24 nt, Human
ccaaagugcugggauuacaggugu

SEQ ID NO: 1269655 - RNA, 20 nt, Human
ccaccacgccuggcuaauuu

SEQ ID NO: 1269656 - RNA, 23 nt, Human
ccaccccagcuuccugaguagcu

SEQ ID NO: 1269657 - RNA, 19 nt, Human
ccaccgcgcccagccuucc

SEQ ID NO: 1269658 - RNA, 20 nt, Human
ccacggagcuccaccucuaa

SEQ ID NO: 1269659 - RNA, 24 nt, Human
ccacuguccaacaaacauaaaaca

SEQ ID NO: 1269660 - RNA, 24 nt, Human
cccaaagugcugggauuacaggcu

SEQ ID NO: 1269661 - RNA, 22 nt, Human
cccaaguagcugggacuacagg

SEQ ID NO: 1269662 - RNA, 23 nt, Human
cccaaguagcugggacuacaggu

SEQ ID NO: 1269663 - RNA, 19 nt, Human
ccccacggagcuccaccuc

SEQ ID NO: 1269664 - RNA, 28 nt, Human
ccccuaauaaauaaauaaaaauaaaaaa

SEQ ID NO: 1269665 - RNA, 23 nt, Human
cccgaguagcugggacuacaggc

SEQ ID NO: 1269666 - RNA, 24 nt, Human
cccgaguagcugggacuacaggca

SEQ ID NO: 1269667 - RNA, 27 nt, Human
cccggaaccggggcagagaagaggaac

SEQ ID NO: 1269668 - RNA, 22 nt, Human
cccgucucggccucccaaagug

SEQ ID NO: 1269669 - RNA, 24 nt, Human
cccuccgggcgccaccucccagcg

SEQ ID NO: 1269670 - RNA, 24 nt, Human
cccucuguugcccaggcuggagug

SEQ ID NO: 1269671 - RNA, 18 nt, Human
cccuguacaggccgcuuc

SEQ ID NO: 1269672 - RNA, 19 nt, Human
ccgccaccacgcccgcccg

SEQ ID NO: 1269673 - RNA, 19 nt, Human
ccuccggcuccggcucauu

SEQ ID NO: 1269674 - RNA, 23 nt, Human
ccuccgggcgccaccucccagcg

SEQ ID NO: 1269675 - RNA, 25 nt, Human
ccucuguugcccaggcuggagugua

SEQ ID NO: 1269676 - RNA, 22 nt, Human
ccugaguagcugggauuacagg

SEQ ID NO: 1269677 - RNA, 23 nt, Human
ccugaguagcugggauuacaggu

SEQ ID NO: 1269678 - RNA, 24 nt, Human
ccugaguagcugggauuacaggug

SEQ ID NO: 1269679 - RNA, 24 nt, Human
ccugccucagccucccgaguagcu

SEQ ID NO: 1269680 - RNA, 19 nt, Human
ccuguaaucccagcuacuc

SEQ ID NO: 1269681 - RNA, 21 nt, Human
ccuguaaucccagcuacucag

SEQ ID NO: 1269682 - RNA, 20 nt, Human
ccuguaaucucaacacuuug

SEQ ID NO: 1269683 - RNA, 22 nt, Human
cgaaagaccccaucuacagccc

SEQ ID NO: 1269684 - RNA, 21 nt, Human
cgccggggccuccgccugcag

SEQ ID NO: 1269685 - RNA, 19 nt, Human
cgccuccuggguucacgcc

SEQ ID NO: 1269686 - RNA, 24 nt, Human
cgcucugucacccaggcuggagug

SEQ ID NO: 1269687 - RNA, 22 nt, Human
cgguguggcaugaucucggcuc

SEQ ID NO: 1269688 - RNA, 19 nt, Human
cuagauuccaacaaccuga

SEQ ID NO: 1269689 - RNA, 20 nt, Human
cuagcaagccuccuagcugc

SEQ ID NO: 1269690 - RNA, 24 nt, Human
cucacugcaagcuccaccucccgg

SEQ ID NO: 1269691 - RNA, 24 nt, Human
cucagccucccaaguagcugggac

SEQ ID NO: 1269692 - RNA, 24 nt, Human
cucagccucccgaguagcugggac

SEQ ID NO: 1269693 - RNA, 24 nt, Human
cucaugccuguaaucucaacacuu

SEQ ID NO: 1269694 - RNA, 19 nt, Human
cucauuugaaaugaagaac

SEQ ID NO: 1269695 - RNA, 21 nt, Human
cucccggguucacgccauucu

SEQ ID NO: 1269696 - RNA, 24 nt, Human
cucccucuguugcccaggcuggag

SEQ ID NO: 1269697 - RNA, 23 nt, Human
cuccugaccucgugaucugcccg

SEQ ID NO: 1269698 - RNA, 22 nt, Human
cuccugaccuugugauccgccc

SEQ ID NO: 1269699 - RNA, 25 nt, Human
cuccugccucagccucccaaguagc

SEQ ID NO: 1269700 - RNA, 22 nt, Human
cuccugccucagccucccgagu

SEQ ID NO: 1269701 - RNA, 21 nt, Human
cuccuggguucacgccauucu

SEQ ID NO: 1269702 - RNA, 24 nt, Human
cucgcucugucacccaggcuggag

SEQ ID NO: 1269703 - RNA, 24 nt, Human
cucucgaagcugaguggugcccag

SEQ ID NO: 1269704 - RNA, 21 nt, Human
cugaguagcugggauuacagg

SEQ ID NO: 1269705 - RNA, 23 nt, Human
cugaguagcugggauuacaggug

SEQ ID NO: 1269706 - RNA, 24 nt, Human
cugaguagcugggauuacaggugu

SEQ ID NO: 1269707 - RNA, 24 nt, Human
cugcaagcuccaccucccggguuc

SEQ ID NO: 1269708 - RNA, 19 nt, Human
cugcaggagccgcugcccc

SEQ ID NO: 1269709 - RNA, 23 nt, Human
cugccucagccucccaaguagcu

SEQ ID NO: 1269710 - RNA, 21 nt, Human
cuggccccgaccccaggcacg

SEQ ID NO: 1269711 - RNA, 19 nt, Human
cugucacccaggcuggagu

SEQ ID NO: 1269712 - RNA, 20 nt, Human
cuucucagcagaacuucugg

SEQ ID NO: 1269713 - RNA, 23 nt, Human
cuugagaucaggaguuugagauc

SEQ ID NO: 1269714 - RNA, 24 nt, Human
gaaaaaaaaggcauaacucugcga

SEQ ID NO: 1269715 - RNA, 21 nt, Human
gaaagaccccaucuacagccc

SEQ ID NO: 1269716 - RNA, 21 nt, Human
gaaccggggcagagaagagga

SEQ ID NO: 1269717 - RNA, 21 nt, Human
gaagaaucgcuugaaccaggg

SEQ ID NO: 1269718 - RNA, 22 nt, Human
gaccucgugaucugcccgucuc

SEQ ID NO: 1269719 - RNA, 24 nt, Human
gaccucgugaucugcccgucucgg

SEQ ID NO: 1269720 - RNA, 22 nt, Human
gaccuugugauccgcccaccuc

SEQ ID NO: 1269721 - RNA, 22 nt, Human
gaccuugugauccgcccaccuc

SEQ ID NO: 1269722 - RNA, 24 nt, Human
gaccuugugauccgcccaccucgg

SEQ ID NO: 1269723 - RNA, 22 nt, Human
gagaauaccccccuucucaaaa

SEQ ID NO: 1269724 - RNA, 22 nt, Human
gagaaucucuauucugcaggua

SEQ ID NO: 1269725 - RNA, 19 nt, Human
gagauacuuccaccccagc

SEQ ID NO: 1269726 - RNA, 23 nt, Human
gagaucacgucauugcacuccag

SEQ ID NO: 1269727 - RNA, 24 nt, Human
gagaugggguuucaccguguuagc

SEQ ID NO: 1269728 - RNA, 23 nt, Human
gaggcagaagaaucgcuugaacc

SEQ ID NO: 1269729 - RNA, 25 nt, Human
gaguagcugggacuacaggcacccg

SEQ ID NO: 1269730 - RNA, 19 nt, Human
gaguagcugggauuacagg

SEQ ID NO: 1269731 - RNA, 24 nt, Human
gaguagcugggauuacagguguga

SEQ ID NO: 1269732 - RNA, 25 nt, Human
gaguagcugggauuacaggugugag

SEQ ID NO: 1269733 - RNA, 24 nt, Human
gaucacuugagaucaggaguuuga

SEQ ID NO: 1269734 - RNA, 18 nt, Human
gaugucgcccaggcugga

SEQ ID NO: 1269735 - RNA, 23 nt, Human
gauuacaggcuuuagccacugca

SEQ ID NO: 1269736 - RNA, 18 nt, Human
gauuacaggugugagcca

SEQ ID NO: 1269737 - RNA, 18 nt, Human
gauuacaggugugagcca

SEQ ID NO: 1269738 - RNA, 18 nt, Human
gauuacaggugugagcca

SEQ ID NO: 1269739 - RNA, 22 nt, Human
gauuacaggugugagccaccgc

SEQ ID NO: 1269740 - RNA, 22 nt, Human
gauuacaggugugagccaccgc

SEQ ID NO: 1269741 - RNA, 24 nt, Human
gauuacaggugugagccaucaugu

SEQ ID NO: 1269742 - RNA, 21 nt, Human
gcacaaacuuuaaaacuuaca

SEQ ID NO: 1269743 - RNA, 24 nt, Human
gcacuccagccugagugacagagu

SEQ ID NO: 1269744 - RNA, 18 nt, Human
gccacauggcaagaacug

SEQ ID NO: 1269745 - RNA, 22 nt, Human
gccaucuuggcgugagccaccg

SEQ ID NO: 1269746 - RNA, 20 nt, Human
gcccaggcuggaguacggug

SEQ ID NO: 1269747 - RNA, 26 nt, Human
gcccaggcuggaguacgguguggcau

SEQ ID NO: 1269748 - RNA, 23 nt, Human
gcccggcuaauuuuuuguauuuu

SEQ ID NO: 1269749 - RNA, 25 nt, Human
gccuccuggguucacgccauucucc

SEQ ID NO: 1269750 - RNA, 23 nt, Human
gccuggcuaauuuuuuguauuuu

SEQ ID NO: 1269751 - RNA, 21 nt, Human
gcucauucuccgccggggccu

SEQ ID NO: 1269752 - RNA, 25 nt, Human
gcucugucacccaggcuggagugca

SEQ ID NO: 1269753 - RNA, 20 nt, Human
gcuggagugcaguggcacca

SEQ ID NO: 1269754 - RNA, 21 nt, Human
gcugggauuacaggcuuuagc

SEQ ID NO: 1269755 - RNA, 19 nt, Human
gcugggcacaguggcucau

SEQ ID NO: 1269756 - RNA, 23 nt, Human
gcuggucucaaacuccugaccuc

SEQ ID NO: 1269757 - RNA, 24 nt, Human
ggaguacgguguggcaugaucucg

SEQ ID NO: 1269758 - RNA, 23 nt, Human
ggagucucccucuguugcccagg

SEQ ID NO: 1269759 - RNA, 24 nt, Human
ggauggucuugaucuccugaccuu

SEQ ID NO: 1269760 - RNA, 24 nt, Human
ggauuacaggugugagccaucaug

SEQ ID NO: 1269761 - RNA, 25 nt, Human
ggcagaucacuugagaucaggaguu

SEQ ID NO: 1269762 - RNA, 20 nt, Human
ggcaugguggcgcaugccug

SEQ ID NO: 1269763 - RNA, 27 nt, Human
ggccgaggcagaagaaucgcuugaacc

SEQ ID NO: 1269764 - RNA, 19 nt, Human
ggcgugagccaccgcaccc

SEQ ID NO: 1269765 - RNA, 23 nt, Human
ggcugggcacaguggcucaugcc

SEQ ID NO: 1269766 - RNA, 24 nt, Human
ggcuggucucaaacuccugaccuc

SEQ ID NO: 1269767 - RNA, 18 nt, Human
gggcacaguggcucaugc

SEQ ID NO: 1269768 - RNA, 24 nt, Human
gggcacaguggcucaugccuguaa

SEQ ID NO: 1269769 - RNA, 24 nt, Human
gggcaugguggcgcaugccuguaa

SEQ ID NO: 1269770 - RNA, 18 nt, Human
gggguuucaccguguuag

SEQ ID NO: 1269771 - RNA, 22 nt, Human
gggguuucaccguguuagccag

SEQ ID NO: 1269772 - RNA, 22 nt, Human
ggguuucaccguguuagccagg

SEQ ID NO: 1269773 - RNA, 20 nt, Human
ggucucgaucuccugaccuc

SEQ ID NO: 1269774 - RNA, 20 nt, Human
ggucuugaucuccugaccuu

SEQ ID NO: 1269775 - RNA, 24 nt, Human
gguggcgcaugccuguaaucccag

SEQ ID NO: 1269776 - RNA, 19 nt, Human
guaaaaagugcaacuuaga

SEQ ID NO: 1269777 - RNA, 20 nt, Human
guaccuguaagcacuuucag

SEQ ID NO: 1269778 - RNA, 24 nt, Human
guagcugggauuacaggugugagc

SEQ ID NO: 1269779 - RNA, 23 nt, Human
gucuagaugucgcccaggcugga

SEQ ID NO: 1269780 - RNA, 24 nt, Human
gucucgcucugucacccaggcugg

SEQ ID NO: 1269781 - RNA, 24 nt, Human
gugagccaccgcgcccagccuucc

SEQ ID NO: 1269782 - RNA, 24 nt, Human
gugauccgcccaccucggccuccc

SEQ ID NO: 1269783 - RNA, 19 nt, Human
gugcccagcugacagucag

SEQ ID NO: 1269784 - RNA, 19 nt, Human
gugggaggccucucgaagc

SEQ ID NO: 1269785 - RNA, 25 nt, Human
uaacaaugcccuaugaucucaugac

SEQ ID NO: 1269786 - RNA, 24 nt, Human
uaacaugaugaaacccccucucua

SEQ ID NO: 1269787 - RNA, 20 nt, Human
uaacuucuccaccgccaucu

SEQ ID NO: 1269788 - RNA, 21 nt, Human
uaacuucuccaccgccaucuc

SEQ ID NO: 1269789 - RNA, 19 nt, Human
uaaucuaauaacacugaaa

SEQ ID NO: 1269790 - RNA, 24 nt, Human
uaauuuuuuguauuuuuaguagag

SEQ ID NO: 1269791 - RNA, 24 nt, Human
uaauuuuuuguauuuuuaguagag

SEQ ID NO: 1269792 - RNA, 25 nt, Human
uaauuuuuuguauuuuuaguagaga

SEQ ID NO: 1269793 - RNA, 23 nt, Human
uacagccuguacagacauuacca

SEQ ID NO: 1269794 - RNA, 23 nt, Human
uacaggcacccgccaccacgccc

SEQ ID NO: 1269795 - RNA, 22 nt, Human
uacaggugccugccaccacgcc

SEQ ID NO: 1269796 - RNA, 24 nt, Human
uacaggugugagccaccgcgccca

SEQ ID NO: 1269797 - RNA, 24 nt, Human
uacaggugugagccaucauguccu

SEQ ID NO: 1269798 - RNA, 18 nt, Human
uaccccccuucucaaaaa

SEQ ID NO: 1269799 - RNA, 21 nt, Human
uaccccccuucucaaaaacaa

SEQ ID NO: 1269800 - RNA, 19 nt, Human
uacccuguaacaguaaaug

SEQ ID NO: 1269801 - RNA, 21 nt, Human
uacuccaaucagguagaaagg

SEQ ID NO: 1269802 - RNA, 19 nt, Human
uagaaucacagaucaggag

SEQ ID NO: 1269803 - RNA, 22 nt, Human
uagagacaggguuucacugugu

SEQ ID NO: 1269804 - RNA, 19 nt, Human
uagcugccaaguaacugcu

SEQ ID NO: 1269805 - RNA, 22 nt, Human
uagcugggcaugguggcgcaug

SEQ ID NO: 1269806 - RNA, 20 nt, Human
uaguagagacaggguuucac

SEQ ID NO: 1269807 - RNA, 24 nt, Human
uaguagagacaggguuucacugug

SEQ ID NO: 1269808 - RNA, 21 nt, Human
uaguagagaugggguuucacc

SEQ ID NO: 1269809 - RNA, 24 nt, Human
uaguagagaugggguuucaccgug

SEQ ID NO: 1269810 - RNA, 23 nt, Human
uauauugcccaggcuggucucaa

SEQ ID NO: 1269811 - RNA, 24 nt, Human
uauauugcccaggcuggucucaaa

SEQ ID NO: 1269812 - RNA, 20 nt, Human
uaucagcagacacuuagcua

SEQ ID NO: 1269813 - RNA, 21 nt, Human
uauggaacuuuaacaaugccc

SEQ ID NO: 1269814 - RNA, 20 nt, Human
ucaacugcauuucaguaggu

SEQ ID NO: 1269815 - RNA, 22 nt, Human
ucaaugaaaugcaguacuaaaa

SEQ ID NO: 1269816 - RNA, 24 nt, Human
ucacccaggcuggagugcaguggc

SEQ ID NO: 1269817 - RNA, 24 nt, Human
ucaccguguuagccaggauggucu

SEQ ID NO: 1269818 - RNA, 23 nt, Human
ucacgucauugcacuccagccug

SEQ ID NO: 1269819 - RNA, 24 nt, Human
ucacugcaagcuccaccucccggg

SEQ ID NO: 1269820 - RNA, 18 nt, Human
ucacugcaagcuccgccu

SEQ ID NO: 1269821 - RNA, 23 nt, Human
ucacugcaagcuccgccuccugg

SEQ ID NO: 1269822 - RNA, 24 nt, Human
ucacugcaagcuccgccuccuggg

SEQ ID NO: 1269823 - RNA, 24 nt, Human
ucacuguguuagccaggauggucu

SEQ ID NO: 1269824 - RNA, 19 nt, Human
ucacuugagaucaggaguu

SEQ ID NO: 1269825 - RNA, 20 nt, Human
ucagccucccaaguagcugg

SEQ ID NO: 1269826 - RNA, 23 nt, Human
ucagccucccgaguagcugggac

SEQ ID NO: 1269827 - RNA, 23 nt, Human
ucaggagauacuuccaccccagc

SEQ ID NO: 1269828 - RNA, 18 nt, Human
ucauugcacuccagccug

SEQ ID NO: 1269829 - RNA, 20 nt, Human
ucauugcacuccagccugag

SEQ ID NO: 1269830 - RNA, 21 nt, Human
ucauugcacuccagccugagu

SEQ ID NO: 1269831 - RNA, 24 nt, Human
ucauugcacuccagccugagugac

SEQ ID NO: 1269832 - RNA, 23 nt, Human
uccagccugagugacagagugag

SEQ ID NO: 1269833 - RNA, 24 nt, Human
uccagccugagugacagagugaga

SEQ ID NO: 1269834 - RNA, 23 nt, Human
ucccaaagugcugggauuacagg

SEQ ID NO: 1269835 - RNA, 24 nt, Human
ucccaaagugcugggauuacaggc

SEQ ID NO: 1269836 - RNA, 24 nt, Human
ucccaaguagcugggacuacaggu

SEQ ID NO: 1269837 - RNA, 19 nt, Human
ucccagcggaccgcccgga

SEQ ID NO: 1269838 - RNA, 22 nt, Human
ucccagcggaccgcccggaacc

SEQ ID NO: 1269839 - RNA, 22 nt, Human
ucccccaccccuaauaaauaaa

SEQ ID NO: 1269840 - RNA, 24 nt, Human
ucccgaguagcugggacuacaggc

SEQ ID NO: 1269841 - RNA, 21 nt, Human
ucccggguucacgccauucuc

SEQ ID NO: 1269842 - RNA, 24 nt, Human
ucccggguucacgccauucuccug

SEQ ID NO: 1269843 - RNA, 20 nt, Human
ucccuccgggcgccaccucc

SEQ ID NO: 1269844 - RNA, 20 nt, Human
ucccucuguugcccaggcug

SEQ ID NO: 1269845 - RNA, 24 nt, Human
ucccucuguugcccaggcuggagu

SEQ ID NO: 1269846 - RNA, 22 nt, Human
uccgccggggccuccgccugca

SEQ ID NO: 1269847 - RNA, 24 nt, Human
uccugaguagcugggauuacaggu

SEQ ID NO: 1269848 - RNA, 24 nt, Human
uccuggguucacgccauucuccug

SEQ ID NO: 1269849 - RNA, 23 nt, Human
ucgcccaggcuggaguacggugu

SEQ ID NO: 1269850 - RNA, 18 nt, Human
ucggccucccaaagugcu

SEQ ID NO: 1269851 - RNA, 20 nt, Human
ucgucuugcugccgccgcgc

SEQ ID NO: 1269852 - RNA, 20 nt, Human
ucuagaugucgcccaggcug

SEQ ID NO: 1269853 - RNA, 22 nt, Human
ucuagaugucgcccaggcugga

SEQ ID NO: 1269854 - RNA, 24 nt, Human
ucuagaugucgcccaggcuggagu

SEQ ID NO: 1269855 - RNA, 23 nt, Human
ucucacuauauugcccaggcugg

SEQ ID NO: 1269856 - RNA, 26 nt, Human
ucucacuauauugcccaggcuggucu

SEQ ID NO: 1269857 - RNA, 19 nt, Human
ucuccaaauuccacuugaa

SEQ ID NO: 1269858 - RNA, 23 nt, Human
ucucccucuguugcccaggcugg

SEQ ID NO: 1269859 - RNA, 24 nt, Human
ucucccucuguugcccaggcugga

SEQ ID NO: 1269860 - RNA, 19 nt, Human
ucucgcucugucacccagg

SEQ ID NO: 1269861 - RNA, 23 nt, Human
ucucgcucugucacccaggcugg

SEQ ID NO: 1269862 - RNA, 24 nt, Human
ucucgcucugucacccaggcugga

SEQ ID NO: 1269863 - RNA, 26 nt, Human
ucucgcucugucacccaggcuggagu

SEQ ID NO: 1269864 - RNA, 27 nt, Human
ucucgcucugucacccaggcuggagug

SEQ ID NO: 1269865 - RNA, 20 nt, Human
ucucggccucccaaagugcu

SEQ ID NO: 1269866 - RNA, 21 nt, Human
ucucuacuaaaaacacaaaaa

SEQ ID NO: 1269867 - RNA, 19 nt, Human
ucugccaggagaccaccac

SEQ ID NO: 1269868 - RNA, 24 nt, Human
ucugucacccaggcuggagugcag

SEQ ID NO: 1269869 - RNA, 22 nt, Human
ucuguguucucuucauugaaau

SEQ ID NO: 1269870 - RNA, 18 nt, Human
ucuguugcccaggcugga

SEQ ID NO: 1269871 - RNA, 24 nt, Human
ucuguugcccaggcuggaguguag

SEQ ID NO: 1269872 - RNA, 21 nt, Human
ugaaaugaagaacaugcuguc

SEQ ID NO: 1269873 - RNA, 22 nt, Human
ugaaaugaagaacaugcuguca

SEQ ID NO: 1269874 - RNA, 20 nt, Human
ugaaccagggaggcagaggu

SEQ ID NO: 1269875 - RNA, 18 nt, Human
ugaagcagaaguaauuuc

SEQ ID NO: 1269876 - RNA, 22 nt, Human
ugaagcagaaguaauuuccaag

SEQ ID NO: 1269877 - RNA, 21 nt, Human
ugacagaaaaaaaaggcauaa

SEQ ID NO: 1269878 - RNA, 18 nt, Human
ugacuccuaggcuaccca

SEQ ID NO: 1269879 - RNA, 23 nt, Human
ugagaaggccacauggcaagaac

SEQ ID NO: 1269880 - RNA, 20 nt, Human
ugagaauaccccccuucuca

SEQ ID NO: 1269881 - RNA, 25 nt, Human
ugagaauaccccccuucucaaaaac

SEQ ID NO: 1269882 - RNA, 21 nt, Human
ugagacaaaacaauggcaaau

SEQ ID NO: 1269883 - RNA, 22 nt, Human
ugagcugagaucacgucauugc

SEQ ID NO: 1269884 - RNA, 26 nt, Human
ugaggugggcagaucacuugagauca

SEQ ID NO: 1269885 - RNA, 20 nt, Human
ugauccaacccuacagauaa

SEQ ID NO: 1269886 - RNA, 22 nt, Human
ugcacuccagccugagugacag

SEQ ID NO: 1269887 - RNA, 21 nt, Human
ugcccaggcuggaguguagug

SEQ ID NO: 1269888 - RNA, 22 nt, Human
ugcccaggcuggaguguagugg

SEQ ID NO: 1269889 - RNA, 24 nt, Human
ugcccaggcuggaguguaguggcg

SEQ ID NO: 1269890 - RNA, 24 nt, Human
ugcccaggcuggucucaaacuccu

SEQ ID NO: 1269891 - RNA, 24 nt, Human
ugccucacuguaaauuacacuugc

SEQ ID NO: 1269892 - RNA, 24 nt, Human
ugccucagccucccaaguagcugg

SEQ ID NO: 1269893 - RNA, 24 nt, Human
ugccucagccucccgaguagcugg

SEQ ID NO: 1269894 - RNA, 24 nt, Human
ugccuguaaucccagcuacucagg

SEQ ID NO: 1269895 - RNA, 23 nt, Human
ugccuguaaucucaacacuuugg

SEQ ID NO: 1269896 - RNA, 24 nt, Human
ugccuguaaucucaacacuuuggg

SEQ ID NO: 1269897 - RNA, 21 nt, Human
ugcgauaacucacccacuguc

SEQ ID NO: 1269898 - RNA, 18 nt, Human
ugcucugagggguggaga

SEQ ID NO: 1269899 - RNA, 24 nt, Human
ugcugggauuacaggugugagcca

SEQ ID NO: 1269900 - RNA, 23 nt, Human
uggaacucauaccuugcuucuag

SEQ ID NO: 1269901 - RNA, 23 nt, Human
uggagcuccgagaagagcacuga

SEQ ID NO: 1269902 - RNA, 26 nt, Human
uggaguacgguguggcaugaucucgg

SEQ ID NO: 1269903 - RNA, 24 nt, Human
uggagucucccucuguugcccagg

SEQ ID NO: 1269904 - RNA, 23 nt, Human
uggagugcaguggcaccaucucg

SEQ ID NO: 1269905 - RNA, 24 nt, Human
uggagugcaguggcaccaucucgg

SEQ ID NO: 1269906 - RNA, 21 nt, Human
uggcaagaacugugggaggcc

SEQ ID NO: 1269907 - RNA, 19 nt, Human
uggcaccaucucggcucac

SEQ ID NO: 1269908 - RNA, 25 nt, Human
uggccuggcuaauggggcauauucc

SEQ ID NO: 1269909 - RNA, 21 nt, Human
uggcgcaugccuguaauccca

SEQ ID NO: 1269910 - RNA, 21 nt, Human
uggcucaugccuguaaucuca

SEQ ID NO: 1269911 - RNA, 24 nt, Human
uggcucaugccuguaaucucaaca

SEQ ID NO: 1269912 - RNA, 21 nt, Human
ugggacuacaggcacccgcca

SEQ ID NO: 1269913 - RNA, 22 nt, Human
ugggacuacaggcacccgccac

SEQ ID NO: 1269914 - RNA, 24 nt, Human
ugggacuacaggcacccgccacca

SEQ ID NO: 1269915 - RNA, 21 nt, Human
ugggacuacaggugccugcca

SEQ ID NO: 1269916 - RNA, 22 nt, Human
ugggacuacaggugccugccac

SEQ ID NO: 1269917 - RNA, 24 nt, Human
ugggacuacaggugccugccacca

SEQ ID NO: 1269918 - RNA, 18 nt, Human
ugggaggccucucgaagc

SEQ ID NO: 1269919 - RNA, 20 nt, Human
ugggaggcugaggugggcag

SEQ ID NO: 1269920 - RNA, 24 nt, Human
ugggaggcugaggugggcagauca

SEQ ID NO: 1269921 - RNA, 21 nt, Human
ugggauuacaggcuuuagcca

SEQ ID NO: 1269922 - RNA, 22 nt, Human
ugggauuacaggcuuuagccac

SEQ ID NO: 1269923 - RNA, 22 nt, Human
ugggauuacaggcuuuagccac

SEQ ID NO: 1269924 - RNA, 24 nt, Human
ugggauuacaggcuuuagccacug

SEQ ID NO: 1269925 - RNA, 18 nt, Human
ugggauuacaggugugag

SEQ ID NO: 1269926 - RNA, 19 nt, Human
ugggauuacaggugugagc

SEQ ID NO: 1269927 - RNA, 19 nt, Human
ugggauuacaggugugagc

SEQ ID NO: 1269928 - RNA, 21 nt, Human
ugggauuacaggugugagcca

SEQ ID NO: 1269929 - RNA, 21 nt, Human
ugggauuacaggugugagcca

SEQ ID NO: 1269930 - RNA, 21 nt, Human
ugggauuacaggugugagcca

SEQ ID NO: 1269931 - RNA, 22 nt, Human
ugggauuacaggugugagccac

SEQ ID NO: 1269932 - RNA, 23 nt, Human
ugggauuacaggugugagccacc

SEQ ID NO: 1269933 - RNA, 24 nt, Human
ugggauuacaggugugagccaccg

SEQ ID NO: 1269934 - RNA, 22 nt, Human
ugggauuacaggugugagccau

SEQ ID NO: 1269935 - RNA, 23 nt, Human
ugggauuacaggugugagccauc

SEQ ID NO: 1269936 - RNA, 24 nt, Human
ugggauuacaggugugagccauca

SEQ ID NO: 1269937 - RNA, 24 nt, Human
ugggcagaucacuugagaucagga

SEQ ID NO: 1269938 - RNA, 24 nt, Human
uggggguaaaaagugcaacuuaga

SEQ ID NO: 1269939 - RNA, 24 nt, Human
ugggguuucaccguguuagccagg

SEQ ID NO: 1269940 - RNA, 20 nt, Human
uggguucacgccauucuccu

SEQ ID NO: 1269941 - RNA, 18 nt, Human
uggugaaccaccgcagcu

SEQ ID NO: 1269942 - RNA, 24 nt, Human
ugguggcgcaugccuguaauccca

SEQ ID NO: 1269943 - RNA, 20 nt, Human
uuagcugggcaugguggcgc

SEQ ID NO: 1269944 - RNA, 21 nt, Human
uuaguagagacaggguuucac

SEQ ID NO: 1269945 - RNA, 24 nt, Human
uuaguagagacaggguuucacugu

SEQ ID NO: 1269946 - RNA, 18 nt, Human
uuaguagagaugggguuu

SEQ ID NO: 1269947 - RNA, 22 nt, Human
uuaguagagaugggguuucacc

SEQ ID NO: 1269948 - RNA, 24 nt, Human
uuaguagagaugggguuucaccgu

SEQ ID NO: 1269949 - RNA, 20 nt, Human
uucaaaggaucaccugcacc

SEQ ID NO: 1269950 - RNA, 21 nt, Human
uucacuguguuagccaggaug

SEQ ID NO: 1269951 - RNA, 21 nt, Human
uugaacauagaauauuagcau

SEQ ID NO: 1269952 - RNA, 18 nt, Human
uugaagaaacugccaugu

SEQ ID NO: 1269953 - RNA, 20 nt, Human
uugagaaucucuauucugca

SEQ ID NO: 1269954 - RNA, 21 nt, Human
uugagacaaaacaauggcaaa

SEQ ID NO: 1269955 - RNA, 23 nt, Human
uugagacagucucgcucugucac

SEQ ID NO: 1269956 - RNA, 18 nt, Human
uugcagugagcugagauc

SEQ ID NO: 1269957 - RNA, 19 nt, Human
uugcagugagcugagauca

SEQ ID NO: 1269958 - RNA, 20 nt, Human
uugcagugagcugagaucac

SEQ ID NO: 1269959 - RNA, 24 nt, Human
uugcccaggcuggaguguaguggc

SEQ ID NO: 1269960 - RNA, 25 nt, Human
uugggaggcugaggugggcagauca

SEQ ID NO: 1269961 - RNA, 23 nt, Human
uuguauuuuuaguagagaugggg

SEQ ID NO: 1269962 - RNA, 24 nt, Human
uuguuuuuuuuuuuugagacaguc

SEQ ID NO: 1269963 - RNA, 19 nt, Human
uuucaccguguuagccagg

SEQ ID NO: 1269964 - RNA, 19 nt, Human
uuucacuguguuagccagg

SEQ ID NO: 1269965 - RNA, 22 nt, Human
uuuccccagcucauaguugaau

SEQ ID NO: 1269966 - RNA, 20 nt, Human
uuuuguauuuuuaguagaga

SEQ ID NO: 1269967 - RNA, 24 nt, Human
uuuuuaguagagacaggguuucac

SEQ ID NO: 1269968 - RNA, 24 nt, Human
uuuuuaguagagaugggguuucac

SEQ ID NO: 1269969 - RNA, 21 nt, Human
uuuuuguauuuuuaguagaga

SEQ ID NO: 1269970 - RNA, 21 nt, Human
uuuuuguauuuuuaguagaga

SEQ ID NO: 1269971 - RNA, 24 nt, Human
uuuuuuguauuuuuaguagagaca

SEQ ID NO: 1269972 - RNA, 23 nt, Human
aaaaacacacaccaaggaaccaa

SEQ ID NO: 1269973 - RNA, 25 nt, Human
aaaaacacacaccaaggaaccaaga

SEQ ID NO: 1269974 - RNA, 23 nt, Human
aaaauagaaaaacauaagcuugg

SEQ ID NO: 1269975 - RNA, 20 nt, Human
aaacaaaaaugauaggguca

SEQ ID NO: 1269976 - RNA, 19 nt, Human
aaacacacaccaaggaacc

SEQ ID NO: 1269977 - RNA, 23 nt, Human
aaacauaagcuuggugaaggcaa

SEQ ID NO: 1269978 - RNA, 21 nt, Human
aaaucaaaaauuaccccaaag

SEQ ID NO: 1269979 - RNA, 25 nt, Human
aacauaacuuuucuuugaguucacu

SEQ ID NO: 1269980 - RNA, 18 nt, Human
aaccagcaacuccugagg

SEQ ID NO: 1269981 - RNA, 24 nt, Human
aaccaggccauccaucccaggacc

SEQ ID NO: 1269982 - RNA, 28 nt, Human
aagaacagcacgggaaagaccgguaccc

SEQ ID NO: 1269983 - RNA, 24 nt, Human
aagcuuucuuucuugguaaaaauc

SEQ ID NO: 1269984 - RNA, 24 nt, Human
aaggaaccaagaguuuagcuacuu

SEQ ID NO: 1269985 - RNA, 18 nt, Human
aaggagcagcaaaucaca

SEQ ID NO: 1269986 - RNA, 19 nt, Human
aaucuggaccagagauaca

SEQ ID NO: 1269987 - RNA, 27 nt, Human
aaugaacaaacaaaaacacacaccaag

SEQ ID NO: 1269988 - RNA, 18 nt, Human
acaaacaaaaacacacac

SEQ ID NO: 1269989 - RNA, 21 nt, Human
accccaaagacauagacaagu

SEQ ID NO: 1269990 - RNA, 25 nt, Human
agguaguugcccaacauaacuuuuc

SEQ ID NO: 1269991 - RNA, 20 nt, Human
aggucccuccaacaacacau

SEQ ID NO: 1269992 - RNA, 25 nt, Human
agugauaagggaaagagcugagaaa

SEQ ID NO: 1269993 - RNA, 21 nt, Human
aguugcccaacauaacuuuuc

SEQ ID NO: 1269994 - RNA, 25 nt, Human
aucccaggaccugccaauuuucauc

SEQ ID NO: 1269995 - RNA, 20 nt, Human
augauaacagcuccugcaug

SEQ ID NO: 1269996 - RNA, 26 nt, Human
auuuggguggggacacagccaaacua

SEQ ID NO: 1269997 - RNA, 24 nt, Human
caaaaacacacaccaaggaaccaa

SEQ ID NO: 1269998 - RNA, 20 nt, Human
caaaaauuaccccaaagaca

SEQ ID NO: 1269999 - RNA, 28 nt, Human
caaacaaaaacacacaccaaccccgggg

SEQ ID NO: 1270000 - RNA, 26 nt, Human
caaacuauaucaaucaccaucagaaa

SEQ ID NO: 1270001 - RNA, 23 nt, Human
caacaacacaugggaauucaaga

SEQ ID NO: 1270002 - RNA, 19 nt, Human
caagcagagauaacaaaac

SEQ ID NO: 1270003 - RNA, 22 nt, Human
caaggaaccaagaguuuagcua

SEQ ID NO: 1270004 - RNA, 24 nt, Human
caauggcaucuacucaagucaaac

SEQ ID NO: 1270005 - RNA, 18 nt, Human
caaugucaucaacccaaa

SEQ ID NO: 1270006 - RNA, 22 nt, Human
cacaccaaggaaccaagaguuu

SEQ ID NO: 1270007 - RNA, 23 nt, Human
cagcaaaucacaucuuauauaga

SEQ ID NO: 1270008 - RNA, 27 nt, Human
cagcacgggaaagacuugcccccauga

SEQ ID NO: 1270009 - RNA, 21 nt, Human
cagucuaaugcaaacucagaa

SEQ ID NO: 1270010 - RNA, 23 nt, Human
ccauccaucccaggaccugccaa

SEQ ID NO: 1270011 - RNA, 21 nt, Human
cccaaagacauagacaaguac

SEQ ID NO: 1270012 - RNA, 22 nt, Human
cccaccaggucccuccaacaac

SEQ ID NO: 1270013 - RNA, 23 nt, Human
ccccaaagacauagacaaguacu

SEQ ID NO: 1270014 - RNA, 21 nt, Human
ccugaggcaaggcccaauaag

SEQ ID NO: 1270015 - RNA, 21 nt, Human
ccugaggcaaggcccaauaag

SEQ ID NO: 1270016 - RNA, 21 nt, Human
ccugcucugucagcccaaggg

SEQ ID NO: 1270017 - RNA, 20 nt, Human
ccuugucuaacacgcucuuc

SEQ ID NO: 1270018 - RNA, 24 nt, Human
cggaaggcaaggagcagcaaauca

SEQ ID NO: 1270019 - RNA, 18 nt, Human
cgggaaagacuugccccc

SEQ ID NO: 1270020 - RNA, 23 nt, Human
gaaaacucccucuuauaauaacc

SEQ ID NO: 1270021 - RNA, 25 nt, Human
gaccugccaauuuucaucccauuca

SEQ ID NO: 1270022 - RNA, 21 nt, Human
gagacuuccucacuaucacaa

SEQ ID NO: 1270023 - RNA, 21 nt, Human
gaucuaaaaaacaauaaaacc

SEQ ID NO: 1270024 - RNA, 22 nt, Human
gcagaguggugggaguaggagg

SEQ ID NO: 1270025 - RNA, 22 nt, Human
gcuacuuuccuuuucuaaaacu

SEQ ID NO: 1270026 - RNA, 20 nt, Human
ggggcagaguucacugcaag

SEQ ID NO: 1270027 - RNA, 24 nt, Human
gguaaaaaucaaacaauccacaaa

SEQ ID NO: 1270028 - RNA, 18 nt, Human
guacuagaaaugaacaaa

SEQ ID NO: 1270029 - RNA, 22 nt, Human
uaaaaaacaauaaaaccuugaa

SEQ ID NO: 1270030 - RNA, 25 nt, Human
uaacaaaacuuugagguaguugccc

SEQ ID NO: 1270031 - RNA, 26 nt, Human
uacuagaaaugaacaaacaaaaacac

SEQ ID NO: 1270032 - RNA, 21 nt, Human
uacuguuuuucaccgugaaca

SEQ ID NO: 1270033 - RNA, 25 nt, Human
uagaaguagccacuuucuggauggg

SEQ ID NO: 1270034 - RNA, 24 nt, Human
uagagcucacucaaguagaaaucu

SEQ ID NO: 1270035 - RNA, 23 nt, Human
uaggagaaagcuuucuuucuugg

SEQ ID NO: 1270036 - RNA, 21 nt, Human
uaucacaagaacagcacggga

SEQ ID NO: 1270037 - RNA, 19 nt, Human
ucaacccaaagggaacccc

SEQ ID NO: 1270038 - RNA, 20 nt, Human
ucagaaaccuuggcaguuuu

SEQ ID NO: 1270039 - RNA, 19 nt, Human
uccacauggcuggggaggc

SEQ ID NO: 1270040 - RNA, 18 nt, Human
ucccagggcccugguuac

SEQ ID NO: 1270041 - RNA, 24 nt, Human
ucccauaaaccuggacucccuaag

SEQ ID NO: 1270042 - RNA, 19 nt, Human
ucccuccaacaacacaugg

SEQ ID NO: 1270043 - RNA, 24 nt, Human
ucugccuucuccuauuauauuccc

SEQ ID NO: 1270044 - RNA, 23 nt, Human
ugaacaaaaauugcaagcagaga

SEQ ID NO: 1270045 - RNA, 24 nt, Human
ugaacaaacaaaaacacacaccaa

SEQ ID NO: 1270046 - RNA, 22 nt, Human
ugagauuuggguggggacacag

SEQ ID NO: 1270047 - RNA, 24 nt, Human
ugaggcaaggcccaauaagggcaa

SEQ ID NO: 1270048 - RNA, 24 nt, Human
ugaggcaaggcccaauaagggcaa

SEQ ID NO: 1270049 - RNA, 22 nt, Human
ugguccgcacagaugagaacug

SEQ ID NO: 1270050 - RNA, 20 nt, Human
ugucaucaacccaaagggaa

SEQ ID NO: 1270051 - RNA, 24 nt, Human
uucaagaugagauuugggugggga

SEQ ID NO: 1270052 - RNA, 18 nt, Human
uucauagagugcuuggac

SEQ ID NO: 1270053 - RNA, 23 nt, Human
uugaauguuucccauaaaccugg

SEQ ID NO: 1270054 - RNA, 21 nt, Human
uuuuucaccgugaacagucua

SEQ ID NO: 1270055 - RNA, 20 nt, Human
aaaaacaccguucuggauca

SEQ ID NO: 1270056 - RNA, 18 nt, Human
aaacaauaaaaacuggca

SEQ ID NO: 1270057 - RNA, 18 nt, Human
aaacaauguuaauaccau

SEQ ID NO: 1270058 - RNA, 21 nt, Human
aaacaccguucuggaucagaa

SEQ ID NO: 1270059 - RNA, 23 nt, Human
aaacaccguucuggaucagaauc

SEQ ID NO: 1270060 - RNA, 21 nt, Human
aaacccagauagcuggcauca

SEQ ID NO: 1270061 - RNA, 21 nt, Human
aaagcuucagccuaugccaga

SEQ ID NO: 1270062 - RNA, 18 nt, Human
aaaggcauguuauggccc

SEQ ID NO: 1270063 - RNA, 21 nt, Human
aaagugcugggauuccauuua

SEQ ID NO: 1270064 - RNA, 22 nt, Human
aaagugcugggauuccauuuaa

SEQ ID NO: 1270065 - RNA, 22 nt, Human
aaauaacaacguggagaauaac

SEQ ID NO: 1270066 - RNA, 22 nt, Human
aaauggaucaccucauuucaaa

SEQ ID NO: 1270067 - RNA, 18 nt, Human
aacagaaagguaacacaa

SEQ ID NO: 1270068 - RNA, 21 nt, Human
aacucaggcucccuucuccaa

SEQ ID NO: 1270069 - RNA, 21 nt, Human
aagauggagaaagacuguauu

SEQ ID NO: 1270070 - RNA, 23 nt, Human
aaucacacagcuagcccacagca

SEQ ID NO: 1270071 - RNA, 20 nt, Human
aauccaaaagcuuugccagg

SEQ ID NO: 1270072 - RNA, 24 nt, Human
aauucuguaacacaaaacaauaac

SEQ ID NO: 1270073 - RNA, 18 nt, Human
acaaagaucaaauaucua

SEQ ID NO: 1270074 - RNA, 22 nt, Human
acaagacaauguaaaugaaagc

SEQ ID NO: 1270075 - RNA, 24 nt, Human
acaaugaauuuacccauaucuaau

SEQ ID NO: 1270076 - RNA, 30 nt, Human
acacuuauucaaagcuauauauaagaaacc

SEQ ID NO: 1270077 - RNA, 19 nt, Human
acagaaagagcuuucucau

SEQ ID NO: 1270078 - RNA, 22 nt, Human
acagauacacuaauucuguaac

SEQ ID NO: 1270079 - RNA, 18 nt, Human
acgggguuucaccguggu

SEQ ID NO: 1270080 - RNA, 19 nt, Human
acgggguuucaccgugguc

SEQ ID NO: 1270081 - RNA, 23 nt, Human
acucacaaaauuuacauuucuua

SEQ ID NO: 1270082 - RNA, 20 nt, Human
acucagggccauguacaagc

SEQ ID NO: 1270083 - RNA, 26 nt, Human
acucugucgcccaggcuggagugcug

SEQ ID NO: 1270084 - RNA, 20 nt, Human
acugcaagcuccgccucccg

SEQ ID NO: 1270085 - RNA, 22 nt, Human
agaaagagcuuucucaugaucc

SEQ ID NO: 1270086 - RNA, 20 nt, Human
agaaagagucaaaacaaaug

SEQ ID NO: 1270087 - RNA, 22 nt, Human
agaaaggaaaauaaauaauuuc

SEQ ID NO: 1270088 - RNA, 24 nt, Human
agaacaaaaucacacacaagagca

SEQ ID NO: 1270089 - RNA, 18 nt, Human
agacaagguaucuacaca

SEQ ID NO: 1270090 - RNA, 26 nt, Human
agaccaaagauggagaaaggggaccc

SEQ ID NO: 1270091 - RNA, 19 nt, Human
agagacgggguuucaccgu

SEQ ID NO: 1270092 - RNA, 18 nt, Human
agauuugaaaguugcucc

SEQ ID NO: 1270093 - RNA, 19 nt, Human
agcacagaaaacacacuca

SEQ ID NO: 1270094 - RNA, 20 nt, Human
aggcccagagaggcuaacgg

SEQ ID NO: 1270095 - RNA, 21 nt, Human
agggggucuugcagcaaaaug

SEQ ID NO: 1270096 - RNA, 21 nt, Human
aguagagacgggguuucaccg

SEQ ID NO: 1270097 - RNA, 21 nt, Human
aguagcuaaccauacagaaug

SEQ ID NO: 1270098 - RNA, 18 nt, Human
aguagcugggacuacagg

SEQ ID NO: 1270099 - RNA, 19 nt, Human
agugcuguggcgugaucuc

SEQ ID NO: 1270100 - RNA, 19 nt, Human
auaaaaacuggcagaggca

SEQ ID NO: 1270101 - RNA, 22 nt, Human
auagagagacaagguaucuaca

SEQ ID NO: 1270102 - RNA, 24 nt, Human
auccaaguggcuucuucacagcuu

SEQ ID NO: 1270103 - RNA, 20 nt, Human
augcauuucugauacagaaa

SEQ ID NO: 1270104 - RNA, 23 nt, Human
auuagaagguauaauuuauuuuu

SEQ ID NO: 1270105 - RNA, 21 nt, Human
caaaguaccauacuggauaug

SEQ ID NO: 1270106 - RNA, 22 nt, Human
caaagugcugggauuccauuua

SEQ ID NO: 1270107 - RNA, 21 nt, Human
caauaaaaacuggcagaggca

SEQ ID NO: 1270108 - RNA, 19 nt, Human
caaugaauuuacccauauc

SEQ ID NO: 1270109 - RNA, 21 nt, Human
cacagccaacagcaggaauuu

SEQ ID NO: 1270110 - RNA, 22 nt, Human
cacauuuacagauguaucagau

SEQ ID NO: 1270111 - RNA, 24 nt, Human
caccucggccucccaaagugcugg

SEQ ID NO: 1270112 - RNA, 24 nt, Human
cacucugucgcccaggcuggagug

SEQ ID NO: 1270113 - RNA, 21 nt, Human
cagaaucaaaauguauucauc

SEQ ID NO: 1270114 - RNA, 24 nt, Human
cagaaucagcaaauggaucaccuc

SEQ ID NO: 1270115 - RNA, 20 nt, Human
cagcaaaaugggaguacacg

SEQ ID NO: 1270116 - RNA, 26 nt, Human
cagcaaauggaucaccucauuucaaa

SEQ ID NO: 1270117 - RNA, 18 nt, Human
cagcaauaaagaagaucc

SEQ ID NO: 1270118 - RNA, 21 nt, Human
cagcaauaaagaagauccauc

SEQ ID NO: 1270119 - RNA, 22 nt, Human
cagcacagaaaacacacucaca

SEQ ID NO: 1270120 - RNA, 24 nt, Human
cagccaaacggucaccuaucucuc

SEQ ID NO: 1270121 - RNA, 20 nt, Human
cagcuagcccacagcagagc

SEQ ID NO: 1270122 - RNA, 22 nt, Human
caggccauucuccugccucagc

SEQ ID NO: 1270123 - RNA, 21 nt, Human
caggcgcccgccacugcgccc

SEQ ID NO: 1270124 - RNA, 26 nt, Human
cauacauuacacaaugaauuuacccu

SEQ ID NO: 1270125 - RNA, 27 nt, Human
caugauccugaaacaauguuaauacca

SEQ ID NO: 1270126 - RNA, 23 nt, Human
cauucucauuuaacacuuaaggg

SEQ ID NO: 1270127 - RNA, 19 nt, Human
ccaaagugcugggauucca

SEQ ID NO: 1270128 - RNA, 20 nt, Human
ccaaagugcugggauuccau

SEQ ID NO: 1270129 - RNA, 19 nt, Human
ccagagugccuucaggagc

SEQ ID NO: 1270130 - RNA, 19 nt, Human
cccaaaucacacagcuagc

SEQ ID NO: 1270131 - RNA, 22 nt, Human
ccccaaaucacacagcuagccc

SEQ ID NO: 1270132 - RNA, 23 nt, Human
cccccaaaucacacagcuagccc

SEQ ID NO: 1270133 - RNA, 20 nt, Human
ccccugcugugacugccaug

SEQ ID NO: 1270134 - RNA, 23 nt, Human
cccgaguagcugggacuacaggc

SEQ ID NO: 1270135 - RNA, 24 nt, Human
cccgaguagcugggacuacaggcg

SEQ ID NO: 1270136 - RNA, 23 nt, Human
cccggguucaggccauucuccug

SEQ ID NO: 1270137 - RNA, 18 nt, Human
cccucuaccccugcugug

SEQ ID NO: 1270138 - RNA, 24 nt, Human
ccuaugccagagugccuucaggag

SEQ ID NO: 1270139 - RNA, 24 nt, Human
ccucccggguucaggccauucucc

SEQ ID NO: 1270140 - RNA, 23 nt, Human
ccugccucagccucccgaguagc

SEQ ID NO: 1270141 - RNA, 18 nt, Human
ccugucauuauuccaaug

SEQ ID NO: 1270142 - RNA, 25 nt, Human
ccuuuggaaucuacugagugcuuuc

SEQ ID NO: 1270143 - RNA, 19 nt, Human
cgccucccggguucaggcc

SEQ ID NO: 1270144 - RNA, 24 nt, Human
cucacucugucgcccaggcuggag

SEQ ID NO: 1270145 - RNA, 24 nt, Human
cucagccucccgaguagcugggac

SEQ ID NO: 1270146 - RNA, 19 nt, Human
cucauucauucucuuucuc

SEQ ID NO: 1270147 - RNA, 22 nt, Human
cuccugaccucgugaucugccc

SEQ ID NO: 1270148 - RNA, 23 nt, Human
cugccucagccucccgaguagcu

SEQ ID NO: 1270149 - RNA, 22 nt, Human
cuguauuuuuaguagagacggg

SEQ ID NO: 1270150 - RNA, 18 nt, Human
cugucuucucuaaugccc

SEQ ID NO: 1270151 - RNA, 19 nt, Human
cugucuucucuaaugcccc

SEQ ID NO: 1270152 - RNA, 18 nt, Human
cugugaccacaaaucucc

SEQ ID NO: 1270153 - RNA, 21 nt, Human
cugugacggaagcugaaauga

SEQ ID NO: 1270154 - RNA, 18 nt, Human
cuuaaaaccacagacucc

SEQ ID NO: 1270155 - RNA, 24 nt, Human
cuuaaaaccacagacuccaaauuu

SEQ ID NO: 1270156 - RNA, 24 nt, Human
cuucaaucuaauaagcagcaauau

SEQ ID NO: 1270157 - RNA, 18 nt, Human
cuuugaaauccaaaagcu

SEQ ID NO: 1270158 - RNA, 22 nt, Human
gaccaugguaaucuuuaacuug

SEQ ID NO: 1270159 - RNA, 22 nt, Human
gaccucgugaucugcccaccuc

SEQ ID NO: 1270160 - RNA, 22 nt, Human
gaccucgugaucugcccaccuc

SEQ ID NO: 1270161 - RNA, 24 nt, Human
gaccucgugaucugcccaccucgg

SEQ ID NO: 1270162 - RNA, 21 nt, Human
gacgggguuucaccguggucu

SEQ ID NO: 1270163 - RNA, 22 nt, Human
gacuacaggcgcccgccacugc

SEQ ID NO: 1270164 - RNA, 20 nt, Human
gagacgggguuucaccgugg

SEQ ID NO: 1270165 - RNA, 21 nt, Human
gagacgggguuucaccguggu

SEQ ID NO: 1270166 - RNA, 20 nt, Human
gaguagcugggacuacaggc

SEQ ID NO: 1270167 - RNA, 25 nt, Human
gaguagcugggacuacaggcgcccg

SEQ ID NO: 1270168 - RNA, 21 nt, Human
gcccaagcugccaaaaugacu

SEQ ID NO: 1270169 - RNA, 20 nt, Human
gcccaggcuggagugcugug

SEQ ID NO: 1270170 - RNA, 24 nt, Human
gcccaggcuggagugcuguggcgu

SEQ ID NO: 1270171 - RNA, 20 nt, Human
gccuaugccagagugccuuc

SEQ ID NO: 1270172 - RNA, 21 nt, Human
ggaagggaguucaauuauuug

SEQ ID NO: 1270173 - RNA, 20 nt, Human
ggacuucccccaaaucacac

SEQ ID NO: 1270174 - RNA, 20 nt, Human
ggcagcaauaaucagccaaa

SEQ ID NO: 1270175 - RNA, 22 nt, Human
ggcuggagugcuguggcgugau

SEQ ID NO: 1270176 - RNA, 22 nt, Human
guaaaauagaaauauauaaaug

SEQ ID NO: 1270177 - RNA, 18 nt, Human
guacauauguauacuuac

SEQ ID NO: 1270178 - RNA, 19 nt, Human
guagagacgggguuucacc

SEQ ID NO: 1270179 - RNA, 24 nt, Human
guagagcuucuuccaaagcagaaa

SEQ ID NO: 1270180 - RNA, 20 nt, Human
guauauuugcagcauuugaa

SEQ ID NO: 1270181 - RNA, 20 nt, Human
gucuccugucccucuacccc

SEQ ID NO: 1270182 - RNA, 24 nt, Human
gugaucugcccaccucggccuccc

SEQ ID NO: 1270183 - RNA, 24 nt, Human
uaaaauagaaauauauaaaugacc

SEQ ID NO: 1270184 - RNA, 21 nt, Human
uaaaauaggcagcaauaauca

SEQ ID NO: 1270185 - RNA, 19 nt, Human
uaaagggcacagccaacag

SEQ ID NO: 1270186 - RNA, 24 nt, Human
uaacacaaagcuucagccuaugcc

SEQ ID NO: 1270187 - RNA, 20 nt, Human
uaagguaaaauauauuuaca

SEQ ID NO: 1270188 - RNA, 22 nt, Human
uaagguaaaauauauuuacaga

SEQ ID NO: 1270189 - RNA, 24 nt, Human
uaauuuucuguauuuuuaguagag

SEQ ID NO: 1270190 - RNA, 25 nt, Human
uaauuuucuguauuuuuaguagaga

SEQ ID NO: 1270191 - RNA, 23 nt, Human
uacaagcaauuacuuccuuagua

SEQ ID NO: 1270192 - RNA, 21 nt, Human
uacagaauguucuaaaauagg

SEQ ID NO: 1270193 - RNA, 23 nt, Human
uacucaacaaaggcauguuaugg

SEQ ID NO: 1270194 - RNA, 20 nt, Human
uacucaagacgacaagacaa

SEQ ID NO: 1270195 - RNA, 21 nt, Human
uagaaauauauaaaugaccau

SEQ ID NO: 1270196 - RNA, 20 nt, Human
uagaacagaaagguaacaca

SEQ ID NO: 1270197 - RNA, 28 nt, Human
uagaagguauaauuuauuuuuauaagag

SEQ ID NO: 1270198 - RNA, 20 nt, Human
uagaaguaaucagaccucac

SEQ ID NO: 1270199 - RNA, 24 nt, Human
uagaaguaaucagaccucacacaa

SEQ ID NO: 1270200 - RNA, 23 nt, Human
uagagagacaagguaucuacaca

SEQ ID NO: 1270201 - RNA, 21 nt, Human
uaguagagacgggguuucacc

SEQ ID NO: 1270202 - RNA, 23 nt, Human
uaguagagacgggguuucaccgu

SEQ ID NO: 1270203 - RNA, 24 nt, Human
uaguagagacgggguuucaccgug

SEQ ID NO: 1270204 - RNA, 23 nt, Human
uaucucucaauguaauggcugcu

SEQ ID NO: 1270205 - RNA, 21 nt, Human
uauucauccaucuccauaacc

SEQ ID NO: 1270206 - RNA, 22 nt, Human
ucaaaacaaaugauacucaaga

SEQ ID NO: 1270207 - RNA, 23 nt, Human
ucaaacccagauagcuggcauca

SEQ ID NO: 1270208 - RNA, 21 nt, Human
ucaaauaucuaauucuucuau

SEQ ID NO: 1270209 - RNA, 20 nt, Human
ucacacacauuuaauaaggu

SEQ ID NO: 1270210 - RNA, 24 nt, Human
ucacucugucgcccaggcuggagu

SEQ ID NO: 1270211 - RNA, 18 nt, Human
ucacugcaagcuccgccu

SEQ ID NO: 1270212 - RNA, 19 nt, Human
ucacugcaagcuccgccuc

SEQ ID NO: 1270213 - RNA, 24 nt, Human
ucacugcaagcuccgccucccggg

SEQ ID NO: 1270214 - RNA, 23 nt, Human
ucagccucccgaguagcugggac

SEQ ID NO: 1270215 - RNA, 25 nt, Human
ucaggccauucuccugccucagccu

SEQ ID NO: 1270216 - RNA, 19 nt, Human
uccaaaagagauaaagcac

SEQ ID NO: 1270217 - RNA, 18 nt, Human
ucccaaagugcugggauu

SEQ ID NO: 1270218 - RNA, 21 nt, Human
ucccccaaaucacacagcuag

SEQ ID NO: 1270219 - RNA, 24 nt, Human
ucccgaguagcugggacuacaggc

SEQ ID NO: 1270220 - RNA, 24 nt, Human
ucccggguucaggccauucuccug

SEQ ID NO: 1270221 - RNA, 18 nt, Human
ucgcccaggcuggagugc

SEQ ID NO: 1270222 - RNA, 18 nt, Human
ucggccucccaaagugcu

SEQ ID NO: 1270223 - RNA, 22 nt, Human
ucuaaaggcgaggaugucugug

SEQ ID NO: 1270224 - RNA, 19 nt, Human
ucuagauacugcugcuuca

SEQ ID NO: 1270225 - RNA, 23 nt, Human
ucuauguaucuuucuuuuucucu

SEQ ID NO: 1270226 - RNA, 23 nt, Human
ucucacucugucgcccaggcugg

SEQ ID NO: 1270227 - RNA, 24 nt, Human
ucucacucugucgcccaggcugga

SEQ ID NO: 1270228 - RNA, 22 nt, Human
ucuccauaaccaacauagacuc

SEQ ID NO: 1270229 - RNA, 24 nt, Human
ucuccugccucagccucccgagua

SEQ ID NO: 1270230 - RNA, 26 nt, Human
ucuccugucccucuaccccugcugug

SEQ ID NO: 1270231 - RNA, 24 nt, Human
ucucuguaaaaacaaacaagaaaa

SEQ ID NO: 1270232 - RNA, 18 nt, Human
ucugucgcccaggcugga

SEQ ID NO: 1270233 - RNA, 19 nt, Human
ugaaauaacaacguggaga

SEQ ID NO: 1270234 - RNA, 24 nt, Human
ugaauaaauaucuaaaggcgagga

SEQ ID NO: 1270235 - RNA, 21 nt, Human
ugagaauuaaaacacacacaa

SEQ ID NO: 1270236 - RNA, 25 nt, Human
ugaguccucaguaaacucaggcucc

SEQ ID NO: 1270237 - RNA, 20 nt, Human
ugauagagagacaagguauc

SEQ ID NO: 1270238 - RNA, 24 nt, Human
ugaucugcccaccucggccuccca

SEQ ID NO: 1270239 - RNA, 21 nt, Human
ugccagagugccuucaggagc

SEQ ID NO: 1270240 - RNA, 22 nt, Human
ugccagguagaaagagucaaaa

SEQ ID NO: 1270241 - RNA, 24 nt, Human
ugccucagccucccgaguagcugg

SEQ ID NO: 1270242 - RNA, 22 nt, Human
ugcuccauaaaguaggucuacc

SEQ ID NO: 1270243 - RNA, 21 nt, Human
uggacagaggcccagagaggc

SEQ ID NO: 1270244 - RNA, 22 nt, Human
uggagaauaacuguguaaaagc

SEQ ID NO: 1270245 - RNA, 19 nt, Human
uggagugcuguggcgugau

SEQ ID NO: 1270246 - RNA, 22 nt, Human
uggcagaggcaauuuccuuacu

SEQ ID NO: 1270247 - RNA, 20 nt, Human
uggcccacucuaaauauggg

SEQ ID NO: 1270248 - RNA, 21 nt, Human
ugggacuacaggcgcccgcca

SEQ ID NO: 1270249 - RNA, 22 nt, Human
ugggacuacaggcgcccgccac

SEQ ID NO: 1270250 - RNA, 22 nt, Human
ugggacuacaggcgcccgccac

SEQ ID NO: 1270251 - RNA, 24 nt, Human
ugggacuacaggcgcccgccacug

SEQ ID NO: 1270252 - RNA, 19 nt, Human
ugggguauaacuaauuaaa

SEQ ID NO: 1270253 - RNA, 20 nt, Human
ugucauagaugagaauuaaa

SEQ ID NO: 1270254 - RNA, 21 nt, Human
ugucuccugucccucuacccc

SEQ ID NO: 1270255 - RNA, 18 nt, Human
ugugccuacauuuucuca

SEQ ID NO: 1270256 - RNA, 24 nt, Human
uuacuuaugaauuuugcugguaag

SEQ ID NO: 1270257 - RNA, 21 nt, Human
uuagaacagaaagguaacaca

SEQ ID NO: 1270258 - RNA, 18 nt, Human
uuaguagagacgggguuu

SEQ ID NO: 1270259 - RNA, 22 nt, Human
uuaguagagacgggguuucacc

SEQ ID NO: 1270260 - RNA, 24 nt, Human
uuaguagagacgggguuucaccgu

SEQ ID NO: 1270261 - RNA, 19 nt, Human
uucagaaucaaaauguauu

SEQ ID NO: 1270262 - RNA, 21 nt, Human
uucaggccauucuccugccuc

SEQ ID NO: 1270263 - RNA, 24 nt, Human
uucuauguaucuuucuuuuucucu

SEQ ID NO: 1270264 - RNA, 21 nt, Human
uuucuguauuuuuaguagaga

SEQ ID NO: 1270265 - RNA, 18 nt, Human
uuuuccacagauacacua

SEQ ID NO: 1270266 - RNA, 24 nt, Human
uuuucuguauuuuuaguagagacg

SEQ ID NO: 1270267 - RNA, 20 nt, Human
uuuugagugcaaaaauagca

SEQ ID NO: 1270268 - RNA, 21 nt, Human
uuuugagugcaaaaauagcag

SEQ ID NO: 1270269 - RNA, 24 nt, Human
uuuuuaguagagacgggguuucac

SEQ ID NO: 1270270 - RNA, 25 nt, Human
uuuuuuuucaaacccagauagcugg

SEQ ID NO: 1270271 - RNA, 25 nt, Human
aggcggccagggagaagugcugagc

SEQ ID NO: 1270272 - RNA, 19 nt, Human
caacagaaaucccaauccu

SEQ ID NO: 1270273 - RNA, 22 nt, Human
caaugccaaaccuuugcaacag

SEQ ID NO: 1270274 - RNA, 24 nt, Human
cagagugugguccaggucgaaucu

SEQ ID NO: 1270275 - RNA, 20 nt, Human
ccauuccaguguccgacaag

SEQ ID NO: 1270276 - RNA, 21 nt, Human
cccuggcacacagaagagcuc

SEQ ID NO: 1270277 - RNA, 24 nt, Human
ccuauggacaaauaucaacuuauu

SEQ ID NO: 1270278 - RNA, 19 nt, Human
cgcggggagcaccagggag

SEQ ID NO: 1270279 - RNA, 23 nt, Human
cuuauuggucaauaaaacuuguu

SEQ ID NO: 1270280 - RNA, 19 nt, Human
gcugagccauggcugcgcg

SEQ ID NO: 1270281 - RNA, 21 nt, Human
gucgcaggcggccagggagaa

SEQ ID NO: 1270282 - RNA, 19 nt, Human
gugcugagccauggcugcg

SEQ ID NO: 1270283 - RNA, 20 nt, Human
uaggaacugggcaaagcuau

SEQ ID NO: 1270284 - RNA, 18 nt, Human
uccaccacccuggcacac

SEQ ID NO: 1270285 - RNA, 19 nt, Human
uccaguguccgacaagaag

SEQ ID NO: 1270286 - RNA, 22 nt, Human
uccuuaacuaggaacugggcaa

SEQ ID NO: 1270287 - RNA, 21 nt, Human
ugauuuauagaaaggagaccu

SEQ ID NO: 1270288 - RNA, 26 nt, Human
ugccaaaccuuugcaacagaaauccc

SEQ ID NO: 1270289 - RNA, 22 nt, Human
ugccauggcuugcccugagaac

SEQ ID NO: 1270290 - RNA, 18 nt, Human
ugccucugccagcaccuc

SEQ ID NO: 1270291 - RNA, 20 nt, Human
ugccucugccagcaccucug

SEQ ID NO: 1270292 - RNA, 18 nt, Human
ugcugagccauggcugcg

SEQ ID NO: 1270293 - RNA, 24 nt, Human
uggcugcgcggggagcaccaggga

SEQ ID NO: 1270294 - RNA, 20 nt, Human
ugggcaaagcuauuauaaau

SEQ ID NO: 1270295 - RNA, 21 nt, Human
uguucaguuuuguuaaauagu

SEQ ID NO: 1270296 - RNA, 22 nt, Human
uugcaacagaaaucccaauccu

SEQ ID NO: 1270297 - RNA, 18 nt, Human
uugccauaugccucugcc

SEQ ID NO: 1270298 - RNA, 23 nt, Human
aaaaaaggaaaacagggagagag

SEQ ID NO: 1270299 - RNA, 22 nt, Human
aaaaacaaagcacaauagaagg

SEQ ID NO: 1270300 - RNA, 21 nt, Human
aaacaggguccaagcagugca

SEQ ID NO: 1270301 - RNA, 20 nt, Human
aaaggaaacagggugcagaa

SEQ ID NO: 1270302 - RNA, 19 nt, Human
aaaggcaguacaaucuaca

SEQ ID NO: 1270303 - RNA, 24 nt, Human
aaccugggcgacagagcaagacuc

SEQ ID NO: 1270304 - RNA, 19 nt, Human
aagcauucaaaguugcgcu

SEQ ID NO: 1270305 - RNA, 19 nt, Human
aaggcaguacaaucuacag

SEQ ID NO: 1270306 - RNA, 23 nt, Human
aaguaccauaaaucacacagaac

SEQ ID NO: 1270307 - RNA, 24 nt, Human
aaucgcuugaacccgggaggugga

SEQ ID NO: 1270308 - RNA, 20 nt, Human
aaugacagagccaaaaugaa

SEQ ID NO: 1270309 - RNA, 24 nt, Human
acaaagcacaauagaaggcauacu

SEQ ID NO: 1270310 - RNA, 18 nt, Human
acaagccuaacaaagacc

SEQ ID NO: 1270311 - RNA, 23 nt, Human
acagagcaagacuccguccuccg

SEQ ID NO: 1270312 - RNA, 22 nt, Human
acagcaaccaguucagaggccc

SEQ ID NO: 1270313 - RNA, 18 nt, Human
accccgucucuacuaaaa

SEQ ID NO: 1270314 - RNA, 23 nt, Human
accugggcgacagagcaagacuc

SEQ ID NO: 1270315 - RNA, 25 nt, Human
acucuaggcccaauuuuuaccuggc

SEQ ID NO: 1270316 - RNA, 18 nt, Human
acugcacuccaaccuggg

SEQ ID NO: 1270317 - RNA, 24 nt, Human
acugcacuccaaccugggcgacag

SEQ ID NO: 1270318 - RNA, 23 nt, Human
agaaauccaagugacagcaacca

SEQ ID NO: 1270319 - RNA, 18 nt, Human
agaaggugguaggagacc

SEQ ID NO: 1270320 - RNA, 22 nt, Human
agaaucgcuugaacccgggagg

SEQ ID NO: 1270321 - RNA, 27 nt, Human
agagaggauugggaggcuaaggagggc

SEQ ID NO: 1270322 - RNA, 26 nt, Human
agaggauugggaggcuaaggagggcg

SEQ ID NO: 1270323 - RNA, 20 nt, Human
agcauggugaaaccccgucu

SEQ ID NO: 1270324 - RNA, 20 nt, Human
agcaugugauauuccagaac

SEQ ID NO: 1270325 - RNA, 23 nt, Human
agccgggcguggcggcgcgcgcc

SEQ ID NO: 1270326 - RNA, 22 nt, Human
agccuggccagcauggugaaac

SEQ ID NO: 1270327 - RNA, 24 nt, Human
agccuggccagcauggugaaaccc

SEQ ID NO: 1270328 - RNA, 23 nt, Human
aggaaguaggaaguugggaagaa

SEQ ID NO: 1270329 - RNA, 24 nt, Human
aggcaggagaaucgcuugaacccg

SEQ ID NO: 1270330 - RNA, 22 nt, Human
aggcgaacgcccguuuuccuca

SEQ ID NO: 1270331 - RNA, 20 nt, Human
aggcugaggcaggagaaucg

SEQ ID NO: 1270332 - RNA, 24 nt, Human
aggcugaggcaggagaaucgcuug

SEQ ID NO: 1270333 - RNA, 24 nt, Human
agggcagguagcaauagaaaguga

SEQ ID NO: 1270334 - RNA, 24 nt, Human
agguggagguugcagugagccgag

SEQ ID NO: 1270335 - RNA, 26 nt, Human
aggugguaggagaccuugugcaggag

SEQ ID NO: 1270336 - RNA, 19 nt, Human
agugacuagaggugaagga

SEQ ID NO: 1270337 - RNA, 24 nt, Human
aucgcgccacugcacuccaaccug

SEQ ID NO: 1270338 - RNA, 23 nt, Human
caacauauuuaacacuuuaaccc

SEQ ID NO: 1270339 - RNA, 22 nt, Human
caagcagugcagauaaaggcag

SEQ ID NO: 1270340 - RNA, 27 nt, Human
caaguugaaaacuguuaugacuauuca

SEQ ID NO: 1270341 - RNA, 26 nt, Human
cacaaaacaaguaagaaagcauucaa

SEQ ID NO: 1270342 - RNA, 22 nt, Human
caccaccgucucaaucuugagg

SEQ ID NO: 1270343 - RNA, 23 nt, Human
cacuccaaccugggcgacagagc

SEQ ID NO: 1270344 - RNA, 23 nt, Human
cacugcacuccaaccugggcgac

SEQ ID NO: 1270345 - RNA, 24 nt, Human
cacugcacuccaaccugggcgaca

SEQ ID NO: 1270346 - RNA, 26 nt, Human
cacugcacuccaaccugggcgacaga

SEQ ID NO: 1270347 - RNA, 20 nt, Human
cagaaaagucagcaaaaaca

SEQ ID NO: 1270348 - RNA, 21 nt, Human
cagagcaagacuccguccucc

SEQ ID NO: 1270349 - RNA, 24 nt, Human
cagagcaagacuccguccuccguc

SEQ ID NO: 1270350 - RNA, 18 nt, Human
cagaggcccugggaauaa

SEQ ID NO: 1270351 - RNA, 18 nt, Human
cagcaaaaacaaagcaca

SEQ ID NO: 1270352 - RNA, 18 nt, Human
cagcaaaaacaaagcaca

SEQ ID NO: 1270353 - RNA, 19 nt, Human
cagcaaaaacaaagcacaa

SEQ ID NO: 1270354 - RNA, 21 nt, Human
cagcaaaaacaaagcacaaua

SEQ ID NO: 1270355 - RNA, 23 nt, Human
cagcaaaaacaaagcacaauaga

SEQ ID NO: 1270356 - RNA, 20 nt, Human
cagcaugaaggucauaugga

SEQ ID NO: 1270357 - RNA, 24 nt, Human
cagcauggugaaaccccgucucua

SEQ ID NO: 1270358 - RNA, 24 nt, Human
cagcuacucgggaggcugaggcag

SEQ ID NO: 1270359 - RNA, 19 nt, Human
caggcucccaaagcuagaa

SEQ ID NO: 1270360 - RNA, 18 nt, Human
cauacucauugcugaugc

SEQ ID NO: 1270361 - RNA, 18 nt, Human
cauggugaaaccccgucu

SEQ ID NO: 1270362 - RNA, 19 nt, Human
cauggugaaaccccgucuc

SEQ ID NO: 1270363 - RNA, 21 nt, Human
cauggugaaaccccgucucua

SEQ ID NO: 1270364 - RNA, 19 nt, Human
ccaaaggaaacagggugca

SEQ ID NO: 1270365 - RNA, 21 nt, Human
ccacugcacuccaaccugggc

SEQ ID NO: 1270366 - RNA, 24 nt, Human
ccacugcacuccaaccugggcgac

SEQ ID NO: 1270367 - RNA, 28 nt, Human
ccaucuagaugugucucucuuuaacuau

SEQ ID NO: 1270368 - RNA, 21 nt, Human
cccauacugcucaaugcagag

SEQ ID NO: 1270369 - RNA, 21 nt, Human
cccgggagguggagguugcag

SEQ ID NO: 1270370 - RNA, 25 nt, Human
ccuccgucucaaaaaaaaaaaaaaa

SEQ ID NO: 1270371 - RNA, 22 nt, Human
ccucugaguucauuaacgucca

SEQ ID NO: 1270372 - RNA, 23 nt, Human
ccuggccagcauggugaaacccc

SEQ ID NO: 1270373 - RNA, 24 nt, Human
ccuggccagcauggugaaaccccg

SEQ ID NO: 1270374 - RNA, 19 nt, Human
ccuguagucccagcuacuc

SEQ ID NO: 1270375 - RNA, 21 nt, Human
ccuguagucccagcuacucgg

SEQ ID NO: 1270376 - RNA, 22 nt, Human
ccuguagucccagcuacucggg

SEQ ID NO: 1270377 - RNA, 24 nt, Human
cgagaccagccuggccagcauggu

SEQ ID NO: 1270378 - RNA, 19 nt, Human
cgagaucgcgccacugcac

SEQ ID NO: 1270379 - RNA, 22 nt, Human
cgcaccgcccacccuacagucu

SEQ ID NO: 1270380 - RNA, 26 nt, Human
cgccacugcacuccaaccugggcgac

SEQ ID NO: 1270381 - RNA, 24 nt, Human
cgccuguagucccagcuacucggg

SEQ ID NO: 1270382 - RNA, 29 nt, Human
cgggagguggagguugcagugacaacggu

SEQ ID NO: 1270383 - RNA, 24 nt, Human
cgggagguggagguugcagugagc

SEQ ID NO: 1270384 - RNA, 24 nt, Human
cuaacaaagaccaaguuguucaaa

SEQ ID NO: 1270385 - RNA, 18 nt, Human
cucaaaaaaaaaaaaaaa

SEQ ID NO: 1270386 - RNA, 19 nt, Human
cuccgucucaaaaaaaaaa

SEQ ID NO: 1270387 - RNA, 21 nt, Human
gaaaacagggagagagaggga

SEQ ID NO: 1270388 - RNA, 22 nt, Human
gaaacaagaacaaguugaaaac

SEQ ID NO: 1270389 - RNA, 23 nt, Human
gagguugcagugagccgagaucg

SEQ ID NO: 1270390 - RNA, 18 nt, Human
gcaauagaaagugacuag

SEQ ID NO: 1270391 - RNA, 21 nt, Human
gcaccgcccacccuacagucu

SEQ ID NO: 1270392 - RNA, 24 nt, Human
gccacugcacuccaaccugggcga

SEQ ID NO: 1270393 - RNA, 24 nt, Human
gccagcauggugaaaccccgucuc

SEQ ID NO: 1270394 - RNA, 20 nt, Human
gccgagaucgcgccacugca

SEQ ID NO: 1270395 - RNA, 23 nt, Human
gcggcgcgcgccuguagucccag

SEQ ID NO: 1270396 - RNA, 20 nt, Human
gcucacugcuuuucuccucu

SEQ ID NO: 1270397 - RNA, 24 nt, Human
ggaagaaggggaggggcguaagag

SEQ ID NO: 1270398 - RNA, 21 nt, Human
ggaauaaacaggguccaagca

SEQ ID NO: 1270399 - RNA, 20 nt, Human
ggagguugcagugagccgag

SEQ ID NO: 1270400 - RNA, 22 nt, Human
ggagguugcagugagccgagau

SEQ ID NO: 1270401 - RNA, 23 nt, Human
ggagguugcagugagccgagauc

SEQ ID NO: 1270402 - RNA, 24 nt, Human
ggagguugcagugagccgagaucg

SEQ ID NO: 1270403 - RNA, 22 nt, Human
ggcguggcggcgcgcgccugua

SEQ ID NO: 1270404 - RNA, 19 nt, Human
gggaagaaggggaggggcg

SEQ ID NO: 1270405 - RNA, 18 nt, Human
gugacuagaggugaagga

SEQ ID NO: 1270406 - RNA, 19 nt, Human
guugcagugagccgagauc

SEQ ID NO: 1270407 - RNA, 26 nt, Human
uaaaucacacagaacaaguggcucac

SEQ ID NO: 1270408 - RNA, 20 nt, Human
uaacaaagaccaaguuguuc

SEQ ID NO: 1270409 - RNA, 20 nt, Human
uaacagaaacaagaacaagu

SEQ ID NO: 1270410 - RNA, 23 nt, Human
uaacagaaacaagaacaaguuga

SEQ ID NO: 1270411 - RNA, 24 nt, Human
uaacagaaacaagaacaaguugaa

SEQ ID NO: 1270412 - RNA, 26 nt, Human
uaacagaaacaagaacaaguugaaaa

SEQ ID NO: 1270413 - RNA, 19 nt, Human
uaacagucggaccaaccgc

SEQ ID NO: 1270414 - RNA, 19 nt, Human
uaaggagggcggaucacga

SEQ ID NO: 1270415 - RNA, 24 nt, Human
uaaguuuagaaucagaaaaaaaaa

SEQ ID NO: 1270416 - RNA, 21 nt, Human
uacaguaucauuugcuuggcu

SEQ ID NO: 1270417 - RNA, 22 nt, Human
uaccuggcccaugccucuagcc

SEQ ID NO: 1270418 - RNA, 24 nt, Human
uagaaucagaaaaaaaaauuuuac

SEQ ID NO: 1270419 - RNA, 22 nt, Human
uaggcaacauauuuaacacuuu

SEQ ID NO: 1270420 - RNA, 22 nt, Human
uaggucacaaaacaaguaagaa

SEQ ID NO: 1270421 - RNA, 22 nt, Human
ucaaaaaaaaaaaaaaaaaaaa

SEQ ID NO: 1270422 - RNA, 23 nt, Human
ucaaaaaaaaaaaaaaaaaaaaa

SEQ ID NO: 1270423 - RNA, 25 nt, Human
ucaaaagaauaucuguacagcucaa

SEQ ID NO: 1270424 - RNA, 23 nt, Human
ucacgagaucgggguucgagacc

SEQ ID NO: 1270425 - RNA, 21 nt, Human
ucagcaaaaacaaagcacaau

SEQ ID NO: 1270426 - RNA, 24 nt, Human
ucagcaaaaacaaagcacaauaga

SEQ ID NO: 1270427 - RNA, 19 nt, Human
ucaguuucuccugcuuagg

SEQ ID NO: 1270428 - RNA, 19 nt, Human
uccaaaggaaacagggugc

SEQ ID NO: 1270429 - RNA, 21 nt, Human
ucccugaaaaguauuuuucca

SEQ ID NO: 1270430 - RNA, 23 nt, Human
uccgucucaaaaaaaaaaaaaaa

SEQ ID NO: 1270431 - RNA, 30 nt, Human
uccuccgucucaaaaaaaaaaaaaaaaaaa

SEQ ID NO: 1270432 - RNA, 19 nt, Human
ucgcaccgcccacccuaca

SEQ ID NO: 1270433 - RNA, 23 nt, Human
ucgcgccacugcacuccaaccug

SEQ ID NO: 1270434 - RNA, 24 nt, Human
ucgcuugaacccgggagguggagg

SEQ ID NO: 1270435 - RNA, 24 nt, Human
ucgggaggcugaggcaggagaauc

SEQ ID NO: 1270436 - RNA, 23 nt, Human
ucucuacuaaaaauauaaaaauu

SEQ ID NO: 1270437 - RNA, 21 nt, Human
ucuuucuuuaaagaacccuug

SEQ ID NO: 1270438 - RNA, 22 nt, Human
ugagccgagaucgcgccacugc

SEQ ID NO: 1270439 - RNA, 20 nt, Human
ugaggcaggagaaucgcuug

SEQ ID NO: 1270440 - RNA, 24 nt, Human
ugaggcaggagaaucgcuugaacc

SEQ ID NO: 1270441 - RNA, 25 nt, Human
ugaggcaggagaaucgcuugaaccc

SEQ ID NO: 1270442 - RNA, 24 nt, Human
ugccucuagccuuuuguucaguuu

SEQ ID NO: 1270443 - RNA, 21 nt, Human
uggaacaggcucccaaagcua

SEQ ID NO: 1270444 - RNA, 21 nt, Human
uggcaggagccaauguagggc

SEQ ID NO: 1270445 - RNA, 24 nt, Human
uggccagcauggugaaaccccguc

SEQ ID NO: 1270446 - RNA, 24 nt, Human
uggcggcgcgcgccuguaguccca

SEQ ID NO: 1270447 - RNA, 21 nt, Human
ugggaagaaggggaggggcgu

SEQ ID NO: 1270448 - RNA, 24 nt, Human
ugggaggcuaaggagggcggauca

SEQ ID NO: 1270449 - RNA, 24 nt, Human
uguucccaauugaaaucaaaagaa

SEQ ID NO: 1270450 - RNA, 22 nt, Human
uguuucugagcuaucacuuuuu

SEQ ID NO: 1270451 - RNA, 20 nt, Human
uuagccgggcguggcggcgc

SEQ ID NO: 1270452 - RNA, 20 nt, Human
uuagccgggcguggcggcgc

SEQ ID NO: 1270453 - RNA, 22 nt, Human
uuagccgggcguggcggcgcgc

SEQ ID NO: 1270454 - RNA, 24 nt, Human
uucaaacuauguuucuaggaauau

SEQ ID NO: 1270455 - RNA, 20 nt, Human
uucacaguauuuaagcaauu

SEQ ID NO: 1270456 - RNA, 20 nt, Human
uucauaugucucuauauugu

SEQ ID NO: 1270457 - RNA, 24 nt, Human
uugaacccgggagguggagguugc

SEQ ID NO: 1270458 - RNA, 18 nt, Human
uugcagugagccgagauc

SEQ ID NO: 1270459 - RNA, 19 nt, Human
uugcagugagccgagaucg

SEQ ID NO: 1270460 - RNA, 20 nt, Human
uugcagugagccgagaucgc

SEQ ID NO: 1270461 - RNA, 22 nt, Human
uugcagugagccgagaucgcgc

SEQ ID NO: 1270462 - RNA, 25 nt, Human
uugggaggcuaaggagggcggauca

SEQ ID NO: 1270463 - RNA, 25 nt, Human
uuuagaaucagaaaaaaaaauuuua

SEQ ID NO: 1270464 - RNA, 22 nt, Human
uuuguucaguuucuccugcuua

SEQ ID NO: 1270465 - RNA, 24 nt, Human
aaauaacaaauaacaccucccccc

SEQ ID NO: 1270466 - RNA, 21 nt, Human
aaauaacaccuccccccacac

SEQ ID NO: 1270467 - RNA, 18 nt, Human
aaaucuccaaggcagcca

SEQ ID NO: 1270468 - RNA, 19 nt, Human
aacaaauaacaccuccccc

SEQ ID NO: 1270469 - RNA, 20 nt, Human
aacaaauaacaccucccccc

SEQ ID NO: 1270470 - RNA, 22 nt, Human
aacaaauaacaccuccccccac

SEQ ID NO: 1270471 - RNA, 26 nt, Human
acacacauacacaaagagguacaaua

SEQ ID NO: 1270472 - RNA, 25 nt, Human
acacacauacacaaagagguacaug

SEQ ID NO: 1270473 - RNA, 20 nt, Human
acacuggagagcaggcacug

SEQ ID NO: 1270474 - RNA, 24 nt, Human
acacuggagagcaggcacuguuac

SEQ ID NO: 1270475 - RNA, 19 nt, Human
acaguaagaagaacaagac

SEQ ID NO: 1270476 - RNA, 24 nt, Human
accacaguaagaagaacaagacaa

SEQ ID NO: 1270477 - RNA, 22 nt, Human
agacacuggagagcaggcacuu

SEQ ID NO: 1270478 - RNA, 21 nt, Human
caacacaaauaacaaauaaca

SEQ ID NO: 1270479 - RNA, 23 nt, Human
caacacaaauaacaaauaacacc

SEQ ID NO: 1270480 - RNA, 25 nt, Human
caacacaaauaacaaauaacaccuc

SEQ ID NO: 1270481 - RNA, 22 nt, Human
cacaaauaacaaauaacaccuc

SEQ ID NO: 1270482 - RNA, 18 nt, Human
caccuccccccacacaca

SEQ ID NO: 1270483 - RNA, 21 nt, Human
caccuccccccacacacauac

SEQ ID NO: 1270484 - RNA, 22 nt, Human
ccaaaucuccaaggcagccaaa

SEQ ID NO: 1270485 - RNA, 21 nt, Human
ccccccacacacauacacaaa

SEQ ID NO: 1270486 - RNA, 25 nt, Human
ccuuccugccucaaaaaagugaaga

SEQ ID NO: 1270487 - RNA, 23 nt, Human
cuccuacaugcugggagcagucg

SEQ ID NO: 1270488 - RNA, 21 nt, Human
cugugauuuuacaacugcucc

SEQ ID NO: 1270489 - RNA, 22 nt, Human
cuuuaaacauggaaguuacuac

SEQ ID NO: 1270490 - RNA, 22 nt, Human
gagagcaggcacuguuacggcu

SEQ ID NO: 1270491 - RNA, 19 nt, Human
ggcaacacaaauaacaaau

SEQ ID NO: 1270492 - RNA, 22 nt, Human
ggcaacacaaauaacaaauaac

SEQ ID NO: 1270493 - RNA, 26 nt, Human
ggcaacacaaauaacaaauaacaccu

SEQ ID NO: 1270494 - RNA, 20 nt, Human
uaacaaauaacaccuccccc

SEQ ID NO: 1270495 - RNA, 21 nt, Human
uaacaaauaacaccucccccc

SEQ ID NO: 1270496 - RNA, 18 nt, Human
uacaacugcuccuacaug

SEQ ID NO: 1270497 - RNA, 19 nt, Human
uacaugaagaucuggccac

SEQ ID NO: 1270498 - RNA, 20 nt, Human
uaccacaguaagaagaacaa

SEQ ID NO: 1270499 - RNA, 24 nt, Human
ucaaaaaagugaagaccagaaaaa

SEQ ID NO: 1270500 - RNA, 27 nt, Human
ucgaaagauccuuccugccucaaaaaa

SEQ ID NO: 1270501 - RNA, 22 nt, Human
ucuccaaaucuccaaggcagcc

SEQ ID NO: 1270502 - RNA, 23 nt, Human
ucuccaaaucuccaaggcagcca

SEQ ID NO: 1270503 - RNA, 20 nt, Human
ugagaugucauauggauuug

SEQ ID NO: 1270504 - RNA, 23 nt, Human
ugagaugucauauggauuuguuu

SEQ ID NO: 1270505 - RNA, 24 nt, Human
uggcaacacaaauaacaaauaaca

SEQ ID NO: 1270506 - RNA, 22 nt, Human
uuaccacaguaagaagaacaag

SEQ ID NO: 1270507 - RNA, 19 nt, Human
uucagacacuggagagcag

SEQ ID NO: 1270508 - RNA, 24 nt, Human
uuccugccucaaaaaagugaagac

SEQ ID NO: 1270509 - RNA, 23 nt, Human
uuuuacaacugcuccuacaugcu

SEQ ID NO: 1270510 - RNA, 19 nt, Human
agcagccuuuuuuuuuuuu

SEQ ID NO: 1270511 - RNA, 23 nt, Human
agcagccuuuuuuuuuuuuuuuu

SEQ ID NO: 1270512 - RNA, 19 nt, Human
auccuucugccucuucguu

SEQ ID NO: 1270513 - RNA, 23 nt, Human
cacaggcccagauccuucugccu

SEQ ID NO: 1270514 - RNA, 21 nt, Human
ccuucugccucuucguugucc

SEQ ID NO: 1270515 - RNA, 25 nt, Human
cucuucguuguccugcuugucaaau

SEQ ID NO: 1270516 - RNA, 24 nt, Human
cuuuuuuuuuuuuuuuuuaaaggg

SEQ ID NO: 1270517 - RNA, 23 nt, Human
uccuucugccucuucguuguccu

SEQ ID NO: 1270518 - RNA, 22 nt, Human
ucugcgagaagcagccuuuuuu

SEQ ID NO: 1270519 - RNA, 26 nt, Human
ugcgagaagcagccuuuucucccggg

SEQ ID NO: 1270520 - RNA, 20 nt, Human
uuuuuuuuuuuuuaaaggga

SEQ ID NO: 1270521 - RNA, 22 nt, Human
aaaaaaaaccuuuaagccuuca

SEQ ID NO: 1270522 - RNA, 20 nt, Human
aaauaaaugagaacaugcaa

SEQ ID NO: 1270523 - RNA, 25 nt, Human
aaaugucuauucagaucuuuugccc

SEQ ID NO: 1270524 - RNA, 18 nt, Human
aacuacccuucccagccu

SEQ ID NO: 1270525 - RNA, 19 nt, Human
aacucucccuucaggccca

SEQ ID NO: 1270526 - RNA, 18 nt, Human
aagaaaagacaaacucgc

SEQ ID NO: 1270527 - RNA, 18 nt, Human
aagcaaaaggaaaaaaaa

SEQ ID NO: 1270528 - RNA, 26 nt, Human
aagcaaaaggaaaaaaaaagggaccc

SEQ ID NO: 1270529 - RNA, 19 nt, Human
aagugcagagauuacaggc

SEQ ID NO: 1270530 - RNA, 18 nt, Human
aaugcaauauacaguauc

SEQ ID NO: 1270531 - RNA, 18 nt, Human
accauauuuucuuuauuu

SEQ ID NO: 1270532 - RNA, 19 nt, Human
acuaauuuacauucccacc

SEQ ID NO: 1270533 - RNA, 21 nt, Human
acucuaugcuauaucauuuca

SEQ ID NO: 1270534 - RNA, 24 nt, Human
agcuggucucaaacuccugagcuc

SEQ ID NO: 1270535 - RNA, 27 nt, Human
aggaaggaauuugguugaagguuacac

SEQ ID NO: 1270536 - RNA, 24 nt, Human
auaguuuugauuugcauuucucug

SEQ ID NO: 1270537 - RNA, 24 nt, Human
auggcugaauaguacuccauugug

SEQ ID NO: 1270538 - RNA, 20 nt, Human
auucacuauugccuguuuug

SEQ ID NO: 1270539 - RNA, 18 nt, Human
auuuuacuccauaucucc

SEQ ID NO: 1270540 - RNA, 25 nt, Human
caaacuccugagcucaagcaauccu

SEQ ID NO: 1270541 - RNA, 20 nt, Human
caaagaaaacauccuuugga

SEQ ID NO: 1270542 - RNA, 22 nt, Human
caaagaaaacauccuuuggaag

SEQ ID NO: 1270543 - RNA, 26 nt, Human
caaagugcagagauuacaggcuugug

SEQ ID NO: 1270544 - RNA, 18 nt, Human
caaaugacaggaucucau

SEQ ID NO: 1270545 - RNA, 21 nt, Human
caaauuucuggcugauuuaua

SEQ ID NO: 1270546 - RNA, 23 nt, Human
caaccgucaaugaagaacugaaa

SEQ ID NO: 1270547 - RNA, 22 nt, Human
caaggguagcgucagaaggcua

SEQ ID NO: 1270548 - RNA, 20 nt, Human
caccaacaguguaccagagu

SEQ ID NO: 1270549 - RNA, 22 nt, Human
caccaacaguguaccagaguuc

SEQ ID NO: 1270550 - RNA, 25 nt, Human
cagcaaagagacaaauacacaacug

SEQ ID NO: 1270551 - RNA, 21 nt, Human
cauaucuccaugaguccacug

SEQ ID NO: 1270552 - RNA, 22 nt, Human
caugagauugaaaaugcgugau

SEQ ID NO: 1270553 - RNA, 19 nt, Human
cauuucaaauuucuggcug

SEQ ID NO: 1270554 - RNA, 19 nt, Human
ccaccaugcccgacccaga

SEQ ID NO: 1270555 - RNA, 21 nt, Human
ccaguagauucugggcugccu

SEQ ID NO: 1270556 - RNA, 24 nt, Human
cccaaagugcagagauuacaggcu

SEQ ID NO: 1270557 - RNA, 20 nt, Human
cccagucucagguaagaaaa

SEQ ID NO: 1270558 - RNA, 24 nt, Human
ccucuaguuccauccauguuuugc

SEQ ID NO: 1270559 - RNA, 22 nt, Human
ccucuugaaacuacccuuccca

SEQ ID NO: 1270560 - RNA, 20 nt, Human
ccugagcucaagcaauccuc

SEQ ID NO: 1270561 - RNA, 18 nt, Human
ccuucaugcccugcauuu

SEQ ID NO: 1270562 - RNA, 23 nt, Human
cgcccuugugugccaguggucug

SEQ ID NO: 1270563 - RNA, 19 nt, Human
cuaaagcuauaagccaagc

SEQ ID NO: 1270564 - RNA, 23 nt, Human
cuagccgccccguggcauuuucc

SEQ ID NO: 1270565 - RNA, 24 nt, Human
cucaagcaauccucccacuuuggc

SEQ ID NO: 1270566 - RNA, 20 nt, Human
cuccuacaaauaaaugagaa

SEQ ID NO: 1270567 - RNA, 18 nt, Human
cucuugaaacuacccuuc

SEQ ID NO: 1270568 - RNA, 20 nt, Human
cuuuauggcugaauaguacu

SEQ ID NO: 1270569 - RNA, 24 nt, Human
cuuucuguccugacauauuucauu

SEQ ID NO: 1270570 - RNA, 18 nt, Human
cuuuugcccaucuuuaau

SEQ ID NO: 1270571 - RNA, 23 nt, Human
gaaagcaaccgucaaugaagaac

SEQ ID NO: 1270572 - RNA, 18 nt, Human
gaaggcuaaagcuauaag

SEQ ID NO: 1270573 - RNA, 23 nt, Human
gagauuacaggcuugugccacca

SEQ ID NO: 1270574 - RNA, 24 nt, Human
gauuacaggcuugugccaccaugc

SEQ ID NO: 1270575 - RNA, 19 nt, Human
gcaaaaggaaaaaaaaacc

SEQ ID NO: 1270576 - RNA, 18 nt, Human
gcagugggauugcuggau

SEQ ID NO: 1270577 - RNA, 20 nt, Human
gccagcuauauuaaaacuaa

SEQ ID NO: 1270578 - RNA, 23 nt, Human
guaccagaguucccucuucucca

SEQ ID NO: 1270579 - RNA, 19 nt, Human
gugcuccuuucagccaggg

SEQ ID NO: 1270580 - RNA, 24 nt, Human
uaaaagccauuuuuaacuagggug

SEQ ID NO: 1270581 - RNA, 23 nt, Human
uaacucagcuagccgccccgugg

SEQ ID NO: 1270582 - RNA, 18 nt, Human
uaagcaaaaggaaaaaaa

SEQ ID NO: 1270583 - RNA, 21 nt, Human
uacaugagaaaaaucaaauca

SEQ ID NO: 1270584 - RNA, 18 nt, Human
uagcacaagggugucaga

SEQ ID NO: 1270585 - RNA, 23 nt, Human
uaugaaauuuuguggacaugaga

SEQ ID NO: 1270586 - RNA, 23 nt, Human
uauguuacccaagcuggucucaa

SEQ ID NO: 1270587 - RNA, 24 nt, Human
uauguuacccaagcuggucucaaa

SEQ ID NO: 1270588 - RNA, 24 nt, Human
uauuugcauaugaaauuuugugga

SEQ ID NO: 1270589 - RNA, 18 nt, Human
ucagccagggcugucugu

SEQ ID NO: 1270590 - RNA, 24 nt, Human
uccauagugguuauacuaauuuac

SEQ ID NO: 1270591 - RNA, 24 nt, Human
ucccaaagugcagagauuacaggc

SEQ ID NO: 1270592 - RNA, 21 nt, Human
ucgaaguauucucucugugcu

SEQ ID NO: 1270593 - RNA, 23 nt, Human
ucucaaacuccugagcucaagca

SEQ ID NO: 1270594 - RNA, 24 nt, Human
ucuccauagugguuauacuaauuu

SEQ ID NO: 1270595 - RNA, 24 nt, Human
ucucugaugaccaaugauguugag

SEQ ID NO: 1270596 - RNA, 18 nt, Human
ucucugugcuccuuucag

SEQ ID NO: 1270597 - RNA, 19 nt, Human
ucuuugcaagcauucacuc

SEQ ID NO: 1270598 - RNA, 20 nt, Human
ugacuuggugauuacaaauc

SEQ ID NO: 1270599 - RNA, 24 nt, Human
ugagaaaaggaaggaauuugguug

SEQ ID NO: 1270600 - RNA, 21 nt, Human
ugagaacaugcaaagucuguc

SEQ ID NO: 1270601 - RNA, 20 nt, Human
uggaucauaugaucauucua

SEQ ID NO: 1270602 - RNA, 22 nt, Human
uggccugaccaucaagcaauau

SEQ ID NO: 1270603 - RNA, 19 nt, Human
uggcugaauaguacuccau

SEQ ID NO: 1270604 - RNA, 22 nt, Human
ugggauugcuggaucauaugau

SEQ ID NO: 1270605 - RNA, 19 nt, Human
ugugccaccaugcccgacc

SEQ ID NO: 1270606 - RNA, 19 nt, Human
uguggaauuccugccugcu

SEQ ID NO: 1270607 - RNA, 25 nt, Human
uuagaaguuuccuggccugaccauc

SEQ ID NO: 1270608 - RNA, 21 nt, Human
uuagcuccuacaaauaaauga

SEQ ID NO: 1270609 - RNA, 23 nt, Human
uuagcuccuacaaauaaaugaga

SEQ ID NO: 1270610 - RNA, 18 nt, Human
uuccuggccugaccaucu

SEQ ID NO: 1270611 - RNA, 24 nt, Human
uucuaugucuauacauguuuagcu

SEQ ID NO: 1270612 - RNA, 19 nt, Human
uuguacccauuaaccaucu

SEQ ID NO: 1270613 - RNA, 19 nt, Human
uuguauguguaugucuucu

SEQ ID NO: 1270614 - RNA, 23 nt, Human
uuuacauucccaccaacagugua

SEQ ID NO: 1270615 - RNA, 23 nt, Human
uuucuggcugauuuauaaaccuu

SEQ ID NO: 1270616 - RNA, 21 nt, Human
uuugcaagcauucacuauugc

SEQ ID NO: 1270617 - RNA, 22 nt, Human
uuuuaauuuuuuccuauggagu

SEQ ID NO: 1270618 - RNA, 21 nt, Human
uuuuggguauauauccagcag

SEQ ID NO: 1270619 - RNA, 23 nt, Human
aaaaaaaugcuauaguacaguaa

SEQ ID NO: 1270620 - RNA, 18 nt, Human
aaacauaaagaaagcuga

SEQ ID NO: 1270621 - RNA, 21 nt, Human
aaccagaaaauagaggcaggg

SEQ ID NO: 1270622 - RNA, 23 nt, Human
aagcaaccugacucaugaaaggu

SEQ ID NO: 1270623 - RNA, 19 nt, Human
aagcauuugguagcaaaau

SEQ ID NO: 1270624 - RNA, 22 nt, Human
aaugcaaaagagaaagagagaa

SEQ ID NO: 1270625 - RNA, 19 nt, Human
acagagaaaagagacacag

SEQ ID NO: 1270626 - RNA, 23 nt, Human
agaaaagagacacagagaaggac

SEQ ID NO: 1270627 - RNA, 24 nt, Human
agaaaagagacacagagaaggaca

SEQ ID NO: 1270628 - RNA, 19 nt, Human
agaaacugauaaaaccaga

SEQ ID NO: 1270629 - RNA, 19 nt, Human
agaaagagggggaggcugu

SEQ ID NO: 1270630 - RNA, 21 nt, Human
agaacagagaaaagagacaca

SEQ ID NO: 1270631 - RNA, 22 nt, Human
agaacuaagaugcaaauuucca

SEQ ID NO: 1270632 - RNA, 21 nt, Human
agagaaaagagacacagagaa

SEQ ID NO: 1270633 - RNA, 22 nt, Human
agagaaagaaaaagaugaagag

SEQ ID NO: 1270634 - RNA, 19 nt, Human
agagaaagagagaaaguaa

SEQ ID NO: 1270635 - RNA, 19 nt, Human
agggggaggcugugaaaag

SEQ ID NO: 1270636 - RNA, 23 nt, Human
aggucugaagaaagagggggagg

SEQ ID NO: 1270637 - RNA, 22 nt, Human
auguuacuggauuagaaagagg

SEQ ID NO: 1270638 - RNA, 21 nt, Human
auuaagcauaaaggggaggga

SEQ ID NO: 1270639 - RNA, 19 nt, Human
caacacgcacagagcugaa

SEQ ID NO: 1270640 - RNA, 20 nt, Human
caaugugcagaugacaaaau

SEQ ID NO: 1270641 - RNA, 19 nt, Human
cacagguucacaacaaacc

SEQ ID NO: 1270642 - RNA, 18 nt, Human
cagagaaaagagacacag

SEQ ID NO: 1270643 - RNA, 18 nt, Human
cagagagaaagaaaaaga

SEQ ID NO: 1270644 - RNA, 23 nt, Human
cagagcugaaggguugcagcaaa

SEQ ID NO: 1270645 - RNA, 19 nt, Human
cagguuuauauaugucaag

SEQ ID NO: 1270646 - RNA, 22 nt, Human
ccaaaagcauuugguagcaaaa

SEQ ID NO: 1270647 - RNA, 21 nt, Human
cugaagaaagagggggaggcu

SEQ ID NO: 1270648 - RNA, 20 nt, Human
gacauggaaugcaaaagaga

SEQ ID NO: 1270649 - RNA, 19 nt, Human
gagaacacagguucacaac

SEQ ID NO: 1270650 - RNA, 18 nt, Human
gagaacagagaaaagaga

SEQ ID NO: 1270651 - RNA, 27 nt, Human
gagaacagagaaaagagaccgguaccc

SEQ ID NO: 1270652 - RNA, 22 nt, Human
gcaugggcuucucccucacaug

SEQ ID NO: 1270653 - RNA, 21 nt, Human
gcuaaugaaauuaagaaagga

SEQ ID NO: 1270654 - RNA, 20 nt, Human
ggaggcugugaaaaguucug

SEQ ID NO: 1270655 - RNA, 18 nt, Human
gucaggacaaauguggag

SEQ ID NO: 1270656 - RNA, 20 nt, Human
guggagaacacagguucaca

SEQ ID NO: 1270657 - RNA, 21 nt, Human
uaaaaccagaaaauagaggcu

SEQ ID NO: 1270658 - RNA, 19 nt, Human
uaaaagccauaaaagccaa

SEQ ID NO: 1270659 - RNA, 20 nt, Human
uaacagaacuaagaugcaaa

SEQ ID NO: 1270660 - RNA, 18 nt, Human
uagcaaaauauaaaguag

SEQ ID NO: 1270661 - RNA, 21 nt, Human
uagcacauaauugacuuuaau

SEQ ID NO: 1270662 - RNA, 24 nt, Human
uagcuguggagcaaaaaaaugcua

SEQ ID NO: 1270663 - RNA, 23 nt, Human
ucaggacaaauguggagaacaca

SEQ ID NO: 1270664 - RNA, 24 nt, Human
uccaugugacuucacauuccaccg

SEQ ID NO: 1270665 - RNA, 22 nt, Human
uccugcaugggcuucucccuca

SEQ ID NO: 1270666 - RNA, 22 nt, Human
ucugaagaaagagggggaggcu

SEQ ID NO: 1270667 - RNA, 20 nt, Human
ucugcuaagcaaccugacuc

SEQ ID NO: 1270668 - RNA, 19 nt, Human
ucuguccugcuucccaaaa

SEQ ID NO: 1270669 - RNA, 20 nt, Human
ucuguccugcuucccaaaag

SEQ ID NO: 1270670 - RNA, 21 nt, Human
ugaagagucaggacaaaugug

SEQ ID NO: 1270671 - RNA, 20 nt, Human
ugacaaaauggcacucagaa

SEQ ID NO: 1270672 - RNA, 21 nt, Human
ugagaacagagaaaagagaca

SEQ ID NO: 1270673 - RNA, 22 nt, Human
ugagaacagagaaaagagacac

SEQ ID NO: 1270674 - RNA, 25 nt, Human
ugaguaaaacacauuuacacauugg

SEQ ID NO: 1270675 - RNA, 22 nt, Human
uggaaaacauaaagaaagcuga

SEQ ID NO: 1270676 - RNA, 18 nt, Human
uggaagacugagaacaga

SEQ ID NO: 1270677 - RNA, 21 nt, Human
uggaaugcaaaagagaaagag

SEQ ID NO: 1270678 - RNA, 19 nt, Human
uggcaaaauuucaaaauga

SEQ ID NO: 1270679 - RNA, 22 nt, Human
uggccugaucauaaaagccaua

SEQ ID NO: 1270680 - RNA, 23 nt, Human
uguccugcuucccaaaaggucaa

SEQ ID NO: 1270681 - RNA, 21 nt, Human
ugugcagaugacaaaauggca

SEQ ID NO: 1270682 - RNA, 18 nt, Human
uguggagcaaaaaaaugc

SEQ ID NO: 1270683 - RNA, 26 nt, Human
uguggagcaaaaaaaugcuauaguac

SEQ ID NO: 1270684 - RNA, 24 nt, Human
uguuuaauucucauaauagcucua

SEQ ID NO: 1270685 - RNA, 22 nt, Human
uucacaacaaaccagguagaaa

SEQ ID NO: 1270686 - RNA, 23 nt, Human
uucacacagcuacuaaguaacag

SEQ ID NO: 1270687 - RNA, 18 nt, Human
uuucacacagcuacuaag

SEQ ID NO: 1270688 - RNA, 18 nt, Human
aauaucuacauuuagaaa

SEQ ID NO: 1270689 - RNA, 27 nt, Human
aaugcaaaaacaagacauuuuauugaa

SEQ ID NO: 1270690 - RNA, 27 nt, Human
agaggccagcagcugccacacugagcu

SEQ ID NO: 1270691 - RNA, 19 nt, Human
caaaagcacuuccuuacuc

SEQ ID NO: 1270692 - RNA, 19 nt, Human
caaguagcggcccagaggc

SEQ ID NO: 1270693 - RNA, 23 nt, Human
cagcagcugccacacugagcucc

SEQ ID NO: 1270694 - RNA, 22 nt, Human
ccccaguaccucauucaaaagc

SEQ ID NO: 1270695 - RNA, 22 nt, Human
cgaggaaagaauuaggaacuuc

SEQ ID NO: 1270696 - RNA, 18 nt, Human
cggcccagaggccagcag

SEQ ID NO: 1270697 - RNA, 24 nt, Human
cugccacacugagcuccgcuaggc

SEQ ID NO: 1270698 - RNA, 18 nt, Human
gaaagaauuaggaacuuc

SEQ ID NO: 1270699 - RNA, 19 nt, Human
gcagaguuucacaguuaac

SEQ ID NO: 1270700 - RNA, 21 nt, Human
gcggcccagaggccagcagcu

SEQ ID NO: 1270701 - RNA, 20 nt, Human
ggcccagaggccagcagcug

SEQ ID NO: 1270702 - RNA, 19 nt, Human
uaggaacuuccaacaccuu

SEQ ID NO: 1270703 - RNA, 23 nt, Human
uagguauaauucaauuaacacag

SEQ ID NO: 1270704 - RNA, 21 nt, Human
uccaacaccuuggcccccagu

SEQ ID NO: 1270705 - RNA, 22 nt, Human
ugacaaguagcggcccagaggc

SEQ ID NO: 1270706 - RNA, 22 nt, Human
uucccaauacgcagaguuucac

SEQ ID NO: 1270707 - RNA, 20 nt, Human
aaguucaaaaacaggcaaaa

SEQ ID NO: 1270708 - RNA, 20 nt, Human
acagguguucacgacauaaa

SEQ ID NO: 1270709 - RNA, 22 nt, Human
cacccgcaccuccggacccagc

SEQ ID NO: 1270710 - RNA, 21 nt, Human
cagcucuccucgucccgcccc

SEQ ID NO: 1270711 - RNA, 22 nt, Human
ccccggccugccgcgcgcugga

SEQ ID NO: 1270712 - RNA, 22 nt, Human
cccgcaccuccggacccagcca

SEQ ID NO: 1270713 - RNA, 27 nt, Human
cccgcgccgcacccgcaccuccggacc

SEQ ID NO: 1270714 - RNA, 18 nt, Human
ccggacccagccacaggc

SEQ ID NO: 1270715 - RNA, 21 nt, Human
cgcacccgcaccuccggaccc

SEQ ID NO: 1270716 - RNA, 23 nt, Human
cuucuacuguugcugaugacagg

SEQ ID NO: 1270717 - RNA, 18 nt, Human
gaaacucagaaaaacugc

SEQ ID NO: 1270718 - RNA, 22 nt, Human
gcgccgcacccgcaccuccgga

SEQ ID NO: 1270719 - RNA, 23 nt, Human
guuuuguccacuuuuugaaugca

SEQ ID NO: 1270720 - RNA, 20 nt, Human
uacuguugcugaugacaggg

SEQ ID NO: 1270721 - RNA, 21 nt, Human
uauuuuucccaucuucuacug

SEQ ID NO: 1270722 - RNA, 26 nt, Human
ucaaaaacaggcaaaaugaaucaaag

SEQ ID NO: 1270723 - RNA, 21 nt, Human
ucuucacuuuggcagugguua

SEQ ID NO: 1270724 - RNA, 21 nt, Human
ucuucuacuguugcugaugac

SEQ ID NO: 1270725 - RNA, 21 nt, Human
uguccccgcagcucuccucgu

SEQ ID NO: 1270726 - RNA, 24 nt, Human
uuuacuaaaaaauaaaaauaaaaa

SEQ ID NO: 1270727 - RNA, 23 nt, Human
agugcugggagagagggaagaga

SEQ ID NO: 1270728 - RNA, 20 nt, Human
cagcagaauagaaucuucua

SEQ ID NO: 1270729 - RNA, 20 nt, Human
ccuucaaaauucagaguuuu

SEQ ID NO: 1270730 - RNA, 23 nt, Human
gaggagaaagugcugggagagag

SEQ ID NO: 1270731 - RNA, 24 nt, Human
uccacuggccagcagaauagaauc

SEQ ID NO: 1270732 - RNA, 23 nt, Human
uccuucaaaauucagaguuuuga

SEQ ID NO: 1270733 - RNA, 21 nt, Human
ugacaagggaggagaaagugg

SEQ ID NO: 1270734 - RNA, 23 nt, Human
ugggagagagggaagagaucagg

SEQ ID NO: 1270735 - RNA, 21 nt, Human
aaaaagagcaucacgucaaaa

SEQ ID NO: 1270736 - RNA, 24 nt, Human
aaaacaggcaugugcuaugcccuu

SEQ ID NO: 1270737 - RNA, 19 nt, Human
aaaauaaucuauugagagc

SEQ ID NO: 1270738 - RNA, 21 nt, Human
aaaauaccaacagaaacaugg

SEQ ID NO: 1270739 - RNA, 18 nt, Human
aaacacacaaagcuauag

SEQ ID NO: 1270740 - RNA, 23 nt, Human
aaacaggcaugugcuaugcccuu

SEQ ID NO: 1270741 - RNA, 18 nt, Human
acaaaacaaauccacaga

SEQ ID NO: 1270742 - RNA, 19 nt, Human
acaaaacaaauccacagaa

SEQ ID NO: 1270743 - RNA, 20 nt, Human
acaaacacacaaagcuauag

SEQ ID NO: 1270744 - RNA, 24 nt, Human
acaacacacauacaugcacacaca

SEQ ID NO: 1270745 - RNA, 33 nt, Human
acacacacaacaacacacauacaugcacacagu

SEQ ID NO: 1270746 - RNA, 29 nt, Human
acacacacaacaacacacauacaugcagu

SEQ ID NO: 1270747 - RNA, 18 nt, Human
acagaaaaaaaaucccua

SEQ ID NO: 1270748 - RNA, 24 nt, Human
acaguacuaaaaucagcucaacca

SEQ ID NO: 1270749 - RNA, 25 nt, Human
acccuguaauucagauuaagaacua

SEQ ID NO: 1270750 - RNA, 24 nt, Human
agaaauauaagaauaaacagcgug

SEQ ID NO: 1270751 - RNA, 19 nt, Human
agcuauaggauuaaaagga

SEQ ID NO: 1270752 - RNA, 21 nt, Human
aggaggaaaggcgggauggcu

SEQ ID NO: 1270753 - RNA, 18 nt, Human
aggcgaaguugcagcugc

SEQ ID NO: 1270754 - RNA, 21 nt, Human
aggcgaaguugcagcugcggg

SEQ ID NO: 1270755 - RNA, 19 nt, Human
auauauguauauauauaaa

SEQ ID NO: 1270756 - RNA, 26 nt, Human
augcacacacaaacacacaaagcuau

SEQ ID NO: 1270757 - RNA, 21 nt, Human
auuuuuuuucuuuuugccuga

SEQ ID NO: 1270758 - RNA, 20 nt, Human
caaaagaacauaaucaaugc

SEQ ID NO: 1270759 - RNA, 23 nt, Human
caaaccaacuuacaaaggacaag

SEQ ID NO: 1270760 - RNA, 24 nt, Human
caaaggacaaggcuuucgccaaaa

SEQ ID NO: 1270761 - RNA, 28 nt, Human
caacacacauacaugcacacacaaacac

SEQ ID NO: 1270762 - RNA, 21 nt, Human
caacuuacaaaggacaaggcu

SEQ ID NO: 1270763 - RNA, 24 nt, Human
cacaagaucaaaccaacuuacaaa

SEQ ID NO: 1270764 - RNA, 22 nt, Human
cacacacacaacaacacacaua

SEQ ID NO: 1270765 - RNA, 26 nt, Human
cacacacacacaacaacacacauaca

SEQ ID NO: 1270766 - RNA, 20 nt, Human
cacccucuaccccuccaucu

SEQ ID NO: 1270767 - RNA, 22 nt, Human
cacgggcaggaggaaaggcggg

SEQ ID NO: 1270768 - RNA, 24 nt, Human
cacguccguccuccugcuucuucg

SEQ ID NO: 1270769 - RNA, 21 nt, Human
cacuugcaaccuuccauuaug

SEQ ID NO: 1270770 - RNA, 24 nt, Human
cagcucaaccacaaacauccuauc

SEQ ID NO: 1270771 - RNA, 22 nt, Human
caggcucaaaggcuccaggcga

SEQ ID NO: 1270772 - RNA, 19 nt, Human
cauacauuacaaugcuaag

SEQ ID NO: 1270773 - RNA, 20 nt, Human
ccaaaauaccaacagaaaca

SEQ ID NO: 1270774 - RNA, 23 nt, Human
ccaaaguacaacacaagcuucua

SEQ ID NO: 1270775 - RNA, 23 nt, Human
cccccuccgccggcagagccaga

SEQ ID NO: 1270776 - RNA, 20 nt, Human
ccccggcugagcccaggcuc

SEQ ID NO: 1270777 - RNA, 24 nt, Human
cccuccgccggcagagccagagcc

SEQ ID NO: 1270778 - RNA, 24 nt, Human
cccuuuaucuggcaagaaaacagg

SEQ ID NO: 1270779 - RNA, 19 nt, Human
ccgcacugccggcgccugc

SEQ ID NO: 1270780 - RNA, 21 nt, Human
ccggcgccugccauggccaag

SEQ ID NO: 1270781 - RNA, 22 nt, Human
ccggcugggcugaggcccgcgc

SEQ ID NO: 1270782 - RNA, 21 nt, Human
ccggggaagcggcgacucggc

SEQ ID NO: 1270783 - RNA, 18 nt, Human
ccucuaccccuccaucuc

SEQ ID NO: 1270784 - RNA, 21 nt, Human
ccuguaauucagauuaagaac

SEQ ID NO: 1270785 - RNA, 23 nt, Human
cggcugagcccaggcucaaaggc

SEQ ID NO: 1270786 - RNA, 19 nt, Human
cggcugggcugaggcccgc

SEQ ID NO: 1270787 - RNA, 27 nt, Human
cggcugggcugaggcccgcgccgggga

SEQ ID NO: 1270788 - RNA, 23 nt, Human
cgugugccuuucucagaagcucu

SEQ ID NO: 1270789 - RNA, 23 nt, Human
cuauaacuauaaaauaaucuauu

SEQ ID NO: 1270790 - RNA, 23 nt, Human
cuccccuucaacaaaacaaaucc

SEQ ID NO: 1270791 - RNA, 19 nt, Human
cuccgcccccuccgccggc

SEQ ID NO: 1270792 - RNA, 25 nt, Human
cugaaggcaauaaaauguauaaucc

SEQ ID NO: 1270793 - RNA, 21 nt, Human
cugauuagauaagccccuuca

SEQ ID NO: 1270794 - RNA, 26 nt, Human
cuucaaaaucucuucacuucccuucu

SEQ ID NO: 1270795 - RNA, 23 nt, Human
cuucacuucccuucuccccuuca

SEQ ID NO: 1270796 - RNA, 20 nt, Human
cuugguccuacaaucaguag

SEQ ID NO: 1270797 - RNA, 23 nt, Human
gaaaaacagcugaccuaucuaca

SEQ ID NO: 1270798 - RNA, 20 nt, Human
gacaaggcuuucgccaaaac

SEQ ID NO: 1270799 - RNA, 18 nt, Human
gagagggccgggugggcc

SEQ ID NO: 1270800 - RNA, 20 nt, Human
gccaagccggcugggcugag

SEQ ID NO: 1270801 - RNA, 19 nt, Human
gcucaaccacaaacauccu

SEQ ID NO: 1270802 - RNA, 18 nt, Human
ggcggggagcgcaggggc

SEQ ID NO: 1270803 - RNA, 26 nt, Human
ggcugggcugaggcccgcgccgggga

SEQ ID NO: 1270804 - RNA, 19 nt, Human
gggcggggagcgcaggggc

SEQ ID NO: 1270805 - RNA, 23 nt, Human
uaaaaucagcucaaccacaaaca

SEQ ID NO: 1270806 - RNA, 20 nt, Human
uaaaugagacuugguugcau

SEQ ID NO: 1270807 - RNA, 19 nt, Human
uaagaaaacaggcaugugc

SEQ ID NO: 1270808 - RNA, 25 nt, Human
uaaggaacauguuaaaauuaguuca

SEQ ID NO: 1270809 - RNA, 21 nt, Human
uacaacacaagcuucuauaug

SEQ ID NO: 1270810 - RNA, 24 nt, Human
uacaguaguuucaacuuugaaaca

SEQ ID NO: 1270811 - RNA, 22 nt, Human
uagauuuuaucauauuuuccaa

SEQ ID NO: 1270812 - RNA, 22 nt, Human
uaguaauacccuguaauucaga

SEQ ID NO: 1270813 - RNA, 18 nt, Human
uauauauguauauauaua

SEQ ID NO: 1270814 - RNA, 20 nt, Human
uauauguauauauauaaaac

SEQ ID NO: 1270815 - RNA, 19 nt, Human
uauccugugaaaaacuguu

SEQ ID NO: 1270816 - RNA, 23 nt, Human
uauguauauauauaaaacauaua

SEQ ID NO: 1270817 - RNA, 27 nt, Human
ucaaaagaacauaaucaaugcugaagg

SEQ ID NO: 1270818 - RNA, 27 nt, Human
ucaacaaaacaaauccacagaaaaaaa

SEQ ID NO: 1270819 - RNA, 20 nt, Human
ucaaccacaaacauccuauc

SEQ ID NO: 1270820 - RNA, 24 nt, Human
ucacguccguccuccugcuucuuc

SEQ ID NO: 1270821 - RNA, 22 nt, Human
ucauauccugugaaaaacuguu

SEQ ID NO: 1270822 - RNA, 25 nt, Human
uccaaaauaccaacagaaacaugga

SEQ ID NO: 1270823 - RNA, 21 nt, Human
uccaaugccuuuauuaauuuu

SEQ ID NO: 1270824 - RNA, 22 nt, Human
uccacaaucacucuggaaaaac

SEQ ID NO: 1270825 - RNA, 19 nt, Human
uccacagaaaaaaaauccc

SEQ ID NO: 1270826 - RNA, 20 nt, Human
uccugcuugagucacacccu

SEQ ID NO: 1270827 - RNA, 25 nt, Human
ucggcggugacggcugcuagauccc

SEQ ID NO: 1270828 - RNA, 25 nt, Human
ugaaaaucccaaaguacaacacaag

SEQ ID NO: 1270829 - RNA, 22 nt, Human
ugaccuaucuacaguacuaaaa

SEQ ID NO: 1270830 - RNA, 18 nt, Human
ugagucacacccucuacc

SEQ ID NO: 1270831 - RNA, 22 nt, Human
ugcuagauccccggcugagccc

SEQ ID NO: 1270832 - RNA, 22 nt, Human
ugcucugacccuagaaacccuu

SEQ ID NO: 1270833 - RNA, 20 nt, Human
ugcugaaggcaauaaaaugu

SEQ ID NO: 1270834 - RNA, 20 nt, Human
uggaaaaacagcugaccuau

SEQ ID NO: 1270835 - RNA, 23 nt, Human
uggaaaaacagcugaccuaucua

SEQ ID NO: 1270836 - RNA, 23 nt, Human
uguguaucuuccuggguagucuc

SEQ ID NO: 1270837 - RNA, 23 nt, Human
uuaauguacuuuaacaaaaggga

SEQ ID NO: 1270838 - RNA, 18 nt, Human
uucaugugaaggguacuc

SEQ ID NO: 1270839 - RNA, 21 nt, Human
uucucuccgcccccuccgccg

SEQ ID NO: 1270840 - RNA, 21 nt, Human
uugcagcugcggguucucucc

SEQ ID NO: 1270841 - RNA, 22 nt, Human
uuuaaacuguguaucuuccugg

SEQ ID NO: 1270842 - RNA, 19 nt, Human
aaagcagaagucagaagcc

SEQ ID NO: 1270843 - RNA, 23 nt, Human
aacauuaucaugaacagagaaga

SEQ ID NO: 1270844 - RNA, 20 nt, Human
aagaaaagcagaagucagaa

SEQ ID NO: 1270845 - RNA, 18 nt, Human
aagcagaagucagaagcc

SEQ ID NO: 1270846 - RNA, 19 nt, Human
aagcagaagucagaagccu

SEQ ID NO: 1270847 - RNA, 21 nt, Human
aauaacacauguugggacuuc

SEQ ID NO: 1270848 - RNA, 19 nt, Human
aauaaccuuagaccaaaga

SEQ ID NO: 1270849 - RNA, 23 nt, Human
acaucaucucuuccauauuccag

SEQ ID NO: 1270850 - RNA, 19 nt, Human
accaaagaaaagcagaagu

SEQ ID NO: 1270851 - RNA, 20 nt, Human
acccagguaagaucauuuuc

SEQ ID NO: 1270852 - RNA, 18 nt, Human
accugcugcuguugaugc

SEQ ID NO: 1270853 - RNA, 18 nt, Human
accugcugcuguugaugc

SEQ ID NO: 1270854 - RNA, 19 nt, Human
acuuaauaaccuuagacca

SEQ ID NO: 1270855 - RNA, 26 nt, Human
agaaaagcagaagucagaagccugga

SEQ ID NO: 1270856 - RNA, 21 nt, Human
agaauucaaaauuauaagucu

SEQ ID NO: 1270857 - RNA, 19 nt, Human
agagaagauuuuauggaag

SEQ ID NO: 1270858 - RNA, 18 nt, Human
agccucuaacaggagaag

SEQ ID NO: 1270859 - RNA, 20 nt, Human
auagccaaauuuuuuaugcc

SEQ ID NO: 1270860 - RNA, 19 nt, Human
augaagaaauuggaauguu

SEQ ID NO: 1270861 - RNA, 22 nt, Human
augaagcacaaauuuuucaagu

SEQ ID NO: 1270862 - RNA, 22 nt, Human
caaacccuccuuuaaaaacaga

SEQ ID NO: 1270863 - RNA, 25 nt, Human
caccagugcuaaaaaagacuuuuga

SEQ ID NO: 1270864 - RNA, 24 nt, Human
cagauugaagucuuacagaaauau

SEQ ID NO: 1270865 - RNA, 22 nt, Human
caggaaucucucacaaugcuuu

SEQ ID NO: 1270866 - RNA, 19 nt, Human
caggagaagaguguccaga

SEQ ID NO: 1270867 - RNA, 21 nt, Human
cauagccaaauuuuuuaugcc

SEQ ID NO: 1270868 - RNA, 24 nt, Human
ccacucguguaaccaaaacuccau

SEQ ID NO: 1270869 - RNA, 23 nt, Human
ccuccuuuaaaaacagauugaaa

SEQ ID NO: 1270870 - RNA, 24 nt, Human
cucucacaaugcuuuaaaacccag

SEQ ID NO: 1270871 - RNA, 22 nt, Human
cugcugcuguugaugccacucg

SEQ ID NO: 1270872 - RNA, 20 nt, Human
cuuaaaauuucaaacccucc

SEQ ID NO: 1270873 - RNA, 22 nt, Human
cuuaauaaccuuagaccaaaga

SEQ ID NO: 1270874 - RNA, 20 nt, Human
gaaaagcagaagucagaagc

SEQ ID NO: 1270875 - RNA, 21 nt, Human
gaucacagcauaucacacuua

SEQ ID NO: 1270876 - RNA, 18 nt, Human
ggaaucucucacaaugcu

SEQ ID NO: 1270877 - RNA, 24 nt, Human
uaacaaguucaccagugcuaaaaa

SEQ ID NO: 1270878 - RNA, 19 nt, Human
uaaccuuagaccaaagaua

SEQ ID NO: 1270879 - RNA, 20 nt, Human
uaagaucauuuucugcacca

SEQ ID NO: 1270880 - RNA, 20 nt, Human
uaccugauacugagccucua

SEQ ID NO: 1270881 - RNA, 18 nt, Human
uagcaggauaggauaaca

SEQ ID NO: 1270882 - RNA, 19 nt, Human
uagugcaaugccaccugcu

SEQ ID NO: 1270883 - RNA, 19 nt, Human
uaucacacuuaauaaccuu

SEQ ID NO: 1270884 - RNA, 24 nt, Human
uauuacaaaguccuucacaaauaa

SEQ ID NO: 1270885 - RNA, 18 nt, Human
uauuccagauuggaccau

SEQ ID NO: 1270886 - RNA, 21 nt, Human
ucagauaccugauacugagcc

SEQ ID NO: 1270887 - RNA, 24 nt, Human
ucuaacaggagaagaguguccaga

SEQ ID NO: 1270888 - RNA, 25 nt, Human
ucucucacaaugcuuuaaaacccag

SEQ ID NO: 1270889 - RNA, 24 nt, Human
ucuucacauuugcaucaguagcug

SEQ ID NO: 1270890 - RNA, 25 nt, Human
ugaugaagaaauuggaauguuuuuu

SEQ ID NO: 1270891 - RNA, 21 nt, Human
ugccccagugaauguaaguau

SEQ ID NO: 1270892 - RNA, 23 nt, Human
ugcuaaaaaagacuuuugacagc

SEQ ID NO: 1270893 - RNA, 18 nt, Human
ugggacuucacgaagaga

SEQ ID NO: 1270894 - RNA, 24 nt, Human
uguaaccaaaacuccauagccaaa

SEQ ID NO: 1270895 - RNA, 19 nt, Human
uucacauuugcaucaguag

SEQ ID NO: 1270896 - RNA, 18 nt, Human
uucaggaaucucucacaa

SEQ ID NO: 1270897 - RNA, 27 nt, Human
uucccuugcaggcagagaagagaagau

SEQ ID NO: 1270898 - RNA, 24 nt, Human
aacaucuugcuguugucauuuuuu

SEQ ID NO: 1270899 - RNA, 18 nt, Human
aagauccaaaaacuauaa

SEQ ID NO: 1270900 - RNA, 20 nt, Human
acuggcagaaauucucuggu

SEQ ID NO: 1270901 - RNA, 22 nt, Human
acuguagcauccucuuuuccaa

SEQ ID NO: 1270902 - RNA, 19 nt, Human
agggaggugggagguggag

SEQ ID NO: 1270903 - RNA, 20 nt, Human
auccguauugggaaauaauu

SEQ ID NO: 1270904 - RNA, 21 nt, Human
caugacuuugugcacugaaga

SEQ ID NO: 1270905 - RNA, 23 nt, Human
caugucugucuuucucacugcca

SEQ ID NO: 1270906 - RNA, 20 nt, Human
cccccugacgacgggcuccg

SEQ ID NO: 1270907 - RNA, 21 nt, Human
cccugacgacgggcuccgcag

SEQ ID NO: 1270908 - RNA, 21 nt, Human
cccuuaggagagcucagcaau

SEQ ID NO: 1270909 - RNA, 22 nt, Human
ccuggcuccuuggcgcccccug

SEQ ID NO: 1270910 - RNA, 24 nt, Human
cggcugcauucuucaaagccccaa

SEQ ID NO: 1270911 - RNA, 18 nt, Human
cuccuuggcgcccccuga

SEQ ID NO: 1270912 - RNA, 21 nt, Human
cuuaugcuaaagauccaaaaa

SEQ ID NO: 1270913 - RNA, 24 nt, Human
cuuuccccggcugcauucuucaaa

SEQ ID NO: 1270914 - RNA, 23 nt, Human
cuuugugcacugaagaaguaugg

SEQ ID NO: 1270915 - RNA, 24 nt, Human
gauuucccugaaaauugaugcauu

SEQ ID NO: 1270916 - RNA, 22 nt, Human
gggcggggcgcagggagguggg

SEQ ID NO: 1270917 - RNA, 18 nt, Human
ggguggaaucuacaugca

SEQ ID NO: 1270918 - RNA, 18 nt, Human
gguaauaaucaauguaca

SEQ ID NO: 1270919 - RNA, 21 nt, Human
gucuuucucacugccaggaag

SEQ ID NO: 1270920 - RNA, 20 nt, Human
guuagaacaugucugguaaa

SEQ ID NO: 1270921 - RNA, 24 nt, Human
uaaaauaaaacaucuugcuguugu

SEQ ID NO: 1270922 - RNA, 21 nt, Human
uaaaccaguuaaaacuaagca

SEQ ID NO: 1270923 - RNA, 26 nt, Human
uaagcaguauagcaauguuguaauga

SEQ ID NO: 1270924 - RNA, 18 nt, Human
uacagagggguauuuggg

SEQ ID NO: 1270925 - RNA, 24 nt, Human
uaccuguaauaccaaaaggaucua

SEQ ID NO: 1270926 - RNA, 20 nt, Human
uacuuugggcaauacaaagu

SEQ ID NO: 1270927 - RNA, 21 nt, Human
uagcaccgccgggaggcuccu

SEQ ID NO: 1270928 - RNA, 21 nt, Human
uaucaaagguuuucugaaauc

SEQ ID NO: 1270929 - RNA, 22 nt, Human
uaucagauuuugggcugacuuu

SEQ ID NO: 1270930 - RNA, 20 nt, Human
uauuacacaucuguauuuaa

SEQ ID NO: 1270931 - RNA, 23 nt, Human
uauuugccaacauuaauuauuuc

SEQ ID NO: 1270932 - RNA, 23 nt, Human
ucaaagguuuucugaaauccuag

SEQ ID NO: 1270933 - RNA, 19 nt, Human
ucacaaaaacuuagguuua

SEQ ID NO: 1270934 - RNA, 22 nt, Human
ucaguucauuucugcuacaaua

SEQ ID NO: 1270935 - RNA, 20 nt, Human
uccuaggaguagggaauacc

SEQ ID NO: 1270936 - RNA, 21 nt, Human
ucucugguuugaugcaucacu

SEQ ID NO: 1270937 - RNA, 20 nt, Human
ucugaaauccuaggaguagg

SEQ ID NO: 1270938 - RNA, 21 nt, Human
ugaaacuacuguagcauccuc

SEQ ID NO: 1270939 - RNA, 20 nt, Human
ugaaggugcuuuguuucaga

SEQ ID NO: 1270940 - RNA, 21 nt, Human
ugacuggcagaaauucucugg

SEQ ID NO: 1270941 - RNA, 21 nt, Human
ugcacaguggucacaugugac

SEQ ID NO: 1270942 - RNA, 23 nt, Human
ugcuuauuuccaaagaaaccaua

SEQ ID NO: 1270943 - RNA, 18 nt, Human
uggcuccuuggcgccccc

SEQ ID NO: 1270944 - RNA, 22 nt, Human
ugggagguggaggguagcaccc

SEQ ID NO: 1270945 - RNA, 19 nt, Human
uggguccacaacacugaac

SEQ ID NO: 1270946 - RNA, 23 nt, Human
uguacagagggguauuuggggau

SEQ ID NO: 1270947 - RNA, 24 nt, Human
uguacagagggguauuuggggauu

SEQ ID NO: 1270948 - RNA, 22 nt, Human
ugucauuuuuuucauauuccca

SEQ ID NO: 1270949 - RNA, 24 nt, Human
ugugugugauuaucaaacccauau

SEQ ID NO: 1270950 - RNA, 19 nt, Human
uuacuugguuagacaugau

SEQ ID NO: 1270951 - RNA, 22 nt, Human
uucucugguuugaugcaucacu

SEQ ID NO: 1270952 - RNA, 18 nt, Human
uugaugaagaauguuuua

SEQ ID NO: 1270953 - RNA, 19 nt, Human
uugugcacugaagaaguau

SEQ ID NO: 1270954 - RNA, 20 nt, Human
uuuaaacaugacuuugugca

SEQ ID NO: 1270955 - RNA, 24 nt, Human
uuuaauauccugagaguuaagauu

SEQ ID NO: 1270956 - RNA, 20 nt, Human
uuucuuggacuucauucuga

SEQ ID NO: 1270957 - RNA, 19 nt, Human
uuuggcuucuugguacagu

SEQ ID NO: 1270958 - RNA, 22 nt, Human
aaaacaccuaaguaacauuucc

SEQ ID NO: 1270959 - RNA, 18 nt, Human
aaaacccaauccauccac

SEQ ID NO: 1270960 - RNA, 31 nt, Human
aaaauaccuauacacacacacacacacacag

SEQ ID NO: 1270961 - RNA, 23 nt, Human
aaacaagaacacaugagaacaca

SEQ ID NO: 1270962 - RNA, 23 nt, Human
aaaggcaucucuaccacccaaaa

SEQ ID NO: 1270963 - RNA, 25 nt, Human
aaaggcaucucuaccacccaaaaac

SEQ ID NO: 1270964 - RNA, 29 nt, Human
aaagugcacaugcacacacacacacacac

SEQ ID NO: 1270965 - RNA, 19 nt, Human
aaauaccauauacuauucu

SEQ ID NO: 1270966 - RNA, 18 nt, Human
aaauaccuauacacacac

SEQ ID NO: 1270967 - RNA, 24 nt, Human
aagcuuacaugccugagacuucaa

SEQ ID NO: 1270968 - RNA, 23 nt, Human
acacacacacacacacacacaca

SEQ ID NO: 1270969 - RNA, 23 nt, Human
acacacacacacacacacacaca

SEQ ID NO: 1270970 - RNA, 23 nt, Human
acacacacacacacacacacaca

SEQ ID NO: 1270971 - RNA, 23 nt, Human
acacacacacacacacacacaca

SEQ ID NO: 1270972 - RNA, 23 nt, Human
acacacacacacacacacacaca

SEQ ID NO: 1270973 - RNA, 23 nt, Human
acacacacacacacacacacaca

SEQ ID NO: 1270974 - RNA, 23 nt, Human
acacacacacacacacacacaca

SEQ ID NO: 1270975 - RNA, 23 nt, Human
acacacacacacacacacacaca

SEQ ID NO: 1270976 - RNA, 23 nt, Human
acacacacacacacacacacaca

SEQ ID NO: 1270977 - RNA, 23 nt, Human
acacacacacacacacacacaca

SEQ ID NO: 1270978 - RNA, 23 nt, Human
acacacacacacacacacacaca

SEQ ID NO: 1270979 - RNA, 29 nt, Human
acacacacacacacacacacacagccuca

SEQ ID NO: 1270980 - RNA, 23 nt, Human
acacacacacacacacacacaua

SEQ ID NO: 1270981 - RNA, 23 nt, Human
acacacacacacacacacauaua

SEQ ID NO: 1270982 - RNA, 28 nt, Human
acacacacacacacacacauauagggau

SEQ ID NO: 1270983 - RNA, 19 nt, Human
acacagccucagaugccuc

SEQ ID NO: 1270984 - RNA, 27 nt, Human
acacagccucagaugccucuggaagag

SEQ ID NO: 1270985 - RNA, 25 nt, Human
acacgcacaaguuaguauucuuaca

SEQ ID NO: 1270986 - RNA, 21 nt, Human
acagaacgagacuccucuuaa

SEQ ID NO: 1270987 - RNA, 24 nt, Human
accacuguucacugacaaugcauu

SEQ ID NO: 1270988 - RNA, 23 nt, Human
acccaauccauccacucuaacug

SEQ ID NO: 1270989 - RNA, 19 nt, Human
acccuggucugaccacuuc

SEQ ID NO: 1270990 - RNA, 22 nt, Human
acucuuguugcccaggcuggag

SEQ ID NO: 1270991 - RNA, 20 nt, Human
acuuugaaaauguacuuaga

SEQ ID NO: 1270992 - RNA, 21 nt, Human
agaaagggagggagggaggga

SEQ ID NO: 1270993 - RNA, 19 nt, Human
agacuucaagucaaaguca

SEQ ID NO: 1270994 - RNA, 19 nt, Human
agaggugaugagaggcagc

SEQ ID NO: 1270995 - RNA, 20 nt, Human
agcaaaaagcaaucugugcu

SEQ ID NO: 1270996 - RNA, 24 nt, Human
agcaacaagcacaaucuccaaaaa

SEQ ID NO: 1270997 - RNA, 19 nt, Human
aggaagaagucagguagaa

SEQ ID NO: 1270998 - RNA, 19 nt, Human
aggaaggaaggaagaaagg

SEQ ID NO: 1270999 - RNA, 21 nt, Human
aggcagaggugaugagaggca

SEQ ID NO: 1271000 - RNA, 19 nt, Human
agugcagaggugagauaug

SEQ ID NO: 1271001 - RNA, 23 nt, Human
auaaaacaagaacacaugagaac

SEQ ID NO: 1271002 - RNA, 23 nt, Human
auauagggauggguggggguggg

SEQ ID NO: 1271003 - RNA, 23 nt, Human
augcacacacacacacacacaca

SEQ ID NO: 1271004 - RNA, 23 nt, Human
augcacacacacacacacacaca

SEQ ID NO: 1271005 - RNA, 21 nt, Human
augggaccaaaacccaaucca

SEQ ID NO: 1271006 - RNA, 23 nt, Human
auuucuguucuccaguuuggaga

SEQ ID NO: 1271007 - RNA, 19 nt, Human
caaaacccaauccauccac

SEQ ID NO: 1271008 - RNA, 22 nt, Human
caaaagcaaagccuugaccuuc

SEQ ID NO: 1271009 - RNA, 26 nt, Human
caaagcaacaagcacaaucuccaaaa

SEQ ID NO: 1271010 - RNA, 19 nt, Human
caaguuaaagcaauuacua

SEQ ID NO: 1271011 - RNA, 18 nt, Human
cacacacacacacacaca

SEQ ID NO: 1271012 - RNA, 18 nt, Human
cacacacacacacacaca

SEQ ID NO: 1271013 - RNA, 20 nt, Human
cacacacacacacacacaca

SEQ ID NO: 1271014 - RNA, 20 nt, Human
cacacacacacacacacaca

SEQ ID NO: 1271015 - RNA, 20 nt, Human
cacacacacacacacacaca

SEQ ID NO: 1271016 - RNA, 20 nt, Human
cacacacacacacacacaca

SEQ ID NO: 1271017 - RNA, 20 nt, Human
cacacacacacacacacaca

SEQ ID NO: 1271018 - RNA, 20 nt, Human
cacacacacacacacacaca

SEQ ID NO: 1271019 - RNA, 20 nt, Human
cacacacacacacacacaca

SEQ ID NO: 1271020 - RNA, 20 nt, Human
cacacacacacacacacaca

SEQ ID NO: 1271021 - RNA, 20 nt, Human
cacacacacacacacacaca

SEQ ID NO: 1271022 - RNA, 20 nt, Human
cacacacacacacacacaca

SEQ ID NO: 1271023 - RNA, 20 nt, Human
cacacacacacacacacaca

SEQ ID NO: 1271024 - RNA, 20 nt, Human
cacacacacacacacacaca

SEQ ID NO: 1271025 - RNA, 20 nt, Human
cacacacacacacacacaca

SEQ ID NO: 1271026 - RNA, 20 nt, Human
cacacacacacacacacaca

SEQ ID NO: 1271027 - RNA, 20 nt, Human
cacacacacacacacacaca

SEQ ID NO: 1271028 - RNA, 20 nt, Human
cacacacacacacacacaca

SEQ ID NO: 1271029 - RNA, 20 nt, Human
cacacacacacacacacaca

SEQ ID NO: 1271030 - RNA, 20 nt, Human
cacacacacacacacacaca

SEQ ID NO: 1271031 - RNA, 20 nt, Human
cacacacacacacacacaca

SEQ ID NO: 1271032 - RNA, 22 nt, Human
cacacacacacacacacacaca

SEQ ID NO: 1271033 - RNA, 22 nt, Human
cacacacacacacacacacaca

SEQ ID NO: 1271034 - RNA, 22 nt, Human
cacacacacacacacacacaca

SEQ ID NO: 1271035 - RNA, 22 nt, Human
cacacacacacacacacacaca

SEQ ID NO: 1271036 - RNA, 22 nt, Human
cacacacacacacacacacaca

SEQ ID NO: 1271037 - RNA, 22 nt, Human
cacacacacacacacacacaca

SEQ ID NO: 1271038 - RNA, 22 nt, Human
cacacacacacacacacacaca

SEQ ID NO: 1271039 - RNA, 22 nt, Human
cacacacacacacacacacaca

SEQ ID NO: 1271040 - RNA, 22 nt, Human
cacacacacacacacacacaca

SEQ ID NO: 1271041 - RNA, 26 nt, Human
cacacacacacacacacacacacaca

SEQ ID NO: 1271042 - RNA, 26 nt, Human
cacacacacacacacacacacacaca

SEQ ID NO: 1271043 - RNA, 26 nt, Human
cacacacacacacacacacacacaca

SEQ ID NO: 1271044 - RNA, 26 nt, Human
cacacacacacacacacacacacaca

SEQ ID NO: 1271045 - RNA, 26 nt, Human
cacacacacacacacacacacacaca

SEQ ID NO: 1271046 - RNA, 26 nt, Human
cacacacacacacacacacacacaca

SEQ ID NO: 1271047 - RNA, 26 nt, Human
cacacacacacacacacacacacaua

SEQ ID NO: 1271048 - RNA, 26 nt, Human
cacacacacacacacacacagccuca

SEQ ID NO: 1271049 - RNA, 20 nt, Human
cacacacacacacacacaua

SEQ ID NO: 1271050 - RNA, 22 nt, Human
cacacacacacacacacauaua

SEQ ID NO: 1271051 - RNA, 19 nt, Human
cacacacacacacacauau

SEQ ID NO: 1271052 - RNA, 20 nt, Human
cacacacagccucagaugcc

SEQ ID NO: 1271053 - RNA, 20 nt, Human
caccaacaagcaaagcaaca

SEQ ID NO: 1271054 - RNA, 20 nt, Human
cacccuuccucacagucaaa

SEQ ID NO: 1271055 - RNA, 24 nt, Human
cacucuuguugcccaggcuggagu

SEQ ID NO: 1271056 - RNA, 20 nt, Human
cacuucugccuagacaaggg

SEQ ID NO: 1271057 - RNA, 18 nt, Human
cagccucaugggaccaaa

SEQ ID NO: 1271058 - RNA, 23 nt, Human
caugacaaacacccauuuucaau

SEQ ID NO: 1271059 - RNA, 22 nt, Human
ccaaaacccaauccauccaccg

SEQ ID NO: 1271060 - RNA, 20 nt, Human
ccaacaagcaaagcaacaag

SEQ ID NO: 1271061 - RNA, 24 nt, Human
ccaacaagcaaagcaacaagcaca

SEQ ID NO: 1271062 - RNA, 20 nt, Human
ccaauccauccacucuaacu

SEQ ID NO: 1271063 - RNA, 19 nt, Human
ccaugacauuuccacauca

SEQ ID NO: 1271064 - RNA, 19 nt, Human
cccaggcuggagugcaacg

SEQ ID NO: 1271065 - RNA, 20 nt, Human
cccauguccaugacauuucc

SEQ ID NO: 1271066 - RNA, 19 nt, Human
ccccuggcugcaggugcgg

SEQ ID NO: 1271067 - RNA, 19 nt, Human
ccucuaaggacuuagcaaa

SEQ ID NO: 1271068 - RNA, 20 nt, Human
ccuuuuauucaacuuuccua

SEQ ID NO: 1271069 - RNA, 21 nt, Human
cucuaccacccaaaaacucaa

SEQ ID NO: 1271070 - RNA, 18 nt, Human
cucuuguugcccaggcug

SEQ ID NO: 1271071 - RNA, 19 nt, Human
cugaaaaaugcaagucacc

SEQ ID NO: 1271072 - RNA, 21 nt, Human
cugagcacccuuccucacagu

SEQ ID NO: 1271073 - RNA, 19 nt, Human
cuggagccccacgacaugc

SEQ ID NO: 1271074 - RNA, 24 nt, Human
cuggagugcaacggcgugaucuca

SEQ ID NO: 1271075 - RNA, 23 nt, Human
cugugaaccucucuucccaguuu

SEQ ID NO: 1271076 - RNA, 20 nt, Human
cuguuccugagcacccuucc

SEQ ID NO: 1271077 - RNA, 21 nt, Human
cuuagacuaaguacacaauga

SEQ ID NO: 1271078 - RNA, 18 nt, Human
cuuguagccuuuucuuuc

SEQ ID NO: 1271079 - RNA, 26 nt, Human
cuuguagccuuuucuuucacuuucuu

SEQ ID NO: 1271080 - RNA, 24 nt, Human
cuuguugcccaggcuggagugcaa

SEQ ID NO: 1271081 - RNA, 21 nt, Human
gaaagucaccaugacaaacac

SEQ ID NO: 1271082 - RNA, 22 nt, Human
gagacagaguuucacucuuguu

SEQ ID NO: 1271083 - RNA, 21 nt, Human
gagggaggaagggagggaggg

SEQ ID NO: 1271084 - RNA, 19 nt, Human
gagggagggagggagggag

SEQ ID NO: 1271085 - RNA, 19 nt, Human
gagggagggagggagggag

SEQ ID NO: 1271086 - RNA, 20 nt, Human
gagggagggagggagggagg

SEQ ID NO: 1271087 - RNA, 20 nt, Human
gagggagggagggagggagg

SEQ ID NO: 1271088 - RNA, 23 nt, Human
gagggaggguaagaagcaauagg

SEQ ID NO: 1271089 - RNA, 21 nt, Human
gcaaaaagcaaucugugcuua

SEQ ID NO: 1271090 - RNA, 27 nt, Human
gcaaagcaacaagcacaaucuccaaaa

SEQ ID NO: 1271091 - RNA, 24 nt, Human
gcccaggcuggagugcaacggcgu

SEQ ID NO: 1271092 - RNA, 19 nt, Human
gcuggagugcaacggcgug

SEQ ID NO: 1271093 - RNA, 21 nt, Human
ggaagggagggaggguaagaa

SEQ ID NO: 1271094 - RNA, 23 nt, Human
ggaagggagggaggguaagaagc

SEQ ID NO: 1271095 - RNA, 21 nt, Human
ggaggaagggagggaggguaa

SEQ ID NO: 1271096 - RNA, 20 nt, Human
ggagggagggaggaagggag

SEQ ID NO: 1271097 - RNA, 19 nt, Human
ggagggagggagggaggaa

SEQ ID NO: 1271098 - RNA, 19 nt, Human
ggagggagggagggaggaa

SEQ ID NO: 1271099 - RNA, 19 nt, Human
ggagggagggagggaggga

SEQ ID NO: 1271100 - RNA, 19 nt, Human
ggagggagggagggaggga

SEQ ID NO: 1271101 - RNA, 20 nt, Human
ggagggagggagggagggag

SEQ ID NO: 1271102 - RNA, 20 nt, Human
ggagggagggagggagggag

SEQ ID NO: 1271103 - RNA, 23 nt, Human
ggagggagggagggagggaggaa

SEQ ID NO: 1271104 - RNA, 20 nt, Human
gggagggagggaggaaggga

SEQ ID NO: 1271105 - RNA, 21 nt, Human
gggagggagggaggaagggag

SEQ ID NO: 1271106 - RNA, 25 nt, Human
gggugggggugggggggagaaaacc

SEQ ID NO: 1271107 - RNA, 21 nt, Human
ggugaugagaggcagcaaaaa

SEQ ID NO: 1271108 - RNA, 24 nt, Human
guaacauuuccucuaaggacuuag

SEQ ID NO: 1271109 - RNA, 22 nt, Human
guagccuuuucuuucacuuucu

SEQ ID NO: 1271110 - RNA, 21 nt, Human
gucacuuucaauauucugcaa

SEQ ID NO: 1271111 - RNA, 20 nt, Human
uaaaaagcauguucuuauaa

SEQ ID NO: 1271112 - RNA, 24 nt, Human
uaaaaagcauguucuuauaaaaca

SEQ ID NO: 1271113 - RNA, 22 nt, Human
uaaugcacgaaacauaugcaug

SEQ ID NO: 1271114 - RNA, 26 nt, Human
uacaaaguccaccauguuugugaaag

SEQ ID NO: 1271115 - RNA, 25 nt, Human
uacacacacacacacacacacacac

SEQ ID NO: 1271116 - RNA, 24 nt, Human
uacacucccuuugcacuaguagcc

SEQ ID NO: 1271117 - RNA, 22 nt, Human
uagaaacuagaacugccaauga

SEQ ID NO: 1271118 - RNA, 19 nt, Human
uagaaucauaagaagucac

SEQ ID NO: 1271119 - RNA, 23 nt, Human
uagccugggauccccuggcugca

SEQ ID NO: 1271120 - RNA, 18 nt, Human
uaguagaaauaaugcacg

SEQ ID NO: 1271121 - RNA, 23 nt, Human
uaguagccugggauccccuggcu

SEQ ID NO: 1271122 - RNA, 21 nt, Human
uauaaucucugagaccccaua

SEQ ID NO: 1271123 - RNA, 25 nt, Human
uauacacacacacacacacacacac

SEQ ID NO: 1271124 - RNA, 25 nt, Human
uauacacacacacacacacacacag

SEQ ID NO: 1271125 - RNA, 20 nt, Human
uauacagauuaauaugcaau

SEQ ID NO: 1271126 - RNA, 21 nt, Human
uaucaggaauggagcuaugac

SEQ ID NO: 1271127 - RNA, 18 nt, Human
uauucagugguuccaguu

SEQ ID NO: 1271128 - RNA, 20 nt, Human
ucaaaagcaaagccuugacu

SEQ ID NO: 1271129 - RNA, 22 nt, Human
ucacucuuguugcccaggcugg

SEQ ID NO: 1271130 - RNA, 23 nt, Human
ucacucuuguugcccaggcugga

SEQ ID NO: 1271131 - RNA, 22 nt, Human
ucagaugccucuggaagagaca

SEQ ID NO: 1271132 - RNA, 23 nt, Human
ucauaacaaauacugaaaugcag

SEQ ID NO: 1271133 - RNA, 20 nt, Human
ucauaagaagucacucaagg

SEQ ID NO: 1271134 - RNA, 18 nt, Human
uccaaagauuuuacucag

SEQ ID NO: 1271135 - RNA, 18 nt, Human
ucccacaaggaacucuag

SEQ ID NO: 1271136 - RNA, 21 nt, Human
uccugagcacccuuccucaca

SEQ ID NO: 1271137 - RNA, 21 nt, Human
ucuaugauacaguauaaaaag

SEQ ID NO: 1271138 - RNA, 19 nt, Human
ucuccaguuuggagagcuc

SEQ ID NO: 1271139 - RNA, 25 nt, Human
ucucugagaccccauaaccuguaga

SEQ ID NO: 1271140 - RNA, 23 nt, Human
ucucuucaaaccacuguaagggc

SEQ ID NO: 1271141 - RNA, 21 nt, Human
ucugaccacuucugccuagga

SEQ ID NO: 1271142 - RNA, 23 nt, Human
ucugagaccccauaaccuguaga

SEQ ID NO: 1271143 - RNA, 20 nt, Human
ucugucuugaggcagagguc

SEQ ID NO: 1271144 - RNA, 24 nt, Human
ucuguguaugauugccugcuacuu

SEQ ID NO: 1271145 - RNA, 26 nt, Human
ucuucaaaccacuguaagggcaaaua

SEQ ID NO: 1271146 - RNA, 22 nt, Human
ucuuguugcccaggcuggagug

SEQ ID NO: 1271147 - RNA, 22 nt, Human
ugaaaauauuucuguucuccag

SEQ ID NO: 1271148 - RNA, 22 nt, Human
ugaagagaaugaauuccaauca

SEQ ID NO: 1271149 - RNA, 24 nt, Human
ugagaacacaugaguauaaugucu

SEQ ID NO: 1271150 - RNA, 26 nt, Human
ugagcacccuuccucacagucaaaac

SEQ ID NO: 1271151 - RNA, 23 nt, Human
ugauacaguauaaaaagcauguu

SEQ ID NO: 1271152 - RNA, 21 nt, Human
ugaugagaggcagcaaaaagc

SEQ ID NO: 1271153 - RNA, 20 nt, Human
ugcaauuucuggagccccac

SEQ ID NO: 1271154 - RNA, 25 nt, Human
ugcacacacacacacacacacacac

SEQ ID NO: 1271155 - RNA, 23 nt, Human
ugcagucaaaauucaucuacccc

SEQ ID NO: 1271156 - RNA, 18 nt, Human
ugcccaggcuggagugca

SEQ ID NO: 1271157 - RNA, 21 nt, Human
ugcccaggcuggagugcaacg

SEQ ID NO: 1271158 - RNA, 19 nt, Human
uggagugcaacggcgugau

SEQ ID NO: 1271159 - RNA, 20 nt, Human
ugguuuuggguucauugugu

SEQ ID NO: 1271160 - RNA, 21 nt, Human
ugugaaccucucuucccaguu

SEQ ID NO: 1271161 - RNA, 18 nt, Human
ugugaccacuguucacug

SEQ ID NO: 1271162 - RNA, 20 nt, Human
uguugcccaggcuggagugc

SEQ ID NO: 1271163 - RNA, 26 nt, Human
uucaacuuuccuaagcaggaaaacaa

SEQ ID NO: 1271164 - RNA, 21 nt, Human
uucaagucaaagucaauuugc

SEQ ID NO: 1271165 - RNA, 21 nt, Human
uucacauuuuguagaaagcuu

SEQ ID NO: 1271166 - RNA, 24 nt, Human
uucacucuuguugcccaggcugga

SEQ ID NO: 1271167 - RNA, 24 nt, Human
uucacuuugaaaauguacuuagac

SEQ ID NO: 1271168 - RNA, 24 nt, Human
uuccacaucaugaaugugaccacu

SEQ ID NO: 1271169 - RNA, 33 nt, Human
uucccaaagugcacaugcacacacacacacagu

SEQ ID NO: 1271170 - RNA, 23 nt, Human
uugaaaauauuucuguucuccag

SEQ ID NO: 1271171 - RNA, 19 nt, Human
uugaagcauggauucacau

SEQ ID NO: 1271172 - RNA, 24 nt, Human
uugaagcauggauucacauuuugu

SEQ ID NO: 1271173 - RNA, 18 nt, Human
uugcccaggcuggagugc

SEQ ID NO: 1271174 - RNA, 24 nt, Human
uuucacucuuguugcccaggcugg

SEQ ID NO: 1271175 - RNA, 24 nt, Human
uuuuucuaugcuccccaguggcug

SEQ ID NO: 1271176 - RNA, 23 nt, Human
agcguucgggccgcucgcccuuc

SEQ ID NO: 1271177 - RNA, 19 nt, Human
caaaagcugcccauugcac

SEQ ID NO: 1271178 - RNA, 21 nt, Human
cauugcacuuugacccuuuaa

SEQ ID NO: 1271179 - RNA, 21 nt, Human
cauugcacuuugacccuuuaa

SEQ ID NO: 1271180 - RNA, 22 nt, Human
ccaguuaguugcccccaaaauc

SEQ ID NO: 1271181 - RNA, 19 nt, Human
ccccaaaaucaaaagcugc

SEQ ID NO: 1271182 - RNA, 24 nt, Human
cccccaaaaucaaaagcugcccau

SEQ ID NO: 1271183 - RNA, 18 nt, Human
cccgcgcgcuuguccccg

SEQ ID NO: 1271184 - RNA, 19 nt, Human
cccgcgcgcuuguccccgc

SEQ ID NO: 1271185 - RNA, 20 nt, Human
cccgcgcgcuuguccccgca

SEQ ID NO: 1271186 - RNA, 21 nt, Human
cccgcgcgcuuguccccgcag

SEQ ID NO: 1271187 - RNA, 18 nt, Human
ccgcagccgcggcugcug

SEQ ID NO: 1271188 - RNA, 25 nt, Human
cugcagccgcagccgcggcugcugc

SEQ ID NO: 1271189 - RNA, 24 nt, Human
guccuagucaccacugcagccgca

SEQ ID NO: 1271190 - RNA, 21 nt, Human
uccuagucaccacugcagccg

SEQ ID NO: 1271191 - RNA, 23 nt, Human
uccuagucaccacugcagccgca

SEQ ID NO: 1271192 - RNA, 23 nt, Human
uuccugcccgccggaccuccgag

SEQ ID NO: 1271193 - RNA, 20 nt, Human
aagcaaaauauauuguaauu

SEQ ID NO: 1271194 - RNA, 21 nt, Human
cccaagacaucagauaauuuu

SEQ ID NO: 1271195 - RNA, 22 nt, Human
gagaagcucugaacuuaggcaa

SEQ ID NO: 1271196 - RNA, 23 nt, Human
uaaaacagagagaagcucugaac

SEQ ID NO: 1271197 - RNA, 20 nt, Human
ugcccaagacaucagauaau

SEQ ID NO: 1271198 - RNA, 22 nt, Human
uguaaaacagagagaagcucug

SEQ ID NO: 1271199 - RNA, 23 nt, Human
uguaaaacagagagaagcucuga

SEQ ID NO: 1271200 - RNA, 23 nt, Human
uguuguuguuuucucuuuuucuc

SEQ ID NO: 1271201 - RNA, 23 nt, Human
uguuguuuucucuuuuucucugu

SEQ ID NO: 1271202 - RNA, 19 nt, Human
uuccagaaaggcaguugga

SEQ ID NO: 1271203 - RNA, 21 nt, Human
uuguuguuguuuucucuuuuu

SEQ ID NO: 1271204 - RNA, 19 nt, Human
aaacaugucuugccuccca

SEQ ID NO: 1271205 - RNA, 18 nt, Human
aacuauaucccaaccacc

SEQ ID NO: 1271206 - RNA, 20 nt, Human
aagcacacguucccagaauc

SEQ ID NO: 1271207 - RNA, 22 nt, Human
acacaaaaucuggaaguccaca

SEQ ID NO: 1271208 - RNA, 18 nt, Human
acagucugaucucucuuu

SEQ ID NO: 1271209 - RNA, 21 nt, Human
acucagcacaccaaggaccug

SEQ ID NO: 1271210 - RNA, 26 nt, Human
agaaggucagcaaaaaacaugugagc

SEQ ID NO: 1271211 - RNA, 23 nt, Human
agacagacucagucucugcccuc

SEQ ID NO: 1271212 - RNA, 23 nt, Human
agagaaacgacagugggcccagg

SEQ ID NO: 1271213 - RNA, 18 nt, Human
aggucuuuagaucauaac

SEQ ID NO: 1271214 - RNA, 23 nt, Human
agguucuggagguagacagugaa

SEQ ID NO: 1271215 - RNA, 18 nt, Human
auggagacaaguaaacag

SEQ ID NO: 1271216 - RNA, 22 nt, Human
caagacagacucagucucugcc

SEQ ID NO: 1271217 - RNA, 18 nt, Human
caagggaagguacuauga

SEQ ID NO: 1271218 - RNA, 22 nt, Human
caccauagggcgguuuuucucc

SEQ ID NO: 1271219 - RNA, 20 nt, Human
cacuuccaguuguccugccu

SEQ ID NO: 1271220 - RNA, 21 nt, Human
cagcaaaaaaggaauguagca

SEQ ID NO: 1271221 - RNA, 22 nt, Human
cagcacaccaaggaccugcacc

SEQ ID NO: 1271222 - RNA, 24 nt, Human
cagcacaccaaggaccugcaccgg

SEQ ID NO: 1271223 - RNA, 22 nt, Human
cagcccuggaucccuuaaaccu

SEQ ID NO: 1271224 - RNA, 25 nt, Human
caggagaacacccaagcauucccca

SEQ ID NO: 1271225 - RNA, 24 nt, Human
cagggugauaauaaggagaagguc

SEQ ID NO: 1271226 - RNA, 20 nt, Human
cccaaacaucucaguggagu

SEQ ID NO: 1271227 - RNA, 21 nt, Human
ccugagggcuguaucacaggc

SEQ ID NO: 1271228 - RNA, 20 nt, Human
cggccucugaguucccucag

SEQ ID NO: 1271229 - RNA, 22 nt, Human
cugcaaacaugucuugccuccc

SEQ ID NO: 1271230 - RNA, 18 nt, Human
cugcaagaggcuuuccuc

SEQ ID NO: 1271231 - RNA, 23 nt, Human
cugcggcuuuccacaguacauug

SEQ ID NO: 1271232 - RNA, 24 nt, Human
cuuaaaccuugauuucauacaaca

SEQ ID NO: 1271233 - RNA, 21 nt, Human
gagaacacccaagcauucccc

SEQ ID NO: 1271234 - RNA, 18 nt, Human
gagguucuggagguagac

SEQ ID NO: 1271235 - RNA, 22 nt, Human
gauucugugugagguucuggag

SEQ ID NO: 1271236 - RNA, 20 nt, Human
gcacaccaaggaccugcacc

SEQ ID NO: 1271237 - RNA, 21 nt, Human
gcccuggaucccuuaaaccuu

SEQ ID NO: 1271238 - RNA, 20 nt, Human
gggcagaggucccugcggcu

SEQ ID NO: 1271239 - RNA, 24 nt, Human
gggcugggggacggucaggucuuu

SEQ ID NO: 1271240 - RNA, 18 nt, Human
gucucugcccucggguag

SEQ ID NO: 1271241 - RNA, 21 nt, Human
guucaagggaagguacuauga

SEQ ID NO: 1271242 - RNA, 22 nt, Human
uaacaaggcacauccugcacag

SEQ ID NO: 1271243 - RNA, 23 nt, Human
uaagcacacguucccagaaucuc

SEQ ID NO: 1271244 - RNA, 20 nt, Human
uaaggagcuuccaggagaac

SEQ ID NO: 1271245 - RNA, 23 nt, Human
uaaggagcuuccaggagaacacc

SEQ ID NO: 1271246 - RNA, 23 nt, Human
uacacaaaaucuggaaguccaca

SEQ ID NO: 1271247 - RNA, 24 nt, Human
uaccccgcuuucaagggcagaggu

SEQ ID NO: 1271248 - RNA, 21 nt, Human
uacuaagugccagauucugug

SEQ ID NO: 1271249 - RNA, 19 nt, Human
uaugacuggacgugcacgu

SEQ ID NO: 1271250 - RNA, 24 nt, Human
ucacguggggagaaaccuuggaca

SEQ ID NO: 1271251 - RNA, 21 nt, Human
ucagcaaaaaacaugugagca

SEQ ID NO: 1271252 - RNA, 21 nt, Human
ucagcaaaaaaggaauguagc

SEQ ID NO: 1271253 - RNA, 20 nt, Human
ucaggucuuucucaucccac

SEQ ID NO: 1271254 - RNA, 23 nt, Human
ucccuuucuacauagacacagua

SEQ ID NO: 1271255 - RNA, 19 nt, Human
ugaacaaauguacaaucgg

SEQ ID NO: 1271256 - RNA, 22 nt, Human
ugauuaaaauaaggagcuucca

SEQ ID NO: 1271257 - RNA, 19 nt, Human
ugcuuguaaacauuuuguu

SEQ ID NO: 1271258 - RNA, 22 nt, Human
uguagcaggagagcagggugau

SEQ ID NO: 1271259 - RNA, 26 nt, Human
uguccugccuuucuggacugaacaaa

SEQ ID NO: 1271260 - RNA, 18 nt, Human
ugugagcuccagguuggg

SEQ ID NO: 1271261 - RNA, 20 nt, Human
uguuaaagacucaguauacu

SEQ ID NO: 1271262 - RNA, 19 nt, Human
uuacugcaaacaugucuug

SEQ ID NO: 1271263 - RNA, 27 nt, Human
uucagcaaaaaaggaauguagcaggag

SEQ ID NO: 1271264 - RNA, 21 nt, Human
uucccagaaucuccugagggc

SEQ ID NO: 1271265 - RNA, 22 nt, Human
uucccugcacccaggucuuuag

SEQ ID NO: 1271266 - RNA, 25 nt, Human
uucucaucccacgaggccauauuuc

SEQ ID NO: 1271267 - RNA, 21 nt, Human
uugguacaaaugaauaccccg

SEQ ID NO: 1271268 - RNA, 22 nt, Human
uuuauacaauaagaggauaaaa

SEQ ID NO: 1271269 - RNA, 25 nt, Human
uuuauacauguuagaaauuuauaca

SEQ ID NO: 1271270 - RNA, 22 nt, Human
aaacauggucacaauauucaca

SEQ ID NO: 1271271 - RNA, 22 nt, Human
aaacuagcacuaucuuguuaca

SEQ ID NO: 1271272 - RNA, 25 nt, Human
aaaguacucccuuaccuucuccuca

SEQ ID NO: 1271273 - RNA, 23 nt, Human
aaagucuuacaagaaaggcaaga

SEQ ID NO: 1271274 - RNA, 22 nt, Human
aaauccucacagaaaugaagaa

SEQ ID NO: 1271275 - RNA, 24 nt, Human
aaauccucacagaaaugaagaaga

SEQ ID NO: 1271276 - RNA, 24 nt, Human
aagaaaggcaagaguuugggaggg

SEQ ID NO: 1271277 - RNA, 18 nt, Human
aaggagccaacacaucug

SEQ ID NO: 1271278 - RNA, 20 nt, Human
aaugaugcaacgauggaugg

SEQ ID NO: 1271279 - RNA, 22 nt, Human
aaugggaugguugguuacccua

SEQ ID NO: 1271280 - RNA, 23 nt, Human
aauucaccuccccaaacucacca

SEQ ID NO: 1271281 - RNA, 18 nt, Human
acaaagcacaccaauuaa

SEQ ID NO: 1271282 - RNA, 24 nt, Human
acaaggcauugaauggauaagauc

SEQ ID NO: 1271283 - RNA, 23 nt, Human
acacaaugcucucaaugcuaaaa

SEQ ID NO: 1271284 - RNA, 22 nt, Human
acauauuaaagauuacaagacc

SEQ ID NO: 1271285 - RNA, 24 nt, Human
acgagaagucuuacgacaaagcca

SEQ ID NO: 1271286 - RNA, 23 nt, Human
acucaccaaaguacucccuuacc

SEQ ID NO: 1271287 - RNA, 24 nt, Human
acucccuuaccuucuccucagugg

SEQ ID NO: 1271288 - RNA, 20 nt, Human
acuuacaaugacagccaucu

SEQ ID NO: 1271289 - RNA, 22 nt, Human
acuucagauucuugauuuuuuu

SEQ ID NO: 1271290 - RNA, 23 nt, Human
agauaugacagaaauuggcuuua

SEQ ID NO: 1271291 - RNA, 24 nt, Human
agaugauuugaaacuccuguuuuc

SEQ ID NO: 1271292 - RNA, 21 nt, Human
aggcaggaggggaggcacaug

SEQ ID NO: 1271293 - RNA, 20 nt, Human
auuucccuucuucuuugucc

SEQ ID NO: 1271294 - RNA, 23 nt, Human
caaagcacaccaauuaauccagc

SEQ ID NO: 1271295 - RNA, 20 nt, Human
caaaguacucccuuaccuuc

SEQ ID NO: 1271296 - RNA, 22 nt, Human
caaaguacucccuuaccuucuc

SEQ ID NO: 1271297 - RNA, 23 nt, Human
caacaauauuuuaugauuucagc

SEQ ID NO: 1271298 - RNA, 23 nt, Human
caaugcuaaaaugggaugguugg

SEQ ID NO: 1271299 - RNA, 22 nt, Human
cacacgucuaaagagguuaccu

SEQ ID NO: 1271300 - RNA, 23 nt, Human
cacaggcaaagucgaagaugaac

SEQ ID NO: 1271301 - RNA, 21 nt, Human
caccuccccaaacucaccaaa

SEQ ID NO: 1271302 - RNA, 20 nt, Human
cagcaguuucauuaaaaucc

SEQ ID NO: 1271303 - RNA, 19 nt, Human
caguggcuuuuuggggguc

SEQ ID NO: 1271304 - RNA, 20 nt, Human
caguguugggauucauuuug

SEQ ID NO: 1271305 - RNA, 18 nt, Human
cauagagcaaucaaggga

SEQ ID NO: 1271306 - RNA, 26 nt, Human
cauccccuucuccaccauguccaauc

SEQ ID NO: 1271307 - RNA, 23 nt, Human
caugacaguggcuuuuugggggu

SEQ ID NO: 1271308 - RNA, 22 nt, Human
cauuuucuuugguaagaaguuu

SEQ ID NO: 1271309 - RNA, 20 nt, Human
ccagccugugcuccuucugc

SEQ ID NO: 1271310 - RNA, 25 nt, Human
ccccaaacucaccaaaguacucccu

SEQ ID NO: 1271311 - RNA, 24 nt, Human
ccuccccaaacucaccaaaguacu

SEQ ID NO: 1271312 - RNA, 27 nt, Human
ccuuccauuucugugaagucaaaaauc

SEQ ID NO: 1271313 - RNA, 22 nt, Human
cuaaaacuuacggguuuugugc

SEQ ID NO: 1271314 - RNA, 21 nt, Human
cucauuaucugaccucuuaga

SEQ ID NO: 1271315 - RNA, 23 nt, Human
cuccauaugugcuugcacauccc

SEQ ID NO: 1271316 - RNA, 18 nt, Human
cucccuuaccuucuccuc

SEQ ID NO: 1271317 - RNA, 19 nt, Human
cugcucaggcagggccuca

SEQ ID NO: 1271318 - RNA, 20 nt, Human
cugcuccucauuuucaaaug

SEQ ID NO: 1271319 - RNA, 25 nt, Human
gaagaugauuugaaacuccuguuuu

SEQ ID NO: 1271320 - RNA, 21 nt, Human
gagccaacacaucuguuauca

SEQ ID NO: 1271321 - RNA, 20 nt, Human
gaggauauuuuagcugcaau

SEQ ID NO: 1271322 - RNA, 24 nt, Human
gauggaugaccauucugaacuacc

SEQ ID NO: 1271323 - RNA, 19 nt, Human
gcagcugcuauuuuugacu

SEQ ID NO: 1271324 - RNA, 23 nt, Human
gccaacacaucuguuaucaaaaa

SEQ ID NO: 1271325 - RNA, 22 nt, Human
gcuugcacauccccuucuccac

SEQ ID NO: 1271326 - RNA, 20 nt, Human
ggcagggccucacgggaugg

SEQ ID NO: 1271327 - RNA, 22 nt, Human
ggcuggcugcucaggcagggcc

SEQ ID NO: 1271328 - RNA, 20 nt, Human
ggggaugguccacgaccucu

SEQ ID NO: 1271329 - RNA, 24 nt, Human
gugcccugcaaagauuuucuucac

SEQ ID NO: 1271330 - RNA, 22 nt, Human
guggauccugagccugcuccuc

SEQ ID NO: 1271331 - RNA, 28 nt, Human
uaaacuagcacuaucuuguuacaaagca

SEQ ID NO: 1271332 - RNA, 18 nt, Human
uaaccaaaagcuuucauu

SEQ ID NO: 1271333 - RNA, 19 nt, Human
uacaagaaaggcaagaguu

SEQ ID NO: 1271334 - RNA, 22 nt, Human
uacaagaaaggcaagaguuugg

SEQ ID NO: 1271335 - RNA, 18 nt, Human
uacggguuuugugcauuu

SEQ ID NO: 1271336 - RNA, 19 nt, Human
uacugcugugguuuguugc

SEQ ID NO: 1271337 - RNA, 19 nt, Human
uagaaaccaggauuguugg

SEQ ID NO: 1271338 - RNA, 28 nt, Human
ucaaauguucagaaacucaguuugucuc

SEQ ID NO: 1271339 - RNA, 21 nt, Human
ucacaauauucacaauguuaa

SEQ ID NO: 1271340 - RNA, 20 nt, Human
uccagaggcaggaggggagg

SEQ ID NO: 1271341 - RNA, 18 nt, Human
uccagggaagggucuccc

SEQ ID NO: 1271342 - RNA, 21 nt, Human
uccauccaucaucaaaauuac

SEQ ID NO: 1271343 - RNA, 19 nt, Human
ucccuuaccuucuccucag

SEQ ID NO: 1271344 - RNA, 23 nt, Human
ucccuucuucuuuguccagagga

SEQ ID NO: 1271345 - RNA, 23 nt, Human
uccuagugaugacagagacacag

SEQ ID NO: 1271346 - RNA, 21 nt, Human
uccucacagaaaugaagaaga

SEQ ID NO: 1271347 - RNA, 22 nt, Human
uccucacagaaaugaagaagau

SEQ ID NO: 1271348 - RNA, 20 nt, Human
ucucaaugcuaaaaugggau

SEQ ID NO: 1271349 - RNA, 24 nt, Human
ucugaacuacaaauuaugguugcc

SEQ ID NO: 1271350 - RNA, 19 nt, Human
ucuucaugacaguggcuuu

SEQ ID NO: 1271351 - RNA, 19 nt, Human
ucuucugggggcacccugg

SEQ ID NO: 1271352 - RNA, 20 nt, Human
ucuuggucuuccaguguugg

SEQ ID NO: 1271353 - RNA, 23 nt, Human
ugaaaaguaaccaaaagcuuuca

SEQ ID NO: 1271354 - RNA, 22 nt, Human
ugacagagacacagguacuaau

SEQ ID NO: 1271355 - RNA, 24 nt, Human
ugagagacagauucauaaaaauca

SEQ ID NO: 1271356 - RNA, 24 nt, Human
ugagccugcuccucauuuucaaau

SEQ ID NO: 1271357 - RNA, 21 nt, Human
ugauuucuauccucuggcccc

SEQ ID NO: 1271358 - RNA, 23 nt, Human
ugauuuggcauauuacuuaaaau

SEQ ID NO: 1271359 - RNA, 20 nt, Human
ugccauuaaccaaagggcua

SEQ ID NO: 1271360 - RNA, 21 nt, Human
ugcccaugcuaauucagcagc

SEQ ID NO: 1271361 - RNA, 23 nt, Human
ugcugugguuuguugccuauuuu

SEQ ID NO: 1271362 - RNA, 20 nt, Human
ugcuuucagacccucuaaaa

SEQ ID NO: 1271363 - RNA, 18 nt, Human
uggaaauaaauaaaaacu

SEQ ID NO: 1271364 - RNA, 20 nt, Human
uggauccugagccugcuccu

SEQ ID NO: 1271365 - RNA, 18 nt, Human
uggcagcccagccugugc

SEQ ID NO: 1271366 - RNA, 19 nt, Human
uggcuuugggaguucaggu

SEQ ID NO: 1271367 - RNA, 22 nt, Human
ugggaugguugguuacccuauu

SEQ ID NO: 1271368 - RNA, 21 nt, Human
ugggauucauuuugggggaug

SEQ ID NO: 1271369 - RNA, 19 nt, Human
ugggggaugguccacgacc

SEQ ID NO: 1271370 - RNA, 23 nt, Human
uggggguccaugcuauggcagcc

SEQ ID NO: 1271371 - RNA, 19 nt, Human
uggguugccauuaaccaaa

SEQ ID NO: 1271372 - RNA, 18 nt, Human
uguaguaugcucuguuuu

SEQ ID NO: 1271373 - RNA, 25 nt, Human
ugucacauuuaagcaacucacaucc

SEQ ID NO: 1271374 - RNA, 23 nt, Human
ugugcauuuccuccaaccuucca

SEQ ID NO: 1271375 - RNA, 18 nt, Human
uguggauccugagccugc

SEQ ID NO: 1271376 - RNA, 24 nt, Human
uuaauccacaggcaaagucgaaga

SEQ ID NO: 1271377 - RNA, 21 nt, Human
uuacggguuuugugcauuucc

SEQ ID NO: 1271378 - RNA, 23 nt, Human
uucaagauagcaaacgucaaccc

SEQ ID NO: 1271379 - RNA, 18 nt, Human
uucaguaguauguguccu

SEQ ID NO: 1271380 - RNA, 21 nt, Human
uucauagagcaaucaagggaa

SEQ ID NO: 1271381 - RNA, 19 nt, Human
uucauuuucuuugguaaga

SEQ ID NO: 1271382 - RNA, 18 nt, Human
uucccuucuucuuugucc

SEQ ID NO: 1271383 - RNA, 18 nt, Human
uugcacauccccuucucc

SEQ ID NO: 1271384 - RNA, 19 nt, Human
uugccuauuuuccugaugg

SEQ ID NO: 1271385 - RNA, 23 nt, Human
uuuaagauaucuguaacguggau

SEQ ID NO: 1271386 - RNA, 20 nt, Human
uuuagcaucguuucuauggc

SEQ ID NO: 1271387 - RNA, 23 nt, Human
uuucagauuucaaacaaugucaa

SEQ ID NO: 1271388 - RNA, 23 nt, Human
uuucuauccucuggccccuuuag

SEQ ID NO: 1271389 - RNA, 22 nt, Human
uuugacugagcauuggugucuu

SEQ ID NO: 1271390 - RNA, 24 nt, Human
uuugauagacaauguugcuuucag

SEQ ID NO: 1271391 - RNA, 23 nt, Human
uuuugguuauuuaccuuccuagu

SEQ ID NO: 1271392 - RNA, 18 nt, Human
aagggagggagcgaggcc

SEQ ID NO: 1271393 - RNA, 23 nt, Human
aggugaagggagggagcgaggcc

SEQ ID NO: 1271394 - RNA, 21 nt, Human
caggagaggaaaggugaaggg

SEQ ID NO: 1271395 - RNA, 21 nt, Human
cauuucucaagugucuacaug

SEQ ID NO: 1271396 - RNA, 23 nt, Human
cccgccaggagaggaaaggugaa

SEQ ID NO: 1271397 - RNA, 18 nt, Human
cccgccgccgggcccgcc

SEQ ID NO: 1271398 - RNA, 19 nt, Human
cgccgccgggcccgccagg

SEQ ID NO: 1271399 - RNA, 24 nt, Human
cugucugaagacacagugugccac

SEQ ID NO: 1271400 - RNA, 24 nt, Human
cuucaaacagaaacauuucucaag

SEQ ID NO: 1271401 - RNA, 19 nt, Human
gacuucuguuucucccucu

SEQ ID NO: 1271402 - RNA, 19 nt, Human
gagaggaaaggugaaggga

SEQ ID NO: 1271403 - RNA, 24 nt, Human
gcccgccaggagaggaaaggugaa

SEQ ID NO: 1271404 - RNA, 19 nt, Human
ggaagagguucuucucugg

SEQ ID NO: 1271405 - RNA, 20 nt, Human
uccccgguaacacgccccgu

SEQ ID NO: 1271406 - RNA, 23 nt, Human
ucuguuucucccucuauuuucuu

SEQ ID NO: 1271407 - RNA, 21 nt, Human
ugaagggagggagcgaggccg

SEQ ID NO: 1271408 - RNA, 19 nt, Human
ugugccacagacuuaagac

SEQ ID NO: 1271409 - RNA, 22 nt, Human
uuuacuggaauuuuacauuuuc

SEQ ID NO: 1271410 - RNA, 20 nt, Human
acaaucaaauguuuacagca

SEQ ID NO: 1271411 - RNA, 21 nt, Human
gcagugaagaggcaaauaagu

SEQ ID NO: 1271412 - RNA, 24 nt, Human
gcagugaagaggcaaauaagugaa

SEQ ID NO: 1271413 - RNA, 21 nt, Human
ggaagaggacuuaaccuuggc

SEQ ID NO: 1271414 - RNA, 18 nt, Human
ggagaacacgaucacagc

SEQ ID NO: 1271415 - RNA, 23 nt, Human
uacagcagugaagaggcaaauaa

SEQ ID NO: 1271416 - RNA, 23 nt, Human
uggccacaaucaaauguuuacag

SEQ ID NO: 1271417 - RNA, 19 nt, Human
aaacucaaacacacaaaca

SEQ ID NO: 1271418 - RNA, 22 nt, Human
aaccacaaucagauuuacagcc

SEQ ID NO: 1271419 - RNA, 18 nt, Human
aaccagaaucuucuuuau

SEQ ID NO: 1271420 - RNA, 20 nt, Human
aacccacacucccacuccca

SEQ ID NO: 1271421 - RNA, 22 nt, Human
aagaagagaaagucuuccaagg

SEQ ID NO: 1271422 - RNA, 21 nt, Human
aagaagccagccucuugcagg

SEQ ID NO: 1271423 - RNA, 26 nt, Human
aagacacauauacacaaacacaaagu

SEQ ID NO: 1271424 - RNA, 19 nt, Human
acaaacacaaacaugugca

SEQ ID NO: 1271425 - RNA, 19 nt, Human
acucauucuuccuccugcc

SEQ ID NO: 1271426 - RNA, 18 nt, Human
acucccacccccaacccu

SEQ ID NO: 1271427 - RNA, 19 nt, Human
acucccacccccaacccua

SEQ ID NO: 1271428 - RNA, 28 nt, Human
acucccacccccaacccuaccccuaaaa

SEQ ID NO: 1271429 - RNA, 24 nt, Human
agaauuuuuuuuuccuguuucaca

SEQ ID NO: 1271430 - RNA, 19 nt, Human
agacacauauacacaaaca

SEQ ID NO: 1271431 - RNA, 19 nt, Human
agacuuggaacugccaaua

SEQ ID NO: 1271432 - RNA, 20 nt, Human
agcaugaccauuccuccuca

SEQ ID NO: 1271433 - RNA, 18 nt, Human
auccaugagaaauggggc

SEQ ID NO: 1271434 - RNA, 22 nt, Human
caaacaguaauaccuacaagaa

SEQ ID NO: 1271435 - RNA, 22 nt, Human
caaaguacccaggauccacgca

SEQ ID NO: 1271436 - RNA, 19 nt, Human
cacacucccacucccaccc

SEQ ID NO: 1271437 - RNA, 21 nt, Human
cacacucccacucccaccccc

SEQ ID NO: 1271438 - RNA, 22 nt, Human
cacacucccacucccaccccca

SEQ ID NO: 1271439 - RNA, 23 nt, Human
cacccccaacccuaccccuaaaa

SEQ ID NO: 1271440 - RNA, 26 nt, Human
cagcauauuaaacaguucucuugcuu

SEQ ID NO: 1271441 - RNA, 20 nt, Human
cagggcacggguagguuaag

SEQ ID NO: 1271442 - RNA, 18 nt, Human
cagggcccuacagccccc

SEQ ID NO: 1271443 - RNA, 24 nt, Human
cauauacacaaacacaaacaugug

SEQ ID NO: 1271444 - RNA, 19 nt, Human
ccaaaguacccaggaucca

SEQ ID NO: 1271445 - RNA, 19 nt, Human
ccaaaguacccaggaucca

SEQ ID NO: 1271446 - RNA, 21 nt, Human
ccaacccacacucccacuccc

SEQ ID NO: 1271447 - RNA, 25 nt, Human
ccaacccacacucccacucccaccc

SEQ ID NO: 1271448 - RNA, 23 nt, Human
ccaacccuaccccuaaaauugga

SEQ ID NO: 1271449 - RNA, 18 nt, Human
ccacauccugagacuugg

SEQ ID NO: 1271450 - RNA, 19 nt, Human
ccacucccacccccaaccc

SEQ ID NO: 1271451 - RNA, 21 nt, Human
cccacacucccacucccaccc

SEQ ID NO: 1271452 - RNA, 24 nt, Human
cccacacucccacucccaccccca

SEQ ID NO: 1271453 - RNA, 18 nt, Human
cccacccccaacccuacc

SEQ ID NO: 1271454 - RNA, 19 nt, Human
cccccagcuggccagggag

SEQ ID NO: 1271455 - RNA, 20 nt, Human
cccuaaaauuggaucgaacc

SEQ ID NO: 1271456 - RNA, 22 nt, Human
cccucacuguccaaaguaccca

SEQ ID NO: 1271457 - RNA, 18 nt, Human
ccucuugcagggcacggg

SEQ ID NO: 1271458 - RNA, 25 nt, Human
cucacuguccaaaguacccaggauc

SEQ ID NO: 1271459 - RNA, 18 nt, Human
cucccacucccaccccca

SEQ ID NO: 1271460 - RNA, 22 nt, Human
cucccacucccacccccaaccc

SEQ ID NO: 1271461 - RNA, 23 nt, Human
gacaagaagagaaagucuuccaa

SEQ ID NO: 1271462 - RNA, 18 nt, Human
gacagcaacaaccaaaac

SEQ ID NO: 1271463 - RNA, 21 nt, Human
gaccaagcccagcagggcccu

SEQ ID NO: 1271464 - RNA, 25 nt, Human
gacucauucuuccuccugccaaccc

SEQ ID NO: 1271465 - RNA, 19 nt, Human
gacuuggaacugccaauag

SEQ ID NO: 1271466 - RNA, 24 nt, Human
gagcuauggagccacagagcaggc

SEQ ID NO: 1271467 - RNA, 25 nt, Human
uaaaagacacauauacacaaacaca

SEQ ID NO: 1271468 - RNA, 21 nt, Human
uaaagcccagucagcaaaugu

SEQ ID NO: 1271469 - RNA, 24 nt, Human
uacacaaacacaaacaugugcagu

SEQ ID NO: 1271470 - RNA, 24 nt, Human
uauacacaaacacaaacaugugca

SEQ ID NO: 1271471 - RNA, 18 nt, Human
uaugaccacauccugaga

SEQ ID NO: 1271472 - RNA, 19 nt, Human
ucccacccccaacccuacc

SEQ ID NO: 1271473 - RNA, 21 nt, Human
ucccacccccaacccuacccc

SEQ ID NO: 1271474 - RNA, 20 nt, Human
uccucaguuuuucuucggcc

SEQ ID NO: 1271475 - RNA, 23 nt, Human
uccugccaacccacacucccacu

SEQ ID NO: 1271476 - RNA, 21 nt, Human
ucuccuggaucuccccucuug

SEQ ID NO: 1271477 - RNA, 21 nt, Human
ugacaagaagagaaagucuuc

SEQ ID NO: 1271478 - RNA, 23 nt, Human
ugacagcaacaaccaaaaccaca

SEQ ID NO: 1271479 - RNA, 28 nt, Human
ugaccaagaagccagccucuugcagggc

SEQ ID NO: 1271480 - RNA, 23 nt, Human
ugacuuaauugucuccaaaguag

SEQ ID NO: 1271481 - RNA, 22 nt, Human
ugccaacccacacucccacucc

SEQ ID NO: 1271482 - RNA, 25 nt, Human
ugccaacccacacucccacucccac

SEQ ID NO: 1271483 - RNA, 21 nt, Human
uuaaaagacacauauacacaa

SEQ ID NO: 1271484 - RNA, 18 nt, Human
uuaaagcccagucagcaa

SEQ ID NO: 1271485 - RNA, 25 nt, Human
uucacaaauaaggaaacuuggaucc

SEQ ID NO: 1271486 - RNA, 22 nt, Human
uuccaaggaagcaugaccauuc

SEQ ID NO: 1271487 - RNA, 18 nt, Human
uucuuccguucccuaucu

SEQ ID NO: 1271488 - RNA, 19 nt, Human
uugcagauugacucuuaau

SEQ ID NO: 1271489 - RNA, 24 nt, Human
uuggauccuagaagcuaaauuagu

SEQ ID NO: 1271490 - RNA, 19 nt, Human
aaacacaauuuagaccaug

SEQ ID NO: 1271491 - RNA, 23 nt, Human
aaauacacaccaaaaaaaagcac

SEQ ID NO: 1271492 - RNA, 23 nt, Human
aaauuucuuuccaggagcuuucc

SEQ ID NO: 1271493 - RNA, 24 nt, Human
aauaauaacagugacaacagcaau

SEQ ID NO: 1271494 - RNA, 23 nt, Human
aaugaaauacacaccaaaaaaaa

SEQ ID NO: 1271495 - RNA, 23 nt, Human
acagagaaguugggccuugaggg

SEQ ID NO: 1271496 - RNA, 22 nt, Human
acuaaaauauaaggcuuuucug

SEQ ID NO: 1271497 - RNA, 23 nt, Human
acugcugaucugcccaaaacccu

SEQ ID NO: 1271498 - RNA, 23 nt, Human
agaaagccucuucucuaugaaaa

SEQ ID NO: 1271499 - RNA, 18 nt, Human
agaacacguuccccauug

SEQ ID NO: 1271500 - RNA, 19 nt, Human
agccagaggaggguggggu

SEQ ID NO: 1271501 - RNA, 20 nt, Human
aggagggugggguuucacaa

SEQ ID NO: 1271502 - RNA, 21 nt, Human
agggggagggaacaaacagaa

SEQ ID NO: 1271503 - RNA, 21 nt, Human
aucaggaagauacugcccaaa

SEQ ID NO: 1271504 - RNA, 23 nt, Human
aucucuuuuuaaaagcacagcca

SEQ ID NO: 1271505 - RNA, 21 nt, Human
augcaacacaccaagggccag

SEQ ID NO: 1271506 - RNA, 25 nt, Human
caaaaaaaagcacacaugcagauaa

SEQ ID NO: 1271507 - RNA, 19 nt, Human
caccaaaaaaaagcacaca

SEQ ID NO: 1271508 - RNA, 21 nt, Human
caccaaaaaaaagcacacaug

SEQ ID NO: 1271509 - RNA, 24 nt, Human
caccaaaaaaaagcacacaugcag

SEQ ID NO: 1271510 - RNA, 26 nt, Human
caccaaaaaaaagcacacaugcagau

SEQ ID NO: 1271511 - RNA, 18 nt, Human
cagaggugaacugccuuc

SEQ ID NO: 1271512 - RNA, 21 nt, Human
cagccuuuuuuuccuccuccc

SEQ ID NO: 1271513 - RNA, 22 nt, Human
caucccauucaaucacacagcc

SEQ ID NO: 1271514 - RNA, 24 nt, Human
caucccauucaaucacacagccag

SEQ ID NO: 1271515 - RNA, 19 nt, Human
ccacuugaagucguucuga

SEQ ID NO: 1271516 - RNA, 19 nt, Human
ccauugcuuugcaagcauc

SEQ ID NO: 1271517 - RNA, 20 nt, Human
cccauucaaucacacagcca

SEQ ID NO: 1271518 - RNA, 19 nt, Human
ccccaugacuugcuuucag

SEQ ID NO: 1271519 - RNA, 19 nt, Human
cccuguuucccucccuucu

SEQ ID NO: 1271520 - RNA, 27 nt, Human
cccuguuucccucccuucuuuccuucc

SEQ ID NO: 1271521 - RNA, 19 nt, Human
ccucccuucuuuccuuccu

SEQ ID NO: 1271522 - RNA, 19 nt, Human
ccuugggaaaggcucugcc

SEQ ID NO: 1271523 - RNA, 18 nt, Human
cucccggaaaccugcccc

SEQ ID NO: 1271524 - RNA, 24 nt, Human
cucccggaaaccugccccgagaac

SEQ ID NO: 1271525 - RNA, 24 nt, Human
cucccuguuucccucccuucuuuc

SEQ ID NO: 1271526 - RNA, 20 nt, Human
cucccuucuuuccuuccuuu

SEQ ID NO: 1271527 - RNA, 21 nt, Human
cuuacugcugaucugcccaaa

SEQ ID NO: 1271528 - RNA, 22 nt, Human
cuucuuagaauucacugaagua

SEQ ID NO: 1271529 - RNA, 21 nt, Human
cuuuuuggcaucugcucccgg

SEQ ID NO: 1271530 - RNA, 22 nt, Human
gagcagaggugaacugccuucu

SEQ ID NO: 1271531 - RNA, 19 nt, Human
ggagcuaugcaacacacca

SEQ ID NO: 1271532 - RNA, 21 nt, Human
gggaacaaacagaaacauaac

SEQ ID NO: 1271533 - RNA, 19 nt, Human
gugggguuucacaagacca

SEQ ID NO: 1271534 - RNA, 19 nt, Human
uaaaagcacagccacuguc

SEQ ID NO: 1271535 - RNA, 24 nt, Human
uaacauacaaaguuagucucagga

SEQ ID NO: 1271536 - RNA, 24 nt, Human
uaauucacaaacaaucaaauccuu

SEQ ID NO: 1271537 - RNA, 19 nt, Human
uacacaccaaaaaaaagca

SEQ ID NO: 1271538 - RNA, 20 nt, Human
uagaauucacugaaguauuu

SEQ ID NO: 1271539 - RNA, 26 nt, Human
uagcuaagaagacaucaggaagauac

SEQ ID NO: 1271540 - RNA, 22 nt, Human
uauuacaauauagacagagaag

SEQ ID NO: 1271541 - RNA, 19 nt, Human
uauuuauauuuuuuaauga

SEQ ID NO: 1271542 - RNA, 21 nt, Human
ucaaagcuuaucuuugugccc

SEQ ID NO: 1271543 - RNA, 22 nt, Human
uccacgugguuggaauaaacac

SEQ ID NO: 1271544 - RNA, 24 nt, Human
ucuauauuacaauauagacagaga

SEQ ID NO: 1271545 - RNA, 19 nt, Human
ucucaggugaggugaaccu

SEQ ID NO: 1271546 - RNA, 19 nt, Human
ucugcagauacauucacuu

SEQ ID NO: 1271547 - RNA, 24 nt, Human
ucugcagauacauucacuuaguuc

SEQ ID NO: 1271548 - RNA, 24 nt, Human
ucuuuccaggagcuuuccacgugg

SEQ ID NO: 1271549 - RNA, 24 nt, Human
ugaaauacacaccaaaaaaaagca

SEQ ID NO: 1271550 - RNA, 22 nt, Human
ugaucugcccaaaacccucuca

SEQ ID NO: 1271551 - RNA, 23 nt, Human
ugcuugaagccauuaaauauaug

SEQ ID NO: 1271552 - RNA, 18 nt, Human
uggaauaaacacaauuua

SEQ ID NO: 1271553 - RNA, 22 nt, Human
uguaaaauuucuuuccaggagc

SEQ ID NO: 1271554 - RNA, 18 nt, Human
uucacaaacaaucaaauc

SEQ ID NO: 1271555 - RNA, 19 nt, Human
uucacugaaguauuuccua

SEQ ID NO: 1271556 - RNA, 18 nt, Human
uugaaggguauaucaaau

SEQ ID NO: 1271557 - RNA, 21 nt, Human
uuggcaauugaaggguauauc

SEQ ID NO: 1271558 - RNA, 23 nt, Human
uuuccauuuuugagccauuaaaa

SEQ ID NO: 1271559 - RNA, 32 nt, Human
uuucccucccuucuuuccuuccuuucuucccc

SEQ ID NO: 1271560 - RNA, 19 nt, Human
uuuccuuccuuucuuccuu

SEQ ID NO: 1271561 - RNA, 24 nt, Human
uuuucuucuuuuucccuuucuccc

SEQ ID NO: 1271562 - RNA, 25 nt, Human
aaacugcauugaccaugggaaaguu

SEQ ID NO: 1271563 - RNA, 18 nt, Human
caagugauuuacaaugaa

SEQ ID NO: 1271564 - RNA, 21 nt, Human
caggacacacuagauacauua

SEQ ID NO: 1271565 - RNA, 23 nt, Human
ccaaagcaaggcugauaaaaacu

SEQ ID NO: 1271566 - RNA, 18 nt, Human
gauaaaaacugcauugac

SEQ ID NO: 1271567 - RNA, 23 nt, Human
ggaaagacagucaauaaaacaag

SEQ ID NO: 1271568 - RNA, 24 nt, Human
ggaaagcaaaugcugugcagccug

SEQ ID NO: 1271569 - RNA, 24 nt, Human
ggccugcauggaggaggugcugcu

SEQ ID NO: 1271570 - RNA, 22 nt, Human
ggucacacauggggcuggaggc

SEQ ID NO: 1271571 - RNA, 19 nt, Human
ggugcugcuguggucuggc

SEQ ID NO: 1271572 - RNA, 19 nt, Human
guccuuggagguccuaucc

SEQ ID NO: 1271573 - RNA, 19 nt, Human
gugcugcuguggucuggcc

SEQ ID NO: 1271574 - RNA, 19 nt, Human
uacauuaggagcacauagc

SEQ ID NO: 1271575 - RNA, 18 nt, Human
uaccuuuauuugaaaucu

SEQ ID NO: 1271576 - RNA, 23 nt, Human
uaggagcacauagcaaaguaaca

SEQ ID NO: 1271577 - RNA, 21 nt, Human
uaucuuaguuauucauucauu

SEQ ID NO: 1271578 - RNA, 22 nt, Human
uccaaagcaaggcugauaaaaa

SEQ ID NO: 1271579 - RNA, 18 nt, Human
ugacaagggucacacaug

SEQ ID NO: 1271580 - RNA, 20 nt, Human
ugcauggaggaggugcugcu

SEQ ID NO: 1271581 - RNA, 22 nt, Human
ugcauggaggaggugcugcugu

SEQ ID NO: 1271582 - RNA, 18 nt, Human
uguggggcagagagauga

SEQ ID NO: 1271583 - RNA, 23 nt, Human
aaacuaaaagagaauagcaucag

SEQ ID NO: 1271584 - RNA, 23 nt, Human
aaacuacuaaagaagucaggcgu

SEQ ID NO: 1271585 - RNA, 19 nt, Human
aaccaggcagggccuggcu

SEQ ID NO: 1271586 - RNA, 21 nt, Human
aacucacuagucccucacccu

SEQ ID NO: 1271587 - RNA, 23 nt, Human
aagcagacauaaagacaguugac

SEQ ID NO: 1271588 - RNA, 23 nt, Human
aagugaccuuucaaucuucagac

SEQ ID NO: 1271589 - RNA, 19 nt, Human
acaagcagacauaaagaca

SEQ ID NO: 1271590 - RNA, 19 nt, Human
acaaguuauuucgucuccc

SEQ ID NO: 1271591 - RNA, 22 nt, Human
acauaguagaacucaaaaauau

SEQ ID NO: 1271592 - RNA, 24 nt, Human
accacugccaacuccucuacuaca

SEQ ID NO: 1271593 - RNA, 21 nt, Human
acccaccccgucaccugaccu

SEQ ID NO: 1271594 - RNA, 21 nt, Human
agaagaaaaacuaaaagagaa

SEQ ID NO: 1271595 - RNA, 22 nt, Human
agaagaggcaauugauuuagcg

SEQ ID NO: 1271596 - RNA, 24 nt, Human
agaaguagaagaaaaacuaaaaga

SEQ ID NO: 1271597 - RNA, 25 nt, Human
agaaguagaagaaaaacuaaaagag

SEQ ID NO: 1271598 - RNA, 21 nt, Human
agaauagcaucagauaaaaca

SEQ ID NO: 1271599 - RNA, 18 nt, Human
agagaauagcaucagaua

SEQ ID NO: 1271600 - RNA, 22 nt, Human
agcccacacuaguaaccaggca

SEQ ID NO: 1271601 - RNA, 24 nt, Human
aggccacucaucccugcacuccac

SEQ ID NO: 1271602 - RNA, 25 nt, Human
agggaagaagucugaagcgugggug

SEQ ID NO: 1271603 - RNA, 19 nt, Human
agguuguuuuuagugucua

SEQ ID NO: 1271604 - RNA, 21 nt, Human
aguauggggaucagggaagaa

SEQ ID NO: 1271605 - RNA, 21 nt, Human
agucccucacccuaagcugga

SEQ ID NO: 1271606 - RNA, 18 nt, Human
auauuugcuaaaugagag

SEQ ID NO: 1271607 - RNA, 24 nt, Human
auuguuucacaacauucccuagga

SEQ ID NO: 1271608 - RNA, 19 nt, Human
caagauccagguuaauccc

SEQ ID NO: 1271609 - RNA, 23 nt, Human
cacauaguagaacucaaaaauau

SEQ ID NO: 1271610 - RNA, 23 nt, Human
cacauauacacacaaccuaugca

SEQ ID NO: 1271611 - RNA, 25 nt, Human
cacauauacacacaaccuaugcaca

SEQ ID NO: 1271612 - RNA, 24 nt, Human
caccccgucaccugaccuuaugcu

SEQ ID NO: 1271613 - RNA, 20 nt, Human
cacuaguaaccaggcagggc

SEQ ID NO: 1271614 - RNA, 19 nt, Human
cacuccacuaucccucacc

SEQ ID NO: 1271615 - RNA, 21 nt, Human
cagaaaugccacacaggcuuu

SEQ ID NO: 1271616 - RNA, 19 nt, Human
cagauggccugcuucugcu

SEQ ID NO: 1271617 - RNA, 19 nt, Human
caggacccuaaggaauguc

SEQ ID NO: 1271618 - RNA, 24 nt, Human
caguugacauuuccaaaaaggcac

SEQ ID NO: 1271619 - RNA, 23 nt, Human
ccaauuaacagacauuuaaaacc

SEQ ID NO: 1271620 - RNA, 24 nt, Human
ccacgcaguaccacugccaacucc

SEQ ID NO: 1271621 - RNA, 20 nt, Human
ccacuaucccucaccuucuc

SEQ ID NO: 1271622 - RNA, 22 nt, Human
ccagcccacacuaguaaccagg

SEQ ID NO: 1271623 - RNA, 18 nt, Human
cccaccccgucaccugac

SEQ ID NO: 1271624 - RNA, 18 nt, Human
ccccaagauuuuaggacc

SEQ ID NO: 1271625 - RNA, 22 nt, Human
ccuucucacauauacacacaac

SEQ ID NO: 1271626 - RNA, 22 nt, Human
cgugaggagcucccuaaugacu

SEQ ID NO: 1271627 - RNA, 24 nt, Human
cgugaggagcucccuaaugacuug

SEQ ID NO: 1271628 - RNA, 22 nt, Human
cucaucccugcacuccacuauc

SEQ ID NO: 1271629 - RNA, 21 nt, Human
cuccacuaucccucaccuucu

SEQ ID NO: 1271630 - RNA, 20 nt, Human
cucuccuuuggcugaaaaug

SEQ ID NO: 1271631 - RNA, 25 nt, Human
cugaaucaaaagcugaauuguuuca

SEQ ID NO: 1271632 - RNA, 19 nt, Human
cuggucacuagggaggggc

SEQ ID NO: 1271633 - RNA, 24 nt, Human
cuuccaauuaacagacauuuaaaa

SEQ ID NO: 1271634 - RNA, 30 nt, Human
cuucugcugcaaaaugagcugggguccagg

SEQ ID NO: 1271635 - RNA, 22 nt, Human
gaaguggagacaauuacauaga

SEQ ID NO: 1271636 - RNA, 25 nt, Human
gaaguucucuuauauccuuuaucuu

SEQ ID NO: 1271637 - RNA, 18 nt, Human
gagaggugaagaagugga

SEQ ID NO: 1271638 - RNA, 18 nt, Human
gagagucaguagaggaca

SEQ ID NO: 1271639 - RNA, 22 nt, Human
gcacuccccacuauuuggaggc

SEQ ID NO: 1271640 - RNA, 18 nt, Human
gcagucuucaaucccacg

SEQ ID NO: 1271641 - RNA, 19 nt, Human
ggaaugucagcauuuaaaa

SEQ ID NO: 1271642 - RNA, 19 nt, Human
ggacauguuguccuucccc

SEQ ID NO: 1271643 - RNA, 21 nt, Human
gggcaggacccuaaggaaugu

SEQ ID NO: 1271644 - RNA, 20 nt, Human
gugaagaaguggagacaauu

SEQ ID NO: 1271645 - RNA, 19 nt, Human
uaaaaccuacucaauuuga

SEQ ID NO: 1271646 - RNA, 18 nt, Human
uaaaaggcacgcaagaac

SEQ ID NO: 1271647 - RNA, 19 nt, Human
uaaaaugcaccucucuccu

SEQ ID NO: 1271648 - RNA, 21 nt, Human
uaaccuucuugauguccagca

SEQ ID NO: 1271649 - RNA, 18 nt, Human
uaaggaauuaucagagaa

SEQ ID NO: 1271650 - RNA, 21 nt, Human
uaagugauccccuugccuaaa

SEQ ID NO: 1271651 - RNA, 20 nt, Human
uaaugcaucuguuucagcuu

SEQ ID NO: 1271652 - RNA, 20 nt, Human
uacaagcagacauaaagaca

SEQ ID NO: 1271653 - RNA, 22 nt, Human
uacaagcagacauaaagacagu

SEQ ID NO: 1271654 - RNA, 22 nt, Human
uagaaaaagcacauuuuaaaag

SEQ ID NO: 1271655 - RNA, 22 nt, Human
uagaagaaaaacuaaaagagaa

SEQ ID NO: 1271656 - RNA, 22 nt, Human
uagaagaaaaacuaaaagagaa

SEQ ID NO: 1271657 - RNA, 25 nt, Human
uagccaggccacucaucccugcacu

SEQ ID NO: 1271658 - RNA, 24 nt, Human
uauagagucaaaauucuauucccu

SEQ ID NO: 1271659 - RNA, 21 nt, Human
uaucuucaucaccuagcccag

SEQ ID NO: 1271660 - RNA, 27 nt, Human
uccaaaaaggcacacguaauuuaugaa

SEQ ID NO: 1271661 - RNA, 20 nt, Human
ucccugcacuccacuauccc

SEQ ID NO: 1271662 - RNA, 22 nt, Human
ucccugcacuccacuaucccuc

SEQ ID NO: 1271663 - RNA, 20 nt, Human
ucuagcagucuucaaucccc

SEQ ID NO: 1271664 - RNA, 21 nt, Human
ucuaggcuucuuuugaaguuc

SEQ ID NO: 1271665 - RNA, 20 nt, Human
ucucacauauacacacaacc

SEQ ID NO: 1271666 - RNA, 21 nt, Human
ucuucaaucccacgcaguacc

SEQ ID NO: 1271667 - RNA, 20 nt, Human
ugacauacacauaguagaac

SEQ ID NO: 1271668 - RNA, 22 nt, Human
ugacauuuccaaaaaggcacac

SEQ ID NO: 1271669 - RNA, 22 nt, Human
ugagagaaaaacauauuuugaa

SEQ ID NO: 1271670 - RNA, 19 nt, Human
ugcacuccacuaucccuca

SEQ ID NO: 1271671 - RNA, 19 nt, Human
ugcauggagaguuuugagu

SEQ ID NO: 1271672 - RNA, 22 nt, Human
ugcauggagaguuuugaguaua

SEQ ID NO: 1271673 - RNA, 20 nt, Human
ugccuagucacucucugucu

SEQ ID NO: 1271674 - RNA, 21 nt, Human
ugccuagucacucucugucuu

SEQ ID NO: 1271675 - RNA, 18 nt, Human
ugcucugccuagccaggc

SEQ ID NO: 1271676 - RNA, 21 nt, Human
uggcagcgugcaaugcaugga

SEQ ID NO: 1271677 - RNA, 22 nt, Human
ugggauuacuuagagagaguca

SEQ ID NO: 1271678 - RNA, 23 nt, Human
ugggauuacuuagagagagucag

SEQ ID NO: 1271679 - RNA, 19 nt, Human
uggucacuagggaggggcu

SEQ ID NO: 1271680 - RNA, 19 nt, Human
ugugcaauccucuucggug

SEQ ID NO: 1271681 - RNA, 19 nt, Human
uuaaaaggcacgcaagaac

SEQ ID NO: 1271682 - RNA, 19 nt, Human
uucaaaggacagcaaacuc

SEQ ID NO: 1271683 - RNA, 21 nt, Human
uucaaaggacagcaaacucac

SEQ ID NO: 1271684 - RNA, 21 nt, Human
uucacucuaaaucaacaguuu

SEQ ID NO: 1271685 - RNA, 22 nt, Human
uuccccaagauuuuaggaccua

SEQ ID NO: 1271686 - RNA, 20 nt, Human
uugcuggcucaacacugucu

SEQ ID NO: 1271687 - RNA, 22 nt, Human
uugcuggcucaacacugucugc

SEQ ID NO: 1271688 - RNA, 26 nt, Human
aaaauaaauccucccaacuaauuaga

SEQ ID NO: 1271689 - RNA, 19 nt, Human
aaacacaccccaccaucaa

SEQ ID NO: 1271690 - RNA, 20 nt, Human
aaacacaccccaccaucaac

SEQ ID NO: 1271691 - RNA, 21 nt, Human
aaacaggcaaagauucaaagu

SEQ ID NO: 1271692 - RNA, 20 nt, Human
aagacaaaaauucugaagga

SEQ ID NO: 1271693 - RNA, 22 nt, Human
aauucugaaggagauccugcua

SEQ ID NO: 1271694 - RNA, 22 nt, Human
acaccccaccaucaaccugaga

SEQ ID NO: 1271695 - RNA, 22 nt, Human
agacaaaaauucugaaggagau

SEQ ID NO: 1271696 - RNA, 22 nt, Human
caaaauaaauccucccaacuaa

SEQ ID NO: 1271697 - RNA, 24 nt, Human
caaacaggcaaagauucaaaguca

SEQ ID NO: 1271698 - RNA, 26 nt, Human
caaacaggcaaagauucaaagucaag

SEQ ID NO: 1271699 - RNA, 25 nt, Human
caaauaauguacuugucaugagccc

SEQ ID NO: 1271700 - RNA, 23 nt, Human
caacuaauuagaaacguaagaca

SEQ ID NO: 1271701 - RNA, 18 nt, Human
caagacaaaaauucugaa

SEQ ID NO: 1271702 - RNA, 24 nt, Human
cacaccccaccaucaaccugagac

SEQ ID NO: 1271703 - RNA, 19 nt, Human
caccaucaaccugagaccu

SEQ ID NO: 1271704 - RNA, 23 nt, Human
caccccaccaucaaccugagacc

SEQ ID NO: 1271705 - RNA, 23 nt, Human
cagcuucugacugauuggccaca

SEQ ID NO: 1271706 - RNA, 23 nt, Human
caggcaaagauucaaagucaaga

SEQ ID NO: 1271707 - RNA, 18 nt, Human
cccaccaucaaccugaga

SEQ ID NO: 1271708 - RNA, 20 nt, Human
cucuguuggucugcguaaga

SEQ ID NO: 1271709 - RNA, 25 nt, Human
cuucuugugguuacauguuuucaau

SEQ ID NO: 1271710 - RNA, 21 nt, Human
cuuugucacaugaaucuccua

SEQ ID NO: 1271711 - RNA, 18 nt, Human
gucugcguaagaugccac

SEQ ID NO: 1271712 - RNA, 24 nt, Human
uagaaacguaagacaauaaagacg

SEQ ID NO: 1271713 - RNA, 19 nt, Human
uagacaaacaggcaaagau

SEQ ID NO: 1271714 - RNA, 20 nt, Human
uagcaaaauaaauccuccca

SEQ ID NO: 1271715 - RNA, 25 nt, Human
uagcaaaauaaauccucccaacuaa

SEQ ID NO: 1271716 - RNA, 20 nt, Human
ucaagacaaaaauucugaag

SEQ ID NO: 1271717 - RNA, 19 nt, Human
ucacaaaauuucagaggca

SEQ ID NO: 1271718 - RNA, 23 nt, Human
uggccacagcuauagauccacgg

SEQ ID NO: 1271719 - RNA, 19 nt, Human
uuucagaggcaaaucuuug

SEQ ID NO: 1271720 - RNA, 20 nt, Human
uuugaaagguaccaaaauag

SEQ ID NO: 1271721 - RNA, 20 nt, Human
aaaaaaaaaaaacgaaccca

SEQ ID NO: 1271722 - RNA, 22 nt, Human
aaaaaaaaaaaacgaacccaac

SEQ ID NO: 1271723 - RNA, 20 nt, Human
aaaaaaaaacgaacccaaca

SEQ ID NO: 1271724 - RNA, 24 nt, Human
aaaaaaaaacgaacccaacaguuc

SEQ ID NO: 1271725 - RNA, 24 nt, Human
aaaaaaaaagaaaacaacacauag

SEQ ID NO: 1271726 - RNA, 19 nt, Human
aaaaaaaacgaacccaaca

SEQ ID NO: 1271727 - RNA, 25 nt, Human
aaaaaaacgaacccaacaguucaga

SEQ ID NO: 1271728 - RNA, 23 nt, Human
aaaagaaagaaagaaaaacaaaa

SEQ ID NO: 1271729 - RNA, 21 nt, Human
aaaagcuucuaaaguguuucu

SEQ ID NO: 1271730 - RNA, 23 nt, Human
aaaagcuucuaaaguguuucugg

SEQ ID NO: 1271731 - RNA, 22 nt, Human
aaaauaccuuuucccuucuuug

SEQ ID NO: 1271732 - RNA, 28 nt, Human
aaacaaaauuuuaaucccuagaccaaaa

SEQ ID NO: 1271733 - RNA, 21 nt, Human
aaauaguaaacaaucugaagc

SEQ ID NO: 1271734 - RNA, 18 nt, Human
aacaaaaacaaaaauacc

SEQ ID NO: 1271735 - RNA, 25 nt, Human
aaccugcugccuuuucagaggaccu

SEQ ID NO: 1271736 - RNA, 21 nt, Human
aacuccacagccccuugcccu

SEQ ID NO: 1271737 - RNA, 21 nt, Human
aagaaaacaacacauagccaa

SEQ ID NO: 1271738 - RNA, 21 nt, Human
aagaaagaaagaaaaacaaaa

SEQ ID NO: 1271739 - RNA, 23 nt, Human
aagcagaaauuggaagaggggac

SEQ ID NO: 1271740 - RNA, 20 nt, Human
acacacaucuccucccuucu

SEQ ID NO: 1271741 - RNA, 20 nt, Human
acacuaguagacaccaaacu

SEQ ID NO: 1271742 - RNA, 18 nt, Human
acauaacauuuccuucau

SEQ ID NO: 1271743 - RNA, 22 nt, Human
accacaucacuccagcauuuca

SEQ ID NO: 1271744 - RNA, 20 nt, Human
accccaaagaaauuagaaaa

SEQ ID NO: 1271745 - RNA, 23 nt, Human
accccaaagaaauuagaaaacca

SEQ ID NO: 1271746 - RNA, 21 nt, Human
acuauaguaacauuucaacac

SEQ ID NO: 1271747 - RNA, 21 nt, Human
acugguuuugugagcugucug

SEQ ID NO: 1271748 - RNA, 21 nt, Human
agaaaaccacaucacuccagc

SEQ ID NO: 1271749 - RNA, 18 nt, Human
agaaaugugaauuacccc

SEQ ID NO: 1271750 - RNA, 23 nt, Human
agacaccaaacuccacagccccu

SEQ ID NO: 1271751 - RNA, 20 nt, Human
agcuggcacuggcgguagca

SEQ ID NO: 1271752 - RNA, 20 nt, Human
aggaaaaaaagcuucuaaag

SEQ ID NO: 1271753 - RNA, 22 nt, Human
aggagaaggcagguuuuaggga

SEQ ID NO: 1271754 - RNA, 25 nt, Human
aggcauucaaagaucugaaagaacu

SEQ ID NO: 1271755 - RNA, 24 nt, Human
aggguucagugaaaaaaaaaaaaa

SEQ ID NO: 1271756 - RNA, 22 nt, Human
agugcaugccacagaaggacuc

SEQ ID NO: 1271757 - RNA, 21 nt, Human
agugcuugaauuuuucccaag

SEQ ID NO: 1271758 - RNA, 22 nt, Human
auccauucuaccucaugucccu

SEQ ID NO: 1271759 - RNA, 19 nt, Human
aucuuaaauaguaaacaau

SEQ ID NO: 1271760 - RNA, 19 nt, Human
caaaagaaauggaauuuua

SEQ ID NO: 1271761 - RNA, 28 nt, Human
caaacacaugacccagugcuguaaugac

SEQ ID NO: 1271762 - RNA, 19 nt, Human
caaaggcugucuguagguc

SEQ ID NO: 1271763 - RNA, 18 nt, Human
caacugguuuugugagcu

SEQ ID NO: 1271764 - RNA, 24 nt, Human
caauagcaauuggaaaaaauaaaa

SEQ ID NO: 1271765 - RNA, 19 nt, Human
cacagaaggacucuagcuc

SEQ ID NO: 1271766 - RNA, 27 nt, Human
caccaaacuccacagccccuugcccuc

SEQ ID NO: 1271767 - RNA, 19 nt, Human
cagccccuugcccuccuug

SEQ ID NO: 1271768 - RNA, 20 nt, Human
cagcuaccugcuggaaccug

SEQ ID NO: 1271769 - RNA, 23 nt, Human
cagcuaccugcuggaaccugcug

SEQ ID NO: 1271770 - RNA, 19 nt, Human
cagucccuuuccucggaau

SEQ ID NO: 1271771 - RNA, 23 nt, Human
caugugcggcuuuuagcugacua

SEQ ID NO: 1271772 - RNA, 26 nt, Human
cauuauggcuauaauaauguauugcc

SEQ ID NO: 1271773 - RNA, 21 nt, Human
cauucugcuccucuaaaugca

SEQ ID NO: 1271774 - RNA, 20 nt, Human
ccaaagaaauuagaaaacca

SEQ ID NO: 1271775 - RNA, 21 nt, Human
ccacuaaucuaaaaccaaagc

SEQ ID NO: 1271776 - RNA, 19 nt, Human
cccaaggaaaaaaagcuuc

SEQ ID NO: 1271777 - RNA, 23 nt, Human
cccccauuggggugguuggagug

SEQ ID NO: 1271778 - RNA, 20 nt, Human
cccuagaccaaaaaagggca

SEQ ID NO: 1271779 - RNA, 28 nt, Human
cccuccugaaccuggaguccaccucgcu

SEQ ID NO: 1271780 - RNA, 21 nt, Human
ccuccuuggcccuccauugua

SEQ ID NO: 1271781 - RNA, 23 nt, Human
ccuccuuggcccuccauuguaag

SEQ ID NO: 1271782 - RNA, 19 nt, Human
ccucucagcucagcuaccu

SEQ ID NO: 1271783 - RNA, 23 nt, Human
ccugaaccuggaguccaccucuc

SEQ ID NO: 1271784 - RNA, 20 nt, Human
ccugcagccacuauaguaac

SEQ ID NO: 1271785 - RNA, 18 nt, Human
ccugcuggaaccugcugc

SEQ ID NO: 1271786 - RNA, 20 nt, Human
ccugcuggaaccugcugccu

SEQ ID NO: 1271787 - RNA, 24 nt, Human
ccuuaaagcuguacacacaucucc

SEQ ID NO: 1271788 - RNA, 21 nt, Human
ccuugcccuccuuggcccucc

SEQ ID NO: 1271789 - RNA, 22 nt, Human
ccuugcccuccuuggcccucca

SEQ ID NO: 1271790 - RNA, 20 nt, Human
ccuuuucccuucuuuguucc

SEQ ID NO: 1271791 - RNA, 24 nt, Human
cgcuuuagaaggcaaagcuguguu

SEQ ID NO: 1271792 - RNA, 21 nt, Human
cuaaaaacaacaaauucaagg

SEQ ID NO: 1271793 - RNA, 24 nt, Human
cuaaaaccaaagcugugguaccug

SEQ ID NO: 1271794 - RNA, 24 nt, Human
cuauaguaacauuucaacacaaaa

SEQ ID NO: 1271795 - RNA, 21 nt, Human
cuccacagccccuugcccucc

SEQ ID NO: 1271796 - RNA, 21 nt, Human
cuccugaaccuggaguccacc

SEQ ID NO: 1271797 - RNA, 21 nt, Human
cugaaagaacuaaacauaaca

SEQ ID NO: 1271798 - RNA, 26 nt, Human
cugaaagcagaaauuggaagaguuau

SEQ ID NO: 1271799 - RNA, 19 nt, Human
cugccaggaguggucaaag

SEQ ID NO: 1271800 - RNA, 19 nt, Human
cuguacacacaucuccucc

SEQ ID NO: 1271801 - RNA, 20 nt, Human
gaaaaaaaaaaaaaaagaaa

SEQ ID NO: 1271802 - RNA, 23 nt, Human
gaaaaaaaaaaaaaaagaaagaa

SEQ ID NO: 1271803 - RNA, 18 nt, Human
gaaaaggggagaaggagu

SEQ ID NO: 1271804 - RNA, 19 nt, Human
gaaagaacuaaacauaaca

SEQ ID NO: 1271805 - RNA, 20 nt, Human
gaaguaaacacacaucuaaa

SEQ ID NO: 1271806 - RNA, 18 nt, Human
gagaaaaaugccaaauaa

SEQ ID NO: 1271807 - RNA, 23 nt, Human
gagauggaaguauuuuuuaaaau

SEQ ID NO: 1271808 - RNA, 20 nt, Human
gaggguggagggaagaagug

SEQ ID NO: 1271809 - RNA, 19 nt, Human
gaguuucucaguucugggc

SEQ ID NO: 1271810 - RNA, 22 nt, Human
gauaguuaaucuguugaguuuc

SEQ ID NO: 1271811 - RNA, 19 nt, Human
gaugggauuucuuuuuggu

SEQ ID NO: 1271812 - RNA, 22 nt, Human
gcaggaaaaaaaaaaaaaaaaa

SEQ ID NO: 1271813 - RNA, 21 nt, Human
gcuguacacacaucuccuccc

SEQ ID NO: 1271814 - RNA, 21 nt, Human
ggaaaaaauaaaaaugaaagc

SEQ ID NO: 1271815 - RNA, 20 nt, Human
ggaaagcugccaguggggcc

SEQ ID NO: 1271816 - RNA, 21 nt, Human
ggcaauagcaauuggaaaaaa

SEQ ID NO: 1271817 - RNA, 22 nt, Human
ggguucagugaaaaaaaaaaaa

SEQ ID NO: 1271818 - RNA, 24 nt, Human
gguucagugggaaaaggggagaag

SEQ ID NO: 1271819 - RNA, 19 nt, Human
gugagacaacugaaaugga

SEQ ID NO: 1271820 - RNA, 18 nt, Human
gugcaugccacagaagga

SEQ ID NO: 1271821 - RNA, 21 nt, Human
gugcaugccacagaaggacuc

SEQ ID NO: 1271822 - RNA, 18 nt, Human
guuggagugaggguggag

SEQ ID NO: 1271823 - RNA, 24 nt, Human
uaagaaauguuucaaggguccaaa

SEQ ID NO: 1271824 - RNA, 18 nt, Human
uaagaguaaacucaucca

SEQ ID NO: 1271825 - RNA, 20 nt, Human
uaagaguaaacucauccaca

SEQ ID NO: 1271826 - RNA, 19 nt, Human
uaaggcagauugggguucc

SEQ ID NO: 1271827 - RNA, 24 nt, Human
uaaucccuagaccaaaaaagggca

SEQ ID NO: 1271828 - RNA, 20 nt, Human
uacaaagagaaccacgcuau

SEQ ID NO: 1271829 - RNA, 23 nt, Human
uacacuaagaaauguuucaaggg

SEQ ID NO: 1271830 - RNA, 26 nt, Human
uaccccaaagaaauuagaagguccuc

SEQ ID NO: 1271831 - RNA, 18 nt, Human
uagaccaaaaaagggcag

SEQ ID NO: 1271832 - RNA, 25 nt, Human
uagaccaaaaaagggcagaauuugu

SEQ ID NO: 1271833 - RNA, 26 nt, Human
uauccaaaagaaauggaauuuuauuc

SEQ ID NO: 1271834 - RNA, 29 nt, Human
uauuuuuuaaaaucacauugugccuggau

SEQ ID NO: 1271835 - RNA, 18 nt, Human
ucaaggguccaaauguca

SEQ ID NO: 1271836 - RNA, 23 nt, Human
ucaaggguccaaaugucauuaaa

SEQ ID NO: 1271837 - RNA, 24 nt, Human
ucagugaaaaaaaaaaaaaaagaa

SEQ ID NO: 1271838 - RNA, 18 nt, Human
ucagugggaaaaggggag

SEQ ID NO: 1271839 - RNA, 23 nt, Human
ucagugggaaaaggggagaagga

SEQ ID NO: 1271840 - RNA, 19 nt, Human
uccacaguaguaguaagac

SEQ ID NO: 1271841 - RNA, 20 nt, Human
uccauacacagcugccaccg

SEQ ID NO: 1271842 - RNA, 22 nt, Human
uccauacacagcugccaccgug

SEQ ID NO: 1271843 - RNA, 19 nt, Human
ucccuagaccaaaaaaggg

SEQ ID NO: 1271844 - RNA, 23 nt, Human
uccuucauacaucacaaaaacaa

SEQ ID NO: 1271845 - RNA, 20 nt, Human
ucucugcucauuuugaaagg

SEQ ID NO: 1271846 - RNA, 20 nt, Human
ugaaaagacugcaaauucca

SEQ ID NO: 1271847 - RNA, 20 nt, Human
ugaaaucacaaaucaaacac

SEQ ID NO: 1271848 - RNA, 22 nt, Human
ugaaaucacaaaucaaacacau

SEQ ID NO: 1271849 - RNA, 19 nt, Human
ugaagucacuuucuuggag

SEQ ID NO: 1271850 - RNA, 18 nt, Human
ugagacaacugaaaugga

SEQ ID NO: 1271851 - RNA, 24 nt, Human
ugaggguggagggaagaagugcuu

SEQ ID NO: 1271852 - RNA, 23 nt, Human
ugauaacagaccaaacaacaaaa

SEQ ID NO: 1271853 - RNA, 25 nt, Human
ugauaacagaccaaacaacaaaaac

SEQ ID NO: 1271854 - RNA, 22 nt, Human
ugccaaauaauucaauuuacag

SEQ ID NO: 1271855 - RNA, 21 nt, Human
ugccacagaaggacucuagcu

SEQ ID NO: 1271856 - RNA, 22 nt, Human
ugccacagaaggacucuagcuc

SEQ ID NO: 1271857 - RNA, 24 nt, Human
uggaaccugcugccuuuucagagg

SEQ ID NO: 1271858 - RNA, 23 nt, Human
uggagcaggaaaaaaaaaaaaaa

SEQ ID NO: 1271859 - RNA, 19 nt, Human
uggauucugggccaguccc

SEQ ID NO: 1271860 - RNA, 20 nt, Human
uggcacuggcgguagcauuu

SEQ ID NO: 1271861 - RNA, 21 nt, Human
uggggugguuggagugagggu

SEQ ID NO: 1271862 - RNA, 23 nt, Human
ugguaaagcauauccaaaagaaa

SEQ ID NO: 1271863 - RNA, 22 nt, Human
ugguaaggcugguugguuaaga

SEQ ID NO: 1271864 - RNA, 18 nt, Human
ugguguggacuucucugg

SEQ ID NO: 1271865 - RNA, 19 nt, Human
uguaaccagacacuggcuu

SEQ ID NO: 1271866 - RNA, 18 nt, Human
uguacuguaaacuuaaaa

SEQ ID NO: 1271867 - RNA, 23 nt, Human
ugucaauuaauuaaaauugaaau

SEQ ID NO: 1271868 - RNA, 20 nt, Human
uguguuguuugguaaggcug

SEQ ID NO: 1271869 - RNA, 18 nt, Human
uguucuaagaaaugugaa

SEQ ID NO: 1271870 - RNA, 18 nt, Human
uguuuugcuuucccaucc

SEQ ID NO: 1271871 - RNA, 25 nt, Human
uuaaggguucagugaaaaaaaaaaa

SEQ ID NO: 1271872 - RNA, 24 nt, Human
uuaccccaaagaaauuagaaaacc

SEQ ID NO: 1271873 - RNA, 19 nt, Human
uucacguuagcaaguuacc

SEQ ID NO: 1271874 - RNA, 20 nt, Human
uucucaguucugggcugaau

SEQ ID NO: 1271875 - RNA, 18 nt, Human
uugugccuggaugaacug

SEQ ID NO: 1271876 - RNA, 18 nt, Human
uugugcuacaaagagaac

SEQ ID NO: 1271877 - RNA, 21 nt, Human
uuuaaaguuauaugaccauuc

SEQ ID NO: 1271878 - RNA, 20 nt, Human
uuuacacuuacaaauaaaug

SEQ ID NO: 1271879 - RNA, 22 nt, Human
uuuguaaacaugaaguaaacac

SEQ ID NO: 1271880 - RNA, 24 nt, Human
uuugugagcugucugcggagggca

SEQ ID NO: 1271881 - RNA, 19 nt, Human
aaagugcuuggauuacagg

SEQ ID NO: 1271882 - RNA, 24 nt, Human
aaagugcuuggauuacagguguga

SEQ ID NO: 1271883 - RNA, 19 nt, Human
acccaggcuggagugcagu

SEQ ID NO: 1271884 - RNA, 23 nt, Human
acccaggcuggagugcaguggug

SEQ ID NO: 1271885 - RNA, 20 nt, Human
acccggccagugaaauaauu

SEQ ID NO: 1271886 - RNA, 21 nt, Human
acccggccagugaaauaauuu

SEQ ID NO: 1271887 - RNA, 19 nt, Human
acuacaggcgugugccacc

SEQ ID NO: 1271888 - RNA, 21 nt, Human
agccucuaguccucgcuucag

SEQ ID NO: 1271889 - RNA, 24 nt, Human
agcgauucuucugccucagccucc

SEQ ID NO: 1271890 - RNA, 21 nt, Human
agcugcuuggccuccagccuc

SEQ ID NO: 1271891 - RNA, 24 nt, Human
aggcgugugccaccacacccggcu

SEQ ID NO: 1271892 - RNA, 25 nt, Human
aggcuggagugcaguggugcgaucu

SEQ ID NO: 1271893 - RNA, 22 nt, Human
agguaauagaaccuucuggagc

SEQ ID NO: 1271894 - RNA, 19 nt, Human
aggugugaaccaccacacc

SEQ ID NO: 1271895 - RNA, 19 nt, Human
aguagcugggacuacaggc

SEQ ID NO: 1271896 - RNA, 23 nt, Human
aguagcugggacuacaggcgugu

SEQ ID NO: 1271897 - RNA, 22 nt, Human
agugcaguggugcgaucuuggc

SEQ ID NO: 1271898 - RNA, 23 nt, Human
agugcaguggugcgaucuuggcc

SEQ ID NO: 1271899 - RNA, 21 nt, Human
aguucagacuggucuuagguu

SEQ ID NO: 1271900 - RNA, 18 nt, Human
augggguuucaccauguu

SEQ ID NO: 1271901 - RNA, 19 nt, Human
augggguuucaccauguua

SEQ ID NO: 1271902 - RNA, 20 nt, Human
augggguuucaccauguuag

SEQ ID NO: 1271903 - RNA, 24 nt, Human
augggguuucaccauguuagccag

SEQ ID NO: 1271904 - RNA, 20 nt, Human
augguucuguaucuucccag

SEQ ID NO: 1271905 - RNA, 24 nt, Human
caaagugcuuggauuacaggugug

SEQ ID NO: 1271906 - RNA, 23 nt, Human
caaccuccaccucccagguucaa

SEQ ID NO: 1271907 - RNA, 20 nt, Human
caagcgauucuucugccuca

SEQ ID NO: 1271908 - RNA, 22 nt, Human
caagcgauucuucugccucagc

SEQ ID NO: 1271909 - RNA, 18 nt, Human
caccauguuagccaggau

SEQ ID NO: 1271910 - RNA, 21 nt, Human
caccauguuagccaggauggu

SEQ ID NO: 1271911 - RNA, 24 nt, Human
caccauguuagccaggaugguuuu

SEQ ID NO: 1271912 - RNA, 24 nt, Human
cacccaggcuggagugcaguggug

SEQ ID NO: 1271913 - RNA, 21 nt, Human
cacugcaaccuccaccuccca

SEQ ID NO: 1271914 - RNA, 24 nt, Human
caucaacaaaccagcagggcccaa

SEQ ID NO: 1271915 - RNA, 21 nt, Human
ccaaagugcuuggauuacagg

SEQ ID NO: 1271916 - RNA, 24 nt, Human
ccaaagugcuuggauuacaggugu

SEQ ID NO: 1271917 - RNA, 20 nt, Human
ccaccacacccggcuaauuu

SEQ ID NO: 1271918 - RNA, 24 nt, Human
ccaccucccagguucaagcgauuc

SEQ ID NO: 1271919 - RNA, 24 nt, Human
ccacugcaaccuccaccucccagg

SEQ ID NO: 1271920 - RNA, 27 nt, Human
ccacugcaaccuccaccucccagguuc

SEQ ID NO: 1271921 - RNA, 24 nt, Human
cccacugcaaccuccaccucccag

SEQ ID NO: 1271922 - RNA, 20 nt, Human
cccagguucaagcgauucuu

SEQ ID NO: 1271923 - RNA, 23 nt, Human
cccagguucaagcgauucuucug

SEQ ID NO: 1271924 - RNA, 23 nt, Human
cccgaguagcugggacuacaggc

SEQ ID NO: 1271925 - RNA, 24 nt, Human
cccgaguagcugggacuacaggcg

SEQ ID NO: 1271926 - RNA, 24 nt, Human
ccucccagguucaagcgauucuuc

SEQ ID NO: 1271927 - RNA, 24 nt, Human
cgcucugucacccaggcuggagug

SEQ ID NO: 1271928 - RNA, 23 nt, Human
cuaauuuuuuguauuuuuaguag

SEQ ID NO: 1271929 - RNA, 24 nt, Human
cucagccucccgaguagcugggac

SEQ ID NO: 1271930 - RNA, 18 nt, Human
cucaugaucuaccugccu

SEQ ID NO: 1271931 - RNA, 22 nt, Human
cuccagccucuaguccucgcuu

SEQ ID NO: 1271932 - RNA, 24 nt, Human
cuccugaccucaugaucuaccugc

SEQ ID NO: 1271933 - RNA, 24 nt, Human
cucgcucugucacccaggcuggag

SEQ ID NO: 1271934 - RNA, 23 nt, Human
cugcaaccuccaccucccagguu

SEQ ID NO: 1271935 - RNA, 24 nt, Human
cugcaaccuccaccucccagguuc

SEQ ID NO: 1271936 - RNA, 23 nt, Human
cugccucagccucccgaguagcu

SEQ ID NO: 1271937 - RNA, 23 nt, Human
cugccucggccucccaaagugcu

SEQ ID NO: 1271938 - RNA, 21 nt, Human
cugccuucccuagcccauguc

SEQ ID NO: 1271939 - RNA, 22 nt, Human
cuggagcuugcuauccucugug

SEQ ID NO: 1271940 - RNA, 20 nt, Human
cuggcuccuucagggcuccu

SEQ ID NO: 1271941 - RNA, 21 nt, Human
cuucccuagcccaugucuccu

SEQ ID NO: 1271942 - RNA, 21 nt, Human
cuuggauuacaggugugaacc

SEQ ID NO: 1271943 - RNA, 21 nt, Human
gaaagaaguaauagcaaagaa

SEQ ID NO: 1271944 - RNA, 22 nt, Human
gaccucaugaucuaccugccuc

SEQ ID NO: 1271945 - RNA, 22 nt, Human
gaccucaugaucuaccugccuc

SEQ ID NO: 1271946 - RNA, 24 nt, Human
gaccucaugaucuaccugccucgg

SEQ ID NO: 1271947 - RNA, 18 nt, Human
gagaugggguuucaccau

SEQ ID NO: 1271948 - RNA, 24 nt, Human
gagaugggguuucaccauguuagc

SEQ ID NO: 1271949 - RNA, 25 nt, Human
gaguagcugggacuacaggcgugug

SEQ ID NO: 1271950 - RNA, 19 nt, Human
gaucuucuuuggcucagcu

SEQ ID NO: 1271951 - RNA, 21 nt, Human
gauuacaggugugaaccacca

SEQ ID NO: 1271952 - RNA, 24 nt, Human
gcaaugaagauggcccgauuugga

SEQ ID NO: 1271953 - RNA, 24 nt, Human
gcgauucuucugccucagccuccc

SEQ ID NO: 1271954 - RNA, 25 nt, Human
gcucugucacccaggcuggagugca

SEQ ID NO: 1271955 - RNA, 21 nt, Human
gcuggcuccuucagggcuccu

SEQ ID NO: 1271956 - RNA, 22 nt, Human
ggaaggaacugucaguuuagug

SEQ ID NO: 1271957 - RNA, 19 nt, Human
ggacuacaggcgugugcca

SEQ ID NO: 1271958 - RNA, 22 nt, Human
ggauuacaggugugaaccacca

SEQ ID NO: 1271959 - RNA, 22 nt, Human
gggguuucaccauguuagccag

SEQ ID NO: 1271960 - RNA, 24 nt, Human
gguuucaccauguuagccaggaug

SEQ ID NO: 1271961 - RNA, 20 nt, Human
gguuuugaucuccugaccuc

SEQ ID NO: 1271962 - RNA, 18 nt, Human
guaauagaaccuucugga

SEQ ID NO: 1271963 - RNA, 23 nt, Human
guagagaugggguuucaccaugu

SEQ ID NO: 1271964 - RNA, 19 nt, Human
gucacagccauaauugucc

SEQ ID NO: 1271965 - RNA, 21 nt, Human
gucuccagugcugaaaugauu

SEQ ID NO: 1271966 - RNA, 24 nt, Human
gucucgcucugucacccaggcugg

SEQ ID NO: 1271967 - RNA, 24 nt, Human
gucuucucuuucaccaagggggug

SEQ ID NO: 1271968 - RNA, 24 nt, Human
uaauuuuuuguauuuuuaguagag

SEQ ID NO: 1271969 - RNA, 25 nt, Human
uaauuuuuuguauuuuuaguagaga

SEQ ID NO: 1271970 - RNA, 23 nt, Human
uacaggcgugugccaccacaccc

SEQ ID NO: 1271971 - RNA, 23 nt, Human
uacaggugugaaccaccacaccc

SEQ ID NO: 1271972 - RNA, 23 nt, Human
uaccugccucggccucccaaagu

SEQ ID NO: 1271973 - RNA, 22 nt, Human
uagagaugggguuucaccaugu

SEQ ID NO: 1271974 - RNA, 24 nt, Human
uaguagagaugggguuucaccaug

SEQ ID NO: 1271975 - RNA, 26 nt, Human
uaguagagaugggguuucaccauguu

SEQ ID NO: 1271976 - RNA, 24 nt, Human
ucaccauguuagccaggaugguuu

SEQ ID NO: 1271977 - RNA, 24 nt, Human
ucacccaggcuggagugcaguggu

SEQ ID NO: 1271978 - RNA, 23 nt, Human
ucagccucccgaguagcugggac

SEQ ID NO: 1271979 - RNA, 19 nt, Human
ucagcugcuuggccuccag

SEQ ID NO: 1271980 - RNA, 22 nt, Human
ucaguuuagugcccgccacguu

SEQ ID NO: 1271981 - RNA, 20 nt, Human
uccaugugggucccugggcg

SEQ ID NO: 1271982 - RNA, 23 nt, Human
ucccaaagugcuuggauuacagg

SEQ ID NO: 1271983 - RNA, 20 nt, Human
ucccagguucaagcgauucu

SEQ ID NO: 1271984 - RNA, 24 nt, Human
ucccagguucaagcgauucuucug

SEQ ID NO: 1271985 - RNA, 19 nt, Human
ucccaguagccagggagcc

SEQ ID NO: 1271986 - RNA, 24 nt, Human
ucccgaguagcugggacuacaggc

SEQ ID NO: 1271987 - RNA, 18 nt, Human
ucccugggcggaccuggg

SEQ ID NO: 1271988 - RNA, 24 nt, Human
uccuccacaugaagcaggcuccau

SEQ ID NO: 1271989 - RNA, 25 nt, Human
uccuggguggccuuucagacagugu

SEQ ID NO: 1271990 - RNA, 24 nt, Human
ucgcucugucacccaggcuggagu

SEQ ID NO: 1271991 - RNA, 19 nt, Human
ucucgcucugucacccagg

SEQ ID NO: 1271992 - RNA, 23 nt, Human
ucucgcucugucacccaggcugg

SEQ ID NO: 1271993 - RNA, 24 nt, Human
ucucgcucugucacccaggcugga

SEQ ID NO: 1271994 - RNA, 26 nt, Human
ucucgcucugucacccaggcuggagu

SEQ ID NO: 1271995 - RNA, 27 nt, Human
ucucgcucugucacccaggcuggagug

SEQ ID NO: 1271996 - RNA, 24 nt, Human
ucugucacccaggcuggagugcag

SEQ ID NO: 1271997 - RNA, 19 nt, Human
ugaaggaaggaacugucag

SEQ ID NO: 1271998 - RNA, 18 nt, Human
ugagacagagucucgcuc

SEQ ID NO: 1271999 - RNA, 22 nt, Human
ugagacagagucucgcucuguc

SEQ ID NO: 1272000 - RNA, 24 nt, Human
ugccucagccucccgaguagcugg

SEQ ID NO: 1272001 - RNA, 21 nt, Human
ugccucggccucccaaagugc

SEQ ID NO: 1272002 - RNA, 25 nt, Human
ugccucggccucccaaagugcuugg

SEQ ID NO: 1272003 - RNA, 22 nt, Human
ugccuuuaguccaugugggucc

SEQ ID NO: 1272004 - RNA, 23 nt, Human
ugcuuuauuuccuguuuccucca

SEQ ID NO: 1272005 - RNA, 23 nt, Human
uggagugcaguggugcgaucuug

SEQ ID NO: 1272006 - RNA, 24 nt, Human
uggagugcaguggugcgaucuugg

SEQ ID NO: 1272007 - RNA, 23 nt, Human
uggauuacaggugugaaccacca

SEQ ID NO: 1272008 - RNA, 18 nt, Human
uggcccaggugaucuucu

SEQ ID NO: 1272009 - RNA, 21 nt, Human
uggccuccagccucuaguccu

SEQ ID NO: 1272010 - RNA, 18 nt, Human
ugggacuacaggcgugug

SEQ ID NO: 1272011 - RNA, 21 nt, Human
ugggacuacaggcgugugcca

SEQ ID NO: 1272012 - RNA, 22 nt, Human
ugggacuacaggcgugugccac

SEQ ID NO: 1272013 - RNA, 24 nt, Human
ugggacuacaggcgugugccacca

SEQ ID NO: 1272014 - RNA, 24 nt, Human
ugggguuucaccauguuagccagg

SEQ ID NO: 1272015 - RNA, 21 nt, Human
uguauuuuuaguagagauggg

SEQ ID NO: 1272016 - RNA, 19 nt, Human
uguccaugucuucucuuuc

SEQ ID NO: 1272017 - RNA, 18 nt, Human
uuaguagagaugggguuu

SEQ ID NO: 1272018 - RNA, 22 nt, Human
uuaguagagaugggguuucacc

SEQ ID NO: 1272019 - RNA, 24 nt, Human
uuaguagagaugggguuucaccau

SEQ ID NO: 1272020 - RNA, 23 nt, Human
uucaagcgauucuucugccucag

SEQ ID NO: 1272021 - RNA, 24 nt, Human
uucaagcgauucuucugccucagc

SEQ ID NO: 1272022 - RNA, 19 nt, Human
uucacaggaugguucugua

SEQ ID NO: 1272023 - RNA, 20 nt, Human
uucagacuggucuuagguug

SEQ ID NO: 1272024 - RNA, 19 nt, Human
uucccuagcccaugucucc

SEQ ID NO: 1272025 - RNA, 22 nt, Human
uuggauuacaggugugaaccac

SEQ ID NO: 1272026 - RNA, 19 nt, Human
uuucaccauguuagccagg

SEQ ID NO: 1272027 - RNA, 20 nt, Human
uuucaccauguuagccagga

SEQ ID NO: 1272028 - RNA, 21 nt, Human
uuugucugcccacuguugccu

SEQ ID NO: 1272029 - RNA, 24 nt, Human
uuuuuaguagagaugggguuucac

SEQ ID NO: 1272030 - RNA, 21 nt, Human
uuuuuguauuuuuaguagaga

SEQ ID NO: 1272031 - RNA, 24 nt, Human
uuuuuuguauuuuuaguagagaug

SEQ ID NO: 1272032 - RNA, 23 nt, Human
aaagccucuuguccccuuuccca

SEQ ID NO: 1272033 - RNA, 24 nt, Human
aauaccgccccaccucaaccccca

SEQ ID NO: 1272034 - RNA, 19 nt, Human
acagaauagcugguguccc

SEQ ID NO: 1272035 - RNA, 18 nt, Human
acauacagaaccaagaca

SEQ ID NO: 1272036 - RNA, 20 nt, Human
acccccaggaaacuggggag

SEQ ID NO: 1272037 - RNA, 21 nt, Human
acccccaggaaacuggggagc

SEQ ID NO: 1272038 - RNA, 20 nt, Human
accgccccaccucaaccccc

SEQ ID NO: 1272039 - RNA, 22 nt, Human
accucaacccccaggaaacugg

SEQ ID NO: 1272040 - RNA, 22 nt, Human
agaaccaagacauaguguccca

SEQ ID NO: 1272041 - RNA, 21 nt, Human
aggcagacaagaggcagguuu

SEQ ID NO: 1272042 - RNA, 19 nt, Human
agggguguggggguggggg

SEQ ID NO: 1272043 - RNA, 21 nt, Human
agguguauagggcgcagcccu

SEQ ID NO: 1272044 - RNA, 23 nt, Human
caacccaaaugggaagggacaac

SEQ ID NO: 1272045 - RNA, 18 nt, Human
cacacacuugggacacga

SEQ ID NO: 1272046 - RNA, 26 nt, Human
caccucaacccccaggaaacugggga

SEQ ID NO: 1272047 - RNA, 21 nt, Human
cacguacgugaggcugggcac

SEQ ID NO: 1272048 - RNA, 19 nt, Human
cacugugcagagcccaggc

SEQ ID NO: 1272049 - RNA, 26 nt, Human
cagaaccaagacauagugucccaagu

SEQ ID NO: 1272050 - RNA, 23 nt, Human
cagcaaccuagucguggucacac

SEQ ID NO: 1272051 - RNA, 24 nt, Human
cagcagccugcuccucugcgccac

SEQ ID NO: 1272052 - RNA, 21 nt, Human
cauacagaaccaagacauagu

SEQ ID NO: 1272053 - RNA, 19 nt, Human
ccaaaagacugaggccacc

SEQ ID NO: 1272054 - RNA, 20 nt, Human
ccacagguugaaccuaggug

SEQ ID NO: 1272055 - RNA, 18 nt, Human
cccaggacauacagaacc

SEQ ID NO: 1272056 - RNA, 20 nt, Human
ccccaccucaacccccagga

SEQ ID NO: 1272057 - RNA, 22 nt, Human
ccccaccucaacccccaggaaa

SEQ ID NO: 1272058 - RNA, 25 nt, Human
cccuuuacaaacagguguauagggc

SEQ ID NO: 1272059 - RNA, 24 nt, Human
ccgccccaccucaacccccaggaa

SEQ ID NO: 1272060 - RNA, 26 nt, Human
ccuauggcagggcacguacgugaggc

SEQ ID NO: 1272061 - RNA, 20 nt, Human
ccucuuguccccuuucccag

SEQ ID NO: 1272062 - RNA, 22 nt, Human
ccugggcagcagccugcuccuc

SEQ ID NO: 1272063 - RNA, 22 nt, Human
cgccaaaagacugaggccacca

SEQ ID NO: 1272064 - RNA, 21 nt, Human
cgugggucggugucgggugug

SEQ ID NO: 1272065 - RNA, 21 nt, Human
cugcaguaccucuuagggacc

SEQ ID NO: 1272066 - RNA, 23 nt, Human
cugggugucuguuucugcaguca

SEQ ID NO: 1272067 - RNA, 18 nt, Human
cuuguucuguggggugag

SEQ ID NO: 1272068 - RNA, 19 nt, Human
gaaccuagguggcugcugg

SEQ ID NO: 1272069 - RNA, 22 nt, Human
gcagcagccugcuccucugcgc

SEQ ID NO: 1272070 - RNA, 19 nt, Human
gcaggaagaggaggaugag

SEQ ID NO: 1272071 - RNA, 20 nt, Human
gccaaaagacugaggccacc

SEQ ID NO: 1272072 - RNA, 25 nt, Human
gccaaaagacugaggccaccacgga

SEQ ID NO: 1272073 - RNA, 24 nt, Human
gccccaccucaacccccaggaaac

SEQ ID NO: 1272074 - RNA, 27 nt, Human
gggaacaggagaaucggcuuuuugggg

SEQ ID NO: 1272075 - RNA, 23 nt, Human
gggaagggacaacggagguugcc

SEQ ID NO: 1272076 - RNA, 19 nt, Human
gggugugggggugggggca

SEQ ID NO: 1272077 - RNA, 22 nt, Human
gggugugggggugggggcacgg

SEQ ID NO: 1272078 - RNA, 18 nt, Human
ggugugggggugggggca

SEQ ID NO: 1272079 - RNA, 21 nt, Human
gucccaggacauacagaacca

SEQ ID NO: 1272080 - RNA, 19 nt, Human
gugcagagcccaggcgcgu

SEQ ID NO: 1272081 - RNA, 20 nt, Human
uagacugugauguugaaaau

SEQ ID NO: 1272082 - RNA, 20 nt, Human
uauggcagggcacguacgug

SEQ ID NO: 1272083 - RNA, 25 nt, Human
ucccucaccauuacauucuaggagg

SEQ ID NO: 1272084 - RNA, 20 nt, Human
ucccugacccuggaagaagg

SEQ ID NO: 1272085 - RNA, 20 nt, Human
uccuuuggaaguggcccuag

SEQ ID NO: 1272086 - RNA, 27 nt, Human
ucggguguguguguacgucugugugug

SEQ ID NO: 1272087 - RNA, 20 nt, Human
ugaaacuggacgccuuccuu

SEQ ID NO: 1272088 - RNA, 24 nt, Human
ugaggggugugggggugggggcac

SEQ ID NO: 1272089 - RNA, 18 nt, Human
ugauguugaaaauuuugu

SEQ ID NO: 1272090 - RNA, 24 nt, Human
ugcacagaauagcuggugucccac

SEQ ID NO: 1272091 - RNA, 18 nt, Human
uggaagaaggguugggag

SEQ ID NO: 1272092 - RNA, 22 nt, Human
uggaagaaggguugggaggggu

SEQ ID NO: 1272093 - RNA, 24 nt, Human
uggaagaaggguugggagggguug

SEQ ID NO: 1272094 - RNA, 24 nt, Human
uggacgccuuccuucccggcgauc

SEQ ID NO: 1272095 - RNA, 24 nt, Human
uggagucugcaugcugagaugcug

SEQ ID NO: 1272096 - RNA, 20 nt, Human
uggcaaggcagggagcuggu

SEQ ID NO: 1272097 - RNA, 20 nt, Human
ugggaggaacugcuauggac

SEQ ID NO: 1272098 - RNA, 21 nt, Human
ugggagggguugcacagaaua

SEQ ID NO: 1272099 - RNA, 19 nt, Human
ugucccaggacauacagaa

SEQ ID NO: 1272100 - RNA, 19 nt, Human
ugugggggugggggcacgg

SEQ ID NO: 1272101 - RNA, 20 nt, Human
uguguacgucugugugugua

SEQ ID NO: 1272102 - RNA, 22 nt, Human
uguguguacgucugugugugua

SEQ ID NO: 1272103 - RNA, 20 nt, Human
uguguguguacgucugugug

SEQ ID NO: 1272104 - RNA, 21 nt, Human
uguguguguacgucugugugu

SEQ ID NO: 1272105 - RNA, 19 nt, Human
uuccuuaggggcuuuaucu

SEQ ID NO: 1272106 - RNA, 19 nt, Human
uugcucccuucuagcaacc

SEQ ID NO: 1272107 - RNA, 21 nt, Human
uuuagaauaccgccccaccuc

SEQ ID NO: 1272108 - RNA, 23 nt, Human
uuucccagauccaccaagcgucu

SEQ ID NO: 1272109 - RNA, 20 nt, Human
uuuggaaguggcccuagggg

SEQ ID NO: 1272110 - RNA, 21 nt, Human
aaacaugcagaccacaaaggg

SEQ ID NO: 1272111 - RNA, 24 nt, Human
aaagaaccuagucccaggggagac

SEQ ID NO: 1272112 - RNA, 22 nt, Human
aacucaagaugacaaaagggag

SEQ ID NO: 1272113 - RNA, 22 nt, Human
aacuuuccaauagaccucacug

SEQ ID NO: 1272114 - RNA, 19 nt, Human
aagcagcccuuucuucagg

SEQ ID NO: 1272115 - RNA, 19 nt, Human
aagcagcccuuucuucagg

SEQ ID NO: 1272116 - RNA, 26 nt, Human
acacagccccaucuucagggagcucc

SEQ ID NO: 1272117 - RNA, 23 nt, Human
acagagaagagggggcucccaga

SEQ ID NO: 1272118 - RNA, 25 nt, Human
accucacuccucaccagcuccccua

SEQ ID NO: 1272119 - RNA, 20 nt, Human
agaaacaugcagaccacaaa

SEQ ID NO: 1272120 - RNA, 19 nt, Human
agccagagggugggguggg

SEQ ID NO: 1272121 - RNA, 18 nt, Human
agccugacgaugacagag

SEQ ID NO: 1272122 - RNA, 22 nt, Human
agcucugagccugguuuugggg

SEQ ID NO: 1272123 - RNA, 22 nt, Human
aggcagacacagccccguccuc

SEQ ID NO: 1272124 - RNA, 23 nt, Human
auccucccauauuccccccuucu

SEQ ID NO: 1272125 - RNA, 23 nt, Human
augcagccucauccucaggcagc

SEQ ID NO: 1272126 - RNA, 22 nt, Human
caaaagggagugcuggaggggu

SEQ ID NO: 1272127 - RNA, 23 nt, Human
caacacccuggaccucaggaaag

SEQ ID NO: 1272128 - RNA, 24 nt, Human
caaccuaaaacccauguacucauu

SEQ ID NO: 1272129 - RNA, 23 nt, Human
caagccaaacaaaaccucacuga

SEQ ID NO: 1272130 - RNA, 19 nt, Human
cagagccaccucacuccuc

SEQ ID NO: 1272131 - RNA, 19 nt, Human
cagccagugguccugggga

SEQ ID NO: 1272132 - RNA, 23 nt, Human
caugcagaccacaaaggggcagc

SEQ ID NO: 1272133 - RNA, 19 nt, Human
ccaaacaaaaccucacuga

SEQ ID NO: 1272134 - RNA, 21 nt, Human
ccagcagagaccuuccaggac

SEQ ID NO: 1272135 - RNA, 23 nt, Human
ccagucugaggcagacacagccc

SEQ ID NO: 1272136 - RNA, 19 nt, Human
ccauugccuucagggagcu

SEQ ID NO: 1272137 - RNA, 21 nt, Human
cccagugaggccucauagcuc

SEQ ID NO: 1272138 - RNA, 24 nt, Human
cccauauuccccccuucuccagcc

SEQ ID NO: 1272139 - RNA, 23 nt, Human
ccccaucuucagggauucccagu

SEQ ID NO: 1272140 - RNA, 23 nt, Human
cccuggaccucaggaaagaauug

SEQ ID NO: 1272141 - RNA, 22 nt, Human
cccuggccccuccccacucucc

SEQ ID NO: 1272142 - RNA, 19 nt, Human
cccuucccuucuccgugcc

SEQ ID NO: 1272143 - RNA, 21 nt, Human
ccgcgagguggguggguggag

SEQ ID NO: 1272144 - RNA, 18 nt, Human
ccgggaccggggagcggc

SEQ ID NO: 1272145 - RNA, 18 nt, Human
ccucagagcgcucccugu

SEQ ID NO: 1272146 - RNA, 21 nt, Human
ccucaggcagccccagucuga

SEQ ID NO: 1272147 - RNA, 24 nt, Human
ccucagggagccccagucugaggg

SEQ ID NO: 1272148 - RNA, 24 nt, Human
ccucagggagcuccagucugaggg

SEQ ID NO: 1272149 - RNA, 21 nt, Human
ccuuaccaagaaacaugcaga

SEQ ID NO: 1272150 - RNA, 19 nt, Human
cgagguggguggguggagg

SEQ ID NO: 1272151 - RNA, 24 nt, Human
cucccacugaaggcuaacuuucca

SEQ ID NO: 1272152 - RNA, 18 nt, Human
cuccgugucuguggcggg

SEQ ID NO: 1272153 - RNA, 18 nt, Human
cucucucacccuaccuga

SEQ ID NO: 1272154 - RNA, 20 nt, Human
cugcagacucucacauucaa

SEQ ID NO: 1272155 - RNA, 22 nt, Human
cugcgugccuuugccacuccuc

SEQ ID NO: 1272156 - RNA, 20 nt, Human
cugggcgccauggggagcca

SEQ ID NO: 1272157 - RNA, 20 nt, Human
cuguucucaagcaaccucua

SEQ ID NO: 1272158 - RNA, 23 nt, Human
cuucccuucccuucuccgugccu

SEQ ID NO: 1272159 - RNA, 20 nt, Human
gaagguaauuuccccgccag

SEQ ID NO: 1272160 - RNA, 19 nt, Human
gagccugacgaugacagag

SEQ ID NO: 1272161 - RNA, 23 nt, Human
gagcuccagucugagggagaagc

SEQ ID NO: 1272162 - RNA, 18 nt, Human
gagguggguggguggagg

SEQ ID NO: 1272163 - RNA, 19 nt, Human
gcaaguggggagccugacg

SEQ ID NO: 1272164 - RNA, 22 nt, Human
gcagaccacaaaggggcagcaa

SEQ ID NO: 1272165 - RNA, 19 nt, Human
gccccauccucagggagcc

SEQ ID NO: 1272166 - RNA, 24 nt, Human
gccccuccccacucucccagucuc

SEQ ID NO: 1272167 - RNA, 19 nt, Human
gcccugcccucagggagcu

SEQ ID NO: 1272168 - RNA, 19 nt, Human
gcccuguccucagggagcc

SEQ ID NO: 1272169 - RNA, 18 nt, Human
gccugggcgccaugggga

SEQ ID NO: 1272170 - RNA, 20 nt, Human
gcgaagggaggguuccggga

SEQ ID NO: 1272171 - RNA, 18 nt, Human
gcgggucugggaguucug

SEQ ID NO: 1272172 - RNA, 21 nt, Human
gcucugagccugguuuugggg

SEQ ID NO: 1272173 - RNA, 20 nt, Human
ggacuucccuucccuucucc

SEQ ID NO: 1272174 - RNA, 23 nt, Human
ggagaaacagccccauccucagg

SEQ ID NO: 1272175 - RNA, 23 nt, Human
ggagaaacagccccauccucagg

SEQ ID NO: 1272176 - RNA, 22 nt, Human
ggagaagcagcccuuucuucag

SEQ ID NO: 1272177 - RNA, 18 nt, Human
ggaggguggcgaagggag

SEQ ID NO: 1272178 - RNA, 21 nt, Human
ggcagacacagccccguccuc

SEQ ID NO: 1272179 - RNA, 21 nt, Human
ggccaugaguuugcaacaccc

SEQ ID NO: 1272180 - RNA, 23 nt, Human
gggagacacaacgcuguccugag

SEQ ID NO: 1272181 - RNA, 18 nt, Human
gggcacccuuaccaagaa

SEQ ID NO: 1272182 - RNA, 24 nt, Human
ggggagacacaacgcuguccugag

SEQ ID NO: 1272183 - RNA, 20 nt, Human
ggugggguggggugcaaaug

SEQ ID NO: 1272184 - RNA, 19 nt, Human
gucaccuuucuucgcagga

SEQ ID NO: 1272185 - RNA, 18 nt, Human
uaggucccuggccccucc

SEQ ID NO: 1272186 - RNA, 21 nt, Human
ucacugggagggcagucggag

SEQ ID NO: 1272187 - RNA, 21 nt, Human
ucagagguccaccuucacugg

SEQ ID NO: 1272188 - RNA, 22 nt, Human
uccaauagaccucacuguuucu

SEQ ID NO: 1272189 - RNA, 19 nt, Human
ucccagagacacuugacug

SEQ ID NO: 1272190 - RNA, 18 nt, Human
ucccagagggcggcagga

SEQ ID NO: 1272191 - RNA, 23 nt, Human
ucccauauuccccccuucuccag

SEQ ID NO: 1272192 - RNA, 18 nt, Human
uccccccuucuccagccc

SEQ ID NO: 1272193 - RNA, 24 nt, Human
uccuggggaccgcgaggugggugg

SEQ ID NO: 1272194 - RNA, 19 nt, Human
ucucaagcaaccucuaguc

SEQ ID NO: 1272195 - RNA, 18 nt, Human
ucuccugggacugagggg

SEQ ID NO: 1272196 - RNA, 26 nt, Human
ugaagguaaaacguggcccaaggcca

SEQ ID NO: 1272197 - RNA, 20 nt, Human
ugacaaaagggagugcugga

SEQ ID NO: 1272198 - RNA, 21 nt, Human
ugacaaaagggagugcuggag

SEQ ID NO: 1272199 - RNA, 22 nt, Human
ugacaaaagggagugcuggagg

SEQ ID NO: 1272200 - RNA, 18 nt, Human
ugacucagggagccccag

SEQ ID NO: 1272201 - RNA, 22 nt, Human
ugagccugguuuugggggaagg

SEQ ID NO: 1272202 - RNA, 19 nt, Human
ugaggaaaaggauguaggc

SEQ ID NO: 1272203 - RNA, 19 nt, Human
ugaggcagacacagccccg

SEQ ID NO: 1272204 - RNA, 20 nt, Human
ugaggggagacacaacgcug

SEQ ID NO: 1272205 - RNA, 18 nt, Human
ugaggggagaugcagccu

SEQ ID NO: 1272206 - RNA, 22 nt, Human
ugaggggcagucccagagggcg

SEQ ID NO: 1272207 - RNA, 26 nt, Human
ugauagaggagagcucugagccuggu

SEQ ID NO: 1272208 - RNA, 23 nt, Human
ugcagaagacacaaagaaccuag

SEQ ID NO: 1272209 - RNA, 21 nt, Human
ugcagaccacaaaggggcagc

SEQ ID NO: 1272210 - RNA, 19 nt, Human
ugccugggcgccaugggga

SEQ ID NO: 1272211 - RNA, 18 nt, Human
uggccccuccccacucuc

SEQ ID NO: 1272212 - RNA, 18 nt, Human
ugggggaggccccagucu

SEQ ID NO: 1272213 - RNA, 25 nt, Human
ugggguggggugcaaaugucccauu

SEQ ID NO: 1272214 - RNA, 23 nt, Human
uuaccaagaaacaugcagaccac

SEQ ID NO: 1272215 - RNA, 24 nt, Human
uucucaagcaaccucuagucucau

SEQ ID NO: 1272216 - RNA, 18 nt, Human
uuggcagccagugguccu

SEQ ID NO: 1272217 - RNA, 18 nt, Human
uugucugcagacucucac

SEQ ID NO: 1272218 - RNA, 22 nt, Human
uuucauucaucaaagcgugaca

SEQ ID NO: 1272219 - RNA, 22 nt, Human
acccccauuccuuuagacccaa

SEQ ID NO: 1272220 - RNA, 24 nt, Human
aggugaggugggggcuaggaggga

SEQ ID NO: 1272221 - RNA, 18 nt, Human
augcagggccucucuguc

SEQ ID NO: 1272222 - RNA, 20 nt, Human
augcuucccaugccagaaug

SEQ ID NO: 1272223 - RNA, 23 nt, Human
cacccccauuccuuuagacccaa

SEQ ID NO: 1272224 - RNA, 22 nt, Human
ccacacaugcuucccaugccaa

SEQ ID NO: 1272225 - RNA, 21 nt, Human
cccuauggccaggccgucacc

SEQ ID NO: 1272226 - RNA, 22 nt, Human
cccuauggccaggccgucaccu

SEQ ID NO: 1272227 - RNA, 24 nt, Human
cccuauggccaggccgucaccuuc

SEQ ID NO: 1272228 - RNA, 20 nt, Human
ccuauggccaggccgucacc

SEQ ID NO: 1272229 - RNA, 25 nt, Human
ccuugcauguuuacauuuccuucuc

SEQ ID NO: 1272230 - RNA, 22 nt, Human
cucucugucuccacugucaaac

SEQ ID NO: 1272231 - RNA, 21 nt, Human
gccaggccgucaccuucccuu

SEQ ID NO: 1272232 - RNA, 22 nt, Human
gccgucaccuucccuuucaugu

SEQ ID NO: 1272233 - RNA, 18 nt, Human
gcugugugcuugagagca

SEQ ID NO: 1272234 - RNA, 21 nt, Human
ggcuaggagggagccccaggg

SEQ ID NO: 1272235 - RNA, 18 nt, Human
gggcagccaggcaggcac

SEQ ID NO: 1272236 - RNA, 20 nt, Human
ggguuuguguuuuccuuuca

SEQ ID NO: 1272237 - RNA, 19 nt, Human
gucaccuucccuuucaugu

SEQ ID NO: 1272238 - RNA, 20 nt, Human
guggggguuguuuuucuacu

SEQ ID NO: 1272239 - RNA, 22 nt, Human
uacccacagcuuuauuuugcuu

SEQ ID NO: 1272240 - RNA, 22 nt, Human
uagaagcccacacaugcuuccc

SEQ ID NO: 1272241 - RNA, 20 nt, Human
uaggagggagccccagggua

SEQ ID NO: 1272242 - RNA, 23 nt, Human
ucacagcaguaccugaccuugca

SEQ ID NO: 1272243 - RNA, 23 nt, Human
uccauaggggugagaagugugcu

SEQ ID NO: 1272244 - RNA, 19 nt, Human
ucccaugccagaauggggu

SEQ ID NO: 1272245 - RNA, 22 nt, Human
ucucagugagccaguaggugag

SEQ ID NO: 1272246 - RNA, 21 nt, Human
ucuccacugucaaacugggag

SEQ ID NO: 1272247 - RNA, 18 nt, Human
ugccugaccagaauaaag

SEQ ID NO: 1272248 - RNA, 20 nt, Human
ugggguggaacuggaacgac

SEQ ID NO: 1272249 - RNA, 18 nt, Human
ugugcuugagagcagugg

SEQ ID NO: 1272250 - RNA, 23 nt, Human
ugugugcuugagagcaguggggg

SEQ ID NO: 1272251 - RNA, 24 nt, Human
uucagauugagaauuccuuaagga

SEQ ID NO: 1272252 - RNA, 22 nt, Human
uuccugggcccuauggccaggc

SEQ ID NO: 1272253 - RNA, 26 nt, Human
uuccuuaaggauugaggcuaugaauc

SEQ ID NO: 1272254 - RNA, 26 nt, Human
uugagagcaguggggguuguuuuucu

SEQ ID NO: 1272255 - RNA, 20 nt, Human
aaacacacaccaacauugac

SEQ ID NO: 1272256 - RNA, 18 nt, Human
aacuauacuccuguccca

SEQ ID NO: 1272257 - RNA, 22 nt, Human
aagcccuuggccacaacuauac

SEQ ID NO: 1272258 - RNA, 24 nt, Human
acaacuauacuccugucccacccc

SEQ ID NO: 1272259 - RNA, 23 nt, Human
acagaguaaaacccaauccuagc

SEQ ID NO: 1272260 - RNA, 25 nt, Human
acaggcaggccaaguucacugaagc

SEQ ID NO: 1272261 - RNA, 19 nt, Human
acaguagcaaugcugggag

SEQ ID NO: 1272262 - RNA, 19 nt, Human
agagaggaaugaucugcuc

SEQ ID NO: 1272263 - RNA, 22 nt, Human
agagcagugcuuccagaguucc

SEQ ID NO: 1272264 - RNA, 18 nt, Human
agaguuccuccugcaccu

SEQ ID NO: 1272265 - RNA, 20 nt, Human
agccaucuuuccccaccccc

SEQ ID NO: 1272266 - RNA, 22 nt, Human
agcccagcccaucuguuuacag

SEQ ID NO: 1272267 - RNA, 21 nt, Human
agcugagugagccaaaugggg

SEQ ID NO: 1272268 - RNA, 23 nt, Human
aggaaagggaaacuggugaaagg

SEQ ID NO: 1272269 - RNA, 19 nt, Human
aggcaggcagggcaguugg

SEQ ID NO: 1272270 - RNA, 24 nt, Human
aggccaugcucagugcuggggaca

SEQ ID NO: 1272271 - RNA, 22 nt, Human
caagcccuuggccacaacuaua

SEQ ID NO: 1272272 - RNA, 20 nt, Human
caaugcugggagcuagaggc

SEQ ID NO: 1272273 - RNA, 22 nt, Human
cacagguugggugaggggcagg

SEQ ID NO: 1272274 - RNA, 19 nt, Human
caccccaccacgauggccu

SEQ ID NO: 1272275 - RNA, 22 nt, Human
cagcucuucucgccccauggcc

SEQ ID NO: 1272276 - RNA, 18 nt, Human
cagggagccaaggugggc

SEQ ID NO: 1272277 - RNA, 18 nt, Human
cagugcuggggacaggag

SEQ ID NO: 1272278 - RNA, 18 nt, Human
caucuacaaaaaaggccc

SEQ ID NO: 1272279 - RNA, 19 nt, Human
ccacagccauuuccaccca

SEQ ID NO: 1272280 - RNA, 22 nt, Human
cccaccccaccacgauggccug

SEQ ID NO: 1272281 - RNA, 23 nt, Human
ccccaccccccuccuauuuacag

SEQ ID NO: 1272282 - RNA, 23 nt, Human
cccccagcccucacaggcaccuc

SEQ ID NO: 1272283 - RNA, 28 nt, Human
ccuccuauuuacaggaaccuuccuaggc

SEQ ID NO: 1272284 - RNA, 19 nt, Human
ccuuacaucagcucuucuc

SEQ ID NO: 1272285 - RNA, 22 nt, Human
ccuuacugugggagagcugcag

SEQ ID NO: 1272286 - RNA, 24 nt, Human
cuagaaucucuuucauuagcacau

SEQ ID NO: 1272287 - RNA, 21 nt, Human
cucaaaggggcccugguuguc

SEQ ID NO: 1272288 - RNA, 18 nt, Human
cucacugcuugggaagug

SEQ ID NO: 1272289 - RNA, 23 nt, Human
cuccuggcuccgucaagcccauc

SEQ ID NO: 1272290 - RNA, 21 nt, Human
cugcgcccacgggcccuuacc

SEQ ID NO: 1272291 - RNA, 20 nt, Human
cugggcacauugccagcugg

SEQ ID NO: 1272292 - RNA, 20 nt, Human
cugucccaccccaccacgau

SEQ ID NO: 1272293 - RNA, 19 nt, Human
cuuaggccaugcucagugc

SEQ ID NO: 1272294 - RNA, 23 nt, Human
cuuccuaggcuagggcugcgccc

SEQ ID NO: 1272295 - RNA, 18 nt, Human
cuuuccccaccccccucc

SEQ ID NO: 1272296 - RNA, 23 nt, Human
gagagcagugcuuccagaguucc

SEQ ID NO: 1272297 - RNA, 20 nt, Human
gagcugcagggagccaaggu

SEQ ID NO: 1272298 - RNA, 22 nt, Human
gccaugcucagugcuggggaca

SEQ ID NO: 1272299 - RNA, 19 nt, Human
gcccugggcugccugaacc

SEQ ID NO: 1272300 - RNA, 19 nt, Human
gcgcucacugcuugggaag

SEQ ID NO: 1272301 - RNA, 22 nt, Human
ggagagcugcagggagccaagg

SEQ ID NO: 1272302 - RNA, 19 nt, Human
ggcacauugccagcugggu

SEQ ID NO: 1272303 - RNA, 19 nt, Human
gggcccuggccauccccaa

SEQ ID NO: 1272304 - RNA, 26 nt, Human
uacaaaaaaggcccccgcuggaacag

SEQ ID NO: 1272305 - RNA, 23 nt, Human
uacccuuggccugcacaguagca

SEQ ID NO: 1272306 - RNA, 22 nt, Human
uaccugacgcgcugggcuccug

SEQ ID NO: 1272307 - RNA, 24 nt, Human
uaggacagaacaggcaggccaagu

SEQ ID NO: 1272308 - RNA, 20 nt, Human
ucaagaacaccuuggaagcu

SEQ ID NO: 1272309 - RNA, 23 nt, Human
ucacaggcaccucuuuguucucc

SEQ ID NO: 1272310 - RNA, 24 nt, Human
uccaagaaacugcguuccucaaag

SEQ ID NO: 1272311 - RNA, 23 nt, Human
uccacagguaccugacgcgcugg

SEQ ID NO: 1272312 - RNA, 20 nt, Human
ucccaccccaccacgauggc

SEQ ID NO: 1272313 - RNA, 25 nt, Human
uccccaaaggaggccaaagguccau

SEQ ID NO: 1272314 - RNA, 20 nt, Human
ucccugaagguugggguagc

SEQ ID NO: 1272315 - RNA, 20 nt, Human
ucuacaaaaaaggcccccgc

SEQ ID NO: 1272316 - RNA, 24 nt, Human
ucucgccccauggcugaggccaga

SEQ ID NO: 1272317 - RNA, 20 nt, Human
ugaggccagagaggaaugau

SEQ ID NO: 1272318 - RNA, 24 nt, Human
ugagucaauugaauucaugggcca

SEQ ID NO: 1272319 - RNA, 19 nt, Human
ugaucugcucuucaggcag

SEQ ID NO: 1272320 - RNA, 20 nt, Human
ugcggcagcaagagcccagc

SEQ ID NO: 1272321 - RNA, 24 nt, Human
uggccacaacuauacuccuguccc

SEQ ID NO: 1272322 - RNA, 18 nt, Human
ugggaagugcaggggguc

SEQ ID NO: 1272323 - RNA, 21 nt, Human
ugggagcuagaggcaggcagg

SEQ ID NO: 1272324 - RNA, 24 nt, Human
ugggcuccuggcuccgucaagccc

SEQ ID NO: 1272325 - RNA, 20 nt, Human
uggggacaggaguuuugccc

SEQ ID NO: 1272326 - RNA, 19 nt, Human
uggggucaccccuucugag

SEQ ID NO: 1272327 - RNA, 24 nt, Human
ugggugcugagcauugagucacug

SEQ ID NO: 1272328 - RNA, 18 nt, Human
ugugauggggccaaugag

SEQ ID NO: 1272329 - RNA, 25 nt, Human
uuacaucagcucuucucgccccaug

SEQ ID NO: 1272330 - RNA, 21 nt, Human
uuaggccaugcucagugcugg

SEQ ID NO: 1272331 - RNA, 18 nt, Human
uucauuagcacauuccaa

SEQ ID NO: 1272332 - RNA, 19 nt, Human
uuccuaggcuagggcugcg

SEQ ID NO: 1272333 - RNA, 19 nt, Human
uucgccaccuuuuccucag

SEQ ID NO: 1272334 - RNA, 24 nt, Human
uucgccaccuuuuccucagcaaac

SEQ ID NO: 1272335 - RNA, 19 nt, Human
uugucuagaaucucuuuca

SEQ ID NO: 1272336 - RNA, 18 nt, Human
uuuacaggaaccuuccua

SEQ ID NO: 1272337 - RNA, 21 nt, Human
acucuggugugggucuugacg

SEQ ID NO: 1272338 - RNA, 21 nt, Human
cacuccuuauccucggccuug

SEQ ID NO: 1272339 - RNA, 25 nt, Human
cagugaauuccugauagggagacuu

SEQ ID NO: 1272340 - RNA, 21 nt, Human
cugaagccuggguccgcugcc

SEQ ID NO: 1272341 - RNA, 18 nt, Human
cugauagggagacuuggu

SEQ ID NO: 1272342 - RNA, 22 nt, Human
cuugguaaauacagucuccuuc

SEQ ID NO: 1272343 - RNA, 19 nt, Human
gcugcaccgagacucuggu

SEQ ID NO: 1272344 - RNA, 22 nt, Human
guagccacaucugaagccuggg

SEQ ID NO: 1272345 - RNA, 21 nt, Human
uaaaaacccuauguuguagcc

SEQ ID NO: 1272346 - RNA, 24 nt, Human
uauaaaaacccuauguuguagcca

SEQ ID NO: 1272347 - RNA, 18 nt, Human
uggucagugaauuccuga

SEQ ID NO: 1272348 - RNA, 21 nt, Human
aagagcuaccgggacugagcc

SEQ ID NO: 1272349 - RNA, 21 nt, Human
aaggagcugggagcgauaggc

SEQ ID NO: 1272350 - RNA, 20 nt, Human
aagugccccccaaggcuguu

SEQ ID NO: 1272351 - RNA, 22 nt, Human
aagugccccccaaggcuguugc

SEQ ID NO: 1272352 - RNA, 20 nt, Human
acagcuuccagagcuuccuu

SEQ ID NO: 1272353 - RNA, 24 nt, Human
acagcuuccagagcuuccuuccca

SEQ ID NO: 1272354 - RNA, 21 nt, Human
accccaguucccucccaaguc

SEQ ID NO: 1272355 - RNA, 25 nt, Human
accccaguucccucccaagucccag

SEQ ID NO: 1272356 - RNA, 19 nt, Human
acccgcucccuccuucucu

SEQ ID NO: 1272357 - RNA, 18 nt, Human
agccccugaccccaguuc

SEQ ID NO: 1272358 - RNA, 22 nt, Human
agccggagccggccagaggugc

SEQ ID NO: 1272359 - RNA, 21 nt, Human
agccugaggcgggcggcuggc

SEQ ID NO: 1272360 - RNA, 22 nt, Human
aggcggcagggcugagugggua

SEQ ID NO: 1272361 - RNA, 22 nt, Human
aggcggcggcuguggcggaggc

SEQ ID NO: 1272362 - RNA, 18 nt, Human
auucuuccauccuucccc

SEQ ID NO: 1272363 - RNA, 21 nt, Human
caagucccagggccugacccc

SEQ ID NO: 1272364 - RNA, 25 nt, Human
caagugccccccaaggcuguugcuc

SEQ ID NO: 1272365 - RNA, 18 nt, Human
caccacacugccaggagc

SEQ ID NO: 1272366 - RNA, 20 nt, Human
cagagcccccaugcagcccc

SEQ ID NO: 1272367 - RNA, 22 nt, Human
cagagcuuccuucccaccacac

SEQ ID NO: 1272368 - RNA, 23 nt, Human
cagggcgcgggccgggcugaagu

SEQ ID NO: 1272369 - RNA, 20 nt, Human
ccaggagcugccagagcccc

SEQ ID NO: 1272370 - RNA, 22 nt, Human
ccaggagcugccagagccccca

SEQ ID NO: 1272371 - RNA, 20 nt, Human
cccaccacacugccaggagc

SEQ ID NO: 1272372 - RNA, 25 nt, Human
cccaccacacugccaggagcugcca

SEQ ID NO: 1272373 - RNA, 20 nt, Human
cccccaugcagccccugacc

SEQ ID NO: 1272374 - RNA, 22 nt, Human
ccccgcccccugcccggccaag

SEQ ID NO: 1272375 - RNA, 22 nt, Human
ccccggcaggggucgcgggcgg

SEQ ID NO: 1272376 - RNA, 22 nt, Human
ccgcccggcuccccccgaccac

SEQ ID NO: 1272377 - RNA, 21 nt, Human
ccuaagguccauacccccgcc

SEQ ID NO: 1272378 - RNA, 19 nt, Human
ccugacccugauaucuggg

SEQ ID NO: 1272379 - RNA, 24 nt, Human
ccugacccugauaucuggggcaag

SEQ ID NO: 1272380 - RNA, 18 nt, Human
ccuuccccguuccuaagg

SEQ ID NO: 1272381 - RNA, 23 nt, Human
cgccccgcccccugcccggccaa

SEQ ID NO: 1272382 - RNA, 23 nt, Human
cgccggaauccagggcacuguuc

SEQ ID NO: 1272383 - RNA, 25 nt, Human
cggcagcggcagcgagcggcucaag

SEQ ID NO: 1272384 - RNA, 19 nt, Human
cggcccgcacgguccgugu

SEQ ID NO: 1272385 - RNA, 19 nt, Human
cggcggcagcggcagcgag

SEQ ID NO: 1272386 - RNA, 20 nt, Human
cggucgcggcggcggcggcg

SEQ ID NO: 1272387 - RNA, 19 nt, Human
cguggagauggcguugggc

SEQ ID NO: 1272388 - RNA, 24 nt, Human
cuccccccgaccaccccgcgggcc

SEQ ID NO: 1272389 - RNA, 21 nt, Human
cucccuccuucucugccgccc

SEQ ID NO: 1272390 - RNA, 21 nt, Human
cugaccccaguucccucccaa

SEQ ID NO: 1272391 - RNA, 20 nt, Human
cugccgcccggcuccccccg

SEQ ID NO: 1272392 - RNA, 18 nt, Human
cugcggcugcggcggagg

SEQ ID NO: 1272393 - RNA, 18 nt, Human
cuggggcaaggugcucgg

SEQ ID NO: 1272394 - RNA, 18 nt, Human
gagauggcguugggcacg

SEQ ID NO: 1272395 - RNA, 18 nt, Human
gagccggagccggccaga

SEQ ID NO: 1272396 - RNA, 24 nt, Human
gagcuuccuucccaccacacugcc

SEQ ID NO: 1272397 - RNA, 21 nt, Human
gauaucuggggcaaggugcuc

SEQ ID NO: 1272398 - RNA, 24 nt, Human
gcagcgagcggcucaagggcuucg

SEQ ID NO: 1272399 - RNA, 21 nt, Human
gcaggcggcagggcugagugg

SEQ ID NO: 1272400 - RNA, 18 nt, Human
gccagagcccccaugcag

SEQ ID NO: 1272401 - RNA, 20 nt, Human
gcccacggcugggccuccgg

SEQ ID NO: 1272402 - RNA, 22 nt, Human
gccccgcccccugcccggccaa

SEQ ID NO: 1272403 - RNA, 20 nt, Human
gcggaauggaggcacgcccc

SEQ ID NO: 1272404 - RNA, 18 nt, Human
gcggcagcggcagcgagc

SEQ ID NO: 1272405 - RNA, 20 nt, Human
gcggcggcggcagcggcagc

SEQ ID NO: 1272406 - RNA, 23 nt, Human
gcgggcggaguggggccgggggu

SEQ ID NO: 1272407 - RNA, 25 nt, Human
gcguuggggcgggugcgcguuccgg

SEQ ID NO: 1272408 - RNA, 20 nt, Human
gcucgccccgcccccugccc

SEQ ID NO: 1272409 - RNA, 22 nt, Human
gcugcggcggaggcugcggcgg

SEQ ID NO: 1272410 - RNA, 27 nt, Human
gcuggggcgggggcggcccgcacgguu

SEQ ID NO: 1272411 - RNA, 23 nt, Human
ggaauccagggcacuguucccuc

SEQ ID NO: 1272412 - RNA, 20 nt, Human
ggaguggggucagccaacug

SEQ ID NO: 1272413 - RNA, 24 nt, Human
ggcaggcggcagggcugagugggu

SEQ ID NO: 1272414 - RNA, 20 nt, Human
ggcagggcugaguggguagg

SEQ ID NO: 1272415 - RNA, 23 nt, Human
ggcgggggcggcccgcacggucc

SEQ ID NO: 1272416 - RNA, 18 nt, Human
ggcugcggcgggggcgga

SEQ ID NO: 1272417 - RNA, 22 nt, Human
gggccggggauagggccggggu

SEQ ID NO: 1272418 - RNA, 20 nt, Human
gggcggaguggggccggggg

SEQ ID NO: 1272419 - RNA, 20 nt, Human
gggcuucggcuuaccggucu

SEQ ID NO: 1272420 - RNA, 19 nt, Human
ggggccgcgggcggggccg

SEQ ID NO: 1272421 - RNA, 19 nt, Human
ggggccggggguggaggcg

SEQ ID NO: 1272422 - RNA, 20 nt, Human
ggucgcggcggcggcggcgg

SEQ ID NO: 1272423 - RNA, 23 nt, Human
gucgcggcggcggcggcggcagc

SEQ ID NO: 1272424 - RNA, 21 nt, Human
guggaggcggcggcuguggcg

SEQ ID NO: 1272425 - RNA, 24 nt, Human
guggggccggggguggaggcggcc

SEQ ID NO: 1272426 - RNA, 21 nt, Human
uacccgcucccuccuucucug

SEQ ID NO: 1272427 - RNA, 22 nt, Human
uaggaggccguacccgcucccu

SEQ ID NO: 1272428 - RNA, 27 nt, Human
ucagucacagcuuccagagcuuccuuc

SEQ ID NO: 1272429 - RNA, 22 nt, Human
uccauacccccgccggaaucca

SEQ ID NO: 1272430 - RNA, 23 nt, Human
ucccaagucccagggccugaccc

SEQ ID NO: 1272431 - RNA, 18 nt, Human
ucccaccacacugccagg

SEQ ID NO: 1272432 - RNA, 19 nt, Human
ucccaccacacugccagga

SEQ ID NO: 1272433 - RNA, 24 nt, Human
ucccagggccugacccugauaucu

SEQ ID NO: 1272434 - RNA, 24 nt, Human
ucccauggcaacggccgcgucacc

SEQ ID NO: 1272435 - RNA, 24 nt, Human
ucccucgcggucgcggcggcggcg

SEQ ID NO: 1272436 - RNA, 19 nt, Human
ugaaauggugugcagaggc

SEQ ID NO: 1272437 - RNA, 23 nt, Human
ugcccggccaaggccacgccggc

SEQ ID NO: 1272438 - RNA, 22 nt, Human
ugcucagucacagcuuccagag

SEQ ID NO: 1272439 - RNA, 18 nt, Human
uggcagagagagccugag

SEQ ID NO: 1272440 - RNA, 20 nt, Human
uggcggcagcuccggcucca

SEQ ID NO: 1272441 - RNA, 19 nt, Human
uggggccggggguggaggc

SEQ ID NO: 1272442 - RNA, 20 nt, Human
uggguagggcugacggggag

SEQ ID NO: 1272443 - RNA, 21 nt, Human
uuccggggguugggcaggcgc

SEQ ID NO: 1272444 - RNA, 27 nt, Human
uucucugccgcccggcuccccccgacu

SEQ ID NO: 1272445 - RNA, 19 nt, Human
uugcucagucacagcuucc

SEQ ID NO: 1272446 - RNA, 21 nt, Human
aaaacccggucauugggcugc

SEQ ID NO: 1272447 - RNA, 20 nt, Human
aaccccaacaagagggagcc

SEQ ID NO: 1272448 - RNA, 21 nt, Human
aacccggucauugggcugcag

SEQ ID NO: 1272449 - RNA, 21 nt, Human
aagggagguggguccaggcca

SEQ ID NO: 1272450 - RNA, 23 nt, Human
aaugaaaccuuccaggacuugaa

SEQ ID NO: 1272451 - RNA, 19 nt, Human
acaaagagaggaccuggac

SEQ ID NO: 1272452 - RNA, 21 nt, Human
agaaacucuagucugaaugau

SEQ ID NO: 1272453 - RNA, 18 nt, Human
agcgcugagaaguccgaa

SEQ ID NO: 1272454 - RNA, 21 nt, Human
agcuuagaaagcuaaguucuc

SEQ ID NO: 1272455 - RNA, 18 nt, Human
aggcggagcgcugagaag

SEQ ID NO: 1272456 - RNA, 19 nt, Human
aguggcauucccagugauu

SEQ ID NO: 1272457 - RNA, 22 nt, Human
aucuccucccuggcuucugcug

SEQ ID NO: 1272458 - RNA, 19 nt, Human
auucauucccuuuugccca

SEQ ID NO: 1272459 - RNA, 18 nt, Human
caagagggagcucauagc

SEQ ID NO: 1272460 - RNA, 23 nt, Human
cauugugggcuuagagaaacucu

SEQ ID NO: 1272461 - RNA, 22 nt, Human
cccaacaagagggagcucauag

SEQ ID NO: 1272462 - RNA, 23 nt, Human
ccccagguggccgggugcggugg

SEQ ID NO: 1272463 - RNA, 18 nt, Human
cccucuuccucccuuucc

SEQ ID NO: 1272464 - RNA, 18 nt, Human
cccucuuccucccuuucc

SEQ ID NO: 1272465 - RNA, 22 nt, Human
cccuuuugcccagcuuucucau

SEQ ID NO: 1272466 - RNA, 21 nt, Human
ccugggugacugaacaugauc

SEQ ID NO: 1272467 - RNA, 28 nt, Human
cucauagcccaugcuaagauaccuuguc

SEQ ID NO: 1272468 - RNA, 20 nt, Human
cuccaacuagggcccucuuc

SEQ ID NO: 1272469 - RNA, 21 nt, Human
cucccacccaggguugcugcu

SEQ ID NO: 1272470 - RNA, 22 nt, Human
cucuuuaaaaaaccugccuucu

SEQ ID NO: 1272471 - RNA, 22 nt, Human
cugaacaugaucagucggugca

SEQ ID NO: 1272472 - RNA, 20 nt, Human
cugcccuaagacuauuagaa

SEQ ID NO: 1272473 - RNA, 23 nt, Human
cuguaucuccucccuggcuucug

SEQ ID NO: 1272474 - RNA, 18 nt, Human
gaaagcuaaguucuccac

SEQ ID NO: 1272475 - RNA, 19 nt, Human
gaagaaccccaacaagagg

SEQ ID NO: 1272476 - RNA, 24 nt, Human
gaccagucucagaagaaccccaac

SEQ ID NO: 1272477 - RNA, 22 nt, Human
gagaaacucuagucugaaugau

SEQ ID NO: 1272478 - RNA, 22 nt, Human
gcccugugggguggucgauggg

SEQ ID NO: 1272479 - RNA, 19 nt, Human
gcggagcgcugagaagucc

SEQ ID NO: 1272480 - RNA, 20 nt, Human
gcucugugcccuguggggug

SEQ ID NO: 1272481 - RNA, 21 nt, Human
ggcauucccagugauucagcu

SEQ ID NO: 1272482 - RNA, 22 nt, Human
ggcucuggcagaugcgaaaacc

SEQ ID NO: 1272483 - RNA, 20 nt, Human
gggugacugaacaugaucag

SEQ ID NO: 1272484 - RNA, 24 nt, Human
gggugcgguggcucaugccuguaa

SEQ ID NO: 1272485 - RNA, 22 nt, Human
gguggccgggugcgguggcuca

SEQ ID NO: 1272486 - RNA, 24 nt, Human
gguggccgggugcgguggcucaug

SEQ ID NO: 1272487 - RNA, 18 nt, Human
guggcucaugccuguaau

SEQ ID NO: 1272488 - RNA, 18 nt, Human
uaacaaaagucugccccu

SEQ ID NO: 1272489 - RNA, 22 nt, Human
uaacaaaagucugccccuccca

SEQ ID NO: 1272490 - RNA, 20 nt, Human
uaacugaauugaaauuuaaa

SEQ ID NO: 1272491 - RNA, 19 nt, Human
uaccagggcauuugaggua

SEQ ID NO: 1272492 - RNA, 22 nt, Human
uaccuugucucauuuagaacau

SEQ ID NO: 1272493 - RNA, 18 nt, Human
uagagugacaggggcucu

SEQ ID NO: 1272494 - RNA, 26 nt, Human
ucauucccuuuugcccagcuuucuca

SEQ ID NO: 1272495 - RNA, 23 nt, Human
ucucccaauacaugcaggagccu

SEQ ID NO: 1272496 - RNA, 21 nt, Human
ucugugcccuguggggugguc

SEQ ID NO: 1272497 - RNA, 21 nt, Human
ugaacuggauaaccuuaaaua

SEQ ID NO: 1272498 - RNA, 23 nt, Human
ugaaggugcugaccucacccucc

SEQ ID NO: 1272499 - RNA, 24 nt, Human
ugaccagucucagaagaaccccaa

SEQ ID NO: 1272500 - RNA, 19 nt, Human
ugaccucacccuccugucc

SEQ ID NO: 1272501 - RNA, 24 nt, Human
ugcgaaaacccggucauugggcug

SEQ ID NO: 1272502 - RNA, 21 nt, Human
uggaauaacaaaagucugccc

SEQ ID NO: 1272503 - RNA, 20 nt, Human
uggcaagggaggugggucca

SEQ ID NO: 1272504 - RNA, 21 nt, Human
uggcagaugcgaaaacccggu

SEQ ID NO: 1272505 - RNA, 23 nt, Human
uggcagaugcgaaaacccgguca

SEQ ID NO: 1272506 - RNA, 24 nt, Human
uggccgggugcgguggcucaugcc

SEQ ID NO: 1272507 - RNA, 19 nt, Human
uggcucaugccuguaaucc

SEQ ID NO: 1272508 - RNA, 18 nt, Human
uucaucucuaaggagguu

SEQ ID NO: 1272509 - RNA, 21 nt, Human
uucugcugauggaucucucca

SEQ ID NO: 1272510 - RNA, 19 nt, Human
uugaaggugcugaccucac

SEQ ID NO: 1272511 - RNA, 19 nt, Human
uuuacuuuucuuacauuuu

SEQ ID NO: 1272512 - RNA, 20 nt, Human
uuucucaucauuuaauuugg

SEQ ID NO: 1272513 - RNA, 18 nt, Human
aaggggccugagggcagc

SEQ ID NO: 1272514 - RNA, 20 nt, Human
aaugacaagggccgcuggaa

SEQ ID NO: 1272515 - RNA, 21 nt, Human
agcaccgaggaagagagaggg

SEQ ID NO: 1272516 - RNA, 21 nt, Human
aggcagcauggaggccugggc

SEQ ID NO: 1272517 - RNA, 18 nt, Human
aucaggguuccaagugcc

SEQ ID NO: 1272518 - RNA, 18 nt, Human
cagcauggaggccugggc

SEQ ID NO: 1272519 - RNA, 19 nt, Human
cagcauggaggccugggca

SEQ ID NO: 1272520 - RNA, 24 nt, Human
cagcauggaggccugggcaugacg

SEQ ID NO: 1272521 - RNA, 25 nt, Human
caggguuccaagugccccugaguuu

SEQ ID NO: 1272522 - RNA, 21 nt, Human
ccacaaacagcaaugacaagg

SEQ ID NO: 1272523 - RNA, 21 nt, Human
ccugaguuugucauccacccu

SEQ ID NO: 1272524 - RNA, 24 nt, Human
ccugccuuucccuggaaagggcgg

SEQ ID NO: 1272525 - RNA, 24 nt, Human
ccugugaccagugaggcuuggggc

SEQ ID NO: 1272526 - RNA, 25 nt, Human
cgaggaagagagaggggcaagaugu

SEQ ID NO: 1272527 - RNA, 19 nt, Human
cuuggaucccacaaacagc

SEQ ID NO: 1272528 - RNA, 23 nt, Human
cuugggcuucacaaggggccuga

SEQ ID NO: 1272529 - RNA, 19 nt, Human
gggcuucacaaggggcccc

SEQ ID NO: 1272530 - RNA, 25 nt, Human
ggguuccaagugccccugaguuugu

SEQ ID NO: 1272531 - RNA, 24 nt, Human
gguuccaagugccccugaguuugu

SEQ ID NO: 1272532 - RNA, 19 nt, Human
gucugaaggcagcauggag

SEQ ID NO: 1272533 - RNA, 23 nt, Human
uacgucuuuucuuggaucccaca

SEQ ID NO: 1272534 - RNA, 20 nt, Human
ucccuggaaagggcggcaaa

SEQ ID NO: 1272535 - RNA, 21 nt, Human
ugacaagggccgcuggaaagc

SEQ ID NO: 1272536 - RNA, 20 nt, Human
uggaggccugggcaugacgu

SEQ ID NO: 1272537 - RNA, 20 nt, Human
ugggcaugacgucccuggcc

SEQ ID NO: 1272538 - RNA, 27 nt, Human
ugguucgcuuuuugaugaucuugggcu

SEQ ID NO: 1272539 - RNA, 22 nt, Human
ugugaucaggguuccaagugcc

SEQ ID NO: 1272540 - RNA, 18 nt, Human
uuugaugaucuugggcuu

SEQ ID NO: 1272541 - RNA, 19 nt, Human
acaauaaaguggguuucca

SEQ ID NO: 1272542 - RNA, 21 nt, Human
caacacguccuuagagagaag

SEQ ID NO: 1272543 - RNA, 22 nt, Human
cagcuggcuuuuuccauagccu

SEQ ID NO: 1272544 - RNA, 20 nt, Human
ccauagccuuuuccaccuuc

SEQ ID NO: 1272545 - RNA, 21 nt, Human
cccacuugcuguuuuccucuu

SEQ ID NO: 1272546 - RNA, 18 nt, Human
cuugcuguuuuccucuuc

SEQ ID NO: 1272547 - RNA, 18 nt, Human
gaaagagcaacacguccu

SEQ ID NO: 1272548 - RNA, 20 nt, Human
gagagaagguccuggcauag

SEQ ID NO: 1272549 - RNA, 23 nt, Human
ucagccaacagcuggcuuuuucc

SEQ ID NO: 1272550 - RNA, 19 nt, Human
uccaccuucauacagaacu

SEQ ID NO: 1272551 - RNA, 30 nt, Human
uccucuuccuccuuuuguaggacaugaaaa

SEQ ID NO: 1272552 - RNA, 21 nt, Human
uccuggcauaggaccucacaa

SEQ ID NO: 1272553 - RNA, 22 nt, Human
ucucagggcuggucugagccag

SEQ ID NO: 1272554 - RNA, 18 nt, Human
ugaaagagcaacacgucc

SEQ ID NO: 1272555 - RNA, 18 nt, Human
ugagaggguuucccacuu

SEQ ID NO: 1272556 - RNA, 18 nt, Human
uuccuccuuuuguaggac

SEQ ID NO: 1272557 - RNA, 20 nt, Human
aaguuuccauguugauggua

SEQ ID NO: 1272558 - RNA, 18 nt, Human
agaagagggaugaaggga

SEQ ID NO: 1272559 - RNA, 21 nt, Human
agugaaaggcuuuaaaaagga

SEQ ID NO: 1272560 - RNA, 18 nt, Human
augguaaauggaaaaacu

SEQ ID NO: 1272561 - RNA, 22 nt, Human
cugagcucugggacaaaaaggg

SEQ ID NO: 1272562 - RNA, 18 nt, Human
cuuagaaauucucagcuc

SEQ ID NO: 1272563 - RNA, 18 nt, Human
cuugauccugcgcaguga

SEQ ID NO: 1272564 - RNA, 18 nt, Human
gaaauucucagcucugcu

SEQ ID NO: 1272565 - RNA, 24 nt, Human
gaaauucucagcucugcucucaua

SEQ ID NO: 1272566 - RNA, 20 nt, Human
gaccaggcuucuugagcccc

SEQ ID NO: 1272567 - RNA, 25 nt, Human
gcuggcagccucugucccggcuuga

SEQ ID NO: 1272568 - RNA, 19 nt, Human
ggaaaaacuuuugagucag

SEQ ID NO: 1272569 - RNA, 18 nt, Human
uagccuggcuggcugacc

SEQ ID NO: 1272570 - RNA, 21 nt, Human
uagccuggcuggcugaccagg

SEQ ID NO: 1272571 - RNA, 22 nt, Human
uccaguggguugaagagggcuu

SEQ ID NO: 1272572 - RNA, 26 nt, Human
ugaccaggcuucuugagccccacagc

SEQ ID NO: 1272573 - RNA, 20 nt, Human
ugaugguaaauggaaaaacu

SEQ ID NO: 1272574 - RNA, 22 nt, Human
uucuugagccccacaggccucu

SEQ ID NO: 1272575 - RNA, 19 nt, Human
aaccuaggaacucaaacca

SEQ ID NO: 1272576 - RNA, 20 nt, Human
accacugcugcccugaacaa

SEQ ID NO: 1272577 - RNA, 21 nt, Human
agacagaugcccuagguccuc

SEQ ID NO: 1272578 - RNA, 20 nt, Human
aggaacucaaaccaggucuc

SEQ ID NO: 1272579 - RNA, 21 nt, Human
aggaacucaaaccaggucucc

SEQ ID NO: 1272580 - RNA, 22 nt, Human
aggggugggagacacagggggc

SEQ ID NO: 1272581 - RNA, 20 nt, Human
cacugcaggccagggggcgu

SEQ ID NO: 1272582 - RNA, 23 nt, Human
ccucugaguccccucugugcagg

SEQ ID NO: 1272583 - RNA, 24 nt, Human
ccucugugcaggccuagggguggg

SEQ ID NO: 1272584 - RNA, 21 nt, Human
cuccagacaccacugcugccc

SEQ ID NO: 1272585 - RNA, 20 nt, Human
cugaguccccucugugcagg

SEQ ID NO: 1272586 - RNA, 21 nt, Human
gaaaaggcaaagaaagcaaaa

SEQ ID NO: 1272587 - RNA, 20 nt, Human
gaagaaacuugaggcucaga

SEQ ID NO: 1272588 - RNA, 21 nt, Human
gacuuguacugugagccucag

SEQ ID NO: 1272589 - RNA, 20 nt, Human
gccuaggggugggagacaca

SEQ ID NO: 1272590 - RNA, 21 nt, Human
gcucuggaaaaggcaaagaaa

SEQ ID NO: 1272591 - RNA, 22 nt, Human
ggaaaaggcaaagaaagcaaaa

SEQ ID NO: 1272592 - RNA, 22 nt, Human
ggagacacagggggcaucgcug

SEQ ID NO: 1272593 - RNA, 21 nt, Human
ggcucagaaggacgcuaggua

SEQ ID NO: 1272594 - RNA, 26 nt, Human
gggagagacaaggagcacuuucaaaa

SEQ ID NO: 1272595 - RNA, 23 nt, Human
gugagccucaggcagggcugggg

SEQ ID NO: 1272596 - RNA, 18 nt, Human
uaggggugggagacacag

SEQ ID NO: 1272597 - RNA, 20 nt, Human
uccagacaccacugcugccc

SEQ ID NO: 1272598 - RNA, 18 nt, Human
ucucaaacuuucaucuuc

SEQ ID NO: 1272599 - RNA, 22 nt, Human
ucuccagacaccacugcugccc

SEQ ID NO: 1272600 - RNA, 26 nt, Human
ucuccagacaccacugcugcccugaa

SEQ ID NO: 1272601 - RNA, 20 nt, Human
uggaaaaggcaaagaaagca

SEQ ID NO: 1272602 - RNA, 22 nt, Human
uggaaaaggcaaagaaagcaaa

SEQ ID NO: 1272603 - RNA, 25 nt, Human
uggaaaaggcaaagaaagcaaaagu

SEQ ID NO: 1272604 - RNA, 23 nt, Human
aaauguguguuguauauauuuug

SEQ ID NO: 1272605 - RNA, 18 nt, Human
aacaaaauccacccuagc

SEQ ID NO: 1272606 - RNA, 21 nt, Human
accugaaucuugacuuugcau

SEQ ID NO: 1272607 - RNA, 18 nt, Human
caaaagaucauaaccaca

SEQ ID NO: 1272608 - RNA, 22 nt, Human
cagcaggaacacugugugaugc

SEQ ID NO: 1272609 - RNA, 20 nt, Human
caugcugucuccucucucca

SEQ ID NO: 1272610 - RNA, 22 nt, Human
cccugugauagugaaugucuuc

SEQ ID NO: 1272611 - RNA, 23 nt, Human
ccugugauagugaaugucuuccc

SEQ ID NO: 1272612 - RNA, 19 nt, Human
cuccagcaggaacacugug

SEQ ID NO: 1272613 - RNA, 20 nt, Human
cuggaggcuucaugucuugg

SEQ ID NO: 1272614 - RNA, 20 nt, Human
gcaaaucuuccaaacuggag

SEQ ID NO: 1272615 - RNA, 23 nt, Human
uagggacagcaacaaaauccacc

SEQ ID NO: 1272616 - RNA, 23 nt, Human
uagugaaugucuucccgcugccu

SEQ ID NO: 1272617 - RNA, 22 nt, Human
uccaaaagaucauaaccaccac

SEQ ID NO: 1272618 - RNA, 22 nt, Human
uccuugggauaaugccucuguc

SEQ ID NO: 1272619 - RNA, 19 nt, Human
ugauaccugaccagggccu

SEQ ID NO: 1272620 - RNA, 26 nt, Human
ugcugcuguccuuuuguaacuguuca

SEQ ID NO: 1272621 - RNA, 26 nt, Human
uggcaaaucuuccaaacuggaggcuu

SEQ ID NO: 1272622 - RNA, 19 nt, Human
uguaacgcucugcaccccc

SEQ ID NO: 1272623 - RNA, 19 nt, Human
uguaugacaguguccuugg

SEQ ID NO: 1272624 - RNA, 24 nt, Human
ugucacuguaacgcucugcacccc

SEQ ID NO: 1272625 - RNA, 25 nt, Human
uugggauaaugccucugucacugua

SEQ ID NO: 1272626 - RNA, 19 nt, Human
agaccuggcacagcuggug

SEQ ID NO: 1272627 - RNA, 21 nt, Human
cacagcuggugcacccgcagc

SEQ ID NO: 1272628 - RNA, 19 nt, Human
cacccgcagcagggaagau

SEQ ID NO: 1272629 - RNA, 19 nt, Human
ugccuggaugagaccuggc

SEQ ID NO: 1272630 - RNA, 22 nt, Human
uggugcacccgcagcagggaag

SEQ ID NO: 1272631 - RNA, 22 nt, Human
aaaugccuggcaucccaggagu

SEQ ID NO: 1272632 - RNA, 23 nt, Human
aaccaugcuggagggccccccac

SEQ ID NO: 1272633 - RNA, 21 nt, Human
aagaagcaugugaauggcuca

SEQ ID NO: 1272634 - RNA, 19 nt, Human
aagcugcuaucucguuccc

SEQ ID NO: 1272635 - RNA, 18 nt, Human
aagggccucugggcaggu

SEQ ID NO: 1272636 - RNA, 18 nt, Human
aaggggcagagguggggg

SEQ ID NO: 1272637 - RNA, 21 nt, Human
aaggggcagaggugggggcag

SEQ ID NO: 1272638 - RNA, 19 nt, Human
aagggugccuccagguagc

SEQ ID NO: 1272639 - RNA, 21 nt, Human
aaucacucaaaaucaaguuaa

SEQ ID NO: 1272640 - RNA, 18 nt, Human
acagcggaggggcaggca

SEQ ID NO: 1272641 - RNA, 22 nt, Human
accauugcccucaugggcccag

SEQ ID NO: 1272642 - RNA, 21 nt, Human
acccauuuucucccccuugag

SEQ ID NO: 1272643 - RNA, 18 nt, Human
acccuaccugcccuacac

SEQ ID NO: 1272644 - RNA, 19 nt, Human
agaacaaagcagccccuuu

SEQ ID NO: 1272645 - RNA, 24 nt, Human
agaagaacaaagcagccccuuucu

SEQ ID NO: 1272646 - RNA, 21 nt, Human
agacggugggggcggggggug

SEQ ID NO: 1272647 - RNA, 21 nt, Human
agagacggugggggcgggggg

SEQ ID NO: 1272648 - RNA, 19 nt, Human
agcccaccaagucacacca

SEQ ID NO: 1272649 - RNA, 20 nt, Human
agcugauaugucuuugacac

SEQ ID NO: 1272650 - RNA, 24 nt, Human
aggaagcggcugacccguuggcuc

SEQ ID NO: 1272651 - RNA, 23 nt, Human
aggagaaaagcuucuuggaacug

SEQ ID NO: 1272652 - RNA, 24 nt, Human
aggagacaugcacgaugggucucu

SEQ ID NO: 1272653 - RNA, 18 nt, Human
agggagagacgguggggg

SEQ ID NO: 1272654 - RNA, 28 nt, Human
agggagagacggugggggccaggagccu

SEQ ID NO: 1272655 - RNA, 26 nt, Human
agggagagacggugggggcggggggu

SEQ ID NO: 1272656 - RNA, 20 nt, Human
aggggcagaggugggggcag

SEQ ID NO: 1272657 - RNA, 21 nt, Human
agugaagggugggggugcugg

SEQ ID NO: 1272658 - RNA, 22 nt, Human
auauggacaaaucacucaaaau

SEQ ID NO: 1272659 - RNA, 19 nt, Human
augaaaugccuggcauccc

SEQ ID NO: 1272660 - RNA, 21 nt, Human
caaaucacucaaaaucaaguu

SEQ ID NO: 1272661 - RNA, 23 nt, Human
caacagagaccccugcucaggga

SEQ ID NO: 1272662 - RNA, 21 nt, Human
caacccggggcugggggcuga

SEQ ID NO: 1272663 - RNA, 24 nt, Human
caacccggggcugggggcugacag

SEQ ID NO: 1272664 - RNA, 20 nt, Human
caaggucagcagcaugcugc

SEQ ID NO: 1272665 - RNA, 19 nt, Human
caagugccaggaugagcug

SEQ ID NO: 1272666 - RNA, 19 nt, Human
caauguauuccagcagaau

SEQ ID NO: 1272667 - RNA, 25 nt, Human
cacaacccccgcuccccacggacug

SEQ ID NO: 1272668 - RNA, 25 nt, Human
cacacacccuaccugccccccugag

SEQ ID NO: 1272669 - RNA, 23 nt, Human
cacaccuugacuuggccuccagg

SEQ ID NO: 1272670 - RNA, 18 nt, Human
cacauguggcuaccgagc

SEQ ID NO: 1272671 - RNA, 23 nt, Human
caccccaaaugacccuccccaga

SEQ ID NO: 1272672 - RNA, 19 nt, Human
cacccccaccagcccaccc

SEQ ID NO: 1272673 - RNA, 22 nt, Human
cacccucucuucccaaggucag

SEQ ID NO: 1272674 - RNA, 22 nt, Human
cagaggugggggcagucaacag

SEQ ID NO: 1272675 - RNA, 23 nt, Human
cagagucagcaaccaugcuggag

SEQ ID NO: 1272676 - RNA, 19 nt, Human
cagcacccccaccagccca

SEQ ID NO: 1272677 - RNA, 24 nt, Human
cagccaggcucuggggaacuccag

SEQ ID NO: 1272678 - RNA, 18 nt, Human
cagcccacccucucuucc

SEQ ID NO: 1272679 - RNA, 23 nt, Human
cagggcaauguauuccagcagaa

SEQ ID NO: 1272680 - RNA, 18 nt, Human
caggggcuuggccauguc

SEQ ID NO: 1272681 - RNA, 21 nt, Human
caguccccggcagguuuggcc

SEQ ID NO: 1272682 - RNA, 25 nt, Human
caguguccacagguugauuugcuug

SEQ ID NO: 1272683 - RNA, 20 nt, Human
caucaacucuccugucccuu

SEQ ID NO: 1272684 - RNA, 24 nt, Human
ccaaaugacccuccccagagcugc

SEQ ID NO: 1272685 - RNA, 22 nt, Human
ccacagguugauuugcuugugu

SEQ ID NO: 1272686 - RNA, 19 nt, Human
ccacauguggcuaccgagc

SEQ ID NO: 1272687 - RNA, 21 nt, Human
ccaccccaaaugacccucccc

SEQ ID NO: 1272688 - RNA, 19 nt, Human
ccacccucucuucccaagg

SEQ ID NO: 1272689 - RNA, 19 nt, Human
ccagcacccccaccagccc

SEQ ID NO: 1272690 - RNA, 19 nt, Human
ccagcccaucccaucauca

SEQ ID NO: 1272691 - RNA, 20 nt, Human
ccauuucuuugccugggugg

SEQ ID NO: 1272692 - RNA, 22 nt, Human
cccaaaugacccuccccagagc

SEQ ID NO: 1272693 - RNA, 18 nt, Human
ccccaaaugacccucccc

SEQ ID NO: 1272694 - RNA, 24 nt, Human
ccccaaaugacccuccccagagcu

SEQ ID NO: 1272695 - RNA, 20 nt, Human
ccccaccagcccacccucuc

SEQ ID NO: 1272696 - RNA, 21 nt, Human
cccccuugagaccugccugau

SEQ ID NO: 1272697 - RNA, 22 nt, Human
ccccuugagaccugccugauuu

SEQ ID NO: 1272698 - RNA, 21 nt, Human
cccgagcccaccaagucacac

SEQ ID NO: 1272699 - RNA, 22 nt, Human
cccggagcacaggagggcucug

SEQ ID NO: 1272700 - RNA, 19 nt, Human
cccuaccugcccuacacuc

SEQ ID NO: 1272701 - RNA, 25 nt, Human
cccugguguguggugugacacaccu

SEQ ID NO: 1272702 - RNA, 20 nt, Human
ccgaaggaaagaaccgccac

SEQ ID NO: 1272703 - RNA, 23 nt, Human
ccgagcccaccaagucacaccag

SEQ ID NO: 1272704 - RNA, 22 nt, Human
ccuccagguagcaaaggcccaa

SEQ ID NO: 1272705 - RNA, 22 nt, Human
ccucccagccacgugccagccc

SEQ ID NO: 1272706 - RNA, 20 nt, Human
ccucccauuucuuugccugg

SEQ ID NO: 1272707 - RNA, 21 nt, Human
ccucccauuucuuugccuggg

SEQ ID NO: 1272708 - RNA, 24 nt, Human
ccucugggcaggugaugcccaugu

SEQ ID NO: 1272709 - RNA, 22 nt, Human
ccugcagcuggagcuacccuac

SEQ ID NO: 1272710 - RNA, 21 nt, Human
ccugccguugcccgagcccac

SEQ ID NO: 1272711 - RNA, 22 nt, Human
ccugucagccucaccugccacc

SEQ ID NO: 1272712 - RNA, 19 nt, Human
cgccacaggccagggagcu

SEQ ID NO: 1272713 - RNA, 20 nt, Human
cuccagcacccccaccagcc

SEQ ID NO: 1272714 - RNA, 24 nt, Human
cuccagcacccccaccagcccacc

SEQ ID NO: 1272715 - RNA, 23 nt, Human
cuccuccagcacccccaccagcc

SEQ ID NO: 1272716 - RNA, 21 nt, Human
cucuauggaggcccauuccua

SEQ ID NO: 1272717 - RNA, 24 nt, Human
cugaugggcagguggcugccucuc

SEQ ID NO: 1272718 - RNA, 19 nt, Human
cugcugggugcuggcugca

SEQ ID NO: 1272719 - RNA, 19 nt, Human
cuguccccgcaagcugaac

SEQ ID NO: 1272720 - RNA, 20 nt, Human
cuucacaacccccgcucccc

SEQ ID NO: 1272721 - RNA, 18 nt, Human
gaaaagcuucuuggaacu

SEQ ID NO: 1272722 - RNA, 24 nt, Human
gaaggugacuuugaaggcuuuuuu

SEQ ID NO: 1272723 - RNA, 19 nt, Human
gacacaccuugacuuggcc

SEQ ID NO: 1272724 - RNA, 22 nt, Human
gagaccugccugauuuggauaa

SEQ ID NO: 1272725 - RNA, 22 nt, Human
gagguccuugcccuggugugug

SEQ ID NO: 1272726 - RNA, 20 nt, Human
gcagccccuuucuguccuug

SEQ ID NO: 1272727 - RNA, 19 nt, Human
gcagcguauuccuuuucag

SEQ ID NO: 1272728 - RNA, 18 nt, Human
gcaggcagcacuggaaug

SEQ ID NO: 1272729 - RNA, 18 nt, Human
gccccagucagaaggccc

SEQ ID NO: 1272730 - RNA, 21 nt, Human
gccccuuucuguccuugggag

SEQ ID NO: 1272731 - RNA, 21 nt, Human
gcgcggcugugagggaaugag

SEQ ID NO: 1272732 - RNA, 24 nt, Human
gcugaugggcagguggcugccucu

SEQ ID NO: 1272733 - RNA, 21 nt, Human
gcuuguugccccuggggcugg

SEQ ID NO: 1272734 - RNA, 21 nt, Human
ggaaaggggcagagguggggg

SEQ ID NO: 1272735 - RNA, 23 nt, Human
ggaagcagcucagcccugcagcu

SEQ ID NO: 1272736 - RNA, 20 nt, Human
ggagccacaucaagccacca

SEQ ID NO: 1272737 - RNA, 22 nt, Human
ggcagagaucagagcugagggg

SEQ ID NO: 1272738 - RNA, 24 nt, Human
ggcagcgcggcugugagggaauga

SEQ ID NO: 1272739 - RNA, 19 nt, Human
gggcagaggugggggcagu

SEQ ID NO: 1272740 - RNA, 23 nt, Human
ggugucugcuuuugcagcuaggu

SEQ ID NO: 1272741 - RNA, 21 nt, Human
ggugugugugugugugugugu

SEQ ID NO: 1272742 - RNA, 24 nt, Human
guauuccaacacaggccugucuau

SEQ ID NO: 1272743 - RNA, 24 nt, Human
guauuccagcagaaugaacacucu

SEQ ID NO: 1272744 - RNA, 20 nt, Human
gucaaaugagguccuuuuga

SEQ ID NO: 1272745 - RNA, 25 nt, Human
gugcuggcugcauggacacagcugc

SEQ ID NO: 1272746 - RNA, 20 nt, Human
gugugugugugugugugugu

SEQ ID NO: 1272747 - RNA, 21 nt, Human
gugugugugugugugugugug

SEQ ID NO: 1272748 - RNA, 21 nt, Human
gugugugugugugugugugug

SEQ ID NO: 1272749 - RNA, 21 nt, Human
gugugugugugugugugugug

SEQ ID NO: 1272750 - RNA, 22 nt, Human
guucuucuucccuuucaauugc

SEQ ID NO: 1272751 - RNA, 30 nt, Human
uaaaacgggugugugugugugugugugugg

SEQ ID NO: 1272752 - RNA, 23 nt, Human
uaacuaaaacaaauaaaaaauca

SEQ ID NO: 1272753 - RNA, 23 nt, Human
uaacuauuuccuugucagccucc

SEQ ID NO: 1272754 - RNA, 20 nt, Human
uaacucagccacacgaguga

SEQ ID NO: 1272755 - RNA, 18 nt, Human
uaauuuccaucaacucuc

SEQ ID NO: 1272756 - RNA, 21 nt, Human
uacagcagggccaaauugaga

SEQ ID NO: 1272757 - RNA, 21 nt, Human
uacugaggaccauugcccuca

SEQ ID NO: 1272758 - RNA, 24 nt, Human
uagacgauagucguuguucuucuu

SEQ ID NO: 1272759 - RNA, 24 nt, Human
uauuuccauauggacaaaucacuc

SEQ ID NO: 1272760 - RNA, 20 nt, Human
ucaaaaaaaaaaaaaaaaaa

SEQ ID NO: 1272761 - RNA, 22 nt, Human
ucaaaaaaaaaaaaaaaaaaaa

SEQ ID NO: 1272762 - RNA, 23 nt, Human
ucaaaaaaaaaaaaaaaaaaaaa

SEQ ID NO: 1272763 - RNA, 23 nt, Human
ucaaauagauccggaacaccuau

SEQ ID NO: 1272764 - RNA, 24 nt, Human
ucacaacccccgcuccccacggac

SEQ ID NO: 1272765 - RNA, 24 nt, Human
ucagcaaaccaagguuugcucucu

SEQ ID NO: 1272766 - RNA, 23 nt, Human
ucagcagcaugcugcuucaggcc

SEQ ID NO: 1272767 - RNA, 20 nt, Human
ucagccucaccugccaccuc

SEQ ID NO: 1272768 - RNA, 25 nt, Human
ucaguccccaguugaguacuguggu

SEQ ID NO: 1272769 - RNA, 21 nt, Human
ucauagcugcuucaaguccaa

SEQ ID NO: 1272770 - RNA, 19 nt, Human
uccaaagugcucacaacgg

SEQ ID NO: 1272771 - RNA, 18 nt, Human
uccagguagcaaaggccc

SEQ ID NO: 1272772 - RNA, 21 nt, Human
ucccaaggucagcagcaugcu

SEQ ID NO: 1272773 - RNA, 19 nt, Human
ucccacgcccucacccucc

SEQ ID NO: 1272774 - RNA, 19 nt, Human
ucccagcaaagcgaggggg

SEQ ID NO: 1272775 - RNA, 21 nt, Human
ucccggagcacaggagggcuc

SEQ ID NO: 1272776 - RNA, 24 nt, Human
ucccggagcacaggagggcucugc

SEQ ID NO: 1272777 - RNA, 23 nt, Human
ucccuggaaaggggcagaggugg

SEQ ID NO: 1272778 - RNA, 27 nt, Human
ucccuggagaugagguccuugcccugg

SEQ ID NO: 1272779 - RNA, 24 nt, Human
uccucccuggaaaggggcagaggu

SEQ ID NO: 1272780 - RNA, 21 nt, Human
uccuugggagaaaaccuguuc

SEQ ID NO: 1272781 - RNA, 20 nt, Human
uccuugucagccucccaagc

SEQ ID NO: 1272782 - RNA, 24 nt, Human
ucuacucucaaaaaaaaaaaaaaa

SEQ ID NO: 1272783 - RNA, 23 nt, Human
ucucuugggcucaugaggcugua

SEQ ID NO: 1272784 - RNA, 18 nt, Human
ucugguagccacucacuu

SEQ ID NO: 1272785 - RNA, 23 nt, Human
ugaaagcagaaaaagcacugaga

SEQ ID NO: 1272786 - RNA, 18 nt, Human
ugaagggugggggugcug

SEQ ID NO: 1272787 - RNA, 22 nt, Human
ugaagggugggggugcuggcca

SEQ ID NO: 1272788 - RNA, 18 nt, Human
ugacuuccuccuguuccc

SEQ ID NO: 1272789 - RNA, 21 nt, Human
ugacuuggccuccaggcccag

SEQ ID NO: 1272790 - RNA, 22 nt, Human
ugcaauggccacagugauggcc

SEQ ID NO: 1272791 - RNA, 23 nt, Human
ugcagaugcagggccgggcagcu

SEQ ID NO: 1272792 - RNA, 20 nt, Human
ugcauuuguggcacuuccuc

SEQ ID NO: 1272793 - RNA, 18 nt, Human
ugcugggugcuggcugca

SEQ ID NO: 1272794 - RNA, 21 nt, Human
uggaauggaaaucacuaagua

SEQ ID NO: 1272795 - RNA, 20 nt, Human
uggacacagcugcugcccag

SEQ ID NO: 1272796 - RNA, 21 nt, Human
uggaggcccauuccuaaaggg

SEQ ID NO: 1272797 - RNA, 21 nt, Human
uggccuccaggcccagcugga

SEQ ID NO: 1272798 - RNA, 22 nt, Human
uggcuaauuggcaacccggggc

SEQ ID NO: 1272799 - RNA, 21 nt, Human
uggcucauuucaaaauguuug

SEQ ID NO: 1272800 - RNA, 18 nt, Human
ugggcaggggacuggagg

SEQ ID NO: 1272801 - RNA, 20 nt, Human
uggggacagcggaggggcag

SEQ ID NO: 1272802 - RNA, 22 nt, Human
uggggacagcggaggggcaggc

SEQ ID NO: 1272803 - RNA, 18 nt, Human
ugggugguggugaccaug

SEQ ID NO: 1272804 - RNA, 25 nt, Human
ugguaaaacgggugugugugugugu

SEQ ID NO: 1272805 - RNA, 22 nt, Human
uggugugggggaagcacggagu

SEQ ID NO: 1272806 - RNA, 21 nt, Human
ugucuggcuccuuugucccca

SEQ ID NO: 1272807 - RNA, 23 nt, Human
ugugagcgggcgcccaccguucc

SEQ ID NO: 1272808 - RNA, 18 nt, Human
uguggcacuuccucugug

SEQ ID NO: 1272809 - RNA, 23 nt, Human
ugugugcaggagcucucuggcua

SEQ ID NO: 1272810 - RNA, 18 nt, Human
ugugugugugugugugug

SEQ ID NO: 1272811 - RNA, 18 nt, Human
ugugugugugugugugug

SEQ ID NO: 1272812 - RNA, 18 nt, Human
ugugugugugugugugug

SEQ ID NO: 1272813 - RNA, 18 nt, Human
ugugugugugugugugug

SEQ ID NO: 1272814 - RNA, 18 nt, Human
ugugugugugugugugug

SEQ ID NO: 1272815 - RNA, 18 nt, Human
ugugugugugugugugug

SEQ ID NO: 1272816 - RNA, 18 nt, Human
ugugugugugugugugug

SEQ ID NO: 1272817 - RNA, 18 nt, Human
ugugugugugugugugug

SEQ ID NO: 1272818 - RNA, 18 nt, Human
ugugugugugugugugug

SEQ ID NO: 1272819 - RNA, 18 nt, Human
ugugugugugugugugug

SEQ ID NO: 1272820 - RNA, 18 nt, Human
ugugugugugugugugug

SEQ ID NO: 1272821 - RNA, 18 nt, Human
ugugugugugugugugug

SEQ ID NO: 1272822 - RNA, 18 nt, Human
ugugugugugugugugug

SEQ ID NO: 1272823 - RNA, 18 nt, Human
ugugugugugugugugug

SEQ ID NO: 1272824 - RNA, 18 nt, Human
ugugugugugugugugug

SEQ ID NO: 1272825 - RNA, 21 nt, Human
ugugugugugugugugugugu

SEQ ID NO: 1272826 - RNA, 21 nt, Human
ugugugugugugugugugugu

SEQ ID NO: 1272827 - RNA, 21 nt, Human
ugugugugugugugugugugu

SEQ ID NO: 1272828 - RNA, 21 nt, Human
ugugugugugugugugugugu

SEQ ID NO: 1272829 - RNA, 21 nt, Human
ugugugugugugugugugugu

SEQ ID NO: 1272830 - RNA, 21 nt, Human
ugugugugugugugugugugu

SEQ ID NO: 1272831 - RNA, 21 nt, Human
ugugugugugugugugugugu

SEQ ID NO: 1272832 - RNA, 21 nt, Human
ugugugugugugugugugugu

SEQ ID NO: 1272833 - RNA, 21 nt, Human
ugugugugugugugugugugu

SEQ ID NO: 1272834 - RNA, 21 nt, Human
ugugugugugugugugugugu

SEQ ID NO: 1272835 - RNA, 21 nt, Human
ugugugugugugugugugugu

SEQ ID NO: 1272836 - RNA, 21 nt, Human
ugugugugugugugugugugu

SEQ ID NO: 1272837 - RNA, 21 nt, Human
ugugugugugugugugugugu

SEQ ID NO: 1272838 - RNA, 21 nt, Human
ugugugugugugugugugugu

SEQ ID NO: 1272839 - RNA, 21 nt, Human
ugugugugugugugugugugu

SEQ ID NO: 1272840 - RNA, 21 nt, Human
ugugugugugugugugugugu

SEQ ID NO: 1272841 - RNA, 21 nt, Human
ugugugugugugugugugugu

SEQ ID NO: 1272842 - RNA, 21 nt, Human
ugugugugugugugugugugu

SEQ ID NO: 1272843 - RNA, 21 nt, Human
ugugugugugugugugugugu

SEQ ID NO: 1272844 - RNA, 21 nt, Human
ugugugugugugugugugugu

SEQ ID NO: 1272845 - RNA, 21 nt, Human
ugugugugugugugugugugu

SEQ ID NO: 1272846 - RNA, 21 nt, Human
ugugugugugugugugugugu

SEQ ID NO: 1272847 - RNA, 21 nt, Human
ugugugugugugugugugugu

SEQ ID NO: 1272848 - RNA, 21 nt, Human
ugugugugugugugugugugu

SEQ ID NO: 1272849 - RNA, 21 nt, Human
ugugugugugugugugugugu

SEQ ID NO: 1272850 - RNA, 21 nt, Human
ugugugugugugugugugugu

SEQ ID NO: 1272851 - RNA, 21 nt, Human
ugugugugugugugugugugu

SEQ ID NO: 1272852 - RNA, 21 nt, Human
ugugugugugugugugugugu

SEQ ID NO: 1272853 - RNA, 22 nt, Human
ugugugugugugugugugugug

SEQ ID NO: 1272854 - RNA, 22 nt, Human
ugugugugugugugugugugug

SEQ ID NO: 1272855 - RNA, 22 nt, Human
ugugugugugugugugugugug

SEQ ID NO: 1272856 - RNA, 22 nt, Human
ugugugugugugugugugugug

SEQ ID NO: 1272857 - RNA, 22 nt, Human
ugugugugugugugugugugug

SEQ ID NO: 1272858 - RNA, 22 nt, Human
ugugugugugugugugugugug

SEQ ID NO: 1272859 - RNA, 22 nt, Human
ugugugugugugugugugugug

SEQ ID NO: 1272860 - RNA, 22 nt, Human
ugugugugugugugugugugug

SEQ ID NO: 1272861 - RNA, 22 nt, Human
ugugugugugugugugugugug

SEQ ID NO: 1272862 - RNA, 22 nt, Human
ugugugugugugugugugugug

SEQ ID NO: 1272863 - RNA, 22 nt, Human
ugugugugugugugugugugug

SEQ ID NO: 1272864 - RNA, 19 nt, Human
uucccuggagaugaggucc

SEQ ID NO: 1272865 - RNA, 20 nt, Human
uucccuggagaugagguccu

SEQ ID NO: 1272866 - RNA, 21 nt, Human
uuccugacgcugaugggcagg

SEQ ID NO: 1272867 - RNA, 22 nt, Human
uuccugccccagucagaaggcc

SEQ ID NO: 1272868 - RNA, 20 nt, Human
uuugaaggcuuuuuucccca

SEQ ID NO: 1272869 - RNA, 26 nt, Human
uuugcagcguauuccuuuucagaugc

SEQ ID NO: 1272870 - RNA, 21 nt, Human
ccagggccucagugccuggcc

SEQ ID NO: 1272871 - RNA, 21 nt, Human
ccugccccugggcaccccagc

SEQ ID NO: 1272872 - RNA, 18 nt, Human
cgggccggcccugccccu

SEQ ID NO: 1272873 - RNA, 18 nt, Human
gcagccaaugcaggcccc

SEQ ID NO: 1272874 - RNA, 20 nt, Human
gcccugccccugggcacccc

SEQ ID NO: 1272875 - RNA, 21 nt, Human
gccucuguccuuguucucugc

SEQ ID NO: 1272876 - RNA, 18 nt, Human
gcgggccggcccugcccc

SEQ ID NO: 1272877 - RNA, 25 nt, Human
ucuccagggccucagugccuggccu

SEQ ID NO: 1272878 - RNA, 20 nt, Human
ucuguccuuguucucugcuu

SEQ ID NO: 1272879 - RNA, 25 nt, Human
ucugugugugugagcaugagugugu

SEQ ID NO: 1272880 - RNA, 20 nt, Human
uggccucuguccuuguucuc

SEQ ID NO: 1272881 - RNA, 21 nt, Human
uggccucuguccuuguucucu

SEQ ID NO: 1272882 - RNA, 24 nt, Human
uggccucuguccuuguucucugcu

SEQ ID NO: 1272883 - RNA, 21 nt, Human
uggcgggccggcccugccccu

SEQ ID NO: 1272884 - RNA, 24 nt, Human
uggggggguggccacacagcucuc

SEQ ID NO: 1272885 - RNA, 19 nt, Human
ugguacaauguggacacuu

SEQ ID NO: 1272886 - RNA, 27 nt, Human
uggugugccgggggcaagguugggggg

SEQ ID NO: 1272887 - RNA, 26 nt, Human
ugugagcaugagugugugcgugugug

SEQ ID NO: 1272888 - RNA, 19 nt, Human
ugugcaaguggaacagcug

SEQ ID NO: 1272889 - RNA, 19 nt, Human
ugugccgggggcaagguug

SEQ ID NO: 1272890 - RNA, 21 nt, Human
ugugugugagcaugagugugu

SEQ ID NO: 1272891 - RNA, 23 nt, Human
ugugugugagcaugagugugugc

SEQ ID NO: 1272892 - RNA, 22 nt, Human
uucucugcucauccuugcagcc

SEQ ID NO: 1272893 - RNA, 18 nt, Human
aaacacacagagaccagc

SEQ ID NO: 1272894 - RNA, 22 nt, Human
aaggagcauuccaggaggaggg

SEQ ID NO: 1272895 - RNA, 20 nt, Human
aaggggugaggauggggcug

SEQ ID NO: 1272896 - RNA, 21 nt, Human
aaggggugaggauggggcugu

SEQ ID NO: 1272897 - RNA, 22 nt, Human
aaugagugcaggcaacaagagg

SEQ ID NO: 1272898 - RNA, 25 nt, Human
acacacaaacacacgcacacuccac

SEQ ID NO: 1272899 - RNA, 25 nt, Human
acacacacacaaacacacgcacagu

SEQ ID NO: 1272900 - RNA, 23 nt, Human
acacacacacacacacacaaaca

SEQ ID NO: 1272901 - RNA, 19 nt, Human
acacugacacccacauccc

SEQ ID NO: 1272902 - RNA, 21 nt, Human
acagacacugacaagucacca

SEQ ID NO: 1272903 - RNA, 21 nt, Human
acccugagggcugacccugaa

SEQ ID NO: 1272904 - RNA, 22 nt, Human
accugggggccacauguaugca

SEQ ID NO: 1272905 - RNA, 19 nt, Human
acuaaaaaaacaaccccaa

SEQ ID NO: 1272906 - RNA, 27 nt, Human
agacagacagcaaggcaaaggggaccc

SEQ ID NO: 1272907 - RNA, 25 nt, Human
agacagcaaggcaaaggggugagga

SEQ ID NO: 1272908 - RNA, 21 nt, Human
agacuggcucuacucaaacua

SEQ ID NO: 1272909 - RNA, 21 nt, Human
agagaggcaaauggggaacag

SEQ ID NO: 1272910 - RNA, 22 nt, Human
agaggugucaggcccaucucug

SEQ ID NO: 1272911 - RNA, 26 nt, Human
agcauccccccauccccccuccaccu

SEQ ID NO: 1272912 - RNA, 19 nt, Human
agccaacauguacugagca

SEQ ID NO: 1272913 - RNA, 23 nt, Human
aggaagcacccagguggugccag

SEQ ID NO: 1272914 - RNA, 23 nt, Human
aggaggagggggcuuggucuuca

SEQ ID NO: 1272915 - RNA, 24 nt, Human
aggcaacaagagggcaaggggugg

SEQ ID NO: 1272916 - RNA, 28 nt, Human
aggcacacacagacacagacacugacaa

SEQ ID NO: 1272917 - RNA, 19 nt, Human
aggcuucacucagcacccu

SEQ ID NO: 1272918 - RNA, 19 nt, Human
agggcaagggguggggugg

SEQ ID NO: 1272919 - RNA, 19 nt, Human
agggcaguccuauccuagg

SEQ ID NO: 1272920 - RNA, 19 nt, Human
agggcugacccugaacacc

SEQ ID NO: 1272921 - RNA, 19 nt, Human
aggggcuuucccagagcac

SEQ ID NO: 1272922 - RNA, 22 nt, Human
agggggccaggaaggagggcag

SEQ ID NO: 1272923 - RNA, 24 nt, Human
agggggccaggaaggagggcaguc

SEQ ID NO: 1272924 - RNA, 21 nt, Human
agggugccuugggaaccccaa

SEQ ID NO: 1272925 - RNA, 20 nt, Human
auccccccauccccccucca

SEQ ID NO: 1272926 - RNA, 22 nt, Human
caaaaugccucagucacccuga

SEQ ID NO: 1272927 - RNA, 21 nt, Human
caaacacacagagaccagcac

SEQ ID NO: 1272928 - RNA, 21 nt, Human
caacaagagggcaaggggugg

SEQ ID NO: 1272929 - RNA, 24 nt, Human
caacacacagacacugacacacca

SEQ ID NO: 1272930 - RNA, 19 nt, Human
caaggcaaaggggugagga

SEQ ID NO: 1272931 - RNA, 23 nt, Human
caaggcagggcugucugcaccca

SEQ ID NO: 1272932 - RNA, 21 nt, Human
caagggagacaagucuccccu

SEQ ID NO: 1272933 - RNA, 21 nt, Human
cacacacaaacacacgcacac

SEQ ID NO: 1272934 - RNA, 29 nt, Human
cacacacacaaacacacgcacacuccaca

SEQ ID NO: 1272935 - RNA, 20 nt, Human
cacacacacacacacacaca

SEQ ID NO: 1272936 - RNA, 19 nt, Human
cacacgcacacuccacaca

SEQ ID NO: 1272937 - RNA, 24 nt, Human
cacacgcacacuccacacaucaca

SEQ ID NO: 1272938 - RNA, 19 nt, Human
cacagacacugacaaguca

SEQ ID NO: 1272939 - RNA, 21 nt, Human
cacagacacugacaagucacc

SEQ ID NO: 1272940 - RNA, 22 nt, Human
cacccaccugcuggcacacaca

SEQ ID NO: 1272941 - RNA, 18 nt, Human
cacugagaccuccagcag

SEQ ID NO: 1272942 - RNA, 22 nt, Human
cagacagcaaggcaaaggggug

SEQ ID NO: 1272943 - RNA, 18 nt, Human
cagcaacaucuauaacau

SEQ ID NO: 1272944 - RNA, 24 nt, Human
cagcagcauccccccauccccccu

SEQ ID NO: 1272945 - RNA, 22 nt, Human
cagccccuucccucccugaccc

SEQ ID NO: 1272946 - RNA, 20 nt, Human
cagcuuuauugauagaacaa

SEQ ID NO: 1272947 - RNA, 20 nt, Human
caggauagcccagcugagac

SEQ ID NO: 1272948 - RNA, 23 nt, Human
cagggaaaaggagaaugaaugag

SEQ ID NO: 1272949 - RNA, 20 nt, Human
cagggcugucugcacccacu

SEQ ID NO: 1272950 - RNA, 21 nt, Human
caggggcagugacaagcggug

SEQ ID NO: 1272951 - RNA, 22 nt, Human
cagggugccuugggaaccccaa

SEQ ID NO: 1272952 - RNA, 24 nt, Human
caguuguuuggcaggagaccucag

SEQ ID NO: 1272953 - RNA, 27 nt, Human
caucaacacacagacacugacacacca

SEQ ID NO: 1272954 - RNA, 23 nt, Human
cauccccccauccccccuccacc

SEQ ID NO: 1272955 - RNA, 22 nt, Human
cauccccccuccaccuugugcc

SEQ ID NO: 1272956 - RNA, 19 nt, Human
cauccucaaggcagggcug

SEQ ID NO: 1272957 - RNA, 31 nt, Human
cauccucacucugacagccugagccaggggg

SEQ ID NO: 1272958 - RNA, 19 nt, Human
cauguacugagcaccuuua

SEQ ID NO: 1272959 - RNA, 29 nt, Human
ccaacacacacacacacacacacaaacac

SEQ ID NO: 1272960 - RNA, 18 nt, Human
ccacaucccccacccacc

SEQ ID NO: 1272961 - RNA, 23 nt, Human
ccagcagcauccccccauccccc

SEQ ID NO: 1272962 - RNA, 19 nt, Human
ccaggaaggagggcagucc

SEQ ID NO: 1272963 - RNA, 21 nt, Human
cccaacacacacacacacaca

SEQ ID NO: 1272964 - RNA, 29 nt, Human
cccacugagaccuccagcagcaucccccc

SEQ ID NO: 1272965 - RNA, 19 nt, Human
cccaggucaagccauccuc

SEQ ID NO: 1272966 - RNA, 28 nt, Human
ccccaacacacacacacacacacacaaa

SEQ ID NO: 1272967 - RNA, 19 nt, Human
ccccaccggcacccugggg

SEQ ID NO: 1272968 - RNA, 19 nt, Human
ccccacucugggcuucagc

SEQ ID NO: 1272969 - RNA, 18 nt, Human
ccccagcacccugagggc

SEQ ID NO: 1272970 - RNA, 19 nt, Human
ccccagcgagggcacagag

SEQ ID NO: 1272971 - RNA, 24 nt, Human
ccccagggcuguaguacuuggcuc

SEQ ID NO: 1272972 - RNA, 26 nt, Human
cccccauccccccuccaccuugugcc

SEQ ID NO: 1272973 - RNA, 18 nt, Human
ccccccauccccccucca

SEQ ID NO: 1272974 - RNA, 19 nt, Human
ccccccuccaccuugugcc

SEQ ID NO: 1272975 - RNA, 23 nt, Human
cccccggaguccuuuucaccaac

SEQ ID NO: 1272976 - RNA, 18 nt, Human
ccccuucccucccugacc

SEQ ID NO: 1272977 - RNA, 20 nt, Human
cccuccaccuugugcccuuc

SEQ ID NO: 1272978 - RNA, 26 nt, Human
ccuaggagccugucugugcucccaag

SEQ ID NO: 1272979 - RNA, 23 nt, Human
ccucugagggaagcaggcacagg

SEQ ID NO: 1272980 - RNA, 25 nt, Human
ccugagccaggggcuuucccagagc

SEQ ID NO: 1272981 - RNA, 19 nt, Human
ccugggcuggggauaaagg

SEQ ID NO: 1272982 - RNA, 19 nt, Human
ccuggucuccccuggcggg

SEQ ID NO: 1272983 - RNA, 22 nt, Human
ccuugggccacuccccuucccc

SEQ ID NO: 1272984 - RNA, 18 nt, Human
cggagcagccaggguugc

SEQ ID NO: 1272985 - RNA, 18 nt, Human
cuacucaaacuagcugug

SEQ ID NO: 1272986 - RNA, 30 nt, Human
cucccaagacuggcucuacucaaacuagcc

SEQ ID NO: 1272987 - RNA, 21 nt, Human
cuccccuggcgggggucacuc

SEQ ID NO: 1272988 - RNA, 21 nt, Human
cuccccuuccccacucugggc

SEQ ID NO: 1272989 - RNA, 20 nt, Human
cucccugacccuucuccugg

SEQ ID NO: 1272990 - RNA, 20 nt, Human
cuccugggcuggggauaaag

SEQ ID NO: 1272991 - RNA, 22 nt, Human
cuccugggcuggggauaaaggc

SEQ ID NO: 1272992 - RNA, 19 nt, Human
cugacccagagggcgaggc

SEQ ID NO: 1272993 - RNA, 23 nt, Human
cugauacagagaugcuggcucac

SEQ ID NO: 1272994 - RNA, 25 nt, Human
cugcgcuccaguccaauuaacucag

SEQ ID NO: 1272995 - RNA, 22 nt, Human
cugcugaggaacacacaaacac

SEQ ID NO: 1272996 - RNA, 18 nt, Human
cuggcccccggaguccuu

SEQ ID NO: 1272997 - RNA, 18 nt, Human
cugucggagcagccaggg

SEQ ID NO: 1272998 - RNA, 21 nt, Human
cugugugaccuugggccacuc

SEQ ID NO: 1272999 - RNA, 22 nt, Human
cuucuccugggcuggggauaaa

SEQ ID NO: 1273000 - RNA, 18 nt, Human
cuuugaggucucagggcu

SEQ ID NO: 1273001 - RNA, 22 nt, Human
gaagaaugcauggagaccuaga

SEQ ID NO: 1273002 - RNA, 19 nt, Human
gaccuccagcagcaucccc

SEQ ID NO: 1273003 - RNA, 21 nt, Human
gagcagccaggguugcggggc

SEQ ID NO: 1273004 - RNA, 24 nt, Human
gagggcaagggguggggugggcag

SEQ ID NO: 1273005 - RNA, 23 nt, Human
gauagcccagcugagacuuccau

SEQ ID NO: 1273006 - RNA, 18 nt, Human
gcaaggcaaaggggugag

SEQ ID NO: 1273007 - RNA, 21 nt, Human
gcacacuccacacaucacaca

SEQ ID NO: 1273008 - RNA, 24 nt, Human
gccagccuggucuccccuggcgga

SEQ ID NO: 1273009 - RNA, 21 nt, Human
gccccagcacccugagggcug

SEQ ID NO: 1273010 - RNA, 18 nt, Human
gcugggaggauggcggga

SEQ ID NO: 1273011 - RNA, 25 nt, Human
gcugugugacuaaaaaaacaacccc

SEQ ID NO: 1273012 - RNA, 21 nt, Human
ggcagaagggucugcagccug

SEQ ID NO: 1273013 - RNA, 18 nt, Human
ggcugggguggucagaca

SEQ ID NO: 1273014 - RNA, 22 nt, Human
gggccacuccccuuccccacuc

SEQ ID NO: 1273015 - RNA, 24 nt, Human
ggggccacauguaugcaguucagc

SEQ ID NO: 1273016 - RNA, 20 nt, Human
guggaaggagcauuccagga

SEQ ID NO: 1273017 - RNA, 20 nt, Human
guuccugcugucaggagaac

SEQ ID NO: 1273018 - RNA, 19 nt, Human
uaacauccccaccggcacc

SEQ ID NO: 1273019 - RNA, 23 nt, Human
uacugagcaccuuuacuguccac

SEQ ID NO: 1273020 - RNA, 18 nt, Human
uagaugcucccuaagguc

SEQ ID NO: 1273021 - RNA, 19 nt, Human
uagccaaacucccugcagu

SEQ ID NO: 1273022 - RNA, 22 nt, Human
uaggagggucccugggaaauga

SEQ ID NO: 1273023 - RNA, 19 nt, Human
ucaagccauccucaaggca

SEQ ID NO: 1273024 - RNA, 20 nt, Human
ucacaggcacacacagacac

SEQ ID NO: 1273025 - RNA, 18 nt, Human
ucagccucacccauucac

SEQ ID NO: 1273026 - RNA, 20 nt, Human
uccacacaucacacacauuc

SEQ ID NO: 1273027 - RNA, 20 nt, Human
uccacaucagccucacccau

SEQ ID NO: 1273028 - RNA, 24 nt, Human
uccagcagcauccccccauccccc

SEQ ID NO: 1273029 - RNA, 19 nt, Human
ucccaagggcaggauagcc

SEQ ID NO: 1273030 - RNA, 20 nt, Human
ucccuaaggucccuucuagu

SEQ ID NO: 1273031 - RNA, 18 nt, Human
ucccucuggaccucgccu

SEQ ID NO: 1273032 - RNA, 18 nt, Human
ucccucuggaccucgccu

SEQ ID NO: 1273033 - RNA, 20 nt, Human
ucccugcaguuguuuggcag

SEQ ID NO: 1273034 - RNA, 19 nt, Human
ucccuucuaguuauaaggg

SEQ ID NO: 1273035 - RNA, 24 nt, Human
ucuagggcaggaagaaugcaugga

SEQ ID NO: 1273036 - RNA, 19 nt, Human
ucuauggauccugagggga

SEQ ID NO: 1273037 - RNA, 24 nt, Human
ucucagggcuggugcagccccuuc

SEQ ID NO: 1273038 - RNA, 23 nt, Human
ucuccugggcuggggauaaaggc

SEQ ID NO: 1273039 - RNA, 20 nt, Human
ucugcagccugggaugagag

SEQ ID NO: 1273040 - RNA, 22 nt, Human
ugacaagcggugugacaccccc

SEQ ID NO: 1273041 - RNA, 21 nt, Human
ugacagccugagccaggggcu

SEQ ID NO: 1273042 - RNA, 21 nt, Human
ugaccuugggccacuccccuu

SEQ ID NO: 1273043 - RNA, 27 nt, Human
ugacuaaaaaaacaaccccaaucauuu

SEQ ID NO: 1273044 - RNA, 19 nt, Human
ugagaggccagaauuugga

SEQ ID NO: 1273045 - RNA, 22 nt, Human
ugagauggugauuaugugggug

SEQ ID NO: 1273046 - RNA, 18 nt, Human
ugaggaacacacaaacac

SEQ ID NO: 1273047 - RNA, 19 nt, Human
ugagggaagcaggcacagg

SEQ ID NO: 1273048 - RNA, 19 nt, Human
ugcacgaggggaucaaacu

SEQ ID NO: 1273049 - RNA, 18 nt, Human
ugcagccccuucccuccc

SEQ ID NO: 1273050 - RNA, 23 nt, Human
ugcagccugggaugagaggccag

SEQ ID NO: 1273051 - RNA, 29 nt, Human
ugccccaacacacacacacacacacacag

SEQ ID NO: 1273052 - RNA, 19 nt, Human
ugccucagucacccugacc

SEQ ID NO: 1273053 - RNA, 22 nt, Human
ugccucagucacccugacccag

SEQ ID NO: 1273054 - RNA, 21 nt, Human
uggcaggagaccucaggggca

SEQ ID NO: 1273055 - RNA, 18 nt, Human
uggcggggugggcugggg

SEQ ID NO: 1273056 - RNA, 24 nt, Human
ugggaaccccaaagagggagcacu

SEQ ID NO: 1273057 - RNA, 20 nt, Human
ugggcagaugccaucccucc

SEQ ID NO: 1273058 - RNA, 21 nt, Human
uggggagaugugcuggaucca

SEQ ID NO: 1273059 - RNA, 18 nt, Human
ugggggcuuggaggugaa

SEQ ID NO: 1273060 - RNA, 19 nt, Human
ugugggccugggcaugagg

SEQ ID NO: 1273061 - RNA, 21 nt, Human
ugugugacuaaaaaaacaacc

SEQ ID NO: 1273062 - RNA, 20 nt, Human
uuagccaaacucccugcagu

SEQ ID NO: 1273063 - RNA, 24 nt, Human
uuccaggaggagggggcuuggucu

SEQ ID NO: 1273064 - RNA, 20 nt, Human
uucccagagcacagggaaaa

SEQ ID NO: 1273065 - RNA, 21 nt, Human
uuccugcugaggaacacacaa

SEQ ID NO: 1273066 - RNA, 21 nt, Human
uuccugcugucaggagaaccc

SEQ ID NO: 1273067 - RNA, 19 nt, Human
uugguggcggggugggcug

SEQ ID NO: 1273068 - RNA, 23 nt, Human
uuuacagugcccacuggcauaca

SEQ ID NO: 1273069 - RNA, 20 nt, Human
uuugagguccauccucacuc

SEQ ID NO: 1273070 - RNA, 20 nt, Human
uuugaggucucagggcuggu

SEQ ID NO: 1273071 - RNA, 20 nt, Human
aaagaugaagaacugggugg

SEQ ID NO: 1273072 - RNA, 21 nt, Human
aaccaagcagcaucaacagaa

SEQ ID NO: 1273073 - RNA, 22 nt, Human
acacaacacaucuguaaaauaa

SEQ ID NO: 1273074 - RNA, 19 nt, Human
accaagcagcaucaacaga

SEQ ID NO: 1273075 - RNA, 22 nt, Human
accaagcagcaucaacagaaga

SEQ ID NO: 1273076 - RNA, 18 nt, Human
acugcaaugguggagcag

SEQ ID NO: 1273077 - RNA, 18 nt, Human
agacagaaaaagugcagg

SEQ ID NO: 1273078 - RNA, 19 nt, Human
agauuuggaagauccagug

SEQ ID NO: 1273079 - RNA, 22 nt, Human
agcccuguggaacaggguccaa

SEQ ID NO: 1273080 - RNA, 24 nt, Human
aggaacaccauucccucccaccuu

SEQ ID NO: 1273081 - RNA, 18 nt, Human
agggagaggccagugcug

SEQ ID NO: 1273082 - RNA, 18 nt, Human
cacacaacacaucuguaa

SEQ ID NO: 1273083 - RNA, 24 nt, Human
caccauucccucccaccuuuccug

SEQ ID NO: 1273084 - RNA, 19 nt, Human
cagaaaaagugcaggagca

SEQ ID NO: 1273085 - RNA, 21 nt, Human
cagcagccccauguagauauu

SEQ ID NO: 1273086 - RNA, 23 nt, Human
caugcuugacgaugaagggcaga

SEQ ID NO: 1273087 - RNA, 22 nt, Human
cucccaccuuuccuggcaucug

SEQ ID NO: 1273088 - RNA, 22 nt, Human
cuccugcuucuucccucucgca

SEQ ID NO: 1273089 - RNA, 18 nt, Human
cucucccgagaaucauuc

SEQ ID NO: 1273090 - RNA, 20 nt, Human
gaacaggguccaagugacua

SEQ ID NO: 1273091 - RNA, 20 nt, Human
gaccuccugcuucuucccuc

SEQ ID NO: 1273092 - RNA, 24 nt, Human
gacgaugaagggcagacagaaaaa

SEQ ID NO: 1273093 - RNA, 22 nt, Human
gacuagcuccgacuuugagucc

SEQ ID NO: 1273094 - RNA, 18 nt, Human
gcagagccuguggcggcg

SEQ ID NO: 1273095 - RNA, 24 nt, Human
ggauacaauaaaggaggaagcagc

SEQ ID NO: 1273096 - RNA, 20 nt, Human
gugagauuuggaagauccag

SEQ ID NO: 1273097 - RNA, 22 nt, Human
guggcggcguuuccugcccaca

SEQ ID NO: 1273098 - RNA, 22 nt, Human
gugugucuucugguucagguca

SEQ ID NO: 1273099 - RNA, 20 nt, Human
uaaaacaagucacacaacac

SEQ ID NO: 1273100 - RNA, 23 nt, Human
uaacucagcgucuugaagugauc

SEQ ID NO: 1273101 - RNA, 22 nt, Human
uaacuuccgguacaacauuccc

SEQ ID NO: 1273102 - RNA, 18 nt, Human
uaaguaagcacaaggcca

SEQ ID NO: 1273103 - RNA, 23 nt, Human
uagaugcugaacuuggccucaua

SEQ ID NO: 1273104 - RNA, 21 nt, Human
uagggaggcuuccauuguuga

SEQ ID NO: 1273105 - RNA, 19 nt, Human
uauuagcccuguggaacag

SEQ ID NO: 1273106 - RNA, 23 nt, Human
ucagugcguaaaacucaaaagcc

SEQ ID NO: 1273107 - RNA, 21 nt, Human
ucccgagaaucauuccucagu

SEQ ID NO: 1273108 - RNA, 18 nt, Human
ugacaaaccaagcagcau

SEQ ID NO: 1273109 - RNA, 23 nt, Human
ugagaccuccugcuucuucccuc

SEQ ID NO: 1273110 - RNA, 22 nt, Human
ugagggagaggccagugcugau

SEQ ID NO: 1273111 - RNA, 24 nt, Human
ugaugguggugagggagaggccag

SEQ ID NO: 1273112 - RNA, 20 nt, Human
ugcaaugguggagcagagcc

SEQ ID NO: 1273113 - RNA, 19 nt, Human
ugguggugagggagaggcc

SEQ ID NO: 1273114 - RNA, 25 nt, Human
ugguggugagggagaggccagugcu

SEQ ID NO: 1273115 - RNA, 20 nt, Human
ugguggugagggagaggccc

SEQ ID NO: 1273116 - RNA, 21 nt, Human
uguggaacaggguccaaguga

SEQ ID NO: 1273117 - RNA, 19 nt, Human
acuugguuguccccuuucu

SEQ ID NO: 1273118 - RNA, 21 nt, Human
acuugguuguccccuuucuag

SEQ ID NO: 1273119 - RNA, 20 nt, Human
aggagcccccuccccgcaag

SEQ ID NO: 1273120 - RNA, 21 nt, Human
agggcuuucugggcaucggcc

SEQ ID NO: 1273121 - RNA, 22 nt, Human
aggguggggagaggugggcagg

SEQ ID NO: 1273122 - RNA, 18 nt, Human
cagcuucuggauguacuc

SEQ ID NO: 1273123 - RNA, 18 nt, Human
caggagcccccuccccgc

SEQ ID NO: 1273124 - RNA, 22 nt, Human
caggguggggagaggugggcag

SEQ ID NO: 1273125 - RNA, 20 nt, Human
cagucuguggcaggagcugg

SEQ ID NO: 1273126 - RNA, 19 nt, Human
ccacuuggggcaguggguc

SEQ ID NO: 1273127 - RNA, 23 nt, Human
ccaguacucuuuaaaagcucccc

SEQ ID NO: 1273128 - RNA, 20 nt, Human
cccagaucgggacacguggc

SEQ ID NO: 1273129 - RNA, 23 nt, Human
cggccuggucuggggccugggcu

SEQ ID NO: 1273130 - RNA, 19 nt, Human
cuggaagucccauggccca

SEQ ID NO: 1273131 - RNA, 26 nt, Human
gaaaaaccauacuauggugaccacca

SEQ ID NO: 1273132 - RNA, 19 nt, Human
gacccauauuuucuaaucc

SEQ ID NO: 1273133 - RNA, 20 nt, Human
gagcagcagcucguaacgug

SEQ ID NO: 1273134 - RNA, 21 nt, Human
gcagcuucuggauguacuccu

SEQ ID NO: 1273135 - RNA, 19 nt, Human
gcccaggagcccccucccc

SEQ ID NO: 1273136 - RNA, 19 nt, Human
gcuggcagcuucuggaugu

SEQ ID NO: 1273137 - RNA, 20 nt, Human
gcuggcagcuucuggaugua

SEQ ID NO: 1273138 - RNA, 22 nt, Human
ggccugggcuggcagcuucugg

SEQ ID NO: 1273139 - RNA, 24 nt, Human
gggcaucggccuggucuggggccu

SEQ ID NO: 1273140 - RNA, 20 nt, Human
ggucuggggccugggcuggc

SEQ ID NO: 1273141 - RNA, 18 nt, Human
guccagggcuuucugggc

SEQ ID NO: 1273142 - RNA, 20 nt, Human
guggggagaggugggcagga

SEQ ID NO: 1273143 - RNA, 21 nt, Human
guuguccccuuucuagaaagg

SEQ ID NO: 1273144 - RNA, 21 nt, Human
uacuauggugaccaccagucc

SEQ ID NO: 1273145 - RNA, 27 nt, Human
uacuauguguuuuucaccaguacucuu

SEQ ID NO: 1273146 - RNA, 21 nt, Human
ucaggguggggagaggugggc

SEQ ID NO: 1273147 - RNA, 18 nt, Human
ucccauggcccaggagcc

SEQ ID NO: 1273148 - RNA, 18 nt, Human
ucugaaagcaccacuugg

SEQ ID NO: 1273149 - RNA, 20 nt, Human
ucugggcaucggccuggucu

SEQ ID NO: 1273150 - RNA, 20 nt, Human
ucuguggcaggagcuggguu

SEQ ID NO: 1273151 - RNA, 18 nt, Human
ugaaaaaccauacuaugg

SEQ ID NO: 1273152 - RNA, 20 nt, Human
uggcaggagcuggguucagg

SEQ ID NO: 1273153 - RNA, 23 nt, Human
uggcaggagcuggguucaggaga

SEQ ID NO: 1273154 - RNA, 24 nt, Human
uggcaggagcuggguucagggugg

SEQ ID NO: 1273155 - RNA, 26 nt, Human
uucaggguggggagaggugggcagga

SEQ ID NO: 1273156 - RNA, 25 nt, Human
aaacacacaugcucccagggcuacc

SEQ ID NO: 1273157 - RNA, 24 nt, Human
aaagcucucccugauaaaucaccu

SEQ ID NO: 1273158 - RNA, 24 nt, Human
aaagugcugggauuacaggcguga

SEQ ID NO: 1273159 - RNA, 23 nt, Human
aaccaggacgcauuacuauaacc

SEQ ID NO: 1273160 - RNA, 24 nt, Human
aagcacuuggcauccucaccucuc

SEQ ID NO: 1273161 - RNA, 22 nt, Human
aagcauguugagugagguggua

SEQ ID NO: 1273162 - RNA, 21 nt, Human
aaggagaaacagguccgcgga

SEQ ID NO: 1273163 - RNA, 19 nt, Human
aagugcugggauuacaggc

SEQ ID NO: 1273164 - RNA, 19 nt, Human
aagugcugggauuacaggc

SEQ ID NO: 1273165 - RNA, 24 nt, Human
aaucaccugaggcaaaccucuguc

SEQ ID NO: 1273166 - RNA, 25 nt, Human
aaugccucccccacaaccaccacau

SEQ ID NO: 1273167 - RNA, 26 nt, Human
acaaagagacucaagugacuugccca

SEQ ID NO: 1273168 - RNA, 27 nt, Human
acaaauacgaaaucuccaaaacuccgu

SEQ ID NO: 1273169 - RNA, 19 nt, Human
acacaaacacacaugcucc

SEQ ID NO: 1273170 - RNA, 21 nt, Human
acacacacgcgcacacacaca

SEQ ID NO: 1273171 - RNA, 21 nt, Human
acaccugucuggacucuccca

SEQ ID NO: 1273172 - RNA, 20 nt, Human
acacuggcacucucaccccu

SEQ ID NO: 1273173 - RNA, 22 nt, Human
acaggacgagcuuggcaaagau

SEQ ID NO: 1273174 - RNA, 18 nt, Human
acaggcugaggccucugu

SEQ ID NO: 1273175 - RNA, 23 nt, Human
acauacacacacgcgcacacaca

SEQ ID NO: 1273176 - RNA, 20 nt, Human
accacauuuuauuuggcauu

SEQ ID NO: 1273177 - RNA, 21 nt, Human
accauggugacccucccaccc

SEQ ID NO: 1273178 - RNA, 21 nt, Human
acccugaagccuacaggaaac

SEQ ID NO: 1273179 - RNA, 20 nt, Human
acccuugaugaauacaccca

SEQ ID NO: 1273180 - RNA, 18 nt, Human
accuguaaugccuccccc

SEQ ID NO: 1273181 - RNA, 21 nt, Human
accuguaaugccucccccaca

SEQ ID NO: 1273182 - RNA, 18 nt, Human
acucaguaaggaguggcu

SEQ ID NO: 1273183 - RNA, 22 nt, Human
acucuaaccugccccuccccau

SEQ ID NO: 1273184 - RNA, 19 nt, Human
acugaguagcugggauuac

SEQ ID NO: 1273185 - RNA, 30 nt, Human
acuuggcauccucaccucucugugucuccu

SEQ ID NO: 1273186 - RNA, 24 nt, Human
agaaaacccuaccugggacagccc

SEQ ID NO: 1273187 - RNA, 22 nt, Human
agaagcagggagagccagccca

SEQ ID NO: 1273188 - RNA, 20 nt, Human
agacuucuaggucuacaucu

SEQ ID NO: 1273189 - RNA, 21 nt, Human
agaggcaucccagcuccagag

SEQ ID NO: 1273190 - RNA, 19 nt, Human
agcagagagagaggccucc

SEQ ID NO: 1273191 - RNA, 19 nt, Human
agcagggagagccagccca

SEQ ID NO: 1273192 - RNA, 19 nt, Human
aggaggguccggggcaggg

SEQ ID NO: 1273193 - RNA, 19 nt, Human
aggcauccuuaugagaaag

SEQ ID NO: 1273194 - RNA, 24 nt, Human
aggccuccccacaccauccccacc

SEQ ID NO: 1273195 - RNA, 23 nt, Human
aggcgugaguuacugcacccggc

SEQ ID NO: 1273196 - RNA, 24 nt, Human
aggugaucugcccaccucggccuc

SEQ ID NO: 1273197 - RNA, 26 nt, Human
aggugcuggagaccucauaaggaagc

SEQ ID NO: 1273198 - RNA, 27 nt, Human
aggugcuggagaccucauaaggaagcc

SEQ ID NO: 1273199 - RNA, 22 nt, Human
aggugcuggcaggcacugggug

SEQ ID NO: 1273200 - RNA, 18 nt, Human
agguuggacacagaugcc

SEQ ID NO: 1273201 - RNA, 18 nt, Human
aguagcugggauuacagg

SEQ ID NO: 1273202 - RNA, 19 nt, Human
aguagcugggauuacaggc

SEQ ID NO: 1273203 - RNA, 19 nt, Human
aguagcugggauuacaggc

SEQ ID NO: 1273204 - RNA, 18 nt, Human
agugcugggauuacaggc

SEQ ID NO: 1273205 - RNA, 20 nt, Human
aguggaguggcgcaaucucg

SEQ ID NO: 1273206 - RNA, 24 nt, Human
aguggaguggcgcaaucucggcuc

SEQ ID NO: 1273207 - RNA, 22 nt, Human
auaacacacaacacacacauac

SEQ ID NO: 1273208 - RNA, 18 nt, Human
aucccgggagaggcaggg

SEQ ID NO: 1273209 - RNA, 24 nt, Human
auccucaccucucugugucuccau

SEQ ID NO: 1273210 - RNA, 20 nt, Human
auccugccgguuuccggggu

SEQ ID NO: 1273211 - RNA, 21 nt, Human
aucucagcuacccucgaagca

SEQ ID NO: 1273212 - RNA, 19 nt, Human
augcucccagggcuaccaa

SEQ ID NO: 1273213 - RNA, 21 nt, Human
augcuugcucguaaccacacc

SEQ ID NO: 1273214 - RNA, 18 nt, Human
auucuccugucucagccu

SEQ ID NO: 1273215 - RNA, 18 nt, Human
caaaaaacuccuacacga

SEQ ID NO: 1273216 - RNA, 24 nt, Human
caaagugcugggauuacaggcgug

SEQ ID NO: 1273217 - RNA, 22 nt, Human
caaggcaguugguauggguccc

SEQ ID NO: 1273218 - RNA, 22 nt, Human
caagugauucuccugucucagc

SEQ ID NO: 1273219 - RNA, 20 nt, Human
cacacaacacacacauacac

SEQ ID NO: 1273220 - RNA, 28 nt, Human
cacacacauacacacacgcgcacacaca

SEQ ID NO: 1273221 - RNA, 33 nt, Human
cacacacgcgcacacacacaaacacacauggug

SEQ ID NO: 1273222 - RNA, 18 nt, Human
cacaccugucuggacucu

SEQ ID NO: 1273223 - RNA, 23 nt, Human
cacacgcgcacacacacaaacac

SEQ ID NO: 1273224 - RNA, 23 nt, Human
caccauggugacccucccacccc

SEQ ID NO: 1273225 - RNA, 19 nt, Human
caccccagcaccccacacc

SEQ ID NO: 1273226 - RNA, 21 nt, Human
caccccagcaccccacaccuc

SEQ ID NO: 1273227 - RNA, 21 nt, Human
caccccagcugcccauaccug

SEQ ID NO: 1273228 - RNA, 22 nt, Human
caccgacacucucccaugcucc

SEQ ID NO: 1273229 - RNA, 24 nt, Human
caccucggccucccaaagugcugg

SEQ ID NO: 1273230 - RNA, 24 nt, Human
caccugagaagaguauuagguuca

SEQ ID NO: 1273231 - RNA, 18 nt, Human
cacucaguaaggaguggc

SEQ ID NO: 1273232 - RNA, 21 nt, Human
cacuggcacucucaccccugc

SEQ ID NO: 1273233 - RNA, 22 nt, Human
cagaaacagaaucuaccccuau

SEQ ID NO: 1273234 - RNA, 22 nt, Human
cagcacggugcguagcaggcag

SEQ ID NO: 1273235 - RNA, 26 nt, Human
cagcagcagaugcucuguucucccag

SEQ ID NO: 1273236 - RNA, 19 nt, Human
cagcauccgggccauuccu

SEQ ID NO: 1273237 - RNA, 27 nt, Human
cagcccaccauggugacccucccaccc

SEQ ID NO: 1273238 - RNA, 19 nt, Human
cagccccuaacacaguccu

SEQ ID NO: 1273239 - RNA, 18 nt, Human
cagcccucuuccucagcu

SEQ ID NO: 1273240 - RNA, 21 nt, Human
cagcugaccucugaucacacc

SEQ ID NO: 1273241 - RNA, 20 nt, Human
caggaaacauugccugccau

SEQ ID NO: 1273242 - RNA, 21 nt, Human
caggcgcccaccaccaugccc

SEQ ID NO: 1273243 - RNA, 21 nt, Human
cagggagagagcugccagaaa

SEQ ID NO: 1273244 - RNA, 19 nt, Human
caguggguaaacugaggcc

SEQ ID NO: 1273245 - RNA, 24 nt, Human
caguguuucccuauguuggccagg

SEQ ID NO: 1273246 - RNA, 21 nt, Human
caguugguauggguccccuca

SEQ ID NO: 1273247 - RNA, 20 nt, Human
cauaacacacaacacacaca

SEQ ID NO: 1273248 - RNA, 20 nt, Human
cauacggucccagcuuuacc

SEQ ID NO: 1273249 - RNA, 25 nt, Human
cauccccaccagcuacugguaguac

SEQ ID NO: 1273250 - RNA, 20 nt, Human
caucuacugucuaugaccuu

SEQ ID NO: 1273251 - RNA, 22 nt, Human
ccaaagugcugggauuacaggc

SEQ ID NO: 1273252 - RNA, 22 nt, Human
ccaaagugcugggauuacaggc

SEQ ID NO: 1273253 - RNA, 24 nt, Human
ccaaagugcugggauuacaggcgu

SEQ ID NO: 1273254 - RNA, 20 nt, Human
ccaaauacugaaacccuucu

SEQ ID NO: 1273255 - RNA, 25 nt, Human
ccacacauaacacacaacacacaca

SEQ ID NO: 1273256 - RNA, 23 nt, Human
ccagaaaggcuggaggguggcug

SEQ ID NO: 1273257 - RNA, 20 nt, Human
ccagcacggugcguagcagg

SEQ ID NO: 1273258 - RNA, 21 nt, Human
ccagcccagcagcagaugcuc

SEQ ID NO: 1273259 - RNA, 21 nt, Human
ccagcugaccucugaucacac

SEQ ID NO: 1273260 - RNA, 22 nt, Human
ccagcuuuaccuguaaugccuc

SEQ ID NO: 1273261 - RNA, 18 nt, Human
ccaggccaaggcaguugg

SEQ ID NO: 1273262 - RNA, 23 nt, Human
ccauacccccaccuggggaacug

SEQ ID NO: 1273263 - RNA, 21 nt, Human
cccacaccauccccaccagcu

SEQ ID NO: 1273264 - RNA, 22 nt, Human
cccacaccauccccaccagcua

SEQ ID NO: 1273265 - RNA, 19 nt, Human
cccacagcuguuguuccca

SEQ ID NO: 1273266 - RNA, 22 nt, Human
cccagcaccccacaccucuacc

SEQ ID NO: 1273267 - RNA, 23 nt, Human
ccccagcaccccacaccucuacc

SEQ ID NO: 1273268 - RNA, 20 nt, Human
ccccagcugcccauaccugg

SEQ ID NO: 1273269 - RNA, 19 nt, Human
cccccugcccggcccugcu

SEQ ID NO: 1273270 - RNA, 22 nt, Human
ccccuucauccugccgguuucc

SEQ ID NO: 1273271 - RNA, 20 nt, Human
cccguacauccugguuugcc

SEQ ID NO: 1273272 - RNA, 23 nt, Human
cccuaacacaguccugagcuuaa

SEQ ID NO: 1273273 - RNA, 21 nt, Human
ccggcccugcuucccucacac

SEQ ID NO: 1273274 - RNA, 20 nt, Human
ccuauguuggccaggcuggu

SEQ ID NO: 1273275 - RNA, 22 nt, Human
ccuauguuggccaggcuggucu

SEQ ID NO: 1273276 - RNA, 22 nt, Human
ccuauguuggccaggcuggucu

SEQ ID NO: 1273277 - RNA, 19 nt, Human
ccucccccacaaccaccac

SEQ ID NO: 1273278 - RNA, 22 nt, Human
ccucccuggcaccccagucccu

SEQ ID NO: 1273279 - RNA, 21 nt, Human
ccuccuggauucaagugauuc

SEQ ID NO: 1273280 - RNA, 24 nt, Human
ccuccuggauucaagugauucucc

SEQ ID NO: 1273281 - RNA, 24 nt, Human
ccugaccucaggugaucugcccac

SEQ ID NO: 1273282 - RNA, 23 nt, Human
ccuggauucaagugauucuccuc

SEQ ID NO: 1273283 - RNA, 23 nt, Human
ccuggauucaagugauucuccug

SEQ ID NO: 1273284 - RNA, 21 nt, Human
ccuuuggaccucaccucuguu

SEQ ID NO: 1273285 - RNA, 23 nt, Human
cgacauccuccacacguccagaa

SEQ ID NO: 1273286 - RNA, 23 nt, Human
cgagggacucgcgaaguaaucca

SEQ ID NO: 1273287 - RNA, 26 nt, Human
cgcacacacacaaacacacaugcucc

SEQ ID NO: 1273288 - RNA, 22 nt, Human
cgcauuacuauaaccacuaucc

SEQ ID NO: 1273289 - RNA, 22 nt, Human
cgggaacagaaacagaaucuac

SEQ ID NO: 1273290 - RNA, 28 nt, Human
cggggcagggcccagggagagagcugcc

SEQ ID NO: 1273291 - RNA, 18 nt, Human
cgucuaagggcugcccac

SEQ ID NO: 1273292 - RNA, 24 nt, Human
cuacucccaggcucucccaccccu

SEQ ID NO: 1273293 - RNA, 19 nt, Human
cuaggucuacaucuaugcc

SEQ ID NO: 1273294 - RNA, 23 nt, Human
cucacugcaaccuccuccuccug

SEQ ID NO: 1273295 - RNA, 24 nt, Human
cucacugcaaccuccuccuccugg

SEQ ID NO: 1273296 - RNA, 24 nt, Human
cucacugcaaccuccuccuccugg

SEQ ID NO: 1273297 - RNA, 24 nt, Human
cucagccuacugaguagcugggau

SEQ ID NO: 1273298 - RNA, 21 nt, Human
cucaugggcguagcugguucu

SEQ ID NO: 1273299 - RNA, 22 nt, Human
cucccaccccucccuggcaccc

SEQ ID NO: 1273300 - RNA, 25 nt, Human
cucccaggcucucccaccccucccu

SEQ ID NO: 1273301 - RNA, 23 nt, Human
cucccagggcuaccaaugacucc

SEQ ID NO: 1273302 - RNA, 23 nt, Human
cucccuggcaccccagucccugg

SEQ ID NO: 1273303 - RNA, 24 nt, Human
cucucccaccccucccuggcaccc

SEQ ID NO: 1273304 - RNA, 20 nt, Human
cucugucacccaggcuagag

SEQ ID NO: 1273305 - RNA, 22 nt, Human
cugagaagaguauuagguucac

SEQ ID NO: 1273306 - RNA, 22 nt, Human
cugaguagcugggauuacaggc

SEQ ID NO: 1273307 - RNA, 22 nt, Human
cugaucacaccauacccccacc

SEQ ID NO: 1273308 - RNA, 23 nt, Human
cugcaaccuccuccuccuggauu

SEQ ID NO: 1273309 - RNA, 24 nt, Human
cugcaaccuccuccuccuggauuc

SEQ ID NO: 1273310 - RNA, 21 nt, Human
cugccuggcuccugguguccc

SEQ ID NO: 1273311 - RNA, 22 nt, Human
cugcugggaccuaacucccguc

SEQ ID NO: 1273312 - RNA, 20 nt, Human
cugcuucccucacacccaca

SEQ ID NO: 1273313 - RNA, 19 nt, Human
cuggcacucucaccccugc

SEQ ID NO: 1273314 - RNA, 23 nt, Human
cugucucagccuacugaguagcu

SEQ ID NO: 1273315 - RNA, 21 nt, Human
cuucacucuaaccugccccuc

SEQ ID NO: 1273316 - RNA, 21 nt, Human
cuucaggaaugaggccucccc

SEQ ID NO: 1273317 - RNA, 20 nt, Human
cuucuguuuccucuuugccc

SEQ ID NO: 1273318 - RNA, 23 nt, Human
cuuggcauccucaccucucugug

SEQ ID NO: 1273319 - RNA, 19 nt, Human
gaacuuagaguagggagua

SEQ ID NO: 1273320 - RNA, 26 nt, Human
gaagagaucagacugggcuuuagucu

SEQ ID NO: 1273321 - RNA, 22 nt, Human
gacccucccaccccagcugccc

SEQ ID NO: 1273322 - RNA, 24 nt, Human
gaccucaggugaucugcccaccuc

SEQ ID NO: 1273323 - RNA, 21 nt, Human
gagacagagucucgcucuguc

SEQ ID NO: 1273324 - RNA, 22 nt, Human
gagagcuccccaccccagcacc

SEQ ID NO: 1273325 - RNA, 26 nt, Human
gagaggccuccagccagcacacucag

SEQ ID NO: 1273326 - RNA, 20 nt, Human
gaggaacgcggggcugcccc

SEQ ID NO: 1273327 - RNA, 24 nt, Human
gaggugcuggagaccucauaagga

SEQ ID NO: 1273328 - RNA, 18 nt, Human
gaguaaaggagaaacagg

SEQ ID NO: 1273329 - RNA, 20 nt, Human
gaguaccccaucaggaugcu

SEQ ID NO: 1273330 - RNA, 20 nt, Human
gaguagcugggauuacaggc

SEQ ID NO: 1273331 - RNA, 25 nt, Human
gaguagcugggauuacaggcgccca

SEQ ID NO: 1273332 - RNA, 21 nt, Human
gaguggcgcaaucucggcuca

SEQ ID NO: 1273333 - RNA, 24 nt, Human
gauuacaggcgcccaccaccaugc

SEQ ID NO: 1273334 - RNA, 22 nt, Human
gauuacaggcgugaguuacugc

SEQ ID NO: 1273335 - RNA, 23 nt, Human
gauuacaggcgugaguuacugca

SEQ ID NO: 1273336 - RNA, 22 nt, Human
gcaaccuccuccuccuggauuc

SEQ ID NO: 1273337 - RNA, 21 nt, Human
gcauuacuauaaccacuaucc

SEQ ID NO: 1273338 - RNA, 18 nt, Human
gccccuggccagcuucug

SEQ ID NO: 1273339 - RNA, 20 nt, Human
gcucacugcaaccuccuccu

SEQ ID NO: 1273340 - RNA, 22 nt, Human
gcucacugcaaccuccuccucc

SEQ ID NO: 1273341 - RNA, 26 nt, Human
gcucacugcaaccuccuccuccugga

SEQ ID NO: 1273342 - RNA, 19 nt, Human
gcucccagcugaccucuga

SEQ ID NO: 1273343 - RNA, 24 nt, Human
gcucugucacccaggcuagagugg

SEQ ID NO: 1273344 - RNA, 19 nt, Human
gcugcccacuccugccagg

SEQ ID NO: 1273345 - RNA, 23 nt, Human
gcuggucuugaacuccugaccuc

SEQ ID NO: 1273346 - RNA, 21 nt, Human
ggacaucuacugucuaugacc

SEQ ID NO: 1273347 - RNA, 22 nt, Human
ggagagccagcccagcagcaga

SEQ ID NO: 1273348 - RNA, 21 nt, Human
ggccaggaaauggaaggccaa

SEQ ID NO: 1273349 - RNA, 23 nt, Human
ggcccugcuucccucacacccac

SEQ ID NO: 1273350 - RNA, 24 nt, Human
ggcuggucuugaacuccugaccuc

SEQ ID NO: 1273351 - RNA, 23 nt, Human
gggaacagaaacagaaucuaccc

SEQ ID NO: 1273352 - RNA, 22 nt, Human
gggaacugcuggcucuggcuag

SEQ ID NO: 1273353 - RNA, 22 nt, Human
gggacagccccuaacacagucc

SEQ ID NO: 1273354 - RNA, 21 nt, Human
ggguccggggcagggcccagg

SEQ ID NO: 1273355 - RNA, 20 nt, Human
ggucugcccaugcuugcucg

SEQ ID NO: 1273356 - RNA, 19 nt, Human
ggucuugaacuccugaccu

SEQ ID NO: 1273357 - RNA, 18 nt, Human
guagcugggauuacaggc

SEQ ID NO: 1273358 - RNA, 20 nt, Human
gucaaagugacuugccccaa

SEQ ID NO: 1273359 - RNA, 23 nt, Human
gucaccuuuauuacccuguguac

SEQ ID NO: 1273360 - RNA, 23 nt, Human
gucccuccuucaggaaugaggcc

SEQ ID NO: 1273361 - RNA, 24 nt, Human
gugaucugcccaccucggccuccc

SEQ ID NO: 1273362 - RNA, 21 nt, Human
gugauucuccugucucagccu

SEQ ID NO: 1273363 - RNA, 19 nt, Human
gugguaccauccacccaca

SEQ ID NO: 1273364 - RNA, 20 nt, Human
uaaaaugaagccacaguguc

SEQ ID NO: 1273365 - RNA, 21 nt, Human
uaaaaugaagccacagugucc

SEQ ID NO: 1273366 - RNA, 25 nt, Human
uaaaucaccugaggcaaaccucugu

SEQ ID NO: 1273367 - RNA, 31 nt, Human
uaacacacaacacacacauacacacacgcgg

SEQ ID NO: 1273368 - RNA, 19 nt, Human
uaagaaaugccugcagaau

SEQ ID NO: 1273369 - RNA, 28 nt, Human
uaagacgggaacagaaacagaaucuacc

SEQ ID NO: 1273370 - RNA, 24 nt, Human
uaauuuuuguauuuuuaguugaga

SEQ ID NO: 1273371 - RNA, 22 nt, Human
uacacacacgcgcacacacaca

SEQ ID NO: 1273372 - RNA, 23 nt, Human
uacacacacgcgcacacacacaa

SEQ ID NO: 1273373 - RNA, 24 nt, Human
uacagcauccgggccauuccuagg

SEQ ID NO: 1273374 - RNA, 19 nt, Human
uacaggcgugaguuacugc

SEQ ID NO: 1273375 - RNA, 22 nt, Human
uacccccaccuggggaacugcu

SEQ ID NO: 1273376 - RNA, 18 nt, Human
uacccccuggauuauccu

SEQ ID NO: 1273377 - RNA, 22 nt, Human
uaccuguaaugccucccccaca

SEQ ID NO: 1273378 - RNA, 20 nt, Human
uacuauaaccacuaucccca

SEQ ID NO: 1273379 - RNA, 24 nt, Human
uacugaguagcugggauuacaggc

SEQ ID NO: 1273380 - RNA, 18 nt, Human
uagcucccagcugaccuc

SEQ ID NO: 1273381 - RNA, 21 nt, Human
uagcugguucucaggcuuucu

SEQ ID NO: 1273382 - RNA, 24 nt, Human
uauguuggccaggcuggucuugaa

SEQ ID NO: 1273383 - RNA, 18 nt, Human
uauuuuauuuucugggga

SEQ ID NO: 1273384 - RNA, 19 nt, Human
ucaacuuccuuguccaaaa

SEQ ID NO: 1273385 - RNA, 27 nt, Human
ucacacccacagcuguuguucccaaaa

SEQ ID NO: 1273386 - RNA, 18 nt, Human
ucacugcaaccuccuccc

SEQ ID NO: 1273387 - RNA, 22 nt, Human
ucacugcaaccuccuccuccug

SEQ ID NO: 1273388 - RNA, 23 nt, Human
ucacugcaaccuccuccuccugg

SEQ ID NO: 1273389 - RNA, 27 nt, Human
ucacugcaaccuccuccuccuggauuc

SEQ ID NO: 1273390 - RNA, 20 nt, Human
ucagccuacugaguagcugg

SEQ ID NO: 1273391 - RNA, 18 nt, Human
uccacacguccagaagcu

SEQ ID NO: 1273392 - RNA, 22 nt, Human
uccagaaaacccuaccugggac

SEQ ID NO: 1273393 - RNA, 23 nt, Human
uccagggaauuugggugcacagu

SEQ ID NO: 1273394 - RNA, 24 nt, Human
ucccaaagugcugggauuacaggc

SEQ ID NO: 1273395 - RNA, 18 nt, Human
ucccaccccagcugccca

SEQ ID NO: 1273396 - RNA, 20 nt, Human
ucccaccccagcugcccaua

SEQ ID NO: 1273397 - RNA, 24 nt, Human
ucccaccccucccuggcaccccag

SEQ ID NO: 1273398 - RNA, 22 nt, Human
ucccuauguuggccaggcuggu

SEQ ID NO: 1273399 - RNA, 22 nt, Human
ucccuccagacagacgccccag

SEQ ID NO: 1273400 - RNA, 23 nt, Human
uccgugaccgaggaacgcggggc

SEQ ID NO: 1273401 - RNA, 25 nt, Human
uccucagcuggaacaaccgagaggc

SEQ ID NO: 1273402 - RNA, 21 nt, Human
uccugccgguuuccggggugg

SEQ ID NO: 1273403 - RNA, 21 nt, Human
uccuggauucaagugauucuc

SEQ ID NO: 1273404 - RNA, 24 nt, Human
uccuggauucaagugauucuccug

SEQ ID NO: 1273405 - RNA, 18 nt, Human
ucggccucccaaagugcu

SEQ ID NO: 1273406 - RNA, 18 nt, Human
ucucaccccugccuggcu

SEQ ID NO: 1273407 - RNA, 20 nt, Human
ucucccaccccucccuggca

SEQ ID NO: 1273408 - RNA, 23 nt, Human
ucucccugauaaaucaccugagg

SEQ ID NO: 1273409 - RNA, 18 nt, Human
ucuccugucucagccuac

SEQ ID NO: 1273410 - RNA, 19 nt, Human
ucucgcucugucacccagg

SEQ ID NO: 1273411 - RNA, 23 nt, Human
ucucgcucugucacccaggcuag

SEQ ID NO: 1273412 - RNA, 26 nt, Human
ucucgcucugucacccaggcuagagu

SEQ ID NO: 1273413 - RNA, 27 nt, Human
ucucgcucugucacccaggcuagagug

SEQ ID NO: 1273414 - RNA, 18 nt, Human
ucugaucacaccauaccc

SEQ ID NO: 1273415 - RNA, 20 nt, Human
ucugcauuucuguucuaggg

SEQ ID NO: 1273416 - RNA, 22 nt, Human
ucugucacccaggcuagagugg

SEQ ID NO: 1273417 - RNA, 24 nt, Human
ucugucacccaggcuagaguggag

SEQ ID NO: 1273418 - RNA, 24 nt, Human
ucuuccucagcuggaacaaccgag

SEQ ID NO: 1273419 - RNA, 23 nt, Human
ucuugaacuccugaccucaggug

SEQ ID NO: 1273420 - RNA, 24 nt, Human
ugaagccacaguguccaggaaucc

SEQ ID NO: 1273421 - RNA, 23 nt, Human
ugaccagguuggacacagaugcc

SEQ ID NO: 1273422 - RNA, 23 nt, Human
ugacccucccaccccagcugccc

SEQ ID NO: 1273423 - RNA, 18 nt, Human
ugaccucaggugaucugc

SEQ ID NO: 1273424 - RNA, 20 nt, Human
ugaccucaggugaucugccc

SEQ ID NO: 1273425 - RNA, 21 nt, Human
ugaccucaggugaucugccca

SEQ ID NO: 1273426 - RNA, 24 nt, Human
ugaccucaggugaucugcccaccu

SEQ ID NO: 1273427 - RNA, 21 nt, Human
ugagaaaacugcaagccacag

SEQ ID NO: 1273428 - RNA, 19 nt, Human
ugagaagaguauuagguuc

SEQ ID NO: 1273429 - RNA, 22 nt, Human
ugagacaguguuucccuauguu

SEQ ID NO: 1273430 - RNA, 22 nt, Human
ugagauuguugucuccuccagu

SEQ ID NO: 1273431 - RNA, 25 nt, Human
ugagauuguugucuccuccaguggg

SEQ ID NO: 1273432 - RNA, 18 nt, Human
ugaguaucagcuaccuuu

SEQ ID NO: 1273433 - RNA, 24 nt, Human
ugaucugcccaccucggccuccca

SEQ ID NO: 1273434 - RNA, 19 nt, Human
ugcugaaugauaaauuaua

SEQ ID NO: 1273435 - RNA, 23 nt, Human
ugcugaggggcuccacccaggug

SEQ ID NO: 1273436 - RNA, 20 nt, Human
ugcugggauuacaggcguga

SEQ ID NO: 1273437 - RNA, 20 nt, Human
uggauucaagugauucuccu

SEQ ID NO: 1273438 - RNA, 24 nt, Human
uggauucaagugauucuccugucu

SEQ ID NO: 1273439 - RNA, 23 nt, Human
uggcacaaagagacucaagugac

SEQ ID NO: 1273440 - RNA, 18 nt, Human
uggcagaggugggauuca

SEQ ID NO: 1273441 - RNA, 24 nt, Human
uggccaggcuggucuugaacuccu

SEQ ID NO: 1273442 - RNA, 24 nt, Human
uggcuccuggugucccaccgacac

SEQ ID NO: 1273443 - RNA, 21 nt, Human
ugggauuacaggcgcccacca

SEQ ID NO: 1273444 - RNA, 24 nt, Human
ugggauuacaggcgcccaccacca

SEQ ID NO: 1273445 - RNA, 25 nt, Human
ugggauuacaggcgcccaccaccau

SEQ ID NO: 1273446 - RNA, 18 nt, Human
ugggauuacaggcgugag

SEQ ID NO: 1273447 - RNA, 18 nt, Human
ugggauuacaggcgugag

SEQ ID NO: 1273448 - RNA, 18 nt, Human
ugggauuacaggcgugag

SEQ ID NO: 1273449 - RNA, 22 nt, Human
ugggauuacaggcgugaguuac

SEQ ID NO: 1273450 - RNA, 22 nt, Human
ugggauuacaggcgugaguuac

SEQ ID NO: 1273451 - RNA, 24 nt, Human
ugggauuacaggcgugaguuacug

SEQ ID NO: 1273452 - RNA, 24 nt, Human
ugggauuacaggcgugaguuacug

SEQ ID NO: 1273453 - RNA, 25 nt, Human
ugggauuacaggcgugaguuacugc

SEQ ID NO: 1273454 - RNA, 18 nt, Human
uggguccccucacucagu

SEQ ID NO: 1273455 - RNA, 19 nt, Human
uggugcugaacaggacgag

SEQ ID NO: 1273456 - RNA, 20 nt, Human
uguccaaaaaacuccuacac

SEQ ID NO: 1273457 - RNA, 25 nt, Human
uguccaaaaaacuccuacacgaggg

SEQ ID NO: 1273458 - RNA, 20 nt, Human
ugucccaccgacacucuccc

SEQ ID NO: 1273459 - RNA, 24 nt, Human
ugugacuccagggaauuugggugc

SEQ ID NO: 1273460 - RNA, 24 nt, Human
ugugccacccaugucccuccuuca

SEQ ID NO: 1273461 - RNA, 22 nt, Human
ugugcugaaugauaaauuauau

SEQ ID NO: 1273462 - RNA, 18 nt, Human
ugugugcugaaugauaaa

SEQ ID NO: 1273463 - RNA, 21 nt, Human
uuaaagcacuuggcauccuca

SEQ ID NO: 1273464 - RNA, 23 nt, Human
uucaagugauucuccugucucag

SEQ ID NO: 1273465 - RNA, 22 nt, Human
uucacacucagaccucuauuuc

SEQ ID NO: 1273466 - RNA, 23 nt, Human
uucacacucagaccucuauuucu

SEQ ID NO: 1273467 - RNA, 24 nt, Human
uucacucuaaccugccccucccca

SEQ ID NO: 1273468 - RNA, 18 nt, Human
uucacuucucucccaaca

SEQ ID NO: 1273469 - RNA, 21 nt, Human
uuccucagcuggaacaaccga

SEQ ID NO: 1273470 - RNA, 23 nt, Human
uuccugagccuucacucuaaccu

SEQ ID NO: 1273471 - RNA, 18 nt, Human
uucucaaugggaucgaca

SEQ ID NO: 1273472 - RNA, 27 nt, Human
uugaugccacacauaacacacaacaca

SEQ ID NO: 1273473 - RNA, 23 nt, Human
uuggcaaagaucccgggagaggc

SEQ ID NO: 1273474 - RNA, 21 nt, Human
uuucccuauguuggccaggcu

SEQ ID NO: 1273475 - RNA, 18 nt, Human
uuucuguucuacauuugg

SEQ ID NO: 1273476 - RNA, 24 nt, Human
uuuucugagaggugcuggcaggca

SEQ ID NO: 1273477 - RNA, 22 nt, Human
uuuuguauuuuuaguugagaca

SEQ ID NO: 1273478 - RNA, 20 nt, Human
uuuuuguauuuuuaguugag

SEQ ID NO: 1273479 - RNA, 23 nt, Human
agaaguaucuuguuuaggggcug

SEQ ID NO: 1273480 - RNA, 27 nt, Human
agaggugugggcccggugacgaccgac

SEQ ID NO: 1273481 - RNA, 23 nt, Human
aggcggccuccugagcucgcagc

SEQ ID NO: 1273482 - RNA, 22 nt, Human
aucugccccuaggaauccccau

SEQ ID NO: 1273483 - RNA, 19 nt, Human
caaagaaccccacuccagu

SEQ ID NO: 1273484 - RNA, 23 nt, Human
caaauccucccacccccaggacu

SEQ ID NO: 1273485 - RNA, 21 nt, Human
cacucaaagaaccccacucca

SEQ ID NO: 1273486 - RNA, 22 nt, Human
caggacucaggagggaggggca

SEQ ID NO: 1273487 - RNA, 19 nt, Human
caggaggacagcugaccuc

SEQ ID NO: 1273488 - RNA, 18 nt, Human
cagugagcucccucaaau

SEQ ID NO: 1273489 - RNA, 19 nt, Human
cagugagcucccucaaauc

SEQ ID NO: 1273490 - RNA, 20 nt, Human
ccacucaaagaaccccacuc

SEQ ID NO: 1273491 - RNA, 18 nt, Human
ccacuccaguggggcuug

SEQ ID NO: 1273492 - RNA, 19 nt, Human
ccaggccagguaggcagug

SEQ ID NO: 1273493 - RNA, 21 nt, Human
cccacccccaggacucaggag

SEQ ID NO: 1273494 - RNA, 18 nt, Human
ccccguagccuuucccuu

SEQ ID NO: 1273495 - RNA, 20 nt, Human
ccucgucccugccuccccca

SEQ ID NO: 1273496 - RNA, 25 nt, Human
ccuucccucgucccugccuccccca

SEQ ID NO: 1273497 - RNA, 21 nt, Human
cggccuccugagcucgcagcc

SEQ ID NO: 1273498 - RNA, 21 nt, Human
cucccccacucaaagaacccc

SEQ ID NO: 1273499 - RNA, 19 nt, Human
gagagcgcacaugcugugu

SEQ ID NO: 1273500 - RNA, 19 nt, Human
gagcucgcagccagccagg

SEQ ID NO: 1273501 - RNA, 21 nt, Human
gccagguaggcagugagcucc

SEQ ID NO: 1273502 - RNA, 20 nt, Human
gccccguagccuuucccuuc

SEQ ID NO: 1273503 - RNA, 21 nt, Human
ggcaggagaggugugggcccg

SEQ ID NO: 1273504 - RNA, 22 nt, Human
ggcuggggacaggguggggaag

SEQ ID NO: 1273505 - RNA, 21 nt, Human
gggcagacagccccaggccag

SEQ ID NO: 1273506 - RNA, 28 nt, Human
gggcaggagaggugugggcccggugugc

SEQ ID NO: 1273507 - RNA, 22 nt, Human
gugcaguccucaggcggccucc

SEQ ID NO: 1273508 - RNA, 24 nt, Human
gugggcagacagccccaggccagg

SEQ ID NO: 1273509 - RNA, 22 nt, Human
gugugggcagacagccccaggc

SEQ ID NO: 1273510 - RNA, 24 nt, Human
uagccuuucccuuccggagggccu

SEQ ID NO: 1273511 - RNA, 24 nt, Human
uaggcagugagcucccucaaaucc

SEQ ID NO: 1273512 - RNA, 20 nt, Human
ucccucaaauccucccaccc

SEQ ID NO: 1273513 - RNA, 19 nt, Human
ucccucgucccugccuccc

SEQ ID NO: 1273514 - RNA, 21 nt, Human
ucccugccucccccacucaaa

SEQ ID NO: 1273515 - RNA, 21 nt, Human
ugaggcacaugccccguagcc

SEQ ID NO: 1273516 - RNA, 21 nt, Human
ugccucccccacucaaagaac

SEQ ID NO: 1273517 - RNA, 19 nt, Human
uggggacaggguggggaag

SEQ ID NO: 1273518 - RNA, 18 nt, Human
aaacaccucaccuugucu

SEQ ID NO: 1273519 - RNA, 23 nt, Human
aaagaacauccuuauuuacacca

SEQ ID NO: 1273520 - RNA, 19 nt, Human
aaagcaguuucaucguuuu

SEQ ID NO: 1273521 - RNA, 24 nt, Human
aaagugcugcaauuacagguguga

SEQ ID NO: 1273522 - RNA, 20 nt, Human
aaccugguuuucggcucugg

SEQ ID NO: 1273523 - RNA, 20 nt, Human
aacuaaguaaccaacccccc

SEQ ID NO: 1273524 - RNA, 20 nt, Human
aacuuguaaaccacccccuc

SEQ ID NO: 1273525 - RNA, 22 nt, Human
aagcaaccccccacuccugggc

SEQ ID NO: 1273526 - RNA, 19 nt, Human
aagggagaaggggaggggg

SEQ ID NO: 1273527 - RNA, 18 nt, Human
aaguaaccaacccccaga

SEQ ID NO: 1273528 - RNA, 24 nt, Human
aagugaucugccugccucagccuc

SEQ ID NO: 1273529 - RNA, 21 nt, Human
aaguggcacaaucuuggcuca

SEQ ID NO: 1273530 - RNA, 20 nt, Human
aaucuccgccuccccgguuc

SEQ ID NO: 1273531 - RNA, 18 nt, Human
aauuacaggugugagcca

SEQ ID NO: 1273532 - RNA, 21 nt, Human
aauuacaggugugagccacca

SEQ ID NO: 1273533 - RNA, 24 nt, Human
aauuacaggugugagccaccaugc

SEQ ID NO: 1273534 - RNA, 20 nt, Human
acagaaacaaaacagagauc

SEQ ID NO: 1273535 - RNA, 24 nt, Human
acauagcccuuccccauguacagc

SEQ ID NO: 1273536 - RNA, 24 nt, Human
acccuguuggccaggcuggucuug

SEQ ID NO: 1273537 - RNA, 25 nt, Human
acccuguuggccaggcuggucuuga

SEQ ID NO: 1273538 - RNA, 23 nt, Human
acgcaucucuguagugggaggcc

SEQ ID NO: 1273539 - RNA, 20 nt, Human
agaaaaaauucccucaggua

SEQ ID NO: 1273540 - RNA, 19 nt, Human
agacagaggaucacauagg

SEQ ID NO: 1273541 - RNA, 18 nt, Human
agagaaagagggccugag

SEQ ID NO: 1273542 - RNA, 22 nt, Human
agaguaacucacagaaacaaaa

SEQ ID NO: 1273543 - RNA, 24 nt, Human
aggaaaagaacauccuuauuuaca

SEQ ID NO: 1273544 - RNA, 20 nt, Human
aggcaagggagaaggggagg

SEQ ID NO: 1273545 - RNA, 20 nt, Human
aggcaagggagaaggggagg

SEQ ID NO: 1273546 - RNA, 26 nt, Human
aggcaagggagaaggggagggggugc

SEQ ID NO: 1273547 - RNA, 21 nt, Human
aggcagggaggacuagggccg

SEQ ID NO: 1273548 - RNA, 18 nt, Human
agggagaaggggaggggg

SEQ ID NO: 1273549 - RNA, 23 nt, Human
agugauguggcaggcaagacagg

SEQ ID NO: 1273550 - RNA, 24 nt, Human
agugauguggcaggcaagacaggg

SEQ ID NO: 1273551 - RNA, 19 nt, Human
agugggaggccacaugaaa

SEQ ID NO: 1273552 - RNA, 18 nt, Human
auacgcaucucuguagug

SEQ ID NO: 1273553 - RNA, 23 nt, Human
aucacaacugagcggcugagaac

SEQ ID NO: 1273554 - RNA, 25 nt, Human
augaaagugaaccuaacucauguac

SEQ ID NO: 1273555 - RNA, 24 nt, Human
augauugacuacaaugauucaugc

SEQ ID NO: 1273556 - RNA, 18 nt, Human
augcggggcucgcgcccc

SEQ ID NO: 1273557 - RNA, 21 nt, Human
augggacuuaggggacuuucc

SEQ ID NO: 1273558 - RNA, 18 nt, Human
augggguuucacccuguu

SEQ ID NO: 1273559 - RNA, 20 nt, Human
augggguuucacccuguugg

SEQ ID NO: 1273560 - RNA, 24 nt, Human
augggguuucacccuguuggccag

SEQ ID NO: 1273561 - RNA, 19 nt, Human
auuguggugguggaggugg

SEQ ID NO: 1273562 - RNA, 24 nt, Human
auuuuuguauuuuuaguagagaug

SEQ ID NO: 1273563 - RNA, 24 nt, Human
caaagugcugcaauuacaggugug

SEQ ID NO: 1273564 - RNA, 22 nt, Human
caagcaauuuuccugccucagc

SEQ ID NO: 1273565 - RNA, 22 nt, Human
caagugaucugccugccucagc

SEQ ID NO: 1273566 - RNA, 21 nt, Human
caauucagaaccagaggccaa

SEQ ID NO: 1273567 - RNA, 26 nt, Human
cacagacagaaaucauuuuaagacag

SEQ ID NO: 1273568 - RNA, 19 nt, Human
cacccucuccccaggccag

SEQ ID NO: 1273569 - RNA, 21 nt, Human
cacccuguuggccaggcuggu

SEQ ID NO: 1273570 - RNA, 24 nt, Human
cacccuguuggccaggcuggucuu

SEQ ID NO: 1273571 - RNA, 23 nt, Human
cacuugguaaaggcaacacagcu

SEQ ID NO: 1273572 - RNA, 28 nt, Human
cagauaggcaagggagaaggggaggggg

SEQ ID NO: 1273573 - RNA, 19 nt, Human
cagcaguagugggcucugg

SEQ ID NO: 1273574 - RNA, 20 nt, Human
cagcaguagugggcucuggc

SEQ ID NO: 1273575 - RNA, 21 nt, Human
cagcaguagugggcucuggga

SEQ ID NO: 1273576 - RNA, 21 nt, Human
cagccccacuuucucauccug

SEQ ID NO: 1273577 - RNA, 21 nt, Human
caggaaaagaacauccuuauu

SEQ ID NO: 1273578 - RNA, 21 nt, Human
caggcgcccaccaucacgccu

SEQ ID NO: 1273579 - RNA, 22 nt, Human
caguagugggcucuggccccgc

SEQ ID NO: 1273580 - RNA, 21 nt, Human
cauagacaaacaggccauuca

SEQ ID NO: 1273581 - RNA, 27 nt, Human
cauccugacaacccucuuucccacacc

SEQ ID NO: 1273582 - RNA, 21 nt, Human
ccaaagugcugcaauuacagg

SEQ ID NO: 1273583 - RNA, 24 nt, Human
ccaaagugcugcaauuacaggugu

SEQ ID NO: 1273584 - RNA, 20 nt, Human
ccaccaugcccagcuugaac

SEQ ID NO: 1273585 - RNA, 20 nt, Human
ccacugcuguucaugagacc

SEQ ID NO: 1273586 - RNA, 24 nt, Human
ccaggccagcuacucuaacucaua

SEQ ID NO: 1273587 - RNA, 18 nt, Human
ccagggaggcacccucuc

SEQ ID NO: 1273588 - RNA, 22 nt, Human
ccaguggccagcuaucuagugg

SEQ ID NO: 1273589 - RNA, 22 nt, Human
ccauagacaaacaggccauuca

SEQ ID NO: 1273590 - RNA, 22 nt, Human
cccacaccgggucauacagagg

SEQ ID NO: 1273591 - RNA, 18 nt, Human
cccacagagaaagagggc

SEQ ID NO: 1273592 - RNA, 19 nt, Human
cccacagagaaagagggcc

SEQ ID NO: 1273593 - RNA, 19 nt, Human
cccccagaaagcaguuuca

SEQ ID NO: 1273594 - RNA, 23 nt, Human
ccccgguucaagcaauuuuccug

SEQ ID NO: 1273595 - RNA, 18 nt, Human
cccucgggcuccucccgc

SEQ ID NO: 1273596 - RNA, 18 nt, Human
cccucgggcuccucccgc

SEQ ID NO: 1273597 - RNA, 23 nt, Human
ccuccagaugaucccucugacuu

SEQ ID NO: 1273598 - RNA, 20 nt, Human
ccugacaacccucuuuccca

SEQ ID NO: 1273599 - RNA, 21 nt, Human
ccugaccucaagugaucugcc

SEQ ID NO: 1273600 - RNA, 23 nt, Human
ccugaccucaagugaucugccug

SEQ ID NO: 1273601 - RNA, 24 nt, Human
ccugccucagccucccaaagugcu

SEQ ID NO: 1273602 - RNA, 18 nt, Human
ccugccucagcuuccugu

SEQ ID NO: 1273603 - RNA, 21 nt, Human
ccuucucuucccuaaaaaaaa

SEQ ID NO: 1273604 - RNA, 18 nt, Human
cggggacagcugccgccg

SEQ ID NO: 1273605 - RNA, 18 nt, Human
cucaagugaucugccugc

SEQ ID NO: 1273606 - RNA, 23 nt, Human
cucaagugaucugccugccucag

SEQ ID NO: 1273607 - RNA, 23 nt, Human
cucagcuuccuguguagcuggga

SEQ ID NO: 1273608 - RNA, 21 nt, Human
cucauaacccucugaagacac

SEQ ID NO: 1273609 - RNA, 26 nt, Human
cuccugaccucaagugaucugccugc

SEQ ID NO: 1273610 - RNA, 18 nt, Human
cucuaacucauaacccuc

SEQ ID NO: 1273611 - RNA, 20 nt, Human
cucugucgcccaggcuggaa

SEQ ID NO: 1273612 - RNA, 20 nt, Human
cugaagacacuugguaaagg

SEQ ID NO: 1273613 - RNA, 24 nt, Human
cugaugaaauggaagaaagcauua

SEQ ID NO: 1273614 - RNA, 24 nt, Human
cugccucagccucccaaagugcug

SEQ ID NO: 1273615 - RNA, 23 nt, Human
cugccucagcuuccuguguagcu

SEQ ID NO: 1273616 - RNA, 23 nt, Human
cuguuggccaggcuggucuugaa

SEQ ID NO: 1273617 - RNA, 22 nt, Human
cuuuccuuuccuuugacagagu

SEQ ID NO: 1273618 - RNA, 24 nt, Human
gaccucaagugaucugccugccuc

SEQ ID NO: 1273619 - RNA, 27 nt, Human
gagaaggggagggggugcaguggggau

SEQ ID NO: 1273620 - RNA, 22 nt, Human
gagacccacagagaaagagggc

SEQ ID NO: 1273621 - RNA, 20 nt, Human
gagaugggguuucacccugu

SEQ ID NO: 1273622 - RNA, 24 nt, Human
gagaugggguuucacccuguuggc

SEQ ID NO: 1273623 - RNA, 18 nt, Human
gagcggcugagaacugga

SEQ ID NO: 1273624 - RNA, 21 nt, Human
gagcucaggacauuuggacag

SEQ ID NO: 1273625 - RNA, 21 nt, Human
gaucugccugccucagccucc

SEQ ID NO: 1273626 - RNA, 23 nt, Human
gcccaggcuggaaugaaguggca

SEQ ID NO: 1273627 - RNA, 18 nt, Human
gcccucuccacugccagg

SEQ ID NO: 1273628 - RNA, 24 nt, Human
gccucagcuuccuguguagcuggg

SEQ ID NO: 1273629 - RNA, 22 nt, Human
gccuggguaauuuuuguauuuu

SEQ ID NO: 1273630 - RNA, 20 nt, Human
gccuugaucaucagaaaggg

SEQ ID NO: 1273631 - RNA, 23 nt, Human
gcucaauaaacuuguaaaccacc

SEQ ID NO: 1273632 - RNA, 24 nt, Human
gcucugucgcccaggcuggaauga

SEQ ID NO: 1273633 - RNA, 23 nt, Human
gcuggucuugaacuccugaccuc

SEQ ID NO: 1273634 - RNA, 24 nt, Human
ggacuagggccgagcuucugagaa

SEQ ID NO: 1273635 - RNA, 18 nt, Human
ggagcgcgacccggaagc

SEQ ID NO: 1273636 - RNA, 18 nt, Human
ggcaugaccaguggccag

SEQ ID NO: 1273637 - RNA, 24 nt, Human
ggcuggucuugaacuccugaccuc

SEQ ID NO: 1273638 - RNA, 18 nt, Human
gggaaaggaauacagagu

SEQ ID NO: 1273639 - RNA, 22 nt, Human
gggguuucacccuguuggccag

SEQ ID NO: 1273640 - RNA, 19 nt, Human
ggucuugaacuccugaccu

SEQ ID NO: 1273641 - RNA, 20 nt, Human
guaaccaacccccagaaagc

SEQ ID NO: 1273642 - RNA, 18 nt, Human
guagcugggauuacaggc

SEQ ID NO: 1273643 - RNA, 18 nt, Human
guagcugggauuacaggc

SEQ ID NO: 1273644 - RNA, 19 nt, Human
guauccauucacuacuuga

SEQ ID NO: 1273645 - RNA, 19 nt, Human
gugaagaaaggcaccagcc

SEQ ID NO: 1273646 - RNA, 18 nt, Human
gugaucugccugccucag

SEQ ID NO: 1273647 - RNA, 24 nt, Human
gugaucugccugccucagccuccc

SEQ ID NO: 1273648 - RNA, 19 nt, Human
guggucuuaucgucacccu

SEQ ID NO: 1273649 - RNA, 24 nt, Human
guuucgcucugucgcccaggcugg

SEQ ID NO: 1273650 - RNA, 23 nt, Human
uaaaaggaacaggaaaagaacau

SEQ ID NO: 1273651 - RNA, 20 nt, Human
uaaaaugaguaguauauccc

SEQ ID NO: 1273652 - RNA, 24 nt, Human
uaaagaucaaacccagggaggcac

SEQ ID NO: 1273653 - RNA, 22 nt, Human
uaaccaacccccagaaagcagu

SEQ ID NO: 1273654 - RNA, 24 nt, Human
uaacuaaguaaccaacccccagaa

SEQ ID NO: 1273655 - RNA, 19 nt, Human
uaacucacagaaacaaaac

SEQ ID NO: 1273656 - RNA, 19 nt, Human
uaacucacagaaacaaaac

SEQ ID NO: 1273657 - RNA, 23 nt, Human
uaagacagaggaucacauaggca

SEQ ID NO: 1273658 - RNA, 21 nt, Human
uaaggacacugcagaaggcug

SEQ ID NO: 1273659 - RNA, 24 nt, Human
uaauuuuuguauuuuuaguagaga

SEQ ID NO: 1273660 - RNA, 20 nt, Human
uacacccagcugacaaacac

SEQ ID NO: 1273661 - RNA, 20 nt, Human
uacagccaggguaaggacac

SEQ ID NO: 1273662 - RNA, 24 nt, Human
uacaggugugagccaccaugccca

SEQ ID NO: 1273663 - RNA, 23 nt, Human
uagacaaacaggccauucaagug

SEQ ID NO: 1273664 - RNA, 21 nt, Human
uagguggucuuaucgucaccc

SEQ ID NO: 1273665 - RNA, 19 nt, Human
uaguagagaugggguuuca

SEQ ID NO: 1273666 - RNA, 21 nt, Human
uaguagagaugggguuucacc

SEQ ID NO: 1273667 - RNA, 24 nt, Human
uaguagagaugggguuucacccug

SEQ ID NO: 1273668 - RNA, 19 nt, Human
uauccugagcucugugaac

SEQ ID NO: 1273669 - RNA, 19 nt, Human
uauuguggugguggaggug

SEQ ID NO: 1273670 - RNA, 22 nt, Human
ucaaccugguuuucggcucugg

SEQ ID NO: 1273671 - RNA, 22 nt, Human
ucaagugaucugccugccucag

SEQ ID NO: 1273672 - RNA, 21 nt, Human
ucacaaccaucuucacucguc

SEQ ID NO: 1273673 - RNA, 21 nt, Human
ucacacaugcaugcaaagggc

SEQ ID NO: 1273674 - RNA, 22 nt, Human
ucacacaugcaugcaaagggca

SEQ ID NO: 1273675 - RNA, 24 nt, Human
ucacggagacuccaagagccacgg

SEQ ID NO: 1273676 - RNA, 19 nt, Human
ucacugcaaucuccgccuc

SEQ ID NO: 1273677 - RNA, 24 nt, Human
ucacugcaaucuccgccuccccgg

SEQ ID NO: 1273678 - RNA, 24 nt, Human
ucacugcaaucuccgccuccccgg

SEQ ID NO: 1273679 - RNA, 26 nt, Human
ucacugcaaucuccgccuccccgguu

SEQ ID NO: 1273680 - RNA, 21 nt, Human
ucagucucagaugggugcugg

SEQ ID NO: 1273681 - RNA, 22 nt, Human
uccaaucagaaacacacagcuu

SEQ ID NO: 1273682 - RNA, 23 nt, Human
ucccaaagugcugcaauuacagg

SEQ ID NO: 1273683 - RNA, 23 nt, Human
uccccaggccagcuacucuaacu

SEQ ID NO: 1273684 - RNA, 20 nt, Human
uccccauguacagccagggu

SEQ ID NO: 1273685 - RNA, 18 nt, Human
uccccgguucaagcaauu

SEQ ID NO: 1273686 - RNA, 24 nt, Human
uccccgguucaagcaauuuuccug

SEQ ID NO: 1273687 - RNA, 24 nt, Human
uccgccuccccgguucaagcaauu

SEQ ID NO: 1273688 - RNA, 24 nt, Human
uccuguguagcugggauuacaggc

SEQ ID NO: 1273689 - RNA, 21 nt, Human
ucgcccaggcuggaaugaagu

SEQ ID NO: 1273690 - RNA, 22 nt, Human
ucgcucugucgcccaggcugga

SEQ ID NO: 1273691 - RNA, 19 nt, Human
ucgggcuccucccgccucg

SEQ ID NO: 1273692 - RNA, 21 nt, Human
ucuccacuuaucuucugcuac

SEQ ID NO: 1273693 - RNA, 21 nt, Human
ucucuguagugggaggccaca

SEQ ID NO: 1273694 - RNA, 21 nt, Human
ucugauccauaauucugacau

SEQ ID NO: 1273695 - RNA, 22 nt, Human
ucugcaauucagaaccagaggc

SEQ ID NO: 1273696 - RNA, 18 nt, Human
ucugucgcccaggcugga

SEQ ID NO: 1273697 - RNA, 22 nt, Human
ucuucccuaaaaaaaauugaga

SEQ ID NO: 1273698 - RNA, 21 nt, Human
ucuugaacuccugaccucaag

SEQ ID NO: 1273699 - RNA, 19 nt, Human
ugaagggcaagagugaaau

SEQ ID NO: 1273700 - RNA, 21 nt, Human
ugaagggcaagagugaaaugg

SEQ ID NO: 1273701 - RNA, 23 nt, Human
ugaaguggcacaaucuuggcuca

SEQ ID NO: 1273702 - RNA, 20 nt, Human
ugacaaacacuuugggucug

SEQ ID NO: 1273703 - RNA, 18 nt, Human
ugacacaucuguaaaaca

SEQ ID NO: 1273704 - RNA, 18 nt, Human
ugaccucaagugaucugc

SEQ ID NO: 1273705 - RNA, 24 nt, Human
ugaccucaagugaucugccugccu

SEQ ID NO: 1273706 - RNA, 23 nt, Human
ugacuucugggcauacgcaucuc

SEQ ID NO: 1273707 - RNA, 19 nt, Human
ugagaugcaggcuccucca

SEQ ID NO: 1273708 - RNA, 22 nt, Human
ugcaauuacaggugugagccac

SEQ ID NO: 1273709 - RNA, 24 nt, Human
ugcaauuacaggugugagccacca

SEQ ID NO: 1273710 - RNA, 22 nt, Human
ugccagggaaggaagcuggcca

SEQ ID NO: 1273711 - RNA, 25 nt, Human
ugccucagccucccaaagugcugca

SEQ ID NO: 1273712 - RNA, 24 nt, Human
ugccucagcuuccuguguagcugg

SEQ ID NO: 1273713 - RNA, 24 nt, Human
uggaaugaaguggcacaaucuugg

SEQ ID NO: 1273714 - RNA, 18 nt, Human
uggaggaggcucugaugu

SEQ ID NO: 1273715 - RNA, 21 nt, Human
uggcaaccccuagccacuccu

SEQ ID NO: 1273716 - RNA, 24 nt, Human
uggcacaaucuuggcucacugcaa

SEQ ID NO: 1273717 - RNA, 22 nt, Human
uggccaggcugaauccuuccug

SEQ ID NO: 1273718 - RNA, 24 nt, Human
uggccaggcuggucuugaacuccu

SEQ ID NO: 1273719 - RNA, 18 nt, Human
ugggaggccacaugaaag

SEQ ID NO: 1273720 - RNA, 21 nt, Human
ugggauuacaggcgcccacca

SEQ ID NO: 1273721 - RNA, 22 nt, Human
ugggauuacaggcgcccaccau

SEQ ID NO: 1273722 - RNA, 21 nt, Human
ugggcucuggccccgccaagg

SEQ ID NO: 1273723 - RNA, 24 nt, Human
ugggguuucacccuguuggccagg

SEQ ID NO: 1273724 - RNA, 18 nt, Human
uggugguggaggugggga

SEQ ID NO: 1273725 - RNA, 22 nt, Human
uggugguggagguggggaguuc

SEQ ID NO: 1273726 - RNA, 23 nt, Human
uguaaaagcuugcacaaagccgg

SEQ ID NO: 1273727 - RNA, 25 nt, Human
uguaaaccacccccucucuuuagag

SEQ ID NO: 1273728 - RNA, 24 nt, Human
uguagcugggauuacaggcgccca

SEQ ID NO: 1273729 - RNA, 21 nt, Human
uguauuuuuaguagagauggg

SEQ ID NO: 1273730 - RNA, 21 nt, Human
ugucgcccaggcuggaaugaa

SEQ ID NO: 1273731 - RNA, 19 nt, Human
ugugcagggccuugaucau

SEQ ID NO: 1273732 - RNA, 21 nt, Human
uguggcaggcaagacagggac

SEQ ID NO: 1273733 - RNA, 18 nt, Human
uguggugguggagguggg

SEQ ID NO: 1273734 - RNA, 21 nt, Human
uguggugguggagguggggag

SEQ ID NO: 1273735 - RNA, 21 nt, Human
uguguagcugggauuacaggc

SEQ ID NO: 1273736 - RNA, 18 nt, Human
uguuucuauccugagcuc

SEQ ID NO: 1273737 - RNA, 18 nt, Human
uuaguagagaugggguuu

SEQ ID NO: 1273738 - RNA, 24 nt, Human
uuaguagagaugggguuucacccu

SEQ ID NO: 1273739 - RNA, 25 nt, Human
uuaguagagaugggguuucacccug

SEQ ID NO: 1273740 - RNA, 20 nt, Human
uuauuuuccuauucugagcu

SEQ ID NO: 1273741 - RNA, 21 nt, Human
uucaagcaauuuuccugccuc

SEQ ID NO: 1273742 - RNA, 24 nt, Human
uucaagcaauuuuccugccucagc

SEQ ID NO: 1273743 - RNA, 23 nt, Human
uuccaauauaaaaucccaaguua

SEQ ID NO: 1273744 - RNA, 18 nt, Human
uuccccauguacagccag

SEQ ID NO: 1273745 - RNA, 24 nt, Human
uugaucacaacugagcggcugaga

SEQ ID NO: 1273746 - RNA, 23 nt, Human
uugaugcuuccagcuagauggca

SEQ ID NO: 1273747 - RNA, 23 nt, Human
uugcuaccuacuaaaagcacuua

SEQ ID NO: 1273748 - RNA, 22 nt, Human
uuucacccuguuggccaggcug

SEQ ID NO: 1273749 - RNA, 24 nt, Human
uuucacccuguuggccaggcuggu

SEQ ID NO: 1273750 - RNA, 19 nt, Human
uuucgcucugucgcccagg

SEQ ID NO: 1273751 - RNA, 22 nt, Human
uuucgcucugucgcccaggcug

SEQ ID NO: 1273752 - RNA, 23 nt, Human
uuucgcucugucgcccaggcugg

SEQ ID NO: 1273753 - RNA, 24 nt, Human
uuucgcucugucgcccaggcugga

SEQ ID NO: 1273754 - RNA, 25 nt, Human
uuuuguuuuuauuuuuccccuuuca

SEQ ID NO: 1273755 - RNA, 24 nt, Human
uuuuuaguagagaugggguuucac

SEQ ID NO: 1273756 - RNA, 20 nt, Human
uuuuuguauuuuuaguagag

SEQ ID NO: 1273757 - RNA, 22 nt, Human
cagcugcucgcuguccacuggg

SEQ ID NO: 1273758 - RNA, 24 nt, Human
caucacagucgcggcucagcugcu

SEQ ID NO: 1273759 - RNA, 20 nt, Human
ccacugggccgaagaggcgg

SEQ ID NO: 1273760 - RNA, 24 nt, Human
ccuugcugccgcauggguucugac

SEQ ID NO: 1273761 - RNA, 20 nt, Human
cggcggcaggccuugcugcc

SEQ ID NO: 1273762 - RNA, 19 nt, Human
ucagcugcucgcuguccac

SEQ ID NO: 1273763 - RNA, 22 nt, Human
aaaaaaaaaaaaaaaaaaagaa

SEQ ID NO: 1273764 - RNA, 21 nt, Human
aaaaaugcaccaagcuuauga

SEQ ID NO: 1273765 - RNA, 23 nt, Human
aaacagauuugaacagcuaaaac

SEQ ID NO: 1273766 - RNA, 21 nt, Human
aaagggaccugcuccggcugc

SEQ ID NO: 1273767 - RNA, 18 nt, Human
aaaugcggcggcucaaau

SEQ ID NO: 1273768 - RNA, 23 nt, Human
aacaccaaccaacucucucacuc

SEQ ID NO: 1273769 - RNA, 22 nt, Human
aagagacaaacagauuugaaca

SEQ ID NO: 1273770 - RNA, 27 nt, Human
aagagacaaacagauuugaacagcuaa

SEQ ID NO: 1273771 - RNA, 22 nt, Human
acaccacuucucuugcaaacug

SEQ ID NO: 1273772 - RNA, 23 nt, Human
agaccuagagaaggaucgggacg

SEQ ID NO: 1273773 - RNA, 21 nt, Human
agccaagcugaauggggcgcg

SEQ ID NO: 1273774 - RNA, 22 nt, Human
aggaaugugugggcggucgagg

SEQ ID NO: 1273775 - RNA, 23 nt, Human
caccaaccaacucucucacucac

SEQ ID NO: 1273776 - RNA, 18 nt, Human
caccuuugugucacuguu

SEQ ID NO: 1273777 - RNA, 18 nt, Human
cagccaagcugaaugggg

SEQ ID NO: 1273778 - RNA, 20 nt, Human
cagcgaucucucucuucucc

SEQ ID NO: 1273779 - RNA, 21 nt, Human
ccaggaagaauuugcugaaaa

SEQ ID NO: 1273780 - RNA, 25 nt, Human
cccaacaccaaccaacucucucacu

SEQ ID NO: 1273781 - RNA, 20 nt, Human
ccuccggcccaacaccaacc

SEQ ID NO: 1273782 - RNA, 20 nt, Human
ccuguacaccacuucucuug

SEQ ID NO: 1273783 - RNA, 21 nt, Human
cgagguggcugcugccgauuu

SEQ ID NO: 1273784 - RNA, 21 nt, Human
cgaugagucuucccgcuuucc

SEQ ID NO: 1273785 - RNA, 23 nt, Human
cggcccaacaccaaccaacucuc

SEQ ID NO: 1273786 - RNA, 26 nt, Human
cuaaaacaucuuaaaaaugcaccaaa

SEQ ID NO: 1273787 - RNA, 18 nt, Human
cugacggccaggaagaau

SEQ ID NO: 1273788 - RNA, 21 nt, Human
cuuaugaagucucaaacaaaa

SEQ ID NO: 1273789 - RNA, 22 nt, Human
gaucuuaccuacgagaccuaga

SEQ ID NO: 1273790 - RNA, 20 nt, Human
ggcuuagaagacaggccuua

SEQ ID NO: 1273791 - RNA, 19 nt, Human
guuggauuuaguugguugg

SEQ ID NO: 1273792 - RNA, 22 nt, Human
uaacuuggugacacuuuaguga

SEQ ID NO: 1273793 - RNA, 24 nt, Human
uacaccacuucucuuggggaagcc

SEQ ID NO: 1273794 - RNA, 22 nt, Human
uacaucuguaacuuggugacac

SEQ ID NO: 1273795 - RNA, 24 nt, Human
uagagguuuauuaucagucugugc

SEQ ID NO: 1273796 - RNA, 22 nt, Human
uagcauacuauguaugcaaaag

SEQ ID NO: 1273797 - RNA, 21 nt, Human
ucaacaagcuagaaaugguga

SEQ ID NO: 1273798 - RNA, 23 nt, Human
uccacgaaauggcggaccaccgc

SEQ ID NO: 1273799 - RNA, 24 nt, Human
ucccgagacagcgaucucucucuu

SEQ ID NO: 1273800 - RNA, 23 nt, Human
ucgacuaaaaaaaaaaaaaaaaa

SEQ ID NO: 1273801 - RNA, 25 nt, Human
ucgacuaaaaaaaaaaaaaaaaaaa

SEQ ID NO: 1273802 - RNA, 24 nt, Human
ucucccgagacagcgaucucucuc

SEQ ID NO: 1273803 - RNA, 21 nt, Human
ucucucucuucuccuaucucu

SEQ ID NO: 1273804 - RNA, 18 nt, Human
ugacgacuggccagccug

SEQ ID NO: 1273805 - RNA, 21 nt, Human
ugagcugauuggccaggaaug

SEQ ID NO: 1273806 - RNA, 20 nt, Human
ugagucuucccgcuuuccuc

SEQ ID NO: 1273807 - RNA, 19 nt, Human
ugcucgggaaccaaagggc

SEQ ID NO: 1273808 - RNA, 19 nt, Human
uggccaggaaugugugggc

SEQ ID NO: 1273809 - RNA, 19 nt, Human
ugggcggucgagguggcug

SEQ ID NO: 1273810 - RNA, 20 nt, Human
ugugaaacgacaccagccaa

SEQ ID NO: 1273811 - RNA, 25 nt, Human
uguuguggauuuuuccugcuuuuuu

SEQ ID NO: 1273812 - RNA, 23 nt, Human
uucaagagacaaacagauuugaa

SEQ ID NO: 1273813 - RNA, 19 nt, Human
uugaauuuucuguacauac

SEQ ID NO: 1273814 - RNA, 22 nt, Human
uuuccuguacaccacuucucuu

SEQ ID NO: 1273815 - RNA, 23 nt, Human
uuuucuguacauacuccugucaa

SEQ ID NO: 1273816 - RNA, 25 nt, Human
aaaagaaagaggaacugagaaagag

SEQ ID NO: 1273817 - RNA, 19 nt, Human
aaaguuucgucagucugug

SEQ ID NO: 1273818 - RNA, 27 nt, Human
aacagagcaacaggaauuagaaaagaa

SEQ ID NO: 1273819 - RNA, 18 nt, Human
aaccccaguucuccuacc

SEQ ID NO: 1273820 - RNA, 21 nt, Human
aaccugggagcaggggagggc

SEQ ID NO: 1273821 - RNA, 23 nt, Human
aagacaggagacagaagugagga

SEQ ID NO: 1273822 - RNA, 21 nt, Human
aagcagagguccuguucuaug

SEQ ID NO: 1273823 - RNA, 23 nt, Human
aaggaagaaacagagcaacagga

SEQ ID NO: 1273824 - RNA, 18 nt, Human
acaggaagcuggggcucc

SEQ ID NO: 1273825 - RNA, 21 nt, Human
accccaacccccaucagcugg

SEQ ID NO: 1273826 - RNA, 22 nt, Human
accccaugacuauagggggcug

SEQ ID NO: 1273827 - RNA, 25 nt, Human
acccucguuggugcaucugucuuca

SEQ ID NO: 1273828 - RNA, 18 nt, Human
accucugugcucugagac

SEQ ID NO: 1273829 - RNA, 20 nt, Human
agaaaagaaagaggaacuga

SEQ ID NO: 1273830 - RNA, 22 nt, Human
agacagaagugaggaccuaagc

SEQ ID NO: 1273831 - RNA, 25 nt, Human
agacagaagugaggaccuaagccug

SEQ ID NO: 1273832 - RNA, 18 nt, Human
agacaggaagagagcugg

SEQ ID NO: 1273833 - RNA, 22 nt, Human
agacaggaagagagcuggucaa

SEQ ID NO: 1273834 - RNA, 18 nt, Human
agagaaagggagggcaag

SEQ ID NO: 1273835 - RNA, 19 nt, Human
agagagaaaccuacagaaa

SEQ ID NO: 1273836 - RNA, 25 nt, Human
agaggcugugcagggagacuucuag

SEQ ID NO: 1273837 - RNA, 21 nt, Human
agcaacaggaauuagaaaaga

SEQ ID NO: 1273838 - RNA, 21 nt, Human
agcaccccaacccccaucagc

SEQ ID NO: 1273839 - RNA, 20 nt, Human
agccccuugccccugcaggc

SEQ ID NO: 1273840 - RNA, 26 nt, Human
agcuauugggacaaauggacaucaga

SEQ ID NO: 1273841 - RNA, 18 nt, Human
agcugucccuucauagcc

SEQ ID NO: 1273842 - RNA, 19 nt, Human
aggaagcaccccaaccccc

SEQ ID NO: 1273843 - RNA, 20 nt, Human
agggaagggaggugcaugga

SEQ ID NO: 1273844 - RNA, 19 nt, Human
agggaccagcgguguggga

SEQ ID NO: 1273845 - RNA, 20 nt, Human
aggggcugggcacuuccacc

SEQ ID NO: 1273846 - RNA, 24 nt, Human
aggggcugggcacuuccacccaga

SEQ ID NO: 1273847 - RNA, 21 nt, Human
aguccaggccaugcuuagccu

SEQ ID NO: 1273848 - RNA, 23 nt, Human
auggagccugcagguaaagugau

SEQ ID NO: 1273849 - RNA, 21 nt, Human
caccgccgccgucccgcaggc

SEQ ID NO: 1273850 - RNA, 26 nt, Human
cacgugcaugcccaaaacacuguaca

SEQ ID NO: 1273851 - RNA, 21 nt, Human
cacuguacaacacugucccgg

SEQ ID NO: 1273852 - RNA, 22 nt, Human
cagaauggcuccuugggaggga

SEQ ID NO: 1273853 - RNA, 21 nt, Human
cagcugugcuuuggcccugcu

SEQ ID NO: 1273854 - RNA, 21 nt, Human
caggagacagaagugaggacc

SEQ ID NO: 1273855 - RNA, 18 nt, Human
cagggagacuucuaggug

SEQ ID NO: 1273856 - RNA, 24 nt, Human
cagggugguucccaucagccuuga

SEQ ID NO: 1273857 - RNA, 21 nt, Human
caguccaggccaugcuuagcc

SEQ ID NO: 1273858 - RNA, 18 nt, Human
cauuccagacccucguug

SEQ ID NO: 1273859 - RNA, 22 nt, Human
ccaaaacacuguacaacacugu

SEQ ID NO: 1273860 - RNA, 23 nt, Human
ccacugggagcaggugcugggcu

SEQ ID NO: 1273861 - RNA, 24 nt, Human
ccagcagagagugauccuggggcc

SEQ ID NO: 1273862 - RNA, 20 nt, Human
ccccaugacuauagggggcu

SEQ ID NO: 1273863 - RNA, 26 nt, Human
ccccggagaccuggcccagcccugcc

SEQ ID NO: 1273864 - RNA, 18 nt, Human
cccuccagugcuggcccc

SEQ ID NO: 1273865 - RNA, 18 nt, Human
cccucggcgccacaccug

SEQ ID NO: 1273866 - RNA, 20 nt, Human
ccggggagggggaggugggu

SEQ ID NO: 1273867 - RNA, 25 nt, Human
ccugcaggaccccugccuccccgga

SEQ ID NO: 1273868 - RNA, 21 nt, Human
ccugcaggcccagucauagcu

SEQ ID NO: 1273869 - RNA, 21 nt, Human
ccugcaggccccucucucugg

SEQ ID NO: 1273870 - RNA, 18 nt, Human
ccugcaggccuggagggc

SEQ ID NO: 1273871 - RNA, 25 nt, Human
ccugccugcucaccugguccccugg

SEQ ID NO: 1273872 - RNA, 18 nt, Human
ccuguagagaucacugcu

SEQ ID NO: 1273873 - RNA, 22 nt, Human
cggggagggggagguggguccc

SEQ ID NO: 1273874 - RNA, 20 nt, Human
cgggucggggcagggacgcg

SEQ ID NO: 1273875 - RNA, 21 nt, Human
cuccagaccauuccagacccu

SEQ ID NO: 1273876 - RNA, 24 nt, Human
cugacccugcuuuccagaccacug

SEQ ID NO: 1273877 - RNA, 19 nt, Human
cugcaggccccucucucug

SEQ ID NO: 1273878 - RNA, 22 nt, Human
cuggaacccaggcccagagagc

SEQ ID NO: 1273879 - RNA, 21 nt, Human
cuggcaucgucugggucugaa

SEQ ID NO: 1273880 - RNA, 21 nt, Human
cuggguucucaccugccucag

SEQ ID NO: 1273881 - RNA, 28 nt, Human
cugugcagggagacuucuagguggccag

SEQ ID NO: 1273882 - RNA, 24 nt, Human
cuuccacccagagucacacacaga

SEQ ID NO: 1273883 - RNA, 18 nt, Human
gaaaggaggacagacgug

SEQ ID NO: 1273884 - RNA, 19 nt, Human
gaacgcagauggaccucua

SEQ ID NO: 1273885 - RNA, 23 nt, Human
gaccccugccuccccggagaccu

SEQ ID NO: 1273886 - RNA, 20 nt, Human
gacccugcuuuccagaccac

SEQ ID NO: 1273887 - RNA, 21 nt, Human
gacgugggggguggagagaga

SEQ ID NO: 1273888 - RNA, 23 nt, Human
gagaaagagggagacaacaaaga

SEQ ID NO: 1273889 - RNA, 18 nt, Human
gagacaacaaagacagga

SEQ ID NO: 1273890 - RNA, 19 nt, Human
gagagaaagggagggcaag

SEQ ID NO: 1273891 - RNA, 20 nt, Human
gaggaccaggcaggacccag

SEQ ID NO: 1273892 - RNA, 23 nt, Human
gaguaucacgugcaugcccaaaa

SEQ ID NO: 1273893 - RNA, 19 nt, Human
gcagggacgcggcaugugg

SEQ ID NO: 1273894 - RNA, 18 nt, Human
gccaccgccgccgucccg

SEQ ID NO: 1273895 - RNA, 19 nt, Human
gccucagggagggaaggga

SEQ ID NO: 1273896 - RNA, 20 nt, Human
gccuggggccuccugcccac

SEQ ID NO: 1273897 - RNA, 22 nt, Human
gccuggggccuccugcccacug

SEQ ID NO: 1273898 - RNA, 18 nt, Human
gcgccaccgccgccgucc

SEQ ID NO: 1273899 - RNA, 18 nt, Human
ggagggaagggaggugca

SEQ ID NO: 1273900 - RNA, 24 nt, Human
ggagggaagggaggugcauggagc

SEQ ID NO: 1273901 - RNA, 21 nt, Human
ggcaagggagaagggaagaga

SEQ ID NO: 1273902 - RNA, 24 nt, Human
ggcauguggccggggagggggagg

SEQ ID NO: 1273903 - RNA, 20 nt, Human
gggacaaauggacaucagaa

SEQ ID NO: 1273904 - RNA, 18 nt, Human
gggcagagggcaggcccc

SEQ ID NO: 1273905 - RNA, 24 nt, Human
gggcaggggcugggcacuuccacc

SEQ ID NO: 1273906 - RNA, 20 nt, Human
ggggaaggggagggcaguag

SEQ ID NO: 1273907 - RNA, 23 nt, Human
gggguggagagagaaagggaggg

SEQ ID NO: 1273908 - RNA, 22 nt, Human
gguggagagagaaagggagggc

SEQ ID NO: 1273909 - RNA, 24 nt, Human
guggccggggagggggaggugggu

SEQ ID NO: 1273910 - RNA, 21 nt, Human
uaccucugugcucugagacuc

SEQ ID NO: 1273911 - RNA, 24 nt, Human
uagaggcugugcagggagacuucu

SEQ ID NO: 1273912 - RNA, 18 nt, Human
ucagacacugagaagagc

SEQ ID NO: 1273913 - RNA, 19 nt, Human
ucagcuggguaggugggga

SEQ ID NO: 1273914 - RNA, 18 nt, Human
uccagccagccccuugcc

SEQ ID NO: 1273915 - RNA, 20 nt, Human
uccccggagaccuggcccag

SEQ ID NO: 1273916 - RNA, 23 nt, Human
uccccggagaccuggcccagccc

SEQ ID NO: 1273917 - RNA, 23 nt, Human
uccccucggcgccacaccugcag

SEQ ID NO: 1273918 - RNA, 22 nt, Human
ucccuucauagccuuggccuga

SEQ ID NO: 1273919 - RNA, 22 nt, Human
uccugcccacuguccuuugcag

SEQ ID NO: 1273920 - RNA, 21 nt, Human
uccuugggagggaggaccagg

SEQ ID NO: 1273921 - RNA, 19 nt, Human
uccuuugcagcagggaccc

SEQ ID NO: 1273922 - RNA, 21 nt, Human
uccuuugcagcagggacccca

SEQ ID NO: 1273923 - RNA, 22 nt, Human
ucggaggggcaaugacagucuu

SEQ ID NO: 1273924 - RNA, 19 nt, Human
ucggcgccacaccugcagg

SEQ ID NO: 1273925 - RNA, 20 nt, Human
ucgucugggucugaacgcag

SEQ ID NO: 1273926 - RNA, 21 nt, Human
ucucuggguucucaccugccu

SEQ ID NO: 1273927 - RNA, 21 nt, Human
ucugacccugcuuuccagacc

SEQ ID NO: 1273928 - RNA, 23 nt, Human
ucugugcucugagacuccagcca

SEQ ID NO: 1273929 - RNA, 24 nt, Human
ucuucugcuccuggggaaaaggug

SEQ ID NO: 1273930 - RNA, 26 nt, Human
ugaaauaauacaaaacaucucacaga

SEQ ID NO: 1273931 - RNA, 22 nt, Human
ugagaaagagggagacaacaaa

SEQ ID NO: 1273932 - RNA, 18 nt, Human
ugagaagagcuguauccu

SEQ ID NO: 1273933 - RNA, 24 nt, Human
ugagaagagcuguauccucagcac

SEQ ID NO: 1273934 - RNA, 18 nt, Human
ugagcagaagccacugug

SEQ ID NO: 1273935 - RNA, 18 nt, Human
ugaggugagcgcaccuca

SEQ ID NO: 1273936 - RNA, 18 nt, Human
ugaggugugcugcuggag

SEQ ID NO: 1273937 - RNA, 22 nt, Human
ugaguaaaggggaaggggaggg

SEQ ID NO: 1273938 - RNA, 23 nt, Human
ugcaugcccaaaacacuguacaa

SEQ ID NO: 1273939 - RNA, 21 nt, Human
ugcccagcugugcuuuggccc

SEQ ID NO: 1273940 - RNA, 18 nt, Human
ugccccugcaggccugga

SEQ ID NO: 1273941 - RNA, 24 nt, Human
ugccugcucaccugcaggccccuc

SEQ ID NO: 1273942 - RNA, 18 nt, Human
ugcuggaggggccaucag

SEQ ID NO: 1273943 - RNA, 23 nt, Human
ugcuggugaaauaauacaaaaca

SEQ ID NO: 1273944 - RNA, 18 nt, Human
ugcuuaugugugugugcu

SEQ ID NO: 1273945 - RNA, 20 nt, Human
uggaaaagucaugugggugg

SEQ ID NO: 1273946 - RNA, 20 nt, Human
uggaacccaggcccagagag

SEQ ID NO: 1273947 - RNA, 19 nt, Human
uggaagggaggcugcagcg

SEQ ID NO: 1273948 - RNA, 19 nt, Human
uggagagagaaagggaggg

SEQ ID NO: 1273949 - RNA, 18 nt, Human
ugggagcaggggagggca

SEQ ID NO: 1273950 - RNA, 21 nt, Human
ugggagcaggugcugggcuga

SEQ ID NO: 1273951 - RNA, 23 nt, Human
ugggagcaggugcugggcugacc

SEQ ID NO: 1273952 - RNA, 21 nt, Human
ugggcacuuccacccagaguc

SEQ ID NO: 1273953 - RNA, 20 nt, Human
ugggcugacccaccaggacc

SEQ ID NO: 1273954 - RNA, 23 nt, Human
ugggcugaguaaaggggaagggg

SEQ ID NO: 1273955 - RNA, 19 nt, Human
uggggcagagggcaggccc

SEQ ID NO: 1273956 - RNA, 18 nt, Human
ugugcaaaagcagagguc

SEQ ID NO: 1273957 - RNA, 22 nt, Human
ugugggugggccccuccagugc

SEQ ID NO: 1273958 - RNA, 24 nt, Human
ugugggugggccccuccagugcug

SEQ ID NO: 1273959 - RNA, 21 nt, Human
ugugugaguaucacgugcaug

SEQ ID NO: 1273960 - RNA, 18 nt, Human
ugugugcuggaggggcca

SEQ ID NO: 1273961 - RNA, 18 nt, Human
uguuucuuuggauggcuc

SEQ ID NO: 1273962 - RNA, 22 nt, Human
uucauagccuuggccugaaagg

SEQ ID NO: 1273963 - RNA, 20 nt, Human
uucccuggaacccaggccca

SEQ ID NO: 1273964 - RNA, 20 nt, Human
uucuagguggccagcugggc

SEQ ID NO: 1273965 - RNA, 19 nt, Human
uuggagucugcagggaggc

SEQ ID NO: 1273966 - RNA, 24 nt, Human
uuggugcaucugucuucaucuguu

SEQ ID NO: 1273967 - RNA, 25 nt, Human
aaagaaggaaaggccaugaguccug

SEQ ID NO: 1273968 - RNA, 23 nt, Human
aaagauuccaaaccagcagaaca

SEQ ID NO: 1273969 - RNA, 24 nt, Human
aaagugcugggauuacagguguga

SEQ ID NO: 1273970 - RNA, 22 nt, Human
aacacaauuggcaaaugaagcc

SEQ ID NO: 1273971 - RNA, 18 nt, Human
aagugcugggauuacagg

SEQ ID NO: 1273972 - RNA, 19 nt, Human
aagugcugggauuacaggu

SEQ ID NO: 1273973 - RNA, 26 nt, Human
aagugcugggauuacaggugugagcc

SEQ ID NO: 1273974 - RNA, 24 nt, Human
acgacaguggugcaaucucggcuc

SEQ ID NO: 1273975 - RNA, 22 nt, Human
acuaaaugacacagggcuauga

SEQ ID NO: 1273976 - RNA, 23 nt, Human
acuggaguacagagauaaucucc

SEQ ID NO: 1273977 - RNA, 18 nt, Human
acuguaucaaaaaacaag

SEQ ID NO: 1273978 - RNA, 24 nt, Human
agcgauuaucucgccucagccucc

SEQ ID NO: 1273979 - RNA, 24 nt, Human
caaagugcugggauuacaggugug

SEQ ID NO: 1273980 - RNA, 18 nt, Human
cacaucuuggcuaaggag

SEQ ID NO: 1273981 - RNA, 18 nt, Human
cacugcaaccucugccuc

SEQ ID NO: 1273982 - RNA, 21 nt, Human
cacugcaaccucugccuccca

SEQ ID NO: 1273983 - RNA, 19 nt, Human
cagcagaacagaaauggac

SEQ ID NO: 1273984 - RNA, 22 nt, Human
ccaaaagugcugaacacuaaau

SEQ ID NO: 1273985 - RNA, 20 nt, Human
ccaaagugcugggauuacag

SEQ ID NO: 1273986 - RNA, 21 nt, Human
ccaaagugcugggauuacagg

SEQ ID NO: 1273987 - RNA, 21 nt, Human
ccaaagugcugggauuacagg

SEQ ID NO: 1273988 - RNA, 24 nt, Human
ccaaagugcugggauuacaggugu

SEQ ID NO: 1273989 - RNA, 21 nt, Human
ccaacucuacugucaacaugu

SEQ ID NO: 1273990 - RNA, 24 nt, Human
ccaacugauguucccaaaagugcu

SEQ ID NO: 1273991 - RNA, 24 nt, Human
ccagcagaacagaaauggaccuga

SEQ ID NO: 1273992 - RNA, 21 nt, Human
cccaagaauccaguuccaacu

SEQ ID NO: 1273993 - RNA, 21 nt, Human
ccuaccccucaaucucaagac

SEQ ID NO: 1273994 - RNA, 20 nt, Human
ccucccagguucaagcgauu

SEQ ID NO: 1273995 - RNA, 20 nt, Human
cgaacuaaacaacacaauug

SEQ ID NO: 1273996 - RNA, 24 nt, Human
cucacugcaaccucugccucccag

SEQ ID NO: 1273997 - RNA, 24 nt, Human
cucacugcaaccucugccucccag

SEQ ID NO: 1273998 - RNA, 19 nt, Human
cucuuaucacccaggcugg

SEQ ID NO: 1273999 - RNA, 23 nt, Human
cugcaaccucugccucccagguu

SEQ ID NO: 1274000 - RNA, 24 nt, Human
cugcaaccucugccucccagguuc

SEQ ID NO: 1274001 - RNA, 23 nt, Human
gaacuaaacaacacaauuggcaa

SEQ ID NO: 1274002 - RNA, 23 nt, Human
gacaguggugcaaucucggcuca

SEQ ID NO: 1274003 - RNA, 18 nt, Human
gauuacaggugugagcca

SEQ ID NO: 1274004 - RNA, 21 nt, Human
gauuacaggugugagccaccg

SEQ ID NO: 1274005 - RNA, 24 nt, Human
gauuacaggugugagccaccgugc

SEQ ID NO: 1274006 - RNA, 22 nt, Human
gcaaccucugccucccagguuc

SEQ ID NO: 1274007 - RNA, 23 nt, Human
gccucagccucccaaagugcugg

SEQ ID NO: 1274008 - RNA, 24 nt, Human
gcgauuaucucgccucagccuccc

SEQ ID NO: 1274009 - RNA, 23 nt, Human
ggaguuucacucuuaucacccag

SEQ ID NO: 1274010 - RNA, 19 nt, Human
guguagcccucccuacccc

SEQ ID NO: 1274011 - RNA, 23 nt, Human
uaaaagcuuuucaaaguuugagu

SEQ ID NO: 1274012 - RNA, 24 nt, Human
uaaaguucaccaacugauguuccc

SEQ ID NO: 1274013 - RNA, 18 nt, Human
uaaggagaugccacugga

SEQ ID NO: 1274014 - RNA, 24 nt, Human
uacaggugugagccaccgugccca

SEQ ID NO: 1274015 - RNA, 23 nt, Human
uagacagcaaaauuuaaaguuca

SEQ ID NO: 1274016 - RNA, 22 nt, Human
uaucucgccucagccucccaaa

SEQ ID NO: 1274017 - RNA, 22 nt, Human
ucacucuuaucacccaggcugg

SEQ ID NO: 1274018 - RNA, 23 nt, Human
ucacucuuaucacccaggcugga

SEQ ID NO: 1274019 - RNA, 19 nt, Human
ucacugcaaccucugccuc

SEQ ID NO: 1274020 - RNA, 24 nt, Human
ucacugcaaccucugccucccagg

SEQ ID NO: 1274021 - RNA, 25 nt, Human
ucacugcaaccucugccucccaggu

SEQ ID NO: 1274022 - RNA, 22 nt, Human
ucagucaguguagcccucccua

SEQ ID NO: 1274023 - RNA, 18 nt, Human
uccaacucuacugucaac

SEQ ID NO: 1274024 - RNA, 23 nt, Human
ucccaaagugcugggauuacagg

SEQ ID NO: 1274025 - RNA, 23 nt, Human
ucccagguucaagcgauuaucuc

SEQ ID NO: 1274026 - RNA, 24 nt, Human
ucgccucagccucccaaagugcug

SEQ ID NO: 1274027 - RNA, 24 nt, Human
ugcugggauuacaggugugagcca

SEQ ID NO: 1274028 - RNA, 18 nt, Human
ugggauuacaggugugag

SEQ ID NO: 1274029 - RNA, 21 nt, Human
ugggauuacaggugugagcca

SEQ ID NO: 1274030 - RNA, 22 nt, Human
ugggauuacaggugugagccac

SEQ ID NO: 1274031 - RNA, 23 nt, Human
ugggauuacaggugugagccacc

SEQ ID NO: 1274032 - RNA, 23 nt, Human
ugggauuacaggugugagccacc

SEQ ID NO: 1274033 - RNA, 24 nt, Human
ugggauuacaggugugagccaccg

SEQ ID NO: 1274034 - RNA, 23 nt, Human
uggggcagaauucaauuucuauc

SEQ ID NO: 1274035 - RNA, 23 nt, Human
uucaagcgauuaucucgccucag

SEQ ID NO: 1274036 - RNA, 24 nt, Human
uucacucuuaucacccaggcugga

SEQ ID NO: 1274037 - RNA, 23 nt, Human
uucccaaaagugcugaacacuaa

SEQ ID NO: 1274038 - RNA, 28 nt, Human
uucugggcagggaaauacagcuuaaaga

SEQ ID NO: 1274039 - RNA, 22 nt, Human
uuuacagaucugggcugaggcc

SEQ ID NO: 1274040 - RNA, 27 nt, Human
aaaaaccacaaagggugaccgguaccc

SEQ ID NO: 1274041 - RNA, 24 nt, Human
aaacauggucaaaugugaaaccgc

SEQ ID NO: 1274042 - RNA, 24 nt, Human
aaagugcugggauuacaggcguga

SEQ ID NO: 1274043 - RNA, 23 nt, Human
aacacauuuacaaaacuacugca

SEQ ID NO: 1274044 - RNA, 22 nt, Human
aagcaagcaagccugagaggca

SEQ ID NO: 1274045 - RNA, 24 nt, Human
aagcaagcaagccugagaggcauu

SEQ ID NO: 1274046 - RNA, 19 nt, Human
aagcuguuuuuuuuuuuuu

SEQ ID NO: 1274047 - RNA, 19 nt, Human
aagugcugggauuacaggc

SEQ ID NO: 1274048 - RNA, 19 nt, Human
aagugcugggauuacaggc

SEQ ID NO: 1274049 - RNA, 26 nt, Human
aagugcugggauuacaggcgugagcc

SEQ ID NO: 1274050 - RNA, 22 nt, Human
acagaaaaucuaacaugguuga

SEQ ID NO: 1274051 - RNA, 24 nt, Human
accauauuggucaggcuggucuug

SEQ ID NO: 1274052 - RNA, 25 nt, Human
acccgccucggccucccaaagugcu

SEQ ID NO: 1274053 - RNA, 24 nt, Human
accuugugauccacccgccucggc

SEQ ID NO: 1274054 - RNA, 19 nt, Human
acuacaggagcgugccacu

SEQ ID NO: 1274055 - RNA, 23 nt, Human
acucugcuccccagaggcuccaa

SEQ ID NO: 1274056 - RNA, 19 nt, Human
acugcaacauccaccuccu

SEQ ID NO: 1274057 - RNA, 22 nt, Human
acuguuucuggaagacuacaga

SEQ ID NO: 1274058 - RNA, 28 nt, Human
agaaauaugugaaggauaaccgguaccc

SEQ ID NO: 1274059 - RNA, 24 nt, Human
agaagacagagagaaaauccuggu

SEQ ID NO: 1274060 - RNA, 19 nt, Human
agacagagagaaaauccug

SEQ ID NO: 1274061 - RNA, 19 nt, Human
agagagaagacagagagaa

SEQ ID NO: 1274062 - RNA, 24 nt, Human
agcgauucuccugccucagccucc

SEQ ID NO: 1274063 - RNA, 23 nt, Human
aggaggaacagaucugcacagaa

SEQ ID NO: 1274064 - RNA, 20 nt, Human
aggcgugagccaccaugacc

SEQ ID NO: 1274065 - RNA, 21 nt, Human
aguagcugggacuacaggagc

SEQ ID NO: 1274066 - RNA, 23 nt, Human
aguagcugggacuacaggagcgu

SEQ ID NO: 1274067 - RNA, 20 nt, Human
agugcaguggcgggaucucg

SEQ ID NO: 1274068 - RNA, 23 nt, Human
agugcaguggcgggaucucggcu

SEQ ID NO: 1274069 - RNA, 24 nt, Human
agugcaguggcgggaucucggcuc

SEQ ID NO: 1274070 - RNA, 18 nt, Human
agugcugggauuacaggc

SEQ ID NO: 1274071 - RNA, 23 nt, Human
auauuggucaggcuggucuugaa

SEQ ID NO: 1274072 - RNA, 20 nt, Human
augggguuucaccauauugg

SEQ ID NO: 1274073 - RNA, 21 nt, Human
augggguuucaccauauuggu

SEQ ID NO: 1274074 - RNA, 24 nt, Human
augggguuucaccauauuggucag

SEQ ID NO: 1274075 - RNA, 23 nt, Human
caaaggaacuugacuauguagca

SEQ ID NO: 1274076 - RNA, 24 nt, Human
caaagugcugggauuacaggcgug

SEQ ID NO: 1274077 - RNA, 18 nt, Human
caacugggcagucugacc

SEQ ID NO: 1274078 - RNA, 20 nt, Human
caagcgauucuccugccuca

SEQ ID NO: 1274079 - RNA, 22 nt, Human
caagcgauucuccugccucagc

SEQ ID NO: 1274080 - RNA, 30 nt, Human
cacacacccagagagaagacagagagaaag

SEQ ID NO: 1274081 - RNA, 21 nt, Human
caccauauuggucaggcuggu

SEQ ID NO: 1274082 - RNA, 23 nt, Human
caccauauuggucaggcuggucu

SEQ ID NO: 1274083 - RNA, 24 nt, Human
caccauauuggucaggcuggucuu

SEQ ID NO: 1274084 - RNA, 18 nt, Human
cacccagagagaagacag

SEQ ID NO: 1274085 - RNA, 23 nt, Human
cacccgccucggccucccaaagu

SEQ ID NO: 1274086 - RNA, 23 nt, Human
cacugcaacauccaccuccuggg

SEQ ID NO: 1274087 - RNA, 21 nt, Human
cagagagaaaauccuggucca

SEQ ID NO: 1274088 - RNA, 20 nt, Human
cagaggcuccaagaagcaag

SEQ ID NO: 1274089 - RNA, 19 nt, Human
caggagccuccaaugagca

SEQ ID NO: 1274090 - RNA, 24 nt, Human
cauacacacacacacacccagaga

SEQ ID NO: 1274091 - RNA, 27 nt, Human
cauacacacacacacacccagagagaa

SEQ ID NO: 1274092 - RNA, 19 nt, Human
cauuguggcuauuaaaucc

SEQ ID NO: 1274093 - RNA, 22 nt, Human
ccaaagugcugggauuacaggc

SEQ ID NO: 1274094 - RNA, 22 nt, Human
ccaaagugcugggauuacaggc

SEQ ID NO: 1274095 - RNA, 24 nt, Human
ccaaagugcugggauuacaggcgu

SEQ ID NO: 1274096 - RNA, 24 nt, Human
ccaccuccuggguucaagcgauuc

SEQ ID NO: 1274097 - RNA, 19 nt, Human
ccagagagaagacagagag

SEQ ID NO: 1274098 - RNA, 21 nt, Human
ccagagagaagacagagagaa

SEQ ID NO: 1274099 - RNA, 18 nt, Human
ccaugaccagcccuccau

SEQ ID NO: 1274100 - RNA, 24 nt, Human
cccaaugacuguaauuuauaaacu

SEQ ID NO: 1274101 - RNA, 24 nt, Human
cccacacccuuugauccuuccaga

SEQ ID NO: 1274102 - RNA, 23 nt, Human
cccgaguagcugggacuacagga

SEQ ID NO: 1274103 - RNA, 25 nt, Human
ccuaggcugcagugcaguggcggga

SEQ ID NO: 1274104 - RNA, 18 nt, Human
ccuccaaugagcacugua

SEQ ID NO: 1274105 - RNA, 24 nt, Human
ccuccuggguucaagcgauucucc

SEQ ID NO: 1274106 - RNA, 20 nt, Human
ccugaccuugugauccaccc

SEQ ID NO: 1274107 - RNA, 24 nt, Human
ccugccucagccucccgaguagcu

SEQ ID NO: 1274108 - RNA, 23 nt, Human
ccuggguucaagcgauucuccug

SEQ ID NO: 1274109 - RNA, 24 nt, Human
cgccucggccucccaaagugcugg

SEQ ID NO: 1274110 - RNA, 21 nt, Human
cuaagcaagcaagccugagag

SEQ ID NO: 1274111 - RNA, 23 nt, Human
cuaauuuuuguauuuuuaguaga

SEQ ID NO: 1274112 - RNA, 24 nt, Human
cuacucugcuccccagaggcucca

SEQ ID NO: 1274113 - RNA, 24 nt, Human
cucacugcaacauccaccuccugg

SEQ ID NO: 1274114 - RNA, 24 nt, Human
cucagccucccgaguagcugggac

SEQ ID NO: 1274115 - RNA, 24 nt, Human
cuccugaccuugugauccacccgc

SEQ ID NO: 1274116 - RNA, 21 nt, Human
cuccuggguucaagcgauucu

SEQ ID NO: 1274117 - RNA, 23 nt, Human
cugcaacauccaccuccuggguu

SEQ ID NO: 1274118 - RNA, 24 nt, Human
cugcaacauccaccuccuggguuc

SEQ ID NO: 1274119 - RNA, 22 nt, Human
cuggaagacuacagaaaaucua

SEQ ID NO: 1274120 - RNA, 24 nt, Human
cuguacauacacacacacacaccc

SEQ ID NO: 1274121 - RNA, 22 nt, Human
gaccuugugauccacccgccuc

SEQ ID NO: 1274122 - RNA, 22 nt, Human
gaccuugugauccacccgccuc

SEQ ID NO: 1274123 - RNA, 24 nt, Human
gaccuugugauccacccgccucgg

SEQ ID NO: 1274124 - RNA, 23 nt, Human
gacucagaauaaaugacugccac

SEQ ID NO: 1274125 - RNA, 21 nt, Human
gagacggagucuugcucuguc

SEQ ID NO: 1274126 - RNA, 24 nt, Human
gagaugggguuucaccauauuggu

SEQ ID NO: 1274127 - RNA, 20 nt, Human
gagcaguaugaacugcccac

SEQ ID NO: 1274128 - RNA, 26 nt, Human
gaguagcugggacuacaggagcgugc

SEQ ID NO: 1274129 - RNA, 22 nt, Human
gaugcggacuccaacaaaggca

SEQ ID NO: 1274130 - RNA, 18 nt, Human
gauuacaggcgugagcca

SEQ ID NO: 1274131 - RNA, 21 nt, Human
gauuacaggcgugagccacca

SEQ ID NO: 1274132 - RNA, 22 nt, Human
gauuacaggcgugagccaccau

SEQ ID NO: 1274133 - RNA, 20 nt, Human
gccucagccucccgaguagc

SEQ ID NO: 1274134 - RNA, 24 nt, Human
gcgauucuccugccucagccuccc

SEQ ID NO: 1274135 - RNA, 18 nt, Human
ggaaggagcaggaggagg

SEQ ID NO: 1274136 - RNA, 24 nt, Human
ggauuacaggcgugagccaccaug

SEQ ID NO: 1274137 - RNA, 24 nt, Human
ggcuaagcuguuuuuuuuuuuuuu

SEQ ID NO: 1274138 - RNA, 23 nt, Human
ggcuggucuugaacuccugaccu

SEQ ID NO: 1274139 - RNA, 19 nt, Human
gggaaggagcaggaggagg

SEQ ID NO: 1274140 - RNA, 26 nt, Human
gggaaggagcaggaggaggaacagau

SEQ ID NO: 1274141 - RNA, 22 nt, Human
gggguuucaccauauuggucag

SEQ ID NO: 1274142 - RNA, 20 nt, Human
ggucuugaacuccugaccuu

SEQ ID NO: 1274143 - RNA, 23 nt, Human
gguuugugaaaggcugcuggccu

SEQ ID NO: 1274144 - RNA, 24 nt, Human
guacauacacacacacacacccag

SEQ ID NO: 1274145 - RNA, 24 nt, Human
gugauccacccgccucggccuccc

SEQ ID NO: 1274146 - RNA, 21 nt, Human
uaaaaaaagugaauguggcuu

SEQ ID NO: 1274147 - RNA, 24 nt, Human
uaagcaagcaagccugagaggcau

SEQ ID NO: 1274148 - RNA, 23 nt, Human
uaaucuccucccuccccauagcc

SEQ ID NO: 1274149 - RNA, 24 nt, Human
uaauuuuuguauuuuuaguagaga

SEQ ID NO: 1274150 - RNA, 24 nt, Human
uacaggcgugagccaccaugacca

SEQ ID NO: 1274151 - RNA, 21 nt, Human
uagaaggacaaacuauuugau

SEQ ID NO: 1274152 - RNA, 21 nt, Human
uagaggcaggguuugugaaag

SEQ ID NO: 1274153 - RNA, 19 nt, Human
uaguagagaugggguuuca

SEQ ID NO: 1274154 - RNA, 23 nt, Human
uaguagagaugggguuucaccau

SEQ ID NO: 1274155 - RNA, 26 nt, Human
uaguagagaugggguuucaccauauu

SEQ ID NO: 1274156 - RNA, 19 nt, Human
ucaagcgauucuccugccu

SEQ ID NO: 1274157 - RNA, 20 nt, Human
ucaauuacagagacagccaa

SEQ ID NO: 1274158 - RNA, 24 nt, Human
ucacugcaacauccaccuccuggg

SEQ ID NO: 1274159 - RNA, 27 nt, Human
ucacugcaacauccaccuccuggguuc

SEQ ID NO: 1274160 - RNA, 19 nt, Human
ucagaauaaaugacugcca

SEQ ID NO: 1274161 - RNA, 23 nt, Human
ucagccucccgaguagcugggac

SEQ ID NO: 1274162 - RNA, 24 nt, Human
ucccaaagugcugggauuacaggc

SEQ ID NO: 1274163 - RNA, 18 nt, Human
ucccgaguagcugggacu

SEQ ID NO: 1274164 - RNA, 21 nt, Human
uccuggguucaagcgauucuc

SEQ ID NO: 1274165 - RNA, 24 nt, Human
uccuggguucaagcgauucuccug

SEQ ID NO: 1274166 - RNA, 22 nt, Human
ucgccuaggcugcagugcagug

SEQ ID NO: 1274167 - RNA, 20 nt, Human
ucuaagcaagcaagccugag

SEQ ID NO: 1274168 - RNA, 21 nt, Human
ucuagcagugagagagcccuc

SEQ ID NO: 1274169 - RNA, 23 nt, Human
ucucacaucccucaaagguuauc

SEQ ID NO: 1274170 - RNA, 24 nt, Human
ucuccugccucagccucccgagua

SEQ ID NO: 1274171 - RNA, 20 nt, Human
ucucugggcucccaggaccu

SEQ ID NO: 1274172 - RNA, 25 nt, Human
ucucugggcucccaggaccuguggu

SEQ ID NO: 1274173 - RNA, 21 nt, Human
ucucuuaaagcaaaaauucau

SEQ ID NO: 1274174 - RNA, 20 nt, Human
ucugggcucccaggaccugu

SEQ ID NO: 1274175 - RNA, 20 nt, Human
ucuguacauacacacacaca

SEQ ID NO: 1274176 - RNA, 19 nt, Human
ucuugaacuccugaccuug

SEQ ID NO: 1274177 - RNA, 19 nt, Human
ucuugcucugucgccuagg

SEQ ID NO: 1274178 - RNA, 20 nt, Human
ucuugcucugucgccuaggc

SEQ ID NO: 1274179 - RNA, 22 nt, Human
ucuugcucugucgccuaggcug

SEQ ID NO: 1274180 - RNA, 21 nt, Human
ugaacugcccaccucaacugg

SEQ ID NO: 1274181 - RNA, 20 nt, Human
ugagaaauaugugaaggaua

SEQ ID NO: 1274182 - RNA, 20 nt, Human
ugagagagcccucuccaugc

SEQ ID NO: 1274183 - RNA, 21 nt, Human
ugaggagauaggcucuaucca

SEQ ID NO: 1274184 - RNA, 21 nt, Human
ugcagugcaguggcgggaucu

SEQ ID NO: 1274185 - RNA, 24 nt, Human
ugcagugcaguggcgggaucucgg

SEQ ID NO: 1274186 - RNA, 22 nt, Human
ugcaguggcgggaucucggcuc

SEQ ID NO: 1274187 - RNA, 23 nt, Human
ugccuaaacucucugggcuccca

SEQ ID NO: 1274188 - RNA, 24 nt, Human
ugccucagccucccgaguagcugg

SEQ ID NO: 1274189 - RNA, 21 nt, Human
ugcuccaacuaggcuucucac

SEQ ID NO: 1274190 - RNA, 24 nt, Human
ugcucugucgccuaggcugcagug

SEQ ID NO: 1274191 - RNA, 24 nt, Human
ugcugggauuacaggcgugagcca

SEQ ID NO: 1274192 - RNA, 19 nt, Human
ugcugugacgccacccucg

SEQ ID NO: 1274193 - RNA, 22 nt, Human
ugcuugaguuaacugucccaca

SEQ ID NO: 1274194 - RNA, 21 nt, Human
uggcaaaaaucacauuguggc

SEQ ID NO: 1274195 - RNA, 22 nt, Human
ugggacuacaggagcgugccac

SEQ ID NO: 1274196 - RNA, 22 nt, Human
ugggacuacaggagcgugccac

SEQ ID NO: 1274197 - RNA, 24 nt, Human
ugggacuacaggagcgugccacua

SEQ ID NO: 1274198 - RNA, 18 nt, Human
ugggauuacaggcgugag

SEQ ID NO: 1274199 - RNA, 22 nt, Human
ugggauuacaggcgugagccac

SEQ ID NO: 1274200 - RNA, 23 nt, Human
ugggauuacaggcgugagccacc

SEQ ID NO: 1274201 - RNA, 24 nt, Human
ugggauuacaggcgugagccacca

SEQ ID NO: 1274202 - RNA, 25 nt, Human
ugggauuacaggcgugagccaccau

SEQ ID NO: 1274203 - RNA, 24 nt, Human
ugggguuucaccauauuggucagg

SEQ ID NO: 1274204 - RNA, 23 nt, Human
uggguucaagcgauucuccugcc

SEQ ID NO: 1274205 - RNA, 24 nt, Human
uggucaggcuggucuugaacuccu

SEQ ID NO: 1274206 - RNA, 18 nt, Human
ugguggacacuugugaaa

SEQ ID NO: 1274207 - RNA, 22 nt, Human
uguacauacacacacacacacc

SEQ ID NO: 1274208 - RNA, 21 nt, Human
uguauuuuuaguagagauggg

SEQ ID NO: 1274209 - RNA, 27 nt, Human
uguccuguguuuuguaaagaugagggu

SEQ ID NO: 1274210 - RNA, 22 nt, Human
ugugaaaggcugcuggccucca

SEQ ID NO: 1274211 - RNA, 18 nt, Human
uuaguagagaugggguuu

SEQ ID NO: 1274212 - RNA, 22 nt, Human
uuaguagagaugggguuucacc

SEQ ID NO: 1274213 - RNA, 24 nt, Human
uuaguagagaugggguuucaccau

SEQ ID NO: 1274214 - RNA, 21 nt, Human
uucaagcgauucuccugccuc

SEQ ID NO: 1274215 - RNA, 23 nt, Human
uucaagcgauucuccugccucag

SEQ ID NO: 1274216 - RNA, 24 nt, Human
uucaagcgauucuccugccucagc

SEQ ID NO: 1274217 - RNA, 22 nt, Human
uucaauaaucuccucccucccc

SEQ ID NO: 1274218 - RNA, 25 nt, Human
uuccugcaauucuaaauccgcccuu

SEQ ID NO: 1274219 - RNA, 18 nt, Human
uugacacuuccugguagc

SEQ ID NO: 1274220 - RNA, 23 nt, Human
uugcauuauuuaaucaccauuca

SEQ ID NO: 1274221 - RNA, 21 nt, Human
uuuagaggcaggguuugugaa

SEQ ID NO: 1274222 - RNA, 23 nt, Human
uuuauaaggggacuagaaggaca

SEQ ID NO: 1274223 - RNA, 24 nt, Human
uuucaccauauuggucaggcuggu

SEQ ID NO: 1274224 - RNA, 20 nt, Human
uuuuguauuuuuaguagaga

SEQ ID NO: 1274225 - RNA, 24 nt, Human
uuuuuaguagagaugggguuucac

SEQ ID NO: 1274226 - RNA, 20 nt, Human
uuuuuguauuuuuaguagag

SEQ ID NO: 1274227 - RNA, 20 nt, Human
uuuuuuuuuuuuuaaagaug

SEQ ID NO: 1274228 - RNA, 19 nt, Human
uuuuuuuuuuuuuuuuuaa

SEQ ID NO: 1274229 - RNA, 21 nt, Human
accacagccaccaccaccccg

SEQ ID NO: 1274230 - RNA, 23 nt, Human
agaagggccccaacacauagccc

SEQ ID NO: 1274231 - RNA, 18 nt, Human
aggccggaggugggggug

SEQ ID NO: 1274232 - RNA, 24 nt, Human
aggccggagguggggguguugggg

SEQ ID NO: 1274233 - RNA, 23 nt, Human
auggagucgcuguuggccugggg

SEQ ID NO: 1274234 - RNA, 19 nt, Human
caccauggaaacaacucca

SEQ ID NO: 1274235 - RNA, 19 nt, Human
cagccaccaccaccccgac

SEQ ID NO: 1274236 - RNA, 21 nt, Human
cagccaccaccaccccgacca

SEQ ID NO: 1274237 - RNA, 25 nt, Human
caucaccauggaaacaacuccaaag

SEQ ID NO: 1274238 - RNA, 20 nt, Human
cauuaccacagccaccacca

SEQ ID NO: 1274239 - RNA, 24 nt, Human
ccaacacauagcccaccauggagu

SEQ ID NO: 1274240 - RNA, 19 nt, Human
ccacugggcuccccagucg

SEQ ID NO: 1274241 - RNA, 21 nt, Human
ccaucaccauggaaacaacuc

SEQ ID NO: 1274242 - RNA, 26 nt, Human
ccccaucaccauggaaacaacuccaa

SEQ ID NO: 1274243 - RNA, 19 nt, Human
cccgaacauccuggaagcc

SEQ ID NO: 1274244 - RNA, 22 nt, Human
cccgaccagggugaugaggaag

SEQ ID NO: 1274245 - RNA, 23 nt, Human
ccucccgccgcugcagccccgac

SEQ ID NO: 1274246 - RNA, 21 nt, Human
cgcccgaacauccuggaagcc

SEQ ID NO: 1274247 - RNA, 20 nt, Human
cguaugcucaucgucccagg

SEQ ID NO: 1274248 - RNA, 18 nt, Human
gcagccggagggcugggu

SEQ ID NO: 1274249 - RNA, 18 nt, Human
gcgcuucgggagggcgcc

SEQ ID NO: 1274250 - RNA, 21 nt, Human
ggagguggggguguuggggga

SEQ ID NO: 1274251 - RNA, 18 nt, Human
ggcaugccagggugggga

SEQ ID NO: 1274252 - RNA, 23 nt, Human
ggcaugccaggguggggagggcg

SEQ ID NO: 1274253 - RNA, 22 nt, Human
ggccccaucaccauggaaacaa

SEQ ID NO: 1274254 - RNA, 24 nt, Human
ggccggagguggggguguuggggg

SEQ ID NO: 1274255 - RNA, 19 nt, Human
gggaggcucaggccggagg

SEQ ID NO: 1274256 - RNA, 22 nt, Human
ggggagggcgucaggccgcugc

SEQ ID NO: 1274257 - RNA, 18 nt, Human
gggggaugcggaugggcc

SEQ ID NO: 1274258 - RNA, 21 nt, Human
ggggguguugggggaugcgga

SEQ ID NO: 1274259 - RNA, 22 nt, Human
gggugaugaggaagaagggccc

SEQ ID NO: 1274260 - RNA, 20 nt, Human
uaccacagccaccaccaccc

SEQ ID NO: 1274261 - RNA, 18 nt, Human
uaccucccgccgcugcag

SEQ ID NO: 1274262 - RNA, 19 nt, Human
uaccucccgccgcugcagc

SEQ ID NO: 1274263 - RNA, 22 nt, Human
ucaggccgcugcuaggaugcgg

SEQ ID NO: 1274264 - RNA, 23 nt, Human
ucaucgucccaggucaagggggc

SEQ ID NO: 1274265 - RNA, 19 nt, Human
ucccgccgcugcagccccg

SEQ ID NO: 1274266 - RNA, 23 nt, Human
ucgcuguuggccuggggggcauu

SEQ ID NO: 1274267 - RNA, 19 nt, Human
ucuggccccaucaccaugg

SEQ ID NO: 1274268 - RNA, 19 nt, Human
ugccaggguggggagggcg

SEQ ID NO: 1274269 - RNA, 24 nt, Human
ugccggcgcucugcagcccagccg

SEQ ID NO: 1274270 - RNA, 20 nt, Human
ugccuggggauuugugccca

SEQ ID NO: 1274271 - RNA, 22 nt, Human
uggucagcaugggcaguggcgc

SEQ ID NO: 1274272 - RNA, 21 nt, Human
uuaccacagccaccaccaccc

SEQ ID NO: 1274273 - RNA, 19 nt, Human
uugggggaugcggaugggc

SEQ ID NO: 1274274 - RNA, 21 nt, Human
aaaagguauaaaguugccaga

SEQ ID NO: 1274275 - RNA, 19 nt, Human
aaacaaacaagggcugcaa

SEQ ID NO: 1274276 - RNA, 22 nt, Human
aaagcucuuaaagcccucacag

SEQ ID NO: 1274277 - RNA, 19 nt, Human
aacaagaccaagaggagaa

SEQ ID NO: 1274278 - RNA, 19 nt, Human
aacagcacagcauccaggg

SEQ ID NO: 1274279 - RNA, 20 nt, Human
aacaugccuauggccucaga

SEQ ID NO: 1274280 - RNA, 21 nt, Human
aacugagaaguuuuggggguc

SEQ ID NO: 1274281 - RNA, 22 nt, Human
aagcagccugugaagugugggc

SEQ ID NO: 1274282 - RNA, 18 nt, Human
aagcagggcagaaaccga

SEQ ID NO: 1274283 - RNA, 19 nt, Human
aagccugugcuccuacaag

SEQ ID NO: 1274284 - RNA, 22 nt, Human
aagcucacuucacaggaaccaa

SEQ ID NO: 1274285 - RNA, 23 nt, Human
aagcucacuucacaggaaccaag

SEQ ID NO: 1274286 - RNA, 20 nt, Human
acaaacaagggcugcaagac

SEQ ID NO: 1274287 - RNA, 25 nt, Human
acaauggaaagaacgacuuuccaaa

SEQ ID NO: 1274288 - RNA, 19 nt, Human
acaggcaaggauauguagu

SEQ ID NO: 1274289 - RNA, 25 nt, Human
acauucuccuuuuugccucuugcca

SEQ ID NO: 1274290 - RNA, 23 nt, Human
acauuuuuuuuuagggagcaaga

SEQ ID NO: 1274291 - RNA, 22 nt, Human
acccauagcccugauccacguc

SEQ ID NO: 1274292 - RNA, 22 nt, Human
acccaucucugccucuccccag

SEQ ID NO: 1274293 - RNA, 23 nt, Human
accuccucucccucugggaccaa

SEQ ID NO: 1274294 - RNA, 23 nt, Human
accucgccaccacccuggguucu

SEQ ID NO: 1274295 - RNA, 19 nt, Human
acgaggcagcaaauccgaa

SEQ ID NO: 1274296 - RNA, 24 nt, Human
acuugaaaagacaacucaaaaagg

SEQ ID NO: 1274297 - RNA, 20 nt, Human
agaccccaaggcaucucccc

SEQ ID NO: 1274298 - RNA, 22 nt, Human
agagggaauuuggccaggcagg

SEQ ID NO: 1274299 - RNA, 21 nt, Human
agcccaccuccucucccucug

SEQ ID NO: 1274300 - RNA, 22 nt, Human
agccuccaggaaagcaucuccc

SEQ ID NO: 1274301 - RNA, 18 nt, Human
aggaaccaagcugugggc

SEQ ID NO: 1274302 - RNA, 24 nt, Human
aggaagaaaacagcaauaacugaa

SEQ ID NO: 1274303 - RNA, 20 nt, Human
aggcaggcucagggccccuu

SEQ ID NO: 1274304 - RNA, 21 nt, Human
aggccucacucuccagugcag

SEQ ID NO: 1274305 - RNA, 20 nt, Human
agggaauuuggccaggcagg

SEQ ID NO: 1274306 - RNA, 21 nt, Human
agggaccacuguccagaauuc

SEQ ID NO: 1274307 - RNA, 18 nt, Human
aggugagucacagugggg

SEQ ID NO: 1274308 - RNA, 22 nt, Human
auccauuuuuuugcuuuucuca

SEQ ID NO: 1274309 - RNA, 24 nt, Human
auccuauggcagccccuccuguua

SEQ ID NO: 1274310 - RNA, 22 nt, Human
auccugugauccucccagacca

SEQ ID NO: 1274311 - RNA, 21 nt, Human
augaaauuaaccaaggcugac

SEQ ID NO: 1274312 - RNA, 22 nt, Human
augaguuccugugguccugggg

SEQ ID NO: 1274313 - RNA, 21 nt, Human
augcauucugaguaucacaca

SEQ ID NO: 1274314 - RNA, 22 nt, Human
auggggcugggggcucugccuc

SEQ ID NO: 1274315 - RNA, 18 nt, Human
auuggagacaaguaucca

SEQ ID NO: 1274316 - RNA, 24 nt, Human
caaaaagguauaaaguugccagau

SEQ ID NO: 1274317 - RNA, 22 nt, Human
caacccccaggccccucucugg

SEQ ID NO: 1274318 - RNA, 18 nt, Human
caagacuaaaagacccau

SEQ ID NO: 1274319 - RNA, 22 nt, Human
cacagaccccaaggcaucuccc

SEQ ID NO: 1274320 - RNA, 20 nt, Human
cacagcaagcucacuucacu

SEQ ID NO: 1274321 - RNA, 20 nt, Human
cacagcccaauuucaucugc

SEQ ID NO: 1274322 - RNA, 22 nt, Human
cacagcccaccuccucucccuc

SEQ ID NO: 1274323 - RNA, 18 nt, Human
cacccuuucucuaaccca

SEQ ID NO: 1274324 - RNA, 25 nt, Human
caccuccucucccucugggaccaag

SEQ ID NO: 1274325 - RNA, 24 nt, Human
caccucgccaccacccuggguucu

SEQ ID NO: 1274326 - RNA, 20 nt, Human
cagaccccaaggcaucuccc

SEQ ID NO: 1274327 - RNA, 21 nt, Human
cagcaaggcggcaaggcccuu

SEQ ID NO: 1274328 - RNA, 22 nt, Human
cagcacacaugaguuccugugg

SEQ ID NO: 1274329 - RNA, 19 nt, Human
cagcauccagggaaggagg

SEQ ID NO: 1274330 - RNA, 18 nt, Human
caggaaccaagcuguggg

SEQ ID NO: 1274331 - RNA, 24 nt, Human
caggaugaaaaaacugaggcacga

SEQ ID NO: 1274332 - RNA, 22 nt, Human
caggcgugggggcagaagaagg

SEQ ID NO: 1274333 - RNA, 25 nt, Human
cagggcagaaaccgaagugcuuuug

SEQ ID NO: 1274334 - RNA, 22 nt, Human
caggguguguucuccuccugca

SEQ ID NO: 1274335 - RNA, 22 nt, Human
caucagcacccauagcccugau

SEQ ID NO: 1274336 - RNA, 23 nt, Human
caucccgcguccccggccgaggg

SEQ ID NO: 1274337 - RNA, 21 nt, Human
cauccuauggcagccccuccu

SEQ ID NO: 1274338 - RNA, 19 nt, Human
caugagguucuguaguugc

SEQ ID NO: 1274339 - RNA, 20 nt, Human
ccaaggaaggaagaaaacag

SEQ ID NO: 1274340 - RNA, 18 nt, Human
ccacaugugccacacagg

SEQ ID NO: 1274341 - RNA, 18 nt, Human
ccaccacccuggguucug

SEQ ID NO: 1274342 - RNA, 25 nt, Human
cccacacccaccacagcccaauuuc

SEQ ID NO: 1274343 - RNA, 24 nt, Human
cccccaggccccucucuggugagc

SEQ ID NO: 1274344 - RNA, 18 nt, Human
ccccuggugguuccguac

SEQ ID NO: 1274345 - RNA, 22 nt, Human
cccugcugaggcacagcccacc

SEQ ID NO: 1274346 - RNA, 22 nt, Human
cccuggcuggcaccugcccccc

SEQ ID NO: 1274347 - RNA, 23 nt, Human
ccuacuagaaccuucuccccugg

SEQ ID NO: 1274348 - RNA, 19 nt, Human
ccuccaugccaacaugcuc

SEQ ID NO: 1274349 - RNA, 21 nt, Human
ccuccugcaaguccaucuuua

SEQ ID NO: 1274350 - RNA, 23 nt, Human
ccuccuguuauuauuuaauagcc

SEQ ID NO: 1274351 - RNA, 19 nt, Human
ccucuaggcaggcacgacu

SEQ ID NO: 1274352 - RNA, 20 nt, Human
ccugccccccaacuggaguu

SEQ ID NO: 1274353 - RNA, 22 nt, Human
ccugcgcucugccagcucccac

SEQ ID NO: 1274354 - RNA, 19 nt, Human
ccugggccuuguugggacc

SEQ ID NO: 1274355 - RNA, 25 nt, Human
cgaacaggcaaaggccucacucucc

SEQ ID NO: 1274356 - RNA, 19 nt, Human
cgaagagggucugagaagc

SEQ ID NO: 1274357 - RNA, 19 nt, Human
cgggguggguagggagggc

SEQ ID NO: 1274358 - RNA, 18 nt, Human
cucaaagacguuucccuu

SEQ ID NO: 1274359 - RNA, 21 nt, Human
cuccccaagaugaccacaguu

SEQ ID NO: 1274360 - RNA, 24 nt, Human
cucccggccccgcaucaucccgcg

SEQ ID NO: 1274361 - RNA, 27 nt, Human
cucccuccagguuucucagccuccagg

SEQ ID NO: 1274362 - RNA, 23 nt, Human
cucccugggcugaguggccucca

SEQ ID NO: 1274363 - RNA, 18 nt, Human
cuccuaacaucaguccuc

SEQ ID NO: 1274364 - RNA, 19 nt, Human
cucugccagcucccaccuc

SEQ ID NO: 1274365 - RNA, 23 nt, Human
cucugccagcucccaccucgcca

SEQ ID NO: 1274366 - RNA, 21 nt, Human
cugugggcugauccuacagac

SEQ ID NO: 1274367 - RNA, 23 nt, Human
cuguuuccugggccuuguuggga

SEQ ID NO: 1274368 - RNA, 18 nt, Human
cuguuucuuuucuguucu

SEQ ID NO: 1274369 - RNA, 19 nt, Human
cuuauguuuggggcuaagg

SEQ ID NO: 1274370 - RNA, 23 nt, Human
cuuuuggaaguccacagggauuc

SEQ ID NO: 1274371 - RNA, 23 nt, Human
gaacaggcaaaggccucacucuc

SEQ ID NO: 1274372 - RNA, 22 nt, Human
gaacuucuucccugcgcucugc

SEQ ID NO: 1274373 - RNA, 25 nt, Human
gaagaagucagccugacauuuuaaa

SEQ ID NO: 1274374 - RNA, 18 nt, Human
gaagccaugccaguaaaa

SEQ ID NO: 1274375 - RNA, 22 nt, Human
gaccaaaguuucugccacagcc

SEQ ID NO: 1274376 - RNA, 20 nt, Human
gaccacuguccagaauucuc

SEQ ID NO: 1274377 - RNA, 23 nt, Human
gacugcgugccuuccauuugggg

SEQ ID NO: 1274378 - RNA, 19 nt, Human
gagagggguucuuguuccc

SEQ ID NO: 1274379 - RNA, 20 nt, Human
gagcaagaagauacuuuugu

SEQ ID NO: 1274380 - RNA, 18 nt, Human
gaggaugggaggcuggaa

SEQ ID NO: 1274381 - RNA, 23 nt, Human
gaggcagcaaauccgaacaggca

SEQ ID NO: 1274382 - RNA, 25 nt, Human
gaggcaguuucuuauccucucuggg

SEQ ID NO: 1274383 - RNA, 18 nt, Human
gaggcauucccuacccuu

SEQ ID NO: 1274384 - RNA, 21 nt, Human
gcaccugccccccaacuggag

SEQ ID NO: 1274385 - RNA, 25 nt, Human
gcaggcacgacugcgugccuuccau

SEQ ID NO: 1274386 - RNA, 24 nt, Human
gcucaaguccccagcaaggcggca

SEQ ID NO: 1274387 - RNA, 18 nt, Human
ggaauuuggccaggcagg

SEQ ID NO: 1274388 - RNA, 23 nt, Human
ggauugagaagaagucagccuga

SEQ ID NO: 1274389 - RNA, 19 nt, Human
ggcagcuugaaacacacga

SEQ ID NO: 1274390 - RNA, 22 nt, Human
ggcugagaggcucaagucccca

SEQ ID NO: 1274391 - RNA, 18 nt, Human
gggaaggagggggccugg

SEQ ID NO: 1274392 - RNA, 20 nt, Human
gggcacagcacugccucagc

SEQ ID NO: 1274393 - RNA, 23 nt, Human
gggcagaaaccgaagugcuuuug

SEQ ID NO: 1274394 - RNA, 19 nt, Human
gggcaggcaggcucagggc

SEQ ID NO: 1274395 - RNA, 22 nt, Human
gggcgggcagcuccagagagca

SEQ ID NO: 1274396 - RNA, 20 nt, Human
gggcgugaguccugccuccc

SEQ ID NO: 1274397 - RNA, 23 nt, Human
gggggccuggaggccaacaaggg

SEQ ID NO: 1274398 - RNA, 18 nt, Human
gggggucggggggugggg

SEQ ID NO: 1274399 - RNA, 18 nt, Human
ggguagggagggcuucga

SEQ ID NO: 1274400 - RNA, 19 nt, Human
ggguuugccacccacagga

SEQ ID NO: 1274401 - RNA, 19 nt, Human
gugaagaacagaaagguga

SEQ ID NO: 1274402 - RNA, 21 nt, Human
gugccuccuucucuugguauc

SEQ ID NO: 1274403 - RNA, 24 nt, Human
gugguccuggggcacccaguugcc

SEQ ID NO: 1274404 - RNA, 19 nt, Human
guuccauuuucccugcaca

SEQ ID NO: 1274405 - RNA, 19 nt, Human
guuucucacggggugggua

SEQ ID NO: 1274406 - RNA, 18 nt, Human
uaaaagacccaucucugc

SEQ ID NO: 1274407 - RNA, 22 nt, Human
uaaaagacccaucucugccucu

SEQ ID NO: 1274408 - RNA, 18 nt, Human
uaaagcucaaauugaucu

SEQ ID NO: 1274409 - RNA, 19 nt, Human
uaacgugaugccccugcaa

SEQ ID NO: 1274410 - RNA, 18 nt, Human
uagccccuccccauccug

SEQ ID NO: 1274411 - RNA, 18 nt, Human
uauggcagccccuccugu

SEQ ID NO: 1274412 - RNA, 21 nt, Human
ucaaagcucuuaaagcccuca

SEQ ID NO: 1274413 - RNA, 18 nt, Human
ucaacccccaggccccuc

SEQ ID NO: 1274414 - RNA, 23 nt, Human
ucacagcaagcucacuucacagg

SEQ ID NO: 1274415 - RNA, 24 nt, Human
ucacuacuaaucuaucuucccaac

SEQ ID NO: 1274416 - RNA, 24 nt, Human
ucagugagaucuggccauguccuu

SEQ ID NO: 1274417 - RNA, 19 nt, Human
ucaguuccaugccaggagc

SEQ ID NO: 1274418 - RNA, 23 nt, Human
uccacagggauucccacacccac

SEQ ID NO: 1274419 - RNA, 19 nt, Human
uccaugcaauugguuucca

SEQ ID NO: 1274420 - RNA, 22 nt, Human
uccaugccaggagcugcaggag

SEQ ID NO: 1274421 - RNA, 23 nt, Human
ucccacacccaccacagcccaau

SEQ ID NO: 1274422 - RNA, 24 nt, Human
uccccaagaugaccacaguugucc

SEQ ID NO: 1274423 - RNA, 23 nt, Human
ucccuccagguuucucagccucc

SEQ ID NO: 1274424 - RNA, 20 nt, Human
ucccugcacagguaaggaac

SEQ ID NO: 1274425 - RNA, 22 nt, Human
ucccugcgcucugccagcuccc

SEQ ID NO: 1274426 - RNA, 22 nt, Human
uccuccuaacaucaguccucag

SEQ ID NO: 1274427 - RNA, 20 nt, Human
uccugccucccugggcugag

SEQ ID NO: 1274428 - RNA, 22 nt, Human
uccugugguccuggggcaccca

SEQ ID NO: 1274429 - RNA, 20 nt, Human
ucuaagauuucacuuaguuu

SEQ ID NO: 1274430 - RNA, 22 nt, Human
ucuaggcuuugagucauguuug

SEQ ID NO: 1274431 - RNA, 19 nt, Human
ucuaugcaccaucaggacc

SEQ ID NO: 1274432 - RNA, 23 nt, Human
ucucaacccccaggccccucucu

SEQ ID NO: 1274433 - RNA, 24 nt, Human
ucucaacccccaggccccucucug

SEQ ID NO: 1274434 - RNA, 23 nt, Human
ucucaggggccauucuccaguag

SEQ ID NO: 1274435 - RNA, 21 nt, Human
ucuccagugcagucugggagg

SEQ ID NO: 1274436 - RNA, 18 nt, Human
ucucgcugaaguccagaa

SEQ ID NO: 1274437 - RNA, 21 nt, Human
ucugaaucaaggccacaggag

SEQ ID NO: 1274438 - RNA, 22 nt, Human
ucugaaucaaggccacaggagc

SEQ ID NO: 1274439 - RNA, 20 nt, Human
ucugccagcucccaccucgc

SEQ ID NO: 1274440 - RNA, 24 nt, Human
ucuguuuccugggccuuguuggga

SEQ ID NO: 1274441 - RNA, 22 nt, Human
ucuucuggggacuucuuucagu

SEQ ID NO: 1274442 - RNA, 20 nt, Human
ugaaaaaacugaggcacgaa

SEQ ID NO: 1274443 - RNA, 23 nt, Human
ugaaaagacaacucaaaaaggua

SEQ ID NO: 1274444 - RNA, 21 nt, Human
ugaaggacaggcgugggggca

SEQ ID NO: 1274445 - RNA, 23 nt, Human
ugaaggacaggcgugggggcaga

SEQ ID NO: 1274446 - RNA, 21 nt, Human
ugaagugugggcagcuugaaa

SEQ ID NO: 1274447 - RNA, 23 nt, Human
ugacucccaaguuccauuuuccc

SEQ ID NO: 1274448 - RNA, 19 nt, Human
ugacugcauggggcugggg

SEQ ID NO: 1274449 - RNA, 23 nt, Human
ugagaagcagucauauugaccca

SEQ ID NO: 1274450 - RNA, 19 nt, Human
ugagaggcucaagucccca

SEQ ID NO: 1274451 - RNA, 18 nt, Human
ugaggugacugcaugggg

SEQ ID NO: 1274452 - RNA, 19 nt, Human
ugaggugacugcauggggc

SEQ ID NO: 1274453 - RNA, 21 nt, Human
ugaguaucacacauucuccuu

SEQ ID NO: 1274454 - RNA, 21 nt, Human
ugaguggccuccaugccaaca

SEQ ID NO: 1274455 - RNA, 21 nt, Human
ugauccuggaacuucuucccu

SEQ ID NO: 1274456 - RNA, 19 nt, Human
ugcaagacuaaaagaccca

SEQ ID NO: 1274457 - RNA, 24 nt, Human
ugcaggguguguucuccuccugca

SEQ ID NO: 1274458 - RNA, 25 nt, Human
ugccacagccaaugaaacaagacca

SEQ ID NO: 1274459 - RNA, 21 nt, Human
ugccacccacaggaugaggcc

SEQ ID NO: 1274460 - RNA, 18 nt, Human
ugcccagagggaauuugg

SEQ ID NO: 1274461 - RNA, 21 nt, Human
ugccggggggucggggggugg

SEQ ID NO: 1274462 - RNA, 21 nt, Human
uggaaagaacgacuuuccaaa

SEQ ID NO: 1274463 - RNA, 21 nt, Human
uggaaguccacagggauuccc

SEQ ID NO: 1274464 - RNA, 20 nt, Human
uggcacaauauuaacgccuc

SEQ ID NO: 1274465 - RNA, 20 nt, Human
ugggaccaaaguuucugcca

SEQ ID NO: 1274466 - RNA, 18 nt, Human
ugggccaggaaaagcucc

SEQ ID NO: 1274467 - RNA, 20 nt, Human
ugggguaucacugucccagg

SEQ ID NO: 1274468 - RNA, 18 nt, Human
uguccagaauucucugau

SEQ ID NO: 1274469 - RNA, 21 nt, Human
uguccagaauucucugauagu

SEQ ID NO: 1274470 - RNA, 24 nt, Human
uuaaacaaacaagggcugcaagac

SEQ ID NO: 1274471 - RNA, 21 nt, Human
uuaaagcucaaauugaucuac

SEQ ID NO: 1274472 - RNA, 25 nt, Human
uucaggaggaggggaauuuccugcc

SEQ ID NO: 1274473 - RNA, 18 nt, Human
uuccagcucgccccaagc

SEQ ID NO: 1274474 - RNA, 19 nt, Human
uucccacacccaccacagc

SEQ ID NO: 1274475 - RNA, 21 nt, Human
uucccacccuuucucuaaccc

SEQ ID NO: 1274476 - RNA, 25 nt, Human
uucucagccuccaggaaagcaucuc

SEQ ID NO: 1274477 - RNA, 22 nt, Human
uugaaaucugauagaagcccau

SEQ ID NO: 1274478 - RNA, 21 nt, Human
uugccagugccaacuaugugu

SEQ ID NO: 1274479 - RNA, 21 nt, Human
uuucucacgggguggguaggg

SEQ ID NO: 1274480 - RNA, 24 nt, Human
uuucugccacagccaaugaaacaa

SEQ ID NO: 1274481 - RNA, 20 nt, Human
aaauaguuuauucauccagc

SEQ ID NO: 1274482 - RNA, 23 nt, Human
aacccuucuccccguuucugcca

SEQ ID NO: 1274483 - RNA, 20 nt, Human
aagacuagagaggggugguu

SEQ ID NO: 1274484 - RNA, 18 nt, Human
aagaguauggcagaccuu

SEQ ID NO: 1274485 - RNA, 23 nt, Human
aagcugcuccccaucccgccacc

SEQ ID NO: 1274486 - RNA, 20 nt, Human
aaggaaacaaaaaauaccag

SEQ ID NO: 1274487 - RNA, 23 nt, Human
aaguaacaacccccugaaggcac

SEQ ID NO: 1274488 - RNA, 20 nt, Human
aaguucuuguuaaacagccc

SEQ ID NO: 1274489 - RNA, 22 nt, Human
accaagcugcuccccaucccgc

SEQ ID NO: 1274490 - RNA, 25 nt, Human
accacggggccagcgcucagauucc

SEQ ID NO: 1274491 - RNA, 27 nt, Human
acccuggagcucucaaguaacaacccc

SEQ ID NO: 1274492 - RNA, 22 nt, Human
acccuucuccccguuucugcca

SEQ ID NO: 1274493 - RNA, 22 nt, Human
acgcugcccaccagcggcgggc

SEQ ID NO: 1274494 - RNA, 20 nt, Human
agaagccgagagagccagcg

SEQ ID NO: 1274495 - RNA, 24 nt, Human
agacaucccggguggugucgguga

SEQ ID NO: 1274496 - RNA, 23 nt, Human
agccagagcacaggcuuucuccc

SEQ ID NO: 1274497 - RNA, 22 nt, Human
agccggcgccccaccucaggcc

SEQ ID NO: 1274498 - RNA, 19 nt, Human
agcuggcgggagggccggu

SEQ ID NO: 1274499 - RNA, 18 nt, Human
aggaaacaaaaaauacca

SEQ ID NO: 1274500 - RNA, 21 nt, Human
aggcccgggcgcgggucggga

SEQ ID NO: 1274501 - RNA, 21 nt, Human
aggccgcggcucccuacccag

SEQ ID NO: 1274502 - RNA, 20 nt, Human
agggaccgugugucugggcc

SEQ ID NO: 1274503 - RNA, 19 nt, Human
agucccuacuucgggaucc

SEQ ID NO: 1274504 - RNA, 22 nt, Human
aucccgccacccgaaacaccau

SEQ ID NO: 1274505 - RNA, 22 nt, Human
auuaaggaaacaaaaaauacca

SEQ ID NO: 1274506 - RNA, 19 nt, Human
caaaaaauaccaguaagac

SEQ ID NO: 1274507 - RNA, 23 nt, Human
caccagcggcgggccgcgagacc

SEQ ID NO: 1274508 - RNA, 23 nt, Human
cacccgaaacaccaucccugccc

SEQ ID NO: 1274509 - RNA, 24 nt, Human
cagagcagaagccgagagagccag

SEQ ID NO: 1274510 - RNA, 23 nt, Human
cagauuccugcccugccgaucau

SEQ ID NO: 1274511 - RNA, 20 nt, Human
cagcuucugugagaagcaac

SEQ ID NO: 1274512 - RNA, 21 nt, Human
cagggcagagucugggcuauc

SEQ ID NO: 1274513 - RNA, 19 nt, Human
cagggggcagccugcagcc

SEQ ID NO: 1274514 - RNA, 24 nt, Human
cagucacuuguucuaauuucuagc

SEQ ID NO: 1274515 - RNA, 23 nt, Human
caugaaaacucaaccgucagaga

SEQ ID NO: 1274516 - RNA, 18 nt, Human
ccagagcagaagccgaga

SEQ ID NO: 1274517 - RNA, 19 nt, Human
ccagccagccagagcacag

SEQ ID NO: 1274518 - RNA, 19 nt, Human
cccaaaggaugcccaggaa

SEQ ID NO: 1274519 - RNA, 24 nt, Human
cccaccagccccacgcuugucagc

SEQ ID NO: 1274520 - RNA, 18 nt, Human
ccccagcccaccagcccc

SEQ ID NO: 1274521 - RNA, 23 nt, Human
ccccgcggccgggccuccucccg

SEQ ID NO: 1274522 - RNA, 23 nt, Human
cccgcaggcccgggcgcgggucg

SEQ ID NO: 1274523 - RNA, 19 nt, Human
cccgcaggcggcgcagcuu

SEQ ID NO: 1274524 - RNA, 23 nt, Human
cccgccacccgaaacaccauccc

SEQ ID NO: 1274525 - RNA, 23 nt, Human
cccgccgccaagagccgcggccg

SEQ ID NO: 1274526 - RNA, 19 nt, Human
cccucgccgcgccagcagg

SEQ ID NO: 1274527 - RNA, 18 nt, Human
cccugccccaccucccag

SEQ ID NO: 1274528 - RNA, 19 nt, Human
cccuggcuucucccccucc

SEQ ID NO: 1274529 - RNA, 18 nt, Human
cccuggggcugcccgacc

SEQ ID NO: 1274530 - RNA, 22 nt, Human
ccgcggagggccggauaucacc

SEQ ID NO: 1274531 - RNA, 18 nt, Human
ccgcggcgggccgggcgc

SEQ ID NO: 1274532 - RNA, 18 nt, Human
ccgcucgagucgcccgca

SEQ ID NO: 1274533 - RNA, 19 nt, Human
ccggguggugucggugaug

SEQ ID NO: 1274534 - RNA, 18 nt, Human
ccguaggccccagggguc

SEQ ID NO: 1274535 - RNA, 20 nt, Human
ccucccaggugacagacucc

SEQ ID NO: 1274536 - RNA, 25 nt, Human
ccugaccugagggaccgugugucug

SEQ ID NO: 1274537 - RNA, 21 nt, Human
ccugccugccgcagaugagga

SEQ ID NO: 1274538 - RNA, 20 nt, Human
ccugcgagccgaacuccucu

SEQ ID NO: 1274539 - RNA, 22 nt, Human
ccuggcuucucccccucccuuu

SEQ ID NO: 1274540 - RNA, 18 nt, Human
ccuggggcugcccgaccc

SEQ ID NO: 1274541 - RNA, 22 nt, Human
cgaggccggcugggagagccag

SEQ ID NO: 1274542 - RNA, 19 nt, Human
cgcagccgcuccucgucgc

SEQ ID NO: 1274543 - RNA, 23 nt, Human
cgcggccgggccuccucccgcag

SEQ ID NO: 1274544 - RNA, 19 nt, Human
cgcucagauuccugcccug

SEQ ID NO: 1274545 - RNA, 18 nt, Human
cggcggcgcggacgcugc

SEQ ID NO: 1274546 - RNA, 19 nt, Human
cggcggcgcggacgcugcu

SEQ ID NO: 1274547 - RNA, 21 nt, Human
cgggagggccggugggcggcg

SEQ ID NO: 1274548 - RNA, 18 nt, Human
cgggccucuucccguaac

SEQ ID NO: 1274549 - RNA, 23 nt, Human
cgggccucuucccguaaccgcuc

SEQ ID NO: 1274550 - RNA, 19 nt, Human
cggggcgggagacgcugcc

SEQ ID NO: 1274551 - RNA, 22 nt, Human
cguaaccgcuccucgccccgcg

SEQ ID NO: 1274552 - RNA, 19 nt, Human
cucccaagcucccggaauc

SEQ ID NO: 1274553 - RNA, 23 nt, Human
cuccucucugcucucagccccag

SEQ ID NO: 1274554 - RNA, 21 nt, Human
cucucagccccagucccuacu

SEQ ID NO: 1274555 - RNA, 23 nt, Human
cucucagccccagucccuacuuc

SEQ ID NO: 1274556 - RNA, 21 nt, Human
cucugcucucagccccagucc

SEQ ID NO: 1274557 - RNA, 22 nt, Human
cugaccgggaacaaguccccgc

SEQ ID NO: 1274558 - RNA, 18 nt, Human
cugauacugaagccuguu

SEQ ID NO: 1274559 - RNA, 21 nt, Human
cugcucacuccuccugaccug

SEQ ID NO: 1274560 - RNA, 22 nt, Human
cuggugacccuccugugccucu

SEQ ID NO: 1274561 - RNA, 19 nt, Human
cuucaggauagaggcccag

SEQ ID NO: 1274562 - RNA, 19 nt, Human
cuucccguaaccgcuccuc

SEQ ID NO: 1274563 - RNA, 21 nt, Human
gaaacaccaucccugccccac

SEQ ID NO: 1274564 - RNA, 25 nt, Human
gaaacaccaucccugccccaccucc

SEQ ID NO: 1274565 - RNA, 22 nt, Human
gagcccgaggccggcugggaga

SEQ ID NO: 1274566 - RNA, 19 nt, Human
gagcuggcgggagggccgg

SEQ ID NO: 1274567 - RNA, 22 nt, Human
gagggaccgugugucugggccu

SEQ ID NO: 1274568 - RNA, 19 nt, Human
gcagccgggccucgccccg

SEQ ID NO: 1274569 - RNA, 18 nt, Human
gcagcggcgcauccucgc

SEQ ID NO: 1274570 - RNA, 18 nt, Human
gcccuggggcugcccgac

SEQ ID NO: 1274571 - RNA, 19 nt, Human
gcccuggggcugcccgacc

SEQ ID NO: 1274572 - RNA, 21 nt, Human
gccgaucauccagacaucaga

SEQ ID NO: 1274573 - RNA, 23 nt, Human
gccggcugggagagccagggcuc

SEQ ID NO: 1274574 - RNA, 20 nt, Human
gccgggccuccucccgcagc

SEQ ID NO: 1274575 - RNA, 18 nt, Human
gccugaguugcgccgggc

SEQ ID NO: 1274576 - RNA, 18 nt, Human
gcgccagcagggcccgcu

SEQ ID NO: 1274577 - RNA, 23 nt, Human
gcggccgggguaacagaaacgcc

SEQ ID NO: 1274578 - RNA, 19 nt, Human
gcuccucgccccgcggccg

SEQ ID NO: 1274579 - RNA, 20 nt, Human
ggccggugggcggcggcgcg

SEQ ID NO: 1274580 - RNA, 22 nt, Human
ggcggcggcgcggacgcugcuc

SEQ ID NO: 1274581 - RNA, 18 nt, Human
ggcuggaagcccagggcc

SEQ ID NO: 1274582 - RNA, 24 nt, Human
gggccgcgagacccgggcccugcg

SEQ ID NO: 1274583 - RNA, 18 nt, Human
gggccgggcgcgcagcgg

SEQ ID NO: 1274584 - RNA, 19 nt, Human
ggguaacagaaacgccggc

SEQ ID NO: 1274585 - RNA, 21 nt, Human
gggugguuaauguuucuggag

SEQ ID NO: 1274586 - RNA, 22 nt, Human
ggugacccuccugugccucugg

SEQ ID NO: 1274587 - RNA, 22 nt, Human
gguguuucuuauuuuucuggcu

SEQ ID NO: 1274588 - RNA, 18 nt, Human
gucuagagucgcagcuuc

SEQ ID NO: 1274589 - RNA, 19 nt, Human
uaacaacccccugaaggca

SEQ ID NO: 1274590 - RNA, 24 nt, Human
uaauaaauaguuuauucauccagc

SEQ ID NO: 1274591 - RNA, 20 nt, Human
uaauuucuagcaccuucccu

SEQ ID NO: 1274592 - RNA, 18 nt, Human
uaggcuggcccagagcag

SEQ ID NO: 1274593 - RNA, 24 nt, Human
ucaaggcaagugugaauucagcac

SEQ ID NO: 1274594 - RNA, 18 nt, Human
ucaccguaggccccaggg

SEQ ID NO: 1274595 - RNA, 18 nt, Human
ucccaagcucccggaauc

SEQ ID NO: 1274596 - RNA, 19 nt, Human
ucccaggaggcugugccgg

SEQ ID NO: 1274597 - RNA, 24 nt, Human
ucccaggaggcugugccggcugcu

SEQ ID NO: 1274598 - RNA, 18 nt, Human
ucccagggagcaggcuga

SEQ ID NO: 1274599 - RNA, 22 nt, Human
ucccccucccuuuaaaggaagc

SEQ ID NO: 1274600 - RNA, 19 nt, Human
ucccucuucaggauagagg

SEQ ID NO: 1274601 - RNA, 23 nt, Human
ucccucuucaggauagaggccca

SEQ ID NO: 1274602 - RNA, 20 nt, Human
ucccuggcguggccaugccc

SEQ ID NO: 1274603 - RNA, 24 nt, Human
uccucgcguaaccgggccucuucc

SEQ ID NO: 1274604 - RNA, 18 nt, Human
uccucggagcugccccgg

SEQ ID NO: 1274605 - RNA, 20 nt, Human
uccucucugcucucagcccc

SEQ ID NO: 1274606 - RNA, 21 nt, Human
uccuggcuggaagcccagggc

SEQ ID NO: 1274607 - RNA, 20 nt, Human
ucgggaccgaggagggagga

SEQ ID NO: 1274608 - RNA, 20 nt, Human
ucgugucaggacgagacuga

SEQ ID NO: 1274609 - RNA, 19 nt, Human
ucuggcugcaggccugguc

SEQ ID NO: 1274610 - RNA, 23 nt, Human
ugacgcagggcucccaagcuccc

SEQ ID NO: 1274611 - RNA, 21 nt, Human
ugaggagcuggcgggagggcc

SEQ ID NO: 1274612 - RNA, 18 nt, Human
ugaggcgggcccgcccgc

SEQ ID NO: 1274613 - RNA, 21 nt, Human
ugccccggaccgaggcgcggc

SEQ ID NO: 1274614 - RNA, 23 nt, Human
ugcucacuccuccugaccugagg

SEQ ID NO: 1274615 - RNA, 20 nt, Human
ugcuccccaucccgccaccc

SEQ ID NO: 1274616 - RNA, 18 nt, Human
uggaagcccagggccugc

SEQ ID NO: 1274617 - RNA, 22 nt, Human
uggagcucucaaguaacaaccc

SEQ ID NO: 1274618 - RNA, 19 nt, Human
uggcccagagcagaagccg

SEQ ID NO: 1274619 - RNA, 24 nt, Human
uggccggcagggggcagccugcag

SEQ ID NO: 1274620 - RNA, 18 nt, Human
uggcuggaagcccagggc

SEQ ID NO: 1274621 - RNA, 20 nt, Human
uggcuggaagcccagggccu

SEQ ID NO: 1274622 - RNA, 22 nt, Human
uggcuggaagcccagggccugc

SEQ ID NO: 1274623 - RNA, 21 nt, Human
uggcuggagccugauuaugag

SEQ ID NO: 1274624 - RNA, 20 nt, Human
uggggcugcccgacccuccu

SEQ ID NO: 1274625 - RNA, 23 nt, Human
uggugacccuccugugccucugg

SEQ ID NO: 1274626 - RNA, 23 nt, Human
uuccugcccugccgaucauccag

SEQ ID NO: 1274627 - RNA, 21 nt, Human
uucuggagccugccucccagg

SEQ ID NO: 1274628 - RNA, 21 nt, Human
uuuauucauccagcaguuuca

SEQ ID NO: 1274629 - RNA, 21 nt, Human
accccgcccccccuccccccg

SEQ ID NO: 1274630 - RNA, 23 nt, Human
accccgcccccccuccccccgca

SEQ ID NO: 1274631 - RNA, 23 nt, Human
acccgccugccuucccgcgcccc

SEQ ID NO: 1274632 - RNA, 23 nt, Human
aggccacaccccgcccccccucc

SEQ ID NO: 1274633 - RNA, 22 nt, Human
caccccgcccccccuccccccc

SEQ ID NO: 1274634 - RNA, 23 nt, Human
ccaacuuccgaaucaguucagcc

SEQ ID NO: 1274635 - RNA, 25 nt, Human
ccagaggcguccugcaaggcaccgg

SEQ ID NO: 1274636 - RNA, 18 nt, Human
cccccgcagcucgcccgc

SEQ ID NO: 1274637 - RNA, 23 nt, Human
ccccgcccccccuccccccgcag

SEQ ID NO: 1274638 - RNA, 21 nt, Human
ccccgcgcuccucgcgcgucc

SEQ ID NO: 1274639 - RNA, 18 nt, Human
ccccggugcuuggguguu

SEQ ID NO: 1274640 - RNA, 19 nt, Human
cccugggaggcccaggcgu

SEQ ID NO: 1274641 - RNA, 21 nt, Human
ccgccugccuucccgcgcccc

SEQ ID NO: 1274642 - RNA, 22 nt, Human
ccggcacccaugugcacccgcc

SEQ ID NO: 1274643 - RNA, 21 nt, Human
cgcagcucgcccgccggcacc

SEQ ID NO: 1274644 - RNA, 24 nt, Human
cgcccccccuccccccgcagcucg

SEQ ID NO: 1274645 - RNA, 24 nt, Human
cgcccggcccgcgcguaccugcag

SEQ ID NO: 1274646 - RNA, 21 nt, Human
cgccgccagcccuccugaucu

SEQ ID NO: 1274647 - RNA, 18 nt, Human
cgcgcguccggggcccgg

SEQ ID NO: 1274648 - RNA, 21 nt, Human
cgcguccggggcccggccucc

SEQ ID NO: 1274649 - RNA, 20 nt, Human
cucggagcugccaucccugg

SEQ ID NO: 1274650 - RNA, 21 nt, Human
cugccaucccugggaggccca

SEQ ID NO: 1274651 - RNA, 18 nt, Human
cuggggccaccacacaca

SEQ ID NO: 1274652 - RNA, 23 nt, Human
cuggggccaccacacacaugcaa

SEQ ID NO: 1274653 - RNA, 26 nt, Human
cuuggcuccuuccgucuuucuuucug

SEQ ID NO: 1274654 - RNA, 18 nt, Human
gaguuggcuccaaaacuc

SEQ ID NO: 1274655 - RNA, 25 nt, Human
gccccgcccggcccgcgcguaccug

SEQ ID NO: 1274656 - RNA, 20 nt, Human
gccgaaugcgccgccagccc

SEQ ID NO: 1274657 - RNA, 26 nt, Human
gccuucccgcgccccgcgcuccucgc

SEQ ID NO: 1274658 - RNA, 19 nt, Human
gcgccccgcgcuccucgcg

SEQ ID NO: 1274659 - RNA, 21 nt, Human
ggaggcggggaggccacaccc

SEQ ID NO: 1274660 - RNA, 22 nt, Human
guccgggugaggaggugcccac

SEQ ID NO: 1274661 - RNA, 21 nt, Human
guucuguuccccggugcuugg

SEQ ID NO: 1274662 - RNA, 21 nt, Human
uacaaagagauccaacuuccg

SEQ ID NO: 1274663 - RNA, 25 nt, Human
uccccccgcagcucgcccgccggca

SEQ ID NO: 1274664 - RNA, 20 nt, Human
ucccggacgccgaaugcgcc

SEQ ID NO: 1274665 - RNA, 22 nt, Human
ucccugggaggcccaggcguag

SEQ ID NO: 1274666 - RNA, 22 nt, Human
uggcgcgcccgccgcccgcccg

SEQ ID NO: 1274667 - RNA, 18 nt, Human
ugggaggcccaggcguag

SEQ ID NO: 1274668 - RNA, 22 nt, Human
uggggagcucuccgcccucggg

SEQ ID NO: 1274669 - RNA, 20 nt, Human
ugugcacccgccugccuucc

SEQ ID NO: 1274670 - RNA, 22 nt, Human
uguucuguuccccggugcuugg

SEQ ID NO: 1274671 - RNA, 23 nt, Human
uuggguguuugcuuccuaguccu

SEQ ID NO: 1274672 - RNA, 22 nt, Human
aaaccuggagugggacgagaaa

SEQ ID NO: 1274673 - RNA, 23 nt, Human
aaauguaucucuagguggagacc

SEQ ID NO: 1274674 - RNA, 23 nt, Human
aagaggagaagggcuugggggua

SEQ ID NO: 1274675 - RNA, 22 nt, Human
acagugcccacagaggucugcu

SEQ ID NO: 1274676 - RNA, 22 nt, Human
acaguuuauuaaaaaauuuuaa

SEQ ID NO: 1274677 - RNA, 22 nt, Human
agaaaaaagcuuagagcuuagc

SEQ ID NO: 1274678 - RNA, 21 nt, Human
agaaagcaagguacaaucuga

SEQ ID NO: 1274679 - RNA, 20 nt, Human
agaggagaagggcuuggggg

SEQ ID NO: 1274680 - RNA, 18 nt, Human
agaggcacaggcuguuga

SEQ ID NO: 1274681 - RNA, 19 nt, Human
agaggucugcucccgggaa

SEQ ID NO: 1274682 - RNA, 19 nt, Human
agcaaugagagaaaaaagc

SEQ ID NO: 1274683 - RNA, 20 nt, Human
aggggcuccuggaaagauac

SEQ ID NO: 1274684 - RNA, 20 nt, Human
auggcagugagggaaaagua

SEQ ID NO: 1274685 - RNA, 18 nt, Human
caaagguagaccagaggc

SEQ ID NO: 1274686 - RNA, 22 nt, Human
caaucugaggggcuccuggaaa

SEQ ID NO: 1274687 - RNA, 24 nt, Human
cacccugacagcacuuuaggacag

SEQ ID NO: 1274688 - RNA, 25 nt, Human
cacuagucacauuccagucauugug

SEQ ID NO: 1274689 - RNA, 22 nt, Human
ccaaaccugagucccucugacc

SEQ ID NO: 1274690 - RNA, 20 nt, Human
ccacagaggucugcucccgg

SEQ ID NO: 1274691 - RNA, 18 nt, Human
ccagccuucagcuugugc

SEQ ID NO: 1274692 - RNA, 18 nt, Human
ccaggcugagaggcccau

SEQ ID NO: 1274693 - RNA, 27 nt, Human
ccgccucacagugcccacagagguugg

SEQ ID NO: 1274694 - RNA, 19 nt, Human
ccguuccgccucacagugc

SEQ ID NO: 1274695 - RNA, 22 nt, Human
ccuccucgaaggugacaagaau

SEQ ID NO: 1274696 - RNA, 21 nt, Human
cucacagugcccacagagguc

SEQ ID NO: 1274697 - RNA, 20 nt, Human
cucccgggaagccgcgguca

SEQ ID NO: 1274698 - RNA, 22 nt, Human
cuccugagaucacuagucacau

SEQ ID NO: 1274699 - RNA, 19 nt, Human
cuccugccccgccgcuccg

SEQ ID NO: 1274700 - RNA, 18 nt, Human
gaccagaggcacaggcug

SEQ ID NO: 1274701 - RNA, 21 nt, Human
gcaaguuacucuccagccuuc

SEQ ID NO: 1274702 - RNA, 18 nt, Human
gccccgccgcuccguucc

SEQ ID NO: 1274703 - RNA, 19 nt, Human
gccccgccgcuccguuccg

SEQ ID NO: 1274704 - RNA, 23 nt, Human
gcgagucccggcccgauuguccu

SEQ ID NO: 1274705 - RNA, 21 nt, Human
gcuccugccccgccgcuccgu

SEQ ID NO: 1274706 - RNA, 21 nt, Human
guaacugcaagucccaccccc

SEQ ID NO: 1274707 - RNA, 22 nt, Human
gucacauuccagucauugugac

SEQ ID NO: 1274708 - RNA, 20 nt, Human
uagccucugaauuacuuaag

SEQ ID NO: 1274709 - RNA, 19 nt, Human
uaguguauagccucagcag

SEQ ID NO: 1274710 - RNA, 23 nt, Human
uaucuauucucuuggcaugauua

SEQ ID NO: 1274711 - RNA, 24 nt, Human
uaucucaacagaggggcugucuau

SEQ ID NO: 1274712 - RNA, 22 nt, Human
uaucuguccccuccauaucuca

SEQ ID NO: 1274713 - RNA, 25 nt, Human
ucaaagguagaccagaggcacaggc

SEQ ID NO: 1274714 - RNA, 22 nt, Human
ucacccggacaccgcgaguccc

SEQ ID NO: 1274715 - RNA, 20 nt, Human
uccaccaugggcaagugauu

SEQ ID NO: 1274716 - RNA, 20 nt, Human
uccaguaucuguccccucca

SEQ ID NO: 1274717 - RNA, 21 nt, Human
ucccaaaccugagucccucug

SEQ ID NO: 1274718 - RNA, 21 nt, Human
ucccgggaagccgcggucacc

SEQ ID NO: 1274719 - RNA, 21 nt, Human
ucucuagguggagaccaacuc

SEQ ID NO: 1274720 - RNA, 19 nt, Human
ugaauuacuuaagcuguaa

SEQ ID NO: 1274721 - RNA, 20 nt, Human
ugacaagaauugggaagagg

SEQ ID NO: 1274722 - RNA, 21 nt, Human
ugacaagaauugggaagagga

SEQ ID NO: 1274723 - RNA, 24 nt, Human
ugccaggcugagaggcccauaucu

SEQ ID NO: 1274724 - RNA, 25 nt, Human
ugccccgccgcuccguuccgccuca

SEQ ID NO: 1274725 - RNA, 19 nt, Human
ugggaaaggaagagguaug

SEQ ID NO: 1274726 - RNA, 21 nt, Human
ugggaagaggagaagggcuug

SEQ ID NO: 1274727 - RNA, 19 nt, Human
ugggugggaugggaaagga

SEQ ID NO: 1274728 - RNA, 18 nt, Human
uggugccacccugacagc

SEQ ID NO: 1274729 - RNA, 18 nt, Human
uggugccacccugacagg

SEQ ID NO: 1274730 - RNA, 26 nt, Human
ugucgggaaggugucuauuggugaga

SEQ ID NO: 1274731 - RNA, 18 nt, Human
ugugccauggcagugagg

SEQ ID NO: 1274732 - RNA, 25 nt, Human
uguuaaagugcucagcuacaacauu

SEQ ID NO: 1274733 - RNA, 22 nt, Human
uuaauggacaucaccaccacaa

SEQ ID NO: 1274734 - RNA, 22 nt, Human
uuacucuccagccuucagcuug

SEQ ID NO: 1274735 - RNA, 23 nt, Human
uucagggcacaguuuauuaaaaa

SEQ ID NO: 1274736 - RNA, 20 nt, Human
aaacaaagccacacauggac

SEQ ID NO: 1274737 - RNA, 21 nt, Human
aaagaauggccuaaaccaaaa

SEQ ID NO: 1274738 - RNA, 21 nt, Human
aauggugcugcaaacaaagcc

SEQ ID NO: 1274739 - RNA, 21 nt, Human
aauucuuguccuaaaaggaaa

SEQ ID NO: 1274740 - RNA, 21 nt, Human
acucuaagcuauggaaagaag

SEQ ID NO: 1274741 - RNA, 20 nt, Human
acuucaaauggugcugcaaa

SEQ ID NO: 1274742 - RNA, 20 nt, Human
agcaagucaagggggaaaca

SEQ ID NO: 1274743 - RNA, 20 nt, Human
caauaacguuuuucucccaa

SEQ ID NO: 1274744 - RNA, 25 nt, Human
caugccauucuuccaagaagccuua

SEQ ID NO: 1274745 - RNA, 23 nt, Human
ccacccaauaacguuuuucuccc

SEQ ID NO: 1274746 - RNA, 22 nt, Human
cugguaauguacagcgacaucu

SEQ ID NO: 1274747 - RNA, 18 nt, Human
cugucauaguuacagucu

SEQ ID NO: 1274748 - RNA, 24 nt, Human
gaagagagcugcagucccgucggg

SEQ ID NO: 1274749 - RNA, 19 nt, Human
gacugguuguuuaagacaa

SEQ ID NO: 1274750 - RNA, 20 nt, Human
ggaguuggaaaagguuggca

SEQ ID NO: 1274751 - RNA, 21 nt, Human
uaaaaggaaaugacugguugu

SEQ ID NO: 1274752 - RNA, 23 nt, Human
uaacaccaaaguuauuuuagcca

SEQ ID NO: 1274753 - RNA, 20 nt, Human
uaaguuauaaagaauggccu

SEQ ID NO: 1274754 - RNA, 26 nt, Human
uaguaaauucuuguccuaaaaggaaa

SEQ ID NO: 1274755 - RNA, 19 nt, Human
uauuacaauccauuggugu

SEQ ID NO: 1274756 - RNA, 19 nt, Human
ugccaagauuaacaccaaa

SEQ ID NO: 1274757 - RNA, 22 nt, Human
ugucauaguuacagucuauagg

SEQ ID NO: 1274758 - RNA, 18 nt, Human
uuaacguuucugguaaug

SEQ ID NO: 1274759 - RNA, 18 nt, Human
uucuuccaagaagccuua

SEQ ID NO: 1274760 - RNA, 22 nt, Human
aagaagaagggaacaugguugg

SEQ ID NO: 1274761 - RNA, 25 nt, Human
aagaagaagggaacaugguuggagg

SEQ ID NO: 1274762 - RNA, 21 nt, Human
acaugcucucaguaagguaua

SEQ ID NO: 1274763 - RNA, 19 nt, Human
agaugcuaacgaaacacag

SEQ ID NO: 1274764 - RNA, 22 nt, Human
agggaacaugguuggaggccca

SEQ ID NO: 1274765 - RNA, 19 nt, Human
agucaggaaaagaaggacu

SEQ ID NO: 1274766 - RNA, 18 nt, Human
agucuuuucagugagcuc

SEQ ID NO: 1274767 - RNA, 19 nt, Human
augaacuucuuuauuaacu

SEQ ID NO: 1274768 - RNA, 21 nt, Human
cacuaaacuugauuugggggc

SEQ ID NO: 1274769 - RNA, 26 nt, Human
cagcaaaugcuuuuccuaaggcacaa

SEQ ID NO: 1274770 - RNA, 19 nt, Human
cagugagcucaggaacccu

SEQ ID NO: 1274771 - RNA, 25 nt, Human
ccuacugucuacuaaaacccucaga

SEQ ID NO: 1274772 - RNA, 18 nt, Human
cuggagccagaugcuaac

SEQ ID NO: 1274773 - RNA, 21 nt, Human
cuucagagcaacuucuuggca

SEQ ID NO: 1274774 - RNA, 21 nt, Human
gaaacacagcaaaugcuuuuc

SEQ ID NO: 1274775 - RNA, 19 nt, Human
ggggcagcucacugaaaua

SEQ ID NO: 1274776 - RNA, 20 nt, Human
gucaggaaaagaaggacucg

SEQ ID NO: 1274777 - RNA, 20 nt, Human
uaagaagaagggaacauggu

SEQ ID NO: 1274778 - RNA, 21 nt, Human
uacagucaauucagaagagug

SEQ ID NO: 1274779 - RNA, 19 nt, Human
ucuacuaaaacccucagag

SEQ ID NO: 1274780 - RNA, 19 nt, Human
ugacuucagagcaacuucu

SEQ ID NO: 1274781 - RNA, 21 nt, Human
ugagagaaacagugcuuugaa

SEQ ID NO: 1274782 - RNA, 26 nt, Human
ugagggcacuaaacuugauuuggggg

SEQ ID NO: 1274783 - RNA, 20 nt, Human
uggaaguugaaggucugucc

SEQ ID NO: 1274784 - RNA, 21 nt, Human
uggcaaaaugaaaagagcugc

SEQ ID NO: 1274785 - RNA, 18 nt, Human
uguggugcuaagaagaag

SEQ ID NO: 1274786 - RNA, 21 nt, Human
uguuggguuuugauuauuugu

SEQ ID NO: 1274787 - RNA, 18 nt, Human
uuaaaccaaaaugaacuu

SEQ ID NO: 1274788 - RNA, 19 nt, Human
uuuaaaggaaaacaaacag

SEQ ID NO: 1274789 - RNA, 22 nt, Human
aaggugacagugagggguucuu

SEQ ID NO: 1274790 - RNA, 18 nt, Human
agauggaguuuguagggc

SEQ ID NO: 1274791 - RNA, 18 nt, Human
caugaagugagaagaaaa

SEQ ID NO: 1274792 - RNA, 21 nt, Human
ggaguaguuuucacaugaagu

SEQ ID NO: 1274793 - RNA, 19 nt, Human
ggauaaggacagagcuuga

SEQ ID NO: 1274794 - RNA, 23 nt, Human
ggauaaggacagagcuugaaggg

SEQ ID NO: 1274795 - RNA, 21 nt, Human
gguauucucgggaaggugaca

SEQ ID NO: 1274796 - RNA, 22 nt, Human
guccucuucuguucagauauuu

SEQ ID NO: 1274797 - RNA, 24 nt, Human
ucagccacuggaguaguuuucaca

SEQ ID NO: 1274798 - RNA, 21 nt, Human
ucagucagccacuggaguagu

SEQ ID NO: 1274799 - RNA, 22 nt, Human
ucuauaauugaugacugugagc

SEQ ID NO: 1274800 - RNA, 19 nt, Human
ugaagggucagcaauucag

SEQ ID NO: 1274801 - RNA, 21 nt, Human
ugaagugagaagaaaagcuga

SEQ ID NO: 1274802 - RNA, 23 nt, Human
uggucuuaggguauucucgggaa

SEQ ID NO: 1274803 - RNA, 18 nt, Human
aaaaaagcucuaaaguca

SEQ ID NO: 1274804 - RNA, 24 nt, Human
aacagaaaccccuuggggccugag

SEQ ID NO: 1274805 - RNA, 21 nt, Human
agagaauagaaacagaaaccc

SEQ ID NO: 1274806 - RNA, 24 nt, Human
cacagccauccgccucaagguggg

SEQ ID NO: 1274807 - RNA, 20 nt, Human
cagcugggaauucugggcag

SEQ ID NO: 1274808 - RNA, 18 nt, Human
cagugcaggaaguagggu

SEQ ID NO: 1274809 - RNA, 21 nt, Human
cgugcacaggcagaggcugug

SEQ ID NO: 1274810 - RNA, 21 nt, Human
cucaagguggggaugaaagga

SEQ ID NO: 1274811 - RNA, 19 nt, Human
gacaggcugacacagacag

SEQ ID NO: 1274812 - RNA, 20 nt, Human
gacaggcugacacagacagc

SEQ ID NO: 1274813 - RNA, 19 nt, Human
gaggcugugggucagugca

SEQ ID NO: 1274814 - RNA, 20 nt, Human
ugaaaggagaugaccuggug

SEQ ID NO: 1274815 - RNA, 20 nt, Human
ugaaaggagaugaccuggug

SEQ ID NO: 1274816 - RNA, 18 nt, Human
ugaccugguggcugcgug

SEQ ID NO: 1274817 - RNA, 21 nt, Human
ugggcagggacaagcaggcgu

SEQ ID NO: 1274818 - RNA, 19 nt, Human
uucaugugcuucucuugag

SEQ ID NO: 1274819 - RNA, 23 nt, Human
uugagacgaagggaaaaguggua

SEQ ID NO: 1274820 - RNA, 21 nt, Human
aggacagaugcugcuggagga

SEQ ID NO: 1274821 - RNA, 18 nt, Human
aggaggccaaggggccag

SEQ ID NO: 1274822 - RNA, 20 nt, Human
aggaggccaaggggccagcu

SEQ ID NO: 1274823 - RNA, 22 nt, Human
caacugccagggaccucgagca

SEQ ID NO: 1274824 - RNA, 21 nt, Human
cacuugccaaggaccacaacu

SEQ ID NO: 1274825 - RNA, 19 nt, Human
cccugaggagagaggacag

SEQ ID NO: 1274826 - RNA, 21 nt, Human
gccaaggaccacaacugccag

SEQ ID NO: 1274827 - RNA, 22 nt, Human
gucaccagauggggauggggag

SEQ ID NO: 1274828 - RNA, 20 nt, Human
ucccugaggagagaggacag

SEQ ID NO: 1274829 - RNA, 26 nt, Human
ucucuaggaggccaaggggccagcuu

SEQ ID NO: 1274830 - RNA, 18 nt, Human
ugccaaggaccacaacug

SEQ ID NO: 1274831 - RNA, 19 nt, Human
ugccucccugaggagagag

SEQ ID NO: 1274832 - RNA, 22 nt, Human
ugcugcuggaggagaugucagg

SEQ ID NO: 1274833 - RNA, 22 nt, Human
ugcuugccucccugaggagaga

SEQ ID NO: 1274834 - RNA, 21 nt, Human
uggguggaggaggaaggacuc

SEQ ID NO: 1274835 - RNA, 22 nt, Human
uguagccaggccuuuggucacc

SEQ ID NO: 1274836 - RNA, 19 nt, Human
uuggggucuuuugaagagg

SEQ ID NO: 1274837 - RNA, 19 nt, Human
agaaauccugcaucucagu

SEQ ID NO: 1274838 - RNA, 24 nt, Human
agacacauucaggugccuuugcag

SEQ ID NO: 1274839 - RNA, 21 nt, Human
agggugggcugucucuccacc

SEQ ID NO: 1274840 - RNA, 19 nt, Human
caagacagcugucucaggc

SEQ ID NO: 1274841 - RNA, 18 nt, Human
caggggucacaguggaca

SEQ ID NO: 1274842 - RNA, 20 nt, Human
cauucaggugccuuugcaga

SEQ ID NO: 1274843 - RNA, 22 nt, Human
cucacauuaugcuaacagggac

SEQ ID NO: 1274844 - RNA, 23 nt, Human
cucacauuaugcuaacagggacg

SEQ ID NO: 1274845 - RNA, 18 nt, Human
gaacaggggucacagugg

SEQ ID NO: 1274846 - RNA, 19 nt, Human
gcagaaagagaugccagag

SEQ ID NO: 1274847 - RNA, 20 nt, Human
gucacaguggacacaagggu

SEQ ID NO: 1274848 - RNA, 23 nt, Human
uaugcuaacagggacgcagacac

SEQ ID NO: 1274849 - RNA, 18 nt, Human
ugaagucacaaaggggag

SEQ ID NO: 1274850 - RNA, 19 nt, Human
aaccucaccgagagcccaa

SEQ ID NO: 1274851 - RNA, 21 nt, Human
agaagaggagagagagaggcc

SEQ ID NO: 1274852 - RNA, 21 nt, Human
agaggccagagccuggggaug

SEQ ID NO: 1274853 - RNA, 25 nt, Human
agccaggugcucugcauggcaaggu

SEQ ID NO: 1274854 - RNA, 21 nt, Human
agcccaaacucucaccuacag

SEQ ID NO: 1274855 - RNA, 23 nt, Human
agccuuuuccuucucccaaccuc

SEQ ID NO: 1274856 - RNA, 19 nt, Human
cacccccuggcccauaagc

SEQ ID NO: 1274857 - RNA, 25 nt, Human
cccugcgugucucaguuucucuccu

SEQ ID NO: 1274858 - RNA, 23 nt, Human
ccugcagccgggucagagugagc

SEQ ID NO: 1274859 - RNA, 23 nt, Human
ccuggcccauaagccuuuuccuu

SEQ ID NO: 1274860 - RNA, 21 nt, Human
cucccucccacccccuggccc

SEQ ID NO: 1274861 - RNA, 20 nt, Human
cuggcccauaagccuuuucc

SEQ ID NO: 1274862 - RNA, 19 nt, Human
gagagagagaggccagagc

SEQ ID NO: 1274863 - RNA, 23 nt, Human
gguugcccucaggguccuccuug

SEQ ID NO: 1274864 - RNA, 19 nt, Human
gugguugcccucagggucc

SEQ ID NO: 1274865 - RNA, 21 nt, Human
guucugguccccuugagucuu

SEQ ID NO: 1274866 - RNA, 20 nt, Human
ucccaaccucaccgagagcc

SEQ ID NO: 1274867 - RNA, 21 nt, Human
ucccaaccucaccgagagccc

SEQ ID NO: 1274868 - RNA, 22 nt, Human
ucccaaccucaccgagagccca

SEQ ID NO: 1274869 - RNA, 18 nt, Human
uccgggguuggcuccuuc

SEQ ID NO: 1274870 - RNA, 23 nt, Human
ucucccaaccucaccgagagccc

SEQ ID NO: 1274871 - RNA, 24 nt, Human
ucucccaaccucaccgagagccca

SEQ ID NO: 1274872 - RNA, 19 nt, Human
uggcagaugagaagccagg

SEQ ID NO: 1274873 - RNA, 19 nt, Human
uggcccauaagccuuuucc

SEQ ID NO: 1274874 - RNA, 24 nt, Human
ugguugcccucaggguccuccuug

SEQ ID NO: 1274875 - RNA, 21 nt, Human
ugucagggaccacaagcccug

SEQ ID NO: 1274876 - RNA, 22 nt, Human
uuccugcagccgggucagagug

SEQ ID NO: 1274877 - RNA, 19 nt, Human
uugcccucaggguccuccu

SEQ ID NO: 1274878 - RNA, 23 nt, Human
aaagucuuucccuugggaaacca

SEQ ID NO: 1274879 - RNA, 20 nt, Human
aaaugcagacacacagauaa

SEQ ID NO: 1274880 - RNA, 18 nt, Human
aauuagccaggcauggug

SEQ ID NO: 1274881 - RNA, 26 nt, Human
acagagugaggcccugucccuacaaa

SEQ ID NO: 1274882 - RNA, 20 nt, Human
accacugcaaaacuccaucu

SEQ ID NO: 1274883 - RNA, 24 nt, Human
accagcuugugcaacagagugagg

SEQ ID NO: 1274884 - RNA, 22 nt, Human
accaggucuugggugcccaggu

SEQ ID NO: 1274885 - RNA, 21 nt, Human
acccaccccggggcacgcaca

SEQ ID NO: 1274886 - RNA, 21 nt, Human
accccccuccccccucccccc

SEQ ID NO: 1274887 - RNA, 23 nt, Human
accccccuccccccucccccccc

SEQ ID NO: 1274888 - RNA, 23 nt, Human
accccccuccccccucccccccc

SEQ ID NO: 1274889 - RNA, 25 nt, Human
accccccuccccccuccccccccac

SEQ ID NO: 1274890 - RNA, 20 nt, Human
acccgcccucccuccuuauc

SEQ ID NO: 1274891 - RNA, 19 nt, Human
agagauacagggaccuugc

SEQ ID NO: 1274892 - RNA, 19 nt, Human
agagcagguaguuguaacg

SEQ ID NO: 1274893 - RNA, 22 nt, Human
agaggucacacuggacccagag

SEQ ID NO: 1274894 - RNA, 22 nt, Human
agcauuuugggaggccaaggca

SEQ ID NO: 1274895 - RNA, 24 nt, Human
aggaauugaaggcugcaaugagcu

SEQ ID NO: 1274896 - RNA, 18 nt, Human
aggcaggaggauugccug

SEQ ID NO: 1274897 - RNA, 24 nt, Human
aggcaggaggauugccugagccca

SEQ ID NO: 1274898 - RNA, 21 nt, Human
aggcugaggcaggaggauugc

SEQ ID NO: 1274899 - RNA, 24 nt, Human
aggcugaggcaggaggauugccug

SEQ ID NO: 1274900 - RNA, 24 nt, Human
aggugcaguggcucacaccuguaa

SEQ ID NO: 1274901 - RNA, 24 nt, Human
aguggcucacaccuguaaucucag

SEQ ID NO: 1274902 - RNA, 24 nt, Human
aguucaaggaggccaggaguucaa

SEQ ID NO: 1274903 - RNA, 18 nt, Human
auccugcucuuggcucuu

SEQ ID NO: 1274904 - RNA, 19 nt, Human
augucugagguggccacaa

SEQ ID NO: 1274905 - RNA, 24 nt, Human
caagugaauaugcguaccccccuc

SEQ ID NO: 1274906 - RNA, 22 nt, Human
cacaaccuaaucucuguguacc

SEQ ID NO: 1274907 - RNA, 23 nt, Human
cacacacagagcagguaguugua

SEQ ID NO: 1274908 - RNA, 24 nt, Human
cacaccuguaaucucagcauuuug

SEQ ID NO: 1274909 - RNA, 22 nt, Human
cacauggaaaugcccugggaac

SEQ ID NO: 1274910 - RNA, 24 nt, Human
caccuguaaucucagcauuuuggg

SEQ ID NO: 1274911 - RNA, 18 nt, Human
cagagugaggcccugucc

SEQ ID NO: 1274912 - RNA, 20 nt, Human
cagauggaguccagcaugga

SEQ ID NO: 1274913 - RNA, 24 nt, Human
cagcauuuugggaggccaaggcag

SEQ ID NO: 1274914 - RNA, 25 nt, Human
cagcauuuugggaggccaaggcagg

SEQ ID NO: 1274915 - RNA, 24 nt, Human
cagcuacucaggaggcugaggcag

SEQ ID NO: 1274916 - RNA, 18 nt, Human
caggucuugggugcccag

SEQ ID NO: 1274917 - RNA, 21 nt, Human
caggucuugggugcccagguc

SEQ ID NO: 1274918 - RNA, 23 nt, Human
ccacacucccucuccaaaaaaua

SEQ ID NO: 1274919 - RNA, 23 nt, Human
ccagagccugcagaggucacacu

SEQ ID NO: 1274920 - RNA, 19 nt, Human
ccauagcaugcuggcaccc

SEQ ID NO: 1274921 - RNA, 23 nt, Human
ccaucuaaaaaaaaaauggccau

SEQ ID NO: 1274922 - RNA, 23 nt, Human
cccauagcaugcuggcacccgcc

SEQ ID NO: 1274923 - RNA, 22 nt, Human
ccccccuccccccccacacaca

SEQ ID NO: 1274924 - RNA, 24 nt, Human
ccccccuccccccccacacacaga

SEQ ID NO: 1274925 - RNA, 19 nt, Human
ccccccuccccccuccccc

SEQ ID NO: 1274926 - RNA, 22 nt, Human
cccccuccccccucccccccca

SEQ ID NO: 1274927 - RNA, 22 nt, Human
ccccucugucuuccaagaccug

SEQ ID NO: 1274928 - RNA, 22 nt, Human
cccucccuccuuaucucuccca

SEQ ID NO: 1274929 - RNA, 22 nt, Human
cccucccuccuuaucucuccca

SEQ ID NO: 1274930 - RNA, 21 nt, Human
ccuccacccugauggguaguc

SEQ ID NO: 1274931 - RNA, 18 nt, Human
ccuggagcacauggaaau

SEQ ID NO: 1274932 - RNA, 21 nt, Human
ccuugccuggggcaaaaagga

SEQ ID NO: 1274933 - RNA, 21 nt, Human
cucacaccuguaaucucagca

SEQ ID NO: 1274934 - RNA, 21 nt, Human
cucacaccuguaaucucagca

SEQ ID NO: 1274935 - RNA, 19 nt, Human
cucauccugcucuuggcuc

SEQ ID NO: 1274936 - RNA, 19 nt, Human
cuccccccuccccccccac

SEQ ID NO: 1274937 - RNA, 22 nt, Human
cucuguguaccacaggccucac

SEQ ID NO: 1274938 - RNA, 19 nt, Human
cugaaacccaugacugcug

SEQ ID NO: 1274939 - RNA, 23 nt, Human
cugacacuggagaaacccaauug

SEQ ID NO: 1274940 - RNA, 21 nt, Human
cuguagucccagcuacucagg

SEQ ID NO: 1274941 - RNA, 18 nt, Human
gaaaggaaaccaggucuu

SEQ ID NO: 1274942 - RNA, 23 nt, Human
gaauaugcguaccccccuccccc

SEQ ID NO: 1274943 - RNA, 23 nt, Human
gaauaugcguaccccccuccccc

SEQ ID NO: 1274944 - RNA, 22 nt, Human
gacuucaagugaauaugcguac

SEQ ID NO: 1274945 - RNA, 19 nt, Human
gauugcaccacugcaaaac

SEQ ID NO: 1274946 - RNA, 19 nt, Human
gcugcaaugagcuaugauu

SEQ ID NO: 1274947 - RNA, 20 nt, Human
ggaaaacaugugcaacuggg

SEQ ID NO: 1274948 - RNA, 20 nt, Human
ggagcacucagggagaugag

SEQ ID NO: 1274949 - RNA, 22 nt, Human
ggaggauugccugagcccagga

SEQ ID NO: 1274950 - RNA, 22 nt, Human
ggcaaaaaggauuagaaaaugc

SEQ ID NO: 1274951 - RNA, 18 nt, Human
ggcgaggugcaguggcuc

SEQ ID NO: 1274952 - RNA, 20 nt, Human
gggaaaccagggagcacuca

SEQ ID NO: 1274953 - RNA, 20 nt, Human
gugcagcucuucugggcggg

SEQ ID NO: 1274954 - RNA, 18 nt, Human
gugcaguggcucacaccu

SEQ ID NO: 1274955 - RNA, 21 nt, Human
uaaagcagcuccccucugucu

SEQ ID NO: 1274956 - RNA, 21 nt, Human
uaagugguggaagauggagca

SEQ ID NO: 1274957 - RNA, 18 nt, Human
uaccacaggccucacgca

SEQ ID NO: 1274958 - RNA, 22 nt, Human
uagauaagcaucuuugugagag

SEQ ID NO: 1274959 - RNA, 22 nt, Human
uagcaugcuggcacccgcccuc

SEQ ID NO: 1274960 - RNA, 20 nt, Human
uagccucuaaagcagcuccc

SEQ ID NO: 1274961 - RNA, 23 nt, Human
uagcuaaaugagcaauauaguau

SEQ ID NO: 1274962 - RNA, 23 nt, Human
ucaaagcaacuuagccucuaaag

SEQ ID NO: 1274963 - RNA, 18 nt, Human
ucaaggaggccaggaguu

SEQ ID NO: 1274964 - RNA, 18 nt, Human
ucacaucacagacuuucu

SEQ ID NO: 1274965 - RNA, 24 nt, Human
ucagagcugcuguuccagagccug

SEQ ID NO: 1274966 - RNA, 25 nt, Human
ucagagcugcuguuccagagccugc

SEQ ID NO: 1274967 - RNA, 21 nt, Human
uccaucuaaaaaaaaaauggc

SEQ ID NO: 1274968 - RNA, 20 nt, Human
uccccccuccccccccacac

SEQ ID NO: 1274969 - RNA, 22 nt, Human
ucccuacaaaaaauucuaaaaa

SEQ ID NO: 1274970 - RNA, 20 nt, Human
ucuacugcugugaguugggg

SEQ ID NO: 1274971 - RNA, 18 nt, Human
ucucaaacaaagcuggga

SEQ ID NO: 1274972 - RNA, 21 nt, Human
ucucugcugagggcucugucc

SEQ ID NO: 1274973 - RNA, 24 nt, Human
ucuggcgaggugcaguggcucaca

SEQ ID NO: 1274974 - RNA, 23 nt, Human
ucuuugguuugcugacacuggag

SEQ ID NO: 1274975 - RNA, 18 nt, Human
ugaaacccaugacugcug

SEQ ID NO: 1274976 - RNA, 20 nt, Human
ugaggcaggaggauugccug

SEQ ID NO: 1274977 - RNA, 24 nt, Human
ugaggcaggaggauugccugagcc

SEQ ID NO: 1274978 - RNA, 25 nt, Human
ugaggcaggaggauugccugagccc

SEQ ID NO: 1274979 - RNA, 19 nt, Human
ugaguuggggugaacccac

SEQ ID NO: 1274980 - RNA, 22 nt, Human
ugcaaugagcuaugauugcacc

SEQ ID NO: 1274981 - RNA, 21 nt, Human
ugcagcucuucugggcgggga

SEQ ID NO: 1274982 - RNA, 24 nt, Human
ugccugagcccaggaauugaaggc

SEQ ID NO: 1274983 - RNA, 21 nt, Human
ugcugaaacccaugacugcug

SEQ ID NO: 1274984 - RNA, 23 nt, Human
uggagguuuucuccuauaacuga

SEQ ID NO: 1274985 - RNA, 22 nt, Human
uggcacccgcccucccuccuua

SEQ ID NO: 1274986 - RNA, 21 nt, Human
uggcucacaccuguaaucuca

SEQ ID NO: 1274987 - RNA, 22 nt, Human
uggcucacaccuguaaucucag

SEQ ID NO: 1274988 - RNA, 24 nt, Human
uggcucacaccuguaaucucagca

SEQ ID NO: 1274989 - RNA, 18 nt, Human
uggcuguguuggccccac

SEQ ID NO: 1274990 - RNA, 21 nt, Human
ugggaggggucuccugggaug

SEQ ID NO: 1274991 - RNA, 24 nt, Human
ugggaugaaugaaaggaaaccagg

SEQ ID NO: 1274992 - RNA, 22 nt, Human
uggggagguuagauaagcaucu

SEQ ID NO: 1274993 - RNA, 21 nt, Human
uggguagucaggccuggagca

SEQ ID NO: 1274994 - RNA, 24 nt, Human
ugguuugcugacacuggagaaacc

SEQ ID NO: 1274995 - RNA, 22 nt, Human
uguaacgccuccaccucauccu

SEQ ID NO: 1274996 - RNA, 18 nt, Human
ugucucagagauacaggg

SEQ ID NO: 1274997 - RNA, 21 nt, Human
ugugcaacagagugaggcccu

SEQ ID NO: 1274998 - RNA, 19 nt, Human
ugugcuggacucagaauug

SEQ ID NO: 1274999 - RNA, 20 nt, Human
ugugcuggacucagaauugg

SEQ ID NO: 1275000 - RNA, 21 nt, Human
uguggugguuucacuucaaga

SEQ ID NO: 1275001 - RNA, 22 nt, Human
uguguaccacaggccucacgca

SEQ ID NO: 1275002 - RNA, 18 nt, Human
uucaagauuuucaggauc

SEQ ID NO: 1275003 - RNA, 24 nt, Human
uucaaggaggccaggaguucaaga

SEQ ID NO: 1275004 - RNA, 20 nt, Human
uucuagaguaagcuuuuagg

SEQ ID NO: 1275005 - RNA, 24 nt, Human
uugccugagcccaggaauugaagg

SEQ ID NO: 1275006 - RNA, 23 nt, Human
uugcugacacuggagaaacccaa

SEQ ID NO: 1275007 - RNA, 22 nt, Human
uuggauuuuacuguggagauuu

SEQ ID NO: 1275008 - RNA, 25 nt, Human
uuuggauuuuacuguggagauuuug

SEQ ID NO: 1275009 - RNA, 22 nt, Human
aaacaaacaccugaucaaacca

SEQ ID NO: 1275010 - RNA, 24 nt, Human
aaacagaaauugcaaguaggaacc

SEQ ID NO: 1275011 - RNA, 18 nt, Human
aaaccuucccucuuaaac

SEQ ID NO: 1275012 - RNA, 19 nt, Human
aaagugcuaggauuauagg

SEQ ID NO: 1275013 - RNA, 19 nt, Human
aaagugcuaggauuauagg

SEQ ID NO: 1275014 - RNA, 24 nt, Human
aaagugcugggauuacagguguga

SEQ ID NO: 1275015 - RNA, 21 nt, Human
aacaaacaccugaucaaacca

SEQ ID NO: 1275016 - RNA, 19 nt, Human
aaccccggguauuuacccc

SEQ ID NO: 1275017 - RNA, 18 nt, Human
aaccucaggugauccacc

SEQ ID NO: 1275018 - RNA, 25 nt, Human
aagcaauucuccugccucagccucc

SEQ ID NO: 1275019 - RNA, 26 nt, Human
aagcaugaaaacaacauuuaucuccu

SEQ ID NO: 1275020 - RNA, 20 nt, Human
aaggagagaagguugggguu

SEQ ID NO: 1275021 - RNA, 20 nt, Human
aaguagcugggauuacaggc

SEQ ID NO: 1275022 - RNA, 26 nt, Human
aaguagcugggauuacaggccucugc

SEQ ID NO: 1275023 - RNA, 18 nt, Human
aagugcugggauuacagg

SEQ ID NO: 1275024 - RNA, 19 nt, Human
aagugcugggauuacaggu

SEQ ID NO: 1275025 - RNA, 26 nt, Human
aagugcugggauuacaggugugagcu

SEQ ID NO: 1275026 - RNA, 23 nt, Human
aaugaugaaugcuuuccaaaaga

SEQ ID NO: 1275027 - RNA, 19 nt, Human
aauggagggaccagcugga

SEQ ID NO: 1275028 - RNA, 24 nt, Human
aauuuuauauuuuuaguagagaug

SEQ ID NO: 1275029 - RNA, 21 nt, Human
acaccccuccccuuuuaaaau

SEQ ID NO: 1275030 - RNA, 18 nt, Human
accaagcaugaaaacaac

SEQ ID NO: 1275031 - RNA, 18 nt, Human
accauguuggccaggcug

SEQ ID NO: 1275032 - RNA, 18 nt, Human
accauguuggccaggcug

SEQ ID NO: 1275033 - RNA, 18 nt, Human
acgagguuucaccguguu

SEQ ID NO: 1275034 - RNA, 20 nt, Human
acgagguuucaccguguuag

SEQ ID NO: 1275035 - RNA, 24 nt, Human
acucuuguugcccaggcuggagug

SEQ ID NO: 1275036 - RNA, 23 nt, Human
acugcaaucucugaacauaaauu

SEQ ID NO: 1275037 - RNA, 20 nt, Human
agaauggacacuguguuacc

SEQ ID NO: 1275038 - RNA, 22 nt, Human
agacuugaaaguugaaaucacu

SEQ ID NO: 1275039 - RNA, 25 nt, Human
agagaagguugggguuuguuuuuga

SEQ ID NO: 1275040 - RNA, 21 nt, Human
agagugcugggauuacaggug

SEQ ID NO: 1275041 - RNA, 24 nt, Human
agagugcugggauuacagguguga

SEQ ID NO: 1275042 - RNA, 20 nt, Human
agccacaggugcaguaagga

SEQ ID NO: 1275043 - RNA, 21 nt, Human
agccuccugaguagcugggac

SEQ ID NO: 1275044 - RNA, 25 nt, Human
agccugguaaauucuagucagaccg

SEQ ID NO: 1275045 - RNA, 21 nt, Human
agcuggccuucuuugguuugg

SEQ ID NO: 1275046 - RNA, 21 nt, Human
agcugggacuacaggggcccg

SEQ ID NO: 1275047 - RNA, 19 nt, Human
aggcccaguuguaaaauuu

SEQ ID NO: 1275048 - RNA, 25 nt, Human
aggcuggagugcaguggugcgaucu

SEQ ID NO: 1275049 - RNA, 21 nt, Human
agggacuccaucauugcaagu

SEQ ID NO: 1275050 - RNA, 24 nt, Human
aggugauccaccugccucggccuc

SEQ ID NO: 1275051 - RNA, 22 nt, Human
aguagaaaugggguuucaccau

SEQ ID NO: 1275052 - RNA, 18 nt, Human
aguagcugggacuacagg

SEQ ID NO: 1275053 - RNA, 21 nt, Human
agugcaguggugcgaucucag

SEQ ID NO: 1275054 - RNA, 23 nt, Human
agugcaguggugcgaucucagcu

SEQ ID NO: 1275055 - RNA, 24 nt, Human
agugcaguggugcgaucucagcuc

SEQ ID NO: 1275056 - RNA, 23 nt, Human
agugcaguggugcggucuuggcu

SEQ ID NO: 1275057 - RNA, 24 nt, Human
agugcaguggugcggucuuggcuc

SEQ ID NO: 1275058 - RNA, 22 nt, Human
agugcugggauuacagguguga

SEQ ID NO: 1275059 - RNA, 24 nt, Human
aguggugcgaucucagcucacugc

SEQ ID NO: 1275060 - RNA, 22 nt, Human
auauaaagcuauuuuaucuaca

SEQ ID NO: 1275061 - RNA, 21 nt, Human
auggaaagcaggcccaaauca

SEQ ID NO: 1275062 - RNA, 18 nt, Human
augggguuucaccauguu

SEQ ID NO: 1275063 - RNA, 18 nt, Human
augggguuucaccauguu

SEQ ID NO: 1275064 - RNA, 22 nt, Human
augggguuucaccauguuggcc

SEQ ID NO: 1275065 - RNA, 22 nt, Human
augggguuucaccauguuggcc

SEQ ID NO: 1275066 - RNA, 23 nt, Human
augggguuucaccauguuggcca

SEQ ID NO: 1275067 - RNA, 24 nt, Human
augggguuucaccauguuggccag

SEQ ID NO: 1275068 - RNA, 24 nt, Human
augggguuucaccauguuggccag

SEQ ID NO: 1275069 - RNA, 19 nt, Human
auuauaggagugugucacc

SEQ ID NO: 1275070 - RNA, 21 nt, Human
auucuccugccucagccuccc

SEQ ID NO: 1275071 - RNA, 23 nt, Human
caaaauggcggccccaucauccc

SEQ ID NO: 1275072 - RNA, 25 nt, Human
caaagugcuaggauuauaggagugu

SEQ ID NO: 1275073 - RNA, 24 nt, Human
caaagugcugggauuacaggugug

SEQ ID NO: 1275074 - RNA, 22 nt, Human
caagcaauucuccugccucagc

SEQ ID NO: 1275075 - RNA, 23 nt, Human
caagcaugaaaacaacauuuauc

SEQ ID NO: 1275076 - RNA, 24 nt, Human
caccaggccuagcuaauuuuugua

SEQ ID NO: 1275077 - RNA, 21 nt, Human
caccauguuggccaggcuggu

SEQ ID NO: 1275078 - RNA, 21 nt, Human
caccauguuggccaggcuggu

SEQ ID NO: 1275079 - RNA, 21 nt, Human
caccauguuggccaggcuggu

SEQ ID NO: 1275080 - RNA, 22 nt, Human
caccauguuggccaggcugguc

SEQ ID NO: 1275081 - RNA, 27 nt, Human
caccauguuggccaggcuggucuggaa

SEQ ID NO: 1275082 - RNA, 24 nt, Human
caccauguuggccaggcugguuuc

SEQ ID NO: 1275083 - RNA, 31 nt, Human; identical to SEQ ID NO: 466129

SEQ ID NO: 1275084 - RNA, 21 nt, Human
cacccacaucggccucccaaa

SEQ ID NO: 1275085 - RNA, 23 nt, Human
caccccuccccuuuuaaaauccc

SEQ ID NO: 1275086 - RNA, 18 nt, Human
caccguguuagccaggau

SEQ ID NO: 1275087 - RNA, 24 nt, Human
caccguguuagccaggauggucuc

SEQ ID NO: 1275088 - RNA, 23 nt, Human
caccugccucggccucccaaagu

SEQ ID NO: 1275089 - RNA, 18 nt, Human
cacugcaaccucugccuc

SEQ ID NO: 1275090 - RNA, 21 nt, Human
cacugcaaccucugccuccca

SEQ ID NO: 1275091 - RNA, 26 nt, Human
cacuggccuuuuuuuuuuuuuuugag

SEQ ID NO: 1275092 - RNA, 22 nt, Human
cacuguguuaccaagcaugaaa

SEQ ID NO: 1275093 - RNA, 22 nt, Human
cagagugcugggauuacaggug

SEQ ID NO: 1275094 - RNA, 24 nt, Human
cagagugcugggauuacaggugug

SEQ ID NO: 1275095 - RNA, 18 nt, Human
cagcaauagauaacaaac

SEQ ID NO: 1275096 - RNA, 22 nt, Human
caggugauccaccugccucggc

SEQ ID NO: 1275097 - RNA, 22 nt, Human
caggugcaguaaggagccgaca

SEQ ID NO: 1275098 - RNA, 20 nt, Human
caguaaggagccgacaaaau

SEQ ID NO: 1275099 - RNA, 26 nt, Human
caguaggucucucaacagugggcuua

SEQ ID NO: 1275100 - RNA, 23 nt, Human
caucuuccucucuuaguagccca

SEQ ID NO: 1275101 - RNA, 24 nt, Human
cauguuggccaggcuggucuggaa

SEQ ID NO: 1275102 - RNA, 23 nt, Human
cauguuggccaggcugguuucaa

SEQ ID NO: 1275103 - RNA, 25 nt, Human
ccaaagugcuaggauuauaggagug

SEQ ID NO: 1275104 - RNA, 21 nt, Human
ccaaagugcugggauuacagg

SEQ ID NO: 1275105 - RNA, 21 nt, Human
ccaaagugcugggauuacagg

SEQ ID NO: 1275106 - RNA, 24 nt, Human
ccaaagugcugggauuacaggugu

SEQ ID NO: 1275107 - RNA, 19 nt, Human
ccacaucggccucccaaag

SEQ ID NO: 1275108 - RNA, 21 nt, Human
ccagacaacuggcugcuucac

SEQ ID NO: 1275109 - RNA, 21 nt, Human
ccagagugcugggauuacagg

SEQ ID NO: 1275110 - RNA, 21 nt, Human
ccagagugcugggauuacagg

SEQ ID NO: 1275111 - RNA, 24 nt, Human
ccagagugcugggauuacaggugu

SEQ ID NO: 1275112 - RNA, 25 nt, Human
cccaaguagcugggauuacaggccu

SEQ ID NO: 1275113 - RNA, 23 nt, Human
ccccagacaacuggcugcuucac

SEQ ID NO: 1275114 - RNA, 18 nt, Human
ccccgguucacgccaucc

SEQ ID NO: 1275115 - RNA, 22 nt, Human
ccccuuuucucucggaaguccc

SEQ ID NO: 1275116 - RNA, 19 nt, Human
cccuguucguacaccccuc

SEQ ID NO: 1275117 - RNA, 23 nt, Human
ccgacaaaauggcacccuccgag

SEQ ID NO: 1275118 - RNA, 18 nt, Human
ccgcuggaggcccaguug

SEQ ID NO: 1275119 - RNA, 23 nt, Human
ccgcuuuagccuccugaguagcu

SEQ ID NO: 1275120 - RNA, 24 nt, Human
ccuaaccucaggugauccacccac

SEQ ID NO: 1275121 - RNA, 23 nt, Human
ccuauuaaaccuucccucuuaaa

SEQ ID NO: 1275122 - RNA, 24 nt, Human
ccuauuaucuucauaaacugagaa

SEQ ID NO: 1275123 - RNA, 21 nt, Human
ccuccagcugccccuuuucuc

SEQ ID NO: 1275124 - RNA, 24 nt, Human
ccucccagauucaagcaauucucc

SEQ ID NO: 1275125 - RNA, 25 nt, Human
ccucgcgacuccucgcguguguccg

SEQ ID NO: 1275126 - RNA, 21 nt, Human
ccucuguagcuaugaaugucc

SEQ ID NO: 1275127 - RNA, 22 nt, Human
ccugaccccgugauccgcccac

SEQ ID NO: 1275128 - RNA, 21 nt, Human
ccugaccucaggugauccacc

SEQ ID NO: 1275129 - RNA, 23 nt, Human
ccugaccucaggugauccaccug

SEQ ID NO: 1275130 - RNA, 23 nt, Human
ccugaccucaggugauccaccug

SEQ ID NO: 1275131 - RNA, 23 nt, Human
ccugaguagcugggacuacaggg

SEQ ID NO: 1275132 - RNA, 23 nt, Human
ccugccucagccucccaaguagc

SEQ ID NO: 1275133 - RNA, 20 nt, Human
cgacaaaauggcacccuccg

SEQ ID NO: 1275134 - RNA, 23 nt, Human
cgacaaaauggcacccuccgaga

SEQ ID NO: 1275135 - RNA, 24 nt, Human
cgagguuucaccguguuagccagg

SEQ ID NO: 1275136 - RNA, 24 nt, Human
cgcccaggcuggagugcaguggug

SEQ ID NO: 1275137 - RNA, 20 nt, Human
cgcuuuagccuccugaguaa

SEQ ID NO: 1275138 - RNA, 25 nt, Human
cuaauacucuuauaauuucuuaugc

SEQ ID NO: 1275139 - RNA, 24 nt, Human
cuaauuuuauauuuuuaguagaga

SEQ ID NO: 1275140 - RNA, 24 nt, Human
cucacugcaaccucugccucccag

SEQ ID NO: 1275141 - RNA, 23 nt, Human
cucagccucccaaguagcuggga

SEQ ID NO: 1275142 - RNA, 20 nt, Human
cuccugaccccgugauccgc

SEQ ID NO: 1275143 - RNA, 19 nt, Human
cucgcccucccagagugcu

SEQ ID NO: 1275144 - RNA, 22 nt, Human
cucgggguugucaucacggucc

SEQ ID NO: 1275145 - RNA, 18 nt, Human
cugacuucuucacuuugu

SEQ ID NO: 1275146 - RNA, 23 nt, Human
cugcaaccucugccucccagauu

SEQ ID NO: 1275147 - RNA, 24 nt, Human
cugcaaccucugccucccagauuc

SEQ ID NO: 1275148 - RNA, 24 nt, Human
cugcaagcuccgccuccccgguuc

SEQ ID NO: 1275149 - RNA, 25 nt, Human
cugccccuuuucucucggaaguccc

SEQ ID NO: 1275150 - RNA, 23 nt, Human
cugccucagccucccaaguagcu

SEQ ID NO: 1275151 - RNA, 23 nt, Human
cugccucggccucccaaagugcu

SEQ ID NO: 1275152 - RNA, 21 nt, Human
cuguucguacaccccuccccu

SEQ ID NO: 1275153 - RNA, 23 nt, Human
cuguuuuccuuucucuuucuuuu

SEQ ID NO: 1275154 - RNA, 24 nt, Human
cuuacucuuguugcccaggcugga

SEQ ID NO: 1275155 - RNA, 24 nt, Human
cuuguugcccaggcuggagugcag

SEQ ID NO: 1275156 - RNA, 18 nt, Human
cuuuguacuguuucucuu

SEQ ID NO: 1275157 - RNA, 19 nt, Human
gaaagauagucuaugccuu

SEQ ID NO: 1275158 - RNA, 19 nt, Human
gacacaggaguuaagaaga

SEQ ID NO: 1275159 - RNA, 22 nt, Human
gaccccgugauccgcccaccuc

SEQ ID NO: 1275160 - RNA, 24 nt, Human
gaccucaggugauccaccugccuc

SEQ ID NO: 1275161 - RNA, 18 nt, Human
gacgccgccuccucaagc

SEQ ID NO: 1275162 - RNA, 18 nt, Human
gagaugggguuucaccau

SEQ ID NO: 1275163 - RNA, 24 nt, Human
gagaugggguuucaccauguuggc

SEQ ID NO: 1275164 - RNA, 25 nt, Human
gagccgacaaaauggcacccuccga

SEQ ID NO: 1275165 - RNA, 19 nt, Human
gagcuguuuuccuuucucu

SEQ ID NO: 1275166 - RNA, 26 nt, Human
gaguagcugggacuacaggggcccgc

SEQ ID NO: 1275167 - RNA, 18 nt, Human
gauuacaggugugagcca

SEQ ID NO: 1275168 - RNA, 18 nt, Human
gauuacaggugugagcca

SEQ ID NO: 1275169 - RNA, 22 nt, Human
gauuacaggugugagccagggc

SEQ ID NO: 1275170 - RNA, 18 nt, Human
gauuacaggugugagcua

SEQ ID NO: 1275171 - RNA, 21 nt, Human
gauuacaggugugagcuaccg

SEQ ID NO: 1275172 - RNA, 24 nt, Human
gauuacaggugugagcuaccgugc

SEQ ID NO: 1275173 - RNA, 22 nt, Human
gauuauaggagugugucaccau

SEQ ID NO: 1275174 - RNA, 21 nt, Human
gcaucagagcucuuggguggc

SEQ ID NO: 1275175 - RNA, 20 nt, Human
gccagccuucccagcuaugu

SEQ ID NO: 1275176 - RNA, 19 nt, Human
gcccaggcuggagugcagu

SEQ ID NO: 1275177 - RNA, 19 nt, Human
gcccaggcuggagugcagu

SEQ ID NO: 1275178 - RNA, 20 nt, Human
gcccaggcuggagugcagug

SEQ ID NO: 1275179 - RNA, 23 nt, Human
gcccaggcuggagugcaguggug

SEQ ID NO: 1275180 - RNA, 22 nt, Human
gccuagcuaauuuuuguauuuu

SEQ ID NO: 1275181 - RNA, 25 nt, Human
gcucugucgcccaggcuggagugca

SEQ ID NO: 1275182 - RNA, 23 nt, Human
gcuggucuggaacuccuaaccuc

SEQ ID NO: 1275183 - RNA, 23 nt, Human
gcugguuucaaacuccugaccuc

SEQ ID NO: 1275184 - RNA, 23 nt, Human
gcuuaggguggggcggccagccu

SEQ ID NO: 1275185 - RNA, 23 nt, Human
ggagucuugcucugucgcccagg

SEQ ID NO: 1275186 - RNA, 24 nt, Human
ggcugguuucaaacuccugaccuc

SEQ ID NO: 1275187 - RNA, 22 nt, Human
gggguuucaccauguuggccag

SEQ ID NO: 1275188 - RNA, 22 nt, Human
gggguuucaccauguuggccag

SEQ ID NO: 1275189 - RNA, 18 nt, Human
ggguuucaccauguuggc

SEQ ID NO: 1275190 - RNA, 22 nt, Human
ggguuucaccauguuggccagg

SEQ ID NO: 1275191 - RNA, 23 nt, Human
guagagaugggguuucaccaugu

SEQ ID NO: 1275192 - RNA, 18 nt, Human
guagcugggauuacaggc

SEQ ID NO: 1275193 - RNA, 24 nt, Human
gucuugcucugucgcccaggcugg

SEQ ID NO: 1275194 - RNA, 24 nt, Human
gugauccacccacaucggccuccc

SEQ ID NO: 1275195 - RNA, 24 nt, Human
gugauccaccugccucggccuccc

SEQ ID NO: 1275196 - RNA, 24 nt, Human
gugauccgcccaccucgcccuccc

SEQ ID NO: 1275197 - RNA, 21 nt, Human
gugcucagcucacaaguguuc

SEQ ID NO: 1275198 - RNA, 24 nt, Human
guuuuuuuguauuuuuaguagaga

SEQ ID NO: 1275199 - RNA, 24 nt, Human
uaaaacacaggcagaguagauuua

SEQ ID NO: 1275200 - RNA, 19 nt, Human
uaaacaaacaccugaucaa

SEQ ID NO: 1275201 - RNA, 23 nt, Human
uaaacaaacaccugaucaaacca

SEQ ID NO: 1275202 - RNA, 18 nt, Human
uaacaaagagcagccugu

SEQ ID NO: 1275203 - RNA, 20 nt, Human
uaacagggacuccaucauug

SEQ ID NO: 1275204 - RNA, 23 nt, Human
uaagaagaaauuacuuagguaga

SEQ ID NO: 1275205 - RNA, 24 nt, Human
uaagguuuguuuuuuuuaauuaaa

SEQ ID NO: 1275206 - RNA, 22 nt, Human
uaauaagacuugaaaguugaaa

SEQ ID NO: 1275207 - RNA, 18 nt, Human
uaauuugccauccggcug

SEQ ID NO: 1275208 - RNA, 22 nt, Human
uaauuuuuguauuuuuaguaga

SEQ ID NO: 1275209 - RNA, 22 nt, Human
uacaccagagcaaauuaaagug

SEQ ID NO: 1275210 - RNA, 23 nt, Human
uacaggggcccgccaccacgccc

SEQ ID NO: 1275211 - RNA, 23 nt, Human
uacaggugugagccagggcgccu

SEQ ID NO: 1275212 - RNA, 19 nt, Human
uaccccagacaacuggcug

SEQ ID NO: 1275213 - RNA, 24 nt, Human
uacucuuguugcccaggcuggagu

SEQ ID NO: 1275214 - RNA, 21 nt, Human
uagaaaacaaacagaaauugc

SEQ ID NO: 1275215 - RNA, 22 nt, Human
uagaaaugggguuucaccaugu

SEQ ID NO: 1275216 - RNA, 20 nt, Human
uagaaugaugaaugcuuucc

SEQ ID NO: 1275217 - RNA, 22 nt, Human
uagagaugggguuucaccaugu

SEQ ID NO: 1275218 - RNA, 21 nt, Human
uagcccagaaaccccagguuc

SEQ ID NO: 1275219 - RNA, 20 nt, Human
uagccuccugaguagcuggg

SEQ ID NO: 1275220 - RNA, 22 nt, Human
uaggauuauaggagugugucac

SEQ ID NO: 1275221 - RNA, 24 nt, Human
uaggauuauaggagugugucacca

SEQ ID NO: 1275222 - RNA, 24 nt, Human
uaguagaaaugggguuucaccaug

SEQ ID NO: 1275223 - RNA, 26 nt, Human
uaguagaaaugggguuucaccauguu

SEQ ID NO: 1275224 - RNA, 21 nt, Human
uaguagagacgagguuucacc

SEQ ID NO: 1275225 - RNA, 24 nt, Human
uaguagagacgagguuucaccgug

SEQ ID NO: 1275226 - RNA, 26 nt, Human
uaguagagacgagguuucaccguguu

SEQ ID NO: 1275227 - RNA, 24 nt, Human
uaguagagaugggguuucaccaug

SEQ ID NO: 1275228 - RNA, 25 nt, Human
uaguagagaugggguuucaccaugu

SEQ ID NO: 1275229 - RNA, 24 nt, Human
uauguaaacaaacaccugaucaaa

SEQ ID NO: 1275230 - RNA, 19 nt, Human
uauguauguguguguguau

SEQ ID NO: 1275231 - RNA, 18 nt, Human
uauugcccuucgaagcau

SEQ ID NO: 1275232 - RNA, 24 nt, Human
ucaccguguuagccaggauggucu

SEQ ID NO: 1275233 - RNA, 18 nt, Human
ucacugcaaccucugccu

SEQ ID NO: 1275234 - RNA, 19 nt, Human
ucacugcaaccucugccuc

SEQ ID NO: 1275235 - RNA, 23 nt, Human
ucacugcaaccucugccucccag

SEQ ID NO: 1275236 - RNA, 24 nt, Human
ucacugcaaccucugccucccaga

SEQ ID NO: 1275237 - RNA, 18 nt, Human
ucacugcaagcuccgccu

SEQ ID NO: 1275238 - RNA, 19 nt, Human
ucacugcaagcuccgccuc

SEQ ID NO: 1275239 - RNA, 19 nt, Human
ucacugcaagcuccgccuc

SEQ ID NO: 1275240 - RNA, 24 nt, Human
ucacugcaagcuccgccuccccgg

SEQ ID NO: 1275241 - RNA, 25 nt, Human
ucacuuugugaaucaguccuucaca

SEQ ID NO: 1275242 - RNA, 20 nt, Human
ucagccucccaaguagcugg

SEQ ID NO: 1275243 - RNA, 27 nt, Human
ucagcucacugcaaccucugccuccca

SEQ ID NO: 1275244 - RNA, 21 nt, Human
ucaggugauccaccugccucg

SEQ ID NO: 1275245 - RNA, 18 nt, Human
ucaguugguaaccgggaa

SEQ ID NO: 1275246 - RNA, 20 nt, Human
uccaagcuuuguuguuccau

SEQ ID NO: 1275247 - RNA, 18 nt, Human
ucccaaagugcuaggauu

SEQ ID NO: 1275248 - RNA, 23 nt, Human
ucccaaagugcugggauuacagg

SEQ ID NO: 1275249 - RNA, 24 nt, Human
ucccaaguagcugggauuacaggc

SEQ ID NO: 1275250 - RNA, 23 nt, Human
ucccagagugcugggauuacagg

SEQ ID NO: 1275251 - RNA, 21 nt, Human
ucccagauucaagcaauucuc

SEQ ID NO: 1275252 - RNA, 24 nt, Human
ucccagauucaagcaauucuccug

SEQ ID NO: 1275253 - RNA, 21 nt, Human
uccccaggugacugcccucug

SEQ ID NO: 1275254 - RNA, 23 nt, Human
uccccaggugacugcccucugac

SEQ ID NO: 1275255 - RNA, 21 nt, Human
uccccgguucacgccauccug

SEQ ID NO: 1275256 - RNA, 25 nt, Human
uccugaguagcugggacuacagggg

SEQ ID NO: 1275257 - RNA, 18 nt, Human
uccuuggaguuuucccca

SEQ ID NO: 1275258 - RNA, 18 nt, Human
uccuugugacacaggagu

SEQ ID NO: 1275259 - RNA, 21 nt, Human
uccuuguggcuuacucccugu

SEQ ID NO: 1275260 - RNA, 24 nt, Human
ucgcccaggcuggagugcaguggu

SEQ ID NO: 1275261 - RNA, 23 nt, Human
ucggaaguccccucucucacuag

SEQ ID NO: 1275262 - RNA, 18 nt, Human
ucggccucccaaagugcu

SEQ ID NO: 1275263 - RNA, 18 nt, Human
ucggccucccaaagugcu

SEQ ID NO: 1275264 - RNA, 19 nt, Human
ucuauccuguaaacugucc

SEQ ID NO: 1275265 - RNA, 26 nt, Human
ucuccugccucagccucccaaguagc

SEQ ID NO: 1275266 - RNA, 21 nt, Human
ucucggaaguccccucucuca

SEQ ID NO: 1275267 - RNA, 20 nt, Human
ucugaacauaaauugugaag

SEQ ID NO: 1275268 - RNA, 24 nt, Human
ucugucgcccaggcuggagugcag

SEQ ID NO: 1275269 - RNA, 24 nt, Human
ucuuacucuuguugcccaggcugg

SEQ ID NO: 1275270 - RNA, 25 nt, Human
ucuuacucuuguugcccaggcugga

SEQ ID NO: 1275271 - RNA, 22 nt, Human
ucuucaucaucacuugcugcuu

SEQ ID NO: 1275272 - RNA, 23 nt, Human
ucuugcucugucgcccaggcugg

SEQ ID NO: 1275273 - RNA, 24 nt, Human
ucuugcucugucgcccaggcugga

SEQ ID NO: 1275274 - RNA, 22 nt, Human
ucuuguugcccaggcuggagug

SEQ ID NO: 1275275 - RNA, 18 nt, Human
ucuuuggucucgaacccu

SEQ ID NO: 1275276 - RNA, 18 nt, Human
ugaaauaugcccuggucu

SEQ ID NO: 1275277 - RNA, 24 nt, Human
ugaccucaggugauccaccugccu

SEQ ID NO: 1275278 - RNA, 18 nt, Human
ugagauaaggacugaaau

SEQ ID NO: 1275279 - RNA, 22 nt, Human
ugagauggagucuugcucuguc

SEQ ID NO: 1275280 - RNA, 19 nt, Human
ugaggcuuggaaagauagu

SEQ ID NO: 1275281 - RNA, 24 nt, Human
ugauccgcccaccucgcccuccca

SEQ ID NO: 1275282 - RNA, 22 nt, Human
ugcagcaauagauaacaaacac

SEQ ID NO: 1275283 - RNA, 22 nt, Human
ugcaguggugcgaucucagcuc

SEQ ID NO: 1275284 - RNA, 22 nt, Human
ugcaguggugcggucuuggcuc

SEQ ID NO: 1275285 - RNA, 18 nt, Human
ugcccaggcuggagugca

SEQ ID NO: 1275286 - RNA, 21 nt, Human
ugcccaggcuggagugcagug

SEQ ID NO: 1275287 - RNA, 24 nt, Human
ugcccaggcuggagugcaguggug

SEQ ID NO: 1275288 - RNA, 24 nt, Human
ugccucagccucccaaguagcugg

SEQ ID NO: 1275289 - RNA, 21 nt, Human
ugccucggccucccaaagugc

SEQ ID NO: 1275290 - RNA, 24 nt, Human
ugccucggccucccaaagugcuag

SEQ ID NO: 1275291 - RNA, 19 nt, Human
ugccuucgcuuugugaucu

SEQ ID NO: 1275292 - RNA, 24 nt, Human
ugcucugucgcccaggcuggagug

SEQ ID NO: 1275293 - RNA, 20 nt, Human
ugcugggauuacagguguga

SEQ ID NO: 1275294 - RNA, 24 nt, Human
ugcugggauuacaggugugagcca

SEQ ID NO: 1275295 - RNA, 22 nt, Human
uggaaaaucuguuguuuagugu

SEQ ID NO: 1275296 - RNA, 23 nt, Human
uggagucuugcucugucgcccag

SEQ ID NO: 1275297 - RNA, 23 nt, Human
uggagugcaguggugcgaucuca

SEQ ID NO: 1275298 - RNA, 24 nt, Human
uggagugcaguggugcgaucucag

SEQ ID NO: 1275299 - RNA, 20 nt, Human
uggagugcaguggugcgguc

SEQ ID NO: 1275300 - RNA, 23 nt, Human
uggagugcaguggugcggucuug

SEQ ID NO: 1275301 - RNA, 24 nt, Human
uggagugcaguggugcggucuugg

SEQ ID NO: 1275302 - RNA, 24 nt, Human
uggcaugggauggcaaaccccggg

SEQ ID NO: 1275303 - RNA, 24 nt, Human
uggccaggcuggucuggaacuccu

SEQ ID NO: 1275304 - RNA, 24 nt, Human
uggccaggcugguuucaaacuccu

SEQ ID NO: 1275305 - RNA, 21 nt, Human
uggcccagguuuaguuuauac

SEQ ID NO: 1275306 - RNA, 20 nt, Human
uggccuuuuuuuuuuuuuuu

SEQ ID NO: 1275307 - RNA, 18 nt, Human
uggcucacugcaagcucc

SEQ ID NO: 1275308 - RNA, 19 nt, Human
uggcugcucugggaguguc

SEQ ID NO: 1275309 - RNA, 21 nt, Human
ugggacuacaggggcccgcca

SEQ ID NO: 1275310 - RNA, 22 nt, Human
ugggacuacaggggcccgccac

SEQ ID NO: 1275311 - RNA, 24 nt, Human
ugggacuacaggggcccgccacca

SEQ ID NO: 1275312 - RNA, 19 nt, Human
ugggauuacaggccucugc

SEQ ID NO: 1275313 - RNA, 21 nt, Human
ugggauuacaggccucugcca

SEQ ID NO: 1275314 - RNA, 22 nt, Human
ugggauuacaggccucugccac

SEQ ID NO: 1275315 - RNA, 24 nt, Human
ugggauuacaggccucugccacca

SEQ ID NO: 1275316 - RNA, 18 nt, Human
ugggauuacaggugugag

SEQ ID NO: 1275317 - RNA, 18 nt, Human
ugggauuacaggugugag

SEQ ID NO: 1275318 - RNA, 19 nt, Human
ugggauuacaggugugagc

SEQ ID NO: 1275319 - RNA, 20 nt, Human
ugggauuacaggugugagcc

SEQ ID NO: 1275320 - RNA, 21 nt, Human
ugggauuacaggugugagcca

SEQ ID NO: 1275321 - RNA, 21 nt, Human
ugggauuacaggugugagcca

SEQ ID NO: 1275322 - RNA, 22 nt, Human
ugggauuacaggugugagccag

SEQ ID NO: 1275323 - RNA, 23 nt, Human
ugggauuacaggugugagccagg

SEQ ID NO: 1275324 - RNA, 27 nt, Human
ugggauuacaggugugagccagggcgc

SEQ ID NO: 1275325 - RNA, 21 nt, Human
ugggauuacaggugugagcua

SEQ ID NO: 1275326 - RNA, 22 nt, Human
ugggauuacaggugugagcuac

SEQ ID NO: 1275327 - RNA, 23 nt, Human
ugggauuacaggugugagcuacc

SEQ ID NO: 1275328 - RNA, 23 nt, Human
ugggauuacaggugugagcuacc

SEQ ID NO: 1275329 - RNA, 24 nt, Human
ugggauuacaggugugagcuaccg

SEQ ID NO: 1275330 - RNA, 24 nt, Human
ugggguuucaccauguuggccagg

SEQ ID NO: 1275331 - RNA, 24 nt, Human
ugggguuucaccauguuggccagg

SEQ ID NO: 1275332 - RNA, 23 nt, Human
uggucuggaacuccuaaccucag

SEQ ID NO: 1275333 - RNA, 24 nt, Human
uggugcgaucucagcucacugcaa

SEQ ID NO: 1275334 - RNA, 21 nt, Human
ugguuuggguggcaaggagag

SEQ ID NO: 1275335 - RNA, 23 nt, Human
uguaaacaaacaccugaucaaac

SEQ ID NO: 1275336 - RNA, 24 nt, Human
uguaaacaaacaccugaucaaacc

SEQ ID NO: 1275337 - RNA, 19 nt, Human
uguauguaugugugugugu

SEQ ID NO: 1275338 - RNA, 20 nt, Human
uguauguguguguguaugug

SEQ ID NO: 1275339 - RNA, 19 nt, Human
uguccuuggaguuuucccc

SEQ ID NO: 1275340 - RNA, 21 nt, Human
ugugggaagucagggacccug

SEQ ID NO: 1275341 - RNA, 19 nt, Human
uguguauguaugugugugu

SEQ ID NO: 1275342 - RNA, 21 nt, Human
uguguauguaugugugugugu

SEQ ID NO: 1275343 - RNA, 22 nt, Human
uguguauguaugugugugugua

SEQ ID NO: 1275344 - RNA, 23 nt, Human
uguguauguauguguguguguaa

SEQ ID NO: 1275345 - RNA, 23 nt, Human
uguguauguauguguguguguau

SEQ ID NO: 1275346 - RNA, 19 nt, Human
uguguguauguaugugugu

SEQ ID NO: 1275347 - RNA, 19 nt, Human
uguguguauguaugugugu

SEQ ID NO: 1275348 - RNA, 23 nt, Human
uguguguauguaugugugugugu

SEQ ID NO: 1275349 - RNA, 21 nt, Human
uguguguguauguaugugugu

SEQ ID NO: 1275350 - RNA, 22 nt, Human
uguguguguauguaugugugug

SEQ ID NO: 1275351 - RNA, 19 nt, Human
uguguuuguguguguaugu

SEQ ID NO: 1275352 - RNA, 19 nt, Human
uguucguacaccccucccc

SEQ ID NO: 1275353 - RNA, 18 nt, Human
uuaaaacuucaacaauaa

SEQ ID NO: 1275354 - RNA, 18 nt, Human
uuaauacuguguuugugu

SEQ ID NO: 1275355 - RNA, 26 nt, Human
uuaauacuuuuauaauuucuuacacc

SEQ ID NO: 1275356 - RNA, 21 nt, Human
uuacuuagguagacagugagg

SEQ ID NO: 1275357 - RNA, 23 nt, Human
uuagccuccugaguagcugggac

SEQ ID NO: 1275358 - RNA, 18 nt, Human
uuaguagaaaugggguuu

SEQ ID NO: 1275359 - RNA, 22 nt, Human
uuaguagaaaugggguuucacc

SEQ ID NO: 1275360 - RNA, 24 nt, Human
uuaguagaaaugggguuucaccau

SEQ ID NO: 1275361 - RNA, 22 nt, Human
uuaguagagacgagguuucacc

SEQ ID NO: 1275362 - RNA, 24 nt, Human
uuaguagagacgagguuucaccgu

SEQ ID NO: 1275363 - RNA, 18 nt, Human
uuaguagagaugggguuu

SEQ ID NO: 1275364 - RNA, 22 nt, Human
uuaguagagaugggguuucacc

SEQ ID NO: 1275365 - RNA, 24 nt, Human
uuaguagagaugggguuucaccau

SEQ ID NO: 1275366 - RNA, 21 nt, Human
uucaagcaauucuccugccuc

SEQ ID NO: 1275367 - RNA, 24 nt, Human
uucaagcaauucuccugccucagc

SEQ ID NO: 1275368 - RNA, 24 nt, Human
uucauggacauuuagcaguucccc

SEQ ID NO: 1275369 - RNA, 23 nt, Human
uucauggauauuuaucacuuccc

SEQ ID NO: 1275370 - RNA, 21 nt, Human
uuccuuggagacucuugaugg

SEQ ID NO: 1275371 - RNA, 24 nt, Human
uucggcucaucugccuccagcugc

SEQ ID NO: 1275372 - RNA, 18 nt, Human
uucuuuggucucgaaccc

SEQ ID NO: 1275373 - RNA, 18 nt, Human
uugagauaaggacugaaa

SEQ ID NO: 1275374 - RNA, 21 nt, Human
uugagauggagucuugcucug

SEQ ID NO: 1275375 - RNA, 24 nt, Human
uugcaaguaggaaccuuauauagg

SEQ ID NO: 1275376 - RNA, 22 nt, Human
uugcaaguuuuccuuggagacu

SEQ ID NO: 1275377 - RNA, 24 nt, Human
uugcccaggcuggagugcaguggu

SEQ ID NO: 1275378 - RNA, 24 nt, Human
uugcucugucgcccaggcuggagu

SEQ ID NO: 1275379 - RNA, 21 nt, Human
uuggagacucuugauggccca

SEQ ID NO: 1275380 - RNA, 25 nt, Human
uuguacuguuucucuuuauuucuca

SEQ ID NO: 1275381 - RNA, 23 nt, Human
uuguauuuuuaguagaaaugggg

SEQ ID NO: 1275382 - RNA, 21 nt, Human
uuuaucuacauggaaaaucug

SEQ ID NO: 1275383 - RNA, 24 nt, Human
uuucaccauguuggccaggcuggu

SEQ ID NO: 1275384 - RNA, 24 nt, Human
uuucaccauguuggccaggcuggu

SEQ ID NO: 1275385 - RNA, 19 nt, Human
uuucaccguguuagccagg

SEQ ID NO: 1275386 - RNA, 18 nt, Human
uuuccuuucucuuucuuu

SEQ ID NO: 1275387 - RNA, 23 nt, Human
uuuguguguguauguaugugugu

SEQ ID NO: 1275388 - RNA, 19 nt, Human
uuuuauauuuuuaguagag

SEQ ID NO: 1275389 - RNA, 20 nt, Human
uuuuauauuuuuaguagaga

SEQ ID NO: 1275390 - RNA, 24 nt, Human
uuuuuaguagaaaugggguuucac

SEQ ID NO: 1275391 - RNA, 24 nt, Human
uuuuuaguagagacgagguuucac

SEQ ID NO: 1275392 - RNA, 24 nt, Human
uuuuuaguagagaugggguuucac

SEQ ID NO: 1275393 - RNA, 18 nt, Human
uuuuuguauuuuuaguag

SEQ ID NO: 1275394 - RNA, 21 nt, Human
uuuuuguauuuuuaguagaga

SEQ ID NO: 1275395 - RNA, 21 nt, Human
uuuuuuguauuuuuaguagag

SEQ ID NO: 1275396 - RNA, 24 nt, Human
uuuuuuguauuuuuaguagagacg

SEQ ID NO: 1275397 - RNA, 24 nt, Human
uuuuuuuuuuuugagauggagucu

SEQ ID NO: 1275398 - RNA, 22 nt, Human
uuuuuuuuuuuuuugagaugga

SEQ ID NO: 1275399 - RNA, 23 nt, Human
aaacgaaaaggaaugggaaugag

SEQ ID NO: 1275400 - RNA, 19 nt, Human
aacuagacuucugacgcug

SEQ ID NO: 1275401 - RNA, 20 nt, Human
aaugacaguaacaaacaaga

SEQ ID NO: 1275402 - RNA, 19 nt, Human
acacgcugcacaacugaca

SEQ ID NO: 1275403 - RNA, 25 nt, Human
acagcugccuauaaaacuagacuuc

SEQ ID NO: 1275404 - RNA, 18 nt, Human
aucaacuguguuccaaaa

SEQ ID NO: 1275405 - RNA, 24 nt, Human
caacugacaucacaggacagcugc

SEQ ID NO: 1275406 - RNA, 23 nt, Human
cacucaucuccuucagcauccca

SEQ ID NO: 1275407 - RNA, 19 nt, Human
cagguccaaacaaugaagg

SEQ ID NO: 1275408 - RNA, 22 nt, Human
ccacagaugaagcacauguucc

SEQ ID NO: 1275409 - RNA, 28 nt, Human
cgcugcacaacugacaucacaggacagc

SEQ ID NO: 1275410 - RNA, 19 nt, Human
cugauucuaaacgaaaagg

SEQ ID NO: 1275411 - RNA, 22 nt, Human
uaaaacuagacuucugacgcug

SEQ ID NO: 1275412 - RNA, 18 nt, Human
uaauaaugagguggcaca

SEQ ID NO: 1275413 - RNA, 21 nt, Human
uagauaauaaugagguggcac

SEQ ID NO: 1275414 - RNA, 20 nt, Human
uauauuugaaacucaaggaa

SEQ ID NO: 1275415 - RNA, 18 nt, Human
ugaauauugugaugugac

SEQ ID NO: 1275416 - RNA, 18 nt, Human
ugacaguaacaaacaaga

SEQ ID NO: 1275417 - RNA, 24 nt, Human
ugggaaugacaguaacaaacaaga

SEQ ID NO: 1275418 - RNA, 22 nt, Human
uuuuugaacugccacauucacu

SEQ ID NO: 1275419 - RNA, 21 nt, Human
aaaaauaccccaacuuuagga

SEQ ID NO: 1275420 - RNA, 21 nt, Human
aaacagacaucccuauuuccu

SEQ ID NO: 1275421 - RNA, 22 nt, Human
aaacagcccaaggugaagcuca

SEQ ID NO: 1275422 - RNA, 24 nt, Human
aaagauccucaaaggucuguguua

SEQ ID NO: 1275423 - RNA, 20 nt, Human
aagacuuuuuagaaagauga

SEQ ID NO: 1275424 - RNA, 19 nt, Human
aagcuacagaaaguccuga

SEQ ID NO: 1275425 - RNA, 20 nt, Human
aaguagauaugcucaagaaa

SEQ ID NO: 1275426 - RNA, 20 nt, Human
aaguagcugggauuacaggc

SEQ ID NO: 1275427 - RNA, 26 nt, Human
aaguagcugggauuacaggcgcaugc

SEQ ID NO: 1275428 - RNA, 23 nt, Human
acagaguggcugggccugacccc

SEQ ID NO: 1275429 - RNA, 23 nt, Human
accagacuggagugcaauggcgu

SEQ ID NO: 1275430 - RNA, 25 nt, Human
acuaggagaaagcaugcaaaacagc

SEQ ID NO: 1275431 - RNA, 27 nt, Human
acucugucaaccagacuggagugcaau

SEQ ID NO: 1275432 - RNA, 19 nt, Human
acuggagugcaauggcgug

SEQ ID NO: 1275433 - RNA, 24 nt, Human
acuucaauagaaaguaagcuaaaa

SEQ ID NO: 1275434 - RNA, 25 nt, Human
agaaaaaaauaacacuaaauaagga

SEQ ID NO: 1275435 - RNA, 22 nt, Human
agaagagauggguuuuugccau

SEQ ID NO: 1275436 - RNA, 19 nt, Human
agccacauccagggagcca

SEQ ID NO: 1275437 - RNA, 23 nt, Human
agcuacagaaaguccugacuauc

SEQ ID NO: 1275438 - RNA, 19 nt, Human
agggagccaaggauauagu

SEQ ID NO: 1275439 - RNA, 18 nt, Human
agggcugaugaaagagga

SEQ ID NO: 1275440 - RNA, 18 nt, Human
aggggaagggcugaggcu

SEQ ID NO: 1275441 - RNA, 19 nt, Human
aguagcugggauuacaggc

SEQ ID NO: 1275442 - RNA, 21 nt, Human
agugcaauggcgugaucucag

SEQ ID NO: 1275443 - RNA, 24 nt, Human
agugcaauggcgugaucucagcuc

SEQ ID NO: 1275444 - RNA, 21 nt, Human
auaagacaagguggcuccuuc

SEQ ID NO: 1275445 - RNA, 20 nt, Human
aucccuauuuccuuccuagg

SEQ ID NO: 1275446 - RNA, 20 nt, Human
auggguuuuugccauguugg

SEQ ID NO: 1275447 - RNA, 21 nt, Human
auuacaggcgcaugccaccau

SEQ ID NO: 1275448 - RNA, 23 nt, Human
caacugauauaagaacuaagaaa

SEQ ID NO: 1275449 - RNA, 25 nt, Human
caagaucagaagggacacuaacacc

SEQ ID NO: 1275450 - RNA, 22 nt, Human
cacaacacuaaucacugucccc

SEQ ID NO: 1275451 - RNA, 23 nt, Human
cacaccauguacucuaaaaugag

SEQ ID NO: 1275452 - RNA, 18 nt, Human
caccauguacucuaaaau

SEQ ID NO: 1275453 - RNA, 23 nt, Human
cacucugucaaccagacuggagu

SEQ ID NO: 1275454 - RNA, 18 nt, Human
cacuguugggugauagaa

SEQ ID NO: 1275455 - RNA, 20 nt, Human
cacuuugacagcuucccucu

SEQ ID NO: 1275456 - RNA, 25 nt, Human
cagcauaaauagguauuugugaaug

SEQ ID NO: 1275457 - RNA, 22 nt, Human
cagcucacugcaaccuccuccu

SEQ ID NO: 1275458 - RNA, 23 nt, Human
cagguuccuucacacauaauuuc

SEQ ID NO: 1275459 - RNA, 22 nt, Human
caugcuaaaaugaaugcaucca

SEQ ID NO: 1275460 - RNA, 24 nt, Human
cauguuggccaggcuggucucaaa

SEQ ID NO: 1275461 - RNA, 22 nt, Human
ccacauccagggagccaaggau

SEQ ID NO: 1275462 - RNA, 19 nt, Human
ccagcuuacucuucucucc

SEQ ID NO: 1275463 - RNA, 22 nt, Human
ccagcuuacucuucucucccuc

SEQ ID NO: 1275464 - RNA, 23 nt, Human
ccagcuuacucuucucucccucc

SEQ ID NO: 1275465 - RNA, 19 nt, Human
ccauguuggccaggcuggu

SEQ ID NO: 1275466 - RNA, 22 nt, Human
ccauguuggccaggcuggucuc

SEQ ID NO: 1275467 - RNA, 20 nt, Human
cccaacccaggucuggcuuc

SEQ ID NO: 1275468 - RNA, 18 nt, Human
cccaaggacaggguugca

SEQ ID NO: 1275469 - RNA, 19 nt, Human
cccagggcacaggggucag

SEQ ID NO: 1275470 - RNA, 20 nt, Human
cccagguucaagcaauucuc

SEQ ID NO: 1275471 - RNA, 23 nt, Human
ccccacugcagggugugugccca

SEQ ID NO: 1275472 - RNA, 19 nt, Human
ccgaaguagcugggauuac

SEQ ID NO: 1275473 - RNA, 23 nt, Human
ccgaaguagcugggauuacaggc

SEQ ID NO: 1275474 - RNA, 24 nt, Human
ccgaaguagcugggauuacaggcg

SEQ ID NO: 1275475 - RNA, 22 nt, Human
ccucccagguucaagcaauucu

SEQ ID NO: 1275476 - RNA, 18 nt, Human
ccuccucccagguucaag

SEQ ID NO: 1275477 - RNA, 22 nt, Human
ccugcagcccagugcccagggc

SEQ ID NO: 1275478 - RNA, 25 nt, Human
cuaauuaaagaagacugagaagccc

SEQ ID NO: 1275479 - RNA, 20 nt, Human
cuacuucaauagaaaguaag

SEQ ID NO: 1275480 - RNA, 19 nt, Human
cuagggcccuucacuccuc

SEQ ID NO: 1275481 - RNA, 19 nt, Human
cucaagugauuugcccacc

SEQ ID NO: 1275482 - RNA, 23 nt, Human
cucacugcaaccuccuccuccca

SEQ ID NO: 1275483 - RNA, 24 nt, Human
cucacugcaaccuccuccucccag

SEQ ID NO: 1275484 - RNA, 22 nt, Human
cuccaaccugcagcccagugcc

SEQ ID NO: 1275485 - RNA, 20 nt, Human
cucccagguucaagcaauuc

SEQ ID NO: 1275486 - RNA, 21 nt, Human
cucucuacaggcccaggagag

SEQ ID NO: 1275487 - RNA, 23 nt, Human
cugcaaccuccuccucccagguu

SEQ ID NO: 1275488 - RNA, 24 nt, Human
cugcaaccuccuccucccagguuc

SEQ ID NO: 1275489 - RNA, 24 nt, Human
cuggagugcaauggcgugaucuca

SEQ ID NO: 1275490 - RNA, 19 nt, Human
cugugguccaagagugugg

SEQ ID NO: 1275491 - RNA, 23 nt, Human
cuuacucuucucucccucccaga

SEQ ID NO: 1275492 - RNA, 22 nt, Human
cuucacugugcccccugcugcc

SEQ ID NO: 1275493 - RNA, 20 nt, Human
cuucagcacuucacugugcc

SEQ ID NO: 1275494 - RNA, 19 nt, Human
cuugucuccuuccacuucu

SEQ ID NO: 1275495 - RNA, 21 nt, Human
gaacuuaaagaauauuuggga

SEQ ID NO: 1275496 - RNA, 25 nt, Human
gacccaacccaggucuggcuucugu

SEQ ID NO: 1275497 - RNA, 22 nt, Human
gaccucaagugauuugcccacc

SEQ ID NO: 1275498 - RNA, 20 nt, Human
gaggaagggcgaagaguaaa

SEQ ID NO: 1275499 - RNA, 22 nt, Human
gaguaaaggugccaggggaagg

SEQ ID NO: 1275500 - RNA, 19 nt, Human
gaguauguguuauccccac

SEQ ID NO: 1275501 - RNA, 20 nt, Human
gauagaguggcaggccagaa

SEQ ID NO: 1275502 - RNA, 22 nt, Human
gaucagaagggacacuaacacc

SEQ ID NO: 1275503 - RNA, 18 nt, Human
gauuacaggcgcaugcca

SEQ ID NO: 1275504 - RNA, 24 nt, Human
gauuacaggcgcaugccaccaugc

SEQ ID NO: 1275505 - RNA, 22 nt, Human
gcaaccuccuccucccagguuc

SEQ ID NO: 1275506 - RNA, 20 nt, Human
gccagguauuagaagguucc

SEQ ID NO: 1275507 - RNA, 20 nt, Human
gccauguuggccaggcuggu

SEQ ID NO: 1275508 - RNA, 22 nt, Human
gcucacugcaaccuccuccucc

SEQ ID NO: 1275509 - RNA, 22 nt, Human
gcuuacucuucucucccuccca

SEQ ID NO: 1275510 - RNA, 24 nt, Human
ggagacagagguuuacaaaaggaa

SEQ ID NO: 1275511 - RNA, 23 nt, Human
ggcuugucuccuuccacuucuuu

SEQ ID NO: 1275512 - RNA, 22 nt, Human
ggguuuuugccauguuggccag

SEQ ID NO: 1275513 - RNA, 21 nt, Human
gucauucaggaguagauuaau

SEQ ID NO: 1275514 - RNA, 22 nt, Human
uaaagcacuaggagaaagcaug

SEQ ID NO: 1275515 - RNA, 20 nt, Human
uaauuuuuauauuuuuuaga

SEQ ID NO: 1275516 - RNA, 24 nt, Human
uagaagagauggguuuuugccaug

SEQ ID NO: 1275517 - RNA, 18 nt, Human
uagaagaugugggaaucc

SEQ ID NO: 1275518 - RNA, 19 nt, Human
uagggcccuucacuccucc

SEQ ID NO: 1275519 - RNA, 23 nt, Human
uaucacuggaacucaguuaaaau

SEQ ID NO: 1275520 - RNA, 20 nt, Human
uaugguuuugagagaucuuc

SEQ ID NO: 1275521 - RNA, 22 nt, Human
uaugguuuugagagaucuucuu

SEQ ID NO: 1275522 - RNA, 22 nt, Human
ucaagaaagcuaucccaaggac

SEQ ID NO: 1275523 - RNA, 18 nt, Human
ucacugcaaccuccuccc

SEQ ID NO: 1275524 - RNA, 24 nt, Human
ucacugcaaccuccuccucccagg

SEQ ID NO: 1275525 - RNA, 25 nt, Human
ucagcucacugcaaccuccuccucc

SEQ ID NO: 1275526 - RNA, 20 nt, Human
ucagggcugaugaaagagga

SEQ ID NO: 1275527 - RNA, 19 nt, Human
uccaauauuguccaacuag

SEQ ID NO: 1275528 - RNA, 20 nt, Human
uccaccaugccaggaggaag

SEQ ID NO: 1275529 - RNA, 21 nt, Human
ucccagguucaagcaauucuc

SEQ ID NO: 1275530 - RNA, 24 nt, Human
ucccagguucaagcaauucucgug

SEQ ID NO: 1275531 - RNA, 24 nt, Human
uccgaaguagcugggauuacaggc

SEQ ID NO: 1275532 - RNA, 25 nt, Human
ucuacaggcccaggagagaacagcu

SEQ ID NO: 1275533 - RNA, 24 nt, Human
ucucacucugucaaccagacugga

SEQ ID NO: 1275534 - RNA, 18 nt, Human
ucucagggcugaugaaag

SEQ ID NO: 1275535 - RNA, 21 nt, Human
ucuguggauuuugauuaucua

SEQ ID NO: 1275536 - RNA, 23 nt, Human
ugaagcucacuuggcagcugaga

SEQ ID NO: 1275537 - RNA, 25 nt, Human
ugaaggauacaaauggagccgaaaa

SEQ ID NO: 1275538 - RNA, 18 nt, Human
ugaccucaagugauuugc

SEQ ID NO: 1275539 - RNA, 22 nt, Human
ugaccucaagugauuugcccac

SEQ ID NO: 1275540 - RNA, 20 nt, Human
ugacucaaccuccgaaguag

SEQ ID NO: 1275541 - RNA, 24 nt, Human
ugacucaaccuccgaaguagcugg

SEQ ID NO: 1275542 - RNA, 22 nt, Human
ugagaaaaaaauaacacuaaau

SEQ ID NO: 1275543 - RNA, 23 nt, Human
ugagucucacucugucaaccaga

SEQ ID NO: 1275544 - RNA, 21 nt, Human
ugauagaguggcaggccagaa

SEQ ID NO: 1275545 - RNA, 18 nt, Human
ugccaggaggaagggcga

SEQ ID NO: 1275546 - RNA, 19 nt, Human
ugccaggggaagggcugag

SEQ ID NO: 1275547 - RNA, 24 nt, Human
ugccauguuggccaggcuggucuc

SEQ ID NO: 1275548 - RNA, 27 nt, Human
ugccauguuggccaggcuggucucaaa

SEQ ID NO: 1275549 - RNA, 19 nt, Human
ugcccagcacacuuugaca

SEQ ID NO: 1275550 - RNA, 24 nt, Human
ugcuaaaaugaaugcauccaagga

SEQ ID NO: 1275551 - RNA, 22 nt, Human
ugcuacugcagccuaaugacuu

SEQ ID NO: 1275552 - RNA, 19 nt, Human
uggagugcaauggcgugau

SEQ ID NO: 1275553 - RNA, 24 nt, Human
uggagugcaauggcgugaucucag

SEQ ID NO: 1275554 - RNA, 19 nt, Human
uggcagcugagagugaguu

SEQ ID NO: 1275555 - RNA, 22 nt, Human
uggccaggcuggucucaaacuc

SEQ ID NO: 1275556 - RNA, 24 nt, Human
uggcgugaucucagcucacugcaa

SEQ ID NO: 1275557 - RNA, 21 nt, Human
ugggauuacaggcgcaugcca

SEQ ID NO: 1275558 - RNA, 22 nt, Human
ugggauuacaggcgcaugccac

SEQ ID NO: 1275559 - RNA, 24 nt, Human
ugggauuacaggcgcaugccacca

SEQ ID NO: 1275560 - RNA, 25 nt, Human
ugggauuacaggcgcaugccaccau

SEQ ID NO: 1275561 - RNA, 20 nt, Human
uggguuuuugccauguuggc

SEQ ID NO: 1275562 - RNA, 24 nt, Human
uggguuuuugccauguuggccagg

SEQ ID NO: 1275563 - RNA, 23 nt, Human
uguaaauacgggguaagguacau

SEQ ID NO: 1275564 - RNA, 18 nt, Human
ugucauaucacuggaacu

SEQ ID NO: 1275565 - RNA, 18 nt, Human
uuacucuucucucccucc

SEQ ID NO: 1275566 - RNA, 24 nt, Human
uuagaagagauggguuuuugccau

SEQ ID NO: 1275567 - RNA, 18 nt, Human
uuaggagguuaaggucac

SEQ ID NO: 1275568 - RNA, 18 nt, Human
uucaauagaaaguaagcu

SEQ ID NO: 1275569 - RNA, 27 nt, Human
uucagacuuaagacuuuuuagaaagau

SEQ ID NO: 1275570 - RNA, 18 nt, Human
uucccaguaacggcgcuu

SEQ ID NO: 1275571 - RNA, 24 nt, Human
uuccguuuucucuauaaauaguuc

SEQ ID NO: 1275572 - RNA, 19 nt, Human
uucgccaggacccaaccca

SEQ ID NO: 1275573 - RNA, 24 nt, Human
uugccauguuggccaggcuggucu

SEQ ID NO: 1275574 - RNA, 18 nt, Human
uuuaagaaauagaagcca

SEQ ID NO: 1275575 - RNA, 23 nt, Human
uuuugccauguuggccaggcugg

SEQ ID NO: 1275576 - RNA, 23 nt, Human
uuuuugccauguuggccaggcug

SEQ ID NO: 1275577 - RNA, 24 nt, Human
uuuuuuucuaacuucugugagauu

SEQ ID NO: 1275578 - RNA, 21 nt, Human
agccaggccccgugagaagcu

SEQ ID NO: 1275579 - RNA, 20 nt, Human
auguggaggccgagcagcug

SEQ ID NO: 1275580 - RNA, 21 nt, Human
caggccccgugagaagcuaug

SEQ ID NO: 1275581 - RNA, 24 nt, Human
cguuccuguaggaagaacuagaga

SEQ ID NO: 1275582 - RNA, 24 nt, Human
uaaaagcagaaauaaggaaaaugc

SEQ ID NO: 1275583 - RNA, 27 nt, Human
uaagagaacugagacauguggaggccg

SEQ ID NO: 1275584 - RNA, 19 nt, Human
uccgagaggaccugauggu

SEQ ID NO: 1275585 - RNA, 19 nt, Human
ugagcgaguuggugggguc

SEQ ID NO: 1275586 - RNA, 20 nt, Human
ugagcgaguuggugggguca

SEQ ID NO: 1275587 - RNA, 22 nt, Human
uguaggaagaacuagagauucc

SEQ ID NO: 1275588 - RNA, 23 nt, Human
ugucaggcgugagcgaguuggug

SEQ ID NO: 1275589 - RNA, 18 nt, Human
uacaagccuugagagaca

SEQ ID NO: 1275590 - RNA, 20 nt, Human
acagccaagucucccuugcc

SEQ ID NO: 1275591 - RNA, 21 nt, Human
caacugguccauccaccuccc

SEQ ID NO: 1275592 - RNA, 22 nt, Human
cacagccaagucucccuugccc

SEQ ID NO: 1275593 - RNA, 23 nt, Human
cacagccaagucucccuugcccc

SEQ ID NO: 1275594 - RNA, 22 nt, Human
caccacagccuaccugccccuc

SEQ ID NO: 1275595 - RNA, 21 nt, Human
caccagcccaccccaggggac

SEQ ID NO: 1275596 - RNA, 23 nt, Human
caccagcccaccccaggggacac

SEQ ID NO: 1275597 - RNA, 18 nt, Human
cagccuaccugccccucc

SEQ ID NO: 1275598 - RNA, 25 nt, Human
caguggaccuugccuccaucucacc

SEQ ID NO: 1275599 - RNA, 20 nt, Human
caugccacucugaagcccac

SEQ ID NO: 1275600 - RNA, 19 nt, Human
ccaugccacucugaagccc

SEQ ID NO: 1275601 - RNA, 19 nt, Human
ccccaggggacaccaacug

SEQ ID NO: 1275602 - RNA, 23 nt, Human
cucacagccaagucucccuugcc

SEQ ID NO: 1275603 - RNA, 21 nt, Human
cuccugccucacagccaaguc

SEQ ID NO: 1275604 - RNA, 18 nt, Human
cuggcaccacagccuacc

SEQ ID NO: 1275605 - RNA, 24 nt, Human
gacaccaacugguccauccaccuc

SEQ ID NO: 1275606 - RNA, 18 nt, Human
gaccuugccuccaucuca

SEQ ID NO: 1275607 - RNA, 21 nt, Human
guccauguugagccuuccuca

SEQ ID NO: 1275608 - RNA, 22 nt, Human
guugagccuuccucaaaggcag

SEQ ID NO: 1275609 - RNA, 18 nt, Human
ucugaagcccacaccauu

SEQ ID NO: 1275610 - RNA, 19 nt, Human
ucuuccccagagccccaca

SEQ ID NO: 1275611 - RNA, 19 nt, Human
ugccaugccacucugaagc

SEQ ID NO: 1275612 - RNA, 19 nt, Human
ugccccuccugccucacag

SEQ ID NO: 1275613 - RNA, 21 nt, Human
uguccauguugagccuuccuc

SEQ ID NO: 1275614 - RNA, 22 nt, Human
aaacaacaagacgcuugacuug

SEQ ID NO: 1275615 - RNA, 18 nt, Human
aagcagcaccaggagcgg

SEQ ID NO: 1275616 - RNA, 25 nt, Human
aagcagcaccaggagcggcagaaga

SEQ ID NO: 1275617 - RNA, 25 nt, Human
agcaccaggagcggcagaagaagga

SEQ ID NO: 1275618 - RNA, 21 nt, Human
aggcggcagcaguggacaagg

SEQ ID NO: 1275619 - RNA, 24 nt, Human
caaacgagcacacaagcagcacca

SEQ ID NO: 1275620 - RNA, 24 nt, Human
caagcagcaccaggagcggcagaa

SEQ ID NO: 1275621 - RNA, 20 nt, Human
cacaagcagcaccaggagcg

SEQ ID NO: 1275622 - RNA, 24 nt, Human
cacaagcagcaccaggagcggcag

SEQ ID NO: 1275623 - RNA, 18 nt, Human
caggagcggcagaagaag

SEQ ID NO: 1275624 - RNA, 23 nt, Human
caggagcggcagaagaaggaggc

SEQ ID NO: 1275625 - RNA, 18 nt, Human
caguaaaggaauggggaa

SEQ ID NO: 1275626 - RNA, 18 nt, Human
caugccacuaauggagaa

SEQ ID NO: 1275627 - RNA, 20 nt, Human
gagaaaggggguauuuucac

SEQ ID NO: 1275628 - RNA, 19 nt, Human
gagcaugccacuaauggag

SEQ ID NO: 1275629 - RNA, 21 nt, Human
gaggcggcagcaguggacaag

SEQ ID NO: 1275630 - RNA, 21 nt, Human
gaggcggcagcaguggacaag

SEQ ID NO: 1275631 - RNA, 21 nt, Human
gcagaagaaggaggcggcagc

SEQ ID NO: 1275632 - RNA, 18 nt, Human
gcggcagcaguggacaag

SEQ ID NO: 1275633 - RNA, 21 nt, Human
gggaaaacuaucuaggauucu

SEQ ID NO: 1275634 - RNA, 23 nt, Human
gguauuuucacagaaucaguauu

SEQ ID NO: 1275635 - RNA, 19 nt, Human
uaaaauucuccaauugaac

SEQ ID NO: 1275636 - RNA, 19 nt, Human
uaagagcugaaugagcaug

SEQ ID NO: 1275637 - RNA, 21 nt, Human
ucagcugccgcuucacaaaag

SEQ ID NO: 1275638 - RNA, 24 nt, Human
uccucagcugccgcuucacaaaag

SEQ ID NO: 1275639 - RNA, 21 nt, Human
ugcauguaacagcuaaguaca

SEQ ID NO: 1275640 - RNA, 19 nt, Human
uggggaagggggaaaugaa

SEQ ID NO: 1275641 - RNA, 23 nt, Human
uguuguuguuuuuuuguuguugu

SEQ ID NO: 1275642 - RNA, 20 nt, Human
uuguuguuguuguuaaaaca

SEQ ID NO: 1275643 - RNA, 19 nt, Human
uuguuguuuuuuuguuguu

SEQ ID NO: 1275644 - RNA, 23 nt, Human
uuucacagaaucaguauuuuucc

SEQ ID NO: 1275645 - RNA, 22 nt, Human
uuuguuguuguuguuaaaacag

SEQ ID NO: 1275646 - RNA, 23 nt, Human
uuuuguuguuguuguuaaaacag

SEQ ID NO: 1275647 - RNA, 24 nt, Human
uuuuuuuguuguuguuguuaaaac

SEQ ID NO: 1275648 - RNA, 18 nt, Human
aagcagcaccaggagcgg

SEQ ID NO: 1275649 - RNA, 24 nt, Human
caaacgagcacacaagcagcacca

SEQ ID NO: 1275650 - RNA, 20 nt, Human
cacaagcagcaccaggagcg

SEQ ID NO: 1275651 - RNA, 19 nt, Human
ucagcugccgcuucacaaa

SEQ ID NO: 1275652 - RNA, 24 nt, Human
uccucagcugccgcuucacaaaag

SEQ ID NO: 1275653 - RNA, 21 nt, Human
aaacagaaaguaacaccagaa

SEQ ID NO: 1275654 - RNA, 21 nt, Human
aaaugucacugacuccugaaa

SEQ ID NO: 1275655 - RNA, 22 nt, Human
aaguucacagcuacauccucaa

SEQ ID NO: 1275656 - RNA, 22 nt, Human
aauaacuaauauaagagacaga

SEQ ID NO: 1275657 - RNA, 19 nt, Human
aauauaagagacagaagga

SEQ ID NO: 1275658 - RNA, 18 nt, Human
agacagaaggaccagccu

SEQ ID NO: 1275659 - RNA, 18 nt, Human
agcuacauccucaaaugu

SEQ ID NO: 1275660 - RNA, 27 nt, Human
aggaaaaacagaaaguaaccgguaccc

SEQ ID NO: 1275661 - RNA, 23 nt, Human
caaugucuuuggggaaucucaca

SEQ ID NO: 1275662 - RNA, 28 nt, Human
guucacagcuacauccucaaaugucacu

SEQ ID NO: 1275663 - RNA, 21 nt, Human
uaggaaaaacagaaaguaaca

SEQ ID NO: 1275664 - RNA, 26 nt, Human
uaggaaaaacagaaaguaacaccaga

SEQ ID NO: 1275665 - RNA, 21 nt, Human
uauuaggaagugauugauaaa

SEQ ID NO: 1275666 - RNA, 22 nt, Human
aaaaacaauuuguuuugaaaac

SEQ ID NO: 1275667 - RNA, 21 nt, Human
aaaaccuaauaacaaguauca

SEQ ID NO: 1275668 - RNA, 23 nt, Human
aaaauuacaacugagacagugag

SEQ ID NO: 1275669 - RNA, 19 nt, Human
aaacaagaaucuaccauac

SEQ ID NO: 1275670 - RNA, 25 nt, Human
aaacauuuagcacuguuaauggaca

SEQ ID NO: 1275671 - RNA, 19 nt, Human
aaaggacuuuggucuuccc

SEQ ID NO: 1275672 - RNA, 21 nt, Human
aacauuugaaaacaccaucgc

SEQ ID NO: 1275673 - RNA, 25 nt, Human
aaccaauuccaucuugcuucuaacc

SEQ ID NO: 1275674 - RNA, 23 nt, Human
aaccuaauaacaaguaucauuca

SEQ ID NO: 1275675 - RNA, 23 nt, Human
aagagccaaggaagcugugguuu

SEQ ID NO: 1275676 - RNA, 22 nt, Human
aagcacccauaaauaauggcaa

SEQ ID NO: 1275677 - RNA, 21 nt, Human
aauagcagcccuuuccaaaac

SEQ ID NO: 1275678 - RNA, 20 nt, Human
aaucuauaaaguguuuccuu

SEQ ID NO: 1275679 - RNA, 22 nt, Human
aaucuuuucuucucuguguuga

SEQ ID NO: 1275680 - RNA, 23 nt, Human
acugcaauccacuuggggagacu

SEQ ID NO: 1275681 - RNA, 25 nt, Human
agaacaaauucacuacaaauuuuca

SEQ ID NO: 1275682 - RNA, 18 nt, Human
agcacuguuaauggacag

SEQ ID NO: 1275683 - RNA, 23 nt, Human
aggaagcugugguuucgcauuug

SEQ ID NO: 1275684 - RNA, 23 nt, Human
aggcuucaguuuuccaccuccag

SEQ ID NO: 1275685 - RNA, 19 nt, Human
agguagucgccaucucaaa

SEQ ID NO: 1275686 - RNA, 24 nt, Human
aucgcaaaauuacaacugagacag

SEQ ID NO: 1275687 - RNA, 25 nt, Human
auuacaacugagacagugagagauc

SEQ ID NO: 1275688 - RNA, 21 nt, Human
caaaaaacuaaaacuauagca

SEQ ID NO: 1275689 - RNA, 22 nt, Human
caaaaccuaauaacaaguauca

SEQ ID NO: 1275690 - RNA, 23 nt, Human
caacucacugguccccuacccac

SEQ ID NO: 1275691 - RNA, 24 nt, Human
caagaggacagcuucgacucccuc

SEQ ID NO: 1275692 - RNA, 21 nt, Human
caaggcccggcaagccaaagg

SEQ ID NO: 1275693 - RNA, 23 nt, Human
cacacagccggcuuugcaugccc

SEQ ID NO: 1275694 - RNA, 23 nt, Human
cacugcuauagaaaucuauaaag

SEQ ID NO: 1275695 - RNA, 24 nt, Human
cagaaucaaggcccggcaagccaa

SEQ ID NO: 1275696 - RNA, 22 nt, Human
cagagcuuuccuuagacuaaaa

SEQ ID NO: 1275697 - RNA, 19 nt, Human
cagcguguggccacguggu

SEQ ID NO: 1275698 - RNA, 21 nt, Human
cagcuggaggcugcaagauuc

SEQ ID NO: 1275699 - RNA, 21 nt, Human
cauggcgcccagcaggaaugg

SEQ ID NO: 1275700 - RNA, 22 nt, Human
ccaaaacaaacccgcuuccugc

SEQ ID NO: 1275701 - RNA, 24 nt, Human
ccaagauagccauuugguugugcc

SEQ ID NO: 1275702 - RNA, 22 nt, Human
ccagagggcauauucaaaaaca

SEQ ID NO: 1275703 - RNA, 21 nt, Human
ccauaaauaauggcaagaaca

SEQ ID NO: 1275704 - RNA, 19 nt, Human
ccauacagaaagguagucg

SEQ ID NO: 1275705 - RNA, 27 nt, Human
ccauccagaaauuaagccaacacaaga

SEQ ID NO: 1275706 - RNA, 23 nt, Human
ccccuguacucuauggaucagcu

SEQ ID NO: 1275707 - RNA, 22 nt, Human
cccgcgcccggagagucgggac

SEQ ID NO: 1275708 - RNA, 21 nt, Human
cccuagauaacuacuauaggu

SEQ ID NO: 1275709 - RNA, 20 nt, Human
ccuccaaaaaacuaaaacua

SEQ ID NO: 1275710 - RNA, 19 nt, Human
ccucgcacaugaaagcacc

SEQ ID NO: 1275711 - RNA, 19 nt, Human
cgacuaaucaacuuuccca

SEQ ID NO: 1275712 - RNA, 21 nt, Human
cgcaaaauuacaacugagaca

SEQ ID NO: 1275713 - RNA, 18 nt, Human
cgcacaugaaagcaccca

SEQ ID NO: 1275714 - RNA, 24 nt, Human
cgcgccggcagaggcuucagccug

SEQ ID NO: 1275715 - RNA, 21 nt, Human
cuaaaacuauagcaaggcuuc

SEQ ID NO: 1275716 - RNA, 19 nt, Human
cuaaccuccaagcuguccu

SEQ ID NO: 1275717 - RNA, 18 nt, Human
cucaaaaucugagaaagc

SEQ ID NO: 1275718 - RNA, 21 nt, Human
cucaucuggucuuguggcccc

SEQ ID NO: 1275719 - RNA, 21 nt, Human
cuccaaaaaacuaaaacuaua

SEQ ID NO: 1275720 - RNA, 20 nt, Human
cucccucugauuucaucucc

SEQ ID NO: 1275721 - RNA, 19 nt, Human
cuccucaggauaacaucac

SEQ ID NO: 1275722 - RNA, 20 nt, Human
cucgccauaaaaccuuacua

SEQ ID NO: 1275723 - RNA, 24 nt, Human
cuguccuuguucauuccuggucgu

SEQ ID NO: 1275724 - RNA, 19 nt, Human
cugugcguuaucacaucaa

SEQ ID NO: 1275725 - RNA, 20 nt, Human
cuuaaaaacugcaauccacu

SEQ ID NO: 1275726 - RNA, 22 nt, Human
cuucagccuggagcucagggug

SEQ ID NO: 1275727 - RNA, 19 nt, Human
cuuuucuucucuguguuga

SEQ ID NO: 1275728 - RNA, 23 nt, Human
gaucauaacccuccaaaaaacua

SEQ ID NO: 1275729 - RNA, 24 nt, Human
gaucauaacccuccaaaaaacuaa

SEQ ID NO: 1275730 - RNA, 21 nt, Human
gcaaaaagagccaaggaagcu

SEQ ID NO: 1275731 - RNA, 21 nt, Human
gcaagauucuaaaccuccccc

SEQ ID NO: 1275732 - RNA, 20 nt, Human
ggagcucaggguggcgggca

SEQ ID NO: 1275733 - RNA, 27 nt, Human
ggcagaggcuucagccuggagcucagg

SEQ ID NO: 1275734 - RNA, 23 nt, Human
ggcaugauguugaagccccacuu

SEQ ID NO: 1275735 - RNA, 23 nt, Human
ggcuucagccuggagcucagggu

SEQ ID NO: 1275736 - RNA, 23 nt, Human
gguagaugaaucuuuucuucucu

SEQ ID NO: 1275737 - RNA, 23 nt, Human
guacaacagcuguuaccaaaacc

SEQ ID NO: 1275738 - RNA, 23 nt, Human
gugcgcgccggcagaggcuucag

SEQ ID NO: 1275739 - RNA, 23 nt, Human
uaaaaccuuacuauguaacacug

SEQ ID NO: 1275740 - RNA, 23 nt, Human
uaacacugcuauagaaaucuaua

SEQ ID NO: 1275741 - RNA, 22 nt, Human
uaagccaacacaagaggacaac

SEQ ID NO: 1275742 - RNA, 23 nt, Human
uaauaacaaguaucauucaaagc

SEQ ID NO: 1275743 - RNA, 24 nt, Human
uacaacagcuguuaccaaaaccua

SEQ ID NO: 1275744 - RNA, 28 nt, Human
uagcaaggcuucaguuuuccaccuccag

SEQ ID NO: 1275745 - RNA, 23 nt, Human
uagucgccaucucaaaacucuca

SEQ ID NO: 1275746 - RNA, 21 nt, Human
uauuagaggaaaauaacucag

SEQ ID NO: 1275747 - RNA, 30 nt, Human
uauucaaaaacaagaaucuaccauacagag

SEQ ID NO: 1275748 - RNA, 19 nt, Human
ucacuacaaauuuucaaaa

SEQ ID NO: 1275749 - RNA, 21 nt, Human
ucagagcuuuccuuagacuaa

SEQ ID NO: 1275750 - RNA, 23 nt, Human
ucagagcuuuccuuagacuaaaa

SEQ ID NO: 1275751 - RNA, 19 nt, Human
ucaggauaacaucacuauu

SEQ ID NO: 1275752 - RNA, 22 nt, Human
uccgcagaaucaaggcccggca

SEQ ID NO: 1275753 - RNA, 18 nt, Human
ucucaaaaucugagaaag

SEQ ID NO: 1275754 - RNA, 24 nt, Human
ucuuguggcccccauccagaaauu

SEQ ID NO: 1275755 - RNA, 23 nt, Human
ugaaaacaccaucgcaaaauuac

SEQ ID NO: 1275756 - RNA, 21 nt, Human
ugaaacaaagacaauagcagc

SEQ ID NO: 1275757 - RNA, 24 nt, Human
ugaaagcacccauaaauaauggca

SEQ ID NO: 1275758 - RNA, 18 nt, Human
ugaagcuuucucuucuaa

SEQ ID NO: 1275759 - RNA, 23 nt, Human
uggcaagaacaaauucacuacaa

SEQ ID NO: 1275760 - RNA, 25 nt, Human
uggcagcagcguguggccacguggu

SEQ ID NO: 1275761 - RNA, 21 nt, Human
uguggcccccauccagaaauu

SEQ ID NO: 1275762 - RNA, 21 nt, Human
uucuaaaccucccccaauugc

SEQ ID NO: 1275763 - RNA, 23 nt, Human
uucuuucuugcuugaucuucgau

SEQ ID NO: 1275764 - RNA, 21 nt, Human
uugaucuucgauaauacuggg

SEQ ID NO: 1275765 - RNA, 23 nt, Human
uugaucuucgauaauacugggaa

SEQ ID NO: 1275766 - RNA, 19 nt, Human
uuucaaauuuucagagcuu

SEQ ID NO: 1275767 - RNA, 24 nt, Human
aaacaguauucuauggacucccaa

SEQ ID NO: 1275768 - RNA, 20 nt, Human
aacaacaaccacguccuccc

SEQ ID NO: 1275769 - RNA, 19 nt, Human
aaccacguccucccugcuc

SEQ ID NO: 1275770 - RNA, 18 nt, Human
aagccacugggggaaaau

SEQ ID NO: 1275771 - RNA, 20 nt, Human
acccgaagccccuccuucuu

SEQ ID NO: 1275772 - RNA, 20 nt, Human
acucuggugauauguuuugg

SEQ ID NO: 1275773 - RNA, 19 nt, Human
agaguagugauccucccuc

SEQ ID NO: 1275774 - RNA, 24 nt, Human
agggaaaaaguccaauuucuuuca

SEQ ID NO: 1275775 - RNA, 19 nt, Human
agggagccuccaacucagc

SEQ ID NO: 1275776 - RNA, 24 nt, Human
agggcugaaguugucacucuggug

SEQ ID NO: 1275777 - RNA, 23 nt, Human
aggggccucagaggacccaaacg

SEQ ID NO: 1275778 - RNA, 20 nt, Human
agggguaaggccagugggag

SEQ ID NO: 1275779 - RNA, 19 nt, Human
agguccuguggucucuuca

SEQ ID NO: 1275780 - RNA, 19 nt, Human
augcagcagccacuauacu

SEQ ID NO: 1275781 - RNA, 26 nt, Human
caaaggagagagaauagaggcaggga

SEQ ID NO: 1275782 - RNA, 24 nt, Human
caaauccuccagaacaacaaccac

SEQ ID NO: 1275783 - RNA, 22 nt, Human
caauggcuccuguccaaggccu

SEQ ID NO: 1275784 - RNA, 22 nt, Human
caaugugccuucucugauguuc

SEQ ID NO: 1275785 - RNA, 19 nt, Human
cacaauggcuccuguccaa

SEQ ID NO: 1275786 - RNA, 19 nt, Human
cacagugggcuacggugac

SEQ ID NO: 1275787 - RNA, 18 nt, Human
cacuauacuggcacugga

SEQ ID NO: 1275788 - RNA, 23 nt, Human
cacugcugacuucaaaacucuua

SEQ ID NO: 1275789 - RNA, 21 nt, Human
cagaacaacaaccacguccuc

SEQ ID NO: 1275790 - RNA, 19 nt, Human
cagagcucccggagccgac

SEQ ID NO: 1275791 - RNA, 19 nt, Human
cagauucaggggagccagg

SEQ ID NO: 1275792 - RNA, 21 nt, Human
cagauucaggggagccaggga

SEQ ID NO: 1275793 - RNA, 20 nt, Human
cagucaugaagcucucuauu

SEQ ID NO: 1275794 - RNA, 21 nt, Human
caucaucaguauuaaagggaa

SEQ ID NO: 1275795 - RNA, 21 nt, Human
ccaaggccuuuacuguuuccu

SEQ ID NO: 1275796 - RNA, 21 nt, Human
ccaaugcuguugccaucccca

SEQ ID NO: 1275797 - RNA, 19 nt, Human
ccagcuucagacuguucuc

SEQ ID NO: 1275798 - RNA, 26 nt, Human
cccgaagccccuccuucuucagauuc

SEQ ID NO: 1275799 - RNA, 19 nt, Human
ccuccagaacaacaaccac

SEQ ID NO: 1275800 - RNA, 19 nt, Human
ccugcacccgggccuggag

SEQ ID NO: 1275801 - RNA, 20 nt, Human
ccuguggucucuucauaacg

SEQ ID NO: 1275802 - RNA, 22 nt, Human
cuacggugacuuuuccuaaagu

SEQ ID NO: 1275803 - RNA, 23 nt, Human
cuccaacucagcccccaagaauu

SEQ ID NO: 1275804 - RNA, 22 nt, Human
cugaaacagcgucuuagcucau

SEQ ID NO: 1275805 - RNA, 23 nt, Human
cugcuccagcaccagcagcucca

SEQ ID NO: 1275806 - RNA, 24 nt, Human
cuguagcacuguugacagagcucc

SEQ ID NO: 1275807 - RNA, 18 nt, Human
gaacaacaaccacguccu

SEQ ID NO: 1275808 - RNA, 20 nt, Human
gaaggaagggguaaggccag

SEQ ID NO: 1275809 - RNA, 20 nt, Human
gacuguaucuucagagacac

SEQ ID NO: 1275810 - RNA, 20 nt, Human
gagccgacuuagugcuucuc

SEQ ID NO: 1275811 - RNA, 21 nt, Human
gagccuccaacucagccccca

SEQ ID NO: 1275812 - RNA, 25 nt, Human
gauucacugcugacuucaaaacucu

SEQ ID NO: 1275813 - RNA, 22 nt, Human
gcaaaggagagagaauagaggc

SEQ ID NO: 1275814 - RNA, 26 nt, Human
gcaaaggagagagaauagaggcaggg

SEQ ID NO: 1275815 - RNA, 27 nt, Human
gcaaaggagagagaauagaggcaggga

SEQ ID NO: 1275816 - RNA, 22 nt, Human
gcugaaguugucacucugguga

SEQ ID NO: 1275817 - RNA, 21 nt, Human
guagaguagugauccucccuc

SEQ ID NO: 1275818 - RNA, 20 nt, Human
uaacuuccgaaguauuccuc

SEQ ID NO: 1275819 - RNA, 23 nt, Human
uacaugaagcuaacccugaaggc

SEQ ID NO: 1275820 - RNA, 18 nt, Human
uagaguagugauccuccc

SEQ ID NO: 1275821 - RNA, 22 nt, Human
uagcauaucaucuacagugaaa

SEQ ID NO: 1275822 - RNA, 21 nt, Human
uaggagaaagcugcuauagca

SEQ ID NO: 1275823 - RNA, 30 nt, Human
uagugauccucccucacuacccgaagcccu

SEQ ID NO: 1275824 - RNA, 23 nt, Human
uaugcagcagccacuauacuggc

SEQ ID NO: 1275825 - RNA, 24 nt, Human
ucaaugugccuucucugauguucu

SEQ ID NO: 1275826 - RNA, 18 nt, Human
ucaggggagccagggaau

SEQ ID NO: 1275827 - RNA, 19 nt, Human
ucaucagacauuuacugaa

SEQ ID NO: 1275828 - RNA, 22 nt, Human
uccaaggccuuuacuguuuccu

SEQ ID NO: 1275829 - RNA, 19 nt, Human
uccagaacaacaaccacgu

SEQ ID NO: 1275830 - RNA, 26 nt, Human
ucccugcucucugggugaugcuccug

SEQ ID NO: 1275831 - RNA, 23 nt, Human
uccucuccaagcugacuuuauug

SEQ ID NO: 1275832 - RNA, 22 nt, Human
ucugugacauucugcuauucac

SEQ ID NO: 1275833 - RNA, 19 nt, Human
ucuuuggcuggucuggguc

SEQ ID NO: 1275834 - RNA, 23 nt, Human
ugacagagcucccggagccgacu

SEQ ID NO: 1275835 - RNA, 24 nt, Human
ugacagagcucccggagccgacuu

SEQ ID NO: 1275836 - RNA, 19 nt, Human
ugagauguccugcagugaa

SEQ ID NO: 1275837 - RNA, 21 nt, Human
ugagauguccugcagugaaga

SEQ ID NO: 1275838 - RNA, 22 nt, Human
ugagggcugaaguugucacucu

SEQ ID NO: 1275839 - RNA, 19 nt, Human
ugaggugaagccacugggg

SEQ ID NO: 1275840 - RNA, 22 nt, Human
ugccacagugggcuacggugac

SEQ ID NO: 1275841 - RNA, 20 nt, Human
ugcuauagcauauccaaaaa

SEQ ID NO: 1275842 - RNA, 25 nt, Human
uggacgccccuaauuuuaauauucu

SEQ ID NO: 1275843 - RNA, 22 nt, Human
uggucaaggggccucagaggac

SEQ ID NO: 1275844 - RNA, 21 nt, Human
ugucacucuggugauauguuu

SEQ ID NO: 1275845 - RNA, 21 nt, Human
uguccuguuucuccaagaucc

SEQ ID NO: 1275846 - RNA, 21 nt, Human
uguccuguuucuccaagaucc

SEQ ID NO: 1275847 - RNA, 21 nt, Human
uuacaugaagcuaacccugaa

SEQ ID NO: 1275848 - RNA, 22 nt, Human
uuccagaacaagcaacauuuca

SEQ ID NO: 1275849 - RNA, 18 nt, Human
uugcagaggcugagggcu

SEQ ID NO: 1275850 - RNA, 22 nt, Human
uuucuccaagauccagcugcaa

SEQ ID NO: 1275851 - RNA, 20 nt, Human
uuuggagaacuuucuuuggg

SEQ ID NO: 1275852 - RNA, 25 nt, Human
aaaaaaguaaauucuacuuuacaga

SEQ ID NO: 1275853 - RNA, 21 nt, Human
aacccugaaaaaagucagagg

SEQ ID NO: 1275854 - RNA, 19 nt, Human
aagggaacagaaaagaggg

SEQ ID NO: 1275855 - RNA, 19 nt, Human
aauaggaacccugaaaaaa

SEQ ID NO: 1275856 - RNA, 25 nt, Human
acccugaaaaaagucagagguguga

SEQ ID NO: 1275857 - RNA, 22 nt, Human
acgccacaggacaaucgcucac

SEQ ID NO: 1275858 - RNA, 19 nt, Human
agcaaguuucuuuuggguc

SEQ ID NO: 1275859 - RNA, 18 nt, Human
agucaaggcugcagcugu

SEQ ID NO: 1275860 - RNA, 22 nt, Human
aguccucugcuuuaacugucag

SEQ ID NO: 1275861 - RNA, 19 nt, Human
augggcuguaacauuucac

SEQ ID NO: 1275862 - RNA, 21 nt, Human
caaaguucccagaaucagcuc

SEQ ID NO: 1275863 - RNA, 23 nt, Human
caaaguucccagaaucagcucac

SEQ ID NO: 1275864 - RNA, 21 nt, Human
caccaggaccacacauccugg

SEQ ID NO: 1275865 - RNA, 19 nt, Human
cagaaucagcucacagccu

SEQ ID NO: 1275866 - RNA, 22 nt, Human
cagccuggguagcuggcagagc

SEQ ID NO: 1275867 - RNA, 19 nt, Human
caggacaaucgcucaccag

SEQ ID NO: 1275868 - RNA, 19 nt, Human
caggauagucaagaacugc

SEQ ID NO: 1275869 - RNA, 18 nt, Human
cauaacccugggccacaa

SEQ ID NO: 1275870 - RNA, 24 nt, Human
caucaauaggaacccugaaaaaag

SEQ ID NO: 1275871 - RNA, 22 nt, Human
ccacaaacucggucccggacgc

SEQ ID NO: 1275872 - RNA, 22 nt, Human
ccuccucuugcugcugccgcua

SEQ ID NO: 1275873 - RNA, 20 nt, Human
ccugcugaggcugauaugag

SEQ ID NO: 1275874 - RNA, 19 nt, Human
ccuggguagcuggcagagc

SEQ ID NO: 1275875 - RNA, 25 nt, Human
cgccuucauccccgaaauccugcuc

SEQ ID NO: 1275876 - RNA, 22 nt, Human
cuccuggggcccgucuuggcca

SEQ ID NO: 1275877 - RNA, 23 nt, Human
cugcuccagcaccagcaauucca

SEQ ID NO: 1275878 - RNA, 23 nt, Human
cugcuccuaaccaucaauaggaa

SEQ ID NO: 1275879 - RNA, 18 nt, Human
cuguucuccggcugaugc

SEQ ID NO: 1275880 - RNA, 18 nt, Human
cuguucuccggcugaugc

SEQ ID NO: 1275881 - RNA, 22 nt, Human
cuugcucaugaauggccuggaa

SEQ ID NO: 1275882 - RNA, 25 nt, Human
cuuucaaccacucccuuucucucga

SEQ ID NO: 1275883 - RNA, 19 nt, Human
cuuuggugugggucucugg

SEQ ID NO: 1275884 - RNA, 23 nt, Human
cuuuuuuauucccuuugagauuu

SEQ ID NO: 1275885 - RNA, 18 nt, Human
gaccuuccaucugauuca

SEQ ID NO: 1275886 - RNA, 24 nt, Human
gagcuaccucccgguugcuggagu

SEQ ID NO: 1275887 - RNA, 23 nt, Human
gaggacagcauuacgccauucug

SEQ ID NO: 1275888 - RNA, 23 nt, Human
gauucagcaugguggauuauguc

SEQ ID NO: 1275889 - RNA, 18 nt, Human
gcacacauaacccugggc

SEQ ID NO: 1275890 - RNA, 25 nt, Human
ggaguucuuccauaugaaguagccc

SEQ ID NO: 1275891 - RNA, 19 nt, Human
ggcgagaggagaggaaagg

SEQ ID NO: 1275892 - RNA, 25 nt, Human
ggcugaugcucuaacauccgggcuu

SEQ ID NO: 1275893 - RNA, 28 nt, Human
gggaacagaaaagaggguaccgguaccc

SEQ ID NO: 1275894 - RNA, 19 nt, Human
guaaagucuucuuuugcag

SEQ ID NO: 1275895 - RNA, 21 nt, Human
gugaagugcacacauaacccu

SEQ ID NO: 1275896 - RNA, 23 nt, Human
uaacauccgggcuuggagcuccu

SEQ ID NO: 1275897 - RNA, 21 nt, Human
uagcuuuuuaaaggaaauuac

SEQ ID NO: 1275898 - RNA, 22 nt, Human
uaggaacccugaaaaaagucag

SEQ ID NO: 1275899 - RNA, 22 nt, Human
uauuuuuuuaaugacaguggcc

SEQ ID NO: 1275900 - RNA, 19 nt, Human
uccccgaaauccugcuccu

SEQ ID NO: 1275901 - RNA, 20 nt, Human
uccccgaaauccugcuccua

SEQ ID NO: 1275902 - RNA, 24 nt, Human
uccucuugcugcugccgccuucau

SEQ ID NO: 1275903 - RNA, 21 nt, Human
uccugaugcuguucagccugg

SEQ ID NO: 1275904 - RNA, 19 nt, Human
ucgcucaccaggaccacac

SEQ ID NO: 1275905 - RNA, 19 nt, Human
ucucuggccucagccacug

SEQ ID NO: 1275906 - RNA, 24 nt, Human
ugaaaaaagucagaggugugaagu

SEQ ID NO: 1275907 - RNA, 18 nt, Human
ugaagugcacacauaacc

SEQ ID NO: 1275908 - RNA, 19 nt, Human
ugagaugcuccugaugcug

SEQ ID NO: 1275909 - RNA, 22 nt, Human
ugagaugcuccugaugcuguuc

SEQ ID NO: 1275910 - RNA, 22 nt, Human
ugagcaaguuucuuuuggguca

SEQ ID NO: 1275911 - RNA, 24 nt, Human
ugaggcugauaugagggaggacag

SEQ ID NO: 1275912 - RNA, 22 nt, Human
ugcuuuaaggaggcuguccuug

SEQ ID NO: 1275913 - RNA, 22 nt, Human
uggaagucugcuuuaaggaggc

SEQ ID NO: 1275914 - RNA, 23 nt, Human
uggauauucccauuuaagcuguc

SEQ ID NO: 1275915 - RNA, 25 nt, Human
uggcaaaguucccagaaucagcuca

SEQ ID NO: 1275916 - RNA, 21 nt, Human
ugguggagggggacgaaucug

SEQ ID NO: 1275917 - RNA, 23 nt, Human
uggugugggucucuggccucagc

SEQ ID NO: 1275918 - RNA, 18 nt, Human
uucacguaaagucuucuu

SEQ ID NO: 1275919 - RNA, 20 nt, Human
uucaggagauggaccuucca

SEQ ID NO: 1275920 - RNA, 22 nt, Human
uucaggagauggaccuuccauc

SEQ ID NO: 1275921 - RNA, 24 nt, Human
aaagugcugggacugcaggcguga

SEQ ID NO: 1275922 - RNA, 20 nt, Human
aacaaggccucagaagaaaa

SEQ ID NO: 1275923 - RNA, 19 nt, Human
aagugcugggacugcaggc

SEQ ID NO: 1275924 - RNA, 26 nt, Human
aagugcugggacugcaggcgugagcc

SEQ ID NO: 1275925 - RNA, 24 nt, Human
caaagugcugggacugcaggcgug

SEQ ID NO: 1275926 - RNA, 21 nt, Human
caggcgugagccaccgcgccc

SEQ ID NO: 1275927 - RNA, 22 nt, Human
ccaaagugcugggacugcaggc

SEQ ID NO: 1275928 - RNA, 24 nt, Human
ccaaagugcugggacugcaggcgu

SEQ ID NO: 1275929 - RNA, 25 nt, Human
ccaaugacagccagugguuuuaauu

SEQ ID NO: 1275930 - RNA, 24 nt, Human
cccaaagugcugggacugcaggcg

SEQ ID NO: 1275931 - RNA, 22 nt, Human
cccgucucggccucccaaagug

SEQ ID NO: 1275932 - RNA, 25 nt, Human
ccucugggugaccagaccuuggccc

SEQ ID NO: 1275933 - RNA, 24 nt, Human
cgugauccgcccgucucggccucc

SEQ ID NO: 1275934 - RNA, 21 nt, Human
cucagaggaaucccggagaaa

SEQ ID NO: 1275935 - RNA, 21 nt, Human
cugggaaugcaggaagguuuu

SEQ ID NO: 1275936 - RNA, 18 nt, Human
gacugcaggcgugagcca

SEQ ID NO: 1275937 - RNA, 21 nt, Human
gacugcaggcgugagccaccg

SEQ ID NO: 1275938 - RNA, 22 nt, Human
gacugcaggcgugagccaccgc

SEQ ID NO: 1275939 - RNA, 19 nt, Human
gcuucaauuucaccaccuc

SEQ ID NO: 1275940 - RNA, 20 nt, Human
ggcuucaauuucaccaccuc

SEQ ID NO: 1275941 - RNA, 22 nt, Human
ucaccaccucgugauccgcccg

SEQ ID NO: 1275942 - RNA, 18 nt, Human
ucccaaagugcugggacu

SEQ ID NO: 1275943 - RNA, 24 nt, Human
ucccaaagugcugggacugcaggc

SEQ ID NO: 1275944 - RNA, 20 nt, Human
ucucggccucccaaagugcu

SEQ ID NO: 1275945 - RNA, 18 nt, Human
ugggacugcaggcgugag

SEQ ID NO: 1275946 - RNA, 19 nt, Human
ugggacugcaggcgugagc

SEQ ID NO: 1275947 - RNA, 21 nt, Human
ugggacugcaggcgugagcca

SEQ ID NO: 1275948 - RNA, 23 nt, Human
ugggacugcaggcgugagccacc

SEQ ID NO: 1275949 - RNA, 24 nt, Human
ugggacugcaggcgugagccaccg

SEQ ID NO: 1275950 - RNA, 20 nt, Human
aagugggaacucugauuaaa

SEQ ID NO: 1275951 - RNA, 20 nt, Human
acaggaagcacaccugggga

SEQ ID NO: 1275952 - RNA, 18 nt, Human
accccaaaguaaaagauc

SEQ ID NO: 1275953 - RNA, 22 nt, Human
agaccagagcaguaacuaaagg

SEQ ID NO: 1275954 - RNA, 23 nt, Human
agaguuuucugauuauuucuuaa

SEQ ID NO: 1275955 - RNA, 21 nt, Human
aggaagcacaccuggggaggc

SEQ ID NO: 1275956 - RNA, 20 nt, Human
aggaauuuuugugcagguag

SEQ ID NO: 1275957 - RNA, 18 nt, Human
agguagcuaucucuugcc

SEQ ID NO: 1275958 - RNA, 22 nt, Human
aucuaucuguucugcaacaagu

SEQ ID NO: 1275959 - RNA, 24 nt, Human
aucuucuuuugaaauguccugcug

SEQ ID NO: 1275960 - RNA, 24 nt, Human
caacugaaggcuuuuccacauuca

SEQ ID NO: 1275961 - RNA, 23 nt, Human
caaguucuuccaucucuaaucuu

SEQ ID NO: 1275962 - RNA, 24 nt, Human
cacagucagugcauuuacugguau

SEQ ID NO: 1275963 - RNA, 26 nt, Human
cagagaaucucuccagugugagguuu

SEQ ID NO: 1275964 - RNA, 19 nt, Human
cagagcaguaacuaaaggc

SEQ ID NO: 1275965 - RNA, 20 nt, Human
caguaacuaaaggccuuucu

SEQ ID NO: 1275966 - RNA, 19 nt, Human
caugguggaaggugaaggg

SEQ ID NO: 1275967 - RNA, 20 nt, Human
cauucauuacauucauaggg

SEQ ID NO: 1275968 - RNA, 23 nt, Human
cauucauuacauucauaggguug

SEQ ID NO: 1275969 - RNA, 20 nt, Human
cauugaauaagaccagagca

SEQ ID NO: 1275970 - RNA, 19 nt, Human
ccacugugaauucucuggu

SEQ ID NO: 1275971 - RNA, 24 nt, Human
cccacacucacugcauuuguaggg

SEQ ID NO: 1275972 - RNA, 20 nt, Human
cccagaaucaugcucucuca

SEQ ID NO: 1275973 - RNA, 23 nt, Human
cccagaaucaugcucucuccacu

SEQ ID NO: 1275974 - RNA, 20 nt, Human
cgauccuccuucuguuuccc

SEQ ID NO: 1275975 - RNA, 21 nt, Human
cuaguaugaguuuucugguga

SEQ ID NO: 1275976 - RNA, 18 nt, Human
cugaaccacaucuauaga

SEQ ID NO: 1275977 - RNA, 21 nt, Human
cugaaggcuuuuccacaguca

SEQ ID NO: 1275978 - RNA, 21 nt, Human
cugaaggcuuuuccacauuca

SEQ ID NO: 1275979 - RNA, 23 nt, Human
cugaaggcuuuuccacauucagu

SEQ ID NO: 1275980 - RNA, 23 nt, Human
cuuccaguuuuucagaugaggaa

SEQ ID NO: 1275981 - RNA, 20 nt, Human
cuugaagaagggcagagucu

SEQ ID NO: 1275982 - RNA, 21 nt, Human
cuugagacaguggcucugucc

SEQ ID NO: 1275983 - RNA, 21 nt, Human
gaacaagugcuaaccaaucac

SEQ ID NO: 1275984 - RNA, 20 nt, Human
gaagagaacugcgcuugcau

SEQ ID NO: 1275985 - RNA, 20 nt, Human
gaggucuguacuccaacuga

SEQ ID NO: 1275986 - RNA, 18 nt, Human
gaucauucuaaguaguca

SEQ ID NO: 1275987 - RNA, 21 nt, Human
gcaguaacuaaaggccuuucu

SEQ ID NO: 1275988 - RNA, 20 nt, Human
gccuaaagauaugaagugac

SEQ ID NO: 1275989 - RNA, 28 nt, Human
gggaagcaggcaugccuuacauggcccc

SEQ ID NO: 1275990 - RNA, 21 nt, Human
guacaggaagcacaccugggg

SEQ ID NO: 1275991 - RNA, 24 nt, Human
uaaacuggccucuagauuuccaau

SEQ ID NO: 1275992 - RNA, 23 nt, Human
uaaauaagucacaauucugaacc

SEQ ID NO: 1275993 - RNA, 20 nt, Human
uaacuacuacaagcucacuu

SEQ ID NO: 1275994 - RNA, 24 nt, Human
uaagaccagagcaguaacuaaagg

SEQ ID NO: 1275995 - RNA, 24 nt, Human
uacagacuuucucuuugcaaguuc

SEQ ID NO: 1275996 - RNA, 22 nt, Human
uauuuaugacaauucucuucca

SEQ ID NO: 1275997 - RNA, 20 nt, Human
ucagagaaucucuccagugu

SEQ ID NO: 1275998 - RNA, 20 nt, Human
ucaugguggaaggugaaggg

SEQ ID NO: 1275999 - RNA, 21 nt, Human
uccacugugaauucucuggug

SEQ ID NO: 1276000 - RNA, 26 nt, Human
uccccacacucaguauguauauuuga

SEQ ID NO: 1276001 - RNA, 24 nt, Human
ucuaaugguuuccccacacucagu

SEQ ID NO: 1276002 - RNA, 24 nt, Human
ucuacacucaguacauuuacaggg

SEQ ID NO: 1276003 - RNA, 21 nt, Human
ucucuucuucugggcucuucu

SEQ ID NO: 1276004 - RNA, 21 nt, Human
ucuuggccccacguucaagcu

SEQ ID NO: 1276005 - RNA, 23 nt, Human
ugaaucacaccugauguacaaua

SEQ ID NO: 1276006 - RNA, 19 nt, Human
ugacuccuuaauaacuacu

SEQ ID NO: 1276007 - RNA, 19 nt, Human
ugagacaguggcucugucc

SEQ ID NO: 1276008 - RNA, 23 nt, Human
ugagacaguggcucuguccgaag

SEQ ID NO: 1276009 - RNA, 21 nt, Human
ugcauuuacugguaugaaggu

SEQ ID NO: 1276010 - RNA, 19 nt, Human
ugcccuagauuauucuccu

SEQ ID NO: 1276011 - RNA, 21 nt, Human
uggaaggugaaggggaagcag

SEQ ID NO: 1276012 - RNA, 24 nt, Human
uggccucuagauuuccagauuucu

SEQ ID NO: 1276013 - RNA, 24 nt, Human
uggcuaaaggcuuucccacauuca

SEQ ID NO: 1276014 - RNA, 19 nt, Human
uguagggcuuuucuccuga

SEQ ID NO: 1276015 - RNA, 22 nt, Human
uguagggcuuuucuccugaaag

SEQ ID NO: 1276016 - RNA, 20 nt, Human
uguccugcugcucuacucuu

SEQ ID NO: 1276017 - RNA, 21 nt, Human
uucccacacucacugcauuug

SEQ ID NO: 1276018 - RNA, 20 nt, Human
uucccugggaagggucucca

SEQ ID NO: 1276019 - RNA, 24 nt, Human
uucuacauucauuacauuuauagg

SEQ ID NO: 1276020 - RNA, 26 nt, Human
uucuuuguauaauuaaaucugaguuu

SEQ ID NO: 1276021 - RNA, 19 nt, Human
uuuacagggucucucucca

SEQ ID NO: 1276022 - RNA, 22 nt, Human
uuugagcaucuuucaacaugua

SEQ ID NO: 1276023 - RNA, 21 nt, Human
uuuucuccaguguugaguuau

SEQ ID NO: 1276024 - RNA, 19 nt, Human
aaccugcuccuucacucug

SEQ ID NO: 1276025 - RNA, 22 nt, Human
aaguucuccaaguacccaccgg

SEQ ID NO: 1276026 - RNA, 18 nt, Human
aggaagcuucaggacuac

SEQ ID NO: 1276027 - RNA, 23 nt, Human
aggaagcuucaggacuacaccaa

SEQ ID NO: 1276028 - RNA, 21 nt, Human
auggagcuugaguucuugagc

SEQ ID NO: 1276029 - RNA, 26 nt, Human
caaguacccaccggacucaggagccc

SEQ ID NO: 1276030 - RNA, 24 nt, Human
caccaaagaaccagaaccugcucc

SEQ ID NO: 1276031 - RNA, 19 nt, Human
caugacugcucucuacaug

SEQ ID NO: 1276032 - RNA, 18 nt, Human
cgcucugaauaaugggau

SEQ ID NO: 1276033 - RNA, 19 nt, Human
cuacaccaaagaaccagaa

SEQ ID NO: 1276034 - RNA, 22 nt, Human
cuccaaguacccaccggacuca

SEQ ID NO: 1276035 - RNA, 22 nt, Human
gacugcucucuacaugaaacau

SEQ ID NO: 1276036 - RNA, 20 nt, Human
ggagcccagcuggcuuugcc

SEQ ID NO: 1276037 - RNA, 21 nt, Human
gugaacuuucuuaggaagcuu

SEQ ID NO: 1276038 - RNA, 19 nt, Human
uccaaguacccaccggacu

SEQ ID NO: 1276039 - RNA, 19 nt, Human
uccauacgcgcucugaaua

SEQ ID NO: 1276040 - RNA, 23 nt, Human
ucuccaaguacccaccggacucu

SEQ ID NO: 1276041 - RNA, 21 nt, Human
uguugcauuguguggagugca

SEQ ID NO: 1276042 - RNA, 18 nt, Human
uucuccaaguacccaccg

SEQ ID NO: 1276043 - RNA, 21 nt, Human
aaaaaaacaggcaggcuuaga

SEQ ID NO: 1276044 - RNA, 21 nt, Human
aaaaaacuuaaucuugagcuc

SEQ ID NO: 1276045 - RNA, 19 nt, Human
aaaaacaggcaggcuuaga

SEQ ID NO: 1276046 - RNA, 26 nt, Human
aaacaaaaaacuuaaucuugagcucu

SEQ ID NO: 1276047 - RNA, 19 nt, Human
aaacuccaggcucucuggc

SEQ ID NO: 1276048 - RNA, 19 nt, Human
aacacacacacacacacac

SEQ ID NO: 1276049 - RNA, 19 nt, Human
aacauaccuagaucauaua

SEQ ID NO: 1276050 - RNA, 22 nt, Human
aagcauaugaauacaacagucu

SEQ ID NO: 1276051 - RNA, 23 nt, Human
aaggugguuucuauguccaauua

SEQ ID NO: 1276052 - RNA, 23 nt, Human
acaaacauaaaagguaugucucc

SEQ ID NO: 1276053 - RNA, 22 nt, Human
acacacacacacacacacacga

SEQ ID NO: 1276054 - RNA, 20 nt, Human
acacacgaaaagccuguaac

SEQ ID NO: 1276055 - RNA, 22 nt, Human
acuuggcaacugauugcaacau

SEQ ID NO: 1276056 - RNA, 19 nt, Human
agacacccuccuucuggug

SEQ ID NO: 1276057 - RNA, 22 nt, Human
agaucauauaaauuugugaagg

SEQ ID NO: 1276058 - RNA, 24 nt, Human
aggaguuccuccacguacucacuu

SEQ ID NO: 1276059 - RNA, 22 nt, Human
auauaaguaaacauacauucua

SEQ ID NO: 1276060 - RNA, 19 nt, Human
aucaguuucccuaguucug

SEQ ID NO: 1276061 - RNA, 20 nt, Human
augaacaucaacuauccuag

SEQ ID NO: 1276062 - RNA, 21 nt, Human
augaagaccaaauugccucca

SEQ ID NO: 1276063 - RNA, 24 nt, Human
auucccauauuuccaucuacuaug

SEQ ID NO: 1276064 - RNA, 20 nt, Human
caaaacacacacacacacac

SEQ ID NO: 1276065 - RNA, 23 nt, Human
caaacauaaaagguaugucuccc

SEQ ID NO: 1276066 - RNA, 21 nt, Human
caaacuccaugagcugauuaa

SEQ ID NO: 1276067 - RNA, 25 nt, Human
caaggucaaaacaauaguucuuugu

SEQ ID NO: 1276068 - RNA, 18 nt, Human
cacacacacacacacaca

SEQ ID NO: 1276069 - RNA, 33 nt, Human; identical to SEQ ID NO: 1165615

SEQ ID NO: 1276070 - RNA, 25 nt, Human
cacacacacgaaaagccuguaaccu

SEQ ID NO: 1276071 - RNA, 18 nt, Human
cacaguguuugaauucca

SEQ ID NO: 1276072 - RNA, 21 nt, Human
cagaaagaaaauugcugacau

SEQ ID NO: 1276073 - RNA, 24 nt, Human
cagcuaaaccuaaugaagaccaaa

SEQ ID NO: 1276074 - RNA, 24 nt, Human
ccaaauugccuccaaggucaaaac

SEQ ID NO: 1276075 - RNA, 21 nt, Human
ccaggcucucuggccuuggga

SEQ ID NO: 1276076 - RNA, 19 nt, Human
ccagggaaguggaaaaaaa

SEQ ID NO: 1276077 - RNA, 20 nt, Human
ccaucaguuucccuaguucu

SEQ ID NO: 1276078 - RNA, 25 nt, Human
cccacgacaauggauauaguugcuu

SEQ ID NO: 1276079 - RNA, 24 nt, Human
ccuacagcuaaaccuaaugaagac

SEQ ID NO: 1276080 - RNA, 18 nt, Human
cuaaaccuaaugaagacc

SEQ ID NO: 1276081 - RNA, 21 nt, Human
cuaugauacugccacucugaa

SEQ ID NO: 1276082 - RNA, 24 nt, Human
cucaagaaguauaaauuuuacaaa

SEQ ID NO: 1276083 - RNA, 22 nt, Human
cucucuggccuugggauuccag

SEQ ID NO: 1276084 - RNA, 20 nt, Human
cugaaauaucuaguguagca

SEQ ID NO: 1276085 - RNA, 20 nt, Human
cuugagcucuaguucuugac

SEQ ID NO: 1276086 - RNA, 24 nt, Human
cuuuuuuaucucaagaaguauaaa

SEQ ID NO: 1276087 - RNA, 20 nt, Human
gaacaucaacuauccuacag

SEQ ID NO: 1276088 - RNA, 19 nt, Human
gaagacaagcauaugaaua

SEQ ID NO: 1276089 - RNA, 19 nt, Human
gaccuaagacacccuccuu

SEQ ID NO: 1276090 - RNA, 21 nt, Human
ggaccuaagacacccuccuuc

SEQ ID NO: 1276091 - RNA, 24 nt, Human
guaugucucccuucaauauuuccu

SEQ ID NO: 1276092 - RNA, 23 nt, Human
uaaaacagauccucuagccagga

SEQ ID NO: 1276093 - RNA, 21 nt, Human
uaaagaaaaaguuuucuguuc

SEQ ID NO: 1276094 - RNA, 22 nt, Human
uaaguggagcaauauuauuggc

SEQ ID NO: 1276095 - RNA, 20 nt, Human
uaaugaacaucaacuauccu

SEQ ID NO: 1276096 - RNA, 21 nt, Human
uaauugaugcugcauugacgc

SEQ ID NO: 1276097 - RNA, 24 nt, Human
uacaugaacacucagcuauguaua

SEQ ID NO: 1276098 - RNA, 24 nt, Human
uaggaugugacuuggcaacugauu

SEQ ID NO: 1276099 - RNA, 18 nt, Human
uaguucagauggaucuua

SEQ ID NO: 1276100 - RNA, 18 nt, Human
uaguucagauggaucuua

SEQ ID NO: 1276101 - RNA, 22 nt, Human
uaguucagauggaucuuaccag

SEQ ID NO: 1276102 - RNA, 24 nt, Human
uaucacaguuaaaauuauaguuaa

SEQ ID NO: 1276103 - RNA, 19 nt, Human
uauuuaauagagggacacc

SEQ ID NO: 1276104 - RNA, 21 nt, Human
ucaaaacacacacacacacac

SEQ ID NO: 1276105 - RNA, 27 nt, Human
ucaaaacacacacacacacacacacga

SEQ ID NO: 1276106 - RNA, 18 nt, Human
ucacuggggucuauuguu

SEQ ID NO: 1276107 - RNA, 20 nt, Human
ucagaaagaaaauugcugac

SEQ ID NO: 1276108 - RNA, 19 nt, Human
ucaguaaguggagcaauau

SEQ ID NO: 1276109 - RNA, 22 nt, Human
uccaagcuagcugcccaucauc

SEQ ID NO: 1276110 - RNA, 21 nt, Human
uccacauuuucucuauuuuuc

SEQ ID NO: 1276111 - RNA, 25 nt, Human
ucccacgacaauggauauaguugcu

SEQ ID NO: 1276112 - RNA, 21 nt, Human
ucuauacuucaguaaguggag

SEQ ID NO: 1276113 - RNA, 24 nt, Human
ucugaaaagcugucuacauccaaa

SEQ ID NO: 1276114 - RNA, 24 nt, Human
ucuggccuugggauuccaggagga

SEQ ID NO: 1276115 - RNA, 21 nt, Human
ucuuucuuuuaucaauucucc

SEQ ID NO: 1276116 - RNA, 18 nt, Human
ugaaaaaaggauguuuua

SEQ ID NO: 1276117 - RNA, 24 nt, Human
ugaaaacauaccuagaucauauaa

SEQ ID NO: 1276118 - RNA, 24 nt, Human
ugaaagccuaaaauguaggaguuc

SEQ ID NO: 1276119 - RNA, 22 nt, Human
ugaaauaucuaguguagcacau

SEQ ID NO: 1276120 - RNA, 25 nt, Human
ugaaauaucuaguguagcacauaau

SEQ ID NO: 1276121 - RNA, 19 nt, Human
ugccucaggucaucuucau

SEQ ID NO: 1276122 - RNA, 20 nt, Human
ugcuaauugaauuacacuuc

SEQ ID NO: 1276123 - RNA, 24 nt, Human
ugcuuuuggacauccaaacuccag

SEQ ID NO: 1276124 - RNA, 26 nt, Human
uggaaaaaaaacaaaaaacaaaaaac

SEQ ID NO: 1276125 - RNA, 27 nt, Human
ugggauguacugaaaaaaggauguuuu

SEQ ID NO: 1276126 - RNA, 25 nt, Human
ugguucuccagcuugcagacaaccu

SEQ ID NO: 1276127 - RNA, 25 nt, Human
uguucccagggaaguggaaaaaaaa

SEQ ID NO: 1276128 - RNA, 20 nt, Human
uucaauauuuccucuuaaug

SEQ ID NO: 1276129 - RNA, 19 nt, Human
uucaauuuccuuucuuuuc

SEQ ID NO: 1276130 - RNA, 21 nt, Human
uuccuccacguacucacuuca

SEQ ID NO: 1276131 - RNA, 22 nt, Human
uucuguucaucucuauacuuca

SEQ ID NO: 1276132 - RNA, 21 nt, Human
uuggacauccaaacuccaggc

SEQ ID NO: 1276133 - RNA, 18 nt, Human
aaccaagacacucugcag

SEQ ID NO: 1276134 - RNA, 22 nt, Human
aagguggcaccaaacucaaaca

SEQ ID NO: 1276135 - RNA, 21 nt, Human
acugcaacguuauucucucaa

SEQ ID NO: 1276136 - RNA, 18 nt, Human
aggaaaaaucaggcugga

SEQ ID NO: 1276137 - RNA, 20 nt, Human
aggaaaaaucaggcuggaaa

SEQ ID NO: 1276138 - RNA, 19 nt, Human
aggaaggcuggcucuggcu

SEQ ID NO: 1276139 - RNA, 24 nt, Human
aggcuggaaaagaacgggcaaggu

SEQ ID NO: 1276140 - RNA, 18 nt, Human
auacacuuuucuacaccc

SEQ ID NO: 1276141 - RNA, 18 nt, Human
auggguuuaacauccacc

SEQ ID NO: 1276142 - RNA, 20 nt, Human
auuuguugggugggaacaca

SEQ ID NO: 1276143 - RNA, 19 nt, Human
caaagcucauaacacagca

SEQ ID NO: 1276144 - RNA, 21 nt, Human
caagacacucugcagagccaa

SEQ ID NO: 1276145 - RNA, 23 nt, Human
caguaaagugcuucagugugugc

SEQ ID NO: 1276146 - RNA, 18 nt, Human
cagugugugccuguagcu

SEQ ID NO: 1276147 - RNA, 22 nt, Human
ccaaggagugcugggucuaagg

SEQ ID NO: 1276148 - RNA, 22 nt, Human
cucacagugaucucgauccugg

SEQ ID NO: 1276149 - RNA, 18 nt, Human
cucugcuuccauacuugc

SEQ ID NO: 1276150 - RNA, 24 nt, Human
cugcagagccaauccaaggagugc

SEQ ID NO: 1276151 - RNA, 18 nt, Human
cuuaacuccacaaccacu

SEQ ID NO: 1276152 - RNA, 23 nt, Human
cuuaucacauuuguuggguggga

SEQ ID NO: 1276153 - RNA, 21 nt, Human
cuucccaugcaggaaaaauca

SEQ ID NO: 1276154 - RNA, 20 nt, Human
gaaaagaacgggcaauuggc

SEQ ID NO: 1276155 - RNA, 22 nt, Human
gagccaauccaaggagugcugg

SEQ ID NO: 1276156 - RNA, 21 nt, Human
gcugcagagaguuugaggagg

SEQ ID NO: 1276157 - RNA, 18 nt, Human
ggaacacaucugugcccc

SEQ ID NO: 1276158 - RNA, 21 nt, Human
gguuuaacauccaccaaugac

SEQ ID NO: 1276159 - RNA, 20 nt, Human
guucacuauuccugucugcu

SEQ ID NO: 1276160 - RNA, 22 nt, Human
uaaaggggccaauaagguggca

SEQ ID NO: 1276161 - RNA, 24 nt, Human
uaacacagcacucagaacguuuua

SEQ ID NO: 1276162 - RNA, 24 nt, Human
uacaguggugagcaauaauaguga

SEQ ID NO: 1276163 - RNA, 23 nt, Human
uagcaggcagcaguugaaaggaa

SEQ ID NO: 1276164 - RNA, 24 nt, Human
uaucacauuuguugggugggaaca

SEQ ID NO: 1276165 - RNA, 24 nt, Human
ucaaccaagacacucugcagagcc

SEQ ID NO: 1276166 - RNA, 21 nt, Human
ucccuguaauucuucuagcuu

SEQ ID NO: 1276167 - RNA, 24 nt, Human
uccuauggaauaauugaaugaaua

SEQ ID NO: 1276168 - RNA, 22 nt, Human
ucucaaccaagacacucugcag

SEQ ID NO: 1276169 - RNA, 25 nt, Human
ucucaaccaagacacucugcagagc

SEQ ID NO: 1276170 - RNA, 22 nt, Human
ucuucccaugcaggaaaaauca

SEQ ID NO: 1276171 - RNA, 22 nt, Human
ugacaagcacuugcccaguaga

SEQ ID NO: 1276172 - RNA, 19 nt, Human
ugaggagguguccaugggg

SEQ ID NO: 1276173 - RNA, 20 nt, Human
ugccaaaugagacuaccuga

SEQ ID NO: 1276174 - RNA, 19 nt, Human
uggcaccaaacucaaacaa

SEQ ID NO: 1276175 - RNA, 25 nt, Human
ugggaaggaguccauaggggucuua

SEQ ID NO: 1276176 - RNA, 24 nt, Human
uguccugggaagggaaccucaggg

SEQ ID NO: 1276177 - RNA, 22 nt, Human
ugugccccauuauuaacugagu

SEQ ID NO: 1276178 - RNA, 19 nt, Human
uguugugaggauuaaagga

SEQ ID NO: 1276179 - RNA, 21 nt, Human
uucuacaccccaguuuccuua

SEQ ID NO: 1276180 - RNA, 22 nt, Human
uuugaggagguguccauggggu

SEQ ID NO: 1276181 - RNA, 18 nt, Human
aaacaagguacacaugug

SEQ ID NO: 1276182 - RNA, 21 nt, Human
aaagaaaucaagccugcccau

SEQ ID NO: 1276183 - RNA, 22 nt, Human
aagaauaauggagugacuccac

SEQ ID NO: 1276184 - RNA, 21 nt, Human
aagagcacucaucagucauuc

SEQ ID NO: 1276185 - RNA, 20 nt, Human
aauuccuggaaaucuucccc

SEQ ID NO: 1276186 - RNA, 20 nt, Human
agacaauggagaacagccau

SEQ ID NO: 1276187 - RNA, 22 nt, Human
aggcaguagcauuuguaguggu

SEQ ID NO: 1276188 - RNA, 24 nt, Human
agguaggggacuccuuucucugca

SEQ ID NO: 1276189 - RNA, 18 nt, Human
aguuuucagacaacaguu

SEQ ID NO: 1276190 - RNA, 21 nt, Human
aucacugucuuucacuguauu

SEQ ID NO: 1276191 - RNA, 24 nt, Human
cacuguauugccaugauucacacc

SEQ ID NO: 1276192 - RNA, 23 nt, Human
caguaguaacccagggaugacuu

SEQ ID NO: 1276193 - RNA, 21 nt, Human
cccccuuuuguuccaaguccc

SEQ ID NO: 1276194 - RNA, 23 nt, Human
cccuuuuguuccaagucccggag

SEQ ID NO: 1276195 - RNA, 21 nt, Human
ccgcugcaguccacgaggcgu

SEQ ID NO: 1276196 - RNA, 20 nt, Human
ccuggaaaucuuccccaucc

SEQ ID NO: 1276197 - RNA, 20 nt, Human
cuggaaaucuuccccauccg

SEQ ID NO: 1276198 - RNA, 25 nt, Human
cuggcucucuucuucccauugaucc

SEQ ID NO: 1276199 - RNA, 18 nt, Human
cuuacucucuguuucugu

SEQ ID NO: 1276200 - RNA, 18 nt, Human
cuugugauaaugcuucag

SEQ ID NO: 1276201 - RNA, 23 nt, Human
gaaaucuuccccauccagggcac

SEQ ID NO: 1276202 - RNA, 20 nt, Human
gaacagccauccaugggucg

SEQ ID NO: 1276203 - RNA, 22 nt, Human
gaaccauacuguugcaaacaag

SEQ ID NO: 1276204 - RNA, 22 nt, Human
gacaauggagaacagccaucca

SEQ ID NO: 1276205 - RNA, 23 nt, Human
gacuuggugacggaaaagaaggc

SEQ ID NO: 1276206 - RNA, 19 nt, Human
gagaggggaggaaagagag

SEQ ID NO: 1276207 - RNA, 20 nt, Human
gcaaaguugcgagagggaga

SEQ ID NO: 1276208 - RNA, 18 nt, Human
ggagaggggaggaaagag

SEQ ID NO: 1276209 - RNA, 20 nt, Human
ggcggcaaaguugcgagagg

SEQ ID NO: 1276210 - RNA, 23 nt, Human
ggcguucggacacuuuuucccgg

SEQ ID NO: 1276211 - RNA, 22 nt, Human
gggaaacaaaaugagacucaag

SEQ ID NO: 1276212 - RNA, 26 nt, Human
gggaggaaagagaguucaucagaguu

SEQ ID NO: 1276213 - RNA, 18 nt, Human
guugcagauuacauguua

SEQ ID NO: 1276214 - RNA, 20 nt, Human
uacaugcuugggcuuuuugg

SEQ ID NO: 1276215 - RNA, 21 nt, Human
uagaaucagaagcaaggagac

SEQ ID NO: 1276216 - RNA, 25 nt, Human
uagaaucagaagcaaggagacacag

SEQ ID NO: 1276217 - RNA, 19 nt, Human
uagcauuuguagugguucc

SEQ ID NO: 1276218 - RNA, 24 nt, Human
uccacagcuccauuagccacuucc

SEQ ID NO: 1276219 - RNA, 19 nt, Human
uccauuagccacuuccuuc

SEQ ID NO: 1276220 - RNA, 18 nt, Human
uccgggggagaggggagg

SEQ ID NO: 1276221 - RNA, 25 nt, Human
uccucuggguuuuccaugcgugugg

SEQ ID NO: 1276222 - RNA, 18 nt, Human
uccuggcuggcucucuuc

SEQ ID NO: 1276223 - RNA, 21 nt, Human
ucuguuucugucaucucuccc

SEQ ID NO: 1276224 - RNA, 23 nt, Human
ucuucugucuguuuguuuugagg

SEQ ID NO: 1276225 - RNA, 21 nt, Human
ugagaaggauguucaguagua

SEQ ID NO: 1276226 - RNA, 21 nt, Human
uggcgugcuucgggcagggcu

SEQ ID NO: 1276227 - RNA, 23 nt, Human
uguaagccguucucucuucucuc

SEQ ID NO: 1276228 - RNA, 21 nt, Human
ugucuugugauaaugcuucag

SEQ ID NO: 1276229 - RNA, 22 nt, Human
uguuucugucaucucuccccca

SEQ ID NO: 1276230 - RNA, 23 nt, Human
uucacuguauugccaugauucac

SEQ ID NO: 1276231 - RNA, 24 nt, Human
uuccucuggguuuuccaugcgugu

SEQ ID NO: 1276232 - RNA, 19 nt, Human
uuccuggaaaucuucccca

SEQ ID NO: 1276233 - RNA, 21 nt, Human
uucuggucuccagaaccauac

SEQ ID NO: 1276234 - RNA, 21 nt, Human
uugcuggauuccucuuggcag

SEQ ID NO: 1276235 - RNA, 20 nt, Human
uuuccuuuuuaucugucagg

SEQ ID NO: 1276236 - RNA, 20 nt, Human
uuucucagaaacuuucaaau

SEQ ID NO: 1276237 - RNA, 22 nt, Human
uuucugucaucucucccccaca

SEQ ID NO: 1276238 - RNA, 21 nt, Human
uuugcuggauuccucuuggca

SEQ ID NO: 1276239 - RNA, 22 nt, Human
uuuguagugguuccuaagcaug

SEQ ID NO: 1276240 - RNA, 20 nt, Human
uuuucucagaaacuuucaaa

SEQ ID NO: 1276241 - RNA, 22 nt, Human
aaacagaagaagauauauacag

SEQ ID NO: 1276242 - RNA, 24 nt, Human
aaaccagucugagaccaaaccaca

SEQ ID NO: 1276243 - RNA, 22 nt, Human
aaagcaaauacugcauguucuc

SEQ ID NO: 1276244 - RNA, 20 nt, Human
aaagugauucucaugccuca

SEQ ID NO: 1276245 - RNA, 24 nt, Human
aaagugcugagaugauaaguguga

SEQ ID NO: 1276246 - RNA, 19 nt, Human
aaagugcuggaauuauagg

SEQ ID NO: 1276247 - RNA, 24 nt, Human
aaagugcuggaauuauaggcauga

SEQ ID NO: 1276248 - RNA, 18 nt, Human
aacaaucccuguguccca

SEQ ID NO: 1276249 - RNA, 19 nt, Human
aacagcucugcuguaaugu

SEQ ID NO: 1276250 - RNA, 19 nt, Human
aaccacagaccuggagccu

SEQ ID NO: 1276251 - RNA, 21 nt, Human
aaccacagucacaaagauuua

SEQ ID NO: 1276252 - RNA, 19 nt, Human
aaccagucugagaccaaac

SEQ ID NO: 1276253 - RNA, 23 nt, Human
aacccuaacacagggauagaaaa

SEQ ID NO: 1276254 - RNA, 20 nt, Human
aacuaaacucccgggaagua

SEQ ID NO: 1276255 - RNA, 23 nt, Human
aagaaaaacagguaaaaucccag

SEQ ID NO: 1276256 - RNA, 21 nt, Human
aagcaaauacugcauguucuc

SEQ ID NO: 1276257 - RNA, 26 nt, Human
aagugcuggaauuauaggcaugagcc

SEQ ID NO: 1276258 - RNA, 23 nt, Human
aaugaugagacuacguggaaaga

SEQ ID NO: 1276259 - RNA, 24 nt, Human
aaugcauucauuucuugaccaccu

SEQ ID NO: 1276260 - RNA, 21 nt, Human
aauuauaggcaugagccacua

SEQ ID NO: 1276261 - RNA, 22 nt, Human
aauuauaggcaugagccacuac

SEQ ID NO: 1276262 - RNA, 19 nt, Human
acaacucacugaaggaggu

SEQ ID NO: 1276263 - RNA, 18 nt, Human
acagugguuuguugauug

SEQ ID NO: 1276264 - RNA, 23 nt, Human
accauguuggucaggcuggucuc

SEQ ID NO: 1276265 - RNA, 19 nt, Human
acccaggcuggagugcagu

SEQ ID NO: 1276266 - RNA, 23 nt, Human
accucagccucccaaagugcugg

SEQ ID NO: 1276267 - RNA, 20 nt, Human
acuuccugaguagcugggac

SEQ ID NO: 1276268 - RNA, 19 nt, Human
agacaaaauguuuagaaau

SEQ ID NO: 1276269 - RNA, 19 nt, Human
agccacuacgcccauccug

SEQ ID NO: 1276270 - RNA, 22 nt, Human
agcguuucaccauguuggucag

SEQ ID NO: 1276271 - RNA, 23 nt, Human
agcguuucaccauguuggucagg

SEQ ID NO: 1276272 - RNA, 21 nt, Human
aggcaugagccacuacgccca

SEQ ID NO: 1276273 - RNA, 25 nt, Human
aggcuggagugcaguggcgcgaucu

SEQ ID NO: 1276274 - RNA, 21 nt, Human
agggcagucaggaacacucaa

SEQ ID NO: 1276275 - RNA, 19 nt, Human
aggggucaggguaguaggu

SEQ ID NO: 1276276 - RNA, 18 nt, Human
aguagagauggggucuca

SEQ ID NO: 1276277 - RNA, 19 nt, Human
aguagcugggacuacaagc

SEQ ID NO: 1276278 - RNA, 20 nt, Human
agucuuugaauuucuuccug

SEQ ID NO: 1276279 - RNA, 19 nt, Human
agugauccacccaccucag

SEQ ID NO: 1276280 - RNA, 21 nt, Human
agugcaguggcgcgaucucag

SEQ ID NO: 1276281 - RNA, 23 nt, Human
agugcaguggcgcgaucucagcu

SEQ ID NO: 1276282 - RNA, 24 nt, Human
agugcaguggcgcgaucucagcuc

SEQ ID NO: 1276283 - RNA, 23 nt, Human
aguugcugaaggucaaggaggcc

SEQ ID NO: 1276284 - RNA, 18 nt, Human
auagaaaagcaaauacug

SEQ ID NO: 1276285 - RNA, 24 nt, Human
auagcguuucaccauguuggucag

SEQ ID NO: 1276286 - RNA, 24 nt, Human
auagcucauugcagccccagucuc

SEQ ID NO: 1276287 - RNA, 21 nt, Human
auccucuuccuccuccugcca

SEQ ID NO: 1276288 - RNA, 22 nt, Human
augaaaaaccagucugagacca

SEQ ID NO: 1276289 - RNA, 22 nt, Human
augccucagccuccugagcagc

SEQ ID NO: 1276290 - RNA, 19 nt, Human
auggggucucauuauguug

SEQ ID NO: 1276291 - RNA, 24 nt, Human
auggggucucauuauguuguccag

SEQ ID NO: 1276292 - RNA, 20 nt, Human
auguuguccaggcuggucuc

SEQ ID NO: 1276293 - RNA, 25 nt, Human
auuuuuaguagagauggggucucau

SEQ ID NO: 1276294 - RNA, 24 nt, Human
auuuuuauauuuuuaguagagaua

SEQ ID NO: 1276295 - RNA, 25 nt, Human
caaacuccugagcucaagcgauccu

SEQ ID NO: 1276296 - RNA, 24 nt, Human
caaagugcugagaugauaagugug

SEQ ID NO: 1276297 - RNA, 24 nt, Human
caaagugcuggaauuauaggcaug

SEQ ID NO: 1276298 - RNA, 19 nt, Human
caacaaucccuguguccca

SEQ ID NO: 1276299 - RNA, 23 nt, Human
caacaaucccugugucccaaaac

SEQ ID NO: 1276300 - RNA, 20 nt, Human
caagagauucuccuaccuuu

SEQ ID NO: 1276301 - RNA, 21 nt, Human
cacaccacuggaagaaaaaca

SEQ ID NO: 1276302 - RNA, 21 nt, Human
caccauguuggucaggcuggu

SEQ ID NO: 1276303 - RNA, 24 nt, Human
caccauguuggucaggcuggucuc

SEQ ID NO: 1276304 - RNA, 22 nt, Human
cacccaccucagccucccaaag

SEQ ID NO: 1276305 - RNA, 23 nt, Human
cacccaccucagccucccaaagu

SEQ ID NO: 1276306 - RNA, 19 nt, Human
cacccaggcuagugugcag

SEQ ID NO: 1276307 - RNA, 24 nt, Human
cacccaggcuggagugcaguggcg

SEQ ID NO: 1276308 - RNA, 23 nt, Human
cacgcaccaucacacccagcuaa

SEQ ID NO: 1276309 - RNA, 21 nt, Human
cacuacaaccuccgccuccca

SEQ ID NO: 1276310 - RNA, 21 nt, Human
cagccccagucucaggcucaa

SEQ ID NO: 1276311 - RNA, 18 nt, Human
cagcugagauuacaggug

SEQ ID NO: 1276312 - RNA, 23 nt, Human
cagggcucuggggugaaaccaaa

SEQ ID NO: 1276313 - RNA, 24 nt, Human
cagggucuugcucugucacccagg

SEQ ID NO: 1276314 - RNA, 22 nt, Human
caucaccaggaacagcucugcu

SEQ ID NO: 1276315 - RNA, 24 nt, Human
ccaaagugcuggaauuauaggcau

SEQ ID NO: 1276316 - RNA, 26 nt, Human
ccacccaccucagccucccaaagugc

SEQ ID NO: 1276317 - RNA, 21 nt, Human
ccauugugccuggccuagaac

SEQ ID NO: 1276318 - RNA, 19 nt, Human
cccaccacauuaaggccau

SEQ ID NO: 1276319 - RNA, 23 nt, Human
cccaggcuagugugcaguggcau

SEQ ID NO: 1276320 - RNA, 23 nt, Human
cccauccugcauauuguuaaaaa

SEQ ID NO: 1276321 - RNA, 21 nt, Human
cccugaccucaggcugccugc

SEQ ID NO: 1276322 - RNA, 21 nt, Human
cccugugucccaaaacaacac

SEQ ID NO: 1276323 - RNA, 20 nt, Human
ccuaacauauuggccacaca

SEQ ID NO: 1276324 - RNA, 18 nt, Human
ccucaacagggcauagaa

SEQ ID NO: 1276325 - RNA, 24 nt, Human
ccugaccucaagugauccacccac

SEQ ID NO: 1276326 - RNA, 18 nt, Human
ccugaccucaggcugccu

SEQ ID NO: 1276327 - RNA, 20 nt, Human
ccugagcucaagcgauccuc

SEQ ID NO: 1276328 - RNA, 19 nt, Human
ccugaguagcugggacuac

SEQ ID NO: 1276329 - RNA, 24 nt, Human
ccugcauauuguuaaaaaacaaag

SEQ ID NO: 1276330 - RNA, 24 nt, Human
cgcucugccacccaggcuggagug

SEQ ID NO: 1276331 - RNA, 18 nt, Human
cguggaaagaaccacaga

SEQ ID NO: 1276332 - RNA, 22 nt, Human
cuaaacucccgggaaguaacgu

SEQ ID NO: 1276333 - RNA, 24 nt, Human
cucaagagauucuccuaccuuuac

SEQ ID NO: 1276334 - RNA, 27 nt, Human
cucaagcgauccucuuccuccuccugc

SEQ ID NO: 1276335 - RNA, 24 nt, Human
cucaagugauccacccaccucagc

SEQ ID NO: 1276336 - RNA, 24 nt, Human
cucacuacaaccuccgccucccag

SEQ ID NO: 1276337 - RNA, 19 nt, Human
cucccaggguaaagugauu

SEQ ID NO: 1276338 - RNA, 22 nt, Human
cuccuggauaccuuaaagaaaa

SEQ ID NO: 1276339 - RNA, 22 nt, Human
cucuggggugaaaccaaaacag

SEQ ID NO: 1276340 - RNA, 18 nt, Human
cucugucacccaggcuag

SEQ ID NO: 1276341 - RNA, 23 nt, Human
cucugucacccaggcuagugugc

SEQ ID NO: 1276342 - RNA, 18 nt, Human
cugagcagcugagauuac

SEQ ID NO: 1276343 - RNA, 21 nt, Human
cugagcagcugagauuacagg

SEQ ID NO: 1276344 - RNA, 23 nt, Human
cugagcccuuucaaggugggaca

SEQ ID NO: 1276345 - RNA, 21 nt, Human
cugaggguaagaagaacuuau

SEQ ID NO: 1276346 - RNA, 22 nt, Human
cugccugcagagaacacaacua

SEQ ID NO: 1276347 - RNA, 22 nt, Human
cugccuuaaaaacagaagaaga

SEQ ID NO: 1276348 - RNA, 20 nt, Human
cuggagccucucagaaggug

SEQ ID NO: 1276349 - RNA, 23 nt, Human
cuggagccucucagaagguggag

SEQ ID NO: 1276350 - RNA, 22 nt, Human
cuuccugccuuaaaaacagaag

SEQ ID NO: 1276351 - RNA, 21 nt, Human
cuucuaguugcugaaggucaa

SEQ ID NO: 1276352 - RNA, 29 nt, Human
gaaaaacagguaaaaucccagaugccugg

SEQ ID NO: 1276353 - RNA, 24 nt, Human
gaccucaagugauccacccaccuc

SEQ ID NO: 1276354 - RNA, 24 nt, Human
gaguagcugggacuacaagcacgc

SEQ ID NO: 1276355 - RNA, 18 nt, Human
gauuacaggugccugcca

SEQ ID NO: 1276356 - RNA, 21 nt, Human
gauucucaugccucagccucc

SEQ ID NO: 1276357 - RNA, 19 nt, Human
gcaagggcagucaggaaca

SEQ ID NO: 1276358 - RNA, 19 nt, Human
gcacgcaccaucacaccca

SEQ ID NO: 1276359 - RNA, 20 nt, Human
gcauaaucauagcucauugc

SEQ ID NO: 1276360 - RNA, 21 nt, Human
gccuccugagcagcugagauu

SEQ ID NO: 1276361 - RNA, 25 nt, Human
gcucugccacccaggcuggagugca

SEQ ID NO: 1276362 - RNA, 19 nt, Human
gcuggagugcaguggcgcg

SEQ ID NO: 1276363 - RNA, 23 nt, Human
gcuggucucaaacuccugaccuc

SEQ ID NO: 1276364 - RNA, 21 nt, Human
ggaaagaaccacagaccugga

SEQ ID NO: 1276365 - RNA, 21 nt, Human
ggccugggggccggggcaagg

SEQ ID NO: 1276366 - RNA, 24 nt, Human
ggcuggucucaaacuccugaccuc

SEQ ID NO: 1276367 - RNA, 20 nt, Human
gggcacaccacuggaagaaa

SEQ ID NO: 1276368 - RNA, 18 nt, Human
gguacuuaucagcuagua

SEQ ID NO: 1276369 - RNA, 24 nt, Human
ggucucauuauguuguccaggcug

SEQ ID NO: 1276370 - RNA, 24 nt, Human
gugauccacccaccucagccuccc

SEQ ID NO: 1276371 - RNA, 23 nt, Human
gugauucucaugccucagccucc

SEQ ID NO: 1276372 - RNA, 18 nt, Human
guuccuauguuuuccaua

SEQ ID NO: 1276373 - RNA, 23 nt, Human
uaaagugauucucaugccucagc

SEQ ID NO: 1276374 - RNA, 25 nt, Human
uaaaugcaacaaucccuguguccca

SEQ ID NO: 1276375 - RNA, 20 nt, Human
uaacacagggauagaaaagc

SEQ ID NO: 1276376 - RNA, 26 nt, Human
uaacagaucacgcaucaccaggaacc

SEQ ID NO: 1276377 - RNA, 23 nt, Human
uaagaagaacuuaugcaugaaaa

SEQ ID NO: 1276378 - RNA, 18 nt, Human
uaagugucaagaacucuu

SEQ ID NO: 1276379 - RNA, 24 nt, Human
uaauuuuuauauuuuuaguagaga

SEQ ID NO: 1276380 - RNA, 21 nt, Human
uaccaugugaccaaucagaau

SEQ ID NO: 1276381 - RNA, 22 nt, Human
uagagauagcguuucaccaugu

SEQ ID NO: 1276382 - RNA, 24 nt, Human
uagcguuucaccauguuggucagg

SEQ ID NO: 1276383 - RNA, 24 nt, Human
uaguagagauagcguuucaccaug

SEQ ID NO: 1276384 - RNA, 24 nt, Human
uaguagagauggggucucauuaug

SEQ ID NO: 1276385 - RNA, 23 nt, Human
uauguuguccaggcuggucucaa

SEQ ID NO: 1276386 - RNA, 24 nt, Human
uauguuguccaggcuggucucaaa

SEQ ID NO: 1276387 - RNA, 24 nt, Human
ucaaagugcugagaugauaagugu

SEQ ID NO: 1276388 - RNA, 20 nt, Human
ucaagugauccacccaccuc

SEQ ID NO: 1276389 - RNA, 18 nt, Human
ucacuacaaccuccgccu

SEQ ID NO: 1276390 - RNA, 19 nt, Human
ucacuacaaccuccgccuc

SEQ ID NO: 1276391 - RNA, 24 nt, Human
ucacuacaaccuccgccucccagg

SEQ ID NO: 1276392 - RNA, 27 nt, Human
ucacuacaaccuccgccucccagggua

SEQ ID NO: 1276393 - RNA, 21 nt, Human
ucagaaugcguggcccaccac

SEQ ID NO: 1276394 - RNA, 18 nt, Human
ucagccucccaaagugcu

SEQ ID NO: 1276395 - RNA, 27 nt, Human
ucagcucacuacaaccuccgccuccca

SEQ ID NO: 1276396 - RNA, 18 nt, Human
ucaggaacacucaaaggg

SEQ ID NO: 1276397 - RNA, 20 nt, Human
ucaguuuuccauccauaguc

SEQ ID NO: 1276398 - RNA, 21 nt, Human
uccacaauguggcggagaggg

SEQ ID NO: 1276399 - RNA, 21 nt, Human
uccacccaccucagccuccca

SEQ ID NO: 1276400 - RNA, 22 nt, Human
ucccaaaacaacacucuuuacc

SEQ ID NO: 1276401 - RNA, 24 nt, Human
ucccaaagugcuggaauuauaggc

SEQ ID NO: 1276402 - RNA, 19 nt, Human
ucccaggguaaagugauuc

SEQ ID NO: 1276403 - RNA, 20 nt, Human
uccucaagauucacaaaaag

SEQ ID NO: 1276404 - RNA, 18 nt, Human
uccugaguagcugggacu

SEQ ID NO: 1276405 - RNA, 24 nt, Human
ucgcucugccacccaggcuggagu

SEQ ID NO: 1276406 - RNA, 23 nt, Human
ucucaaacuccugagcucaagcg

SEQ ID NO: 1276407 - RNA, 21 nt, Human
ucucaggcucaagagauucuc

SEQ ID NO: 1276408 - RNA, 23 nt, Human
ucucauuauguuguccaggcugg

SEQ ID NO: 1276409 - RNA, 24 nt, Human
ucucauuauguuguccaggcuggu

SEQ ID NO: 1276410 - RNA, 23 nt, Human
ucucgcucugccacccaggcugg

SEQ ID NO: 1276411 - RNA, 24 nt, Human
ucucgcucugccacccaggcugga

SEQ ID NO: 1276412 - RNA, 26 nt, Human
ucucgcucugccacccaggcuggagu

SEQ ID NO: 1276413 - RNA, 27 nt, Human
ucucgcucugccacccaggcuggagug

SEQ ID NO: 1276414 - RNA, 24 nt, Human
ucugccacccaggcuggagugcag

SEQ ID NO: 1276415 - RNA, 24 nt, Human
ucugucacccaggcuagugugcag

SEQ ID NO: 1276416 - RNA, 19 nt, Human
ucuugcucugucacccagg

SEQ ID NO: 1276417 - RNA, 22 nt, Human
ucuugcucugucacccaggcua

SEQ ID NO: 1276418 - RNA, 23 nt, Human
ucuugcucugucacccaggcuag

SEQ ID NO: 1276419 - RNA, 27 nt, Human
ucuugcucugucacccaggcuagugug

SEQ ID NO: 1276420 - RNA, 23 nt, Human
ugaaaaaccagucugagaccaaa

SEQ ID NO: 1276421 - RNA, 20 nt, Human
ugaaaacccuaacacaggga

SEQ ID NO: 1276422 - RNA, 22 nt, Human
ugaaaacccuaacacagggaua

SEQ ID NO: 1276423 - RNA, 22 nt, Human
ugaaaccaaaacagugguuugu

SEQ ID NO: 1276424 - RNA, 22 nt, Human
ugagaccaaaccacagucacaa

SEQ ID NO: 1276425 - RNA, 23 nt, Human
ugagaccaaaccacagucacaaa

SEQ ID NO: 1276426 - RNA, 21 nt, Human
ugagaugauaagugugagcca

SEQ ID NO: 1276427 - RNA, 24 nt, Human
ugagaugauaagugugagccauug

SEQ ID NO: 1276428 - RNA, 19 nt, Human
ugagauuacaggugccugc

SEQ ID NO: 1276429 - RNA, 21 nt, Human
ugagauuacaggugccugcca

SEQ ID NO: 1276430 - RNA, 21 nt, Human
ugagauuacaggugccugcca

SEQ ID NO: 1276431 - RNA, 22 nt, Human
ugagauuacaggugccugccau

SEQ ID NO: 1276432 - RNA, 24 nt, Human
ugagcagcugagauuacaggugcc

SEQ ID NO: 1276433 - RNA, 21 nt, Human
ugagcucaagcgauccucuuc

SEQ ID NO: 1276434 - RNA, 24 nt, Human
ugauccacccaccucagccuccca

SEQ ID NO: 1276435 - RNA, 22 nt, Human
ugcaugaaaaaccagucugaga

SEQ ID NO: 1276436 - RNA, 22 nt, Human
ugccucagccuccugagcagcu

SEQ ID NO: 1276437 - RNA, 24 nt, Human
ugccucagccuccugagcagcuga

SEQ ID NO: 1276438 - RNA, 21 nt, Human
ugccuggcuauuuuguuauca

SEQ ID NO: 1276439 - RNA, 20 nt, Human
uggaaagaaccacagaccug

SEQ ID NO: 1276440 - RNA, 18 nt, Human
uggaauuauaggcaugag

SEQ ID NO: 1276441 - RNA, 21 nt, Human
uggaauuauaggcaugagcca

SEQ ID NO: 1276442 - RNA, 22 nt, Human
uggaauuauaggcaugagccac

SEQ ID NO: 1276443 - RNA, 22 nt, Human
uggaauuauaggcaugagccac

SEQ ID NO: 1276444 - RNA, 24 nt, Human
uggaauuauaggcaugagccacua

SEQ ID NO: 1276445 - RNA, 24 nt, Human
uggaauuauaggcaugagccacua

SEQ ID NO: 1276446 - RNA, 20 nt, Human
uggaggagggagaggaucag

SEQ ID NO: 1276447 - RNA, 21 nt, Human
uggagggacuguuuaauaaug

SEQ ID NO: 1276448 - RNA, 23 nt, Human
uggagugcaguggcgcgaucuca

SEQ ID NO: 1276449 - RNA, 24 nt, Human
uggagugcaguggcgcgaucucag

SEQ ID NO: 1276450 - RNA, 24 nt, Human
uggcgcgaucucagcucacuacaa

SEQ ID NO: 1276451 - RNA, 21 nt, Human
ugggacuacaagcacgcacca

SEQ ID NO: 1276452 - RNA, 26 nt, Human
ugggacuacaagcacgcaccaucaca

SEQ ID NO: 1276453 - RNA, 19 nt, Human
ugggcuuuuuguuuuuugu

SEQ ID NO: 1276454 - RNA, 24 nt, Human
uggggucucauuauguuguccagg

SEQ ID NO: 1276455 - RNA, 21 nt, Human
uggggugaaaccaaaacagug

SEQ ID NO: 1276456 - RNA, 24 nt, Human
uggucaggcuggucucaaacuccu

SEQ ID NO: 1276457 - RNA, 21 nt, Human
ugucacccaggcuagugugca

SEQ ID NO: 1276458 - RNA, 24 nt, Human
uguccaggcuggucucaaacuccu

SEQ ID NO: 1276459 - RNA, 23 nt, Human
ugugcaguggcauaaucauagcu

SEQ ID NO: 1276460 - RNA, 27 nt, Human
uguucauuccucaagauucacaaaaag

SEQ ID NO: 1276461 - RNA, 25 nt, Human
uguuuaauaaugagucuccuggaua

SEQ ID NO: 1276462 - RNA, 18 nt, Human
uguuuuguuuuuaauuuu

SEQ ID NO: 1276463 - RNA, 24 nt, Human
uuaguagagauagcguuucaccau

SEQ ID NO: 1276464 - RNA, 18 nt, Human
uuaguagagauggggucu

SEQ ID NO: 1276465 - RNA, 20 nt, Human
uuaguagagauggggucuca

SEQ ID NO: 1276466 - RNA, 24 nt, Human
uuaguagagauggggucucauuau

SEQ ID NO: 1276467 - RNA, 19 nt, Human
uuccuauguuuuccauauu

SEQ ID NO: 1276468 - RNA, 21 nt, Human
uuccucaagauucacaaaaag

SEQ ID NO: 1276469 - RNA, 22 nt, Human
uuccucaagauucacaaaaagu

SEQ ID NO: 1276470 - RNA, 28 nt, Human
uugaccaccuauuaagugucaagaacuc

SEQ ID NO: 1276471 - RNA, 20 nt, Human
uugcugaaggucaaggaggc

SEQ ID NO: 1276472 - RNA, 22 nt, Human
uugcugaaggucaaggaggccu

SEQ ID NO: 1276473 - RNA, 22 nt, Human
uuguuccugaacuaaccucaac

SEQ ID NO: 1276474 - RNA, 20 nt, Human
uuguugcagaaaugaauaga

SEQ ID NO: 1276475 - RNA, 30 nt, Human
uuguuuuguuuuuaauuuuuaguagagaug

SEQ ID NO: 1276476 - RNA, 20 nt, Human
uuguuuuuuguuuuguuuuu

SEQ ID NO: 1276477 - RNA, 24 nt, Human
uuucaccauguuggucaggcuggu

SEQ ID NO: 1276478 - RNA, 19 nt, Human
uuuuuaauuuuuaguagag

SEQ ID NO: 1276479 - RNA, 20 nt, Human
uuuuuaauuuuuaguagaga

SEQ ID NO: 1276480 - RNA, 24 nt, Human
uuuuuaguagagauagcguuucac

SEQ ID NO: 1276481 - RNA, 20 nt, Human
uuuuuauauuuuuaguagag

SEQ ID NO: 1276482 - RNA, 21 nt, Human
caagaaucaauauuccuccca

SEQ ID NO: 1276483 - RNA, 20 nt, Human
aaaaaaaagauaaaaguaaa

SEQ ID NO: 1276484 - RNA, 25 nt, Human
aaaaaacauauccaaaguaacucaa

SEQ ID NO: 1276485 - RNA, 22 nt, Human
aaaguaacucaagaaaaaagua

SEQ ID NO: 1276486 - RNA, 19 nt, Human
aagcccacacuaucugugc

SEQ ID NO: 1276487 - RNA, 25 nt, Human
aaguaaaagcucaauauuggaccua

SEQ ID NO: 1276488 - RNA, 19 nt, Human
acagcuguuggcuuguuuu

SEQ ID NO: 1276489 - RNA, 21 nt, Human
acucaagaaaaaaguaccaug

SEQ ID NO: 1276490 - RNA, 20 nt, Human
agaagaaaaacauggcuuua

SEQ ID NO: 1276491 - RNA, 23 nt, Human
agaagaaagcuggguccaccgaa

SEQ ID NO: 1276492 - RNA, 19 nt, Human
aggugucuuaaaugccuga

SEQ ID NO: 1276493 - RNA, 20 nt, Human
agucaguaccaaugagucuc

SEQ ID NO: 1276494 - RNA, 19 nt, Human
auccugaagacccugcaac

SEQ ID NO: 1276495 - RNA, 21 nt, Human
aucgaauacgcacgagacccc

SEQ ID NO: 1276496 - RNA, 21 nt, Human
auggcauugaaaaaacauauc

SEQ ID NO: 1276497 - RNA, 24 nt, Human
caaaaacaaaagcauauuucuaac

SEQ ID NO: 1276498 - RNA, 21 nt, Human
caaaauaggcauccugaagac

SEQ ID NO: 1276499 - RNA, 23 nt, Human
caaaauaggcauccugaagaccc

SEQ ID NO: 1276500 - RNA, 21 nt, Human
caaugagucucaacaaauaac

SEQ ID NO: 1276501 - RNA, 20 nt, Human
cagaagaaagcuggguccac

SEQ ID NO: 1276502 - RNA, 23 nt, Human
caguaccaaugagucucaacaaa

SEQ ID NO: 1276503 - RNA, 21 nt, Human
ccacagugcgaggaugagguu

SEQ ID NO: 1276504 - RNA, 19 nt, Human
cccggacgaugaugugagg

SEQ ID NO: 1276505 - RNA, 18 nt, Human
cugaaacuuacauucugc

SEQ ID NO: 1276506 - RNA, 22 nt, Human
cugaaauccagacuuucagcag

SEQ ID NO: 1276507 - RNA, 22 nt, Human
cuguauauuuacugcuacucaa

SEQ ID NO: 1276508 - RNA, 22 nt, Human
gaacacccaguaggaggaaaua

SEQ ID NO: 1276509 - RNA, 24 nt, Human
gagucucaacaaauaaccuaaaua

SEQ ID NO: 1276510 - RNA, 20 nt, Human
gauuggggggggcggggggc

SEQ ID NO: 1276511 - RNA, 22 nt, Human
gcauugaaaaaacauauccaaa

SEQ ID NO: 1276512 - RNA, 20 nt, Human
gcuguauccaaaaaaaaguu

SEQ ID NO: 1276513 - RNA, 18 nt, Human
ggcgggcggugggggagg

SEQ ID NO: 1276514 - RNA, 21 nt, Human
gggcgggcggugggggaggug

SEQ ID NO: 1276515 - RNA, 18 nt, Human
ggggcggggggcgggcgg

SEQ ID NO: 1276516 - RNA, 19 nt, Human
ggggcggggggcgggcggu

SEQ ID NO: 1276517 - RNA, 22 nt, Human
gggggcggggggcgggcggugg

SEQ ID NO: 1276518 - RNA, 18 nt, Human
ggggggcggggggcgggc

SEQ ID NO: 1276519 - RNA, 21 nt, Human
ggggggcggggggcgggcggu

SEQ ID NO: 1276520 - RNA, 27 nt, Human
uaaaaaaaagauaaaaguaaauacuug

SEQ ID NO: 1276521 - RNA, 18 nt, Human
uaaaguguccuaucaccc

SEQ ID NO: 1276522 - RNA, 24 nt, Human
uacaauacaaaauaccuagaagcu

SEQ ID NO: 1276523 - RNA, 21 nt, Human
uacuauuuaccaggagagcuc

SEQ ID NO: 1276524 - RNA, 18 nt, Human
uacuugccauguucuuag

SEQ ID NO: 1276525 - RNA, 18 nt, Human
uagcaauugaaucagugc

SEQ ID NO: 1276526 - RNA, 21 nt, Human
uagugugaagcccacacuauc

SEQ ID NO: 1276527 - RNA, 21 nt, Human
uauaaacugaccuacuuuuaa

SEQ ID NO: 1276528 - RNA, 22 nt, Human
uaucauaucgccuuagaaacau

SEQ ID NO: 1276529 - RNA, 19 nt, Human
uauccaaaaaaaaguucua

SEQ ID NO: 1276530 - RNA, 20 nt, Human
uaucugguuuuuaaaugauu

SEQ ID NO: 1276531 - RNA, 19 nt, Human
uauucugugucuauagugu

SEQ ID NO: 1276532 - RNA, 20 nt, Human
uauucugugucuauagugug

SEQ ID NO: 1276533 - RNA, 21 nt, Human
ucacagaagaaaaacauggcu

SEQ ID NO: 1276534 - RNA, 27 nt, Human
ucgccuuagaaacauuucaguuuuacu

SEQ ID NO: 1276535 - RNA, 24 nt, Human
ucucaacaaauaaccuaaauauca

SEQ ID NO: 1276536 - RNA, 19 nt, Human
ucuuggguuaacuuuugag

SEQ ID NO: 1276537 - RNA, 19 nt, Human
ucuuggguuaacuuuugag

SEQ ID NO: 1276538 - RNA, 18 nt, Human
ugaaaaaacauauccaaa

SEQ ID NO: 1276539 - RNA, 21 nt, Human
ugaacgcaucgaauacgcacg

SEQ ID NO: 1276540 - RNA, 21 nt, Human
ugaagcccacacuaucugugc

SEQ ID NO: 1276541 - RNA, 23 nt, Human
ugaagucucuuuaaagucauauu

SEQ ID NO: 1276542 - RNA, 21 nt, Human
ugacaaguuuuuuugcuagug

SEQ ID NO: 1276543 - RNA, 19 nt, Human
ugagauauacagcuguugg

SEQ ID NO: 1276544 - RNA, 22 nt, Human
ugauaaauugucacagaagaaa

SEQ ID NO: 1276545 - RNA, 18 nt, Human
ugauacaauaccuaucug

SEQ ID NO: 1276546 - RNA, 18 nt, Human
ugccugagguucacugca

SEQ ID NO: 1276547 - RNA, 19 nt, Human
ugccugagguucacugcac

SEQ ID NO: 1276548 - RNA, 21 nt, Human
ugggugcacaaaucuaaaaca

SEQ ID NO: 1276549 - RNA, 18 nt, Human
uguagagacgguuuuuuc

SEQ ID NO: 1276550 - RNA, 24 nt, Human
uguucaaaaacaaaagcauauuuc

SEQ ID NO: 1276551 - RNA, 23 nt, Human
uuaaaugauuccugcuugauuga

SEQ ID NO: 1276552 - RNA, 19 nt, Human
uucaaauuuccccaucugg

SEQ ID NO: 1276553 - RNA, 22 nt, Human
uucaagugccuggaaacuaaca

SEQ ID NO: 1276554 - RNA, 25 nt, Human
uuggcuuguuuugggaccacacuuu

SEQ ID NO: 1276555 - RNA, 19 nt, Human
uuuaaaguguccuaucacc

SEQ ID NO: 1276556 - RNA, 22 nt, Human
uuuccuguuuugccaaugggug

SEQ ID NO: 1276557 - RNA, 25 nt, Human
uuucuuggcaaaauaggcauccuga

SEQ ID NO: 1276558 - RNA, 23 nt, Human
uuugaagucucuuuaaagucaua

SEQ ID NO: 1276559 - RNA, 23 nt, Human
uuuuuugaggucagugcuuuuag

SEQ ID NO: 1276560 - RNA, 20 nt, Human
aaaaagggaaaaaaaauaaa

SEQ ID NO: 1276561 - RNA, 22 nt, Human
aaaauaaaaaucccguuacaaa

SEQ ID NO: 1276562 - RNA, 25 nt, Human
aaacaagcacaagugauguguucuu

SEQ ID NO: 1276563 - RNA, 18 nt, Human
aaacaggauggggagagg

SEQ ID NO: 1276564 - RNA, 21 nt, Human
aaagagaaggcuguuguagua

SEQ ID NO: 1276565 - RNA, 22 nt, Human
aaauagcauuacuauuaaggca

SEQ ID NO: 1276566 - RNA, 22 nt, Human
aagagaaaacaauucaacuuug

SEQ ID NO: 1276567 - RNA, 22 nt, Human
aagcuacauauugcucgcucug

SEQ ID NO: 1276568 - RNA, 22 nt, Human
aagucauucaugauaaaacuga

SEQ ID NO: 1276569 - RNA, 19 nt, Human
aaucagaauugcugacacc

SEQ ID NO: 1276570 - RNA, 21 nt, Human
acccacugccacgcuccuaga

SEQ ID NO: 1276571 - RNA, 22 nt, Human
accuuccgacuugaaaaaaguu

SEQ ID NO: 1276572 - RNA, 22 nt, Human
agaaaacaauucaacuuugauc

SEQ ID NO: 1276573 - RNA, 20 nt, Human
agugauaauggagaaagucc

SEQ ID NO: 1276574 - RNA, 22 nt, Human
aguucuauaggccuuaagugac

SEQ ID NO: 1276575 - RNA, 19 nt, Human
auaaaaaucccguuacaaa

SEQ ID NO: 1276576 - RNA, 19 nt, Human
auaaagcaauauacacaac

SEQ ID NO: 1276577 - RNA, 20 nt, Human
aucuagaacacuaccuggag

SEQ ID NO: 1276578 - RNA, 20 nt, Human
caagugaauagauuagaaga

SEQ ID NO: 1276579 - RNA, 23 nt, Human
caauacaguguaaaauaguauuc

SEQ ID NO: 1276580 - RNA, 19 nt, Human
cacaagugauguguucuuu

SEQ ID NO: 1276581 - RNA, 19 nt, Human
cacccauuaauuccacauc

SEQ ID NO: 1276582 - RNA, 21 nt, Human
cacccauuaauuccacaucac

SEQ ID NO: 1276583 - RNA, 18 nt, Human
cagaaucagaauugcuga

SEQ ID NO: 1276584 - RNA, 22 nt, Human
cagaaucagaauugcugacacc

SEQ ID NO: 1276585 - RNA, 19 nt, Human
cagauacaaguuucccaaa

SEQ ID NO: 1276586 - RNA, 19 nt, Human
caguuugcuucccugauac

SEQ ID NO: 1276587 - RNA, 22 nt, Human
caucuagacuuacuaaauaauu

SEQ ID NO: 1276588 - RNA, 26 nt, Human
caugaaacuagcaauauaucguuuaa

SEQ ID NO: 1276589 - RNA, 24 nt, Human
cucuuauacagugcacauaugaau

SEQ ID NO: 1276590 - RNA, 28 nt, Human
cucuuauuagcuacuaaaaauuggaaag

SEQ ID NO: 1276591 - RNA, 22 nt, Human
cuuaagacaguucugcaaacuu

SEQ ID NO: 1276592 - RNA, 19 nt, Human
gaaacaggauggggagagg

SEQ ID NO: 1276593 - RNA, 24 nt, Human
gauaauggagaaaguccauaaaaa

SEQ ID NO: 1276594 - RNA, 21 nt, Human
gccacgcuccuagauugauug

SEQ ID NO: 1276595 - RNA, 26 nt, Human
ggacagaugagaaaauagcuuuggug

SEQ ID NO: 1276596 - RNA, 21 nt, Human
ggccuuaagugacugcuaaaa

SEQ ID NO: 1276597 - RNA, 24 nt, Human
ggggagagggauuagaaugugaca

SEQ ID NO: 1276598 - RNA, 25 nt, Human
guaaaagccugauccuauuucagaa

SEQ ID NO: 1276599 - RNA, 25 nt, Human
uaaaaaaaaaucuaaaaacuaaacu

SEQ ID NO: 1276600 - RNA, 22 nt, Human
uaaaaacuacauaauaguguua

SEQ ID NO: 1276601 - RNA, 26 nt, Human
uaaaaauaaauaucuuaaauagcauu

SEQ ID NO: 1276602 - RNA, 18 nt, Human
uaaaaaucccguuacaaa

SEQ ID NO: 1276603 - RNA, 23 nt, Human
uaaagcagcauuuaaaaacuaca

SEQ ID NO: 1276604 - RNA, 20 nt, Human
uaagaacaggaccuuccgac

SEQ ID NO: 1276605 - RNA, 22 nt, Human
uaagaguacucucuuauacagu

SEQ ID NO: 1276606 - RNA, 23 nt, Human
uacagugucacaucuaaaguucc

SEQ ID NO: 1276607 - RNA, 24 nt, Human
uagaagaucugaaauguuauaaag

SEQ ID NO: 1276608 - RNA, 23 nt, Human
uaggccuuaagugacugcuaaaa

SEQ ID NO: 1276609 - RNA, 21 nt, Human
uaguaagaacaggaccuuccg

SEQ ID NO: 1276610 - RNA, 21 nt, Human
uaguaugggaauacuuaaagu

SEQ ID NO: 1276611 - RNA, 23 nt, Human
uauacacaacgaauaaauaauuu

SEQ ID NO: 1276612 - RNA, 21 nt, Human
uauugcucgcucuguauuccc

SEQ ID NO: 1276613 - RNA, 24 nt, Human
ucaagcuacauauugcucgcucug

SEQ ID NO: 1276614 - RNA, 20 nt, Human
ucagaaucagaauugcugac

SEQ ID NO: 1276615 - RNA, 21 nt, Human
uccacaggacagaugagaaaa

SEQ ID NO: 1276616 - RNA, 19 nt, Human
uccacaguuccacucaucc

SEQ ID NO: 1276617 - RNA, 20 nt, Human
uccacaucacuuguuccaca

SEQ ID NO: 1276618 - RNA, 20 nt, Human
ucccguuacaaaagugaagu

SEQ ID NO: 1276619 - RNA, 22 nt, Human
ucuaaauuaacccaugaaggaa

SEQ ID NO: 1276620 - RNA, 18 nt, Human
ucugaaauguuauaaagc

SEQ ID NO: 1276621 - RNA, 25 nt, Human
ugaaacuagcaauauaucguuuaaa

SEQ ID NO: 1276622 - RNA, 27 nt, Human
ugaaaucuacacaggcaaaaucagagg

SEQ ID NO: 1276623 - RNA, 19 nt, Human
ugacaagcucaucaaacaa

SEQ ID NO: 1276624 - RNA, 22 nt, Human
ugacaagcucaucaaacaagca

SEQ ID NO: 1276625 - RNA, 21 nt, Human
ugacaccagcagauacaaguu

SEQ ID NO: 1276626 - RNA, 26 nt, Human
ugacaccagcagauacaaguuuccca

SEQ ID NO: 1276627 - RNA, 18 nt, Human
ugauugucuguacagcug

SEQ ID NO: 1276628 - RNA, 21 nt, Human
uguacagcuguugcacccauu

SEQ ID NO: 1276629 - RNA, 22 nt, Human
uguucaaguauaaaaauccaau

SEQ ID NO: 1276630 - RNA, 24 nt, Human
uugcacccauuaauuccacaucac

SEQ ID NO: 1276631 - RNA, 22 nt, Human
uuuaagaauaaaaauugcaagu

SEQ ID NO: 1276632 - RNA, 19 nt, Human
uuuuuuuuuuuaaagcugu

SEQ ID NO: 1276633 - RNA, 19 nt, Human
aaaaaaaccaacgugaaag

SEQ ID NO: 1276634 - RNA, 23 nt, Human
aaaaaaaccaacgugaaaguuga

SEQ ID NO: 1276635 - RNA, 24 nt, Human
aaaaaaccaacgugaaaguugaua

SEQ ID NO: 1276636 - RNA, 22 nt, Human
aaaaaccaacgugaaaguugau

SEQ ID NO: 1276637 - RNA, 21 nt, Human
aaauaaauaaauaaaugaaua

SEQ ID NO: 1276638 - RNA, 20 nt, Human
aacauagugaaaccuugucu

SEQ ID NO: 1276639 - RNA, 21 nt, Human
aacauagugaaaccuugucuc

SEQ ID NO: 1276640 - RNA, 21 nt, Human
aaccacauggcccccaauccc

SEQ ID NO: 1276641 - RNA, 21 nt, Human
aaccuucagccugugcagccc

SEQ ID NO: 1276642 - RNA, 19 nt, Human
aagcccaaggcagaaaucc

SEQ ID NO: 1276643 - RNA, 18 nt, Human
aauuagccaggcauggug

SEQ ID NO: 1276644 - RNA, 18 nt, Human
acaaaggagagugccaaa

SEQ ID NO: 1276645 - RNA, 24 nt, Human
acagagcgagacccugucucuaaa

SEQ ID NO: 1276646 - RNA, 23 nt, Human
accuugucucuacaaaaauacaa

SEQ ID NO: 1276647 - RNA, 19 nt, Human
acuacaaaugucacaaaug

SEQ ID NO: 1276648 - RNA, 18 nt, Human
acucuguucugggcuuug

SEQ ID NO: 1276649 - RNA, 19 nt, Human
acucuguucugggcuuugc

SEQ ID NO: 1276650 - RNA, 24 nt, Human
acugcacuccagccuuggcaacag

SEQ ID NO: 1276651 - RNA, 24 nt, Human
acugcacuccagccuuggcaacag

SEQ ID NO: 1276652 - RNA, 19 nt, Human
acugcacuccagccuuggg

SEQ ID NO: 1276653 - RNA, 21 nt, Human
agaaggaaaaaaucuugagaa

SEQ ID NO: 1276654 - RNA, 23 nt, Human
agccaggcaugguggugugugcc

SEQ ID NO: 1276655 - RNA, 23 nt, Human
agccugggcaacauagugaaacc

SEQ ID NO: 1276656 - RNA, 24 nt, Human
agccugggcaacauagugaaaccu

SEQ ID NO: 1276657 - RNA, 25 nt, Human
agccugggcaacauagugaaaccuu

SEQ ID NO: 1276658 - RNA, 20 nt, Human
aggaaggauuucauuuggca

SEQ ID NO: 1276659 - RNA, 28 nt, Human
aggagcagcagaggauggaccgguaccc

SEQ ID NO: 1276660 - RNA, 18 nt, Human
aggcaugguggugugugc

SEQ ID NO: 1276661 - RNA, 20 nt, Human
aggcccuaugaaugcaggug

SEQ ID NO: 1276662 - RNA, 24 nt, Human
aggcugaggguggaggaucgcuug

SEQ ID NO: 1276663 - RNA, 24 nt, Human
agguggagguugcagugagccaag

SEQ ID NO: 1276664 - RNA, 19 nt, Human
agucugggugcaguggcuc

SEQ ID NO: 1276665 - RNA, 22 nt, Human
aguggcucaugccuguaauccc

SEQ ID NO: 1276666 - RNA, 22 nt, Human
aguggcucaugccuguaauccc

SEQ ID NO: 1276667 - RNA, 24 nt, Human
aguggcucaugccuguaaucccgg

SEQ ID NO: 1276668 - RNA, 23 nt, Human
auaaaaaacauauaagccauuaa

SEQ ID NO: 1276669 - RNA, 25 nt, Human
aucaacuacccuuucaacaguucaa

SEQ ID NO: 1276670 - RNA, 22 nt, Human
aucccggcacuuugggaggcca

SEQ ID NO: 1276671 - RNA, 23 nt, Human
aucgcuugagcccaggaggugga

SEQ ID NO: 1276672 - RNA, 25 nt, Human
aucguuccacugcacuccagccuug

SEQ ID NO: 1276673 - RNA, 23 nt, Human
aucuaugcuggucaagucucccc

SEQ ID NO: 1276674 - RNA, 18 nt, Human
augcaauuuguuuuaaag

SEQ ID NO: 1276675 - RNA, 19 nt, Human
augccuguaaucccggcac

SEQ ID NO: 1276676 - RNA, 20 nt, Human
auuacaaaaaggcccuauga

SEQ ID NO: 1276677 - RNA, 20 nt, Human
caacagagcgagacccuguc

SEQ ID NO: 1276678 - RNA, 22 nt, Human
caacagagcgagacccugucuc

SEQ ID NO: 1276679 - RNA, 21 nt, Human
caacauagugaaaccuugucu

SEQ ID NO: 1276680 - RNA, 22 nt, Human
caacauagugaaaccuugucuc

SEQ ID NO: 1276681 - RNA, 24 nt, Human
caacauagugaaaccuugucucua

SEQ ID NO: 1276682 - RNA, 20 nt, Human
caacuggaauaaaacaucuu

SEQ ID NO: 1276683 - RNA, 22 nt, Human
caaucccaguccuuagcaugaa

SEQ ID NO: 1276684 - RNA, 19 nt, Human
cacaaggcaggaguaaaca

SEQ ID NO: 1276685 - RNA, 21 nt, Human
cacaaucauccuuaagcccaa

SEQ ID NO: 1276686 - RNA, 23 nt, Human
cacuccagccuuggcaacagagc

SEQ ID NO: 1276687 - RNA, 19 nt, Human
cacugcacuccagccuugg

SEQ ID NO: 1276688 - RNA, 21 nt, Human
cacugcacuccagccuuggca

SEQ ID NO: 1276689 - RNA, 22 nt, Human
cacugcacuccagccuuggcaa

SEQ ID NO: 1276690 - RNA, 23 nt, Human
cacugcacuccagccuuggcaac

SEQ ID NO: 1276691 - RNA, 24 nt, Human
cacugcacuccagccuuggcaaca

SEQ ID NO: 1276692 - RNA, 22 nt, Human
cagauuaaaaaaaccaacguga

SEQ ID NO: 1276693 - RNA, 23 nt, Human
cagcauaaaaaacauauaagcca

SEQ ID NO: 1276694 - RNA, 29 nt, Human
caggagguggagguugcagugacaacggu

SEQ ID NO: 1276695 - RNA, 24 nt, Human
caggagguggagguugcagugagc

SEQ ID NO: 1276696 - RNA, 21 nt, Human
caguuuaaaauguaaauucua

SEQ ID NO: 1276697 - RNA, 18 nt, Human
caugaagaaacaaucaua

SEQ ID NO: 1276698 - RNA, 20 nt, Human
caugccuguaaucccggcac

SEQ ID NO: 1276699 - RNA, 24 nt, Human
caugccuguaaucccggcacuuug

SEQ ID NO: 1276700 - RNA, 20 nt, Human
ccacugcacuccagccuugg

SEQ ID NO: 1276701 - RNA, 20 nt, Human
ccacugcacuccagccuugg

SEQ ID NO: 1276702 - RNA, 21 nt, Human
ccacugcacuccagccuuggc

SEQ ID NO: 1276703 - RNA, 24 nt, Human
ccacugcacuccagccuuggcaac

SEQ ID NO: 1276704 - RNA, 21 nt, Human
cccaggagguggagguugcag

SEQ ID NO: 1276705 - RNA, 23 nt, Human
cccccucgcucuuuuuuuaaaag

SEQ ID NO: 1276706 - RNA, 21 nt, Human
ccccgccacaaggcaggaguu

SEQ ID NO: 1276707 - RNA, 18 nt, Human
cccguagucccagcuacu

SEQ ID NO: 1276708 - RNA, 21 nt, Human
cccguagucccagcuacuugg

SEQ ID NO: 1276709 - RNA, 22 nt, Human
cccguagucccagcuacuuggg

SEQ ID NO: 1276710 - RNA, 21 nt, Human
ccugggcaacauagugaaacc

SEQ ID NO: 1276711 - RNA, 24 nt, Human
ccugggcaacauagugaaaccuug

SEQ ID NO: 1276712 - RNA, 19 nt, Human
ccuucacaacacagagaaa

SEQ ID NO: 1276713 - RNA, 21 nt, Human
cgccacaaggcaggaguaaac

SEQ ID NO: 1276714 - RNA, 24 nt, Human
cggcacuuugggaggccaaggugg

SEQ ID NO: 1276715 - RNA, 19 nt, Human
cguuccacugcacuccagc

SEQ ID NO: 1276716 - RNA, 26 nt, Human
cuaaccuucagccugugcagcccaca

SEQ ID NO: 1276717 - RNA, 23 nt, Human
cucaugccuguaaucccggcacu

SEQ ID NO: 1276718 - RNA, 24 nt, Human
cucaugccuguaaucccggcacuu

SEQ ID NO: 1276719 - RNA, 21 nt, Human
cuggaggaacuugacaaacau

SEQ ID NO: 1276720 - RNA, 21 nt, Human
cuggcagaagagaagggcaaa

SEQ ID NO: 1276721 - RNA, 23 nt, Human
cugggauagagauuaguucucau

SEQ ID NO: 1276722 - RNA, 18 nt, Human
cuuauccucuauuuaacc

SEQ ID NO: 1276723 - RNA, 20 nt, Human
cuugaguuuuuucagucugg

SEQ ID NO: 1276724 - RNA, 19 nt, Human
cuuugcuggaggaacuuga

SEQ ID NO: 1276725 - RNA, 20 nt, Human
gagaaugaaugcuuucuuau

SEQ ID NO: 1276726 - RNA, 18 nt, Human
gagguugcagugagccaa

SEQ ID NO: 1276727 - RNA, 23 nt, Human
gagguugcagugagccaagaucg

SEQ ID NO: 1276728 - RNA, 24 nt, Human
gaucgcuugagcccaggaggugga

SEQ ID NO: 1276729 - RNA, 18 nt, Human
gcacauauauauguuaag

SEQ ID NO: 1276730 - RNA, 24 nt, Human
gcacuccagccuuggcaacagagc

SEQ ID NO: 1276731 - RNA, 20 nt, Human
gcacuuugggaggccaaggu

SEQ ID NO: 1276732 - RNA, 23 nt, Human
gcacuuugggaggccaagguggg

SEQ ID NO: 1276733 - RNA, 24 nt, Human
gcccaggagguggagguugcagug

SEQ ID NO: 1276734 - RNA, 20 nt, Human
ggagaaugggggugaauuug

SEQ ID NO: 1276735 - RNA, 20 nt, Human
ggagguugcagugagccaag

SEQ ID NO: 1276736 - RNA, 23 nt, Human
ggagguugcagugagccaagauc

SEQ ID NO: 1276737 - RNA, 24 nt, Human
ggagguugcagugagccaagaucg

SEQ ID NO: 1276738 - RNA, 18 nt, Human
ggcccuaugaaugcaggu

SEQ ID NO: 1276739 - RNA, 19 nt, Human
gggagaaugaaugcuuucu

SEQ ID NO: 1276740 - RNA, 23 nt, Human
ggugcaguggcucaugccuguaa

SEQ ID NO: 1276741 - RNA, 21 nt, Human
gguggaggaucgcuugagccc

SEQ ID NO: 1276742 - RNA, 25 nt, Human
uaaaaccauagacauacagcauaaa

SEQ ID NO: 1276743 - RNA, 23 nt, Human
uaagcccaaggcagaaaucccag

SEQ ID NO: 1276744 - RNA, 22 nt, Human
uacauaaaucaucuccuuaucc

SEQ ID NO: 1276745 - RNA, 22 nt, Human
uacccuuucaacaguucaaagc

SEQ ID NO: 1276746 - RNA, 22 nt, Human
uagccaggcaugguggugugug

SEQ ID NO: 1276747 - RNA, 22 nt, Human
uauaagaugaaaagcaguggag

SEQ ID NO: 1276748 - RNA, 21 nt, Human
uaucuacucugcacauauaua

SEQ ID NO: 1276749 - RNA, 24 nt, Human
uaucuacucugcacauauauaugu

SEQ ID NO: 1276750 - RNA, 24 nt, Human
uaugaucaacuacccuuucaacag

SEQ ID NO: 1276751 - RNA, 19 nt, Human
ucaaagcaguaaugaugac

SEQ ID NO: 1276752 - RNA, 21 nt, Human
uccacugcacuccagccuugg

SEQ ID NO: 1276753 - RNA, 23 nt, Human
uccagccuuggcaacagagcgag

SEQ ID NO: 1276754 - RNA, 24 nt, Human
uccagccuuggcaacagagcgaga

SEQ ID NO: 1276755 - RNA, 19 nt, Human
ucccagauaucuacucuga

SEQ ID NO: 1276756 - RNA, 23 nt, Human
ucccaguccuuagcaugaaccuu

SEQ ID NO: 1276757 - RNA, 20 nt, Human
ucccccucgcucuuuuuuua

SEQ ID NO: 1276758 - RNA, 24 nt, Human
ucgcuugagcccaggagguggagg

SEQ ID NO: 1276759 - RNA, 27 nt, Human
ucucagacugcauagaagaugaacccu

SEQ ID NO: 1276760 - RNA, 18 nt, Human
ucucuaaauaaauaaaua

SEQ ID NO: 1276761 - RNA, 21 nt, Human
ucucuacaaaaauacaaaaaa

SEQ ID NO: 1276762 - RNA, 21 nt, Human
ucuguucugggcuuugcugga

SEQ ID NO: 1276763 - RNA, 23 nt, Human
ucuugaguuuuuucagucuggag

SEQ ID NO: 1276764 - RNA, 20 nt, Human
ugaacaacaacucuguucug

SEQ ID NO: 1276765 - RNA, 19 nt, Human
ugaagaaacaaucauauuc

SEQ ID NO: 1276766 - RNA, 23 nt, Human
ugagcuccggaguuugaggccag

SEQ ID NO: 1276767 - RNA, 24 nt, Human
ugaggccagccugggcaacauagu

SEQ ID NO: 1276768 - RNA, 22 nt, Human
ugcaauuuguuuuaaaggagca

SEQ ID NO: 1276769 - RNA, 24 nt, Human
ugcccguagucccagcuacuuggg

SEQ ID NO: 1276770 - RNA, 23 nt, Human
ugccuguaaucccggcacuuugg

SEQ ID NO: 1276771 - RNA, 24 nt, Human
ugccuguaaucccggcacuuuggg

SEQ ID NO: 1276772 - RNA, 22 nt, Human
ugcuuuauuccuucacaacaca

SEQ ID NO: 1276773 - RNA, 18 nt, Human
uggaagguggcuuucuca

SEQ ID NO: 1276774 - RNA, 20 nt, Human
uggcccccaaucccaguccu

SEQ ID NO: 1276775 - RNA, 24 nt, Human
uggcucaugccuguaaucccggca

SEQ ID NO: 1276776 - RNA, 18 nt, Human
ugggaagacugcuugagc

SEQ ID NO: 1276777 - RNA, 20 nt, Human
ugggaggccaaggugggaag

SEQ ID NO: 1276778 - RNA, 23 nt, Human
ugggaggcugaggguggaggauc

SEQ ID NO: 1276779 - RNA, 19 nt, Human
ugggauagagauuaguucu

SEQ ID NO: 1276780 - RNA, 24 nt, Human
ugggcaacauagugaaaccuuguc

SEQ ID NO: 1276781 - RNA, 24 nt, Human
ugguggugugugcccguaguccca

SEQ ID NO: 1276782 - RNA, 18 nt, Human
uggugugugcccguaguc

SEQ ID NO: 1276783 - RNA, 24 nt, Human
uggugugugcccguagucccagcu

SEQ ID NO: 1276784 - RNA, 21 nt, Human
ugucauaaaguauuuaugaag

SEQ ID NO: 1276785 - RNA, 18 nt, Human
ugugguagaaagagauaa

SEQ ID NO: 1276786 - RNA, 20 nt, Human
uguuuuaaaggagcagcaga

SEQ ID NO: 1276787 - RNA, 18 nt, Human
uuagaaggaaaaaaucuu

SEQ ID NO: 1276788 - RNA, 20 nt, Human
uuagaugccuuaaaagcacc

SEQ ID NO: 1276789 - RNA, 24 nt, Human
uuagccaggcaugguggugugugc

SEQ ID NO: 1276790 - RNA, 19 nt, Human
uuccacugcacuccagccu

SEQ ID NO: 1276791 - RNA, 24 nt, Human
uugagcccaggagguggagguugc

SEQ ID NO: 1276792 - RNA, 20 nt, Human
uugcagugagccaagaucgu

SEQ ID NO: 1276793 - RNA, 23 nt, Human
uugcuuuauuccuucacaacaca

SEQ ID NO: 1276794 - RNA, 24 nt, Human
uugggaggcugaggguggaggauc

SEQ ID NO: 1276795 - RNA, 21 nt, Human
uuguaaagaguucagugugug

SEQ ID NO: 1276796 - RNA, 19 nt, Human
uuuuucagucuggaaggug

SEQ ID NO: 1276797 - RNA, 19 nt, Human
aaacaaaaaccuacaaaga

SEQ ID NO: 1276798 - RNA, 18 nt, Human
aaaccccaucagaaugac

SEQ ID NO: 1276799 - RNA, 19 nt, Human
aaaccuccaggccucuccc

SEQ ID NO: 1276800 - RNA, 21 nt, Human
aacaaaagugauaauguccau

SEQ ID NO: 1276801 - RNA, 21 nt, Human
aagaaggacuagaaucagaua

SEQ ID NO: 1276802 - RNA, 26 nt, Human
aagcaaguacaguguuuggaaaacaa

SEQ ID NO: 1276803 - RNA, 19 nt, Human
aagcagcaucuuuguugag

SEQ ID NO: 1276804 - RNA, 20 nt, Human
aagcagguugcugaauccca

SEQ ID NO: 1276805 - RNA, 20 nt, Human
aagcagguugcugaauccca

SEQ ID NO: 1276806 - RNA, 18 nt, Human
aagcuucccagagcuugc

SEQ ID NO: 1276807 - RNA, 19 nt, Human
aaugcacaacuacagacaa

SEQ ID NO: 1276808 - RNA, 21 nt, Human
acaaacaaaaaccuacaaaga

SEQ ID NO: 1276809 - RNA, 20 nt, Human
acaacuacagacaacaaaaa

SEQ ID NO: 1276810 - RNA, 18 nt, Human
acagacaacaaaaaccgu

SEQ ID NO: 1276811 - RNA, 19 nt, Human
acaguguuuggaaaacaaa

SEQ ID NO: 1276812 - RNA, 19 nt, Human
acgggaaggagagacggca

SEQ ID NO: 1276813 - RNA, 19 nt, Human
agaaauucccuuauuacca

SEQ ID NO: 1276814 - RNA, 22 nt, Human
agaagcuagagaucagggugcc

SEQ ID NO: 1276815 - RNA, 22 nt, Human
agaucaaggggcuggaaggaug

SEQ ID NO: 1276816 - RNA, 21 nt, Human
agcauccuccuuucauugugg

SEQ ID NO: 1276817 - RNA, 19 nt, Human
agcccgggagagacggcag

SEQ ID NO: 1276818 - RNA, 18 nt, Human
agccuuccggguuacagg

SEQ ID NO: 1276819 - RNA, 25 nt, Human
aggaagccuugaaauccuuugccaa

SEQ ID NO: 1276820 - RNA, 26 nt, Human
aggcagagagggagcaagggaucuag

SEQ ID NO: 1276821 - RNA, 21 nt, Human
aggcagggaugggagaagcag

SEQ ID NO: 1276822 - RNA, 20 nt, Human
aggcaggguacagcccggga

SEQ ID NO: 1276823 - RNA, 19 nt, Human
aggcaucagagauccauuc

SEQ ID NO: 1276824 - RNA, 18 nt, Human
agggauggauuucugcac

SEQ ID NO: 1276825 - RNA, 23 nt, Human
aguaaugggcaacgcucaaggaa

SEQ ID NO: 1276826 - RNA, 21 nt, Human
aucucauuaugagggccccac

SEQ ID NO: 1276827 - RNA, 24 nt, Human
augcuggcgccacuccagccgcgu

SEQ ID NO: 1276828 - RNA, 22 nt, Human
auggugguggcugcugcgccuu

SEQ ID NO: 1276829 - RNA, 21 nt, Human
auuaaucccuaaaacuuucag

SEQ ID NO: 1276830 - RNA, 19 nt, Human
auucugggggcuacaaaca

SEQ ID NO: 1276831 - RNA, 22 nt, Human
auuggcuccuguagaaaguaaa

SEQ ID NO: 1276832 - RNA, 21 nt, Human
auugucuacaccuccugaagu

SEQ ID NO: 1276833 - RNA, 19 nt, Human
caaacaaaaaccuacaaag

SEQ ID NO: 1276834 - RNA, 26 nt, Human
caaacaaaaaccuacaaagaguucua

SEQ ID NO: 1276835 - RNA, 28 nt, Human
caaacaaaaaccuacaaagaguucuaga

SEQ ID NO: 1276836 - RNA, 18 nt, Human
cacaggccacagagaagc

SEQ ID NO: 1276837 - RNA, 19 nt, Human
cacucagacuuuuccuaca

SEQ ID NO: 1276838 - RNA, 18 nt, Human
cacuggugauugcaggca

SEQ ID NO: 1276839 - RNA, 22 nt, Human
cagcacaguggggauuagggag

SEQ ID NO: 1276840 - RNA, 19 nt, Human
caggacaaaccgucccacc

SEQ ID NO: 1276841 - RNA, 22 nt, Human
caucacaccaaaaccuaagacu

SEQ ID NO: 1276842 - RNA, 22 nt, Human
caucagaaugacgggcuaaucc

SEQ ID NO: 1276843 - RNA, 24 nt, Human
caucaggaguccuuaggaauaggg

SEQ ID NO: 1276844 - RNA, 21 nt, Human
ccaagaagagguuuaaaucuc

SEQ ID NO: 1276845 - RNA, 22 nt, Human
ccagcauggcuggguucuggga

SEQ ID NO: 1276846 - RNA, 18 nt, Human
ccaggacuuauuuucaug

SEQ ID NO: 1276847 - RNA, 23 nt, Human
ccagugaggggccggacgaaggu

SEQ ID NO: 1276848 - RNA, 18 nt, Human
cccacgucugacuuuccu

SEQ ID NO: 1276849 - RNA, 22 nt, Human
cccauggcacaggccacagaga

SEQ ID NO: 1276850 - RNA, 28 nt, Human
cccccuacccccauuucuccaggaagcc

SEQ ID NO: 1276851 - RNA, 23 nt, Human
cccucaccauccuaauguaccua

SEQ ID NO: 1276852 - RNA, 20 nt, Human
cccuuauuaccaccccggcc

SEQ ID NO: 1276853 - RNA, 21 nt, Human
cccuuuuguggcuuucccucc

SEQ ID NO: 1276854 - RNA, 23 nt, Human
ccuccugaaguuuccugucaccu

SEQ ID NO: 1276855 - RNA, 22 nt, Human
ccuugugccagccucagucuuc

SEQ ID NO: 1276856 - RNA, 21 nt, Human
cgcagauaagcaaaaugacug

SEQ ID NO: 1276857 - RNA, 19 nt, Human
cgccuucggcccccuuugc

SEQ ID NO: 1276858 - RNA, 20 nt, Human
cgugcagacucgagcaggaa

SEQ ID NO: 1276859 - RNA, 25 nt, Human
cuauagcccccuuuuguggcuuucc

SEQ ID NO: 1276860 - RNA, 24 nt, Human
cucacaguucuggaggcugagaag

SEQ ID NO: 1276861 - RNA, 24 nt, Human
cuccauaacaaaccgugggguacc

SEQ ID NO: 1276862 - RNA, 19 nt, Human
cucccccuacccccauuuc

SEQ ID NO: 1276863 - RNA, 27 nt, Human
cucccccuacccccauuucuccaggaa

SEQ ID NO: 1276864 - RNA, 23 nt, Human
cucugccuugcugaaaacuggag

SEQ ID NO: 1276865 - RNA, 19 nt, Human
cugauuaucacaggagaua

SEQ ID NO: 1276866 - RNA, 18 nt, Human
cugcugggugaagacagg

SEQ ID NO: 1276867 - RNA, 19 nt, Human
cuggaaauaccucaucuuc

SEQ ID NO: 1276868 - RNA, 22 nt, Human
cuuauuaccaccccggccagac

SEQ ID NO: 1276869 - RNA, 22 nt, Human
cuugggcgaagcuguuggagcu

SEQ ID NO: 1276870 - RNA, 22 nt, Human
cuuucauugugggaccuucuca

SEQ ID NO: 1276871 - RNA, 22 nt, Human
cuuuccuuuuuauaucuggggu

SEQ ID NO: 1276872 - RNA, 22 nt, Human
gaaaacaaacaaaaaccuacaa

SEQ ID NO: 1276873 - RNA, 24 nt, Human
gaaaacaaacaaaaaccuacaaag

SEQ ID NO: 1276874 - RNA, 20 nt, Human
gaagagcaaauauggcucau

SEQ ID NO: 1276875 - RNA, 21 nt, Human
gaaucccaguuuucacuucua

SEQ ID NO: 1276876 - RNA, 21 nt, Human
gagcaggacaaaccgucccac

SEQ ID NO: 1276877 - RNA, 23 nt, Human
gaguccuuaggaauagggauggg

SEQ ID NO: 1276878 - RNA, 20 nt, Human
gagugugggaggcaggaagg

SEQ ID NO: 1276879 - RNA, 19 nt, Human
gaucccucccccuaccccc

SEQ ID NO: 1276880 - RNA, 18 nt, Human
gcaccagaguuccugggg

SEQ ID NO: 1276881 - RNA, 18 nt, Human
gcagauccuggaagcagc

SEQ ID NO: 1276882 - RNA, 24 nt, Human
gccccaccuccuaauaccagcaca

SEQ ID NO: 1276883 - RNA, 19 nt, Human
gcgcaaaaccuccaggccu

SEQ ID NO: 1276884 - RNA, 22 nt, Human
gcuccagccagugucugccugc

SEQ ID NO: 1276885 - RNA, 24 nt, Human
ggaaaacaaacaaaaaccuacaaa

SEQ ID NO: 1276886 - RNA, 22 nt, Human
ggaaauaccucaucuuccagaa

SEQ ID NO: 1276887 - RNA, 22 nt, Human
ggauuugggagugugggaggca

SEQ ID NO: 1276888 - RNA, 19 nt, Human
ggcagagagggagcaaggg

SEQ ID NO: 1276889 - RNA, 20 nt, Human
ggcagggaugggagaagcag

SEQ ID NO: 1276890 - RNA, 21 nt, Human
ggcgaagcuguuggagcuggg

SEQ ID NO: 1276891 - RNA, 21 nt, Human
ggguuacaggcacaagggcca

SEQ ID NO: 1276892 - RNA, 18 nt, Human
ggugguggcugcugcgcc

SEQ ID NO: 1276893 - RNA, 19 nt, Human
ggugguggcugcugcgccu

SEQ ID NO: 1276894 - RNA, 25 nt, Human
gucaccuucucuucaaguagcuuug

SEQ ID NO: 1276895 - RNA, 20 nt, Human
gucacuaaucucauuaugag

SEQ ID NO: 1276896 - RNA, 21 nt, Human
gugaagagcaaauauggcuca

SEQ ID NO: 1276897 - RNA, 18 nt, Human
guggcugcugcgccuucg

SEQ ID NO: 1276898 - RNA, 19 nt, Human
gugggaggcaggaaggccg

SEQ ID NO: 1276899 - RNA, 23 nt, Human
guggugggcaggcaucagagauc

SEQ ID NO: 1276900 - RNA, 22 nt, Human
uaaugcacaacuacagacaaca

SEQ ID NO: 1276901 - RNA, 23 nt, Human
uaaugcacaacuacagacaacaa

SEQ ID NO: 1276902 - RNA, 23 nt, Human
uaccagcacaguggggauuagga

SEQ ID NO: 1276903 - RNA, 18 nt, Human
uaggggagacugaaggca

SEQ ID NO: 1276904 - RNA, 18 nt, Human
uaggggagacugaaggca

SEQ ID NO: 1276905 - RNA, 24 nt, Human
uaugaaaguggcgaucaaagcuag

SEQ ID NO: 1276906 - RNA, 21 nt, Human
ucaaggaaaaccccaucagaa

SEQ ID NO: 1276907 - RNA, 19 nt, Human
ucacuuggccuuucacugg

SEQ ID NO: 1276908 - RNA, 21 nt, Human
ucaucuaacccuaaucacauc

SEQ ID NO: 1276909 - RNA, 22 nt, Human
uccacauauggauucugggggc

SEQ ID NO: 1276910 - RNA, 18 nt, Human
uccacucagacuuuuccu

SEQ ID NO: 1276911 - RNA, 24 nt, Human
uccaucacaccaaaaccuaagacu

SEQ ID NO: 1276912 - RNA, 22 nt, Human
ucccagagcuugcugaaagaca

SEQ ID NO: 1276913 - RNA, 21 nt, Human
ucccugaggacaauuucucug

SEQ ID NO: 1276914 - RNA, 21 nt, Human
uccucacuuggccuuucacug

SEQ ID NO: 1276915 - RNA, 18 nt, Human
uccuuuuuauaucugggg

SEQ ID NO: 1276916 - RNA, 19 nt, Human
ucuaacccuaaucacaucc

SEQ ID NO: 1276917 - RNA, 23 nt, Human
ucuauagcaagaaggaccggggc

SEQ ID NO: 1276918 - RNA, 19 nt, Human
ucucccugaggacaauuuc

SEQ ID NO: 1276919 - RNA, 23 nt, Human
ucuggaaauaccucaucuuccag

SEQ ID NO: 1276920 - RNA, 18 nt, Human
ugacaguacugagcuuaa

SEQ ID NO: 1276921 - RNA, 18 nt, Human
ugaggaccacgagguccu

SEQ ID NO: 1276922 - RNA, 20 nt, Human
ugaggaccacgagguccucu

SEQ ID NO: 1276923 - RNA, 21 nt, Human
ugauaaggucacuaaucucau

SEQ ID NO: 1276924 - RNA, 18 nt, Human
ugcacagauucugggugu

SEQ ID NO: 1276925 - RNA, 24 nt, Human
ugccagcauggcuggguucuggga

SEQ ID NO: 1276926 - RNA, 21 nt, Human
ugccagggcuuaacgaucccu

SEQ ID NO: 1276927 - RNA, 20 nt, Human
ugccugguucucauuaguga

SEQ ID NO: 1276928 - RNA, 20 nt, Human
ugcugaaaacuggagcugcu

SEQ ID NO: 1276929 - RNA, 21 nt, Human
ugcuguucugcauaagcuuug

SEQ ID NO: 1276930 - RNA, 21 nt, Human
uggaaaacaaacaaaaaccua

SEQ ID NO: 1276931 - RNA, 23 nt, Human
uggaaaacaaacaaaaaccuaca

SEQ ID NO: 1276932 - RNA, 19 nt, Human
uggagauucuucucagaaa

SEQ ID NO: 1276933 - RNA, 24 nt, Human
uggauucugggggcuacaaacauu

SEQ ID NO: 1276934 - RNA, 23 nt, Human
uggcuuucccuccauaacaaacc

SEQ ID NO: 1276935 - RNA, 19 nt, Human
ugggagaagcaggcagggu

SEQ ID NO: 1276936 - RNA, 24 nt, Human
ugucucauccucuugauaagguca

SEQ ID NO: 1276937 - RNA, 21 nt, Human
ugucuugggacaugguucugc

SEQ ID NO: 1276938 - RNA, 27 nt, Human
uuaaugcacaacuacagacaacaaaaa

SEQ ID NO: 1276939 - RNA, 21 nt, Human
uuccaucacaccaaaaccuaa

SEQ ID NO: 1276940 - RNA, 18 nt, Human
uucucaguuuggacauaa

SEQ ID NO: 1276941 - RNA, 20 nt, Human
uucucaguuuggacauaauc

SEQ ID NO: 1276942 - RNA, 22 nt, Human
uugaaaggaaacgggaaggaga

SEQ ID NO: 1276943 - RNA, 21 nt, Human
uugagcguacacuccccaaac

SEQ ID NO: 1276944 - RNA, 25 nt, Human
uuggugcugauuaucacaggagaua

SEQ ID NO: 1276945 - RNA, 23 nt, Human
uuuauaagcuucccagagcuugc

SEQ ID NO: 1276946 - RNA, 18 nt, Human
uuuccugucaccuucucu

SEQ ID NO: 1276947 - RNA, 19 nt, Human
uuugucuguaaccgugaga

SEQ ID NO: 1276948 - RNA, 18 nt, Human
uuuguggcuuucccucca

SEQ ID NO: 1276949 - RNA, 18 nt, Human
aaaaaaccaaaacuaaga

SEQ ID NO: 1276950 - RNA, 20 nt, Human
aaaaggcaggauaaguagug

SEQ ID NO: 1276951 - RNA, 21 nt, Human
aaaugaacauuuuuacuucca

SEQ ID NO: 1276952 - RNA, 19 nt, Human
aaauuccucagugcuuuuc

SEQ ID NO: 1276953 - RNA, 18 nt, Human
aaccuauuccaucagcag

SEQ ID NO: 1276954 - RNA, 21 nt, Human
aacuucacacucaaacagggc

SEQ ID NO: 1276955 - RNA, 21 nt, Human
aagaaaccagaaaucuuccag

SEQ ID NO: 1276956 - RNA, 24 nt, Human
aagaaaccagaaaucuuccaggca

SEQ ID NO: 1276957 - RNA, 25 nt, Human
aagaacauaaaagaaaauaaauuau

SEQ ID NO: 1276958 - RNA, 19 nt, Human
aagggucuuuucaagcagg

SEQ ID NO: 1276959 - RNA, 22 nt, Human
aaguaaauccuaauagaaccaa

SEQ ID NO: 1276960 - RNA, 18 nt, Human
acaauuuugcuaaccccu

SEQ ID NO: 1276961 - RNA, 19 nt, Human
acacaaagucuugcacaua

SEQ ID NO: 1276962 - RNA, 21 nt, Human
acacacuuugugucucagagc

SEQ ID NO: 1276963 - RNA, 20 nt, Human
acacaucguacccaugucca

SEQ ID NO: 1276964 - RNA, 21 nt, Human
accccuuugucuagacuacaa

SEQ ID NO: 1276965 - RNA, 21 nt, Human
accugcaucacacaacaaaga

SEQ ID NO: 1276966 - RNA, 21 nt, Human
acuucaaacugugagcugaag

SEQ ID NO: 1276967 - RNA, 21 nt, Human
acuucacacucaaacagggca

SEQ ID NO: 1276968 - RNA, 21 nt, Human
agaaaccagaaaucuuccagg

SEQ ID NO: 1276969 - RNA, 20 nt, Human
agagagaaaacaccugaaga

SEQ ID NO: 1276970 - RNA, 19 nt, Human
agaggaaaacagacaugga

SEQ ID NO: 1276971 - RNA, 21 nt, Human
agcaaaacacaucguacccau

SEQ ID NO: 1276972 - RNA, 19 nt, Human
agcaacuuuccucuugugu

SEQ ID NO: 1276973 - RNA, 19 nt, Human
agcaggaaagccuucauca

SEQ ID NO: 1276974 - RNA, 20 nt, Human
agcucaguaccguacagcaa

SEQ ID NO: 1276975 - RNA, 18 nt, Human
aggagcucgcgcgaggag

SEQ ID NO: 1276976 - RNA, 22 nt, Human
agggagguucccguggaggagg

SEQ ID NO: 1276977 - RNA, 19 nt, Human
aggggugaggcugauuggg

SEQ ID NO: 1276978 - RNA, 18 nt, Human
agugaaagaaaccagaaa

SEQ ID NO: 1276979 - RNA, 21 nt, Human
auaaauccaaaccacaaaaca

SEQ ID NO: 1276980 - RNA, 21 nt, Human
auaacacaccacaccccugcc

SEQ ID NO: 1276981 - RNA, 23 nt, Human
auuaacuagaaaaaaagacugcc

SEQ ID NO: 1276982 - RNA, 19 nt, Human
caaaaaggcaggauaagua

SEQ ID NO: 1276983 - RNA, 25 nt, Human
caacauguuaagcugcacucugccc

SEQ ID NO: 1276984 - RNA, 22 nt, Human
caacugccaucauagaacaucc

SEQ ID NO: 1276985 - RNA, 21 nt, Human
cacaauacacggagacacaag

SEQ ID NO: 1276986 - RNA, 23 nt, Human
cacaaugcuaucuaaacuagauu

SEQ ID NO: 1276987 - RNA, 18 nt, Human
cacugcugucagugcucc

SEQ ID NO: 1276988 - RNA, 25 nt, Human
caggauaaguagugaaagaaaccag

SEQ ID NO: 1276989 - RNA, 21 nt, Human
cagugcuuuucauucuccuua

SEQ ID NO: 1276990 - RNA, 24 nt, Human
ccaaucaagucaacauguggccaa

SEQ ID NO: 1276991 - RNA, 21 nt, Human
ccaugaauacgaaaggaggga

SEQ ID NO: 1276992 - RNA, 22 nt, Human
ccauguauacuauucucauccu

SEQ ID NO: 1276993 - RNA, 24 nt, Human
ccucagugcuuuucauucuccuua

SEQ ID NO: 1276994 - RNA, 19 nt, Human
ccugccgucugucuggcag

SEQ ID NO: 1276995 - RNA, 18 nt, Human
cggcggcccagggcccgg

SEQ ID NO: 1276996 - RNA, 19 nt, Human
cguacccauguccagagcu

SEQ ID NO: 1276997 - RNA, 20 nt, Human
cuacccaagggaauggaacc

SEQ ID NO: 1276998 - RNA, 19 nt, Human
cucagugcuuuucauucuc

SEQ ID NO: 1276999 - RNA, 19 nt, Human
cuuucccuacaucaugaaa

SEQ ID NO: 1277000 - RNA, 23 nt, Human
gaacauccaugaauacgaaagga

SEQ ID NO: 1277001 - RNA, 21 nt, Human
gaagcaaaacacaucguaccc

SEQ ID NO: 1277002 - RNA, 22 nt, Human
gcccagggcccgggagccgcuc

SEQ ID NO: 1277003 - RNA, 23 nt, Human
gcgcacuguaccugcaucacaca

SEQ ID NO: 1277004 - RNA, 24 nt, Human
gcgcacuguaccugcaucacacaa

SEQ ID NO: 1277005 - RNA, 24 nt, Human
gcuccggcugcggcggcgccuggg

SEQ ID NO: 1277006 - RNA, 18 nt, Human
ggcauacauauucccgaa

SEQ ID NO: 1277007 - RNA, 21 nt, Human
ggcggcggcccagggcccggg

SEQ ID NO: 1277008 - RNA, 21 nt, Human
gggagggagguucccguggag

SEQ ID NO: 1277009 - RNA, 21 nt, Human
gggcaauguguguccaauuuc

SEQ ID NO: 1277010 - RNA, 18 nt, Human
gguauggggugggaaagg

SEQ ID NO: 1277011 - RNA, 21 nt, Human
ggugggucuuguugaagaaug

SEQ ID NO: 1277012 - RNA, 23 nt, Human
guaaauccuaauagaaccaaaaa

SEQ ID NO: 1277013 - RNA, 22 nt, Human
uaaauccuaauagaaccaaaaa

SEQ ID NO: 1277014 - RNA, 25 nt, Human
uaacuagaaaaaaagacugccacaa

SEQ ID NO: 1277015 - RNA, 22 nt, Human
uaaguagugaaagaaaccagaa

SEQ ID NO: 1277016 - RNA, 21 nt, Human
uacaacacaaagucuugcaca

SEQ ID NO: 1277017 - RNA, 19 nt, Human
uagaaaaaaagacugccac

SEQ ID NO: 1277018 - RNA, 21 nt, Human
uagggaaaaaaaguauugaug

SEQ ID NO: 1277019 - RNA, 21 nt, Human
uaguauaacacaccacacccc

SEQ ID NO: 1277020 - RNA, 22 nt, Human
uauacagagaagcaaaacacau

SEQ ID NO: 1277021 - RNA, 19 nt, Human
ucaacauguggccaagggu

SEQ ID NO: 1277022 - RNA, 23 nt, Human
uccaaggccagcucuagcaaacc

SEQ ID NO: 1277023 - RNA, 23 nt, Human
uccagagcuuucuagaaaucuca

SEQ ID NO: 1277024 - RNA, 21 nt, Human
uccuggccggcggcggcccag

SEQ ID NO: 1277025 - RNA, 24 nt, Human
uccuggccggcggcggcccagggc

SEQ ID NO: 1277026 - RNA, 19 nt, Human
ucuagacuacaacacaaag

SEQ ID NO: 1277027 - RNA, 23 nt, Human
ucuuagaaauauauacauucaac

SEQ ID NO: 1277028 - RNA, 22 nt, Human
ugaaaagaaguucauuaacuca

SEQ ID NO: 1277029 - RNA, 26 nt, Human
ugaaagaaaccagaaaucuuccaggc

SEQ ID NO: 1277030 - RNA, 24 nt, Human
ugaaaucauaaauguauuuagcug

SEQ ID NO: 1277031 - RNA, 21 nt, Human
ugacuuaagagagaaaacacc

SEQ ID NO: 1277032 - RNA, 20 nt, Human
ugaggagagaggaaaacaga

SEQ ID NO: 1277033 - RNA, 18 nt, Human
ugcagccaacacaaguau

SEQ ID NO: 1277034 - RNA, 22 nt, Human
ugccccugccauuuuacuuccu

SEQ ID NO: 1277035 - RNA, 24 nt, Human
ugcuccaugaagugugagcuuauc

SEQ ID NO: 1277036 - RNA, 18 nt, Human
ugcugagagaaacccugu

SEQ ID NO: 1277037 - RNA, 18 nt, Human
uggcagugcugagagaaa

SEQ ID NO: 1277038 - RNA, 21 nt, Human
ugggaggggagggagguuccc

SEQ ID NO: 1277039 - RNA, 22 nt, Human
ugggaggggagggagguucccg

SEQ ID NO: 1277040 - RNA, 18 nt, Human
uggggugggaaaggagua

SEQ ID NO: 1277041 - RNA, 24 nt, Human
ugguacagcucaguaccguacaga

SEQ ID NO: 1277042 - RNA, 21 nt, Human
ugguagcaucccuggaaaugc

SEQ ID NO: 1277043 - RNA, 24 nt, Human
uguaccugcaucacacaacaaaga

SEQ ID NO: 1277044 - RNA, 23 nt, Human
ugucauggauacuaaucauaaag

SEQ ID NO: 1277045 - RNA, 21 nt, Human
uguccagagcuuucuagaaau

SEQ ID NO: 1277046 - RNA, 18 nt, Human
ugucucuugcccaccccu

SEQ ID NO: 1277047 - RNA, 21 nt, Human
uuagaaauauauacauucaac

SEQ ID NO: 1277048 - RNA, 24 nt, Human
uuauacagagaagcaaaacacauc

SEQ ID NO: 1277049 - RNA, 22 nt, Human
uuccucagugcuuuucauucuc

SEQ ID NO: 1277050 - RNA, 25 nt, Human
uuccucagugcuuuucauucuccuu

SEQ ID NO: 1277051 - RNA, 20 nt, Human
uuggcaagggagaaugggca

SEQ ID NO: 1277052 - RNA, 20 nt, Human
uuguugaagaauggcuuuga

SEQ ID NO: 1277053 - RNA, 23 nt, Human
aaaaagccagaacaaauuugaua

SEQ ID NO: 1277054 - RNA, 19 nt, Human
aaaaggcuaaacauucuca

SEQ ID NO: 1277055 - RNA, 27 nt, Human
aagcaaaggaacauaaguguaaaaugu

SEQ ID NO: 1277056 - RNA, 21 nt, Human
aaggagaaggcuagaagaggg

SEQ ID NO: 1277057 - RNA, 20 nt, Human
acagacaggcuugaaaggag

SEQ ID NO: 1277058 - RNA, 21 nt, Human
acuauauggagcucacaaucu

SEQ ID NO: 1277059 - RNA, 22 nt, Human
acugcuauugcucaugcaaaag

SEQ ID NO: 1277060 - RNA, 18 nt, Human
acugugucgcccaggcag

SEQ ID NO: 1277061 - RNA, 25 nt, Human
acuugauuuucauacuauauggagc

SEQ ID NO: 1277062 - RNA, 22 nt, Human
agacaaaggcaaucccgacaca

SEQ ID NO: 1277063 - RNA, 18 nt, Human
agacagagucucacugug

SEQ ID NO: 1277064 - RNA, 23 nt, Human
aggcauguuuguugcggcucagg

SEQ ID NO: 1277065 - RNA, 19 nt, Human
aggguagcucaggagguuc

SEQ ID NO: 1277066 - RNA, 24 nt, Human
agggugggggaagauaaaugcuug

SEQ ID NO: 1277067 - RNA, 22 nt, Human
caaacugaucaaaaaaucugcc

SEQ ID NO: 1277068 - RNA, 21 nt, Human
cacuguaugugugugcagaga

SEQ ID NO: 1277069 - RNA, 19 nt, Human
cacugugucgcccaggcag

SEQ ID NO: 1277070 - RNA, 23 nt, Human
caggguuucuguuuuucaagugu

SEQ ID NO: 1277071 - RNA, 18 nt, Human
ccaaaaaagccagaacaa

SEQ ID NO: 1277072 - RNA, 19 nt, Human
ccaaaaaagccagaacaaa

SEQ ID NO: 1277073 - RNA, 25 nt, Human
ccaaaaaagccagaacaaauuugau

SEQ ID NO: 1277074 - RNA, 24 nt, Human
ccacauggaagcagagacaaaggc

SEQ ID NO: 1277075 - RNA, 19 nt, Human
ccagccaucuuccccccuc

SEQ ID NO: 1277076 - RNA, 24 nt, Human
ccuccuagugcuaaugccuaauuu

SEQ ID NO: 1277077 - RNA, 22 nt, Human
cugucucuucuggggacuucuc

SEQ ID NO: 1277078 - RNA, 22 nt, Human
gaaaagccacauggaagcagag

SEQ ID NO: 1277079 - RNA, 23 nt, Human
gaaaagccacauggaagcagaga

SEQ ID NO: 1277080 - RNA, 21 nt, Human
gacaaaagguaacuauuuuuu

SEQ ID NO: 1277081 - RNA, 22 nt, Human
gagaaaggcagaaaagcuucua

SEQ ID NO: 1277082 - RNA, 18 nt, Human
gagacagagucucacugu

SEQ ID NO: 1277083 - RNA, 21 nt, Human
ggccaggcgcagcggcucacg

SEQ ID NO: 1277084 - RNA, 25 nt, Human
gucauugucucucuugcccaugugc

SEQ ID NO: 1277085 - RNA, 20 nt, Human
gugccaaaaaagccagaaca

SEQ ID NO: 1277086 - RNA, 19 nt, Human
gugguuccuucacuguaug

SEQ ID NO: 1277087 - RNA, 24 nt, Human
uaaauauuuuccaaauaaaauucu

SEQ ID NO: 1277088 - RNA, 23 nt, Human
uaacagacaggcuugaaaggaga

SEQ ID NO: 1277089 - RNA, 28 nt, Human
uacaaaaggaaaagccacauggaagcag

SEQ ID NO: 1277090 - RNA, 22 nt, Human
uacauacaugaagaauaaauua

SEQ ID NO: 1277091 - RNA, 21 nt, Human
uagacaugacauccaaaggac

SEQ ID NO: 1277092 - RNA, 22 nt, Human
uauuuuacauacaugaagaaua

SEQ ID NO: 1277093 - RNA, 20 nt, Human
uccaaaggacaaaagguaac

SEQ ID NO: 1277094 - RNA, 22 nt, Human
ucuauuuacuuauuuauuuauu

SEQ ID NO: 1277095 - RNA, 24 nt, Human
ugaaacauaaucgcauauggcccu

SEQ ID NO: 1277096 - RNA, 26 nt, Human
ugacaacgagcaauguauucaccccu

SEQ ID NO: 1277097 - RNA, 20 nt, Human
ugagaaugggccaggcgcag

SEQ ID NO: 1277098 - RNA, 19 nt, Human
ugagacagagucucacugu

SEQ ID NO: 1277099 - RNA, 22 nt, Human
ugcagugguguaaucucugcug

SEQ ID NO: 1277100 - RNA, 20 nt, Human
ugccaaaaaagccagaacaa

SEQ ID NO: 1277101 - RNA, 21 nt, Human
ugccaaaaaagccagaacaaa

SEQ ID NO: 1277102 - RNA, 24 nt, Human
ugccaaaaaagccagaacaaauuu

SEQ ID NO: 1277103 - RNA, 18 nt, Human
uggaacagugacaacgag

SEQ ID NO: 1277104 - RNA, 19 nt, Human
uggaagcagagacaaaggc

SEQ ID NO: 1277105 - RNA, 18 nt, Human
ugugcagagaaaggcaga

SEQ ID NO: 1277106 - RNA, 19 nt, Human
uuacuuauuuauuuauuuu

SEQ ID NO: 1277107 - RNA, 20 nt, Human
uuagugccaaaaaagccaga

SEQ ID NO: 1277108 - RNA, 21 nt, Human
uuccaaaguuuagacaugaca

SEQ ID NO: 1277109 - RNA, 21 nt, Human
uuccuucacuguaugugugug

SEQ ID NO: 1277110 - RNA, 21 nt, Human
uugcagugguguaaucucugc

SEQ ID NO: 1277111 - RNA, 21 nt, Human
uuuacauacaugaagaauaaa

SEQ ID NO: 1277112 - RNA, 24 nt, Human
uuugcaaaauucuuagaagauugc

SEQ ID NO: 1277113 - RNA, 24 nt, Human
aaacaagagccguuccagccagag

SEQ ID NO: 1277114 - RNA, 22 nt, Human
aaagccgccacaaaacaucagg

SEQ ID NO: 1277115 - RNA, 22 nt, Human
aaccagaaggagggaacuccca

SEQ ID NO: 1277116 - RNA, 23 nt, Human
aacccaaggcucucaaagcucca

SEQ ID NO: 1277117 - RNA, 23 nt, Human
aaggggcucauuuauuuuuuucu

SEQ ID NO: 1277118 - RNA, 18 nt, Human
acccaagcucaaaggacc

SEQ ID NO: 1277119 - RNA, 19 nt, Human
acccggaaguagggagccc

SEQ ID NO: 1277120 - RNA, 18 nt, Human
accucgucuaccacuccu

SEQ ID NO: 1277121 - RNA, 18 nt, Human
acggggcggggcggggcg

SEQ ID NO: 1277122 - RNA, 18 nt, Human
acuagccucagacuucug

SEQ ID NO: 1277123 - RNA, 24 nt, Human
acucacuaaaaggaagguucugcc

SEQ ID NO: 1277124 - RNA, 20 nt, Human
acugcuguccaucaaaugcu

SEQ ID NO: 1277125 - RNA, 20 nt, Human
agaaaacacuggaacacugc

SEQ ID NO: 1277126 - RNA, 20 nt, Human
agacagcaagaaccagaagg

SEQ ID NO: 1277127 - RNA, 18 nt, Human
agacauugauaaaggcag

SEQ ID NO: 1277128 - RNA, 19 nt, Human
agagggcacacggugaaaa

SEQ ID NO: 1277129 - RNA, 21 nt, Human
agauagguuuuuuccuguggu

SEQ ID NO: 1277130 - RNA, 21 nt, Human
agaucucuccagaaaccguac

SEQ ID NO: 1277131 - RNA, 19 nt, Human
agcgguaaaacaagagccg

SEQ ID NO: 1277132 - RNA, 27 nt, Human
agcugugggaauccugagagacagaca

SEQ ID NO: 1277133 - RNA, 24 nt, Human
aggcaacuaggaagacaggccagg

SEQ ID NO: 1277134 - RNA, 19 nt, Human
aggcagaagguaccaagac

SEQ ID NO: 1277135 - RNA, 21 nt, Human
aggcagacagcaagaaccaga

SEQ ID NO: 1277136 - RNA, 22 nt, Human
aggcagacagcaagaaccagaa

SEQ ID NO: 1277137 - RNA, 21 nt, Human
aguagagauaaacuggggggc

SEQ ID NO: 1277138 - RNA, 18 nt, Human
auaguauauaucuuucuc

SEQ ID NO: 1277139 - RNA, 23 nt, Human
auaucacagucuccauuuucaag

SEQ ID NO: 1277140 - RNA, 22 nt, Human
auggacauuucccuuauuuuag

SEQ ID NO: 1277141 - RNA, 18 nt, Human
augguagcaaugaaugaa

SEQ ID NO: 1277142 - RNA, 26 nt, Human
caaauggcugaaagcucagaaaauca

SEQ ID NO: 1277143 - RNA, 22 nt, Human
caacagcagccagcugcaaugc

SEQ ID NO: 1277144 - RNA, 26 nt, Human
caagaaccagaaggagggaacuccca

SEQ ID NO: 1277145 - RNA, 19 nt, Human
cacaaggccacagugagca

SEQ ID NO: 1277146 - RNA, 25 nt, Human
cacugcaaaaaauaaaaaucaaagg

SEQ ID NO: 1277147 - RNA, 20 nt, Human
cacuggcugcuggacagaac

SEQ ID NO: 1277148 - RNA, 24 nt, Human
cagcaagaaccagaaggagggaag

SEQ ID NO: 1277149 - RNA, 20 nt, Human
cagcauggagccuucaucuc

SEQ ID NO: 1277150 - RNA, 22 nt, Human
cagcauggagccuucaucuccu

SEQ ID NO: 1277151 - RNA, 20 nt, Human
cagcugccaccgucagaggg

SEQ ID NO: 1277152 - RNA, 20 nt, Human
caggucccuucagagccgug

SEQ ID NO: 1277153 - RNA, 19 nt, Human
caugugauuuacugggcac

SEQ ID NO: 1277154 - RNA, 22 nt, Human
ccaaagcggaacccagcacccc

SEQ ID NO: 1277155 - RNA, 19 nt, Human
ccagcugcaaugcaaaguc

SEQ ID NO: 1277156 - RNA, 23 nt, Human
cccagcacccaccuucagcagac

SEQ ID NO: 1277157 - RNA, 23 nt, Human
cccaggaccaggcaggguggggc

SEQ ID NO: 1277158 - RNA, 22 nt, Human
ccccaccacccaacaccgagca

SEQ ID NO: 1277159 - RNA, 20 nt, Human
cccccggaggcuuuuagcuu

SEQ ID NO: 1277160 - RNA, 21 nt, Human
cccccggaggcuuuuagcuuc

SEQ ID NO: 1277161 - RNA, 18 nt, Human
ccgggaccagcuguggga

SEQ ID NO: 1277162 - RNA, 22 nt, Human
cgguagaaagguaaagucaaga

SEQ ID NO: 1277163 - RNA, 23 nt, Human
cgguagaaagguaaagucaagaa

SEQ ID NO: 1277164 - RNA, 18 nt, Human
cuaauccugaaaauaacu

SEQ ID NO: 1277165 - RNA, 22 nt, Human
cuaauccugaaaauaacuucua

SEQ ID NO: 1277166 - RNA, 20 nt, Human
cuacaagccaaaugcuuccc

SEQ ID NO: 1277167 - RNA, 19 nt, Human
cuagggccaugaggggacc

SEQ ID NO: 1277168 - RNA, 24 nt, Human
cuaucugucagcgguaaaacaaga

SEQ ID NO: 1277169 - RNA, 18 nt, Human
cuccagaaaccguacucc

SEQ ID NO: 1277170 - RNA, 19 nt, Human
cuuuuuuuuuuuaaagcac

SEQ ID NO: 1277171 - RNA, 19 nt, Human
gaaaagguggucuggaugu

SEQ ID NO: 1277172 - RNA, 19 nt, Human
gacaggcaugcccgggacc

SEQ ID NO: 1277173 - RNA, 19 nt, Human
gaccaggcaggguggggcu

SEQ ID NO: 1277174 - RNA, 19 nt, Human
gauccucuguacauauuca

SEQ ID NO: 1277175 - RNA, 19 nt, Human
gcacggggcggggcggggc

SEQ ID NO: 1277176 - RNA, 22 nt, Human
gccacagugagcacgguagaaa

SEQ ID NO: 1277177 - RNA, 21 nt, Human
gcguuucuuaggucacucuga

SEQ ID NO: 1277178 - RNA, 18 nt, Human
gcuuugaaaaagcucuga

SEQ ID NO: 1277179 - RNA, 18 nt, Human
ggaacccagcacccaccu

SEQ ID NO: 1277180 - RNA, 20 nt, Human
ggaggcagacagcaagaacc

SEQ ID NO: 1277181 - RNA, 21 nt, Human
ggaggucgucuuugguguucu

SEQ ID NO: 1277182 - RNA, 23 nt, Human
ggaucugauaucuuugagagagc

SEQ ID NO: 1277183 - RNA, 21 nt, Human
ggcacacggugaaaauuuaca

SEQ ID NO: 1277184 - RNA, 21 nt, Human
ggccacaaguacagcagcggg

SEQ ID NO: 1277185 - RNA, 22 nt, Human
ggccacagugagcacgguagaa

SEQ ID NO: 1277186 - RNA, 23 nt, Human
gggaacucccauuuugcgauguc

SEQ ID NO: 1277187 - RNA, 21 nt, Human
gggcggggcggggcggggggg

SEQ ID NO: 1277188 - RNA, 25 nt, Human
ggggcucauuuauuuuuuucugucu

SEQ ID NO: 1277189 - RNA, 19 nt, Human
gggugcuguaggcaacagg

SEQ ID NO: 1277190 - RNA, 20 nt, Human
gguagggggaacagggucau

SEQ ID NO: 1277191 - RNA, 24 nt, Human
gguucauuaugugcucagaggugc

SEQ ID NO: 1277192 - RNA, 21 nt, Human
guacagcagcgggcugugagu

SEQ ID NO: 1277193 - RNA, 19 nt, Human
guaccaagacaaccccauu

SEQ ID NO: 1277194 - RNA, 20 nt, Human
gugacccugcucuuaaaaau

SEQ ID NO: 1277195 - RNA, 24 nt, Human
gugcguuucuuaggucacucugag

SEQ ID NO: 1277196 - RNA, 18 nt, Human
guggccagucacacccua

SEQ ID NO: 1277197 - RNA, 21 nt, Human
uaaaacaagagccguuccagc

SEQ ID NO: 1277198 - RNA, 21 nt, Human
uaaaagagaaccaugggaaca

SEQ ID NO: 1277199 - RNA, 24 nt, Human
uaaaggcagaguugacauaaacgg

SEQ ID NO: 1277200 - RNA, 18 nt, Human
uaaaggguaccccuuggg

SEQ ID NO: 1277201 - RNA, 21 nt, Human
uaaauaauaacaaaagccgcc

SEQ ID NO: 1277202 - RNA, 21 nt, Human
uaacaaaagccgccacaaaac

SEQ ID NO: 1277203 - RNA, 20 nt, Human
uaacaugcacacaugaagcu

SEQ ID NO: 1277204 - RNA, 21 nt, Human
uaacaugcacacaugaagcuu

SEQ ID NO: 1277205 - RNA, 19 nt, Human
uacaggucccuucagagcc

SEQ ID NO: 1277206 - RNA, 20 nt, Human
uagagauaaacuggggggca

SEQ ID NO: 1277207 - RNA, 23 nt, Human
uaguagagauaaacuggggggca

SEQ ID NO: 1277208 - RNA, 19 nt, Human
uaguucaaagccauugacc

SEQ ID NO: 1277209 - RNA, 20 nt, Human
uauaacugaggaucugaagc

SEQ ID NO: 1277210 - RNA, 19 nt, Human
ucaaagccauugaccaacc

SEQ ID NO: 1277211 - RNA, 19 nt, Human
ucacacccuaccuggcuca

SEQ ID NO: 1277212 - RNA, 27 nt, Human
ucagcgguaaaacaagagccguuccuu

SEQ ID NO: 1277213 - RNA, 23 nt, Human
ucauuacuagccucagacuucug

SEQ ID NO: 1277214 - RNA, 25 nt, Human
uccagggcugagccauggcaucucu

SEQ ID NO: 1277215 - RNA, 18 nt, Human
ucccagggaucuggacaa

SEQ ID NO: 1277216 - RNA, 27 nt, Human
uccccaccaaagcggaacccagcaccc

SEQ ID NO: 1277217 - RNA, 22 nt, Human
uccuccucauuacuagccucag

SEQ ID NO: 1277218 - RNA, 22 nt, Human
ucuccccaccaaagcggaaccc

SEQ ID NO: 1277219 - RNA, 18 nt, Human
ucucuccaacaaugggaa

SEQ ID NO: 1277220 - RNA, 23 nt, Human
ucucuguguccuaaaccaaacaa

SEQ ID NO: 1277221 - RNA, 23 nt, Human
ucugauccuacaggucccuucag

SEQ ID NO: 1277222 - RNA, 24 nt, Human
ucugucugcagcaauggugaaagg

SEQ ID NO: 1277223 - RNA, 23 nt, Human
ugaagcacuucacuuggaaaugc

SEQ ID NO: 1277224 - RNA, 24 nt, Human
ugaauuuucaggcagaagguacca

SEQ ID NO: 1277225 - RNA, 23 nt, Human
ugagagacagacaugaagcacuu

SEQ ID NO: 1277226 - RNA, 18 nt, Human
ugagagagcccagagcug

SEQ ID NO: 1277227 - RNA, 18 nt, Human
ugaggaucugaagccuca

SEQ ID NO: 1277228 - RNA, 21 nt, Human
ugagggauuuuuaucaacagc

SEQ ID NO: 1277229 - RNA, 20 nt, Human
ugaguaaguuguacagguuc

SEQ ID NO: 1277230 - RNA, 22 nt, Human
ugauaagcacuauuuucugaaa

SEQ ID NO: 1277231 - RNA, 23 nt, Human
ugcaaaaaauaaaaaucaaaggc

SEQ ID NO: 1277232 - RNA, 19 nt, Human
ugcccgggaccagcugugg

SEQ ID NO: 1277233 - RNA, 21 nt, Human
ugcgggggcgucgggcggggg

SEQ ID NO: 1277234 - RNA, 23 nt, Human
uggaaaugcuuugaaaaagcucu

SEQ ID NO: 1277235 - RNA, 20 nt, Human
uggaagaaaagguggucugg

SEQ ID NO: 1277236 - RNA, 19 nt, Human
ugggguagggggaacaggg

SEQ ID NO: 1277237 - RNA, 18 nt, Human
ugggugcuguaggcaaca

SEQ ID NO: 1277238 - RNA, 21 nt, Human
ugggugcuguaggcaacaggu

SEQ ID NO: 1277239 - RNA, 19 nt, Human
ugguagcaaugaaugaaua

SEQ ID NO: 1277240 - RNA, 23 nt, Human
ugguccccugaaucuaaguuccc

SEQ ID NO: 1277241 - RNA, 21 nt, Human
uguacaaaugcaaauuucagu

SEQ ID NO: 1277242 - RNA, 22 nt, Human
uguccuaaaccaaacaaggggc

SEQ ID NO: 1277243 - RNA, 21 nt, Human
ugucucaggugggaaaacgga

SEQ ID NO: 1277244 - RNA, 21 nt, Human
ugugacacagcugacacagca

SEQ ID NO: 1277245 - RNA, 20 nt, Human
uuaaaggguaccccuugggc

SEQ ID NO: 1277246 - RNA, 19 nt, Human
uuaagcuuggaaacuuuaa

SEQ ID NO: 1277247 - RNA, 24 nt, Human
uuagaaagguuuucaaugcuuucc

SEQ ID NO: 1277248 - RNA, 24 nt, Human
uuauuuuuuucugucugcagcaau

SEQ ID NO: 1277249 - RNA, 18 nt, Human
uucaaagccauugaccaa

SEQ ID NO: 1277250 - RNA, 23 nt, Human
uucaaagccauugaccaacccag

SEQ ID NO: 1277251 - RNA, 22 nt, Human
uucaugaauuuucaggcagaag

SEQ ID NO: 1277252 - RNA, 19 nt, Human
uuccccaccacccaacacc

SEQ ID NO: 1277253 - RNA, 21 nt, Human
uucccugaccuuggaaaugcu

SEQ ID NO: 1277254 - RNA, 21 nt, Human
uucugauccuacaggucccuu

SEQ ID NO: 1277255 - RNA, 21 nt, Human
uuggaaaugcuuugaaaaagc

SEQ ID NO: 1277256 - RNA, 23 nt, Human
uuugaguuuaggucucaggucag

SEQ ID NO: 1277257 - RNA, 20 nt, Human
uuuuuuuaaagcaccaagug

SEQ ID NO: 1277258 - RNA, 18 nt, Human
uuggcuuaccugauggcu

SEQ ID NO: 1277259 - RNA, 21 nt, Human
acaaggagucuccuuuacuuu

SEQ ID NO: 1277260 - RNA, 23 nt, Human
accauauaauaacauagcuuaaa

SEQ ID NO: 1277261 - RNA, 25 nt, Human
caggggcuccccuccacaaggaguc

SEQ ID NO: 1277262 - RNA, 21 nt, Human
ggcaggggcuccccuccacaa

SEQ ID NO: 1277263 - RNA, 21 nt, Human
uguauuuccuuuuuccucuuu

SEQ ID NO: 1277264 - RNA, 19 nt, Human
aaaauguuuauauuuauug

SEQ ID NO: 1277265 - RNA, 21 nt, Human
aaccgcacaccaucagcagca

SEQ ID NO: 1277266 - RNA, 20 nt, Human
aagaaaauaagcccaaaagc

SEQ ID NO: 1277267 - RNA, 18 nt, Human
aagcccaaaagccaagga

SEQ ID NO: 1277268 - RNA, 25 nt, Human
aagugucuucuucaguuucagaccc

SEQ ID NO: 1277269 - RNA, 23 nt, Human
accccagggaugccagaugucag

SEQ ID NO: 1277270 - RNA, 22 nt, Human
acccugaaggcucaugaucucu

SEQ ID NO: 1277271 - RNA, 18 nt, Human
acgcugugccacaucuug

SEQ ID NO: 1277272 - RNA, 19 nt, Human
agaaaauaagcccaaaagc

SEQ ID NO: 1277273 - RNA, 21 nt, Human
aggaggaagugucuucuucag

SEQ ID NO: 1277274 - RNA, 24 nt, Human
aggcaauccuuuugcacgugucuc

SEQ ID NO: 1277275 - RNA, 22 nt, Human
aggggucuguggccuucaucag

SEQ ID NO: 1277276 - RNA, 24 nt, Human
aguaaugagaugcaucccaauuuc

SEQ ID NO: 1277277 - RNA, 21 nt, Human
auaaaaaaagaugccauacaa

SEQ ID NO: 1277278 - RNA, 22 nt, Human
aucuugggggcagaagggcagu

SEQ ID NO: 1277279 - RNA, 25 nt, Human
caaagcgaagucaguaaaagacaga

SEQ ID NO: 1277280 - RNA, 24 nt, Human
caagaaaauaagcccaaaagccaa

SEQ ID NO: 1277281 - RNA, 25 nt, Human
cacaaguacaggacuaugucaggaa

SEQ ID NO: 1277282 - RNA, 23 nt, Human
cacgaacacaagcagagucagcc

SEQ ID NO: 1277283 - RNA, 18 nt, Human
cagcaggugcccuccuuu

SEQ ID NO: 1277284 - RNA, 22 nt, Human
cagcccgacgcugugccacauc

SEQ ID NO: 1277285 - RNA, 18 nt, Human
cagcguggccacgaacac

SEQ ID NO: 1277286 - RNA, 23 nt, Human
caggacgaucagcagcguggcca

SEQ ID NO: 1277287 - RNA, 21 nt, Human
cauccuucacaaguacaggac

SEQ ID NO: 1277288 - RNA, 18 nt, Human
ccgccccaggcccccuac

SEQ ID NO: 1277289 - RNA, 20 nt, Human
cgaacacaagcagagucagc

SEQ ID NO: 1277290 - RNA, 24 nt, Human
cgagcggaucugauucugugugga

SEQ ID NO: 1277291 - RNA, 23 nt, Human
cgccccaggcccccuaccgcugg

SEQ ID NO: 1277292 - RNA, 20 nt, Human
cggcggugagcgcgggcggc

SEQ ID NO: 1277293 - RNA, 25 nt, Human
cggcggugagcgcgggcggcggcgc

SEQ ID NO: 1277294 - RNA, 21 nt, Human
cggcucggggcggcuggcgcg

SEQ ID NO: 1277295 - RNA, 19 nt, Human
cggcuggcgcggacggcgg

SEQ ID NO: 1277296 - RNA, 24 nt, Human
cguggccacgaacacaagcagagu

SEQ ID NO: 1277297 - RNA, 22 nt, Human
cucaugaucucccucuugggau

SEQ ID NO: 1277298 - RNA, 24 nt, Human
cucaugaucucccucuugggaucc

SEQ ID NO: 1277299 - RNA, 19 nt, Human
cuugggggcagaagggcag

SEQ ID NO: 1277300 - RNA, 22 nt, Human
gaacacaagcagagucagcccg

SEQ ID NO: 1277301 - RNA, 21 nt, Human
gaggaggaagugucuucuuca

SEQ ID NO: 1277302 - RNA, 23 nt, Human
gauccugugucucccaccaguuc

SEQ ID NO: 1277303 - RNA, 26 nt, Human
gcccucgucgcuguccacccgugucu

SEQ ID NO: 1277304 - RNA, 18 nt, Human
ggaucugauucugugugg

SEQ ID NO: 1277305 - RNA, 18 nt, Human
ggcggcggcgcguccugc

SEQ ID NO: 1277306 - RNA, 21 nt, Human
ggcggcggcgcguccugcgcu

SEQ ID NO: 1277307 - RNA, 18 nt, Human
gggcggcuggcgcggacg

SEQ ID NO: 1277308 - RNA, 19 nt, Human
guagaaagcuggugaaaca

SEQ ID NO: 1277309 - RNA, 23 nt, Human
gucgcccggccgcggcuguagcg

SEQ ID NO: 1277310 - RNA, 23 nt, Human
guggccacgaacacaagcagagu

SEQ ID NO: 1277311 - RNA, 18 nt, Human
uaaaagacagaagcuggc

SEQ ID NO: 1277312 - RNA, 22 nt, Human
uaaaagacagaagcuggcaacu

SEQ ID NO: 1277313 - RNA, 22 nt, Human
uaaguuaaaaugggaagaaaaa

SEQ ID NO: 1277314 - RNA, 21 nt, Human
uacaggacuaugucagggguc

SEQ ID NO: 1277315 - RNA, 24 nt, Human
ucucugagaccccagggaugccag

SEQ ID NO: 1277316 - RNA, 24 nt, Human
ucucugagaccccagggaugccag

SEQ ID NO: 1277317 - RNA, 23 nt, Human
ucugagaccccagggaugccaga

SEQ ID NO: 1277318 - RNA, 19 nt, Human
ucuugggggcagaagggca

SEQ ID NO: 1277319 - RNA, 20 nt, Human
ucuugggggcagaagggcag

SEQ ID NO: 1277320 - RNA, 18 nt, Human
ugccauacaaaauaccaa

SEQ ID NO: 1277321 - RNA, 24 nt, Human
ugggggcagaagggcagucggcuc

SEQ ID NO: 1277322 - RNA, 23 nt, Human
uucagucauuaguaaauuucaaa

SEQ ID NO: 1277323 - RNA, 19 nt, Human
aacaaggccugagccaaca

SEQ ID NO: 1277324 - RNA, 24 nt, Human
aagacauuucucaaacaaaaaaaa

SEQ ID NO: 1277325 - RNA, 22 nt, Human
aauggauaauaacccaacugcc

SEQ ID NO: 1277326 - RNA, 20 nt, Human
agcaguucccagggaugaug

SEQ ID NO: 1277327 - RNA, 24 nt, Human
aggcagcccaggcugagggcugca

SEQ ID NO: 1277328 - RNA, 21 nt, Human
auaaaaaaaaagcaacaccac

SEQ ID NO: 1277329 - RNA, 21 nt, Human
caaaagcagcaauacacggaa

SEQ ID NO: 1277330 - RNA, 21 nt, Human
caacugcaaacuaccaacaua

SEQ ID NO: 1277331 - RNA, 21 nt, Human
cacccuucuuuggucaccaag

SEQ ID NO: 1277332 - RNA, 19 nt, Human
cagcaaaagcagcaauaca

SEQ ID NO: 1277333 - RNA, 24 nt, Human
cagcaaaagcagcaauacacggaa

SEQ ID NO: 1277334 - RNA, 22 nt, Human
caggcagcccaggcugagggcu

SEQ ID NO: 1277335 - RNA, 18 nt, Human
ccaacugcaaacuaccaa

SEQ ID NO: 1277336 - RNA, 20 nt, Human
ccacuccaaguuguuuaaca

SEQ ID NO: 1277337 - RNA, 21 nt, Human
cccaacugcaaacuaccaaca

SEQ ID NO: 1277338 - RNA, 21 nt, Human
cugcaaucauaaaaccaggcu

SEQ ID NO: 1277339 - RNA, 20 nt, Human
cuuucucuucgucuucaggc

SEQ ID NO: 1277340 - RNA, 19 nt, Human
gaaaugaauacacccuucu

SEQ ID NO: 1277341 - RNA, 24 nt, Human
gcagcaauacacggaaaugaauac

SEQ ID NO: 1277342 - RNA, 21 nt, Human
gcugcaaucauaaaaccaggc

SEQ ID NO: 1277343 - RNA, 21 nt, Human
ggcugcaaucauaaaaccagg

SEQ ID NO: 1277344 - RNA, 23 nt, Human
uacaaaagguuaauuuuuaugaa

SEQ ID NO: 1277345 - RNA, 19 nt, Human
ucagcaaaagcagcaauac

SEQ ID NO: 1277346 - RNA, 21 nt, Human
ucuucaggcagcccaggcuga

SEQ ID NO: 1277347 - RNA, 25 nt, Human
ucuuuggucaccaagucuguuguuc

SEQ ID NO: 1277348 - RNA, 24 nt, Human
uguuuggaggggaggaaauugaau

SEQ ID NO: 1277349 - RNA, 24 nt, Human
uuacuuuuauaaaaaaaaagcaac

SEQ ID NO: 1277350 - RNA, 23 nt, Human
uucucuucgucuucaggcagccc

SEQ ID NO: 1277351 - RNA, 22 nt, Human
uuuggaggggaggaaauugaau

SEQ ID NO: 1277352 - RNA, 20 nt, Human
agagggguggagguuggggc

SEQ ID NO: 1277353 - RNA, 20 nt, Human
aucccaucucuuuccucuug

SEQ ID NO: 1277354 - RNA, 22 nt, Human
augguggccccugaacauugua

SEQ ID NO: 1277355 - RNA, 21 nt, Human
caauucauaucaaaauacgga

SEQ ID NO: 1277356 - RNA, 24 nt, Human
cacagagagggguggagguugggg

SEQ ID NO: 1277357 - RNA, 19 nt, Human
caccaugugugccaggugc

SEQ ID NO: 1277358 - RNA, 21 nt, Human
cauaucaaaauacggaaucca

SEQ ID NO: 1277359 - RNA, 19 nt, Human
ccaucuccaccuuccuugc

SEQ ID NO: 1277360 - RNA, 24 nt, Human
ccccugaacauuguaugagguagg

SEQ ID NO: 1277361 - RNA, 22 nt, Human
cccuuuucuuccugagaaugga

SEQ ID NO: 1277362 - RNA, 20 nt, Human
gaggccaucgcauuucccac

SEQ ID NO: 1277363 - RNA, 20 nt, Human
gauuggaccugggacuggag

SEQ ID NO: 1277364 - RNA, 21 nt, Human
gcguggggcaccuugccucuu

SEQ ID NO: 1277365 - RNA, 23 nt, Human
ggagcuggucggcccugcaggug

SEQ ID NO: 1277366 - RNA, 21 nt, Human
ggagguuggggcagguggggg

SEQ ID NO: 1277367 - RNA, 19 nt, Human
ggggaugguggccccugaa

SEQ ID NO: 1277368 - RNA, 24 nt, Human
ggguggagguuggggcaggugggg

SEQ ID NO: 1277369 - RNA, 22 nt, Human
ggguuuccggcuuuuggccacu

SEQ ID NO: 1277370 - RNA, 20 nt, Human
gucaauaucacagagagggg

SEQ ID NO: 1277371 - RNA, 22 nt, Human
uagcaggcaucuuccaccagau

SEQ ID NO: 1277372 - RNA, 24 nt, Human
uagcaggcaucuuccaccagauuu

SEQ ID NO: 1277373 - RNA, 23 nt, Human
ucaauaucacagagaggggugga

SEQ ID NO: 1277374 - RNA, 19 nt, Human
ucgucuucagcaccacgau

SEQ ID NO: 1277375 - RNA, 19 nt, Human
ucucuugacagcguuuacu

SEQ ID NO: 1277376 - RNA, 21 nt, Human
uggaggccaucgcauuuccca

SEQ ID NO: 1277377 - RNA, 22 nt, Human
uggaggccaucgcauuucccac

SEQ ID NO: 1277378 - RNA, 18 nt, Human
ugguggccccugaacauu

SEQ ID NO: 1277379 - RNA, 20 nt, Human
ugguggccccugaacauugu

SEQ ID NO: 1277380 - RNA, 18 nt, Human
uguaagcauccaucucca

SEQ ID NO: 1277381 - RNA, 19 nt, Human
uguugaaugaucaacuuuu

SEQ ID NO: 1277382 - RNA, 21 nt, Human
uucagcaccacgauccacagg

SEQ ID NO: 1277383 - RNA, 22 nt, Human
uucccacaugauaacaauucau

SEQ ID NO: 1277384 - RNA, 25 nt, Human
uuccuugcuccauuguuuauccgac

SEQ ID NO: 1277385 - RNA, 18 nt, Human
uugcaccgucucuugaca

SEQ ID NO: 1277386 - RNA, 23 nt, Human
uuggggcaggugggggauggugg

SEQ ID NO: 1277387 - RNA, 21 nt, Human
aagccucguuccgcugguccc

SEQ ID NO: 1277388 - RNA, 20 nt, Human
ucccugaacaaaaacuccua

SEQ ID NO: 1277389 - RNA, 21 nt, Human
ucguuccgcuggucccugaac

SEQ ID NO: 1277390 - RNA, 23 nt, Human
aaacauuuuaagcuucggugguc

SEQ ID NO: 1277391 - RNA, 22 nt, Human
aaacgucucuguggcuucugag

SEQ ID NO: 1277392 - RNA, 20 nt, Human
aacuuagcccugccauugua

SEQ ID NO: 1277393 - RNA, 21 nt, Human
aagcagccauaggcccucuca

SEQ ID NO: 1277394 - RNA, 22 nt, Human
aagcagccauaggcccucucag

SEQ ID NO: 1277395 - RNA, 21 nt, Human
aagccaggaucuagacccacg

SEQ ID NO: 1277396 - RNA, 24 nt, Human
aagccaggaucuagacccacgcag

SEQ ID NO: 1277397 - RNA, 19 nt, Human
aagcucaugcuuugcuacc

SEQ ID NO: 1277398 - RNA, 24 nt, Human
accuacuucaggacaacugugauu

SEQ ID NO: 1277399 - RNA, 19 nt, Human
acuagcaaagccaggaucu

SEQ ID NO: 1277400 - RNA, 23 nt, Human
acuuucaaagacgcuguaagaaa

SEQ ID NO: 1277401 - RNA, 26 nt, Human
agacgcuguaagaaagcuacugagcu

SEQ ID NO: 1277402 - RNA, 21 nt, Human
agccaggaucuagacccacgc

SEQ ID NO: 1277403 - RNA, 21 nt, Human
auaccagugacgccauugaga

SEQ ID NO: 1277404 - RNA, 21 nt, Human
caaaccuucucugguaaaggc

SEQ ID NO: 1277405 - RNA, 24 nt, Human
caaacucuucaguccuugcagaag

SEQ ID NO: 1277406 - RNA, 22 nt, Human
caacuaggaacuagcaaagcca

SEQ ID NO: 1277407 - RNA, 20 nt, Human
caagauuccuuucaauccug

SEQ ID NO: 1277408 - RNA, 18 nt, Human
cacacaacuaggaacuag

SEQ ID NO: 1277409 - RNA, 24 nt, Human
cacgcaaaccucucuuugaagcuc

SEQ ID NO: 1277410 - RNA, 25 nt, Human
caggcaagaaaauguucuuggauga

SEQ ID NO: 1277411 - RNA, 23 nt, Human
cccacgcaaaccucucuuugaag

SEQ ID NO: 1277412 - RNA, 22 nt, Human
ccuacuucaggacaacugugau

SEQ ID NO: 1277413 - RNA, 23 nt, Human
cgucacacaacuaggaacuagca

SEQ ID NO: 1277414 - RNA, 23 nt, Human
cuacugagcugcuucacaaacgu

SEQ ID NO: 1277415 - RNA, 21 nt, Human
cuagacccacgcaaaccucuc

SEQ ID NO: 1277416 - RNA, 22 nt, Human
cuccaggcugaccugcacugcc

SEQ ID NO: 1277417 - RNA, 20 nt, Human
cugccagcgauacuugaucc

SEQ ID NO: 1277418 - RNA, 21 nt, Human
cuuauggccacguccauaacu

SEQ ID NO: 1277419 - RNA, 19 nt, Human
gaaaaauaaagguagaggc

SEQ ID NO: 1277420 - RNA, 21 nt, Human
gaaugaugaauccagaaaaga

SEQ ID NO: 1277421 - RNA, 20 nt, Human
gaccugcacugccugaaaga

SEQ ID NO: 1277422 - RNA, 18 nt, Human
gcccaacgucacacaacu

SEQ ID NO: 1277423 - RNA, 19 nt, Human
gugaaagcagccauaggcc

SEQ ID NO: 1277424 - RNA, 19 nt, Human
uaagacagauaggaaaagu

SEQ ID NO: 1277425 - RNA, 21 nt, Human
uaccaaauaucgugucauucu

SEQ ID NO: 1277426 - RNA, 18 nt, Human
uacuucaggacaacugug

SEQ ID NO: 1277427 - RNA, 26 nt, Human
uagcaaagccaggaucuagacccacg

SEQ ID NO: 1277428 - RNA, 22 nt, Human
uaggaaaaauaaagguagaggc

SEQ ID NO: 1277429 - RNA, 21 nt, Human
uagggcuuauggccacgucca

SEQ ID NO: 1277430 - RNA, 18 nt, Human
uccaggcugaccugcacu

SEQ ID NO: 1277431 - RNA, 18 nt, Human
ucccgcaaaaauaucuuc

SEQ ID NO: 1277432 - RNA, 18 nt, Human
ucugagagggagucucug

SEQ ID NO: 1277433 - RNA, 22 nt, Human
ucugcaagauuccuuucaaucc

SEQ ID NO: 1277434 - RNA, 22 nt, Human
ugaaaauaaagcaaaaaguugu

SEQ ID NO: 1277435 - RNA, 23 nt, Human
ugaaaauauaccagugacgccau

SEQ ID NO: 1277436 - RNA, 18 nt, Human
ugacaggcaagaaaaugu

SEQ ID NO: 1277437 - RNA, 21 nt, Human
ugacaggcaagaaaauguucu

SEQ ID NO: 1277438 - RNA, 22 nt, Human
ugagaaaauggagacaaaaugu

SEQ ID NO: 1277439 - RNA, 27 nt, Human
ugagaaaauggagacaaaaugugauag

SEQ ID NO: 1277440 - RNA, 23 nt, Human
ugcauaauggaaccuguguccaa

SEQ ID NO: 1277441 - RNA, 25 nt, Human
ugccauuguaacgugaaagcagcca

SEQ ID NO: 1277442 - RNA, 22 nt, Human
ugccugaaguugaagaaauaua

SEQ ID NO: 1277443 - RNA, 20 nt, Human
uggcaugauugugacaggca

SEQ ID NO: 1277444 - RNA, 25 nt, Human
ugggggaagaucucaaacucuucag

SEQ ID NO: 1277445 - RNA, 24 nt, Human
uucaauccugaaauacuauaaauu

SEQ ID NO: 1277446 - RNA, 19 nt, Human
uucacaaacgucucugugg

SEQ ID NO: 1277447 - RNA, 18 nt, Human
uugaagaaauauaguguc

SEQ ID NO: 1277448 - RNA, 19 nt, Human
uuugaagcucaugcuuugc

SEQ ID NO: 1277449 - RNA, 24 nt, Human
aaaaaagaaaaagaagcucucaaa

SEQ ID NO: 1277450 - RNA, 20 nt, Human
aaaagaaaaagaagcucuca

SEQ ID NO: 1277451 - RNA, 19 nt, Human
aaaccccuuugauccucag

SEQ ID NO: 1277452 - RNA, 23 nt, Human
aaagaagcucucaaauaucccuu

SEQ ID NO: 1277453 - RNA, 21 nt, Human
aaccccuuugauccucagcgg

SEQ ID NO: 1277454 - RNA, 20 nt, Human
aaccgaccugaauugcaaac

SEQ ID NO: 1277455 - RNA, 20 nt, Human
aacuugcuucccaaugucug

SEQ ID NO: 1277456 - RNA, 18 nt, Human
aagcacauggcucagaaa

SEQ ID NO: 1277457 - RNA, 19 nt, Human
aagcacauggcucagaaac

SEQ ID NO: 1277458 - RNA, 20 nt, Human
acacugcaaagaagacacac

SEQ ID NO: 1277459 - RNA, 20 nt, Human
agacagccaccuucucucug

SEQ ID NO: 1277460 - RNA, 18 nt, Human
agcucuuaaagagacaau

SEQ ID NO: 1277461 - RNA, 21 nt, Human
aggagcagucgaagaaggagg

SEQ ID NO: 1277462 - RNA, 18 nt, Human
aucacagugacuaaaacu

SEQ ID NO: 1277463 - RNA, 24 nt, Human
caaaauacaaccgaccugaauugc

SEQ ID NO: 1277464 - RNA, 24 nt, Human
caaauguauacacauauguagaca

SEQ ID NO: 1277465 - RNA, 23 nt, Human
cacaaaaaagaaaaagaagcucu

SEQ ID NO: 1277466 - RNA, 20 nt, Human
caguagaggcuagaacugga

SEQ ID NO: 1277467 - RNA, 27 nt, Human
cagugacuaaaacuuuuucugaaaucc

SEQ ID NO: 1277468 - RNA, 22 nt, Human
ccaaaucucaugauuuucuaaa

SEQ ID NO: 1277469 - RNA, 21 nt, Human
cccuuucccaaacguuuccca

SEQ ID NO: 1277470 - RNA, 21 nt, Human
ccuaaacauuugcugccccca

SEQ ID NO: 1277471 - RNA, 18 nt, Human
cguagacagccaccuucu

SEQ ID NO: 1277472 - RNA, 20 nt, Human
cuaaaccacaaaaaagaaaa

SEQ ID NO: 1277473 - RNA, 23 nt, Human
cuaaauggaaucacagugacuaa

SEQ ID NO: 1277474 - RNA, 27 nt, Human
cuaagagaggagcagucgaagaaggag

SEQ ID NO: 1277475 - RNA, 23 nt, Human
cucaaauaucccuuucccaaacg

SEQ ID NO: 1277476 - RNA, 22 nt, Human
cucccugaagacagagagugaa

SEQ ID NO: 1277477 - RNA, 18 nt, Human
cucguagacagccaccuu

SEQ ID NO: 1277478 - RNA, 22 nt, Human
cugaagacagagagugaacccu

SEQ ID NO: 1277479 - RNA, 25 nt, Human
cugaggacucucccucuucuuguaa

SEQ ID NO: 1277480 - RNA, 19 nt, Human
gaagaaggaggggaacugc

SEQ ID NO: 1277481 - RNA, 20 nt, Human
gagcugcugugaggguuggu

SEQ ID NO: 1277482 - RNA, 23 nt, Human
gauuaugaaaacagcuaaaggaa

SEQ ID NO: 1277483 - RNA, 26 nt, Human
ggcuggaaguccaagauggagcugcu

SEQ ID NO: 1277484 - RNA, 21 nt, Human
gucgaagaaggaggggaacug

SEQ ID NO: 1277485 - RNA, 22 nt, Human
uaaagagacaauguuaggagua

SEQ ID NO: 1277486 - RNA, 19 nt, Human
uaaauggaaucacagugac

SEQ ID NO: 1277487 - RNA, 21 nt, Human
uaacacagauggaaugauucc

SEQ ID NO: 1277488 - RNA, 26 nt, Human
uaacuaaaccacaaaaaagaaaaaga

SEQ ID NO: 1277489 - RNA, 29 nt, Human
uaacuaaaccacaaaaaagaaaaagaaaa

SEQ ID NO: 1277490 - RNA, 21 nt, Human
uagcaaacacugcaaagaaga

SEQ ID NO: 1277491 - RNA, 22 nt, Human
uagcaaacacugcaaagaagac

SEQ ID NO: 1277492 - RNA, 21 nt, Human
uauacagcauucgcagguuag

SEQ ID NO: 1277493 - RNA, 25 nt, Human
ucaaaauuagcaaacacugcaaaga

SEQ ID NO: 1277494 - RNA, 23 nt, Human
ucaaauaacuaaaccacaaaaaa

SEQ ID NO: 1277495 - RNA, 20 nt, Human
ucaaauaucccuuucccaaa

SEQ ID NO: 1277496 - RNA, 26 nt, Human
ucaauaucaucaaauaacuaaaccac

SEQ ID NO: 1277497 - RNA, 22 nt, Human
uccaugccgagagagaggacuc

SEQ ID NO: 1277498 - RNA, 22 nt, Human
ugaggacucucccucuucuugu

SEQ ID NO: 1277499 - RNA, 24 nt, Human
ugcugagcaugggcucuggaagcc

SEQ ID NO: 1277500 - RNA, 22 nt, Human
ugggcucuggaagccacagcuc

SEQ ID NO: 1277501 - RNA, 24 nt, Human
ugugacucaaaauuagcaaacacu

SEQ ID NO: 1277502 - RNA, 22 nt, Human
uuagcaaacacugcaaagaaga

SEQ ID NO: 1277503 - RNA, 19 nt, Human
uuggaagcuaaauggaauc

SEQ ID NO: 1277504 - RNA, 23 nt, Human
aaaaaaaaaaaaaaaaaaaagag

SEQ ID NO: 1277505 - RNA, 18 nt, Human
aaaacccuaagggaugua

SEQ ID NO: 1277506 - RNA, 20 nt, Human
aaacaacaauaacaacugua

SEQ ID NO: 1277507 - RNA, 19 nt, Human
aaagaaaaaacacaagaaa

SEQ ID NO: 1277508 - RNA, 24 nt, Human
aaagaaaaaacacaagaaacccca

SEQ ID NO: 1277509 - RNA, 26 nt, Human
aaagaaaaaacacaagaaaccccaag

SEQ ID NO: 1277510 - RNA, 23 nt, Human
aaagagacgaacagagggucaga

SEQ ID NO: 1277511 - RNA, 23 nt, Human
aaaguaccaaaaccaaacuugug

SEQ ID NO: 1277512 - RNA, 23 nt, Human
aacaaaaacaacaauaacaacug

SEQ ID NO: 1277513 - RNA, 24 nt, Human
aacaacaaaaacaacaauaacaac

SEQ ID NO: 1277514 - RNA, 22 nt, Human
aacugaauacaaagaggaacaa

SEQ ID NO: 1277515 - RNA, 22 nt, Human
aacuugcaccucaaaaaacuuu

SEQ ID NO: 1277516 - RNA, 23 nt, Human
aagaaaaaacacaagaaacccca

SEQ ID NO: 1277517 - RNA, 22 nt, Human
aagcaccaaccccacaucgcag

SEQ ID NO: 1277518 - RNA, 21 nt, Human
aauaauaaaaacccuaaggga

SEQ ID NO: 1277519 - RNA, 21 nt, Human
aaucaaugagaaaaaaaaaaa

SEQ ID NO: 1277520 - RNA, 23 nt, Human
aaucuuccaaaacuggcauccga

SEQ ID NO: 1277521 - RNA, 21 nt, Human
acgaacagagggucagaacgc

SEQ ID NO: 1277522 - RNA, 23 nt, Human
agaaaaaacacaagaaaccccaa

SEQ ID NO: 1277523 - RNA, 24 nt, Human
agaaaaaacacaagaaaccccaaa

SEQ ID NO: 1277524 - RNA, 26 nt, Human
agaaggagaaagagaaucaaacaaaa

SEQ ID NO: 1277525 - RNA, 23 nt, Human
agaggaaagagacgaacagaggg

SEQ ID NO: 1277526 - RNA, 18 nt, Human
aggaaagagacgaacaga

SEQ ID NO: 1277527 - RNA, 24 nt, Human
aggaacaaaaaguaccaaaaccaa

SEQ ID NO: 1277528 - RNA, 19 nt, Human
aggaagacugggaauaccu

SEQ ID NO: 1277529 - RNA, 24 nt, Human
aguguggagagucgcaaagaaaaa

SEQ ID NO: 1277530 - RNA, 22 nt, Human
aucaaacaaaauguauagaaac

SEQ ID NO: 1277531 - RNA, 20 nt, Human
aucuugcauguguaguuuua

SEQ ID NO: 1277532 - RNA, 23 nt, Human
caaagaaaaaacacaagaaaccc

SEQ ID NO: 1277533 - RNA, 27 nt, Human
caaagaaaaaacacaagaaaccccaaa

SEQ ID NO: 1277534 - RNA, 24 nt, Human
caacaaaaacaacaauaacaacug

SEQ ID NO: 1277535 - RNA, 23 nt, Human
caagcaccaaccccacaucgcag

SEQ ID NO: 1277536 - RNA, 25 nt, Human
caaggcuaaguaaagcuuuaaauca

SEQ ID NO: 1277537 - RNA, 18 nt, Human
caccucacuaauaaaaug

SEQ ID NO: 1277538 - RNA, 24 nt, Human
cauggugaaucuuccaaaacuggc

SEQ ID NO: 1277539 - RNA, 21 nt, Human
ccagcgcugcuuggaacacag

SEQ ID NO: 1277540 - RNA, 19 nt, Human
ccagcuacacacgucgcug

SEQ ID NO: 1277541 - RNA, 22 nt, Human
ccucaaaaaacuuuucagaaga

SEQ ID NO: 1277542 - RNA, 21 nt, Human
cgaggguacagaucaaggcua

SEQ ID NO: 1277543 - RNA, 19 nt, Human
cuucaagcaccaaccccac

SEQ ID NO: 1277544 - RNA, 24 nt, Human
gaagaaagaggagaggaaagagac

SEQ ID NO: 1277545 - RNA, 21 nt, Human
gaagguaaauauaaaccuauu

SEQ ID NO: 1277546 - RNA, 24 nt, Human
gagaaagagaaucaaacaaaaugu

SEQ ID NO: 1277547 - RNA, 19 nt, Human
gaucauugguucugauuug

SEQ ID NO: 1277548 - RNA, 20 nt, Human
gcaaagaaaaaacacaagaa

SEQ ID NO: 1277549 - RNA, 23 nt, Human
gcaaagaaaaaacacaagaaacc

SEQ ID NO: 1277550 - RNA, 25 nt, Human
gcaaagaaaaaacacaagaaacccc

SEQ ID NO: 1277551 - RNA, 24 nt, Human
gggcuauuuaagaaacuagaaaca

SEQ ID NO: 1277552 - RNA, 20 nt, Human
gguaaggcuuggauuaggcu

SEQ ID NO: 1277553 - RNA, 23 nt, Human
guaaagcuuuaaaucaauaguga

SEQ ID NO: 1277554 - RNA, 20 nt, Human
guagcacagcuggguaaggc

SEQ ID NO: 1277555 - RNA, 22 nt, Human
uaaacugguucauacaccccua

SEQ ID NO: 1277556 - RNA, 22 nt, Human
uaauaauaauaaaaacccuaag

SEQ ID NO: 1277557 - RNA, 19 nt, Human
uacaaagaggaacaaaaag

SEQ ID NO: 1277558 - RNA, 26 nt, Human
uagaaacaaauuagcuggacaugcaa

SEQ ID NO: 1277559 - RNA, 23 nt, Human
uaggccaagggaucauugguucu

SEQ ID NO: 1277560 - RNA, 20 nt, Human
uaguaguauuuccuugcuuu

SEQ ID NO: 1277561 - RNA, 23 nt, Human
ucacccagaguuuaaacaaauca

SEQ ID NO: 1277562 - RNA, 25 nt, Human
ucauugguucugauuugcauucauc

SEQ ID NO: 1277563 - RNA, 19 nt, Human
uccugugaagucugggagg

SEQ ID NO: 1277564 - RNA, 21 nt, Human
ucucuacaguaaauaaaaccu

SEQ ID NO: 1277565 - RNA, 20 nt, Human
ucugcagugcuccaggcacg

SEQ ID NO: 1277566 - RNA, 23 nt, Human
ugaagaaagaggagaggaaagag

SEQ ID NO: 1277567 - RNA, 18 nt, Human
ugacaguagcacagcugg

SEQ ID NO: 1277568 - RNA, 20 nt, Human
ugagagaaggagaaagagaa

SEQ ID NO: 1277569 - RNA, 18 nt, Human
ugauuacugcuacaucuc

SEQ ID NO: 1277570 - RNA, 18 nt, Human
ugcaugggcugaaaucac

SEQ ID NO: 1277571 - RNA, 24 nt, Human
ugcgagcggcagccccagcuacac

SEQ ID NO: 1277572 - RNA, 19 nt, Human
uggaaguucuauacaacug

SEQ ID NO: 1277573 - RNA, 18 nt, Human
uggggggugggggaaggg

SEQ ID NO: 1277574 - RNA, 20 nt, Human
uggggggugggggaagggca

SEQ ID NO: 1277575 - RNA, 23 nt, Human
uggggggugggggaagggcaaaa

SEQ ID NO: 1277576 - RNA, 19 nt, Human
ugugaagucugggagguug

SEQ ID NO: 1277577 - RNA, 31 nt, Human
uuaaucaaugagaaaaaaaaaaaaaaaaaaa

SEQ ID NO: 1277578 - RNA, 19 nt, Human
uucacaguuuaauauuggg

SEQ ID NO: 1277579 - RNA, 21 nt, Human
uucauguagugauugaaucuc

SEQ ID NO: 1277580 - RNA, 21 nt, Human
uuggaaguucuauacaacuga

SEQ ID NO: 1277581 - RNA, 18 nt, Human
uuuguaaaagcccugaga

SEQ ID NO: 1277582 - RNA, 19 nt, Human
aaaaagagagcuucugcag

SEQ ID NO: 1277583 - RNA, 24 nt, Human
aagacccacccccauaauuaaauc

SEQ ID NO: 1277584 - RNA, 26 nt, Human
aaucaccucccaccggguuccuccca

SEQ ID NO: 1277585 - RNA, 23 nt, Human
aauuauuuuuuacauauaagcau

SEQ ID NO: 1277586 - RNA, 19 nt, Human
aauucaagaugagauuugg

SEQ ID NO: 1277587 - RNA, 20 nt, Human
acaaagaggagcaagucaca

SEQ ID NO: 1277588 - RNA, 22 nt, Human
acccccauaauuaaaucaccuc

SEQ ID NO: 1277589 - RNA, 26 nt, Human
agagauaugugcccuuuaaaugggcc

SEQ ID NO: 1277590 - RNA, 21 nt, Human
agauaugugcccuuuaaaugg

SEQ ID NO: 1277591 - RNA, 19 nt, Human
agauuauguaaauuucaug

SEQ ID NO: 1277592 - RNA, 21 nt, Human
aggcaaaaagagagcuucugc

SEQ ID NO: 1277593 - RNA, 21 nt, Human
auauguaguagaauuuauaua

SEQ ID NO: 1277594 - RNA, 19 nt, Human
aucaccucccaccggguuc

SEQ ID NO: 1277595 - RNA, 25 nt, Human
aucaccucccaccggguuccuccca

SEQ ID NO: 1277596 - RNA, 21 nt, Human
augaagacauacccaagacug

SEQ ID NO: 1277597 - RNA, 21 nt, Human
auuuggguggggacacagcca

SEQ ID NO: 1277598 - RNA, 23 nt, Human
caaaacaaagagguuuauugaac

SEQ ID NO: 1277599 - RNA, 27 nt, Human
caacgggagaaguuugaaaaaagagaa

SEQ ID NO: 1277600 - RNA, 23 nt, Human
cacccccauaauuaaaucaccuc

SEQ ID NO: 1277601 - RNA, 23 nt, Human
cacguuagaaccaaaagaugaga

SEQ ID NO: 1277602 - RNA, 25 nt, Human
cagagaaacccccauuuuuaaaacc

SEQ ID NO: 1277603 - RNA, 23 nt, Human
cagcacaggaaagacccaccccc

SEQ ID NO: 1277604 - RNA, 27 nt, Human
cagcacaggaaagacccacccccauaa

SEQ ID NO: 1277605 - RNA, 26 nt, Human
caggaaagacccacccccauaauuaa

SEQ ID NO: 1277606 - RNA, 23 nt, Human
cccccauaauuaaaucaccuccc

SEQ ID NO: 1277607 - RNA, 22 nt, Human
ccucccacagacaugugggaau

SEQ ID NO: 1277608 - RNA, 20 nt, Human
ccucccaccggguuccuccc

SEQ ID NO: 1277609 - RNA, 19 nt, Human
gacauuaagaauagugggg

SEQ ID NO: 1277610 - RNA, 28 nt, Human
gagaacagcacaggaaagaccgguaccc

SEQ ID NO: 1277611 - RNA, 19 nt, Human
gagcuucugcagagaaacc

SEQ ID NO: 1277612 - RNA, 21 nt, Human
ggaguuacaauucaagaugag

SEQ ID NO: 1277613 - RNA, 22 nt, Human
uaacauaaguaaauagauucuc

SEQ ID NO: 1277614 - RNA, 23 nt, Human
uaagaauaguggggugcuaaaga

SEQ ID NO: 1277615 - RNA, 20 nt, Human
uacuuguaaucugcucuaga

SEQ ID NO: 1277616 - RNA, 23 nt, Human
uagaaccaaaagaugagagauau

SEQ ID NO: 1277617 - RNA, 24 nt, Human
uauccuauugacccuucucauaaa

SEQ ID NO: 1277618 - RNA, 18 nt, Human
uauuaggagaacagcaca

SEQ ID NO: 1277619 - RNA, 21 nt, Human
uauuuguguauguguauauaa

SEQ ID NO: 1277620 - RNA, 19 nt, Human
uccacauggcugaggaggc

SEQ ID NO: 1277621 - RNA, 21 nt, Human
ucuaaacuagauuauguaaau

SEQ ID NO: 1277622 - RNA, 19 nt, Human
ucugcagagaaacccccau

SEQ ID NO: 1277623 - RNA, 22 nt, Human
ugagauuuggguggggacacag

SEQ ID NO: 1277624 - RNA, 22 nt, Human
ugagcugcugaugugugugcuu

SEQ ID NO: 1277625 - RNA, 19 nt, Human
uggaagacaaagaggagca

SEQ ID NO: 1277626 - RNA, 19 nt, Human
uggcaggaggcaaaaagag

SEQ ID NO: 1277627 - RNA, 21 nt, Human
uggcaggaggcaaaaagagag

SEQ ID NO: 1277628 - RNA, 22 nt, Human
uguauuuguguauguguauaua

SEQ ID NO: 1277629 - RNA, 24 nt, Human
uguguauuuguguauguguauaua

SEQ ID NO: 1277630 - RNA, 24 nt, Human
uucaagaugagauuugggugggga

SEQ ID NO: 1277631 - RNA, 24 nt, Human
uugaaaguuucuuuauccuauuga

SEQ ID NO: 1277632 - RNA, 20 nt, Human
uuguguauuuguguaugugu

SEQ ID NO: 1277633 - RNA, 18 nt, Human
uuuucccaguaaugcuga

SEQ ID NO: 1277634 - RNA, 23 nt, Human
aaagaaaaaaaaaaaggccacau

SEQ ID NO: 1277635 - RNA, 25 nt, Human
aaauacuccugggguugacccaaac

SEQ ID NO: 1277636 - RNA, 24 nt, Human
aacagacuguguaaaagaauuaga

SEQ ID NO: 1277637 - RNA, 22 nt, Human
aagagguccggcuggccgcgcc

SEQ ID NO: 1277638 - RNA, 19 nt, Human
acccucagaacacaggccc

SEQ ID NO: 1277639 - RNA, 18 nt, Human
acgcaugcccccgccaag

SEQ ID NO: 1277640 - RNA, 23 nt, Human
agcaguagcagugagagcgagcc

SEQ ID NO: 1277641 - RNA, 26 nt, Human
aggcccagagaccuggcaggccggga

SEQ ID NO: 1277642 - RNA, 18 nt, Human
auucucaauaauuuacua

SEQ ID NO: 1277643 - RNA, 21 nt, Human
caagagggaugcaccucccag

SEQ ID NO: 1277644 - RNA, 22 nt, Human
caaggacacuggcgucuccccc

SEQ ID NO: 1277645 - RNA, 22 nt, Human
caccaggacccgcgcugaaggc

SEQ ID NO: 1277646 - RNA, 18 nt, Human
cacccagcagccgcgcac

SEQ ID NO: 1277647 - RNA, 18 nt, Human
caccuggaaugggugacu

SEQ ID NO: 1277648 - RNA, 22 nt, Human
cagcuugcuggagacucugcgg

SEQ ID NO: 1277649 - RNA, 26 nt, Human
cagcuugcuggagacucugcggucag

SEQ ID NO: 1277650 - RNA, 19 nt, Human
caggggagccccagcuucc

SEQ ID NO: 1277651 - RNA, 24 nt, Human
caguccaagcucacacgguuaucu

SEQ ID NO: 1277652 - RNA, 18 nt, Human
cagugaacagcugaggcg

SEQ ID NO: 1277653 - RNA, 21 nt, Human
cagugcgcagcccugugggca

SEQ ID NO: 1277654 - RNA, 30 nt, Human
ccagauaaaagauaaaaagaaaaaaaaaaa

SEQ ID NO: 1277655 - RNA, 18 nt, Human
cccaagcgcucgcccccg

SEQ ID NO: 1277656 - RNA, 25 nt, Human
cccacuaggagccccugcugcucca

SEQ ID NO: 1277657 - RNA, 21 nt, Human
cccccgcgccuccucccucgc

SEQ ID NO: 1277658 - RNA, 19 nt, Human
ccccgccgcccgcccgccc

SEQ ID NO: 1277659 - RNA, 19 nt, Human
ccccgcgccuccucccucg

SEQ ID NO: 1277660 - RNA, 23 nt, Human
cccgccaagggcuccccagcccc

SEQ ID NO: 1277661 - RNA, 21 nt, Human
cccgcgcugaaggcccagaga

SEQ ID NO: 1277662 - RNA, 18 nt, Human
cccggagccgggagccgg

SEQ ID NO: 1277663 - RNA, 23 nt, Human
ccgcaggucggugacuggaccag

SEQ ID NO: 1277664 - RNA, 20 nt, Human
ccgccgcccgcccgcccgca

SEQ ID NO: 1277665 - RNA, 21 nt, Human
ccgcgcccccgccgccucccc

SEQ ID NO: 1277666 - RNA, 20 nt, Human
ccgcgccuccucccucgcgg

SEQ ID NO: 1277667 - RNA, 23 nt, Human
ccgcguccgccucccgcccgccu

SEQ ID NO: 1277668 - RNA, 19 nt, Human
ccucccgcccgccucccgc

SEQ ID NO: 1277669 - RNA, 22 nt, Human
ccuccggcugugaccucagcuu

SEQ ID NO: 1277670 - RNA, 22 nt, Human
ccuggcccacuaggagccccug

SEQ ID NO: 1277671 - RNA, 19 nt, Human
ccuucugcaaauacuccug

SEQ ID NO: 1277672 - RNA, 20 nt, Human
cgccaagggcuccccagccc

SEQ ID NO: 1277673 - RNA, 18 nt, Human
cgcgcugccgcggccacg

SEQ ID NO: 1277674 - RNA, 21 nt, Human
cgcucaguccaagcucacacg

SEQ ID NO: 1277675 - RNA, 19 nt, Human
cgcucuggaaaggaagagg

SEQ ID NO: 1277676 - RNA, 23 nt, Human
cggaugccguucacccagcagcc

SEQ ID NO: 1277677 - RNA, 22 nt, Human
cgggaaaggcgucgcgcaggcg

SEQ ID NO: 1277678 - RNA, 21 nt, Human
cgggagccgggccgaguccca

SEQ ID NO: 1277679 - RNA, 20 nt, Human
cggggucggcccgucacucc

SEQ ID NO: 1277680 - RNA, 21 nt, Human
cuaaacauccccugccugugg

SEQ ID NO: 1277681 - RNA, 18 nt, Human
cuagucggcaaugccuuc

SEQ ID NO: 1277682 - RNA, 18 nt, Human
cucgaagaacuccucuuc

SEQ ID NO: 1277683 - RNA, 21 nt, Human
cucuccugugggcaggggagc

SEQ ID NO: 1277684 - RNA, 24 nt, Human
cucuucgucgccgcgccggcugac

SEQ ID NO: 1277685 - RNA, 18 nt, Human
cugcagccaauacccccc

SEQ ID NO: 1277686 - RNA, 22 nt, Human
cuggccgcgcccccgccgccuc

SEQ ID NO: 1277687 - RNA, 19 nt, Human
cuugucaaaaucucccuca

SEQ ID NO: 1277688 - RNA, 18 nt, Human
cuuugcagggauggggaa

SEQ ID NO: 1277689 - RNA, 21 nt, Human
gaacacaggcccuguggccuc

SEQ ID NO: 1277690 - RNA, 23 nt, Human
gagaccgcgcugccgcggccacg

SEQ ID NO: 1277691 - RNA, 24 nt, Human
gcagcagcugugaccaugggggcc

SEQ ID NO: 1277692 - RNA, 18 nt, Human
gccgcagcaccaggaccc

SEQ ID NO: 1277693 - RNA, 19 nt, Human
gccuccucccucgcggccc

SEQ ID NO: 1277694 - RNA, 18 nt, Human
gcgcgccccggccggggu

SEQ ID NO: 1277695 - RNA, 22 nt, Human
gcggcgcggcggcgaguggcuc

SEQ ID NO: 1277696 - RNA, 21 nt, Human
ggagccccugcugcuccacuu

SEQ ID NO: 1277697 - RNA, 21 nt, Human
gggaaugguggggagucaggg

SEQ ID NO: 1277698 - RNA, 25 nt, Human
gggaaugguggggagucaggguggc

SEQ ID NO: 1277699 - RNA, 20 nt, Human
gggagggaaugguggggagu

SEQ ID NO: 1277700 - RNA, 19 nt, Human
gggcaggggagccccagcu

SEQ ID NO: 1277701 - RNA, 23 nt, Human
ggucggugacuggaccagccggg

SEQ ID NO: 1277702 - RNA, 19 nt, Human
guagagcacgcugcggucc

SEQ ID NO: 1277703 - RNA, 21 nt, Human
uaaaaacagacuguguaaaag

SEQ ID NO: 1277704 - RNA, 20 nt, Human
uaacuuuuucagaaguucug

SEQ ID NO: 1277705 - RNA, 24 nt, Human
uagcagugagagcgagccccacag

SEQ ID NO: 1277706 - RNA, 18 nt, Human
ucaaaaucucccucaaga

SEQ ID NO: 1277707 - RNA, 19 nt, Human
ucagagcuggcagugaaca

SEQ ID NO: 1277708 - RNA, 20 nt, Human
ucagagcuggcagugaacag

SEQ ID NO: 1277709 - RNA, 22 nt, Human
uccacuugcaggacacccaggc

SEQ ID NO: 1277710 - RNA, 18 nt, Human
uccccagccccgccgccc

SEQ ID NO: 1277711 - RNA, 19 nt, Human
uccccagccccgccgcccg

SEQ ID NO: 1277712 - RNA, 18 nt, Human
ucccguccuuucaaguuc

SEQ ID NO: 1277713 - RNA, 21 nt, Human
uccgucggcuuugcagggaug

SEQ ID NO: 1277714 - RNA, 30 nt, Human
ucgcacgcaugcccccgccaagggcucccu

SEQ ID NO: 1277715 - RNA, 21 nt, Human
ucgcccccgccucgcgccccc

SEQ ID NO: 1277716 - RNA, 21 nt, Human
ugacuugucaaaaucucccuc

SEQ ID NO: 1277717 - RNA, 22 nt, Human
ugacuugucaaaaucucccuca

SEQ ID NO: 1277718 - RNA, 18 nt, Human
ugcccaaggacacuggcg

SEQ ID NO: 1277719 - RNA, 21 nt, Human
ugcccuggcagugcgcagccc

SEQ ID NO: 1277720 - RNA, 22 nt, Human
ugccuguggcaccuggaauggg

SEQ ID NO: 1277721 - RNA, 21 nt, Human
uggcagugcgcagcccugugg

SEQ ID NO: 1277722 - RNA, 23 nt, Human
uggccgcgcccccgccgccuccg

SEQ ID NO: 1277723 - RNA, 23 nt, Human
uggccuccggcugugaccucagc

SEQ ID NO: 1277724 - RNA, 28 nt, Human
ugggaagaaccaccaacgcucaguccaa

SEQ ID NO: 1277725 - RNA, 21 nt, Human
ugggacgucugggaguuccag

SEQ ID NO: 1277726 - RNA, 19 nt, Human
ugggaguuccagagcuggg

SEQ ID NO: 1277727 - RNA, 18 nt, Human
uggggagucaggguggcu

SEQ ID NO: 1277728 - RNA, 25 nt, Human
uggggcagcagcugugaccaugggg

SEQ ID NO: 1277729 - RNA, 21 nt, Human
ugggugacuugucaaaaucuc

SEQ ID NO: 1277730 - RNA, 21 nt, Human
ugucaaaaucucccucaagac

SEQ ID NO: 1277731 - RNA, 21 nt, Human
ugugaccaugggggccagcac

SEQ ID NO: 1277732 - RNA, 21 nt, Human
uguguaaaagaauuagaauuc

SEQ ID NO: 1277733 - RNA, 22 nt, Human
uucaccaagagggaugcaccuc

SEQ ID NO: 1277734 - RNA, 18 nt, Human
uucauuauggcagcucug

SEQ ID NO: 1277735 - RNA, 18 nt, Human
uuccagagcuggggcagc

SEQ ID NO: 1277736 - RNA, 21 nt, Human
uugacccaaacccaguuucca

SEQ ID NO: 1277737 - RNA, 20 nt, Human
uugcaggggaaaagccuguu

SEQ ID NO: 1277738 - RNA, 23 nt, Human
uuuugcaggggaaaagccuguuc

SEQ ID NO: 1277739 - RNA, 22 nt, Human
aaaaaaaaguuuacacgaccag

SEQ ID NO: 1277740 - RNA, 25 nt, Human
aaaaaaccauacacagacucuagca

SEQ ID NO: 1277741 - RNA, 20 nt, Human
aaacaaaaacauguaaccuu

SEQ ID NO: 1277742 - RNA, 19 nt, Human
aaacagaaagggaaaaagg

SEQ ID NO: 1277743 - RNA, 20 nt, Human
aaagaacaaagugaagaaau

SEQ ID NO: 1277744 - RNA, 23 nt, Human
aaaggaccuuaaaaaaccauaca

SEQ ID NO: 1277745 - RNA, 18 nt, Human
aaaguggugccugcccuu

SEQ ID NO: 1277746 - RNA, 24 nt, Human
aaccauacacagacucuagcaaaa

SEQ ID NO: 1277747 - RNA, 18 nt, Human
aaccuuuuuccuguuucu

SEQ ID NO: 1277748 - RNA, 19 nt, Human
aagcagcaggccgggugga

SEQ ID NO: 1277749 - RNA, 18 nt, Human
aagcaggaagcuggccca

SEQ ID NO: 1277750 - RNA, 21 nt, Human
aagcaggaagcuggcccagga

SEQ ID NO: 1277751 - RNA, 22 nt, Human
aagggaaaaaggaccuuaaaaa

SEQ ID NO: 1277752 - RNA, 18 nt, Human
acaaaguggugccugccc

SEQ ID NO: 1277753 - RNA, 22 nt, Human
acacagacucuagcaaaagcca

SEQ ID NO: 1277754 - RNA, 25 nt, Human
acacagcccauggcaaagacaugcu

SEQ ID NO: 1277755 - RNA, 24 nt, Human
acaguuuuuauauuacaaccucaa

SEQ ID NO: 1277756 - RNA, 19 nt, Human
accucaaggacagggaggg

SEQ ID NO: 1277757 - RNA, 22 nt, Human
acucugcucccaagagcccagg

SEQ ID NO: 1277758 - RNA, 24 nt, Human
acuuuaaaaaagagggaaggugag

SEQ ID NO: 1277759 - RNA, 22 nt, Human
agaaaaagaacaaagugaagaa

SEQ ID NO: 1277760 - RNA, 22 nt, Human
agaaaagaaagucuugaaaggg

SEQ ID NO: 1277761 - RNA, 20 nt, Human
agaaaguagccauguuuuca

SEQ ID NO: 1277762 - RNA, 23 nt, Human
agaggcuggaggucauuuggacu

SEQ ID NO: 1277763 - RNA, 21 nt, Human
agagggaauaaagugcuucuc

SEQ ID NO: 1277764 - RNA, 19 nt, Human
agcuccugcgggugcuccc

SEQ ID NO: 1277765 - RNA, 21 nt, Human
agcuuagaaaguagccauguu

SEQ ID NO: 1277766 - RNA, 19 nt, Human
aggaacacgaagagaccca

SEQ ID NO: 1277767 - RNA, 19 nt, Human
aggaagcgguggugucuga

SEQ ID NO: 1277768 - RNA, 20 nt, Human
aggaggaauaaaaacgagca

SEQ ID NO: 1277769 - RNA, 18 nt, Human
aggcagccuggggggcuc

SEQ ID NO: 1277770 - RNA, 21 nt, Human
aggcaggcgugagggggccca

SEQ ID NO: 1277771 - RNA, 22 nt, Human
aggcagggagaggcuggccaga

SEQ ID NO: 1277772 - RNA, 22 nt, Human
agguacaacagaugcgacacca

SEQ ID NO: 1277773 - RNA, 22 nt, Human
aggucgaggcaggggcagcguu

SEQ ID NO: 1277774 - RNA, 19 nt, Human
aggugugggugacgggcgu

SEQ ID NO: 1277775 - RNA, 20 nt, Human
agguuuguuuuuguuuucuu

SEQ ID NO: 1277776 - RNA, 22 nt, Human
auaaaaacgagcacaucucagg

SEQ ID NO: 1277777 - RNA, 23 nt, Human
auccugaaggaaagaugaagcug

SEQ ID NO: 1277778 - RNA, 19 nt, Human
caaccucaaggacagggag

SEQ ID NO: 1277779 - RNA, 23 nt, Human
caaguacaaaaggaugauccuga

SEQ ID NO: 1277780 - RNA, 23 nt, Human
cacacgggacaugaaagcgaggu

SEQ ID NO: 1277781 - RNA, 21 nt, Human
cacaucuccaggcccuuacug

SEQ ID NO: 1277782 - RNA, 23 nt, Human
cacuggacucugcucccaagagc

SEQ ID NO: 1277783 - RNA, 26 nt, Human
cacuggacucugcucccaagagccca

SEQ ID NO: 1277784 - RNA, 18 nt, Human
cacuguggcaucuuccca

SEQ ID NO: 1277785 - RNA, 19 nt, Human
cagagaauucccacccaca

SEQ ID NO: 1277786 - RNA, 18 nt, Human
cagaugcgacaccaugca

SEQ ID NO: 1277787 - RNA, 18 nt, Human
cagcuccugcgggugcuc

SEQ ID NO: 1277788 - RNA, 21 nt, Human
caggugucggcgugguccagc

SEQ ID NO: 1277789 - RNA, 22 nt, Human
caguaaacaaaaacauguaacc

SEQ ID NO: 1277790 - RNA, 18 nt, Human
cagugucuucguuggacc

SEQ ID NO: 1277791 - RNA, 25 nt, Human
cauggcaaagacaugcuucgagaag

SEQ ID NO: 1277792 - RNA, 18 nt, Human
ccaaaacacacgggacau

SEQ ID NO: 1277793 - RNA, 21 nt, Human
ccaaagguacaacagaugcga

SEQ ID NO: 1277794 - RNA, 22 nt, Human
ccagugagacugcucgcaacuu

SEQ ID NO: 1277795 - RNA, 20 nt, Human
cccacacguacagaaacaca

SEQ ID NO: 1277796 - RNA, 24 nt, Human
cccacccacacguacagaaacaca

SEQ ID NO: 1277797 - RNA, 22 nt, Human
cccugcacacgaacagaagcuc

SEQ ID NO: 1277798 - RNA, 18 nt, Human
cccuggucacuguggcau

SEQ ID NO: 1277799 - RNA, 25 nt, Human
ccgaagccccaccucugugcuaugc

SEQ ID NO: 1277800 - RNA, 20 nt, Human
ccgcucccugcccgaagccc

SEQ ID NO: 1277801 - RNA, 19 nt, Human
ccggcacaagagcugccug

SEQ ID NO: 1277802 - RNA, 21 nt, Human
ccggguggaaagccagaaggg

SEQ ID NO: 1277803 - RNA, 22 nt, Human
ccgucagagaauucccacccac

SEQ ID NO: 1277804 - RNA, 20 nt, Human
ccgucuaaaaugcagucccg

SEQ ID NO: 1277805 - RNA, 18 nt, Human
ccuuuuuccuguuucucu

SEQ ID NO: 1277806 - RNA, 20 nt, Human
cgacaccaugcagacacgca

SEQ ID NO: 1277807 - RNA, 18 nt, Human
cgaggaacacgaagagac

SEQ ID NO: 1277808 - RNA, 21 nt, Human
cggaaacgcuccacgguccuc

SEQ ID NO: 1277809 - RNA, 21 nt, Human
cggugugaccucacaggccca

SEQ ID NO: 1277810 - RNA, 24 nt, Human
cgucuaaaaugcagucccggaaac

SEQ ID NO: 1277811 - RNA, 22 nt, Human
cuacagcuucaauuuccaaaaa

SEQ ID NO: 1277812 - RNA, 19 nt, Human
cuccccagagggaccggcc

SEQ ID NO: 1277813 - RNA, 22 nt, Human
cucccccgcacaugcgauaccu

SEQ ID NO: 1277814 - RNA, 22 nt, Human
cuccugccucugcacgcaggca

SEQ ID NO: 1277815 - RNA, 24 nt, Human
cucgcuggauccuucccaccuucc

SEQ ID NO: 1277816 - RNA, 18 nt, Human
cucuuaccuuacaaacag

SEQ ID NO: 1277817 - RNA, 19 nt, Human
cuguaguguggaccucccc

SEQ ID NO: 1277818 - RNA, 23 nt, Human
cuguucuguagccaaaccaauuu

SEQ ID NO: 1277819 - RNA, 19 nt, Human
cuuccccaacugccuacug

SEQ ID NO: 1277820 - RNA, 23 nt, Human
gaaaaugccaagaggaaaccucc

SEQ ID NO: 1277821 - RNA, 21 nt, Human
gaaacgaggaacacgaagaga

SEQ ID NO: 1277822 - RNA, 20 nt, Human
gaccaguuuuuuauugucau

SEQ ID NO: 1277823 - RNA, 18 nt, Human
gaggagcuggacguggag

SEQ ID NO: 1277824 - RNA, 22 nt, Human
gagguuuguuuuuguuuucuuu

SEQ ID NO: 1277825 - RNA, 24 nt, Human
gcaggcaggcagccuggggggcuc

SEQ ID NO: 1277826 - RNA, 20 nt, Human
gcagggagaggcuggccaga

SEQ ID NO: 1277827 - RNA, 21 nt, Human
gccuggggggcuccugggugc

SEQ ID NO: 1277828 - RNA, 25 nt, Human
gcuuagaaaguagccauguuuucaa

SEQ ID NO: 1277829 - RNA, 23 nt, Human
ggaaggcaggcgugagggggccc

SEQ ID NO: 1277830 - RNA, 19 nt, Human
ggaaucuccgcucccugcc

SEQ ID NO: 1277831 - RNA, 23 nt, Human
ggacucugcucccaagagcccag

SEQ ID NO: 1277832 - RNA, 18 nt, Human
ggacugcaggguggccug

SEQ ID NO: 1277833 - RNA, 19 nt, Human
ggagagggaauaaagugcu

SEQ ID NO: 1277834 - RNA, 20 nt, Human
ggcugaagugcugagcagug

SEQ ID NO: 1277835 - RNA, 25 nt, Human
gggaaaaaggaccuuaaaaaaccau

SEQ ID NO: 1277836 - RNA, 18 nt, Human
gggcccagcuccugcggg

SEQ ID NO: 1277837 - RNA, 23 nt, Human
ggggcccagcuccugcgggugcu

SEQ ID NO: 1277838 - RNA, 19 nt, Human
ggugcccaaguugcuacaa

SEQ ID NO: 1277839 - RNA, 21 nt, Human
guccugauggcugaagugcug

SEQ ID NO: 1277840 - RNA, 23 nt, Human
gugcagacguacaccuguccagg

SEQ ID NO: 1277841 - RNA, 18 nt, Human
guggagggcagccccccu

SEQ ID NO: 1277842 - RNA, 21 nt, Human
guggagggcagccccccuucu

SEQ ID NO: 1277843 - RNA, 24 nt, Human
guggagggcagccccccuucugug

SEQ ID NO: 1277844 - RNA, 19 nt, Human
uaaaaaagagggaagguga

SEQ ID NO: 1277845 - RNA, 22 nt, Human
uaaaaugcagucccggaaacgc

SEQ ID NO: 1277846 - RNA, 22 nt, Human
uacaacagaugcgacaccaugc

SEQ ID NO: 1277847 - RNA, 22 nt, Human
uaccagcccgucuuccagaugc

SEQ ID NO: 1277848 - RNA, 22 nt, Human
uacuccaaaaaagguaaaagga

SEQ ID NO: 1277849 - RNA, 18 nt, Human
uagggcauuugauaagag

SEQ ID NO: 1277850 - RNA, 18 nt, Human
uauagcaaguacuccaaa

SEQ ID NO: 1277851 - RNA, 22 nt, Human
uauagcaaguacuccaaaaaag

SEQ ID NO: 1277852 - RNA, 23 nt, Human
ucaauuuccaaaaaaaaaaaaaa

SEQ ID NO: 1277853 - RNA, 23 nt, Human
ucaauuuccaaaaaaaaaaaaaa

SEQ ID NO: 1277854 - RNA, 19 nt, Human
ucacuguggcaucuuccca

SEQ ID NO: 1277855 - RNA, 19 nt, Human
ucagaacucagcguaagcu

SEQ ID NO: 1277856 - RNA, 18 nt, Human
ucauuugagguggagauc

SEQ ID NO: 1277857 - RNA, 19 nt, Human
uccacgguccucuccugcc

SEQ ID NO: 1277858 - RNA, 22 nt, Human
uccacgguccucuccugccucu

SEQ ID NO: 1277859 - RNA, 20 nt, Human
ucccagagcaacugcgucuc

SEQ ID NO: 1277860 - RNA, 21 nt, Human
ucccaggugucggcguggucc

SEQ ID NO: 1277861 - RNA, 21 nt, Human
ucccaucuccccagagggacc

SEQ ID NO: 1277862 - RNA, 18 nt, Human
ucccggaaacgcuccacg

SEQ ID NO: 1277863 - RNA, 23 nt, Human
ucccugcacacgaacagaagcuc

SEQ ID NO: 1277864 - RNA, 19 nt, Human
ucccuggagugaugucuga

SEQ ID NO: 1277865 - RNA, 18 nt, Human
uccuccgacccgcgcucc

SEQ ID NO: 1277866 - RNA, 22 nt, Human
ucgggcagcacucuacagcuuc

SEQ ID NO: 1277867 - RNA, 27 nt, Human
ucuccaagagcuuccagcaucaaguac

SEQ ID NO: 1277868 - RNA, 19 nt, Human
ucugugagcugcuuucccu

SEQ ID NO: 1277869 - RNA, 25 nt, Human
ugaaacgaggaacacgaagagaccc

SEQ ID NO: 1277870 - RNA, 19 nt, Human
ugaagaaauguucagcucc

SEQ ID NO: 1277871 - RNA, 19 nt, Human
ugaagcugguuuuaacggc

SEQ ID NO: 1277872 - RNA, 20 nt, Human
ugacugcaagcaggaagcug

SEQ ID NO: 1277873 - RNA, 21 nt, Human
ugacugcugcucaauuaagau

SEQ ID NO: 1277874 - RNA, 21 nt, Human
ugagguggagaucagagauca

SEQ ID NO: 1277875 - RNA, 24 nt, Human
ugaugggugcagacguacaccugu

SEQ ID NO: 1277876 - RNA, 19 nt, Human
ugcagacacgcagcuguga

SEQ ID NO: 1277877 - RNA, 20 nt, Human
ugccaguaagaagccaggcu

SEQ ID NO: 1277878 - RNA, 21 nt, Human
ugcccaaguugcuacaaagug

SEQ ID NO: 1277879 - RNA, 23 nt, Human
ugcgggugcucccuggagugaug

SEQ ID NO: 1277880 - RNA, 19 nt, Human
ugcucccaagagcccaggc

SEQ ID NO: 1277881 - RNA, 22 nt, Human
uggaaagacaggauuuccccac

SEQ ID NO: 1277882 - RNA, 18 nt, Human
uggaaggacacagcccau

SEQ ID NO: 1277883 - RNA, 23 nt, Human
uggaccucccccgcacaugcgau

SEQ ID NO: 1277884 - RNA, 22 nt, Human
uggacucaccuaugaggaaucu

SEQ ID NO: 1277885 - RNA, 20 nt, Human
uggaggcagggagaggcugg

SEQ ID NO: 1277886 - RNA, 18 nt, Human
uggcgacagcaagcagca

SEQ ID NO: 1277887 - RNA, 19 nt, Human
uggcgacagcaagcagcag

SEQ ID NO: 1277888 - RNA, 18 nt, Human
uggguguccuacaaguuu

SEQ ID NO: 1277889 - RNA, 18 nt, Human
uguggaggagacaugagu

SEQ ID NO: 1277890 - RNA, 22 nt, Human
uguggcgauaugacugcugcuc

SEQ ID NO: 1277891 - RNA, 20 nt, Human
uguguggaccgcauguggag

SEQ ID NO: 1277892 - RNA, 22 nt, Human
uguuuaagcuuuuucuccaaga

SEQ ID NO: 1277893 - RNA, 24 nt, Human
uguuuuuguuuucuuucuguucug

SEQ ID NO: 1277894 - RNA, 20 nt, Human
uuccucaaagcuagccucuu

SEQ ID NO: 1277895 - RNA, 28 nt, Human
uuccuggguaucucaagaucccaggugu

SEQ ID NO: 1277896 - RNA, 18 nt, Human
uugccccuugcugugucu

SEQ ID NO: 1277897 - RNA, 21 nt, Human
uuucugcccugugaauucuag

SEQ ID NO: 1277898 - RNA, 24 nt, Human
aaacaaaacgggagcgcggccuga

SEQ ID NO: 1277899 - RNA, 24 nt, Human
aagcucaaaagauuaaccccuuaa

SEQ ID NO: 1277900 - RNA, 19 nt, Human
aucccauuucaucccucua

SEQ ID NO: 1277901 - RNA, 23 nt, Human
cacucacagccaaaugaggaagu

SEQ ID NO: 1277902 - RNA, 25 nt, Human
ccagacccgauggagcgagcaccga

SEQ ID NO: 1277903 - RNA, 26 nt, Human
ccagacccgauggagcgagcaccgag

SEQ ID NO: 1277904 - RNA, 20 nt, Human
cccacagcgccagacccggg

SEQ ID NO: 1277905 - RNA, 23 nt, Human
ccccuuaaaaacaaaacgggagc

SEQ ID NO: 1277906 - RNA, 20 nt, Human
ccgcugccagccccgccaga

SEQ ID NO: 1277907 - RNA, 22 nt, Human
cucaaaagauuaaccccuuaaa

SEQ ID NO: 1277908 - RNA, 18 nt, Human
cuuugccucuccuucacc

SEQ ID NO: 1277909 - RNA, 22 nt, Human
gaaguauauacugcccacuuug

SEQ ID NO: 1277910 - RNA, 21 nt, Human
gccccacggcucccggcccac

SEQ ID NO: 1277911 - RNA, 27 nt, Human
uauacugcccacuuugccucuccuuca

SEQ ID NO: 1277912 - RNA, 21 nt, Human
ucccucuaucacucacagcca

SEQ ID NO: 1277913 - RNA, 26 nt, Human
ucuucaaucccaacaaaaaucccauu

SEQ ID NO: 1277914 - RNA, 18 nt, Human
ugccagccccgccagacc

SEQ ID NO: 1277915 - RNA, 18 nt, Human
uuaaccccuuaaaaacaa

SEQ ID NO: 1277916 - RNA, 19 nt, Human
aaaccagcugaagcuggcg

SEQ ID NO: 1277917 - RNA, 19 nt, Human
aagagaccaagaagggaca

SEQ ID NO: 1277918 - RNA, 24 nt, Human
aagcacgaauauucccccccgugc

SEQ ID NO: 1277919 - RNA, 19 nt, Human
aagggacagaaaaaaaggg

SEQ ID NO: 1277920 - RNA, 19 nt, Human
aaguagccccuuggcagga

SEQ ID NO: 1277921 - RNA, 23 nt, Human
aaguccuugaggaaggggguggg

SEQ ID NO: 1277922 - RNA, 20 nt, Human
accacgcaacaggaaacaac

SEQ ID NO: 1277923 - RNA, 21 nt, Human
acucaucccacacugugcccu

SEQ ID NO: 1277924 - RNA, 18 nt, Human
agaaaaaaagggguuucu

SEQ ID NO: 1277925 - RNA, 21 nt, Human
agaaguaaaguaggcaaaaag

SEQ ID NO: 1277926 - RNA, 18 nt, Human
agacaggggagaggggga

SEQ ID NO: 1277927 - RNA, 20 nt, Human
agacaggggagagggggagu

SEQ ID NO: 1277928 - RNA, 25 nt, Human
aggcaaaaaguuaaaaggagggacc

SEQ ID NO: 1277929 - RNA, 19 nt, Human
aguugauuucagaucuucc

SEQ ID NO: 1277930 - RNA, 26 nt, Human
auacagccugcacugcuugacacacu

SEQ ID NO: 1277931 - RNA, 25 nt, Human
auauauacauaucuuaauguaugca

SEQ ID NO: 1277932 - RNA, 22 nt, Human
caaaaacaaacucugauccccc

SEQ ID NO: 1277933 - RNA, 21 nt, Human
caccacgcaacaggaaacaac

SEQ ID NO: 1277934 - RNA, 24 nt, Human
caccacgcaacaggaaacaacccu

SEQ ID NO: 1277935 - RNA, 18 nt, Human
cacccugcuuuugcugcc

SEQ ID NO: 1277936 - RNA, 23 nt, Human
cacugugcccugcgacucacccu

SEQ ID NO: 1277937 - RNA, 21 nt, Human
caggagccccgagccgcuuuu

SEQ ID NO: 1277938 - RNA, 21 nt, Human
cauaaaggacucacuucuccg

SEQ ID NO: 1277939 - RNA, 22 nt, Human
cauaugcgugcaugugugcgug

SEQ ID NO: 1277940 - RNA, 19 nt, Human
cauucuugaugugcuggga

SEQ ID NO: 1277941 - RNA, 22 nt, Human
ccaaggaaagcacgaauauucc

SEQ ID NO: 1277942 - RNA, 21 nt, Human
ccacaguaucuuaucaguuaa

SEQ ID NO: 1277943 - RNA, 23 nt, Human
ccauagccauugaauacagccug

SEQ ID NO: 1277944 - RNA, 21 nt, Human
ccccccgugcucuuaaugccc

SEQ ID NO: 1277945 - RNA, 20 nt, Human
ccccgaugcaagucuuuccc

SEQ ID NO: 1277946 - RNA, 23 nt, Human
cccugcgacucacccugucgcuu

SEQ ID NO: 1277947 - RNA, 20 nt, Human
ccgggaaaaaucuccguucu

SEQ ID NO: 1277948 - RNA, 21 nt, Human
ccucaccacgcaacaggaaac

SEQ ID NO: 1277949 - RNA, 21 nt, Human
ccucugaagagccucuggcuu

SEQ ID NO: 1277950 - RNA, 25 nt, Human
ccucuggcuuuaucaucauccuguu

SEQ ID NO: 1277951 - RNA, 20 nt, Human
ccuugaggaagggggugggu

SEQ ID NO: 1277952 - RNA, 20 nt, Human
cgagagacagcuagcgcucg

SEQ ID NO: 1277953 - RNA, 21 nt, Human
cuccgcgcaggaaguagcccc

SEQ ID NO: 1277954 - RNA, 22 nt, Human
gagaccaagaagggacagaaaa

SEQ ID NO: 1277955 - RNA, 19 nt, Human
gcucugggugcuauuaacc

SEQ ID NO: 1277956 - RNA, 18 nt, Human
gcuggaccccacccugcu

SEQ ID NO: 1277957 - RNA, 26 nt, Human
gcuuucaggagccccgagccgcuuuu

SEQ ID NO: 1277958 - RNA, 18 nt, Human
ggagcuugcaagcuagug

SEQ ID NO: 1277959 - RNA, 18 nt, Human
ggaguccgucuggcucuc

SEQ ID NO: 1277960 - RNA, 25 nt, Human
gggauugggacuggccuggggucuc

SEQ ID NO: 1277961 - RNA, 18 nt, Human
gggcugcgagugaaggag

SEQ ID NO: 1277962 - RNA, 18 nt, Human
ggguauguuacucauugc

SEQ ID NO: 1277963 - RNA, 19 nt, Human
ggguuucuugauuccggga

SEQ ID NO: 1277964 - RNA, 24 nt, Human
ggucuccuacucuccuacuccgcg

SEQ ID NO: 1277965 - RNA, 20 nt, Human
guaaaaaugcugcauaaacg

SEQ ID NO: 1277966 - RNA, 19 nt, Human
guaguaugguuucauuuuc

SEQ ID NO: 1277967 - RNA, 21 nt, Human
gugaagcuuuuuaaauagaga

SEQ ID NO: 1277968 - RNA, 20 nt, Human
gugcaugugugcgugaagcu

SEQ ID NO: 1277969 - RNA, 18 nt, Human
uaaaaaugcugcauaaac

SEQ ID NO: 1277970 - RNA, 24 nt, Human
uaaacaacaugucgccaugacaac

SEQ ID NO: 1277971 - RNA, 25 nt, Human
uacuuugguuuagacaggggagagg

SEQ ID NO: 1277972 - RNA, 19 nt, Human
uagcgcucgaaauucucuu

SEQ ID NO: 1277973 - RNA, 22 nt, Human
uaggacgaaaccagcugaagcu

SEQ ID NO: 1277974 - RNA, 18 nt, Human
uaggguaucccacuagaa

SEQ ID NO: 1277975 - RNA, 22 nt, Human
uauauacauaucuuaauguaug

SEQ ID NO: 1277976 - RNA, 24 nt, Human
uaucccacuagaagccucacauca

SEQ ID NO: 1277977 - RNA, 19 nt, Human
ucagucaggcaggcauucc

SEQ ID NO: 1277978 - RNA, 22 nt, Human
uccccgaugcaagucuuucccg

SEQ ID NO: 1277979 - RNA, 25 nt, Human
uccgcaaaaacaaacucugaucccc

SEQ ID NO: 1277980 - RNA, 18 nt, Human
uccuugaggaagggggug

SEQ ID NO: 1277981 - RNA, 24 nt, Human
ucucaugcuaaacaacaugucgcc

SEQ ID NO: 1277982 - RNA, 24 nt, Human
ucuccuacucuccuacuccgcgca

SEQ ID NO: 1277983 - RNA, 19 nt, Human
ucugggugcagcucagcuc

SEQ ID NO: 1277984 - RNA, 21 nt, Human
ucuuaaugcccagccccuuca

SEQ ID NO: 1277985 - RNA, 23 nt, Human
ugcccagccccuucauuaaagac

SEQ ID NO: 1277986 - RNA, 23 nt, Human
ugccugcugauuucgcuggaccc

SEQ ID NO: 1277987 - RNA, 18 nt, Human
ugcugcuuucaggagccc

SEQ ID NO: 1277988 - RNA, 21 nt, Human
uggaagagaccaagaagggac

SEQ ID NO: 1277989 - RNA, 21 nt, Human
uggcgaaauccaagauggcgc

SEQ ID NO: 1277990 - RNA, 19 nt, Human
ugggaaaaauugggaacug

SEQ ID NO: 1277991 - RNA, 22 nt, Human
ugggaaaaauugggaacuggug

SEQ ID NO: 1277992 - RNA, 25 nt, Human
ugggaaaaauugggaacuggugcaa

SEQ ID NO: 1277993 - RNA, 19 nt, Human
uguauacagccugucuuuu

SEQ ID NO: 1277994 - RNA, 23 nt, Human
uguuucgaaguuccuucuuagga

SEQ ID NO: 1277995 - RNA, 22 nt, Human
uuaacauuugcaacauuuuuaa

SEQ ID NO: 1277996 - RNA, 25 nt, Human
uuaugcucuguuaaccucauuuguu

SEQ ID NO: 1277997 - RNA, 25 nt, Human
uuccauagccauugaauacagccug

SEQ ID NO: 1277998 - RNA, 23 nt, Human
uugggacuggccuggggucuccu

SEQ ID NO: 1277999 - RNA, 20 nt, Human
uugggcguuaucaaccggac

SEQ ID NO: 1278000 - RNA, 19 nt, Human
uugucagggaaaauuaaaa

SEQ ID NO: 1278001 - RNA, 24 nt, Human
uuuacugaguaccuucucuauguc

SEQ ID NO: 1278002 - RNA, 20 nt, Human
aaaaugucuccgccagcacg

SEQ ID NO: 1278003 - RNA, 18 nt, Human
aagcuucucucugaaucc

SEQ ID NO: 1278004 - RNA, 18 nt, Human
acagagcagaggacagga

SEQ ID NO: 1278005 - RNA, 20 nt, Human
acagcaaagcagcuggaggg

SEQ ID NO: 1278006 - RNA, 20 nt, Human
acagcaaagcagcuggaggg

SEQ ID NO: 1278007 - RNA, 24 nt, Human
acgcugcugucaucuccaguauac

SEQ ID NO: 1278008 - RNA, 22 nt, Human
acuggagaggaagucuggggac

SEQ ID NO: 1278009 - RNA, 21 nt, Human
agaaugaaaagggaugggugg

SEQ ID NO: 1278010 - RNA, 24 nt, Human
agcgcacaaacuuggacagggacg

SEQ ID NO: 1278011 - RNA, 22 nt, Human
aggaguccagaggaucugggcc

SEQ ID NO: 1278012 - RNA, 24 nt, Human
aguggaggguaaccacuggagagg

SEQ ID NO: 1278013 - RNA, 19 nt, Human
cacaagcagaccaucccuu

SEQ ID NO: 1278014 - RNA, 20 nt, Human
caccagcaccgcaagggcuc

SEQ ID NO: 1278015 - RNA, 20 nt, Human
caccagcaccgcaagggcuc

SEQ ID NO: 1278016 - RNA, 18 nt, Human
cacgugagguccuuuguu

SEQ ID NO: 1278017 - RNA, 18 nt, Human
cacugcauucauagugug

SEQ ID NO: 1278018 - RNA, 19 nt, Human
cacuggagaggaagucugg

SEQ ID NO: 1278019 - RNA, 25 nt, Human
cacuuuuacuguucucucuuaggga

SEQ ID NO: 1278020 - RNA, 20 nt, Human
cagcaaagcagcuggaggga

SEQ ID NO: 1278021 - RNA, 20 nt, Human
cagcacaauacagcaaagca

SEQ ID NO: 1278022 - RNA, 23 nt, Human
cagcacaauacagcaaagcagcu

SEQ ID NO: 1278023 - RNA, 21 nt, Human
cagcacgcucucaaaagcuuc

SEQ ID NO: 1278024 - RNA, 18 nt, Human
cagcugccuuuguuucuu

SEQ ID NO: 1278025 - RNA, 19 nt, Human
cagcuggagggauugccuu

SEQ ID NO: 1278026 - RNA, 23 nt, Human
caggcaucuuuaucuggggucuu

SEQ ID NO: 1278027 - RNA, 20 nt, Human
caucugaggaguccagagga

SEQ ID NO: 1278028 - RNA, 21 nt, Human
cauuucuguucuaaauccaaa

SEQ ID NO: 1278029 - RNA, 22 nt, Human
cccaggcacgccacggacacca

SEQ ID NO: 1278030 - RNA, 18 nt, Human
cccuguugcuggcugagg

SEQ ID NO: 1278031 - RNA, 20 nt, Human
cccuguugcuggcugagguc

SEQ ID NO: 1278032 - RNA, 24 nt, Human
ccucagagauccuaaaguuuccug

SEQ ID NO: 1278033 - RNA, 21 nt, Human
ccugcgugaaaccucuuuaug

SEQ ID NO: 1278034 - RNA, 21 nt, Human
ccuggcuuuguccacucgcug

SEQ ID NO: 1278035 - RNA, 21 nt, Human
ccugugaaggacgccgccccc

SEQ ID NO: 1278036 - RNA, 22 nt, Human
cucaaaacguuuccgcacaagc

SEQ ID NO: 1278037 - RNA, 24 nt, Human
cucucuguccuguucugcuggaga

SEQ ID NO: 1278038 - RNA, 18 nt, Human
cugacacugugaccgccg

SEQ ID NO: 1278039 - RNA, 22 nt, Human
cuucccgcagcccucgccagaa

SEQ ID NO: 1278040 - RNA, 22 nt, Human
cuuuccuucugcuuucaaaaug

SEQ ID NO: 1278041 - RNA, 23 nt, Human
gaggaguccagaggaucugggcc

SEQ ID NO: 1278042 - RNA, 20 nt, Human
gcacaagcagaccaucccuu

SEQ ID NO: 1278043 - RNA, 25 nt, Human
ggacaccagcaccgcaagggcucuu

SEQ ID NO: 1278044 - RNA, 20 nt, Human
uaagcucauuuuccacccag

SEQ ID NO: 1278045 - RNA, 23 nt, Human
uaagcucugagcucaggauuuca

SEQ ID NO: 1278046 - RNA, 21 nt, Human
uagugugacaggagacagcac

SEQ ID NO: 1278047 - RNA, 20 nt, Human
ucacgugagguccuuuguuc

SEQ ID NO: 1278048 - RNA, 21 nt, Human
ucacugcauucauagugugac

SEQ ID NO: 1278049 - RNA, 24 nt, Human
uccagggcaguggaggguaaccac

SEQ ID NO: 1278050 - RNA, 19 nt, Human
ucccugugaaggacgccgc

SEQ ID NO: 1278051 - RNA, 21 nt, Human
ucccugugaaggacgccgccc

SEQ ID NO: 1278052 - RNA, 21 nt, Human
uccgcacaagcagaccauccc

SEQ ID NO: 1278053 - RNA, 23 nt, Human
ucuccaguauaccucagagaucc

SEQ ID NO: 1278054 - RNA, 19 nt, Human
ucucugaccuccaugaagg

SEQ ID NO: 1278055 - RNA, 20 nt, Human
ucucuugggugauauucugg

SEQ ID NO: 1278056 - RNA, 18 nt, Human
ucugucuccuuuccuucu

SEQ ID NO: 1278057 - RNA, 18 nt, Human
ugaaaagggauggguggc

SEQ ID NO: 1278058 - RNA, 21 nt, Human
ugaaaccucuuuauggggcuu

SEQ ID NO: 1278059 - RNA, 21 nt, Human
ugagcucaggauuucacguga

SEQ ID NO: 1278060 - RNA, 19 nt, Human
ugagguccuuuguucggga

SEQ ID NO: 1278061 - RNA, 22 nt, Human
ugagguccuuuguucgggaggc

SEQ ID NO: 1278062 - RNA, 22 nt, Human
ugccuuuguuucuuccucucug

SEQ ID NO: 1278063 - RNA, 20 nt, Human
uggaagaccuuccgcagaac

SEQ ID NO: 1278064 - RNA, 22 nt, Human
ugggagcagccaaauauaaaau

SEQ ID NO: 1278065 - RNA, 20 nt, Human
ugggccauucuuuuccaguc

SEQ ID NO: 1278066 - RNA, 20 nt, Human
uuccgcagaacagaacgcuc

SEQ ID NO: 1278067 - RNA, 25 nt, Human
uucuacgcugcugucaucuccagua

SEQ ID NO: 1278068 - RNA, 21 nt, Human
uucucccuguugcuggcugag

SEQ ID NO: 1278069 - RNA, 18 nt, Human
uuugacccaguggaggac

SEQ ID NO: 1278070 - RNA, 24 nt, Human
uuuuacuguucucucuuagggaag

SEQ ID NO: 1278071 - RNA, 18 nt, Human
aaaauuaagaucuugccu

SEQ ID NO: 1278072 - RNA, 20 nt, Human
aaagcacccuccaagucucc

SEQ ID NO: 1278073 - RNA, 21 nt, Human
aaauuaggagugaggaaagga

SEQ ID NO: 1278074 - RNA, 20 nt, Human
aacuuauucccucaaccuua

SEQ ID NO: 1278075 - RNA, 23 nt, Human
aagaucuugccucagcccugagg

SEQ ID NO: 1278076 - RNA, 25 nt, Human
acaaaacaucagcaguucucuccaa

SEQ ID NO: 1278077 - RNA, 18 nt, Human
acuugaaugggcaacagc

SEQ ID NO: 1278078 - RNA, 21 nt, Human
agagaacacacaucccaucac

SEQ ID NO: 1278079 - RNA, 18 nt, Human
agagagugaggcucacaa

SEQ ID NO: 1278080 - RNA, 22 nt, Human
agaggccaguccucugugaguc

SEQ ID NO: 1278081 - RNA, 19 nt, Human
agauucgggaggccacugc

SEQ ID NO: 1278082 - RNA, 25 nt, Human
agcagguuuggcuuuauccagccuc

SEQ ID NO: 1278083 - RNA, 19 nt, Human
agcugguuucuucucccuu

SEQ ID NO: 1278084 - RNA, 23 nt, Human
aggcaggaggaucccuugagccc

SEQ ID NO: 1278085 - RNA, 24 nt, Human
aggcaggaggaucccuugagccca

SEQ ID NO: 1278086 - RNA, 24 nt, Human
aggcugaggcaggaggaucccuug

SEQ ID NO: 1278087 - RNA, 21 nt, Human
aggucaguuucucacuucucu

SEQ ID NO: 1278088 - RNA, 21 nt, Human
agucuccuucggucuccacug

SEQ ID NO: 1278089 - RNA, 20 nt, Human
auugcaccacugcacuccag

SEQ ID NO: 1278090 - RNA, 19 nt, Human
caaaagcacccuccaaguc

SEQ ID NO: 1278091 - RNA, 22 nt, Human
caaaagcacccuccaagucucc

SEQ ID NO: 1278092 - RNA, 18 nt, Human
caacacacaggaaccacc

SEQ ID NO: 1278093 - RNA, 22 nt, Human
cacacagagagagugaggcuca

SEQ ID NO: 1278094 - RNA, 21 nt, Human
cacacauuaccauuaaaacuc

SEQ ID NO: 1278095 - RNA, 22 nt, Human
cacagcccgagaauucagcaaa

SEQ ID NO: 1278096 - RNA, 22 nt, Human
cacaucccaucacacauuacca

SEQ ID NO: 1278097 - RNA, 23 nt, Human
caccacugcacuccagccagcca

SEQ ID NO: 1278098 - RNA, 20 nt, Human
cacugcacuccagccagcca

SEQ ID NO: 1278099 - RNA, 18 nt, Human
cagaagaugguuucugac

SEQ ID NO: 1278100 - RNA, 22 nt, Human
cagcaccagccgagggcuccuc

SEQ ID NO: 1278101 - RNA, 19 nt, Human
cagcccgagaauucagcaa

SEQ ID NO: 1278102 - RNA, 23 nt, Human
cagguuuaaaacuaggguuuucu

SEQ ID NO: 1278103 - RNA, 20 nt, Human
caguucucuccaaaagcacc

SEQ ID NO: 1278104 - RNA, 25 nt, Human
caucacacauuaccauuaaaacucc

SEQ ID NO: 1278105 - RNA, 18 nt, Human
ccacugcacuccagccag

SEQ ID NO: 1278106 - RNA, 19 nt, Human
ccacugcacuccagccagc

SEQ ID NO: 1278107 - RNA, 24 nt, Human
ccacugcacuccagccagccauga

SEQ ID NO: 1278108 - RNA, 21 nt, Human
ccaggccccccacggccagcc

SEQ ID NO: 1278109 - RNA, 23 nt, Human
cccacggccagccaggcgagagg

SEQ ID NO: 1278110 - RNA, 20 nt, Human
cccaucacacauuaccauua

SEQ ID NO: 1278111 - RNA, 27 nt, Human
ccccacacaucucacacgcucccucca

SEQ ID NO: 1278112 - RNA, 21 nt, Human
ccccccacggccagccaggcu

SEQ ID NO: 1278113 - RNA, 19 nt, Human
ccccugggacuauaaccca

SEQ ID NO: 1278114 - RNA, 26 nt, Human
ccccugggacuauaacccagcagggg

SEQ ID NO: 1278115 - RNA, 18 nt, Human
cccuuugcuugaauucuu

SEQ ID NO: 1278116 - RNA, 18 nt, Human
ccuccaagucuccuucgg

SEQ ID NO: 1278117 - RNA, 20 nt, Human
ccuccagagcuaagagcagg

SEQ ID NO: 1278118 - RNA, 19 nt, Human
ccucuauucaggauggggg

SEQ ID NO: 1278119 - RNA, 23 nt, Human
cgggcgauauuaggguccuggga

SEQ ID NO: 1278120 - RNA, 19 nt, Human
cguccaggccccccacggc

SEQ ID NO: 1278121 - RNA, 23 nt, Human
cucaaccuuaaauaucuugugac

SEQ ID NO: 1278122 - RNA, 23 nt, Human
cuccagagcuaagagcaggagaa

SEQ ID NO: 1278123 - RNA, 24 nt, Human
cuccaguaacagaccugagguacc

SEQ ID NO: 1278124 - RNA, 23 nt, Human
cucccagcauccucgggcgauau

SEQ ID NO: 1278125 - RNA, 22 nt, Human
cuccuggaguuggcugagaugc

SEQ ID NO: 1278126 - RNA, 20 nt, Human
cugggagauucgggaggcca

SEQ ID NO: 1278127 - RNA, 19 nt, Human
cuucucccuuuuugcaguc

SEQ ID NO: 1278128 - RNA, 25 nt, Human
cuugccucagcccugaggaacuggc

SEQ ID NO: 1278129 - RNA, 26 nt, Human
gaacacacaucccaucacacauuacc

SEQ ID NO: 1278130 - RNA, 24 nt, Human
gaacuguaguccuagcuacuuggg

SEQ ID NO: 1278131 - RNA, 27 nt, Human
gagaacagcaagagguagccgguaccc

SEQ ID NO: 1278132 - RNA, 21 nt, Human
gagguugcagugagccaugau

SEQ ID NO: 1278133 - RNA, 23 nt, Human
gagguugcagugagccaugauug

SEQ ID NO: 1278134 - RNA, 18 nt, Human
gcagcacgcugccccaca

SEQ ID NO: 1278135 - RNA, 20 nt, Human
gcugaccagcucaguuccca

SEQ ID NO: 1278136 - RNA, 22 nt, Human
ggaauuugagguugcagugagc

SEQ ID NO: 1278137 - RNA, 21 nt, Human
ggccucuaaucuccaucccag

SEQ ID NO: 1278138 - RNA, 21 nt, Human
uaaaaaucaagccucuaugac

SEQ ID NO: 1278139 - RNA, 26 nt, Human
uaauacacucugcuccuacucaaaau

SEQ ID NO: 1278140 - RNA, 21 nt, Human
uaaucuccaucccagcacagc

SEQ ID NO: 1278141 - RNA, 22 nt, Human
uaaucuccaucccagcacagcc

SEQ ID NO: 1278142 - RNA, 24 nt, Human
uaccauaagagaacacacauccca

SEQ ID NO: 1278143 - RNA, 25 nt, Human
uaccauuaaaacuccauucccggga

SEQ ID NO: 1278144 - RNA, 22 nt, Human
uagcaauccucuuccugauccc

SEQ ID NO: 1278145 - RNA, 23 nt, Human
uagcaauccucuuccugaucccu

SEQ ID NO: 1278146 - RNA, 24 nt, Human
uagcuacuugggaggcugaggcag

SEQ ID NO: 1278147 - RNA, 20 nt, Human
uagcugguuucuucucccuu

SEQ ID NO: 1278148 - RNA, 28 nt, Human
ucagcaguucucuccaaaagcacccucc

SEQ ID NO: 1278149 - RNA, 22 nt, Human
ucagcguuccucccagcauccu

SEQ ID NO: 1278150 - RNA, 25 nt, Human
ucaguuucucacuucucuuuccuua

SEQ ID NO: 1278151 - RNA, 23 nt, Human
uccacacacagagagagugaggc

SEQ ID NO: 1278152 - RNA, 22 nt, Human
uccagagcuaagagcaggagaa

SEQ ID NO: 1278153 - RNA, 19 nt, Human
uccaggccccccacggcca

SEQ ID NO: 1278154 - RNA, 23 nt, Human
ucccagaugccaagagugaguuc

SEQ ID NO: 1278155 - RNA, 20 nt, Human
uccccugggacuauaaccca

SEQ ID NO: 1278156 - RNA, 22 nt, Human
ucccuggucaagaggcagaggc

SEQ ID NO: 1278157 - RNA, 22 nt, Human
ucuccaguaacagaccugaccu

SEQ ID NO: 1278158 - RNA, 25 nt, Human
ucucucacgggaaagaauucagggu

SEQ ID NO: 1278159 - RNA, 22 nt, Human
ucugcaccugguccuugggcuc

SEQ ID NO: 1278160 - RNA, 25 nt, Human
ucugcuccuacucaaaauuaagauc

SEQ ID NO: 1278161 - RNA, 22 nt, Human
ugaagagcagcugaccagcuca

SEQ ID NO: 1278162 - RNA, 18 nt, Human
ugacagauucacugcagc

SEQ ID NO: 1278163 - RNA, 22 nt, Human
ugagaacagcaagagguagcug

SEQ ID NO: 1278164 - RNA, 23 nt, Human
ugagaacagcaagagguagcugg

SEQ ID NO: 1278165 - RNA, 22 nt, Human
ugagcccaggaauuugagguug

SEQ ID NO: 1278166 - RNA, 19 nt, Human
ugaggcaggaggaucccuu

SEQ ID NO: 1278167 - RNA, 24 nt, Human
ugaggcaggaggaucccuugagcc

SEQ ID NO: 1278168 - RNA, 25 nt, Human
ugaggcaggaggaucccuugagccc

SEQ ID NO: 1278169 - RNA, 23 nt, Human
ugagguugcagugagccaugauu

SEQ ID NO: 1278170 - RNA, 23 nt, Human
ugauagccuuuugucccucuggg

SEQ ID NO: 1278171 - RNA, 22 nt, Human
ugcagugagccaugauugcacc

SEQ ID NO: 1278172 - RNA, 20 nt, Human
uggccucuaaucuccauccc

SEQ ID NO: 1278173 - RNA, 20 nt, Human
ugggaggcugaggcaggagg

SEQ ID NO: 1278174 - RNA, 23 nt, Human
ugggaggcugaggcaggaggauc

SEQ ID NO: 1278175 - RNA, 21 nt, Human
ugguuugugcaaucuucagcc

SEQ ID NO: 1278176 - RNA, 18 nt, Human
ugucuuuccagugugaga

SEQ ID NO: 1278177 - RNA, 20 nt, Human
ugucuuuucucuccaguaac

SEQ ID NO: 1278178 - RNA, 20 nt, Human
uucacugcagcaccagccga

SEQ ID NO: 1278179 - RNA, 21 nt, Human
uucaggaugggggcacucugg

SEQ ID NO: 1278180 - RNA, 21 nt, Human
uucauugguuucucugccucu

SEQ ID NO: 1278181 - RNA, 23 nt, Human
uucccgggacuucaggagaguuu

SEQ ID NO: 1278182 - RNA, 22 nt, Human
uugcagugagccaugauugcac

SEQ ID NO: 1278183 - RNA, 23 nt, Human
uugcauugcucucuuuggaugua

SEQ ID NO: 1278184 - RNA, 18 nt, Human
uugucuuuccagugugag

SEQ ID NO: 1278185 - RNA, 23 nt, Human
uuucuucucccuuuuugcagucu

SEQ ID NO: 1278186 - RNA, 21 nt, Human
uuugugcaaucuucagccuaa

SEQ ID NO: 1278187 - RNA, 21 nt, Human
uuuugguggaccuaagucacc

SEQ ID NO: 1278188 - RNA, 18 nt, Human
uuuuuuaaguuuuccaga

SEQ ID NO: 1278189 - RNA, 22 nt, Human
aaaagaaagcgacuuucauaaa

SEQ ID NO: 1278190 - RNA, 22 nt, Human
aaacaaacugcaagccccccac

SEQ ID NO: 1278191 - RNA, 21 nt, Human
aaaccacccuagaccaaaaug

SEQ ID NO: 1278192 - RNA, 23 nt, Human
aaacugguuuauuuuuccuuuua

SEQ ID NO: 1278193 - RNA, 19 nt, Human
aaagaaaccacccuagacc

SEQ ID NO: 1278194 - RNA, 21 nt, Human
aaagcaagaagaaacuuacgu

SEQ ID NO: 1278195 - RNA, 25 nt, Human
aagaaaaaaugguuuaaaaagaaac

SEQ ID NO: 1278196 - RNA, 19 nt, Human
aagcaacagcaauuacugc

SEQ ID NO: 1278197 - RNA, 18 nt, Human
aagccccccacccccccg

SEQ ID NO: 1278198 - RNA, 18 nt, Human
aaggaagaaggcaagaga

SEQ ID NO: 1278199 - RNA, 21 nt, Human
aauaucuauucagcaucuggc

SEQ ID NO: 1278200 - RNA, 22 nt, Human
acaggcaucaccgugguaagac

SEQ ID NO: 1278201 - RNA, 19 nt, Human
accgugguaagaccgcggc

SEQ ID NO: 1278202 - RNA, 20 nt, Human
agacgggaggaggggaaagc

SEQ ID NO: 1278203 - RNA, 20 nt, Human
agaggggagacgggaggagg

SEQ ID NO: 1278204 - RNA, 24 nt, Human
agaucacccuaagauaaugaauuu

SEQ ID NO: 1278205 - RNA, 23 nt, Human
aggggaaagcaggucucugaaaa

SEQ ID NO: 1278206 - RNA, 18 nt, Human
aggggagacgggaggagg

SEQ ID NO: 1278207 - RNA, 19 nt, Human
aucuggaguaacacugucc

SEQ ID NO: 1278208 - RNA, 24 nt, Human
augaauaaaaagaaagcgacuuuc

SEQ ID NO: 1278209 - RNA, 30 nt, Human
caaaacaaacugcaagccccccaccccccu

SEQ ID NO: 1278210 - RNA, 18 nt, Human
caaaauguucugcuccuc

SEQ ID NO: 1278211 - RNA, 24 nt, Human
caacauaggauaaaauaauaucuu

SEQ ID NO: 1278212 - RNA, 19 nt, Human
cacacaggcaucaccgugg

SEQ ID NO: 1278213 - RNA, 20 nt, Human
cagaagaugcugcaggaaaa

SEQ ID NO: 1278214 - RNA, 23 nt, Human
caggaaaauaaaucuaaacaaaa

SEQ ID NO: 1278215 - RNA, 19 nt, Human
ccaaaacaaacugcaagcc

SEQ ID NO: 1278216 - RNA, 21 nt, Human
ccaaaacaaacugcaagcccc

SEQ ID NO: 1278217 - RNA, 22 nt, Human
ccaacuacaaauuaaaaauaaa

SEQ ID NO: 1278218 - RNA, 23 nt, Human
ccccccacccccccgaacgucug

SEQ ID NO: 1278219 - RNA, 18 nt, Human
ccucucgccuuccuucuu

SEQ ID NO: 1278220 - RNA, 24 nt, Human
cuccucucgccuuccuucuuguua

SEQ ID NO: 1278221 - RNA, 19 nt, Human
cucugaaaagcaagaagaa

SEQ ID NO: 1278222 - RNA, 21 nt, Human
cugcaagccccccaccccccc

SEQ ID NO: 1278223 - RNA, 23 nt, Human
cugcaagccccccacccccccga

SEQ ID NO: 1278224 - RNA, 20 nt, Human
gaaaccacccuagaccaaaa

SEQ ID NO: 1278225 - RNA, 18 nt, Human
gacaacaagcaacagcaa

SEQ ID NO: 1278226 - RNA, 19 nt, Human
gagaggggagacgggagga

SEQ ID NO: 1278227 - RNA, 21 nt, Human
gagaggggagacgggaggagg

SEQ ID NO: 1278228 - RNA, 24 nt, Human
gaggggaaagcaggucucugaaaa

SEQ ID NO: 1278229 - RNA, 23 nt, Human
ggaaagcaggucucugaaaagca

SEQ ID NO: 1278230 - RNA, 25 nt, Human
ggauguauaauaugcacugcaauuu

SEQ ID NO: 1278231 - RNA, 24 nt, Human
gggaggaggggaaagcaggucucu

SEQ ID NO: 1278232 - RNA, 18 nt, Human
gggcagaucacccuaaga

SEQ ID NO: 1278233 - RNA, 20 nt, Human
guauuuauuugcagcaaucc

SEQ ID NO: 1278234 - RNA, 23 nt, Human
uaaaaaagcaauccuucuaugua

SEQ ID NO: 1278235 - RNA, 22 nt, Human
uaaaaagaaaccacccuagacc

SEQ ID NO: 1278236 - RNA, 23 nt, Human
uaaaaagaaaccacccuagacca

SEQ ID NO: 1278237 - RNA, 21 nt, Human
uaaaaagaaagcgacuuucau

SEQ ID NO: 1278238 - RNA, 28 nt, Human
uaaaauaauaucuuacaggugagaggca

SEQ ID NO: 1278239 - RNA, 23 nt, Human
uaaaauaguuucucaaagauuaa

SEQ ID NO: 1278240 - RNA, 23 nt, Human
uaaaucuaaacaaaaagacuuuu

SEQ ID NO: 1278241 - RNA, 26 nt, Human
uauaaaggacugaaauaauaggaaaa

SEQ ID NO: 1278242 - RNA, 21 nt, Human
uaugcacugcaauuuuauaug

SEQ ID NO: 1278243 - RNA, 21 nt, Human
uccaaaacaaacugcaagccc

SEQ ID NO: 1278244 - RNA, 19 nt, Human
uccccaaagucugauuggc

SEQ ID NO: 1278245 - RNA, 21 nt, Human
ugaaaagcaagaagaaacuua

SEQ ID NO: 1278246 - RNA, 20 nt, Human
ugcaagccccccaccccccc

SEQ ID NO: 1278247 - RNA, 21 nt, Human
uggacugucauuagugagaaa

SEQ ID NO: 1278248 - RNA, 18 nt, Human
uguccccuagguuuaacu

SEQ ID NO: 1278249 - RNA, 20 nt, Human
uuaaaaagaaaccacccuag

SEQ ID NO: 1278250 - RNA, 19 nt, Human
uucagcaucuggcucacag

SEQ ID NO: 1278251 - RNA, 24 nt, Human
uuccuucuuguuauugcuuuaaau

SEQ ID NO: 1278252 - RNA, 20 nt, Human
aaagugcugggauuacaggc

SEQ ID NO: 1278253 - RNA, 22 nt, Human
aaagugcugggauuacaggcga

SEQ ID NO: 1278254 - RNA, 18 nt, Human
aagugcugggauuacagg

SEQ ID NO: 1278255 - RNA, 19 nt, Human
aagugcugggauuacaggc

SEQ ID NO: 1278256 - RNA, 26 nt, Human
aagugcugggauuacaggcgagagcc

SEQ ID NO: 1278257 - RNA, 22 nt, Human
agacagucgaagcugcugaagc

SEQ ID NO: 1278258 - RNA, 18 nt, Human
aggcuggacucgaacucc

SEQ ID NO: 1278259 - RNA, 24 nt, Human
aggugaucugcccaccucggccuc

SEQ ID NO: 1278260 - RNA, 18 nt, Human
agugcugggauuacaggc

SEQ ID NO: 1278261 - RNA, 22 nt, Human
augaaccagcuggaucugcuca

SEQ ID NO: 1278262 - RNA, 27 nt, Human
caaagugcugggauuacaggcgagagc

SEQ ID NO: 1278263 - RNA, 24 nt, Human
caccucggccucccaaagugcugg

SEQ ID NO: 1278264 - RNA, 21 nt, Human
cagcuccagccccgggaugaa

SEQ ID NO: 1278265 - RNA, 23 nt, Human
cagcuuccuuccgggccuuggag

SEQ ID NO: 1278266 - RNA, 19 nt, Human
ccaaagugcugggauuaca

SEQ ID NO: 1278267 - RNA, 22 nt, Human
ccaaagugcugggauuacaggc

SEQ ID NO: 1278268 - RNA, 23 nt, Human
ccaaagugcugggauuacaggcg

SEQ ID NO: 1278269 - RNA, 21 nt, Human
ccacggcgugugucuccggcc

SEQ ID NO: 1278270 - RNA, 19 nt, Human
ccgccgcugcucacggugu

SEQ ID NO: 1278271 - RNA, 23 nt, Human
ccggccgcggguuccaccuccuc

SEQ ID NO: 1278272 - RNA, 24 nt, Human
ccugaccucaggugaucugcccac

SEQ ID NO: 1278273 - RNA, 18 nt, Human
cgcggguuccaccuccuc

SEQ ID NO: 1278274 - RNA, 22 nt, Human
cggccgcggguuccaccuccuc

SEQ ID NO: 1278275 - RNA, 24 nt, Human
cggguuccaccuccuccccugccg

SEQ ID NO: 1278276 - RNA, 24 nt, Human
cggguuccaccuccuccccugccg

SEQ ID NO: 1278277 - RNA, 19 nt, Human
cguugccagcuguggcccc

SEQ ID NO: 1278278 - RNA, 23 nt, Human
cucgccgcggguuccaccuccuc

SEQ ID NO: 1278279 - RNA, 24 nt, Human
gaccucaggugaucugcccaccuc

SEQ ID NO: 1278280 - RNA, 18 nt, Human
gauuacaggcgagagccg

SEQ ID NO: 1278281 - RNA, 25 nt, Human
gcggguuccaccuccuccccugccg

SEQ ID NO: 1278282 - RNA, 25 nt, Human
gcggguuccaccuccuccccugccg

SEQ ID NO: 1278283 - RNA, 19 nt, Human
gcguugccagcuguggccc

SEQ ID NO: 1278284 - RNA, 23 nt, Human
gcuggacucgaacuccugaccuc

SEQ ID NO: 1278285 - RNA, 24 nt, Human
gcuguggccccugccccugccguu

SEQ ID NO: 1278286 - RNA, 18 nt, Human
ggccucagcuuccuuccg

SEQ ID NO: 1278287 - RNA, 24 nt, Human
ggcuggacucgaacuccugaccuc

SEQ ID NO: 1278288 - RNA, 22 nt, Human
gugaagcagcagcuccagcccc

SEQ ID NO: 1278289 - RNA, 24 nt, Human
gugaucugcccaccucggccuccc

SEQ ID NO: 1278290 - RNA, 18 nt, Human
gugugucuccggccgcgg

SEQ ID NO: 1278291 - RNA, 22 nt, Human
uaaaauuaaaguaggcguugcc

SEQ ID NO: 1278292 - RNA, 19 nt, Human
uaaaguaggcguugccagc

SEQ ID NO: 1278293 - RNA, 24 nt, Human
ucccaaagugcugggauuacaggc

SEQ ID NO: 1278294 - RNA, 21 nt, Human
uccccugccgccgcugcucac

SEQ ID NO: 1278295 - RNA, 23 nt, Human
uccccugccgccgcugcucaccg

SEQ ID NO: 1278296 - RNA, 23 nt, Human
uccccugccgccgcugcucacgg

SEQ ID NO: 1278297 - RNA, 24 nt, Human
uccuccccugccgccgcugcucac

SEQ ID NO: 1278298 - RNA, 18 nt, Human
ucgaagcugcugaagccc

SEQ ID NO: 1278299 - RNA, 23 nt, Human
ucgaagcugcugaagcccugcuu

SEQ ID NO: 1278300 - RNA, 18 nt, Human
ucggccucccaaagugcu

SEQ ID NO: 1278301 - RNA, 24 nt, Human
ucugcucaucucggggguggaagc

SEQ ID NO: 1278302 - RNA, 19 nt, Human
ugaagcagcagcuccagcc

SEQ ID NO: 1278303 - RNA, 18 nt, Human
ugaccucaggugaucugc

SEQ ID NO: 1278304 - RNA, 20 nt, Human
ugaccucaggugaucugccc

SEQ ID NO: 1278305 - RNA, 21 nt, Human
ugaccucaggugaucugccca

SEQ ID NO: 1278306 - RNA, 24 nt, Human
ugaccucaggugaucugcccaccu

SEQ ID NO: 1278307 - RNA, 24 nt, Human
ugaucugcccaccucggccuccca

SEQ ID NO: 1278308 - RNA, 19 nt, Human
uggaagcaucugcucacag

SEQ ID NO: 1278309 - RNA, 19 nt, Human
ugggauuacaggcgagagc

SEQ ID NO: 1278310 - RNA, 20 nt, Human
ugggauuacaggcgagagcc

SEQ ID NO: 1278311 - RNA, 21 nt, Human
ugggauuacaggcgagagccg

SEQ ID NO: 1278312 - RNA, 21 nt, Human
ugggauuacaggcgagagccg

SEQ ID NO: 1278313 - RNA, 22 nt, Human
ugggauuacaggcgagagccgc

SEQ ID NO: 1278314 - RNA, 24 nt, Human
ugggauuacaggcgagagccgcug

SEQ ID NO: 1278315 - RNA, 22 nt, Human
uugccagcuguggccccugccc

SEQ ID NO: 1278316 - RNA, 23 nt, Human
aaaaaaaaaaaaaaaggaaaaag

SEQ ID NO: 1278317 - RNA, 22 nt, Human
aaagaccagcuuuuucaaacac

SEQ ID NO: 1278318 - RNA, 20 nt, Human
aaagcaauugaaauggagca

SEQ ID NO: 1278319 - RNA, 20 nt, Human
aaagccaagaggugcgagua

SEQ ID NO: 1278320 - RNA, 21 nt, Human
aaaucuucaacagcacugucc

SEQ ID NO: 1278321 - RNA, 22 nt, Human
aacauacacauagauguaaaga

SEQ ID NO: 1278322 - RNA, 18 nt, Human
aacugcagcuccuacaua

SEQ ID NO: 1278323 - RNA, 22 nt, Human
aacugcagcuccuacauacauu

SEQ ID NO: 1278324 - RNA, 21 nt, Human
aagaacaagacauaaaccaag

SEQ ID NO: 1278325 - RNA, 20 nt, Human
aagaaugagggucaaaaaga

SEQ ID NO: 1278326 - RNA, 20 nt, Human
aagaccuaaucuacaacaaa

SEQ ID NO: 1278327 - RNA, 23 nt, Human
aagcaaguggaggucuuugggau

SEQ ID NO: 1278328 - RNA, 24 nt, Human
aauaccuaccugcccuugguggua

SEQ ID NO: 1278329 - RNA, 22 nt, Human
acagaacacaagaaaugcaaag

SEQ ID NO: 1278330 - RNA, 23 nt, Human
acagagcaagaccccguaucccc

SEQ ID NO: 1278331 - RNA, 18 nt, Human
acagcaaggccucugagc

SEQ ID NO: 1278332 - RNA, 22 nt, Human
accaaucccaacacuuucagaa

SEQ ID NO: 1278333 - RNA, 23 nt, Human
acuccagccugggagacagagca

SEQ ID NO: 1278334 - RNA, 18 nt, Human
acugcacuccagccuggg

SEQ ID NO: 1278335 - RNA, 24 nt, Human
acugcacuccagccugggagacag

SEQ ID NO: 1278336 - RNA, 23 nt, Human
acugcaguucacgaaacacaguc

SEQ ID NO: 1278337 - RNA, 21 nt, Human
acuucauuccuguaacaggcu

SEQ ID NO: 1278338 - RNA, 20 nt, Human
agaaaaccacucaucuugac

SEQ ID NO: 1278339 - RNA, 23 nt, Human
agacaaaaaugucccauccaaga

SEQ ID NO: 1278340 - RNA, 21 nt, Human
agccaagaagcauuuuccaga

SEQ ID NO: 1278341 - RNA, 22 nt, Human
agccaagaagcauuuuccagaa

SEQ ID NO: 1278342 - RNA, 25 nt, Human
agccaagaggugcgaguacccaaga

SEQ ID NO: 1278343 - RNA, 21 nt, Human
aggaaaaagaaaaccacucau

SEQ ID NO: 1278344 - RNA, 23 nt, Human
aggaaaaagaaaaccacucauug

SEQ ID NO: 1278345 - RNA, 20 nt, Human
aggaacacacauuugagagc

SEQ ID NO: 1278346 - RNA, 21 nt, Human
aggaagccguuccuuuucaga

SEQ ID NO: 1278347 - RNA, 20 nt, Human
aggcaaguuuucucugucuu

SEQ ID NO: 1278348 - RNA, 23 nt, Human
aggcaggagagucucuugaaccc

SEQ ID NO: 1278349 - RNA, 20 nt, Human
aggcggaggucacagugagc

SEQ ID NO: 1278350 - RNA, 24 nt, Human
aggcggaggucacagugagcugag

SEQ ID NO: 1278351 - RNA, 24 nt, Human
aggcugaggcaggagagucucuug

SEQ ID NO: 1278352 - RNA, 21 nt, Human
agggaggcugaggcaggagag

SEQ ID NO: 1278353 - RNA, 18 nt, Human
aguggccccagccaagaa

SEQ ID NO: 1278354 - RNA, 24 nt, Human
aguggcucacaccuguaaucccag

SEQ ID NO: 1278355 - RNA, 30 nt, Human
auccccguaucaaaaaaaaaaaaaaaaaaa

SEQ ID NO: 1278356 - RNA, 19 nt, Human
augacuccaugagguuuuc

SEQ ID NO: 1278357 - RNA, 24 nt, Human
auugugucacugcacuccagccug

SEQ ID NO: 1278358 - RNA, 22 nt, Human
caaaaucucaagaacaagacau

SEQ ID NO: 1278359 - RNA, 23 nt, Human
caaacaaacagaggagcguggca

SEQ ID NO: 1278360 - RNA, 20 nt, Human
caaagcaauugaaauggagc

SEQ ID NO: 1278361 - RNA, 19 nt, Human
caacauacacauagauguc

SEQ ID NO: 1278362 - RNA, 18 nt, Human
caagaaaugcaaagccac

SEQ ID NO: 1278363 - RNA, 19 nt, Human
caagaaaugcaaagccacc

SEQ ID NO: 1278364 - RNA, 21 nt, Human
caagaaaugcaccugggagac

SEQ ID NO: 1278365 - RNA, 23 nt, Human
caagaacaagacauaaaccaaga

SEQ ID NO: 1278366 - RNA, 21 nt, Human
caagacaaggaaugaggaagc

SEQ ID NO: 1278367 - RNA, 23 nt, Human
caagaggugcgaguacccaagac

SEQ ID NO: 1278368 - RNA, 18 nt, Human
caagaugacuccaugagg

SEQ ID NO: 1278369 - RNA, 18 nt, Human
caaggagagaaagccaau

SEQ ID NO: 1278370 - RNA, 21 nt, Human
cacaagaaaugcaaagccacc

SEQ ID NO: 1278371 - RNA, 21 nt, Human
cacaagaacugcagcuccuac

SEQ ID NO: 1278372 - RNA, 24 nt, Human
cacaccuguaaucccagcuaccag

SEQ ID NO: 1278373 - RNA, 18 nt, Human
caccuguaaucccagcua

SEQ ID NO: 1278374 - RNA, 24 nt, Human
caccuguaaucccagcuaccaggg

SEQ ID NO: 1278375 - RNA, 18 nt, Human
cacugcacuccagccugg

SEQ ID NO: 1278376 - RNA, 19 nt, Human
cacugcacuccagccuggg

SEQ ID NO: 1278377 - RNA, 19 nt, Human
cacugcacuccagccuggg

SEQ ID NO: 1278378 - RNA, 21 nt, Human
cacugcacuccagccugggag

SEQ ID NO: 1278379 - RNA, 22 nt, Human
cacugcacuccagccugggaga

SEQ ID NO: 1278380 - RNA, 23 nt, Human
cacugcacuccagccugggagac

SEQ ID NO: 1278381 - RNA, 24 nt, Human
cacugcacuccagccugggagaca

SEQ ID NO: 1278382 - RNA, 24 nt, Human
cacugcacuccagccugggagaca

SEQ ID NO: 1278383 - RNA, 25 nt, Human
cagaaaaacuuucaccuguggggaa

SEQ ID NO: 1278384 - RNA, 22 nt, Human
cagaacacaagaaaugcaaagc

SEQ ID NO: 1278385 - RNA, 25 nt, Human
cagaacacaagaaaugcaaagccac

SEQ ID NO: 1278386 - RNA, 25 nt, Human
cagaacacaagaaaugcaaagccag

SEQ ID NO: 1278387 - RNA, 21 nt, Human
cagagcaagaccccguauccc

SEQ ID NO: 1278388 - RNA, 18 nt, Human
cagaugcagcuggccaca

SEQ ID NO: 1278389 - RNA, 18 nt, Human
cagugguggguccuggca

SEQ ID NO: 1278390 - RNA, 19 nt, Human
cauggcugaucgcuggaca

SEQ ID NO: 1278391 - RNA, 21 nt, Human
ccaaucccaacacuuucagaa

SEQ ID NO: 1278392 - RNA, 24 nt, Human
ccauugccuguuaagucccaucug

SEQ ID NO: 1278393 - RNA, 20 nt, Human
ccccgcgugccguccgcgcc

SEQ ID NO: 1278394 - RNA, 22 nt, Human
ccccgcgugccguccgcgcccg

SEQ ID NO: 1278395 - RNA, 22 nt, Human
ccgcgcccgcgcccgggguccu

SEQ ID NO: 1278396 - RNA, 18 nt, Human
ccgcgcccgggguccucc

SEQ ID NO: 1278397 - RNA, 18 nt, Human
ccucaaaucuucaacagc

SEQ ID NO: 1278398 - RNA, 19 nt, Human
ccuggcccuucucucacgu

SEQ ID NO: 1278399 - RNA, 20 nt, Human
ccuguaaucccagcuaccag

SEQ ID NO: 1278400 - RNA, 23 nt, Human
cgcccgggguccuccgcccgcuc

SEQ ID NO: 1278401 - RNA, 20 nt, Human
cgcugaacugaaaucuccac

SEQ ID NO: 1278402 - RNA, 22 nt, Human
cuaacccugaguauuucauagc

SEQ ID NO: 1278403 - RNA, 25 nt, Human
cuaguucauucccuaggucauaccc

SEQ ID NO: 1278404 - RNA, 20 nt, Human
cucacaccuguaaucccagc

SEQ ID NO: 1278405 - RNA, 23 nt, Human
cucacaccuguaaucccagcuac

SEQ ID NO: 1278406 - RNA, 23 nt, Human
cucacuaagcuugauaaaggcug

SEQ ID NO: 1278407 - RNA, 19 nt, Human
cugaacugaaaucuccacu

SEQ ID NO: 1278408 - RNA, 21 nt, Human
cugcugcccaauacauaucca

SEQ ID NO: 1278409 - RNA, 19 nt, Human
cuggcccuucucucacguc

SEQ ID NO: 1278410 - RNA, 20 nt, Human
gaagaauaaacaccccuucu

SEQ ID NO: 1278411 - RNA, 24 nt, Human
gacucccagaguuguuccaccccu

SEQ ID NO: 1278412 - RNA, 22 nt, Human
gacucggagcugagggcagcgg

SEQ ID NO: 1278413 - RNA, 19 nt, Human
gagagaaagccaaugggaa

SEQ ID NO: 1278414 - RNA, 23 nt, Human
gagauugugucacugcacuccag

SEQ ID NO: 1278415 - RNA, 22 nt, Human
gagggucaaaaagaugcagaaa

SEQ ID NO: 1278416 - RNA, 23 nt, Human
gaggucacagugagcugagauug

SEQ ID NO: 1278417 - RNA, 18 nt, Human
gcaaagccacccuuccuu

SEQ ID NO: 1278418 - RNA, 19 nt, Human
gcacagacauaccuacaag

SEQ ID NO: 1278419 - RNA, 20 nt, Human
gcacagucucuuuuuaguuc

SEQ ID NO: 1278420 - RNA, 28 nt, Human
gcacggcuucagucaaagagggaacgcc

SEQ ID NO: 1278421 - RNA, 24 nt, Human
gcacuccagccugggagacagagc

SEQ ID NO: 1278422 - RNA, 22 nt, Human
gcaggagagucucuugaaccca

SEQ ID NO: 1278423 - RNA, 23 nt, Human
gccuucacgcaccauucagacag

SEQ ID NO: 1278424 - RNA, 18 nt, Human
gcuuccaggaaaggccaa

SEQ ID NO: 1278425 - RNA, 26 nt, Human
ggaacagauaguuaaguacuuggaca

SEQ ID NO: 1278426 - RNA, 21 nt, Human
ggaggcggaggucacagugag

SEQ ID NO: 1278427 - RNA, 22 nt, Human
ggaggucacagugagcugagau

SEQ ID NO: 1278428 - RNA, 24 nt, Human
ggaggucacagugagcugagauug

SEQ ID NO: 1278429 - RNA, 19 nt, Human
ggaguccccggcuccuccu

SEQ ID NO: 1278430 - RNA, 21 nt, Human
ggcuuccuagguuucaguugu

SEQ ID NO: 1278431 - RNA, 21 nt, Human
gggaaggagggcggggcagag

SEQ ID NO: 1278432 - RNA, 23 nt, Human
gggaaggagggcggggcagaggg

SEQ ID NO: 1278433 - RNA, 18 nt, Human
gggugggugcaguggcuc

SEQ ID NO: 1278434 - RNA, 23 nt, Human
ggugcaguggcucacaccuguaa

SEQ ID NO: 1278435 - RNA, 19 nt, Human
guaaagauaggaaaggagg

SEQ ID NO: 1278436 - RNA, 18 nt, Human
gugcaguggcucacaccu

SEQ ID NO: 1278437 - RNA, 21 nt, Human
guuaaauauucuucagcaaag

SEQ ID NO: 1278438 - RNA, 20 nt, Human
guuccguagucagcuccauc

SEQ ID NO: 1278439 - RNA, 22 nt, Human
uaaaaaaacaaagaagaagaag

SEQ ID NO: 1278440 - RNA, 20 nt, Human
uaaagagcgcauuucaguaa

SEQ ID NO: 1278441 - RNA, 22 nt, Human
uaagcaaguggaggucuuuggg

SEQ ID NO: 1278442 - RNA, 18 nt, Human
uaagcagaaacagcccac

SEQ ID NO: 1278443 - RNA, 26 nt, Human
uacaaaaaaaaacugaccuuuacuuc

SEQ ID NO: 1278444 - RNA, 22 nt, Human
uacaaagagcacugcaugaaag

SEQ ID NO: 1278445 - RNA, 23 nt, Human
uacagcaggcacuuacuaggugc

SEQ ID NO: 1278446 - RNA, 18 nt, Human
uaccagggaggcugaggc

SEQ ID NO: 1278447 - RNA, 21 nt, Human
uaccagggaggcugaggcagg

SEQ ID NO: 1278448 - RNA, 20 nt, Human
uaccuacaagcagucaucac

SEQ ID NO: 1278449 - RNA, 20 nt, Human
uaggauuccuaacccugagu

SEQ ID NO: 1278450 - RNA, 23 nt, Human
uauuaauuacugcuugagguuuu

SEQ ID NO: 1278451 - RNA, 21 nt, Human
ucaaaaaaaaaaaaaaaaaaa

SEQ ID NO: 1278452 - RNA, 19 nt, Human
ucaaaaagaugcagaaaca

SEQ ID NO: 1278453 - RNA, 20 nt, Human
ucacuaagcuugauaaaggc

SEQ ID NO: 1278454 - RNA, 24 nt, Human
ucacuaagcuugauaaaggcugaa

SEQ ID NO: 1278455 - RNA, 24 nt, Human
ucacugcacuccagccugggagac

SEQ ID NO: 1278456 - RNA, 21 nt, Human
ucacugcaguucacgaaacac

SEQ ID NO: 1278457 - RNA, 21 nt, Human
ucagaaaaacuuucaccugug

SEQ ID NO: 1278458 - RNA, 21 nt, Human
ucagaauuuuaaaaagucaac

SEQ ID NO: 1278459 - RNA, 23 nt, Human
ucagacagaugcagcuggccaca

SEQ ID NO: 1278460 - RNA, 21 nt, Human
ucagucaaagauucauuuccu

SEQ ID NO: 1278461 - RNA, 21 nt, Human
uccagaaaauucagcuccacu

SEQ ID NO: 1278462 - RNA, 19 nt, Human
uccauaugacccagugcuc

SEQ ID NO: 1278463 - RNA, 18 nt, Human
ucccaacacuuucagaaa

SEQ ID NO: 1278464 - RNA, 25 nt, Human
uccccguaucaaaaaaaaaaaaaaa

SEQ ID NO: 1278465 - RNA, 21 nt, Human
uccuagguuucaguuguaaau

SEQ ID NO: 1278466 - RNA, 24 nt, Human
uccuggcagugcucuccagccugg

SEQ ID NO: 1278467 - RNA, 21 nt, Human
uccuuaauuucuucuucuuua

SEQ ID NO: 1278468 - RNA, 19 nt, Human
ucuagcuggguuuucugua

SEQ ID NO: 1278469 - RNA, 19 nt, Human
ucugucucaguuugaagca

SEQ ID NO: 1278470 - RNA, 19 nt, Human
ucuucaacagcacugucca

SEQ ID NO: 1278471 - RNA, 22 nt, Human
ucuucaauuuacaucuuacuuc

SEQ ID NO: 1278472 - RNA, 21 nt, Human
ugaaacagcaguucuuaauau

SEQ ID NO: 1278473 - RNA, 21 nt, Human
ugaaauaagcagaaacagccc

SEQ ID NO: 1278474 - RNA, 20 nt, Human
ugaaaugucaaacccuacug

SEQ ID NO: 1278475 - RNA, 22 nt, Human
ugaacggaaguuuacacuggau

SEQ ID NO: 1278476 - RNA, 21 nt, Human
ugacccagugcucuuuaacaa

SEQ ID NO: 1278477 - RNA, 18 nt, Human
ugagacaagugcuaggau

SEQ ID NO: 1278478 - RNA, 22 nt, Human
ugagcugagauugugucacugc

SEQ ID NO: 1278479 - RNA, 24 nt, Human
ugaggcaggagagucucuugaacc

SEQ ID NO: 1278480 - RNA, 25 nt, Human
ugaggcaggagagucucuugaaccc

SEQ ID NO: 1278481 - RNA, 20 nt, Human
ugagggcagcgguggguccc

SEQ ID NO: 1278482 - RNA, 24 nt, Human
ugagggcagcggugggucccaaga

SEQ ID NO: 1278483 - RNA, 20 nt, Human
ugcuguacuuucucaaaacc

SEQ ID NO: 1278484 - RNA, 18 nt, Human
ugcuguucucuacuguuu

SEQ ID NO: 1278485 - RNA, 19 nt, Human
uggacagaagggcaacagu

SEQ ID NO: 1278486 - RNA, 22 nt, Human
uggcacagacauaccuacaagc

SEQ ID NO: 1278487 - RNA, 19 nt, Human
uggcaggugggggaugggc

SEQ ID NO: 1278488 - RNA, 24 nt, Human
uggcaggugggggaugggccuccc

SEQ ID NO: 1278489 - RNA, 21 nt, Human
uggcccuucucucacgucccc

SEQ ID NO: 1278490 - RNA, 18 nt, Human
uggcggagcaucaacaaa

SEQ ID NO: 1278491 - RNA, 21 nt, Human
uggcucacaccuguaauccca

SEQ ID NO: 1278492 - RNA, 21 nt, Human
ugggaaggagggcggggcaga

SEQ ID NO: 1278493 - RNA, 20 nt, Human
uggggaagugggggcaugug

SEQ ID NO: 1278494 - RNA, 23 nt, Human
ugggggaugggccuccccaaggc

SEQ ID NO: 1278495 - RNA, 24 nt, Human
uggguacauggcaguggagcucca

SEQ ID NO: 1278496 - RNA, 19 nt, Human
ugggugggugcaguggcuc

SEQ ID NO: 1278497 - RNA, 19 nt, Human
uguauauuuacagaaaagu

SEQ ID NO: 1278498 - RNA, 24 nt, Human
uguauuaauauucugacuuuaaua

SEQ ID NO: 1278499 - RNA, 19 nt, Human
ugucaaacccuacugggua

SEQ ID NO: 1278500 - RNA, 21 nt, Human
uguguaauguagggauacagc

SEQ ID NO: 1278501 - RNA, 19 nt, Human
uuaaaaaaacaaagaagaa

SEQ ID NO: 1278502 - RNA, 27 nt, Human
uucacuaaagucaaauauuuacaauga

SEQ ID NO: 1278503 - RNA, 27 nt, Human
uuccagaaaauucagcuccacuguuaa

SEQ ID NO: 1278504 - RNA, 22 nt, Human
uuccagugguggguccuggcaa

SEQ ID NO: 1278505 - RNA, 22 nt, Human
uucuuugaagugcugugugggg

SEQ ID NO: 1278506 - RNA, 23 nt, Human
uugggugggugcaguggcucaca

SEQ ID NO: 1278507 - RNA, 25 nt, Human
uuuaaaaagucaacauacacauaga

SEQ ID NO: 1278508 - RNA, 24 nt, Human
uuuaaaauauccauuagaaaagca

SEQ ID NO: 1278509 - RNA, 22 nt, Human
uuucagaguccugagacaagug

SEQ ID NO: 1278510 - RNA, 18 nt, Human
uuugaagugcuguguggg

SEQ ID NO: 1278511 - RNA, 23 nt, Human
uuuuuugcuguucucuacuguuu

SEQ ID NO: 1278512 - RNA, 19 nt, Human
accagcagcaccccagccc

SEQ ID NO: 1278513 - RNA, 21 nt, Human
agcucuggcugugcgaugagg

SEQ ID NO: 1278514 - RNA, 24 nt, Human
cucaggaugggaggagacaucuga

SEQ ID NO: 1278515 - RNA, 18 nt, Human
gacaucugaugugggauc

SEQ ID NO: 1278516 - RNA, 19 nt, Human
ggaugggaggagacaucug

SEQ ID NO: 1278517 - RNA, 23 nt, Human
ggcuggugugcagagcagcacug

SEQ ID NO: 1278518 - RNA, 19 nt, Human
ugagggcuuggccauuccu

SEQ ID NO: 1278519 - RNA, 19 nt, Human
ugggaggagacaucugaug

SEQ ID NO: 1278520 - RNA, 21 nt, Human
acuguguugcccaagcuaaca

SEQ ID NO: 1278521 - RNA, 20 nt, Human
agccaccacaccuggcuuug

SEQ ID NO: 1278522 - RNA, 19 nt, Human
aggugugagccaccacacc

SEQ ID NO: 1278523 - RNA, 24 nt, Human
aucuccgccaagccgccuccacca

SEQ ID NO: 1278524 - RNA, 22 nt, Human
cacucugucacccagccuucuu

SEQ ID NO: 1278525 - RNA, 24 nt, Human
caggggcugggcucuccucucggg

SEQ ID NO: 1278526 - RNA, 20 nt, Human
ccaagccgccuccaccaggg

SEQ ID NO: 1278527 - RNA, 19 nt, Human
ccaccacaccuggcuuugu

SEQ ID NO: 1278528 - RNA, 18 nt, Human
ccaggggcugggcucucc

SEQ ID NO: 1278529 - RNA, 24 nt, Human
cccagccuucuuaguagcugggac

SEQ ID NO: 1278530 - RNA, 24 nt, Human
ccucacucugucacccagccuucu

SEQ ID NO: 1278531 - RNA, 25 nt, Human
ccucacucugucacccagccuucuu

SEQ ID NO: 1278532 - RNA, 18 nt, Human
ccuggucuuuugcaaggg

SEQ ID NO: 1278533 - RNA, 23 nt, Human
gccaagccgccuccaccaggggc

SEQ ID NO: 1278534 - RNA, 21 nt, Human
ggacgucuggcugagcugcug

SEQ ID NO: 1278535 - RNA, 19 nt, Human
ggaggaacagacacaacca

SEQ ID NO: 1278536 - RNA, 22 nt, Human
ggaucucacuguguugcccaag

SEQ ID NO: 1278537 - RNA, 20 nt, Human
ggcucccauagaaaaacccu

SEQ ID NO: 1278538 - RNA, 18 nt, Human
guagagaugggaucucac

SEQ ID NO: 1278539 - RNA, 18 nt, Human
guagagaugggaucucac

SEQ ID NO: 1278540 - RNA, 22 nt, Human
uaccggaggaacagacacaacc

SEQ ID NO: 1278541 - RNA, 22 nt, Human
uagagaugggaucucacugugu

SEQ ID NO: 1278542 - RNA, 18 nt, Human
uagcugggacuggaggug

SEQ ID NO: 1278543 - RNA, 19 nt, Human
ucaccccuuaccggaggaa

SEQ ID NO: 1278544 - RNA, 18 nt, Human
uccgccaagccgccucca

SEQ ID NO: 1278545 - RNA, 22 nt, Human
uccgcgccccucggcgaaucac

SEQ ID NO: 1278546 - RNA, 18 nt, Human
ucucacuguguugcccaa

SEQ ID NO: 1278547 - RNA, 23 nt, Human
ucucacuguguugcccaagcuaa

SEQ ID NO: 1278548 - RNA, 23 nt, Human
ucuuaguagcugggacuggaggu

SEQ ID NO: 1278549 - RNA, 27 nt, Human
ugacccgaggucugucugguccgcgcc

SEQ ID NO: 1278550 - RNA, 24 nt, Human
ugggacuggaggugugagccacca

SEQ ID NO: 1278551 - RNA, 18 nt, Human
ugggaucucacuguguug

SEQ ID NO: 1278552 - RNA, 24 nt, Human
uguagagaugggaucucacugugu

SEQ ID NO: 1278553 - RNA, 22 nt, Human
ugucugguccgcgccccucggc

SEQ ID NO: 1278554 - RNA, 24 nt, Human
uuguagagaugggaucucacugug

SEQ ID NO: 1278555 - RNA, 24 nt, Human
uuuguagagaugggaucucacugu

SEQ ID NO: 1278556 - RNA, 24 nt, Human
uuuuuuguagagaugggaucucac

SEQ ID NO: 1278557 - RNA, 19 nt, Human
agacauggccacccacugg

SEQ ID NO: 1278558 - RNA, 19 nt, Human
agacauggccacccacugg

SEQ ID NO: 1278559 - RNA, 23 nt, Human
caagcugacaugaagacauggcc

SEQ ID NO: 1278560 - RNA, 20 nt, Human
cacuuggggucagaccauuc

SEQ ID NO: 1278561 - RNA, 18 nt, Human
cauggagcaagggagugc

SEQ ID NO: 1278562 - RNA, 19 nt, Human
gaggagaaaccuggguuuc

SEQ ID NO: 1278563 - RNA, 20 nt, Human
gcugaggagaaaccuggguu

SEQ ID NO: 1278564 - RNA, 20 nt, Human
ggagugcuggacuacacagg

SEQ ID NO: 1278565 - RNA, 19 nt, Human
uagcagcaucucuggucuc

SEQ ID NO: 1278566 - RNA, 21 nt, Human
ucagaccauucaugguggugg

SEQ ID NO: 1278567 - RNA, 24 nt, Human
ucagaccauucauggugguggugg

SEQ ID NO: 1278568 - RNA, 19 nt, Human
ugguggggccgucccgugu

SEQ ID NO: 1278569 - RNA, 21 nt, Human
ugguggugguggggccguccc

SEQ ID NO: 1278570 - RNA, 18 nt, Human
uggugguggugguggggc

SEQ ID NO: 1278571 - RNA, 20 nt, Human
uggugguggugguggggccc

SEQ ID NO: 1278572 - RNA, 24 nt, Human
uuagcagcaucucuggucuccauc

SEQ ID NO: 1278573 - RNA, 25 nt, Human
uucaaaugucauggagcaagggagu

SEQ ID NO: 1278574 - RNA, 24 nt, Human
uucauggugguggugguggggccu

SEQ ID NO: 1278575 - RNA, 20 nt, Human
uucucagcuuuggcacaguc

SEQ ID NO: 1278576 - RNA, 21 nt, Human
uugcugaggagaaaccugggu

SEQ ID NO: 1278577 - RNA, 20 nt, Human
aaccuccaccuccugggcuc

SEQ ID NO: 1278578 - RNA, 24 nt, Human
aaggauucuccucccucagccucc

SEQ ID NO: 1278579 - RNA, 24 nt, Human
aaggugcugagaucacagguguga

SEQ ID NO: 1278580 - RNA, 19 nt, Human
aaguagcugggaaugcagg

SEQ ID NO: 1278581 - RNA, 20 nt, Human
acagaacucaagggacagga

SEQ ID NO: 1278582 - RNA, 21 nt, Human
acaggugcccaccaccacacc

SEQ ID NO: 1278583 - RNA, 22 nt, Human
accauagggaaaugucuucuca

SEQ ID NO: 1278584 - RNA, 23 nt, Human
accuaucagguacuggaggugaa

SEQ ID NO: 1278585 - RNA, 25 nt, Human
acucuguugcccaggcuggagugca

SEQ ID NO: 1278586 - RNA, 19 nt, Human
agaucacaggugugagcca

SEQ ID NO: 1278587 - RNA, 18 nt, Human
aggaaggagaugaguugg

SEQ ID NO: 1278588 - RNA, 21 nt, Human
aggaaggcagguuugggcugg

SEQ ID NO: 1278589 - RNA, 25 nt, Human
aggcuggagugcaguggcaugaucu

SEQ ID NO: 1278590 - RNA, 24 nt, Human
aggugauccgccugccucggccuc

SEQ ID NO: 1278591 - RNA, 26 nt, Human
aggugcugagaucacaggugugagcc

SEQ ID NO: 1278592 - RNA, 18 nt, Human
aguagcugggauuacagg

SEQ ID NO: 1278593 - RNA, 24 nt, Human
agugauucuccugccucagccucc

SEQ ID NO: 1278594 - RNA, 18 nt, Human
agugcaguggcaugaucu

SEQ ID NO: 1278595 - RNA, 19 nt, Human
agugcaguggcaugaucuc

SEQ ID NO: 1278596 - RNA, 21 nt, Human
agugcaguggcaugaucucug

SEQ ID NO: 1278597 - RNA, 20 nt, Human
augggguuucaccauguugu

SEQ ID NO: 1278598 - RNA, 24 nt, Human
augggguuucaccauguuguccag

SEQ ID NO: 1278599 - RNA, 24 nt, Human
auuuuuguauuuuuaguagagaug

SEQ ID NO: 1278600 - RNA, 24 nt, Human
caaaggauucuccucccucagccu

SEQ ID NO: 1278601 - RNA, 23 nt, Human
caaccuccaccuccugggcucaa

SEQ ID NO: 1278602 - RNA, 24 nt, Human
caaccuccaccuccugggcucaag

SEQ ID NO: 1278603 - RNA, 22 nt, Human
caagccccuccagagaagcaag

SEQ ID NO: 1278604 - RNA, 24 nt, Human
caaggugcugagaucacaggugug

SEQ ID NO: 1278605 - RNA, 22 nt, Human
caagugauucuccugccucagc

SEQ ID NO: 1278606 - RNA, 19 nt, Human
cacagaacucaagggacag

SEQ ID NO: 1278607 - RNA, 19 nt, Human
cacaggugugagccaccac

SEQ ID NO: 1278608 - RNA, 24 nt, Human
caccacaccuggcuaauuuuugua

SEQ ID NO: 1278609 - RNA, 24 nt, Human
caccauguuguccaggcuggucuc

SEQ ID NO: 1278610 - RNA, 27 nt, Human
caccauguuguccaggcuggucucaaa

SEQ ID NO: 1278611 - RNA, 21 nt, Human
cacccaccuagacugcagagu

SEQ ID NO: 1278612 - RNA, 21 nt, Human
cacugcaaccuccaccuccug

SEQ ID NO: 1278613 - RNA, 23 nt, Human
cacugcaaccuccaccuccuggg

SEQ ID NO: 1278614 - RNA, 20 nt, Human
cacuggacauuucaagcccc

SEQ ID NO: 1278615 - RNA, 24 nt, Human
caggugcccaccaccacaccuggc

SEQ ID NO: 1278616 - RNA, 23 nt, Human
cauguuguccaggcuggucucaa

SEQ ID NO: 1278617 - RNA, 24 nt, Human
cauguuguccaggcuggucucaaa

SEQ ID NO: 1278618 - RNA, 20 nt, Human
cauuguaacacagacaaagc

SEQ ID NO: 1278619 - RNA, 21 nt, Human
ccaaggugcugagaucacagg

SEQ ID NO: 1278620 - RNA, 24 nt, Human
ccaaggugcugagaucacaggugu

SEQ ID NO: 1278621 - RNA, 24 nt, Human
ccaccuccugggcucaagugauuc

SEQ ID NO: 1278622 - RNA, 21 nt, Human
ccagggggcaacgugugccag

SEQ ID NO: 1278623 - RNA, 23 nt, Human
cccaaguagcugggaaugcaggu

SEQ ID NO: 1278624 - RNA, 23 nt, Human
cccaggcuggagugcaguggcau

SEQ ID NO: 1278625 - RNA, 23 nt, Human
cccgaguagcugggauuacaggu

SEQ ID NO: 1278626 - RNA, 24 nt, Human
cccgaguagcugggauuacaggug

SEQ ID NO: 1278627 - RNA, 21 nt, Human
ccgaguagcugggauuacagg

SEQ ID NO: 1278628 - RNA, 18 nt, Human
ccgcaggguuggcaggcc

SEQ ID NO: 1278629 - RNA, 22 nt, Human
ccucagccucccaaguagcugg

SEQ ID NO: 1278630 - RNA, 22 nt, Human
ccuccaccuccugggcucaagu

SEQ ID NO: 1278631 - RNA, 24 nt, Human
ccucccauguucaaaggauucucc

SEQ ID NO: 1278632 - RNA, 24 nt, Human
ccuccugggcucaagugauucucc

SEQ ID NO: 1278633 - RNA, 21 nt, Human
ccugaccuaaggugauccgcc

SEQ ID NO: 1278634 - RNA, 23 nt, Human
ccugaccuaaggugauccgccug

SEQ ID NO: 1278635 - RNA, 23 nt, Human
ccugggcucaagugauucuccuc

SEQ ID NO: 1278636 - RNA, 23 nt, Human
ccugggcucaagugauucuccug

SEQ ID NO: 1278637 - RNA, 21 nt, Human
cgacagagaggggcaggguac

SEQ ID NO: 1278638 - RNA, 23 nt, Human
cuaaggugauccgccugccucgg

SEQ ID NO: 1278639 - RNA, 23 nt, Human
cuaauuuuuguauuuuuaguaga

SEQ ID NO: 1278640 - RNA, 23 nt, Human
cucaagugauucuccugccucag

SEQ ID NO: 1278641 - RNA, 24 nt, Human
cucaagugauucuccugccucagc

SEQ ID NO: 1278642 - RNA, 24 nt, Human
cucacugcaaccuccaccuccugg

SEQ ID NO: 1278643 - RNA, 27 nt, Human
cucacugcaaccuccaccuccugggcu

SEQ ID NO: 1278644 - RNA, 24 nt, Human
cucagccucccgaguagcugggau

SEQ ID NO: 1278645 - RNA, 21 nt, Human
cucccaaggugcugagaucac

SEQ ID NO: 1278646 - RNA, 25 nt, Human
cucccucagccucccaaguagcugg

SEQ ID NO: 1278647 - RNA, 26 nt, Human
cuccugaccuaaggugauccgccugc

SEQ ID NO: 1278648 - RNA, 20 nt, Human
cuccugggcucaagugauuc

SEQ ID NO: 1278649 - RNA, 21 nt, Human
cuccugggcucaagugauucu

SEQ ID NO: 1278650 - RNA, 25 nt, Human
cuccugggcucaagugauucuccug

SEQ ID NO: 1278651 - RNA, 18 nt, Human
cugcaaccuccaccuccu

SEQ ID NO: 1278652 - RNA, 23 nt, Human
cugcaaccuccaccuccugggcu

SEQ ID NO: 1278653 - RNA, 24 nt, Human
cugcaaccuccaccuccugggcuc

SEQ ID NO: 1278654 - RNA, 23 nt, Human
cugccucagccucccgaguagcu

SEQ ID NO: 1278655 - RNA, 23 nt, Human
cugccucggccucccaaggugcu

SEQ ID NO: 1278656 - RNA, 26 nt, Human
cuuacugugcugggaguacuugugga

SEQ ID NO: 1278657 - RNA, 19 nt, Human
cuuguggagugcgggcugu

SEQ ID NO: 1278658 - RNA, 20 nt, Human
cuuguggagugcgggcugug

SEQ ID NO: 1278659 - RNA, 20 nt, Human
cuuuuguauuuuuaguggag

SEQ ID NO: 1278660 - RNA, 19 nt, Human
gacacagaacucaagggac

SEQ ID NO: 1278661 - RNA, 21 nt, Human
gacaggaaggagaugaguugg

SEQ ID NO: 1278662 - RNA, 19 nt, Human
gacagugucaggcaaggac

SEQ ID NO: 1278663 - RNA, 24 nt, Human
gaccuaaggugauccgccugccuc

SEQ ID NO: 1278664 - RNA, 20 nt, Human
gagaugaguuggaggcuggg

SEQ ID NO: 1278665 - RNA, 20 nt, Human
gagaugggguuucaccaugu

SEQ ID NO: 1278666 - RNA, 23 nt, Human
gagaugggguuucaccauguugu

SEQ ID NO: 1278667 - RNA, 20 nt, Human
gaggcugggacagggguccc

SEQ ID NO: 1278668 - RNA, 19 nt, Human
gaguuggaggcugggacag

SEQ ID NO: 1278669 - RNA, 18 nt, Human
gaucacaggugugagcca

SEQ ID NO: 1278670 - RNA, 22 nt, Human
gaugggguuucaccauguuguc

SEQ ID NO: 1278671 - RNA, 20 nt, Human
gcccaggcuggagugcagug

SEQ ID NO: 1278672 - RNA, 20 nt, Human
gccucagccucccgaguagc

SEQ ID NO: 1278673 - RNA, 20 nt, Human
gccuguuccccaccacaucc

SEQ ID NO: 1278674 - RNA, 24 nt, Human
gcuggagugcaguggcaugaucuc

SEQ ID NO: 1278675 - RNA, 25 nt, Human
ggacaggggucccugccagggaugc

SEQ ID NO: 1278676 - RNA, 19 nt, Human
gggcuaggaaggcagguuu

SEQ ID NO: 1278677 - RNA, 22 nt, Human
gggcucaagugauucuccugcc

SEQ ID NO: 1278678 - RNA, 22 nt, Human
gggguuucaccauguuguccag

SEQ ID NO: 1278679 - RNA, 22 nt, Human
ggguuucaccauguuguccagg

SEQ ID NO: 1278680 - RNA, 23 nt, Human
guagagaugggguuucaccaugu

SEQ ID NO: 1278681 - RNA, 18 nt, Human
guagcugggauuacaggu

SEQ ID NO: 1278682 - RNA, 19 nt, Human
gugauccgccugccucggc

SEQ ID NO: 1278683 - RNA, 24 nt, Human
gugauucuccugccucagccuccc

SEQ ID NO: 1278684 - RNA, 21 nt, Human
gugcugagaucacagguguga

SEQ ID NO: 1278685 - RNA, 21 nt, Human
gugugagccaccacgcugggc

SEQ ID NO: 1278686 - RNA, 23 nt, Human
guuucaccauguuguccaggcug

SEQ ID NO: 1278687 - RNA, 22 nt, Human
uaacuuuuguauuuuuagugga

SEQ ID NO: 1278688 - RNA, 24 nt, Human
uaauuuuuguauuuuuaguagaga

SEQ ID NO: 1278689 - RNA, 22 nt, Human
uacaggugcccaccaccacacc

SEQ ID NO: 1278690 - RNA, 24 nt, Human
uacucuguugcccaggcuggagug

SEQ ID NO: 1278691 - RNA, 22 nt, Human
uagagaugggguuucaccaugu

SEQ ID NO: 1278692 - RNA, 18 nt, Human
uagcauuguaacacagac

SEQ ID NO: 1278693 - RNA, 22 nt, Human
uagcuacgacagagaggggcag

SEQ ID NO: 1278694 - RNA, 19 nt, Human
uagcugggaaugcaggugc

SEQ ID NO: 1278695 - RNA, 25 nt, Human
uaggaaggcagguuugggcuggaga

SEQ ID NO: 1278696 - RNA, 24 nt, Human
uaguagagaugggguuucaccaug

SEQ ID NO: 1278697 - RNA, 26 nt, Human
uaguagagaugggguuucaccauguu

SEQ ID NO: 1278698 - RNA, 19 nt, Human
uauguguuucucaguugga

SEQ ID NO: 1278699 - RNA, 20 nt, Human
uauguuccaaaggacugacg

SEQ ID NO: 1278700 - RNA, 21 nt, Human
ucaccauguuguccaggcugg

SEQ ID NO: 1278701 - RNA, 23 nt, Human
ucacugcaaccuccaccuccugg

SEQ ID NO: 1278702 - RNA, 24 nt, Human
ucacugcaaccuccaccuccuggg

SEQ ID NO: 1278703 - RNA, 25 nt, Human
ucacugcaaccuccaccuccugggc

SEQ ID NO: 1278704 - RNA, 27 nt, Human
ucacugcaaccuccaccuccugggcuc

SEQ ID NO: 1278705 - RNA, 20 nt, Human
ucagccucccaaguagcugg

SEQ ID NO: 1278706 - RNA, 20 nt, Human
ucagccucccgaguagcugg

SEQ ID NO: 1278707 - RNA, 19 nt, Human
uccaaaggacugacggacc

SEQ ID NO: 1278708 - RNA, 22 nt, Human
uccagagaagcaagucuuacug

SEQ ID NO: 1278709 - RNA, 23 nt, Human
ucccaaggugcugagaucacagg

SEQ ID NO: 1278710 - RNA, 24 nt, Human
ucccaaguagcugggaaugcaggu

SEQ ID NO: 1278711 - RNA, 24 nt, Human
ucccagguagacagugguugaggc

SEQ ID NO: 1278712 - RNA, 23 nt, Human
ucccgaguagcugggauuacagg

SEQ ID NO: 1278713 - RNA, 24 nt, Human
ucccgaguagcugggauuacaggu

SEQ ID NO: 1278714 - RNA, 21 nt, Human
uccugggcucaagugauucuc

SEQ ID NO: 1278715 - RNA, 24 nt, Human
uccugggcucaagugauucuccug

SEQ ID NO: 1278716 - RNA, 18 nt, Human
ucggccucccaaggugcu

SEQ ID NO: 1278717 - RNA, 22 nt, Human
ucuagacuccauccuccauccc

SEQ ID NO: 1278718 - RNA, 20 nt, Human
ucuccucccucagccuccca

SEQ ID NO: 1278719 - RNA, 24 nt, Human
ucuccugccucagccucccgagua

SEQ ID NO: 1278720 - RNA, 18 nt, Human
ucuguugcccaggcugga

SEQ ID NO: 1278721 - RNA, 24 nt, Human
ucuguugcccaggcuggagugcag

SEQ ID NO: 1278722 - RNA, 22 nt, Human
ucuuacucuguugcccaggcug

SEQ ID NO: 1278723 - RNA, 23 nt, Human
ucuuacucuguugcccaggcugg

SEQ ID NO: 1278724 - RNA, 24 nt, Human
ucuuacucuguugcccaggcugga

SEQ ID NO: 1278725 - RNA, 19 nt, Human
ugacacagaacucaaggga

SEQ ID NO: 1278726 - RNA, 22 nt, Human
ugaccgugauugccugggauga

SEQ ID NO: 1278727 - RNA, 18 nt, Human
ugaccuaaggugauccgc

SEQ ID NO: 1278728 - RNA, 24 nt, Human
ugaccuaaggugauccgccugccu

SEQ ID NO: 1278729 - RNA, 18 nt, Human
ugacguuggacucauugg

SEQ ID NO: 1278730 - RNA, 22 nt, Human
ugagaucacaggugugagccac

SEQ ID NO: 1278731 - RNA, 24 nt, Human
ugagaucacaggugugagccacca

SEQ ID NO: 1278732 - RNA, 23 nt, Human
ugaucucugcucacugcaaccuc

SEQ ID NO: 1278733 - RNA, 20 nt, Human
ugauucuccugccucagccu

SEQ ID NO: 1278734 - RNA, 18 nt, Human
ugcagaguggauuugggu

SEQ ID NO: 1278735 - RNA, 18 nt, Human
ugcccaggcuggagugca

SEQ ID NO: 1278736 - RNA, 21 nt, Human
ugcccaggcuggagugcagug

SEQ ID NO: 1278737 - RNA, 22 nt, Human
ugcccaggcuggagugcagugg

SEQ ID NO: 1278738 - RNA, 24 nt, Human
ugcccaggcuggagugcaguggca

SEQ ID NO: 1278739 - RNA, 21 nt, Human
ugcccugggcuuuaauuauuu

SEQ ID NO: 1278740 - RNA, 24 nt, Human
ugccucagccucccgaguagcugg

SEQ ID NO: 1278741 - RNA, 21 nt, Human
ugccucggccucccaaggugc

SEQ ID NO: 1278742 - RNA, 24 nt, Human
ugccucggccucccaaggugcuga

SEQ ID NO: 1278743 - RNA, 22 nt, Human
ugccugggaugagaguggagac

SEQ ID NO: 1278744 - RNA, 21 nt, Human
ugccugguuuagggaauauuc

SEQ ID NO: 1278745 - RNA, 24 nt, Human
ugcugagaucacaggugugagcca

SEQ ID NO: 1278746 - RNA, 24 nt, Human
uggagucuuacucuguugcccagg

SEQ ID NO: 1278747 - RNA, 19 nt, Human
uggagugcaguggcaugau

SEQ ID NO: 1278748 - RNA, 22 nt, Human
uggagugcaguggcaugaucuc

SEQ ID NO: 1278749 - RNA, 23 nt, Human
uggagugcaguggcaugaucucu

SEQ ID NO: 1278750 - RNA, 24 nt, Human
uggagugcaguggcaugaucucug

SEQ ID NO: 1278751 - RNA, 23 nt, Human
uggauuuggguggcaucuuggcu

SEQ ID NO: 1278752 - RNA, 24 nt, Human
ugggaaugcaggugcgugccacca

SEQ ID NO: 1278753 - RNA, 20 nt, Human
ugggaugagaguggagacgg

SEQ ID NO: 1278754 - RNA, 21 nt, Human
ugggauuacaggugcccacca

SEQ ID NO: 1278755 - RNA, 24 nt, Human
ugggauuacaggugcccaccacca

SEQ ID NO: 1278756 - RNA, 18 nt, Human
ugggcucaagugauucuc

SEQ ID NO: 1278757 - RNA, 24 nt, Human
ugggcucaagugauucuccugccu

SEQ ID NO: 1278758 - RNA, 20 nt, Human
ugggcuggagacuugggcuu

SEQ ID NO: 1278759 - RNA, 24 nt, Human
ugggguuucaccauguuguccagg

SEQ ID NO: 1278760 - RNA, 24 nt, Human
uguccaggcuggucucaaacuccu

SEQ ID NO: 1278761 - RNA, 22 nt, Human
ugugacacagaacucaagggac

SEQ ID NO: 1278762 - RNA, 24 nt, Human
uuacucuguugcccaggcuggagu

SEQ ID NO: 1278763 - RNA, 18 nt, Human
uuaguagagaugggguuu

SEQ ID NO: 1278764 - RNA, 22 nt, Human
uuaguagagaugggguuucacc

SEQ ID NO: 1278765 - RNA, 24 nt, Human
uuaguagagaugggguuucaccau

SEQ ID NO: 1278766 - RNA, 18 nt, Human
uucuucuuguggccucug

SEQ ID NO: 1278767 - RNA, 19 nt, Human
uugauauguguuucucagu

SEQ ID NO: 1278768 - RNA, 19 nt, Human
uugcuugggacccaggggg

SEQ ID NO: 1278769 - RNA, 20 nt, Human
uuggaggcugggacaggggu

SEQ ID NO: 1278770 - RNA, 21 nt, Human
uugggaggcaucccagguaga

SEQ ID NO: 1278771 - RNA, 23 nt, Human
uuguauuuuuaguagagaugggg

SEQ ID NO: 1278772 - RNA, 22 nt, Human
uuuaaagauggagucuuacucu

SEQ ID NO: 1278773 - RNA, 22 nt, Human
uuucaccauguuguccaggcug

SEQ ID NO: 1278774 - RNA, 24 nt, Human
uuucaccauguuguccaggcuggu

SEQ ID NO: 1278775 - RNA, 24 nt, Human
uuuuuaguagagaugggguuucac

SEQ ID NO: 1278776 - RNA, 21 nt, Human
uuuuucuucuuguggccucug

SEQ ID NO: 1278777 - RNA, 20 nt, Human
uuuuuguauuuuuaguagag

SEQ ID NO: 1278778 - RNA, 23 nt, Human
aacuccaaguuaucuccaacuuu

SEQ ID NO: 1278779 - RNA, 19 nt, Human
aggcaauuucugaucgaga

SEQ ID NO: 1278780 - RNA, 23 nt, Human
ccaaggcaauuucugaucgagaa

SEQ ID NO: 1278781 - RNA, 22 nt, Human
ccuaucccaucucaacaucaaa

SEQ ID NO: 1278782 - RNA, 21 nt, Human
cucucugacaagagugucuga

SEQ ID NO: 1278783 - RNA, 19 nt, Human
cuggauuucuucuuugcuu

SEQ ID NO: 1278784 - RNA, 20 nt, Human
gguaucaaagaagauaagcu

SEQ ID NO: 1278785 - RNA, 22 nt, Human
uaucaaagaagauaagcugaca

SEQ ID NO: 1278786 - RNA, 26 nt, Human
uaucaaagaagauaagcugacaugau

SEQ ID NO: 1278787 - RNA, 22 nt, Human
ucucuaugauuacaacagagau

SEQ ID NO: 1278788 - RNA, 18 nt, Human
ucugacaagagugucuga

SEQ ID NO: 1278789 - RNA, 19 nt, Human
ugagaaaauauucaguuua

SEQ ID NO: 1278790 - RNA, 21 nt, Human
uggauuucuucuuugcuuuuc

SEQ ID NO: 1278791 - RNA, 24 nt, Human
uuaagauacaggcuuguaauucau

SEQ ID NO: 1278792 - RNA, 26 nt, Human
aaaaaagacccuaccuuacauaugaa

SEQ ID NO: 1278793 - RNA, 18 nt, Human
aaaaacauaaaaacucaa

SEQ ID NO: 1278794 - RNA, 23 nt, Human
aaaaagaagaaaaaggagaaaag

SEQ ID NO: 1278795 - RNA, 23 nt, Human
aaaaaggagaaaagagaaaaaga

SEQ ID NO: 1278796 - RNA, 28 nt, Human
aaacaaaaacauaaaaacucaaccaaaa

SEQ ID NO: 1278797 - RNA, 22 nt, Human
aaacagcagugaagauaaaagc

SEQ ID NO: 1278798 - RNA, 22 nt, Human
aaauuuucuuccccauagaagc

SEQ ID NO: 1278799 - RNA, 29 nt, Human
aaccaaaaaguggaaucaaaagggacccc

SEQ ID NO: 1278800 - RNA, 24 nt, Human
aacuagaccuccaagauccgccca

SEQ ID NO: 1278801 - RNA, 24 nt, Human
aacuuucacugaauauuuuaacau

SEQ ID NO: 1278802 - RNA, 21 nt, Human
aagaagaaaaaggagaaaaga

SEQ ID NO: 1278803 - RNA, 24 nt, Human
aagaagaaaaaggagaaaagagaa

SEQ ID NO: 1278804 - RNA, 21 nt, Human
aagaaucuugcagaaaucagc

SEQ ID NO: 1278805 - RNA, 18 nt, Human
aagcauccuuauaagagg

SEQ ID NO: 1278806 - RNA, 19 nt, Human
aaggaucuugagauggaga

SEQ ID NO: 1278807 - RNA, 25 nt, Human
aaguccuaaaaguacuaguugagcu

SEQ ID NO: 1278808 - RNA, 19 nt, Human
agaaaaagaaaaaaaagga

SEQ ID NO: 1278809 - RNA, 25 nt, Human
agaaaaagaaaaaaaaggaacaaaa

SEQ ID NO: 1278810 - RNA, 26 nt, Human
agaaaaagaaaaaaaaggaacaaaaa

SEQ ID NO: 1278811 - RNA, 24 nt, Human
agaaaaaggagaaaagagaaaaag

SEQ ID NO: 1278812 - RNA, 21 nt, Human
agaagaaaaaggagaaaagag

SEQ ID NO: 1278813 - RNA, 21 nt, Human
agaaggaaccagaccuaagga

SEQ ID NO: 1278814 - RNA, 19 nt, Human
agacucuagaagugaaagc

SEQ ID NO: 1278815 - RNA, 22 nt, Human
agcauggcccaauucuuccuca

SEQ ID NO: 1278816 - RNA, 19 nt, Human
agccaggagccaaggaaug

SEQ ID NO: 1278817 - RNA, 24 nt, Human
agcuucuggcaauauauuucuuuc

SEQ ID NO: 1278818 - RNA, 19 nt, Human
aggcaggaaggaaauuuga

SEQ ID NO: 1278819 - RNA, 24 nt, Human
aggcaggaaggaaauuugacuaua

SEQ ID NO: 1278820 - RNA, 25 nt, Human
aggcaggaaggaaauuugacuauag

SEQ ID NO: 1278821 - RNA, 23 nt, Human
aguaacuaauacuggagucuaua

SEQ ID NO: 1278822 - RNA, 21 nt, Human
aguguuuuccugggggcuggg

SEQ ID NO: 1278823 - RNA, 19 nt, Human
aucacuuuuacccaauuug

SEQ ID NO: 1278824 - RNA, 18 nt, Human
auggaaaauagcuuacuc

SEQ ID NO: 1278825 - RNA, 18 nt, Human
auuucugccauuguucuc

SEQ ID NO: 1278826 - RNA, 22 nt, Human
caaaaaagacccuaccuuacau

SEQ ID NO: 1278827 - RNA, 24 nt, Human
caaaaacauaaaaacucaaccaaa

SEQ ID NO: 1278828 - RNA, 21 nt, Human
caaaacacaagaaucuugcag

SEQ ID NO: 1278829 - RNA, 31 nt, Human
caaaugaccuucuccucuguaauguuuucuu

SEQ ID NO: 1278830 - RNA, 20 nt, Human
caagagacagcaaacagcag

SEQ ID NO: 1278831 - RNA, 22 nt, Human
cacuacguuaaaacagcaaaac

SEQ ID NO: 1278832 - RNA, 19 nt, Human
cagacucuagaagugaaag

SEQ ID NO: 1278833 - RNA, 24 nt, Human
cagcagacucuagaagugaaagcu

SEQ ID NO: 1278834 - RNA, 19 nt, Human
cagcccugcccucaccccu

SEQ ID NO: 1278835 - RNA, 20 nt, Human
cagugagucacuacguuaaa

SEQ ID NO: 1278836 - RNA, 21 nt, Human
cauauuaacaccaaaagaaau

SEQ ID NO: 1278837 - RNA, 20 nt, Human
ccauuguucucuugugauaa

SEQ ID NO: 1278838 - RNA, 22 nt, Human
cuacgggaaacuagaccuccaa

SEQ ID NO: 1278839 - RNA, 22 nt, Human
cucagcagaacuccacuguucc

SEQ ID NO: 1278840 - RNA, 18 nt, Human
cuggcaaaauucuguagc

SEQ ID NO: 1278841 - RNA, 20 nt, Human
cuucaauuucaccaaaucuc

SEQ ID NO: 1278842 - RNA, 24 nt, Human
gaaaaagaaaaaaaaggaacaaaa

SEQ ID NO: 1278843 - RNA, 21 nt, Human
gaaaacaaaaacauaaaaacu

SEQ ID NO: 1278844 - RNA, 18 nt, Human
gaaggaaccagaccuaag

SEQ ID NO: 1278845 - RNA, 19 nt, Human
gagaaaagagaaaaagaaa

SEQ ID NO: 1278846 - RNA, 19 nt, Human
ggacuuggcacacgucauu

SEQ ID NO: 1278847 - RNA, 20 nt, Human
guauauaaaaaaagaagucu

SEQ ID NO: 1278848 - RNA, 21 nt, Human
uaacagcccugcccucacccc

SEQ ID NO: 1278849 - RNA, 23 nt, Human
uaacaugucaucaucaagagaca

SEQ ID NO: 1278850 - RNA, 18 nt, Human
uaacuaauaccauuucug

SEQ ID NO: 1278851 - RNA, 18 nt, Human
uaaguugacucauuuugc

SEQ ID NO: 1278852 - RNA, 18 nt, Human
uaccugaaaacaaaaaca

SEQ ID NO: 1278853 - RNA, 19 nt, Human
uacuauuauuaucauaccu

SEQ ID NO: 1278854 - RNA, 19 nt, Human
uagaagaguaugugaccau

SEQ ID NO: 1278855 - RNA, 26 nt, Human
uaguguuuuccugggggcuggggaag

SEQ ID NO: 1278856 - RNA, 19 nt, Human
uauauaaaaaaagaagucc

SEQ ID NO: 1278857 - RNA, 24 nt, Human
uauauaaagauaaguugacucauu

SEQ ID NO: 1278858 - RNA, 20 nt, Human
ucaaaacagaacuuaaaaaa

SEQ ID NO: 1278859 - RNA, 24 nt, Human
ucaaauucuccucuuaaacuguac

SEQ ID NO: 1278860 - RNA, 21 nt, Human
uccaagauccgcccaugauuu

SEQ ID NO: 1278861 - RNA, 23 nt, Human
uccuagaucccucagcagaacuc

SEQ ID NO: 1278862 - RNA, 22 nt, Human
ucuugcagaaaucagcugccag

SEQ ID NO: 1278863 - RNA, 28 nt, Human
ugaaaacaaaaacauaaaaacucaacca

SEQ ID NO: 1278864 - RNA, 18 nt, Human
ugaagauaaaagcugaga

SEQ ID NO: 1278865 - RNA, 18 nt, Human
ugaccauggaagcagaga

SEQ ID NO: 1278866 - RNA, 21 nt, Human
ugagaaauucaaaacacaaga

SEQ ID NO: 1278867 - RNA, 18 nt, Human
ugaguauaaguguuuguu

SEQ ID NO: 1278868 - RNA, 18 nt, Human
ugcagaauaaggggaaaa

SEQ ID NO: 1278869 - RNA, 22 nt, Human
ugccauuguucucuugugauaa

SEQ ID NO: 1278870 - RNA, 20 nt, Human
uggauuaucugagcaucccc

SEQ ID NO: 1278871 - RNA, 21 nt, Human
uggcaaaauucuguagcuucu

SEQ ID NO: 1278872 - RNA, 23 nt, Human
uggcaauauauuucuuuccuggu

SEQ ID NO: 1278873 - RNA, 25 nt, Human
uuagucuaaucaaauucuccucuua

SEQ ID NO: 1278874 - RNA, 23 nt, Human
uucaccaaaucucaauuauauau

SEQ ID NO: 1278875 - RNA, 24 nt, Human
uuccugggggcuggggaaggauuu

SEQ ID NO: 1278876 - RNA, 24 nt, Human
uugacucauuuugcaauuguucuu

SEQ ID NO: 1278877 - RNA, 18 nt, Human
uugcagaaaucagcugcc

SEQ ID NO: 1278878 - RNA, 26 nt, Human
caaaaagaccccuuggggcuuacaaa

SEQ ID NO: 1278879 - RNA, 20 nt, Human
caagcuacaaaaaaauaguu

SEQ ID NO: 1278880 - RNA, 22 nt, Human
cccuuggggcuuacaaaaucuu

SEQ ID NO: 1278881 - RNA, 19 nt, Human
cuuuaauagcugagaugaa

SEQ ID NO: 1278882 - RNA, 21 nt, Human
gaugaagaugaugagaaggga

SEQ ID NO: 1278883 - RNA, 23 nt, Human
uaaauggaaaggguuuugaauuu

SEQ ID NO: 1278884 - RNA, 23 nt, Human
uaauagcugagaugaagaugaug

SEQ ID NO: 1278885 - RNA, 18 nt, Human
uagagaacuggauaauag

SEQ ID NO: 1278886 - RNA, 19 nt, Human
ucauggaucaaaaagaccc

SEQ ID NO: 1278887 - RNA, 22 nt, Human
ugaaaggaagucagauuuuagu

SEQ ID NO: 1278888 - RNA, 21 nt, Human
uguacaacuguauauaucuuu

SEQ ID NO: 1278889 - RNA, 18 nt, Human
uuuaauagcugagaugaa

SEQ ID NO: 1278890 - RNA, 24 nt, Human
uuucaagcuacaaaaaaauaguuu

SEQ ID NO: 1278891 - RNA, 21 nt, Human
aaaacagacaacucacugcuu

SEQ ID NO: 1278892 - RNA, 18 nt, Human
aaaauuagcugggcaugg

SEQ ID NO: 1278893 - RNA, 20 nt, Human
aaaauucugaacaaggauaa

SEQ ID NO: 1278894 - RNA, 26 nt, Human
aaacaaaacaaacacucacucacugg

SEQ ID NO: 1278895 - RNA, 23 nt, Human
aaaccccuucaucucuuggagaa

SEQ ID NO: 1278896 - RNA, 19 nt, Human
aaagacacaaaacagacaa

SEQ ID NO: 1278897 - RNA, 18 nt, Human
aacaagucacucaccacc

SEQ ID NO: 1278898 - RNA, 26 nt, Human
aagaaaaucaaagacacaaaacagac

SEQ ID NO: 1278899 - RNA, 22 nt, Human
aagaaacauaaaucuauuagcu

SEQ ID NO: 1278900 - RNA, 25 nt, Human
aagcaaucagaggccacuacacaca

SEQ ID NO: 1278901 - RNA, 24 nt, Human
aagcugaggcaggaggaucacuug

SEQ ID NO: 1278902 - RNA, 22 nt, Human
aaugccaaaaaaucaggaauaa

SEQ ID NO: 1278903 - RNA, 23 nt, Human
acaaaaaaaggacuuuacaugaa

SEQ ID NO: 1278904 - RNA, 22 nt, Human
acagaaaauuugaaaccccaau

SEQ ID NO: 1278905 - RNA, 24 nt, Human
acagagcaagacucugucgcaaaa

SEQ ID NO: 1278906 - RNA, 21 nt, Human
accuggaaaccccuucaucuc

SEQ ID NO: 1278907 - RNA, 22 nt, Human
acucuagaaagugcuacagggg

SEQ ID NO: 1278908 - RNA, 23 nt, Human
acugcacucuggcuuggcgacag

SEQ ID NO: 1278909 - RNA, 25 nt, Human
acugcacucuggcuuggcgacagag

SEQ ID NO: 1278910 - RNA, 22 nt, Human
acuugaaacgaggaggcggagg

SEQ ID NO: 1278911 - RNA, 23 nt, Human
agaaaaaacaaaacaaacacuca

SEQ ID NO: 1278912 - RNA, 25 nt, Human
agaaaacuacucacaaucaacccac

SEQ ID NO: 1278913 - RNA, 24 nt, Human
agacagcuuauuucaaccccaagc

SEQ ID NO: 1278914 - RNA, 18 nt, Human
agagaaggcauuagggau

SEQ ID NO: 1278915 - RNA, 29 nt, Human
agcaagacucugucgcaaaaaaaaaaaaa

SEQ ID NO: 1278916 - RNA, 26 nt, Human
agcuacauuuuccauaagguuaucau

SEQ ID NO: 1278917 - RNA, 23 nt, Human
agcugggcaugguggugcaugcu

SEQ ID NO: 1278918 - RNA, 22 nt, Human
agcuuauuucaaccccaagcaa

SEQ ID NO: 1278919 - RNA, 23 nt, Human
aggaagcugaggcaggaggauca

SEQ ID NO: 1278920 - RNA, 18 nt, Human
aggcaggaggaucacuug

SEQ ID NO: 1278921 - RNA, 20 nt, Human
aggcaggaggaucacuugaa

SEQ ID NO: 1278922 - RNA, 21 nt, Human
aggcggagcuugcagugaacu

SEQ ID NO: 1278923 - RNA, 24 nt, Human
aggcggagcuugcagugaacugag

SEQ ID NO: 1278924 - RNA, 21 nt, Human
aguuggaagugaccuugaagc

SEQ ID NO: 1278925 - RNA, 24 nt, Human
aucacaccacugcacucuggcuug

SEQ ID NO: 1278926 - RNA, 18 nt, Human
auguaaguuucaaagcca

SEQ ID NO: 1278927 - RNA, 21 nt, Human
auguacauauacccaaacaca

SEQ ID NO: 1278928 - RNA, 23 nt, Human
caaaaaaaggacuuuacaugaaa

SEQ ID NO: 1278929 - RNA, 20 nt, Human
caaaaacuauaaaaagcuac

SEQ ID NO: 1278930 - RNA, 23 nt, Human
caaaacaaacacucacucacugg

SEQ ID NO: 1278931 - RNA, 25 nt, Human
caaaacaaacacucacucacuggca

SEQ ID NO: 1278932 - RNA, 27 nt, Human
caaaacagacaacucacugcuuuauca

SEQ ID NO: 1278933 - RNA, 23 nt, Human
caagacucugucgcaaaaaaaaa

SEQ ID NO: 1278934 - RNA, 26 nt, Human
caauagauuucucuuuguuaaaguuu

SEQ ID NO: 1278935 - RNA, 22 nt, Human
cacaaucaacccacacacauug

SEQ ID NO: 1278936 - RNA, 21 nt, Human
cacacaggugucuaauguuag

SEQ ID NO: 1278937 - RNA, 19 nt, Human
cacauauauauguaugugu

SEQ ID NO: 1278938 - RNA, 22 nt, Human
cacucacuggcagaguugagag

SEQ ID NO: 1278939 - RNA, 22 nt, Human
cacucuggcuuggcgacagagc

SEQ ID NO: 1278940 - RNA, 18 nt, Human
cacugcacucuggcuugg

SEQ ID NO: 1278941 - RNA, 20 nt, Human
cacugcacucuggcuuggcg

SEQ ID NO: 1278942 - RNA, 21 nt, Human
cacugcacucuggcuuggcga

SEQ ID NO: 1278943 - RNA, 23 nt, Human
cacugcacucuggcuuggcgaca

SEQ ID NO: 1278944 - RNA, 23 nt, Human
cacugcacucuggcuuggcgaca

SEQ ID NO: 1278945 - RNA, 19 nt, Human
cagaacagaaugugauaua

SEQ ID NO: 1278946 - RNA, 24 nt, Human
cagaguugagagaaggcauuaggg

SEQ ID NO: 1278947 - RNA, 19 nt, Human
cauugcaauguaaauugau

SEQ ID NO: 1278948 - RNA, 19 nt, Human
ccaagcaaucagaggccac

SEQ ID NO: 1278949 - RNA, 19 nt, Human
ccacuaagugaugauugug

SEQ ID NO: 1278950 - RNA, 19 nt, Human
ccacugcacucuggcuugg

SEQ ID NO: 1278951 - RNA, 19 nt, Human
ccacugcacucuggcuugg

SEQ ID NO: 1278952 - RNA, 20 nt, Human
ccacugcacucuggcuuggc

SEQ ID NO: 1278953 - RNA, 23 nt, Human
ccacugcacucuggcuuggcgac

SEQ ID NO: 1278954 - RNA, 25 nt, Human
cccacacacauugacuacacacuca

SEQ ID NO: 1278955 - RNA, 27 nt, Human
cccacacacauugacuacacacucaca

SEQ ID NO: 1278956 - RNA, 19 nt, Human
cccacacguauauguaggu

SEQ ID NO: 1278957 - RNA, 20 nt, Human
ccuggaaaccccuucaucuc

SEQ ID NO: 1278958 - RNA, 20 nt, Human
ccuguccuucugaagauaga

SEQ ID NO: 1278959 - RNA, 23 nt, Human
cgaagaaugccaaaaaaucagga

SEQ ID NO: 1278960 - RNA, 22 nt, Human
cgcaaaaaaaaaaaaaaaaaaa

SEQ ID NO: 1278961 - RNA, 21 nt, Human
cgcuuuauggagauuguggag

SEQ ID NO: 1278962 - RNA, 26 nt, Human
cucacaaucaacccacacacauugac

SEQ ID NO: 1278963 - RNA, 24 nt, Human
cucugucgcaaaaaaaaaaaaaaa

SEQ ID NO: 1278964 - RNA, 25 nt, Human
cuguauacacccacacguauaugua

SEQ ID NO: 1278965 - RNA, 21 nt, Human
cuuggcgacagagcaagacuc

SEQ ID NO: 1278966 - RNA, 25 nt, Human
cuugucacauauauauguaugugug

SEQ ID NO: 1278967 - RNA, 26 nt, Human
cuuuuuugcuggugaggaauuggagg

SEQ ID NO: 1278968 - RNA, 21 nt, Human
gaaaaucaaagacacaaaaca

SEQ ID NO: 1278969 - RNA, 18 nt, Human
gaaaccccuucaucucuu

SEQ ID NO: 1278970 - RNA, 19 nt, Human
gaagaaaaaacaaaacaaa

SEQ ID NO: 1278971 - RNA, 19 nt, Human
gacagcuuauuucaacccc

SEQ ID NO: 1278972 - RNA, 22 nt, Human
gagaaggcauuagggauaaaau

SEQ ID NO: 1278973 - RNA, 20 nt, Human
gagaucacaccacugcacuc

SEQ ID NO: 1278974 - RNA, 20 nt, Human
gagcaagacucugucgcaaa

SEQ ID NO: 1278975 - RNA, 23 nt, Human
gaggaucacuugaaacgaggagg

SEQ ID NO: 1278976 - RNA, 24 nt, Human
gaucacuugaaacgaggaggcgga

SEQ ID NO: 1278977 - RNA, 23 nt, Human
gaugcuacaaucugggacuuggg

SEQ ID NO: 1278978 - RNA, 20 nt, Human
gcaaaaaaaaaaaaaaaaaa

SEQ ID NO: 1278979 - RNA, 23 nt, Human
gcacucuggcuuggcgacagagc

SEQ ID NO: 1278980 - RNA, 18 nt, Human
gcuacaaucugggacuug

SEQ ID NO: 1278981 - RNA, 22 nt, Human
gcuuggcgacagagcaagacuc

SEQ ID NO: 1278982 - RNA, 18 nt, Human
ggagaacaaauagguaca

SEQ ID NO: 1278983 - RNA, 24 nt, Human
ggagcuugcagugaacugagauca

SEQ ID NO: 1278984 - RNA, 25 nt, Human
ggugcaugcuuguaaucccaccuac

SEQ ID NO: 1278985 - RNA, 23 nt, Human
guauguacauauacccaaacaca

SEQ ID NO: 1278986 - RNA, 18 nt, Human
guggugcaugcuuguaau

SEQ ID NO: 1278987 - RNA, 19 nt, Human
uaaaaaaugcaugcaauga

SEQ ID NO: 1278988 - RNA, 19 nt, Human
uaaaggucaaaguuggaag

SEQ ID NO: 1278989 - RNA, 24 nt, Human
uaacaacauccaguggaaaggggc

SEQ ID NO: 1278990 - RNA, 19 nt, Human
uaacaagucacucaccacc

SEQ ID NO: 1278991 - RNA, 18 nt, Human
uaagaaaaucaaagacac

SEQ ID NO: 1278992 - RNA, 22 nt, Human
uaauacuugucacauauauaug

SEQ ID NO: 1278993 - RNA, 27 nt, Human
uaauacuugucacauauauauguaugu

SEQ ID NO: 1278994 - RNA, 23 nt, Human
uacaaagaacacuaaggaccaaa

SEQ ID NO: 1278995 - RNA, 19 nt, Human
uacagaacagaaugugaua

SEQ ID NO: 1278996 - RNA, 25 nt, Human
uauauaauaccaugcuauguaugua

SEQ ID NO: 1278997 - RNA, 26 nt, Human
uauauacuaaaaaaugcaugcagugu

SEQ ID NO: 1278998 - RNA, 20 nt, Human
uauauguaugugugugugua

SEQ ID NO: 1278999 - RNA, 21 nt, Human
uauauguauguguguguguau

SEQ ID NO: 1279000 - RNA, 18 nt, Human
uauguacuuccauuauag

SEQ ID NO: 1279001 - RNA, 19 nt, Human
uauguauguguguguguau

SEQ ID NO: 1279002 - RNA, 19 nt, Human
uauuuuacaaaaaaaggac

SEQ ID NO: 1279003 - RNA, 18 nt, Human
ucaaaaaauuccuuuucc

SEQ ID NO: 1279004 - RNA, 28 nt, Human
ucaacccacacacauugacuacacagug

SEQ ID NO: 1279005 - RNA, 21 nt, Human
ucaaccccaagcaaucagagg

SEQ ID NO: 1279006 - RNA, 19 nt, Human
ucacaaucaacccacacac

SEQ ID NO: 1279007 - RNA, 23 nt, Human
ucacaccacugcacucuggcuug

SEQ ID NO: 1279008 - RNA, 21 nt, Human
ucauggaauaaaggucaaagu

SEQ ID NO: 1279009 - RNA, 22 nt, Human
ucauuccuucucacccuuaaaa

SEQ ID NO: 1279010 - RNA, 19 nt, Human
ucuaacaacauccagugga

SEQ ID NO: 1279011 - RNA, 20 nt, Human
ucuaauguuaguccucaacu

SEQ ID NO: 1279012 - RNA, 23 nt, Human
ucuggcuuggcgacagagcaaga

SEQ ID NO: 1279013 - RNA, 22 nt, Human
ugaaaccccaauagauuucucu

SEQ ID NO: 1279014 - RNA, 22 nt, Human
ugaacauauacaggauucaugg

SEQ ID NO: 1279015 - RNA, 20 nt, Human
ugacuacacacucacaaaua

SEQ ID NO: 1279016 - RNA, 20 nt, Human
ugacucuagaaagugcuaca

SEQ ID NO: 1279017 - RNA, 18 nt, Human
ugagaucacaccacugca

SEQ ID NO: 1279018 - RNA, 18 nt, Human
ugagcuaaugagaggauu

SEQ ID NO: 1279019 - RNA, 20 nt, Human
ugaggcaggaggaucacuug

SEQ ID NO: 1279020 - RNA, 23 nt, Human
ugaggcaggaggaucacuugaaa

SEQ ID NO: 1279021 - RNA, 19 nt, Human
ugauuguguucaugaaagu

SEQ ID NO: 1279022 - RNA, 24 nt, Human
ugcauucuaaaagaauacauauuu

SEQ ID NO: 1279023 - RNA, 26 nt, Human
ugccaaaaaaucaggaauaaacuuaa

SEQ ID NO: 1279024 - RNA, 24 nt, Human
ugcuuguaaucccaccuacucagg

SEQ ID NO: 1279025 - RNA, 18 nt, Human
uggaaaccccuucaucuc

SEQ ID NO: 1279026 - RNA, 19 nt, Human
uggaaaggggcauuuagua

SEQ ID NO: 1279027 - RNA, 21 nt, Human
uggugcaugcuuguaauccca

SEQ ID NO: 1279028 - RNA, 24 nt, Human
ugguggugcaugcuuguaauccca

SEQ ID NO: 1279029 - RNA, 27 nt, Human
uguaaauugauuuuaaagucauaaugg

SEQ ID NO: 1279030 - RNA, 20 nt, Human
uguauguguguguguaugug

SEQ ID NO: 1279031 - RNA, 18 nt, Human
ugucacauauauauguau

SEQ ID NO: 1279032 - RNA, 22 nt, Human
ugucgcaaaaaaaaaaaaaaaa

SEQ ID NO: 1279033 - RNA, 19 nt, Human
uuaaucaucccucugauau

SEQ ID NO: 1279034 - RNA, 24 nt, Human
uuagcugggcaugguggugcaugc

SEQ ID NO: 1279035 - RNA, 19 nt, Human
uugcagugaacugagauca

SEQ ID NO: 1279036 - RNA, 20 nt, Human
uugcagugaacugagaucac

SEQ ID NO: 1279037 - RNA, 20 nt, Human
uuuaacaagucacucaccac

SEQ ID NO: 1279038 - RNA, 22 nt, Human
uuuacaugaaaauucugaacaa

SEQ ID NO: 1279039 - RNA, 18 nt, Human
aaaauuagcugggcaugg

SEQ ID NO: 1279040 - RNA, 18 nt, Human
aacaagucacucaccacc

SEQ ID NO: 1279041 - RNA, 24 nt, Human
aagcugaggcaggaggaucacuug

SEQ ID NO: 1279042 - RNA, 22 nt, Human
acuugaaacgaggaggcggagg

SEQ ID NO: 1279043 - RNA, 23 nt, Human
agcugggcaugguggugcaugcu

SEQ ID NO: 1279044 - RNA, 18 nt, Human
aggcaggaggaucacuug

SEQ ID NO: 1279045 - RNA, 20 nt, Human
aggcaggaggaucacuugaa

SEQ ID NO: 1279046 - RNA, 21 nt, Human
aggcggagcuugcagugaacu

SEQ ID NO: 1279047 - RNA, 24 nt, Human
aggcggagcuugcagugaacugag

SEQ ID NO: 1279048 - RNA, 21 nt, Human
aguuggaagugaccuugaagc

SEQ ID NO: 1279049 - RNA, 21 nt, Human
aucacaccacugcacucuggc

SEQ ID NO: 1279050 - RNA, 24 nt, Human
caggaagcugaggcaggaggauca

SEQ ID NO: 1279051 - RNA, 19 nt, Human
ccacuaagugaugauugug

SEQ ID NO: 1279052 - RNA, 23 nt, Human
gaggaucacuugaaacgaggagg

SEQ ID NO: 1279053 - RNA, 24 nt, Human
gaucacuugaaacgaggaggcgga

SEQ ID NO: 1279054 - RNA, 24 nt, Human
ggagcuugcagugaacugagauca

SEQ ID NO: 1279055 - RNA, 25 nt, Human
ggugcaugcuuguaaucccaccuac

SEQ ID NO: 1279056 - RNA, 19 nt, Human
gguggugcaugcuuguaau

SEQ ID NO: 1279057 - RNA, 19 nt, Human
uaacaagucacucaccacc

SEQ ID NO: 1279058 - RNA, 18 nt, Human
ucacaccacugcacucug

SEQ ID NO: 1279059 - RNA, 21 nt, Human
ucauggaauaaaggucaaagu

SEQ ID NO: 1279060 - RNA, 22 nt, Human
ugaacauauacaggauucaugg

SEQ ID NO: 1279061 - RNA, 18 nt, Human
ugagaucacaccacugca

SEQ ID NO: 1279062 - RNA, 24 nt, Human
ugagaucacaccacugcacucugg

SEQ ID NO: 1279063 - RNA, 20 nt, Human
ugaggcaggaggaucacuug

SEQ ID NO: 1279064 - RNA, 24 nt, Human
ugaggcaggaggaucacuugaaac

SEQ ID NO: 1279065 - RNA, 19 nt, Human
ugauuguguucaugaaagu

SEQ ID NO: 1279066 - RNA, 24 nt, Human
ugcuuguaaucccaccuacucagg

SEQ ID NO: 1279067 - RNA, 21 nt, Human
uggugcaugcuuguaauccca

SEQ ID NO: 1279068 - RNA, 24 nt, Human
ugguggugcaugcuuguaauccca

SEQ ID NO: 1279069 - RNA, 20 nt, Human
uguaaucccaccuacucagg

SEQ ID NO: 1279070 - RNA, 19 nt, Human
uuaaucaucccucugauau

SEQ ID NO: 1279071 - RNA, 24 nt, Human
uuagcugggcaugguggugcaugc

SEQ ID NO: 1279072 - RNA, 19 nt, Human
uugcagugaacugagauca

SEQ ID NO: 1279073 - RNA, 20 nt, Human
uugcagugaacugagaucac

SEQ ID NO: 1279074 - RNA, 20 nt, Human
uuuaacaagucacucaccac

SEQ ID NO: 1279075 - RNA, 18 nt, Human
uuuaagacugauauuuac

SEQ ID NO: 1279076 - RNA, 23 nt, Human
aaugugagaaugucaaagaagga

SEQ ID NO: 1279077 - RNA, 18 nt, Human
accuuuacuggcuccagu

SEQ ID NO: 1279078 - RNA, 19 nt, Human
cagacagacuggacacugc

SEQ ID NO: 1279079 - RNA, 21 nt, Human
ccaaacaaaugugagaauguc

SEQ ID NO: 1279080 - RNA, 27 nt, Human
cuggcaauuaauggauaaacucuuuuu

SEQ ID NO: 1279081 - RNA, 20 nt, Human
cuggugccucuguccagucc

SEQ ID NO: 1279082 - RNA, 21 nt, Human
cuggugccucuguccagucca

SEQ ID NO: 1279083 - RNA, 19 nt, Human
cuucaggaaucgccaaucc

SEQ ID NO: 1279084 - RNA, 19 nt, Human
gaaacuucaggaaucgcca

SEQ ID NO: 1279085 - RNA, 20 nt, Human
gaccuugcuuuucuucauac

SEQ ID NO: 1279086 - RNA, 24 nt, Human
ucugaaccucaauaacaggcagca

SEQ ID NO: 1279087 - RNA, 19 nt, Human
ugagaaugucaaagaagga

SEQ ID NO: 1279088 - RNA, 24 nt, Human
uuaguuuaagaguuaccuuucuca

SEQ ID NO: 1279089 - RNA, 24 nt, Human
uucaaguuucagccaaacaaaugu

SEQ ID NO: 1279090 - RNA, 22 nt, Human
cagcugccgcugaggcuggaac

SEQ ID NO: 1279091 - RNA, 22 nt, Human
uccgucgagcgauccagcugcc

SEQ ID NO: 1279092 - RNA, 20 nt, Human
aaaaaaaacaaugaacaaag

SEQ ID NO: 1279093 - RNA, 22 nt, Human
aaaaaaaacaaugaacaaaguu

SEQ ID NO: 1279094 - RNA, 22 nt, Human
aaaaagcaaaauaaaauagcau

SEQ ID NO: 1279095 - RNA, 19 nt, Human
aaaaugaauaaauauggcc

SEQ ID NO: 1279096 - RNA, 24 nt, Human
aaacacacacaaaaucaaaucauc

SEQ ID NO: 1279097 - RNA, 18 nt, Human
aaacagguaaacaguuug

SEQ ID NO: 1279098 - RNA, 23 nt, Human
aaacaguccuuuccagcaaccuc

SEQ ID NO: 1279099 - RNA, 20 nt, Human
aaaugaacaaguacaagaaa

SEQ ID NO: 1279100 - RNA, 20 nt, Human
aacaaaaaaaacaaugaaca

SEQ ID NO: 1279101 - RNA, 19 nt, Human
aacaauacuggcuuucccc

SEQ ID NO: 1279102 - RNA, 21 nt, Human
aacacuuacuaagcauuuccu

SEQ ID NO: 1279103 - RNA, 18 nt, Human
aacaucugccacucugcc

SEQ ID NO: 1279104 - RNA, 18 nt, Human
aagacaaggacacacaug

SEQ ID NO: 1279105 - RNA, 19 nt, Human
aagagguuggccugcaucc

SEQ ID NO: 1279106 - RNA, 22 nt, Human
aagcaaaacaaaaguaacgugg

SEQ ID NO: 1279107 - RNA, 20 nt, Human
aagcauuuccuggguaugcc

SEQ ID NO: 1279108 - RNA, 19 nt, Human
aaguacaagaaaacagucc

SEQ ID NO: 1279109 - RNA, 25 nt, Human
acacaacaaaacuagaauggcugag

SEQ ID NO: 1279110 - RNA, 26 nt, Human
accaccacacagucaguacuggccug

SEQ ID NO: 1279111 - RNA, 18 nt, Human
agaaaagaaaauaaugaa

SEQ ID NO: 1279112 - RNA, 21 nt, Human
agaaauacuguagaaagccau

SEQ ID NO: 1279113 - RNA, 18 nt, Human
agacaaggacacacaugc

SEQ ID NO: 1279114 - RNA, 19 nt, Human
agacaaggacacacaugca

SEQ ID NO: 1279115 - RNA, 22 nt, Human
agucuugacauuguagaaauaa

SEQ ID NO: 1279116 - RNA, 25 nt, Human
agugcagcaugugccaaauguuuug

SEQ ID NO: 1279117 - RNA, 20 nt, Human
auaaaacacaacuggcagaa

SEQ ID NO: 1279118 - RNA, 18 nt, Human
auguaauaaggugaagcc

SEQ ID NO: 1279119 - RNA, 22 nt, Human
auuaccaaauauuaagcuguga

SEQ ID NO: 1279120 - RNA, 22 nt, Human
caaaacgguaagcccuuaagag

SEQ ID NO: 1279121 - RNA, 23 nt, Human
caaaacgguaagcccuuaagagc

SEQ ID NO: 1279122 - RNA, 23 nt, Human
caaaacuagaauggcugaggcac

SEQ ID NO: 1279123 - RNA, 20 nt, Human
caaaaguaacgugggaacuu

SEQ ID NO: 1279124 - RNA, 23 nt, Human
caaauuaauuuacagucaguuuu

SEQ ID NO: 1279125 - RNA, 21 nt, Human
caaauuccaagauagaaaaga

SEQ ID NO: 1279126 - RNA, 21 nt, Human
caacacacaacaaaacuagaa

SEQ ID NO: 1279127 - RNA, 22 nt, Human
cacaacaaaacuagaauggcug

SEQ ID NO: 1279128 - RNA, 24 nt, Human
cacaauaucuuauagcccauucca

SEQ ID NO: 1279129 - RNA, 24 nt, Human
cacacaugcacuuggaagaaagaa

SEQ ID NO: 1279130 - RNA, 22 nt, Human
cacucugccaauucuauauccc

SEQ ID NO: 1279131 - RNA, 24 nt, Human
cagguaaacaguuugaaauaaugc

SEQ ID NO: 1279132 - RNA, 19 nt, Human
cagguucuccaccuggaau

SEQ ID NO: 1279133 - RNA, 24 nt, Human
ccaacaacaagcuuaaacacuaaa

SEQ ID NO: 1279134 - RNA, 20 nt, Human
cgguaagcccuuaagagcag

SEQ ID NO: 1279135 - RNA, 26 nt, Human
cuauucuaggaaagacaaauggccag

SEQ ID NO: 1279136 - RNA, 25 nt, Human
cugguacuaaauaaauggcaacaaa

SEQ ID NO: 1279137 - RNA, 18 nt, Human
cuuaugacaugccacaag

SEQ ID NO: 1279138 - RNA, 22 nt, Human
cuuccauugucuagcacaucua

SEQ ID NO: 1279139 - RNA, 23 nt, Human
gaaaaaguuuaugcgaagguggu

SEQ ID NO: 1279140 - RNA, 18 nt, Human
gaaaauaaugaauagcau

SEQ ID NO: 1279141 - RNA, 21 nt, Human
gaaaaugaauaaauauggcca

SEQ ID NO: 1279142 - RNA, 25 nt, Human
gaacaaguacaagaaaacaguccuu

SEQ ID NO: 1279143 - RNA, 21 nt, Human
gacaaaacgguaagcccuuaa

SEQ ID NO: 1279144 - RNA, 20 nt, Human
gagcaaauuccaagauagaa

SEQ ID NO: 1279145 - RNA, 25 nt, Human
gcaaaaccuggaagaauaugagagc

SEQ ID NO: 1279146 - RNA, 18 nt, Human
gcaaacuauuuuauguua

SEQ ID NO: 1279147 - RNA, 22 nt, Human
gcaacaaaaaugcugacauggg

SEQ ID NO: 1279148 - RNA, 21 nt, Human
gccaauucuauaucccaucau

SEQ ID NO: 1279149 - RNA, 19 nt, Human
ggaaaagggguuuagaauu

SEQ ID NO: 1279150 - RNA, 20 nt, Human
gugcagcaugugccaaaugu

SEQ ID NO: 1279151 - RNA, 22 nt, Human
uaaaauagcacugaccaaaaga

SEQ ID NO: 1279152 - RNA, 22 nt, Human
uaaaauagcacugaccaaaaga

SEQ ID NO: 1279153 - RNA, 24 nt, Human
uaaucaaagagguuggccugcauc

SEQ ID NO: 1279154 - RNA, 24 nt, Human
uacacuuugucaauuagucaagag

SEQ ID NO: 1279155 - RNA, 20 nt, Human
uacuauagauauaguuaagg

SEQ ID NO: 1279156 - RNA, 23 nt, Human
uagauggucaaguguguggaaaa

SEQ ID NO: 1279157 - RNA, 18 nt, Human
uauaaagccuccuacucc

SEQ ID NO: 1279158 - RNA, 21 nt, Human
uauggccaugcauugauuacc

SEQ ID NO: 1279159 - RNA, 21 nt, Human
uauuaaacacacacaaaauca

SEQ ID NO: 1279160 - RNA, 22 nt, Human
ucagaaagacaaacaaaaaaaa

SEQ ID NO: 1279161 - RNA, 20 nt, Human
ucagucuuucugugucagaa

SEQ ID NO: 1279162 - RNA, 21 nt, Human
uccaacaacaagcuuaaacac

SEQ ID NO: 1279163 - RNA, 23 nt, Human
uccuggguaugccacuauauuaa

SEQ ID NO: 1279164 - RNA, 23 nt, Human
ucuaggaaagacaaauggccaga

SEQ ID NO: 1279165 - RNA, 21 nt, Human
ucugucagguucuccaccugg

SEQ ID NO: 1279166 - RNA, 19 nt, Human
ugaaaaaagcaggaacaaa

SEQ ID NO: 1279167 - RNA, 24 nt, Human
ugaaaugggugaaugauaggaacu

SEQ ID NO: 1279168 - RNA, 26 nt, Human
ugaacaucugccacucugccaauucu

SEQ ID NO: 1279169 - RNA, 22 nt, Human
ugacauuguagaaauaauuuua

SEQ ID NO: 1279170 - RNA, 20 nt, Human
ugagaaaggcuaaaauuguu

SEQ ID NO: 1279171 - RNA, 19 nt, Human
ugagcaaauuccaagauag

SEQ ID NO: 1279172 - RNA, 22 nt, Human
ugaggugucuugcacagugaaa

SEQ ID NO: 1279173 - RNA, 20 nt, Human
ugagugaacaauccuccccc

SEQ ID NO: 1279174 - RNA, 23 nt, Human
ugauauaguuuauuucaauuuuu

SEQ ID NO: 1279175 - RNA, 19 nt, Human
ugcgaagguggugccugag

SEQ ID NO: 1279176 - RNA, 24 nt, Human
uggaagaauaugagagcugacagu

SEQ ID NO: 1279177 - RNA, 21 nt, Human
uggaaugccacagcuaguuuu

SEQ ID NO: 1279178 - RNA, 23 nt, Human
uggaaugccacagcuaguuuuuc

SEQ ID NO: 1279179 - RNA, 23 nt, Human
uggcaacaaaaaugcugacaugg

SEQ ID NO: 1279180 - RNA, 22 nt, Human
uggccugcauccuuccauuguc

SEQ ID NO: 1279181 - RNA, 20 nt, Human
uggcugaggcacaaaugaac

SEQ ID NO: 1279182 - RNA, 26 nt, Human
uggcugaggcacaaaugaacaaguac

SEQ ID NO: 1279183 - RNA, 24 nt, Human
ugucagaaagacaaacaaaaaaaa

SEQ ID NO: 1279184 - RNA, 22 nt, Human
uguggaaaaugaauaaauaugg

SEQ ID NO: 1279185 - RNA, 19 nt, Human
ugugucagaaagacaaaca

SEQ ID NO: 1279186 - RNA, 20 nt, Human
uuaaaaaagcaaaauaaaau

SEQ ID NO: 1279187 - RNA, 20 nt, Human
uuaaaauuaucuguugaugc

SEQ ID NO: 1279188 - RNA, 23 nt, Human
uuaaacacacacaaaaucaaauc

SEQ ID NO: 1279189 - RNA, 21 nt, Human
uuauaaaguccuuuggcuagu

SEQ ID NO: 1279190 - RNA, 25 nt, Human
uucauuauacaaaggauucacuguu

SEQ ID NO: 1279191 - RNA, 22 nt, Human
uuuacagucaguuuuaucauuu

SEQ ID NO: 1279192 - RNA, 24 nt, Human
uuucuauauugucaaacaugauug

SEQ ID NO: 1279193 - RNA, 24 nt, Human
aaccucugcagaagcuggacuacc

SEQ ID NO: 1279194 - RNA, 21 nt, Human
aagaaaacagagagauauuag

SEQ ID NO: 1279195 - RNA, 21 nt, Human
acacuaaagaaaacagagaga

SEQ ID NO: 1279196 - RNA, 22 nt, Human
acacuaaagaaaacagagagau

SEQ ID NO: 1279197 - RNA, 19 nt, Human
aggcagcaggaggucaggg

SEQ ID NO: 1279198 - RNA, 21 nt, Human
aggcagcaggaggucagggug

SEQ ID NO: 1279199 - RNA, 21 nt, Human
augaaaggcagcuccucgggc

SEQ ID NO: 1279200 - RNA, 20 nt, Human
ccguacucuucccacugcca

SEQ ID NO: 1279201 - RNA, 22 nt, Human
cuccaaugcaauaacugcuaug

SEQ ID NO: 1279202 - RNA, 26 nt, Human
cucuucccacugccauugagaccgac

SEQ ID NO: 1279203 - RNA, 21 nt, Human
cuggacuaccguacucuuccc

SEQ ID NO: 1279204 - RNA, 20 nt, Human
ggaggucagggugagguuug

SEQ ID NO: 1279205 - RNA, 23 nt, Human
gugagggacugcugcuccaaugc

SEQ ID NO: 1279206 - RNA, 25 nt, Human
uccaaugcaauaacugcuauggauu

SEQ ID NO: 1279207 - RNA, 19 nt, Human
ucugcagaagcuggacuac

SEQ ID NO: 1279208 - RNA, 22 nt, Human
ugaggggccagagcugucgaag

SEQ ID NO: 1279209 - RNA, 22 nt, Human
uuacacuaaagaaaacagagag

SEQ ID NO: 1279210 - RNA, 25 nt, Human
uuacacuaaagaaaacagagagaua

SEQ ID NO: 1279211 - RNA, 18 nt, Human
uucaaagugagggacugc

SEQ ID NO: 1279212 - RNA, 20 nt, Human
uuugaggggccagagcuguc

SEQ ID NO: 1279213 - RNA, 19 nt, Human
aaaaagaggcagacugaca

SEQ ID NO: 1279214 - RNA, 19 nt, Human
aaaagcaccuacccucacc

SEQ ID NO: 1279215 - RNA, 21 nt, Human
aaaagucacccccaccaagcc

SEQ ID NO: 1279216 - RNA, 23 nt, Human
aaacagaaagagacagagagcga

SEQ ID NO: 1279217 - RNA, 20 nt, Human
aaagugcccuccuccucuca

SEQ ID NO: 1279218 - RNA, 20 nt, Human
aacucuacaaacucuggguc

SEQ ID NO: 1279219 - RNA, 19 nt, Human
aagaaaaaagcaccuaccc

SEQ ID NO: 1279220 - RNA, 19 nt, Human
acagcggcucuggaaccaa

SEQ ID NO: 1279221 - RNA, 18 nt, Human
acccccaccaagccccga

SEQ ID NO: 1279222 - RNA, 18 nt, Human
acccccgcccccaccccg

SEQ ID NO: 1279223 - RNA, 19 nt, Human
acccucacccccgccccca

SEQ ID NO: 1279224 - RNA, 20 nt, Human
acccucacccccgcccccac

SEQ ID NO: 1279225 - RNA, 20 nt, Human
acugcaccucacacccuuac

SEQ ID NO: 1279226 - RNA, 22 nt, Human
agaaacagaaagagacagagag

SEQ ID NO: 1279227 - RNA, 23 nt, Human
agaaacagaaagagacagagagc

SEQ ID NO: 1279228 - RNA, 18 nt, Human
agaaagcugcugcagcga

SEQ ID NO: 1279229 - RNA, 25 nt, Human
agaaggaagaggggcagaaacagaa

SEQ ID NO: 1279230 - RNA, 20 nt, Human
agagaacgagaaauaaaggc

SEQ ID NO: 1279231 - RNA, 24 nt, Human
agaggaaaaaacuauuauagaagg

SEQ ID NO: 1279232 - RNA, 26 nt, Human
agauugggagguuauguuugggagug

SEQ ID NO: 1279233 - RNA, 21 nt, Human
aggaaauacacaaaggccaaa

SEQ ID NO: 1279234 - RNA, 23 nt, Human
aggcaguguuuuuuuuagaggug

SEQ ID NO: 1279235 - RNA, 24 nt, Human
aggugcucaguacagcggcucugg

SEQ ID NO: 1279236 - RNA, 19 nt, Human
agucacagaaggaagaagg

SEQ ID NO: 1279237 - RNA, 23 nt, Human
aucuagaacgauucuccaguugu

SEQ ID NO: 1279238 - RNA, 21 nt, Human
caaaaucgucuccuggacaac

SEQ ID NO: 1279239 - RNA, 25 nt, Human
caaaugcaaauaaguacaugcucca

SEQ ID NO: 1279240 - RNA, 24 nt, Human
caacaauaacucuuaauauuuucu

SEQ ID NO: 1279241 - RNA, 23 nt, Human
caacggguucaggcagcguuacc

SEQ ID NO: 1279242 - RNA, 18 nt, Human
caaugugaaauauccaaa

SEQ ID NO: 1279243 - RNA, 21 nt, Human
cacacaaaaaaguuuaacccu

SEQ ID NO: 1279244 - RNA, 26 nt, Human
cacccccaccaagccccgacagccug

SEQ ID NO: 1279245 - RNA, 22 nt, Human
caccuacccucacccccgcccc

SEQ ID NO: 1279246 - RNA, 18 nt, Human
caccucacacccuuacac

SEQ ID NO: 1279247 - RNA, 23 nt, Human
cacuuuaacuaugccugaacugc

SEQ ID NO: 1279248 - RNA, 22 nt, Human
cagccgagccgcuccugcccgc

SEQ ID NO: 1279249 - RNA, 19 nt, Human
cagcucaucagaacugcaa

SEQ ID NO: 1279250 - RNA, 20 nt, Human
caggggccuggcagggugcu

SEQ ID NO: 1279251 - RNA, 22 nt, Human
ccaagcagccgucugcccgggc

SEQ ID NO: 1279252 - RNA, 19 nt, Human
ccagaagugaguucaaaaa

SEQ ID NO: 1279253 - RNA, 23 nt, Human
ccaggccuccagccucucccucu

SEQ ID NO: 1279254 - RNA, 19 nt, Human
cccaccaagccccgacagc

SEQ ID NO: 1279255 - RNA, 20 nt, Human
cccccuaguuuuuuuaaaaa

SEQ ID NO: 1279256 - RNA, 20 nt, Human
cccucuuuugguauuuaaac

SEQ ID NO: 1279257 - RNA, 22 nt, Human
ccuucacaaccuggggggugga

SEQ ID NO: 1279258 - RNA, 19 nt, Human
cgacaagacugcccuuugc

SEQ ID NO: 1279259 - RNA, 22 nt, Human
cgagcaaaacuaggccccgaaa

SEQ ID NO: 1279260 - RNA, 21 nt, Human
cggccggacuaacaaaaaaga

SEQ ID NO: 1279261 - RNA, 24 nt, Human
cgggcggcgcuguucugcccaggc

SEQ ID NO: 1279262 - RNA, 21 nt, Human
cugggucucgggcugccaaaa

SEQ ID NO: 1279263 - RNA, 20 nt, Human
cuuuuuuauuuucccucuuu

SEQ ID NO: 1279264 - RNA, 22 nt, Human
gaaaaaacgagguagaaaagga

SEQ ID NO: 1279265 - RNA, 19 nt, Human
gaaaaaagcaccuacccuc

SEQ ID NO: 1279266 - RNA, 20 nt, Human
gaaaaggacaaacauggaga

SEQ ID NO: 1279267 - RNA, 19 nt, Human
gacaaaaaaaaaaaaucaa

SEQ ID NO: 1279268 - RNA, 24 nt, Human
gagaacucucacuuuaacuaugcc

SEQ ID NO: 1279269 - RNA, 19 nt, Human
gaggaggggaggacaagga

SEQ ID NO: 1279270 - RNA, 20 nt, Human
gagguuauguuugggagugg

SEQ ID NO: 1279271 - RNA, 18 nt, Human
gcauaagaaaaaagcacc

SEQ ID NO: 1279272 - RNA, 20 nt, Human
gccagggcccgggacagcga

SEQ ID NO: 1279273 - RNA, 18 nt, Human
gcccgcgcgaggcccgcu

SEQ ID NO: 1279274 - RNA, 23 nt, Human
gccuccagccucucccucuccac

SEQ ID NO: 1279275 - RNA, 20 nt, Human
gcugccaaaagucaccccca

SEQ ID NO: 1279276 - RNA, 21 nt, Human
gcugccaaaagucacccccac

SEQ ID NO: 1279277 - RNA, 23 nt, Human
ggacaacugcaccucacacccuu

SEQ ID NO: 1279278 - RNA, 20 nt, Human
ggaggaggucggggagaggg

SEQ ID NO: 1279279 - RNA, 22 nt, Human
ggcagaaacagaaagagacaga

SEQ ID NO: 1279280 - RNA, 24 nt, Human
ggcagaccacuuauuaugaaauau

SEQ ID NO: 1279281 - RNA, 22 nt, Human
ggcuggaguugaaguccggaca

SEQ ID NO: 1279282 - RNA, 22 nt, Human
gggaacaaagaaaaagaggccg

SEQ ID NO: 1279283 - RNA, 18 nt, Human
gggagaggggcgggcgca

SEQ ID NO: 1279284 - RNA, 21 nt, Human
gggcagaaacagaaagagaca

SEQ ID NO: 1279285 - RNA, 20 nt, Human
ggggcagaaacagaaagaga

SEQ ID NO: 1279286 - RNA, 21 nt, Human
ggucggggagaggggcgggcg

SEQ ID NO: 1279287 - RNA, 24 nt, Human
uaaaaugcuccagagaaaggcuuu

SEQ ID NO: 1279288 - RNA, 19 nt, Human
uaacaauauuaccuucagg

SEQ ID NO: 1279289 - RNA, 24 nt, Human
uaagaaaaaagcaccuacccucac

SEQ ID NO: 1279290 - RNA, 22 nt, Human
uaaguacaugcuccauuaaauu

SEQ ID NO: 1279291 - RNA, 19 nt, Human
uaaucuggucucaccggaa

SEQ ID NO: 1279292 - RNA, 19 nt, Human
uacaaaaucgucuccugga

SEQ ID NO: 1279293 - RNA, 18 nt, Human
uacaaaguuaagucacag

SEQ ID NO: 1279294 - RNA, 21 nt, Human
uacagccucgucugaaauaaa

SEQ ID NO: 1279295 - RNA, 20 nt, Human
uacccucacccccgccccca

SEQ ID NO: 1279296 - RNA, 22 nt, Human
uacuuguccauauccccuuuac

SEQ ID NO: 1279297 - RNA, 23 nt, Human
uacuuguccauauccccuuuaca

SEQ ID NO: 1279298 - RNA, 23 nt, Human
uagaacgauucuccaguuguaca

SEQ ID NO: 1279299 - RNA, 22 nt, Human
uagaagggaaaccaaauggaag

SEQ ID NO: 1279300 - RNA, 20 nt, Human
ucacuuguuuguaaguuuaa

SEQ ID NO: 1279301 - RNA, 21 nt, Human
ucaggcagcguuacccgugga

SEQ ID NO: 1279302 - RNA, 19 nt, Human
ucauauucgagcaaaacua

SEQ ID NO: 1279303 - RNA, 18 nt, Human
uccagccucucccucucc

SEQ ID NO: 1279304 - RNA, 19 nt, Human
uccccuuuacaaaguuaag

SEQ ID NO: 1279305 - RNA, 22 nt, Human
uccggacagacagggcccaaga

SEQ ID NO: 1279306 - RNA, 22 nt, Human
ucucgggcugccaaaagucacc

SEQ ID NO: 1279307 - RNA, 24 nt, Human
ucucgggcugccaaaagucacccc

SEQ ID NO: 1279308 - RNA, 24 nt, Human
ucuuuuuuauauugauaaaucaga

SEQ ID NO: 1279309 - RNA, 19 nt, Human
ugaacugccagcaaaugca

SEQ ID NO: 1279310 - RNA, 23 nt, Human
ugacggccggacuaacaaaaaag

SEQ ID NO: 1279311 - RNA, 23 nt, Human
ugcaaaucuaaaaugcuccagag

SEQ ID NO: 1279312 - RNA, 21 nt, Human
ugcauaagaaaaaagcaccua

SEQ ID NO: 1279313 - RNA, 22 nt, Human
uggaggaggggaggacaaggaa

SEQ ID NO: 1279314 - RNA, 21 nt, Human
ugggaggaggucggggagagg

SEQ ID NO: 1279315 - RNA, 20 nt, Human
ugggggguggaggaggggag

SEQ ID NO: 1279316 - RNA, 21 nt, Human
uggugaaaaaacgagguagaa

SEQ ID NO: 1279317 - RNA, 20 nt, Human
uguacaagaaaaauacuaua

SEQ ID NO: 1279318 - RNA, 22 nt, Human
uguggcucugcaccuccagaag

SEQ ID NO: 1279319 - RNA, 21 nt, Human
uugugacaaaaaaaaaaaauc

SEQ ID NO: 1279320 - RNA, 24 nt, Human
uuucaacauuacaaugagcaauua

SEQ ID NO: 1279321 - RNA, 20 nt, Human
uuugcagaaucuggacgagg

SEQ ID NO: 1279322 - RNA, 21 nt, Human
uuuucaaauauuuacuggaag

SEQ ID NO: 1279323 - RNA, 24 nt, Human
aaaaaagaaaaccaaaguggucca

SEQ ID NO: 1279324 - RNA, 24 nt, Human
aaaaaguacugauuuuaaaaacua

SEQ ID NO: 1279325 - RNA, 18 nt, Human
aaacaaacaguucugaga

SEQ ID NO: 1279326 - RNA, 20 nt, Human
aaagaaaaccaaaguggucc

SEQ ID NO: 1279327 - RNA, 24 nt, Human
aacaguucugagaccauucuucca

SEQ ID NO: 1279328 - RNA, 24 nt, Human
aagaaaaccaaagugguccacaaa

SEQ ID NO: 1279329 - RNA, 22 nt, Human
acacccaguguguaagccagaa

SEQ ID NO: 1279330 - RNA, 18 nt, Human
accacguucacgcucagc

SEQ ID NO: 1279331 - RNA, 23 nt, Human
acguucacgcucagcuuucaguu

SEQ ID NO: 1279332 - RNA, 24 nt, Human
acuugaaggagcccuuucccaucu

SEQ ID NO: 1279333 - RNA, 26 nt, Human
agaaaaccaaagugguccacaaaaca

SEQ ID NO: 1279334 - RNA, 24 nt, Human
auaccagcuucaaauucaccaaca

SEQ ID NO: 1279335 - RNA, 22 nt, Human
caacaccagcagcaacaaucag

SEQ ID NO: 1279336 - RNA, 18 nt, Human
caaggagauaucaauggu

SEQ ID NO: 1279337 - RNA, 26 nt, Human
cacgcaaaaaagaaaaccaaaguggu

SEQ ID NO: 1279338 - RNA, 21 nt, Human
cagcaacaaucaggacagcac

SEQ ID NO: 1279339 - RNA, 22 nt, Human
cagcaacaaucaggacagcaca

SEQ ID NO: 1279340 - RNA, 24 nt, Human
cagcacagucagccugagaugucc

SEQ ID NO: 1279341 - RNA, 23 nt, Human
cagccuccuucucaaauuuuuca

SEQ ID NO: 1279342 - RNA, 21 nt, Human
ccaccacugauuaagaguggg

SEQ ID NO: 1279343 - RNA, 23 nt, Human
ccagaaauuggcacaaaugcuac

SEQ ID NO: 1279344 - RNA, 18 nt, Human
ccagcuucaaauucacca

SEQ ID NO: 1279345 - RNA, 23 nt, Human
cguucacgcucagcuuucaguuu

SEQ ID NO: 1279346 - RNA, 26 nt, Human
cugagaugucccuguaaucauguuuu

SEQ ID NO: 1279347 - RNA, 21 nt, Human
cuuucaguuuauccaagaccc

SEQ ID NO: 1279348 - RNA, 23 nt, Human
cuuucaguuuauccaagacccag

SEQ ID NO: 1279349 - RNA, 24 nt, Human
cuuucccauuuuggcuuuuagggg

SEQ ID NO: 1279350 - RNA, 19 nt, Human
gaagucccuguguccuggg

SEQ ID NO: 1279351 - RNA, 19 nt, Human
gagcccuuucccaucucag

SEQ ID NO: 1279352 - RNA, 23 nt, Human
gcaaaaaagaaaaccaaaguggu

SEQ ID NO: 1279353 - RNA, 21 nt, Human
gcacaaaugcuacugugucgg

SEQ ID NO: 1279354 - RNA, 24 nt, Human
ggagcccuuucccaucucagcagc

SEQ ID NO: 1279355 - RNA, 24 nt, Human
guccaguuguuuccauuaaaaagu

SEQ ID NO: 1279356 - RNA, 24 nt, Human
uaaugggucucaaaauucugugac

SEQ ID NO: 1279357 - RNA, 25 nt, Human
uaaugggucucaaaauucugugaca

SEQ ID NO: 1279358 - RNA, 23 nt, Human
uaccagcuucaaauucaccaaca

SEQ ID NO: 1279359 - RNA, 23 nt, Human
ucaguuuauccaagacccaggca

SEQ ID NO: 1279360 - RNA, 23 nt, Human
uccacaaaacauucuccuuuccu

SEQ ID NO: 1279361 - RNA, 26 nt, Human
ucccaucucagcagccuccuucucaa

SEQ ID NO: 1279362 - RNA, 22 nt, Human
ucuuuugucgaugccaccgcau

SEQ ID NO: 1279363 - RNA, 18 nt, Human
ugagaccauucuuccacc

SEQ ID NO: 1279364 - RNA, 23 nt, Human
ugcauuguuaucauuaaccaguc

SEQ ID NO: 1279365 - RNA, 24 nt, Human
ugcauuguuaucauuaaccagucu

SEQ ID NO: 1279366 - RNA, 23 nt, Human
ugccacacgcaaaaaagaaaacc

SEQ ID NO: 1279367 - RNA, 23 nt, Human
uggaauccauuuuguuaacaccg

SEQ ID NO: 1279368 - RNA, 22 nt, Human
uggcagguauuagggauaauau

SEQ ID NO: 1279369 - RNA, 22 nt, Human
ugguccacaaaacauucuccuu

SEQ ID NO: 1279370 - RNA, 24 nt, Human
uuaaauggccaauugaaacaaaca

SEQ ID NO: 1279371 - RNA, 23 nt, Human
uucaccaacaccagcagcaacaa

SEQ ID NO: 1279372 - RNA, 18 nt, Human
uuccaccacugauuaaga

SEQ ID NO: 1279373 - RNA, 23 nt, Human
uucuccuuuccuucugaagguuu

SEQ ID NO: 1279374 - RNA, 24 nt, Human
uuuaacuuuuuuaaugggucucaa

SEQ ID NO: 1279375 - RNA, 26 nt, Human
uuuacuacuaaacuuaaaagguuuuc

SEQ ID NO: 1279376 - RNA, 26 nt, Human
uuucccauuuuggcuuuuaggggaag

SEQ ID NO: 1279377 - RNA, 22 nt, Human
acacccaguguguaagccagaa

SEQ ID NO: 1279378 - RNA, 24 nt, Human
acuugaaggagcccuuucccaucu

SEQ ID NO: 1279379 - RNA, 26 nt, Human
auguuuuugaugaagucucugugucc

SEQ ID NO: 1279380 - RNA, 23 nt, Human
auuuucuuaauguaagugcugac

SEQ ID NO: 1279381 - RNA, 22 nt, Human
caacaccagcagcaacaaucag

SEQ ID NO: 1279382 - RNA, 21 nt, Human
cagcaacaaucaggacagcac

SEQ ID NO: 1279383 - RNA, 22 nt, Human
cagcaacaaucaggacagcaca

SEQ ID NO: 1279384 - RNA, 23 nt, Human
cagccuccuucucaaauuuuuca

SEQ ID NO: 1279385 - RNA, 23 nt, Human
ccagaaauuggcacaaaugcuac

SEQ ID NO: 1279386 - RNA, 18 nt, Human
ccagcuucaaauucacca

SEQ ID NO: 1279387 - RNA, 21 nt, Human
ccagcuucaaauucaccaaca

SEQ ID NO: 1279388 - RNA, 24 nt, Human
ccaguagugguggacuugcccgaa

SEQ ID NO: 1279389 - RNA, 21 nt, Human
cuuucaguuuauccaagaccc

SEQ ID NO: 1279390 - RNA, 23 nt, Human
cuuucaguuuauccaagacccag

SEQ ID NO: 1279391 - RNA, 19 nt, Human
gaagucucuguguccuggg

SEQ ID NO: 1279392 - RNA, 19 nt, Human
gagcccuuucccaucucag

SEQ ID NO: 1279393 - RNA, 23 nt, Human
ggagcccuuucccaucucagcag

SEQ ID NO: 1279394 - RNA, 20 nt, Human
guagaauccauuuuguuaac

SEQ ID NO: 1279395 - RNA, 23 nt, Human
gugauaccauguucacacucagc

SEQ ID NO: 1279396 - RNA, 23 nt, Human
uaccagcuucaaauucaccaaca

SEQ ID NO: 1279397 - RNA, 18 nt, Human
uaccauguucacacucag

SEQ ID NO: 1279398 - RNA, 23 nt, Human
ucaguuuauccaagacccaggca

SEQ ID NO: 1279399 - RNA, 26 nt, Human
ucccaucucagcagccuccuucucaa

SEQ ID NO: 1279400 - RNA, 20 nt, Human
ucuuuugucgaugccaccgc

SEQ ID NO: 1279401 - RNA, 21 nt, Human
ugcccgaaucuauguguccaa

SEQ ID NO: 1279402 - RNA, 22 nt, Human
uggcagguauuagggauaauau

SEQ ID NO: 1279403 - RNA, 23 nt, Human
uguucacacucagcuuucaguuu

SEQ ID NO: 1279404 - RNA, 23 nt, Human
uucaccaacaccagcagcaacaa

SEQ ID NO: 1279405 - RNA, 22 nt, Human
uucccauuuuggcuuuuggggg

SEQ ID NO: 1279406 - RNA, 21 nt, Human
uugaugaagucucuguguccu

SEQ ID NO: 1279407 - RNA, 23 nt, Human
uuucccauuuuggcuuuuggggg

SEQ ID NO: 1279408 - RNA, 26 nt, Human
aaaagacauuuauacaguaaaaaaaa

SEQ ID NO: 1279409 - RNA, 21 nt, Human
aaacaugaaaaagauacuugg

SEQ ID NO: 1279410 - RNA, 24 nt, Human
aacaugaaaaagauacuuggauga

SEQ ID NO: 1279411 - RNA, 26 nt, Human
aacaugaaaaagauacuuggaugaaa

SEQ ID NO: 1279412 - RNA, 20 nt, Human
aagcccgacccgccccguuc

SEQ ID NO: 1279413 - RNA, 20 nt, Human
acccgccccguucccucccg

SEQ ID NO: 1279414 - RNA, 23 nt, Human
acccgccccguucccucccggua

SEQ ID NO: 1279415 - RNA, 27 nt, Human
caaaagacauuuauacaguaaaaaaaa

SEQ ID NO: 1279416 - RNA, 21 nt, Human
cagcugaccucgaagcccgac

SEQ ID NO: 1279417 - RNA, 18 nt, Human
ccgacccgccccguuccc

SEQ ID NO: 1279418 - RNA, 25 nt, Human
cgccccguucccucccgguaccgcg

SEQ ID NO: 1279419 - RNA, 19 nt, Human
cucgaagcccgacccgccc

SEQ ID NO: 1279420 - RNA, 18 nt, Human
gacccgccccguucccuc

SEQ ID NO: 1279421 - RNA, 24 nt, Human
gggaagccaaaggcuucccugcgg

SEQ ID NO: 1279422 - RNA, 22 nt, Human
ucauauguuuguccaaaacccu

SEQ ID NO: 1279423 - RNA, 21 nt, Human
ucuuuuguucucuuguuuuua

SEQ ID NO: 1279424 - RNA, 23 nt, Human
ucuuuuguucucuuguuuuuaac

SEQ ID NO: 1279425 - RNA, 18 nt, Human
ugaaugacaaaaaaaugg

SEQ ID NO: 1279426 - RNA, 19 nt, Human
ugaaugacaaaaaaauggc

SEQ ID NO: 1279427 - RNA, 20 nt, Human
ugaaugacaaaaaaauggcu

SEQ ID NO: 1279428 - RNA, 24 nt, Human
uugacaaaaguaauaggcauuuuu

SEQ ID NO: 1279429 - RNA, 21 nt, Human
uuuucuuuuguucucuuguuu

SEQ ID NO: 1279430 - RNA, 18 nt, Human
aggaaaaccaaccccagg

SEQ ID NO: 1279431 - RNA, 19 nt, Human
aggagcguggauguucacu

SEQ ID NO: 1279432 - RNA, 23 nt, Human
cacacugcaagcccucggcagcc

SEQ ID NO: 1279433 - RNA, 23 nt, Human
cacugccuuccuucaaccacucc

SEQ ID NO: 1279434 - RNA, 20 nt, Human
cagcacagcuacagagguuc

SEQ ID NO: 1279435 - RNA, 19 nt, Human
ccacacugcaagcccucgg

SEQ ID NO: 1279436 - RNA, 27 nt, Human
ccccagugagcagcacagcuacagagg

SEQ ID NO: 1279437 - RNA, 21 nt, Human
ccccauauacccaaaauauua

SEQ ID NO: 1279438 - RNA, 20 nt, Human
ccgccgccggcugcaggcgg

SEQ ID NO: 1279439 - RNA, 18 nt, Human
cgcauauaaaaaugacgc

SEQ ID NO: 1279440 - RNA, 18 nt, Human
cguuccgccgccggcugc

SEQ ID NO: 1279441 - RNA, 25 nt, Human
cuccaggcaggugcguccaccuuuc

SEQ ID NO: 1279442 - RNA, 20 nt, Human
cuggucuggccuggccacac

SEQ ID NO: 1279443 - RNA, 22 nt, Human
gccacacugcaagcccucggca

SEQ ID NO: 1279444 - RNA, 20 nt, Human
gcguccaccuuuccuccuca

SEQ ID NO: 1279445 - RNA, 21 nt, Human
ggccuggccacacugcaagcc

SEQ ID NO: 1279446 - RNA, 19 nt, Human
ggcugccccagugagcagc

SEQ ID NO: 1279447 - RNA, 18 nt, Human
uccgcauauaaaaaugac

SEQ ID NO: 1279448 - RNA, 22 nt, Human
ugccccagugagcagcacagcu

SEQ ID NO: 1279449 - RNA, 24 nt, Human
ugucucagccgccugcccucguuc

SEQ ID NO: 1279450 - RNA, 20 nt, Human
aaagucacaaauacuauucu

SEQ ID NO: 1279451 - RNA, 18 nt, Human
aaagugucccguccacca

SEQ ID NO: 1279452 - RNA, 23 nt, Human
aaugaggaagguuauaaaaggaa

SEQ ID NO: 1279453 - RNA, 22 nt, Human
agaaaaagaggaacgcaacgaa

SEQ ID NO: 1279454 - RNA, 23 nt, Human
agaaaaagaggaacgcaacgaag

SEQ ID NO: 1279455 - RNA, 21 nt, Human
agaggacagguuugggggaac

SEQ ID NO: 1279456 - RNA, 22 nt, Human
agaggagguggccugggaaccc

SEQ ID NO: 1279457 - RNA, 24 nt, Human
agagggaagguggggaagaagagc

SEQ ID NO: 1279458 - RNA, 19 nt, Human
agcauaagagcccugaaag

SEQ ID NO: 1279459 - RNA, 25 nt, Human
agccucgcccuccaccacgguucua

SEQ ID NO: 1279460 - RNA, 20 nt, Human
aggaaaggcugaagaggagu

SEQ ID NO: 1279461 - RNA, 21 nt, Human
aggaaauguuuggggagaaug

SEQ ID NO: 1279462 - RNA, 22 nt, Human
agggaagguggggaagaagagc

SEQ ID NO: 1279463 - RNA, 19 nt, Human
aguuccucccagccagccc

SEQ ID NO: 1279464 - RNA, 22 nt, Human
auguuggagcuguggaccggcc

SEQ ID NO: 1279465 - RNA, 21 nt, Human
caagagaaccgcuuguaggcg

SEQ ID NO: 1279466 - RNA, 22 nt, Human
caccgccccucccaccugccag

SEQ ID NO: 1279467 - RNA, 21 nt, Human
cagaaaaagaggaacgcaacg

SEQ ID NO: 1279468 - RNA, 20 nt, Human
cagauggccugcagcgcacc

SEQ ID NO: 1279469 - RNA, 24 nt, Human
cagcagccucagggaaguagggug

SEQ ID NO: 1279470 - RNA, 20 nt, Human
cagcccccacacccacucua

SEQ ID NO: 1279471 - RNA, 21 nt, Human
cagccggauuccccgccuucc

SEQ ID NO: 1279472 - RNA, 20 nt, Human
cagcgcaccgcccggccccc

SEQ ID NO: 1279473 - RNA, 20 nt, Human
cagggcgccggcagauggcc

SEQ ID NO: 1279474 - RNA, 19 nt, Human
cagggcucauccgccccuc

SEQ ID NO: 1279475 - RNA, 21 nt, Human
cauaagcaacuacacagccag

SEQ ID NO: 1279476 - RNA, 18 nt, Human
cauccgccccuccaaguc

SEQ ID NO: 1279477 - RNA, 18 nt, Human
ccaccgccccucccaccu

SEQ ID NO: 1279478 - RNA, 22 nt, Human
ccaccgccccucccaccugguc

SEQ ID NO: 1279479 - RNA, 19 nt, Human
ccagaaaaagaggaacgca

SEQ ID NO: 1279480 - RNA, 21 nt, Human
cccaaggcguugaaagagacc

SEQ ID NO: 1279481 - RNA, 18 nt, Human
ccccagaauuucuugggg

SEQ ID NO: 1279482 - RNA, 22 nt, Human
cccccgcgcuggccacguccgc

SEQ ID NO: 1279483 - RNA, 19 nt, Human
ccccgcgcuggccacgucc

SEQ ID NO: 1279484 - RNA, 23 nt, Human
ccccuccauuccgagcuugaaga

SEQ ID NO: 1279485 - RNA, 25 nt, Human
ccgccccucccaccugccagccccc

SEQ ID NO: 1279486 - RNA, 22 nt, Human
ccgccuccuaccccuaaaaauc

SEQ ID NO: 1279487 - RNA, 21 nt, Human
ccucacagccccacggucucc

SEQ ID NO: 1279488 - RNA, 21 nt, Human
ccuccuuauuccuuuccuuuc

SEQ ID NO: 1279489 - RNA, 20 nt, Human
ccugcagcgcaccgcccggc

SEQ ID NO: 1279490 - RNA, 22 nt, Human
ccugccagcccccacacccacu

SEQ ID NO: 1279491 - RNA, 24 nt, Human
ccuugaaaaaaaaaaaaccuuccu

SEQ ID NO: 1279492 - RNA, 21 nt, Human
cgagaggggcuguggggagag

SEQ ID NO: 1279493 - RNA, 18 nt, Human
cgcugcgggcugggccgg

SEQ ID NO: 1279494 - RNA, 20 nt, Human
cggcagauggccugcagcgc

SEQ ID NO: 1279495 - RNA, 22 nt, Human
cggcagauggccugcagcgcac

SEQ ID NO: 1279496 - RNA, 26 nt, Human
cggugcaaaacugagugggaaagaga

SEQ ID NO: 1279497 - RNA, 22 nt, Human
cgguggcccagccucgcccucc

SEQ ID NO: 1279498 - RNA, 25 nt, Human
cgugaaaccuaauaguaaacaacaa

SEQ ID NO: 1279499 - RNA, 18 nt, Human
cucccagccagcccucug

SEQ ID NO: 1279500 - RNA, 19 nt, Human
cucccccgccuccuacccc

SEQ ID NO: 1279501 - RNA, 24 nt, Human
cuccuggaagaagggaaguuucuu

SEQ ID NO: 1279502 - RNA, 19 nt, Human
cucgguggaacggccccca

SEQ ID NO: 1279503 - RNA, 21 nt, Human
cucugcgcucuucccccucca

SEQ ID NO: 1279504 - RNA, 18 nt, Human
cucuuuuaaaacaacagc

SEQ ID NO: 1279505 - RNA, 22 nt, Human
cuuucuagcauaagagcccuga

SEQ ID NO: 1279506 - RNA, 19 nt, Human
cuuuuccggcgagcucuga

SEQ ID NO: 1279507 - RNA, 22 nt, Human
gaggaaaggcugaagaggagug

SEQ ID NO: 1279508 - RNA, 21 nt, Human
gccagcccccacacccacucu

SEQ ID NO: 1279509 - RNA, 21 nt, Human
gccaugaacaguucagggccu

SEQ ID NO: 1279510 - RNA, 28 nt, Human
gcccagccucagaacagaggggaacgcc

SEQ ID NO: 1279511 - RNA, 21 nt, Human
gccccucccaccugccagccc

SEQ ID NO: 1279512 - RNA, 24 nt, Human
gccccucccaccugccagccccca

SEQ ID NO: 1279513 - RNA, 23 nt, Human
ggaagaagggaaguuucuuuucu

SEQ ID NO: 1279514 - RNA, 19 nt, Human
ggaaggacuugaagguucu

SEQ ID NO: 1279515 - RNA, 19 nt, Human
ggacagguuugggggaacu

SEQ ID NO: 1279516 - RNA, 19 nt, Human
ggacuugaagguucucaua

SEQ ID NO: 1279517 - RNA, 21 nt, Human
ggagcuguggaccggcccugu

SEQ ID NO: 1279518 - RNA, 22 nt, Human
ggcugaagaggaguggaaaccc

SEQ ID NO: 1279519 - RNA, 20 nt, Human
ggcugggccggcguacuugc

SEQ ID NO: 1279520 - RNA, 24 nt, Human
ggcugggcgcgcugcgggcugggc

SEQ ID NO: 1279521 - RNA, 24 nt, Human
gggcgcggugucagccggauuccc

SEQ ID NO: 1279522 - RNA, 18 nt, Human
ggguuucgaagacccucc

SEQ ID NO: 1279523 - RNA, 21 nt, Human
gguggccugggaacccggggc

SEQ ID NO: 1279524 - RNA, 18 nt, Human
gucuccuucacgcccacc

SEQ ID NO: 1279525 - RNA, 25 nt, Human
uacacagccaguuggaaaggggagg

SEQ ID NO: 1279526 - RNA, 18 nt, Human
uacagcauugcuuauaau

SEQ ID NO: 1279527 - RNA, 21 nt, Human
uaguaaacaacaauuuaacga

SEQ ID NO: 1279528 - RNA, 25 nt, Human
uauuccuuuccuuucuagcauaaga

SEQ ID NO: 1279529 - RNA, 19 nt, Human
ucccagccagcccucugcg

SEQ ID NO: 1279530 - RNA, 21 nt, Human
ucccccgccuccuaccccuaa

SEQ ID NO: 1279531 - RNA, 23 nt, Human
ucccccgccuccuaccccuaaaa

SEQ ID NO: 1279532 - RNA, 26 nt, Human
ucccccgccuccuaccccuaaaaauc

SEQ ID NO: 1279533 - RNA, 25 nt, Human
uccccuccagaaaaagaggaacgca

SEQ ID NO: 1279534 - RNA, 18 nt, Human
ucccggagggcucccggu

SEQ ID NO: 1279535 - RNA, 21 nt, Human
uccuggacaagcucucgauuu

SEQ ID NO: 1279536 - RNA, 19 nt, Human
ucucccccgccuccuaccc

SEQ ID NO: 1279537 - RNA, 23 nt, Human
ucucucucuucuaacauuccccu

SEQ ID NO: 1279538 - RNA, 20 nt, Human
ucugcgcucuucccccucca

SEQ ID NO: 1279539 - RNA, 20 nt, Human
ucuucuaacauuccccucca

SEQ ID NO: 1279540 - RNA, 20 nt, Human
ucuugcccucgucuccuuca

SEQ ID NO: 1279541 - RNA, 21 nt, Human
ugaaauguaccuuccuugaaa

SEQ ID NO: 1279542 - RNA, 20 nt, Human
ugaagagccgguggcccagc

SEQ ID NO: 1279543 - RNA, 21 nt, Human
ugaagaggaguggaaacccca

SEQ ID NO: 1279544 - RNA, 18 nt, Human
uggaaaccccaaacccac

SEQ ID NO: 1279545 - RNA, 23 nt, Human
uggaucaaagucacaaauacuau

SEQ ID NO: 1279546 - RNA, 19 nt, Human
ugggaaagagaaaggggcg

SEQ ID NO: 1279547 - RNA, 28 nt, Human
ugggaaagagaaaggggcggagagcgac

SEQ ID NO: 1279548 - RNA, 23 nt, Human
uggggagaggguuucgaagaccc

SEQ ID NO: 1279549 - RNA, 22 nt, Human
uuccuuucuagcauaagagccc

SEQ ID NO: 1279550 - RNA, 21 nt, Human
uugaaagagaccagcuccagu

SEQ ID NO: 1279551 - RNA, 21 nt, Human
uuugggggaacuucgguacgu

SEQ ID NO: 1279552 - RNA, 20 nt, Human
uuuguccaccgccccuccca

SEQ ID NO: 1279553 - RNA, 18 nt, Human
gacaguucuuucuuuuuc

SEQ ID NO: 1279554 - RNA, 21 nt, Human
ucuuucuuuuucucucuagcu

SEQ ID NO: 1279555 - RNA, 25 nt, Human
aaacaaaaagucagaacaaaccagc

SEQ ID NO: 1279556 - RNA, 27 nt, Human
aaaccagcaccaagcaaacacaaagaa

SEQ ID NO: 1279557 - RNA, 20 nt, Human
aaagaaacaaaaagucagaa

SEQ ID NO: 1279558 - RNA, 23 nt, Human
aacaaaccagcccugcacagaug

SEQ ID NO: 1279559 - RNA, 21 nt, Human
aacaaauaaaccagcaccaag

SEQ ID NO: 1279560 - RNA, 24 nt, Human
aacacaaagaaacaaaaagucaga

SEQ ID NO: 1279561 - RNA, 21 nt, Human
aaccagcaccaagcaaacaca

SEQ ID NO: 1279562 - RNA, 19 nt, Human
aagcaaacacaaagaaaca

SEQ ID NO: 1279563 - RNA, 18 nt, Human
acaaaccagcccugcaca

SEQ ID NO: 1279564 - RNA, 21 nt, Human
acaaaccagcccugcacagau

SEQ ID NO: 1279565 - RNA, 23 nt, Human
acaaagaaacaaaaagucagaac

SEQ ID NO: 1279566 - RNA, 23 nt, Human
acaacaaauaaaccagcaccaag

SEQ ID NO: 1279567 - RNA, 19 nt, Human
acugccaagggacagcugg

SEQ ID NO: 1279568 - RNA, 21 nt, Human
agaaaacaacaaauaaaccag

SEQ ID NO: 1279569 - RNA, 24 nt, Human
agaaaucgcugcaaaaccccagcc

SEQ ID NO: 1279570 - RNA, 18 nt, Human
agaaggagagaggagagg

SEQ ID NO: 1279571 - RNA, 19 nt, Human
agagggaggggaccagcgc

SEQ ID NO: 1279572 - RNA, 22 nt, Human
agcaaacacaaagaaacaaaaa

SEQ ID NO: 1279573 - RNA, 22 nt, Human
agcgaacaaaggccaagaauca

SEQ ID NO: 1279574 - RNA, 24 nt, Human
agugaaaaaaccgcgucgccugga

SEQ ID NO: 1279575 - RNA, 21 nt, Human
cacaaagaaacaaaaagucag

SEQ ID NO: 1279576 - RNA, 26 nt, Human
cagaacaaaccagcccugcacagaug

SEQ ID NO: 1279577 - RNA, 23 nt, Human
cagagccugaagacagagggagg

SEQ ID NO: 1279578 - RNA, 27 nt, Human
ccagcaccaagcaaacacaaagaaaca

SEQ ID NO: 1279579 - RNA, 21 nt, Human
cccagaaaacaacaaauaaac

SEQ ID NO: 1279580 - RNA, 22 nt, Human
ccccgagccgagagacggaaac

SEQ ID NO: 1279581 - RNA, 24 nt, Human
ccccuuuuucuguuaugaagggga

SEQ ID NO: 1279582 - RNA, 20 nt, Human
cccggacggguuuacgacca

SEQ ID NO: 1279583 - RNA, 21 nt, Human
cccggacggguuuacgaccac

SEQ ID NO: 1279584 - RNA, 18 nt, Human
ccgcgcccgcccgccgcc

SEQ ID NO: 1279585 - RNA, 22 nt, Human
ccgcgcccgcccgccgcccgcc

SEQ ID NO: 1279586 - RNA, 20 nt, Human
ccgugcugcucuuaguauca

SEQ ID NO: 1279587 - RNA, 25 nt, Human
ccugcacagauguaacggcccagga

SEQ ID NO: 1279588 - RNA, 27 nt, Human
cgagcaguccuccuggcuagacucucu

SEQ ID NO: 1279589 - RNA, 22 nt, Human
cgagccgagagacggaaaccag

SEQ ID NO: 1279590 - RNA, 22 nt, Human
cgccaucucguggcggcugcgc

SEQ ID NO: 1279591 - RNA, 18 nt, Human
cggcccaggagauggcga

SEQ ID NO: 1279592 - RNA, 19 nt, Human
cugccaagggacagcuggc

SEQ ID NO: 1279593 - RNA, 22 nt, Human
cuuuaaauuaccauaccaauca

SEQ ID NO: 1279594 - RNA, 21 nt, Human
gaaaaaaccgcgucgccugga

SEQ ID NO: 1279595 - RNA, 21 nt, Human
gaaaacaacaaauaaaccagc

SEQ ID NO: 1279596 - RNA, 19 nt, Human
gagaaggagagaggagagg

SEQ ID NO: 1279597 - RNA, 20 nt, Human
gagaaggagagaggagagga

SEQ ID NO: 1279598 - RNA, 26 nt, Human
gagcaguccuccuggcuagacucucu

SEQ ID NO: 1279599 - RNA, 20 nt, Human
gccccgagccgagagacgga

SEQ ID NO: 1279600 - RNA, 18 nt, Human
gcccgcccgccgcccgcc

SEQ ID NO: 1279601 - RNA, 23 nt, Human
gccuagcgaaugcgcguugcuuu

SEQ ID NO: 1279602 - RNA, 24 nt, Human
gccugaagacagagggaggggacc

SEQ ID NO: 1279603 - RNA, 21 nt, Human
ggagagaggagaggaugugcc

SEQ ID NO: 1279604 - RNA, 18 nt, Human
ggcucagaaaucaaaccc

SEQ ID NO: 1279605 - RNA, 23 nt, Human
gggcagagccugaagacagaggg

SEQ ID NO: 1279606 - RNA, 24 nt, Human
gggcuccagcacaggugcgaguuc

SEQ ID NO: 1279607 - RNA, 21 nt, Human
gugcgaguuccugggcagagc

SEQ ID NO: 1279608 - RNA, 22 nt, Human
uaaaccagcaccaagcaaacac

SEQ ID NO: 1279609 - RNA, 22 nt, Human
uagcaacuugagagacuuuggu

SEQ ID NO: 1279610 - RNA, 20 nt, Human
ucagaaaucaaacccgcgcc

SEQ ID NO: 1279611 - RNA, 21 nt, Human
ucagaacaaaccagcccugca

SEQ ID NO: 1279612 - RNA, 21 nt, Human
ucagaagcgaacaaaggccaa

SEQ ID NO: 1279613 - RNA, 19 nt, Human
uccagccccgagccgagag

SEQ ID NO: 1279614 - RNA, 27 nt, Human
ucccccagaaaacaacagcggcucucc

SEQ ID NO: 1279615 - RNA, 18 nt, Human
ucccggcuccccggcggc

SEQ ID NO: 1279616 - RNA, 20 nt, Human
ugaaggggagcgggacaagu

SEQ ID NO: 1279617 - RNA, 18 nt, Human
ugauauggcuuuuucccc

SEQ ID NO: 1279618 - RNA, 20 nt, Human
ugccaagggacagcuggccg

SEQ ID NO: 1279619 - RNA, 19 nt, Human
ugccaagggacagcuggcu

SEQ ID NO: 1279620 - RNA, 21 nt, Human
ugccaagggacagcuggcucc

SEQ ID NO: 1279621 - RNA, 23 nt, Human
uggcuagacucucucuagcaacu

SEQ ID NO: 1279622 - RNA, 20 nt, Human
ugggagggaggaacagggcu

SEQ ID NO: 1279623 - RNA, 24 nt, Human
aaacugcuauaaaaccgcaggucu

SEQ ID NO: 1279624 - RNA, 26 nt, Human
caccacaaccccgucugcucaggcac

SEQ ID NO: 1279625 - RNA, 26 nt, Human
ccccgucugcucaggcacaagcugaa

SEQ ID NO: 1279626 - RNA, 18 nt, Human
aaaaaaacgcacaaacag

SEQ ID NO: 1279627 - RNA, 23 nt, Human
aaaaaaacgcacaaacaggcacu

SEQ ID NO: 1279628 - RNA, 18 nt, Human
aaaaaacgcacaaacagg

SEQ ID NO: 1279629 - RNA, 23 nt, Human
aaagaaaaaaacgcacaaacagg

SEQ ID NO: 1279630 - RNA, 18 nt, Human
agcaaagcccagaaugua

SEQ ID NO: 1279631 - RNA, 19 nt, Human
cacaaacaggcacuagaua

SEQ ID NO: 1279632 - RNA, 24 nt, Human
cagcggaagaaagaaaaaaacgca

SEQ ID NO: 1279633 - RNA, 25 nt, Human
gaaaauggggaagcagcggaagaaa

SEQ ID NO: 1279634 - RNA, 23 nt, Human
ggaagaaagaaaaaaacgcacaa

SEQ ID NO: 1279635 - RNA, 19 nt, Human
gggaagcagcggaagaaag

SEQ ID NO: 1279636 - RNA, 18 nt, Human
uacagcaaagcccagaau

SEQ ID NO: 1279637 - RNA, 21 nt, Human
ucacaagcuguguuuccgcug

SEQ ID NO: 1279638 - RNA, 22 nt, Human
aaaaagacaaaaagaauaagcg

SEQ ID NO: 1279639 - RNA, 20 nt, Human
aaagaugucauucuuaaguc

SEQ ID NO: 1279640 - RNA, 18 nt, Human
aaagcagauaggugaccu

SEQ ID NO: 1279641 - RNA, 21 nt, Human
aacccugguagugcaguaacc

SEQ ID NO: 1279642 - RNA, 21 nt, Human
aagaaagaaaaaaauauaaaa

SEQ ID NO: 1279643 - RNA, 19 nt, Human
aagaugucauucuuaaguc

SEQ ID NO: 1279644 - RNA, 22 nt, Human
aagcagauaggugaccuuugau

SEQ ID NO: 1279645 - RNA, 21 nt, Human
aaguauucaaugauuuaguug

SEQ ID NO: 1279646 - RNA, 25 nt, Human
aauaagcggugaaaaauccuaggga

SEQ ID NO: 1279647 - RNA, 20 nt, Human
agaaaaaaaauucggauaau

SEQ ID NO: 1279648 - RNA, 23 nt, Human
agggauuacugugaccuagacaa

SEQ ID NO: 1279649 - RNA, 23 nt, Human
auaauauaauaauuaucuaaagc

SEQ ID NO: 1279650 - RNA, 21 nt, Human
caaaaaauacguaguaagaau

SEQ ID NO: 1279651 - RNA, 19 nt, Human
cacugcauuucccuucucu

SEQ ID NO: 1279652 - RNA, 27 nt, Human
cagcucccuggaaaauaaaccaguaac

SEQ ID NO: 1279653 - RNA, 20 nt, Human
ccacggagaagggcgcgcgc

SEQ ID NO: 1279654 - RNA, 24 nt, Human
cccacgcgcgagggaaggagcgcg

SEQ ID NO: 1279655 - RNA, 21 nt, Human
ccgccgccucccggagggccc

SEQ ID NO: 1279656 - RNA, 19 nt, Human
cgcgcacgcgcucucaccg

SEQ ID NO: 1279657 - RNA, 18 nt, Human
cuagggauuacugugacc

SEQ ID NO: 1279658 - RNA, 19 nt, Human
cuccaagacagaguuuggu

SEQ ID NO: 1279659 - RNA, 25 nt, Human
cucuaacuucucucuucacaccaau

SEQ ID NO: 1279660 - RNA, 22 nt, Human
gaauaagcggugaaaaauccua

SEQ ID NO: 1279661 - RNA, 19 nt, Human
gagccgagaggagcggccu

SEQ ID NO: 1279662 - RNA, 24 nt, Human
gaggcuccaagacagaguuugguu

SEQ ID NO: 1279663 - RNA, 19 nt, Human
gagggaaggagcgcggagc

SEQ ID NO: 1279664 - RNA, 21 nt, Human
gagugagcuaaaaggaggcuc

SEQ ID NO: 1279665 - RNA, 20 nt, Human
gcgagggaaggagcgcggag

SEQ ID NO: 1279666 - RNA, 21 nt, Human
uaaaaaggucaauuaagcuag

SEQ ID NO: 1279667 - RNA, 20 nt, Human
uaauucacugcauuucccuu

SEQ ID NO: 1279668 - RNA, 20 nt, Human
uagaaaacaugcagcaacag

SEQ ID NO: 1279669 - RNA, 21 nt, Human
uagcagagacuaucaguggcu

SEQ ID NO: 1279670 - RNA, 25 nt, Human
ucccuggaaaauaaaccaguaaccc

SEQ ID NO: 1279671 - RNA, 26 nt, Human
ucuaaagcaaauaucaucauuggcuc

SEQ ID NO: 1279672 - RNA, 24 nt, Human
ucugcugagugucgggaguuggug

SEQ ID NO: 1279673 - RNA, 20 nt, Human
ugagcuaaaaggaggcucca

SEQ ID NO: 1279674 - RNA, 23 nt, Human
ugcgcccgccccucuccccgcgg

SEQ ID NO: 1279675 - RNA, 22 nt, Human
uguggagugagcuaaaaggagg

SEQ ID NO: 1279676 - RNA, 21 nt, Human
uuaaaaagacaaaaagaauaa

SEQ ID NO: 1279677 - RNA, 18 nt, Human
uugguucccaacaguguc

SEQ ID NO: 1279678 - RNA, 23 nt, Human
uuguggagugagcuaaaaggagg

SEQ ID NO: 1279679 - RNA, 28 nt, Human
aaaaaaaguaaaaaaugagcaugaagaa

SEQ ID NO: 1279680 - RNA, 22 nt, Human
aaaauauucccauccuuaccug

SEQ ID NO: 1279681 - RNA, 24 nt, Human
aaaaugccauuuauaacacuaaaa

SEQ ID NO: 1279682 - RNA, 23 nt, Human
aaagcuaaacagacauuuccaau

SEQ ID NO: 1279683 - RNA, 23 nt, Human
aaaggguugcugaaugcuucccc

SEQ ID NO: 1279684 - RNA, 23 nt, Human
aaaugugcugaagaaccuagagc

SEQ ID NO: 1279685 - RNA, 23 nt, Human
aacacagaaagcacaccuuuacg

SEQ ID NO: 1279686 - RNA, 20 nt, Human
aagaugaagauauaacuaaa

SEQ ID NO: 1279687 - RNA, 24 nt, Human
aagcaauuugaguuuguuuuaugg

SEQ ID NO: 1279688 - RNA, 23 nt, Human
aagcauugaaagaaauuuaacau

SEQ ID NO: 1279689 - RNA, 25 nt, Human
aaguaaaaaaugagcaugaagaaga

SEQ ID NO: 1279690 - RNA, 18 nt, Human
aauaugcaacaugcccuc

SEQ ID NO: 1279691 - RNA, 21 nt, Human
aaucucagugccagccccucc

SEQ ID NO: 1279692 - RNA, 23 nt, Human
aaugugaugagaaaaguaccuuu

SEQ ID NO: 1279693 - RNA, 21 nt, Human
acaaagauacaucauuccaaa

SEQ ID NO: 1279694 - RNA, 22 nt, Human
agcauugaaagaaauuuaacau

SEQ ID NO: 1279695 - RNA, 18 nt, Human
agccccuccuccccccag

SEQ ID NO: 1279696 - RNA, 18 nt, Human
caaaaucagcaacugcug

SEQ ID NO: 1279697 - RNA, 25 nt, Human
caaagugcuuuaaaacuucaucuga

SEQ ID NO: 1279698 - RNA, 20 nt, Human
caagaccauacuucagaucu

SEQ ID NO: 1279699 - RNA, 21 nt, Human
caaucuugaaaaaaaaaucuc

SEQ ID NO: 1279700 - RNA, 19 nt, Human
caccgcaauacaauucaac

SEQ ID NO: 1279701 - RNA, 23 nt, Human
cacuaaaaugacuaguaagucag

SEQ ID NO: 1279702 - RNA, 20 nt, Human
cagacuuaaugugcucuguc

SEQ ID NO: 1279703 - RNA, 24 nt, Human
cagccugcaguuucuugcacuaga

SEQ ID NO: 1279704 - RNA, 22 nt, Human
caguacaauacauucacuauac

SEQ ID NO: 1279705 - RNA, 21 nt, Human
cccacagguuugguagggcag

SEQ ID NO: 1279706 - RNA, 23 nt, Human
ccuucaguucuaaaacaaaccuc

SEQ ID NO: 1279707 - RNA, 20 nt, Human
cuacaucgagagccccccug

SEQ ID NO: 1279708 - RNA, 22 nt, Human
cuuggcacaguuaugaccagca

SEQ ID NO: 1279709 - RNA, 20 nt, Human
cuuuaaaacuucaucugaag

SEQ ID NO: 1279710 - RNA, 18 nt, Human
gaaaaacuuaaggaaugg

SEQ ID NO: 1279711 - RNA, 18 nt, Human
gaacauaugugaguugau

SEQ ID NO: 1279712 - RNA, 18 nt, Human
gcacugaaguauuucaaa

SEQ ID NO: 1279713 - RNA, 19 nt, Human
gcaguuuauuuuaaaugug

SEQ ID NO: 1279714 - RNA, 19 nt, Human
gccagccccuccucccccc

SEQ ID NO: 1279715 - RNA, 21 nt, Human
ggaccaagaccauacuucaga

SEQ ID NO: 1279716 - RNA, 23 nt, Human
ggagaaaagaacacucaaggcau

SEQ ID NO: 1279717 - RNA, 20 nt, Human
gggagaaaagaacacucaag

SEQ ID NO: 1279718 - RNA, 19 nt, Human
uaaaacacagaaagcacac

SEQ ID NO: 1279719 - RNA, 23 nt, Human
uaaaaugacuaguaagucagaug

SEQ ID NO: 1279720 - RNA, 23 nt, Human
uaaagcuaaacagacauuuccaa

SEQ ID NO: 1279721 - RNA, 22 nt, Human
uaacaaaauauucccauccuua

SEQ ID NO: 1279722 - RNA, 22 nt, Human
uaaccaguuugauaaugaaggu

SEQ ID NO: 1279723 - RNA, 18 nt, Human
uaacuaaacuucacacac

SEQ ID NO: 1279724 - RNA, 22 nt, Human
uacacaguauaacaaaauauuc

SEQ ID NO: 1279725 - RNA, 20 nt, Human
uagaacuuaugaauauagag

SEQ ID NO: 1279726 - RNA, 20 nt, Human
uagagguuuacucaucuaac

SEQ ID NO: 1279727 - RNA, 20 nt, Human
uauaacacuaaaaugacuag

SEQ ID NO: 1279728 - RNA, 22 nt, Human
uauagagguuuacucaucuaac

SEQ ID NO: 1279729 - RNA, 22 nt, Human
uaucaaaguaaugaaaaugggu

SEQ ID NO: 1279730 - RNA, 19 nt, Human
uaugcaccaacuaguugcg

SEQ ID NO: 1279731 - RNA, 18 nt, Human
uauucaggaccaagacca

SEQ ID NO: 1279732 - RNA, 18 nt, Human
ucaaaaucagcaacugcu

SEQ ID NO: 1279733 - RNA, 19 nt, Human
ucaaaaucagcaacugcug

SEQ ID NO: 1279734 - RNA, 18 nt, Human
ucaauguguguuaaauga

SEQ ID NO: 1279735 - RNA, 23 nt, Human
ucacuaaauggguaucuuggucc

SEQ ID NO: 1279736 - RNA, 18 nt, Human
ucaguucuaaaacaaacc

SEQ ID NO: 1279737 - RNA, 24 nt, Human
uccauuaccuaaagucuuucuacu

SEQ ID NO: 1279738 - RNA, 22 nt, Human
uccccugaaaaaagguggcugu

SEQ ID NO: 1279739 - RNA, 24 nt, Human
ucuaaaacaaaccucuguugcuuu

SEQ ID NO: 1279740 - RNA, 24 nt, Human
ugaagaagaggcaauaggggucuu

SEQ ID NO: 1279741 - RNA, 22 nt, Human
ugaauagacuauuuuguacaaa

SEQ ID NO: 1279742 - RNA, 25 nt, Human
ugaggaaaaacuuaaggaauggucc

SEQ ID NO: 1279743 - RNA, 23 nt, Human
ugcacugaaguauuucaaagucu

SEQ ID NO: 1279744 - RNA, 25 nt, Human
ugccagccccuccuccccccagguu

SEQ ID NO: 1279745 - RNA, 19 nt, Human
uggcacaguuaugaccagc

SEQ ID NO: 1279746 - RNA, 24 nt, Human
uuaaagcacaguuuucacagacac

SEQ ID NO: 1279747 - RNA, 21 nt, Human
uuaaaugaaugaacgaacuga

SEQ ID NO: 1279748 - RNA, 21 nt, Human
uuaacucuacaaagauacauc

SEQ ID NO: 1279749 - RNA, 19 nt, Human
uuacucaucuaacaaacag

SEQ ID NO: 1279750 - RNA, 19 nt, Human
uuauaaauacuuugaaucc

SEQ ID NO: 1279751 - RNA, 21 nt, Human
uuuaaagggcaaaaggauuug

SEQ ID NO: 1279752 - RNA, 18 nt, Human
aacuggaacugagaaccc

SEQ ID NO: 1279753 - RNA, 18 nt, Human
aagaaaacuuuuucuggc

SEQ ID NO: 1279754 - RNA, 18 nt, Human
aagaaaacuuuuucuggc

SEQ ID NO: 1279755 - RNA, 26 nt, Human
aagagaagacagcauuuggugacaaa

SEQ ID NO: 1279756 - RNA, 18 nt, Human
aagggggacuccagacag

SEQ ID NO: 1279757 - RNA, 28 nt, Human
acuuuuucuggcuuuuuuuuuuccucuu

SEQ ID NO: 1279758 - RNA, 22 nt, Human
agggggacuccagacagcgguc

SEQ ID NO: 1279759 - RNA, 19 nt, Human
augagacaacagacuugga

SEQ ID NO: 1279760 - RNA, 18 nt, Human
cacccccucuuccguccc

SEQ ID NO: 1279761 - RNA, 20 nt, Human
ccagacagcggucuugaagc

SEQ ID NO: 1279762 - RNA, 20 nt, Human
ccucuuccgucccgcaccuc

SEQ ID NO: 1279763 - RNA, 22 nt, Human
cgagccucuggccuucaccccc

SEQ ID NO: 1279764 - RNA, 22 nt, Human
cuccagaaaagaaaacuuuuuc

SEQ ID NO: 1279765 - RNA, 20 nt, Human
gagaaagagaagacagcauu

SEQ ID NO: 1279766 - RNA, 18 nt, Human
gccccgagccucuggccu

SEQ ID NO: 1279767 - RNA, 19 nt, Human
uccagacagcggucuugaa

SEQ ID NO: 1279768 - RNA, 23 nt, Human
ugagaacccagcagguacuucua

SEQ ID NO: 1279769 - RNA, 19 nt, Human
ugagacaacagacuuggaa

SEQ ID NO: 1279770 - RNA, 22 nt, Human
uuuuuuuuuuccucuuccuccc

SEQ ID NO: 1279771 - RNA, 24 nt, Human
aaaaaauaaauauugugaacaccc

SEQ ID NO: 1279772 - RNA, 20 nt, Human
aaauaaauacccccaggccc

SEQ ID NO: 1279773 - RNA, 18 nt, Human
aaauacccccaggccccc

SEQ ID NO: 1279774 - RNA, 23 nt, Human
aagcacccucaguccccugcccu

SEQ ID NO: 1279775 - RNA, 19 nt, Human
accccaggacggcaaagug

SEQ ID NO: 1279776 - RNA, 27 nt, Human
acuuccuucaaaccccuuccccagcug

SEQ ID NO: 1279777 - RNA, 22 nt, Human
agaauaaacauggacucaaaca

SEQ ID NO: 1279778 - RNA, 19 nt, Human
agaccagaugcccccaccc

SEQ ID NO: 1279779 - RNA, 22 nt, Human
agagccucccaaacucgggaau

SEQ ID NO: 1279780 - RNA, 19 nt, Human
agaugagcacccccccacc

SEQ ID NO: 1279781 - RNA, 25 nt, Human
agaugcccccaccccuccccacuuc

SEQ ID NO: 1279782 - RNA, 23 nt, Human
agcuggaccaggcggcaucugcc

SEQ ID NO: 1279783 - RNA, 18 nt, Human
agggcuagagacuauacc

SEQ ID NO: 1279784 - RNA, 24 nt, Human
auacccccaggccccccucccauu

SEQ ID NO: 1279785 - RNA, 20 nt, Human
auuuggggccccagccauuc

SEQ ID NO: 1279786 - RNA, 21 nt, Human
caaagucccuucucuacccuc

SEQ ID NO: 1279787 - RNA, 23 nt, Human
caaagucccuucucuacccucuc

SEQ ID NO: 1279788 - RNA, 23 nt, Human
caccagccccagccuuagagggc

SEQ ID NO: 1279789 - RNA, 19 nt, Human
caccccaggacggcaaagu

SEQ ID NO: 1279790 - RNA, 23 nt, Human
caccccuccccacuuccaacuuc

SEQ ID NO: 1279791 - RNA, 18 nt, Human
cagaacccaggcccauga

SEQ ID NO: 1279792 - RNA, 23 nt, Human
cagaacccaggcccaugaagucu

SEQ ID NO: 1279793 - RNA, 21 nt, Human
cagaggucacgagaugagcac

SEQ ID NO: 1279794 - RNA, 23 nt, Human
cagaugcccccaccccuccccac

SEQ ID NO: 1279795 - RNA, 22 nt, Human
caggccccccucccauuaccaa

SEQ ID NO: 1279796 - RNA, 23 nt, Human
ccaccccuccccacuuccaacuu

SEQ ID NO: 1279797 - RNA, 20 nt, Human
ccagccuuagagggcuagag

SEQ ID NO: 1279798 - RNA, 21 nt, Human
cccaccccuccccacuuccaa

SEQ ID NO: 1279799 - RNA, 22 nt, Human
cccacuuccaacuuccuucaaa

SEQ ID NO: 1279800 - RNA, 22 nt, Human
ccccaccccuccccacuuccaa

SEQ ID NO: 1279801 - RNA, 22 nt, Human
ccccaccccuccccacuuccaa

SEQ ID NO: 1279802 - RNA, 21 nt, Human
cccccaccccuccccacuucc

SEQ ID NO: 1279803 - RNA, 22 nt, Human
cccccaccccuccccacuucca

SEQ ID NO: 1279804 - RNA, 25 nt, Human
cccccccaccuuguuuuuuuuaaaa

SEQ ID NO: 1279805 - RNA, 23 nt, Human
cccccuucgacuccuccccaggc

SEQ ID NO: 1279806 - RNA, 18 nt, Human
ccccuucgacuccucccc

SEQ ID NO: 1279807 - RNA, 19 nt, Human
ccccuucgacuccucccca

SEQ ID NO: 1279808 - RNA, 24 nt, Human
ccccuucgacuccuccccaggccc

SEQ ID NO: 1279809 - RNA, 24 nt, Human
cccugcauccagcugguccauuuc

SEQ ID NO: 1279810 - RNA, 21 nt, Human
cccuucucuacccucucugca

SEQ ID NO: 1279811 - RNA, 23 nt, Human
ccugcaaagucccuucucuaccc

SEQ ID NO: 1279812 - RNA, 22 nt, Human
ccuuccccagcugcaacucuaa

SEQ ID NO: 1279813 - RNA, 27 nt, Human
cuaaauaaauacccccaggccccccuc

SEQ ID NO: 1279814 - RNA, 23 nt, Human
cucaagcacccucaguccccugc

SEQ ID NO: 1279815 - RNA, 23 nt, Human
cucacauccuacucaagcacccu

SEQ ID NO: 1279816 - RNA, 25 nt, Human
cuccccaggcccagcugagggggga

SEQ ID NO: 1279817 - RNA, 23 nt, Human
cuccuggauuuggggccccagcc

SEQ ID NO: 1279818 - RNA, 23 nt, Human
cugaaaaaacucaacagaaccca

SEQ ID NO: 1279819 - RNA, 18 nt, Human
cugagaccagaugccccc

SEQ ID NO: 1279820 - RNA, 21 nt, Human
cugagaccagaugcccccacc

SEQ ID NO: 1279821 - RNA, 22 nt, Human
cugaugcuagggcaccccuccc

SEQ ID NO: 1279822 - RNA, 20 nt, Human
cugcagcccccuucgacucc

SEQ ID NO: 1279823 - RNA, 22 nt, Human
cuguuggggcugaucaccagcc

SEQ ID NO: 1279824 - RNA, 23 nt, Human
cuuccuucaaaccccuuccccag

SEQ ID NO: 1279825 - RNA, 20 nt, Human
gaaaaaacucaacagaaccc

SEQ ID NO: 1279826 - RNA, 26 nt, Human
gaacacccacccaccucugaugaaaa

SEQ ID NO: 1279827 - RNA, 22 nt, Human
gaucaccagccccagccuuaga

SEQ ID NO: 1279828 - RNA, 19 nt, Human
gggaccgcuccgcgggcca

SEQ ID NO: 1279829 - RNA, 22 nt, Human
ggggggaggaggggaaagggcc

SEQ ID NO: 1279830 - RNA, 19 nt, Human
uaaauacccccaggccccc

SEQ ID NO: 1279831 - RNA, 20 nt, Human
uacccccaggccccccuccc

SEQ ID NO: 1279832 - RNA, 21 nt, Human
uacucggccgcgggaccgcuc

SEQ ID NO: 1279833 - RNA, 23 nt, Human
ucaacagaacccaggcccaugaa

SEQ ID NO: 1279834 - RNA, 25 nt, Human
ucaccagccccagccuuagagggcu

SEQ ID NO: 1279835 - RNA, 23 nt, Human
ucccauuaccaaaugaaaaaaua

SEQ ID NO: 1279836 - RNA, 23 nt, Human
uccccugcccugcauccagcugg

SEQ ID NO: 1279837 - RNA, 23 nt, Human
uccgguacucggccgcgggaccg

SEQ ID NO: 1279838 - RNA, 22 nt, Human
ucucacauccuacucaagcacc

SEQ ID NO: 1279839 - RNA, 24 nt, Human
ucugcagcccccuucgacuccucc

SEQ ID NO: 1279840 - RNA, 21 nt, Human
ugaaaaaacucaacagaaccc

SEQ ID NO: 1279841 - RNA, 24 nt, Human
ugaaaaaacucaacagaacccagg

SEQ ID NO: 1279842 - RNA, 22 nt, Human
ugaaacauggaguuugugaagg

SEQ ID NO: 1279843 - RNA, 23 nt, Human
ugaggggggaggaggggaaaggg

SEQ ID NO: 1279844 - RNA, 24 nt, Human
ugaugaaaaucuccuggauuuggg

SEQ ID NO: 1279845 - RNA, 20 nt, Human
ugcaaagucccuucucuacc

SEQ ID NO: 1279846 - RNA, 18 nt, Human
uggcagaggucacgagau

SEQ ID NO: 1279847 - RNA, 28 nt, Human
uggguggcagaggucacgagaugagcac

SEQ ID NO: 1279848 - RNA, 21 nt, Human
uucucuacccucucugcagcc

SEQ ID NO: 1279849 - RNA, 22 nt, Human
uugauacugaaaaaacucaaca

SEQ ID NO: 1279850 - RNA, 18 nt, Human
uugugaaggaugugggug

SEQ ID NO: 1279851 - RNA, 23 nt, Human
acagaggcccaggacccaauccg

SEQ ID NO: 1279852 - RNA, 23 nt, Human
accacaaacacccucuguccuga

SEQ ID NO: 1279853 - RNA, 22 nt, Human
accucgguucugccucuucacc

SEQ ID NO: 1279854 - RNA, 23 nt, Human
agagacacaccuucccccgcccc

SEQ ID NO: 1279855 - RNA, 20 nt, Human
agagggaagggagcacagag

SEQ ID NO: 1279856 - RNA, 19 nt, Human
aggacccaauccgcuucuc

SEQ ID NO: 1279857 - RNA, 28 nt, Human
agggaagggagcacagaguuaguggggg

SEQ ID NO: 1279858 - RNA, 26 nt, Human
caagccaagaccgacaggugugccug

SEQ ID NO: 1279859 - RNA, 18 nt, Human
caaugggcucccgaccuu

SEQ ID NO: 1279860 - RNA, 23 nt, Human
cacagcucagaguccccaagccu

SEQ ID NO: 1279861 - RNA, 22 nt, Human
cagaguccccaagccugggccc

SEQ ID NO: 1279862 - RNA, 23 nt, Human
cauuggcugggaucaaagccaaa

SEQ ID NO: 1279863 - RNA, 19 nt, Human
ccagcaguguguguucucc

SEQ ID NO: 1279864 - RNA, 23 nt, Human
ccaggagagggaagggagcacaa

SEQ ID NO: 1279865 - RNA, 18 nt, Human
cccaggagagggaaggga

SEQ ID NO: 1279866 - RNA, 23 nt, Human
cccucuguccugacaccgucacc

SEQ ID NO: 1279867 - RNA, 19 nt, Human
ccguccagguagggguggg

SEQ ID NO: 1279868 - RNA, 18 nt, Human
ccugggcccguccaggua

SEQ ID NO: 1279869 - RNA, 19 nt, Human
cgcagucuucggugcuggg

SEQ ID NO: 1279870 - RNA, 24 nt, Human
cuccuugcccuuguucuccuuaac

SEQ ID NO: 1279871 - RNA, 24 nt, Human
cucgcccuccggcaggcucagaca

SEQ ID NO: 1279872 - RNA, 18 nt, Human
gagaacaucagacucaug

SEQ ID NO: 1279873 - RNA, 19 nt, Human
gagacacaccuucccccgc

SEQ ID NO: 1279874 - RNA, 18 nt, Human
gagagacacaccuucccc

SEQ ID NO: 1279875 - RNA, 20 nt, Human
gaguccccaagccugggccc

SEQ ID NO: 1279876 - RNA, 22 nt, Human
gcacauuggcugggaucaaagc

SEQ ID NO: 1279877 - RNA, 21 nt, Human
gcccaggacccaauccgcuuc

SEQ ID NO: 1279878 - RNA, 20 nt, Human
gcccuuguucuccuuaacac

SEQ ID NO: 1279879 - RNA, 21 nt, Human
gcucagacaucaaugggcucc

SEQ ID NO: 1279880 - RNA, 19 nt, Human
uagcuuccggcuucaggcc

SEQ ID NO: 1279881 - RNA, 18 nt, Human
uagguagcuuccggcuuc

SEQ ID NO: 1279882 - RNA, 24 nt, Human
uauuagggagugagggagcacaaa

SEQ ID NO: 1279883 - RNA, 21 nt, Human
ucaccacaaacacccucuguc

SEQ ID NO: 1279884 - RNA, 22 nt, Human
ucaccagcaguguguguucucc

SEQ ID NO: 1279885 - RNA, 18 nt, Human
uccccaagccugggcccg

SEQ ID NO: 1279886 - RNA, 20 nt, Human
uucaccacaaacacccucug

SEQ ID NO: 1279887 - RNA, 19 nt, Human
uugcccuuguucuccuuaa

SEQ ID NO: 1279888 - RNA, 21 nt, Human
aaagcuccuucagaaaagcuc

SEQ ID NO: 1279889 - RNA, 22 nt, Human
aacacgcccccccacgccccca

SEQ ID NO: 1279890 - RNA, 23 nt, Human
aaccauuccagagaaccccacca

SEQ ID NO: 1279891 - RNA, 24 nt, Human
aaccccccucccacggccccgcca

SEQ ID NO: 1279892 - RNA, 20 nt, Human
aaccccgcucucccuccggc

SEQ ID NO: 1279893 - RNA, 21 nt, Human
aacuccugcccuccugcuccc

SEQ ID NO: 1279894 - RNA, 25 nt, Human
aagcagcccaccucacagcaggaag

SEQ ID NO: 1279895 - RNA, 22 nt, Human
aagccagugcccaccccuccac

SEQ ID NO: 1279896 - RNA, 18 nt, Human
aaggccucagaugcacag

SEQ ID NO: 1279897 - RNA, 26 nt, Human
aauggaacacgcccccccacgccccc

SEQ ID NO: 1279898 - RNA, 22 nt, Human
acacgcagcugucccugccccu

SEQ ID NO: 1279899 - RNA, 23 nt, Human
acacgcccccccacgcccccacc

SEQ ID NO: 1279900 - RNA, 23 nt, Human
acagagccaaccccagggcacac

SEQ ID NO: 1279901 - RNA, 20 nt, Human
accccuccccggccagggag

SEQ ID NO: 1279902 - RNA, 20 nt, Human
accccugcccccuugcucuc

SEQ ID NO: 1279903 - RNA, 20 nt, Human
accccugcccucuugcucuc

SEQ ID NO: 1279904 - RNA, 21 nt, Human
accccugcccucuugcucucc

SEQ ID NO: 1279905 - RNA, 21 nt, Human
accccuguucuccuguucucc

SEQ ID NO: 1279906 - RNA, 23 nt, Human
acccugcccuccugacccuccca

SEQ ID NO: 1279907 - RNA, 24 nt, Human
accuccauccucagccucuggaca

SEQ ID NO: 1279908 - RNA, 22 nt, Human
accugcagcaguaagcagccuc

SEQ ID NO: 1279909 - RNA, 20 nt, Human
acggccguucccucuggccg

SEQ ID NO: 1279910 - RNA, 18 nt, Human
agaagcagacccaggccu

SEQ ID NO: 1279911 - RNA, 25 nt, Human
agaagcagacccaggccugaggcgg

SEQ ID NO: 1279912 - RNA, 22 nt, Human
agaggaggaaggggagggaggu

SEQ ID NO: 1279913 - RNA, 22 nt, Human
agaggccuugcagccuucugcc

SEQ ID NO: 1279914 - RNA, 19 nt, Human
agcaccugaugcccuccac

SEQ ID NO: 1279915 - RNA, 21 nt, Human
agccucagugccacacggugc

SEQ ID NO: 1279916 - RNA, 22 nt, Human
aggcacuggguggcagaggagg

SEQ ID NO: 1279917 - RNA, 22 nt, Human
agugcccaccccuccacagagc

SEQ ID NO: 1279918 - RNA, 20 nt, Human
auccucagccucuggacaug

SEQ ID NO: 1279919 - RNA, 25 nt, Human
auggaacacgcccccccacgccccc

SEQ ID NO: 1279920 - RNA, 24 nt, Human
augguccacggaugcgccucccga

SEQ ID NO: 1279921 - RNA, 20 nt, Human
caaccccccucccacggccc

SEQ ID NO: 1279922 - RNA, 25 nt, Human
caacuccugcccuccugcucccucc

SEQ ID NO: 1279923 - RNA, 19 nt, Human
cacaaucucugugagauga

SEQ ID NO: 1279924 - RNA, 19 nt, Human
cacacauguuuauugauaa

SEQ ID NO: 1279925 - RNA, 18 nt, Human
cacagggcaugaggccac

SEQ ID NO: 1279926 - RNA, 22 nt, Human
cacagggucaugguguggacac

SEQ ID NO: 1279927 - RNA, 22 nt, Human
caccaugaugcugccccucccg

SEQ ID NO: 1279928 - RNA, 22 nt, Human
caccccugcccuccagccuucc

SEQ ID NO: 1279929 - RNA, 26 nt, Human
caccccugccuuccugcccccccacc

SEQ ID NO: 1279930 - RNA, 20 nt, Human
cacccugcccuccugacccu

SEQ ID NO: 1279931 - RNA, 24 nt, Human
cacccugcccuccugacccuccca

SEQ ID NO: 1279932 - RNA, 19 nt, Human
caccucacagcaggaaggc

SEQ ID NO: 1279933 - RNA, 24 nt, Human
caccucacagcaggaaggcagcag

SEQ ID NO: 1279934 - RNA, 18 nt, Human
caccugcagcaguaagca

SEQ ID NO: 1279935 - RNA, 20 nt, Human
caccuguccucugccagccc

SEQ ID NO: 1279936 - RNA, 20 nt, Human
cacgcccccaccuguccucu

SEQ ID NO: 1279937 - RNA, 23 nt, Human
cacgcccccaccuguccucugcc

SEQ ID NO: 1279938 - RNA, 22 nt, Human
cacgcccccccacgcccccacc

SEQ ID NO: 1279939 - RNA, 25 nt, Human
cacgcccccccacgcccccaccugu

SEQ ID NO: 1279940 - RNA, 22 nt, Human
cacucacugaccccggaguccc

SEQ ID NO: 1279941 - RNA, 26 nt, Human
cacuggaccccacaggccacucccag

SEQ ID NO: 1279942 - RNA, 23 nt, Human
cagaaggaagcagcccaccucac

SEQ ID NO: 1279943 - RNA, 23 nt, Human
cagaaggcagcgcagcccaagac

SEQ ID NO: 1279944 - RNA, 21 nt, Human
cagacccaggccugaggcgga

SEQ ID NO: 1279945 - RNA, 26 nt, Human
cagaccccaacacuggccaccagaaa

SEQ ID NO: 1279946 - RNA, 26 nt, Human
cagagccaaccccagggcacacagga

SEQ ID NO: 1279947 - RNA, 20 nt, Human
cagcaccuggaggcccugcc

SEQ ID NO: 1279948 - RNA, 24 nt, Human
cagcaggaaggcagcagcagaacc

SEQ ID NO: 1279949 - RNA, 21 nt, Human
cagcaguaagcagccucucag

SEQ ID NO: 1279950 - RNA, 19 nt, Human
cagcccccccuucacccug

SEQ ID NO: 1279951 - RNA, 20 nt, Human
cagcccccuucccacagccc

SEQ ID NO: 1279952 - RNA, 22 nt, Human
cagccucucagccccugagccu

SEQ ID NO: 1279953 - RNA, 18 nt, Human
cagcgcagcccaagacuc

SEQ ID NO: 1279954 - RNA, 19 nt, Human
cagggcacacaggaagcag

SEQ ID NO: 1279955 - RNA, 18 nt, Human
cauacacucacugacccc

SEQ ID NO: 1279956 - RNA, 22 nt, Human
caucccacggccgugagcugcc

SEQ ID NO: 1279957 - RNA, 25 nt, Human
caucccucuucugcucccccucacc

SEQ ID NO: 1279958 - RNA, 23 nt, Human
caugguccacggaugcgccuccc

SEQ ID NO: 1279959 - RNA, 23 nt, Human
ccaaagccagugcccaccccucc

SEQ ID NO: 1279960 - RNA, 21 nt, Human
ccacaaccccccucccacggc

SEQ ID NO: 1279961 - RNA, 20 nt, Human
ccacagccaccgagucagca

SEQ ID NO: 1279962 - RNA, 22 nt, Human
ccaccagcaucacacgcagcug

SEQ ID NO: 1279963 - RNA, 22 nt, Human
ccacgcccccaccuguccucug

SEQ ID NO: 1279964 - RNA, 22 nt, Human
ccacggaugcgccucccgaccc

SEQ ID NO: 1279965 - RNA, 24 nt, Human
ccagcaccccuccccggccaggga

SEQ ID NO: 1279966 - RNA, 19 nt, Human
ccagcccacaaccccccuc

SEQ ID NO: 1279967 - RNA, 20 nt, Human
ccagccguccucacagggca

SEQ ID NO: 1279968 - RNA, 20 nt, Human
ccagcugcccccauggucca

SEQ ID NO: 1279969 - RNA, 22 nt, Human
ccauccucagccucuggacaug

SEQ ID NO: 1279970 - RNA, 20 nt, Human
ccauuccagagaaccccacc

SEQ ID NO: 1279971 - RNA, 18 nt, Human
cccacaaccccccuccca

SEQ ID NO: 1279972 - RNA, 23 nt, Human
cccacagagcucaggaggcggac

SEQ ID NO: 1279973 - RNA, 26 nt, Human
cccaccccuccacagagccaacccca

SEQ ID NO: 1279974 - RNA, 23 nt, Human
cccaccccugccuuccugccccc

SEQ ID NO: 1279975 - RNA, 21 nt, Human
cccacggccccgccagccguc

SEQ ID NO: 1279976 - RNA, 19 nt, Human
cccacggccgugagcugcc

SEQ ID NO: 1279977 - RNA, 20 nt, Human
cccagcaccugaugcccucc

SEQ ID NO: 1279978 - RNA, 21 nt, Human
cccagccucagcaccacuggc

SEQ ID NO: 1279979 - RNA, 21 nt, Human
cccaugccugggcugcagggc

SEQ ID NO: 1279980 - RNA, 20 nt, Human
ccccacaggccacucccaga

SEQ ID NO: 1279981 - RNA, 24 nt, Human
ccccaccuguccucugccagccca

SEQ ID NO: 1279982 - RNA, 21 nt, Human
ccccacgcccaauggcccucc

SEQ ID NO: 1279983 - RNA, 20 nt, Human
ccccaggaaggugcggggug

SEQ ID NO: 1279984 - RNA, 20 nt, Human
ccccaucaccccuacucucc

SEQ ID NO: 1279985 - RNA, 22 nt, Human
ccccaucaccccuacucuccug

SEQ ID NO: 1279986 - RNA, 18 nt, Human
ccccccaccucccuccug

SEQ ID NO: 1279987 - RNA, 18 nt, Human
ccccccucccacggcccc

SEQ ID NO: 1279988 - RNA, 18 nt, Human
ccccccuucacccugccc

SEQ ID NO: 1279989 - RNA, 20 nt, Human
cccccucaccccugcccucc

SEQ ID NO: 1279990 - RNA, 20 nt, Human
cccccucaccccugcccucc

SEQ ID NO: 1279991 - RNA, 21 nt, Human
cccccucaccccugcccuccc

SEQ ID NO: 1279992 - RNA, 21 nt, Human
cccccucaccccugcccuccc

SEQ ID NO: 1279993 - RNA, 18 nt, Human
cccccucccacggccccg

SEQ ID NO: 1279994 - RNA, 28 nt, Human
ccccgccagcccacaaccccccucccac

SEQ ID NO: 1279995 - RNA, 27 nt, Human
ccccggagucccugccaggaaagcucc

SEQ ID NO: 1279996 - RNA, 19 nt, Human
ccccucaccccugcccucc

SEQ ID NO: 1279997 - RNA, 19 nt, Human
ccccucaucccucuucugc

SEQ ID NO: 1279998 - RNA, 23 nt, Human
ccccuccacagagccaaccccag

SEQ ID NO: 1279999 - RNA, 19 nt, Human
ccccugcccucccuuaccc

SEQ ID NO: 1280000 - RNA, 20 nt, Human
ccccugcccucccuuacccc

SEQ ID NO: 1280001 - RNA, 20 nt, Human
ccccugcccucuugcucucc

SEQ ID NO: 1280002 - RNA, 20 nt, Human
ccccugccuuccugcccccc

SEQ ID NO: 1280003 - RNA, 22 nt, Human
ccccuguucuccuguucuccug

SEQ ID NO: 1280004 - RNA, 18 nt, Human
ccccuugcucucucaccc

SEQ ID NO: 1280005 - RNA, 22 nt, Human
cccgcaaagcaagggcaaaggc

SEQ ID NO: 1280006 - RNA, 19 nt, Human
cccuacucuccugcucucc

SEQ ID NO: 1280007 - RNA, 20 nt, Human
cccuccacagagccaacccc

SEQ ID NO: 1280008 - RNA, 22 nt, Human
cccucccagccucagcaccacu

SEQ ID NO: 1280009 - RNA, 19 nt, Human
cccuccugacccucccacc

SEQ ID NO: 1280010 - RNA, 24 nt, Human
cccuccugacccucccaccccugc

SEQ ID NO: 1280011 - RNA, 20 nt, Human
cccuccugccuucccacccc

SEQ ID NO: 1280012 - RNA, 20 nt, Human
cccugcccuccugacccucc

SEQ ID NO: 1280013 - RNA, 19 nt, Human
cccugcccuccugcucccc

SEQ ID NO: 1280014 - RNA, 23 nt, Human
cccugcccuccugcucccccuca

SEQ ID NO: 1280015 - RNA, 19 nt, Human
cccugccuccacgcucccc

SEQ ID NO: 1280016 - RNA, 23 nt, Human
ccgcucucccuccggcauggggc

SEQ ID NO: 1280017 - RNA, 22 nt, Human
ccucaucccucuucugcucccc

SEQ ID NO: 1280018 - RNA, 21 nt, Human
ccuccagcccccccuucaccc

SEQ ID NO: 1280019 - RNA, 23 nt, Human
ccucccaccccugccuuccugcc

SEQ ID NO: 1280020 - RNA, 18 nt, Human
ccucccagccucagcacc

SEQ ID NO: 1280021 - RNA, 22 nt, Human
ccucccgacuguuccagcaccu

SEQ ID NO: 1280022 - RNA, 19 nt, Human
ccucccuuaccccuguucu

SEQ ID NO: 1280023 - RNA, 19 nt, Human
ccuccgccaccccugccua

SEQ ID NO: 1280024 - RNA, 18 nt, Human
ccuccggcauggggccuc

SEQ ID NO: 1280025 - RNA, 19 nt, Human
ccuccugacccucccaccc

SEQ ID NO: 1280026 - RNA, 21 nt, Human
ccuccugcucccccucacccc

SEQ ID NO: 1280027 - RNA, 20 nt, Human
ccuccugucccaacgccugc

SEQ ID NO: 1280028 - RNA, 20 nt, Human
ccucggaaacccuggagccc

SEQ ID NO: 1280029 - RNA, 20 nt, Human
ccucgucaccgcugcccucc

SEQ ID NO: 1280030 - RNA, 19 nt, Human
ccucuggacaugaggaccc

SEQ ID NO: 1280031 - RNA, 22 nt, Human
ccucuggacaugaggacccuga

SEQ ID NO: 1280032 - RNA, 19 nt, Human
ccucuugcucuccucaccc

SEQ ID NO: 1280033 - RNA, 24 nt, Human
ccugaaagaccacugguucccucu

SEQ ID NO: 1280034 - RNA, 18 nt, Human
ccugacccucccaccccu

SEQ ID NO: 1280035 - RNA, 24 nt, Human
ccugcagcuggacaggccgggguc

SEQ ID NO: 1280036 - RNA, 21 nt, Human
ccugcucucucaccccugccc

SEQ ID NO: 1280037 - RNA, 19 nt, Human
ccugggcugcagggcagcc

SEQ ID NO: 1280038 - RNA, 18 nt, Human
ccuggggaccugcccggg

SEQ ID NO: 1280039 - RNA, 23 nt, Human
ccuucagaaaagcucauucugaa

SEQ ID NO: 1280040 - RNA, 22 nt, Human
ccuuccaccuccauccucagcc

SEQ ID NO: 1280041 - RNA, 20 nt, Human
ccuuccugcccccccaccuc

SEQ ID NO: 1280042 - RNA, 18 nt, Human
ccuuugucuuccaggccu

SEQ ID NO: 1280043 - RNA, 22 nt, Human
ccuuugucuuccaggccugggc

SEQ ID NO: 1280044 - RNA, 19 nt, Human
cgacccgcaggcgugagcu

SEQ ID NO: 1280045 - RNA, 24 nt, Human
cggagucccugccaggaaagcucc

SEQ ID NO: 1280046 - RNA, 18 nt, Human
cguccaaaauguagguca

SEQ ID NO: 1280047 - RNA, 18 nt, Human
cgugggcagcaggagggc

SEQ ID NO: 1280048 - RNA, 19 nt, Human
cuaaagccucagcuggaau

SEQ ID NO: 1280049 - RNA, 20 nt, Human
cuacucuggagacacagagg

SEQ ID NO: 1280050 - RNA, 23 nt, Human
cucccauguaccuuccacaaaag

SEQ ID NO: 1280051 - RNA, 18 nt, Human
cucccccucaccccugcc

SEQ ID NO: 1280052 - RNA, 18 nt, Human
cucccccucaccccugcc

SEQ ID NO: 1280053 - RNA, 19 nt, Human
cuccucaccccugcccucc

SEQ ID NO: 1280054 - RNA, 19 nt, Human
cuccucaccccugcccucc

SEQ ID NO: 1280055 - RNA, 19 nt, Human
cuccucaccccugcccucc

SEQ ID NO: 1280056 - RNA, 19 nt, Human
cuccucaccccugcucucc

SEQ ID NO: 1280057 - RNA, 19 nt, Human
cuccugaccccugcccucc

SEQ ID NO: 1280058 - RNA, 22 nt, Human
cuccugcucccccucaucccuc

SEQ ID NO: 1280059 - RNA, 18 nt, Human
cucucaccccugcccucc

SEQ ID NO: 1280060 - RNA, 20 nt, Human
cucucucaccccugcccccu

SEQ ID NO: 1280061 - RNA, 20 nt, Human
cucugcuccagcugcagcac

SEQ ID NO: 1280062 - RNA, 19 nt, Human
cucuuccagcaccccuccc

SEQ ID NO: 1280063 - RNA, 23 nt, Human
cugcagccuccuaaagugcuuug

SEQ ID NO: 1280064 - RNA, 23 nt, Human
cugcuccagcugcagcacggggc

SEQ ID NO: 1280065 - RNA, 23 nt, Human
cugcucccuccucaccccugccc

SEQ ID NO: 1280066 - RNA, 23 nt, Human
cugcucccuccucaccccugccc

SEQ ID NO: 1280067 - RNA, 19 nt, Human
cugcucucucaccccugcc

SEQ ID NO: 1280068 - RNA, 20 nt, Human
cugcucucucaccccugccc

SEQ ID NO: 1280069 - RNA, 21 nt, Human
cugcucucucaccccugcccc

SEQ ID NO: 1280070 - RNA, 23 nt, Human
cuggacaugaggacccugagacc

SEQ ID NO: 1280071 - RNA, 23 nt, Human
cuuccaccuccauccucagccuc

SEQ ID NO: 1280072 - RNA, 21 nt, Human
cuugcucucucaccccugccc

SEQ ID NO: 1280073 - RNA, 18 nt, Human
gaacacgcccccccacgc

SEQ ID NO: 1280074 - RNA, 19 nt, Human
gaaggaaauccacuuaaaa

SEQ ID NO: 1280075 - RNA, 26 nt, Human
gaaggcagcgcagcccaagacucggg

SEQ ID NO: 1280076 - RNA, 21 nt, Human
gacaggcugcccucgucaccg

SEQ ID NO: 1280077 - RNA, 22 nt, Human
gacaguguggcccagcugcccc

SEQ ID NO: 1280078 - RNA, 20 nt, Human
gaccccacaggccacuccca

SEQ ID NO: 1280079 - RNA, 22 nt, Human
gacccgcaggcgugagcuccuc

SEQ ID NO: 1280080 - RNA, 19 nt, Human
gacccucccaccccugccu

SEQ ID NO: 1280081 - RNA, 19 nt, Human
gagaaccccaccaccucuc

SEQ ID NO: 1280082 - RNA, 19 nt, Human
gagaggcauggggggaacc

SEQ ID NO: 1280083 - RNA, 22 nt, Human
gaggaaggggagggagguguuc

SEQ ID NO: 1280084 - RNA, 22 nt, Human
gaugcccuccacgacuccccac

SEQ ID NO: 1280085 - RNA, 20 nt, Human
gcacuggguggcagaggagg

SEQ ID NO: 1280086 - RNA, 20 nt, Human
gcagacccaggccugaggcg

SEQ ID NO: 1280087 - RNA, 19 nt, Human
gcagaccccaacacuggcc

SEQ ID NO: 1280088 - RNA, 22 nt, Human
gcagcagcagaacccacagggc

SEQ ID NO: 1280089 - RNA, 19 nt, Human
gcagggcagcccugcccuc

SEQ ID NO: 1280090 - RNA, 22 nt, Human
gccaaccccagggcacacagga

SEQ ID NO: 1280091 - RNA, 21 nt, Human
gccacacggugcagaccccaa

SEQ ID NO: 1280092 - RNA, 24 nt, Human
gccagaaggcacggccguucccuc

SEQ ID NO: 1280093 - RNA, 18 nt, Human
gccagcccacaacccccc

SEQ ID NO: 1280094 - RNA, 23 nt, Human
gccagugcccaccccuccacaga

SEQ ID NO: 1280095 - RNA, 20 nt, Human
gcccaccccuccacagagcc

SEQ ID NO: 1280096 - RNA, 24 nt, Human
gcccaccucacagcaggaaggcag

SEQ ID NO: 1280097 - RNA, 21 nt, Human
gcccacucucagagccccagc

SEQ ID NO: 1280098 - RNA, 19 nt, Human
gccccaggaaggugcgggg

SEQ ID NO: 1280099 - RNA, 21 nt, Human
gcccuccugcucccccaacuc

SEQ ID NO: 1280100 - RNA, 20 nt, Human
gccucagcuggaauggaaca

SEQ ID NO: 1280101 - RNA, 19 nt, Human
gccucucauacacucacug

SEQ ID NO: 1280102 - RNA, 25 nt, Human
gccucuuucugcugcccuuuagaag

SEQ ID NO: 1280103 - RNA, 23 nt, Human
gccugcccuccugcucccccuca

SEQ ID NO: 1280104 - RNA, 21 nt, Human
gcggaagggaagcacccuccg

SEQ ID NO: 1280105 - RNA, 24 nt, Human
gcucuugaaguuuccaacacaggg

SEQ ID NO: 1280106 - RNA, 22 nt, Human
gcuguccccucgcuguccgugg

SEQ ID NO: 1280107 - RNA, 22 nt, Human
gcuugggcuugggccgugggca

SEQ ID NO: 1280108 - RNA, 24 nt, Human
ggaacacgcccccccacgccccca

SEQ ID NO: 1280109 - RNA, 18 nt, Human
ggaacgcugcccucugcu

SEQ ID NO: 1280110 - RNA, 23 nt, Human
ggaaggcagcagcagaacccaca

SEQ ID NO: 1280111 - RNA, 22 nt, Human
ggcagaagcagacccaggccug

SEQ ID NO: 1280112 - RNA, 19 nt, Human
ggcagcccccuucccacag

SEQ ID NO: 1280113 - RNA, 18 nt, Human
ggccagaaggaagcagcc

SEQ ID NO: 1280114 - RNA, 21 nt, Human
ggcguggcggggaggggagcu

SEQ ID NO: 1280115 - RNA, 21 nt, Human
ggcugcagggcagcccugccc

SEQ ID NO: 1280116 - RNA, 22 nt, Human
gggagcugccguccaaagggaa

SEQ ID NO: 1280117 - RNA, 19 nt, Human
gggaggcugggaggagggc

SEQ ID NO: 1280118 - RNA, 23 nt, Human
gggaggggagcugccguccaaag

SEQ ID NO: 1280119 - RNA, 18 nt, Human
gggcacagggcaugaggc

SEQ ID NO: 1280120 - RNA, 24 nt, Human
gggcagcccugcccucucuccucg

SEQ ID NO: 1280121 - RNA, 19 nt, Human
gggccagggccaagaagua

SEQ ID NO: 1280122 - RNA, 21 nt, Human
ggguggcagaggaggaagggg

SEQ ID NO: 1280123 - RNA, 20 nt, Human
ggucaucauaugggcacagg

SEQ ID NO: 1280124 - RNA, 18 nt, Human
gucacgcuucauggcucg

SEQ ID NO: 1280125 - RNA, 24 nt, Human
gucagucccaugccugggcugcag

SEQ ID NO: 1280126 - RNA, 22 nt, Human
gucaugguguggacacaggcac

SEQ ID NO: 1280127 - RNA, 18 nt, Human
gugccacacggugcagac

SEQ ID NO: 1280128 - RNA, 19 nt, Human
gugcgugacgggaggcugg

SEQ ID NO: 1280129 - RNA, 22 nt, Human
gugggcagcaggagggcuggag

SEQ ID NO: 1280130 - RNA, 18 nt, Human
uaagcagccucucagccc

SEQ ID NO: 1280131 - RNA, 23 nt, Human
uaagcagccucucagccccugag

SEQ ID NO: 1280132 - RNA, 18 nt, Human
ucacacauguuuauugau

SEQ ID NO: 1280133 - RNA, 19 nt, Human
ucagagccccagcucuccg

SEQ ID NO: 1280134 - RNA, 19 nt, Human
ucagcacagcccacggggc

SEQ ID NO: 1280135 - RNA, 23 nt, Human
ucagccccugagccuggggaccu

SEQ ID NO: 1280136 - RNA, 19 nt, Human
ucagucccaugccugggcu

SEQ ID NO: 1280137 - RNA, 21 nt, Human
ucagugccacacggugcagac

SEQ ID NO: 1280138 - RNA, 23 nt, Human
ucauacacucacugaccccggaa

SEQ ID NO: 1280139 - RNA, 19 nt, Human
uccaaagccagugcccacc

SEQ ID NO: 1280140 - RNA, 22 nt, Human
uccaaagccagugcccaccccu

SEQ ID NO: 1280141 - RNA, 18 nt, Human
uccacagagccaacccca

SEQ ID NO: 1280142 - RNA, 18 nt, Human
ucccaacgccugcccucc

SEQ ID NO: 1280143 - RNA, 23 nt, Human
ucccaccccugccuuccugcccc

SEQ ID NO: 1280144 - RNA, 23 nt, Human
ucccagccucagcaccacuggcu

SEQ ID NO: 1280145 - RNA, 21 nt, Human
ucccccaacuccugcccuccu

SEQ ID NO: 1280146 - RNA, 19 nt, Human
ucccuccggcauggggccu

SEQ ID NO: 1280147 - RNA, 21 nt, Human
ucccuccugccuucccacccc

SEQ ID NO: 1280148 - RNA, 21 nt, Human
ucccucuucugcucccccuca

SEQ ID NO: 1280149 - RNA, 21 nt, Human
ucccuuggcucggagucccug

SEQ ID NO: 1280150 - RNA, 19 nt, Human
uccucaccccugcccucca

SEQ ID NO: 1280151 - RNA, 24 nt, Human
uccucaccccugcccuccuauucc

SEQ ID NO: 1280152 - RNA, 24 nt, Human
uccucaccccugcccuccugcucc

SEQ ID NO: 1280153 - RNA, 24 nt, Human
uccucaccccugcucuccugcucu

SEQ ID NO: 1280154 - RNA, 24 nt, Human
uccugaccccugcccuccugcucc

SEQ ID NO: 1280155 - RNA, 26 nt, Human
uccugcccuccugcucccuccucacc

SEQ ID NO: 1280156 - RNA, 24 nt, Human
uccugcucccccaacuccugcccu

SEQ ID NO: 1280157 - RNA, 18 nt, Human
ucggagucccugugcccc

SEQ ID NO: 1280158 - RNA, 21 nt, Human
ucggcagcccccuucccacag

SEQ ID NO: 1280159 - RNA, 19 nt, Human
ucuaugguccugcagcugg

SEQ ID NO: 1280160 - RNA, 23 nt, Human
ucucaccccugcccuccuguccc

SEQ ID NO: 1280161 - RNA, 21 nt, Human
ucucagagccccagcucuccg

SEQ ID NO: 1280162 - RNA, 24 nt, Human
ucucauacacucacugaccccgga

SEQ ID NO: 1280163 - RNA, 20 nt, Human
ucuccugcucuccucacccc

SEQ ID NO: 1280164 - RNA, 19 nt, Human
ucuccugcucucucacccc

SEQ ID NO: 1280165 - RNA, 25 nt, Human
ucucgaccaggcuagcaggccacag

SEQ ID NO: 1280166 - RNA, 24 nt, Human
ucucucgaccaggcuagcaggcca

SEQ ID NO: 1280167 - RNA, 21 nt, Human
ucucugugagaugagagaucc

SEQ ID NO: 1280168 - RNA, 21 nt, Human
ugaacgccccagaggccagug

SEQ ID NO: 1280169 - RNA, 22 nt, Human
ugaccccugcccuccugcuccc

SEQ ID NO: 1280170 - RNA, 24 nt, Human
ugaccccugcccuccugcuccccc

SEQ ID NO: 1280171 - RNA, 19 nt, Human
ugacugcagcaauuucccu

SEQ ID NO: 1280172 - RNA, 20 nt, Human
ugagaaccugucucugcaga

SEQ ID NO: 1280173 - RNA, 24 nt, Human
ugagcagguggcugggccggcaag

SEQ ID NO: 1280174 - RNA, 19 nt, Human
ugaggacccugagacccug

SEQ ID NO: 1280175 - RNA, 20 nt, Human
ugaggcggacaguccagccc

SEQ ID NO: 1280176 - RNA, 19 nt, Human
ugauaaaccguccaaaaug

SEQ ID NO: 1280177 - RNA, 18 nt, Human
ugcagccuucugcccaca

SEQ ID NO: 1280178 - RNA, 24 nt, Human
ugccacacggugcagaccccaaca

SEQ ID NO: 1280179 - RNA, 25 nt, Human
ugcccccccaccucccuccugccuu

SEQ ID NO: 1280180 - RNA, 20 nt, Human
ugccccucccgacuguucca

SEQ ID NO: 1280181 - RNA, 18 nt, Human
ugcccgggcagcacaggg

SEQ ID NO: 1280182 - RNA, 20 nt, Human
ugcccuccagcccccccuuc

SEQ ID NO: 1280183 - RNA, 19 nt, Human
ugcccucccuuaccccugu

SEQ ID NO: 1280184 - RNA, 23 nt, Human
ugcccuccugcucccccaacucc

SEQ ID NO: 1280185 - RNA, 19 nt, Human
ugcccugacaucccuuggc

SEQ ID NO: 1280186 - RNA, 18 nt, Human
ugccugggcugcagggca

SEQ ID NO: 1280187 - RNA, 18 nt, Human
ugccugggcugcagggca

SEQ ID NO: 1280188 - RNA, 28 nt, Human
ugccugggcugcagggcagcccugcccu

SEQ ID NO: 1280189 - RNA, 19 nt, Human
ugcucucucaccccugccc

SEQ ID NO: 1280190 - RNA, 19 nt, Human
ugcucucucaccccugccc

SEQ ID NO: 1280191 - RNA, 24 nt, Human
uggaacacgcccccccacgccccc

SEQ ID NO: 1280192 - RNA, 19 nt, Human
uggaauggaacacgccccc

SEQ ID NO: 1280193 - RNA, 21 nt, Human
uggaccccacaggccacuccc

SEQ ID NO: 1280194 - RNA, 22 nt, Human
uggagaggcauggggggaaccc

SEQ ID NO: 1280195 - RNA, 18 nt, Human
uggcagaggaggaagggg

SEQ ID NO: 1280196 - RNA, 20 nt, Human
uggcccucccucccagccuc

SEQ ID NO: 1280197 - RNA, 19 nt, Human
ugggcugcagggcagcccu

SEQ ID NO: 1280198 - RNA, 23 nt, Human
ugggcuugggccgugggcagcag

SEQ ID NO: 1280199 - RNA, 19 nt, Human
ugucaggaggaaaccauuc

SEQ ID NO: 1280200 - RNA, 23 nt, Human
ugugagaaggaagguggccuccg

SEQ ID NO: 1280201 - RNA, 21 nt, Human
uguggacacaggcacacaugg

SEQ ID NO: 1280202 - RNA, 19 nt, Human
uuccagcaccuggaggccc

SEQ ID NO: 1280203 - RNA, 21 nt, Human
uucuccugcucccuccucacc

SEQ ID NO: 1280204 - RNA, 19 nt, Human
uugaaguuuccaacacagg

SEQ ID NO: 1280205 - RNA, 18 nt, Human
uugauaaaccguccaaaa

SEQ ID NO: 1280206 - RNA, 23 nt, Human
uugcagccuucugcccacacggg

SEQ ID NO: 1280207 - RNA, 19 nt, Human
uugcucucucaccccugcc

SEQ ID NO: 1280208 - RNA, 23 nt, Human
uugcucucuccucaccccugccc

SEQ ID NO: 1280209 - RNA, 23 nt, Human
accagaacagcacagagagccgg

SEQ ID NO: 1280210 - RNA, 24 nt, Human
accugaagauacuggaagcaguuu

SEQ ID NO: 1280211 - RNA, 19 nt, Human
agaaggagaggaccccaga

SEQ ID NO: 1280212 - RNA, 24 nt, Human
aggaccccagaacucagguccugg

SEQ ID NO: 1280213 - RNA, 23 nt, Human
aggagaggaccccagaacucagg

SEQ ID NO: 1280214 - RNA, 18 nt, Human
aggauccaccgggcuggg

SEQ ID NO: 1280215 - RNA, 18 nt, Human
aggcuggagucucccugc

SEQ ID NO: 1280216 - RNA, 26 nt, Human
aguccaggagcuucuccaaacaggug

SEQ ID NO: 1280217 - RNA, 19 nt, Human
auggugcugccucccuugg

SEQ ID NO: 1280218 - RNA, 18 nt, Human
cagaacucagguccugga

SEQ ID NO: 1280219 - RNA, 19 nt, Human
cagcuccaccaggcagggg

SEQ ID NO: 1280220 - RNA, 20 nt, Human
cagcugggcgcauucugggu

SEQ ID NO: 1280221 - RNA, 21 nt, Human
ccccagaggauccaccgggcu

SEQ ID NO: 1280222 - RNA, 20 nt, Human
ccgccgaggccacaaacagg

SEQ ID NO: 1280223 - RNA, 20 nt, Human
cgcauucuggguccauggug

SEQ ID NO: 1280224 - RNA, 20 nt, Human
cugcgaagguuccugccagg

SEQ ID NO: 1280225 - RNA, 18 nt, Human
cuggccgccgaggccaca

SEQ ID NO: 1280226 - RNA, 21 nt, Human
gaccuugcuucucuccugguc

SEQ ID NO: 1280227 - RNA, 18 nt, Human
gagaaggagaggacccca

SEQ ID NO: 1280228 - RNA, 20 nt, Human
gcccuggggcuggcaguguc

SEQ ID NO: 1280229 - RNA, 21 nt, Human
gcugggcuggagcccuggggc

SEQ ID NO: 1280230 - RNA, 24 nt, Human
gcugggcuggagcccuggggcugg

SEQ ID NO: 1280231 - RNA, 20 nt, Human
ggaagcaguuuuccugggcu

SEQ ID NO: 1280232 - RNA, 23 nt, Human
ggagcccuggggcuggcaguguc

SEQ ID NO: 1280233 - RNA, 24 nt, Human
ggagcuucuccaaacaggugucau

SEQ ID NO: 1280234 - RNA, 21 nt, Human
ggcagugucccacagaaggac

SEQ ID NO: 1280235 - RNA, 22 nt, Human
ggcugggcuggagcccuggggc

SEQ ID NO: 1280236 - RNA, 18 nt, Human
gggcuggagcccuggggc

SEQ ID NO: 1280237 - RNA, 21 nt, Human
gugcugccucccuugguccug

SEQ ID NO: 1280238 - RNA, 18 nt, Human
uaaaccaguccaggagcu

SEQ ID NO: 1280239 - RNA, 24 nt, Human
ucagugaccguuuuaaaccagucc

SEQ ID NO: 1280240 - RNA, 19 nt, Human
uccauggugaggccgcagg

SEQ ID NO: 1280241 - RNA, 22 nt, Human
ucccacagaaggacauggugcu

SEQ ID NO: 1280242 - RNA, 23 nt, Human
uccugagccccaguggcagacuc

SEQ ID NO: 1280243 - RNA, 21 nt, Human
uccugggcugcgaagguuccu

SEQ ID NO: 1280244 - RNA, 18 nt, Human
uccuucagugaccguuuu

SEQ ID NO: 1280245 - RNA, 19 nt, Human
ugaccguuuuaaaccaguc

SEQ ID NO: 1280246 - RNA, 30 nt, Human
uggacuuucagcacaugggacagcagcucu

SEQ ID NO: 1280247 - RNA, 21 nt, Human
uggccgccgaggccacaaaca

SEQ ID NO: 1280248 - RNA, 20 nt, Human
ugggacagcagcuccaccag

SEQ ID NO: 1280249 - RNA, 21 nt, Human
ugggaucuaccagaacagcac

SEQ ID NO: 1280250 - RNA, 23 nt, Human
uuccugggcugcgaagguuccug

SEQ ID NO: 1280251 - RNA, 20 nt, Human
aaacacugacacacagccuc

SEQ ID NO: 1280252 - RNA, 20 nt, Human
aagcacucauugacaaggcc

SEQ ID NO: 1280253 - RNA, 20 nt, Human
aagccagacccucccaaugu

SEQ ID NO: 1280254 - RNA, 18 nt, Human
aagcccagcaaacacuga

SEQ ID NO: 1280255 - RNA, 20 nt, Human
aauaaaaaagacaauaagga

SEQ ID NO: 1280256 - RNA, 21 nt, Human
aaugcuaggacacaucccaaa

SEQ ID NO: 1280257 - RNA, 19 nt, Human
accaugaacaacugacccg

SEQ ID NO: 1280258 - RNA, 22 nt, Human
agacaaaacugacuagagucua

SEQ ID NO: 1280259 - RNA, 20 nt, Human
agccaaaaaaggagccacaa

SEQ ID NO: 1280260 - RNA, 26 nt, Human
agccaaaaaaggagccacaagcccag

SEQ ID NO: 1280261 - RNA, 25 nt, Human
aggaggaggaaguccagcucagcaa

SEQ ID NO: 1280262 - RNA, 21 nt, Human
aucccccugcgcuuucuaucg

SEQ ID NO: 1280263 - RNA, 22 nt, Human
augaggaggaggaggaggaagu

SEQ ID NO: 1280264 - RNA, 21 nt, Human
caagcacucauugacaaggcc

SEQ ID NO: 1280265 - RNA, 20 nt, Human
caaggccaagugccucggcc

SEQ ID NO: 1280266 - RNA, 25 nt, Human
cacagaagcaguacaaaaacagcga

SEQ ID NO: 1280267 - RNA, 22 nt, Human
caccaugaacaacugacccgga

SEQ ID NO: 1280268 - RNA, 23 nt, Human
cacugugcaaagcuuacaccaug

SEQ ID NO: 1280269 - RNA, 20 nt, Human
cagcgcugagcgggucaaga

SEQ ID NO: 1280270 - RNA, 19 nt, Human
cagguuagaugucugugcc

SEQ ID NO: 1280271 - RNA, 26 nt, Human
ccagccaaaaaaggagccacaagccc

SEQ ID NO: 1280272 - RNA, 21 nt, Human
cccgcgccgggggccaucccc

SEQ ID NO: 1280273 - RNA, 24 nt, Human
ccuaugacucaaaauccuugaaac

SEQ ID NO: 1280274 - RNA, 21 nt, Human
cgcugagcgggucaagagccc

SEQ ID NO: 1280275 - RNA, 20 nt, Human
cugugcccagaaccccuaaa

SEQ ID NO: 1280276 - RNA, 21 nt, Human
cuuuauccagccaaaaaagga

SEQ ID NO: 1280277 - RNA, 23 nt, Human
gacacacagccucgagcacugcg

SEQ ID NO: 1280278 - RNA, 24 nt, Human
gagacaaaacugacuagagucuau

SEQ ID NO: 1280279 - RNA, 19 nt, Human
gcaguacaaaaacagcgac

SEQ ID NO: 1280280 - RNA, 23 nt, Human
gccacaagcccagcaaacacuga

SEQ ID NO: 1280281 - RNA, 21 nt, Human
gccuaagguucuggagacaaa

SEQ ID NO: 1280282 - RNA, 24 nt, Human
ggaaaacaagcacucauugacaag

SEQ ID NO: 1280283 - RNA, 22 nt, Human
ggaaaacaagccaagggugagc

SEQ ID NO: 1280284 - RNA, 26 nt, Human
ggacacaucccaaaacacacuaggca

SEQ ID NO: 1280285 - RNA, 21 nt, Human
gggcgguggggucagcgcuug

SEQ ID NO: 1280286 - RNA, 20 nt, Human
gggcucggggcucggggcag

SEQ ID NO: 1280287 - RNA, 24 nt, Human
ggucaugaggaggaggaggaggaa

SEQ ID NO: 1280288 - RNA, 20 nt, Human
guuuaaaggaaaacaagcac

SEQ ID NO: 1280289 - RNA, 21 nt, Human
guuuccccucccucuucugcu

SEQ ID NO: 1280290 - RNA, 25 nt, Human
guuuuuuuuuucaaucuuggaguua

SEQ ID NO: 1280291 - RNA, 19 nt, Human
uaaaaaagacaauaaggau

SEQ ID NO: 1280292 - RNA, 22 nt, Human
uaaaaaagacaauaaggauuaa

SEQ ID NO: 1280293 - RNA, 25 nt, Human
uacacagaggggaccagcuuggaau

SEQ ID NO: 1280294 - RNA, 18 nt, Human
uaccagguuagaugucug

SEQ ID NO: 1280295 - RNA, 18 nt, Human
uauagcuaugaggaacag

SEQ ID NO: 1280296 - RNA, 18 nt, Human
ucaaagaaguaggaaaau

SEQ ID NO: 1280297 - RNA, 20 nt, Human
ucaguagagugauacacaga

SEQ ID NO: 1280298 - RNA, 22 nt, Human
ugaaugacaguuuagccuugca

SEQ ID NO: 1280299 - RNA, 24 nt, Human
ugacccggaccacuaccauuccaa

SEQ ID NO: 1280300 - RNA, 22 nt, Human
ugacucaaaauccuugaaacaa

SEQ ID NO: 1280301 - RNA, 21 nt, Human
ugagcgggucaagagcccgcg

SEQ ID NO: 1280302 - RNA, 20 nt, Human
ugcaucugccccaagggcuu

SEQ ID NO: 1280303 - RNA, 20 nt, Human
ugcgagagagaguuccaugc

SEQ ID NO: 1280304 - RNA, 19 nt, Human
uggggucagcgcugagcgg

SEQ ID NO: 1280305 - RNA, 19 nt, Human
uguaaaugcuaggacacau

SEQ ID NO: 1280306 - RNA, 23 nt, Human
ugugaagagccacagaagcagua

SEQ ID NO: 1280307 - RNA, 19 nt, Human
uuaaacggaccccacaaua

SEQ ID NO: 1280308 - RNA, 22 nt, Human
uuaaaggaaaacaagcacucau

SEQ ID NO: 1280309 - RNA, 21 nt, Human
uuuccccucccucuucugcuu

SEQ ID NO: 1280310 - RNA, 18 nt, Human
uuuccuucuucuccaauu

SEQ ID NO: 1280311 - RNA, 24 nt, Human
uuuuugcaauaauugaggcacaac

SEQ ID NO: 1280312 - RNA, 24 nt, Human
aaagcagacuaggagcugugcaga

SEQ ID NO: 1280313 - RNA, 24 nt, Human
aaagugcugggauuacaggcauga

SEQ ID NO: 1280314 - RNA, 21 nt, Human
aaaugaucuucccaccucggc

SEQ ID NO: 1280315 - RNA, 22 nt, Human
aaccuaacaucacccagcguca

SEQ ID NO: 1280316 - RNA, 19 nt, Human
aagugcugggauuacaggc

SEQ ID NO: 1280317 - RNA, 21 nt, Human
aagugcugggauuacaggcau

SEQ ID NO: 1280318 - RNA, 26 nt, Human
aagugcugggauuacaggcaugagcc

SEQ ID NO: 1280319 - RNA, 20 nt, Human
accccaggcucugagcacac

SEQ ID NO: 1280320 - RNA, 22 nt, Human
accucauuucaucccgagccaa

SEQ ID NO: 1280321 - RNA, 18 nt, Human
acuggagacugugagaac

SEQ ID NO: 1280322 - RNA, 23 nt, Human
aggaggaugcuuugaugggucag

SEQ ID NO: 1280323 - RNA, 22 nt, Human
aggcaggugcgucaccccaggc

SEQ ID NO: 1280324 - RNA, 24 nt, Human
aggcaugagccagcaugccuguaa

SEQ ID NO: 1280325 - RNA, 23 nt, Human
aggugucuccacacccugacccc

SEQ ID NO: 1280326 - RNA, 18 nt, Human
agugcugggauuacaggc

SEQ ID NO: 1280327 - RNA, 21 nt, Human
auggcaggguacuggugggug

SEQ ID NO: 1280328 - RNA, 21 nt, Human
auugagcagccuuucucagca

SEQ ID NO: 1280329 - RNA, 24 nt, Human
caaagugcugggauuacaggcaug

SEQ ID NO: 1280330 - RNA, 20 nt, Human
cacacaccucauuucauccc

SEQ ID NO: 1280331 - RNA, 26 nt, Human
cacccagcgucaucugaagaaccugc

SEQ ID NO: 1280332 - RNA, 24 nt, Human
caccucggccucccaaagugcugg

SEQ ID NO: 1280333 - RNA, 19 nt, Human
cacucuguugcucuggcag

SEQ ID NO: 1280334 - RNA, 20 nt, Human
cacucuguugcucuggcagg

SEQ ID NO: 1280335 - RNA, 26 nt, Human
cagaaaccuaacaucacccagcguca

SEQ ID NO: 1280336 - RNA, 23 nt, Human
cagcaagucugacuccaaagccc

SEQ ID NO: 1280337 - RNA, 23 nt, Human
cagcaugccuguaaacuggcugc

SEQ ID NO: 1280338 - RNA, 24 nt, Human
cagcccccaggugcucaggcucaa

SEQ ID NO: 1280339 - RNA, 21 nt, Human
cagcgucaucugaagaaccug

SEQ ID NO: 1280340 - RNA, 23 nt, Human
ccaaagugcugggauuacaggca

SEQ ID NO: 1280341 - RNA, 24 nt, Human
ccaaagugcugggauuacaggcau

SEQ ID NO: 1280342 - RNA, 23 nt, Human
ccagaaaccuaacaucacccagc

SEQ ID NO: 1280343 - RNA, 20 nt, Human
ccagcgucaucugaagaacc

SEQ ID NO: 1280344 - RNA, 24 nt, Human
cccaaagugcugggauuacaggca

SEQ ID NO: 1280345 - RNA, 19 nt, Human
cccagggaaucaggaggau

SEQ ID NO: 1280346 - RNA, 18 nt, Human
cccgagccaacacugcuc

SEQ ID NO: 1280347 - RNA, 18 nt, Human
ccuccugcagaagccgaa

SEQ ID NO: 1280348 - RNA, 18 nt, Human
ccuuccugucuccucucc

SEQ ID NO: 1280349 - RNA, 20 nt, Human
cuauugucccauggcagggu

SEQ ID NO: 1280350 - RNA, 19 nt, Human
cucacggaggcuucaaagc

SEQ ID NO: 1280351 - RNA, 25 nt, Human
cugagcacacaccucauuucauccc

SEQ ID NO: 1280352 - RNA, 19 nt, Human
cuggaagaagccgcugaag

SEQ ID NO: 1280353 - RNA, 19 nt, Human
cuggcaggucuugaacucc

SEQ ID NO: 1280354 - RNA, 23 nt, Human
cuggcaggucuugaacuccuggg

SEQ ID NO: 1280355 - RNA, 22 nt, Human
cuucccaaucccuguuuuugac

SEQ ID NO: 1280356 - RNA, 18 nt, Human
gauuacaggcaugagcca

SEQ ID NO: 1280357 - RNA, 22 nt, Human
gauuacaggcaugagccagcau

SEQ ID NO: 1280358 - RNA, 22 nt, Human
gccucuugugaagggccugucc

SEQ ID NO: 1280359 - RNA, 19 nt, Human
ggacguugaggccuaaagu

SEQ ID NO: 1280360 - RNA, 24 nt, Human
ggauuacaggcaugagccagcaug

SEQ ID NO: 1280361 - RNA, 20 nt, Human
gucucacucuguugcucugg

SEQ ID NO: 1280362 - RNA, 23 nt, Human
guugcucugaugucacuggagac

SEQ ID NO: 1280363 - RNA, 22 nt, Human
uaacuuccaagucgagcccagu

SEQ ID NO: 1280364 - RNA, 22 nt, Human
uacaggcaugagccagcaugcc

SEQ ID NO: 1280365 - RNA, 23 nt, Human
uagagacaggggucucacucugu

SEQ ID NO: 1280366 - RNA, 24 nt, Human
uaggugucuccacacccugacccc

SEQ ID NO: 1280367 - RNA, 20 nt, Human
ucacugugguugcucugaug

SEQ ID NO: 1280368 - RNA, 18 nt, Human
uccaaagcccgugugccc

SEQ ID NO: 1280369 - RNA, 21 nt, Human
uccacacccugaccccaaucc

SEQ ID NO: 1280370 - RNA, 24 nt, Human
uccagaaaccuaacaucacccagc

SEQ ID NO: 1280371 - RNA, 24 nt, Human
ucccaaagugcugggauuacaggc

SEQ ID NO: 1280372 - RNA, 24 nt, Human
ucccuaaggauuuucuuguugcuu

SEQ ID NO: 1280373 - RNA, 18 nt, Human
ucggccucccaaagugcu

SEQ ID NO: 1280374 - RNA, 19 nt, Human
ucucacucuguugcucugg

SEQ ID NO: 1280375 - RNA, 24 nt, Human
ucuggcaggucuugaacuccuggg

SEQ ID NO: 1280376 - RNA, 19 nt, Human
ugaaggcaccauguguauc

SEQ ID NO: 1280377 - RNA, 18 nt, Human
ugacuccaaagcccgugu

SEQ ID NO: 1280378 - RNA, 19 nt, Human
ugacuucugcuuuuuggau

SEQ ID NO: 1280379 - RNA, 21 nt, Human
ugagcuguucauagaaauggg

SEQ ID NO: 1280380 - RNA, 18 nt, Human
ugaguuuuuggaacugaa

SEQ ID NO: 1280381 - RNA, 19 nt, Human
ugaugucacuggagacugu

SEQ ID NO: 1280382 - RNA, 24 nt, Human
ugcacagaaaaaugaaacuguugu

SEQ ID NO: 1280383 - RNA, 21 nt, Human
uggaagaagccgcugaaggca

SEQ ID NO: 1280384 - RNA, 18 nt, Human
ugggauuacaggcaugag

SEQ ID NO: 1280385 - RNA, 19 nt, Human
ugggauuacaggcaugagc

SEQ ID NO: 1280386 - RNA, 21 nt, Human
ugggauuacaggcaugagcca

SEQ ID NO: 1280387 - RNA, 22 nt, Human
ugggauuacaggcaugagccag

SEQ ID NO: 1280388 - RNA, 23 nt, Human
ugggauuacaggcaugagccagc

SEQ ID NO: 1280389 - RNA, 24 nt, Human
ugggauuacaggcaugagccagca

SEQ ID NO: 1280390 - RNA, 25 nt, Human
ugggauuacaggcaugagccagcau

SEQ ID NO: 1280391 - RNA, 27 nt, Human
ugggauuacaggcaugagccagcaugc

SEQ ID NO: 1280392 - RNA, 22 nt, Human
uuacauuaggugucuccacacc

SEQ ID NO: 1280393 - RNA, 27 nt, Human
uucaaagcaggggaggacuugguugga

SEQ ID NO: 1280394 - RNA, 24 nt, Human
uugacagaugaggacguugaggcc

SEQ ID NO: 1280395 - RNA, 21 nt, Human
uuucugucccauugcuggaag

SEQ ID NO: 1280396 - RNA, 18 nt, Human
uuucuuguugcuuuuaaa

SEQ ID NO: 1280397 - RNA, 20 nt, Human
uuuggaacugaaagcagacu

SEQ ID NO: 1280398 - RNA, 18 nt, Human
uuuuuuuguagagacagg

SEQ ID NO: 1280399 - RNA, 30 nt, Human
uuuuuuuuuuuguagagacaggggucucaa

SEQ ID NO: 1280400 - RNA, 27 nt, Human
uuuuuuuuuuuuuuuguagagacaggg

SEQ ID NO: 1280401 - RNA, 19 nt, Human
ccugucagacagugguuac

SEQ ID NO: 1280402 - RNA, 22 nt, Human
cuugcagaauuaccauuuggga

SEQ ID NO: 1280403 - RNA, 22 nt, Human
ucagacagugguuacugauuaa

SEQ ID NO: 1280404 - RNA, 22 nt, Human
uugcuugcagaauuaccauuug

SEQ ID NO: 1280405 - RNA, 19 nt, Human
aaaaagaaacaaaccugcu

SEQ ID NO: 1280406 - RNA, 22 nt, Human
aaaagaaaaagaaacaaaccug

SEQ ID NO: 1280407 - RNA, 21 nt, Human
aaaaggaaacuugccauaccc

SEQ ID NO: 1280408 - RNA, 19 nt, Human
aaacagaugaaguugggac

SEQ ID NO: 1280409 - RNA, 24 nt, Human
aaacagaugaaguugggacaaaac

SEQ ID NO: 1280410 - RNA, 21 nt, Human
aaacaugagcuugaaacagaa

SEQ ID NO: 1280411 - RNA, 19 nt, Human
aaacuugccauacccucua

SEQ ID NO: 1280412 - RNA, 22 nt, Human
aaaggaagaaggaauaggggag

SEQ ID NO: 1280413 - RNA, 21 nt, Human
aagaaacauuuccaaaaaacc

SEQ ID NO: 1280414 - RNA, 24 nt, Human
aagacaggcagaaaagccugagga

SEQ ID NO: 1280415 - RNA, 23 nt, Human
aagaggagguagaaagaggggac

SEQ ID NO: 1280416 - RNA, 23 nt, Human
aagcagcgcuggccauggucucc

SEQ ID NO: 1280417 - RNA, 18 nt, Human
aagggugugagccgcugg

SEQ ID NO: 1280418 - RNA, 20 nt, Human
aaucucugcccuggcacccc

SEQ ID NO: 1280419 - RNA, 22 nt, Human
acaaaaauagacuccggaaagu

SEQ ID NO: 1280420 - RNA, 20 nt, Human
acagaaagcagcgcuggcca

SEQ ID NO: 1280421 - RNA, 22 nt, Human
acagcauugagugaagugcgcc

SEQ ID NO: 1280422 - RNA, 30 nt, Human
accaugcuacgaaccauuaggcaaacaucu

SEQ ID NO: 1280423 - RNA, 18 nt, Human
accccaggaggagggagc

SEQ ID NO: 1280424 - RNA, 23 nt, Human
acccucuaauuuuggaaagacug

SEQ ID NO: 1280425 - RNA, 26 nt, Human
accuuagcaucccugccuggccguca

SEQ ID NO: 1280426 - RNA, 19 nt, Human
acgcugacagcacagaauc

SEQ ID NO: 1280427 - RNA, 23 nt, Human
agaaaaaaggaaacuugccauac

SEQ ID NO: 1280428 - RNA, 18 nt, Human
agaaaagaaaaagaaaca

SEQ ID NO: 1280429 - RNA, 25 nt, Human
agaaaaggaagaaggaauaggggag

SEQ ID NO: 1280430 - RNA, 20 nt, Human
agaagggagggaaggaagga

SEQ ID NO: 1280431 - RNA, 21 nt, Human
agagagcagucaucagagugc

SEQ ID NO: 1280432 - RNA, 26 nt, Human
agagaggaaggaagggagggaaggag

SEQ ID NO: 1280433 - RNA, 22 nt, Human
agagaggaagggagggagggaa

SEQ ID NO: 1280434 - RNA, 24 nt, Human
agaggaaggaagggagggaaggag

SEQ ID NO: 1280435 - RNA, 18 nt, Human
agaggaagggaggaagga

SEQ ID NO: 1280436 - RNA, 19 nt, Human
agaggaagggagggaggga

SEQ ID NO: 1280437 - RNA, 26 nt, Human
agaggaagggagggagggaaagaagg

SEQ ID NO: 1280438 - RNA, 22 nt, Human
agagggaggggacggccuggug

SEQ ID NO: 1280439 - RNA, 19 nt, Human
agagggggcagcagcagcg

SEQ ID NO: 1280440 - RNA, 19 nt, Human
agagucccuccgaggcauu

SEQ ID NO: 1280441 - RNA, 26 nt, Human
agcacagaauccaggcaauauccaca

SEQ ID NO: 1280442 - RNA, 22 nt, Human
aggaaggaagggagggaaggag

SEQ ID NO: 1280443 - RNA, 18 nt, Human
aggaaggaggggaaggaa

SEQ ID NO: 1280444 - RNA, 20 nt, Human
aggaaggaggggaaggaagg

SEQ ID NO: 1280445 - RNA, 21 nt, Human
aggaagggaggaaggaaggaa

SEQ ID NO: 1280446 - RNA, 18 nt, Human
aggaagggagggaaggag

SEQ ID NO: 1280447 - RNA, 19 nt, Human
aggaagggagggaaggagg

SEQ ID NO: 1280448 - RNA, 25 nt, Human
aggcaauauccacacccucugccca

SEQ ID NO: 1280449 - RNA, 21 nt, Human
agggaggaaggaaggaaagga

SEQ ID NO: 1280450 - RNA, 27 nt, Human
agggagggaaagaagggagggaaggaa

SEQ ID NO: 1280451 - RNA, 18 nt, Human
agggagggagggaaagaa

SEQ ID NO: 1280452 - RNA, 19 nt, Human
agggagggagggaaagaag

SEQ ID NO: 1280453 - RNA, 19 nt, Human
aggggaaggaagggaggag

SEQ ID NO: 1280454 - RNA, 21 nt, Human
aggggagagaggaagggaggg

SEQ ID NO: 1280455 - RNA, 19 nt, Human
aggggcuugggcuggaccg

SEQ ID NO: 1280456 - RNA, 21 nt, Human
auaaaaaggcaccuggagaca

SEQ ID NO: 1280457 - RNA, 23 nt, Human
aucacuuaucagauuuuuuucuu

SEQ ID NO: 1280458 - RNA, 24 nt, Human
auccaaccuccaucuuccuaggcu

SEQ ID NO: 1280459 - RNA, 19 nt, Human
augcagaaguggcuuuggg

SEQ ID NO: 1280460 - RNA, 24 nt, Human
augccgcauugcucugggaggcca

SEQ ID NO: 1280461 - RNA, 23 nt, Human
caaaccccaggagccgccgagga

SEQ ID NO: 1280462 - RNA, 24 nt, Human
cacaauuucagaaaaaguuguagg

SEQ ID NO: 1280463 - RNA, 18 nt, Human
cacccaucccuguggcuc

SEQ ID NO: 1280464 - RNA, 24 nt, Human
caccuuagcaucccugccuggccg

SEQ ID NO: 1280465 - RNA, 18 nt, Human
cacuccgugaccacaucc

SEQ ID NO: 1280466 - RNA, 22 nt, Human
cagaaaagccugaggaccgcac

SEQ ID NO: 1280467 - RNA, 19 nt, Human
cagacagugacggcugagc

SEQ ID NO: 1280468 - RNA, 21 nt, Human
cagcagcgccagugguggaga

SEQ ID NO: 1280469 - RNA, 24 nt, Human
cagcagcgccagugguggagaagc

SEQ ID NO: 1280470 - RNA, 20 nt, Human
caggaaccugaaagccgacu

SEQ ID NO: 1280471 - RNA, 18 nt, Human
caggcaauauccacaccc

SEQ ID NO: 1280472 - RNA, 20 nt, Human
cagucgucuguugcaaagau

SEQ ID NO: 1280473 - RNA, 18 nt, Human
caguuguccccuacccuc

SEQ ID NO: 1280474 - RNA, 18 nt, Human
cauuccaucuagccuggc

SEQ ID NO: 1280475 - RNA, 19 nt, Human
cauuccaucuagccuggcu

SEQ ID NO: 1280476 - RNA, 18 nt, Human
ccagccuauacaaaacuc

SEQ ID NO: 1280477 - RNA, 21 nt, Human
ccagucgucuguugcaaagau

SEQ ID NO: 1280478 - RNA, 21 nt, Human
ccagugggcaccagcagugcu

SEQ ID NO: 1280479 - RNA, 19 nt, Human
cccauguacaaagcugaac

SEQ ID NO: 1280480 - RNA, 20 nt, Human
cccugaagauaaggaguuag

SEQ ID NO: 1280481 - RNA, 25 nt, Human
ccgcggaguugaccgugugcugugu

SEQ ID NO: 1280482 - RNA, 23 nt, Human
ccguuccauccagacccgggacc

SEQ ID NO: 1280483 - RNA, 18 nt, Human
ccucaccuuucagacugg

SEQ ID NO: 1280484 - RNA, 20 nt, Human
ccucauggcugcagagagca

SEQ ID NO: 1280485 - RNA, 20 nt, Human
ccuccacucccucuccccgc

SEQ ID NO: 1280486 - RNA, 19 nt, Human
cgacuccuugacuagacac

SEQ ID NO: 1280487 - RNA, 23 nt, Human
cgagcagccagcagaagccagga

SEQ ID NO: 1280488 - RNA, 18 nt, Human
cgaggggguguggccugg

SEQ ID NO: 1280489 - RNA, 22 nt, Human
cgccagugggcaccagcagugc

SEQ ID NO: 1280490 - RNA, 23 nt, Human
cgccagugguggagaagcggugg

SEQ ID NO: 1280491 - RNA, 27 nt, Human
cgccagugguggagaagcgguggcugc

SEQ ID NO: 1280492 - RNA, 20 nt, Human
cgugcaggaggccgaggggg

SEQ ID NO: 1280493 - RNA, 20 nt, Human
cucauccggggaacuguggg

SEQ ID NO: 1280494 - RNA, 21 nt, Human
cugaaggcgaggcuggggaga

SEQ ID NO: 1280495 - RNA, 24 nt, Human
cugagccacaccuuagcaucccug

SEQ ID NO: 1280496 - RNA, 21 nt, Human
cugcauguggccaggagacug

SEQ ID NO: 1280497 - RNA, 24 nt, Human
cugcccguuugccgugcacugggg

SEQ ID NO: 1280498 - RNA, 19 nt, Human
cuggguccccucucccugg

SEQ ID NO: 1280499 - RNA, 20 nt, Human
gaaaacccgagagcaacaaa

SEQ ID NO: 1280500 - RNA, 18 nt, Human
gaaagaagagaggaaggg

SEQ ID NO: 1280501 - RNA, 22 nt, Human
gaaauaaaaaccaugcuacgaa

SEQ ID NO: 1280502 - RNA, 18 nt, Human
gaagaggagguagaaaga

SEQ ID NO: 1280503 - RNA, 18 nt, Human
gaaggaaggaaaggaggg

SEQ ID NO: 1280504 - RNA, 20 nt, Human
gaagggaggagagaaaaaag

SEQ ID NO: 1280505 - RNA, 25 nt, Human
gaagggagggagggaaagaagggag

SEQ ID NO: 1280506 - RNA, 21 nt, Human
gacccgggcugagggguggac

SEQ ID NO: 1280507 - RNA, 24 nt, Human
gacccuccacucccucuccccgcu

SEQ ID NO: 1280508 - RNA, 20 nt, Human
gagcucugcacacccauccc

SEQ ID NO: 1280509 - RNA, 21 nt, Human
gaggaaggaaggaaaggaggg

SEQ ID NO: 1280510 - RNA, 18 nt, Human
gaggaccgcaccacugca

SEQ ID NO: 1280511 - RNA, 21 nt, Human
gaggcauggccaucucugagc

SEQ ID NO: 1280512 - RNA, 22 nt, Human
gagggaaggaaggaggaaagag

SEQ ID NO: 1280513 - RNA, 18 nt, Human
gagggaaggagggaggga

SEQ ID NO: 1280514 - RNA, 20 nt, Human
gaggggacggccuggugugc

SEQ ID NO: 1280515 - RNA, 23 nt, Human
gagggguaaaggaaaggaaggag

SEQ ID NO: 1280516 - RNA, 19 nt, Human
gaucucaccugacccucca

SEQ ID NO: 1280517 - RNA, 26 nt, Human
gcacaauuucagaaaaaggggaacgc

SEQ ID NO: 1280518 - RNA, 18 nt, Human
gcaccugcccguuugccg

SEQ ID NO: 1280519 - RNA, 18 nt, Human
gcacuguccacuguggug

SEQ ID NO: 1280520 - RNA, 19 nt, Human
gcagcagcagcgccagugg

SEQ ID NO: 1280521 - RNA, 20 nt, Human
gccaaaaucuaccuggaaac

SEQ ID NO: 1280522 - RNA, 21 nt, Human
gccacauccucauggcugcag

SEQ ID NO: 1280523 - RNA, 20 nt, Human
gccaggagacuggcuccugg

SEQ ID NO: 1280524 - RNA, 19 nt, Human
gcgaggcuggggagagggg

SEQ ID NO: 1280525 - RNA, 21 nt, Human
gcucuucaaaccccaggagcc

SEQ ID NO: 1280526 - RNA, 22 nt, Human
gcuggaccgauucacccagaag

SEQ ID NO: 1280527 - RNA, 19 nt, Human
ggaaaacaugagcuugaaa

SEQ ID NO: 1280528 - RNA, 18 nt, Human
ggaaagagaggaaggaag

SEQ ID NO: 1280529 - RNA, 18 nt, Human
ggaaaggaaggaggggaa

SEQ ID NO: 1280530 - RNA, 25 nt, Human
ggaaaggagggguaaaggaaaggaa

SEQ ID NO: 1280531 - RNA, 19 nt, Human
ggaaggagggagggaggga

SEQ ID NO: 1280532 - RNA, 20 nt, Human
ggaaggagggagggagggag

SEQ ID NO: 1280533 - RNA, 19 nt, Human
ggacugggagagggggcag

SEQ ID NO: 1280534 - RNA, 22 nt, Human
ggagggaggaaagaagagagga

SEQ ID NO: 1280535 - RNA, 19 nt, Human
ggagggagggagggaggaa

SEQ ID NO: 1280536 - RNA, 19 nt, Human
ggagggagggagggaggaa

SEQ ID NO: 1280537 - RNA, 18 nt, Human
ggaggggacggccuggug

SEQ ID NO: 1280538 - RNA, 23 nt, Human
ggcaauauccacacccucugccc

SEQ ID NO: 1280539 - RNA, 18 nt, Human
ggcaggcucagcucauga

SEQ ID NO: 1280540 - RNA, 21 nt, Human
ggccacacuuucugcaugugg

SEQ ID NO: 1280541 - RNA, 19 nt, Human
ggccagcgugguggcuucc

SEQ ID NO: 1280542 - RNA, 18 nt, Human
ggcuggggaggucugagg

SEQ ID NO: 1280543 - RNA, 23 nt, Human
gggaaggaaggaggaaagagagg

SEQ ID NO: 1280544 - RNA, 22 nt, Human
gggaaggagagggccagcgugg

SEQ ID NO: 1280545 - RNA, 23 nt, Human
gggagggaggaaagaagagagga

SEQ ID NO: 1280546 - RNA, 23 nt, Human
gggagggagggaggaaagaagag

SEQ ID NO: 1280547 - RNA, 21 nt, Human
gggcagcagcagcgccagugg

SEQ ID NO: 1280548 - RNA, 22 nt, Human
gggcagcagcagcgccaguggu

SEQ ID NO: 1280549 - RNA, 20 nt, Human
gggcuggggaggucugaggu

SEQ ID NO: 1280550 - RNA, 23 nt, Human
gggggccggccggggcagcucug

SEQ ID NO: 1280551 - RNA, 18 nt, Human
ggguggucuugagucuug

SEQ ID NO: 1280552 - RNA, 18 nt, Human
gguagaaagagacggggg

SEQ ID NO: 1280553 - RNA, 18 nt, Human
gguggagaagcgguggcu

SEQ ID NO: 1280554 - RNA, 21 nt, Human
gucgucuguugcaaagaugac

SEQ ID NO: 1280555 - RNA, 22 nt, Human
gugggcaccagcagugcucccg

SEQ ID NO: 1280556 - RNA, 18 nt, Human
uaaaaucaucacuuauca

SEQ ID NO: 1280557 - RNA, 21 nt, Human
uaagacgucucaacacucucc

SEQ ID NO: 1280558 - RNA, 25 nt, Human
uaaguuuuccaaaguaguucauacu

SEQ ID NO: 1280559 - RNA, 19 nt, Human
uacuaagaguggaggggag

SEQ ID NO: 1280560 - RNA, 19 nt, Human
uacugcucaguuguccccu

SEQ ID NO: 1280561 - RNA, 25 nt, Human
uagcaucccugccuggccgucagga

SEQ ID NO: 1280562 - RNA, 20 nt, Human
uagggaacguuuagggaccu

SEQ ID NO: 1280563 - RNA, 19 nt, Human
uaggggagagaggaaggga

SEQ ID NO: 1280564 - RNA, 20 nt, Human
ucaccugacccuccacuccc

SEQ ID NO: 1280565 - RNA, 18 nt, Human
ucacgcugcugcugguga

SEQ ID NO: 1280566 - RNA, 19 nt, Human
ucacugggggaacggcacc

SEQ ID NO: 1280567 - RNA, 25 nt, Human
ucagaaacagaugaaguugggacaa

SEQ ID NO: 1280568 - RNA, 21 nt, Human
ucaggugagaaggaaggggga

SEQ ID NO: 1280569 - RNA, 21 nt, Human
ucaucacuuaucagauuuuuu

SEQ ID NO: 1280570 - RNA, 21 nt, Human
uccaaaaaaccuguuaaggcu

SEQ ID NO: 1280571 - RNA, 19 nt, Human
uccacucagaaaaaggagg

SEQ ID NO: 1280572 - RNA, 20 nt, Human
ucccaggccccggaggugcc

SEQ ID NO: 1280573 - RNA, 19 nt, Human
ucccggggcuguggaggcg

SEQ ID NO: 1280574 - RNA, 18 nt, Human
ucccguguccucgugucc

SEQ ID NO: 1280575 - RNA, 22 nt, Human
ucucaugggacagagucccucc

SEQ ID NO: 1280576 - RNA, 21 nt, Human
ugaaaagggguuuuccagccu

SEQ ID NO: 1280577 - RNA, 19 nt, Human
ugacccuccacucccucuc

SEQ ID NO: 1280578 - RNA, 20 nt, Human
ugacgugaggggcuggaggc

SEQ ID NO: 1280579 - RNA, 18 nt, Human
ugagaucucaccugaccc

SEQ ID NO: 1280580 - RNA, 21 nt, Human
ugagcuguuaaguuuuccaaa

SEQ ID NO: 1280581 - RNA, 21 nt, Human
ugagggggcacuuacagggac

SEQ ID NO: 1280582 - RNA, 24 nt, Human
ugcagagagcagucaucagagugc

SEQ ID NO: 1280583 - RNA, 23 nt, Human
ugcaggguggggccgaagcaauc

SEQ ID NO: 1280584 - RNA, 24 nt, Human
ugccaagaaugcguaagaaauaaa

SEQ ID NO: 1280585 - RNA, 24 nt, Human
ugccuggaaucucugcccuggcac

SEQ ID NO: 1280586 - RNA, 18 nt, Human
uggaaacauccagcucug

SEQ ID NO: 1280587 - RNA, 21 nt, Human
uggaagaggagguagaaagga

SEQ ID NO: 1280588 - RNA, 19 nt, Human
uggaccauggcagcccagu

SEQ ID NO: 1280589 - RNA, 18 nt, Human
uggcuccuggguggcacu

SEQ ID NO: 1280590 - RNA, 19 nt, Human
ugggagagggggcagcagc

SEQ ID NO: 1280591 - RNA, 18 nt, Human
uggggaggucugaggucc

SEQ ID NO: 1280592 - RNA, 23 nt, Human
uggggguggguggggagacucag

SEQ ID NO: 1280593 - RNA, 24 nt, Human
uggguccccucucccuggggcccc

SEQ ID NO: 1280594 - RNA, 18 nt, Human
ugguggcuuccagcccua

SEQ ID NO: 1280595 - RNA, 24 nt, Human
uguagggaacguuuagggaccuga

SEQ ID NO: 1280596 - RNA, 21 nt, Human
ugugugucacgcugcugcugg

SEQ ID NO: 1280597 - RNA, 27 nt, Human
uuaaaaccgagauuaaaauccaacuga

SEQ ID NO: 1280598 - RNA, 21 nt, Human
uuaaaccaaacaaugacaauu

SEQ ID NO: 1280599 - RNA, 20 nt, Human
uuccuaguuggucuugaaga

SEQ ID NO: 1280600 - RNA, 21 nt, Human
uuccuaguuggucuugaagac

SEQ ID NO: 1280601 - RNA, 20 nt, Human
uucggggaaggagagggcca

SEQ ID NO: 1280602 - RNA, 21 nt, Human
uucggggaaggagagggccag

SEQ ID NO: 1280603 - RNA, 23 nt, Human
uucggggaaggagagggccagcg

SEQ ID NO: 1280604 - RNA, 21 nt, Human
uuggucuugaagacggagaaa

SEQ ID NO: 1280605 - RNA, 23 nt, Human
uuuuucuuuuuaaacaaaaacuu

SEQ ID NO: 1280606 - RNA, 19 nt, Human
aggaacucgaacucgcggc

SEQ ID NO: 1280607 - RNA, 21 nt, Human
ccgcgccagcgccggccccgg

SEQ ID NO: 1280608 - RNA, 23 nt, Human
ccggccccgggcucugccguacc

SEQ ID NO: 1280609 - RNA, 23 nt, Human
cgccagcgccggccccgggcucc

SEQ ID NO: 1280610 - RNA, 21 nt, Human
cgcugggugagucccacuccc

SEQ ID NO: 1280611 - RNA, 18 nt, Human
gagucccacucccccgcg

SEQ ID NO: 1280612 - RNA, 19 nt, Human
ggcccuccagccgcgccag

SEQ ID NO: 1280613 - RNA, 18 nt, Human
uccagccgcgccagcgcc

SEQ ID NO: 1280614 - RNA, 24 nt, Human
aauuucuccucuguaagaauggcu

SEQ ID NO: 1280615 - RNA, 18 nt, Human
agaaacgugcuccacucc

SEQ ID NO: 1280616 - RNA, 21 nt, Human
agggaugaucuggcugucacc

SEQ ID NO: 1280617 - RNA, 19 nt, Human
cagagccuggggggcgcgg

SEQ ID NO: 1280618 - RNA, 18 nt, Human
cccaaacgaccucucaag

SEQ ID NO: 1280619 - RNA, 19 nt, Human
cccgagccggagcuggagg

SEQ ID NO: 1280620 - RNA, 19 nt, Human
ccuaaagcccaaacgaccu

SEQ ID NO: 1280621 - RNA, 21 nt, Human
cgcggguagcuggcagagccu

SEQ ID NO: 1280622 - RNA, 21 nt, Human
cggagccggagcccgagccgg

SEQ ID NO: 1280623 - RNA, 21 nt, Human
cggguagcuggcagagccugg

SEQ ID NO: 1280624 - RNA, 23 nt, Human
cuggccccgggcucagagcgcgg

SEQ ID NO: 1280625 - RNA, 23 nt, Human
cugucaccagaagucaccuugga

SEQ ID NO: 1280626 - RNA, 20 nt, Human
gagccggagcccgagccgga

SEQ ID NO: 1280627 - RNA, 20 nt, Human
gagccggagccggagcccga

SEQ ID NO: 1280628 - RNA, 22 nt, Human
gcagcagcagguuggagggcgc

SEQ ID NO: 1280629 - RNA, 21 nt, Human
gcccgagccggagcuggaggc

SEQ ID NO: 1280630 - RNA, 23 nt, Human
gcggcggcagcagcagguuggag

SEQ ID NO: 1280631 - RNA, 21 nt, Human
gcuuucuuucucgcuggggac

SEQ ID NO: 1280632 - RNA, 22 nt, Human
ggcggcagcagcagguuggagg

SEQ ID NO: 1280633 - RNA, 19 nt, Human
ggcggcggcagcagcaggu

SEQ ID NO: 1280634 - RNA, 18 nt, Human
gggaccuggucggcgccc

SEQ ID NO: 1280635 - RNA, 24 nt, Human
gggcgcgcggcgggggccaagggg

SEQ ID NO: 1280636 - RNA, 18 nt, Human
gggcgcggcggcggcagc

SEQ ID NO: 1280637 - RNA, 22 nt, Human
ggggggcgcggcggcggcagca

SEQ ID NO: 1280638 - RNA, 23 nt, Human
uaaaugcuuucuuucucgcuggg

SEQ ID NO: 1280639 - RNA, 18 nt, Human
uaagaauggcuaaaugcu

SEQ ID NO: 1280640 - RNA, 21 nt, Human
uccacuccuaaagcccaaacg

SEQ ID NO: 1280641 - RNA, 22 nt, Human
ucuuucucgcuggggacucgag

SEQ ID NO: 1280642 - RNA, 20 nt, Human
ugaagauguuaauguugcuu

SEQ ID NO: 1280643 - RNA, 18 nt, Human
uggcagagccuggggggc

SEQ ID NO: 1280644 - RNA, 20 nt, Human
uggcagagccuggggggcgg

SEQ ID NO: 1280645 - RNA, 22 nt, Human
uuccaugggaaucuggccccgg

SEQ ID NO: 1280646 - RNA, 19 nt, Human
aaagugcugggauuccagg

SEQ ID NO: 1280647 - RNA, 24 nt, Human
aaagugcugggauuccaggcggga

SEQ ID NO: 1280648 - RNA, 24 nt, Human
aacgauucuccugccucagccucc

SEQ ID NO: 1280649 - RNA, 20 nt, Human
aaggggcucaccagagcucc

SEQ ID NO: 1280650 - RNA, 19 nt, Human
aagugcugggauuccaggc

SEQ ID NO: 1280651 - RNA, 24 nt, Human
aauuacaggcacaugcugucaugc

SEQ ID NO: 1280652 - RNA, 25 nt, Human
acccgccuuggccucccaaagugcu

SEQ ID NO: 1280653 - RNA, 22 nt, Human
acgcagugaagcaggaagguuu

SEQ ID NO: 1280654 - RNA, 20 nt, Human
aggaauccaccuuguagacc

SEQ ID NO: 1280655 - RNA, 22 nt, Human
aggcauugguggucgccgagcu

SEQ ID NO: 1280656 - RNA, 24 nt, Human
aggcauugguggucgccgagcuga

SEQ ID NO: 1280657 - RNA, 22 nt, Human
aggcgggagcacugugcccggc

SEQ ID NO: 1280658 - RNA, 25 nt, Human
aggcuggagugcagugguacuaucu

SEQ ID NO: 1280659 - RNA, 24 nt, Human
aggugauccacccgccuuggccuc

SEQ ID NO: 1280660 - RNA, 18 nt, Human
aguagcuggaauuacagg

SEQ ID NO: 1280661 - RNA, 18 nt, Human
augggguuucgccauguu

SEQ ID NO: 1280662 - RNA, 24 nt, Human
augggguuucgccauguuggccag

SEQ ID NO: 1280663 - RNA, 20 nt, Human
caaacgauucuccugccuca

SEQ ID NO: 1280664 - RNA, 22 nt, Human
caaacgauucuccugccucagc

SEQ ID NO: 1280665 - RNA, 19 nt, Human
caagaagcucucagagccu

SEQ ID NO: 1280666 - RNA, 26 nt, Human
caagugccuuuacuucucugggcuuc

SEQ ID NO: 1280667 - RNA, 24 nt, Human
caaugagcuccugcccaaaaacuc

SEQ ID NO: 1280668 - RNA, 23 nt, Human
cacccgccuuggccucccaaagu

SEQ ID NO: 1280669 - RNA, 24 nt, Human
cacccgccuuggccucccaaagug

SEQ ID NO: 1280670 - RNA, 21 nt, Human
cacugcaaccuccgccuccug

SEQ ID NO: 1280671 - RNA, 23 nt, Human
cacugcaaccuccgccuccuggg

SEQ ID NO: 1280672 - RNA, 21 nt, Human
cagaaacagaugcuagcguug

SEQ ID NO: 1280673 - RNA, 20 nt, Human
cagagccugagcccuggguc

SEQ ID NO: 1280674 - RNA, 20 nt, Human
caggcagcccuggguggggg

SEQ ID NO: 1280675 - RNA, 19 nt, Human
cagggccgggguccuggug

SEQ ID NO: 1280676 - RNA, 19 nt, Human
cauguuggccaggcugguc

SEQ ID NO: 1280677 - RNA, 18 nt, Human
ccaaagugcugggauucc

SEQ ID NO: 1280678 - RNA, 23 nt, Human
ccaccgccuccccaggaauccac

SEQ ID NO: 1280679 - RNA, 21 nt, Human
ccaggcuggucuuccuggccu

SEQ ID NO: 1280680 - RNA, 19 nt, Human
ccauguuggccaggcuggu

SEQ ID NO: 1280681 - RNA, 21 nt, Human
ccauguuggccaggcuggucu

SEQ ID NO: 1280682 - RNA, 22 nt, Human
cccagguaggcauugguggucg

SEQ ID NO: 1280683 - RNA, 23 nt, Human
cccgaguagcuggaauuacaggc

SEQ ID NO: 1280684 - RNA, 24 nt, Human
ccgccuccuggguucaaacgauuc

SEQ ID NO: 1280685 - RNA, 22 nt, Human
ccggccccuaguguguuuugug

SEQ ID NO: 1280686 - RNA, 21 nt, Human
ccucaggugauccacccgccu

SEQ ID NO: 1280687 - RNA, 24 nt, Human
ccucauaaaagacaugccuggcuu

SEQ ID NO: 1280688 - RNA, 19 nt, Human
ccuccgccuccuggguuca

SEQ ID NO: 1280689 - RNA, 21 nt, Human
ccuccugcccucuuuggggcc

SEQ ID NO: 1280690 - RNA, 24 nt, Human
ccuccuggguucaaacgauucucc

SEQ ID NO: 1280691 - RNA, 23 nt, Human
ccugccucagccucccgaguagc

SEQ ID NO: 1280692 - RNA, 18 nt, Human
ccuggccucaggugaucc

SEQ ID NO: 1280693 - RNA, 22 nt, Human
ccuggccucaggugauccaccc

SEQ ID NO: 1280694 - RNA, 23 nt, Human
ccuggccucaggugauccacccg

SEQ ID NO: 1280695 - RNA, 23 nt, Human
ccuggguucaaacgauucuccug

SEQ ID NO: 1280696 - RNA, 21 nt, Human
ccuuguugcaaugagcuccug

SEQ ID NO: 1280697 - RNA, 24 nt, Human
cgccauguuggccaggcuggucuu

SEQ ID NO: 1280698 - RNA, 25 nt, Human
cgccauguuggccaggcuggucuuc

SEQ ID NO: 1280699 - RNA, 24 nt, Human
cgccgagcugacucccucccauuu

SEQ ID NO: 1280700 - RNA, 24 nt, Human
cucaggugauccacccgccuuggc

SEQ ID NO: 1280701 - RNA, 18 nt, Human
cuccccaggaauccaccu

SEQ ID NO: 1280702 - RNA, 22 nt, Human
cuccugccucagccucccgagu

SEQ ID NO: 1280703 - RNA, 21 nt, Human
cuccuggguucaaacgauucu

SEQ ID NO: 1280704 - RNA, 23 nt, Human
cugcaaccuccgccuccuggguu

SEQ ID NO: 1280705 - RNA, 18 nt, Human
cugccaggccuggcugug

SEQ ID NO: 1280706 - RNA, 23 nt, Human
cugccucagccucccgaguagcu

SEQ ID NO: 1280707 - RNA, 20 nt, Human
cuggccccccuuguccugac

SEQ ID NO: 1280708 - RNA, 19 nt, Human
cugucgcccaggcuggagu

SEQ ID NO: 1280709 - RNA, 24 nt, Human
cuuccuggccucaggugauccacc

SEQ ID NO: 1280710 - RNA, 24 nt, Human
gaauuacaggcacaugcugucaug

SEQ ID NO: 1280711 - RNA, 23 nt, Human
gacgcagugaagcaggaagguuu

SEQ ID NO: 1280712 - RNA, 18 nt, Human
gagagcggccuguccuug

SEQ ID NO: 1280713 - RNA, 18 nt, Human
gagaugggguuucgccau

SEQ ID NO: 1280714 - RNA, 24 nt, Human
gagaugggguuucgccauguuggc

SEQ ID NO: 1280715 - RNA, 18 nt, Human
gagcggccuguccuugga

SEQ ID NO: 1280716 - RNA, 25 nt, Human
gaguagcuggaauuacaggcacaug

SEQ ID NO: 1280717 - RNA, 22 nt, Human
gcaaccuccgccuccuggguuc

SEQ ID NO: 1280718 - RNA, 23 nt, Human
gcaagaagcucucagagccugag

SEQ ID NO: 1280719 - RNA, 21 nt, Human
gcauugguggucgccgagcug

SEQ ID NO: 1280720 - RNA, 18 nt, Human
gccauguuggccaggcug

SEQ ID NO: 1280721 - RNA, 20 nt, Human
gcccaggcuggagugcagug

SEQ ID NO: 1280722 - RNA, 19 nt, Human
gcccugggugggggcuggg

SEQ ID NO: 1280723 - RNA, 22 nt, Human
gccuuggccucccaaagugcug

SEQ ID NO: 1280724 - RNA, 22 nt, Human
gcgcuuuguucugguguuuguu

SEQ ID NO: 1280725 - RNA, 24 nt, Human
gcuaauuuuuuucucuauuuuuag

SEQ ID NO: 1280726 - RNA, 25 nt, Human
gcucugucgcccaggcuggagugca

SEQ ID NO: 1280727 - RNA, 19 nt, Human
gcuggagugcagugguacu

SEQ ID NO: 1280728 - RNA, 23 nt, Human
ggagucuugcucugucgcccagg

SEQ ID NO: 1280729 - RNA, 23 nt, Human
ggcccagguagugcauacagcaa

SEQ ID NO: 1280730 - RNA, 20 nt, Human
gggccgggguccugguggag

SEQ ID NO: 1280731 - RNA, 21 nt, Human
gggccgggguccugguggagg

SEQ ID NO: 1280732 - RNA, 21 nt, Human
gggccuugugccccccaucug

SEQ ID NO: 1280733 - RNA, 22 nt, Human
gggguuucgccauguuggccag

SEQ ID NO: 1280734 - RNA, 18 nt, Human
ggguuucgccauguuggc

SEQ ID NO: 1280735 - RNA, 23 nt, Human
guagagaugggguuucgccaugu

SEQ ID NO: 1280736 - RNA, 24 nt, Human
gucuugcucugucgcccaggcugg

SEQ ID NO: 1280737 - RNA, 24 nt, Human
gugauccacccgccuuggccuccc

SEQ ID NO: 1280738 - RNA, 21 nt, Human
gugcagggccgggguccuggu

SEQ ID NO: 1280739 - RNA, 21 nt, Human
uaaaagacaugccuggcuucc

SEQ ID NO: 1280740 - RNA, 28 nt, Human
uaauuuuuuucucuauuuuuaguagaga

SEQ ID NO: 1280741 - RNA, 22 nt, Human
uagagaugggguuucgccaugu

SEQ ID NO: 1280742 - RNA, 24 nt, Human
uaguagagaugggguuucgccaug

SEQ ID NO: 1280743 - RNA, 19 nt, Human
ucaaacgauucuccugccu

SEQ ID NO: 1280744 - RNA, 23 nt, Human
ucacugcaaccuccgccuccugg

SEQ ID NO: 1280745 - RNA, 24 nt, Human
ucacugcaaccuccgccuccuggg

SEQ ID NO: 1280746 - RNA, 25 nt, Human
ucacugcaaccuccgccuccugggu

SEQ ID NO: 1280747 - RNA, 27 nt, Human
ucacugcaaccuccgccuccuggguuc

SEQ ID NO: 1280748 - RNA, 22 nt, Human
ucagccucccgaguagcuggaa

SEQ ID NO: 1280749 - RNA, 24 nt, Human
ucccaaagugcugggauuccaggc

SEQ ID NO: 1280750 - RNA, 24 nt, Human
ucccgaguagcuggaauuacaggc

SEQ ID NO: 1280751 - RNA, 23 nt, Human
uccuccugcccucuuuggggccu

SEQ ID NO: 1280752 - RNA, 21 nt, Human
uccuggguucaaacgauucuc

SEQ ID NO: 1280753 - RNA, 24 nt, Human
uccuggguucaaacgauucuccug

SEQ ID NO: 1280754 - RNA, 21 nt, Human
uccuuggagcgcuuuguucug

SEQ ID NO: 1280755 - RNA, 22 nt, Human
ucgccauguuggccaggcuggu

SEQ ID NO: 1280756 - RNA, 24 nt, Human
ucgccauguuggccaggcuggucu

SEQ ID NO: 1280757 - RNA, 22 nt, Human
ucgcccaggcuggagugcagug

SEQ ID NO: 1280758 - RNA, 21 nt, Human
ucucccagaaacagaugcuag

SEQ ID NO: 1280759 - RNA, 24 nt, Human
ucugucgcccaggcuggagugcag

SEQ ID NO: 1280760 - RNA, 23 nt, Human
ucuugcucugucgcccaggcugg

SEQ ID NO: 1280761 - RNA, 24 nt, Human
ucuugcucugucgcccaggcugga

SEQ ID NO: 1280762 - RNA, 20 nt, Human
ugacucccucccauuuccuc

SEQ ID NO: 1280763 - RNA, 22 nt, Human
ugagguggagucuugcucuguc

SEQ ID NO: 1280764 - RNA, 19 nt, Human
ugcagggccgggguccugg

SEQ ID NO: 1280765 - RNA, 18 nt, Human
ugccaucgaggugugggg

SEQ ID NO: 1280766 - RNA, 27 nt, Human
ugcccaaaaacuccauaaagagaagcu

SEQ ID NO: 1280767 - RNA, 24 nt, Human
ugccucagccucccgaguagcugg

SEQ ID NO: 1280768 - RNA, 21 nt, Human
ugccuggcuuccuccugcccu

SEQ ID NO: 1280769 - RNA, 24 nt, Human
ugcucugucgcccaggcuggagug

SEQ ID NO: 1280770 - RNA, 19 nt, Human
ugcugggauuccaggcggg

SEQ ID NO: 1280771 - RNA, 18 nt, Human
uggaauuacaggcacaug

SEQ ID NO: 1280772 - RNA, 19 nt, Human
uggaauuacaggcacaugc

SEQ ID NO: 1280773 - RNA, 19 nt, Human
uggaauuacaggcacaugc

SEQ ID NO: 1280774 - RNA, 21 nt, Human
uggaauuacaggcacaugcug

SEQ ID NO: 1280775 - RNA, 22 nt, Human
uggaauuacaggcacaugcugu

SEQ ID NO: 1280776 - RNA, 23 nt, Human
uggaauuacaggcacaugcuguc

SEQ ID NO: 1280777 - RNA, 24 nt, Human
uggaauuacaggcacaugcuguca

SEQ ID NO: 1280778 - RNA, 24 nt, Human
uggagcgcuuuguucugguguuug

SEQ ID NO: 1280779 - RNA, 21 nt, Human
uggaggucccccaucagcccu

SEQ ID NO: 1280780 - RNA, 23 nt, Human
uggaggucccccaucagcccugg

SEQ ID NO: 1280781 - RNA, 23 nt, Human
uggagucuugcucugucgcccag

SEQ ID NO: 1280782 - RNA, 24 nt, Human
uggagucuugcucugucgcccagg

SEQ ID NO: 1280783 - RNA, 23 nt, Human
uggagugcagugguacuaucucg

SEQ ID NO: 1280784 - RNA, 24 nt, Human
uggagugcagugguacuaucucgg

SEQ ID NO: 1280785 - RNA, 24 nt, Human
uggccucaggugauccacccgccu

SEQ ID NO: 1280786 - RNA, 21 nt, Human
ugggaggggugggagaaggcg

SEQ ID NO: 1280787 - RNA, 19 nt, Human
ugggggcugggauuccccu

SEQ ID NO: 1280788 - RNA, 24 nt, Human
ugggguuucgccauguuggccagg

SEQ ID NO: 1280789 - RNA, 23 nt, Human
uggguucaaacgauucuccugcc

SEQ ID NO: 1280790 - RNA, 24 nt, Human
uggguucaaacgauucuccugccu

SEQ ID NO: 1280791 - RNA, 18 nt, Human
uuaguagagaugggguuu

SEQ ID NO: 1280792 - RNA, 22 nt, Human
uuaguagagaugggguuucgcc

SEQ ID NO: 1280793 - RNA, 24 nt, Human
uuaguagagaugggguuucgccau

SEQ ID NO: 1280794 - RNA, 24 nt, Human
uucaaacgauucuccugccucagc

SEQ ID NO: 1280795 - RNA, 18 nt, Human
uuggccucccaaagugcu

SEQ ID NO: 1280796 - RNA, 20 nt, Human
uuguuuguuuguuuguuuuu

SEQ ID NO: 1280797 - RNA, 26 nt, Human
uuguuuguuuguuuuuguuguuuuuu

SEQ ID NO: 1280798 - RNA, 24 nt, Human
uuucgccauguuggccaggcuggu

SEQ ID NO: 1280799 - RNA, 21 nt, Human
uuucucuauuuuuaguagaga

SEQ ID NO: 1280800 - RNA, 22 nt, Human
uuugagguggagucuugcucug

SEQ ID NO: 1280801 - RNA, 21 nt, Human
uuuucucuauuuuuaguagag

SEQ ID NO: 1280802 - RNA, 24 nt, Human
uuuucucuauuuuuaguagagaug

SEQ ID NO: 1280803 - RNA, 23 nt, Human
uuuuuaguagagaugggguuucg

SEQ ID NO: 1280804 - RNA, 24 nt, Human
uuuuuaguagagaugggguuucgc

SEQ ID NO: 1280805 - RNA, 18 nt, Human
uuuuuugagguggagucu

SEQ ID NO: 1280806 - RNA, 23 nt, Human
aaacuccuggccucaagcagucc

SEQ ID NO: 1280807 - RNA, 19 nt, Human
aaaguacugggauuacacg

SEQ ID NO: 1280808 - RNA, 24 nt, Human
aaaguacugggauuacacguauga

SEQ ID NO: 1280809 - RNA, 18 nt, Human
aagcaguccucuugccuc

SEQ ID NO: 1280810 - RNA, 26 nt, Human
aaguacugggauuacacguaugagcc

SEQ ID NO: 1280811 - RNA, 24 nt, Human
caaaguacugggauuacacguaug

SEQ ID NO: 1280812 - RNA, 21 nt, Human
caagcaguccucuugccucca

SEQ ID NO: 1280813 - RNA, 23 nt, Human
caagcaguccucuugccuccacc

SEQ ID NO: 1280814 - RNA, 21 nt, Human
caauggcagaggaugcgacgg

SEQ ID NO: 1280815 - RNA, 19 nt, Human
ccaaaguacugggauuaca

SEQ ID NO: 1280816 - RNA, 22 nt, Human
ccaaaguacugggauuacacgu

SEQ ID NO: 1280817 - RNA, 24 nt, Human
ccaaaguacugggauuacacguau

SEQ ID NO: 1280818 - RNA, 22 nt, Human
ccucuugccuccaccuuccaaa

SEQ ID NO: 1280819 - RNA, 24 nt, Human
cucaagcaguccucuugccuccac

SEQ ID NO: 1280820 - RNA, 18 nt, Human
cuggccucaagcaguccu

SEQ ID NO: 1280821 - RNA, 18 nt, Human
gauuacacguaugagcca

SEQ ID NO: 1280822 - RNA, 21 nt, Human
gcaguccucuugccuccaccu

SEQ ID NO: 1280823 - RNA, 23 nt, Human
gcugaucugaaacuccuggccuc

SEQ ID NO: 1280824 - RNA, 19 nt, Human
guagugguaacuauccaca

SEQ ID NO: 1280825 - RNA, 19 nt, Human
uacacguaugagccaccca

SEQ ID NO: 1280826 - RNA, 24 nt, Human
uacugggauuacacguaugagcca

SEQ ID NO: 1280827 - RNA, 19 nt, Human
uagagauggaggucuugcu

SEQ ID NO: 1280828 - RNA, 23 nt, Human
uaggaauauuccgagggacaaug

SEQ ID NO: 1280829 - RNA, 23 nt, Human
uauauugcuugggcugaucugaa

SEQ ID NO: 1280830 - RNA, 18 nt, Human
ucuugcuauauugcuugg

SEQ ID NO: 1280831 - RNA, 23 nt, Human
ucuugcuauauugcuugggcuga

SEQ ID NO: 1280832 - RNA, 19 nt, Human
uggcagaggaugcgacgga

SEQ ID NO: 1280833 - RNA, 24 nt, Human
uggccucaagcaguccucuugccu

SEQ ID NO: 1280834 - RNA, 22 nt, Human
ugggauuacacguaugagccac

SEQ ID NO: 1280835 - RNA, 23 nt, Human
ugggauuacacguaugagccacc

SEQ ID NO: 1280836 - RNA, 20 nt, Human
uguagagauggaggucuugc

SEQ ID NO: 1280837 - RNA, 24 nt, Human
uuguagagauggaggucuugcuau

SEQ ID NO: 1280838 - RNA, 19 nt, Human
uuuguagagauggaggucu

SEQ ID NO: 1280839 - RNA, 18 nt, Human
cccacgccuccucucccg

SEQ ID NO: 1280840 - RNA, 18 nt, Human
ccccacgccuccucuccc

SEQ ID NO: 1280841 - RNA, 21 nt, Human
cccccacgccuccucucccgc

SEQ ID NO: 1280842 - RNA, 22 nt, Human
cgacccccacgccuccucuccc

SEQ ID NO: 1280843 - RNA, 22 nt, Human
cucccgcgcaugcgcgucuuac

SEQ ID NO: 1280844 - RNA, 19 nt, Human
aaagugcugggauuacagg

SEQ ID NO: 1280845 - RNA, 24 nt, Human
aaagugcugggauuacaggcaaga

SEQ ID NO: 1280846 - RNA, 24 nt, Human
aaagugcugggauuacagguguga

SEQ ID NO: 1280847 - RNA, 18 nt, Human
aagugcugggauuacagg

SEQ ID NO: 1280848 - RNA, 18 nt, Human
aagugcugggauuacagg

SEQ ID NO: 1280849 - RNA, 19 nt, Human
aagugcugggauuacaggc

SEQ ID NO: 1280850 - RNA, 26 nt, Human
aagugcugggauuacaggcaagagcc

SEQ ID NO: 1280851 - RNA, 19 nt, Human
aagugcugggauuacaggu

SEQ ID NO: 1280852 - RNA, 26 nt, Human
aagugcugggauuacaggugugagcc

SEQ ID NO: 1280853 - RNA, 24 nt, Human
aaguguccgccugccucagccucc

SEQ ID NO: 1280854 - RNA, 18 nt, Human
acagcagagaggccccaa

SEQ ID NO: 1280855 - RNA, 21 nt, Human
acagcagagaggccccaagga

SEQ ID NO: 1280856 - RNA, 18 nt, Human
acaggcaagagccacugc

SEQ ID NO: 1280857 - RNA, 19 nt, Human
acagguaccugccaccacg

SEQ ID NO: 1280858 - RNA, 24 nt, Human
accauguuggccaggcuggucucg

SEQ ID NO: 1280859 - RNA, 20 nt, Human
accgcagcucacugcagcug

SEQ ID NO: 1280860 - RNA, 28 nt, Human
accgcagcucacugcagcuuugcgugca

SEQ ID NO: 1280861 - RNA, 23 nt, Human
acgcaguggcacgaucucggcuc

SEQ ID NO: 1280862 - RNA, 23 nt, Human
acggguuucaccauguuggccag

SEQ ID NO: 1280863 - RNA, 25 nt, Human
acucugucacccaggcuggagugca

SEQ ID NO: 1280864 - RNA, 24 nt, Human
agcgauucuccugccucagucucc

SEQ ID NO: 1280865 - RNA, 19 nt, Human
aggcuggagugcaguggca

SEQ ID NO: 1280866 - RNA, 25 nt, Human
aggcuggagugcaguggcaugaucu

SEQ ID NO: 1280867 - RNA, 19 nt, Human
aggugagugcaggaauugg

SEQ ID NO: 1280868 - RNA, 19 nt, Human
aggugcacaccaccacacc

SEQ ID NO: 1280869 - RNA, 18 nt, Human
aguagcugggauuacagg

SEQ ID NO: 1280870 - RNA, 18 nt, Human
agucuccugaauagcugg

SEQ ID NO: 1280871 - RNA, 23 nt, Human
agugcaguggcaugaccgcagcu

SEQ ID NO: 1280872 - RNA, 24 nt, Human
agugcaguggcaugaccgcagcuc

SEQ ID NO: 1280873 - RNA, 19 nt, Human
agugcaguggcaugaucuc

SEQ ID NO: 1280874 - RNA, 21 nt, Human
agugcaguggcaugaucucag

SEQ ID NO: 1280875 - RNA, 23 nt, Human
agugcaguggcaugaucucagcu

SEQ ID NO: 1280876 - RNA, 24 nt, Human
agugcaguggcaugaucucagcuc

SEQ ID NO: 1280877 - RNA, 18 nt, Human
agugcugggauuacaggc

SEQ ID NO: 1280878 - RNA, 24 nt, Human
auuuuuaguagagacggguuucac

SEQ ID NO: 1280879 - RNA, 24 nt, Human
auuuuuguauuuuuaguagagacg

SEQ ID NO: 1280880 - RNA, 24 nt, Human
caaagcucuaagguggcauggcug

SEQ ID NO: 1280881 - RNA, 27 nt, Human
caaagugcugggauuacaggcaagagc

SEQ ID NO: 1280882 - RNA, 24 nt, Human
caaagugcugggauuacaggugug

SEQ ID NO: 1280883 - RNA, 20 nt, Human
caagcgauucuccugccuca

SEQ ID NO: 1280884 - RNA, 21 nt, Human
caagcgauucuccugccucag

SEQ ID NO: 1280885 - RNA, 21 nt, Human
caaguguccgccugccucagc

SEQ ID NO: 1280886 - RNA, 19 nt, Human
cacaccaccacaccuggcu

SEQ ID NO: 1280887 - RNA, 24 nt, Human
caccacaccuggcuaauuuuugua

SEQ ID NO: 1280888 - RNA, 21 nt, Human
caccauguuggccaggcuggu

SEQ ID NO: 1280889 - RNA, 24 nt, Human
caccauguuggccaggcuggucuc

SEQ ID NO: 1280890 - RNA, 27 nt, Human
caccauguuggccaggcuggucucgaa

SEQ ID NO: 1280891 - RNA, 21 nt, Human
caccgcaaccuccgccuccca

SEQ ID NO: 1280892 - RNA, 22 nt, Human
caccgcaaccuccgccucccag

SEQ ID NO: 1280893 - RNA, 23 nt, Human
cacugcagccucugccuccuggg

SEQ ID NO: 1280894 - RNA, 19 nt, Human
cagccucugccuccugggc

SEQ ID NO: 1280895 - RNA, 23 nt, Human
cagccucugccuccugggcucaa

SEQ ID NO: 1280896 - RNA, 21 nt, Human
cagguaccugccaccacgccu

SEQ ID NO: 1280897 - RNA, 23 nt, Human
caggugauccgcccacuuugucc

SEQ ID NO: 1280898 - RNA, 21 nt, Human
cagucuccugaauagcugggg

SEQ ID NO: 1280899 - RNA, 24 nt, Human
cauguuggccaggcuggucucgaa

SEQ ID NO: 1280900 - RNA, 19 nt, Human
ccaaagugcugggauuaca

SEQ ID NO: 1280901 - RNA, 21 nt, Human
ccaaagugcugggauuacagg

SEQ ID NO: 1280902 - RNA, 21 nt, Human
ccaaagugcugggauuacagg

SEQ ID NO: 1280903 - RNA, 23 nt, Human
ccaaagugcugggauuacaggca

SEQ ID NO: 1280904 - RNA, 24 nt, Human
ccaaagugcugggauuacaggugu

SEQ ID NO: 1280905 - RNA, 21 nt, Human
ccacugcgccuggcuugaagu

SEQ ID NO: 1280906 - RNA, 24 nt, Human
cccaaagugcugggauuacaggca

SEQ ID NO: 1280907 - RNA, 23 nt, Human
cccaagcuggaacgcaguggcac

SEQ ID NO: 1280908 - RNA, 19 nt, Human
cccaggcuggagugcagug

SEQ ID NO: 1280909 - RNA, 23 nt, Human
cccaggcuggagugcaguggcau

SEQ ID NO: 1280910 - RNA, 23 nt, Human
cccagguucaagcgauucuccug

SEQ ID NO: 1280911 - RNA, 24 nt, Human
ccccaaagugcugggauuacaggc

SEQ ID NO: 1280912 - RNA, 18 nt, Human
ccccaaggaggugucuuc

SEQ ID NO: 1280913 - RNA, 20 nt, Human
ccccugggcucaaguguccg

SEQ ID NO: 1280914 - RNA, 23 nt, Human
cccgaguagcugggauuacaggu

SEQ ID NO: 1280915 - RNA, 24 nt, Human
cccgaguagcugggauuacaggua

SEQ ID NO: 1280916 - RNA, 23 nt, Human
cccugggcucaaguguccgccug

SEQ ID NO: 1280917 - RNA, 21 nt, Human
ccgaguagcugggauuacagg

SEQ ID NO: 1280918 - RNA, 23 nt, Human
ccgcaaccuccgccucccagguu

SEQ ID NO: 1280919 - RNA, 24 nt, Human
ccgcaaccuccgccucccagguuc

SEQ ID NO: 1280920 - RNA, 24 nt, Human
ccgccucccagguucaagcgauuc

SEQ ID NO: 1280921 - RNA, 26 nt, Human
ccgccugccucagccucccaaagugc

SEQ ID NO: 1280922 - RNA, 24 nt, Human
ccucccagguucaagcgauucucc

SEQ ID NO: 1280923 - RNA, 19 nt, Human
ccucugccuccugggcuca

SEQ ID NO: 1280924 - RNA, 24 nt, Human
ccugaauagcuggggcuauaggug

SEQ ID NO: 1280925 - RNA, 24 nt, Human
ccugaccucaggugauccgcccac

SEQ ID NO: 1280926 - RNA, 24 nt, Human
ccugccucagccucccaaagugcu

SEQ ID NO: 1280927 - RNA, 22 nt, Human
ccugggcucaaguguccgccug

SEQ ID NO: 1280928 - RNA, 22 nt, Human
ccuugaagacuugggagccagg

SEQ ID NO: 1280929 - RNA, 24 nt, Human
cgcucuguugcccaggcuggagug

SEQ ID NO: 1280930 - RNA, 24 nt, Human
cggagucucgcucuguugcccagg

SEQ ID NO: 1280931 - RNA, 23 nt, Human
cuaauuuuuguauuuuuaguaga

SEQ ID NO: 1280932 - RNA, 20 nt, Human
cucaaguguccgccugccuc

SEQ ID NO: 1280933 - RNA, 24 nt, Human
cucaccgcaaccuccgccucccag

SEQ ID NO: 1280934 - RNA, 24 nt, Human
cucacugcagccucugccuccugg

SEQ ID NO: 1280935 - RNA, 24 nt, Human
cuccugaauagcuggggcuauagg

SEQ ID NO: 1280936 - RNA, 24 nt, Human
cucgcucuguugcccaggcuggag

SEQ ID NO: 1280937 - RNA, 23 nt, Human
cugcagccucugccuccugggcu

SEQ ID NO: 1280938 - RNA, 22 nt, Human
cugccucaccucccgaguagcu

SEQ ID NO: 1280939 - RNA, 24 nt, Human
cugccucagccucccaaagugcug

SEQ ID NO: 1280940 - RNA, 23 nt, Human
cugccucagucuccugaauagcu

SEQ ID NO: 1280941 - RNA, 26 nt, Human
cugcuacuguuuuuuuuuuuuuuuuu

SEQ ID NO: 1280942 - RNA, 24 nt, Human
cuggagugcaguggcaugaucuca

SEQ ID NO: 1280943 - RNA, 19 nt, Human
cugucacccaggcuggagu

SEQ ID NO: 1280944 - RNA, 24 nt, Human
cuuacucugucacccaggcuggag

SEQ ID NO: 1280945 - RNA, 19 nt, Human
cuuguaccuuucugacacu

SEQ ID NO: 1280946 - RNA, 24 nt, Human
gaccucaggugauccgcccacuuu

SEQ ID NO: 1280947 - RNA, 24 nt, Human
gacggguuucaccauguuggccag

SEQ ID NO: 1280948 - RNA, 20 nt, Human
gagacagggucuuacucugu

SEQ ID NO: 1280949 - RNA, 22 nt, Human
gaguagcugggauuacagguac

SEQ ID NO: 1280950 - RNA, 20 nt, Human
gaguccaucuuguaccuuuc

SEQ ID NO: 1280951 - RNA, 18 nt, Human
gauuacaggcaagagcca

SEQ ID NO: 1280952 - RNA, 22 nt, Human
gauuacaggcaagagccacugc

SEQ ID NO: 1280953 - RNA, 22 nt, Human
gauuacaggcaagagccacugc

SEQ ID NO: 1280954 - RNA, 18 nt, Human
gauuacaggugugagcca

SEQ ID NO: 1280955 - RNA, 22 nt, Human
gauuacaggugugagccacugc

SEQ ID NO: 1280956 - RNA, 22 nt, Human
gauuacaggugugagccacugc

SEQ ID NO: 1280957 - RNA, 19 nt, Human
gcaggaauuggguuuagaa

SEQ ID NO: 1280958 - RNA, 23 nt, Human
gcccaagcuggaacgcaguggca

SEQ ID NO: 1280959 - RNA, 24 nt, Human
gcccaggcuggagugcaguggcau

SEQ ID NO: 1280960 - RNA, 18 nt, Human
gccccaaggaggugucuu

SEQ ID NO: 1280961 - RNA, 24 nt, Human
gccucagucuccugaauagcuggg

SEQ ID NO: 1280962 - RNA, 19 nt, Human
gcuacuguuuuuuuuuuuu

SEQ ID NO: 1280963 - RNA, 20 nt, Human
gcuacuguuuuuuuuuuuuu

SEQ ID NO: 1280964 - RNA, 21 nt, Human
gcucacugcagccucugccuc

SEQ ID NO: 1280965 - RNA, 25 nt, Human
gcucugucgcccaagcuggaacgca

SEQ ID NO: 1280966 - RNA, 25 nt, Human
gcucuguugcccaggcuggagugca

SEQ ID NO: 1280967 - RNA, 19 nt, Human
gcuggaacgcaguggcacg

SEQ ID NO: 1280968 - RNA, 19 nt, Human
gcuggagugcaguggcaug

SEQ ID NO: 1280969 - RNA, 23 nt, Human
gcuggagugcaguggcaugaccg

SEQ ID NO: 1280970 - RNA, 23 nt, Human
gcuggucucgaacuccugaccuc

SEQ ID NO: 1280971 - RNA, 18 nt, Human
ggagccaggaggggcaca

SEQ ID NO: 1280972 - RNA, 23 nt, Human
ggagucucgcucuguugcccagg

SEQ ID NO: 1280973 - RNA, 22 nt, Human
ggauuacaggcaagagccacug

SEQ ID NO: 1280974 - RNA, 20 nt, Human
ggcggagucucgcucuguug

SEQ ID NO: 1280975 - RNA, 24 nt, Human
ggcucaaguguccgccugccucag

SEQ ID NO: 1280976 - RNA, 24 nt, Human
ggcuggucucgaacuccugaccuc

SEQ ID NO: 1280977 - RNA, 21 nt, Human
ggcuugaaguuuuuaaagagc

SEQ ID NO: 1280978 - RNA, 19 nt, Human
ggguuuagaaacaaagcuu

SEQ ID NO: 1280979 - RNA, 22 nt, Human
ggguuucaccauguuggccagg

SEQ ID NO: 1280980 - RNA, 19 nt, Human
ggucucgaacuccugaccu

SEQ ID NO: 1280981 - RNA, 18 nt, Human
guagcugggauuacaggu

SEQ ID NO: 1280982 - RNA, 24 nt, Human
gucucgcucuguugcccaggcugg

SEQ ID NO: 1280983 - RNA, 23 nt, Human
guguccgccugccucagccuccc

SEQ ID NO: 1280984 - RNA, 22 nt, Human
gugucuuguuccucuaguguca

SEQ ID NO: 1280985 - RNA, 22 nt, Human
uaaaaguugaaguuggaagcag

SEQ ID NO: 1280986 - RNA, 24 nt, Human
uaauuuuuguauuuuuaguagaga

SEQ ID NO: 1280987 - RNA, 23 nt, Human
uacaaagcucuaagguggcaugg

SEQ ID NO: 1280988 - RNA, 22 nt, Human
uacagguaccugccaccacgcc

SEQ ID NO: 1280989 - RNA, 22 nt, Human
uacaggugugagccacugcgcc

SEQ ID NO: 1280990 - RNA, 23 nt, Human
uacaggugugagccacugcgccu

SEQ ID NO: 1280991 - RNA, 24 nt, Human
uacucugucacccaggcuggagug

SEQ ID NO: 1280992 - RNA, 21 nt, Human
uagagacggguuucaccaugu

SEQ ID NO: 1280993 - RNA, 23 nt, Human
uaggagggucacaccauguagcg

SEQ ID NO: 1280994 - RNA, 21 nt, Human
uaggugcacaccaccacaccu

SEQ ID NO: 1280995 - RNA, 24 nt, Human
uaggugcacaccaccacaccuggc

SEQ ID NO: 1280996 - RNA, 23 nt, Human
uaguagagacggguuucaccaug

SEQ ID NO: 1280997 - RNA, 22 nt, Human
ucacccaggcuggagugcagug

SEQ ID NO: 1280998 - RNA, 24 nt, Human
ucaccgcaaccuccgccucccagg

SEQ ID NO: 1280999 - RNA, 25 nt, Human
ucaccgcaaccuccgccucccaggu

SEQ ID NO: 1281000 - RNA, 27 nt, Human
ucaccgcaaccuccgccucccagguuc

SEQ ID NO: 1281001 - RNA, 24 nt, Human
ucacugcagccucugccuccuggg

SEQ ID NO: 1281002 - RNA, 25 nt, Human
ucacugcagccucugccuccugggc

SEQ ID NO: 1281003 - RNA, 24 nt, Human
ucacugcagcugugaaccccuggg

SEQ ID NO: 1281004 - RNA, 27 nt, Human
ucagcucaccgcaaccuccgccuccca

SEQ ID NO: 1281005 - RNA, 23 nt, Human
ucagucuccugaauagcuggggc

SEQ ID NO: 1281006 - RNA, 20 nt, Human
ucaugcuuaaaaguugaagu

SEQ ID NO: 1281007 - RNA, 23 nt, Human
ucccaaagugcugggauuacagg

SEQ ID NO: 1281008 - RNA, 21 nt, Human
ucccagguucaagcgauucuc

SEQ ID NO: 1281009 - RNA, 24 nt, Human
ucccagguucaagcgauucuccug

SEQ ID NO: 1281010 - RNA, 20 nt, Human
uccccaaagugcugggauua

SEQ ID NO: 1281011 - RNA, 24 nt, Human
uccccaaagugcugggauuacagg

SEQ ID NO: 1281012 - RNA, 23 nt, Human
ucccgaguagcugggauuacagg

SEQ ID NO: 1281013 - RNA, 24 nt, Human
ucccgaguagcugggauuacaggu

SEQ ID NO: 1281014 - RNA, 24 nt, Human
uccugaauagcuggggcuauaggu

SEQ ID NO: 1281015 - RNA, 21 nt, Human
uccugggcucaagccauucuc

SEQ ID NO: 1281016 - RNA, 22 nt, Human
uccugggcucaagccauucucc

SEQ ID NO: 1281017 - RNA, 22 nt, Human
uccugggcucaagccauucucc

SEQ ID NO: 1281018 - RNA, 24 nt, Human
uccugggcucaagccauucuccug

SEQ ID NO: 1281019 - RNA, 24 nt, Human
ucgcucuguugcccaggcuggagu

SEQ ID NO: 1281020 - RNA, 23 nt, Human
ucucgaacuccugaccucaggug

SEQ ID NO: 1281021 - RNA, 19 nt, Human
ucucgcucuguugcccagg

SEQ ID NO: 1281022 - RNA, 22 nt, Human
ucucgcucuguugcccaggcug

SEQ ID NO: 1281023 - RNA, 23 nt, Human
ucucgcucuguugcccaggcugg

SEQ ID NO: 1281024 - RNA, 24 nt, Human
ucucgcucuguugcccaggcugga

SEQ ID NO: 1281025 - RNA, 26 nt, Human
ucucgcucuguugcccaggcuggagu

SEQ ID NO: 1281026 - RNA, 24 nt, Human
ucugucacccaggcuggagugcag

SEQ ID NO: 1281027 - RNA, 18 nt, Human
ucuguugcccaggcugga

SEQ ID NO: 1281028 - RNA, 24 nt, Human
ucuguugcccaggcuggagugcag

SEQ ID NO: 1281029 - RNA, 23 nt, Human
ucuuacucugucacccaggcugg

SEQ ID NO: 1281030 - RNA, 24 nt, Human
ucuuacucugucacccaggcugga

SEQ ID NO: 1281031 - RNA, 23 nt, Human
ucuugcucugucgcccaagcugg

SEQ ID NO: 1281032 - RNA, 24 nt, Human
ucuugcucugucgcccaagcugga

SEQ ID NO: 1281033 - RNA, 19 nt, Human
ucuugcuguguugcccaca

SEQ ID NO: 1281034 - RNA, 23 nt, Human
ugaaccccugggcucaagugucc

SEQ ID NO: 1281035 - RNA, 22 nt, Human
ugaaguuggaagcaguucccua

SEQ ID NO: 1281036 - RNA, 24 nt, Human
ugaaguuggaagcaguucccuagg

SEQ ID NO: 1281037 - RNA, 19 nt, Human
ugacagcagagaggcccca

SEQ ID NO: 1281038 - RNA, 20 nt, Human
ugaccgcagcucacugcagc

SEQ ID NO: 1281039 - RNA, 18 nt, Human
ugaccucaggugauccgc

SEQ ID NO: 1281040 - RNA, 21 nt, Human
ugaccucaggugauccgccca

SEQ ID NO: 1281041 - RNA, 22 nt, Human
ugaccucaggugauccgcccac

SEQ ID NO: 1281042 - RNA, 24 nt, Human
ugaccucaggugauccgcccacuu

SEQ ID NO: 1281043 - RNA, 19 nt, Human
ugagacagggucuuacucu

SEQ ID NO: 1281044 - RNA, 22 nt, Human
ugagacagggucuuacucuguc

SEQ ID NO: 1281045 - RNA, 22 nt, Human
ugaggcggagucucgcucuguu

SEQ ID NO: 1281046 - RNA, 18 nt, Human
ugaggucagauuucccgg

SEQ ID NO: 1281047 - RNA, 24 nt, Human
ugauccgcccacuuuguccucccc

SEQ ID NO: 1281048 - RNA, 18 nt, Human
ugcccaggcuggagugca

SEQ ID NO: 1281049 - RNA, 22 nt, Human
ugcccaggcuggagugcagugg

SEQ ID NO: 1281050 - RNA, 24 nt, Human
ugcccaggcuggagugcaguggca

SEQ ID NO: 1281051 - RNA, 19 nt, Human
ugccucaccucccgaguag

SEQ ID NO: 1281052 - RNA, 23 nt, Human
ugccucaccucccgaguagcugg

SEQ ID NO: 1281053 - RNA, 24 nt, Human
ugccucagccucccaaagugcugg

SEQ ID NO: 1281054 - RNA, 24 nt, Human
ugccucagucuccugaauagcugg

SEQ ID NO: 1281055 - RNA, 19 nt, Human
ugccuccugggcucaagcc

SEQ ID NO: 1281056 - RNA, 19 nt, Human
ugcucugucgcccaagcug

SEQ ID NO: 1281057 - RNA, 22 nt, Human
ugcugggauuacaggcaagagc

SEQ ID NO: 1281058 - RNA, 24 nt, Human
ugcugggauuacaggugugagcca

SEQ ID NO: 1281059 - RNA, 24 nt, Human
uggaacgcaguggcacgaucucgg

SEQ ID NO: 1281060 - RNA, 20 nt, Human
uggagugcaguggcaugacc

SEQ ID NO: 1281061 - RNA, 21 nt, Human
uggagugcaguggcaugaccg

SEQ ID NO: 1281062 - RNA, 19 nt, Human
uggagugcaguggcaugau

SEQ ID NO: 1281063 - RNA, 24 nt, Human
uggagugcaguggcaugaucucag

SEQ ID NO: 1281064 - RNA, 23 nt, Human
uggcaugaccgcagcucacugca

SEQ ID NO: 1281065 - RNA, 24 nt, Human
uggcaugaucucagcucaccgcaa

SEQ ID NO: 1281066 - RNA, 19 nt, Human
uggcauggcugugacagca

SEQ ID NO: 1281067 - RNA, 24 nt, Human
uggccaggcuggucucgaacuccu

SEQ ID NO: 1281068 - RNA, 19 nt, Human
ugggagccaggaggggcac

SEQ ID NO: 1281069 - RNA, 21 nt, Human
ugggagccaggaggggcacag

SEQ ID NO: 1281070 - RNA, 22 nt, Human
ugggauuacaggcaagagccac

SEQ ID NO: 1281071 - RNA, 22 nt, Human
ugggauuacaggcaagagccac

SEQ ID NO: 1281072 - RNA, 24 nt, Human
ugggauuacaggcaagagccacug

SEQ ID NO: 1281073 - RNA, 24 nt, Human
ugggauuacaggcaagagccacug

SEQ ID NO: 1281074 - RNA, 21 nt, Human
ugggauuacagguaccugcca

SEQ ID NO: 1281075 - RNA, 22 nt, Human
ugggauuacagguaccugccac

SEQ ID NO: 1281076 - RNA, 24 nt, Human
ugggauuacagguaccugccacca

SEQ ID NO: 1281077 - RNA, 18 nt, Human
ugggauuacaggugugag

SEQ ID NO: 1281078 - RNA, 19 nt, Human
ugggauuacaggugugagc

SEQ ID NO: 1281079 - RNA, 21 nt, Human
ugggauuacaggugugagcca

SEQ ID NO: 1281080 - RNA, 22 nt, Human
ugggauuacaggugugagccac

SEQ ID NO: 1281081 - RNA, 22 nt, Human
ugggauuacaggugugagccac

SEQ ID NO: 1281082 - RNA, 24 nt, Human
ugggauuacaggugugagccacug

SEQ ID NO: 1281083 - RNA, 23 nt, Human
uggggucuugcuguguugcccac

SEQ ID NO: 1281084 - RNA, 26 nt, Human
uguauuuauuuauuuauuuauuuauu

SEQ ID NO: 1281085 - RNA, 23 nt, Human
ugucuuguuccucuagugucagg

SEQ ID NO: 1281086 - RNA, 24 nt, Human
uguguugcccacacuugucuugag

SEQ ID NO: 1281087 - RNA, 24 nt, Human
uuaggaggcuucuguccacaucau

SEQ ID NO: 1281088 - RNA, 23 nt, Human
uuaguagagacggguuucaccau

SEQ ID NO: 1281089 - RNA, 24 nt, Human
uuaguagagacggguuucaccaug

SEQ ID NO: 1281090 - RNA, 27 nt, Human
uuauuuauuuauuuauuuauuuuuuug

SEQ ID NO: 1281091 - RNA, 21 nt, Human
uucaagcgauucuccugccuc

SEQ ID NO: 1281092 - RNA, 23 nt, Human
uucaagcgauucuccugccucag

SEQ ID NO: 1281093 - RNA, 25 nt, Human
uucaagcgauucuccugccucaguc

SEQ ID NO: 1281094 - RNA, 18 nt, Human
uucccuaggagggucaca

SEQ ID NO: 1281095 - RNA, 21 nt, Human
uucugugagacagggucuuac

SEQ ID NO: 1281096 - RNA, 21 nt, Human
uugagacagucuugcucuguc

SEQ ID NO: 1281097 - RNA, 24 nt, Human
uugcccaggcuggagugcaguggc

SEQ ID NO: 1281098 - RNA, 24 nt, Human
uuuaguagagacggguuucaccau

SEQ ID NO: 1281099 - RNA, 24 nt, Human
uuucaccauguuggccaggcuggu

SEQ ID NO: 1281100 - RNA, 23 nt, Human
uuucccgggagaaucuucuccuu

SEQ ID NO: 1281101 - RNA, 20 nt, Human
uuuuuguauuuuuaguagag

SEQ ID NO: 1281102 - RNA, 23 nt, Human
uuuuuuuuuuuuugagacagucu

SEQ ID NO: 1281103 - RNA, 18 nt, Human
uuuuuuuuuuuuuuuuug

SEQ ID NO: 1281104 - RNA, 18 nt, Human
aaaccccagcccgcaccc

SEQ ID NO: 1281105 - RNA, 23 nt, Human
aaauuaucggcgcucaagcgcaa

SEQ ID NO: 1281106 - RNA, 21 nt, Human
aagagcugccuuggggggugg

SEQ ID NO: 1281107 - RNA, 22 nt, Human
accacaguuccauuuguacauc

SEQ ID NO: 1281108 - RNA, 18 nt, Human
accccagagccagaagag

SEQ ID NO: 1281109 - RNA, 24 nt, Human
accgagaacaaaccagcacccucc

SEQ ID NO: 1281110 - RNA, 21 nt, Human
acuucugcuaccauuauggcc

SEQ ID NO: 1281111 - RNA, 21 nt, Human
agaaaaccccagcccgcaccc

SEQ ID NO: 1281112 - RNA, 21 nt, Human
agcaacuccugauguggacaa

SEQ ID NO: 1281113 - RNA, 25 nt, Human
aggaagcccaguuugaaaaacaaac

SEQ ID NO: 1281114 - RNA, 22 nt, Human
cacgggccagggcuucccgagg

SEQ ID NO: 1281115 - RNA, 20 nt, Human
cagacagccaagggauccau

SEQ ID NO: 1281116 - RNA, 22 nt, Human
cagccagagcccagggcugccc

SEQ ID NO: 1281117 - RNA, 24 nt, Human
caggagaaaaccccagcccgcacc

SEQ ID NO: 1281118 - RNA, 20 nt, Human
ccacuggccgaccccagagc

SEQ ID NO: 1281119 - RNA, 24 nt, Human
ccagagccagaagaguagcaagaa

SEQ ID NO: 1281120 - RNA, 18 nt, Human
ccagcccgcacccucacc

SEQ ID NO: 1281121 - RNA, 21 nt, Human
cccaggagaaaaccccagccc

SEQ ID NO: 1281122 - RNA, 22 nt, Human
ccccagagccagaagaguagca

SEQ ID NO: 1281123 - RNA, 19 nt, Human
ccccgcgcgccguucaccg

SEQ ID NO: 1281124 - RNA, 20 nt, Human
ccccgcgcgccguucaccga

SEQ ID NO: 1281125 - RNA, 22 nt, Human
cccgcacccucaccacaguucc

SEQ ID NO: 1281126 - RNA, 21 nt, Human
ccucagacagccaagggaucc

SEQ ID NO: 1281127 - RNA, 22 nt, Human
cgagaacaaaccagcacccucc

SEQ ID NO: 1281128 - RNA, 21 nt, Human
cgcacccucaccacaguucca

SEQ ID NO: 1281129 - RNA, 20 nt, Human
cuccacuuacuuucccgauc

SEQ ID NO: 1281130 - RNA, 20 nt, Human
cuccugaauccacuggccga

SEQ ID NO: 1281131 - RNA, 24 nt, Human
cuucugcuaccauuauggccacaa

SEQ ID NO: 1281132 - RNA, 20 nt, Human
gaacaaaccagcacccuccg

SEQ ID NO: 1281133 - RNA, 19 nt, Human
gaauccacuggccgacccc

SEQ ID NO: 1281134 - RNA, 20 nt, Human
gcccaggagaaaaccccagc

SEQ ID NO: 1281135 - RNA, 20 nt, Human
gggaauaggcaguugggggg

SEQ ID NO: 1281136 - RNA, 20 nt, Human
gggggugggaggcuaaggaa

SEQ ID NO: 1281137 - RNA, 22 nt, Human
ggugacgcccaggagaaaaccc

SEQ ID NO: 1281138 - RNA, 21 nt, Human
ucaccgagaacaaaccagcac

SEQ ID NO: 1281139 - RNA, 23 nt, Human
ucaccugagcgugcucacuacuu

SEQ ID NO: 1281140 - RNA, 18 nt, Human
ucauugagaccauggaau

SEQ ID NO: 1281141 - RNA, 21 nt, Human
uccacuggccgaccccagagc

SEQ ID NO: 1281142 - RNA, 23 nt, Human
uccacuggccgaccccagagccc

SEQ ID NO: 1281143 - RNA, 20 nt, Human
uccauuuguacauccaggaa

SEQ ID NO: 1281144 - RNA, 21 nt, Human
uccccagccagagcccagggc

SEQ ID NO: 1281145 - RNA, 22 nt, Human
uccugaauccacuggccgaccc

SEQ ID NO: 1281146 - RNA, 20 nt, Human
ucuucugggugggcccugga

SEQ ID NO: 1281147 - RNA, 23 nt, Human
ugaaaaacaaaccacgccuguaa

SEQ ID NO: 1281148 - RNA, 23 nt, Human
ugacgcccaggagaaaaccccag

SEQ ID NO: 1281149 - RNA, 18 nt, Human
ugccuuggggggugggag

SEQ ID NO: 1281150 - RNA, 20 nt, Human
uggagcaguccucagacagc

SEQ ID NO: 1281151 - RNA, 21 nt, Human
uggaugaaaagagcugccuug

SEQ ID NO: 1281152 - RNA, 27 nt, Human
uggauucccgcacuucuggagcagucc

SEQ ID NO: 1281153 - RNA, 24 nt, Human
ugggcagugggaauaggcaguugg

SEQ ID NO: 1281154 - RNA, 20 nt, Human
uggggggugggaggcuaagg

SEQ ID NO: 1281155 - RNA, 22 nt, Human
uggggggugggaggcuaaggaa

SEQ ID NO: 1281156 - RNA, 24 nt, Human
uuaaggacaaaagcgugaguccau

SEQ ID NO: 1281157 - RNA, 21 nt, Human
uuuuggcgucaugggaacucc

SEQ ID NO: 1281158 - RNA, 23 nt, Human
uuuuuuuuuuuuuuuuuuuaugg

SEQ ID NO: 1281159 - RNA, 18 nt, Human
aaaauuaaaacaucagcc

SEQ ID NO: 1281160 - RNA, 20 nt, Human
aacauagugagaccccccca

SEQ ID NO: 1281161 - RNA, 23 nt, Human
aacauagugagacccccccaucu

SEQ ID NO: 1281162 - RNA, 25 nt, Human
aagaagaaaaaguagagagacacga

SEQ ID NO: 1281163 - RNA, 21 nt, Human
aagaagaagaaaaaguagaga

SEQ ID NO: 1281164 - RNA, 23 nt, Human
aagaggccaagagacaugguggg

SEQ ID NO: 1281165 - RNA, 20 nt, Human
aaugucaaaagaaugaaaug

SEQ ID NO: 1281166 - RNA, 21 nt, Human
acaucacagugcucaaggagc

SEQ ID NO: 1281167 - RNA, 25 nt, Human
agaaaaaguagagagacacgaggac

SEQ ID NO: 1281168 - RNA, 21 nt, Human
agaagaagaaaaaguagagag

SEQ ID NO: 1281169 - RNA, 22 nt, Human
agacccccccaucucugcaaaa

SEQ ID NO: 1281170 - RNA, 21 nt, Human
agacucaacaccaaaccagaa

SEQ ID NO: 1281171 - RNA, 23 nt, Human
agcaagaagaagaaaaaguagag

SEQ ID NO: 1281172 - RNA, 25 nt, Human
agcaagaagaagaaaaaguagagag

SEQ ID NO: 1281173 - RNA, 22 nt, Human
agccugggcaacauagugagac

SEQ ID NO: 1281174 - RNA, 23 nt, Human
agccugggcaacauagugagacc

SEQ ID NO: 1281175 - RNA, 24 nt, Human
agccugggcaacauagugagaccc

SEQ ID NO: 1281176 - RNA, 20 nt, Human
agcuucuugggaggcugagg

SEQ ID NO: 1281177 - RNA, 24 nt, Human
agcuucuugggaggcugagguggg

SEQ ID NO: 1281178 - RNA, 19 nt, Human
aggcagcaggagagagacu

SEQ ID NO: 1281179 - RNA, 22 nt, Human
aggccaagagacaugacuauga

SEQ ID NO: 1281180 - RNA, 24 nt, Human
aggcugaggugggaggauugcuug

SEQ ID NO: 1281181 - RNA, 22 nt, Human
aggugggaggauugcuugagcu

SEQ ID NO: 1281182 - RNA, 23 nt, Human
agguugaggcugcagugagccau

SEQ ID NO: 1281183 - RNA, 24 nt, Human
agugagccauugcauuccagccug

SEQ ID NO: 1281184 - RNA, 18 nt, Human
auacuggacccucccaag

SEQ ID NO: 1281185 - RNA, 18 nt, Human
augucaaaagaaugaaau

SEQ ID NO: 1281186 - RNA, 18 nt, Human
auugcauuccagccuggg

SEQ ID NO: 1281187 - RNA, 24 nt, Human
auugcauuccagccugggucacgg

SEQ ID NO: 1281188 - RNA, 19 nt, Human
auugcuugagcucaggagg

SEQ ID NO: 1281189 - RNA, 20 nt, Human
caaaauuaaaacaucagccg

SEQ ID NO: 1281190 - RNA, 22 nt, Human
caaaauuaaaacaucagccgac

SEQ ID NO: 1281191 - RNA, 23 nt, Human
cagcagaccgagucgaaaucuga

SEQ ID NO: 1281192 - RNA, 23 nt, Human
caucuuuaucuugagagaggaag

SEQ ID NO: 1281193 - RNA, 23 nt, Human
cauuccagccugggucacggagc

SEQ ID NO: 1281194 - RNA, 18 nt, Human
cauugcauuccagccugg

SEQ ID NO: 1281195 - RNA, 19 nt, Human
cauugcauuccagccuggg

SEQ ID NO: 1281196 - RNA, 20 nt, Human
cauugcauuccagccugggu

SEQ ID NO: 1281197 - RNA, 22 nt, Human
cauugcauuccagccuggguca

SEQ ID NO: 1281198 - RNA, 20 nt, Human
ccauugcauuccagccuggg

SEQ ID NO: 1281199 - RNA, 21 nt, Human
ccauugcauuccagccugggu

SEQ ID NO: 1281200 - RNA, 22 nt, Human
ccauugcauuccagccuggguc

SEQ ID NO: 1281201 - RNA, 24 nt, Human
ccauugcauuccagccugggucac

SEQ ID NO: 1281202 - RNA, 25 nt, Human
cccgccccggcccccaccucgggag

SEQ ID NO: 1281203 - RNA, 21 nt, Human
cccggcccccaccucgggagc

SEQ ID NO: 1281204 - RNA, 22 nt, Human
ccucauacuggacccucccaag

SEQ ID NO: 1281205 - RNA, 24 nt, Human
cgagaccagccugggcaacauagu

SEQ ID NO: 1281206 - RNA, 24 nt, Human
cgccccggcccccaccucgggagc

SEQ ID NO: 1281207 - RNA, 18 nt, Human
cugcagugagccauugca

SEQ ID NO: 1281208 - RNA, 21 nt, Human
cuuagcacugaacucgucaca

SEQ ID NO: 1281209 - RNA, 24 nt, Human
gaccguguccccauccagcaagac

SEQ ID NO: 1281210 - RNA, 22 nt, Human
gagccucccacggcccgcccag

SEQ ID NO: 1281211 - RNA, 24 nt, Human
gaggugggaggauugcuugagcuc

SEQ ID NO: 1281212 - RNA, 24 nt, Human
gcaggagagagacucaacaccaaa

SEQ ID NO: 1281213 - RNA, 24 nt, Human
gcauuccagccugggucacggagc

SEQ ID NO: 1281214 - RNA, 19 nt, Human
gccauugcauuccagccug

SEQ ID NO: 1281215 - RNA, 24 nt, Human
gcucaggagguugaggcugcagug

SEQ ID NO: 1281216 - RNA, 24 nt, Human
gcuugagcucaggagguugaggcu

SEQ ID NO: 1281217 - RNA, 21 nt, Human
ggagccucccacggcccgccc

SEQ ID NO: 1281218 - RNA, 22 nt, Human
ggaggauugcuugagcucagga

SEQ ID NO: 1281219 - RNA, 27 nt, Human
gucauccucucaccucauacuggaccc

SEQ ID NO: 1281220 - RNA, 25 nt, Human
uaaaaaccucagaucagcagaccga

SEQ ID NO: 1281221 - RNA, 20 nt, Human
uaaaauauucaaauaauguc

SEQ ID NO: 1281222 - RNA, 24 nt, Human
uagagagacacgaggacacacaca

SEQ ID NO: 1281223 - RNA, 23 nt, Human
uagcuucuugggaggcugaggug

SEQ ID NO: 1281224 - RNA, 24 nt, Human
uagcuucuugggaggcugaggugg

SEQ ID NO: 1281225 - RNA, 22 nt, Human
uagugagacccccccaucucug

SEQ ID NO: 1281226 - RNA, 22 nt, Human
ucaaagcaaguauugcuuuacc

SEQ ID NO: 1281227 - RNA, 19 nt, Human
ucacggagcugguggccag

SEQ ID NO: 1281228 - RNA, 24 nt, Human
ucagcagaccgagucgaaaucuga

SEQ ID NO: 1281229 - RNA, 19 nt, Human
ucccaaggaggaugugacc

SEQ ID NO: 1281230 - RNA, 21 nt, Human
ucucagguuuccuacauggcu

SEQ ID NO: 1281231 - RNA, 23 nt, Human
ugaaaugauagcgauauagccaa

SEQ ID NO: 1281232 - RNA, 23 nt, Human
ugaaugcaguccgucauaugacc

SEQ ID NO: 1281233 - RNA, 21 nt, Human
ugagagaggaagaggccaaga

SEQ ID NO: 1281234 - RNA, 20 nt, Human
ugaggugggaggauugcuug

SEQ ID NO: 1281235 - RNA, 22 nt, Human
ugaggugggaggauugcuugag

SEQ ID NO: 1281236 - RNA, 22 nt, Human
ugaggugggaggauugcuugag

SEQ ID NO: 1281237 - RNA, 23 nt, Human
ugaggugggaggauugcuugagc

SEQ ID NO: 1281238 - RNA, 24 nt, Human
ugaggugggaggauugcuugagcu

SEQ ID NO: 1281239 - RNA, 20 nt, Human
ugcauuccagccugggucac

SEQ ID NO: 1281240 - RNA, 18 nt, Human
ugcucaaggagccggcag

SEQ ID NO: 1281241 - RNA, 22 nt, Human
ugggaggcugaggugggaggau

SEQ ID NO: 1281242 - RNA, 24 nt, Human
ugggaggcugaggugggaggauug

SEQ ID NO: 1281243 - RNA, 20 nt, Human
uggugguguguacauguggu

SEQ ID NO: 1281244 - RNA, 21 nt, Human
uguccccauccagcaagacca

SEQ ID NO: 1281245 - RNA, 20 nt, Human
ugugaccaaauguuugcaga

SEQ ID NO: 1281246 - RNA, 24 nt, Human
uugcuugagcucaggagguugagg

SEQ ID NO: 1281247 - RNA, 20 nt, Human
uugggaggcugaggugggag

SEQ ID NO: 1281248 - RNA, 19 nt, Human
uuuaacauaccccuuggcc

SEQ ID NO: 1281249 - RNA, 24 nt, Human
uuuauuagucuuauuuuccaguaa

SEQ ID NO: 1281250 - RNA, 20 nt, Human
aaaaccugagauugugaaga

SEQ ID NO: 1281251 - RNA, 24 nt, Human
aaaggagaaauguugaacagagag

SEQ ID NO: 1281252 - RNA, 24 nt, Human
aaagugcugggauuacagguguga

SEQ ID NO: 1281253 - RNA, 21 nt, Human
aacauccuacaaugccccgga

SEQ ID NO: 1281254 - RNA, 20 nt, Human
aagaaaaggcagacucauga

SEQ ID NO: 1281255 - RNA, 24 nt, Human
aagaaaaggcagacucaugacuga

SEQ ID NO: 1281256 - RNA, 21 nt, Human
aagaaugauccagccccaaau

SEQ ID NO: 1281257 - RNA, 25 nt, Human
aagcgauccucccaccucagccucc

SEQ ID NO: 1281258 - RNA, 18 nt, Human
aagugcugggauuacagg

SEQ ID NO: 1281259 - RNA, 19 nt, Human
aagugcugggauuacaggu

SEQ ID NO: 1281260 - RNA, 22 nt, Human
aauagugcugaaagugagagac

SEQ ID NO: 1281261 - RNA, 19 nt, Human
acagcuguccuaagacuuu

SEQ ID NO: 1281262 - RNA, 24 nt, Human
acccugauuccaucuuagagauca

SEQ ID NO: 1281263 - RNA, 24 nt, Human
acucuauccagccucaacuguuuu

SEQ ID NO: 1281264 - RNA, 19 nt, Human
acugcagccucuaccuccu

SEQ ID NO: 1281265 - RNA, 24 nt, Human
agcguccacuuuucuccccugggc

SEQ ID NO: 1281266 - RNA, 18 nt, Human
aggcccugagcgugacau

SEQ ID NO: 1281267 - RNA, 22 nt, Human
aguacagaguucuggagagaga

SEQ ID NO: 1281268 - RNA, 23 nt, Human
aguagcugagaccacaggcgugu

SEQ ID NO: 1281269 - RNA, 18 nt, Human
agugagggguucauguac

SEQ ID NO: 1281270 - RNA, 20 nt, Human
agugcaguggugcaaucccg

SEQ ID NO: 1281271 - RNA, 21 nt, Human
aguggggcugggagguggcug

SEQ ID NO: 1281272 - RNA, 22 nt, Human
aucacuuugcaauaaaaccuga

SEQ ID NO: 1281273 - RNA, 19 nt, Human
auggagcaguaaguacaga

SEQ ID NO: 1281274 - RNA, 24 nt, Human
caaagugcugggauuacaggugug

SEQ ID NO: 1281275 - RNA, 27 nt, Human
caagcgauccucccaccucagccuccc

SEQ ID NO: 1281276 - RNA, 24 nt, Human
caaggucuugcuauuuugcccagg

SEQ ID NO: 1281277 - RNA, 19 nt, Human
caaucucugguuucuuugc

SEQ ID NO: 1281278 - RNA, 20 nt, Human
cacauauuuaugaaaaugcc

SEQ ID NO: 1281279 - RNA, 24 nt, Human
caccucagccucccgaguagcuga

SEQ ID NO: 1281280 - RNA, 21 nt, Human
caccuggcuaauuuuuuuccc

SEQ ID NO: 1281281 - RNA, 21 nt, Human
cacguguggucagcaaaucca

SEQ ID NO: 1281282 - RNA, 23 nt, Human
cacugcagccucuaccuccuggg

SEQ ID NO: 1281283 - RNA, 21 nt, Human
cacuuugcaauaaaaccugag

SEQ ID NO: 1281284 - RNA, 21 nt, Human
cacuuuucuccccugggccau

SEQ ID NO: 1281285 - RNA, 20 nt, Human
cagcaucuuuuaaccucagu

SEQ ID NO: 1281286 - RNA, 23 nt, Human
cagccucuaccuccuggguucaa

SEQ ID NO: 1281287 - RNA, 19 nt, Human
cagggcuucucagccaggg

SEQ ID NO: 1281288 - RNA, 20 nt, Human
cauccaagcacacuuggcca

SEQ ID NO: 1281289 - RNA, 23 nt, Human
caugaagaaaaggcagacucaug

SEQ ID NO: 1281290 - RNA, 25 nt, Human
caugaagaaaaggcagacucaugac

SEQ ID NO: 1281291 - RNA, 24 nt, Human
cauuuucaauugauucauuggggg

SEQ ID NO: 1281292 - RNA, 20 nt, Human
ccaaagugcugggauuacag

SEQ ID NO: 1281293 - RNA, 21 nt, Human
ccaaagugcugggauuacagg

SEQ ID NO: 1281294 - RNA, 21 nt, Human
ccaaagugcugggauuacagg

SEQ ID NO: 1281295 - RNA, 24 nt, Human
ccaaagugcugggauuacaggugu

SEQ ID NO: 1281296 - RNA, 23 nt, Human
ccaccucagccucccgaguagcu

SEQ ID NO: 1281297 - RNA, 22 nt, Human
ccaugaagaaaaggcagacuca

SEQ ID NO: 1281298 - RNA, 23 nt, Human
cccaccucagccucccgaguagc

SEQ ID NO: 1281299 - RNA, 19 nt, Human
cccaggcuggagugcagug

SEQ ID NO: 1281300 - RNA, 21 nt, Human
cccccagagaacauguggcca

SEQ ID NO: 1281301 - RNA, 22 nt, Human
cccccagagaacauguggccau

SEQ ID NO: 1281302 - RNA, 18 nt, Human
cccuggagagcaggaugg

SEQ ID NO: 1281303 - RNA, 21 nt, Human
ccuacaaugccccggacaacu

SEQ ID NO: 1281304 - RNA, 21 nt, Human
ccucaguuuaaagaugacuau

SEQ ID NO: 1281305 - RNA, 24 nt, Human
ccuccuggguucaagcgauccucc

SEQ ID NO: 1281306 - RNA, 19 nt, Human
ccucuaccuccuggguuca

SEQ ID NO: 1281307 - RNA, 23 nt, Human
ccugaguucaagcaauuuucccg

SEQ ID NO: 1281308 - RNA, 20 nt, Human
ccuggguucaagcgauccuc

SEQ ID NO: 1281309 - RNA, 23 nt, Human
ccuggguucaagcgauccuccca

SEQ ID NO: 1281310 - RNA, 21 nt, Human
ccuguagcugucaacucugug

SEQ ID NO: 1281311 - RNA, 19 nt, Human
cggcuggaggagguggugc

SEQ ID NO: 1281312 - RNA, 24 nt, Human
cggggaguggggcugggagguggc

SEQ ID NO: 1281313 - RNA, 19 nt, Human
cuacguggcaauaagcagu

SEQ ID NO: 1281314 - RNA, 24 nt, Human
cucacugcagccucuaccuccugg

SEQ ID NO: 1281315 - RNA, 22 nt, Human
cucucggcagcugggacuucau

SEQ ID NO: 1281316 - RNA, 20 nt, Human
cucugugcuauaguacugcu

SEQ ID NO: 1281317 - RNA, 23 nt, Human
cugcagccucuaccuccuggguu

SEQ ID NO: 1281318 - RNA, 18 nt, Human
cugcccggaacauggcgg

SEQ ID NO: 1281319 - RNA, 20 nt, Human
cugcggggaguggggcuggg

SEQ ID NO: 1281320 - RNA, 18 nt, Human
cuguagcccaggcuggag

SEQ ID NO: 1281321 - RNA, 25 nt, Human
cuucagggcuucucagccagggggu

SEQ ID NO: 1281322 - RNA, 21 nt, Human
gaaaaugccaccccaggaauu

SEQ ID NO: 1281323 - RNA, 21 nt, Human
gacugcggggaguggggcugg

SEQ ID NO: 1281324 - RNA, 24 nt, Human
gagagagaaggaauugagagaguu

SEQ ID NO: 1281325 - RNA, 24 nt, Human
gagaggaccucauuuuuauaacuc

SEQ ID NO: 1281326 - RNA, 19 nt, Human
gaguaaucccaaagugcug

SEQ ID NO: 1281327 - RNA, 26 nt, Human
gaguagcugagaccacaggcguguau

SEQ ID NO: 1281328 - RNA, 20 nt, Human
gaguucuggagagagaagga

SEQ ID NO: 1281329 - RNA, 19 nt, Human
gauuacaggugugauucac

SEQ ID NO: 1281330 - RNA, 20 nt, Human
gauuacaggugugauucacu

SEQ ID NO: 1281331 - RNA, 18 nt, Human
gcaacaucgaugggaguu

SEQ ID NO: 1281332 - RNA, 20 nt, Human
gcagaaugagccgcucaccc

SEQ ID NO: 1281333 - RNA, 19 nt, Human
gcccaggcuggagugcagu

SEQ ID NO: 1281334 - RNA, 20 nt, Human
gcccaggcuggagugcagug

SEQ ID NO: 1281335 - RNA, 23 nt, Human
gcccaggcuggagugcaguggug

SEQ ID NO: 1281336 - RNA, 18 nt, Human
gcggggaguggggcuggg

SEQ ID NO: 1281337 - RNA, 22 nt, Human
gcuaauuuuuuucccuuuuucu

SEQ ID NO: 1281338 - RNA, 21 nt, Human
gcucacugcagccucuaccuc

SEQ ID NO: 1281339 - RNA, 23 nt, Human
gcuggaggagguggugcuacugg

SEQ ID NO: 1281340 - RNA, 19 nt, Human
ggagguggcuguuugcacg

SEQ ID NO: 1281341 - RNA, 21 nt, Human
ggcaaggucuugcuauuuugc

SEQ ID NO: 1281342 - RNA, 20 nt, Human
ggcuggucuugaacuccuga

SEQ ID NO: 1281343 - RNA, 18 nt, Human
gggaguggggcugggagg

SEQ ID NO: 1281344 - RNA, 18 nt, Human
ggggaguggggcugggag

SEQ ID NO: 1281345 - RNA, 19 nt, Human
gucucaaucucugguuucu

SEQ ID NO: 1281346 - RNA, 24 nt, Human
gucuugcuauuuugcccaggcugg

SEQ ID NO: 1281347 - RNA, 20 nt, Human
uaagacucuggcuuugucag

SEQ ID NO: 1281348 - RNA, 18 nt, Human
uaaucccaaagugcuggg

SEQ ID NO: 1281349 - RNA, 21 nt, Human
uacagaguucuggagagagaa

SEQ ID NO: 1281350 - RNA, 22 nt, Human
uaccguuugugcaaguugugca

SEQ ID NO: 1281351 - RNA, 24 nt, Human
uaccuccuggguucaagcgauccu

SEQ ID NO: 1281352 - RNA, 22 nt, Human
uacugcuuuuuuuuuuuuccuu

SEQ ID NO: 1281353 - RNA, 21 nt, Human
uacuuacaugugaucugcgua

SEQ ID NO: 1281354 - RNA, 21 nt, Human
uagagaucauccaagcacacu

SEQ ID NO: 1281355 - RNA, 20 nt, Human
uagaggcaaggucuugcuau

SEQ ID NO: 1281356 - RNA, 24 nt, Human
uagaggcccugagcgugacauuuc

SEQ ID NO: 1281357 - RNA, 25 nt, Human
uaguacugcuuuuuuuuuuuuccuu

SEQ ID NO: 1281358 - RNA, 18 nt, Human
uaugucuuuacuucaggg

SEQ ID NO: 1281359 - RNA, 24 nt, Human
uauuuugcccaggcuggucuugaa

SEQ ID NO: 1281360 - RNA, 23 nt, Human
ucaagaaaggagaaauguugaaa

SEQ ID NO: 1281361 - RNA, 24 nt, Human
ucacccucagaauugcuuuuaauc

SEQ ID NO: 1281362 - RNA, 23 nt, Human
ucacugcagccucuaccuccugg

SEQ ID NO: 1281363 - RNA, 24 nt, Human
ucacugcagccucuaccuccuggg

SEQ ID NO: 1281364 - RNA, 18 nt, Human
ucagcagcguugucccug

SEQ ID NO: 1281365 - RNA, 20 nt, Human
ucagggagacugcggggagu

SEQ ID NO: 1281366 - RNA, 26 nt, Human
ucagugcagcuguguuuggggcuuug

SEQ ID NO: 1281367 - RNA, 24 nt, Human
ucauggcuuauacuuuugauagau

SEQ ID NO: 1281368 - RNA, 23 nt, Human
ucccaaagugcugggauuacagg

SEQ ID NO: 1281369 - RNA, 24 nt, Human
ucccgaguagcugagaccacaggc

SEQ ID NO: 1281370 - RNA, 19 nt, Human
ucccuggagagcaggaugg

SEQ ID NO: 1281371 - RNA, 26 nt, Human
uccucccaccucagccucccgaguag

SEQ ID NO: 1281372 - RNA, 21 nt, Human
uccugaguucaagcaauuuuc

SEQ ID NO: 1281373 - RNA, 24 nt, Human
uccugaguucaagcaauuuucccg

SEQ ID NO: 1281374 - RNA, 21 nt, Human
uccuggguucaagcgauccuc

SEQ ID NO: 1281375 - RNA, 25 nt, Human
ucuacguggcaauaagcaguugcuc

SEQ ID NO: 1281376 - RNA, 23 nt, Human
ucucugguuucuuugcucagugc

SEQ ID NO: 1281377 - RNA, 19 nt, Human
ucuguagcccaggcuggag

SEQ ID NO: 1281378 - RNA, 24 nt, Human
ucuguagcccaggcuggagugcag

SEQ ID NO: 1281379 - RNA, 23 nt, Human
ucuugaacuccugaguucaagca

SEQ ID NO: 1281380 - RNA, 23 nt, Human
ucuugcuauuuugcccaggcugg

SEQ ID NO: 1281381 - RNA, 24 nt, Human
ucuugcuauuuugcccaggcuggu

SEQ ID NO: 1281382 - RNA, 24 nt, Human
ugaaaaugccaccccaggaauugc

SEQ ID NO: 1281383 - RNA, 19 nt, Human
ugaacagagaggaccucau

SEQ ID NO: 1281384 - RNA, 20 nt, Human
ugaagaaaaggcagacucau

SEQ ID NO: 1281385 - RNA, 19 nt, Human
ugacugauggcaacaucga

SEQ ID NO: 1281386 - RNA, 21 nt, Human
ugagaccacaggcguguauca

SEQ ID NO: 1281387 - RNA, 23 nt, Human
ugagggaaugucauuuugucuca

SEQ ID NO: 1281388 - RNA, 21 nt, Human
ugaguucaagcaauuuucccg

SEQ ID NO: 1281389 - RNA, 24 nt, Human
ugaguucaagcaauuuucccgucu

SEQ ID NO: 1281390 - RNA, 23 nt, Human
ugaugggauuucuuuaguuucug

SEQ ID NO: 1281391 - RNA, 20 nt, Human
ugcagcuguguuuggggcuu

SEQ ID NO: 1281392 - RNA, 22 nt, Human
ugcaguggugcaaucccggcuc

SEQ ID NO: 1281393 - RNA, 19 nt, Human
ugccaccccaggaauugca

SEQ ID NO: 1281394 - RNA, 24 nt, Human
ugcccaggcuggucuugaacuccu

SEQ ID NO: 1281395 - RNA, 27 nt, Human
ugcccaggcuggucuugaacuccugag

SEQ ID NO: 1281396 - RNA, 19 nt, Human
ugccccggacaacucccac

SEQ ID NO: 1281397 - RNA, 22 nt, Human
ugcccggaacauggcgguaaga

SEQ ID NO: 1281398 - RNA, 18 nt, Human
ugcccuggggugcucugg

SEQ ID NO: 1281399 - RNA, 21 nt, Human
ugcccuggggugcucuggaac

SEQ ID NO: 1281400 - RNA, 19 nt, Human
ugcggggaguggggcuggg

SEQ ID NO: 1281401 - RNA, 18 nt, Human
ugcugggauuacaggugu

SEQ ID NO: 1281402 - RNA, 24 nt, Human
ugcugggauuacaggugugauuca

SEQ ID NO: 1281403 - RNA, 18 nt, Human
uggagacaauuuuggugg

SEQ ID NO: 1281404 - RNA, 18 nt, Human
uggagcaguaaguacaga

SEQ ID NO: 1281405 - RNA, 24 nt, Human
uggagugcaguggugcaaucccgg

SEQ ID NO: 1281406 - RNA, 22 nt, Human
uggcaacaucgaugggaguuuu

SEQ ID NO: 1281407 - RNA, 24 nt, Human
uggcuaauuuuuuucccuuuuucu

SEQ ID NO: 1281408 - RNA, 21 nt, Human
ugggauuacaggugugauuca

SEQ ID NO: 1281409 - RNA, 22 nt, Human
ugggauuacaggugugauucac

SEQ ID NO: 1281410 - RNA, 23 nt, Human
ugggauuacaggugugauucacu

SEQ ID NO: 1281411 - RNA, 25 nt, Human
ugggauuacaggugugauucacucu

SEQ ID NO: 1281412 - RNA, 24 nt, Human
uggugcaaucccggcucacugcag

SEQ ID NO: 1281413 - RNA, 19 nt, Human
ugguugcggcuggaggagg

SEQ ID NO: 1281414 - RNA, 21 nt, Human
uguagcccaggcuggagugca

SEQ ID NO: 1281415 - RNA, 18 nt, Human
ugucccuggagagcagga

SEQ ID NO: 1281416 - RNA, 18 nt, Human
uguggcccuuaggcucuc

SEQ ID NO: 1281417 - RNA, 24 nt, Human
uucaagcgauccucccaccucagc

SEQ ID NO: 1281418 - RNA, 18 nt, Human
uucauugucauuaccagu

SEQ ID NO: 1281419 - RNA, 24 nt, Human
uucucagccagggggugauuuugc

SEQ ID NO: 1281420 - RNA, 18 nt, Human
uugcucagugcagcugug

SEQ ID NO: 1281421 - RNA, 23 nt, Human
uuggugguugcggcuggaggagg

SEQ ID NO: 1281422 - RNA, 19 nt, Human
uugucccuggagagcagga

SEQ ID NO: 1281423 - RNA, 21 nt, Human
uuuccuuucucuuucuccacc

SEQ ID NO: 1281424 - RNA, 23 nt, Human
uuuuucagcagcguugucccugg

SEQ ID NO: 1281425 - RNA, 18 nt, Human
aaacagcauuuacuacuu

SEQ ID NO: 1281426 - RNA, 19 nt, Human
aaagaggucaugauuuuga

SEQ ID NO: 1281427 - RNA, 19 nt, Human
aaaggcacaaacaaguucu

SEQ ID NO: 1281428 - RNA, 20 nt, Human
aacacggcaaaacccugucu

SEQ ID NO: 1281429 - RNA, 21 nt, Human
aacacggcaaaacccugucuc

SEQ ID NO: 1281430 - RNA, 23 nt, Human
aacacuacuugcaccaaaaucac

SEQ ID NO: 1281431 - RNA, 25 nt, Human
aaccaaugaaaugaacauccucuca

SEQ ID NO: 1281432 - RNA, 23 nt, Human
aagaaugcauacucuugggcccc

SEQ ID NO: 1281433 - RNA, 22 nt, Human
acaaaacagaaugaauuagcag

SEQ ID NO: 1281434 - RNA, 25 nt, Human
acaaaacagaaugaauuagcagaaa

SEQ ID NO: 1281435 - RNA, 21 nt, Human
acaauuaucccaaaauagcac

SEQ ID NO: 1281436 - RNA, 22 nt, Human
acccaaauuuugaggauuaaca

SEQ ID NO: 1281437 - RNA, 24 nt, Human
acccugucucuacuaaaaauauga

SEQ ID NO: 1281438 - RNA, 21 nt, Human
acuaaacuuggagaauuacag

SEQ ID NO: 1281439 - RNA, 18 nt, Human
acugcaguccagccuggg

SEQ ID NO: 1281440 - RNA, 20 nt, Human
acugcaguccagccugggag

SEQ ID NO: 1281441 - RNA, 24 nt, Human
acugcaguccagccugggagacag

SEQ ID NO: 1281442 - RNA, 19 nt, Human
agagcaagaauuuaaaccc

SEQ ID NO: 1281443 - RNA, 24 nt, Human
agcacuuugggaugccaagguggg

SEQ ID NO: 1281444 - RNA, 24 nt, Human
agcagaaaaauguauguuauaaaa

SEQ ID NO: 1281445 - RNA, 20 nt, Human
agccuggccaacacggcaag

SEQ ID NO: 1281446 - RNA, 18 nt, Human
aggcaggagaaucgcacc

SEQ ID NO: 1281447 - RNA, 19 nt, Human
aggcaggagaaucgcacca

SEQ ID NO: 1281448 - RNA, 20 nt, Human
aggcugaggcaggagaaucg

SEQ ID NO: 1281449 - RNA, 20 nt, Human
aggcugaggcaggagaaucg

SEQ ID NO: 1281450 - RNA, 19 nt, Human
aggucaggaguucaagacc

SEQ ID NO: 1281451 - RNA, 25 nt, Human
aguaucuacucuuucaaaauauaac

SEQ ID NO: 1281452 - RNA, 24 nt, Human
agucaaguaacacauaugaaaauu

SEQ ID NO: 1281453 - RNA, 24 nt, Human
aucaccugaggucaggaguucaag

SEQ ID NO: 1281454 - RNA, 18 nt, Human
aucauauacauaaaaaug

SEQ ID NO: 1281455 - RNA, 24 nt, Human
aucgcaccacugcaguccagccug

SEQ ID NO: 1281456 - RNA, 19 nt, Human
augaaaauucauguccaca

SEQ ID NO: 1281457 - RNA, 20 nt, Human
augaaaugaacauccucuca

SEQ ID NO: 1281458 - RNA, 26 nt, Human
auuaggucacacaaaacagaaugaau

SEQ ID NO: 1281459 - RNA, 23 nt, Human
caaaauagcaccaaccuucagac

SEQ ID NO: 1281460 - RNA, 18 nt, Human
caagaauuuaaacccaag

SEQ ID NO: 1281461 - RNA, 24 nt, Human
caagguggguggaucaccugaggu

SEQ ID NO: 1281462 - RNA, 26 nt, Human
caagguggguggaucaccugagguca

SEQ ID NO: 1281463 - RNA, 23 nt, Human
cacacaaaacagaaugaauuagc

SEQ ID NO: 1281464 - RNA, 22 nt, Human
caccauggugaagaguuguuca

SEQ ID NO: 1281465 - RNA, 19 nt, Human
caccucagauccuauaaac

SEQ ID NO: 1281466 - RNA, 22 nt, Human
caccucagauccuauaaacuaa

SEQ ID NO: 1281467 - RNA, 23 nt, Human
caccugaggucaggaguucaaga

SEQ ID NO: 1281468 - RNA, 24 nt, Human
cacgcucguaaucccagcacuuug

SEQ ID NO: 1281469 - RNA, 18 nt, Human
cacugcaguccagccugg

SEQ ID NO: 1281470 - RNA, 24 nt, Human
cacugcaguccagccugggagaca

SEQ ID NO: 1281471 - RNA, 24 nt, Human
cacugugacaauuuggcuggguua

SEQ ID NO: 1281472 - RNA, 23 nt, Human
cagaaugaauuagcagaaaaaug

SEQ ID NO: 1281473 - RNA, 21 nt, Human
cagcacuuugggaugccaagg

SEQ ID NO: 1281474 - RNA, 24 nt, Human
cagcacuuugggaugccaaggugg

SEQ ID NO: 1281475 - RNA, 20 nt, Human
cagccugggagacagaguga

SEQ ID NO: 1281476 - RNA, 23 nt, Human
caguccagccugggagacagagu

SEQ ID NO: 1281477 - RNA, 21 nt, Human
ccaaaaugaaugauccaauga

SEQ ID NO: 1281478 - RNA, 23 nt, Human
ccaagccugauacgguuccaaug

SEQ ID NO: 1281479 - RNA, 22 nt, Human
ccaaugauccuuuaaguuaucu

SEQ ID NO: 1281480 - RNA, 20 nt, Human
ccacugcaguccagccuggg

SEQ ID NO: 1281481 - RNA, 24 nt, Human
ccacugcaguccagccugggagac

SEQ ID NO: 1281482 - RNA, 24 nt, Human
ccgcuacucgggaggcugaggcag

SEQ ID NO: 1281483 - RNA, 22 nt, Human
ccuggccaacacggcaaaaccc

SEQ ID NO: 1281484 - RNA, 24 nt, Human
ccuggccaacacggcaaaacccug

SEQ ID NO: 1281485 - RNA, 19 nt, Human
ccuguaauccccgcuacuc

SEQ ID NO: 1281486 - RNA, 19 nt, Human
ccuguaauccccgcuacuc

SEQ ID NO: 1281487 - RNA, 21 nt, Human
cgcaccacugcaguccagccu

SEQ ID NO: 1281488 - RNA, 24 nt, Human
cgcucguaaucccagcacuuuggg

SEQ ID NO: 1281489 - RNA, 22 nt, Human
cucacgcucguaaucccagcac

SEQ ID NO: 1281490 - RNA, 24 nt, Human
cucacgcucguaaucccagcacuu

SEQ ID NO: 1281491 - RNA, 18 nt, Human
cugccccugccccugccc

SEQ ID NO: 1281492 - RNA, 19 nt, Human
cugccccugccccugcccc

SEQ ID NO: 1281493 - RNA, 18 nt, Human
gagaaucgcaccacugca

SEQ ID NO: 1281494 - RNA, 23 nt, Human
gaguuugcuuaaacacaacugcu

SEQ ID NO: 1281495 - RNA, 21 nt, Human
gaucaccugaggucaggaguu

SEQ ID NO: 1281496 - RNA, 23 nt, Human
gaucaccugaggucaggaguuca

SEQ ID NO: 1281497 - RNA, 24 nt, Human
gaucaccugaggucaggaguucaa

SEQ ID NO: 1281498 - RNA, 20 nt, Human
gcaccacugcaguccagccu

SEQ ID NO: 1281499 - RNA, 24 nt, Human
gccaacacggcaaaacccugucuc

SEQ ID NO: 1281500 - RNA, 26 nt, Human
gccaagguggguggaucaccugaggu

SEQ ID NO: 1281501 - RNA, 21 nt, Human
gcuuugugacagugacaaagu

SEQ ID NO: 1281502 - RNA, 19 nt, Human
gggcguggcagcgcgugcc

SEQ ID NO: 1281503 - RNA, 24 nt, Human
gggcguggcagcgcgugccuguaa

SEQ ID NO: 1281504 - RNA, 21 nt, Human
gguggaucaccugaggucagg

SEQ ID NO: 1281505 - RNA, 20 nt, Human
gugcauguuuucacuacgug

SEQ ID NO: 1281506 - RNA, 21 nt, Human
uaaaugcaguacuuacacucc

SEQ ID NO: 1281507 - RNA, 23 nt, Human
uaacuaauagccaccucagaucc

SEQ ID NO: 1281508 - RNA, 20 nt, Human
uagcaccaaccuucagacug

SEQ ID NO: 1281509 - RNA, 20 nt, Human
uagcauacaguuggcauugg

SEQ ID NO: 1281510 - RNA, 18 nt, Human
uagccaccucagauccua

SEQ ID NO: 1281511 - RNA, 23 nt, Human
uagccgggugcugugacucacgg

SEQ ID NO: 1281512 - RNA, 22 nt, Human
uaggucacacaaaacagaauga

SEQ ID NO: 1281513 - RNA, 24 nt, Human
uagugugauccuggacuacacuga

SEQ ID NO: 1281514 - RNA, 22 nt, Human
uauaacacccaaauuuugagga

SEQ ID NO: 1281515 - RNA, 21 nt, Human
ucaaagcaaauuuuucauuca

SEQ ID NO: 1281516 - RNA, 20 nt, Human
ucaguaucuggucaaagcaa

SEQ ID NO: 1281517 - RNA, 23 nt, Human
uccagccugggagacagagugag

SEQ ID NO: 1281518 - RNA, 24 nt, Human
uccagccugggagacagagugaga

SEQ ID NO: 1281519 - RNA, 20 nt, Human
ucccagcacuuugggaugcc

SEQ ID NO: 1281520 - RNA, 18 nt, Human
ucccuaauuaaaagauga

SEQ ID NO: 1281521 - RNA, 22 nt, Human
uccuucaguaucuggucaaagc

SEQ ID NO: 1281522 - RNA, 23 nt, Human
ucgcaccacugcaguccagccug

SEQ ID NO: 1281523 - RNA, 24 nt, Human
ucgggaggcugaggcaggagaauc

SEQ ID NO: 1281524 - RNA, 20 nt, Human
ucuccgaaaaaagaaauuac

SEQ ID NO: 1281525 - RNA, 23 nt, Human
ucucuacuaaaaauaugaaaacu

SEQ ID NO: 1281526 - RNA, 21 nt, Human
ucugcauuuaacaacauccug

SEQ ID NO: 1281527 - RNA, 18 nt, Human
ucuuaguaauugggcagu

SEQ ID NO: 1281528 - RNA, 19 nt, Human
ugaaaacuggcggggcgug

SEQ ID NO: 1281529 - RNA, 20 nt, Human
ugaaaacuggcggggcgugg

SEQ ID NO: 1281530 - RNA, 23 nt, Human
ugaaaugaacauccucucaaaua

SEQ ID NO: 1281531 - RNA, 24 nt, Human
ugacucacgcucguaaucccagca

SEQ ID NO: 1281532 - RNA, 24 nt, Human
ugagaugaggccccgagagaggcu

SEQ ID NO: 1281533 - RNA, 22 nt, Human
ugagauuggggucuucagaucu

SEQ ID NO: 1281534 - RNA, 19 nt, Human
ugaggcaggagaaucgcac

SEQ ID NO: 1281535 - RNA, 19 nt, Human
ugagguagguaguauuauc

SEQ ID NO: 1281536 - RNA, 23 nt, Human
ugagguagguaguauuaucaucc

SEQ ID NO: 1281537 - RNA, 23 nt, Human
ugauacgguuccaaugaacacac

SEQ ID NO: 1281538 - RNA, 27 nt, Human
ugccccugccccuagaguaucugauuu

SEQ ID NO: 1281539 - RNA, 24 nt, Human
ugccuguaauccccgcuacucggg

SEQ ID NO: 1281540 - RNA, 21 nt, Human
uggacagaguaguccaugguu

SEQ ID NO: 1281541 - RNA, 24 nt, Human
uggaucaccugaggucaggaguuc

SEQ ID NO: 1281542 - RNA, 27 nt, Human
uggaucaccugaggucaggaguucaag

SEQ ID NO: 1281543 - RNA, 24 nt, Human
uggguggaucaccugaggucagga

SEQ ID NO: 1281544 - RNA, 21 nt, Human
ugugauccuggacuacacuga

SEQ ID NO: 1281545 - RNA, 18 nt, Human
uuaauccucauaaaaauc

SEQ ID NO: 1281546 - RNA, 21 nt, Human
uuaaugcuguuuguugggacc

SEQ ID NO: 1281547 - RNA, 22 nt, Human
uucaaagaauaaaaugaaugcc

SEQ ID NO: 1281548 - RNA, 23 nt, Human
uucaaagaauaaaaugaaugccc

SEQ ID NO: 1281549 - RNA, 22 nt, Human
uuuaaacccaagcaagucugac

SEQ ID NO: 1281550 - RNA, 23 nt, Human
uuuaaacccaagcaagucugacu

SEQ ID NO: 1281551 - RNA, 22 nt, Human
uuuccuuaucuauaauaggggu

SEQ ID NO: 1281552 - RNA, 18 nt, Human
uuugaauuucugagauug

SEQ ID NO: 1281553 - RNA, 24 nt, Human
uuuuauuguaggcccugauguuag

SEQ ID NO: 1281554 - RNA, 27 nt, Human
aaacaaacaugcauaauacuuuaaaac

SEQ ID NO: 1281555 - RNA, 18 nt, Human
aacaaaggugggaacaca

SEQ ID NO: 1281556 - RNA, 20 nt, Human
aagcauauuuuugucaauag

SEQ ID NO: 1281557 - RNA, 26 nt, Human
acaaacugacuaugugcuugcauuua

SEQ ID NO: 1281558 - RNA, 24 nt, Human
accaauucaacuuccuacaaacca

SEQ ID NO: 1281559 - RNA, 22 nt, Human
agaaaaaaaugcaggaauaaca

SEQ ID NO: 1281560 - RNA, 18 nt, Human
agaaaauucucuaucaca

SEQ ID NO: 1281561 - RNA, 28 nt, Human
agaaaggaaguagaacuuaaggggaccc

SEQ ID NO: 1281562 - RNA, 19 nt, Human
aguaaaacauuuccaucuc

SEQ ID NO: 1281563 - RNA, 20 nt, Human
aguaaguaauggauauucaa

SEQ ID NO: 1281564 - RNA, 23 nt, Human
agugaaacggcaaagaacaucaa

SEQ ID NO: 1281565 - RNA, 19 nt, Human
aguugauuucaguuuuucc

SEQ ID NO: 1281566 - RNA, 24 nt, Human
auaacaccaauucaacuuccuaca

SEQ ID NO: 1281567 - RNA, 24 nt, Human
auacaaauguaccuuuuucuuaaa

SEQ ID NO: 1281568 - RNA, 23 nt, Human
aucuaauuuaaucauuaacacca

SEQ ID NO: 1281569 - RNA, 21 nt, Human
caaaauguucacguuugcauc

SEQ ID NO: 1281570 - RNA, 21 nt, Human
caaagaacaucaaacagguua

SEQ ID NO: 1281571 - RNA, 18 nt, Human
caaccgaggcagaagcag

SEQ ID NO: 1281572 - RNA, 23 nt, Human
cacaguguuuaguuucacuaugg

SEQ ID NO: 1281573 - RNA, 19 nt, Human
cacaguucuucuaagauaa

SEQ ID NO: 1281574 - RNA, 22 nt, Human
cacuccagaaagagcacgcaga

SEQ ID NO: 1281575 - RNA, 21 nt, Human
ccagaaagagcacgcagagca

SEQ ID NO: 1281576 - RNA, 22 nt, Human
ccuacaaaccagagaggagacu

SEQ ID NO: 1281577 - RNA, 21 nt, Human
cuaaaaccuucauagccuaau

SEQ ID NO: 1281578 - RNA, 22 nt, Human
cugaaaaaugccacaauucuuu

SEQ ID NO: 1281579 - RNA, 19 nt, Human
cugcugcugcugcugcugc

SEQ ID NO: 1281580 - RNA, 19 nt, Human
cugcugcugcugcugcugc

SEQ ID NO: 1281581 - RNA, 18 nt, Human
cuggaucugaaaauaauc

SEQ ID NO: 1281582 - RNA, 25 nt, Human
cuuggcacagaguuaacaaaucaua

SEQ ID NO: 1281583 - RNA, 18 nt, Human
gaaaauucucuaucacaa

SEQ ID NO: 1281584 - RNA, 24 nt, Human
gaaaauucucuaucacaauuuacc

SEQ ID NO: 1281585 - RNA, 21 nt, Human
gaaaugggccacuccagaaag

SEQ ID NO: 1281586 - RNA, 18 nt, Human
gagcaggucuagcauccu

SEQ ID NO: 1281587 - RNA, 21 nt, Human
gaggcagagggguugaaagga

SEQ ID NO: 1281588 - RNA, 23 nt, Human
ggagaaaggaaguagaacuuaag

SEQ ID NO: 1281589 - RNA, 23 nt, Human
ggcaaccgaggcagaagcaggga

SEQ ID NO: 1281590 - RNA, 24 nt, Human
gugaaacggcaaagaacaucaaac

SEQ ID NO: 1281591 - RNA, 20 nt, Human
uaacaugguaggcacaaaua

SEQ ID NO: 1281592 - RNA, 23 nt, Human
uaaucaaaauaaaugugauuuca

SEQ ID NO: 1281593 - RNA, 18 nt, Human
uaauuuaaucauuaacac

SEQ ID NO: 1281594 - RNA, 25 nt, Human
uacaaaauguucacguuugcaucag

SEQ ID NO: 1281595 - RNA, 18 nt, Human
uacaguuuauugaccaau

SEQ ID NO: 1281596 - RNA, 19 nt, Human
uagaguagugaacauaaug

SEQ ID NO: 1281597 - RNA, 22 nt, Human
uagguauuuucgacaaaauuuc

SEQ ID NO: 1281598 - RNA, 23 nt, Human
uaucaucaugagauguuuuucuu

SEQ ID NO: 1281599 - RNA, 20 nt, Human
ucaaaauaaaugugauuucc

SEQ ID NO: 1281600 - RNA, 23 nt, Human
ucuuuggaaagcuggucagagag

SEQ ID NO: 1281601 - RNA, 21 nt, Human
ugaaaauaaucaaaaauuuua

SEQ ID NO: 1281602 - RNA, 23 nt, Human
ugaaguagcaaaaaggcagagaa

SEQ ID NO: 1281603 - RNA, 20 nt, Human
ugaauucauucauaaacacu

SEQ ID NO: 1281604 - RNA, 20 nt, Human
ugagagaccaucugaaggaa

SEQ ID NO: 1281605 - RNA, 20 nt, Human
ugagagaccaucugaaggaa

SEQ ID NO: 1281606 - RNA, 20 nt, Human
ugagauguuuuucuucagga

SEQ ID NO: 1281607 - RNA, 19 nt, Human
ugcauuuaauuucaagggu

SEQ ID NO: 1281608 - RNA, 19 nt, Human
ugccacaauucuuuuucac

SEQ ID NO: 1281609 - RNA, 22 nt, Human
ugccacauuuauuaaacaaaca

SEQ ID NO: 1281610 - RNA, 20 nt, Human
ugcucagacuucggagcugu

SEQ ID NO: 1281611 - RNA, 21 nt, Human
ugcugcugcugcugcugcugc

SEQ ID NO: 1281612 - RNA, 21 nt, Human
ugcugcugcugcugcugcugc

SEQ ID NO: 1281613 - RNA, 21 nt, Human
ugcugcugcugcugcugcugc

SEQ ID NO: 1281614 - RNA, 21 nt, Human
ugcugcugcugcugcugcugc

SEQ ID NO: 1281615 - RNA, 21 nt, Human
ugcugcugcugcugcugcugc

SEQ ID NO: 1281616 - RNA, 21 nt, Human
ugcugcugcugcugcugcugc

SEQ ID NO: 1281617 - RNA, 21 nt, Human
ugcugcugcugcugcugcugc

SEQ ID NO: 1281618 - RNA, 21 nt, Human
ugcugcugcugcugcugcugc

SEQ ID NO: 1281619 - RNA, 21 nt, Human
ugcugcugcugcugcugcugc

SEQ ID NO: 1281620 - RNA, 18 nt, Human
uggaaagcuggucagaga

SEQ ID NO: 1281621 - RNA, 26 nt, Human
uggaauaauucauguaccuuuaugca

SEQ ID NO: 1281622 - RNA, 23 nt, Human
ugguaaucaaaauaaaugugauu

SEQ ID NO: 1281623 - RNA, 24 nt, Human
uguauuaaaaccaugccacauuua

SEQ ID NO: 1281624 - RNA, 18 nt, Human
uuaaaguaaguaauggau

SEQ ID NO: 1281625 - RNA, 18 nt, Human
uucaagaacuaaaaguca

SEQ ID NO: 1281626 - RNA, 24 nt, Human
uucacacaaaauuagacaaacuga

SEQ ID NO: 1281627 - RNA, 18 nt, Human
uucagaaaaccgaaaugg

SEQ ID NO: 1281628 - RNA, 21 nt, Human
uuccaucucuauuguggccaa

SEQ ID NO: 1281629 - RNA, 24 nt, Human
aaaagagauuuccauaacagcaac

SEQ ID NO: 1281630 - RNA, 22 nt, Human
aacagcccugucauaugaccuu

SEQ ID NO: 1281631 - RNA, 21 nt, Human
aagacagaaagggagggagga

SEQ ID NO: 1281632 - RNA, 24 nt, Human
aauaacacuugguuaaacuaugua

SEQ ID NO: 1281633 - RNA, 21 nt, Human
aauaagcagcucaaauaacac

SEQ ID NO: 1281634 - RNA, 18 nt, Human
aaugaucagaacuuauuu

SEQ ID NO: 1281635 - RNA, 24 nt, Human
aaugugcaugacgguguguuugug

SEQ ID NO: 1281636 - RNA, 21 nt, Human
accacacggcagacgagagca

SEQ ID NO: 1281637 - RNA, 19 nt, Human
accugacauccacuuuaca

SEQ ID NO: 1281638 - RNA, 18 nt, Human
acggagcagcuguaccuc

SEQ ID NO: 1281639 - RNA, 20 nt, Human
acggagcagcuguaccucua

SEQ ID NO: 1281640 - RNA, 18 nt, Human
acuguaugcuggaaaaaa

SEQ ID NO: 1281641 - RNA, 24 nt, Human
acuguaugcuggaaaaaaguuacu

SEQ ID NO: 1281642 - RNA, 20 nt, Human
agagaggaagacagaaaggg

SEQ ID NO: 1281643 - RNA, 20 nt, Human
agaggaagacagaaagggag

SEQ ID NO: 1281644 - RNA, 24 nt, Human
agaggcaagagagggagggagcag

SEQ ID NO: 1281645 - RNA, 24 nt, Human
agagggagggagagaggggaaugc

SEQ ID NO: 1281646 - RNA, 18 nt, Human
agagggagggagcaguag

SEQ ID NO: 1281647 - RNA, 18 nt, Human
agcaagagggagggagag

SEQ ID NO: 1281648 - RNA, 23 nt, Human
agcgcagacggguccggcugccu

SEQ ID NO: 1281649 - RNA, 21 nt, Human
agcgccccggacgugcccucc

SEQ ID NO: 1281650 - RNA, 24 nt, Human
agcuacuccaagcaguaggaaugc

SEQ ID NO: 1281651 - RNA, 23 nt, Human
aggaaagagaggaagacagaaag

SEQ ID NO: 1281652 - RNA, 24 nt, Human
aggaggaaagagaggaagacagaa

SEQ ID NO: 1281653 - RNA, 24 nt, Human
agggagggagcaguagaggaggaa

SEQ ID NO: 1281654 - RNA, 19 nt, Human
agggaggggugggguggcg

SEQ ID NO: 1281655 - RNA, 20 nt, Human
aggggaaugcgccgggcugc

SEQ ID NO: 1281656 - RNA, 21 nt, Human
caacagaugugaccuucuucu

SEQ ID NO: 1281657 - RNA, 21 nt, Human
caagcagagagacaaguacaa

SEQ ID NO: 1281658 - RNA, 21 nt, Human
caaggagcgcucucagcagcc

SEQ ID NO: 1281659 - RNA, 20 nt, Human
cagcagccgcacaggacuug

SEQ ID NO: 1281660 - RNA, 18 nt, Human
cagcgccccggacgugcc

SEQ ID NO: 1281661 - RNA, 21 nt, Human
caggccccuuucaaagaaaaa

SEQ ID NO: 1281662 - RNA, 25 nt, Human
caguaggaaugcaugaguggagauu

SEQ ID NO: 1281663 - RNA, 23 nt, Human
ccagcgccccggacgugcccucc

SEQ ID NO: 1281664 - RNA, 19 nt, Human
cccaaugucugcccacaug

SEQ ID NO: 1281665 - RNA, 19 nt, Human
cccaggcgcuccgucucca

SEQ ID NO: 1281666 - RNA, 24 nt, Human
ccgcacaggacuuggggcgaaucc

SEQ ID NO: 1281667 - RNA, 18 nt, Human
ccgggucgcgcucaggau

SEQ ID NO: 1281668 - RNA, 19 nt, Human
ccgggucgcgcucaggauu

SEQ ID NO: 1281669 - RNA, 22 nt, Human
ccucccaggcgcuccgucucca

SEQ ID NO: 1281670 - RNA, 19 nt, Human
ccucuggacuugaagugga

SEQ ID NO: 1281671 - RNA, 18 nt, Human
ccuggcgucuccagcgcc

SEQ ID NO: 1281672 - RNA, 21 nt, Human
ccuucagaaacauagauccac

SEQ ID NO: 1281673 - RNA, 18 nt, Human
cgaacaguccaggacucu

SEQ ID NO: 1281674 - RNA, 22 nt, Human
cgagaagggaccgcucugggca

SEQ ID NO: 1281675 - RNA, 24 nt, Human
cgccccggacgugcccucccaggc

SEQ ID NO: 1281676 - RNA, 18 nt, Human
cgucccagugcccggguc

SEQ ID NO: 1281677 - RNA, 21 nt, Human
cuccagcgccccggacgugcc

SEQ ID NO: 1281678 - RNA, 18 nt, Human
cuggugucaacuucacaa

SEQ ID NO: 1281679 - RNA, 22 nt, Human
cuucagucucacccccauguuc

SEQ ID NO: 1281680 - RNA, 19 nt, Human
gaagaaaagagaaccacac

SEQ ID NO: 1281681 - RNA, 18 nt, Human
gaagacagaaagggaggg

SEQ ID NO: 1281682 - RNA, 19 nt, Human
gacaaugaaagcccucuca

SEQ ID NO: 1281683 - RNA, 23 nt, Human
gagcaaggagcgcucucagcagc

SEQ ID NO: 1281684 - RNA, 19 nt, Human
gagggaggggugggguggc

SEQ ID NO: 1281685 - RNA, 22 nt, Human
gagguaacagcccugucauaug

SEQ ID NO: 1281686 - RNA, 23 nt, Human
gaugauuuacaauuauacugagg

SEQ ID NO: 1281687 - RNA, 21 nt, Human
gccaguugacaagagcagcag

SEQ ID NO: 1281688 - RNA, 23 nt, Human
gcuuucaacaauacuugaucuga

SEQ ID NO: 1281689 - RNA, 19 nt, Human
ggacugggacugccagcgc

SEQ ID NO: 1281690 - RNA, 21 nt, Human
ggacugggacugccagcgcug

SEQ ID NO: 1281691 - RNA, 18 nt, Human
ggagagcaagagggaggg

SEQ ID NO: 1281692 - RNA, 19 nt, Human
ggcaggcuccauggagaag

SEQ ID NO: 1281693 - RNA, 24 nt, Human
ggugggguggcgagaaucuggagc

SEQ ID NO: 1281694 - RNA, 19 nt, Human
gugcccucccaggcgcucc

SEQ ID NO: 1281695 - RNA, 18 nt, Human
uaacaagcagauacuccu

SEQ ID NO: 1281696 - RNA, 19 nt, Human
uaacaagcagauacuccua

SEQ ID NO: 1281697 - RNA, 19 nt, Human
uaaccaauaacaagcagag

SEQ ID NO: 1281698 - RNA, 20 nt, Human
uaagacagacacuuauaacc

SEQ ID NO: 1281699 - RNA, 20 nt, Human
uaagacagacacuuauaacu

SEQ ID NO: 1281700 - RNA, 21 nt, Human
uacauuaaguuugucuuuuua

SEQ ID NO: 1281701 - RNA, 24 nt, Human
uaccucuacccgcgacgcugggaa

SEQ ID NO: 1281702 - RNA, 20 nt, Human
uacuguaugcuggaaaaaag

SEQ ID NO: 1281703 - RNA, 23 nt, Human
uagaggaggaaagagaggaagac

SEQ ID NO: 1281704 - RNA, 24 nt, Human
uagcuggugucaacuucacaaaag

SEQ ID NO: 1281705 - RNA, 25 nt, Human
uaugcuggaaaaaaguuacuacauu

SEQ ID NO: 1281706 - RNA, 27 nt, Human
uauguguaguaaagauaagacagacac

SEQ ID NO: 1281707 - RNA, 18 nt, Human
ucagucucacccccaugu

SEQ ID NO: 1281708 - RNA, 20 nt, Human
ucagucucacccccauguuc

SEQ ID NO: 1281709 - RNA, 22 nt, Human
uccgcagagccgcggcuuggca

SEQ ID NO: 1281710 - RNA, 19 nt, Human
uccuucagaaacauagauc

SEQ ID NO: 1281711 - RNA, 26 nt, Human
uccuucagaaacauagauccaccuga

SEQ ID NO: 1281712 - RNA, 22 nt, Human
ucgggccuggcgucuccagcgc

SEQ ID NO: 1281713 - RNA, 23 nt, Human
ucuaaagacacauuuuuccauuu

SEQ ID NO: 1281714 - RNA, 22 nt, Human
ugacaagagcagcaguguagac

SEQ ID NO: 1281715 - RNA, 18 nt, Human
ugagaacaggccccuuuc

SEQ ID NO: 1281716 - RNA, 18 nt, Human
ugagggaugaagcugacu

SEQ ID NO: 1281717 - RNA, 21 nt, Human
ugagucagacaaugaaagccc

SEQ ID NO: 1281718 - RNA, 19 nt, Human
ugcaugacgguguguuugu

SEQ ID NO: 1281719 - RNA, 20 nt, Human
uggagucccgggcgcugucc

SEQ ID NO: 1281720 - RNA, 21 nt, Human
uggagucccgggcgcuguccc

SEQ ID NO: 1281721 - RNA, 21 nt, Human
ugggcaggcuccauggagaag

SEQ ID NO: 1281722 - RNA, 23 nt, Human
ugggcaggcuccauggagaagcu

SEQ ID NO: 1281723 - RNA, 22 nt, Human
uggugucaacuucacaaaaguc

SEQ ID NO: 1281724 - RNA, 25 nt, Human
uggugucaacuucacaaaaguccaa

SEQ ID NO: 1281725 - RNA, 21 nt, Human
ugucugccaggcauuucccuu

SEQ ID NO: 1281726 - RNA, 21 nt, Human
uuacuacauuuuguuguguuu

SEQ ID NO: 1281727 - RNA, 18 nt, Human
uucaaagaaaaaagagcc

SEQ ID NO: 1281728 - RNA, 21 nt, Human
aagagcagcaaaucuugaaca

SEQ ID NO: 1281729 - RNA, 19 nt, Human
aagcaccaccagaaggagg

SEQ ID NO: 1281730 - RNA, 22 nt, Human
auauucaaguauugagaaugcc

SEQ ID NO: 1281731 - RNA, 22 nt, Human
aucauuaaucuugucuugaagu

SEQ ID NO: 1281732 - RNA, 19 nt, Human
caaaguuccuccagcucuu

SEQ ID NO: 1281733 - RNA, 21 nt, Human
caccaacagggaaucccccag

SEQ ID NO: 1281734 - RNA, 23 nt, Human
caccaccagaaggaggagcucca

SEQ ID NO: 1281735 - RNA, 21 nt, Human
caccagaaggaggagcuccaa

SEQ ID NO: 1281736 - RNA, 23 nt, Human
cauauucaaguauugagaaugcc

SEQ ID NO: 1281737 - RNA, 20 nt, Human
ccagaaucuucuguuugucc

SEQ ID NO: 1281738 - RNA, 27 nt, Human
ccuccagcucuuucugcuggggccgcc

SEQ ID NO: 1281739 - RNA, 22 nt, Human
cgccuugucccucugcuucuca

SEQ ID NO: 1281740 - RNA, 21 nt, Human
cugcacucugguacagcuugg

SEQ ID NO: 1281741 - RNA, 18 nt, Human
gacuccacuagcaguuuc

SEQ ID NO: 1281742 - RNA, 18 nt, Human
gcaugccuucugcacucu

SEQ ID NO: 1281743 - RNA, 20 nt, Human
gccuugucccucugcuucuc

SEQ ID NO: 1281744 - RNA, 18 nt, Human
uacagcuuggugaugauu

SEQ ID NO: 1281745 - RNA, 18 nt, Human
uacaguguuuauaaagug

SEQ ID NO: 1281746 - RNA, 19 nt, Human
uacaguguuuauaaagugc

SEQ ID NO: 1281747 - RNA, 21 nt, Human
uacaguguuuauaaagugcaa

SEQ ID NO: 1281748 - RNA, 22 nt, Human
uaccaagggaaagaggagugac

SEQ ID NO: 1281749 - RNA, 23 nt, Human
uaccaagggaaagaggagugacg

SEQ ID NO: 1281750 - RNA, 18 nt, Human
ucccccaggcauucuucc

SEQ ID NO: 1281751 - RNA, 20 nt, Human
ucccucugcuucucaucuuc

SEQ ID NO: 1281752 - RNA, 23 nt, Human
ucccucugcuucucaucuucagc

SEQ ID NO: 1281753 - RNA, 18 nt, Human
ugaauucuuggaugacgc

SEQ ID NO: 1281754 - RNA, 19 nt, Human
ugacguccaagagcagcaa

SEQ ID NO: 1281755 - RNA, 21 nt, Human
ugccacagaauuugcuacaaa

SEQ ID NO: 1281756 - RNA, 20 nt, Human
uggcaugccuucugcacucu

SEQ ID NO: 1281757 - RNA, 23 nt, Human
uucaaauucuuccuucuuggcag

SEQ ID NO: 1281758 - RNA, 24 nt, Human
uucaaauucuuccuucuuggcagu

SEQ ID NO: 1281759 - RNA, 23 nt, Human
uuucugcugauguucaaauucuu

SEQ ID NO: 1281760 - RNA, 20 nt, Human
aaaaaggcuuugaaauuaaa

SEQ ID NO: 1281761 - RNA, 21 nt, Human
aaaacagauaaaauggacuuu

SEQ ID NO: 1281762 - RNA, 25 nt, Human
aaacaaaaauaaggccauuuucaug

SEQ ID NO: 1281763 - RNA, 20 nt, Human
aaacagauaaaauggacuuu

SEQ ID NO: 1281764 - RNA, 24 nt, Human
aaacauccagaccaggggucagca

SEQ ID NO: 1281765 - RNA, 22 nt, Human
aaacaugaauauaauaaccuuc

SEQ ID NO: 1281766 - RNA, 22 nt, Human
aaagagaucaacuuuaggauua

SEQ ID NO: 1281767 - RNA, 19 nt, Human
aaagugucaauagagaagu

SEQ ID NO: 1281768 - RNA, 24 nt, Human
aacacagcuguuuaagauaaaaua

SEQ ID NO: 1281769 - RNA, 25 nt, Human
acagugaccuuccaauauguucucu

SEQ ID NO: 1281770 - RNA, 18 nt, Human
accaggggucagcaaaau

SEQ ID NO: 1281771 - RNA, 19 nt, Human
aguuuuaaaguaacaauau

SEQ ID NO: 1281772 - RNA, 28 nt, Human
auauaugggugugugugugugugugugg

SEQ ID NO: 1281773 - RNA, 21 nt, Human
aucacaguuuuaaaguaacaa

SEQ ID NO: 1281774 - RNA, 21 nt, Human
caaaaaaggcuuugaaauuaa

SEQ ID NO: 1281775 - RNA, 18 nt, Human
caccguaguauccucaaa

SEQ ID NO: 1281776 - RNA, 20 nt, Human
cacugugccauucccagggc

SEQ ID NO: 1281777 - RNA, 22 nt, Human
caguaaaaauaagguuuugaug

SEQ ID NO: 1281778 - RNA, 22 nt, Human
cauuauugucucaugucagaaa

SEQ ID NO: 1281779 - RNA, 22 nt, Human
ccaaaacacuuuuacaggaaca

SEQ ID NO: 1281780 - RNA, 25 nt, Human
ccaaaacacuuuuacaggaacacag

SEQ ID NO: 1281781 - RNA, 23 nt, Human
ccacaauagagucuuucuuaacu

SEQ ID NO: 1281782 - RNA, 19 nt, Human
ccacugugccauucccagg

SEQ ID NO: 1281783 - RNA, 23 nt, Human
ccugaaaagcuaguguccucucu

SEQ ID NO: 1281784 - RNA, 24 nt, Human
cuacaucuguagaaaauacagcua

SEQ ID NO: 1281785 - RNA, 22 nt, Human
cuagcauuaaaaaacauccaga

SEQ ID NO: 1281786 - RNA, 18 nt, Human
cuccucuuuccaccuuuc

SEQ ID NO: 1281787 - RNA, 24 nt, Human
cuuuuuaaauucacuuaagcuaca

SEQ ID NO: 1281788 - RNA, 21 nt, Human
gaauuagcgcuuacugcauuu

SEQ ID NO: 1281789 - RNA, 18 nt, Human
gauugcuacguucuccuc

SEQ ID NO: 1281790 - RNA, 18 nt, Human
gcauuaaaaaacauccag

SEQ ID NO: 1281791 - RNA, 21 nt, Human
ggugugugugugugugugugu

SEQ ID NO: 1281792 - RNA, 23 nt, Human
guguguguguguguguguguaau

SEQ ID NO: 1281793 - RNA, 25 nt, Human
guuacuacuauauuccccucccaaa

SEQ ID NO: 1281794 - RNA, 20 nt, Human
uaagcaaaucagccccuuuc

SEQ ID NO: 1281795 - RNA, 24 nt, Human
uaagcaaaucagccccuuucaaaa

SEQ ID NO: 1281796 - RNA, 21 nt, Human
uacguucuccucuuuccaccu

SEQ ID NO: 1281797 - RNA, 25 nt, Human
uacuguccacauauuggauuaguua

SEQ ID NO: 1281798 - RNA, 21 nt, Human
uagcauuaaaaaacauccaga

SEQ ID NO: 1281799 - RNA, 22 nt, Human
uauauauaugcaugcauauagu

SEQ ID NO: 1281800 - RNA, 25 nt, Human
uauauauaugcaugcauauaugcug

SEQ ID NO: 1281801 - RNA, 19 nt, Human
uauaugggugugugugugu

SEQ ID NO: 1281802 - RNA, 19 nt, Human
uauaugggugugugugugu

SEQ ID NO: 1281803 - RNA, 19 nt, Human
uauaugggugugugugugu

SEQ ID NO: 1281804 - RNA, 23 nt, Human
uauuccccucccaaauuuuuaga

SEQ ID NO: 1281805 - RNA, 19 nt, Human
uauugcuuuuuaauggcac

SEQ ID NO: 1281806 - RNA, 20 nt, Human
ucaaacuuuuucugcucuuc

SEQ ID NO: 1281807 - RNA, 18 nt, Human
uccacauauuggauuagu

SEQ ID NO: 1281808 - RNA, 21 nt, Human
ucuaauccaaaacacuuuuac

SEQ ID NO: 1281809 - RNA, 21 nt, Human
ugaaaaaugaaugaaaacgaa

SEQ ID NO: 1281810 - RNA, 18 nt, Human
ugaaaagcuaguguccuc

SEQ ID NO: 1281811 - RNA, 18 nt, Human
ugaaaaugguauugcuuu

SEQ ID NO: 1281812 - RNA, 21 nt, Human
ugaaauaguccagcaaaauca

SEQ ID NO: 1281813 - RNA, 23 nt, Human
ugaauaaaauguauuuuucauaa

SEQ ID NO: 1281814 - RNA, 23 nt, Human
ugcaaauacucuaaugaacagca

SEQ ID NO: 1281815 - RNA, 24 nt, Human
uguagaaaauacagcuacuucuga

SEQ ID NO: 1281816 - RNA, 18 nt, Human
uguguauauauauauaug

SEQ ID NO: 1281817 - RNA, 22 nt, Human
uguguauauauauauaugcaug

SEQ ID NO: 1281818 - RNA, 23 nt, Human
uguguguauauauauauaugcau

SEQ ID NO: 1281819 - RNA, 18 nt, Human
uguguguguauauauaua

SEQ ID NO: 1281820 - RNA, 24 nt, Human
uguguguguauauauauauaugau

SEQ ID NO: 1281821 - RNA, 26 nt, Human
uguguguguguauauauauauaaugu

SEQ ID NO: 1281822 - RNA, 23 nt, Human
uguguguguguauauauauauau

SEQ ID NO: 1281823 - RNA, 23 nt, Human
uguguguguguguauauauauau

SEQ ID NO: 1281824 - RNA, 20 nt, Human
uguguguguguguguauaua

SEQ ID NO: 1281825 - RNA, 18 nt, Human
ugugugugugugugugug

SEQ ID NO: 1281826 - RNA, 24 nt, Human
uguguguguguguguguguauaua

SEQ ID NO: 1281827 - RNA, 20 nt, Human
uuaaaaaccaaacaacagac

SEQ ID NO: 1281828 - RNA, 24 nt, Human
uuaaaaaccaaacaacagaccuuc

SEQ ID NO: 1281829 - RNA, 22 nt, Human
uuaaauauuguuccacugugcc

SEQ ID NO: 1281830 - RNA, 24 nt, Human
uuaauggcaccuuuugaguuuucu

SEQ ID NO: 1281831 - RNA, 23 nt, Human
uuaucuggaagaccccugauuau

SEQ ID NO: 1281832 - RNA, 22 nt, Human
uuccaccuuucuaacgagguua

SEQ ID NO: 1281833 - RNA, 19 nt, Human
uugaaauuaagauuacugu

SEQ ID NO: 1281834 - RNA, 18 nt, Human
uuuagaaggaacaguaaa

SEQ ID NO: 1281835 - RNA, 20 nt, Human
uuuaugcacucuuuuuaaau

SEQ ID NO: 1281836 - RNA, 18 nt, Human
aaaaauauuaaagaaggc

SEQ ID NO: 1281837 - RNA, 18 nt, Human
aacauuccaaaucuugcu

SEQ ID NO: 1281838 - RNA, 24 nt, Human
aaucaaaauggcuucccauugcuu

SEQ ID NO: 1281839 - RNA, 24 nt, Human
aggcauuaggaauuuuuuuaaacc

SEQ ID NO: 1281840 - RNA, 21 nt, Human
auaguuauauuaaauggguac

SEQ ID NO: 1281841 - RNA, 23 nt, Human
caaaauggcuucccauugcuuga

SEQ ID NO: 1281842 - RNA, 23 nt, Human
caauagcuuuucuccacgagcuc

SEQ ID NO: 1281843 - RNA, 20 nt, Human
cacaucucacgguacuacuu

SEQ ID NO: 1281844 - RNA, 19 nt, Human
cagacggugguucuuuugc

SEQ ID NO: 1281845 - RNA, 21 nt, Human
cauugcuugacguuuguuuuc

SEQ ID NO: 1281846 - RNA, 24 nt, Human
ccaugcuaaauucucuuugauugu

SEQ ID NO: 1281847 - RNA, 23 nt, Human
cucaaucuuuguuccacuggaga

SEQ ID NO: 1281848 - RNA, 21 nt, Human
gcauagcuucaauuuaagugc

SEQ ID NO: 1281849 - RNA, 18 nt, Human
ggggaguagggcucaauu

SEQ ID NO: 1281850 - RNA, 21 nt, Human
uaaaaauauuaaagaaggcua

SEQ ID NO: 1281851 - RNA, 19 nt, Human
uaaagaaggcuaaaaggca

SEQ ID NO: 1281852 - RNA, 25 nt, Human
uaacuuucucuucagucgaaugaga

SEQ ID NO: 1281853 - RNA, 22 nt, Human
uaccuacaaagagaaaaaaucc

SEQ ID NO: 1281854 - RNA, 23 nt, Human
uacucaagaaaucaaaauggcuu

SEQ ID NO: 1281855 - RNA, 19 nt, Human
ucacgguacuacuuuucuc

SEQ ID NO: 1281856 - RNA, 26 nt, Human
ucagucgaaugagacuggccaaaauc

SEQ ID NO: 1281857 - RNA, 23 nt, Human
ucaucuguuuguacauuuugggg

SEQ ID NO: 1281858 - RNA, 24 nt, Human
ugaaaaacaguguuacacuuccaa

SEQ ID NO: 1281859 - RNA, 19 nt, Human
ugaggcacacacucgcaau

SEQ ID NO: 1281860 - RNA, 25 nt, Human
ugaggcacacacucgcaaucugaaa

SEQ ID NO: 1281861 - RNA, 25 nt, Human
ugcacuuuauuccaucaaacaucac

SEQ ID NO: 1281862 - RNA, 21 nt, Human
ugcaucaaggcucuuauucaa

SEQ ID NO: 1281863 - RNA, 25 nt, Human
ugguuugugucuuucagguguuugg

SEQ ID NO: 1281864 - RNA, 20 nt, Human
ugucuucuucuuuuaaauua

SEQ ID NO: 1281865 - RNA, 22 nt, Human
uuaaugcuuacaagauuacuca

SEQ ID NO: 1281866 - RNA, 19 nt, Human
uuaguucuguuuucuucca

SEQ ID NO: 1281867 - RNA, 21 nt, Human
uugacguuuguuuuccaaaua

SEQ ID NO: 1281868 - RNA, 24 nt, Human
uuucuauccuguggcauagcuuca

SEQ ID NO: 1281869 - RNA, 22 nt, Human
uuucugguuagccagaauguuc

SEQ ID NO: 1281870 - RNA, 22 nt, Human
aaaaauauuauccaguauucac

SEQ ID NO: 1281871 - RNA, 28 nt, Human
aaagauuauaaagaaaaaaauuagacaa

SEQ ID NO: 1281872 - RNA, 19 nt, Human
aaauauccaccccagauac

SEQ ID NO: 1281873 - RNA, 23 nt, Human
aaaucugcaaaucacauccauua

SEQ ID NO: 1281874 - RNA, 19 nt, Human
aaccccaaaagcuaagaaa

SEQ ID NO: 1281875 - RNA, 24 nt, Human
aagcagaaaagauuauaaagaaaa

SEQ ID NO: 1281876 - RNA, 19 nt, Human
aagcuaagaaaacauucua

SEQ ID NO: 1281877 - RNA, 20 nt, Human
aaggcgugcgaguggauggc

SEQ ID NO: 1281878 - RNA, 23 nt, Human
aaguggggagugggcaagcgggg

SEQ ID NO: 1281879 - RNA, 24 nt, Human
aauacagaaaggauaaaaaccaga

SEQ ID NO: 1281880 - RNA, 22 nt, Human
acaagcaaggacuuaaagauac

SEQ ID NO: 1281881 - RNA, 23 nt, Human
acauaccuauauguauuucuaca

SEQ ID NO: 1281882 - RNA, 18 nt, Human
acugcccucccuaaacac

SEQ ID NO: 1281883 - RNA, 22 nt, Human
acuugcacugaacuaggucucc

SEQ ID NO: 1281884 - RNA, 22 nt, Human
agaaaaagcaauuuugaaucug

SEQ ID NO: 1281885 - RNA, 24 nt, Human
agaacccuaauccaagugcccuac

SEQ ID NO: 1281886 - RNA, 28 nt, Human
agaguugcucaucuacauuauaaggcag

SEQ ID NO: 1281887 - RNA, 21 nt, Human
aggcaaaaaucauaaaucagg

SEQ ID NO: 1281888 - RNA, 22 nt, Human
aggcuaagccaucuguucauca

SEQ ID NO: 1281889 - RNA, 18 nt, Human
agugagugacuggacugc

SEQ ID NO: 1281890 - RNA, 24 nt, Human
augaauauagacuucaugagucac

SEQ ID NO: 1281891 - RNA, 20 nt, Human
auggauacacacauauaugu

SEQ ID NO: 1281892 - RNA, 20 nt, Human
augugugugugugugcgugu

SEQ ID NO: 1281893 - RNA, 22 nt, Human
augugugugugugugcgugugu

SEQ ID NO: 1281894 - RNA, 21 nt, Human
auuaaugccauucagaacagc

SEQ ID NO: 1281895 - RNA, 19 nt, Human
caacgucagcccgccgcuc

SEQ ID NO: 1281896 - RNA, 22 nt, Human
cacaagcaaggacuuaaagaua

SEQ ID NO: 1281897 - RNA, 20 nt, Human
caccccagauacugaaucau

SEQ ID NO: 1281898 - RNA, 19 nt, Human
cacugcaaacauccugcug

SEQ ID NO: 1281899 - RNA, 26 nt, Human
cagaaaagauuauaaagaaaaaaauu

SEQ ID NO: 1281900 - RNA, 21 nt, Human
cagaauccugugacuaagcuu

SEQ ID NO: 1281901 - RNA, 20 nt, Human
cagcgaggcuuccugcggag

SEQ ID NO: 1281902 - RNA, 23 nt, Human
ccagauacugaaucauauauaau

SEQ ID NO: 1281903 - RNA, 18 nt, Human
ccccaaaagcuaagaaaa

SEQ ID NO: 1281904 - RNA, 20 nt, Human
ccugcggagcccaggcugga

SEQ ID NO: 1281905 - RNA, 19 nt, Human
cucugcaccacuuacaguc

SEQ ID NO: 1281906 - RNA, 22 nt, Human
cugcuugcuuggcgagggcugg

SEQ ID NO: 1281907 - RNA, 18 nt, Human
cuuacagucuucaauccc

SEQ ID NO: 1281908 - RNA, 23 nt, Human
cuuccugcggagcccaggcugga

SEQ ID NO: 1281909 - RNA, 21 nt, Human
cuugcgugaucacugcccucc

SEQ ID NO: 1281910 - RNA, 24 nt, Human
cuugcgugaucacugcccucccua

SEQ ID NO: 1281911 - RNA, 22 nt, Human
gaaggcaaauucacagaggagu

SEQ ID NO: 1281912 - RNA, 22 nt, Human
gagcuaugggucgcugaaaaug

SEQ ID NO: 1281913 - RNA, 19 nt, Human
gagucacuuuuuucucucc

SEQ ID NO: 1281914 - RNA, 21 nt, Human
gcccuggaaaugaagcaccac

SEQ ID NO: 1281915 - RNA, 18 nt, Human
gcuugcuuggcgagggcu

SEQ ID NO: 1281916 - RNA, 19 nt, Human
ggagaguugcucaucuaca

SEQ ID NO: 1281917 - RNA, 19 nt, Human
ggcgugcgaguggauggca

SEQ ID NO: 1281918 - RNA, 20 nt, Human
ggcuguggggagaagggauu

SEQ ID NO: 1281919 - RNA, 18 nt, Human
gggaaguggggagugggc

SEQ ID NO: 1281920 - RNA, 22 nt, Human
gggaagugucucggcugccugg

SEQ ID NO: 1281921 - RNA, 22 nt, Human
gguacugcucauuccacgaagc

SEQ ID NO: 1281922 - RNA, 19 nt, Human
gucuucaauccccccucca

SEQ ID NO: 1281923 - RNA, 19 nt, Human
guggauggcaggcucaguc

SEQ ID NO: 1281924 - RNA, 21 nt, Human
gugugugcgugugugugugug

SEQ ID NO: 1281925 - RNA, 30 nt, Human
gugugugcgugugugugugugugugugugg

SEQ ID NO: 1281926 - RNA, 20 nt, Human
uaaaauaaauagauauuuug

SEQ ID NO: 1281927 - RNA, 19 nt, Human
uaaaccccaaaagcuaaga

SEQ ID NO: 1281928 - RNA, 21 nt, Human
uaaaccccaaaagcuaagaaa

SEQ ID NO: 1281929 - RNA, 25 nt, Human
uaagcuucuaaauuggccuggaagg

SEQ ID NO: 1281930 - RNA, 22 nt, Human
uacagaaaggauaaaaaccaga

SEQ ID NO: 1281931 - RNA, 19 nt, Human
uagaaccagcuggcuggga

SEQ ID NO: 1281932 - RNA, 22 nt, Human
uagccaacagccgaaaagcccu

SEQ ID NO: 1281933 - RNA, 25 nt, Human
uagguuguaaauugucugcuuaggc

SEQ ID NO: 1281934 - RNA, 27 nt, Human
uaguguguauggauacacacauauagu

SEQ ID NO: 1281935 - RNA, 24 nt, Human
uauaaagaaaaaaauuagacaaau

SEQ ID NO: 1281936 - RNA, 22 nt, Human
uauauguauuucuacauguaua

SEQ ID NO: 1281937 - RNA, 24 nt, Human
uauauguauuucuacauguauaua

SEQ ID NO: 1281938 - RNA, 24 nt, Human
uaugauaaugugaagaaagagggg

SEQ ID NO: 1281939 - RNA, 19 nt, Human
uauggauacacacauauau

SEQ ID NO: 1281940 - RNA, 19 nt, Human
ucacuuggaauagguaauc

SEQ ID NO: 1281941 - RNA, 19 nt, Human
ucagaugcccuggaaauga

SEQ ID NO: 1281942 - RNA, 21 nt, Human
ucagcccgccgcuccggcuug

SEQ ID NO: 1281943 - RNA, 18 nt, Human
uccauuaggaaguaaagc

SEQ ID NO: 1281944 - RNA, 22 nt, Human
ucccuaaacacggagccggcuc

SEQ ID NO: 1281945 - RNA, 20 nt, Human
uccugcggagcccaggcugg

SEQ ID NO: 1281946 - RNA, 21 nt, Human
uccugcggagcccaggcugga

SEQ ID NO: 1281947 - RNA, 18 nt, Human
uccugcugcuugcuuggc

SEQ ID NO: 1281948 - RNA, 21 nt, Human
uccuucuaccuuuaacucuag

SEQ ID NO: 1281949 - RNA, 19 nt, Human
ucuacauguauauauauau

SEQ ID NO: 1281950 - RNA, 21 nt, Human
ucuguuugauuuuauucugcc

SEQ ID NO: 1281951 - RNA, 21 nt, Human
ugaagaaagaggggaaaaucc

SEQ ID NO: 1281952 - RNA, 22 nt, Human
ugacuggacugccccagcuucu

SEQ ID NO: 1281953 - RNA, 24 nt, Human
ugagaugagaucucagaaaucauc

SEQ ID NO: 1281954 - RNA, 19 nt, Human
ugagaugugugugugugug

SEQ ID NO: 1281955 - RNA, 23 nt, Human
ugagaugugugugugugugcgug

SEQ ID NO: 1281956 - RNA, 21 nt, Human
ugaggcaaaaaucauaaauca

SEQ ID NO: 1281957 - RNA, 21 nt, Human
ugauauggcaugucucucuca

SEQ ID NO: 1281958 - RNA, 24 nt, Human
ugccccagcuucugaaaucgaaau

SEQ ID NO: 1281959 - RNA, 21 nt, Human
ugcgugugugugugugugugu

SEQ ID NO: 1281960 - RNA, 21 nt, Human
ugcgugugugugugugugugu

SEQ ID NO: 1281961 - RNA, 20 nt, Human
ugcucccuucaucccauguc

SEQ ID NO: 1281962 - RNA, 20 nt, Human
uggaaucgcugggaaguguc

SEQ ID NO: 1281963 - RNA, 18 nt, Human
uggauacacacauauaug

SEQ ID NO: 1281964 - RNA, 20 nt, Human
uggcuguggggagaagggau

SEQ ID NO: 1281965 - RNA, 24 nt, Human
ugggaagugucucggcugccuggc

SEQ ID NO: 1281966 - RNA, 20 nt, Human
uggggagugggcaagcgggg

SEQ ID NO: 1281967 - RNA, 23 nt, Human
uguauauauauauuugauauaua

SEQ ID NO: 1281968 - RNA, 26 nt, Human
uguauggauacacacauauauguucc

SEQ ID NO: 1281969 - RNA, 25 nt, Human
ugucuaacuucuuuuaugauaaugu

SEQ ID NO: 1281970 - RNA, 21 nt, Human
ugugcgugugugugugugugu

SEQ ID NO: 1281971 - RNA, 21 nt, Human
ugugcgugugugugugugugu

SEQ ID NO: 1281972 - RNA, 22 nt, Human
uguggggagaagggauugcgau

SEQ ID NO: 1281973 - RNA, 19 nt, Human
uguguauggauacacacau

SEQ ID NO: 1281974 - RNA, 19 nt, Human
ugugugcgugugugugugu

SEQ ID NO: 1281975 - RNA, 21 nt, Human
ugugugcgugugugugugugu

SEQ ID NO: 1281976 - RNA, 21 nt, Human
ugugugugcgugugugugugu

SEQ ID NO: 1281977 - RNA, 25 nt, Human
ugugugugcgugugugugugugugu

SEQ ID NO: 1281978 - RNA, 20 nt, Human
ugugugugugugcgugugug

SEQ ID NO: 1281979 - RNA, 22 nt, Human
ugugugugugugcgugugugug

SEQ ID NO: 1281980 - RNA, 25 nt, Human
ugugugugugugcgugugugugugu

SEQ ID NO: 1281981 - RNA, 21 nt, Human
ugugugugugugugcgugugu

SEQ ID NO: 1281982 - RNA, 18 nt, Human
ugugugugugugugugug

SEQ ID NO: 1281983 - RNA, 18 nt, Human
ugugugugugugugugug

SEQ ID NO: 1281984 - RNA, 23 nt, Human
uguguguguguguguguguguaa

SEQ ID NO: 1281985 - RNA, 22 nt, Human
uguguguguguguguguguguu

SEQ ID NO: 1281986 - RNA, 20 nt, Human
uguuagaagagaucuagagu

SEQ ID NO: 1281987 - RNA, 22 nt, Human
uuaaauauuagcaauguaauuu

SEQ ID NO: 1281988 - RNA, 21 nt, Human
uuagguuguaaauugucugcu

SEQ ID NO: 1281989 - RNA, 18 nt, Human
uucagcuaccuggcagcu

SEQ ID NO: 1281990 - RNA, 20 nt, Human
uucagcuaccuggcagcucg

SEQ ID NO: 1281991 - RNA, 22 nt, Human
uucaugagucacuuuuuucucu

SEQ ID NO: 1281992 - RNA, 20 nt, Human
uucuacauguauauauauau

SEQ ID NO: 1281993 - RNA, 19 nt, Human
uuggcgagggcuggcugug

SEQ ID NO: 1281994 - RNA, 23 nt, Human
uuggcgagggcuggcugugggga

SEQ ID NO: 1281995 - RNA, 20 nt, Human
uuguuagaagagaucuagag

SEQ ID NO: 1281996 - RNA, 18 nt, Human
aagcagcaccaggagcgg

SEQ ID NO: 1281997 - RNA, 24 nt, Human
caaacgagcacacaagcagcacca

SEQ ID NO: 1281998 - RNA, 18 nt, Human
caauaaaggaauggggaa

SEQ ID NO: 1281999 - RNA, 20 nt, Human
cacaagcagcaccaggagcg

SEQ ID NO: 1282000 - RNA, 25 nt, Human
ccagguccgcaccaaacgagcacac

SEQ ID NO: 1282001 - RNA, 19 nt, Human
cuggaguaaagaagcaggu

SEQ ID NO: 1282002 - RNA, 18 nt, Human
gaguaaagaagcagguuc

SEQ ID NO: 1282003 - RNA, 23 nt, Human
gcacauauaccaguuauguacaa

SEQ ID NO: 1282004 - RNA, 21 nt, Human
gggaagggggaaaugaaagac

SEQ ID NO: 1282005 - RNA, 21 nt, Human
ucagcugccacuucacaaaag

SEQ ID NO: 1282006 - RNA, 24 nt, Human
uccucagcugccacuucacaaaag

SEQ ID NO: 1282007 - RNA, 20 nt, Human
ucuggaguaaagaagcaggu

SEQ ID NO: 1282008 - RNA, 19 nt, Human
uggggaagggggaaaugaa

SEQ ID NO: 1282009 - RNA, 23 nt, Human
ugugcacauauaccaguuaugua

SEQ ID NO: 1282010 - RNA, 23 nt, Human
ugugcacauauaccaguuaugua

SEQ ID NO: 1282011 - RNA, 19 nt, Human
agauaucgaagcaguaaac

SEQ ID NO: 1282012 - RNA, 23 nt, Human
cauucuugcugcucucuuuuaau

SEQ ID NO: 1282013 - RNA, 19 nt, Human
cgaagcaguaaacuuaagu

SEQ ID NO: 1282014 - RNA, 21 nt, Human
cugcccaggccuguggccacc

SEQ ID NO: 1282015 - RNA, 22 nt, Human
ggcggccaccugcccgcgucug

SEQ ID NO: 1282016 - RNA, 18 nt, Human
guuacaguuggaguuaca

SEQ ID NO: 1282017 - RNA, 30 nt, Human
ugaccaaacauggauucucuccuccucagg

SEQ ID NO: 1282018 - RNA, 25 nt, Human
aaaaaaaaguauuaaaggcagauga

SEQ ID NO: 1282019 - RNA, 19 nt, Human
aaaaccauaccaaggccau

SEQ ID NO: 1282020 - RNA, 22 nt, Human
aaaggcgucccauggagauucu

SEQ ID NO: 1282021 - RNA, 23 nt, Human
aaaggcgucccauggagauucug

SEQ ID NO: 1282022 - RNA, 26 nt, Human
aaauccugcaguaauacugaugcucc

SEQ ID NO: 1282023 - RNA, 18 nt, Human
aauagguucuccuuagag

SEQ ID NO: 1282024 - RNA, 23 nt, Human
aauauaaauaaaaccauaccaag

SEQ ID NO: 1282025 - RNA, 22 nt, Human
aauuuguuucuuccaaauccug

SEQ ID NO: 1282026 - RNA, 18 nt, Human
acuuagaagagugaaaaa

SEQ ID NO: 1282027 - RNA, 23 nt, Human
aggagacuggcaaggcagagcuu

SEQ ID NO: 1282028 - RNA, 20 nt, Human
auccugcacggagcugaagc

SEQ ID NO: 1282029 - RNA, 25 nt, Human
augcuccagaaaggcgucccaugga

SEQ ID NO: 1282030 - RNA, 19 nt, Human
cauccauccugcacggagc

SEQ ID NO: 1282031 - RNA, 19 nt, Human
ccugcacggagcugaagcu

SEQ ID NO: 1282032 - RNA, 21 nt, Human
cuccucuaguuucauuagcgu

SEQ ID NO: 1282033 - RNA, 22 nt, Human
cuccuuagaguuucuuuuuuuu

SEQ ID NO: 1282034 - RNA, 20 nt, Human
cuggcaaggcagagcuuucu

SEQ ID NO: 1282035 - RNA, 19 nt, Human
gaguuucuuuuuuuuucuu

SEQ ID NO: 1282036 - RNA, 25 nt, Human
gcuccagaaaggcgucccauggaga

SEQ ID NO: 1282037 - RNA, 21 nt, Human
uccagaaaggcgucccaugga

SEQ ID NO: 1282038 - RNA, 24 nt, Human
ugcuccagaaaggcgucccaugga

SEQ ID NO: 1282039 - RNA, 19 nt, Human
ugucaacaaacccguccaa

SEQ ID NO: 1282040 - RNA, 21 nt, Human
uucauuagcguuuagucgugg

SEQ ID NO: 1282041 - RNA, 21 nt, Human
uucgaguuaaucuggaaaacu

SEQ ID NO: 1282042 - RNA, 23 nt, Human
uuuccagcuuccucuuaaauuuc

SEQ ID NO: 1282043 - RNA, 22 nt, Human
agagcucccccugucugugccc

SEQ ID NO: 1282044 - RNA, 22 nt, Human
agccacacaccccugggcagca

SEQ ID NO: 1282045 - RNA, 23 nt, Human
agccacacaccccugggcagcac

SEQ ID NO: 1282046 - RNA, 21 nt, Human
caccccaaacucuagcccugc

SEQ ID NO: 1282047 - RNA, 18 nt, Human
caccccugggcagcacug

SEQ ID NO: 1282048 - RNA, 23 nt, Human
cacuucucagccuuccuggaacu

SEQ ID NO: 1282049 - RNA, 20 nt, Human
cagugagacagagcuccccc

SEQ ID NO: 1282050 - RNA, 22 nt, Human
cccccugucugugcccuggagg

SEQ ID NO: 1282051 - RNA, 18 nt, Human
ccccugggcagcacuguc

SEQ ID NO: 1282052 - RNA, 21 nt, Human
ccccugggcagcacuguccca

SEQ ID NO: 1282053 - RNA, 22 nt, Human
ccugcagguuuuuuaccacagc

SEQ ID NO: 1282054 - RNA, 22 nt, Human
cuaccuggaggccaagacccaa

SEQ ID NO: 1282055 - RNA, 22 nt, Human
cuggaggccaagacccaaccaa

SEQ ID NO: 1282056 - RNA, 19 nt, Human
cuggugauguggucacuuu

SEQ ID NO: 1282057 - RNA, 20 nt, Human
cuuccuggaacugagccugg

SEQ ID NO: 1282058 - RNA, 20 nt, Human
gccacacaccccugggcagc

SEQ ID NO: 1282059 - RNA, 18 nt, Human
gugagacagagcuccccc

SEQ ID NO: 1282060 - RNA, 23 nt, Human
uaacacaugcaugaacucaugua

SEQ ID NO: 1282061 - RNA, 24 nt, Human
uaacacaugcaugaacucauguag

SEQ ID NO: 1282062 - RNA, 24 nt, Human
uaccacagccaccaccaagaauca

SEQ ID NO: 1282063 - RNA, 25 nt, Human
uaccacagccaccaccaagaaucac

SEQ ID NO: 1282064 - RNA, 19 nt, Human
uaggagaggccacaguuac

SEQ ID NO: 1282065 - RNA, 24 nt, Human
uauauucauauauacauauacaug

SEQ ID NO: 1282066 - RNA, 20 nt, Human
uaugggagcugcuccauaga

SEQ ID NO: 1282067 - RNA, 21 nt, Human
ucacuuuuggggagacuguug

SEQ ID NO: 1282068 - RNA, 21 nt, Human
ucagccuuccuggaacugagc

SEQ ID NO: 1282069 - RNA, 23 nt, Human
ucauuuauuuuauguaacugagg

SEQ ID NO: 1282070 - RNA, 19 nt, Human
ucugugcccuggaggugga

SEQ ID NO: 1282071 - RNA, 20 nt, Human
ucugugcccugggaacagug

SEQ ID NO: 1282072 - RNA, 21 nt, Human
ugagacagagcucccccuguc

SEQ ID NO: 1282073 - RNA, 22 nt, Human
ugcccugggaacaguguguccu

SEQ ID NO: 1282074 - RNA, 25 nt, Human
uggaggccaagacccaaccaaagcc

SEQ ID NO: 1282075 - RNA, 18 nt, Human
uggagguggagguaagag

SEQ ID NO: 1282076 - RNA, 22 nt, Human
ugggagugggagugacauacug

SEQ ID NO: 1282077 - RNA, 26 nt, Human
ugucugugcccugggaacagugugac

SEQ ID NO: 1282078 - RNA, 19 nt, Human
uguggucacuuuuggggag

SEQ ID NO: 1282079 - RNA, 24 nt, Human
uuacagugagacagagcucccccu

SEQ ID NO: 1282080 - RNA, 22 nt, Human
uuacuacaguaaagcaauuuaa

SEQ ID NO: 1282081 - RNA, 24 nt, Human
aaaagaaaaaaaaauuucugcaga

SEQ ID NO: 1282082 - RNA, 25 nt, Human
aaaagaaaaaaaaauuucugcagag

SEQ ID NO: 1282083 - RNA, 22 nt, Human
aaaagccucuuuucuuuccacc

SEQ ID NO: 1282084 - RNA, 18 nt, Human
aaaauuagcugggcaugg

SEQ ID NO: 1282085 - RNA, 23 nt, Human
aaacaguauuacacaguugcuuu

SEQ ID NO: 1282086 - RNA, 21 nt, Human
aaagcaaagaggcagcagagc

SEQ ID NO: 1282087 - RNA, 23 nt, Human
aaagcaaagaggcagcagagcuu

SEQ ID NO: 1282088 - RNA, 22 nt, Human
aagacuuaucuugcaagagccc

SEQ ID NO: 1282089 - RNA, 23 nt, Human
aagagcccaggaaagccccaaau

SEQ ID NO: 1282090 - RNA, 20 nt, Human
aagcaaaagaaaaaaaaagg

SEQ ID NO: 1282091 - RNA, 18 nt, Human
aagcaaagaggcagcaga

SEQ ID NO: 1282092 - RNA, 20 nt, Human
aagcagugcugagcagccca

SEQ ID NO: 1282093 - RNA, 22 nt, Human
aagcgucucaugcugagagggg

SEQ ID NO: 1282094 - RNA, 22 nt, Human
aaggacaccaccuggaggcuga

SEQ ID NO: 1282095 - RNA, 21 nt, Human
aauauaagaaauauucucuua

SEQ ID NO: 1282096 - RNA, 24 nt, Human
aaucacuugaacccaggaggcgga

SEQ ID NO: 1282097 - RNA, 21 nt, Human
acagcaucaaguaaggccuuu

SEQ ID NO: 1282098 - RNA, 22 nt, Human
acagugugagcaguguggcagu

SEQ ID NO: 1282099 - RNA, 21 nt, Human
accagcaccgacuguuacaca

SEQ ID NO: 1282100 - RNA, 21 nt, Human
acccaguauggagucugugcc

SEQ ID NO: 1282101 - RNA, 23 nt, Human
acccaucccuuucccaguaucag

SEQ ID NO: 1282102 - RNA, 24 nt, Human
accucgucucuacuaaaaauacaa

SEQ ID NO: 1282103 - RNA, 24 nt, Human
accugaggucaggaguucaagacc

SEQ ID NO: 1282104 - RNA, 20 nt, Human
acgaggcugaggcaggagaa

SEQ ID NO: 1282105 - RNA, 22 nt, Human
acggugggaauagagauauggc

SEQ ID NO: 1282106 - RNA, 23 nt, Human
acuucuguccaggcacacacccc

SEQ ID NO: 1282107 - RNA, 23 nt, Human
acuuuauucacuguuauagacag

SEQ ID NO: 1282108 - RNA, 23 nt, Human
agaccugggguggcuggaggugg

SEQ ID NO: 1282109 - RNA, 21 nt, Human
agagaguaacauggucaccac

SEQ ID NO: 1282110 - RNA, 24 nt, Human
agagauauggcuggaccaaccccc

SEQ ID NO: 1282111 - RNA, 18 nt, Human
agagaugcuaggaauuca

SEQ ID NO: 1282112 - RNA, 20 nt, Human
agaggcagcagagcuugcug

SEQ ID NO: 1282113 - RNA, 20 nt, Human
agaggcuucggucggucccc

SEQ ID NO: 1282114 - RNA, 19 nt, Human
agauguccucggggaaaaa

SEQ ID NO: 1282115 - RNA, 24 nt, Human
agauuugggaggccaaggagggug

SEQ ID NO: 1282116 - RNA, 18 nt, Human
agcaccaccugaggcugg

SEQ ID NO: 1282117 - RNA, 21 nt, Human
agccagcccuggaaauuugca

SEQ ID NO: 1282118 - RNA, 20 nt, Human
agccuggccaacauguugaa

SEQ ID NO: 1282119 - RNA, 23 nt, Human
agccuggccaacauguugaaacc

SEQ ID NO: 1282120 - RNA, 22 nt, Human
aggaaguggggaaucuagaagg

SEQ ID NO: 1282121 - RNA, 18 nt, Human
aggaggagggggccagcc

SEQ ID NO: 1282122 - RNA, 22 nt, Human
aggaggguggaucaccugaggu

SEQ ID NO: 1282123 - RNA, 18 nt, Human
aggcacacaccccuggcc

SEQ ID NO: 1282124 - RNA, 19 nt, Human
aggcacacaccccuggcca

SEQ ID NO: 1282125 - RNA, 18 nt, Human
aggcaggagaaucacuug

SEQ ID NO: 1282126 - RNA, 23 nt, Human
aggcaggagaaucacuugaaccc

SEQ ID NO: 1282127 - RNA, 26 nt, Human
aggcagguggaugcuauauggucaga

SEQ ID NO: 1282128 - RNA, 24 nt, Human
aggcugaggcaggagaaucacuug

SEQ ID NO: 1282129 - RNA, 23 nt, Human
aggcugcugacugaaagccccaa

SEQ ID NO: 1282130 - RNA, 23 nt, Human
aggggcaggaaaagcuguggccc

SEQ ID NO: 1282131 - RNA, 24 nt, Human
agggggccaguagcacauccuggg

SEQ ID NO: 1282132 - RNA, 18 nt, Human
aguaaauggggugggguc

SEQ ID NO: 1282133 - RNA, 23 nt, Human
aucaccugaggucaggaguucaa

SEQ ID NO: 1282134 - RNA, 24 nt, Human
auggagccagccugggguggagug

SEQ ID NO: 1282135 - RNA, 18 nt, Human
auggccccaaacccuguc

SEQ ID NO: 1282136 - RNA, 22 nt, Human
augggcaucucagagagaaagc

SEQ ID NO: 1282137 - RNA, 19 nt, Human
caaagaggaugcugccucc

SEQ ID NO: 1282138 - RNA, 24 nt, Human
caaagccaccaccaagauucauga

SEQ ID NO: 1282139 - RNA, 24 nt, Human
caacauguugaaaccucgucucua

SEQ ID NO: 1282140 - RNA, 19 nt, Human
caaggacaccaccuggagg

SEQ ID NO: 1282141 - RNA, 22 nt, Human
caaggacaccaccuggaggcug

SEQ ID NO: 1282142 - RNA, 24 nt, Human
caaggaggguggaucaccugaggu

SEQ ID NO: 1282143 - RNA, 26 nt, Human
caaggaggguggaucaccugagguca

SEQ ID NO: 1282144 - RNA, 21 nt, Human
cacagagaguaacauggucac

SEQ ID NO: 1282145 - RNA, 27 nt, Human
caccugaggcuggggacugggguaccc

SEQ ID NO: 1282146 - RNA, 23 nt, Human
caccugaggucaggaguucaaga

SEQ ID NO: 1282147 - RNA, 18 nt, Human
caccugggaccccucagc

SEQ ID NO: 1282148 - RNA, 24 nt, Human
cacgaggcugaggcaggagaauca

SEQ ID NO: 1282149 - RNA, 21 nt, Human
cacgcccccaacccagcaauc

SEQ ID NO: 1282150 - RNA, 21 nt, Human
cacuacagacugagcucccag

SEQ ID NO: 1282151 - RNA, 22 nt, Human
cacugcccacugaccacaagga

SEQ ID NO: 1282152 - RNA, 21 nt, Human
cacuguguagccggaaguccc

SEQ ID NO: 1282153 - RNA, 18 nt, Human
cagagaaaaaugggagga

SEQ ID NO: 1282154 - RNA, 25 nt, Human
cagcccaccaggccuggcuugguuu

SEQ ID NO: 1282155 - RNA, 21 nt, Human
caggggcaggaaaagcugugg

SEQ ID NO: 1282156 - RNA, 18 nt, Human
cagugagucuugugucug

SEQ ID NO: 1282157 - RNA, 22 nt, Human
cagugagucuugugucuguucc

SEQ ID NO: 1282158 - RNA, 19 nt, Human
caucaggcaggacaggcuc

SEQ ID NO: 1282159 - RNA, 23 nt, Human
cauggugucaguguuaggccagu

SEQ ID NO: 1282160 - RNA, 21 nt, Human
ccacgcccccaacccagcaau

SEQ ID NO: 1282161 - RNA, 25 nt, Human
ccacugaccacaaggacaccaccug

SEQ ID NO: 1282162 - RNA, 21 nt, Human
ccaggcacacaccccuggcca

SEQ ID NO: 1282163 - RNA, 19 nt, Human
ccagggcugcugcagugaa

SEQ ID NO: 1282164 - RNA, 18 nt, Human
ccaucaggcaggacaggc

SEQ ID NO: 1282165 - RNA, 22 nt, Human
cccaccaggccuggcuugguuu

SEQ ID NO: 1282166 - RNA, 19 nt, Human
cccaggcagggaagagcuc

SEQ ID NO: 1282167 - RNA, 20 nt, Human
ccccacagacccccuucggg

SEQ ID NO: 1282168 - RNA, 19 nt, Human
cccccaacccagcaaucuc

SEQ ID NO: 1282169 - RNA, 22 nt, Human
ccccuagaugcccugcaggucc

SEQ ID NO: 1282170 - RNA, 19 nt, Human
ccccuggccagcacuggcc

SEQ ID NO: 1282171 - RNA, 19 nt, Human
ccccuggguucucagcagu

SEQ ID NO: 1282172 - RNA, 20 nt, Human
cccucuggagacucagcucc

SEQ ID NO: 1282173 - RNA, 22 nt, Human
cccugcagguccagcccauggu

SEQ ID NO: 1282174 - RNA, 18 nt, Human
cccugugccagggcugcu

SEQ ID NO: 1282175 - RNA, 20 nt, Human
cccugugccagggcugcugc

SEQ ID NO: 1282176 - RNA, 18 nt, Human
cccuucagaaaaugaaaa

SEQ ID NO: 1282177 - RNA, 23 nt, Human
ccguuucccagccuuuucugugu

SEQ ID NO: 1282178 - RNA, 18 nt, Human
ccucaugugugugggggg

SEQ ID NO: 1282179 - RNA, 18 nt, Human
ccucuggagacucagcuc

SEQ ID NO: 1282180 - RNA, 18 nt, Human
ccucuuuucuuuccacca

SEQ ID NO: 1282181 - RNA, 22 nt, Human
ccugcagucguuuuaccaaagc

SEQ ID NO: 1282182 - RNA, 21 nt, Human
ccuggccaacauguugaaacc

SEQ ID NO: 1282183 - RNA, 24 nt, Human
ccuggccaacauguugaaaccucg

SEQ ID NO: 1282184 - RNA, 19 nt, Human
ccuggccagcacuggccca

SEQ ID NO: 1282185 - RNA, 24 nt, Human
ccuggccagcacuggcccaucuca

SEQ ID NO: 1282186 - RNA, 22 nt, Human
ccugggguggcuggagguggag

SEQ ID NO: 1282187 - RNA, 22 nt, Human
ccuguaaucucagcuacucacg

SEQ ID NO: 1282188 - RNA, 25 nt, Human
cgccuguaaucucagcuacucacga

SEQ ID NO: 1282189 - RNA, 21 nt, Human
cuccagaugcauccucaguuc

SEQ ID NO: 1282190 - RNA, 18 nt, Human
cucccacgcccccaaccc

SEQ ID NO: 1282191 - RNA, 22 nt, Human
cucggggaaaaugaacuagacu

SEQ ID NO: 1282192 - RNA, 20 nt, Human
cucguggugccccguccagc

SEQ ID NO: 1282193 - RNA, 18 nt, Human
cugaccacaaggacacca

SEQ ID NO: 1282194 - RNA, 24 nt, Human
cugcugacugaaagccccaagcac

SEQ ID NO: 1282195 - RNA, 19 nt, Human
cugcugcauggaaggcugg

SEQ ID NO: 1282196 - RNA, 20 nt, Human
cugcugcauggaaggcuggu

SEQ ID NO: 1282197 - RNA, 23 nt, Human
cuggguccuuucuggacaccccu

SEQ ID NO: 1282198 - RNA, 19 nt, Human
cuguccccacagacccccu

SEQ ID NO: 1282199 - RNA, 21 nt, Human
cugugaaacccucagucaccc

SEQ ID NO: 1282200 - RNA, 19 nt, Human
cuugcaagagcccaggaaa

SEQ ID NO: 1282201 - RNA, 20 nt, Human
cuugcagagaaagauguccu

SEQ ID NO: 1282202 - RNA, 18 nt, Human
gaacugaugacuuuggga

SEQ ID NO: 1282203 - RNA, 20 nt, Human
gacauuuacuagauuuggga

SEQ ID NO: 1282204 - RNA, 23 nt, Human
gagaaucacuugaacccaggagg

SEQ ID NO: 1282205 - RNA, 18 nt, Human
gagccagccuggggugga

SEQ ID NO: 1282206 - RNA, 24 nt, Human
gagcuugcugcuaagguaaccuga

SEQ ID NO: 1282207 - RNA, 19 nt, Human
gaggggcaauggggagaca

SEQ ID NO: 1282208 - RNA, 24 nt, Human
gaguccaacccuaugaggagcuga

SEQ ID NO: 1282209 - RNA, 23 nt, Human
gaguuucucaguucccaaagagg

SEQ ID NO: 1282210 - RNA, 21 nt, Human
gaucaccugaggucaggaguu

SEQ ID NO: 1282211 - RNA, 23 nt, Human
gaucaccugaggucaggaguuca

SEQ ID NO: 1282212 - RNA, 24 nt, Human
gaucaccugaggucaggaguucaa

SEQ ID NO: 1282213 - RNA, 19 nt, Human
gcaggaaaagcuguggccc

SEQ ID NO: 1282214 - RNA, 22 nt, Human
gcaggagaaucacuugaaccca

SEQ ID NO: 1282215 - RNA, 20 nt, Human
ggaacccagagaaacggugg

SEQ ID NO: 1282216 - RNA, 18 nt, Human
ggagacucagcucccugc

SEQ ID NO: 1282217 - RNA, 27 nt, Human
ggagguggagcugguccuccccugggg

SEQ ID NO: 1282218 - RNA, 20 nt, Human
ggauggagccagccuggggu

SEQ ID NO: 1282219 - RNA, 21 nt, Human
ggcaggaagauuuuugaucug

SEQ ID NO: 1282220 - RNA, 18 nt, Human
ggccaaggaggguggauc

SEQ ID NO: 1282221 - RNA, 22 nt, Human
ggccaggaggggucuccuugga

SEQ ID NO: 1282222 - RNA, 18 nt, Human
ggccccuggugcccccaa

SEQ ID NO: 1282223 - RNA, 21 nt, Human
gggaaagugaggaagcagggg

SEQ ID NO: 1282224 - RNA, 19 nt, Human
gggaggcugagaccugggg

SEQ ID NO: 1282225 - RNA, 20 nt, Human
gggcacagagaguaacaugg

SEQ ID NO: 1282226 - RNA, 24 nt, Human
gggcaugguggcgggcgccuguaa

SEQ ID NO: 1282227 - RNA, 24 nt, Human
ggguacaggggcaggaaaagcugu

SEQ ID NO: 1282228 - RNA, 21 nt, Human
gguggaucaccugaggucagg

SEQ ID NO: 1282229 - RNA, 24 nt, Human
gguggcgggcgccuguaaucucag

SEQ ID NO: 1282230 - RNA, 19 nt, Human
ggugggaauagagauaugg

SEQ ID NO: 1282231 - RNA, 19 nt, Human
gucaacaaaggaggagggg

SEQ ID NO: 1282232 - RNA, 23 nt, Human
guccagcaggucucugagggcua

SEQ ID NO: 1282233 - RNA, 21 nt, Human
guggaucaccugaggucagga

SEQ ID NO: 1282234 - RNA, 20 nt, Human
gugggcaguuguccagcagg

SEQ ID NO: 1282235 - RNA, 18 nt, Human
uaaaagaagagccagagu

SEQ ID NO: 1282236 - RNA, 18 nt, Human
uaaaagaagagccagagu

SEQ ID NO: 1282237 - RNA, 20 nt, Human
uacagcaucaaguaaggccu

SEQ ID NO: 1282238 - RNA, 18 nt, Human
uaccaaagccaccaccaa

SEQ ID NO: 1282239 - RNA, 24 nt, Human
uaccaaagccaccaccaagauuca

SEQ ID NO: 1282240 - RNA, 18 nt, Human
uauagacagguguacugc

SEQ ID NO: 1282241 - RNA, 23 nt, Human
ucaccugaggucaggaguucaag

SEQ ID NO: 1282242 - RNA, 22 nt, Human
ucagagagaaagcaaagaggca

SEQ ID NO: 1282243 - RNA, 19 nt, Human
ucagauacaagcaaaagaa

SEQ ID NO: 1282244 - RNA, 25 nt, Human
ucagauacaagcaaaagaaaaaaaa

SEQ ID NO: 1282245 - RNA, 19 nt, Human
ucagcucuccucacugccu

SEQ ID NO: 1282246 - RNA, 23 nt, Human
ucauugggaaaguuggggugggg

SEQ ID NO: 1282247 - RNA, 18 nt, Human
uccaccagcaccgacugu

SEQ ID NO: 1282248 - RNA, 20 nt, Human
uccagugagacagagcugcg

SEQ ID NO: 1282249 - RNA, 24 nt, Human
uccuuggaggggucuguuucuguc

SEQ ID NO: 1282250 - RNA, 24 nt, Human
ucucaagcagcauaugcccagcuc

SEQ ID NO: 1282251 - RNA, 24 nt, Human
ucucacucuaugcagagggguccc

SEQ ID NO: 1282252 - RNA, 28 nt, Human
ucucacucuaugcagaggggucccuggc

SEQ ID NO: 1282253 - RNA, 21 nt, Human
ucucuacuaaaaauacaaaaa

SEQ ID NO: 1282254 - RNA, 18 nt, Human
ucugcugagaugagucca

SEQ ID NO: 1282255 - RNA, 18 nt, Human
ucuggauggagccagccu

SEQ ID NO: 1282256 - RNA, 24 nt, Human
ucugggcuaaagcagaccgggguc

SEQ ID NO: 1282257 - RNA, 20 nt, Human
ucuuuggguuagacaggcug

SEQ ID NO: 1282258 - RNA, 21 nt, Human
ucuuuggguuagacaggcugg

SEQ ID NO: 1282259 - RNA, 18 nt, Human
ugaaaaagaaaaacuugc

SEQ ID NO: 1282260 - RNA, 21 nt, Human
ugaacuagacugaccuggaca

SEQ ID NO: 1282261 - RNA, 18 nt, Human
ugaaucucaagcagcaua

SEQ ID NO: 1282262 - RNA, 21 nt, Human
ugaccaagcgucucaugcuuu

SEQ ID NO: 1282263 - RNA, 22 nt, Human
ugaccugauggguggucaguga

SEQ ID NO: 1282264 - RNA, 21 nt, Human
ugacugaaagccccaagcacc

SEQ ID NO: 1282265 - RNA, 24 nt, Human
ugacuuggucaacaccaugaucag

SEQ ID NO: 1282266 - RNA, 19 nt, Human
ugagacagagcugcgccuc

SEQ ID NO: 1282267 - RNA, 19 nt, Human
ugagcucccaguaggacac

SEQ ID NO: 1282268 - RNA, 24 nt, Human
ugaggcaggagaaucacuugaacc

SEQ ID NO: 1282269 - RNA, 25 nt, Human
ugaggcaggagaaucacuugaaccc

SEQ ID NO: 1282270 - RNA, 21 nt, Human
ugagguacuuuuccugcacuc

SEQ ID NO: 1282271 - RNA, 18 nt, Human
ugaguccaacccuaugag

SEQ ID NO: 1282272 - RNA, 24 nt, Human
ugaguggcccauugugggaaccca

SEQ ID NO: 1282273 - RNA, 18 nt, Human
ugaucagaggacagaugg

SEQ ID NO: 1282274 - RNA, 20 nt, Human
ugauggguggucagugaugc

SEQ ID NO: 1282275 - RNA, 18 nt, Human
ugcagagaaaaagccucu

SEQ ID NO: 1282276 - RNA, 28 nt, Human
ugcagagaaagauguccucggggaaaau

SEQ ID NO: 1282277 - RNA, 19 nt, Human
ugccccguccagcccacca

SEQ ID NO: 1282278 - RNA, 20 nt, Human
ugcccugugccagggcugcu

SEQ ID NO: 1282279 - RNA, 18 nt, Human
ugccugugaaacccucag

SEQ ID NO: 1282280 - RNA, 21 nt, Human
ugcuaagguaaccugaccaag

SEQ ID NO: 1282281 - RNA, 21 nt, Human
uggaaagucaucagcuccaaa

SEQ ID NO: 1282282 - RNA, 23 nt, Human
uggacauggggcaggaagauuuu

SEQ ID NO: 1282283 - RNA, 21 nt, Human
uggaggcaucugaggggcaau

SEQ ID NO: 1282284 - RNA, 24 nt, Human
uggaucaccugaggucaggaguuc

SEQ ID NO: 1282285 - RNA, 27 nt, Human
uggaucaccugaggucaggaguucaag

SEQ ID NO: 1282286 - RNA, 21 nt, Human
uggauggagccagccuggggu

SEQ ID NO: 1282287 - RNA, 23 nt, Human
uggcacuacagacugagcuccca

SEQ ID NO: 1282288 - RNA, 18 nt, Human
uggcauggccugugggca

SEQ ID NO: 1282289 - RNA, 19 nt, Human
uggcugaaaagacaguccu

SEQ ID NO: 1282290 - RNA, 18 nt, Human
uggcuggaccaacccccu

SEQ ID NO: 1282291 - RNA, 19 nt, Human
uggcuggagguggagcugg

SEQ ID NO: 1282292 - RNA, 18 nt, Human
ugggaaaaacccaguaug

SEQ ID NO: 1282293 - RNA, 22 nt, Human
ugggaaaguuggggugggggug

SEQ ID NO: 1282294 - RNA, 21 nt, Human
ugggaaggaggauggccccca

SEQ ID NO: 1282295 - RNA, 23 nt, Human
ugggaaggaggauggcccccagc

SEQ ID NO: 1282296 - RNA, 27 nt, Human
ugggaaggaggauggcccccagccugg

SEQ ID NO: 1282297 - RNA, 20 nt, Human
ugggaccccucagcagagag

SEQ ID NO: 1282298 - RNA, 21 nt, Human
ugggaggagaagauggucagg

SEQ ID NO: 1282299 - RNA, 24 nt, Human
ugggaggccaaggaggguggauca

SEQ ID NO: 1282300 - RNA, 21 nt, Human
uggggacuggguacaggacca

SEQ ID NO: 1282301 - RNA, 22 nt, Human
uggggggaugcuuggcauggcc

SEQ ID NO: 1282302 - RNA, 21 nt, Human
ugggguggaguggauggaucu

SEQ ID NO: 1282303 - RNA, 25 nt, Human
ugggguggcuggagguggagcuggu

SEQ ID NO: 1282304 - RNA, 25 nt, Human
uggguggucagugaugcagugugug

SEQ ID NO: 1282305 - RNA, 22 nt, Human
uggugcagguccucagcucucc

SEQ ID NO: 1282306 - RNA, 21 nt, Human
uggugcccccaagcagugcug

SEQ ID NO: 1282307 - RNA, 24 nt, Human
ugguggcgggcgccuguaaucuca

SEQ ID NO: 1282308 - RNA, 23 nt, Human
ugguggugagugggggcgacaug

SEQ ID NO: 1282309 - RNA, 27 nt, Human
uguccugggcaccuugcacugggcagu

SEQ ID NO: 1282310 - RNA, 23 nt, Human
uguggggccaucaggcaggacag

SEQ ID NO: 1282311 - RNA, 21 nt, Human
uguucuugcuuagagguuuug

SEQ ID NO: 1282312 - RNA, 18 nt, Human
uuagcugggcaugguggc

SEQ ID NO: 1282313 - RNA, 24 nt, Human
uuagcugggcaugguggcgggcgc

SEQ ID NO: 1282314 - RNA, 18 nt, Human
uucccaguaucagcacuc

SEQ ID NO: 1282315 - RNA, 20 nt, Human
uuccuuggagccagcccugg

SEQ ID NO: 1282316 - RNA, 19 nt, Human
uucugcacaggaggccacg

SEQ ID NO: 1282317 - RNA, 20 nt, Human
uugaguggcccauuguggga

SEQ ID NO: 1282318 - RNA, 22 nt, Human
uugcuuagagguuuugacagcg

SEQ ID NO: 1282319 - RNA, 23 nt, Human
uuuaccaaagccaccaccaagau

SEQ ID NO: 1282320 - RNA, 20 nt, Human
uuucauauucugggagugcu

SEQ ID NO: 1282321 - RNA, 21 nt, Human
uuugcaggguguggccacagg

SEQ ID NO: 1282322 - RNA, 26 nt, Human
aaaagauaaacaaauuagaggccaag

SEQ ID NO: 1282323 - RNA, 19 nt, Human
aaagaggccacugggaggc

SEQ ID NO: 1282324 - RNA, 19 nt, Human
aaaguuaggcuaggaaagg

SEQ ID NO: 1282325 - RNA, 18 nt, Human
aaaguuuugcuccuggag

SEQ ID NO: 1282326 - RNA, 22 nt, Human
aagauaaacaaauuagaggcca

SEQ ID NO: 1282327 - RNA, 23 nt, Human
aagcagcaaacgcuaggccugga

SEQ ID NO: 1282328 - RNA, 21 nt, Human
aagcaggaggcugggcaugga

SEQ ID NO: 1282329 - RNA, 18 nt, Human
aagccuuugggaggaaga

SEQ ID NO: 1282330 - RNA, 23 nt, Human
aagcuuguuuuccugcaacugga

SEQ ID NO: 1282331 - RNA, 24 nt, Human
aagcuuguuuuccugcaacuggau

SEQ ID NO: 1282332 - RNA, 21 nt, Human
aaguggccgaaaggcaggagc

SEQ ID NO: 1282333 - RNA, 19 nt, Human
aaguggugggccuggaggg

SEQ ID NO: 1282334 - RNA, 19 nt, Human
aaugagccaugauaggacc

SEQ ID NO: 1282335 - RNA, 21 nt, Human
acaacagagggagacccugaa

SEQ ID NO: 1282336 - RNA, 20 nt, Human
acacagcagggaagaagagc

SEQ ID NO: 1282337 - RNA, 25 nt, Human
accacaaauggaagaaaggccauga

SEQ ID NO: 1282338 - RNA, 19 nt, Human
acgggccuguagacgcacu

SEQ ID NO: 1282339 - RNA, 18 nt, Human
acuacacuccagccuugg

SEQ ID NO: 1282340 - RNA, 18 nt, Human
acuacacuccagccuugg

SEQ ID NO: 1282341 - RNA, 19 nt, Human
acuacacuccagccuugga

SEQ ID NO: 1282342 - RNA, 25 nt, Human
acuacacuccagccuuggacaacag

SEQ ID NO: 1282343 - RNA, 19 nt, Human
acuacacuccagccuuggg

SEQ ID NO: 1282344 - RNA, 21 nt, Human
acuggauugugagggccagag

SEQ ID NO: 1282345 - RNA, 23 nt, Human
agaaguugggcaaaaggcugauu

SEQ ID NO: 1282346 - RNA, 26 nt, Human
agacagaaguugggcaaaagggaccc

SEQ ID NO: 1282347 - RNA, 19 nt, Human
agacagggaagagcugggu

SEQ ID NO: 1282348 - RNA, 19 nt, Human
agacgggccuguagacgca

SEQ ID NO: 1282349 - RNA, 28 nt, Human
agaggcaggagcugagucccccaagggg

SEQ ID NO: 1282350 - RNA, 22 nt, Human
agaggcugcagaaaggcaggag

SEQ ID NO: 1282351 - RNA, 19 nt, Human
agaggcugccagcugcuca

SEQ ID NO: 1282352 - RNA, 20 nt, Human
agaggcugggccuguacaug

SEQ ID NO: 1282353 - RNA, 20 nt, Human
agcagcaaacgcuaggccug

SEQ ID NO: 1282354 - RNA, 24 nt, Human
agccacgugggagguugagguggg

SEQ ID NO: 1282355 - RNA, 21 nt, Human
aggaagaggugggccuggaga

SEQ ID NO: 1282356 - RNA, 25 nt, Human
aggaggccagggugaggaagaggug

SEQ ID NO: 1282357 - RNA, 19 nt, Human
aggcacuaggccuggaaau

SEQ ID NO: 1282358 - RNA, 18 nt, Human
aggcaggagacgggccug

SEQ ID NO: 1282359 - RNA, 20 nt, Human
aggcaggagacgggccugua

SEQ ID NO: 1282360 - RNA, 22 nt, Human
aggcaggagcugacacuucggc

SEQ ID NO: 1282361 - RNA, 21 nt, Human
aggcaggagcugaguccaaag

SEQ ID NO: 1282362 - RNA, 22 nt, Human
aggcaggagcuucaccugagga

SEQ ID NO: 1282363 - RNA, 25 nt, Human
aggcaggagcuucaccugaggaugc

SEQ ID NO: 1282364 - RNA, 19 nt, Human
aggcaggaggagcugggcc

SEQ ID NO: 1282365 - RNA, 21 nt, Human
aggcaggaggagcugggccug

SEQ ID NO: 1282366 - RNA, 23 nt, Human
aggcaggcagauucguggccugg

SEQ ID NO: 1282367 - RNA, 22 nt, Human
aggccagagucgggccuggaga

SEQ ID NO: 1282368 - RNA, 22 nt, Human
aggccgccgagaggauggagcu

SEQ ID NO: 1282369 - RNA, 22 nt, Human
aggccggagcugggccugggga

SEQ ID NO: 1282370 - RNA, 23 nt, Human
agguugaggugggaggaucgcuu

SEQ ID NO: 1282371 - RNA, 19 nt, Human
agucccagcuacugggaag

SEQ ID NO: 1282372 - RNA, 24 nt, Human
aguggcaagcaccuguagucucag

SEQ ID NO: 1282373 - RNA, 22 nt, Human
auaaacaaauuagaggccaaga

SEQ ID NO: 1282374 - RNA, 19 nt, Human
aucugggucuggagggucc

SEQ ID NO: 1282375 - RNA, 20 nt, Human
augguaggauugcuugagcc

SEQ ID NO: 1282376 - RNA, 20 nt, Human
caaagcagcaaacgcuaggc

SEQ ID NO: 1282377 - RNA, 18 nt, Human
caacagagggagacccug

SEQ ID NO: 1282378 - RNA, 23 nt, Human
caacuggaguaaguucagggcuu

SEQ ID NO: 1282379 - RNA, 18 nt, Human
caacuggauggucccacg

SEQ ID NO: 1282380 - RNA, 19 nt, Human
caccuguagucucagccac

SEQ ID NO: 1282381 - RNA, 23 nt, Human
caccuguagucucagccacgugg

SEQ ID NO: 1282382 - RNA, 24 nt, Human
caccuguagucucagccacguggg

SEQ ID NO: 1282383 - RNA, 18 nt, Human
cacggcaugaucuuggcc

SEQ ID NO: 1282384 - RNA, 23 nt, Human
cagaagucuuucaugguaggucc

SEQ ID NO: 1282385 - RNA, 18 nt, Human
cagaugaguuucgucucc

SEQ ID NO: 1282386 - RNA, 24 nt, Human
cagccaguuucucuuccuggauuc

SEQ ID NO: 1282387 - RNA, 23 nt, Human
cagccuuggacaacagagggaga

SEQ ID NO: 1282388 - RNA, 22 nt, Human
cagcuguagucccagcuacugg

SEQ ID NO: 1282389 - RNA, 23 nt, Human
cagcuguagucccagcuacuggg

SEQ ID NO: 1282390 - RNA, 21 nt, Human
caggcagauucguggccuggg

SEQ ID NO: 1282391 - RNA, 24 nt, Human
cagggccuggagaagaugcaaagc

SEQ ID NO: 1282392 - RNA, 24 nt, Human
cagucagucucucuuccuggauuc

SEQ ID NO: 1282393 - RNA, 19 nt, Human
ccaccgugaggcaaaugcu

SEQ ID NO: 1282394 - RNA, 19 nt, Human
ccacugaacuccauccuga

SEQ ID NO: 1282395 - RNA, 19 nt, Human
ccagcacugggaaacuagg

SEQ ID NO: 1282396 - RNA, 18 nt, Human
ccaguuucucuuccugga

SEQ ID NO: 1282397 - RNA, 19 nt, Human
cccacugugagguagaggc

SEQ ID NO: 1282398 - RNA, 18 nt, Human
cccaugcaggccuuugag

SEQ ID NO: 1282399 - RNA, 20 nt, Human
ccucauuuuccguuccccag

SEQ ID NO: 1282400 - RNA, 18 nt, Human
ccuggagaggcugaccug

SEQ ID NO: 1282401 - RNA, 24 nt, Human
ccuggcaugaggcgugcccagagg

SEQ ID NO: 1282402 - RNA, 19 nt, Human
ccuguagaggccacuggga

SEQ ID NO: 1282403 - RNA, 19 nt, Human
cgacaugaggcaggagcug

SEQ ID NO: 1282404 - RNA, 20 nt, Human
cgaggccgggcccaugcagg

SEQ ID NO: 1282405 - RNA, 23 nt, Human
cgcugucaccccucuggaaucca

SEQ ID NO: 1282406 - RNA, 22 nt, Human
cgggccuggagacacagcaggg

SEQ ID NO: 1282407 - RNA, 22 nt, Human
cuacuacacuccagccuuggac

SEQ ID NO: 1282408 - RNA, 19 nt, Human
cucaagggaaucuucagcu

SEQ ID NO: 1282409 - RNA, 18 nt, Human
cucgcuggucuuugucuc

SEQ ID NO: 1282410 - RNA, 18 nt, Human
cugagaggaagagcuggg

SEQ ID NO: 1282411 - RNA, 18 nt, Human
cugccaggaggcaagagc

SEQ ID NO: 1282412 - RNA, 23 nt, Human
cuggaagguugaggcugcaguca

SEQ ID NO: 1282413 - RNA, 19 nt, Human
cuggagaggccgcagacag

SEQ ID NO: 1282414 - RNA, 21 nt, Human
cuggcaugaggcgugcccaga

SEQ ID NO: 1282415 - RNA, 18 nt, Human
cugggcccggggaggcca

SEQ ID NO: 1282416 - RNA, 18 nt, Human
cugggccuaaagaggcca

SEQ ID NO: 1282417 - RNA, 23 nt, Human
cugguggcugugguggcucgcug

SEQ ID NO: 1282418 - RNA, 19 nt, Human
gaauccacguauacgaaaa

SEQ ID NO: 1282419 - RNA, 21 nt, Human
gacaugaggcaggagcugagu

SEQ ID NO: 1282420 - RNA, 21 nt, Human
gaggagcuggaccuguacaag

SEQ ID NO: 1282421 - RNA, 20 nt, Human
gaggggaugggcccguugag

SEQ ID NO: 1282422 - RNA, 21 nt, Human
gagugacagggcaagguccug

SEQ ID NO: 1282423 - RNA, 21 nt, Human
gaguuucgucuccuccacugg

SEQ ID NO: 1282424 - RNA, 18 nt, Human
gauugcuugagccuggga

SEQ ID NO: 1282425 - RNA, 22 nt, Human
gauugcuugagccugggaguuu

SEQ ID NO: 1282426 - RNA, 27 nt, Human
gcaaagcagcaaacgcuaggccuggaa

SEQ ID NO: 1282427 - RNA, 20 nt, Human
gcagacagggaagagcuggg

SEQ ID NO: 1282428 - RNA, 21 nt, Human
gcaggagcuaggccugcagag

SEQ ID NO: 1282429 - RNA, 20 nt, Human
gcaggagcugggcccgcaga

SEQ ID NO: 1282430 - RNA, 21 nt, Human
gcaggagcugggcccgcagag

SEQ ID NO: 1282431 - RNA, 26 nt, Human
gccagagucgggccuggagacacagg

SEQ ID NO: 1282432 - RNA, 19 nt, Human
gccgaaaggcaggagcuug

SEQ ID NO: 1282433 - RNA, 25 nt, Human
gccgaaaggcaggagcuuuggacug

SEQ ID NO: 1282434 - RNA, 24 nt, Human
gccugcagaagccuuuggcgacug

SEQ ID NO: 1282435 - RNA, 19 nt, Human
gccuggacaggcugcaaaa

SEQ ID NO: 1282436 - RNA, 19 nt, Human
gccuggagaagaugcaaag

SEQ ID NO: 1282437 - RNA, 20 nt, Human
ggaaggcugacaugguagga

SEQ ID NO: 1282438 - RNA, 21 nt, Human
ggaagggaaaaacggggccug

SEQ ID NO: 1282439 - RNA, 21 nt, Human
ggagaggccgacuggaggaag

SEQ ID NO: 1282440 - RNA, 19 nt, Human
ggagcugggcccgcagagg

SEQ ID NO: 1282441 - RNA, 21 nt, Human
ggagcugggcccggggaggcc

SEQ ID NO: 1282442 - RNA, 23 nt, Human
ggaggaugagcucguccuggaga

SEQ ID NO: 1282443 - RNA, 23 nt, Human
ggaggcaggaggagcugggcccc

SEQ ID NO: 1282444 - RNA, 21 nt, Human
ggagguugaggugggaggauc

SEQ ID NO: 1282445 - RNA, 22 nt, Human
ggagguugaggugggaggaucg

SEQ ID NO: 1282446 - RNA, 21 nt, Human
ggaguaaguucagggcuugga

SEQ ID NO: 1282447 - RNA, 18 nt, Human
ggaguuugaggcuauaau

SEQ ID NO: 1282448 - RNA, 22 nt, Human
ggcauaguggcaagcaccugua

SEQ ID NO: 1282449 - RNA, 19 nt, Human
ggccgaaagaggucaccgu

SEQ ID NO: 1282450 - RNA, 18 nt, Human
ggccuggggaggccaccg

SEQ ID NO: 1282451 - RNA, 19 nt, Human
ggccuggggaggccgacuu

SEQ ID NO: 1282452 - RNA, 23 nt, Human
ggcgugcccagagggacagaggc

SEQ ID NO: 1282453 - RNA, 19 nt, Human
gggaagaagagcugggcug

SEQ ID NO: 1282454 - RNA, 24 nt, Human
gggaagcaggaggcugggcaugga

SEQ ID NO: 1282455 - RNA, 19 nt, Human
gggaggaagagcuuggccu

SEQ ID NO: 1282456 - RNA, 19 nt, Human
gggaggcaggaggagcugg

SEQ ID NO: 1282457 - RNA, 25 nt, Human
gggcaaaaggcugauuugaggaagu

SEQ ID NO: 1282458 - RNA, 22 nt, Human
gggccgaaagaggucaccguga

SEQ ID NO: 1282459 - RNA, 23 nt, Human
gggccuggagacacagcagggaa

SEQ ID NO: 1282460 - RNA, 23 nt, Human
ggugggccuggagagcccacugu

SEQ ID NO: 1282461 - RNA, 23 nt, Human
ggugggccuggagggucuacugu

SEQ ID NO: 1282462 - RNA, 19 nt, Human
guaugcaucaaaaagcaaa

SEQ ID NO: 1282463 - RNA, 23 nt, Human
gucuacugugugguaagagucug

SEQ ID NO: 1282464 - RNA, 18 nt, Human
gugaggcagaggcuggcc

SEQ ID NO: 1282465 - RNA, 19 nt, Human
gugaggcagaggcugggcc

SEQ ID NO: 1282466 - RNA, 18 nt, Human
guggccuagagaggcugc

SEQ ID NO: 1282467 - RNA, 22 nt, Human
uacaaaggcaauugcgaggcag

SEQ ID NO: 1282468 - RNA, 25 nt, Human
uacuacacuccagccuuggacaaca

SEQ ID NO: 1282469 - RNA, 18 nt, Human
uagaggccgggccuguag

SEQ ID NO: 1282470 - RNA, 20 nt, Human
uagaggcugcagaaaggcag

SEQ ID NO: 1282471 - RNA, 20 nt, Human
uagaggcugccgaaaggcag

SEQ ID NO: 1282472 - RNA, 20 nt, Human
uagcacuacuacacuccagc

SEQ ID NO: 1282473 - RNA, 18 nt, Human
uaggguuuauccaucuug

SEQ ID NO: 1282474 - RNA, 23 nt, Human
uaguggcaagcaccuguagucuc

SEQ ID NO: 1282475 - RNA, 24 nt, Human
uaguggcaagcaccuguagucuca

SEQ ID NO: 1282476 - RNA, 20 nt, Human
uaguugggcauaguggcaag

SEQ ID NO: 1282477 - RNA, 20 nt, Human
ucaaaagugugcugugagga

SEQ ID NO: 1282478 - RNA, 21 nt, Human
ucauuuuccguuccccagcau

SEQ ID NO: 1282479 - RNA, 27 nt, Human
uccacguauacgaaaauuccaaauauu

SEQ ID NO: 1282480 - RNA, 19 nt, Human
uccacugugaggcagaggc

SEQ ID NO: 1282481 - RNA, 20 nt, Human
ucugcccugaggcacgggcu

SEQ ID NO: 1282482 - RNA, 24 nt, Human
ucuguggccuagagaggccggggc

SEQ ID NO: 1282483 - RNA, 21 nt, Human
ucuuagaagguggggaauaau

SEQ ID NO: 1282484 - RNA, 19 nt, Human
ucuuuuagcaugaacuggg

SEQ ID NO: 1282485 - RNA, 23 nt, Human
ugaacucccucauuuuccguucc

SEQ ID NO: 1282486 - RNA, 21 nt, Human
ugacagggcaagguccuguuu

SEQ ID NO: 1282487 - RNA, 18 nt, Human
ugacaugguaggauugcu

SEQ ID NO: 1282488 - RNA, 22 nt, Human
ugagccugggaguuugaggcua

SEQ ID NO: 1282489 - RNA, 25 nt, Human
ugaggaugccacagugagacaccau

SEQ ID NO: 1282490 - RNA, 18 nt, Human
ugaggcagaggcugggcc

SEQ ID NO: 1282491 - RNA, 18 nt, Human
ugaggcagaggcugggcc

SEQ ID NO: 1282492 - RNA, 18 nt, Human
ugaggcagcagcugccuu

SEQ ID NO: 1282493 - RNA, 18 nt, Human
ugaggcaggagacgggcc

SEQ ID NO: 1282494 - RNA, 20 nt, Human
ugaggcaggagacgggccuc

SEQ ID NO: 1282495 - RNA, 20 nt, Human
ugaggcaggagacgggccug

SEQ ID NO: 1282496 - RNA, 19 nt, Human
ugaggcaggagcugacacu

SEQ ID NO: 1282497 - RNA, 22 nt, Human
ugaggccgaggccgggcccaug

SEQ ID NO: 1282498 - RNA, 19 nt, Human
ugagggaggagcuggaccu

SEQ ID NO: 1282499 - RNA, 21 nt, Human
ugagggaggagcuggaccugu

SEQ ID NO: 1282500 - RNA, 20 nt, Human
ugagguccccaugccuggac

SEQ ID NO: 1282501 - RNA, 18 nt, Human
ugaggugggaggaucgcu

SEQ ID NO: 1282502 - RNA, 19 nt, Human
ugaggugggaggaucgcuu

SEQ ID NO: 1282503 - RNA, 23 nt, Human
ugaguccaaagacguuguuggga

SEQ ID NO: 1282504 - RNA, 22 nt, Human
ugcaaaaggcaaaagcugugcc

SEQ ID NO: 1282505 - RNA, 18 nt, Human
ugcacaaaaggaaacgcu

SEQ ID NO: 1282506 - RNA, 20 nt, Human
ugcccagagggacagaggca

SEQ ID NO: 1282507 - RNA, 21 nt, Human
ugcccagccaguuucucuucc

SEQ ID NO: 1282508 - RNA, 23 nt, Human
ugccggaagggaaaaacggggcc

SEQ ID NO: 1282509 - RNA, 23 nt, Human
ugccuggaaaagucgccaugggg

SEQ ID NO: 1282510 - RNA, 19 nt, Human
uggaagguugaggcugcag

SEQ ID NO: 1282511 - RNA, 22 nt, Human
uggaagguugaggcugcaguca

SEQ ID NO: 1282512 - RNA, 20 nt, Human
uggagaggccgacuggaggg

SEQ ID NO: 1282513 - RNA, 20 nt, Human
uggagaggcugaccugagga

SEQ ID NO: 1282514 - RNA, 20 nt, Human
uggagaggcugacucgagga

SEQ ID NO: 1282515 - RNA, 21 nt, Human
uggaggaaguccagggccugg

SEQ ID NO: 1282516 - RNA, 22 nt, Human
uggaggaaguccagggccugga

SEQ ID NO: 1282517 - RNA, 23 nt, Human
uggaggaaguuuugggacuggag

SEQ ID NO: 1282518 - RNA, 22 nt, Human
uggcagcuuucuccaacuuugg

SEQ ID NO: 1282519 - RNA, 22 nt, Human
uggcaggcaggagcuggaccug

SEQ ID NO: 1282520 - RNA, 22 nt, Human
ugggaggaagagcuuggccugg

SEQ ID NO: 1282521 - RNA, 18 nt, Human
ugggaggcaggagcuggg

SEQ ID NO: 1282522 - RNA, 21 nt, Human
ugggaggcaggaggagcuggg

SEQ ID NO: 1282523 - RNA, 21 nt, Human
ugggagggagagcuuggucug

SEQ ID NO: 1282524 - RNA, 18 nt, Human
ugggagguugagguggga

SEQ ID NO: 1282525 - RNA, 23 nt, Human
ugggagguugaggugggaggauc

SEQ ID NO: 1282526 - RNA, 21 nt, Human
ugggcaaaaggcugauuugag

SEQ ID NO: 1282527 - RNA, 21 nt, Human
ugggccaaaggagguugugag

SEQ ID NO: 1282528 - RNA, 19 nt, Human
ugggccgaaagaggucacc

SEQ ID NO: 1282529 - RNA, 20 nt, Human
ugggccuaaagagaccauug

SEQ ID NO: 1282530 - RNA, 20 nt, Human
ugggccuaaagaggccacug

SEQ ID NO: 1282531 - RNA, 26 nt, Human
ugggccucaacaggccaggacccguc

SEQ ID NO: 1282532 - RNA, 18 nt, Human
uggggaggccaccgugag

SEQ ID NO: 1282533 - RNA, 22 nt, Human
uggucuuugucucuuagaaggu

SEQ ID NO: 1282534 - RNA, 18 nt, Human
ugugaggaaugagcuggg

SEQ ID NO: 1282535 - RNA, 18 nt, Human
ugugaggcagaggcuggg

SEQ ID NO: 1282536 - RNA, 18 nt, Human
ugugaggccgaggccggg

SEQ ID NO: 1282537 - RNA, 21 nt, Human
uguugagguccccaugccugg

SEQ ID NO: 1282538 - RNA, 25 nt, Human
uuaaggacauucugggccuggacag

SEQ ID NO: 1282539 - RNA, 18 nt, Human
uuaguugggcauaguggc

SEQ ID NO: 1282540 - RNA, 24 nt, Human
uuccccagcauuggcggguucugg

SEQ ID NO: 1282541 - RNA, 19 nt, Human
uugcaccuggagaggccgc

SEQ ID NO: 1282542 - RNA, 24 nt, Human
uugcuugagccugggaguuugagg

SEQ ID NO: 1282543 - RNA, 18 nt, Human
uuggaagcccaggagcau

SEQ ID NO: 1282544 - RNA, 18 nt, Human
uuggacuggagaggccgc

SEQ ID NO: 1282545 - RNA, 18 nt, Human
uuggccuguagaggcugc

SEQ ID NO: 1282546 - RNA, 19 nt, Human
uugggaggccagagucggg

SEQ ID NO: 1282547 - RNA, 18 nt, Human
uugugaggaaugagcugg

SEQ ID NO: 1282548 - RNA, 21 nt, Human
uuuuccugcaacuggaugguc

SEQ ID NO: 1282549 - RNA, 22 nt, Human
aaaaauagacccguauugauca

SEQ ID NO: 1282550 - RNA, 22 nt, Human
aaaccaacacaaaucuugcaac

SEQ ID NO: 1282551 - RNA, 21 nt, Human
aaacccagaagaacgcaggcg

SEQ ID NO: 1282552 - RNA, 22 nt, Human
aaagccuaacauuuuauuuccu

SEQ ID NO: 1282553 - RNA, 24 nt, Human
aaagugcugggcuuacaggcauga

SEQ ID NO: 1282554 - RNA, 23 nt, Human
aagacccauggagacugugguaa

SEQ ID NO: 1282555 - RNA, 25 nt, Human
aagcaauucucccaccuuagccucc

SEQ ID NO: 1282556 - RNA, 22 nt, Human
aauagaucucuugggaguucau

SEQ ID NO: 1282557 - RNA, 21 nt, Human
aaugaaggaguugugccuaaa

SEQ ID NO: 1282558 - RNA, 23 nt, Human
acacaacccuaucuagccaaacc

SEQ ID NO: 1282559 - RNA, 18 nt, Human
acaucacucuccauucca

SEQ ID NO: 1282560 - RNA, 19 nt, Human
accagcaggaaccaaugcc

SEQ ID NO: 1282561 - RNA, 24 nt, Human
accauguugaccaggcuggucuug

SEQ ID NO: 1282562 - RNA, 20 nt, Human
acccgccuccgccucccaaa

SEQ ID NO: 1282563 - RNA, 23 nt, Human
acccuugcccacaucacucucca

SEQ ID NO: 1282564 - RNA, 22 nt, Human
accugcugagguggccccucca

SEQ ID NO: 1282565 - RNA, 18 nt, Human
acgggguuucaccauguu

SEQ ID NO: 1282566 - RNA, 19 nt, Human
acgggguuucaccauguug

SEQ ID NO: 1282567 - RNA, 24 nt, Human
acgggguuucaccauguugaccag

SEQ ID NO: 1282568 - RNA, 20 nt, Human
agaagcauccucagugaguu

SEQ ID NO: 1282569 - RNA, 21 nt, Human
agaaguuacccagugagagug

SEQ ID NO: 1282570 - RNA, 19 nt, Human
agagcgacaagugcccuuc

SEQ ID NO: 1282571 - RNA, 18 nt, Human
aggcaggaugcucugggc

SEQ ID NO: 1282572 - RNA, 21 nt, Human
agugcaauggugcaaucucag

SEQ ID NO: 1282573 - RNA, 19 nt, Human
aguugggugggggguugcu

SEQ ID NO: 1282574 - RNA, 22 nt, Human
auagacccguauugaucauaca

SEQ ID NO: 1282575 - RNA, 20 nt, Human
auggaacccugguccugccu

SEQ ID NO: 1282576 - RNA, 21 nt, Human
caaaaacacagcauuaggcca

SEQ ID NO: 1282577 - RNA, 22 nt, Human
caaaaccaacacaaaucuugca

SEQ ID NO: 1282578 - RNA, 22 nt, Human
caaagaggcacuaaacauaaug

SEQ ID NO: 1282579 - RNA, 24 nt, Human
caaagugcugggcuuacaggcaug

SEQ ID NO: 1282580 - RNA, 23 nt, Human
caaaucucucaccauccaucaua

SEQ ID NO: 1282581 - RNA, 21 nt, Human
caagaccauacaucucuccca

SEQ ID NO: 1282582 - RNA, 27 nt, Human
caauggauccacccgccuccgccuccc

SEQ ID NO: 1282583 - RNA, 21 nt, Human
caccauguugaccaggcuggu

SEQ ID NO: 1282584 - RNA, 22 nt, Human
caccauguugaccaggcugguc

SEQ ID NO: 1282585 - RNA, 24 nt, Human
caccauguugaccaggcuggucuu

SEQ ID NO: 1282586 - RNA, 23 nt, Human
cacccgccuccgccucccaaagu

SEQ ID NO: 1282587 - RNA, 24 nt, Human
caccuuagccucccguguagcugg

SEQ ID NO: 1282588 - RNA, 21 nt, Human
cacugcaaccuccgccucccg

SEQ ID NO: 1282589 - RNA, 23 nt, Human
cacugcaaccuccgccucccggg

SEQ ID NO: 1282590 - RNA, 21 nt, Human
cagcuucccacugcccucacc

SEQ ID NO: 1282591 - RNA, 24 nt, Human
caggaauggaacccugguccugcc

SEQ ID NO: 1282592 - RNA, 20 nt, Human
cagguacaaaaacacagcau

SEQ ID NO: 1282593 - RNA, 23 nt, Human
cauguugaccaggcuggucuuga

SEQ ID NO: 1282594 - RNA, 24 nt, Human
cauguugaccaggcuggucuugag

SEQ ID NO: 1282595 - RNA, 24 nt, Human
cauucagaacccaccugcugaggu

SEQ ID NO: 1282596 - RNA, 19 nt, Human
ccaaacccagaagaacgca

SEQ ID NO: 1282597 - RNA, 24 nt, Human
ccaaagugcugggcuuacaggcau

SEQ ID NO: 1282598 - RNA, 22 nt, Human
ccacccgccuccgccucccaaa

SEQ ID NO: 1282599 - RNA, 20 nt, Human
ccacugcccucaccugggag

SEQ ID NO: 1282600 - RNA, 21 nt, Human
ccacugcccucaccugggagg

SEQ ID NO: 1282601 - RNA, 20 nt, Human
cccacaagauuuaauagauc

SEQ ID NO: 1282602 - RNA, 20 nt, Human
cccacacugggcgugccucc

SEQ ID NO: 1282603 - RNA, 23 nt, Human
cccacacugggcgugccuccuag

SEQ ID NO: 1282604 - RNA, 23 nt, Human
cccaccuuagccucccguguagc

SEQ ID NO: 1282605 - RNA, 21 nt, Human
cccaggagagggucagagcac

SEQ ID NO: 1282606 - RNA, 20 nt, Human
ccccugucagguacaaaaac

SEQ ID NO: 1282607 - RNA, 24 nt, Human
cccguguagcugggacuacaggcu

SEQ ID NO: 1282608 - RNA, 27 nt, Human
ccgccucccggguucaagcaauucuuu

SEQ ID NO: 1282609 - RNA, 24 nt, Human
ccgccuccgccucccaaagugcug

SEQ ID NO: 1282610 - RNA, 19 nt, Human
ccguguagcugggacuaca

SEQ ID NO: 1282611 - RNA, 22 nt, Human
ccuaucuagccaaacccagaag

SEQ ID NO: 1282612 - RNA, 22 nt, Human
ccucaccagcagcauaugacaa

SEQ ID NO: 1282613 - RNA, 24 nt, Human
ccuccaccacuugggcacuagcau

SEQ ID NO: 1282614 - RNA, 24 nt, Human
ccucccggguucaagcaauucucc

SEQ ID NO: 1282615 - RNA, 22 nt, Human
ccugaccucaauggauccaccc

SEQ ID NO: 1282616 - RNA, 18 nt, Human
ccugccagugccagggag

SEQ ID NO: 1282617 - RNA, 20 nt, Human
ccuugcccacaucacucucc

SEQ ID NO: 1282618 - RNA, 18 nt, Human
cgacuuagauacuaguga

SEQ ID NO: 1282619 - RNA, 24 nt, Human
cgccuccgccucccaaagugcugg

SEQ ID NO: 1282620 - RNA, 23 nt, Human
cggcaaaagacccauggagacug

SEQ ID NO: 1282621 - RNA, 24 nt, Human
cgggguuucaccauguugaccagg

SEQ ID NO: 1282622 - RNA, 23 nt, Human
cuagaguucuccaucaaaaccaa

SEQ ID NO: 1282623 - RNA, 20 nt, Human
cuagaguucuccaucaaaag

SEQ ID NO: 1282624 - RNA, 20 nt, Human
cucaccagcagcauaugaca

SEQ ID NO: 1282625 - RNA, 21 nt, Human
cucaccagcagcauaugacaa

SEQ ID NO: 1282626 - RNA, 24 nt, Human
cucacugcaaccuccgccucccgg

SEQ ID NO: 1282627 - RNA, 23 nt, Human
cucccguguagcugggacuacag

SEQ ID NO: 1282628 - RNA, 23 nt, Human
cugcaaccuccgccucccggguu

SEQ ID NO: 1282629 - RNA, 24 nt, Human
cugcaaccuccgccucccggguuc

SEQ ID NO: 1282630 - RNA, 23 nt, Human
cugcauucagaacccaccugcug

SEQ ID NO: 1282631 - RNA, 22 nt, Human
cugcugaaaucggcccuuugaa

SEQ ID NO: 1282632 - RNA, 20 nt, Human
cuggugacggguagaaggaa

SEQ ID NO: 1282633 - RNA, 22 nt, Human
cuggugggaggugagaaacaag

SEQ ID NO: 1282634 - RNA, 19 nt, Human
cugucgcccaggcuggagu

SEQ ID NO: 1282635 - RNA, 24 nt, Human
cuuagccucccguguagcugggac

SEQ ID NO: 1282636 - RNA, 20 nt, Human
cuucuacagaagcauccuca

SEQ ID NO: 1282637 - RNA, 21 nt, Human
cuugagcuccugaccucaaug

SEQ ID NO: 1282638 - RNA, 18 nt, Human
cuuuuuuuuuuuuuuuug

SEQ ID NO: 1282639 - RNA, 19 nt, Human
gaaaaugacacccuugccc

SEQ ID NO: 1282640 - RNA, 18 nt, Human
gaaguagagagugaggug

SEQ ID NO: 1282641 - RNA, 23 nt, Human
gaauggaacccugguccugccuc

SEQ ID NO: 1282642 - RNA, 24 nt, Human
gaccucaauggauccacccgccuc

SEQ ID NO: 1282643 - RNA, 20 nt, Human
gagacgggguuucaccaugu

SEQ ID NO: 1282644 - RNA, 22 nt, Human
gagacugugguaaccagguggg

SEQ ID NO: 1282645 - RNA, 24 nt, Human
gagagggucagagcacaugugcuc

SEQ ID NO: 1282646 - RNA, 21 nt, Human
gagcagaagcugagcagggaa

SEQ ID NO: 1282647 - RNA, 21 nt, Human
gagcagggaagaaauggugug

SEQ ID NO: 1282648 - RNA, 22 nt, Human
gauccacccgccuccgccuccc

SEQ ID NO: 1282649 - RNA, 19 nt, Human
gcccaggcuggagugcaau

SEQ ID NO: 1282650 - RNA, 20 nt, Human
gcccaggcuggagugcaaug

SEQ ID NO: 1282651 - RNA, 18 nt, Human
gccucagauucuucacug

SEQ ID NO: 1282652 - RNA, 21 nt, Human
gcggggacagccuuggcugca

SEQ ID NO: 1282653 - RNA, 27 nt, Human
gcucugucgcccaggcuggagugcaau

SEQ ID NO: 1282654 - RNA, 23 nt, Human
gcuggucuugagcuccugaccuc

SEQ ID NO: 1282655 - RNA, 22 nt, Human
gcuuacaggcaugagccacugc

SEQ ID NO: 1282656 - RNA, 19 nt, Human
ggaaaacacaagggcuugg

SEQ ID NO: 1282657 - RNA, 25 nt, Human
ggaggugccaccauuucuccccauu

SEQ ID NO: 1282658 - RNA, 21 nt, Human
ggcaccugcucugagggcggg

SEQ ID NO: 1282659 - RNA, 24 nt, Human
ggcuggucuugagcuccugaccuc

SEQ ID NO: 1282660 - RNA, 22 nt, Human
ggcuuacaggcaugagccacug

SEQ ID NO: 1282661 - RNA, 21 nt, Human
gggccucagauucuucacugg

SEQ ID NO: 1282662 - RNA, 23 nt, Human
gggguuucaccauguugaccagg

SEQ ID NO: 1282663 - RNA, 23 nt, Human
guagagacgggguuucaccaugu

SEQ ID NO: 1282664 - RNA, 21 nt, Human
uaaaaugagugaccccuguca

SEQ ID NO: 1282665 - RNA, 21 nt, Human
uaaacauaauggaaaacacaa

SEQ ID NO: 1282666 - RNA, 19 nt, Human
uaaagcccgacuuagauac

SEQ ID NO: 1282667 - RNA, 30 nt, Human; identical to SEQ ID NO: 260408

SEQ ID NO: 1282668 - RNA, 29 nt, Human
uacaaccaauggccuucccauagcucaca

SEQ ID NO: 1282669 - RNA, 19 nt, Human
uacagcagaggaagaugaa

SEQ ID NO: 1282670 - RNA, 23 nt, Human
uacaggcaugagccacugcgccc

SEQ ID NO: 1282671 - RNA, 19 nt, Human
uacucaucguguuucucac

SEQ ID NO: 1282672 - RNA, 22 nt, Human
uagagacgggguuucaccaugu

SEQ ID NO: 1282673 - RNA, 21 nt, Human
uagcaaagaggcacuaaacau

SEQ ID NO: 1282674 - RNA, 25 nt, Human
uagcaaauacaaccaauggccuucc

SEQ ID NO: 1282675 - RNA, 19 nt, Human
uagcaaugugagguaaggc

SEQ ID NO: 1282676 - RNA, 24 nt, Human
uaguagagacgggguuucaccaug

SEQ ID NO: 1282677 - RNA, 26 nt, Human
uaguagagacgggguuucaccauguu

SEQ ID NO: 1282678 - RNA, 20 nt, Human
ucaagcaauucucccaccuu

SEQ ID NO: 1282679 - RNA, 18 nt, Human
ucaauuacuugucucaau

SEQ ID NO: 1282680 - RNA, 23 nt, Human
ucacugcaaccuccgccucccgg

SEQ ID NO: 1282681 - RNA, 24 nt, Human
ucacugcaaccuccgccucccggg

SEQ ID NO: 1282682 - RNA, 25 nt, Human
ucacugcaaccuccgccucccgggu

SEQ ID NO: 1282683 - RNA, 27 nt, Human
ucacugcaaccuccgccucccggguuc

SEQ ID NO: 1282684 - RNA, 19 nt, Human
ucagauucuucacugucaa

SEQ ID NO: 1282685 - RNA, 20 nt, Human
ucagauucuucacugucaac

SEQ ID NO: 1282686 - RNA, 20 nt, Human
ucaguuaguaaagaaggagg

SEQ ID NO: 1282687 - RNA, 19 nt, Human
uccacccgccuccgccucc

SEQ ID NO: 1282688 - RNA, 24 nt, Human
ucccaaagugcugggcuuacaggc

SEQ ID NO: 1282689 - RNA, 18 nt, Human
ucccacugcccucaccug

SEQ ID NO: 1282690 - RNA, 18 nt, Human
uccccaaccucucugggc

SEQ ID NO: 1282691 - RNA, 21 nt, Human
ucccggguucaagcaauucuc

SEQ ID NO: 1282692 - RNA, 23 nt, Human
ucccggguucaagcaauucuccc

SEQ ID NO: 1282693 - RNA, 24 nt, Human
ucccguguagcugggacuacaggc

SEQ ID NO: 1282694 - RNA, 24 nt, Human
uccgccucccggguucaagcaauu

SEQ ID NO: 1282695 - RNA, 18 nt, Human
ucgcccaggcuggagugc

SEQ ID NO: 1282696 - RNA, 23 nt, Human
ucucagggcugugugacuuuacu

SEQ ID NO: 1282697 - RNA, 26 nt, Human
ucucccaccuuagccucccguguagc

SEQ ID NO: 1282698 - RNA, 18 nt, Human
ucugauuucuuucuuucu

SEQ ID NO: 1282699 - RNA, 24 nt, Human
ucugucgcccaggcuggagugcaa

SEQ ID NO: 1282700 - RNA, 23 nt, Human
ucuugagcuccugaccucaaugg

SEQ ID NO: 1282701 - RNA, 23 nt, Human
ucuugcucugucgcccaggcugg

SEQ ID NO: 1282702 - RNA, 24 nt, Human
ucuugcucugucgcccaggcugga

SEQ ID NO: 1282703 - RNA, 18 nt, Human
ugaaaaagacuggaaggu

SEQ ID NO: 1282704 - RNA, 21 nt, Human
ugaaagcucuuuugaaagcaa

SEQ ID NO: 1282705 - RNA, 19 nt, Human
ugaaauuagacgcaaugac

SEQ ID NO: 1282706 - RNA, 18 nt, Human
ugacaaaguagggauuuu

SEQ ID NO: 1282707 - RNA, 24 nt, Human
ugaccaggcuggucuugagcuccu

SEQ ID NO: 1282708 - RNA, 20 nt, Human
ugagcagggaagaaauggug

SEQ ID NO: 1282709 - RNA, 27 nt, Human
ugagggcgggcaguuggagcgagucuc

SEQ ID NO: 1282710 - RNA, 22 nt, Human
ugagguaaggccugccagugcc

SEQ ID NO: 1282711 - RNA, 23 nt, Human
ugcaauggugcaaucucagcucc

SEQ ID NO: 1282712 - RNA, 18 nt, Human
ugccaccauuucucccca

SEQ ID NO: 1282713 - RNA, 19 nt, Human
ugcucugagggcgggcagu

SEQ ID NO: 1282714 - RNA, 24 nt, Human
ugcucugucgcccaggcuggagug

SEQ ID NO: 1282715 - RNA, 21 nt, Human
ugcuggggaucaguuaguaaa

SEQ ID NO: 1282716 - RNA, 24 nt, Human
ugcuggggaucaguuaguaaagaa

SEQ ID NO: 1282717 - RNA, 18 nt, Human
uggaacccugguccugcc

SEQ ID NO: 1282718 - RNA, 23 nt, Human
uggaacccugguccugccucuca

SEQ ID NO: 1282719 - RNA, 19 nt, Human
uggagcgagucucacccau

SEQ ID NO: 1282720 - RNA, 23 nt, Human
uggagugcaauggugcaaucuca

SEQ ID NO: 1282721 - RNA, 24 nt, Human
uggagugcaauggugcaaucucag

SEQ ID NO: 1282722 - RNA, 19 nt, Human
ugggacuacaggcucccgc

SEQ ID NO: 1282723 - RNA, 21 nt, Human
ugggacuacaggcucccgcca

SEQ ID NO: 1282724 - RNA, 22 nt, Human
ugggcuuacaggcaugagccac

SEQ ID NO: 1282725 - RNA, 22 nt, Human
ugggcuuacaggcaugagccac

SEQ ID NO: 1282726 - RNA, 24 nt, Human
ugggcuuacaggcaugagccacug

SEQ ID NO: 1282727 - RNA, 24 nt, Human
ugggcuuacaggcaugagccacug

SEQ ID NO: 1282728 - RNA, 24 nt, Human
uggugcaaucucagcucacugcaa

SEQ ID NO: 1282729 - RNA, 23 nt, Human
uggugguugucaaaucucucacc

SEQ ID NO: 1282730 - RNA, 19 nt, Human
uguagcugggacuacaggc

SEQ ID NO: 1282731 - RNA, 24 nt, Human
uguagcugggacuacaggcucccg

SEQ ID NO: 1282732 - RNA, 21 nt, Human
uguauuuuuaguagagacggg

SEQ ID NO: 1282733 - RNA, 20 nt, Human
ugucgcccaggcuggagugc

SEQ ID NO: 1282734 - RNA, 23 nt, Human
uguuaaauaagauuccagaaagu

SEQ ID NO: 1282735 - RNA, 19 nt, Human
uuaacauuucaguccauuc

SEQ ID NO: 1282736 - RNA, 20 nt, Human
uuacaggcaugagccacugc

SEQ ID NO: 1282737 - RNA, 18 nt, Human
uuaguagagacgggguuu

SEQ ID NO: 1282738 - RNA, 22 nt, Human
uuaguagagacgggguuucacc

SEQ ID NO: 1282739 - RNA, 24 nt, Human
uuaguagagacgggguuucaccau

SEQ ID NO: 1282740 - RNA, 24 nt, Human
uucaagcaauucucccaccuuagc

SEQ ID NO: 1282741 - RNA, 23 nt, Human
uuccauagagggacacaacccua

SEQ ID NO: 1282742 - RNA, 19 nt, Human
uucugauuucuuucuuucu

SEQ ID NO: 1282743 - RNA, 20 nt, Human
uucugauuucuuucuuucuu

SEQ ID NO: 1282744 - RNA, 25 nt, Human
uucugauuucuuucuuucuuuuuuu

SEQ ID NO: 1282745 - RNA, 24 nt, Human
uugaaguagagagugaggugaagc

SEQ ID NO: 1282746 - RNA, 18 nt, Human
uuggaacuggauagagca

SEQ ID NO: 1282747 - RNA, 23 nt, Human
uuguauuuuuaguagagacgggg

SEQ ID NO: 1282748 - RNA, 20 nt, Human
uugugcuucgugugccuggg

SEQ ID NO: 1282749 - RNA, 24 nt, Human
uuucaccauguugaccaggcuggu

SEQ ID NO: 1282750 - RNA, 20 nt, Human
uuugaaauuagacgcaauga

SEQ ID NO: 1282751 - RNA, 20 nt, Human
uuuuauuuccuugcugggga

SEQ ID NO: 1282752 - RNA, 24 nt, Human
uuuuuaguagagacgggguuucac

SEQ ID NO: 1282753 - RNA, 22 nt, Human
uuuuuguauuuuuaguagagaa

SEQ ID NO: 1282754 - RNA, 21 nt, Human
uuuuuuguauuuuuaguagag

SEQ ID NO: 1282755 - RNA, 24 nt, Human
uuuuuuguauuuuuaguagagacg

SEQ ID NO: 1282756 - RNA, 23 nt, Human
uuuuuuuuuuuuugagagagucu

SEQ ID NO: 1282757 - RNA, 22 nt, Human
aaaaccuccagcaucucugcuc

SEQ ID NO: 1282758 - RNA, 26 nt, Human
aaaaggaaauuuacuauggggcggga

SEQ ID NO: 1282759 - RNA, 27 nt, Human
aaacagaaaguacgacaaaggggaccc

SEQ ID NO: 1282760 - RNA, 21 nt, Human
aaacagaaaguacgacaaagu

SEQ ID NO: 1282761 - RNA, 24 nt, Human
aaagugccgcgauuacaggcguga

SEQ ID NO: 1282762 - RNA, 22 nt, Human
aaaugucucuccugggcaagcc

SEQ ID NO: 1282763 - RNA, 25 nt, Human
aacagcucuucagcugaagccaacc

SEQ ID NO: 1282764 - RNA, 18 nt, Human
aacaggcagggcaggugg

SEQ ID NO: 1282765 - RNA, 23 nt, Human
aagaugucgcaucuuuuuaaaug

SEQ ID NO: 1282766 - RNA, 18 nt, Human
aagcagaggccucccagg

SEQ ID NO: 1282767 - RNA, 19 nt, Human
aagcagaggccucccaggg

SEQ ID NO: 1282768 - RNA, 24 nt, Human
aaguagcuggggcuacaggcacgu

SEQ ID NO: 1282769 - RNA, 18 nt, Human
aagugcugggaucacagg

SEQ ID NO: 1282770 - RNA, 23 nt, Human
aagugcugggaucacagguguga

SEQ ID NO: 1282771 - RNA, 26 nt, Human
aagugcugggaucacaggugugagcc

SEQ ID NO: 1282772 - RNA, 18 nt, Human
aauagcugggauuacagg

SEQ ID NO: 1282773 - RNA, 20 nt, Human
acaggguuucaccacuuugg

SEQ ID NO: 1282774 - RNA, 24 nt, Human
acaggguuucaccacuuuggccag

SEQ ID NO: 1282775 - RNA, 23 nt, Human
acccacgaagccaccacugaccc

SEQ ID NO: 1282776 - RNA, 19 nt, Human
acgaagccaccacugaccc

SEQ ID NO: 1282777 - RNA, 18 nt, Human
acucugucacccaagcug

SEQ ID NO: 1282778 - RNA, 27 nt, Human
acucugucacccaagcuggagugcaau

SEQ ID NO: 1282779 - RNA, 18 nt, Human
acugacucccugcccucc

SEQ ID NO: 1282780 - RNA, 22 nt, Human
acugcaccuggcccuguucaga

SEQ ID NO: 1282781 - RNA, 23 nt, Human
agcacagcuccguccccucccca

SEQ ID NO: 1282782 - RNA, 19 nt, Human
agcaguuuuugccgcauuc

SEQ ID NO: 1282783 - RNA, 18 nt, Human
aggcagggucucuguugc

SEQ ID NO: 1282784 - RNA, 19 nt, Human
aggccucccagggacaaga

SEQ ID NO: 1282785 - RNA, 21 nt, Human
agggacaagagcugagaagga

SEQ ID NO: 1282786 - RNA, 24 nt, Human
aggugaucugccugccucggccuc

SEQ ID NO: 1282787 - RNA, 21 nt, Human
agugcaguggugcugucauag

SEQ ID NO: 1282788 - RNA, 20 nt, Human
agugcugggaucacaggugu

SEQ ID NO: 1282789 - RNA, 20 nt, Human
auaaauuucccucagagcag

SEQ ID NO: 1282790 - RNA, 24 nt, Human
auagcugggauuacaggugugagc

SEQ ID NO: 1282791 - RNA, 21 nt, Human
auccuccugcuucagccuccc

SEQ ID NO: 1282792 - RNA, 24 nt, Human
aucuuucuaggaauuuuuuuguug

SEQ ID NO: 1282793 - RNA, 23 nt, Human
auuucuccuuugacccuuuggcu

SEQ ID NO: 1282794 - RNA, 23 nt, Human
auuugcagcuauaaauuucccuc

SEQ ID NO: 1282795 - RNA, 24 nt, Human
auuuuuguguuuuuaguagagaca

SEQ ID NO: 1282796 - RNA, 23 nt, Human
caaaacagcucuucagcugaagc

SEQ ID NO: 1282797 - RNA, 24 nt, Human
caaagugaaacccacgaagccacc

SEQ ID NO: 1282798 - RNA, 24 nt, Human
caaagugccgcgauuacaggcgug

SEQ ID NO: 1282799 - RNA, 19 nt, Human
caacaggcagggcaggugg

SEQ ID NO: 1282800 - RNA, 18 nt, Human
caacuuggaaaauuccag

SEQ ID NO: 1282801 - RNA, 22 nt, Human
caagugauuuuccugccucagc

SEQ ID NO: 1282802 - RNA, 24 nt, Human
caagugcugggaucacagguguga

SEQ ID NO: 1282803 - RNA, 18 nt, Human
cacagcuccguccccucc

SEQ ID NO: 1282804 - RNA, 22 nt, Human
cacaggugugagccacugcacc

SEQ ID NO: 1282805 - RNA, 19 nt, Human
caccacacccagccaagau

SEQ ID NO: 1282806 - RNA, 23 nt, Human
caccacgccuggcuaauuuuugu

SEQ ID NO: 1282807 - RNA, 21 nt, Human
caccacuuuggccagguuggu

SEQ ID NO: 1282808 - RNA, 24 nt, Human
caccacuuuggccagguuggucuc

SEQ ID NO: 1282809 - RNA, 23 nt, Human
cacucugucacccaagcuggagu

SEQ ID NO: 1282810 - RNA, 24 nt, Human
cacucugucacccaagcuggagug

SEQ ID NO: 1282811 - RNA, 21 nt, Human
cacugcaaccucugccuccug

SEQ ID NO: 1282812 - RNA, 23 nt, Human
cacugcaaccucugccuccuggg

SEQ ID NO: 1282813 - RNA, 20 nt, Human
cacuucuguucccucaucca

SEQ ID NO: 1282814 - RNA, 23 nt, Human
cacuucuguucccucauccagag

SEQ ID NO: 1282815 - RNA, 19 nt, Human
cagauaaggugacauagug

SEQ ID NO: 1282816 - RNA, 21 nt, Human
cagcucuucagcugaagccaa

SEQ ID NO: 1282817 - RNA, 20 nt, Human
cagggacaagagcugagaag

SEQ ID NO: 1282818 - RNA, 19 nt, Human
cagggucucuguugcccag

SEQ ID NO: 1282819 - RNA, 24 nt, Human
caggguuucaccacuuuggccagg

SEQ ID NO: 1282820 - RNA, 22 nt, Human
caggugaucugccugccucggc

SEQ ID NO: 1282821 - RNA, 22 nt, Human
cauaguggcaaaugucucuccu

SEQ ID NO: 1282822 - RNA, 22 nt, Human
ccaaagugccgcgauuacaggc

SEQ ID NO: 1282823 - RNA, 24 nt, Human
ccaaagugccgcgauuacaggcgu

SEQ ID NO: 1282824 - RNA, 19 nt, Human
ccaagugcugggaucacag

SEQ ID NO: 1282825 - RNA, 23 nt, Human
ccaagugcugggaucacaggugu

SEQ ID NO: 1282826 - RNA, 24 nt, Human
ccaagugcugggaucacaggugug

SEQ ID NO: 1282827 - RNA, 26 nt, Human
ccacacccagccaagaugguggaccc

SEQ ID NO: 1282828 - RNA, 24 nt, Human
ccacacccagccaagaugucgcaa

SEQ ID NO: 1282829 - RNA, 20 nt, Human
ccaccacgccuggcuaauuu

SEQ ID NO: 1282830 - RNA, 19 nt, Human
ccacugcaccuggcccugu

SEQ ID NO: 1282831 - RNA, 20 nt, Human
ccagggacaagagcugagaa

SEQ ID NO: 1282832 - RNA, 23 nt, Human
cccaagcuggagugcaauggcau

SEQ ID NO: 1282833 - RNA, 24 nt, Human
cccaaguagcuggggcuacaggca

SEQ ID NO: 1282834 - RNA, 24 nt, Human
cccaagugcugggaucacaggugu

SEQ ID NO: 1282835 - RNA, 22 nt, Human
cccagggcaagcccagauaagg

SEQ ID NO: 1282836 - RNA, 23 nt, Human
ccgcacccagcgacaggacugug

SEQ ID NO: 1282837 - RNA, 24 nt, Human
ccucccagggacaagagcugagaa

SEQ ID NO: 1282838 - RNA, 26 nt, Human
ccucccagggacaagagcugagaagg

SEQ ID NO: 1282839 - RNA, 23 nt, Human
ccucccugaugacuuuagcaccu

SEQ ID NO: 1282840 - RNA, 26 nt, Human
ccuccugcuucagccucccaaguagc

SEQ ID NO: 1282841 - RNA, 22 nt, Human
ccucugccuccuggguucaagu

SEQ ID NO: 1282842 - RNA, 18 nt, Human
ccugagguucaaaaccuc

SEQ ID NO: 1282843 - RNA, 24 nt, Human
ccuggccucaggccauccuccuaa

SEQ ID NO: 1282844 - RNA, 18 nt, Human
ccuggcuggagugcagug

SEQ ID NO: 1282845 - RNA, 21 nt, Human
ccuggcuggagugcaguggug

SEQ ID NO: 1282846 - RNA, 23 nt, Human
ccuggguucaagugauuuuccuc

SEQ ID NO: 1282847 - RNA, 23 nt, Human
ccuggguucaagugauuuuccug

SEQ ID NO: 1282848 - RNA, 24 nt, Human
cgcgauuacaggcgugagccacca

SEQ ID NO: 1282849 - RNA, 24 nt, Human
cgugaauagcugggauuacaggug

SEQ ID NO: 1282850 - RNA, 24 nt, Human
cuagcuauccuccugcuucagccu

SEQ ID NO: 1282851 - RNA, 27 nt, Human
cuagcuauccuccugcuucagccuccc

SEQ ID NO: 1282852 - RNA, 27 nt, Human
cuaggaauuuuuuuguuguuguuuuga

SEQ ID NO: 1282853 - RNA, 24 nt, Human
cucacucugucacccaagcuggag

SEQ ID NO: 1282854 - RNA, 24 nt, Human
cucacugcaaccucugccuccugg

SEQ ID NO: 1282855 - RNA, 21 nt, Human
cuccagcaucucugcucuucc

SEQ ID NO: 1282856 - RNA, 25 nt, Human
cucccugcccucccugaugacuuua

SEQ ID NO: 1282857 - RNA, 21 nt, Human
cuccgcacccagcgacaggac

SEQ ID NO: 1282858 - RNA, 19 nt, Human
cuccguccccuccccacgg

SEQ ID NO: 1282859 - RNA, 21 nt, Human
cuccuggccucaggccaucuu

SEQ ID NO: 1282860 - RNA, 23 nt, Human
cuccugggcucuagcuauccucc

SEQ ID NO: 1282861 - RNA, 24 nt, Human
cucgugaauagcugggauuacagg

SEQ ID NO: 1282862 - RNA, 20 nt, Human
cugaccucaggugaucugcc

SEQ ID NO: 1282863 - RNA, 23 nt, Human
cugaccucaggugaucugccugc

SEQ ID NO: 1282864 - RNA, 23 nt, Human
cugcaaccucugccuccuggguu

SEQ ID NO: 1282865 - RNA, 24 nt, Human
cugcaaccucugccuccuggguuc

SEQ ID NO: 1282866 - RNA, 23 nt, Human
cugccucagccucgugaauagcu

SEQ ID NO: 1282867 - RNA, 23 nt, Human
cugccuccuggguucaagugauu

SEQ ID NO: 1282868 - RNA, 23 nt, Human
cugcuucagccucccaaguagcu

SEQ ID NO: 1282869 - RNA, 24 nt, Human
cuggagugcaauggcaugaucuca

SEQ ID NO: 1282870 - RNA, 24 nt, Human
cuggccucaggccauccuccuaac

SEQ ID NO: 1282871 - RNA, 18 nt, Human
cugucucagugccccagg

SEQ ID NO: 1282872 - RNA, 19 nt, Human
cugucucagugccccaggg

SEQ ID NO: 1282873 - RNA, 20 nt, Human
cuucugguauggauuucugg

SEQ ID NO: 1282874 - RNA, 23 nt, Human
cuuugaacuccugggcucuagcu

SEQ ID NO: 1282875 - RNA, 19 nt, Human
gaauagcugggauuacagg

SEQ ID NO: 1282876 - RNA, 19 nt, Human
gaauagcugggauuacagg

SEQ ID NO: 1282877 - RNA, 24 nt, Human
gaauagcugggauuacagguguga

SEQ ID NO: 1282878 - RNA, 25 nt, Human
gaauagcugggauuacaggugugag

SEQ ID NO: 1282879 - RNA, 24 nt, Human
gaccucaggugaucugccugccuc

SEQ ID NO: 1282880 - RNA, 18 nt, Human
gaucacaggugugagcca

SEQ ID NO: 1282881 - RNA, 22 nt, Human
gaucacaggugugagccacugc

SEQ ID NO: 1282882 - RNA, 23 nt, Human
gaucacaggugugagccacugca

SEQ ID NO: 1282883 - RNA, 18 nt, Human
gauuacaggcgugagcca

SEQ ID NO: 1282884 - RNA, 21 nt, Human
gauuacaggcgugagccacca

SEQ ID NO: 1282885 - RNA, 22 nt, Human
gauuacaggcgugagccaccac

SEQ ID NO: 1282886 - RNA, 18 nt, Human
gauuacaggugugagcca

SEQ ID NO: 1282887 - RNA, 21 nt, Human
gauuacaggugugagccacca

SEQ ID NO: 1282888 - RNA, 22 nt, Human
gauuacaggugugagccaccac

SEQ ID NO: 1282889 - RNA, 19 nt, Human
gcuggagugcaauggcaug

SEQ ID NO: 1282890 - RNA, 21 nt, Human
gcuggagugcaguggugcugg

SEQ ID NO: 1282891 - RNA, 19 nt, Human
gcugggauuacagguguga

SEQ ID NO: 1282892 - RNA, 23 nt, Human
gcuggucucgaacuccuggccuc

SEQ ID NO: 1282893 - RNA, 22 nt, Human
ggaaauuuacuauggggcggga

SEQ ID NO: 1282894 - RNA, 19 nt, Human
ggacaagagcugagaagga

SEQ ID NO: 1282895 - RNA, 21 nt, Human
ggagaaggugguuugcaggau

SEQ ID NO: 1282896 - RNA, 18 nt, Human
ggagggccuggggccugc

SEQ ID NO: 1282897 - RNA, 23 nt, Human
ggcggaagagcucugcaaucucu

SEQ ID NO: 1282898 - RNA, 19 nt, Human
ggcuacaggcacgugccau

SEQ ID NO: 1282899 - RNA, 24 nt, Human
ggcuggucucgaacuccuggccuc

SEQ ID NO: 1282900 - RNA, 20 nt, Human
gggaaaaggaaauuuacuau

SEQ ID NO: 1282901 - RNA, 19 nt, Human
gggcucuagcuauccuccu

SEQ ID NO: 1282902 - RNA, 19 nt, Human
ggucucgaacuucugaccu

SEQ ID NO: 1282903 - RNA, 20 nt, Human
ggucucgaacuucugaccuc

SEQ ID NO: 1282904 - RNA, 23 nt, Human
gugaaacagaaaguacgacaaag

SEQ ID NO: 1282905 - RNA, 21 nt, Human
gugauuuuccugccucagccu

SEQ ID NO: 1282906 - RNA, 21 nt, Human
gugcgugcugcugcuucuuuu

SEQ ID NO: 1282907 - RNA, 19 nt, Human
guucccucauccagagagg

SEQ ID NO: 1282908 - RNA, 21 nt, Human
uaaaaaguguguucaauuucu

SEQ ID NO: 1282909 - RNA, 19 nt, Human
uaagcacagcuccgucccc

SEQ ID NO: 1282910 - RNA, 20 nt, Human
uaagcacagcuccguccccu

SEQ ID NO: 1282911 - RNA, 23 nt, Human
uaagucuggucagccuuuugguu

SEQ ID NO: 1282912 - RNA, 24 nt, Human
uaauuuuuguguuuuuaguagaga

SEQ ID NO: 1282913 - RNA, 24 nt, Human
uacaggcgugagccaccacaccca

SEQ ID NO: 1282914 - RNA, 22 nt, Human
uacaggugugagccaccacgcc

SEQ ID NO: 1282915 - RNA, 23 nt, Human
uacaggugugagccaccacgccu

SEQ ID NO: 1282916 - RNA, 21 nt, Human
uagagacaggguuucaccacu

SEQ ID NO: 1282917 - RNA, 19 nt, Human
uaguagagacaggguuuca

SEQ ID NO: 1282918 - RNA, 26 nt, Human
uaguagagacaggguuucaccacuuu

SEQ ID NO: 1282919 - RNA, 19 nt, Human
ucaagugauuuuccugccu

SEQ ID NO: 1282920 - RNA, 21 nt, Human
ucaccacuuuggccagguugg

SEQ ID NO: 1282921 - RNA, 24 nt, Human
ucacugcaaccucugccuccuggg

SEQ ID NO: 1282922 - RNA, 25 nt, Human
ucacugcaaccucugccuccugggu

SEQ ID NO: 1282923 - RNA, 27 nt, Human
ucacugcaaccucugccuccuggguuc

SEQ ID NO: 1282924 - RNA, 20 nt, Human
ucagccucccaaguagcugg

SEQ ID NO: 1282925 - RNA, 21 nt, Human
ucagccucccaaguagcuggg

SEQ ID NO: 1282926 - RNA, 23 nt, Human
ucagccucccaaguagcuggggc

SEQ ID NO: 1282927 - RNA, 25 nt, Human
ucaggccauccuccuaacuaguucu

SEQ ID NO: 1282928 - RNA, 21 nt, Human
ucaggccauggcugaguggga

SEQ ID NO: 1282929 - RNA, 22 nt, Human
uccagagagggcggaagagcuc

SEQ ID NO: 1282930 - RNA, 24 nt, Human
uccagcaucucugcucuucccuaa

SEQ ID NO: 1282931 - RNA, 24 nt, Human
ucccaaagugccgcgauuacaggc

SEQ ID NO: 1282932 - RNA, 24 nt, Human
ucccaaguagcuggggcuacaggc

SEQ ID NO: 1282933 - RNA, 23 nt, Human
uccccaagugcugggaucacagg

SEQ ID NO: 1282934 - RNA, 22 nt, Human
ucccucagagcaguuuuugccg

SEQ ID NO: 1282935 - RNA, 19 nt, Human
uccgcacccagcgacagga

SEQ ID NO: 1282936 - RNA, 20 nt, Human
uccugggcaagccugggaug

SEQ ID NO: 1282937 - RNA, 21 nt, Human
uccuggguucaagugauuuuc

SEQ ID NO: 1282938 - RNA, 24 nt, Human
uccuggguucaagugauuuuccug

SEQ ID NO: 1282939 - RNA, 20 nt, Human
ucgaggcagggucucuguug

SEQ ID NO: 1282940 - RNA, 24 nt, Human
ucgugaauagcugggauuacaggu

SEQ ID NO: 1282941 - RNA, 21 nt, Human
ucguugcagcuuugaacuccu

SEQ ID NO: 1282942 - RNA, 24 nt, Human
ucguugcagcuuugaacuccuggg

SEQ ID NO: 1282943 - RNA, 22 nt, Human
ucucacucugucacccaagcug

SEQ ID NO: 1282944 - RNA, 24 nt, Human
ucucacucugucacccaagcugga

SEQ ID NO: 1282945 - RNA, 26 nt, Human
ucucacucugucacccaagcuggagu

SEQ ID NO: 1282946 - RNA, 27 nt, Human
ucucacucugucacccaagcuggagug

SEQ ID NO: 1282947 - RNA, 20 nt, Human
ucucgaacuccuggccucag

SEQ ID NO: 1282948 - RNA, 23 nt, Human
ucucgaacuucugaccucaggug

SEQ ID NO: 1282949 - RNA, 23 nt, Human
ucucuccugggcaagccugggau

SEQ ID NO: 1282950 - RNA, 24 nt, Human
ucucugggaagugacaagcagagg

SEQ ID NO: 1282951 - RNA, 18 nt, Human
ucucuguugcccaggcug

SEQ ID NO: 1282952 - RNA, 18 nt, Human
ucucuguugcccaggcug

SEQ ID NO: 1282953 - RNA, 25 nt, Human
ucucuguugcccaggcuggucucga

SEQ ID NO: 1282954 - RNA, 23 nt, Human
ucugaccucaggugaucugccug

SEQ ID NO: 1282955 - RNA, 24 nt, Human
ucugucacccaagcuggagugcaa

SEQ ID NO: 1282956 - RNA, 19 nt, Human
ucuguucccucauccagag

SEQ ID NO: 1282957 - RNA, 24 nt, Human
ucuguugcccaggcuggucucgaa

SEQ ID NO: 1282958 - RNA, 21 nt, Human
ugaaacagaaaguacgacaaa

SEQ ID NO: 1282959 - RNA, 24 nt, Human
ugaaacagaaaguacgacaaagug

SEQ ID NO: 1282960 - RNA, 19 nt, Human
ugaaacccacgaagccacc

SEQ ID NO: 1282961 - RNA, 24 nt, Human
ugaaacccacgaagccaccacuga

SEQ ID NO: 1282962 - RNA, 25 nt, Human
ugaacuccugggcucuagcuauccu

SEQ ID NO: 1282963 - RNA, 20 nt, Human
ugacauaguggcaaaugucu

SEQ ID NO: 1282964 - RNA, 18 nt, Human
ugaccucaggugaucugc

SEQ ID NO: 1282965 - RNA, 20 nt, Human
ugaccucaggugaucugccu

SEQ ID NO: 1282966 - RNA, 24 nt, Human
ugaccucaggugaucugccugccu

SEQ ID NO: 1282967 - RNA, 18 nt, Human
ugagacagagucucacuc

SEQ ID NO: 1282968 - RNA, 22 nt, Human
ugagacagagucucacucuguc

SEQ ID NO: 1282969 - RNA, 21 nt, Human
ugagccccuggcugggcuggg

SEQ ID NO: 1282970 - RNA, 22 nt, Human
ugagccccuggcugggcugggg

SEQ ID NO: 1282971 - RNA, 23 nt, Human
ugcaccuggcccuguucagauuu

SEQ ID NO: 1282972 - RNA, 20 nt, Human
ugcagcuuugaacuccuggg

SEQ ID NO: 1282973 - RNA, 23 nt, Human
ugcagcuuugaacuccugggcuc

SEQ ID NO: 1282974 - RNA, 18 nt, Human
ugcaggauuccgaucucu

SEQ ID NO: 1282975 - RNA, 24 nt, Human
ugcccaggcuggucucgaacuccu

SEQ ID NO: 1282976 - RNA, 24 nt, Human
ugccucagccucgugaauagcugg

SEQ ID NO: 1282977 - RNA, 22 nt, Human
ugccuccuggguucaagugauu

SEQ ID NO: 1282978 - RNA, 22 nt, Human
ugccucggccucccaaagugcc

SEQ ID NO: 1282979 - RNA, 25 nt, Human
ugccucggccucccaaagugccgcg

SEQ ID NO: 1282980 - RNA, 24 nt, Human
ugcugggaucacaggugugagcca

SEQ ID NO: 1282981 - RNA, 24 nt, Human
ugcuucagccucccaaguagcugg

SEQ ID NO: 1282982 - RNA, 19 nt, Human
uggagugcaauggcaugau

SEQ ID NO: 1282983 - RNA, 24 nt, Human
uggagugcaauggcaugaucucag

SEQ ID NO: 1282984 - RNA, 21 nt, Human
uggagugcaguggugcuguca

SEQ ID NO: 1282985 - RNA, 25 nt, Human
uggagugcaguggugcugucauagg

SEQ ID NO: 1282986 - RNA, 28 nt, Human
uggagugcaguggugcuguccuagcacg

SEQ ID NO: 1282987 - RNA, 24 nt, Human
uggcaugaucucagcucacugcaa

SEQ ID NO: 1282988 - RNA, 24 nt, Human
uggccagguuggucucgaacuucu

SEQ ID NO: 1282989 - RNA, 20 nt, Human
uggccucaggccauccuccu

SEQ ID NO: 1282990 - RNA, 20 nt, Human
uggcuggagugcaguggugc

SEQ ID NO: 1282991 - RNA, 23 nt, Human
ugggacuuugccaggcugucucc

SEQ ID NO: 1282992 - RNA, 19 nt, Human
ugggaucacaggugugagc

SEQ ID NO: 1282993 - RNA, 21 nt, Human
ugggaucacaggugugagcca

SEQ ID NO: 1282994 - RNA, 22 nt, Human
ugggaucacaggugugagccac

SEQ ID NO: 1282995 - RNA, 22 nt, Human
ugggaucacaggugugagccac

SEQ ID NO: 1282996 - RNA, 24 nt, Human
ugggaucacaggugugagccacug

SEQ ID NO: 1282997 - RNA, 18 nt, Human
ugggauuacaggugugag

SEQ ID NO: 1282998 - RNA, 19 nt, Human
ugggauuacaggugugagc

SEQ ID NO: 1282999 - RNA, 22 nt, Human
ugggauuacaggugugagccac

SEQ ID NO: 1283000 - RNA, 23 nt, Human
ugggauuacaggugugagccacc

SEQ ID NO: 1283001 - RNA, 24 nt, Human
ugggauuacaggugugagccacca

SEQ ID NO: 1283002 - RNA, 21 nt, Human
uggggcuacaggcacgugcca

SEQ ID NO: 1283003 - RNA, 22 nt, Human
uggggcuacaggcacgugccau

SEQ ID NO: 1283004 - RNA, 23 nt, Human
uggguucaagugauuuuccugcc

SEQ ID NO: 1283005 - RNA, 24 nt, Human
uggguucaagugauuuuccugccu

SEQ ID NO: 1283006 - RNA, 20 nt, Human
ugucacccaagcuggagugc

SEQ ID NO: 1283007 - RNA, 22 nt, Human
ugucacccaagcuggagugcaa

SEQ ID NO: 1283008 - RNA, 23 nt, Human
uguccaggacacagucauuugac

SEQ ID NO: 1283009 - RNA, 22 nt, Human
ugugcgugcugcugcuucuuuu

SEQ ID NO: 1283010 - RNA, 19 nt, Human
uguugcccaggcuggucuc

SEQ ID NO: 1283011 - RNA, 20 nt, Human
uguugcccaggcuggucucg

SEQ ID NO: 1283012 - RNA, 22 nt, Human
uguugcccaggcuggucucgaa

SEQ ID NO: 1283013 - RNA, 18 nt, Human
uguuguacugacucccug

SEQ ID NO: 1283014 - RNA, 21 nt, Human
uguuguuuucauccaucucua

SEQ ID NO: 1283015 - RNA, 18 nt, Human
uuaguagagacaggguuu

SEQ ID NO: 1283016 - RNA, 21 nt, Human
uucaagugauuuuccugccuc

SEQ ID NO: 1283017 - RNA, 23 nt, Human
uucaagugauuuuccugccucag

SEQ ID NO: 1283018 - RNA, 24 nt, Human
uucaagugauuuuccugccucagc

SEQ ID NO: 1283019 - RNA, 23 nt, Human
uuccauugugauuggagaaggug

SEQ ID NO: 1283020 - RNA, 21 nt, Human
uuggagaaggugguuugcagg

SEQ ID NO: 1283021 - RNA, 18 nt, Human
uuggccagguuggucucg

SEQ ID NO: 1283022 - RNA, 23 nt, Human
uuggucauuuguaucuuucuagg

SEQ ID NO: 1283023 - RNA, 24 nt, Human
uuuuuaguagagacaggguuucac

SEQ ID NO: 1283024 - RNA, 20 nt, Human
uuuuuguguuuuuaguagag

SEQ ID NO: 1283025 - RNA, 23 nt, Human
aaaaaaaaaggaaaaacaaaacc

SEQ ID NO: 1283026 - RNA, 24 nt, Human
aaaaaaggaaaaacaaaacccaga

SEQ ID NO: 1283027 - RNA, 23 nt, Human
aaaaacaucucaauccucuaggg

SEQ ID NO: 1283028 - RNA, 23 nt, Human
aaacauuuagcacagcuuaaaua

SEQ ID NO: 1283029 - RNA, 21 nt, Human
aaacucaaaaaaaaaaaaaaa

SEQ ID NO: 1283030 - RNA, 19 nt, Human
aacaugguaaaaccccauc

SEQ ID NO: 1283031 - RNA, 20 nt, Human
aacaugguaaaaccccaucu

SEQ ID NO: 1283032 - RNA, 21 nt, Human
aacaugguaaaaccccaucuc

SEQ ID NO: 1283033 - RNA, 21 nt, Human
aacaugguaaaaccccaucuc

SEQ ID NO: 1283034 - RNA, 20 nt, Human
aagaaaacauuuagcacagc

SEQ ID NO: 1283035 - RNA, 21 nt, Human
aagaaccagggucagcaagug

SEQ ID NO: 1283036 - RNA, 20 nt, Human
aagaagcaggacugaguccu

SEQ ID NO: 1283037 - RNA, 27 nt, Human
aagcagaagguaauggagaggggaccc

SEQ ID NO: 1283038 - RNA, 24 nt, Human
aaucauuugaacccgggaggcaga

SEQ ID NO: 1283039 - RNA, 20 nt, Human
acaaaacccagaaugcagaa

SEQ ID NO: 1283040 - RNA, 24 nt, Human
accccaucucuacuaaaaauacaa

SEQ ID NO: 1283041 - RNA, 22 nt, Human
acugaaugcagaggcugaggca

SEQ ID NO: 1283042 - RNA, 22 nt, Human
agaaucauuugaacccgggagg

SEQ ID NO: 1283043 - RNA, 24 nt, Human
agacugaggcaggagaaucauuug

SEQ ID NO: 1283044 - RNA, 25 nt, Human
agagaguuuucauuugcuuauuuag

SEQ ID NO: 1283045 - RNA, 21 nt, Human
agcaaaacucaaaaaaaaaaa

SEQ ID NO: 1283046 - RNA, 22 nt, Human
agccuggccaacaugguaaaac

SEQ ID NO: 1283047 - RNA, 24 nt, Human
agccuggccaacaugguaaaaccc

SEQ ID NO: 1283048 - RNA, 23 nt, Human
agcgugguggcgggcaccuguaa

SEQ ID NO: 1283049 - RNA, 23 nt, Human
aggagacugaggcaggagaauca

SEQ ID NO: 1283050 - RNA, 22 nt, Human
aggcaaaagaagcaggagggac

SEQ ID NO: 1283051 - RNA, 23 nt, Human
aggcagauguugccagugagcug

SEQ ID NO: 1283052 - RNA, 18 nt, Human
aggcaggagaaucauuug

SEQ ID NO: 1283053 - RNA, 24 nt, Human
aggcaggagaaucauuugaacccg

SEQ ID NO: 1283054 - RNA, 19 nt, Human
aggcagggccugcucugug

SEQ ID NO: 1283055 - RNA, 21 nt, Human
aggcagggccugcucuguggc

SEQ ID NO: 1283056 - RNA, 26 nt, Human
aggcagguggaucaacugaggucagg

SEQ ID NO: 1283057 - RNA, 18 nt, Human
aggcugaggcagguggau

SEQ ID NO: 1283058 - RNA, 23 nt, Human
aggcugaggcagguggaucaacu

SEQ ID NO: 1283059 - RNA, 22 nt, Human
agguggaucaacugaggucagg

SEQ ID NO: 1283060 - RNA, 22 nt, Human
auaguucuaagauuuagaaaaa

SEQ ID NO: 1283061 - RNA, 24 nt, Human
aucacgccauugcacuccagccug

SEQ ID NO: 1283062 - RNA, 23 nt, Human
auuacaacauguuuuauuucacu

SEQ ID NO: 1283063 - RNA, 24 nt, Human
auugcacuccagccugggcgacaa

SEQ ID NO: 1283064 - RNA, 25 nt, Human
auugcacuccagccugggcgacaag

SEQ ID NO: 1283065 - RNA, 24 nt, Human
caaaagaagcaggacugaguccug

SEQ ID NO: 1283066 - RNA, 19 nt, Human
caccguguauucccauacc

SEQ ID NO: 1283067 - RNA, 24 nt, Human
caccuguaaucccagcuacucagg

SEQ ID NO: 1283068 - RNA, 24 nt, Human
cacuccagccugggcgacaagagc

SEQ ID NO: 1283069 - RNA, 22 nt, Human
cagcuuaaauaaaaguugagaa

SEQ ID NO: 1283070 - RNA, 20 nt, Human
caggcaccuuuccucuuuuc

SEQ ID NO: 1283071 - RNA, 18 nt, Human
caggccaagccuuaguac

SEQ ID NO: 1283072 - RNA, 24 nt, Human
cagguggaucaacugaggucagga

SEQ ID NO: 1283073 - RNA, 26 nt, Human
cagugaggcagggccugcucuguggc

SEQ ID NO: 1283074 - RNA, 19 nt, Human
cauugcacuccagccuggg

SEQ ID NO: 1283075 - RNA, 21 nt, Human
cauugcacuccagccugggcg

SEQ ID NO: 1283076 - RNA, 22 nt, Human
cauugcacuccagccugggcga

SEQ ID NO: 1283077 - RNA, 24 nt, Human
cauugcacuccagccugggcgaca

SEQ ID NO: 1283078 - RNA, 25 nt, Human
cauuuagcacagcuuaaauaaaagu

SEQ ID NO: 1283079 - RNA, 24 nt, Human
ccacaaccucuuauuucaucucaa

SEQ ID NO: 1283080 - RNA, 21 nt, Human
ccaggcaccuuuccucuuuuc

SEQ ID NO: 1283081 - RNA, 20 nt, Human
ccauugcacuccagccuggg

SEQ ID NO: 1283082 - RNA, 21 nt, Human
ccauugcacuccagccugggc

SEQ ID NO: 1283083 - RNA, 22 nt, Human
ccauugcacuccagccugggcg

SEQ ID NO: 1283084 - RNA, 23 nt, Human
ccauugcacuccagccugggcga

SEQ ID NO: 1283085 - RNA, 24 nt, Human
ccauugcacuccagccugggcgac

SEQ ID NO: 1283086 - RNA, 22 nt, Human
ccucuagggccaagaccugccc

SEQ ID NO: 1283087 - RNA, 24 nt, Human
ccuggccaacaugguaaaacccca

SEQ ID NO: 1283088 - RNA, 21 nt, Human
ccuguaaucccagcuacucag

SEQ ID NO: 1283089 - RNA, 30 nt, Human
cgacaagagcaaaacucaaaaaaaaaaaaa

SEQ ID NO: 1283090 - RNA, 24 nt, Human
cgaggcaaaagaagcaggacugag

SEQ ID NO: 1283091 - RNA, 26 nt, Human
cgccauugcacuccagccugggcgac

SEQ ID NO: 1283092 - RNA, 22 nt, Human
cucaaacacagcuauuacaaca

SEQ ID NO: 1283093 - RNA, 21 nt, Human
cucgaggcaaaagaagcagga

SEQ ID NO: 1283094 - RNA, 23 nt, Human
cuggccaacaugguaaaacccca

SEQ ID NO: 1283095 - RNA, 21 nt, Human
cuguaaucccagcuacucagg

SEQ ID NO: 1283096 - RNA, 22 nt, Human
cuuaccucugacucuaaggccc

SEQ ID NO: 1283097 - RNA, 21 nt, Human
gaaaagcagguauccaaaaga

SEQ ID NO: 1283098 - RNA, 21 nt, Human
gaacccagaacugaccagcag

SEQ ID NO: 1283099 - RNA, 18 nt, Human
gaacccgggaggcagaug

SEQ ID NO: 1283100 - RNA, 23 nt, Human
gagaucacgccauugcacuccag

SEQ ID NO: 1283101 - RNA, 18 nt, Human
gaucaacugaggucagga

SEQ ID NO: 1283102 - RNA, 24 nt, Human
gaucaacugaggucaggagucuaa

SEQ ID NO: 1283103 - RNA, 27 nt, Human
gcaaaacucaaaaaaaaaaaaaaaaaa

SEQ ID NO: 1283104 - RNA, 24 nt, Human
gccaacaugguaaaaccccaucuc

SEQ ID NO: 1283105 - RNA, 22 nt, Human
gccauugcacuccagccugggc

SEQ ID NO: 1283106 - RNA, 24 nt, Human
gccauugcacuccagccugggcga

SEQ ID NO: 1283107 - RNA, 20 nt, Human
gcgggcaccuguaaucccag

SEQ ID NO: 1283108 - RNA, 25 nt, Human
ggaaaaacaaaacccagaaugcaga

SEQ ID NO: 1283109 - RNA, 19 nt, Human
ggcaccuguaaucccagcu

SEQ ID NO: 1283110 - RNA, 27 nt, Human
ggcgacaagagcaaaacucaaaaaaaa

SEQ ID NO: 1283111 - RNA, 21 nt, Human
ggcgggcaccuguaaucccag

SEQ ID NO: 1283112 - RNA, 22 nt, Human
guggaucaacugaggucaggag

SEQ ID NO: 1283113 - RNA, 21 nt, Human
uaaaaaggaagggucauacaa

SEQ ID NO: 1283114 - RNA, 21 nt, Human
uaaacugaaugcagaggcuga

SEQ ID NO: 1283115 - RNA, 18 nt, Human
uaaagaacuaaaucuggu

SEQ ID NO: 1283116 - RNA, 24 nt, Human
uaagaccagccuggccaacauggu

SEQ ID NO: 1283117 - RNA, 21 nt, Human
uaccaaaaauaugugaauaaa

SEQ ID NO: 1283118 - RNA, 19 nt, Human
uacuuugcgaacauguggu

SEQ ID NO: 1283119 - RNA, 18 nt, Human
uagcccaggcaccuuucc

SEQ ID NO: 1283120 - RNA, 21 nt, Human
uagggccaagaccugccccuu

SEQ ID NO: 1283121 - RNA, 19 nt, Human
uauauagaagggcaugagg

SEQ ID NO: 1283122 - RNA, 24 nt, Human
uauuucacuggaaaauucuguaaa

SEQ ID NO: 1283123 - RNA, 20 nt, Human
uauuuugagcuaguuacagg

SEQ ID NO: 1283124 - RNA, 22 nt, Human
ucaaaaaaaaaaaaaaaaaaaa

SEQ ID NO: 1283125 - RNA, 23 nt, Human
ucaaaaaaaaaaaaaaaaaaaaa

SEQ ID NO: 1283126 - RNA, 18 nt, Human
ucaagaauggggaacuaa

SEQ ID NO: 1283127 - RNA, 23 nt, Human
ucacaaagccauuaagugaaccc

SEQ ID NO: 1283128 - RNA, 23 nt, Human
ucacgccauugcacuccagccug

SEQ ID NO: 1283129 - RNA, 22 nt, Human
ucacucgaggcaaaagaagcag

SEQ ID NO: 1283130 - RNA, 24 nt, Human
uccaaaagaacucugcuuggcccu

SEQ ID NO: 1283131 - RNA, 19 nt, Human
uccagccugggcgacaaga

SEQ ID NO: 1283132 - RNA, 25 nt, Human
ucgaggcaaaagaagcaggacugag

SEQ ID NO: 1283133 - RNA, 21 nt, Human
ucuaagaccagccuggccaac

SEQ ID NO: 1283134 - RNA, 24 nt, Human
ucuaaggcccugugggaugaaaag

SEQ ID NO: 1283135 - RNA, 23 nt, Human
ucuagcucuguugcuaccuuacc

SEQ ID NO: 1283136 - RNA, 21 nt, Human
ucucuacuaaaaauacaaaaa

SEQ ID NO: 1283137 - RNA, 19 nt, Human
ugaaaaacagaggaaaauc

SEQ ID NO: 1283138 - RNA, 24 nt, Human
ugaaaagcagguauccaaaagaac

SEQ ID NO: 1283139 - RNA, 23 nt, Human
ugaacccagaacugaccagcaga

SEQ ID NO: 1283140 - RNA, 21 nt, Human
ugagaaggaggguaagagugc

SEQ ID NO: 1283141 - RNA, 23 nt, Human
ugagaaggaggguaagagugcau

SEQ ID NO: 1283142 - RNA, 19 nt, Human
ugagagggcuaagaaggua

SEQ ID NO: 1283143 - RNA, 24 nt, Human
ugagcuaguuacaggcaguaacac

SEQ ID NO: 1283144 - RNA, 22 nt, Human
ugagcugagaucacgccauugc

SEQ ID NO: 1283145 - RNA, 20 nt, Human
ugaggcaggagaaucauuug

SEQ ID NO: 1283146 - RNA, 24 nt, Human
ugaggcaggagaaucauuugaacc

SEQ ID NO: 1283147 - RNA, 25 nt, Human
ugaggcaggagaaucauuugaaccc

SEQ ID NO: 1283148 - RNA, 20 nt, Human
ugaggcagguggaucaacug

SEQ ID NO: 1283149 - RNA, 26 nt, Human
ugaggcagguggaucaacugagguca

SEQ ID NO: 1283150 - RNA, 25 nt, Human
ugcagaggcugaggcagguggauca

SEQ ID NO: 1283151 - RNA, 21 nt, Human
ugcauagguagcccaggcacu

SEQ ID NO: 1283152 - RNA, 19 nt, Human
ugcauugccccauucuagc

SEQ ID NO: 1283153 - RNA, 20 nt, Human
ugcauugccccauucuagcu

SEQ ID NO: 1283154 - RNA, 21 nt, Human
uggagagaguuuucauuugcu

SEQ ID NO: 1283155 - RNA, 23 nt, Human
uggaucaacugaggucaggaguc

SEQ ID NO: 1283156 - RNA, 24 nt, Human
uggaucaacugaggucaggagucu

SEQ ID NO: 1283157 - RNA, 22 nt, Human
uggcgggcaccuguaaucccag

SEQ ID NO: 1283158 - RNA, 24 nt, Human
ugguggcgggcaccuguaauccca

SEQ ID NO: 1283159 - RNA, 18 nt, Human
uguaaagaacuaaaucug

SEQ ID NO: 1283160 - RNA, 22 nt, Human
uguugccagugagcugagauca

SEQ ID NO: 1283161 - RNA, 24 nt, Human
uuacauucacaaagccauuaagug

SEQ ID NO: 1283162 - RNA, 18 nt, Human
uuagcugagcgugguggc

SEQ ID NO: 1283163 - RNA, 24 nt, Human
uugccagugagcugagaucacgcc

SEQ ID NO: 1283164 - RNA, 21 nt, Human
uuuagugaaaaacagaggaaa

SEQ ID NO: 1283165 - RNA, 21 nt, Human
aaaaaaaaaaaaaaaaggcaa

SEQ ID NO: 1283166 - RNA, 26 nt, Human
aaaaaaaaaaaaaaaggcaauccuca

SEQ ID NO: 1283167 - RNA, 19 nt, Human
aaaauacaaaaauuagccc

SEQ ID NO: 1283168 - RNA, 21 nt, Human
aaagugcuucuuccuuuguua

SEQ ID NO: 1283169 - RNA, 21 nt, Human
aaaucaaccucccacagccac

SEQ ID NO: 1283170 - RNA, 19 nt, Human
aacagcauucuccccaacu

SEQ ID NO: 1283171 - RNA, 20 nt, Human
aacauggugaaacaccgucu

SEQ ID NO: 1283172 - RNA, 21 nt, Human
aacauggugaaacaccgucuc

SEQ ID NO: 1283173 - RNA, 18 nt, Human
aagaaagaggcugaaaug

SEQ ID NO: 1283174 - RNA, 18 nt, Human
aagcaacgaagauacaag

SEQ ID NO: 1283175 - RNA, 19 nt, Human
aagcaggggaagaaggggu

SEQ ID NO: 1283176 - RNA, 18 nt, Human
aaggagccuguucuccag

SEQ ID NO: 1283177 - RNA, 19 nt, Human
aaggagccuguucuccagg

SEQ ID NO: 1283178 - RNA, 21 nt, Human
aaggggccuuaugguagcagg

SEQ ID NO: 1283179 - RNA, 19 nt, Human
aaguggaccagcuuuauaa

SEQ ID NO: 1283180 - RNA, 18 nt, Human
aauugcuugaaccuggga

SEQ ID NO: 1283181 - RNA, 24 nt, Human
aauugcuugaaccugggaggcaga

SEQ ID NO: 1283182 - RNA, 25 nt, Human
acagagaaaaaaacacauuacucca

SEQ ID NO: 1283183 - RNA, 24 nt, Human
acagagcaaggcucuguguuaaaa

SEQ ID NO: 1283184 - RNA, 26 nt, Human
accacaaaccccaaagggcugauuug

SEQ ID NO: 1283185 - RNA, 20 nt, Human
accagauggcacugcugcuc

SEQ ID NO: 1283186 - RNA, 22 nt, Human
acccucacaaagggaaugcagc

SEQ ID NO: 1283187 - RNA, 19 nt, Human
accugaaccccucaaagac

SEQ ID NO: 1283188 - RNA, 23 nt, Human
acuccagccugggagacagagca

SEQ ID NO: 1283189 - RNA, 18 nt, Human
acugcacuccagccuggg

SEQ ID NO: 1283190 - RNA, 24 nt, Human
acugcacuccagccugggagacag

SEQ ID NO: 1283191 - RNA, 24 nt, Human
agagguugcagugagccaagaucg

SEQ ID NO: 1283192 - RNA, 22 nt, Human
agaugcagugugacaacugccu

SEQ ID NO: 1283193 - RNA, 18 nt, Human
agcaaagaccaaagaagc

SEQ ID NO: 1283194 - RNA, 19 nt, Human
agcaacgaagauacaagaa

SEQ ID NO: 1283195 - RNA, 24 nt, Human
agcacuuugggaggccaauguggg

SEQ ID NO: 1283196 - RNA, 23 nt, Human
agcaugguggcacaugccuguaa

SEQ ID NO: 1283197 - RNA, 20 nt, Human
agccauaugcuaacagccuu

SEQ ID NO: 1283198 - RNA, 19 nt, Human
agccuggccaacaugguga

SEQ ID NO: 1283199 - RNA, 24 nt, Human
agccugggagacagagcaaggcuc

SEQ ID NO: 1283200 - RNA, 21 nt, Human
agcggaucaaaaucucagcuc

SEQ ID NO: 1283201 - RNA, 24 nt, Human
aggcagagguugcagugagccaag

SEQ ID NO: 1283202 - RNA, 22 nt, Human
aggcaggagaauugcuugaacc

SEQ ID NO: 1283203 - RNA, 24 nt, Human
aggcaggagaauugcuugaaccug

SEQ ID NO: 1283204 - RNA, 18 nt, Human
aggccaaugugggcgggu

SEQ ID NO: 1283205 - RNA, 22 nt, Human
aggcucaaagcuuuaaaggcaa

SEQ ID NO: 1283206 - RNA, 21 nt, Human
aggcugaggcaggagaauugc

SEQ ID NO: 1283207 - RNA, 24 nt, Human
aggcugaggcaggagaauugcuug

SEQ ID NO: 1283208 - RNA, 21 nt, Human
aggggaagaagggguggggag

SEQ ID NO: 1283209 - RNA, 18 nt, Human
agggguggggaggggagg

SEQ ID NO: 1283210 - RNA, 24 nt, Human
agggguggggaggggaggagagau

SEQ ID NO: 1283211 - RNA, 19 nt, Human
aggguuccuucucugcccu

SEQ ID NO: 1283212 - RNA, 21 nt, Human
agucccaccuucccugaccac

SEQ ID NO: 1283213 - RNA, 24 nt, Human
aucgcaccacugcacuccagccug

SEQ ID NO: 1283214 - RNA, 24 nt, Human
auugacuguaccacaguggcucuu

SEQ ID NO: 1283215 - RNA, 20 nt, Human
caaagaaccccaaaaggggc

SEQ ID NO: 1283216 - RNA, 20 nt, Human
caaagcuuuaaaggcaaauc

SEQ ID NO: 1283217 - RNA, 24 nt, Human
caaccugagaccuuccuuggaagc

SEQ ID NO: 1283218 - RNA, 18 nt, Human
caagaacagccuggccaa

SEQ ID NO: 1283219 - RNA, 24 nt, Human
caagaacagccuggccaacauggu

SEQ ID NO: 1283220 - RNA, 19 nt, Human
cacacccaaagaaccccaa

SEQ ID NO: 1283221 - RNA, 19 nt, Human
cacagacgcuucuggggga

SEQ ID NO: 1283222 - RNA, 18 nt, Human
cacaugaucucaggcacc

SEQ ID NO: 1283223 - RNA, 25 nt, Human
cacccaaagaaccccaaaaggggcu

SEQ ID NO: 1283224 - RNA, 24 nt, Human
cacgccuguaaucccagcacuuug

SEQ ID NO: 1283225 - RNA, 18 nt, Human
cacugcacuccagccugg

SEQ ID NO: 1283226 - RNA, 19 nt, Human
cacugcacuccagccuggg

SEQ ID NO: 1283227 - RNA, 22 nt, Human
cacugcacuccagccugggaga

SEQ ID NO: 1283228 - RNA, 25 nt, Human
cacugcacuccagccugggagacag

SEQ ID NO: 1283229 - RNA, 27 nt, Human
cagaaagccaaggcagaaagccgauca

SEQ ID NO: 1283230 - RNA, 23 nt, Human
cagagaaaaaaacacauuacucc

SEQ ID NO: 1283231 - RNA, 19 nt, Human
cagcacuuugggaggccaa

SEQ ID NO: 1283232 - RNA, 24 nt, Human
cagcacuuugggaggccaaugugg

SEQ ID NO: 1283233 - RNA, 23 nt, Human
cagccacacccaaagaaccccaa

SEQ ID NO: 1283234 - RNA, 18 nt, Human
cagccggcaaaagcccca

SEQ ID NO: 1283235 - RNA, 18 nt, Human
cagugaggcaguguggaa

SEQ ID NO: 1283236 - RNA, 24 nt, Human
caugccuguaauuccggcuacuug

SEQ ID NO: 1283237 - RNA, 21 nt, Human
ccaaagggcugauuugacuuu

SEQ ID NO: 1283238 - RNA, 19 nt, Human
ccacugcacuccagccugg

SEQ ID NO: 1283239 - RNA, 20 nt, Human
ccacugcacuccagccuggg

SEQ ID NO: 1283240 - RNA, 22 nt, Human
ccacugcacuccagccugggag

SEQ ID NO: 1283241 - RNA, 23 nt, Human
ccacugcacuccagccugggaga

SEQ ID NO: 1283242 - RNA, 24 nt, Human
ccacugcacuccagccugggagac

SEQ ID NO: 1283243 - RNA, 25 nt, Human
ccacugcacuccagccugggagaca

SEQ ID NO: 1283244 - RNA, 18 nt, Human
cccaaagggcugauuuga

SEQ ID NO: 1283245 - RNA, 19 nt, Human
cccacagccaccuuuggcu

SEQ ID NO: 1283246 - RNA, 22 nt, Human
ccccaacaccaaguugggccuu

SEQ ID NO: 1283247 - RNA, 23 nt, Human
ccccaacaccaaguugggccuua

SEQ ID NO: 1283248 - RNA, 20 nt, Human
ccccucaaagacauggcaaa

SEQ ID NO: 1283249 - RNA, 23 nt, Human
ccuaggaaaggaauucugcagac

SEQ ID NO: 1283250 - RNA, 23 nt, Human
ccuggccaacauggugaaacacc

SEQ ID NO: 1283251 - RNA, 24 nt, Human
ccuggccaacauggugaaacaccg

SEQ ID NO: 1283252 - RNA, 22 nt, Human
ccugggagacagagcaaggcuc

SEQ ID NO: 1283253 - RNA, 25 nt, Human
ccugggaggcagagguugcagugag

SEQ ID NO: 1283254 - RNA, 21 nt, Human
cgcaccacugcacuccagccu

SEQ ID NO: 1283255 - RNA, 23 nt, Human
cgccuguaaucccagcacuuugg

SEQ ID NO: 1283256 - RNA, 24 nt, Human
cgccuguaaucccagcacuuuggg

SEQ ID NO: 1283257 - RNA, 24 nt, Human
cggcuacuugggaggcugaggcag

SEQ ID NO: 1283258 - RNA, 21 nt, Human
cgggucacuugaggccaggag

SEQ ID NO: 1283259 - RNA, 24 nt, Human
cgggucacuugaggccaggaguuc

SEQ ID NO: 1283260 - RNA, 23 nt, Human
cuaaaagaaagaggcugaaaugu

SEQ ID NO: 1283261 - RNA, 22 nt, Human
cucacgccuguaaucccagcac

SEQ ID NO: 1283262 - RNA, 24 nt, Human
cucacgccuguaaucccagcacuu

SEQ ID NO: 1283263 - RNA, 24 nt, Human
cucuguguuaaaaaaaaaaaaaaa

SEQ ID NO: 1283264 - RNA, 23 nt, Human
cuguguuaaaaaaaaaaaaaaaa

SEQ ID NO: 1283265 - RNA, 25 nt, Human
gaaaauucaucaguuucuugggaag

SEQ ID NO: 1283266 - RNA, 26 nt, Human
gaagauacaagaauuaaaacagcaau

SEQ ID NO: 1283267 - RNA, 24 nt, Human
gaagcacaugaucucaggcaccag

SEQ ID NO: 1283268 - RNA, 19 nt, Human
gaagcaccuucucuggcac

SEQ ID NO: 1283269 - RNA, 21 nt, Human
gaagggguggggaggggagga

SEQ ID NO: 1283270 - RNA, 21 nt, Human
gacauggcaagcaggugacau

SEQ ID NO: 1283271 - RNA, 23 nt, Human
gagaauugcuugaaccugggagg

SEQ ID NO: 1283272 - RNA, 18 nt, Human
gagguugcagugagccaa

SEQ ID NO: 1283273 - RNA, 21 nt, Human
gaucacucuuguccacagaga

SEQ ID NO: 1283274 - RNA, 20 nt, Human
gcaccacugcacuccagccu

SEQ ID NO: 1283275 - RNA, 24 nt, Human
gcacuccagccugggagacagagc

SEQ ID NO: 1283276 - RNA, 24 nt, Human
gcagccacacccaaagaaccccaa

SEQ ID NO: 1283277 - RNA, 20 nt, Human
gcaggggaagaagggguggg

SEQ ID NO: 1283278 - RNA, 24 nt, Human
gccaacauggugaaacaccgucuc

SEQ ID NO: 1283279 - RNA, 20 nt, Human
gccaagaucgcaccacugca

SEQ ID NO: 1283280 - RNA, 20 nt, Human
gccuguaauuccggcuacuu

SEQ ID NO: 1283281 - RNA, 21 nt, Human
gcuacuacacuugaaagacca

SEQ ID NO: 1283282 - RNA, 28 nt, Human
gcucuguguuaaaaaaaaaaaaaaaaaa

SEQ ID NO: 1283283 - RNA, 19 nt, Human
ggaagaagggguggggagg

SEQ ID NO: 1283284 - RNA, 23 nt, Human
ggaagcaggggaagaaggggugg

SEQ ID NO: 1283285 - RNA, 18 nt, Human
ggaggccaaugugggcgg

SEQ ID NO: 1283286 - RNA, 20 nt, Human
ggcucacgccuguaauccca

SEQ ID NO: 1283287 - RNA, 21 nt, Human
ggcucacgccuguaaucccag

SEQ ID NO: 1283288 - RNA, 18 nt, Human
ggcugauuugacuuucuc

SEQ ID NO: 1283289 - RNA, 20 nt, Human
gggaagaagggguggggagg

SEQ ID NO: 1283290 - RNA, 19 nt, Human
gggaauggaagcaggggaa

SEQ ID NO: 1283291 - RNA, 20 nt, Human
gggaggccaaugugggcggg

SEQ ID NO: 1283292 - RNA, 24 nt, Human
gggcacgggggcucacgccuguaa

SEQ ID NO: 1283293 - RNA, 24 nt, Human
gggcucacgccuguaaucccagca

SEQ ID NO: 1283294 - RNA, 24 nt, Human
gggggcucacgccuguaaucccag

SEQ ID NO: 1283295 - RNA, 23 nt, Human
gggucacuugaggccaggaguuc

SEQ ID NO: 1283296 - RNA, 28 nt, Human
gguaccagagacagacccuaggaaagga

SEQ ID NO: 1283297 - RNA, 24 nt, Human
ggucacuugaggccaggaguucaa

SEQ ID NO: 1283298 - RNA, 24 nt, Human
gguggcacaugccuguaauuccgg

SEQ ID NO: 1283299 - RNA, 22 nt, Human
guggggaggggaggagagauga

SEQ ID NO: 1283300 - RNA, 24 nt, Human
guugggccuuaauuuucccaucug

SEQ ID NO: 1283301 - RNA, 20 nt, Human
uaaaaauacaaaaauuagcc

SEQ ID NO: 1283302 - RNA, 21 nt, Human
uaaaaauacaaaaauuagccc

SEQ ID NO: 1283303 - RNA, 22 nt, Human
uaacagccuuccuagaggacac

SEQ ID NO: 1283304 - RNA, 20 nt, Human
uaagcaaagaccaaagaagc

SEQ ID NO: 1283305 - RNA, 18 nt, Human
uacaaagccaccuuaggc

SEQ ID NO: 1283306 - RNA, 20 nt, Human
uacaagaauuaaaacagcaa

SEQ ID NO: 1283307 - RNA, 24 nt, Human
uacacaucacuuccuggaagugga

SEQ ID NO: 1283308 - RNA, 18 nt, Human
uacccauccuugagcaac

SEQ ID NO: 1283309 - RNA, 26 nt, Human
uaucuggcaauaaauuuguagccaca

SEQ ID NO: 1283310 - RNA, 22 nt, Human
ucacuugaggccaggaguucaa

SEQ ID NO: 1283311 - RNA, 23 nt, Human
ucacuugaggccaggaguucaag

SEQ ID NO: 1283312 - RNA, 18 nt, Human
uccacagagaaaaaaaca

SEQ ID NO: 1283313 - RNA, 20 nt, Human
uccacagagaaaaaaacaca

SEQ ID NO: 1283314 - RNA, 20 nt, Human
ucccaucugaccugucucua

SEQ ID NO: 1283315 - RNA, 23 nt, Human
ucgcaccacugcacuccagccug

SEQ ID NO: 1283316 - RNA, 22 nt, Human
ucuccaggcugaccugaacccc

SEQ ID NO: 1283317 - RNA, 22 nt, Human
ucuccaggcugaccugaacccu

SEQ ID NO: 1283318 - RNA, 23 nt, Human
ucuguguuaaaaaaaaaaaaaaa

SEQ ID NO: 1283319 - RNA, 19 nt, Human
ucuuccuaacuaaccuaau

SEQ ID NO: 1283320 - RNA, 22 nt, Human
ucuuggaagcaccuucucuggc

SEQ ID NO: 1283321 - RNA, 21 nt, Human
ugaaacaccgucuccacuaaa

SEQ ID NO: 1283322 - RNA, 22 nt, Human
ugaaacaccgucuccacuaaaa

SEQ ID NO: 1283323 - RNA, 18 nt, Human
ugaaagaccagaguaugg

SEQ ID NO: 1283324 - RNA, 22 nt, Human
ugaaagaccagaguaugguuau

SEQ ID NO: 1283325 - RNA, 24 nt, Human
ugaaccugggaggcagagguugca

SEQ ID NO: 1283326 - RNA, 19 nt, Human
ugaaguguuucugugaugc

SEQ ID NO: 1283327 - RNA, 21 nt, Human
ugaccugaaccccucaaagac

SEQ ID NO: 1283328 - RNA, 21 nt, Human
ugacucuuugccauguucuug

SEQ ID NO: 1283329 - RNA, 20 nt, Human
ugacuguaccacaguggcuc

SEQ ID NO: 1283330 - RNA, 24 nt, Human
ugaggcaggagaauugcuugaacc

SEQ ID NO: 1283331 - RNA, 25 nt, Human
ugaggcaggagaauugcuugaaccu

SEQ ID NO: 1283332 - RNA, 20 nt, Human
ugauagcggaucaaaaucuc

SEQ ID NO: 1283333 - RNA, 22 nt, Human
ugcagccacacccaaagaaccc

SEQ ID NO: 1283334 - RNA, 21 nt, Human
ugcaucagaaagccaaggcag

SEQ ID NO: 1283335 - RNA, 23 nt, Human
ugccuguaauuccggcuacuugg

SEQ ID NO: 1283336 - RNA, 24 nt, Human
ugccuguaauuccggcuacuuggg

SEQ ID NO: 1283337 - RNA, 20 nt, Human
uggaacuccuggaucuuucu

SEQ ID NO: 1283338 - RNA, 21 nt, Human
uggaagaaaucaaccucccac

SEQ ID NO: 1283339 - RNA, 18 nt, Human
uggaagcaggggaagaag

SEQ ID NO: 1283340 - RNA, 23 nt, Human
uggaagcaggggaagaaggggug

SEQ ID NO: 1283341 - RNA, 22 nt, Human
uggaagguacaaagccaccuua

SEQ ID NO: 1283342 - RNA, 24 nt, Human
uggaagguacaaagccaccuuagg

SEQ ID NO: 1283343 - RNA, 19 nt, Human
uggcacaugccuguaauuc

SEQ ID NO: 1283344 - RNA, 20 nt, Human
uggcacaugccuguaauucc

SEQ ID NO: 1283345 - RNA, 21 nt, Human
uggcacaugccuguaauuccg

SEQ ID NO: 1283346 - RNA, 18 nt, Human
uggccaacauggugaaac

SEQ ID NO: 1283347 - RNA, 23 nt, Human
ugggaaaauaucuggcaauaaau

SEQ ID NO: 1283348 - RNA, 24 nt, Human
ugggaggcagagguugcagugagc

SEQ ID NO: 1283349 - RNA, 18 nt, Human
ugggaggccaaugugggc

SEQ ID NO: 1283350 - RNA, 24 nt, Human
ugggaggccaaugugggcggguca

SEQ ID NO: 1283351 - RNA, 19 nt, Human
ugggaggcugaggcaggag

SEQ ID NO: 1283352 - RNA, 22 nt, Human
ugggaggcugaggcaggagaau

SEQ ID NO: 1283353 - RNA, 18 nt, Human
uggggaggggaggagaga

SEQ ID NO: 1283354 - RNA, 20 nt, Human
uggggaggggaggagagaug

SEQ ID NO: 1283355 - RNA, 23 nt, Human
uggggaggggaggagagaugaag

SEQ ID NO: 1283356 - RNA, 21 nt, Human
ugggggagagcuaauggucau

SEQ ID NO: 1283357 - RNA, 23 nt, Human
ugguggcacaugccuguaauucc

SEQ ID NO: 1283358 - RNA, 19 nt, Human
uguucaagaucaagcaccu

SEQ ID NO: 1283359 - RNA, 20 nt, Human
uuaaaaaaaaaaaaaaaaaa

SEQ ID NO: 1283360 - RNA, 25 nt, Human
uuaaaacagcaauccuugcugggca

SEQ ID NO: 1283361 - RNA, 20 nt, Human
uucagagacagaaacauacc

SEQ ID NO: 1283362 - RNA, 24 nt, Human
uugaaccugggaggcagagguugc

SEQ ID NO: 1283363 - RNA, 22 nt, Human
uugcagugagccaagaucgcac

SEQ ID NO: 1283364 - RNA, 24 nt, Human
uugcuugaaccugggaggcagagg

SEQ ID NO: 1283365 - RNA, 23 nt, Human
uugggaggcugaggcaggagaau

SEQ ID NO: 1283366 - RNA, 22 nt, Human
uuuaauuccuuguccuaagauu

SEQ ID NO: 1283367 - RNA, 23 nt, Human
uuugcagauuuuuuauagcuuuu

SEQ ID NO: 1283368 - RNA, 20 nt, Human
aaacccagaaagaaagccca

SEQ ID NO: 1283369 - RNA, 28 nt, Human
aaagaacacuaagagagggacaaggcua

SEQ ID NO: 1283370 - RNA, 22 nt, Human
aagaacacuaagagagggaccg

SEQ ID NO: 1283371 - RNA, 19 nt, Human
aaggcuagaagccgcaggc

SEQ ID NO: 1283372 - RNA, 20 nt, Human
aggagcuguggaaaacaugg

SEQ ID NO: 1283373 - RNA, 18 nt, Human
auuuggguuggcuggagg

SEQ ID NO: 1283374 - RNA, 22 nt, Human
caaacccagaaagaaagcccaa

SEQ ID NO: 1283375 - RNA, 26 nt, Human
caaacccagaaagaaagcccaacuag

SEQ ID NO: 1283376 - RNA, 22 nt, Human
cacacaugagaacugaaauggc

SEQ ID NO: 1283377 - RNA, 22 nt, Human
caccacauaauucaacuagcaa

SEQ ID NO: 1283378 - RNA, 27 nt, Human
ccaaacccagaaagaaagcccaacuag

SEQ ID NO: 1283379 - RNA, 20 nt, Human
ccgcaggcugucuacacuau

SEQ ID NO: 1283380 - RNA, 18 nt, Human
cucugugugcccacuggu

SEQ ID NO: 1283381 - RNA, 22 nt, Human
gaaaaacacaccacauaauuca

SEQ ID NO: 1283382 - RNA, 22 nt, Human
gcccaaacccagaaagaaagcc

SEQ ID NO: 1283383 - RNA, 23 nt, Human
gcccaaacccagaaagaaagccc

SEQ ID NO: 1283384 - RNA, 19 nt, Human
ggaggagcuguggaaaaca

SEQ ID NO: 1283385 - RNA, 22 nt, Human
uaaaaugaaaggcuuccaggca

SEQ ID NO: 1283386 - RNA, 21 nt, Human
uacacacaugagaacugaaau

SEQ ID NO: 1283387 - RNA, 20 nt, Human
uauagcaggcgcuauuuggg

SEQ ID NO: 1283388 - RNA, 23 nt, Human
uccaggcaguuaucugauuaaag

SEQ ID NO: 1283389 - RNA, 20 nt, Human
ugagaacugaaauggcccaa

SEQ ID NO: 1283390 - RNA, 23 nt, Human
uggugcuggagaucgccauggcu

SEQ ID NO: 1283391 - RNA, 23 nt, Human
uucaacuagcaaagaagacugcu

SEQ ID NO: 1283392 - RNA, 24 nt, Human
uugcuuauuacggaaaaacacacc

SEQ ID NO: 1283393 - RNA, 21 nt, Human
aaagugcuuccugucccuucg

SEQ ID NO: 1283394 - RNA, 21 nt, Human
aagcagaaauuaucacacagc

SEQ ID NO: 1283395 - RNA, 20 nt, Human
aagguacccguacccaagga

SEQ ID NO: 1283396 - RNA, 18 nt, Human
aagugcgggcaagcccag

SEQ ID NO: 1283397 - RNA, 23 nt, Human
aaugcaguggcaguggugccacu

SEQ ID NO: 1283398 - RNA, 21 nt, Human
acaauagucuccugacucccu

SEQ ID NO: 1283399 - RNA, 28 nt, Human
acugccuugcucaaaauguuucuuuaga

SEQ ID NO: 1283400 - RNA, 21 nt, Human
agaauaguaaauuuuauuacu

SEQ ID NO: 1283401 - RNA, 18 nt, Human
agaaugcuuuaaaaugca

SEQ ID NO: 1283402 - RNA, 22 nt, Human
agacauuaggauucucuaaacu

SEQ ID NO: 1283403 - RNA, 23 nt, Human
agcagccaggcacccagggcgcc

SEQ ID NO: 1283404 - RNA, 21 nt, Human
aggcccagaggccgcccagca

SEQ ID NO: 1283405 - RNA, 22 nt, Human
aggcccagaggccgcccagcag

SEQ ID NO: 1283406 - RNA, 20 nt, Human
aggcguccgggaucagagug

SEQ ID NO: 1283407 - RNA, 19 nt, Human
agggcgcccgggacggugc

SEQ ID NO: 1283408 - RNA, 18 nt, Human
auagaaaaaaaagaagcu

SEQ ID NO: 1283409 - RNA, 18 nt, Human
aucaaaaccccacaucaa

SEQ ID NO: 1283410 - RNA, 20 nt, Human
auccaucuccagcuggggcc

SEQ ID NO: 1283411 - RNA, 23 nt, Human
auugcaaaagcaacaguaucaaa

SEQ ID NO: 1283412 - RNA, 19 nt, Human
caaaagcaacaguaucaaa

SEQ ID NO: 1283413 - RNA, 24 nt, Human
caaagugcgggcaagcccagugca

SEQ ID NO: 1283414 - RNA, 23 nt, Human
caagcccaagcccaagggggcgc

SEQ ID NO: 1283415 - RNA, 24 nt, Human
caaggcaaacuucucuuacugacc

SEQ ID NO: 1283416 - RNA, 23 nt, Human
caaugccaacccuggugcagcaa

SEQ ID NO: 1283417 - RNA, 23 nt, Human
caccgcccccaggcugcacaggc

SEQ ID NO: 1283418 - RNA, 21 nt, Human
cagaaaaccagcccugaacag

SEQ ID NO: 1283419 - RNA, 25 nt, Human
cagaggccgcccagcagccaggcac

SEQ ID NO: 1283420 - RNA, 19 nt, Human
cagggacaggguggaguag

SEQ ID NO: 1283421 - RNA, 21 nt, Human
caggguccaggcccagaggcc

SEQ ID NO: 1283422 - RNA, 22 nt, Human
cauaacaguagaagcaucuaga

SEQ ID NO: 1283423 - RNA, 21 nt, Human
ccaaaguguccauauuagcca

SEQ ID NO: 1283424 - RNA, 21 nt, Human
ccaagcccaagggggcgcuga

SEQ ID NO: 1283425 - RNA, 18 nt, Human
ccacuagcauccugggag

SEQ ID NO: 1283426 - RNA, 18 nt, Human
ccacugccugcugccacu

SEQ ID NO: 1283427 - RNA, 19 nt, Human
ccacugccugcugccacug

SEQ ID NO: 1283428 - RNA, 22 nt, Human
ccagcagccaggcacccagggc

SEQ ID NO: 1283429 - RNA, 23 nt, Human
ccagcccugaacaggcauuagaa

SEQ ID NO: 1283430 - RNA, 20 nt, Human
ccaggcacuugcuuugugcu

SEQ ID NO: 1283431 - RNA, 20 nt, Human
ccaggcccagaggccgccca

SEQ ID NO: 1283432 - RNA, 21 nt, Human
ccagugcauuuaaugaccaaa

SEQ ID NO: 1283433 - RNA, 19 nt, Human
ccaucuagucaguucauau

SEQ ID NO: 1283434 - RNA, 23 nt, Human
cccacaucaaugugcaucuuccu

SEQ ID NO: 1283435 - RNA, 20 nt, Human
cccgugcaugcagaaaacca

SEQ ID NO: 1283436 - RNA, 22 nt, Human
ccuuccccggcccgagggcaag

SEQ ID NO: 1283437 - RNA, 24 nt, Human
cgagggcaagcccaagcccaaggg

SEQ ID NO: 1283438 - RNA, 21 nt, Human
cuagcaauggacaaacucaac

SEQ ID NO: 1283439 - RNA, 19 nt, Human
cuagcauccugggaggcau

SEQ ID NO: 1283440 - RNA, 23 nt, Human
cuaguccuggguuuaggagacaa

SEQ ID NO: 1283441 - RNA, 18 nt, Human
cucccaccgcccccaggc

SEQ ID NO: 1283442 - RNA, 24 nt, Human
cucccuagcaauggacaaacucaa

SEQ ID NO: 1283443 - RNA, 18 nt, Human
cugccacugccugcugcc

SEQ ID NO: 1283444 - RNA, 27 nt, Human
cugccugcugccacugccugcugccac

SEQ ID NO: 1283445 - RNA, 24 nt, Human
cugccugcugccacugccuucugc

SEQ ID NO: 1283446 - RNA, 24 nt, Human
cuggcaucgcggucagccuucccc

SEQ ID NO: 1283447 - RNA, 21 nt, Human
cugguaacuaagaaagauaaa

SEQ ID NO: 1283448 - RNA, 21 nt, Human
cuggugcagcaauaaaggggg

SEQ ID NO: 1283449 - RNA, 23 nt, Human
cuugugaaugagcugaccuggaa

SEQ ID NO: 1283450 - RNA, 18 nt, Human
gaaggagaugcagaaguc

SEQ ID NO: 1283451 - RNA, 20 nt, Human
gcacaggguccaggcccaga

SEQ ID NO: 1283452 - RNA, 21 nt, Human
gcagaaaaccagcccugaaca

SEQ ID NO: 1283453 - RNA, 25 nt, Human
gcagggacaggguggaguagggcuc

SEQ ID NO: 1283454 - RNA, 19 nt, Human
gcauagaaaaaaaagaagc

SEQ ID NO: 1283455 - RNA, 22 nt, Human
gccaaagugcgggcaagcccag

SEQ ID NO: 1283456 - RNA, 18 nt, Human
gcccgggacggugcggag

SEQ ID NO: 1283457 - RNA, 18 nt, Human
gccuggcacgggcgcggg

SEQ ID NO: 1283458 - RNA, 19 nt, Human
gccuggcacgggcgcgggg

SEQ ID NO: 1283459 - RNA, 18 nt, Human
gcugccgcuucccuaugc

SEQ ID NO: 1283460 - RNA, 18 nt, Human
gcugcggcgccuggcacg

SEQ ID NO: 1283461 - RNA, 18 nt, Human
ggcaaacuucucuuacug

SEQ ID NO: 1283462 - RNA, 20 nt, Human
ggcgccccucccacugcugc

SEQ ID NO: 1283463 - RNA, 20 nt, Human
ggcugacauccgaugcugcc

SEQ ID NO: 1283464 - RNA, 18 nt, Human
gggacaagagaggcuggc

SEQ ID NO: 1283465 - RNA, 18 nt, Human
gggcgcggggcucccacc

SEQ ID NO: 1283466 - RNA, 21 nt, Human
guaaugagauuguuuucauua

SEQ ID NO: 1283467 - RNA, 19 nt, Human
gucaaaaucagacacauca

SEQ ID NO: 1283468 - RNA, 20 nt, Human
uaagaaagauaaaugggcag

SEQ ID NO: 1283469 - RNA, 23 nt, Human
uacuugcugccaaggcaaacuuc

SEQ ID NO: 1283470 - RNA, 24 nt, Human
uagccgggaccagggcccggggaa

SEQ ID NO: 1283471 - RNA, 22 nt, Human
uaggaaggccaaagugcgggca

SEQ ID NO: 1283472 - RNA, 25 nt, Human
uauaaaaguaaacauacaagguacc

SEQ ID NO: 1283473 - RNA, 29 nt, Human
uaugugcauggcacugcauuauguguaua

SEQ ID NO: 1283474 - RNA, 22 nt, Human
uauguguauacccgugcaugca

SEQ ID NO: 1283475 - RNA, 19 nt, Human
uauuuuagaauacugccug

SEQ ID NO: 1283476 - RNA, 23 nt, Human
ucaaagaaugcuuuaaaaugcaa

SEQ ID NO: 1283477 - RNA, 27 nt, Human
ucagaguggcucccgccggcucuuucc

SEQ ID NO: 1283478 - RNA, 25 nt, Human
uccauauuagccaucuagucaguuc

SEQ ID NO: 1283479 - RNA, 22 nt, Human
uccccggcccgagggcaagccc

SEQ ID NO: 1283480 - RNA, 24 nt, Human
ucuccagcuggggccgcagggggc

SEQ ID NO: 1283481 - RNA, 23 nt, Human
ucucccuagcaauggacaaacuc

SEQ ID NO: 1283482 - RNA, 23 nt, Human
ucuucuguaaacagagcuugagu

SEQ ID NO: 1283483 - RNA, 23 nt, Human
ugacaguacgagggaacucuagu

SEQ ID NO: 1283484 - RNA, 21 nt, Human
ugaguagucaaaaucagacac

SEQ ID NO: 1283485 - RNA, 26 nt, Human
ugcacaggccgcacaggguccaggcc

SEQ ID NO: 1283486 - RNA, 20 nt, Human
ugcauagaaaaaaaagaagc

SEQ ID NO: 1283487 - RNA, 24 nt, Human
ugcaugcagaaaaccagcccugaa

SEQ ID NO: 1283488 - RNA, 21 nt, Human
ugccacuagcauccugggagg

SEQ ID NO: 1283489 - RNA, 25 nt, Human
ugccauaaaauucuuaagucuggaa

SEQ ID NO: 1283490 - RNA, 20 nt, Human
ugcugccacugccugcugcc

SEQ ID NO: 1283491 - RNA, 22 nt, Human
ugcuuccugucccuucgguggc

SEQ ID NO: 1283492 - RNA, 21 nt, Human
uggaugaguguccugaaagca

SEQ ID NO: 1283493 - RNA, 19 nt, Human
uggcaguggugccacuagc

SEQ ID NO: 1283494 - RNA, 22 nt, Human
ugggagcaaugccaacccuggu

SEQ ID NO: 1283495 - RNA, 25 nt, Human
uguaaacagagcuugaguagucaaa

SEQ ID NO: 1283496 - RNA, 20 nt, Human
ugucccuucgguggccucug

SEQ ID NO: 1283497 - RNA, 23 nt, Human
ugugccaggcacuugcuuugugc

SEQ ID NO: 1283498 - RNA, 22 nt, Human
cuauauggugagagaaacaagg

SEQ ID NO: 1283499 - RNA, 18 nt, Human
ggugagagaaacaaggaa

SEQ ID NO: 1283500 - RNA, 22 nt, Human
aaaaagaagcacaguacuguaa

SEQ ID NO: 1283501 - RNA, 23 nt, Human
aaaauauacaucugaaguacaag

SEQ ID NO: 1283502 - RNA, 20 nt, Human
aaauugccagggaagcauaa

SEQ ID NO: 1283503 - RNA, 19 nt, Human
aacauaaaagcaagcagga

SEQ ID NO: 1283504 - RNA, 24 nt, Human
aacuggaaggggucgagaaggguc

SEQ ID NO: 1283505 - RNA, 23 nt, Human
aagaagaagauaaguacauugaa

SEQ ID NO: 1283506 - RNA, 18 nt, Human
aagaagauaaguacauug

SEQ ID NO: 1283507 - RNA, 22 nt, Human
acaccaacauaaaagcaagcag

SEQ ID NO: 1283508 - RNA, 20 nt, Human
accaccuuuagcuccaagcc

SEQ ID NO: 1283509 - RNA, 20 nt, Human
acucgccuggcagccucaac

SEQ ID NO: 1283510 - RNA, 24 nt, Human
agcauaaaagcaacauuggaaaga

SEQ ID NO: 1283511 - RNA, 18 nt, Human
agcuuaauaaggcugaca

SEQ ID NO: 1283512 - RNA, 20 nt, Human
aggaaaaacuuucauggaga

SEQ ID NO: 1283513 - RNA, 25 nt, Human
aggugagagaaaugacgaucauuuu

SEQ ID NO: 1283514 - RNA, 23 nt, Human
auaaaagcaagcaggaucuccca

SEQ ID NO: 1283515 - RNA, 24 nt, Human
auaguguaauggguaguuuccuuc

SEQ ID NO: 1283516 - RNA, 20 nt, Human
aucauuaguccauuuaaaau

SEQ ID NO: 1283517 - RNA, 20 nt, Human
auggagaggugguguccaca

SEQ ID NO: 1283518 - RNA, 19 nt, Human
auggcgaugcugagagugg

SEQ ID NO: 1283519 - RNA, 18 nt, Human
auguaucccacaacauac

SEQ ID NO: 1283520 - RNA, 26 nt, Human
caacauaaaagcaagcaggaucuccc

SEQ ID NO: 1283521 - RNA, 23 nt, Human
caccaacauaaaagcaagcagga

SEQ ID NO: 1283522 - RNA, 23 nt, Human
caccuccagcucccgggcggggg

SEQ ID NO: 1283523 - RNA, 24 nt, Human
cagaaaggccugacucgccuggca

SEQ ID NO: 1283524 - RNA, 18 nt, Human
cagcucccgggcggggga

SEQ ID NO: 1283525 - RNA, 21 nt, Human
caggcgagguccagaaaggcc

SEQ ID NO: 1283526 - RNA, 18 nt, Human
caguacuguaauaagacc

SEQ ID NO: 1283527 - RNA, 20 nt, Human
caguuucccgccgccuaggg

SEQ ID NO: 1283528 - RNA, 22 nt, Human
ccaacauaaaagcaagcaggau

SEQ ID NO: 1283529 - RNA, 22 nt, Human
ccacaaagauggcgaugcugag

SEQ ID NO: 1283530 - RNA, 21 nt, Human
ccaccaccuuuagcuccaagc

SEQ ID NO: 1283531 - RNA, 20 nt, Human
ccagaaaggccugacucgcc

SEQ ID NO: 1283532 - RNA, 24 nt, Human
cccccuggcaguuucccgccgccu

SEQ ID NO: 1283533 - RNA, 21 nt, Human
ccccggggaggaccuccuggc

SEQ ID NO: 1283534 - RNA, 21 nt, Human
ccccguacggccgcuuagacg

SEQ ID NO: 1283535 - RNA, 20 nt, Human
cccggagcugcgccagggaa

SEQ ID NO: 1283536 - RNA, 19 nt, Human
cccguacggccgcuuagac

SEQ ID NO: 1283537 - RNA, 18 nt, Human
ccgcagccguugacuagc

SEQ ID NO: 1283538 - RNA, 22 nt, Human
ccgcgccugcaguucgugcacc

SEQ ID NO: 1283539 - RNA, 18 nt, Human
ccuccuggcgcccccugg

SEQ ID NO: 1283540 - RNA, 21 nt, Human
ccucuggauaaagauggaagc

SEQ ID NO: 1283541 - RNA, 24 nt, Human
ccugacucgccuggcagccucaac

SEQ ID NO: 1283542 - RNA, 18 nt, Human
ccugcaguucgugcaccu

SEQ ID NO: 1283543 - RNA, 19 nt, Human
ccugcaguucgugcaccuc

SEQ ID NO: 1283544 - RNA, 27 nt, Human
cgugcaccucuucccggagcugcgcca

SEQ ID NO: 1283545 - RNA, 19 nt, Human
cugaaguacaaggaaagga

SEQ ID NO: 1283546 - RNA, 22 nt, Human
cuggcaguuucccgccgccuag

SEQ ID NO: 1283547 - RNA, 18 nt, Human
gacagagugcaaugaagg

SEQ ID NO: 1283548 - RNA, 18 nt, Human
gaugaagaauaagaagaa

SEQ ID NO: 1283549 - RNA, 22 nt, Human
gcaaugaagggccuucuaucau

SEQ ID NO: 1283550 - RNA, 20 nt, Human
gccaccaccuuuagcuccaa

SEQ ID NO: 1283551 - RNA, 21 nt, Human
gccugucauucauaaucaucc

SEQ ID NO: 1283552 - RNA, 18 nt, Human
gcuuagacgggcuggggc

SEQ ID NO: 1283553 - RNA, 19 nt, Human
gcuuagacgggcuggggcg

SEQ ID NO: 1283554 - RNA, 22 nt, Human
ggaaagacagagugcaaugaag

SEQ ID NO: 1283555 - RNA, 21 nt, Human
ggcagccucaacggacuuguc

SEQ ID NO: 1283556 - RNA, 20 nt, Human
ggcuggggcgggaagauugc

SEQ ID NO: 1283557 - RNA, 20 nt, Human
gggauccuccccggggagga

SEQ ID NO: 1283558 - RNA, 21 nt, Human
gggucaauuucaggcacagcc

SEQ ID NO: 1283559 - RNA, 22 nt, Human
ggucgagaagggucuuggccac

SEQ ID NO: 1283560 - RNA, 19 nt, Human
gucauuaacaaagaugaag

SEQ ID NO: 1283561 - RNA, 24 nt, Human
guuaaaauauacaucugaaguaca

SEQ ID NO: 1283562 - RNA, 20 nt, Human
guuuuugaauuucauuucuc

SEQ ID NO: 1283563 - RNA, 23 nt, Human
uaaauaagccaaagggugauugu

SEQ ID NO: 1283564 - RNA, 21 nt, Human
uaccaggcagcuaugauuacc

SEQ ID NO: 1283565 - RNA, 24 nt, Human
uagccaaaaguugaguuuagauac

SEQ ID NO: 1283566 - RNA, 21 nt, Human
uaggaaaaacuuucauggaga

SEQ ID NO: 1283567 - RNA, 21 nt, Human
uagugcgaaaagucaucuccc

SEQ ID NO: 1283568 - RNA, 21 nt, Human
uaucuuauuuuuaagugucug

SEQ ID NO: 1283569 - RNA, 22 nt, Human
ucaaaaugaaacuaaggguaac

SEQ ID NO: 1283570 - RNA, 23 nt, Human
ucaggcgaauguggucugaaacg

SEQ ID NO: 1283571 - RNA, 20 nt, Human
uccaaacaucaaaaugaaac

SEQ ID NO: 1283572 - RNA, 22 nt, Human
uccacaccaccaggcacuaccu

SEQ ID NO: 1283573 - RNA, 19 nt, Human
uccaugguugaaaaagaag

SEQ ID NO: 1283574 - RNA, 21 nt, Human
uccaugguugaaaaagaagca

SEQ ID NO: 1283575 - RNA, 19 nt, Human
uccauuuaaaauaaagauu

SEQ ID NO: 1283576 - RNA, 21 nt, Human
ucugaaguacaaggaaaggau

SEQ ID NO: 1283577 - RNA, 22 nt, Human
ucuucugaaauuugcuugguuc

SEQ ID NO: 1283578 - RNA, 20 nt, Human
ugaaacgccuaagauuuuag

SEQ ID NO: 1283579 - RNA, 26 nt, Human
ugaagaacaaucccaucauuagucca

SEQ ID NO: 1283580 - RNA, 22 nt, Human
ugaaguaggaauaauaaagucc

SEQ ID NO: 1283581 - RNA, 19 nt, Human
ugacacaccacauugugcc

SEQ ID NO: 1283582 - RNA, 23 nt, Human
ugacacaccacauugugccauag

SEQ ID NO: 1283583 - RNA, 19 nt, Human
ugacucgccuggcagccuc

SEQ ID NO: 1283584 - RNA, 23 nt, Human
ugccagggaagcauaaaagcaac

SEQ ID NO: 1283585 - RNA, 19 nt, Human
ugcuauaagaucacucagg

SEQ ID NO: 1283586 - RNA, 23 nt, Human
ugcuggggaaccaccgcgccugc

SEQ ID NO: 1283587 - RNA, 23 nt, Human
uggguuuacuccuuguuucuuca

SEQ ID NO: 1283588 - RNA, 22 nt, Human
uuaacaaagaugaagaauaaga

SEQ ID NO: 1283589 - RNA, 19 nt, Human
uucccggagcugcgccagg

SEQ ID NO: 1283590 - RNA, 19 nt, Human
uucgugcaccucuucccgg

SEQ ID NO: 1283591 - RNA, 18 nt, Human
uucuggugacauuccagc

SEQ ID NO: 1283592 - RNA, 21 nt, Human
uuggaaagacagagugcaaug

SEQ ID NO: 1283593 - RNA, 23 nt, Human
uuucaggcacagcccauccgagu

SEQ ID NO: 1283594 - RNA, 18 nt, Human
uuugaauuucauuucucu

SEQ ID NO: 1283595 - RNA, 26 nt, Human
aaaaacuagugaagguucuugagcaa

SEQ ID NO: 1283596 - RNA, 24 nt, Human
aaaacuagugaagguucuugagca

SEQ ID NO: 1283597 - RNA, 18 nt, Human
aacauugugcaaguagau

SEQ ID NO: 1283598 - RNA, 22 nt, Human
agaaauaaaaaacuagugaagg

SEQ ID NO: 1283599 - RNA, 21 nt, Human
agaugacagcaagaaugugga

SEQ ID NO: 1283600 - RNA, 23 nt, Human
ggccuuaaagaaggguaaauguu

SEQ ID NO: 1283601 - RNA, 21 nt, Human
guggauggcugagaugacagc

SEQ ID NO: 1283602 - RNA, 20 nt, Human
ugaauaaauaagugaaucaa

SEQ ID NO: 1283603 - RNA, 23 nt, Human
ugacgugggugguguggauggcu

SEQ ID NO: 1283604 - RNA, 23 nt, Human
ugacugacagaacucuaauacag

SEQ ID NO: 1283605 - RNA, 19 nt, Human
ugagaugacagcaagaaug

SEQ ID NO: 1283606 - RNA, 21 nt, Human
ugagcaaaacacuaauggauu

SEQ ID NO: 1283607 - RNA, 20 nt, Human
uguuaugagggaguaaauuu

SEQ ID NO: 1283608 - RNA, 22 nt, Human
uuagggccuuaaagaaggguaa

SEQ ID NO: 1283609 - RNA, 20 nt, Human
uucacuguacauuucuaaac

SEQ ID NO: 1283610 - RNA, 20 nt, Human
uuugaggaacauugugcaag

SEQ ID NO: 1283611 - RNA, 20 nt, Human
accugcuggcuguaaguugc

SEQ ID NO: 1283612 - RNA, 19 nt, Human
agagcuccugccagccccg

SEQ ID NO: 1283613 - RNA, 23 nt, Human
agcuggaucccgcuucaccuggc

SEQ ID NO: 1283614 - RNA, 21 nt, Human
agggaggccagggccccaggg

SEQ ID NO: 1283615 - RNA, 22 nt, Human
caccuggcccucaacucugcgu

SEQ ID NO: 1283616 - RNA, 19 nt, Human
cagcugccgcagcucacag

SEQ ID NO: 1283617 - RNA, 23 nt, Human
cagcuuccaguuccccagccccu

SEQ ID NO: 1283618 - RNA, 19 nt, Human
ccagccccgccggcucucg

SEQ ID NO: 1283619 - RNA, 20 nt, Human
ccagccccgccggcucucgg

SEQ ID NO: 1283620 - RNA, 18 nt, Human
ccagggccccagggcgcg

SEQ ID NO: 1283621 - RNA, 25 nt, Human
ccagggcgcggaccagagccgagaa

SEQ ID NO: 1283622 - RNA, 19 nt, Human
cccgcgccgccgccucugc

SEQ ID NO: 1283623 - RNA, 20 nt, Human
cccgcugggggcgcccgggc

SEQ ID NO: 1283624 - RNA, 21 nt, Human
cccucccggagcgcgcucgcu

SEQ ID NO: 1283625 - RNA, 18 nt, Human
ccgcgccgccgccucugc

SEQ ID NO: 1283626 - RNA, 20 nt, Human
ccgcgccgccgccucugcuc

SEQ ID NO: 1283627 - RNA, 21 nt, Human
cgccucugcucagcugccgca

SEQ ID NO: 1283628 - RNA, 18 nt, Human
cgggaacucucucggccc

SEQ ID NO: 1283629 - RNA, 19 nt, Human
cucgcuccgccgcaacaga

SEQ ID NO: 1283630 - RNA, 19 nt, Human
cuuccaguuccccagcccc

SEQ ID NO: 1283631 - RNA, 18 nt, Human
gaccagagccgagaaggc

SEQ ID NO: 1283632 - RNA, 19 nt, Human
gcaacagacgugggcucac

SEQ ID NO: 1283633 - RNA, 20 nt, Human
gcccagcuuccaguucccca

SEQ ID NO: 1283634 - RNA, 20 nt, Human
gcccgagagcuccugccagc

SEQ ID NO: 1283635 - RNA, 20 nt, Human
gcucgcuccgccgcaacaga

SEQ ID NO: 1283636 - RNA, 19 nt, Human
ggaggccagggccccaggg

SEQ ID NO: 1283637 - RNA, 18 nt, Human
gggagaccguccgcgaag

SEQ ID NO: 1283638 - RNA, 20 nt, Human
ucaccgggcgccucccggaa

SEQ ID NO: 1283639 - RNA, 19 nt, Human
uccccagccccuccaggga

SEQ ID NO: 1283640 - RNA, 18 nt, Human
ucgaaaagggcucucagc

SEQ ID NO: 1283641 - RNA, 22 nt, Human
ucgaagggguuggggugaagug

SEQ ID NO: 1283642 - RNA, 19 nt, Human
ugaaguggggagcuggauc

SEQ ID NO: 1283643 - RNA, 18 nt, Human
ugcaggucccgcgccgcc

SEQ ID NO: 1283644 - RNA, 23 nt, Human
uggcccucaacucugcguuguuu

SEQ ID NO: 1283645 - RNA, 21 nt, Human
uuggggugaaguggggagcug

SEQ ID NO: 1283646 - RNA, 18 nt, Human
aaacaaagacucaugaac

SEQ ID NO: 1283647 - RNA, 22 nt, Human
aaagagcugaaugacaacaaac

SEQ ID NO: 1283648 - RNA, 20 nt, Human
aaaugggguucaagaagccc

SEQ ID NO: 1283649 - RNA, 21 nt, Human
aaauuagagcagcuggcaggu

SEQ ID NO: 1283650 - RNA, 19 nt, Human
aacaagcacuuaaugagca

SEQ ID NO: 1283651 - RNA, 21 nt, Human
aagaagcccucacaucagaac

SEQ ID NO: 1283652 - RNA, 18 nt, Human
aagaaguuauuuaccagu

SEQ ID NO: 1283653 - RNA, 18 nt, Human
acagugcccccacccucc

SEQ ID NO: 1283654 - RNA, 18 nt, Human
acaugggcuuggugauuu

SEQ ID NO: 1283655 - RNA, 22 nt, Human
accaagugaggagacacagccc

SEQ ID NO: 1283656 - RNA, 22 nt, Human
accaguagaacaugguuggcug

SEQ ID NO: 1283657 - RNA, 22 nt, Human
accaugugaccgguccugggaa

SEQ ID NO: 1283658 - RNA, 21 nt, Human
acccaggaugaccauuuugac

SEQ ID NO: 1283659 - RNA, 18 nt, Human
acuuucccaggcacaugg

SEQ ID NO: 1283660 - RNA, 20 nt, Human
agaacaacaagagguugaag

SEQ ID NO: 1283661 - RNA, 25 nt, Human
agagaacaacaagagguugaaggug

SEQ ID NO: 1283662 - RNA, 19 nt, Human
agagcagcuggcagguuac

SEQ ID NO: 1283663 - RNA, 22 nt, Human
agaggagggaagaggagacagu

SEQ ID NO: 1283664 - RNA, 23 nt, Human
agcccaaaauggugggagaaaga

SEQ ID NO: 1283665 - RNA, 20 nt, Human
aggaggaaaaagcccagaua

SEQ ID NO: 1283666 - RNA, 21 nt, Human
aggcacaccugugucugggau

SEQ ID NO: 1283667 - RNA, 18 nt, Human
aggcacauggaccugggc

SEQ ID NO: 1283668 - RNA, 22 nt, Human
aggcuuuggaaagaaaugagcu

SEQ ID NO: 1283669 - RNA, 18 nt, Human
caaacaaagacucaugaa

SEQ ID NO: 1283670 - RNA, 18 nt, Human
caagagguugaagguguc

SEQ ID NO: 1283671 - RNA, 23 nt, Human
caagugaggagacacagccccug

SEQ ID NO: 1283672 - RNA, 20 nt, Human
caauagagauaaucugugcc

SEQ ID NO: 1283673 - RNA, 22 nt, Human
cacaaacaaagacucaugaaca

SEQ ID NO: 1283674 - RNA, 19 nt, Human
caccucaguuccuaaaugg

SEQ ID NO: 1283675 - RNA, 18 nt, Human
cagaucccagagaaccag

SEQ ID NO: 1283676 - RNA, 21 nt, Human
cagcuucuuuuagagaacaac

SEQ ID NO: 1283677 - RNA, 19 nt, Human
cagggaguugacacccaag

SEQ ID NO: 1283678 - RNA, 21 nt, Human
ccaaaauggugggagaaagaa

SEQ ID NO: 1283679 - RNA, 24 nt, Human
ccagcuucuuuuagagaacaacaa

SEQ ID NO: 1283680 - RNA, 22 nt, Human
cccacaaacaaagacucaugaa

SEQ ID NO: 1283681 - RNA, 24 nt, Human
cccauuccuccccuccccuuuccc

SEQ ID NO: 1283682 - RNA, 26 nt, Human
ccccauuccuccccuccccuuuccca

SEQ ID NO: 1283683 - RNA, 20 nt, Human
ccucaguuucccccaucugc

SEQ ID NO: 1283684 - RNA, 19 nt, Human
ccuccccuccccuuuccca

SEQ ID NO: 1283685 - RNA, 24 nt, Human
ccuggaugagcuacacagaaagua

SEQ ID NO: 1283686 - RNA, 21 nt, Human
cuacaggguccgggcuuuucu

SEQ ID NO: 1283687 - RNA, 19 nt, Human
cuccaaagagcugcucuuc

SEQ ID NO: 1283688 - RNA, 22 nt, Human
cugugaccacccaggaugacca

SEQ ID NO: 1283689 - RNA, 22 nt, Human
cuuccucccuccagcuucuuuu

SEQ ID NO: 1283690 - RNA, 22 nt, Human
cuugauugagggguuggaugac

SEQ ID NO: 1283691 - RNA, 22 nt, Human
gaaaaggcuggccagaaacuug

SEQ ID NO: 1283692 - RNA, 20 nt, Human
gacucaugaacauuucacuu

SEQ ID NO: 1283693 - RNA, 19 nt, Human
gcuuccucccuccagcuuc

SEQ ID NO: 1283694 - RNA, 19 nt, Human
guagaacaugguuggcugc

SEQ ID NO: 1283695 - RNA, 26 nt, Human
uaaauggaaucuuuggggguguauaa

SEQ ID NO: 1283696 - RNA, 18 nt, Human
uaaguaaagcugauugug

SEQ ID NO: 1283697 - RNA, 22 nt, Human
ucagacaggaggaaaaagccca

SEQ ID NO: 1283698 - RNA, 20 nt, Human
uccaaauuagagcagcuggc

SEQ ID NO: 1283699 - RNA, 24 nt, Human
ucccacaaacaaagacucaugaac

SEQ ID NO: 1283700 - RNA, 25 nt, Human
uccccuccccuuucccacaaacaaa

SEQ ID NO: 1283701 - RNA, 21 nt, Human
uccgggcuuuucuccaacccu

SEQ ID NO: 1283702 - RNA, 18 nt, Human
uccucaguuucccccauc

SEQ ID NO: 1283703 - RNA, 22 nt, Human
ucucaggcaaagccaaagagcu

SEQ ID NO: 1283704 - RNA, 23 nt, Human
ugaaaccaagugaggagacacag

SEQ ID NO: 1283705 - RNA, 22 nt, Human
ugaaggugucaucuuuuuucuu

SEQ ID NO: 1283706 - RNA, 25 nt, Human
ugaaugggcuuccucccuccagcuu

SEQ ID NO: 1283707 - RNA, 19 nt, Human
ugacaaauacuucccaaga

SEQ ID NO: 1283708 - RNA, 19 nt, Human
ugagugaaaacguucauuu

SEQ ID NO: 1283709 - RNA, 23 nt, Human
ugcauggccuggaugagcuacac

SEQ ID NO: 1283710 - RNA, 30 nt, Human
ugccuucacccauacaauagagauaaucuu

SEQ ID NO: 1283711 - RNA, 23 nt, Human
uggaagaaguuauuuaccaguga

SEQ ID NO: 1283712 - RNA, 21 nt, Human
uggccagaaacuugaaugggc

SEQ ID NO: 1283713 - RNA, 23 nt, Human
uggccagaaacuugaaugggcuu

SEQ ID NO: 1283714 - RNA, 25 nt, Human
ugggaaaaggcuggccagaaacuug

SEQ ID NO: 1283715 - RNA, 21 nt, Human
ugggagaaagaauaggcuuug

SEQ ID NO: 1283716 - RNA, 19 nt, Human
ugggagugaaguagaggaa

SEQ ID NO: 1283717 - RNA, 22 nt, Human
ugggcuuccucccuccagcuuc

SEQ ID NO: 1283718 - RNA, 23 nt, Human
ugggucagacaggaggaaaaagc

SEQ ID NO: 1283719 - RNA, 19 nt, Human
uggugaugucagcccaaaa

SEQ ID NO: 1283720 - RNA, 19 nt, Human
uucaaaugggguucaagaa

SEQ ID NO: 1283721 - RNA, 21 nt, Human
uucccaggcacauggaccugg

SEQ ID NO: 1283722 - RNA, 23 nt, Human
uugaaauaaaaaugaacgugugc

SEQ ID NO: 1283723 - RNA, 19 nt, Human
uugaaggugucaucuuuuu

SEQ ID NO: 1283724 - RNA, 21 nt, Human
uuucccacaaacaaagacuca

SEQ ID NO: 1283725 - RNA, 24 nt, Human
aaaucagcugcuguccagagcuag

SEQ ID NO: 1283726 - RNA, 19 nt, Human
aaggcgggugggagcucac

SEQ ID NO: 1283727 - RNA, 19 nt, Human
agacacucccucuccuggg

SEQ ID NO: 1283728 - RNA, 22 nt, Human
caaaggaaucguaaacucaugu

SEQ ID NO: 1283729 - RNA, 25 nt, Human
caacagagaagacuccagccugaug

SEQ ID NO: 1283730 - RNA, 19 nt, Human
caccuggaaggagacacuc

SEQ ID NO: 1283731 - RNA, 25 nt, Human
caucuucacugcaaggcggguggga

SEQ ID NO: 1283732 - RNA, 19 nt, Human
cggcgucucuauccugcug

SEQ ID NO: 1283733 - RNA, 22 nt, Human
cuauccugcugcuuucucugac

SEQ ID NO: 1283734 - RNA, 20 nt, Human
gaggacaacgaugaagaaac

SEQ ID NO: 1283735 - RNA, 18 nt, Human
gagggccuggaagacacg

SEQ ID NO: 1283736 - RNA, 21 nt, Human
gccuaaaaucagcugcugucc

SEQ ID NO: 1283737 - RNA, 23 nt, Human
gccucagagauucucccaguccu

SEQ ID NO: 1283738 - RNA, 18 nt, Human
guccagagcuagcaccug

SEQ ID NO: 1283739 - RNA, 21 nt, Human
uaaacucaugugaccagcagg

SEQ ID NO: 1283740 - RNA, 21 nt, Human
ucagcugcuguccagagcuag

SEQ ID NO: 1283741 - RNA, 19 nt, Human
ucuauccugcugcuuucuc

SEQ ID NO: 1283742 - RNA, 19 nt, Human
ucuaugggaccugagucca

SEQ ID NO: 1283743 - RNA, 18 nt, Human
ucucccaguccugccacc

SEQ ID NO: 1283744 - RNA, 18 nt, Human
ucugacugcaucuuccuc

SEQ ID NO: 1283745 - RNA, 18 nt, Human
ucuuccucuguuccuugg

SEQ ID NO: 1283746 - RNA, 18 nt, Human
ugcugugacccacauaua

SEQ ID NO: 1283747 - RNA, 19 nt, Human
uggagggcacaagcugugg

SEQ ID NO: 1283748 - RNA, 20 nt, Human
uguccagagcuagcaccugg

SEQ ID NO: 1283749 - RNA, 27 nt, Human
aaaaagacauaagccaccuucuucagc

SEQ ID NO: 1283750 - RNA, 23 nt, Human
aaacacuuuaaaagaagugauuc

SEQ ID NO: 1283751 - RNA, 20 nt, Human
aagggcccaagauugggcug

SEQ ID NO: 1283752 - RNA, 19 nt, Human
acucucauuccuacuccug

SEQ ID NO: 1283753 - RNA, 18 nt, Human
agcuggacuggugguauu

SEQ ID NO: 1283754 - RNA, 20 nt, Human
aggaaaaagacauaagccaa

SEQ ID NO: 1283755 - RNA, 21 nt, Human
aggaaggagaugugagcccca

SEQ ID NO: 1283756 - RNA, 22 nt, Human
aggauugguagucuguuuggau

SEQ ID NO: 1283757 - RNA, 24 nt, Human
aggauugguagucuguuuggauga

SEQ ID NO: 1283758 - RNA, 23 nt, Human
agguuuucuaaaugaugcagcuu

SEQ ID NO: 1283759 - RNA, 22 nt, Human
aguaggaacuggucccacacgg

SEQ ID NO: 1283760 - RNA, 19 nt, Human
auccuuggacaagcauugg

SEQ ID NO: 1283761 - RNA, 18 nt, Human
augauacuuuugggcaau

SEQ ID NO: 1283762 - RNA, 24 nt, Human
augaugauggagauaaacaaagcc

SEQ ID NO: 1283763 - RNA, 22 nt, Human
augugaggguuuaaucuguaug

SEQ ID NO: 1283764 - RNA, 21 nt, Human
caaagccaccacugccaaaga

SEQ ID NO: 1283765 - RNA, 23 nt, Human
caauccauuuggaagaaagcaau

SEQ ID NO: 1283766 - RNA, 21 nt, Human
caccacugccaaagacucuau

SEQ ID NO: 1283767 - RNA, 23 nt, Human
cagggcgggaccaaaauuuuggc

SEQ ID NO: 1283768 - RNA, 19 nt, Human
cauuaauuaccagaggggu

SEQ ID NO: 1283769 - RNA, 20 nt, Human
ccaaagcuggacugguggua

SEQ ID NO: 1283770 - RNA, 23 nt, Human
ccaaggcaaguauaauaauuaau

SEQ ID NO: 1283771 - RNA, 22 nt, Human
ccaguccccuucuauuuuacaa

SEQ ID NO: 1283772 - RNA, 19 nt, Human
cccacacgggaaaaagagu

SEQ ID NO: 1283773 - RNA, 22 nt, Human
ccccuucuauuuuacaaagcca

SEQ ID NO: 1283774 - RNA, 21 nt, Human
ccuaccuuaacgguauuuaga

SEQ ID NO: 1283775 - RNA, 24 nt, Human
cuuuccauaaaauccuuggacaag

SEQ ID NO: 1283776 - RNA, 19 nt, Human
gaacauguggguuagcuug

SEQ ID NO: 1283777 - RNA, 18 nt, Human
gaggguuuaaucuguaug

SEQ ID NO: 1283778 - RNA, 19 nt, Human
gaugauacuuuugggcaau

SEQ ID NO: 1283779 - RNA, 23 nt, Human
ggaaacugcaaggcugcuaacuc

SEQ ID NO: 1283780 - RNA, 21 nt, Human
gggaaacugcaaggcugcuaa

SEQ ID NO: 1283781 - RNA, 21 nt, Human
gggcaaugucaccuaagcuuu

SEQ ID NO: 1283782 - RNA, 21 nt, Human
guggacuggccagaggaagga

SEQ ID NO: 1283783 - RNA, 19 nt, Human
uaaaaacagcauucuuccc

SEQ ID NO: 1283784 - RNA, 24 nt, Human
uaaaaacuguacagguuuucuaaa

SEQ ID NO: 1283785 - RNA, 18 nt, Human
uaaaugaugcagcuuggg

SEQ ID NO: 1283786 - RNA, 21 nt, Human
uaaguaggaacuggucccaca

SEQ ID NO: 1283787 - RNA, 18 nt, Human
uaagucagccagguucau

SEQ ID NO: 1283788 - RNA, 22 nt, Human
uagggaugguuuccauaaaaac

SEQ ID NO: 1283789 - RNA, 18 nt, Human
uccauaaaaacuguacag

SEQ ID NO: 1283790 - RNA, 19 nt, Human
ucccacacgggaaaaagag

SEQ ID NO: 1283791 - RNA, 24 nt, Human
ucggcuaguuuuuggguggcaucc

SEQ ID NO: 1283792 - RNA, 20 nt, Human
ugacuaggcgccccaugacu

SEQ ID NO: 1283793 - RNA, 20 nt, Human
ugaugauacuuuugggcaau

SEQ ID NO: 1283794 - RNA, 21 nt, Human
ugaugcagcuuggguaacugc

SEQ ID NO: 1283795 - RNA, 21 nt, Human
ugccaaagcuggacugguggu

SEQ ID NO: 1283796 - RNA, 24 nt, Human
uggccagaggaaggagaugugagc

SEQ ID NO: 1283797 - RNA, 20 nt, Human
ugggcugggaucaggauugg

SEQ ID NO: 1283798 - RNA, 21 nt, Human
ugggcugggaucaggauuggu

SEQ ID NO: 1283799 - RNA, 24 nt, Human
uggguuucugaggggaugcaaccc

SEQ ID NO: 1283800 - RNA, 22 nt, Human
uguccuugacuagggaugguuu

SEQ ID NO: 1283801 - RNA, 19 nt, Human
ugugucuggugguugcagu

SEQ ID NO: 1283802 - RNA, 21 nt, Human
uugagauugggccccaaaugg

SEQ ID NO: 1283803 - RNA, 19 nt, Human
uuuaaaguguccuugacua

SEQ ID NO: 1283804 - RNA, 22 nt, Human
uuuggcuucucucaauacaaag

SEQ ID NO: 1283805 - RNA, 19 nt, Human
aaaaaguaaaaagacaacc

SEQ ID NO: 1283806 - RNA, 28 nt, Human
aaaagaacaggcaauagucauaagcaag

SEQ ID NO: 1283807 - RNA, 23 nt, Human
aaaaugagaauuugugcugcaaa

SEQ ID NO: 1283808 - RNA, 23 nt, Human
aaagacaacccacacaaucaaaa

SEQ ID NO: 1283809 - RNA, 22 nt, Human
aaagaugggguggccacaggcg

SEQ ID NO: 1283810 - RNA, 22 nt, Human
aaagaugguaaaagggugacaa

SEQ ID NO: 1283811 - RNA, 24 nt, Human
aaaguacugagauuacaggcauga

SEQ ID NO: 1283812 - RNA, 21 nt, Human
aaagugcugggauuacaggca

SEQ ID NO: 1283813 - RNA, 22 nt, Human
aaagugcugggauuacaggcau

SEQ ID NO: 1283814 - RNA, 24 nt, Human
aaagugcugggauuacaggcauca

SEQ ID NO: 1283815 - RNA, 21 nt, Human
aaauacacauggccaggacac

SEQ ID NO: 1283816 - RNA, 25 nt, Human
aacuacccagccucagguauuccuu

SEQ ID NO: 1283817 - RNA, 22 nt, Human
aacugcuucauuaauagucuua

SEQ ID NO: 1283818 - RNA, 24 nt, Human
aagaaagagccagccaaaugaaga

SEQ ID NO: 1283819 - RNA, 20 nt, Human
aagauaaacaaggaaacaaa

SEQ ID NO: 1283820 - RNA, 19 nt, Human
aagcaaguaauucacuagg

SEQ ID NO: 1283821 - RNA, 27 nt, Human
aagcgauucuccugccucugccuccca

SEQ ID NO: 1283822 - RNA, 19 nt, Human
aaggaaacaaacaugauga

SEQ ID NO: 1283823 - RNA, 26 nt, Human
aaguacugagauuacaggcaugagcc

SEQ ID NO: 1283824 - RNA, 25 nt, Human
aaguagcuggaacuacaggcacgug

SEQ ID NO: 1283825 - RNA, 25 nt, Human
aagugauccucccaucucagccucc

SEQ ID NO: 1283826 - RNA, 21 nt, Human
aagugauccuccuaccuccca

SEQ ID NO: 1283827 - RNA, 19 nt, Human
aagugcugggauuacaggc

SEQ ID NO: 1283828 - RNA, 21 nt, Human
aagugcugggauuacaggcau

SEQ ID NO: 1283829 - RNA, 19 nt, Human
aaucaugacucacugcagc

SEQ ID NO: 1283830 - RNA, 24 nt, Human
aaugaacaagacagaaaaaaaucu

SEQ ID NO: 1283831 - RNA, 21 nt, Human
acaaagaaagagccagccaaa

SEQ ID NO: 1283832 - RNA, 18 nt, Human
acacaaaucucucaaaca

SEQ ID NO: 1283833 - RNA, 24 nt, Human
acacacacccucuccuugcuuccu

SEQ ID NO: 1283834 - RNA, 19 nt, Human
acacugaaagcauaagcag

SEQ ID NO: 1283835 - RNA, 22 nt, Human
acagaaaaaaaucucgcuuuca

SEQ ID NO: 1283836 - RNA, 22 nt, Human
acagcagauguaucagagaccu

SEQ ID NO: 1283837 - RNA, 21 nt, Human
acaggcaauagucauaagccg

SEQ ID NO: 1283838 - RNA, 18 nt, Human
acaggguuucaccguguu

SEQ ID NO: 1283839 - RNA, 19 nt, Human
acaggguuucaccguguua

SEQ ID NO: 1283840 - RNA, 20 nt, Human
acaggguuucaccguguuag

SEQ ID NO: 1283841 - RNA, 24 nt, Human
acaggguuucaccguguuagccag

SEQ ID NO: 1283842 - RNA, 23 nt, Human
accagcaaaaaucaacacgguuu

SEQ ID NO: 1283843 - RNA, 21 nt, Human
acccacacaaucaaaauauuu

SEQ ID NO: 1283844 - RNA, 19 nt, Human
acgggguuuugccaugcug

SEQ ID NO: 1283845 - RNA, 20 nt, Human
acgggguuuugccaugcugg

SEQ ID NO: 1283846 - RNA, 24 nt, Human
acgggguuuugccaugcuggccag

SEQ ID NO: 1283847 - RNA, 24 nt, Human
acuauguugcucaggcugcuuuug

SEQ ID NO: 1283848 - RNA, 23 nt, Human
acugacuaagacauauacaaaua

SEQ ID NO: 1283849 - RNA, 19 nt, Human
acugcagccucaaccuccu

SEQ ID NO: 1283850 - RNA, 22 nt, Human
agaaagguuuuucaaacagcua

SEQ ID NO: 1283851 - RNA, 19 nt, Human
agacacaaaucucucaaac

SEQ ID NO: 1283852 - RNA, 18 nt, Human
agacaggguuucaccgug

SEQ ID NO: 1283853 - RNA, 21 nt, Human
agaccuaaauaagagccaaug

SEQ ID NO: 1283854 - RNA, 19 nt, Human
agagacaggguuucaccgu

SEQ ID NO: 1283855 - RNA, 23 nt, Human
agagaccuaaauaagagccaaug

SEQ ID NO: 1283856 - RNA, 19 nt, Human
agaggcuauuuuauaaaga

SEQ ID NO: 1283857 - RNA, 18 nt, Human
agaguauaaacuagaaac

SEQ ID NO: 1283858 - RNA, 18 nt, Human
agauguaucagagaccua

SEQ ID NO: 1283859 - RNA, 22 nt, Human
agauuacaggcaugagccacug

SEQ ID NO: 1283860 - RNA, 23 nt, Human
agauuacaggcaugagccacugc

SEQ ID NO: 1283861 - RNA, 23 nt, Human
agcacauucaucaaauauuaaca

SEQ ID NO: 1283862 - RNA, 24 nt, Human
agcccaagaacacuuuccaaucuc

SEQ ID NO: 1283863 - RNA, 18 nt, Human
agccuccagaauagcugg

SEQ ID NO: 1283864 - RNA, 23 nt, Human
agcgauucugcugccccagccuc

SEQ ID NO: 1283865 - RNA, 19 nt, Human
agcuacuggcuugacuguc

SEQ ID NO: 1283866 - RNA, 18 nt, Human
agcucaauggaauaaaau

SEQ ID NO: 1283867 - RNA, 18 nt, Human
aggcuggagugcaguggc

SEQ ID NO: 1283868 - RNA, 25 nt, Human
aggcuggagugcaguggcgcgaucu

SEQ ID NO: 1283869 - RNA, 21 nt, Human
agggugacaaaacucuguuuu

SEQ ID NO: 1283870 - RNA, 20 nt, Human
aggugcaaauccuaaugacc

SEQ ID NO: 1283871 - RNA, 22 nt, Human
aguagagacgggguuuugccau

SEQ ID NO: 1283872 - RNA, 18 nt, Human
aguagcugggauuacagg

SEQ ID NO: 1283873 - RNA, 21 nt, Human
aguagcugggauuacaggugu

SEQ ID NO: 1283874 - RNA, 20 nt, Human
agugcaguggcgcaaucaug

SEQ ID NO: 1283875 - RNA, 20 nt, Human
agugcaguggcgcgaucucg

SEQ ID NO: 1283876 - RNA, 23 nt, Human
agugcaguggcgcgaucucggcu

SEQ ID NO: 1283877 - RNA, 24 nt, Human
agugcaguggcgcgaucucggcuc

SEQ ID NO: 1283878 - RNA, 18 nt, Human
agugcugggauuacaggc

SEQ ID NO: 1283879 - RNA, 19 nt, Human
auagaucaauaccuuccuu

SEQ ID NO: 1283880 - RNA, 19 nt, Human
aucaaaaggcugaugugaa

SEQ ID NO: 1283881 - RNA, 24 nt, Human
aucaucuccgcucacugcaaacuc

SEQ ID NO: 1283882 - RNA, 18 nt, Human
augcagucaucaagacug

SEQ ID NO: 1283883 - RNA, 18 nt, Human
auggggucucacuauguu

SEQ ID NO: 1283884 - RNA, 24 nt, Human
auuuuuguauuuuuaguagagacg

SEQ ID NO: 1283885 - RNA, 24 nt, Human
caaaguacugagauuacaggcaug

SEQ ID NO: 1283886 - RNA, 22 nt, Human
caaagugagagccaucacuauu

SEQ ID NO: 1283887 - RNA, 25 nt, Human
caaagugcugggauuacaggcauca

SEQ ID NO: 1283888 - RNA, 23 nt, Human
caacaacagaggcaagacgacag

SEQ ID NO: 1283889 - RNA, 23 nt, Human
caaccuccaccuccuggguucaa

SEQ ID NO: 1283890 - RNA, 22 nt, Human
caaccuccuggguucaagugau

SEQ ID NO: 1283891 - RNA, 25 nt, Human
caaccuccuggguucaagugauccu

SEQ ID NO: 1283892 - RNA, 20 nt, Human
caagcgauucugcugcccca

SEQ ID NO: 1283893 - RNA, 19 nt, Human
caaggaaacaaacaugaug

SEQ ID NO: 1283894 - RNA, 21 nt, Human
caaugaacaagacagaaaaaa

SEQ ID NO: 1283895 - RNA, 23 nt, Human
cacaacacuucaaaagaaguuaa

SEQ ID NO: 1283896 - RNA, 25 nt, Human
cacacaacacuucaaaagaaguuaa

SEQ ID NO: 1283897 - RNA, 22 nt, Human
cacacccggcuaaguuuaugua

SEQ ID NO: 1283898 - RNA, 19 nt, Human
cacaguauaguuaaugaaa

SEQ ID NO: 1283899 - RNA, 24 nt, Human
caccacacccagcuaauuuuugua

SEQ ID NO: 1283900 - RNA, 18 nt, Human
caccguguuagccaggau

SEQ ID NO: 1283901 - RNA, 24 nt, Human
caccguguuagccaggauggucuc

SEQ ID NO: 1283902 - RNA, 23 nt, Human
cacuccugggcucaagugauccu

SEQ ID NO: 1283903 - RNA, 21 nt, Human
cacugcaaacucugccuccca

SEQ ID NO: 1283904 - RNA, 21 nt, Human
cacugcaaccuccaccuccug

SEQ ID NO: 1283905 - RNA, 23 nt, Human
cacugcaaccuccaccuccuggg

SEQ ID NO: 1283906 - RNA, 19 nt, Human
cacugcagccucaaccucc

SEQ ID NO: 1283907 - RNA, 20 nt, Human
cagaggucugaacaaagaaa

SEQ ID NO: 1283908 - RNA, 23 nt, Human
cagccucaaccuccuggguucaa

SEQ ID NO: 1283909 - RNA, 20 nt, Human
cagccuccugaguagcuggg

SEQ ID NO: 1283910 - RNA, 23 nt, Human
cagccuguagaaacaugagccaa

SEQ ID NO: 1283911 - RNA, 18 nt, Human
caggcaauagucauaagc

SEQ ID NO: 1283912 - RNA, 19 nt, Human
cagggaacaggaugcagaa

SEQ ID NO: 1283913 - RNA, 19 nt, Human
caggggugaguucuuccug

SEQ ID NO: 1283914 - RNA, 24 nt, Human
caggguuucaccguguuagccagg

SEQ ID NO: 1283915 - RNA, 22 nt, Human
cauauacaaauacuuaugaacu

SEQ ID NO: 1283916 - RNA, 24 nt, Human
caugcuggccaggcuggucucgaa

SEQ ID NO: 1283917 - RNA, 24 nt, Human
ccaaaguacugagauuacaggcau

SEQ ID NO: 1283918 - RNA, 23 nt, Human
ccaaagugcugggauuacaggca

SEQ ID NO: 1283919 - RNA, 24 nt, Human
ccaaagugcugggauuacaggcau

SEQ ID NO: 1283920 - RNA, 24 nt, Human
ccacacaaucaaaauauuugcaaa

SEQ ID NO: 1283921 - RNA, 24 nt, Human
ccaccuccuggguucaagcgauuc

SEQ ID NO: 1283922 - RNA, 18 nt, Human
ccacugcgcccagccuau

SEQ ID NO: 1283923 - RNA, 19 nt, Human
ccacugcgcccagccuauu

SEQ ID NO: 1283924 - RNA, 23 nt, Human
ccacugcgcccagccuauugccu

SEQ ID NO: 1283925 - RNA, 24 nt, Human
ccagaauagcugggacuacaggca

SEQ ID NO: 1283926 - RNA, 19 nt, Human
ccaugcuggccaggcuggu

SEQ ID NO: 1283927 - RNA, 23 nt, Human
ccaugcuggccaggcuggucucg

SEQ ID NO: 1283928 - RNA, 24 nt, Human
cccaaagugcugggauuacaggca

SEQ ID NO: 1283929 - RNA, 22 nt, Human
cccaggcuggagugcaguggcg

SEQ ID NO: 1283930 - RNA, 23 nt, Human
ccgucccacuucguaccauacau

SEQ ID NO: 1283931 - RNA, 22 nt, Human
ccucaaccuccuggguucaagu

SEQ ID NO: 1283932 - RNA, 19 nt, Human
ccuccaccuccuggguuca

SEQ ID NO: 1283933 - RNA, 22 nt, Human
ccucccagguucaagcgauucu

SEQ ID NO: 1283934 - RNA, 26 nt, Human
ccucccaucucagccuccagaauagc

SEQ ID NO: 1283935 - RNA, 24 nt, Human
ccuccuggguucaagcgauucucc

SEQ ID NO: 1283936 - RNA, 24 nt, Human
ccuccuggguucaagugauccucc

SEQ ID NO: 1283937 - RNA, 19 nt, Human
ccucugcugcccaggcugg

SEQ ID NO: 1283938 - RNA, 25 nt, Human
ccucugcugcccaggcuggagugca

SEQ ID NO: 1283939 - RNA, 18 nt, Human
ccugacacacacccucuc

SEQ ID NO: 1283940 - RNA, 22 nt, Human
ccugaguagcugggauuacagg

SEQ ID NO: 1283941 - RNA, 22 nt, Human
ccugaguagcugggauuacagg

SEQ ID NO: 1283942 - RNA, 23 nt, Human
ccugaguagcugggauuacaggu

SEQ ID NO: 1283943 - RNA, 24 nt, Human
ccugaguagcugggauuacaggug

SEQ ID NO: 1283944 - RNA, 22 nt, Human
ccugggcucaagugauccuccu

SEQ ID NO: 1283945 - RNA, 23 nt, Human
ccuggguucaagcgauucuccug

SEQ ID NO: 1283946 - RNA, 22 nt, Human
ccuggguucaagugauccuccc

SEQ ID NO: 1283947 - RNA, 24 nt, Human
ccuugcuuccucucucacccugug

SEQ ID NO: 1283948 - RNA, 22 nt, Human
cgagacaagaucuuccucugcu

SEQ ID NO: 1283949 - RNA, 24 nt, Human
cgggguuuugccaugcuggccagg

SEQ ID NO: 1283950 - RNA, 23 nt, Human
cuaauuuuuguauuuuuaguaga

SEQ ID NO: 1283951 - RNA, 22 nt, Human
cuacugccuuuuuuucgagaca

SEQ ID NO: 1283952 - RNA, 27 nt, Human
cucaagugauccuccuaccucccaaag

SEQ ID NO: 1283953 - RNA, 23 nt, Human
cucacugcaaacucugccuccca

SEQ ID NO: 1283954 - RNA, 24 nt, Human
cucacugcaaccuccaccuccugg

SEQ ID NO: 1283955 - RNA, 26 nt, Human
cucacugcaaccuccaccuccugggu

SEQ ID NO: 1283956 - RNA, 21 nt, Human
cucacugcagccucaaccucc

SEQ ID NO: 1283957 - RNA, 24 nt, Human
cucacugcagccucaaccuccugg

SEQ ID NO: 1283958 - RNA, 21 nt, Human
cucagccuccagaauagcugg

SEQ ID NO: 1283959 - RNA, 24 nt, Human
cuccagaauagcugggacuacagg

SEQ ID NO: 1283960 - RNA, 21 nt, Human
cucccaaaguacugagauuac

SEQ ID NO: 1283961 - RNA, 22 nt, Human
cuccugaccucgugauccgccc

SEQ ID NO: 1283962 - RNA, 23 nt, Human
cuccugggcucaagugauccucc

SEQ ID NO: 1283963 - RNA, 21 nt, Human
cuccuggguucaagcgauucu

SEQ ID NO: 1283964 - RNA, 21 nt, Human
cucuccuugcuuccucucuca

SEQ ID NO: 1283965 - RNA, 20 nt, Human
cucugucgcccaggcuggag

SEQ ID NO: 1283966 - RNA, 21 nt, Human
cugaguagcugggauuacagg

SEQ ID NO: 1283967 - RNA, 24 nt, Human
cugaguagcugggauuacaggugu

SEQ ID NO: 1283968 - RNA, 18 nt, Human
cugcaaccuccaccuccu

SEQ ID NO: 1283969 - RNA, 23 nt, Human
cugcaaccuccaccuccuggguu

SEQ ID NO: 1283970 - RNA, 24 nt, Human
cugcaaccuccaccuccuggguuc

SEQ ID NO: 1283971 - RNA, 24 nt, Human
cugcccaggcuggagugcaguggc

SEQ ID NO: 1283972 - RNA, 18 nt, Human
cuuuuuuuuuuuuuuuug

SEQ ID NO: 1283973 - RNA, 19 nt, Human
gaaaaaauaccacaauaau

SEQ ID NO: 1283974 - RNA, 20 nt, Human
gaaauacacauggccaggac

SEQ ID NO: 1283975 - RNA, 24 nt, Human
gaauagcugggacuacaggcaugc

SEQ ID NO: 1283976 - RNA, 22 nt, Human
gaccucgugauccgcccaucuc

SEQ ID NO: 1283977 - RNA, 22 nt, Human
gaccucgugauccgcccaucuc

SEQ ID NO: 1283978 - RNA, 24 nt, Human
gagacgggguuuugccaugcuggc

SEQ ID NO: 1283979 - RNA, 25 nt, Human
gaggucugaacaaagaaagagccag

SEQ ID NO: 1283980 - RNA, 19 nt, Human
gaguagcugggauuacagg

SEQ ID NO: 1283981 - RNA, 24 nt, Human
gaguagcugggauuacaggugugc

SEQ ID NO: 1283982 - RNA, 25 nt, Human
gaugcagaacaauggggguggucuu

SEQ ID NO: 1283983 - RNA, 18 nt, Human
gauuacaggcaucagcca

SEQ ID NO: 1283984 - RNA, 22 nt, Human
gauuacaggcaucagccaccgc

SEQ ID NO: 1283985 - RNA, 18 nt, Human
gauuacaggcaugagcca

SEQ ID NO: 1283986 - RNA, 22 nt, Human
gauuacaggcaugagccacugc

SEQ ID NO: 1283987 - RNA, 22 nt, Human
gcaaacucugccucccagguuc

SEQ ID NO: 1283988 - RNA, 19 nt, Human
gcccaggcuggagugcagu

SEQ ID NO: 1283989 - RNA, 19 nt, Human
gcccaggcuggagugcagu

SEQ ID NO: 1283990 - RNA, 20 nt, Human
gcccaggcuggagugcagug

SEQ ID NO: 1283991 - RNA, 23 nt, Human
gcucucuuucucccccuucuuuu

SEQ ID NO: 1283992 - RNA, 25 nt, Human
gcucugucgcccaggcuggagugca

SEQ ID NO: 1283993 - RNA, 24 nt, Human
gcugccccagccuccugaguagcu

SEQ ID NO: 1283994 - RNA, 19 nt, Human
gcuggagugcaguggcgca

SEQ ID NO: 1283995 - RNA, 19 nt, Human
gcuggagugcaguggcgcg

SEQ ID NO: 1283996 - RNA, 23 nt, Human
gcuggucucgaacuccugaccuc

SEQ ID NO: 1283997 - RNA, 23 nt, Human
ggagucuugcucugucgcccagg

SEQ ID NO: 1283998 - RNA, 24 nt, Human
ggauggucucgaucuccugaccuc

SEQ ID NO: 1283999 - RNA, 22 nt, Human
ggauuacaggcaucagccaccg

SEQ ID NO: 1284000 - RNA, 24 nt, Human
ggcuggucucgaacuccugaccuc

SEQ ID NO: 1284001 - RNA, 21 nt, Human
gggcucaagugauccuccuac

SEQ ID NO: 1284002 - RNA, 22 nt, Human
gggcucaagugauccuccuacc

SEQ ID NO: 1284003 - RNA, 22 nt, Human
ggggucucacuauguugcucag

SEQ ID NO: 1284004 - RNA, 23 nt, Human
gggguuuugccaugcuggccagg

SEQ ID NO: 1284005 - RNA, 22 nt, Human
gggucucacuauguugcucagg

SEQ ID NO: 1284006 - RNA, 19 nt, Human
ggucucgaacuccugaccu

SEQ ID NO: 1284007 - RNA, 21 nt, Human
guagagacgggguuuugccau

SEQ ID NO: 1284008 - RNA, 18 nt, Human
guagcugggauuacaggu

SEQ ID NO: 1284009 - RNA, 19 nt, Human
gugggacaccccucccccg

SEQ ID NO: 1284010 - RNA, 20 nt, Human
guucaagugauccucccauc

SEQ ID NO: 1284011 - RNA, 24 nt, Human
guuuauguauuuuuaguagagaca

SEQ ID NO: 1284012 - RNA, 19 nt, Human
uaaaaagacaacccacaca

SEQ ID NO: 1284013 - RNA, 23 nt, Human
uaaaaagacaacccacacaauca

SEQ ID NO: 1284014 - RNA, 24 nt, Human
uaaaaauauaaagcugcauugcua

SEQ ID NO: 1284015 - RNA, 22 nt, Human
uaaacuacccagccucagguau

SEQ ID NO: 1284016 - RNA, 25 nt, Human
uaaagugggacaccccucccccguc

SEQ ID NO: 1284017 - RNA, 24 nt, Human
uaacagugguuauccauauacagu

SEQ ID NO: 1284018 - RNA, 20 nt, Human
uaagacacaaaucucucaaa

SEQ ID NO: 1284019 - RNA, 23 nt, Human
uaagugcuccaaagugagagcca

SEQ ID NO: 1284020 - RNA, 24 nt, Human
uaaguuuauguauuuuuaguagag

SEQ ID NO: 1284021 - RNA, 24 nt, Human
uaaugaaguagacccacauuuaau

SEQ ID NO: 1284022 - RNA, 24 nt, Human
uaauuuuuguauuuuuaguagaga

SEQ ID NO: 1284023 - RNA, 20 nt, Human
uacaaaaaacuguaucucac

SEQ ID NO: 1284024 - RNA, 24 nt, Human
uacaggcaugagccacugcgccca

SEQ ID NO: 1284025 - RNA, 24 nt, Human
uacaggugugcaccaccacaccca

SEQ ID NO: 1284026 - RNA, 19 nt, Human
uacccagccucagguauuc

SEQ ID NO: 1284027 - RNA, 18 nt, Human
uaccugcacacauaggcu

SEQ ID NO: 1284028 - RNA, 22 nt, Human
uagagacaggguuucaccgugu

SEQ ID NO: 1284029 - RNA, 20 nt, Human
uagagacgggguuuugccau

SEQ ID NO: 1284030 - RNA, 21 nt, Human
uagcauaauagauauagcuca

SEQ ID NO: 1284031 - RNA, 22 nt, Human
uagggauggggucucacuaugu

SEQ ID NO: 1284032 - RNA, 21 nt, Human
uaggugggggccuaaugggag

SEQ ID NO: 1284033 - RNA, 21 nt, Human
uaguagagacaggguuucacc

SEQ ID NO: 1284034 - RNA, 24 nt, Human
uaguagagacaggguuucaccgug

SEQ ID NO: 1284035 - RNA, 26 nt, Human
uaguagagacaggguuucaccguguu

SEQ ID NO: 1284036 - RNA, 24 nt, Human
uaguagagacgggguuuugccaug

SEQ ID NO: 1284037 - RNA, 24 nt, Human
uaguauagcaaagaugguaaaagg

SEQ ID NO: 1284038 - RNA, 23 nt, Human
uauagggauggggucucacuaug

SEQ ID NO: 1284039 - RNA, 24 nt, Human
uaugaggaaacuuuaauucacguu

SEQ ID NO: 1284040 - RNA, 22 nt, Human
uauguugcucaggcugcuuuug

SEQ ID NO: 1284041 - RNA, 19 nt, Human
uauugggcagaauaaaaag

SEQ ID NO: 1284042 - RNA, 21 nt, Human
uauuugcaaaucacauauaug

SEQ ID NO: 1284043 - RNA, 24 nt, Human
ucaaaacauauuacaaagaugcag

SEQ ID NO: 1284044 - RNA, 18 nt, Human
ucaaacagcuacuggcuu

SEQ ID NO: 1284045 - RNA, 19 nt, Human
ucaagcgauucuccugccu

SEQ ID NO: 1284046 - RNA, 24 nt, Human
ucaccguguuagccaggauggucu

SEQ ID NO: 1284047 - RNA, 18 nt, Human
ucacugcaaacucugccu

SEQ ID NO: 1284048 - RNA, 19 nt, Human
ucacugcaaacucugccuc

SEQ ID NO: 1284049 - RNA, 24 nt, Human
ucacugcaaacucugccucccagg

SEQ ID NO: 1284050 - RNA, 23 nt, Human
ucacugcaaccuccaccuccugg

SEQ ID NO: 1284051 - RNA, 24 nt, Human
ucacugcaaccuccaccuccuggg

SEQ ID NO: 1284052 - RNA, 25 nt, Human
ucacugcaaccuccaccuccugggu

SEQ ID NO: 1284053 - RNA, 27 nt, Human
ucacugcaaccuccaccuccuggguuc

SEQ ID NO: 1284054 - RNA, 23 nt, Human
ucacugcagccucaaccuccugg

SEQ ID NO: 1284055 - RNA, 24 nt, Human
ucacugcagccucaaccuccuggg

SEQ ID NO: 1284056 - RNA, 24 nt, Human
uccagaauagcugggacuacaggc

SEQ ID NO: 1284057 - RNA, 24 nt, Human
ucccaaaguacugagauuacaggc

SEQ ID NO: 1284058 - RNA, 24 nt, Human
ucccaaagugcugggauuacaggc

SEQ ID NO: 1284059 - RNA, 24 nt, Human
ucccaaguagcuggaacuacaggc

SEQ ID NO: 1284060 - RNA, 19 nt, Human
ucccagguucaagcgauuc

SEQ ID NO: 1284061 - RNA, 24 nt, Human
ucccagguucaagcgauucugcug

SEQ ID NO: 1284062 - RNA, 23 nt, Human
uccucugcugcccaggcuggagu

SEQ ID NO: 1284063 - RNA, 24 nt, Human
uccucugcugcccaggcuggagug

SEQ ID NO: 1284064 - RNA, 24 nt, Human
uccugaguagcugggauuacaggu

SEQ ID NO: 1284065 - RNA, 21 nt, Human
uccugggcucaagugauccuc

SEQ ID NO: 1284066 - RNA, 22 nt, Human
uccugggcucaagugauccucc

SEQ ID NO: 1284067 - RNA, 21 nt, Human
uccuggguucaagcgauucuc

SEQ ID NO: 1284068 - RNA, 24 nt, Human
uccuggguucaagcgauucuccug

SEQ ID NO: 1284069 - RNA, 21 nt, Human
uccuggguucaagugauccuc

SEQ ID NO: 1284070 - RNA, 24 nt, Human
uccuggguucaagugauccuccca

SEQ ID NO: 1284071 - RNA, 22 nt, Human
ucgcccaggcuggagugcagug

SEQ ID NO: 1284072 - RNA, 20 nt, Human
ucucggccucccaaagugcu

SEQ ID NO: 1284073 - RNA, 28 nt, Human
ucucuuucucccccuucuuuuuuuuuuu

SEQ ID NO: 1284074 - RNA, 24 nt, Human
ucugcugcccaggcuggagugcag

SEQ ID NO: 1284075 - RNA, 24 nt, Human
ucugucgcccaggcuggagugcag

SEQ ID NO: 1284076 - RNA, 23 nt, Human
ucuuccucugcugcccaggcugg

SEQ ID NO: 1284077 - RNA, 24 nt, Human
ucuuccucugcugcccaggcugga

SEQ ID NO: 1284078 - RNA, 22 nt, Human
ucuugcucugucgcccaggcug

SEQ ID NO: 1284079 - RNA, 23 nt, Human
ucuugcucugucgcccaggcugg

SEQ ID NO: 1284080 - RNA, 24 nt, Human
ucuugcucugucgcccaggcugga

SEQ ID NO: 1284081 - RNA, 26 nt, Human
ucuuucucccccuucuuuuuuuuuuu

SEQ ID NO: 1284082 - RNA, 24 nt, Human
ugaaagacagcacguaugguauga

SEQ ID NO: 1284083 - RNA, 22 nt, Human
ugaaagacauucaacuacaguc

SEQ ID NO: 1284084 - RNA, 22 nt, Human
ugaaagcauaagcagccaaaug

SEQ ID NO: 1284085 - RNA, 19 nt, Human
ugaaagcauaagcagccag

SEQ ID NO: 1284086 - RNA, 22 nt, Human
ugaacaaagaaagagccagcca

SEQ ID NO: 1284087 - RNA, 20 nt, Human
ugaacaagacagaaaaaaau

SEQ ID NO: 1284088 - RNA, 19 nt, Human
ugaacugcuucauuaauag

SEQ ID NO: 1284089 - RNA, 24 nt, Human
ugacacugaaagcauaagcagcca

SEQ ID NO: 1284090 - RNA, 19 nt, Human
ugacucacugcagccucaa

SEQ ID NO: 1284091 - RNA, 19 nt, Human
ugagaauuugugcugcaaa

SEQ ID NO: 1284092 - RNA, 22 nt, Human
ugagauggagucuugcucuguc

SEQ ID NO: 1284093 - RNA, 21 nt, Human
ugagauuacaggcaugagcca

SEQ ID NO: 1284094 - RNA, 22 nt, Human
ugagauuacaggcaugagccac

SEQ ID NO: 1284095 - RNA, 22 nt, Human
ugagauuacaggcaugagccac

SEQ ID NO: 1284096 - RNA, 24 nt, Human
ugagauuacaggcaugagccacug

SEQ ID NO: 1284097 - RNA, 26 nt, Human
ugagauuacaggcaugagccacugcg

SEQ ID NO: 1284098 - RNA, 22 nt, Human
ugagggcgcagguugaaagaca

SEQ ID NO: 1284099 - RNA, 22 nt, Human
ugaggugugagauuuaugcaga

SEQ ID NO: 1284100 - RNA, 24 nt, Human
ugauccgcccaucucggccuccca

SEQ ID NO: 1284101 - RNA, 22 nt, Human
ugcaguggcgcgaucucggcuc

SEQ ID NO: 1284102 - RNA, 24 nt, Human
ugccaugcuggccaggcuggucuc

SEQ ID NO: 1284103 - RNA, 27 nt, Human
ugccaugcuggccaggcuggucucgaa

SEQ ID NO: 1284104 - RNA, 19 nt, Human
ugcccaacugaggucuuuc

SEQ ID NO: 1284105 - RNA, 18 nt, Human
ugcccaggcuggagugca

SEQ ID NO: 1284106 - RNA, 21 nt, Human
ugcccaggcuggagugcagug

SEQ ID NO: 1284107 - RNA, 22 nt, Human
ugcccaggcuggagugcagugg

SEQ ID NO: 1284108 - RNA, 24 nt, Human
ugcccaggcuggagugcaguggcg

SEQ ID NO: 1284109 - RNA, 21 nt, Human
ugccccaccaaugccuggcua

SEQ ID NO: 1284110 - RNA, 24 nt, Human
ugccccagccuccugaguagcugg

SEQ ID NO: 1284111 - RNA, 24 nt, Human
ugccucugccucccaaguagcugg

SEQ ID NO: 1284112 - RNA, 19 nt, Human
ugcuaagacacaaaucucu

SEQ ID NO: 1284113 - RNA, 25 nt, Human
ugcuaagacacaaaucucucaaaca

SEQ ID NO: 1284114 - RNA, 23 nt, Human
ugcucaggcugcuuuugcacucc

SEQ ID NO: 1284115 - RNA, 18 nt, Human
ugcuggccaggcuggucu

SEQ ID NO: 1284116 - RNA, 20 nt, Human
ugcugggauuacaggcauca

SEQ ID NO: 1284117 - RNA, 22 nt, Human
ugcuuuugcacuccugggcuca

SEQ ID NO: 1284118 - RNA, 21 nt, Human
uggaacuacaggcacgugcca

SEQ ID NO: 1284119 - RNA, 26 nt, Human
uggaacuacaggcacgugccagcaca

SEQ ID NO: 1284120 - RNA, 30 nt, Human
uggaacuacaggcacgugccagcacacccg

SEQ ID NO: 1284121 - RNA, 23 nt, Human
uggagucuugcucugucgcccag

SEQ ID NO: 1284122 - RNA, 24 nt, Human
uggagucuugcucugucgcccagg

SEQ ID NO: 1284123 - RNA, 18 nt, Human
uggagugcaguggcgcaa

SEQ ID NO: 1284124 - RNA, 19 nt, Human
uggagugcaguggcgcaau

SEQ ID NO: 1284125 - RNA, 21 nt, Human
uggagugcaguggcgcaauca

SEQ ID NO: 1284126 - RNA, 23 nt, Human
uggagugcaguggcgcgaucucg

SEQ ID NO: 1284127 - RNA, 24 nt, Human
uggagugcaguggcgcgaucucgg

SEQ ID NO: 1284128 - RNA, 24 nt, Human
uggaugucuuucacacaacacuuc

SEQ ID NO: 1284129 - RNA, 24 nt, Human
uggccaggcuggucucgaacuccu

SEQ ID NO: 1284130 - RNA, 24 nt, Human
ugggacuacaggcaugccccacca

SEQ ID NO: 1284131 - RNA, 18 nt, Human
ugggauuacaggcaucag

SEQ ID NO: 1284132 - RNA, 21 nt, Human
ugggauuacaggcaucagcca

SEQ ID NO: 1284133 - RNA, 22 nt, Human
ugggauuacaggcaucagccac

SEQ ID NO: 1284134 - RNA, 23 nt, Human
ugggauuacaggcaucagccacc

SEQ ID NO: 1284135 - RNA, 24 nt, Human
ugggauuacaggcaucagccaccg

SEQ ID NO: 1284136 - RNA, 21 nt, Human
ugggauuacaggugugcacca

SEQ ID NO: 1284137 - RNA, 22 nt, Human
ugggauuacaggugugcaccac

SEQ ID NO: 1284138 - RNA, 24 nt, Human
ugggauuacaggugugcaccacca

SEQ ID NO: 1284139 - RNA, 28 nt, Human
ugggcagaauaaaaaguucuucuugcgg

SEQ ID NO: 1284140 - RNA, 20 nt, Human
ugggcucaagugauccuccu

SEQ ID NO: 1284141 - RNA, 24 nt, Human
uggggucucacuauguugcucagg

SEQ ID NO: 1284142 - RNA, 23 nt, Human
uggguucaagcgauucuccugcc

SEQ ID NO: 1284143 - RNA, 24 nt, Human
uggguucaagcgauucuccugccu

SEQ ID NO: 1284144 - RNA, 20 nt, Human
uggguucaagugauccuccc

SEQ ID NO: 1284145 - RNA, 23 nt, Human
uggguucaagugauccucccauc

SEQ ID NO: 1284146 - RNA, 24 nt, Human
uggguucaagugauccucccaucu

SEQ ID NO: 1284147 - RNA, 21 nt, Human
uguauuuuuaguagagacggg

SEQ ID NO: 1284148 - RNA, 19 nt, Human
ugucagaaucuuuucuggg

SEQ ID NO: 1284149 - RNA, 22 nt, Human
ugucccuggcauuagaugacuc

SEQ ID NO: 1284150 - RNA, 18 nt, Human
ugugcaccaccacaccca

SEQ ID NO: 1284151 - RNA, 24 nt, Human
uguugcucaggcugcuuuugcacu

SEQ ID NO: 1284152 - RNA, 22 nt, Human
uuaguagagacaggguuucacc

SEQ ID NO: 1284153 - RNA, 24 nt, Human
uuaguagagacaggguuucaccgu

SEQ ID NO: 1284154 - RNA, 18 nt, Human
uuaguagagacgggguuu

SEQ ID NO: 1284155 - RNA, 22 nt, Human
uuaguagagacgggguuuugcc

SEQ ID NO: 1284156 - RNA, 24 nt, Human
uuaguagagacgggguuuugccau

SEQ ID NO: 1284157 - RNA, 22 nt, Human
uuauaaagaugggguggccaca

SEQ ID NO: 1284158 - RNA, 23 nt, Human
uuauagggauggggucucacuau

SEQ ID NO: 1284159 - RNA, 19 nt, Human
uucaaauacuuaccagcaa

SEQ ID NO: 1284160 - RNA, 21 nt, Human
uucaagcgauucuccugccuc

SEQ ID NO: 1284161 - RNA, 23 nt, Human
uucaagcgauucuccugccucug

SEQ ID NO: 1284162 - RNA, 24 nt, Human
uucaagcgauucuccugccucugc

SEQ ID NO: 1284163 - RNA, 18 nt, Human
uucaagcgauucugcugc

SEQ ID NO: 1284164 - RNA, 23 nt, Human
uucaagugauccucccaucucag

SEQ ID NO: 1284165 - RNA, 24 nt, Human
uucaagugauccucccaucucagc

SEQ ID NO: 1284166 - RNA, 18 nt, Human
uuccuuuauugcaauaca

SEQ ID NO: 1284167 - RNA, 25 nt, Human
uugaaagacagcacguaugguauga

SEQ ID NO: 1284168 - RNA, 21 nt, Human
uugagauggagucuugcucug

SEQ ID NO: 1284169 - RNA, 21 nt, Human
uugcaauacaaaacugacuaa

SEQ ID NO: 1284170 - RNA, 26 nt, Human
uugcucucuuucucccccuucuuuuu

SEQ ID NO: 1284171 - RNA, 24 nt, Human
uugcucugucgcccaggcuggagu

SEQ ID NO: 1284172 - RNA, 21 nt, Human
uuuauguauuuuuaguagaga

SEQ ID NO: 1284173 - RNA, 19 nt, Human
uuucaccguguuagccagg

SEQ ID NO: 1284174 - RNA, 22 nt, Human
uuucucccccuucuuuuuuuuu

SEQ ID NO: 1284175 - RNA, 20 nt, Human
uuugcacuccugggcucaag

SEQ ID NO: 1284176 - RNA, 22 nt, Human
uuuguagguacuuauauuuuug

SEQ ID NO: 1284177 - RNA, 22 nt, Human
uuuucuggguucugggauacug

SEQ ID NO: 1284178 - RNA, 24 nt, Human
uuuuuaguagagacaggguuucac

SEQ ID NO: 1284179 - RNA, 21 nt, Human
uuuuuaguagagacgggguuu

SEQ ID NO: 1284180 - RNA, 21 nt, Human
uuuuuaguagagacgggguuu

SEQ ID NO: 1284181 - RNA, 18 nt, Human
uuuuuauagggauggggu

SEQ ID NO: 1284182 - RNA, 20 nt, Human
uuuuuguauuuuuaguagag

SEQ ID NO: 1284183 - RNA, 21 nt, Human
uuuuuuauagggauggggucu

SEQ ID NO: 1284184 - RNA, 24 nt, Human
uuuuuuuuuuuugagauggagucu

SEQ ID NO: 1284185 - RNA, 23 nt, Human
aaacaacaguaucaccagauucc

SEQ ID NO: 1284186 - RNA, 24 nt, Human
aaauaucuaaaaauaaaccaagcc

SEQ ID NO: 1284187 - RNA, 23 nt, Human
aaaucagcugcaaaugcaccugg

SEQ ID NO: 1284188 - RNA, 26 nt, Human
aaaugcaccuggaguucagaacuguu

SEQ ID NO: 1284189 - RNA, 21 nt, Human
aagaaacacaauguugguuca

SEQ ID NO: 1284190 - RNA, 20 nt, Human
aagguguuacaaaaagaguu

SEQ ID NO: 1284191 - RNA, 23 nt, Human
aaucuuaaauucaauuuuguggg

SEQ ID NO: 1284192 - RNA, 21 nt, Human
acgcuggcaucugcuucccuc

SEQ ID NO: 1284193 - RNA, 21 nt, Human
acuacuucccugacacaggag

SEQ ID NO: 1284194 - RNA, 20 nt, Human
acuucacuguucccuccagc

SEQ ID NO: 1284195 - RNA, 19 nt, Human
agaaagaaaauguaauagg

SEQ ID NO: 1284196 - RNA, 23 nt, Human
agaacgcuggcaucugcuucccu

SEQ ID NO: 1284197 - RNA, 20 nt, Human
agcaagaucauuugggaguu

SEQ ID NO: 1284198 - RNA, 27 nt, Human
agucagaaaaggaaggcaugagaauuu

SEQ ID NO: 1284199 - RNA, 19 nt, Human
auacaaaaauaaagaagcc

SEQ ID NO: 1284200 - RNA, 20 nt, Human
auagaagggagaauaugaca

SEQ ID NO: 1284201 - RNA, 22 nt, Human
aucagcugcaaaugcaccugga

SEQ ID NO: 1284202 - RNA, 19 nt, Human
augcccuucacuucagccu

SEQ ID NO: 1284203 - RNA, 19 nt, Human
auugcaguugacccuggag

SEQ ID NO: 1284204 - RNA, 19 nt, Human
auuucauccaugaagauga

SEQ ID NO: 1284205 - RNA, 25 nt, Human
caaacauaaaucauuaguaccuacc

SEQ ID NO: 1284206 - RNA, 22 nt, Human
caacaguaucaccagauuccaa

SEQ ID NO: 1284207 - RNA, 20 nt, Human
caacuucuagauagaaggga

SEQ ID NO: 1284208 - RNA, 20 nt, Human
caagaucauuugggaguuuu

SEQ ID NO: 1284209 - RNA, 20 nt, Human
caaugugcccugggcaaagc

SEQ ID NO: 1284210 - RNA, 22 nt, Human
cacaugcccuucacuucagccu

SEQ ID NO: 1284211 - RNA, 26 nt, Human
caccugccgccuccagagguuuuggg

SEQ ID NO: 1284212 - RNA, 22 nt, Human
caccuggaguucagaacuguuc

SEQ ID NO: 1284213 - RNA, 23 nt, Human
cacuucagccugaugcuccuggc

SEQ ID NO: 1284214 - RNA, 20 nt, Human
cagcaauuuuucucagguug

SEQ ID NO: 1284215 - RNA, 22 nt, Human
cagcagcuguagcuccuccugu

SEQ ID NO: 1284216 - RNA, 21 nt, Human
cagcucugaggagccaaaaga

SEQ ID NO: 1284217 - RNA, 18 nt, Human
cauaaaugagcaaccaaa

SEQ ID NO: 1284218 - RNA, 22 nt, Human
caucaucugcugcacuucacug

SEQ ID NO: 1284219 - RNA, 22 nt, Human
caucugcugcacuucacuguuc

SEQ ID NO: 1284220 - RNA, 19 nt, Human
cauuacuaauacaagcauu

SEQ ID NO: 1284221 - RNA, 19 nt, Human
ccacagagaaucaggugac

SEQ ID NO: 1284222 - RNA, 20 nt, Human
ccccaaugaauuucuguacc

SEQ ID NO: 1284223 - RNA, 23 nt, Human
ccccugggucagguucauuucug

SEQ ID NO: 1284224 - RNA, 21 nt, Human
cccgugcaccugccgccucca

SEQ ID NO: 1284225 - RNA, 18 nt, Human
ccuccagcaucccccucc

SEQ ID NO: 1284226 - RNA, 21 nt, Human
ccugccuuuuccuccuccagc

SEQ ID NO: 1284227 - RNA, 21 nt, Human
ccugccuuuuccuccuccccc

SEQ ID NO: 1284228 - RNA, 21 nt, Human
cuccagcaucccccuccagcu

SEQ ID NO: 1284229 - RNA, 20 nt, Human
cuccagcuccaucugcugug

SEQ ID NO: 1284230 - RNA, 18 nt, Human
cuccuggcauaagcucag

SEQ ID NO: 1284231 - RNA, 19 nt, Human
cucuccauaaaugagcaac

SEQ ID NO: 1284232 - RNA, 19 nt, Human
cucugaggagccaaaagag

SEQ ID NO: 1284233 - RNA, 22 nt, Human
cugcagcagcuguagcuccucc

SEQ ID NO: 1284234 - RNA, 19 nt, Human
cuguuccuuguggcuuucc

SEQ ID NO: 1284235 - RNA, 24 nt, Human
cuuuuccuccuccagcuccaucug

SEQ ID NO: 1284236 - RNA, 18 nt, Human
gaguucuucaaucuugga

SEQ ID NO: 1284237 - RNA, 18 nt, Human
gaugagcauuuucucugc

SEQ ID NO: 1284238 - RNA, 23 nt, Human
gcccugggcaaagcagugccgag

SEQ ID NO: 1284239 - RNA, 19 nt, Human
guaacaaagaaagacuucu

SEQ ID NO: 1284240 - RNA, 27 nt, Human
gucagaaaaggaaggcaugagaauuua

SEQ ID NO: 1284241 - RNA, 21 nt, Human
guccacugccugccuuuuccu

SEQ ID NO: 1284242 - RNA, 23 nt, Human
guuacuaccuagaaagauuuacc

SEQ ID NO: 1284243 - RNA, 20 nt, Human
uaaagaaagaaaauguaaua

SEQ ID NO: 1284244 - RNA, 22 nt, Human
uaacaggaaaauaccuaagaga

SEQ ID NO: 1284245 - RNA, 22 nt, Human
uaagaaacacaauguugguuca

SEQ ID NO: 1284246 - RNA, 23 nt, Human
uaaguacaguaauguugcacuuu

SEQ ID NO: 1284247 - RNA, 23 nt, Human
uacaggucagagcuaagaaacac

SEQ ID NO: 1284248 - RNA, 22 nt, Human
uacaguaauguugcacuuucaa

SEQ ID NO: 1284249 - RNA, 23 nt, Human
uacaucagaaaugucaaaguaca

SEQ ID NO: 1284250 - RNA, 19 nt, Human
uagcaagaucauuugggag

SEQ ID NO: 1284251 - RNA, 21 nt, Human
uaguaauaggagaacuuuguc

SEQ ID NO: 1284252 - RNA, 20 nt, Human
uagugggauaauuuagcaag

SEQ ID NO: 1284253 - RNA, 28 nt, Human
uauacaaaaauaaagaagccauaacauu

SEQ ID NO: 1284254 - RNA, 22 nt, Human
uaucauucaaaaucagcugcaa

SEQ ID NO: 1284255 - RNA, 24 nt, Human
ucaaaguacaucuuuuacuaacgg

SEQ ID NO: 1284256 - RNA, 23 nt, Human
ucaaagugaccagccaggccuac

SEQ ID NO: 1284257 - RNA, 20 nt, Human
ucaaccaaaacuaaguauua

SEQ ID NO: 1284258 - RNA, 21 nt, Human
ucacagaaauuccccaaugaa

SEQ ID NO: 1284259 - RNA, 24 nt, Human
ucacuucagccugaugcuccuggc

SEQ ID NO: 1284260 - RNA, 26 nt, Human
ucagcagaacuuaaguuuaucaaaca

SEQ ID NO: 1284261 - RNA, 19 nt, Human
uccagcaucccccuccagc

SEQ ID NO: 1284262 - RNA, 19 nt, Human
uccagugccaagacuaggg

SEQ ID NO: 1284263 - RNA, 18 nt, Human
uccauaguuucuugaugg

SEQ ID NO: 1284264 - RNA, 21 nt, Human
uccauaguuucuugauggaca

SEQ ID NO: 1284265 - RNA, 18 nt, Human
ucccgugcaccugccgcc

SEQ ID NO: 1284266 - RNA, 23 nt, Human
uccgucaagcgccaucuugucuu

SEQ ID NO: 1284267 - RNA, 19 nt, Human
ucuacuaagucagaaaagg

SEQ ID NO: 1284268 - RNA, 21 nt, Human
ucucagguugauccccugggu

SEQ ID NO: 1284269 - RNA, 22 nt, Human
ucucuuuugacucuguaagggu

SEQ ID NO: 1284270 - RNA, 18 nt, Human
ucugaggagccaaaagag

SEQ ID NO: 1284271 - RNA, 20 nt, Human
ucugcuucccuccccaaaac

SEQ ID NO: 1284272 - RNA, 18 nt, Human
ugaaagcacucuucucuu

SEQ ID NO: 1284273 - RNA, 20 nt, Human
ugacacaggaguccuauucc

SEQ ID NO: 1284274 - RNA, 22 nt, Human
ugacacaggaguccuauuccug

SEQ ID NO: 1284275 - RNA, 23 nt, Human
ugagcaaccaaaaaucucucuua

SEQ ID NO: 1284276 - RNA, 19 nt, Human
ugaggagccaaaagaguca

SEQ ID NO: 1284277 - RNA, 19 nt, Human
ugcccucaauuccauaguu

SEQ ID NO: 1284278 - RNA, 21 nt, Human
ugccugccuuuuccuccucca

SEQ ID NO: 1284279 - RNA, 22 nt, Human
uggcagaguccacugccugccu

SEQ ID NO: 1284280 - RNA, 21 nt, Human
uggcauaagcucagcaauuuu

SEQ ID NO: 1284281 - RNA, 22 nt, Human
uggcaugagauaggacuuugga

SEQ ID NO: 1284282 - RNA, 24 nt, Human
uguucccuccagcaucccccucca

SEQ ID NO: 1284283 - RNA, 21 nt, Human
uuaguucauucccgugcaccu

SEQ ID NO: 1284284 - RNA, 19 nt, Human
uuccagugccaagacuagg

SEQ ID NO: 1284285 - RNA, 22 nt, Human
uucccgugcaccugccgccucc

SEQ ID NO: 1284286 - RNA, 19 nt, Human
uucugugcacaugcccuuc

SEQ ID NO: 1284287 - RNA, 24 nt, Human
uucuuaguuuuauugcaauucauu

SEQ ID NO: 1284288 - RNA, 24 nt, Human
uuuaaaaagaauauucaguuuccc

SEQ ID NO: 1284289 - RNA, 26 nt, Human
aaaaaaaaaaaaaacaacaaccaaaa

SEQ ID NO: 1284290 - RNA, 23 nt, Human
aaaaaaacaacaaccaaaaaaca

SEQ ID NO: 1284291 - RNA, 21 nt, Human
aaaacaaaaacccaacaacua

SEQ ID NO: 1284292 - RNA, 21 nt, Human
aaaacagaaaaacagggaaag

SEQ ID NO: 1284293 - RNA, 22 nt, Human
aaacaaaaacccaacaacuauu

SEQ ID NO: 1284294 - RNA, 23 nt, Human
aaacauacaccacuuccaaagcc

SEQ ID NO: 1284295 - RNA, 20 nt, Human
aaagcacacauacccuaccg

SEQ ID NO: 1284296 - RNA, 22 nt, Human
aacaaccaaaaaacaaaaaccc

SEQ ID NO: 1284297 - RNA, 19 nt, Human
aacagaaaccacaggcugc

SEQ ID NO: 1284298 - RNA, 21 nt, Human
aacagaaaccacaggcugcca

SEQ ID NO: 1284299 - RNA, 19 nt, Human
aacauacagacauguucuc

SEQ ID NO: 1284300 - RNA, 21 nt, Human
aaccaaaaaacaaaaacccaa

SEQ ID NO: 1284301 - RNA, 22 nt, Human
aaccaaaaaacaaaaacccaac

SEQ ID NO: 1284302 - RNA, 19 nt, Human
aacuccauagaaaccccac

SEQ ID NO: 1284303 - RNA, 18 nt, Human
aacucucccauucucccu

SEQ ID NO: 1284304 - RNA, 19 nt, Human
aagaugacagcaacuauaa

SEQ ID NO: 1284305 - RNA, 18 nt, Human
aagcaaguaacauuuaca

SEQ ID NO: 1284306 - RNA, 19 nt, Human
aagccccagucugccacag

SEQ ID NO: 1284307 - RNA, 19 nt, Human
aaguggagguuacgaaacc

SEQ ID NO: 1284308 - RNA, 18 nt, Human
aaugacacuugggaccac

SEQ ID NO: 1284309 - RNA, 22 nt, Human
aaugacacuugggaccacagcu

SEQ ID NO: 1284310 - RNA, 21 nt, Human
acaaaacagaaaaacagggaa

SEQ ID NO: 1284311 - RNA, 26 nt, Human
acaaagaaaagccaugucuccacagg

SEQ ID NO: 1284312 - RNA, 20 nt, Human
acaagcaaguaacauuuaca

SEQ ID NO: 1284313 - RNA, 25 nt, Human
acacacacacauaaggcaggcacaa

SEQ ID NO: 1284314 - RNA, 19 nt, Human
acacggggccucaccuccc

SEQ ID NO: 1284315 - RNA, 18 nt, Human
acaggcagagcauguaca

SEQ ID NO: 1284316 - RNA, 25 nt, Human
accaaaaaacaaaaacccaacaacu

SEQ ID NO: 1284317 - RNA, 22 nt, Human
accaggacacaaggaggauccc

SEQ ID NO: 1284318 - RNA, 22 nt, Human
accccaucuauauuuuccacua

SEQ ID NO: 1284319 - RNA, 21 nt, Human
accugagugcaggugaaucca

SEQ ID NO: 1284320 - RNA, 19 nt, Human
acgaaaccugggcgacacc

SEQ ID NO: 1284321 - RNA, 27 nt, Human
acucuaaauucaaaauggcaaaggcua

SEQ ID NO: 1284322 - RNA, 24 nt, Human
acugaagcacagauggaaaucacu

SEQ ID NO: 1284323 - RNA, 20 nt, Human
agcccagaauucucaucagc

SEQ ID NO: 1284324 - RNA, 19 nt, Human
agcuggaagggcaaaugcc

SEQ ID NO: 1284325 - RNA, 20 nt, Human
aggagcggccggcacccccg

SEQ ID NO: 1284326 - RNA, 18 nt, Human
aggggagggaggagggag

SEQ ID NO: 1284327 - RNA, 19 nt, Human
aggguuccuguuggucucc

SEQ ID NO: 1284328 - RNA, 21 nt, Human
aggguuccuguuggucuccuu

SEQ ID NO: 1284329 - RNA, 21 nt, Human
agucgaacaagcaaguaacau

SEQ ID NO: 1284330 - RNA, 18 nt, Human
auacaccacuuccaaagc

SEQ ID NO: 1284331 - RNA, 21 nt, Human
auucacucaaacccaggauca

SEQ ID NO: 1284332 - RNA, 24 nt, Human
auuccgcauccuagguuaacuaaa

SEQ ID NO: 1284333 - RNA, 24 nt, Human
auugugcucuuucuacaaccuuga

SEQ ID NO: 1284334 - RNA, 20 nt, Human
auuuccauaacagaaaccac

SEQ ID NO: 1284335 - RNA, 26 nt, Human
caaaacaaaacagaaaaacagggaaa

SEQ ID NO: 1284336 - RNA, 19 nt, Human
caaagccaugccaacacaa

SEQ ID NO: 1284337 - RNA, 19 nt, Human
caaagccccagucugccac

SEQ ID NO: 1284338 - RNA, 28 nt, Human
caacaaccaaaaaacaaaaacccaacaa

SEQ ID NO: 1284339 - RNA, 21 nt, Human
caacacaaggcauugccucuc

SEQ ID NO: 1284340 - RNA, 26 nt, Human
caaccaaaaaacaaaaacccaacaac

SEQ ID NO: 1284341 - RNA, 28 nt, Human
caagacaacuccauagaaaccccacuga

SEQ ID NO: 1284342 - RNA, 24 nt, Human
cacaaagaaaagccaugucuccac

SEQ ID NO: 1284343 - RNA, 21 nt, Human
cacacucuuucucucucacgu

SEQ ID NO: 1284344 - RNA, 21 nt, Human
cacugacugcagcuuugcacc

SEQ ID NO: 1284345 - RNA, 20 nt, Human
cagcaccuuggcaagauccc

SEQ ID NO: 1284346 - RNA, 21 nt, Human
cagccgaacuccucacagcac

SEQ ID NO: 1284347 - RNA, 21 nt, Human
cagcuggaagggcaaaugccc

SEQ ID NO: 1284348 - RNA, 21 nt, Human
caggaggggcagugaccccac

SEQ ID NO: 1284349 - RNA, 18 nt, Human
cagguuucagaauuacuc

SEQ ID NO: 1284350 - RNA, 23 nt, Human
cagugaacaacaagcaaucaagc

SEQ ID NO: 1284351 - RNA, 19 nt, Human
cauaaaaagugcagacugc

SEQ ID NO: 1284352 - RNA, 22 nt, Human
cauacaccacuuccaaagcccc

SEQ ID NO: 1284353 - RNA, 20 nt, Human
cauagaaaccccacugaagc

SEQ ID NO: 1284354 - RNA, 18 nt, Human
ccaaaaguacuggcacuc

SEQ ID NO: 1284355 - RNA, 24 nt, Human
ccacaccgcugccaccuccuggug

SEQ ID NO: 1284356 - RNA, 19 nt, Human
ccagucgcuacauacccag

SEQ ID NO: 1284357 - RNA, 25 nt, Human
cccacaccgcugccaccuccuggug

SEQ ID NO: 1284358 - RNA, 18 nt, Human
cccagugaacaacaagca

SEQ ID NO: 1284359 - RNA, 21 nt, Human
cccagugaacaacaagcaauc

SEQ ID NO: 1284360 - RNA, 20 nt, Human
ccccaacucucccauucucc

SEQ ID NO: 1284361 - RNA, 20 nt, Human
ccccagucugccacagcaca

SEQ ID NO: 1284362 - RNA, 18 nt, Human
ccccgccuccccccgccc

SEQ ID NO: 1284363 - RNA, 19 nt, Human
ccccgcgcccgccucccgc

SEQ ID NO: 1284364 - RNA, 19 nt, Human
ccccgcugccaaggacacc

SEQ ID NO: 1284365 - RNA, 24 nt, Human
ccccuugcgggccgccgugggggu

SEQ ID NO: 1284366 - RNA, 24 nt, Human
cccgcggcuccuccuccgccccgc

SEQ ID NO: 1284367 - RNA, 18 nt, Human
cccuuuacaaauacacca

SEQ ID NO: 1284368 - RNA, 23 nt, Human
ccgccccgccuccccccgccccc

SEQ ID NO: 1284369 - RNA, 24 nt, Human
ccgcccgcccucccgcuccuaggc

SEQ ID NO: 1284370 - RNA, 22 nt, Human
ccgccgcccgcccucccgcucc

SEQ ID NO: 1284371 - RNA, 23 nt, Human
ccgccgcccgcccucccgcuccu

SEQ ID NO: 1284372 - RNA, 22 nt, Human
ccgccucccgccgccgcccgcc

SEQ ID NO: 1284373 - RNA, 21 nt, Human
ccgcgcccgccucccgccgcc

SEQ ID NO: 1284374 - RNA, 19 nt, Human
ccgcgcccgcggcuccucc

SEQ ID NO: 1284375 - RNA, 19 nt, Human
ccucaccuuucccuuuccu

SEQ ID NO: 1284376 - RNA, 21 nt, Human
ccucccaccccaaguuaaguc

SEQ ID NO: 1284377 - RNA, 18 nt, Human
ccucccgccgccgcccgc

SEQ ID NO: 1284378 - RNA, 23 nt, Human
ccucccgccgccgcccgcccucc

SEQ ID NO: 1284379 - RNA, 18 nt, Human
ccuccgccccgccucccc

SEQ ID NO: 1284380 - RNA, 21 nt, Human
ccuccggggccgggcugggcc

SEQ ID NO: 1284381 - RNA, 18 nt, Human
ccuccucccgggcgggca

SEQ ID NO: 1284382 - RNA, 21 nt, Human
ccucucuuacccucuuagucc

SEQ ID NO: 1284383 - RNA, 21 nt, Human
ccucugcugcuacugcuuguu

SEQ ID NO: 1284384 - RNA, 24 nt, Human
cgcgcccgccucccgccgccgccc

SEQ ID NO: 1284385 - RNA, 22 nt, Human
cgcggccccgcgcccgccuccc

SEQ ID NO: 1284386 - RNA, 21 nt, Human
cgcucggcucggccugcgcgg

SEQ ID NO: 1284387 - RNA, 23 nt, Human
cgggccgggacgcggggcggcgg

SEQ ID NO: 1284388 - RNA, 27 nt, Human
cuaaaaaaaaaaaaaaacaacaaccaa

SEQ ID NO: 1284389 - RNA, 28 nt, Human
cuaaaaaaaaaaaaaaacaacaaccaaa

SEQ ID NO: 1284390 - RNA, 20 nt, Human
cuaaacugggagaagugacu

SEQ ID NO: 1284391 - RNA, 22 nt, Human
cuacaaccuugaagcacaguga

SEQ ID NO: 1284392 - RNA, 19 nt, Human
cuacuggauaacaggccaa

SEQ ID NO: 1284393 - RNA, 21 nt, Human
cuagauauuaaaauucaugcu

SEQ ID NO: 1284394 - RNA, 18 nt, Human
cuccacaggcagagcaug

SEQ ID NO: 1284395 - RNA, 23 nt, Human
cucccgccgccgcccgcccuccc

SEQ ID NO: 1284396 - RNA, 21 nt, Human
cuccggggccgggcugggccg

SEQ ID NO: 1284397 - RNA, 18 nt, Human
cuccuaggcgcccuccuc

SEQ ID NO: 1284398 - RNA, 20 nt, Human
cuccuaggcgcccuccuccc

SEQ ID NO: 1284399 - RNA, 20 nt, Human
cuuucaccccaucuauauuu

SEQ ID NO: 1284400 - RNA, 21 nt, Human
gaaauauauugugcuagagac

SEQ ID NO: 1284401 - RNA, 20 nt, Human
gagaaacaaaacaaaacaga

SEQ ID NO: 1284402 - RNA, 19 nt, Human
gagccaaucagaacacagg

SEQ ID NO: 1284403 - RNA, 24 nt, Human
gagcggccggcacccccgcgggcg

SEQ ID NO: 1284404 - RNA, 23 nt, Human
gcacacauacccuaccggcaaca

SEQ ID NO: 1284405 - RNA, 20 nt, Human
gcaucuacuuuuaaucgcuu

SEQ ID NO: 1284406 - RNA, 19 nt, Human
gccugggagacaggagugg

SEQ ID NO: 1284407 - RNA, 25 nt, Human
gcgcggccgggccgggacgcggggc

SEQ ID NO: 1284408 - RNA, 18 nt, Human
gcggcggccggggacagc

SEQ ID NO: 1284409 - RNA, 18 nt, Human
gcggcuccuccuccgccc

SEQ ID NO: 1284410 - RNA, 18 nt, Human
gcucacugacugcagcuu

SEQ ID NO: 1284411 - RNA, 18 nt, Human
gcuccuaggcgcccuccu

SEQ ID NO: 1284412 - RNA, 20 nt, Human
gcucuuaugaaacagaaaca

SEQ ID NO: 1284413 - RNA, 19 nt, Human
gcugccaggcucacugacu

SEQ ID NO: 1284414 - RNA, 20 nt, Human
ggaagauauacaagacuccc

SEQ ID NO: 1284415 - RNA, 20 nt, Human
ggagggaggagggagcagag

SEQ ID NO: 1284416 - RNA, 21 nt, Human
ggcccagugaacaacaagcaa

SEQ ID NO: 1284417 - RNA, 25 nt, Human
gggauguguuucaccauggaaccau

SEQ ID NO: 1284418 - RNA, 27 nt, Human
gggccgggacgcggggcggcgggagga

SEQ ID NO: 1284419 - RNA, 18 nt, Human
gggcugggccggcuggga

SEQ ID NO: 1284420 - RNA, 20 nt, Human
ggguacugaagcacagaugg

SEQ ID NO: 1284421 - RNA, 19 nt, Human
guagaugacuaaauuuugc

SEQ ID NO: 1284422 - RNA, 23 nt, Human
guccucacucucaggggagggag

SEQ ID NO: 1284423 - RNA, 22 nt, Human
uaaaaaguacauaaaaagugca

SEQ ID NO: 1284424 - RNA, 23 nt, Human
uaaaagacaacauauuauguuaa

SEQ ID NO: 1284425 - RNA, 23 nt, Human
uaaaauacauuuuauguuaaugu

SEQ ID NO: 1284426 - RNA, 22 nt, Human
uaacaggccaaaaguacuggca

SEQ ID NO: 1284427 - RNA, 19 nt, Human
uaacauuuacaccuaacca

SEQ ID NO: 1284428 - RNA, 24 nt, Human
uaaccaagcuaacccacgauuaaa

SEQ ID NO: 1284429 - RNA, 18 nt, Human
uaaggcaggcacagaagg

SEQ ID NO: 1284430 - RNA, 24 nt, Human
uaaguaacauacagacauguucuc

SEQ ID NO: 1284431 - RNA, 25 nt, Human
uacaccacuuccaaagccccagucu

SEQ ID NO: 1284432 - RNA, 18 nt, Human
uacagaaguuguuucugu

SEQ ID NO: 1284433 - RNA, 18 nt, Human
uacauggucggaugaggu

SEQ ID NO: 1284434 - RNA, 18 nt, Human
uaccagcauucuggcagg

SEQ ID NO: 1284435 - RNA, 19 nt, Human
uaccuguuaucacuaaacu

SEQ ID NO: 1284436 - RNA, 25 nt, Human
uauaucuuucaccccaucuauauuu

SEQ ID NO: 1284437 - RNA, 20 nt, Human
uauuuuaccauggacaccca

SEQ ID NO: 1284438 - RNA, 19 nt, Human
ucacagaccaguuagacuu

SEQ ID NO: 1284439 - RNA, 21 nt, Human
ucacucaaacccaggaucacg

SEQ ID NO: 1284440 - RNA, 18 nt, Human
ucagcccacagaauggcc

SEQ ID NO: 1284441 - RNA, 22 nt, Human
ucauggguacuauauuuucgua

SEQ ID NO: 1284442 - RNA, 22 nt, Human
uccacuauagacuucaaaagug

SEQ ID NO: 1284443 - RNA, 22 nt, Human
ucccgccgccgcccgcccuccc

SEQ ID NO: 1284444 - RNA, 28 nt, Human
ucgaacaagcaaguaacauuguaaugac

SEQ ID NO: 1284445 - RNA, 20 nt, Human
ucggaugagguccucacucu

SEQ ID NO: 1284446 - RNA, 18 nt, Human
ucggcucggccugcgcgg

SEQ ID NO: 1284447 - RNA, 21 nt, Human
ucugccacagcacaaagaaaa

SEQ ID NO: 1284448 - RNA, 21 nt, Human
ucuuucaccccaucuauauuu

SEQ ID NO: 1284449 - RNA, 20 nt, Human
ucuuucucucucacguuacu

SEQ ID NO: 1284450 - RNA, 19 nt, Human
ucuuucuuucucucucucc

SEQ ID NO: 1284451 - RNA, 22 nt, Human
ugaaaacaguuuuccuggggcu

SEQ ID NO: 1284452 - RNA, 21 nt, Human
ugaagggucagggauguguuu

SEQ ID NO: 1284453 - RNA, 20 nt, Human
ugacaggcacuacacggggc

SEQ ID NO: 1284454 - RNA, 24 nt, Human
ugacuaaauuuugcucucaugcuc

SEQ ID NO: 1284455 - RNA, 22 nt, Human
ugagaaacaaaacaaaacagaa

SEQ ID NO: 1284456 - RNA, 19 nt, Human
ugagguccucacucucagg

SEQ ID NO: 1284457 - RNA, 18 nt, Human
ugccaugcuuucccucag

SEQ ID NO: 1284458 - RNA, 24 nt, Human
ugcccagugagcagaagcuauaga

SEQ ID NO: 1284459 - RNA, 23 nt, Human
ugccgggugccuggagccccucu

SEQ ID NO: 1284460 - RNA, 21 nt, Human
ugccuaaaaaaaaaaaaaaac

SEQ ID NO: 1284461 - RNA, 20 nt, Human
ugcggaguggggcgggcggc

SEQ ID NO: 1284462 - RNA, 19 nt, Human
ugcuuuugcuucuugugua

SEQ ID NO: 1284463 - RNA, 22 nt, Human
ugcuuuugcuucuuguguagau

SEQ ID NO: 1284464 - RNA, 19 nt, Human
uggacaccacaggcuacca

SEQ ID NO: 1284465 - RNA, 19 nt, Human
uggaguacgcuguuuuacc

SEQ ID NO: 1284466 - RNA, 20 nt, Human
uggcaaaacacuuaaaggcu

SEQ ID NO: 1284467 - RNA, 18 nt, Human
uggcccagugaacaacaa

SEQ ID NO: 1284468 - RNA, 19 nt, Human
uggccucugcugcuacugc

SEQ ID NO: 1284469 - RNA, 20 nt, Human
uggcuaaacgauaacagcag

SEQ ID NO: 1284470 - RNA, 21 nt, Human
uggggcucacucuccuucuca

SEQ ID NO: 1284471 - RNA, 18 nt, Human
ugugaagggucagggaug

SEQ ID NO: 1284472 - RNA, 21 nt, Human
uguguuuuacuaauaggcuac

SEQ ID NO: 1284473 - RNA, 19 nt, Human
uuaaaacuggaguacgcug

SEQ ID NO: 1284474 - RNA, 21 nt, Human
uuaaauaaaaauauaaaagac

SEQ ID NO: 1284475 - RNA, 19 nt, Human
uuaaccaagcuaacccacg

SEQ ID NO: 1284476 - RNA, 19 nt, Human
uuacugcauuaaaguggag

SEQ ID NO: 1284477 - RNA, 22 nt, Human
uuacuuucacugucacuuucuc

SEQ ID NO: 1284478 - RNA, 24 nt, Human
uuagaaagagagaagguaaaaugu

SEQ ID NO: 1284479 - RNA, 19 nt, Human
uucacuuucuuccagcuau

SEQ ID NO: 1284480 - RNA, 19 nt, Human
uuccuggggcucagguggu

SEQ ID NO: 1284481 - RNA, 23 nt, Human
uugaaauuaaccuuuaguaugac

SEQ ID NO: 1284482 - RNA, 23 nt, Human
uugcaccaugugcugcuuugggc

SEQ ID NO: 1284483 - RNA, 22 nt, Human
uuggagcuaacacccacugcag

SEQ ID NO: 1284484 - RNA, 23 nt, Human
uuggauuucagagcuggcccagu

SEQ ID NO: 1284485 - RNA, 20 nt, Human
uuggccgacuugaacuagaa

SEQ ID NO: 1284486 - RNA, 20 nt, Human
uuuaguaugacuuuucaaga

SEQ ID NO: 1284487 - RNA, 27 nt, Human
uuuccaguuauuacagaaguuguuucu

SEQ ID NO: 1284488 - RNA, 21 nt, Human
uuuccuggggcucagguggua

SEQ ID NO: 1284489 - RNA, 22 nt, Human
uuugaaaggcucuuuaauagca

SEQ ID NO: 1284490 - RNA, 23 nt, Human
aaccgaaaccagcggcagucgca

SEQ ID NO: 1284491 - RNA, 18 nt, Human
aagcuaccccaaaaaaca

SEQ ID NO: 1284492 - RNA, 25 nt, Human
aaucaacaacaguauuuuacaauaa

SEQ ID NO: 1284493 - RNA, 22 nt, Human
aaugacagcauuuuuggaagaa

SEQ ID NO: 1284494 - RNA, 23 nt, Human
agcgcgccgggcgccgacugccc

SEQ ID NO: 1284495 - RNA, 18 nt, Human
agggcggacaugagcgcc

SEQ ID NO: 1284496 - RNA, 22 nt, Human
auagaagacuaacuuauaguca

SEQ ID NO: 1284497 - RNA, 22 nt, Human
caagcagagcggccuggccgcu

SEQ ID NO: 1284498 - RNA, 23 nt, Human
ccccgagaagagcgcgccgggcg

SEQ ID NO: 1284499 - RNA, 21 nt, Human
cccuggacgugcgggggccuc

SEQ ID NO: 1284500 - RNA, 22 nt, Human
ccgcagcgccucggcccugccc

SEQ ID NO: 1284501 - RNA, 23 nt, Human
ccgcagcgccucggcccugcccu

SEQ ID NO: 1284502 - RNA, 22 nt, Human
ccgccagccuugcccaccgccc

SEQ ID NO: 1284503 - RNA, 19 nt, Human
ccgccccgagaagagcgcg

SEQ ID NO: 1284504 - RNA, 19 nt, Human
ccgcgucaggccgccagcc

SEQ ID NO: 1284505 - RNA, 20 nt, Human
ccggccgcagcgccucggcc

SEQ ID NO: 1284506 - RNA, 19 nt, Human
ccucggggcgccgggcggc

SEQ ID NO: 1284507 - RNA, 20 nt, Human
ccugcagccgggacaccuuc

SEQ ID NO: 1284508 - RNA, 20 nt, Human
cgagaagagcgcgccgggcg

SEQ ID NO: 1284509 - RNA, 19 nt, Human
cgccagccuugcccaccgc

SEQ ID NO: 1284510 - RNA, 23 nt, Human
cgccccgagaagagcgcgccggg

SEQ ID NO: 1284511 - RNA, 19 nt, Human
cgccgggcgccgacugccc

SEQ ID NO: 1284512 - RNA, 24 nt, Human
cgccucggcccugcccucuagcuc

SEQ ID NO: 1284513 - RNA, 20 nt, Human
cgcgccgggcgccgacugcc

SEQ ID NO: 1284514 - RNA, 20 nt, Human
cucggcccugcccucuagcc

SEQ ID NO: 1284515 - RNA, 21 nt, Human
cuucuuggcucucggggcaca

SEQ ID NO: 1284516 - RNA, 23 nt, Human
gaaccgaaaccagcggcagucgc

SEQ ID NO: 1284517 - RNA, 23 nt, Human
gacaccuucuucuccgcgucucc

SEQ ID NO: 1284518 - RNA, 19 nt, Human
gagcagggcggacaugagc

SEQ ID NO: 1284519 - RNA, 20 nt, Human
gccaguucuaauuuuuuuuu

SEQ ID NO: 1284520 - RNA, 24 nt, Human
gccuucucagaaaacuacuuuaaa

SEQ ID NO: 1284521 - RNA, 18 nt, Human
gcgcggcccgguccggag

SEQ ID NO: 1284522 - RNA, 18 nt, Human
gcgcggcccgguccggag

SEQ ID NO: 1284523 - RNA, 24 nt, Human
ggcgcaccagaaccgaaaccagcg

SEQ ID NO: 1284524 - RNA, 20 nt, Human
gggcacagcgcgcggcccgg

SEQ ID NO: 1284525 - RNA, 22 nt, Human
gucucccgcgcccgcgucaggc

SEQ ID NO: 1284526 - RNA, 20 nt, Human
uagcucccgcguucgcuccu

SEQ ID NO: 1284527 - RNA, 23 nt, Human
ucaacaacaguauuuuacaauaa

SEQ ID NO: 1284528 - RNA, 21 nt, Human
ucccgcgcccgcgucaggccg

SEQ ID NO: 1284529 - RNA, 19 nt, Human
ucucugggccggccgcagc

SEQ ID NO: 1284530 - RNA, 18 nt, Human
ugaggugagccaguucua

SEQ ID NO: 1284531 - RNA, 18 nt, Human
uggaagaaacaugccuuc

SEQ ID NO: 1284532 - RNA, 20 nt, Human
uggaagaaacaugccuucac

SEQ ID NO: 1284533 - RNA, 18 nt, Human
uucuggugacauuccagc

SEQ ID NO: 1284534 - RNA, 22 nt, Human
uuuuacaauaauucuuuaaagu

SEQ ID NO: 1284535 - RNA, 19 nt, Human
aagggggcgggccugaagu

SEQ ID NO: 1284536 - RNA, 20 nt, Human
acaagcuuaugauauuuguu

SEQ ID NO: 1284537 - RNA, 18 nt, Human
acccagauggaagggcca

SEQ ID NO: 1284538 - RNA, 24 nt, Human
agaaugcuucuuccucccccacuc

SEQ ID NO: 1284539 - RNA, 22 nt, Human
agagaaggacaagcuuaugaua

SEQ ID NO: 1284540 - RNA, 27 nt, Human
aggcauuaaaaacagcacugugauuug

SEQ ID NO: 1284541 - RNA, 23 nt, Human
agucacgaaauuucccuccaaga

SEQ ID NO: 1284542 - RNA, 19 nt, Human
auaacagccaccuucuuca

SEQ ID NO: 1284543 - RNA, 24 nt, Human
cacagaguccuaaauaacagccac

SEQ ID NO: 1284544 - RNA, 27 nt, Human
cagucacgaaauuucccuccaagauuu

SEQ ID NO: 1284545 - RNA, 20 nt, Human
ccacacgugggcugcggggu

SEQ ID NO: 1284546 - RNA, 21 nt, Human
ccacacuaaaauaggcuguac

SEQ ID NO: 1284547 - RNA, 19 nt, Human
ccacagaguccuaaauaac

SEQ ID NO: 1284548 - RNA, 21 nt, Human
ccagaaaaauaaaaucaugaa

SEQ ID NO: 1284549 - RNA, 20 nt, Human
ccgcggcagguaucuucucu

SEQ ID NO: 1284550 - RNA, 26 nt, Human
ccguucacuccaccccuuccccggcc

SEQ ID NO: 1284551 - RNA, 18 nt, Human
ccuaaagugcauuucuca

SEQ ID NO: 1284552 - RNA, 18 nt, Human
ccugugcugggaggaggg

SEQ ID NO: 1284553 - RNA, 23 nt, Human
cgcggcagguaucuucucuuacc

SEQ ID NO: 1284554 - RNA, 18 nt, Human
cggcacccagauggaagg

SEQ ID NO: 1284555 - RNA, 23 nt, Human
cggcacccagauggaagggccaa

SEQ ID NO: 1284556 - RNA, 20 nt, Human
cggccguucacuccaccccu

SEQ ID NO: 1284557 - RNA, 18 nt, Human
cuccaagauuugccccca

SEQ ID NO: 1284558 - RNA, 19 nt, Human
cugcgggguggaugcugag

SEQ ID NO: 1284559 - RNA, 22 nt, Human
gaggcuacagaguucaagcuga

SEQ ID NO: 1284560 - RNA, 22 nt, Human
gcggcagguaucuucucuuacc

SEQ ID NO: 1284561 - RNA, 20 nt, Human
ggaggagggcgcugggaacc

SEQ ID NO: 1284562 - RNA, 19 nt, Human
ggccggagggccuaggggc

SEQ ID NO: 1284563 - RNA, 18 nt, Human
gggaggagggcgcuggga

SEQ ID NO: 1284564 - RNA, 21 nt, Human
gggcgggccugaagucucggg

SEQ ID NO: 1284565 - RNA, 20 nt, Human
gggggcgggccugaagucuc

SEQ ID NO: 1284566 - RNA, 22 nt, Human
gucaugaaauauugagaaccca

SEQ ID NO: 1284567 - RNA, 19 nt, Human
guccuggagcgcgcaggcu

SEQ ID NO: 1284568 - RNA, 23 nt, Human
guuugggguagugcuggguaggc

SEQ ID NO: 1284569 - RNA, 19 nt, Human
uaagaaugcuucuuccucc

SEQ ID NO: 1284570 - RNA, 19 nt, Human
uaaugcauccuuggaguca

SEQ ID NO: 1284571 - RNA, 19 nt, Human
uagacuuaacuucccuuga

SEQ ID NO: 1284572 - RNA, 23 nt, Human
uagcuuuuugaaaaaaaaauaau

SEQ ID NO: 1284573 - RNA, 23 nt, Human
uauuuguuuugguucuuuuaaau

SEQ ID NO: 1284574 - RNA, 21 nt, Human
ucaggcauuaaaaacagcacu

SEQ ID NO: 1284575 - RNA, 24 nt, Human
uccaagauuugcccccaucgacuu

SEQ ID NO: 1284576 - RNA, 26 nt, Human
ucccccacuccuucacuuaagguaua

SEQ ID NO: 1284577 - RNA, 19 nt, Human
ugaagucucggguuuggaa

SEQ ID NO: 1284578 - RNA, 21 nt, Human
ugaagucucggguuuggaacu

SEQ ID NO: 1284579 - RNA, 20 nt, Human
ugacaggagccagggggcca

SEQ ID NO: 1284580 - RNA, 23 nt, Human
ugagaggcuacagaguucaagcu

SEQ ID NO: 1284581 - RNA, 22 nt, Human
ugagauacuuaggagaauuuau

SEQ ID NO: 1284582 - RNA, 18 nt, Human
ugagcugugacaggagcc

SEQ ID NO: 1284583 - RNA, 20 nt, Human
ugauuugcuuuccacagagu

SEQ ID NO: 1284584 - RNA, 24 nt, Human
uggaacuggggguuugggguagug

SEQ ID NO: 1284585 - RNA, 19 nt, Human
uggaagggccaaagcggcc

SEQ ID NO: 1284586 - RNA, 22 nt, Human
ugggcugcgggguggaugcuga

SEQ ID NO: 1284587 - RNA, 19 nt, Human
uuaaugcauccuuggaguc

SEQ ID NO: 1284588 - RNA, 23 nt, Human
uuccacagaguccuaaauaacag

SEQ ID NO: 1284589 - RNA, 27 nt, Human
uugaaaaccgccauccuaauucuuccu

SEQ ID NO: 1284590 - RNA, 21 nt, Human
aaaaagcacuaagggagcuga

SEQ ID NO: 1284591 - RNA, 24 nt, Human
aaaaagcuuaacacaaaauuaaac

SEQ ID NO: 1284592 - RNA, 18 nt, Human
aaaagcacuaagggagcu

SEQ ID NO: 1284593 - RNA, 24 nt, Human
aaacaaacacaaaugcuuugcugu
